United States Patent 10,706,955 (BIOINFORMATIC PROCESSES FOR DETERMINATION OF PEPTIDE BINDING) - sequence listing, part 17

SEQ ID NO: 658916 - protein, 18 aa, Mycobacterium
FFTPADIDTVLGHDYEVH

SEQ ID NO: 658917 - protein, 18 aa, Mycobacterium
FFTPLGMHTRAALDGVAD

SEQ ID NO: 658918 - protein, 17 aa, Mycobacterium
FFTPLLRNLGHSARVAV

SEQ ID NO: 658919 - protein, 18 aa, Mycobacterium
FFTPLLRNLGHSGRVVVI

SEQ ID NO: 658920 - protein, 24 aa, Mycobacterium
FFTTKGRVYRAKAYDLPEAARTAR

SEQ ID NO: 658921 - protein, 20 aa, Mycobacterium
FFVGPAGAIAKSAFDKLIEE

SEQ ID NO: 658922 - protein, 17 aa, Mycobacterium
FFVHDPFTLEPYSRDPR

SEQ ID NO: 658923 - protein, 17 aa, Mycobacterium
FFVILGPSGAGKTTTLK

SEQ ID NO: 658924 - protein, 18 aa, Mycobacterium
FFVMPGGGHQLMLFDTTV

SEQ ID NO: 658925 - protein, 23 aa, Mycobacterium
FFVQEACRQWELPAADTVITVGK

SEQ ID NO: 658926 - protein, 28 aa, Mycobacterium
FFWQTALSWMMWNFRLAGLLVGATVVCY

SEQ ID NO: 658927 - protein, 22 aa, Mycobacterium
FFWYTSPSWMMWNFQVAGLLVG

SEQ ID NO: 658928 - protein, 19 aa, Mycobacterium
FFYIKGRSSEMIISGGVNI

SEQ ID NO: 658929 - protein, 17 aa, Mycobacterium
FGAAIAAAADFRRPNLF

SEQ ID NO: 658930 - protein, 20 aa, Mycobacterium
FGAALAELDGAFGVGDAAPA

SEQ ID NO: 658931 - protein, 27 aa, Mycobacterium
FGAALPDKFEQMWGYIYEQNIAPIYLG

SEQ ID NO: 658932 - protein, 17 aa, Mycobacterium
FGAAMSMRQRHELHERY

SEQ ID NO: 658933 - protein, 19 aa, Mycobacterium
FGADALRFTLARGASPGGD

SEQ ID NO: 658934 - protein, 17 aa, Mycobacterium
FGADEKAAWIAEIAAYL

SEQ ID NO: 658935 - protein, 25 aa, Mycobacterium
FGADGDGGWVLPGLVDAHCHVGLGP

SEQ ID NO: 658936 - protein, 22 aa, Mycobacterium
FGADLLALLGVDAVPRDLVEAE

SEQ ID NO: 658937 - protein, 17 aa, Mycobacterium
FGAEFPLDDALRLLEAH

SEQ ID NO: 658938 - protein, 19 aa, Mycobacterium
FGAEGDWKTSAMVRTVKTM

SEQ ID NO: 658939 - protein, 22 aa, Mycobacterium
FGAEGWRPGLHRLTDGLINDAR

SEQ ID NO: 658940 - protein, 22 aa, Mycobacterium
FGAEGWRPGLHRVTDGLINDAR

SEQ ID NO: 658941 - protein, 17 aa, Mycobacterium
FGAEIGRQSGRAAEGLG

SEQ ID NO: 658942 - protein, 27 aa, Mycobacterium
FGAELFPRMRVPQAWYDAGIAARADNL

SEQ ID NO: 658943 - protein, 17 aa, Mycobacterium
FGAFLPKGITLRVYGDA

SEQ ID NO: 658944 - protein, 24 aa, Mycobacterium
FGAFRELERLIGLHRTPPPLPEVP

SEQ ID NO: 658945 - protein, 19 aa, Mycobacterium
FGAGIFQLGTLFAQQLLPD

SEQ ID NO: 658946 - protein, 18 aa, Mycobacterium
FGAGIGMALGRANSGRPA

SEQ ID NO: 658947 - protein, 21 aa, Mycobacterium
FGAGIRPPWSLGEPQPELATL

SEQ ID NO: 658948 - protein, 17 aa, Mycobacterium
FGAGLAMHLAAARPNQV

SEQ ID NO: 658949 - protein, 25 aa, Mycobacterium
FGAGNRGNGNFGFGNSQATGGGNIG

SEQ ID NO: 658950 - protein, 25 aa, Mycobacterium
FGAGNRYNGNIGFGNIGNPATSPNP

SEQ ID NO: 658951 - protein, 24 aa, Mycobacterium
FGAGPIGIGLWFALRGKGLDDVFV

SEQ ID NO: 658952 - protein, 25 aa, Mycobacterium
FGAGPIGIGLWFALRGKGLESVYVA

SEQ ID NO: 658953 - protein, 17 aa, Mycobacterium
FGAGVCQGGPEMLDIAS

SEQ ID NO: 658954 - protein, 25 aa, Mycobacterium
FGAGWKVRAGEVFSRDGTVLDESTV

SEQ ID NO: 658955 - protein, 17 aa, Mycobacterium
FGAGYAKAMEKMLEVNQ

SEQ ID NO: 658956 - protein, 19 aa, Mycobacterium
FGAITPSVCNLRPSSRGHV

SEQ ID NO: 658957 - protein, 25 aa, Mycobacterium
FGAITSPELAEWGIPTAEALVEVHA

SEQ ID NO: 658958 - protein, 17 aa, Mycobacterium
FGAKADQLRSIFLGDPQ

SEQ ID NO: 658959 - protein, 23 aa, Mycobacterium
FGAKHADALFTIHSSIPAGQKYY

SEQ ID NO: 658960 - protein, 19 aa, Mycobacterium
FGALAARPADAPVVMVNLL

SEQ ID NO: 658961 - protein, 17 aa, Mycobacterium
FGALLGEAWTQKKRMSP

SEQ ID NO: 658962 - protein, 19 aa, Mycobacterium
FGALLSNAKTVFWNGPMGV

SEQ ID NO: 658963 - protein, 17 aa, Mycobacterium
FGALNVMVNNAGISSPL

SEQ ID NO: 658964 - protein, 18 aa, Mycobacterium
FGALPLARRPRGVVAGLV

SEQ ID NO: 658965 - protein, 23 aa, Mycobacterium
FGALRVAKAFAPVLADNGGGALV

SEQ ID NO: 658966 - protein, 25 aa, Mycobacterium
FGAPAAEALDAWLADGRPALVNADS

SEQ ID NO: 658967 - protein, 17 aa, Mycobacterium
FGAPDWDEFMSVVKGFG

SEQ ID NO: 658968 - protein, 18 aa, Mycobacterium
FGAPERKMGWHAQPTAQV

SEQ ID NO: 658969 - protein, 26 aa, Mycobacterium
FGAPMEKRTRFGLAAAQQALEDGGVT

SEQ ID NO: 658970 - protein, 18 aa, Mycobacterium
FGARAERIFMYLRTRDDY

SEQ ID NO: 658971 - protein, 17 aa, Mycobacterium
FGARRVVADAFERARRR

SEQ ID NO: 658972 - protein, 21 aa, Mycobacterium
FGARYAIHGHEYFAHRAGLSE

SEQ ID NO: 658973 - protein, 24 aa, Mycobacterium
FGASGPRSSWRATDAVLYAMSGSL

SEQ ID NO: 658974 - protein, 23 aa, Mycobacterium
FGASNFPLAFSVAGGDTASALAA

SEQ ID NO: 658975 - protein, 20 aa, Mycobacterium
FGASSAFGGPCRTPVAERLA

SEQ ID NO: 658976 - protein, 19 aa, Mycobacterium
FGASTALFCYLDRDMPPPQ

SEQ ID NO: 658977 - protein, 26 aa, Mycobacterium
FGATDCALPMMWALRRGVKVDTFHIY

SEQ ID NO: 658978 - protein, 18 aa, Mycobacterium
FGATEILAGLAPAGDGAG

SEQ ID NO: 658979 - protein, 18 aa, Mycobacterium
FGATESHAAGGLGSIENF

SEQ ID NO: 658980 - protein, 18 aa, Mycobacterium
FGATGIHRCPERELSPCP

SEQ ID NO: 658981 - protein, 17 aa, Mycobacterium
FGATHAFPDAASAAAKV

SEQ ID NO: 658982 - protein, 25 aa, Mycobacterium
FGAVEMARLPGPNGKLMHAAFQING

SEQ ID NO: 658983 - protein, 17 aa, Mycobacterium
FGAVTGRDDVKREGQAQ

SEQ ID NO: 658984 - protein, 26 aa, Mycobacterium
FGCADPDTGVGFAYVMNRLGFHLWSD

SEQ ID NO: 658985 - protein, 18 aa, Mycobacterium
FGCAGRAELENWVTRLGE

SEQ ID NO: 658986 - protein, 17 aa, Mycobacterium
FGCGDKISLAAVGQKAS

SEQ ID NO: 658987 - protein, 23 aa, Mycobacterium
FGCKRPSMHNEWFSTFTKPNVDL

SEQ ID NO: 658988 - protein, 18 aa, Mycobacterium
FGCRFGCVVQDGFGSTEG

SEQ ID NO: 658989 - protein, 24 aa, Mycobacterium
FGCRMGICQSCVVGLVDGHVRDLR

SEQ ID NO: 658990 - protein, 19 aa, Mycobacterium
FGDAPACRALFASAHHVVR

SEQ ID NO: 658991 - protein, 17 aa, Mycobacterium
FGDAVAVDVRYPRDMST

SEQ ID NO: 658992 - protein, 25 aa, Mycobacterium
FGDDGSMMACVFNFSGAEHSRYRLG

SEQ ID NO: 658993 - protein, 24 aa, Mycobacterium
FGDEAKRPLAVYLSDWGTEEFTRG

SEQ ID NO: 658994 - protein, 25 aa, Mycobacterium
FGDGEFPDSAALFWEAISAESADQL

SEQ ID NO: 658995 - protein, 25 aa, Mycobacterium
FGDGNRGSNNFGFGNTNSGNVGFGN

SEQ ID NO: 658996 - protein, 22 aa, Mycobacterium
FGDGPLVVGICAEYDALPEIGH

SEQ ID NO: 658997 - protein, 19 aa, Mycobacterium
FGDIDGFWAAVLHRTAQRR

SEQ ID NO: 658998 - protein, 31 aa, Mycobacterium
FGDKVLPLYLPTGLPSCRGLIGLLSQARYEY

SEQ ID NO: 658999 - protein, 17 aa, Mycobacterium
FGDLNLDAVPGLPDGAS

SEQ ID NO: 659000 - protein, 18 aa, Mycobacterium
FGDMALAGMAGRALGSTA

SEQ ID NO: 659001 - protein, 23 aa, Mycobacterium
FGDPAGAVVLWFHGTPGARRQFP

SEQ ID NO: 659002 - protein, 20 aa, Mycobacterium
FGDPEVMQWTQVADLPAPGP

SEQ ID NO: 659003 - protein, 18 aa, Mycobacterium
FGDPTGDVVLWFHGTPGG

SEQ ID NO: 659004 - protein, 17 aa, Mycobacterium
FGDRLPVILLDGREHSY

SEQ ID NO: 659005 - protein, 18 aa, Mycobacterium
FGDRLPVVLLDGQEHSYW

SEQ ID NO: 659006 - protein, 18 aa, Mycobacterium
FGDRVLILMLNRTEFMES

SEQ ID NO: 659007 - protein, 19 aa, Mycobacterium
FGDSAFPSGGFAFSSGLEG

SEQ ID NO: 659008 - protein, 18 aa, Mycobacterium
FGDSEFDTVISAIGVMFA

SEQ ID NO: 659009 - protein, 18 aa, Mycobacterium
FGDTEPWHISRTLTNAVL

SEQ ID NO: 659010 - protein, 18 aa, Mycobacterium
FGDTEPWNVTRTVTNAVL

SEQ ID NO: 659011 - protein, 18 aa, Mycobacterium
FGDVDGFWAAVLHRTAER

SEQ ID NO: 659012 - protein, 25 aa, Mycobacterium
FGDYFKKGAIELAWSLLTNPVSEGG

SEQ ID NO: 659013 - protein, 25 aa, Mycobacterium
FGDYFKREAIELAWTLLTNGVSEGG

SEQ ID NO: 659014 - protein, 25 aa, Mycobacterium
FGDYFKREAIRLAWTLLTNPVSEGG

SEQ ID NO: 659015 - protein, 26 aa, Mycobacterium
FGDYFKRGAIELAWALLTNSVADGGY

SEQ ID NO: 659016 - protein, 26 aa, Mycobacterium
FGDYFKRGAIELAWSLLTNGVAAGGY

SEQ ID NO: 659017 - protein, 26 aa, Mycobacterium
FGDYFKRGAIELAWTLLTNPVEEGGY

SEQ ID NO: 659018 - protein, 26 aa, Mycobacterium
FGDYFKRRAIELAWTLLTNSVEQGGY

SEQ ID NO: 659019 - protein, 23 aa, Mycobacterium
FGDYRCRADASALVCVNFAHQSG

SEQ ID NO: 659020 - protein, 23 aa, Mycobacterium
FGDYRCRADQAGVFCVNYAHQSA

SEQ ID NO: 659021 - protein, 17 aa, Mycobacterium
FGEALPRHLELIYEIND

SEQ ID NO: 659022 - protein, 21 aa, Mycobacterium
FGEALPVRVCPLRTDPWNVAA

SEQ ID NO: 659023 - protein, 22 aa, Mycobacterium
FGEAVKLGDRIAILTTGSKVVQ

SEQ ID NO: 659024 - protein, 23 aa, Mycobacterium
FGEAVKLGDRIAVLGQQSKVLQY

SEQ ID NO: 659025 - protein, 23 aa, Mycobacterium
FGEDGIRCTWLETSHAFHSELLD

SEQ ID NO: 659026 - protein, 18 aa, Mycobacterium
FGEFKGWAKAQGKHSNIG

SEQ ID NO: 659027 - protein, 24 aa, Mycobacterium
FGEFNLILCRNVFIYFEDMLQHRV

SEQ ID NO: 659028 - protein, 25 aa, Mycobacterium
FGEGPRWFEGLLWFSDMLGEAVHTV

SEQ ID NO: 659029 - protein, 24 aa, Mycobacterium
FGEGPRWFEGLVWFSDMLGEAVHT

SEQ ID NO: 659030 - protein, 20 aa, Mycobacterium
FGEHAVLPVLRRDQPERRAV

SEQ ID NO: 659031 - protein, 32 aa, Mycobacterium
FGEIDYRNTIDILQRYYNIILTDCGTGIMHSA

SEQ ID NO: 659032 - protein, 18 aa, Mycobacterium
FGEKVCLYAELTGSATID

SEQ ID NO: 659033 - protein, 18 aa, Mycobacterium
FGELRRRGATTFEVTEEA

SEQ ID NO: 659034 - protein, 25 aa, Mycobacterium
FGELTQLAGVFGFAECVDLLGAYTA

SEQ ID NO: 659035 - protein, 25 aa, Mycobacterium
FGELTQLAGVFGFMECIELLSDYAL

SEQ ID NO: 659036 - protein, 17 aa, Mycobacterium
FGEMFARQGHLGAMPAT

SEQ ID NO: 659037 - protein, 25 aa, Mycobacterium
FGENMRRWGLLGSFGTVGDCFDNAA

SEQ ID NO: 659038 - protein, 23 aa, Mycobacterium
FGEPAHAALTAWLTEGRPQLSIP

SEQ ID NO: 659039 - protein, 22 aa, Mycobacterium
FGEPELRPDDLLRVDGQGRGII

SEQ ID NO: 659040 - protein, 18 aa, Mycobacterium
FGEPGGRELDLWLHRASV

SEQ ID NO: 659041 - protein, 19 aa, Mycobacterium
FGEPIARRQAVAFMCANIA

SEQ ID NO: 659042 - protein, 25 aa, Mycobacterium
FGEPLHPFAAITPSVCNLRPTSRGH

SEQ ID NO: 659043 - protein, 20 aa, Mycobacterium
FGEPRAVSLKGLRGTQNVYP

SEQ ID NO: 659044 - protein, 19 aa, Mycobacterium
FGERFPDRLFDVGIAEQHA

SEQ ID NO: 659045 - protein, 18 aa, Mycobacterium
FGERGFLPHDERYRLAEE

SEQ ID NO: 659046 - protein, 21 aa, Mycobacterium
FGERQRLAIRLHDSVGATLFS

SEQ ID NO: 659047 - protein, 20 aa, Mycobacterium
FGESSFCRFAQIGDFEAIVS

SEQ ID NO: 659048 - protein, 19 aa, Mycobacterium
FGETGCVKARSVIIAAGGF

SEQ ID NO: 659049 - protein, 18 aa, Mycobacterium
FGEVEARGVALTRRGRER

SEQ ID NO: 659050 - protein, 32 aa, Mycobacterium
FGEVLRRAGLPAPRFGMATSFDQARRIAAEIG

SEQ ID NO: 659051 - protein, 24 aa, Mycobacterium
FGEVVPGLRIPGKIDKLGYKGIET

SEQ ID NO: 659052 - protein, 26 aa, Mycobacterium
FGFAPLRLPPDLDFAALFHGVDERVP

SEQ ID NO: 659053 - protein, 27 aa, Mycobacterium
FGFAPLRLPPDLDFAALFHGVDERVPV

SEQ ID NO: 659054 - protein, 18 aa, Mycobacterium
FGFAPPVATPSWGILERP

SEQ ID NO: 659055 - protein, 19 aa, Mycobacterium
FGFATRLSRRSEVLGTVAL

SEQ ID NO: 659056 - protein, 17 aa, Mycobacterium
FGFAYQQSPGFFNSTTD

SEQ ID NO: 659057 - protein, 17 aa, Mycobacterium
FGFDPGAGFGFGPGGPR

SEQ ID NO: 659058 - protein, 18 aa, Mycobacterium
FGFELAMRKTTAEQRAGW

SEQ ID NO: 659059 - protein, 18 aa, Mycobacterium
FGFGFVMFVNGYRADEVL

SEQ ID NO: 659060 - protein, 28 aa, Mycobacterium
FGFGPGGPRGGWRRGGRGRGRRGDIRSA

SEQ ID NO: 659061 - protein, 19 aa, Mycobacterium
FGFHEYLEVKSTLGYAPGK

SEQ ID NO: 659062 - protein, 26 aa, Mycobacterium
FGFIACAVVRGGSWRRKREFWRQAVA

SEQ ID NO: 659063 - protein, 23 aa, Mycobacterium
FGFKCKEGATFGMTQLLYSDAIV

SEQ ID NO: 659064 - protein, 17 aa, Mycobacterium
FGFLLMCGQACESGTRL

SEQ ID NO: 659065 - protein, 17 aa, Mycobacterium
FGFPEIQIGILPSSGGV

SEQ ID NO: 659066 - protein, 17 aa, Mycobacterium
FGFPHYFLLPQYSSASS

SEQ ID NO: 659067 - protein, 19 aa, Mycobacterium
FGFPRADLDDLLGGDAQAN

SEQ ID NO: 659068 - protein, 17 aa, Mycobacterium
FGFSAAIPPNLPLPTKI

SEQ ID NO: 659069 - protein, 26 aa, Mycobacterium
FGFSPLRLPPDLDFTSLFHGVDERVP

SEQ ID NO: 659070 - protein, 27 aa, Mycobacterium
FGFSPLRLPPELDFAALFHGVDERVPI

SEQ ID NO: 659071 - protein, 17 aa, Mycobacterium
FGFSTAIGIGGDPVIGT

SEQ ID NO: 659072 - protein, 19 aa, Mycobacterium
FGGAFTISATAVFDYPTIS

SEQ ID NO: 659073 - protein, 17 aa, Mycobacterium
FGGAGGVGGISGNDTGG

SEQ ID NO: 659074 - protein, 21 aa, Mycobacterium
FGGAGSEQWCDAEVLRILRRR

SEQ ID NO: 659075 - protein, 22 aa, Mycobacterium
FGGAKPWFAIGGIDEARLPEVL

SEQ ID NO: 659076 - protein, 26 aa, Mycobacterium
FGGALSRAVADFVLINVTGGIAAEEA

SEQ ID NO: 659077 - protein, 18 aa, Mycobacterium
FGGARVVLTAGYPALSPV

SEQ ID NO: 659078 - protein, 20 aa, Mycobacterium
FGGATIRLTRDAGWGNAMRW

SEQ ID NO: 659079 - protein, 21 aa, Mycobacterium
FGGAVALRLSVVRPDLIAALV

SEQ ID NO: 659080 - protein, 20 aa, Mycobacterium
FGGCEGDALLMLLDANGIEC

SEQ ID NO: 659081 - protein, 23 aa, Mycobacterium
FGGDLIWGVEDCRNLSQRLERDL

SEQ ID NO: 659082 - protein, 24 aa, Mycobacterium
FGGDPRDGFPRSPASELAQGPPGT

SEQ ID NO: 659083 - protein, 17 aa, Mycobacterium
FGGEHGVEGSIAREGGL

SEQ ID NO: 659084 - protein, 18 aa, Mycobacterium
FGGEVERGLSMVDGVVLL

SEQ ID NO: 659085 - protein, 18 aa, Mycobacterium
FGGFAARVRGSDVDIAVT

SEQ ID NO: 659086 - protein, 20 aa, Mycobacterium
FGGFGGWGGQSGLIGSGGNG

SEQ ID NO: 659087 - protein, 17 aa, Mycobacterium
FGGFSVPGHGGAGGVGG

SEQ ID NO: 659088 - protein, 27 aa, Mycobacterium
FGGGAKRCLGAAFSMRELVTVLHVLLR

SEQ ID NO: 659089 - protein, 26 aa, Mycobacterium
FGGGARRCLGATFALVEMRVVLREVL

SEQ ID NO: 659090 - protein, 17 aa, Mycobacterium
FGGGCTTQSIVMRSKSG

SEQ ID NO: 659091 - protein, 17 aa, Mycobacterium
FGGGFQHWGESMMSDGK

SEQ ID NO: 659092 - protein, 18 aa, Mycobacterium
FGGGFQHWGETMMTDGQW

SEQ ID NO: 659093 - protein, 17 aa, Mycobacterium
FGGGGGGGGAGGHGGNG

SEQ ID NO: 659094 - protein, 18 aa, Mycobacterium
FGGGHGHGGFGPHIGIPG

SEQ ID NO: 659095 - protein, 23 aa, Mycobacterium
FGGGMMRCIGASFATMEMDVTLR

SEQ ID NO: 659096 - protein, 21 aa, Mycobacterium
FGGGPRMPMVPGTWEQDAVNG

SEQ ID NO: 659097 - protein, 26 aa, Mycobacterium
FGGGSRRCLGAAFAMAEMRVVLREIL

SEQ ID NO: 659098 - protein, 21 aa, Mycobacterium
FGGGVRRCLGATFAECEMRIV

SEQ ID NO: 659099 - protein, 34 aa, Mycobacterium
FGGHAQEYQALVARAEAFHQQFVQLMTTGAGSYA

SEQ ID NO: 659100 - protein, 28 aa, Mycobacterium
FGGHCGTCVPCRKGLFIHCVNGQVPSLS

SEQ ID NO: 659101 - protein, 17 aa, Mycobacterium
FGGIEMIQQATVLLSSM

SEQ ID NO: 659102 - protein, 19 aa, Mycobacterium
FGGIKRSGFGRELGRFGME

SEQ ID NO: 659103 - protein, 26 aa, Mycobacterium
FGGIKRSGFGRELGTLGIDEFVNKQV

SEQ ID NO: 659104 - protein, 18 aa, Mycobacterium
FGGIPQPWLRDLAKRWAR

SEQ ID NO: 659105 - protein, 23 aa, Mycobacterium
FGGKSELFLAIFEQLADDVERRI

SEQ ID NO: 659106 - protein, 18 aa, Mycobacterium
FGGLAGRLHYDADHFDDT

SEQ ID NO: 659107 - protein, 18 aa, Mycobacterium
FGGLDVFFANAGIAYPTP

SEQ ID NO: 659108 - protein, 19 aa, Mycobacterium
FGGLHAWADRVDHCCLLNS

SEQ ID NO: 659109 - protein, 18 aa, Mycobacterium
FGGLPAYQQRLGRKVRFM

SEQ ID NO: 659110 - protein, 17 aa, Mycobacterium
FGGMKLDFLLTIDPEYY

SEQ ID NO: 659111 - protein, 19 aa, Mycobacterium
FGGPAAVGALLLRRDVACV

SEQ ID NO: 659112 - protein, 19 aa, Mycobacterium
FGGPAGVGALLLRRDTACV

SEQ ID NO: 659113 - protein, 25 aa, Mycobacterium
FGGPAYPRGFMRLGGVGSREPFEAP

SEQ ID NO: 659114 - protein, 23 aa, Mycobacterium
FGGPGRRALGFTPSYSMHPIISD

SEQ ID NO: 659115 - protein, 18 aa, Mycobacterium
FGGPLLDGFDNLYVGQPG

SEQ ID NO: 659116 - protein, 22 aa, Mycobacterium
FGGQAGTPLAVYAANNSLTAAQ

SEQ ID NO: 659117 - protein, 20 aa, Mycobacterium
FGGQPILLDVCRIAEDAGAE

SEQ ID NO: 659118 - protein, 23 aa, Mycobacterium
FGGRAEFAGPISTVRCFQDNALL

SEQ ID NO: 659119 - protein, 24 aa, Mycobacterium
FGGRAEFAGPISTVRCFQDNALLK

SEQ ID NO: 659120 - protein, 17 aa, Mycobacterium
FGGRAKEVIRYKGENLS

SEQ ID NO: 659121 - protein, 25 aa, Mycobacterium
FGGRPVLRDVEWRIAPGERTGIVGA

SEQ ID NO: 659122 - protein, 25 aa, Mycobacterium
FGGSAYPQMLLRVGWAPINADPLPA

SEQ ID NO: 659123 - protein, 25 aa, Mycobacterium
FGGSLIHGLLHDWPLEKTLRYANAA

SEQ ID NO: 659124 - protein, 17 aa, Mycobacterium
FGGSLIRRAAEVLRRPT

SEQ ID NO: 659125 - protein, 19 aa, Mycobacterium
FGGSTALSGGGIWVPGAPS

SEQ ID NO: 659126 - protein, 22 aa, Mycobacterium
FGGTGGNGGLLFGNGGTGGAAG

SEQ ID NO: 659127 - protein, 26 aa, Mycobacterium
FGGTIAHGLLTLSLLPRFTHQLYTVD

SEQ ID NO: 659128 - protein, 17 aa, Mycobacterium
FGGTVCIHPSQIPVVRE

SEQ ID NO: 659129 - protein, 19 aa, Mycobacterium
FGGVVPEIASRAHLEALGV

SEQ ID NO: 659130 - protein, 17 aa, Mycobacterium
FGGYDGRFGTIVDSTLF

SEQ ID NO: 659131 - protein, 17 aa, Mycobacterium
FGGYLSGPRVIDAGTKD

SEQ ID NO: 659132 - protein, 17 aa, Mycobacterium
FGHAVKTFYRDAFAKHQ

SEQ ID NO: 659133 - protein, 27 aa, Mycobacterium
FGHDIGYRIAHHADLDAPPPVEVHEYT

SEQ ID NO: 659134 - protein, 22 aa, Mycobacterium
FGHDRYDDFFAMAYRVLPADGV

SEQ ID NO: 659135 - protein, 18 aa, Mycobacterium
FGHEPMRLLTVVQAPLQR

SEQ ID NO: 659136 - protein, 18 aa, Mycobacterium
FGHGDPWTAMRAAVHRTT

SEQ ID NO: 659137 - protein, 18 aa, Mycobacterium
FGHGLWGFTDALRAAGWD

SEQ ID NO: 659138 - protein, 19 aa, Mycobacterium
FGHGSDAWLAELAALPLVH

SEQ ID NO: 659139 - protein, 18 aa, Mycobacterium
FGHIGLGGSMGWADPKRK

SEQ ID NO: 659140 - protein, 17 aa, Mycobacterium
FGHLEAAAGLLSVAKIV

SEQ ID NO: 659141 - protein, 31 aa, Mycobacterium
FGHPSFRYYGWGPRMWWWAQTMGIRKFQEMV

SEQ ID NO: 659142 - protein, 18 aa, Mycobacterium
FGHQEFEGGVGRPARAQP

SEQ ID NO: 659143 - protein, 24 aa, Mycobacterium
FGHSMGAVVAFEFARVAETHGAAV

SEQ ID NO: 659144 - protein, 26 aa, Mycobacterium
FGHSMGAVVSFEFARLAEAAGLDVHQ

SEQ ID NO: 659145 - protein, 17 aa, Mycobacterium
FGHSRFAGSAPRRNAQL

SEQ ID NO: 659146 - protein, 27 aa, Mycobacterium
FGHSRFDSGGLIFAEFEPGRALLGTVE

SEQ ID NO: 659147 - protein, 26 aa, Mycobacterium
FGIAERRGPICYLVHAGVGMDFGRNA

SEQ ID NO: 659148 - protein, 23 aa, Mycobacterium
FGIAGLRPRLARRVDDADSTRRR

SEQ ID NO: 659149 - protein, 19 aa, Mycobacterium
FGICAKHAPGYFSLDDWGY

SEQ ID NO: 659150 - protein, 17 aa, Mycobacterium
FGIDIVVASVRRAQEQG

SEQ ID NO: 659151 - protein, 18 aa, Mycobacterium
FGIEPDLAEALVCAAARE

SEQ ID NO: 659152 - protein, 24 aa, Mycobacterium
FGIEVPDRQLACVPVNSPEGRAYL

SEQ ID NO: 659153 - protein, 20 aa, Mycobacterium
FGIPEVKRGLVAAGGGLLRL

SEQ ID NO: 659154 - protein, 18 aa, Mycobacterium
FGIPEVKRGLVAGAGGLL

SEQ ID NO: 659155 - protein, 20 aa, Mycobacterium
FGIPEVKRGLVAGGGGLLRL

SEQ ID NO: 659156 - protein, 23 aa, Mycobacterium
FGIPEVKRGLVAGGGGLLRLPER

SEQ ID NO: 659157 - protein, 19 aa, Mycobacterium
FGIPGEALSPVAQSVAHSL

SEQ ID NO: 659158 - protein, 22 aa, Mycobacterium
FGIPGGAVLPVYDPLFDSKKLR

SEQ ID NO: 659159 - protein, 20 aa, Mycobacterium
FGIRADPALWQEVLVRLTPR

SEQ ID NO: 659160 - protein, 21 aa, Mycobacterium
FGIRLYPMGNIEQGIVHVVGP

SEQ ID NO: 659161 - protein, 23 aa, Mycobacterium
FGISEACLHRWLKIADREDGRGQ

SEQ ID NO: 659162 - protein, 23 aa, Mycobacterium
FGISEACLHRWLKIADRQDGGDR

SEQ ID NO: 659163 - protein, 26 aa, Mycobacterium
FGISGEATFDYGVAFDRSRKVADGRV

SEQ ID NO: 659164 - protein, 26 aa, Mycobacterium
FGISGEATFDYGVAFDRSRKVAEGRV

SEQ ID NO: 659165 - protein, 17 aa, Mycobacterium
FGIVKGLMTTIHAYTQD

SEQ ID NO: 659166 - protein, 17 aa, Mycobacterium
FGIVKGLMTTVHAYTQD

SEQ ID NO: 659167 - protein, 17 aa, Mycobacterium
FGIVLVEAMAAGTAVVA

SEQ ID NO: 659168 - protein, 24 aa, Mycobacterium
FGKAKEILGTVIGRNDLVNEGQAQ

SEQ ID NO: 659169 - protein, 17 aa, Mycobacterium
FGKFVLCQLDDLWRQFD

SEQ ID NO: 659170 - protein, 17 aa, Mycobacterium
FGKKRKMSFPAAIRSNF

SEQ ID NO: 659171 - protein, 21 aa, Mycobacterium
FGKKVEAGWVNVLRSDATPIE

SEQ ID NO: 659172 - protein, 25 aa, Mycobacterium
FGKNTFHGLALLRHVNDLVNTGWPV

SEQ ID NO: 659173 - protein, 27 aa, Mycobacterium
FGKNTYHGLSLLRHVKDLVNTGWPVLM

SEQ ID NO: 659174 - protein, 27 aa, Mycobacterium
FGKNTYHGLSLLRHVKELVNTGWPVLM

SEQ ID NO: 659175 - protein, 25 aa, Mycobacterium
FGKRDVMVIHTLLWPDEIRDPDFPI

SEQ ID NO: 659176 - protein, 22 aa, Mycobacterium
FGKSPRDAERWALGPDERNAQL

SEQ ID NO: 659177 - protein, 20 aa, Mycobacterium
FGKVMLALPLQIGFPTAIDG

SEQ ID NO: 659178 - protein, 19 aa, Mycobacterium
FGLAHIRPDDVLAAFSDLS

SEQ ID NO: 659179 - protein, 25 aa, Mycobacterium
FGLAIPEPYGFGAVSMPCYVQVAEE

SEQ ID NO: 659180 - protein, 24 aa, Mycobacterium
FGLARRLSAAGADVVMAIRNRAKG

SEQ ID NO: 659181 - protein, 19 aa, Mycobacterium
FGLARRLSASGAEVVMAIR

SEQ ID NO: 659182 - protein, 18 aa, Mycobacterium
FGLARVLDGLEPVINRTA

SEQ ID NO: 659183 - protein, 17 aa, Mycobacterium
FGLCAKQAPGYFTLDDW

SEQ ID NO: 659184 - protein, 19 aa, Mycobacterium
FGLDGPWRNNVGFAQTMEQ

SEQ ID NO: 659185 - protein, 17 aa, Mycobacterium
FGLDKFPLWTGQPYDID

SEQ ID NO: 659186 - protein, 21 aa, Mycobacterium
FGLEGPWRDNPAFAYVIEAAS

SEQ ID NO: 659187 - protein, 18 aa, Mycobacterium
FGLERIIVNSAADWGRSD

SEQ ID NO: 659188 - protein, 18 aa, Mycobacterium
FGLFPEVDPKVVAQQLVI

SEQ ID NO: 659189 - protein, 18 aa, Mycobacterium
FGLGCVAGAAGIARMHDY

SEQ ID NO: 659190 - protein, 18 aa, Mycobacterium
FGLGCVAGAAGVARLHDY

SEQ ID NO: 659191 - protein, 18 aa, Mycobacterium
FGLGCVAGAAGVARLNDY

SEQ ID NO: 659192 - protein, 17 aa, Mycobacterium
FGLGCVAGAAGVARMHD

SEQ ID NO: 659193 - protein, 17 aa, Mycobacterium
FGLGLWLVDWRFPNRLN

SEQ ID NO: 659194 - protein, 18 aa, Mycobacterium
FGLHPDKVLAELKEAQEL

SEQ ID NO: 659195 - protein, 24 aa, Mycobacterium
FGLHRMTRAVLPHMRARGRGRILN

SEQ ID NO: 659196 - protein, 17 aa, Mycobacterium
FGLIPDVAHDIDVFRNW

SEQ ID NO: 659197 - protein, 28 aa, Mycobacterium
FGLIPEFIGRLPIVASVTNLDRESLIKI

SEQ ID NO: 659198 - protein, 25 aa, Mycobacterium
FGLIPEFIGRLPVVASVTNLDKASL

SEQ ID NO: 659199 - protein, 17 aa, Mycobacterium
FGLIVYQEQIMFIAQKV

SEQ ID NO: 659200 - protein, 18 aa, Mycobacterium
FGLLDHIEFGNGVVHAER

SEQ ID NO: 659201 - protein, 18 aa, Mycobacterium
FGLLRAGAIPVMCLPGHR

SEQ ID NO: 659202 - protein, 17 aa, Mycobacterium
FGLMLPVEPDTRLLGET

SEQ ID NO: 659203 - protein, 17 aa, Mycobacterium
FGLNMPIAREVDAVINH

SEQ ID NO: 659204 - protein, 18 aa, Mycobacterium
FGLPELQLGLIPGAGGTL

SEQ ID NO: 659205 - protein, 19 aa, Mycobacterium
FGLPHPDWQVFLDVSPELA

SEQ ID NO: 659206 - protein, 19 aa, Mycobacterium
FGLPPHRYLTGRRVDEARR

SEQ ID NO: 659207 - protein, 20 aa, Mycobacterium
FGLQYCHGVGLSVWEKPLMS

SEQ ID NO: 659208 - protein, 17 aa, Mycobacterium
FGLRLLRHVREAQQAGR

SEQ ID NO: 659209 - protein, 17 aa, Mycobacterium
FGLRPVTGIDPAAVSPW

SEQ ID NO: 659210 - protein, 23 aa, Mycobacterium
FGLSGYSGGLTYLYATYHAPVDF

SEQ ID NO: 659211 - protein, 19 aa, Mycobacterium
FGLSRIPIREALKTLEAEE

SEQ ID NO: 659212 - protein, 20 aa, Mycobacterium
FGLTEAMASYSTRLKITPTR

SEQ ID NO: 659213 - protein, 19 aa, Mycobacterium
FGLVAMAWRDEDFVQAWLH

SEQ ID NO: 659214 - protein, 17 aa, Mycobacterium
FGLVDLYNAPSMRELDT

SEQ ID NO: 659215 - protein, 17 aa, Mycobacterium
FGLVKINPIAAWTDEDM

SEQ ID NO: 659216 - protein, 19 aa, Mycobacterium
FGMEGMKVVLADVLAEPLD

SEQ ID NO: 659217 - protein, 23 aa, Mycobacterium
FGMLDAFHPGRIDLGVGRSAQRR

SEQ ID NO: 659218 - protein, 28 aa, Mycobacterium
FGMLDAFYPGRIDLGLGRSAQRRGIKPR

SEQ ID NO: 659219 - protein, 19 aa, Mycobacterium
FGMNCHWSQGQSCGSTTRL

SEQ ID NO: 659220 - protein, 23 aa, Mycobacterium
FGMPAADALRAWLDDGRPALVTA

SEQ ID NO: 659221 - protein, 19 aa, Mycobacterium
FGMRADAVVPAYGMAEATL

SEQ ID NO: 659222 - protein, 17 aa, Mycobacterium
FGMRFPSPIFMAPIGVI

SEQ ID NO: 659223 - protein, 24 aa, Mycobacterium
FGMSEERVRLISPFVGGAFGSAGR

SEQ ID NO: 659224 - protein, 19 aa, Mycobacterium
FGMSMRFIKSRAAFVDKVR

SEQ ID NO: 659225 - protein, 17 aa, Mycobacterium
FGMTVLLTTHYMGEADA

SEQ ID NO: 659226 - protein, 19 aa, Mycobacterium
FGNAGRLNAGYGNAGILNA

SEQ ID NO: 659227 - protein, 17 aa, Mycobacterium
FGNAGSRTHGYGQVAKE

SEQ ID NO: 659228 - protein, 19 aa, Mycobacterium
FGNFAARTSGFLNVGSGSS

SEQ ID NO: 659229 - protein, 26 aa, Mycobacterium
FGNGLWMSLRVARRLEQRDIAVRVVD

SEQ ID NO: 659230 - protein, 25 aa, Mycobacterium
FGNGMLLRRGIRLVAAFDHRHIFVD

SEQ ID NO: 659231 - protein, 24 aa, Mycobacterium
FGNGNRGNLNWGSGNLGNANVGFG

SEQ ID NO: 659232 - protein, 20 aa, Mycobacterium
FGNLGARTSGFLNVGSGISG

SEQ ID NO: 659233 - protein, 17 aa, Mycobacterium
FGNLGLVNIAIWADPAR

SEQ ID NO: 659234 - protein, 17 aa, Mycobacterium
FGNLGWDNVGFFNSGVG

SEQ ID NO: 659235 - protein, 17 aa, Mycobacterium
FGNRAIYHEGWIASCFH

SEQ ID NO: 659236 - protein, 17 aa, Mycobacterium
FGNRGPWSTRLGYGPLV

SEQ ID NO: 659237 - protein, 25 aa, Mycobacterium
FGNRLLRTPLRGVGMALVELGLGGA

SEQ ID NO: 659238 - protein, 19 aa, Mycobacterium
FGNTGAWNVGIGNIGNYNL

SEQ ID NO: 659239 - protein, 23 aa, Mycobacterium
FGNTGSWNLGMGNIGDFNPGSGN

SEQ ID NO: 659240 - protein, 24 aa, Mycobacterium
FGNTGVPGIIFGPALSGGNSGLFN

SEQ ID NO: 659241 - protein, 19 aa, Mycobacterium
FGNVIRLLPPLTITDELLA

SEQ ID NO: 659242 - protein, 23 aa, Mycobacterium
FGNVLRFLPPLSISDELLTEAFD

SEQ ID NO: 659243 - protein, 24 aa, Mycobacterium
FGNVLRFLPPLTITDELLVDAFGV

SEQ ID NO: 659244 - protein, 24 aa, Mycobacterium
FGPACPQPVFPNMPLDLGAPQGED

SEQ ID NO: 659245 - protein, 17 aa, Mycobacterium
FGPALRLDAVRIGATPA

SEQ ID NO: 659246 - protein, 23 aa, Mycobacterium
FGPDFPFEFDAWISHPDGLGQVP

SEQ ID NO: 659247 - protein, 18 aa, Mycobacterium
FGPDMLAALGADVSMQAL

SEQ ID NO: 659248 - protein, 17 aa, Mycobacterium
FGPDRVISADNLRDAID

SEQ ID NO: 659249 - protein, 17 aa, Mycobacterium
FGPERVITATTLPDAIE

SEQ ID NO: 659250 - protein, 23 aa, Mycobacterium
FGPEVRRKLVLKQLVDLYGEQAN

SEQ ID NO: 659251 - protein, 26 aa, Mycobacterium
FGPGDLEKAWPLWEADGYLTRMSGTH

SEQ ID NO: 659252 - protein, 19 aa, Mycobacterium
FGPGEVLWTAMPLFHLSAA

SEQ ID NO: 659253 - protein, 18 aa, Mycobacterium
FGPGGARGGGRRGGPGRG

SEQ ID NO: 659254 - protein, 30 aa, Mycobacterium
FGPGGLGTFSWPGAYGTWWQADPGADLILL

SEQ ID NO: 659255 - protein, 17 aa, Mycobacterium
FGPGKGLGVIPREGYFQ

SEQ ID NO: 659256 - protein, 20 aa, Mycobacterium
FGPGLRPWPGLPGRARDALM

SEQ ID NO: 659257 - protein, 18 aa, Mycobacterium
FGPGSFGPGFGFGPGSRR

SEQ ID NO: 659258 - protein, 20 aa, Mycobacterium
FGPHPTWYAAPGIPHDGFLA

SEQ ID NO: 659259 - protein, 28 aa, Mycobacterium
FGPIGAHYLGAFAMTSAKQGLDVGQLAM

SEQ ID NO: 659260 - protein, 25 aa, Mycobacterium
FGPLARTRIRPHFFPFTEPSAEVDV

SEQ ID NO: 659261 - protein, 18 aa, Mycobacterium
FGPLEARDELAACEILAD

SEQ ID NO: 659262 - protein, 18 aa, Mycobacterium
FGPLEAREELAACEILAD

SEQ ID NO: 659263 - protein, 17 aa, Mycobacterium
FGPLRFGHSRFDRGGMI

SEQ ID NO: 659264 - protein, 26 aa, Mycobacterium
FGPLRLQFWVCGVFEVHNGRITLWRD

SEQ ID NO: 659265 - protein, 28 aa, Mycobacterium
FGPMTRRLACLRGISTLTGFALAVEIGD

SEQ ID NO: 659266 - protein, 18 aa, Mycobacterium
FGPNLMIMNHFGFTPVWL

SEQ ID NO: 659267 - protein, 24 aa, Mycobacterium
FGPNPLDPGCRVASARAGREQGRR

SEQ ID NO: 659268 - protein, 18 aa, Mycobacterium
FGPPELRQSYAEAIAAAE

SEQ ID NO: 659269 - protein, 20 aa, Mycobacterium
FGPSAIREASRLLKPYHPAL

SEQ ID NO: 659270 - protein, 18 aa, Mycobacterium
FGPTLAEALERYDRRPRL

SEQ ID NO: 659271 - protein, 17 aa, Mycobacterium
FGPTLAETLEKAGGEPQ

SEQ ID NO: 659272 - protein, 24 aa, Mycobacterium
FGPVARGGLRWSDRRDDFRTEILG

SEQ ID NO: 659273 - protein, 25 aa, Mycobacterium
FGPVARGGLRWSDRREDFRTEILGL

SEQ ID NO: 659274 - protein, 17 aa, Mycobacterium
FGPVLAVIPFRDSDEAL

SEQ ID NO: 659275 - protein, 19 aa, Mycobacterium
FGPVLPILRYSRVDEAVER

SEQ ID NO: 659276 - protein, 17 aa, Mycobacterium
FGPVLTVLRCRDDDDAV

SEQ ID NO: 659277 - protein, 17 aa, Mycobacterium
FGPVLVVIGYDGDEQAI

SEQ ID NO: 659278 - protein, 23 aa, Mycobacterium
FGPVQLRVGPGVFIPRPETEALL

SEQ ID NO: 659279 - protein, 23 aa, Mycobacterium
FGPYARAMIRVCKEESFHQRQAY

SEQ ID NO: 659280 - protein, 21 aa, Mycobacterium
FGQDRLEAMAEAATVPVVNAL

SEQ ID NO: 659281 - protein, 24 aa, Mycobacterium
FGQIARGGVRWSDRLDDYRTEVLG

SEQ ID NO: 659282 - protein, 25 aa, Mycobacterium
FGQLGRDRVPVFLLPANPVSALVVF

SEQ ID NO: 659283 - protein, 20 aa, Mycobacterium
FGQLPLRPTVAFECVGVPGL

SEQ ID NO: 659284 - protein, 26 aa, Mycobacterium
FGQPLCWDDLSWLRSLTELPLIVKGI

SEQ ID NO: 659285 - protein, 20 aa, Mycobacterium
FGQPLVLHCVHRNAAVPPSF

SEQ ID NO: 659286 - protein, 23 aa, Mycobacterium
FGQPRPMPGYWREVEKQVEAKRK

SEQ ID NO: 659287 - protein, 18 aa, Mycobacterium
FGQRFPDRLFDVGIAEQH

SEQ ID NO: 659288 - protein, 27 aa, Mycobacterium
FGQRVKWNLMAWWSAKMLMAARNDIAI

SEQ ID NO: 659289 - protein, 21 aa, Mycobacterium
FGQSGTFLWVDPVADLALLVL

SEQ ID NO: 659290 - protein, 18 aa, Mycobacterium
FGQVQTRLVGNAGVQADS

SEQ ID NO: 659291 - protein, 25 aa, Mycobacterium
FGRAADFARPLTVIAGAATRWVWVA

SEQ ID NO: 659292 - protein, 17 aa, Mycobacterium
FGRAEVRNFLVANALYW

SEQ ID NO: 659293 - protein, 19 aa, Mycobacterium
FGRALGFAGEAARAREISD

SEQ ID NO: 659294 - protein, 20 aa, Mycobacterium
FGRAMLRDRVGVSAGCGLAG

SEQ ID NO: 659295 - protein, 26 aa, Mycobacterium
FGRDIGYRIAHHADLNAPPPIEVHEY

SEQ ID NO: 659296 - protein, 23 aa, Mycobacterium
FGRDRLAPFEVPASFQQAAELPH

SEQ ID NO: 659297 - protein, 17 aa, Mycobacterium
FGREGMRVVLADVLAEP

SEQ ID NO: 659298 - protein, 26 aa, Mycobacterium
FGRELFIDKVWDWKRESGGTIGAQMR

SEQ ID NO: 659299 - protein, 24 aa, Mycobacterium
FGREVRLTGFWLGNWYASEPRHEI

SEQ ID NO: 659300 - protein, 17 aa, Mycobacterium
FGRFEGKTAMQMGVDAI

SEQ ID NO: 659301 - protein, 22 aa, Mycobacterium
FGRFTPRARGAVVAAQNAAHEA

SEQ ID NO: 659302 - protein, 22 aa, Mycobacterium
FGRFTPRARSAVVAAQNAAHQG

SEQ ID NO: 659303 - protein, 17 aa, Mycobacterium
FGRGGDWSILKKMTAAL

SEQ ID NO: 659304 - protein, 21 aa, Mycobacterium
FGRHLPFGLTVTMDGRQGADL

SEQ ID NO: 659305 - protein, 19 aa, Mycobacterium
FGRHVMKHVDEIGGVPVVM

SEQ ID NO: 659306 - protein, 20 aa, Mycobacterium
FGRIDGRPVGIVANQPTQFA

SEQ ID NO: 659307 - protein, 20 aa, Mycobacterium
FGRIEGRPVGIVANQPTHFA

SEQ ID NO: 659308 - protein, 17 aa, Mycobacterium
FGRIRDVVISISIVRQQ

SEQ ID NO: 659309 - protein, 20 aa, Mycobacterium
FGRLPTAYPYTLMISQADTE

SEQ ID NO: 659310 - protein, 17 aa, Mycobacterium
FGRMGLRLPATVVAVDG

SEQ ID NO: 659311 - protein, 26 aa, Mycobacterium
FGRNEVRNFLVANALYWLEEYHVDGL

SEQ ID NO: 659312 - protein, 17 aa, Mycobacterium
FGRPGGAPRRGRKSKRA

SEQ ID NO: 659313 - protein, 18 aa, Mycobacterium
FGRPLSKFQAIQHLIADI

SEQ ID NO: 659314 - protein, 28 aa, Mycobacterium
FGRPMILKRFVKGIATEAIFQKRAPEKR

SEQ ID NO: 659315 - protein, 27 aa, Mycobacterium
FGRQLRYDLSAGFPLLTTKKVHLKSVV

SEQ ID NO: 659316 - protein, 17 aa, Mycobacterium
FGRRPRREGVLTLPNEA

SEQ ID NO: 659317 - protein, 17 aa, Mycobacterium
FGRRVAVLVHHCHRELW

SEQ ID NO: 659318 - protein, 25 aa, Mycobacterium
FGRRVAVVACEFDFLAGSIGVAAAE

SEQ ID NO: 659319 - protein, 25 aa, Mycobacterium
FGRRVAVVVCEFGFLGGSIGVAAAE

SEQ ID NO: 659320 - protein, 19 aa, Mycobacterium
FGRTVLRDRVGVAPGCGLA

SEQ ID NO: 659321 - protein, 21 aa, Mycobacterium
FGRVDGRPVGIVANQPTQFAG

SEQ ID NO: 659322 - protein, 26 aa, Mycobacterium
FGRVIGRWSALPGVDAIRVYRVPAEL

SEQ ID NO: 659323 - protein, 18 aa, Mycobacterium
FGRYWPANIHMIGKDIIR

SEQ ID NO: 659324 - protein, 20 aa, Mycobacterium
FGSAAWRVAEAHGRYAPTYF

SEQ ID NO: 659325 - protein, 27 aa, Mycobacterium
FGSAAYWKRHVRDAVRFADSIRFAQSA

SEQ ID NO: 659326 - protein, 25 aa, Mycobacterium
FGSAQLSRRGFIGAGIAGGLALAGC

SEQ ID NO: 659327 - protein, 24 aa, Mycobacterium
FGSARSASALSSRIADWEKESAEH

SEQ ID NO: 659328 - protein, 24 aa, Mycobacterium
FGSASILPITWAYIRMMGADGLRT

SEQ ID NO: 659329 - protein, 26 aa, Mycobacterium
FGSCQAIWRLEHGYLAASDPRRDGQA

SEQ ID NO: 659330 - protein, 17 aa, Mycobacterium
FGSCRFATLTATAGNTH

SEQ ID NO: 659331 - protein, 17 aa, Mycobacterium
FGSDFSRERYDRLGSVS

SEQ ID NO: 659332 - protein, 22 aa, Mycobacterium
FGSERIVAAPVTFVDIAGLVKG

SEQ ID NO: 659333 - protein, 20 aa, Mycobacterium
FGSEVVRRADIPQNDPGVRV

SEQ ID NO: 659334 - protein, 25 aa, Mycobacterium
FGSFLIPRTDYRIDDVWNVVGLKAT

SEQ ID NO: 659335 - protein, 17 aa, Mycobacterium
FGSFNFGDGNRGSNNFG

SEQ ID NO: 659336 - protein, 26 aa, Mycobacterium
FGSGELFDAATLRRLYPGGSTEYLER

SEQ ID NO: 659337 - protein, 19 aa, Mycobacterium
FGSGGIGGPGGFAVAASGN

SEQ ID NO: 659338 - protein, 24 aa, Mycobacterium
FGSGGRYRLGLDGTELDSDAWSEV

SEQ ID NO: 659339 - protein, 18 aa, Mycobacterium
FGSGNRGGNVNFGNGNNG

SEQ ID NO: 659340 - protein, 29 aa, Mycobacterium
FGSGVSPGFAELLAIVAGTACDRIDKVVI

SEQ ID NO: 659341 - protein, 21 aa, Mycobacterium
FGSGVSPGFAELLAIVSAMVC

SEQ ID NO: 659342 - protein, 21 aa, Mycobacterium
FGSLEGILGCVAADMGVSLLP

SEQ ID NO: 659343 - protein, 25 aa, Mycobacterium
FGSLHMPDFPLLPVRVETWEGLVFV

SEQ ID NO: 659344 - protein, 18 aa, Mycobacterium
FGSLKKVNPGIVVVDSSA

SEQ ID NO: 659345 - protein, 29 aa, Mycobacterium
FGSLNLVGGLARSMAKAGYCDLKEFQKVG

SEQ ID NO: 659346 - protein, 24 aa, Mycobacterium
FGSLPEGGRMVAVFADAKRVEQVA

SEQ ID NO: 659347 - protein, 17 aa, Mycobacterium
FGSLRPLLDTAVANGRG

SEQ ID NO: 659348 - protein, 24 aa, Mycobacterium
FGSLTSGLAAQAWQGPASTAMVAA

SEQ ID NO: 659349 - protein, 17 aa, Mycobacterium
FGSMVMSLLGFDDQVAT

SEQ ID NO: 659350 - protein, 27 aa, Mycobacterium
FGSPHGGTWLPWLTDRGFTAVHSQADV

SEQ ID NO: 659351 - protein, 26 aa, Mycobacterium
FGSRAIYRDGWWACARLDRAPWDLSP

SEQ ID NO: 659352 - protein, 17 aa, Mycobacterium
FGSRQGLAQGYALRLAD

SEQ ID NO: 659353 - protein, 17 aa, Mycobacterium
FGSRQGLAQGYALRLTD

SEQ ID NO: 659354 - protein, 23 aa, Mycobacterium
FGSRQGLAQGYAMRLADRLVDQI

SEQ ID NO: 659355 - protein, 24 aa, Mycobacterium
FGSSGLRTTVQFIGPLSVVDNVLA

SEQ ID NO: 659356 - protein, 25 aa, Mycobacterium
FGSSLRFYANTALRIARVRTHRRLK

SEQ ID NO: 659357 - protein, 29 aa, Mycobacterium
FGSSSFRYAAPAGRDWKIADLAGKRVATA

SEQ ID NO: 659358 - protein, 19 aa, Mycobacterium
FGSSYPHWQCHDVGDIRQL

SEQ ID NO: 659359 - protein, 20 aa, Mycobacterium
FGSSYPHWQCYDLRDVRNLP

SEQ ID NO: 659360 - protein, 17 aa, Mycobacterium
FGSTAAIFPIDDVTIEY

SEQ ID NO: 659361 - protein, 17 aa, Mycobacterium
FGSVAAQLREFLDSLGG

SEQ ID NO: 659362 - protein, 18 aa, Mycobacterium
FGSVKGFNDDSTWNDLKV

SEQ ID NO: 659363 - protein, 19 aa, Mycobacterium
FGSVTSGLVGSSWQGAAAA

SEQ ID NO: 659364 - protein, 18 aa, Mycobacterium
FGSWDWRLYSAEAVAEIR

SEQ ID NO: 659365 - protein, 18 aa, Mycobacterium
FGSYRRQLSLGEGIDTSA

SEQ ID NO: 659366 - protein, 18 aa, Mycobacterium
FGTAAGPHPFPMMVRDFQ

SEQ ID NO: 659367 - protein, 26 aa, Mycobacterium
FGTAGCNLACKFCQNWDISKSRETDT

SEQ ID NO: 659368 - protein, 18 aa, Mycobacterium
FGTDCFAERARDKAGNAD

SEQ ID NO: 659369 - protein, 29 aa, Mycobacterium
FGTDEQKLRWAVPILRAQITASLGMSEPS

SEQ ID NO: 659370 - protein, 17 aa, Mycobacterium
FGTDIGVAFQLRDDVLG

SEQ ID NO: 659371 - protein, 23 aa, Mycobacterium
FGTDLLERFRDLIVLQAVPDAVE

SEQ ID NO: 659372 - protein, 17 aa, Mycobacterium
FGTDWGQPVIPEHPDMG

SEQ ID NO: 659373 - protein, 18 aa, Mycobacterium
FGTEAPRVVFLHGGGQNA

SEQ ID NO: 659374 - protein, 20 aa, Mycobacterium
FGTEVKALWWDEGRRQWQIH

SEQ ID NO: 659375 - protein, 23 aa, Mycobacterium
FGTFREIERLMGLHDTPPEQPVV

SEQ ID NO: 659376 - protein, 17 aa, Mycobacterium
FGTGAFRANLQAASEAA

SEQ ID NO: 659377 - protein, 27 aa, Mycobacterium
FGTGRGHLAALIAHAGFDCYSTDVMDY

SEQ ID NO: 659378 - protein, 18 aa, Mycobacterium
FGTIPLLGLDVFEHAYYL

SEQ ID NO: 659379 - protein, 21 aa, Mycobacterium
FGTKIMRYMHDHGITEETLAR

SEQ ID NO: 659380 - protein, 17 aa, Mycobacterium
FGTLVAGKNLLGCLVGS

SEQ ID NO: 659381 - protein, 17 aa, Mycobacterium
FGTNGWHPGEPWIADTT

SEQ ID NO: 659382 - protein, 23 aa, Mycobacterium
FGTPDSWVIWNLTGGVRSGVHVT

SEQ ID NO: 659383 - protein, 17 aa, Mycobacterium
FGTPGMPGMPGMPGMPA

SEQ ID NO: 659384 - protein, 34 aa, Mycobacterium
FGTPNFTGRSWPLADVRLLAPILASKVVCIGKNY

SEQ ID NO: 659385 - protein, 17 aa, Mycobacterium
FGTPRTMLNVAVGGARR

SEQ ID NO: 659386 - protein, 23 aa, Mycobacterium
FGTPSGRGGAAFLSRVPPAQLPD

SEQ ID NO: 659387 - protein, 23 aa, Mycobacterium
FGTPSGRGGAAFLSRVPPNQLPD

SEQ ID NO: 659388 - protein, 23 aa, Mycobacterium
FGTSGPRSSWRATDPVLYAMSGS

SEQ ID NO: 659389 - protein, 22 aa, Mycobacterium
FGTTALMMLKCVMAKNCNIKCP

SEQ ID NO: 659390 - protein, 19 aa, Mycobacterium
FGTTLGRRGNRGLGGALQN

SEQ ID NO: 659391 - protein, 26 aa, Mycobacterium
FGTTQRFGVPMGFGGPHAGYLAVHSK

SEQ ID NO: 659392 - protein, 26 aa, Mycobacterium
FGTTQRFGVPMGFGGPHAGYLAVHTA

SEQ ID NO: 659393 - protein, 21 aa, Mycobacterium
FGVADARLGQRVAAAVVTTPE

SEQ ID NO: 659394 - protein, 18 aa, Mycobacterium
FGVCRDGHFYAAGRAALC

SEQ ID NO: 659395 - protein, 17 aa, Mycobacterium
FGVDGLMEAVRAIADGD

SEQ ID NO: 659396 - protein, 25 aa, Mycobacterium
FGVDQLRYFLLREVPFGQDGSYSED

SEQ ID NO: 659397 - protein, 24 aa, Mycobacterium
FGVDQLRYFLLREVSFGQDGSYSE

SEQ ID NO: 659398 - protein, 22 aa, Mycobacterium
FGVDQVRYFLLREVPFGQDGSF

SEQ ID NO: 659399 - protein, 17 aa, Mycobacterium
FGVDSFAGSVLADVGVD

SEQ ID NO: 659400 - protein, 22 aa, Mycobacterium
FGVEPPVALILQGASLHDLTVD

SEQ ID NO: 659401 - protein, 22 aa, Mycobacterium
FGVEPPVALLLQGATLNDVALD

SEQ ID NO: 659402 - protein, 21 aa, Mycobacterium
FGVGATECLGRARAALESTDD

SEQ ID NO: 659403 - protein, 17 aa, Mycobacterium
FGVGIAFPGFRTDPTGL

SEQ ID NO: 659404 - protein, 18 aa, Mycobacterium
FGVGKTHLLASIYHTVPG

SEQ ID NO: 659405 - protein, 18 aa, Mycobacterium
FGVITKVRLRVHRIPETT

SEQ ID NO: 659406 - protein, 17 aa, Mycobacterium
FGVKILLDVLGYDRLIG

SEQ ID NO: 659407 - protein, 26 aa, Mycobacterium
FGVLPRLDAPTGRRTVLCVRRLEHRM

SEQ ID NO: 659408 - protein, 23 aa, Mycobacterium
FGVLSRFTAFVAIDPERTEAGPI

SEQ ID NO: 659409 - protein, 17 aa, Mycobacterium
FGVPLLHRIATGVEDRP

SEQ ID NO: 659410 - protein, 19 aa, Mycobacterium
FGVPPLEFFDPRATPHPRA

SEQ ID NO: 659411 - protein, 18 aa, Mycobacterium
FGVPRVVARINDIRNQWL

SEQ ID NO: 659412 - protein, 18 aa, Mycobacterium
FGVPYAFGKYDQLFVPEF

SEQ ID NO: 659413 - protein, 23 aa, Mycobacterium
FGVRCGTALPGLPELAVGRLNDC

SEQ ID NO: 659414 - protein, 17 aa, Mycobacterium
FGVRKLESEPGLDGAPA

SEQ ID NO: 659415 - protein, 23 aa, Mycobacterium
FGVSFDPNSGWFGLANTYANQFI

SEQ ID NO: 659416 - protein, 21 aa, Mycobacterium
FGVSRITVRRALADLAEQGYI

SEQ ID NO: 659417 - protein, 22 aa, Mycobacterium
FGVTQQPAWAFISANGEVEVVK

SEQ ID NO: 659418 - protein, 18 aa, Mycobacterium
FGVVPKWGFYLSSKAAFD

SEQ ID NO: 659419 - protein, 17 aa, Mycobacterium
FGWAGPFAERAASEFTL

SEQ ID NO: 659420 - protein, 17 aa, Mycobacterium
FGWDRKAPGSSVLIAAS

SEQ ID NO: 659421 - protein, 17 aa, Mycobacterium
FGWKSSFGSGKGKDAIT

SEQ ID NO: 659422 - protein, 24 aa, Mycobacterium
FGWLGDAFPLSALTQIYLSGGESN

SEQ ID NO: 659423 - protein, 23 aa, Mycobacterium
FGWTGPFADRAATEFTLQAWAGS

SEQ ID NO: 659424 - protein, 26 aa, Mycobacterium
FGYAEHREILCAAGADVVTFDPLCDP

SEQ ID NO: 659425 - protein, 27 aa, Mycobacterium
FGYAIPQQWGGLGLNLAQDVELAMEFG

SEQ ID NO: 659426 - protein, 26 aa, Mycobacterium
FGYDFKEFRVDPAWVPPEEEALAMEM

SEQ ID NO: 659427 - protein, 19 aa, Mycobacterium
FGYDRPVYTLGHYGLFMGP

SEQ ID NO: 659428 - protein, 22 aa, Mycobacterium
FGYDRYDDFFAMAHRLLPDDGV

SEQ ID NO: 659429 - protein, 17 aa, Mycobacterium
FGYGPATVWENVSVERE

SEQ ID NO: 659430 - protein, 23 aa, Mycobacterium
FGYMSGALKHFFDTVYYPVLDHV

SEQ ID NO: 659431 - protein, 17 aa, Mycobacterium
FGYRGADPVLLRDDTHP

SEQ ID NO: 659432 - protein, 21 aa, Mycobacterium
FGYRVSRYELDLEYKTTINRL

SEQ ID NO: 659433 - protein, 24 aa, Mycobacterium
FGYRVSRYELDLEYKVAINRLSGT

SEQ ID NO: 659434 - protein, 17 aa, Mycobacterium
FGYRYLVEEARDAGEPM

SEQ ID NO: 659435 - protein, 17 aa, Mycobacterium
FGYRYLVEEAREAGEPM

SEQ ID NO: 659436 - protein, 18 aa, Mycobacterium
FGYVVARAVVSARETLLR

SEQ ID NO: 659437 - protein, 17 aa, Mycobacterium
FHAAALAHLALLDLAAG

SEQ ID NO: 659438 - protein, 26 aa, Mycobacterium
FHAALEFWSALHGFVLLEMTGLMEEI

SEQ ID NO: 659439 - protein, 26 aa, Mycobacterium
FHAALEFWSALHGFVLLEMTGVMDDI

SEQ ID NO: 659440 - protein, 26 aa, Mycobacterium
FHAALEFWSAMHGFVLLEMTGVMDDI

SEQ ID NO: 659441 - protein, 19 aa, Mycobacterium
FHADHIVTAQQWRSRIAAR

SEQ ID NO: 659442 - protein, 18 aa, Mycobacterium
FHAIVSRFYAQVAEDEIL

SEQ ID NO: 659443 - protein, 17 aa, Mycobacterium
FHAKAIVLATGGSGRMY

SEQ ID NO: 659444 - protein, 19 aa, Mycobacterium
FHAMYPRIDEWIAVRRNVD

SEQ ID NO: 659445 - protein, 33 aa, Mycobacterium
FHAPIEWQQRLWPTEEFELARARVPVTLPEDDL

SEQ ID NO: 659446 - protein, 27 aa, Mycobacterium
FHAQPVCCPNCGPTLRLLTTEGEHATG

SEQ ID NO: 659447 - protein, 19 aa, Mycobacterium
FHATRITAVIQWSDMLPAL

SEQ ID NO: 659448 - protein, 19 aa, Mycobacterium
FHCAKAFLRSDAWDPQSWD

SEQ ID NO: 659449 - protein, 29 aa, Mycobacterium
FHDGRLFIGECREGGRLLEFDLSGGPPRV

SEQ ID NO: 659450 - protein, 17 aa, Mycobacterium
FHDQFVRALTASGGSYA

SEQ ID NO: 659451 - protein, 24 aa, Mycobacterium
FHEAANMAALWDLPLVFVCQNNLY

SEQ ID NO: 659452 - protein, 24 aa, Mycobacterium
FHEAANMAALWDLPLVFVCQNNRY

SEQ ID NO: 659453 - protein, 24 aa, Mycobacterium
FHEAANMAALWDLPMVFLCQNNLY

SEQ ID NO: 659454 - protein, 23 aa, Mycobacterium
FHEAVHWDIPVAELTTDDAGQTT

SEQ ID NO: 659455 - protein, 18 aa, Mycobacterium
FHEMAPDLSCARAVVVGN

SEQ ID NO: 659456 - protein, 18 aa, Mycobacterium
FHERITLRFGAAYGASVL

SEQ ID NO: 659457 - protein, 20 aa, Mycobacterium
FHERPRTVIEWLRDGGEVDK

SEQ ID NO: 659458 - protein, 22 aa, Mycobacterium
FHFPERRALCMAENATHTLHNL

SEQ ID NO: 659459 - protein, 24 aa, Mycobacterium
FHGCEGDSLLMLLDAKGVECSTGS

SEQ ID NO: 659460 - protein, 23 aa, Mycobacterium
FHGDDPRFCTVIFGVITAAPDGF

SEQ ID NO: 659461 - protein, 19 aa, Mycobacterium
FHGDFTFGQALFSYDMKAV

SEQ ID NO: 659462 - protein, 25 aa, Mycobacterium
FHGFLLRTAGKWTLKHPLRPMPMLR

SEQ ID NO: 659463 - protein, 19 aa, Mycobacterium
FHGGLSWPFADDDDPLDTP

SEQ ID NO: 659464 - protein, 17 aa, Mycobacterium
FHGLHVHGFPNCFIESI

SEQ ID NO: 659465 - protein, 22 aa, Mycobacterium
FHGPADMVYLGIGQDYTITGHG

SEQ ID NO: 659466 - protein, 17 aa, Mycobacterium
FHGWEWNRDGRNVCIPY

SEQ ID NO: 659467 - protein, 31 aa, Mycobacterium
FHHAGTKGPIPWWWRPSGALFDQFLGAAETE

SEQ ID NO: 659468 - protein, 27 aa, Mycobacterium
FHHAGTKGPVPWWWRPSGALFDQFLGA

SEQ ID NO: 659469 - protein, 26 aa, Mycobacterium
FHHGVTGPVPWWWRPSGALFDQFLGA

SEQ ID NO: 659470 - protein, 22 aa, Mycobacterium
FHHPCDLGRAGLPEEVASITAY

SEQ ID NO: 659471 - protein, 18 aa, Mycobacterium
FHHREVFGQVGFGTGGWD

SEQ ID NO: 659472 - protein, 17 aa, Mycobacterium
FHIDRVAALLPHCARAE

SEQ ID NO: 659473 - protein, 28 aa, Mycobacterium
FHIFGYKAGCIASLIRGATIIPVRVFVL

SEQ ID NO: 659474 - protein, 21 aa, Mycobacterium
FHKDVVIDMLCYRRRGHNEGD

SEQ ID NO: 659475 - protein, 17 aa, Mycobacterium
FHKPESPDAPLLLIFPH

SEQ ID NO: 659476 - protein, 22 aa, Mycobacterium
FHKRADIVLSGLRKLRSALTEA

SEQ ID NO: 659477 - protein, 17 aa, Mycobacterium
FHLAGIPSYLVVGELAI

SEQ ID NO: 659478 - protein, 19 aa, Mycobacterium
FHLGYHGLPIPGLLPGFGH

SEQ ID NO: 659479 - protein, 29 aa, Mycobacterium
FHLLERYGTWRLSDVLGYAAEYAERGIEC

SEQ ID NO: 659480 - protein, 25 aa, Mycobacterium
FHLRNRLVVAALHWDGDITGLVRSH

SEQ ID NO: 659481 - protein, 22 aa, Mycobacterium
FHLRNRLVVAALHWDGDVKGLI

SEQ ID NO: 659482 - protein, 26 aa, Mycobacterium
FHLRNRLVVAALHWDGPVSGLIASHL

SEQ ID NO: 659483 - protein, 22 aa, Mycobacterium
FHLRNRLVVAALHWDNNIRGLL

SEQ ID NO: 659484 - protein, 25 aa, Mycobacterium
FHLRNRLVVAAMHWNGDVTGLVRSH

SEQ ID NO: 659485 - protein, 18 aa, Mycobacterium
FHLSGAVASMMVVPPQSS

SEQ ID NO: 659486 - protein, 18 aa, Mycobacterium
FHLSRQWWSYLADHALLR

SEQ ID NO: 659487 - protein, 18 aa, Mycobacterium
FHLSYVFVSHNLAVVRKL

SEQ ID NO: 659488 - protein, 22 aa, Mycobacterium
FHLYSECRSVLDAARTADGGAW

SEQ ID NO: 659489 - protein, 20 aa, Mycobacterium
FHMAGFGWALAGLWEGAVTV

SEQ ID NO: 659490 - protein, 17 aa, Mycobacterium
FHMKQGEGFLAHMHDPF

SEQ ID NO: 659491 - protein, 25 aa, Mycobacterium
FHNDVEQVWRWPARRTKDNSTSTRL

SEQ ID NO: 659492 - protein, 18 aa, Mycobacterium
FHNFGYKAGILACLQTGA

SEQ ID NO: 659493 - protein, 18 aa, Mycobacterium
FHNICRHRGNKLVWNDFP

SEQ ID NO: 659494 - protein, 24 aa, Mycobacterium
FHNTRGAGLASAFAAVSAGVTRLD

SEQ ID NO: 659495 - protein, 19 aa, Mycobacterium
FHNVCRHRGNKLVWNDFPS

SEQ ID NO: 659496 - protein, 17 aa, Mycobacterium
FHPELFAAGISICGMSD

SEQ ID NO: 659497 - protein, 19 aa, Mycobacterium
FHPELQFDKPYLLAMANAG

SEQ ID NO: 659498 - protein, 20 aa, Mycobacterium
FHPELQFDKPYLLAMANAGP

SEQ ID NO: 659499 - protein, 18 aa, Mycobacterium
FHPGVTYHHYRLGQAGKT

SEQ ID NO: 659500 - protein, 20 aa, Mycobacterium
FHPHIAKLKLADGVATVERI

SEQ ID NO: 659501 - protein, 19 aa, Mycobacterium
FHPLFGSPMWNAADEARRS

SEQ ID NO: 659502 - protein, 23 aa, Mycobacterium
FHPLRLHAAIDMLLDGVIRTRGR

SEQ ID NO: 659503 - protein, 18 aa, Mycobacterium
FHPSYRHAGAVRREIGVP

SEQ ID NO: 659504 - protein, 22 aa, Mycobacterium
FHQCRPAVVFEAVGAPGIIDDI

SEQ ID NO: 659505 - protein, 20 aa, Mycobacterium
FHQLRPGWADGVSPGDILVA

SEQ ID NO: 659506 - protein, 17 aa, Mycobacterium
FHQPAAVLIDLATLESL

SEQ ID NO: 659507 - protein, 26 aa, Mycobacterium
FHQPRPPWLMSRCAPAPVGRTAAPGA

SEQ ID NO: 659508 - protein, 17 aa, Mycobacterium
FHRAINIAADSPKLAQL

SEQ ID NO: 659509 - protein, 18 aa, Mycobacterium
FHRGKRLVNLDVKKDPEA

SEQ ID NO: 659510 - protein, 20 aa, Mycobacterium
FHRGRLLAMGPRCLMTSMEL

SEQ ID NO: 659511 - protein, 23 aa, Mycobacterium
FHRMAVDAFGSLAADAIEAAQQT

SEQ ID NO: 659512 - protein, 19 aa, Mycobacterium
FHRRGEVLGALGVAGTDFT

SEQ ID NO: 659513 - protein, 20 aa, Mycobacterium
FHSARWDYDYTGGDADGGLH

SEQ ID NO: 659514 - protein, 18 aa, Mycobacterium
FHSPDCPYPVTWDEADAK

SEQ ID NO: 659515 - protein, 18 aa, Mycobacterium
FHSPHLLEAIERFCADKT

SEQ ID NO: 659516 - protein, 17 aa, Mycobacterium
FHSPLMEPMMGDFAAVV

SEQ ID NO: 659517 - protein, 18 aa, Mycobacterium
FHSSRWDYSYTGGDTTGN

SEQ ID NO: 659518 - protein, 22 aa, Mycobacterium
FHTAVYPGVWVPREAELSPVQR

SEQ ID NO: 659519 - protein, 25 aa, Mycobacterium
FHTFGYKAGLIASFIRGATMFPVPV

SEQ ID NO: 659520 - protein, 17 aa, Mycobacterium
FHVKGDPSASVTIADIA

SEQ ID NO: 659521 - protein, 17 aa, Mycobacterium
FHVKGDPSASVTIQDVA

SEQ ID NO: 659522 - protein, 26 aa, Mycobacterium
FHVLAHDWGAAVAWQLAGNHADRVQT

SEQ ID NO: 659523 - protein, 20 aa, Mycobacterium
FHVPVAPAITGRQFIELIAS

SEQ ID NO: 659524 - protein, 17 aa, Mycobacterium
FHVVPVLAYSPDPGPVH

SEQ ID NO: 659525 - protein, 20 aa, Mycobacterium
FHYFPGGKDQLMLAVAEHEA

SEQ ID NO: 659526 - protein, 25 aa, Mycobacterium
FHYLESWLLPALHLRVTVFHFNPGH

SEQ ID NO: 659527 - protein, 17 aa, Mycobacterium
FHYLTIFGDDGRPLHLG

SEQ ID NO: 659528 - protein, 23 aa, Mycobacterium
FHYTRKWLQRMTVGQIDRSVSQI

SEQ ID NO: 659529 - protein, 23 aa, Mycobacterium
FHYTRKWLQRMTVSQFDRSVAQI

SEQ ID NO: 659530 - protein, 22 aa, Mycobacterium
FIAAEALIAMDLLPTAILRKLT

SEQ ID NO: 659531 - protein, 25 aa, Mycobacterium
FIAAWKGLPSFAFRSQFRTWLYSLA

SEQ ID NO: 659532 - protein, 24 aa, Mycobacterium
FIADFVPRVRAGLEALGIGSQYLG

SEQ ID NO: 659533 - protein, 23 aa, Mycobacterium
FIAELRSGLLADEIGRLEADGAA

SEQ ID NO: 659534 - protein, 21 aa, Mycobacterium
FIAEVLPKVGIARRLVDSGEL

SEQ ID NO: 659535 - protein, 27 aa, Mycobacterium
FIAGARLTVPLGMIILRKGYGLGAMAM

SEQ ID NO: 659536 - protein, 22 aa, Mycobacterium
FIAGRPDPWAGIDDNAQSIDTL

SEQ ID NO: 659537 - protein, 18 aa, Mycobacterium
FIAKEIFPGGSVPGEENI

SEQ ID NO: 659538 - protein, 18 aa, Mycobacterium
FIALKVGIDNWRWAGVPI

SEQ ID NO: 659539 - protein, 18 aa, Mycobacterium
FIALRPATQLHWTGHDHP

SEQ ID NO: 659540 - protein, 23 aa, Mycobacterium
FIANILKNLGINWDPSEGTVNGL

SEQ ID NO: 659541 - protein, 17 aa, Mycobacterium
FIASISLSYLGDMQLEL

SEQ ID NO: 659542 - protein, 33 aa, Mycobacterium
FIDAAKAYVRFALDHPGHYAVMFDKSLYDDTDP

SEQ ID NO: 659543 - protein, 17 aa, Mycobacterium
FIDAEVMPVERAVLAHH

SEQ ID NO: 659544 - protein, 22 aa, Mycobacterium
FIDAFVEFYHAPILHMKQATPE

SEQ ID NO: 659545 - protein, 23 aa, Mycobacterium
FIDAGVSGGIWGLTEGYGLMVGG

SEQ ID NO: 659546 - protein, 18 aa, Mycobacterium
FIDDGGYDQPRWWSPRGW

SEQ ID NO: 659547 - protein, 20 aa, Mycobacterium
FIDDRPHLLTSRSPADRGTR

SEQ ID NO: 659548 - protein, 20 aa, Mycobacterium
FIDELRVCLHGCGVTNLAGL

SEQ ID NO: 659549 - protein, 20 aa, Mycobacterium
FIDERPQLLTARSSADRGTK

SEQ ID NO: 659550 - protein, 18 aa, Mycobacterium
FIDERPQLLTARTSADRG

SEQ ID NO: 659551 - protein, 17 aa, Mycobacterium
FIDFGYATGLPGPFQSI

SEQ ID NO: 659552 - protein, 19 aa, Mycobacterium
FIDGQCLFGPVLVDPPTGT

SEQ ID NO: 659553 - protein, 28 aa, Mycobacterium
FIDHAGFQCGFCTAGMVLTAATLTGDQT

SEQ ID NO: 659554 - protein, 20 aa, Mycobacterium
FIDHAVELGCQALLGALDEA

SEQ ID NO: 659555 - protein, 19 aa, Mycobacterium
FIDLPYRPGHEAVGVVETL

SEQ ID NO: 659556 - protein, 18 aa, Mycobacterium
FIDRAPFRFVSTVDLPIT

SEQ ID NO: 659557 - protein, 22 aa, Mycobacterium
FIDRIRVSAPMLVDGRTVHVIA

SEQ ID NO: 659558 - protein, 18 aa, Mycobacterium
FIDYCINMLYITAAPYVP

SEQ ID NO: 659559 - protein, 24 aa, Mycobacterium
FIEDAAHFYFEFHMKQGEGFLAHM

SEQ ID NO: 659560 - protein, 18 aa, Mycobacterium
FIEDGGYREPRWWSERGW

SEQ ID NO: 659561 - protein, 25 aa, Mycobacterium
FIEDWAETWPAQGLTYPKELADDLE

SEQ ID NO: 659562 - protein, 21 aa, Mycobacterium
FIEERPQLLTARSSADRGTKI

SEQ ID NO: 659563 - protein, 17 aa, Mycobacterium
FIEGASWAESSVGTNGI

SEQ ID NO: 659564 - protein, 26 aa, Mycobacterium
FIEGYNLNMAIPWIAAERGFIDAVVD

SEQ ID NO: 659565 - protein, 30 aa, Mycobacterium
FIEGYNLNMAIPWTAAERGFIDAVIDPHQT

SEQ ID NO: 659566 - protein, 30 aa, Mycobacterium
FIEGYNLNMAIPWTAAERGFIDAVVDPHET

SEQ ID NO: 659567 - protein, 25 aa, Mycobacterium
FIEHLDALGFDEVWMGEHHSAGSEI

SEQ ID NO: 659568 - protein, 20 aa, Mycobacterium
FIEHRLPHFGRYEDAMMGQD

SEQ ID NO: 659569 - protein, 24 aa, Mycobacterium
FIELCVDLANTVWLFLHSGSRGVG

SEQ ID NO: 659570 - protein, 24 aa, Mycobacterium
FIELLAWQFASPVRWIETQDLLFI

SEQ ID NO: 659571 - protein, 18 aa, Mycobacterium
FIEMAWQAPIYLIAGGLG

SEQ ID NO: 659572 - protein, 26 aa, Mycobacterium
FIERPMRWLEALSRYGGTITAAPNFA

SEQ ID NO: 659573 - protein, 18 aa, Mycobacterium
FIESCFELNLTDGYGSTE

SEQ ID NO: 659574 - protein, 18 aa, Mycobacterium
FIETCRRAEQWGYDAVFA

SEQ ID NO: 659575 - protein, 24 aa, Mycobacterium
FIEVPGRGLFAVECNPRATSGILL

SEQ ID NO: 659576 - protein, 23 aa, Mycobacterium
FIEVRRAGIALAREVERRAPDAV

SEQ ID NO: 659577 - protein, 23 aa, Mycobacterium
FIEVRRAGIALAREVERRAPEAV

SEQ ID NO: 659578 - protein, 18 aa, Mycobacterium
FIEVTFRGANSLGDHVSG

SEQ ID NO: 659579 - protein, 17 aa, Mycobacterium
FIGDGAQRWPAVHRDDA

SEQ ID NO: 659580 - protein, 19 aa, Mycobacterium
FIGKRLMQTAGVDRLSALY

SEQ ID NO: 659581 - protein, 30 aa, Mycobacterium
FIGLGPGHRAVFWVPPYHDFGLISGILSAL

SEQ ID NO: 659582 - protein, 25 aa, Mycobacterium
FIGNGRFDFVREFAGPFVGNALSRA

SEQ ID NO: 659583 - protein, 18 aa, Mycobacterium
FIGRGMLTAACPGLIFTS

SEQ ID NO: 659584 - protein, 25 aa, Mycobacterium
FIGRMGGVPPSAWGGPAATRFKDVI

SEQ ID NO: 659585 - protein, 26 aa, Mycobacterium
FIGRMGGVPPSVWGGTAAARFKDVLD

SEQ ID NO: 659586 - protein, 23 aa, Mycobacterium
FIGRVASPFALLVIADLLGVPEE

SEQ ID NO: 659587 - protein, 17 aa, Mycobacterium
FIGSPAMNLVKLPIVPD

SEQ ID NO: 659588 - protein, 18 aa, Mycobacterium
FIGTAGFSALHRINVVCS

SEQ ID NO: 659589 - protein, 18 aa, Mycobacterium
FIHRLRKYIGAYLAVLGH

SEQ ID NO: 659590 - protein, 17 aa, Mycobacterium
FIIDRAWTQVDVIELDP

SEQ ID NO: 659591 - protein, 23 aa, Mycobacterium
FIILRPAPSGTRLLLSDATAALD

SEQ ID NO: 659592 - protein, 17 aa, Mycobacterium
FIKHGYDGASMDAIAKA

SEQ ID NO: 659593 - protein, 19 aa, Mycobacterium
FIKRDPIHRSFHHGEITFS

SEQ ID NO: 659594 - protein, 24 aa, Mycobacterium
FILAEIFPGGWLPTIPTVEEHATA

SEQ ID NO: 659595 - protein, 17 aa, Mycobacterium
FILAELGHERIIYSEDY

SEQ ID NO: 659596 - protein, 17 aa, Mycobacterium
FILALFVDLRGKPCAKL

SEQ ID NO: 659597 - protein, 27 aa, Mycobacterium
FILALPCPMCLGALYYCSPDEVVFLTT

SEQ ID NO: 659598 - protein, 19 aa, Mycobacterium
FILGEVFRRITGRTIGHYL

SEQ ID NO: 659599 - protein, 19 aa, Mycobacterium
FILGEVFRRITGRTVGQYL

SEQ ID NO: 659600 - protein, 19 aa, Mycobacterium
FILQLADPAIVQWTVGRVR

SEQ ID NO: 659601 - protein, 23 aa, Mycobacterium
FILRGIALLGMDSCRCRSGRAAN

SEQ ID NO: 659602 - protein, 22 aa, Mycobacterium
FILRGIALLGMDSVLMPIGPRR

SEQ ID NO: 659603 - protein, 17 aa, Mycobacterium
FILRRWLSTDTKTSPPL

SEQ ID NO: 659604 - protein, 19 aa, Mycobacterium
FILTEIFPGGQLPSSEMVH

SEQ ID NO: 659605 - protein, 23 aa, Mycobacterium
FILTEIFPGGWLPTPQTVGEYAV

SEQ ID NO: 659606 - protein, 20 aa, Mycobacterium
FIMDEIFPGGMLPKVDDVEK

SEQ ID NO: 659607 - protein, 23 aa, Mycobacterium
FIMTEIFPGGRLPSVVMEQEKAI

SEQ ID NO: 659608 - protein, 26 aa, Mycobacterium
FINLSRKGVRFIPLHGPLPYRPLALA

SEQ ID NO: 659609 - protein, 25 aa, Mycobacterium
FINSRPKPLAAYAFTESKYTANRYA

SEQ ID NO: 659610 - protein, 26 aa, Mycobacterium
FIPEGLLNYLALLGWAIADDHDLFSL

SEQ ID NO: 659611 - protein, 26 aa, Mycobacterium
FIPEGLLNYLALLGWGIADDHDVFSL

SEQ ID NO: 659612 - protein, 26 aa, Mycobacterium
FIPEGLLNYLALLGWSIADDRDLFSL

SEQ ID NO: 659613 - protein, 19 aa, Mycobacterium
FIPVSRWQYDIVGADGGCR

SEQ ID NO: 659614 - protein, 25 aa, Mycobacterium
FIQPDLRVLVDLGYSDWGSGQDYAN

SEQ ID NO: 659615 - protein, 21 aa, Mycobacterium
FIQQRVDGVRLREEHIAGKPA

SEQ ID NO: 659616 - protein, 24 aa, Mycobacterium
FIQRPALWFEVMDRVRATVTVAPN

SEQ ID NO: 659617 - protein, 23 aa, Mycobacterium
FIQRPRFLAISEFGPDAFIYHEG

SEQ ID NO: 659618 - protein, 22 aa, Mycobacterium
FIQVRRAGIALARELERRTPDT

SEQ ID NO: 659619 - protein, 20 aa, Mycobacterium
FIRDYSRGFADQAIRRTSVM

SEQ ID NO: 659620 - protein, 26 aa, Mycobacterium
FIRFCDSFQIPLVFVVDTPGFLPGAE

SEQ ID NO: 659621 - protein, 24 aa, Mycobacterium
FIRFCDSYNLPLVFVVDTPGAMPG

SEQ ID NO: 659622 - protein, 19 aa, Mycobacterium
FIRHRARGLALTAAGEEML

SEQ ID NO: 659623 - protein, 19 aa, Mycobacterium
FIRLELTPGIGSVRPAIQV

SEQ ID NO: 659624 - protein, 23 aa, Mycobacterium
FIRVARKFWDSWAPDAVIADVDA

SEQ ID NO: 659625 - protein, 17 aa, Mycobacterium
FIRVFAQRIRICAPNST

SEQ ID NO: 659626 - protein, 29 aa, Mycobacterium
FISARTVEWHLSKIFAKLGVTSRRELRAI

SEQ ID NO: 659627 - protein, 27 aa, Mycobacterium
FISDWPRLADGILQLSVRDFEYPRSDL

SEQ ID NO: 659628 - protein, 29 aa, Mycobacterium
FISGDYSNGAFWRGDHQGLADISYGITIP

SEQ ID NO: 659629 - protein, 32 aa, Mycobacterium
FISGDYSNGAFWRGDHQGLVGFSYAINIPETP

SEQ ID NO: 659630 - protein, 33 aa, Mycobacterium
FISGDYSNGAFWRGDHQGLVGFSYGFTIPALPA

SEQ ID NO: 659631 - protein, 24 aa, Mycobacterium
FISGNYSNGAFWRGDHQGTGISYS

SEQ ID NO: 659632 - protein, 33 aa, Mycobacterium
FISGNYSNGFLWRGDYQGLITISYSSTIPEIPW

SEQ ID NO: 659633 - protein, 21 aa, Mycobacterium
FISQRLGRVIDHFPTQVLGKT

SEQ ID NO: 659634 - protein, 23 aa, Mycobacterium
FISRQMDLRKWFADAGASGAEQD

SEQ ID NO: 659635 - protein, 26 aa, Mycobacterium
FISSGFPINLLGVWAQLATAQGVASV

SEQ ID NO: 659636 - protein, 17 aa, Mycobacterium
FISSVAGMGWENDLDLM

SEQ ID NO: 659637 - protein, 26 aa, Mycobacterium
FISVFGYKAQSAFFKHANIGVSDQQI

SEQ ID NO: 659638 - protein, 17 aa, Mycobacterium
FITAGVSIGERLVFLFG

SEQ ID NO: 659639 - protein, 25 aa, Mycobacterium
FITCTNCGPRFTVIRTLPYDRPGTT

SEQ ID NO: 659640 - protein, 50 aa, Mycobacterium
FITGNMANGVFWRADSMGQLSAHYAITVNRIPAFMTIDAPVNIPITGTIT

SEQ ID NO: 659641 - protein, 17 aa, Mycobacterium
FITKGWLELQFENGESK

SEQ ID NO: 659642 - protein, 17 aa, Mycobacterium
FITQLGRNFQVIHEQAN

SEQ ID NO: 659643 - protein, 17 aa, Mycobacterium
FITQLGRNFQVIYEQAN

SEQ ID NO: 659644 - protein, 25 aa, Mycobacterium
FITSEFPVTLLLVGIGLENIGLFPR

SEQ ID NO: 659645 - protein, 18 aa, Mycobacterium
FITSGPLVAAVLEGPRAI

SEQ ID NO: 659646 - protein, 18 aa, Mycobacterium
FIVADRAGKVFVDATRAG

SEQ ID NO: 659647 - protein, 17 aa, Mycobacterium
FIVAGGLATTVKAGLGL

SEQ ID NO: 659648 - protein, 24 aa, Mycobacterium
FIVDEFTGRMLVGRRYNEGLHQAI

SEQ ID NO: 659649 - protein, 24 aa, Mycobacterium
FIVEDHGGWKVCEIRRGNGVFGPL

SEQ ID NO: 659650 - protein, 19 aa, Mycobacterium
FIVEYQHSYSGVRMVDVEP

SEQ ID NO: 659651 - protein, 25 aa, Mycobacterium
FIVGRIKDLLIIRGRNHYPEDIEAT

SEQ ID NO: 659652 - protein, 23 aa, Mycobacterium
FIVGRTAVIARFAYPQRAPEADA

SEQ ID NO: 659653 - protein, 17 aa, Mycobacterium
FIVHGHFINSSDGTERL

SEQ ID NO: 659654 - protein, 18 aa, Mycobacterium
FIVHTDIYDAFVDKFTER

SEQ ID NO: 659655 - protein, 30 aa, Mycobacterium
FIVPADGFLPALLDWCRSNDVVFIADEVQT

SEQ ID NO: 659656 - protein, 31 aa, Mycobacterium
FIVPAEGFLPALLDWCRKNDVVFIADEVQTG

SEQ ID NO: 659657 - protein, 21 aa, Mycobacterium
FIVTDIFPGGRLPMIETVEEH

SEQ ID NO: 659658 - protein, 24 aa, Mycobacterium
FIVTEIFPGGRLPSIEKVEEHAGK

SEQ ID NO: 659659 - protein, 19 aa, Mycobacterium
FIVTEIFPGGRLPSTGMMV

SEQ ID NO: 659660 - protein, 23 aa, Mycobacterium
FIVTEIFPGGRLPTVDMVIDHAT

SEQ ID NO: 659661 - protein, 26 aa, Mycobacterium
FIVVGKIRDAWNIQRDADGTPSITGN

SEQ ID NO: 659662 - protein, 20 aa, Mycobacterium
FIYFAGRRGDWIRVDGENMS

SEQ ID NO: 659663 - protein, 17 aa, Mycobacterium
FKAAARRAVAAGYDGIE

SEQ ID NO: 659664 - protein, 17 aa, Mycobacterium
FKAALTYSFLWRMLAGS

SEQ ID NO: 659665 - protein, 20 aa, Mycobacterium
FKAAVIHFTRSLAVQVGNHG

SEQ ID NO: 659666 - protein, 21 aa, Mycobacterium
FKAAYRQGLSIVLKGPTGCGK

SEQ ID NO: 659667 - protein, 18 aa, Mycobacterium
FKAELRGDELVRMVPQKA

SEQ ID NO: 659668 - protein, 18 aa, Mycobacterium
FKAHKRSGAEIVSGRLLG

SEQ ID NO: 659669 - protein, 22 aa, Mycobacterium
FKAKLGESVLYPRRLGKPEELA

SEQ ID NO: 659670 - protein, 21 aa, Mycobacterium
FKAPKAFIVVEHIQRLGNGKP

SEQ ID NO: 659671 - protein, 17 aa, Mycobacterium
FKASARKARILRYRFEP

SEQ ID NO: 659672 - protein, 21 aa, Mycobacterium
FKCPRSVAFEAQLPRTDTGKL

SEQ ID NO: 659673 - protein, 22 aa, Mycobacterium
FKEARTVACDVLKPLLDELGLV

SEQ ID NO: 659674 - protein, 25 aa, Mycobacterium
FKEGERLWISWAMANRDPAVFHDPD

SEQ ID NO: 659675 - protein, 25 aa, Mycobacterium
FKEGERLWISWAMANRDPAVFKDPD

SEQ ID NO: 659676 - protein, 25 aa, Mycobacterium
FKEGERLWISWAMANRDPAVFPDPD

SEQ ID NO: 659677 - protein, 25 aa, Mycobacterium
FKEGERLWISWAMANRDPQVFPDPD

SEQ ID NO: 659678 - protein, 18 aa, Mycobacterium
FKEKLIRRDISMKAFDAG

SEQ ID NO: 659679 - protein, 22 aa, Mycobacterium
FKENIKRQWWRAVVSGRDDVVG

SEQ ID NO: 659680 - protein, 20 aa, Mycobacterium
FKEPLYAAPPLLLRMVEAGQ

SEQ ID NO: 659681 - protein, 27 aa, Mycobacterium
FKEQYGSSLVTGWARLHGYPIGILANA

SEQ ID NO: 659682 - protein, 30 aa, Mycobacterium
FKERAEGAGHSYGTTAVRGFVDMTEESISF

SEQ ID NO: 659683 - protein, 24 aa, Mycobacterium
FKERHIFRIDHFLGKEAAQNILAF

SEQ ID NO: 659684 - protein, 17 aa, Mycobacterium
FKEVMNWAEYAEFLTNW

SEQ ID NO: 659685 - protein, 17 aa, Mycobacterium
FKFVPVVGEILADLVTE

SEQ ID NO: 659686 - protein, 19 aa, Mycobacterium
FKGDERWRNLPTPGGNTFE

SEQ ID NO: 659687 - protein, 19 aa, Mycobacterium
FKGDERWRNLPTPSGNTFD

SEQ ID NO: 659688 - protein, 19 aa, Mycobacterium
FKGDPEFYVSPVVASAPKV

SEQ ID NO: 659689 - protein, 17 aa, Mycobacterium
FKGGKRAAQLPAEQQAA

SEQ ID NO: 659690 - protein, 21 aa, Mycobacterium
FKGGLRFHPSVYLGIVKFLGF

SEQ ID NO: 659691 - protein, 20 aa, Mycobacterium
FKGIIRWIQTQGQYSALNVF

SEQ ID NO: 659692 - protein, 31 aa, Mycobacterium
FKGLEAATRARGLRTLDMFVSGLVASGGLPE

SEQ ID NO: 659693 - protein, 24 aa, Mycobacterium
FKGLPGAEGRLKVKPAKPSKLELF

SEQ ID NO: 659694 - protein, 27 aa, Mycobacterium
FKGMYGSSLVTGWARLHGYPLGILANA

SEQ ID NO: 659695 - protein, 26 aa, Mycobacterium
FKGQLTAARASHDWAKGMRDQLLGRA

SEQ ID NO: 659696 - protein, 26 aa, Mycobacterium
FKGRNVEIPDHFRIYVSQKLARLERF

SEQ ID NO: 659697 - protein, 24 aa, Mycobacterium
FKGRNVEIPDHFRTYVSQKLSRLE

SEQ ID NO: 659698 - protein, 17 aa, Mycobacterium
FKGSGFYRTDSRETDKK

SEQ ID NO: 659699 - protein, 19 aa, Mycobacterium
FKGSGFYRTDSRSGSVDAA

SEQ ID NO: 659700 - protein, 19 aa, Mycobacterium
FKGVKGYEAYAAREASATA

SEQ ID NO: 659701 - protein, 20 aa, Mycobacterium
FKGVKGYEAYAAREASATAV

SEQ ID NO: 659702 - protein, 24 aa, Mycobacterium
FKGVLDRRGGQFIRFTRTAGGATA

SEQ ID NO: 659703 - protein, 21 aa, Mycobacterium
FKHITDAGGRVFLELEERSEV

SEQ ID NO: 659704 - protein, 23 aa, Mycobacterium
FKHLHKAGLRRVFVGLETGSYDQ

SEQ ID NO: 659705 - protein, 22 aa, Mycobacterium
FKHLHRAGLRRVFVGLETGSYD

SEQ ID NO: 659706 - protein, 24 aa, Mycobacterium
FKHLSVRDNVAFGLKIRKRPKAEI

SEQ ID NO: 659707 - protein, 31 aa, Mycobacterium
FKHMSRMTWRSMISDGLAMRHGKELTWSQVV

SEQ ID NO: 659708 - protein, 32 aa, Mycobacterium
FKHPKPRLEVNLNRLGGWPTIKGTRVPYDTIV

SEQ ID NO: 659709 - protein, 21 aa, Mycobacterium
FKHVAEMFAELEAAALRSYPR

SEQ ID NO: 659710 - protein, 21 aa, Mycobacterium
FKHVAEMFAELEAAAMRSYPR

SEQ ID NO: 659711 - protein, 20 aa, Mycobacterium
FKHVAEMFAELEATALRSYP

SEQ ID NO: 659712 - protein, 24 aa, Mycobacterium
FKIKHRRTADCVVAGYRLHKSGDD

SEQ ID NO: 659713 - protein, 19 aa, Mycobacterium
FKIKQGVKFHDGTPLDAEA

SEQ ID NO: 659714 - protein, 21 aa, Mycobacterium
FKISPHPSIPHAPDAEAQRDT

SEQ ID NO: 659715 - protein, 18 aa, Mycobacterium
FKITNRLDLLLAHAVVRG

SEQ ID NO: 659716 - protein, 18 aa, Mycobacterium
FKITNRLDLLLAQAVVRG

SEQ ID NO: 659717 - protein, 25 aa, Mycobacterium
FKIVKDEGVEFVDVRFCDLPGTMQH

SEQ ID NO: 659718 - protein, 20 aa, Mycobacterium
FKKDVVIDMLCYRKRGHNEG

SEQ ID NO: 659719 - protein, 17 aa, Mycobacterium
FKKGFAATGGGSVVPDE

SEQ ID NO: 659720 - protein, 18 aa, Mycobacterium
FKKGKLVFKQAGVANPAV

SEQ ID NO: 659721 - protein, 19 aa, Mycobacterium
FKKGKLVFNQAGALPPAAL

SEQ ID NO: 659722 - protein, 27 aa, Mycobacterium
FKKGPEFADIMQRWGFDAEAALGVTTA

SEQ ID NO: 659723 - protein, 22 aa, Mycobacterium
FKKLRSSFDLMLNTVSANLNLN

SEQ ID NO: 659724 - protein, 21 aa, Mycobacterium
FKKRSYQAYLMCFGSTGMFEQ

SEQ ID NO: 659725 - protein, 25 aa, Mycobacterium
FKKSMRALFDGGWDKVGLAEHLGGI

SEQ ID NO: 659726 - protein, 21 aa, Mycobacterium
FKLAAELAYLEYGDLIDTMVD

SEQ ID NO: 659727 - protein, 17 aa, Mycobacterium
FKLARAALFQQQLTLPF

SEQ ID NO: 659728 - protein, 17 aa, Mycobacterium
FKLGADVALALDAAATE

SEQ ID NO: 659729 - protein, 17 aa, Mycobacterium
FKLHEDWGTTPAAIDAC

SEQ ID NO: 659730 - protein, 18 aa, Mycobacterium
FKLHEDWGTTPAVIDACL

SEQ ID NO: 659731 - protein, 20 aa, Mycobacterium
FKLSGEIKPGVTATDVVLTV

SEQ ID NO: 659732 - protein, 23 aa, Mycobacterium
FKLVLLTHNFDFFRTLRSRGVVG

SEQ ID NO: 659733 - protein, 21 aa, Mycobacterium
FKMAAELAYLEFGDLIDAMVT

SEQ ID NO: 659734 - protein, 21 aa, Mycobacterium
FKMAAELAYLEFGDLIDDLVA

SEQ ID NO: 659735 - protein, 21 aa, Mycobacterium
FKMAAELAYLEYGDLIDTLVE

SEQ ID NO: 659736 - protein, 19 aa, Mycobacterium
FKMSARGGLLLYGPPGCGK

SEQ ID NO: 659737 - protein, 23 aa, Mycobacterium
FKNFIRGPVKLIREAWEPVLKNW

SEQ ID NO: 659738 - protein, 18 aa, Mycobacterium
FKPAYGLAEATLLASGQG

SEQ ID NO: 659739 - protein, 21 aa, Mycobacterium
FKPGTLTALGFSYDELRALNP

SEQ ID NO: 659740 - protein, 22 aa, Mycobacterium
FKPGTLTALGFSYDNLRAANPR

SEQ ID NO: 659741 - protein, 22 aa, Mycobacterium
FKPGTLTSLGFNYDKLRGLNPG

SEQ ID NO: 659742 - protein, 24 aa, Mycobacterium
FKPGVAQALGMDFGSLKKVNPGIV

SEQ ID NO: 659743 - protein, 17 aa, Mycobacterium
FKPKPLFYRQPIYYMSN

SEQ ID NO: 659744 - protein, 21 aa, Mycobacterium
FKPKPLFYRQPIYYMSNAQTF

SEQ ID NO: 659745 - protein, 25 aa, Mycobacterium
FKPLRLDIENGEWLVLATFEPGATV

SEQ ID NO: 659746 - protein, 25 aa, Mycobacterium
FKPLRLDIENGEWVVLATFAPGARI

SEQ ID NO: 659747 - protein, 25 aa, Mycobacterium
FKPLYGGSLVTGWATLHGYPLGILA

SEQ ID NO: 659748 - protein, 25 aa, Mycobacterium
FKPLYGSSLVTGWAQLHGYPIGILA

SEQ ID NO: 659749 - protein, 27 aa, Mycobacterium
FKPLYGSSLVTGWARLHGYPLGILANA

SEQ ID NO: 659750 - protein, 28 aa, Mycobacterium
FKPLYGSSLVTGWARLHGYPVGILANAR

SEQ ID NO: 659751 - protein, 31 aa, Mycobacterium
FKPLYGSSLVTGWARLWGYPVGILANARGVL

SEQ ID NO: 659752 - protein, 20 aa, Mycobacterium
FKPLYGTSLVTGWASIHGYP

SEQ ID NO: 659753 - protein, 17 aa, Mycobacterium
FKPMPSYERGAVVHLGP

SEQ ID NO: 659754 - protein, 26 aa, Mycobacterium
FKPPYLPFATLWNFVSELAAHPLPPA

SEQ ID NO: 659755 - protein, 28 aa, Mycobacterium
FKPSPAVYRYVCDELRVTPGDCMMVAAH

SEQ ID NO: 659756 - protein, 21 aa, Mycobacterium
FKPSYGIAEATLFIANIAPDA

SEQ ID NO: 659757 - protein, 21 aa, Mycobacterium
FKPSYGIAEATLFVATIAPDA

SEQ ID NO: 659758 - protein, 23 aa, Mycobacterium
FKPTRPRVMSVAGRAECVKLLVV

SEQ ID NO: 659759 - protein, 25 aa, Mycobacterium
FKPYLGAGLHLASWGFGVETGTHAL

SEQ ID NO: 659760 - protein, 18 aa, Mycobacterium
FKQCPLLYRLRAIDRLPE

SEQ ID NO: 659761 - protein, 20 aa, Mycobacterium
FKQFDEWDVRIVPRERLGVR

SEQ ID NO: 659762 - protein, 20 aa, Mycobacterium
FKQFEEWDVCIVPRDQLRLS

SEQ ID NO: 659763 - protein, 20 aa, Mycobacterium
FKQKSALRFGATHTAATAAE

SEQ ID NO: 659764 - protein, 17 aa, Mycobacterium
FKQPYIALMPQWDFLDF

SEQ ID NO: 659765 - protein, 22 aa, Mycobacterium
FKQSVRMIADHMGFRIDPNIRT

SEQ ID NO: 659766 - protein, 20 aa, Mycobacterium
FKQYAETLARDFAPTKNPAT

SEQ ID NO: 659767 - protein, 22 aa, Mycobacterium
FKQYRVGSVADYRAMREDPSHP

SEQ ID NO: 659768 - protein, 17 aa, Mycobacterium
FKREIAPTFGATHAAAD

SEQ ID NO: 659769 - protein, 19 aa, Mycobacterium
FKRIRGYEVDEANAVRVHS

SEQ ID NO: 659770 - protein, 18 aa, Mycobacterium
FKRIRGYEVDEDNAVRVH

SEQ ID NO: 659771 - protein, 21 aa, Mycobacterium
FKRKWAPHVIEPEYLAFANGP

SEQ ID NO: 659772 - protein, 18 aa, Mycobacterium
FKRLAWWPYSVAMRQVNV

SEQ ID NO: 659773 - protein, 17 aa, Mycobacterium
FKRLTALQYEYGSTAAH

SEQ ID NO: 659774 - protein, 21 aa, Mycobacterium
FKRSFDVAVGAQWTGEGAEAA

SEQ ID NO: 659775 - protein, 17 aa, Mycobacterium
FKRSMQWPYAPSVPNAL

SEQ ID NO: 659776 - protein, 21 aa, Mycobacterium
FKRTLWWPYSVAMRVANYAFT

SEQ ID NO: 659777 - protein, 19 aa, Mycobacterium
FKRTMWLPYSIAMKQVNPL

SEQ ID NO: 659778 - protein, 20 aa, Mycobacterium
FKRVLDINVLGVFHTVRAAL

SEQ ID NO: 659779 - protein, 20 aa, Mycobacterium
FKSAMRSAGTVIGREITRSI

SEQ ID NO: 659780 - protein, 17 aa, Mycobacterium
FKSIHLDQARLLQVPAA

SEQ ID NO: 659781 - protein, 21 aa, Mycobacterium
FKSKHKYYYCGDQVTAEPEYV

SEQ ID NO: 659782 - protein, 18 aa, Mycobacterium
FKTALRLARHRELVDEAG

SEQ ID NO: 659783 - protein, 21 aa, Mycobacterium
FKTERAGVIIAGLEVPHLHVH

SEQ ID NO: 659784 - protein, 17 aa, Mycobacterium
FKTGPKVIGVANITDHT

SEQ ID NO: 659785 - protein, 18 aa, Mycobacterium
FKTIQPWLTDGIAHVPFW

SEQ ID NO: 659786 - protein, 17 aa, Mycobacterium
FKTLPRLHLARHVVTIV

SEQ ID NO: 659787 - protein, 24 aa, Mycobacterium
FKVDDVDVMWKWLGKHRDGLHSIG

SEQ ID NO: 659788 - protein, 19 aa, Mycobacterium
FKVDFAIEDGVPWTNPDAG

SEQ ID NO: 659789 - protein, 25 aa, Mycobacterium
FKVDFAIEGAVPWTNPQARRAGTVH

SEQ ID NO: 659790 - protein, 21 aa, Mycobacterium
FKVDFAIEGDIPWTNPDCARA

SEQ ID NO: 659791 - protein, 21 aa, Mycobacterium
FKVDFAIEGDIPWTNPDCRRA

SEQ ID NO: 659792 - protein, 24 aa, Mycobacterium
FKVDKPGTVAITFTPADGSEPMVH

SEQ ID NO: 659793 - protein, 23 aa, Mycobacterium
FKVDKPGTVSITFTPSDGSEPMV

SEQ ID NO: 659794 - protein, 23 aa, Mycobacterium
FKVEKPGTVTLTFTPADGSQPIV

SEQ ID NO: 659795 - protein, 18 aa, Mycobacterium
FKVGDHVGVGCMVNSCGR

SEQ ID NO: 659796 - protein, 20 aa, Mycobacterium
FKVHLDAFNLLPYLTGEVEE

SEQ ID NO: 659797 - protein, 25 aa, Mycobacterium
FKVLLKELQSLCLNVEVLSKDGAAI

SEQ ID NO: 659798 - protein, 25 aa, Mycobacterium
FKYRSVDKWHRCPAPTLGQHNASIL

SEQ ID NO: 659799 - protein, 18 aa, Mycobacterium
FLAADCLYVDMPVPALAA

SEQ ID NO: 659800 - protein, 19 aa, Mycobacterium
FLACGEMLSSFLLDATLAG

SEQ ID NO: 659801 - protein, 23 aa, Mycobacterium
FLADCGRGVLQRAAAVGVGAAGL

SEQ ID NO: 659802 - protein, 17 aa, Mycobacterium
FLADDFTILDGLLAFYA

SEQ ID NO: 659803 - protein, 20 aa, Mycobacterium
FLADEIVRPLGLDMHIGLPD

SEQ ID NO: 659804 - protein, 33 aa, Mycobacterium
FLADRYPKWWQAPLRWAFRTALGARASLVVRRS

SEQ ID NO: 659805 - protein, 17 aa, Mycobacterium
FLAEAGFSLHDVIADGK

SEQ ID NO: 659806 - protein, 21 aa, Mycobacterium
FLAEEISPWLSPAYGAANVVM

SEQ ID NO: 659807 - protein, 18 aa, Mycobacterium
FLAEGLRLREHRGKIHDL

SEQ ID NO: 659808 - protein, 17 aa, Mycobacterium
FLAEGWNVVATMRNPRP

SEQ ID NO: 659809 - protein, 20 aa, Mycobacterium
FLAEHRHELFPDSFIADLFR

SEQ ID NO: 659810 - protein, 17 aa, Mycobacterium
FLAELERELPAAPAQQG

SEQ ID NO: 659811 - protein, 17 aa, Mycobacterium
FLAELMSVFADGPVVIG

SEQ ID NO: 659812 - protein, 21 aa, Mycobacterium
FLAELNPGFASFVEDKIEQPI

SEQ ID NO: 659813 - protein, 22 aa, Mycobacterium
FLAELPAPMLLGKVELSDGRWV

SEQ ID NO: 659814 - protein, 33 aa, Mycobacterium
FLAESGFMQAIRPELVVPLVIFLASRACTFSHR

SEQ ID NO: 659815 - protein, 18 aa, Mycobacterium
FLAESGFMQAIRPKLVVP

SEQ ID NO: 659816 - protein, 19 aa, Mycobacterium
FLAGFRRLGARHQQFARAF

SEQ ID NO: 659817 - protein, 25 aa, Mycobacterium
FLAGGKRFRPLFTVLSAQVGPNPGA

SEQ ID NO: 659818 - protein, 18 aa, Mycobacterium
FLAGLSPETVHEMVLADP

SEQ ID NO: 659819 - protein, 21 aa, Mycobacterium
FLAGRGGEFIGRVASPFALLV

SEQ ID NO: 659820 - protein, 17 aa, Mycobacterium
FLAHGRLPDRVQRFAAD

SEQ ID NO: 659821 - protein, 25 aa, Mycobacterium
FLAHLPGYQGWQWAAVVASYVGADR

SEQ ID NO: 659822 - protein, 25 aa, Mycobacterium
FLAHLPGYQGWQWAVVVAAHAGADR

SEQ ID NO: 659823 - protein, 26 aa, Mycobacterium
FLAHLPGYQGWQWAVVVAAHPGADHA

SEQ ID NO: 659824 - protein, 29 aa, Mycobacterium
FLAHLPGYQGWQWAVVVAAYAGADHATVS

SEQ ID NO: 659825 - protein, 19 aa, Mycobacterium
FLAIAGRRVQLEIFNKFNI

SEQ ID NO: 659826 - protein, 32 aa, Mycobacterium; identical to SEQ ID NO: 79766

SEQ ID NO: 659827 - protein, 18 aa, Mycobacterium
FLALAAIRTKAVRQGDPL

SEQ ID NO: 659828 - protein, 17 aa, Mycobacterium
FLANWVREAGPKIVEPS

SEQ ID NO: 659829 - protein, 17 aa, Mycobacterium
FLAPAAAIAAEITDAPT

SEQ ID NO: 659830 - protein, 18 aa, Mycobacterium
FLAPDDWTLPTGKFPGAK

SEQ ID NO: 659831 - protein, 18 aa, Mycobacterium
FLAPEIEAAATMVGTGAM

SEQ ID NO: 659832 - protein, 27 aa, Mycobacterium
FLAPLPLAAITPRWVARRLVGMAAGGP

SEQ ID NO: 659833 - protein, 19 aa, Mycobacterium
FLAQLQWRPAGLGPEAMVS

SEQ ID NO: 659834 - protein, 17 aa, Mycobacterium
FLARALAFAAGVAIDNA

SEQ ID NO: 659835 - protein, 18 aa, Mycobacterium
FLAREVVPHQHDWDRDHR

SEQ ID NO: 659836 - protein, 24 aa, Mycobacterium
FLARLCKTAMWIDHGVIRMTGGIE

SEQ ID NO: 659837 - protein, 24 aa, Mycobacterium
FLASQRFAALTGRDHDGVLWISPL

SEQ ID NO: 659838 - protein, 17 aa, Mycobacterium
FLASRPTERYGVSDLAR

SEQ ID NO: 659839 - protein, 20 aa, Mycobacterium
FLATGCGITGRDGHPASTVF

SEQ ID NO: 659840 - protein, 19 aa, Mycobacterium
FLATLGQFVEFVRDGQFDP

SEQ ID NO: 659841 - protein, 18 aa, Mycobacterium
FLATLPQFVEFVRDGHFD

SEQ ID NO: 659842 - protein, 18 aa, Mycobacterium
FLATLSQFVEFVRDGQFD

SEQ ID NO: 659843 - protein, 17 aa, Mycobacterium
FLATRIGGQWGGAFGTM

SEQ ID NO: 659844 - protein, 17 aa, Mycobacterium
FLATRLAGDWGGAFGTL

SEQ ID NO: 659845 - protein, 19 aa, Mycobacterium
FLAVAGRRVQLDLFDKFDV

SEQ ID NO: 659846 - protein, 25 aa, Mycobacterium
FLAWEPFSHMAFRFNDCSTQAVAAF

SEQ ID NO: 659847 - protein, 24 aa, Mycobacterium
FLAWEPFSRMAFRFNTTTSGAISA

SEQ ID NO: 659848 - protein, 18 aa, Mycobacterium
FLCDTAASDDLWILPEKW

SEQ ID NO: 659849 - protein, 23 aa, Mycobacterium
FLCGEVRSLADLIAELPERVAER

SEQ ID NO: 659850 - protein, 18 aa, Mycobacterium
FLCGSVIFVDGGTDAYFR

SEQ ID NO: 659851 - protein, 17 aa, Mycobacterium
FLCGTVIFVDGGTDAYF

SEQ ID NO: 659852 - protein, 20 aa, Mycobacterium
FLCVDGAVAAIEFYTEVFGA

SEQ ID NO: 659853 - protein, 17 aa, Mycobacterium
FLDADGYPTTVDPPAAE

SEQ ID NO: 659854 - protein, 19 aa, Mycobacterium
FLDALAWRLRGQGIFAVSV

SEQ ID NO: 659855 - protein, 31 aa, Mycobacterium
FLDEFGIDTPEVWLPDSFGYSAAMPQIVAAS

SEQ ID NO: 659856 - protein, 18 aa, Mycobacterium
FLDELRAAGAEVVPIRVY

SEQ ID NO: 659857 - protein, 18 aa, Mycobacterium
FLDEPRIAERVKKARTRG

SEQ ID NO: 659858 - protein, 20 aa, Mycobacterium
FLDERLAHWATVNPDGEAMD

SEQ ID NO: 659859 - protein, 18 aa, Mycobacterium
FLDGARVPDVHRVGAVND

SEQ ID NO: 659860 - protein, 18 aa, Mycobacterium
FLDGKAFIEAFVLASALC

SEQ ID NO: 659861 - protein, 24 aa, Mycobacterium
FLDGKEFIETFVLTAALGAVTTKL

SEQ ID NO: 659862 - protein, 24 aa, Mycobacterium
FLDGKEFIETFVLTSALGAVTSKL

SEQ ID NO: 659863 - protein, 24 aa, Mycobacterium
FLDGKEIIETFVLTAALGAVTKTL

SEQ ID NO: 659864 - protein, 33 aa, Mycobacterium
FLDGKVATWWIPERWAFVPEIPRTSVGKYDKKV

SEQ ID NO: 659865 - protein, 19 aa, Mycobacterium
FLDGLAWRLREQGIAGTSV

SEQ ID NO: 659866 - protein, 18 aa, Mycobacterium
FLDGLAWRLREQGVAGVS

SEQ ID NO: 659867 - protein, 18 aa, Mycobacterium
FLDGLAWRLRERGVTAVS

SEQ ID NO: 659868 - protein, 23 aa, Mycobacterium
FLDGLRAARLFGVRTAGGHVLCP

SEQ ID NO: 659869 - protein, 17 aa, Mycobacterium
FLDGLSWRLREQGVPGV

SEQ ID NO: 659870 - protein, 19 aa, Mycobacterium
FLDHIIAHPSLRWVGNANE

SEQ ID NO: 659871 - protein, 18 aa, Mycobacterium
FLDKVVGGAVPRQFIPSV

SEQ ID NO: 659872 - protein, 27 aa, Mycobacterium
FLDLMLRAPFRLARDVLPHMRPGSAII

SEQ ID NO: 659873 - protein, 18 aa, Mycobacterium
FLDLPIPIDGLYLAGAGC

SEQ ID NO: 659874 - protein, 20 aa, Mycobacterium
FLDLSYRMHPAVCAAVSALS

SEQ ID NO: 659875 - protein, 17 aa, Mycobacterium
FLDPELRHLNDDGSDSA

SEQ ID NO: 659876 - protein, 19 aa, Mycobacterium
FLDPSALKPAGSLTAPMPG

SEQ ID NO: 659877 - protein, 17 aa, Mycobacterium
FLDQGITFSLSGQERPF

SEQ ID NO: 659878 - protein, 30 aa, Mycobacterium
FLDRGLRDTGRWRVPLILRLDPKVGSEDVR

SEQ ID NO: 659879 - protein, 26 aa, Mycobacterium
FLDRHGHRGYRELCMRDPSWADDPDG

SEQ ID NO: 659880 - protein, 17 aa, Mycobacterium
FLDRNLIGHIPLIGGGL

SEQ ID NO: 659881 - protein, 29 aa, Mycobacterium
FLDRRRHVYPWVGWLVCHGVVPGDVLVCT

SEQ ID NO: 659882 - protein, 17 aa, Mycobacterium
FLDTIGIERRWHLEDGR

SEQ ID NO: 659883 - protein, 18 aa, Mycobacterium
FLDVGGLRRLCGTPVEIA

SEQ ID NO: 659884 - protein, 28 aa, Mycobacterium
FLDYHANVIARYCARKARIREIEQLLSS

SEQ ID NO: 659885 - protein, 29 aa, Mycobacterium
FLDYHPRWAPSPFPAVLCVSVNDAVVHGI

SEQ ID NO: 659886 - protein, 20 aa, Mycobacterium
FLDYRETLGFEVLALTGDAS

SEQ ID NO: 659887 - protein, 29 aa, Mycobacterium
FLEAGELINAIPFPSIVADDFTFLDGVMA

SEQ ID NO: 659888 - protein, 17 aa, Mycobacterium
FLECAWEAVESAGYDLQ

SEQ ID NO: 659889 - protein, 18 aa, Mycobacterium
FLECAYHVFEQAGYDPDR

SEQ ID NO: 659890 - protein, 19 aa, Mycobacterium
FLEDCKPYAKALYNAIVTI

SEQ ID NO: 659891 - protein, 21 aa, Mycobacterium
FLEFARGAVLVAHNAGFDIGF

SEQ ID NO: 659892 - protein, 19 aa, Mycobacterium
FLEGCGRTDFPGGDVDDMF

SEQ ID NO: 659893 - protein, 19 aa, Mycobacterium
FLEGCGRTDFPGGNVDDMF

SEQ ID NO: 659894 - protein, 25 aa, Mycobacterium
FLEGKEFIEPFVLAAYLGALTRRIR

SEQ ID NO: 659895 - protein, 30 aa, Mycobacterium
FLEGLSAWLEFVWKPGYADYYPELPGGSVL

SEQ ID NO: 659896 - protein, 18 aa, Mycobacterium
FLEHSRILHFRAIDEFWI

SEQ ID NO: 659897 - protein, 17 aa, Mycobacterium
FLEHWDEGAEFEPLLTL

SEQ ID NO: 659898 - protein, 18 aa, Mycobacterium
FLELCPLAAWGSDFTVGA

SEQ ID NO: 659899 - protein, 25 aa, Mycobacterium
FLELWTSNMFGEFDIGPQAHLLITG

SEQ ID NO: 659900 - protein, 29 aa, Mycobacterium
FLENLSPWLEFVWKPGYADYYPELPGGSA

SEQ ID NO: 659901 - protein, 17 aa, Mycobacterium
FLERDAWLRCMHTAVAE

SEQ ID NO: 659902 - protein, 20 aa, Mycobacterium
FLEREESWVSVSRAAVADVE

SEQ ID NO: 659903 - protein, 23 aa, Mycobacterium
FLERLDPSIYWMGVHHSRLVKPE

SEQ ID NO: 659904 - protein, 29 aa, Mycobacterium
FLERLSGWFEFVWKPGYADYYPELPGGSE

SEQ ID NO: 659905 - protein, 17 aa, Mycobacterium
FLESEWADRTPVEVEVP

SEQ ID NO: 659906 - protein, 22 aa, Mycobacterium
FLETFRFLRQFSVDPALIRCPA

SEQ ID NO: 659907 - protein, 24 aa, Mycobacterium
FLETVPIAPIWLCPLRLRDNDGWP

SEQ ID NO: 659908 - protein, 25 aa, Mycobacterium
FLEVVSRPILRSSFVAVLDGCAAAL

SEQ ID NO: 659909 - protein, 25 aa, Mycobacterium
FLEYDRELFKAATAERLAAELVATI

SEQ ID NO: 659910 - protein, 25 aa, Mycobacterium
FLFADAHAYAGLGMITASLLARLSD

SEQ ID NO: 659911 - protein, 25 aa, Mycobacterium
FLFAVAYQAFSWVGASLTYPQLILD

SEQ ID NO: 659912 - protein, 17 aa, Mycobacterium
FLFCAVLAFSRWRFVRF

SEQ ID NO: 659913 - protein, 26 aa, Mycobacterium
FLFEFADPRRLFGLGGQIHREQPPVG

SEQ ID NO: 659914 - protein, 17 aa, Mycobacterium
FLFGLSLDDETRRRAEI

SEQ ID NO: 659915 - protein, 20 aa, Mycobacterium
FLFRGPMLWIAALVGEEIFD

SEQ ID NO: 659916 - protein, 18 aa, Mycobacterium
FLGAECRPGVEVIAETVG

SEQ ID NO: 659917 - protein, 18 aa, Mycobacterium
FLGAEVKAMYPLGPIFHG

SEQ ID NO: 659918 - protein, 18 aa, Mycobacterium
FLGAGEIRTCPRCHNTTQ

SEQ ID NO: 659919 - protein, 17 aa, Mycobacterium
FLGCPDVIALARDQRAA

SEQ ID NO: 659920 - protein, 27 aa, Mycobacterium
FLGDILLWPRLIHKYRGTMTAAPNFAY

SEQ ID NO: 659921 - protein, 22 aa, Mycobacterium
FLGGGGNGGRAFLLGDGGTGGD

SEQ ID NO: 659922 - protein, 18 aa, Mycobacterium
FLGKEIFPGGQMCGEADI

SEQ ID NO: 659923 - protein, 18 aa, Mycobacterium
FLGKKVVDRLEWIYNSDP

SEQ ID NO: 659924 - protein, 18 aa, Mycobacterium
FLGLKAHSYPSCGPLIEP

SEQ ID NO: 659925 - protein, 20 aa, Mycobacterium
FLGLRHFTEALIPRMPAGSA

SEQ ID NO: 659926 - protein, 18 aa, Mycobacterium
FLGLVPFPATPALPDDTQ

SEQ ID NO: 659927 - protein, 22 aa, Mycobacterium
FLGNELLPGLDLIVPAIPPGTT

SEQ ID NO: 659928 - protein, 18 aa, Mycobacterium
FLGPMITALEGYPFDKMT

SEQ ID NO: 659929 - protein, 18 aa, Mycobacterium
FLGPMITGLEGYPFDKMV

SEQ ID NO: 659930 - protein, 17 aa, Mycobacterium
FLGPMVTGLDDYPFEKL

SEQ ID NO: 659931 - protein, 17 aa, Mycobacterium
FLGPMVTGLDDYPFGKL

SEQ ID NO: 659932 - protein, 18 aa, Mycobacterium
FLGPVAKLNGILVRPHDI

SEQ ID NO: 659933 - protein, 29 aa, Mycobacterium
FLGREIPRPGLLGRFGFMDEKTMRKQAAA

SEQ ID NO: 659934 - protein, 27 aa, Mycobacterium
FLGRFDEPRKGMAVLLGALPAVVEPFP

SEQ ID NO: 659935 - protein, 24 aa, Mycobacterium
FLGRFPLELINPFPRPSDAEEART

SEQ ID NO: 659936 - protein, 24 aa, Mycobacterium
FLGSSCIYPKFAEQPIKESALLTG

SEQ ID NO: 659937 - protein, 25 aa, Mycobacterium
FLGSSCIYPKFAEQPIREDSLLTGH

SEQ ID NO: 659938 - protein, 19 aa, Mycobacterium
FLGSSCIYPKYAPQPISEN

SEQ ID NO: 659939 - protein, 25 aa, Mycobacterium
FLGTVTRPALPRVDVVSLYPGADAV

SEQ ID NO: 659940 - protein, 24 aa, Mycobacterium
FLHADRLYSGRIVDEIDRDTVWAF

SEQ ID NO: 659941 - protein, 17 aa, Mycobacterium
FLHDFAGIGARWTPANI

SEQ ID NO: 659942 - protein, 18 aa, Mycobacterium
FLHDFAGLGADWTAANIA

SEQ ID NO: 659943 - protein, 19 aa, Mycobacterium
FLHGLGLNRRVYIRLLSRV

SEQ ID NO: 659944 - protein, 25 aa, Mycobacterium
FLHGLPDSWWQWHYALEGLGRRYHC

SEQ ID NO: 659945 - protein, 29 aa, Mycobacterium
FLHIPFPPVELFLQMPWRTEIIEGLLGAD

SEQ ID NO: 659946 - protein, 27 aa, Mycobacterium
FLHIPFPPVELFMQMPWRTEIVEGLLG

SEQ ID NO: 659947 - protein, 20 aa, Mycobacterium
FLHRRFCDVVTLATKVLPKR

SEQ ID NO: 659948 - protein, 17 aa, Mycobacterium
FLHRVRIRVGDVPVGTW

SEQ ID NO: 659949 - protein, 24 aa, Mycobacterium
FLHRVRVRVGAVVPGEWTPKFGAA

SEQ ID NO: 659950 - protein, 17 aa, Mycobacterium
FLHRVRVRVGGVEPGEW

SEQ ID NO: 659951 - protein, 18 aa, Mycobacterium
FLHRVRVRVGGVEPGQWT

SEQ ID NO: 659952 - protein, 25 aa, Mycobacterium
FLHVDYRRIALIGAQLQVEAAIDDI

SEQ ID NO: 659953 - protein, 17 aa, Mycobacterium
FLIGANMAIRAQAWKSV

SEQ ID NO: 659954 - protein, 20 aa, Mycobacterium
FLIIDGWPAFVSEFPDLEGQ

SEQ ID NO: 659955 - protein, 20 aa, Mycobacterium
FLIIDGWPAFVSEFPDLELQ

SEQ ID NO: 659956 - protein, 20 aa, Mycobacterium
FLIKHAKAIPVDRSAGHGAY

SEQ ID NO: 659957 - protein, 18 aa, Mycobacterium
FLIMPKLIPALIAGCAVI

SEQ ID NO: 659958 - protein, 20 aa, Mycobacterium
FLKDLLEAFSDGPVVIGPTA

SEQ ID NO: 659959 - protein, 20 aa, Mycobacterium
FLKELRLERGPLDHDEAVEA

SEQ ID NO: 659960 - protein, 24 aa, Mycobacterium
FLKELRVPRDGRLYGIERALAAGV

SEQ ID NO: 659961 - protein, 20 aa, Mycobacterium
FLKNPALEAVRFTARSAPKL

SEQ ID NO: 659962 - protein, 24 aa, Mycobacterium
FLKSKLRTGGLLLNHCITRHDNKS

SEQ ID NO: 659963 - protein, 24 aa, Mycobacterium
FLKSKLRTGGLLLNHCITRHDNTS

SEQ ID NO: 659964 - protein, 24 aa, Mycobacterium
FLKSKLRTGGLLLNHCITRPDNRS

SEQ ID NO: 659965 - protein, 19 aa, Mycobacterium
FLKVEWRTIQHYGVQVDNR

SEQ ID NO: 659966 - protein, 18 aa, Mycobacterium
FLLAMGLKVGRGMGVAEM

SEQ ID NO: 659967 - protein, 19 aa, Mycobacterium
FLLAPSWRYRPAADKREFV

SEQ ID NO: 659968 - protein, 17 aa, Mycobacterium
FLLAQQCDLVIAAEHAR

SEQ ID NO: 659969 - protein, 26 aa, Mycobacterium
FLLARARGGVALAFADVAQVHWSSPA

SEQ ID NO: 659970 - protein, 18 aa, Mycobacterium
FLLARPLIGNGADGTAAN

SEQ ID NO: 659971 - protein, 19 aa, Mycobacterium
FLLEETYELLDAVGSGNAD

SEQ ID NO: 659972 - protein, 18 aa, Mycobacterium
FLLEETYELLDAVRSGSA

SEQ ID NO: 659973 - protein, 17 aa, Mycobacterium
FLLEGMPVQVAFHDGAP

SEQ ID NO: 659974 - protein, 27 aa, Mycobacterium
FLLERLRDWGVEHVFAYPGDGINGLLA

SEQ ID NO: 659975 - protein, 18 aa, Mycobacterium
FLLGAGYAPTVVDLPHPA

SEQ ID NO: 659976 - protein, 17 aa, Mycobacterium
FLLGIGVSHAPLIDSKE

SEQ ID NO: 659977 - protein, 21 aa, Mycobacterium
FLLGLDLIDRVVFWMLPMDDP

SEQ ID NO: 659978 - protein, 23 aa, Mycobacterium
FLLGLDLIDRVVFWMLPVDDLLP

SEQ ID NO: 659979 - protein, 20 aa, Mycobacterium
FLLGQCLFGPVLVDPPTGPK

SEQ ID NO: 659980 - protein, 19 aa, Mycobacterium
FLLGRPLIGNGADGTATSP

SEQ ID NO: 659981 - protein, 18 aa, Mycobacterium
FLLGVGIHDITAGYRAYR

SEQ ID NO: 659982 - protein, 20 aa, Mycobacterium
FLLIAAALAEGWAVSVPDHE

SEQ ID NO: 659983 - protein, 18 aa, Mycobacterium
FLLIRAALPHMYRNEFGR

SEQ ID NO: 659984 - protein, 24 aa, Mycobacterium
FLLMRHVFGLGYRRYEWKCDSLNE

SEQ ID NO: 659985 - protein, 21 aa, Mycobacterium
FLLNRNRLNVAVSRAKYAAVI

SEQ ID NO: 659986 - protein, 20 aa, Mycobacterium
FLLNRNRLNVAVSRAKYLAV

SEQ ID NO: 659987 - protein, 20 aa, Mycobacterium
FLLNRNRLNVAVSRAQYAAV

SEQ ID NO: 659988 - protein, 20 aa, Mycobacterium
FLLNTGRLAHQWHTLTKTGK

SEQ ID NO: 659989 - protein, 23 aa, Mycobacterium
FLLPSNMVTPFLGMLGTAAVADA

SEQ ID NO: 659990 - protein, 17 aa, Mycobacterium
FLLQFEFDGHRLTDEQL

SEQ ID NO: 659991 - protein, 17 aa, Mycobacterium
FLLQGGDCAETFADNTE

SEQ ID NO: 659992 - protein, 17 aa, Mycobacterium
FLLQGGDCAETFTENTE

SEQ ID NO: 659993 - protein, 17 aa, Mycobacterium
FLLQGGDCAETFVDNTE

SEQ ID NO: 659994 - protein, 18 aa, Mycobacterium
FLLQRPLLTAIRRTDPTV

SEQ ID NO: 659995 - protein, 18 aa, Mycobacterium
FLLREQKVTLGFAGPEAP

SEQ ID NO: 659996 - protein, 17 aa, Mycobacterium
FLLSREGEWINGQVVNI

SEQ ID NO: 659997 - protein, 24 aa, Mycobacterium
FLLSVGDLLLAWLLLQQAEIALNA

SEQ ID NO: 659998 - protein, 18 aa, Mycobacterium
FLLTAGAIGSLYKERASI

SEQ ID NO: 659999 - protein, 17 aa, Mycobacterium
FLLTRPLLTAIRRTEPT

SEQ ID NO: 660000 - protein, 17 aa, Mycobacterium
FLLVGGLLGDLANHVAR

SEQ ID NO: 660001 - protein, 17 aa, Mycobacterium
FLMQEANPWGYSNKELL

SEQ ID NO: 660002 - protein, 25 aa, Mycobacterium
FLMSVGDLIIGWLLQRQAAVAVAAL

SEQ ID NO: 660003 - protein, 27 aa, Mycobacterium
FLMSVGDLLIGWLLQRQAAVAIEALDA

SEQ ID NO: 660004 - protein, 24 aa, Mycobacterium
FLMSVGDLVIAWLLQRQAAVAVAA

SEQ ID NO: 660005 - protein, 24 aa, Mycobacterium
FLMSVGDLVIGWLLQQQAAVAIEK

SEQ ID NO: 660006 - protein, 24 aa, Mycobacterium
FLMSVGDLVIGWLLQQQAAVAVQA

SEQ ID NO: 660007 - protein, 25 aa, Mycobacterium
FLMSVGDLVIGWLLQRQAAVAVAAL

SEQ ID NO: 660008 - protein, 17 aa, Mycobacterium
FLMVCTGYYRYDGGYLP

SEQ ID NO: 660009 - protein, 17 aa, Mycobacterium
FLMWLLADLFAVLPEVG

SEQ ID NO: 660010 - protein, 17 aa, Mycobacterium
FLMWVLADLFTFLPEVG

SEQ ID NO: 660011 - protein, 17 aa, Mycobacterium
FLMWVLADLFTYLPEVG

SEQ ID NO: 660012 - protein, 18 aa, Mycobacterium
FLNCLGGYTYSRHSYSLG

SEQ ID NO: 660013 - protein, 26 aa, Mycobacterium
FLNGEVTLPLLLPLGLGLVVLDIPFD

SEQ ID NO: 660014 - protein, 19 aa, Mycobacterium
FLNGNLFGRDGFILSNLIP

SEQ ID NO: 660015 - protein, 17 aa, Mycobacterium
FLNGVFPLDRNRLTREW

SEQ ID NO: 660016 - protein, 28 aa, Mycobacterium
FLNLMLRAPFRLTREVLPHMPAGSGIVN

SEQ ID NO: 660017 - protein, 26 aa, Mycobacterium
FLNLMPRWYIGSVLRHVDFLTSDVPG

SEQ ID NO: 660018 - protein, 17 aa, Mycobacterium
FLNNLLLKHRSAKRRGA

SEQ ID NO: 660019 - protein, 19 aa, Mycobacterium
FLNRAQFADGTFRNRMSAD

SEQ ID NO: 660020 - protein, 18 aa, Mycobacterium
FLNRDFSVYAVDLLGKRE

SEQ ID NO: 660021 - protein, 17 aa, Mycobacterium
FLNTRCLSIAGGTEQIL

SEQ ID NO: 660022 - protein, 18 aa, Mycobacterium
FLPAVARMRALDPVTSEL

SEQ ID NO: 660023 - protein, 25 aa, Mycobacterium
FLPDLGLRRENIVFISGIGCSSRFP

SEQ ID NO: 660024 - protein, 20 aa, Mycobacterium
FLPERLRSLIAGRVGVDEGQ

SEQ ID NO: 660025 - protein, 22 aa, Mycobacterium
FLPFKPTPFRSFAMGHRPILDA

SEQ ID NO: 660026 - protein, 22 aa, Mycobacterium
FLPGARRKFGIDLEDIRAVNPS

SEQ ID NO: 660027 - protein, 17 aa, Mycobacterium
FLPGHREKFGIDVDDIR

SEQ ID NO: 660028 - protein, 17 aa, Mycobacterium
FLPGHRQKFGIDVDDIR

SEQ ID NO: 660029 - protein, 28 aa, Mycobacterium
FLPGYSFPRLPLSAFIPAERRTRNGEGD

SEQ ID NO: 660030 - protein, 26 aa, Mycobacterium
FLPLLRRAAGRIVVIASIGDRFTPPF

SEQ ID NO: 660031 - protein, 18 aa, Mycobacterium
FLPLRYGQVTLKEKMPRR

SEQ ID NO: 660032 - protein, 21 aa, Mycobacterium
FLPNFLWDFINEVITVHPLGG

SEQ ID NO: 660033 - protein, 26 aa, Mycobacterium
FLPPTAAVDIWWCQGFSEPEAGSDLA

SEQ ID NO: 660034 - protein, 27 aa, Mycobacterium
FLPRGIPGRAYWFFARTAHHAGMRALA

SEQ ID NO: 660035 - protein, 29 aa, Mycobacterium
FLPSCGHCSYCARGMGNLCDMGAAIMMGP

SEQ ID NO: 660036 - protein, 27 aa, Mycobacterium
FLPSCGHCSYCARGMGNMCDLGAALMM

SEQ ID NO: 660037 - protein, 18 aa, Mycobacterium
FLPSNTFDYPPIVNPGLE

SEQ ID NO: 660038 - protein, 22 aa, Mycobacterium
FLPSRLTVDLFRAARGVETTTK

SEQ ID NO: 660039 - protein, 22 aa, Mycobacterium
FLPSVPNLLLLASEMEAQRNHV

SEQ ID NO: 660040 - protein, 26 aa, Mycobacterium
FLPVEELIAAFLPVLFPGMEIVEHHA

SEQ ID NO: 660041 - protein, 23 aa, Mycobacterium
FLPVFAEGALFYVGDPHMAMGDG

SEQ ID NO: 660042 - protein, 17 aa, Mycobacterium
FLQAGLVERAMVVSGEY

SEQ ID NO: 660043 - protein, 21 aa, Mycobacterium
FLQDLERSWQLVLPGIANPDR

SEQ ID NO: 660044 - protein, 22 aa, Mycobacterium
FLQDRIEHVYRFRSELAKDAGV

SEQ ID NO: 660045 - protein, 25 aa, Mycobacterium
FLQFFRAGAEWDVLAAIPASLLPYA

SEQ ID NO: 660046 - protein, 19 aa, Mycobacterium
FLQGAFDFVGAGYDKPVPL

SEQ ID NO: 660047 - protein, 17 aa, Mycobacterium
FLQPGALLDSLETRLAD

SEQ ID NO: 660048 - protein, 18 aa, Mycobacterium
FLQPGALLESLETRLAGL

SEQ ID NO: 660049 - protein, 23 aa, Mycobacterium
FLQPGHPYRMWPARLRRPEPAPR

SEQ ID NO: 660050 - protein, 28 aa, Mycobacterium
FLQPRVEPEIALVIKRDLAGPGVTVAEA

SEQ ID NO: 660051 - protein, 19 aa, Mycobacterium
FLQQWVYRPPHDEVIAQLR

SEQ ID NO: 660052 - protein, 20 aa, Mycobacterium
FLQRHVEAGQRIVAEVRAAA

SEQ ID NO: 660053 - protein, 19 aa, Mycobacterium
FLQRPARWLQMLATSSHAF

SEQ ID NO: 660054 - protein, 20 aa, Mycobacterium
FLQRPARWMQLLASNCQVFS

SEQ ID NO: 660055 - protein, 24 aa, Mycobacterium
FLQRTKDRFPWADLVADPVPLDRI

SEQ ID NO: 660056 - protein, 18 aa, Mycobacterium
FLQYPWQVIPDELVKPLE

SEQ ID NO: 660057 - protein, 18 aa, Mycobacterium
FLQYPWQVLPEELVKPIE

SEQ ID NO: 660058 - protein, 20 aa, Mycobacterium
FLRAADLARAITFVAETPRG

SEQ ID NO: 660059 - protein, 21 aa, Mycobacterium
FLRAADLARAITFVAETPRGG

SEQ ID NO: 660060 - protein, 19 aa, Mycobacterium
FLRAGGIEVVTMGSHGIIT

SEQ ID NO: 660061 - protein, 24 aa, Mycobacterium
FLRDAWKPGDRIFLFGAGTGGHLA

SEQ ID NO: 660062 - protein, 17 aa, Mycobacterium
FLRDLPLHTDVNETTKT

SEQ ID NO: 660063 - protein, 17 aa, Mycobacterium
FLRDMFGDVRMLCHDTG

SEQ ID NO: 660064 - protein, 19 aa, Mycobacterium
FLRDPRSGLRVEVVSVKGR

SEQ ID NO: 660065 - protein, 25 aa, Mycobacterium
FLRDRCREVPFLPGATYHFVATSAA

SEQ ID NO: 660066 - protein, 19 aa, Mycobacterium
FLREGFPVNVLNPVKAVPE

SEQ ID NO: 660067 - protein, 17 aa, Mycobacterium
FLREGRAVHDFRHPDRL

SEQ ID NO: 660068 - protein, 22 aa, Mycobacterium
FLRENLCAVGIELSDDHLRRLE

SEQ ID NO: 660069 - protein, 24 aa, Mycobacterium
FLREYPYREAYLLRDAKLFRAELK

SEQ ID NO: 660070 - protein, 23 aa, Mycobacterium
FLREYPYREAYLLREAKQFRAEL

SEQ ID NO: 660071 - protein, 30 aa, Mycobacterium
FLREYPYREAYLLRHAKLFRAELTMPLILL

SEQ ID NO: 660072 - protein, 21 aa, Mycobacterium
FLRFGEMLEPVFAAAKNPRTG

SEQ ID NO: 660073 - protein, 17 aa, Mycobacterium
FLRHFDSKLGRGPAISA

SEQ ID NO: 660074 - protein, 19 aa, Mycobacterium
FLRLGRDGYTQVMHALADT

SEQ ID NO: 660075 - protein, 18 aa, Mycobacterium
FLRMSREITCAQANLVPA

SEQ ID NO: 660076 - protein, 19 aa, Mycobacterium
FLRNWRDALQLPKEKHPDT

SEQ ID NO: 660077 - protein, 17 aa, Mycobacterium
FLRRHAVLPDERITAVQ

SEQ ID NO: 660078 - protein, 17 aa, Mycobacterium
FLRRLLGSSPGSPGSSS

SEQ ID NO: 660079 - protein, 19 aa, Mycobacterium
FLRSLRRKKRNPDEGEPND

SEQ ID NO: 660080 - protein, 19 aa, Mycobacterium
FLRVFGFRGGTARAVQEAM

SEQ ID NO: 660081 - protein, 21 aa, Mycobacterium
FLRWGQGAFDDFKVVPPGTGI

SEQ ID NO: 660082 - protein, 26 aa, Mycobacterium
FLSAANWAGFGLHPRGNFEAFTQAAS

SEQ ID NO: 660083 - protein, 25 aa, Mycobacterium
FLSADGKTARFAIESSYNPYSSEAM

SEQ ID NO: 660084 - protein, 26 aa, Mycobacterium
FLSCQVRLLIVDDVHFLQPRSRNGVE

SEQ ID NO: 660085 - protein, 18 aa, Mycobacterium
FLSDDCLYVDMPVPALSA

SEQ ID NO: 660086 - protein, 23 aa, Mycobacterium
FLSDRMDFDRSYHHVLFNQDFTS

SEQ ID NO: 660087 - protein, 25 aa, Mycobacterium
FLSDRSATLPGVWQGLYESLLTERL

SEQ ID NO: 660088 - protein, 17 aa, Mycobacterium
FLSEGFAHLTLDEIAAR

SEQ ID NO: 660089 - protein, 19 aa, Mycobacterium
FLSFSGPDVREGLAAHREK

SEQ ID NO: 660090 - protein, 18 aa, Mycobacterium
FLSGQLWESAGSPEVDPD

SEQ ID NO: 660091 - protein, 18 aa, Mycobacterium
FLSGRPGRAAALREFIAE

SEQ ID NO: 660092 - protein, 18 aa, Mycobacterium
FLSGWQIVALQPYGGAWL

SEQ ID NO: 660093 - protein, 20 aa, Mycobacterium
FLSLHLARLMAAAGHDVLIT

SEQ ID NO: 660094 - protein, 18 aa, Mycobacterium
FLSLLKDRADALVVGDPT

SEQ ID NO: 660095 - protein, 26 aa, Mycobacterium
FLSPDARKLFADWDVQARSVVENLRL

SEQ ID NO: 660096 - protein, 19 aa, Mycobacterium
FLSPDCLYVDMPVPALSAR

SEQ ID NO: 660097 - protein, 21 aa, Mycobacterium
FLSRFVEKMAALRVGDPTDPA

SEQ ID NO: 660098 - protein, 23 aa, Mycobacterium
FLSTYASAAWLWTGRTGIIAGEA

SEQ ID NO: 660099 - protein, 24 aa, Mycobacterium
FLTAGPKEARAWVIHQGDTAPKAA

SEQ ID NO: 660100 - protein, 18 aa, Mycobacterium
FLTAGPKESRAWVIHQGD

SEQ ID NO: 660101 - protein, 23 aa, Mycobacterium
FLTARPGICLTTSGPGFLNGLPA

SEQ ID NO: 660102 - protein, 21 aa, Mycobacterium
FLTDFPALRLIGLDRDPNALA

SEQ ID NO: 660103 - protein, 17 aa, Mycobacterium
FLTDIGYLLPEPEDFTI

SEQ ID NO: 660104 - protein, 18 aa, Mycobacterium
FLTEPWWCRMVVLSAERI

SEQ ID NO: 660105 - protein, 17 aa, Mycobacterium
FLTEVARVLRPNGHFLY

SEQ ID NO: 660106 - protein, 25 aa, Mycobacterium
FLTGFRRAGARRKTLVTTFLDAVGR

SEQ ID NO: 660107 - protein, 17 aa, Mycobacterium
FLTGGSMIETVTMEAST

SEQ ID NO: 660108 - protein, 25 aa, Mycobacterium
FLTGPWPVGFVRLRRLRGISLHGTD

SEQ ID NO: 660109 - protein, 26 aa, Mycobacterium
FLTIARLLAPVAVPLVYRASIAARGV

SEQ ID NO: 660110 - protein, 26 aa, Mycobacterium
FLTKRDARSWLSLRQAEIVARAWMPP

SEQ ID NO: 660111 - protein, 17 aa, Mycobacterium
FLTLKVAASEFAYHATD

SEQ ID NO: 660112 - protein, 31 aa, Mycobacterium
FLTPDGRPFFCGTYYPKANFLQLLTAVAETW

SEQ ID NO: 660113 - protein, 28 aa, Mycobacterium
FLTPDGRPFFCGTYYPKVSFLQLLAAVS

SEQ ID NO: 660114 - protein, 17 aa, Mycobacterium
FLTPQLPAPLIRVYGTT

SEQ ID NO: 660115 - protein, 17 aa, Mycobacterium
FLTPRIASLWVGTVTPI

SEQ ID NO: 660116 - protein, 17 aa, Mycobacterium
FLTQCWQEVSSTLRSQA

SEQ ID NO: 660117 - protein, 22 aa, Mycobacterium
FLTRRWPDLLTWTSQASSSSGG

SEQ ID NO: 660118 - protein, 25 aa, Mycobacterium
FLTSDGRPFFCGTYYPKDAFLQLLS

SEQ ID NO: 660119 - protein, 18 aa, Mycobacterium
FLTSLSLPQMVVGSPETI

SEQ ID NO: 660120 - protein, 19 aa, Mycobacterium
FLTTPGLQTPVFVRFSTVA

SEQ ID NO: 660121 - protein, 25 aa, Mycobacterium
FLTTPGLRTPVFVRFSTVAGSRGSA

SEQ ID NO: 660122 - protein, 17 aa, Mycobacterium
FLTTRLDGQWGGAYGTM

SEQ ID NO: 660123 - protein, 23 aa, Mycobacterium
FLTVARKFWDSWAPGAVLADVEN

SEQ ID NO: 660124 - protein, 18 aa, Mycobacterium
FLTVHFSNPAPFIPGVEL

SEQ ID NO: 660125 - protein, 17 aa, Mycobacterium
FLVANALFWLEEFHIDG

SEQ ID NO: 660126 - protein, 19 aa, Mycobacterium
FLVAVARSCAGQACSVVVR

SEQ ID NO: 660127 - protein, 24 aa, Mycobacterium
FLVEDCAPRVLVTEAVLAPVATGV

SEQ ID NO: 660128 - protein, 18 aa, Mycobacterium
FLVHAAMALVVDLGRMVD

SEQ ID NO: 660129 - protein, 27 aa, Mycobacterium
FLVHAWDYAVATGQEFEPMDALTDGVL

SEQ ID NO: 660130 - protein, 18 aa, Mycobacterium
FLVMPYCGLGCIQDRIHR

SEQ ID NO: 660131 - protein, 19 aa, Mycobacterium
FLVPFELDPTVLLSSDGSN

SEQ ID NO: 660132 - protein, 17 aa, Mycobacterium
FLVQLAVTTTVGNAIAE

SEQ ID NO: 660133 - protein, 20 aa, Mycobacterium
FLVRDELCRIFRLDRDVVRV

SEQ ID NO: 660134 - protein, 23 aa, Mycobacterium
FLVRHLAAKRIRAIEQFAAQTAS

SEQ ID NO: 660135 - protein, 21 aa, Mycobacterium
FLVVDECHYYRGVFGSNVAMV

SEQ ID NO: 660136 - protein, 22 aa, Mycobacterium
FLVVVPDRWEPLANNLFHGIRS

SEQ ID NO: 660137 - protein, 20 aa, Mycobacterium
FLWQHCTAMVPGFAGNTTVA

SEQ ID NO: 660138 - protein, 17 aa, Mycobacterium
FLWYRGRQLGGRLHTWS

SEQ ID NO: 660139 - protein, 20 aa, Mycobacterium
FLYFSPREYIVIFGSPTGTQ

SEQ ID NO: 660140 - protein, 17 aa, Mycobacterium
FLYHQMNPWDVPIGGMG

SEQ ID NO: 660141 - protein, 18 aa, Mycobacterium
FLYHRARDGGSAWFTVDD

SEQ ID NO: 660142 - protein, 18 aa, Mycobacterium
FLYLDRLVGRHARSAKRA

SEQ ID NO: 660143 - protein, 19 aa, Mycobacterium
FLYLDRLVGRYARAAKKAV

SEQ ID NO: 660144 - protein, 25 aa, Mycobacterium
FLYRRGPYADAPRPDLILLDLNLPK

SEQ ID NO: 660145 - protein, 34 aa, Mycobacterium
FLYTHFEELCEILARYDVTFSLGDGLRPGSIADA

SEQ ID NO: 660146 - protein, 19 aa, Mycobacterium
FMAAQPGFVSFRIHRAVVP

SEQ ID NO: 660147 - protein, 28 aa, Mycobacterium
FMADIALPLPIAIIGEWLGLDDSSAAVL

SEQ ID NO: 660148 - protein, 18 aa, Mycobacterium
FMADLCWIENIGARGFAA

SEQ ID NO: 660149 - protein, 17 aa, Mycobacterium
FMADVKANRLPQVSWVV

SEQ ID NO: 660150 - protein, 18 aa, Mycobacterium
FMAGFAGMQGHVIDAILA

SEQ ID NO: 660151 - protein, 31 aa, Mycobacterium
FMAQLQLWARRGHPTLADIVELERLAKDPDY

SEQ ID NO: 660152 - protein, 17 aa, Mycobacterium
FMATRTAFFDEFFLGAA

SEQ ID NO: 660153 - protein, 25 aa, Mycobacterium
FMAVCAAASAWIRIGQIQAAEVAAA

SEQ ID NO: 660154 - protein, 19 aa, Mycobacterium
FMDCVRAVIGGTSMDEFAD

SEQ ID NO: 660155 - protein, 22 aa, Mycobacterium
FMEAIVRPVTWAEWPESAAGIF

SEQ ID NO: 660156 - protein, 19 aa, Mycobacterium
FMETFRAGLADLKRKGNAV

SEQ ID NO: 660157 - protein, 27 aa, Mycobacterium
FMEVAKLRAGRLLWSDLVAQFGPQNPK

SEQ ID NO: 660158 - protein, 27 aa, Mycobacterium
FMEVAKLRAGRLLWSELVAEFDPKSSK

SEQ ID NO: 660159 - protein, 27 aa, Mycobacterium
FMEVAKLRAGRLLWSELVAKFEPKNSK

SEQ ID NO: 660160 - protein, 27 aa, Mycobacterium
FMEVAKLRAGRLLWSELVAQFDPKSSK

SEQ ID NO: 660161 - protein, 27 aa, Mycobacterium
FMEVAKLRAGRLLWSELVAQFHPKNPK

SEQ ID NO: 660162 - protein, 27 aa, Mycobacterium
FMEVAKLRAGRLLWSELVSEFEPKSEK

SEQ ID NO: 660163 - protein, 27 aa, Mycobacterium
FMEVAKLRAGRLLWSELVSQFDPKSAK

SEQ ID NO: 660164 - protein, 23 aa, Mycobacterium
FMGNPILCDLILIRAALSPKAAR

SEQ ID NO: 660165 - protein, 24 aa, Mycobacterium
FMGNPILCDLILIRAALSPKAARM

SEQ ID NO: 660166 - protein, 18 aa, Mycobacterium
FMGNPILCDLILIRSALS

SEQ ID NO: 660167 - protein, 17 aa, Mycobacterium
FMGRRAVACLGTAAALY

SEQ ID NO: 660168 - protein, 23 aa, Mycobacterium
FMGSRLRAPVLIGAMTGGAALSG

SEQ ID NO: 660169 - protein, 19 aa, Mycobacterium
FMHVLPVGWVEPRDISNAV

SEQ ID NO: 660170 - protein, 18 aa, Mycobacterium
FMKYLRRGSGYYIDVGAS

SEQ ID NO: 660171 - protein, 17 aa, Mycobacterium
FMLIGAAFYRDTYRRTT

SEQ ID NO: 660172 - protein, 17 aa, Mycobacterium
FMLKDPIYGLGPRLAQL

SEQ ID NO: 660173 - protein, 17 aa, Mycobacterium
FMLKEIVRYPSVADEVE

SEQ ID NO: 660174 - protein, 17 aa, Mycobacterium
FMMLYAFGVGEAAISIS

SEQ ID NO: 660175 - protein, 19 aa, Mycobacterium
FMMRNARCVLSKAQILDRV

SEQ ID NO: 660176 - protein, 17 aa, Mycobacterium
FMMRVRCDGGALSAAAL

SEQ ID NO: 660177 - protein, 25 aa, Mycobacterium
FMPACGHCRWCASGNSVLCDYGAVI

SEQ ID NO: 660178 - protein, 17 aa, Mycobacterium
FMPAYLHDAQDLPVPGV

SEQ ID NO: 660179 - protein, 22 aa, Mycobacterium
FMPVVWALFEWGRRHIPNDSPL

SEQ ID NO: 660180 - protein, 23 aa, Mycobacterium
FMRDVLLWGRLIDKYKGTMTAAP

SEQ ID NO: 660181 - protein, 21 aa, Mycobacterium
FMRDVPCPECDGTRLKPEILA

SEQ ID NO: 660182 - protein, 18 aa, Mycobacterium
FMRPFRADEWLLYDQSSP

SEQ ID NO: 660183 - protein, 24 aa, Mycobacterium
FMSAQRLAVVGARDDAGRVWAGPL

SEQ ID NO: 660184 - protein, 19 aa, Mycobacterium
FMSDLVWIENVGARGFAAL

SEQ ID NO: 660185 - protein, 27 aa, Mycobacterium
FMSREMLRLVEAFGYGWSDLERFTINA

SEQ ID NO: 660186 - protein, 18 aa, Mycobacterium
FMSYLNLWHYLRGQRKSL

SEQ ID NO: 660187 - protein, 18 aa, Mycobacterium
FMSYLNLWRYLREQRTEM

SEQ ID NO: 660188 - protein, 17 aa, Mycobacterium
FMVNYLRLFATDPAERV

SEQ ID NO: 660189 - protein, 25 aa, Mycobacterium
FMVPPQWFAMWARRHQHEYGSTSED

SEQ ID NO: 660190 - protein, 20 aa, Mycobacterium
FMWRLADRQLDEFLGAGECE

SEQ ID NO: 660191 - protein, 17 aa, Mycobacterium
FNAARSCLEQGVRVGCF

SEQ ID NO: 660192 - protein, 17 aa, Mycobacterium
FNADKPFMMYWASGCLH

SEQ ID NO: 660193 - protein, 19 aa, Mycobacterium
FNAEKGFGFIAPEDGSADV

SEQ ID NO: 660194 - protein, 30 aa, Mycobacterium
FNAFPASYWRRWSICASVVLRVELTGTGRV

SEQ ID NO: 660195 - protein, 29 aa, Mycobacterium
FNAFPASYWRRWSICKSVVLRVELSGAGR

SEQ ID NO: 660196 - protein, 30 aa, Mycobacterium
FNAFPASYWRRWSICSSVVLRVELTGTGRV

SEQ ID NO: 660197 - protein, 29 aa, Mycobacterium
FNAFPASYWRRWSICTSVVLRVELIGAGR

SEQ ID NO: 660198 - protein, 24 aa, Mycobacterium
FNAFPASYWRRWSTLDTVVLRVEL

SEQ ID NO: 660199 - protein, 24 aa, Mycobacterium
FNAFPASYWRRWSTLESVVLRVEL

SEQ ID NO: 660200 - protein, 18 aa, Mycobacterium
FNAGCPVVAAAIGSDDDD

SEQ ID NO: 660201 - protein, 20 aa, Mycobacterium
FNAHYEPIDFMLPAAEFGGA

SEQ ID NO: 660202 - protein, 19 aa, Mycobacterium
FNAIRCVDAPAPTDAASWV

SEQ ID NO: 660203 - protein, 17 aa, Mycobacterium
FNAIRCVDAPNPTDQAS

SEQ ID NO: 660204 - protein, 19 aa, Mycobacterium
FNALDEWGRFDEAFTALRR

SEQ ID NO: 660205 - protein, 22 aa, Mycobacterium
FNALLQWGPMIFALGYTAAEGG

SEQ ID NO: 660206 - protein, 24 aa, Mycobacterium
FNALPIRRLGVLPGSGESVTVPVV

SEQ ID NO: 660207 - protein, 17 aa, Mycobacterium
FNATRFALMNGAALGEL

SEQ ID NO: 660208 - protein, 17 aa, Mycobacterium
FNATRFALMNGAAPAPL

SEQ ID NO: 660209 - protein, 24 aa, Mycobacterium
FNAVSWLEALGFCGVGEAADFLDG

SEQ ID NO: 660210 - protein, 24 aa, Mycobacterium
FNCLAPGMWPAWWLSNDDPGRSGE

SEQ ID NO: 660211 - protein, 17 aa, Mycobacterium
FNCLTSYSDASKMRDDL

SEQ ID NO: 660212 - protein, 18 aa, Mycobacterium
FNDEWVLAHAEFHQALLD

SEQ ID NO: 660213 - protein, 17 aa, Mycobacterium
FNDGWMSSYGFLRTRLD

SEQ ID NO: 660214 - protein, 20 aa, Mycobacterium
FNDPQWKGITDWRAELSPHY

SEQ ID NO: 660215 - protein, 24 aa, Mycobacterium
FNDRGACLAGAVLDEGLRRQVVQL

SEQ ID NO: 660216 - protein, 18 aa, Mycobacterium
FNDTIFKRTTGLAYFSNG

SEQ ID NO: 660217 - protein, 25 aa, Mycobacterium
FNDVDLRWVILAARIGILRQPLNIK

SEQ ID NO: 660218 - protein, 17 aa, Mycobacterium
FNDYEIVAANLLDGDPR

SEQ ID NO: 660219 - protein, 26 aa, Mycobacterium
FNEALELARGFGLRYELAHLSNSAAT

SEQ ID NO: 660220 - protein, 23 aa, Mycobacterium
FNEALPALNSFILPGGTPLSALL

SEQ ID NO: 660221 - protein, 22 aa, Mycobacterium
FNEDFAGLIVSGDEAWTTINDY

SEQ ID NO: 660222 - protein, 22 aa, Mycobacterium
FNEDFAGLIVSGDEAWTTITDY

SEQ ID NO: 660223 - protein, 21 aa, Mycobacterium
FNEMTFLNGIVLDADHQLQLI

SEQ ID NO: 660224 - protein, 30 aa, Mycobacterium
FNEPFPGFVWEGCLNPVLGCPIQDHKLTNF

SEQ ID NO: 660225 - protein, 25 aa, Mycobacterium
FNEPICPPCGSFIRSNAGDIDTAVN

SEQ ID NO: 660226 - protein, 25 aa, Mycobacterium
FNEPICPPCGTFIRSNGADIDAAVN

SEQ ID NO: 660227 - protein, 21 aa, Mycobacterium
FNEPLPALNSFILPGGTTLSA

SEQ ID NO: 660228 - protein, 23 aa, Mycobacterium
FNEVRARRGLPGPAVVFECVGAP

SEQ ID NO: 660229 - protein, 18 aa, Mycobacterium
FNGAPRLARHVQNSQTVL

SEQ ID NO: 660230 - protein, 20 aa, Mycobacterium
FNGDKGFGFIAPDNASEDVF

SEQ ID NO: 660231 - protein, 29 aa, Mycobacterium
FNGDRALCIKAMIEKVVDRMYAEIDDNRF

SEQ ID NO: 660232 - protein, 20 aa, Mycobacterium
FNGEKGFGFIAPDDGSKDVF

SEQ ID NO: 660233 - protein, 19 aa, Mycobacterium
FNGEKGFGFIAPDGGAPDV

SEQ ID NO: 660234 - protein, 19 aa, Mycobacterium
FNGEKGFGFITPDDGTKDL

SEQ ID NO: 660235 - protein, 17 aa, Mycobacterium
FNGGFANMMNIGMGNWA

SEQ ID NO: 660236 - protein, 17 aa, Mycobacterium
FNGGMAGAGGNGGSALL

SEQ ID NO: 660237 - protein, 20 aa, Mycobacterium
FNGGVLNTGFFSATTHAGPN

SEQ ID NO: 660238 - protein, 22 aa, Mycobacterium
FNGKGRAAIAIGNPDRAQNTSV

SEQ ID NO: 660239 - protein, 17 aa, Mycobacterium
FNGKNMRAYEDITEQEV

SEQ ID NO: 660240 - protein, 26 aa, Mycobacterium
FNGKPEFVENFFLFIAEEVRELMAEL

SEQ ID NO: 660241 - protein, 22 aa, Mycobacterium
FNGRGGRVLPMLHPGGRVNMAK

SEQ ID NO: 660242 - protein, 18 aa, Mycobacterium
FNGRHYALPYARSTPLFY

SEQ ID NO: 660243 - protein, 18 aa, Mycobacterium
FNGSLMVMPGSHRTFYPC

SEQ ID NO: 660244 - protein, 34 aa, Mycobacterium
FNHASGRIKLAWFLLHVARYLPALIYSTDPGWGQ

SEQ ID NO: 660245 - protein, 18 aa, Mycobacterium
FNHPMLILARSLSAALAN

SEQ ID NO: 660246 - protein, 18 aa, Mycobacterium
FNHPSVRGLATMLSDGEG

SEQ ID NO: 660247 - protein, 23 aa, Mycobacterium
FNHSRRVFFFGALQGLRRGIHPN

SEQ ID NO: 660248 - protein, 17 aa, Mycobacterium
FNIDAPAAFVLLTQLSA

SEQ ID NO: 660249 - protein, 29 aa, Mycobacterium
FNIFCGSCYFCARGLYSNCHNVNPNATAV

SEQ ID NO: 660250 - protein, 21 aa, Mycobacterium
FNKAFAPYGLRPTAFKPSYGI

SEQ ID NO: 660251 - protein, 20 aa, Mycobacterium
FNKDVVIDMICYRRRGHNEG

SEQ ID NO: 660252 - protein, 22 aa, Mycobacterium
FNKGGPYLARGAQDLVPSAQLL

SEQ ID NO: 660253 - protein, 20 aa, Mycobacterium
FNLCSGSIGMCEHAFYEAIT

SEQ ID NO: 660254 - protein, 17 aa, Mycobacterium
FNLDEMPNPVASIYKTR

SEQ ID NO: 660255 - protein, 17 aa, Mycobacterium
FNLFPHLSVLKNVAMAP

SEQ ID NO: 660256 - protein, 29 aa, Mycobacterium
FNLKNLYVYFWRWGTWKVFDANADQPNGD

SEQ ID NO: 660257 - protein, 17 aa, Mycobacterium
FNLNAADLFYRGERNVI

SEQ ID NO: 660258 - protein, 17 aa, Mycobacterium
FNLQWKPLGGFPVTAGW

SEQ ID NO: 660259 - protein, 18 aa, Mycobacterium
FNLSALRFAMGGGSPVPL

SEQ ID NO: 660260 - protein, 19 aa, Mycobacterium
FNLSALRFAMGGGSPVPLT

SEQ ID NO: 660261 - protein, 22 aa, Mycobacterium
FNLSDMFTRMVLSLVATGIAPR

SEQ ID NO: 660262 - protein, 25 aa, Mycobacterium
FNMGSGNRGSRNFGAGNRGNGNFGF

SEQ ID NO: 660263 - protein, 18 aa, Mycobacterium
FNMPEEFGGGGTDDFRFN

SEQ ID NO: 660264 - protein, 18 aa, Mycobacterium
FNMRERLREAGHEVIGYD

SEQ ID NO: 660265 - protein, 24 aa, Mycobacterium
FNNELGHPWTVLRATRGTDYLILE

SEQ ID NO: 660266 - protein, 25 aa, Mycobacterium
FNPEARLFIDGRLRDSSTGKTVDNI

SEQ ID NO: 660267 - protein, 17 aa, Mycobacterium
FNPEIVCVAMTGFGLDG

SEQ ID NO: 660268 - protein, 22 aa, Mycobacterium
FNPELVCEITLQPIRRHRVDAA

SEQ ID NO: 660269 - protein, 18 aa, Mycobacterium
FNPFDFSSGNNFGDANQG

SEQ ID NO: 660270 - protein, 19 aa, Mycobacterium
FNPNPGLPVSRNVYTFTEH

SEQ ID NO: 660271 - protein, 18 aa, Mycobacterium
FNPPLDRWADAAREIHSL

SEQ ID NO: 660272 - protein, 25 aa, Mycobacterium
FNPTGKFVVGGPMGDAGLTGRKIIV

SEQ ID NO: 660273 - protein, 17 aa, Mycobacterium
FNQPNFIGFVFARTEVD

SEQ ID NO: 660274 - protein, 17 aa, Mycobacterium
FNRACEALYHFAWDEFC

SEQ ID NO: 660275 - protein, 31 aa, Mycobacterium
FNRACEALYHFAWDEFCDWYVELAKVQLGQE

SEQ ID NO: 660276 - protein, 23 aa, Mycobacterium
FNRAMCREMRDAWHLVKSDESIN

SEQ ID NO: 660277 - protein, 29 aa, Mycobacterium
FNRDAVFGIQLYVKRVFIMGDCDQLMPEY

SEQ ID NO: 660278 - protein, 26 aa, Mycobacterium
FNRDLFRQFAEWDIRIVPDELMDRNP

SEQ ID NO: 660279 - protein, 25 aa, Mycobacterium
FNRELCARFGVPPIDFDGRTDALLH

SEQ ID NO: 660280 - protein, 19 aa, Mycobacterium
FNRIFPTAIKATAGNSLSL

SEQ ID NO: 660281 - protein, 28 aa, Mycobacterium
FNRLAIPSWMARTGFQMMDPLKTAKARL

SEQ ID NO: 660282 - protein, 22 aa, Mycobacterium
FNRLRVRYVIVSAVSGAMGGSA

SEQ ID NO: 660283 - protein, 23 aa, Mycobacterium
FNSARMYAGPGPLSLVAAAVAWD

SEQ ID NO: 660284 - protein, 35 aa, Mycobacterium
FNSCGACPTCATGEPAYCHDFLAYNFGGVRPDGSS

SEQ ID NO: 660285 - protein, 20 aa, Mycobacterium
FNSDKGFGFIAPDGGEKDVF

SEQ ID NO: 660286 - protein, 19 aa, Mycobacterium
FNSGSGWSNSGLFNSGDGG

SEQ ID NO: 660287 - protein, 19 aa, Mycobacterium
FNSLFFRNAVNAGLPAMTV

SEQ ID NO: 660288 - protein, 17 aa, Mycobacterium
FNSLFLDPYLWKLQIGG

SEQ ID NO: 660289 - protein, 22 aa, Mycobacterium
FNSRFPDTFVVPDLLIPKATAK

SEQ ID NO: 660290 - protein, 18 aa, Mycobacterium
FNSSIFSEQVWFLGDALG

SEQ ID NO: 660291 - protein, 17 aa, Mycobacterium
FNSVLALELHNDKPMSP

SEQ ID NO: 660292 - protein, 18 aa, Mycobacterium
FNTAALFSAFSMVTHAGQ

SEQ ID NO: 660293 - protein, 24 aa, Mycobacterium
FNTGEKTEMYWAIRAYEIAMEEGI

SEQ ID NO: 660294 - protein, 27 aa, Mycobacterium
FNTGYSEAIGPFALGQVSGFNSGFFNW

SEQ ID NO: 660295 - protein, 23 aa, Mycobacterium
FNTLEQWGRFDEAFAHLRQWEAE

SEQ ID NO: 660296 - protein, 24 aa, Mycobacterium
FNVDWKGRVPGRYRLTVLEKLSRI

SEQ ID NO: 660297 - protein, 17 aa, Mycobacterium
FNVEGLATVIPFHRAVT

SEQ ID NO: 660298 - protein, 18 aa, Mycobacterium
FNVTGWKIGWACGPSDLI

SEQ ID NO: 660299 - protein, 24 aa, Mycobacterium
FNWMPLEHVGGIVMSHLQDVYVHC

SEQ ID NO: 660300 - protein, 19 aa, Mycobacterium
FNWPALPVAMADTIVPDFP

SEQ ID NO: 660301 - protein, 19 aa, Mycobacterium
FNYAVVVEFCERLTQLLPD

SEQ ID NO: 660302 - protein, 20 aa, Mycobacterium
FNYPAPAHWYFPTQADGSVN

SEQ ID NO: 660303 - protein, 19 aa, Mycobacterium
FNYQDRIFPVPAISLNDPA

SEQ ID NO: 660304 - protein, 25 aa, Mycobacterium
FPAAEAIAALKPIFFGAVALGGSTG

SEQ ID NO: 660305 - protein, 17 aa, Mycobacterium
FPAAEEVVVDWPHRYLA

SEQ ID NO: 660306 - protein, 23 aa, Mycobacterium
FPAAELTRILGMPVDDPDGDYLV

SEQ ID NO: 660307 - protein, 19 aa, Mycobacterium
FPADELLVAGTRYWNGFDF

SEQ ID NO: 660308 - protein, 20 aa, Mycobacterium
FPADERRPGQTVAELIAERT

SEQ ID NO: 660309 - protein, 25 aa, Mycobacterium
FPADYAGKWVIFFSHPADFTPVCTS

SEQ ID NO: 660310 - protein, 17 aa, Mycobacterium
FPAEWRLSKKARKKAKA

SEQ ID NO: 660311 - protein, 24 aa, Mycobacterium
FPAGSELRRALAMVKTLDELDSLL

SEQ ID NO: 660312 - protein, 23 aa, Mycobacterium
FPAHTSLLDGLRADFVRLLAPAR

SEQ ID NO: 660313 - protein, 24 aa, Mycobacterium
FPAIIDMWLPLSWSLNMVNRSMGH

SEQ ID NO: 660314 - protein, 21 aa, Mycobacterium
FPAKQGCLIATLREFMADEDI

SEQ ID NO: 660315 - protein, 18 aa, Mycobacterium
FPALHKRTRLAFLELAAE

SEQ ID NO: 660316 - protein, 17 aa, Mycobacterium
FPALMSLVTGFDFPFAA

SEQ ID NO: 660317 - protein, 18 aa, Mycobacterium
FPALPLTLGEAIEAFRAD

SEQ ID NO: 660318 - protein, 17 aa, Mycobacterium
FPANPLNLLAFANALAG

SEQ ID NO: 660319 - protein, 21 aa, Mycobacterium
FPAPDLRTTFGVIELDTSDSA

SEQ ID NO: 660320 - protein, 17 aa, Mycobacterium
FPAPQLSTSDGRGPVLV

SEQ ID NO: 660321 - protein, 33 aa, Mycobacterium
FPAPVSLVAGGIWLWGDVAGWARSRNYEVEDVS

SEQ ID NO: 660322 - protein, 22 aa, Mycobacterium
FPAQRAAPMVTVLDGHPHTLAF

SEQ ID NO: 660323 - protein, 28 aa, Mycobacterium
FPARELPKARVADGVGIPISMPAYARAF

SEQ ID NO: 660324 - protein, 20 aa, Mycobacterium
FPARLFRLGPEDEPVAAFQD

SEQ ID NO: 660325 - protein, 22 aa, Mycobacterium
FPARLQRGAGVPAVERLAYFAE

SEQ ID NO: 660326 - protein, 23 aa, Mycobacterium
FPARTCSNGVFKRHKQIDRPCLL

SEQ ID NO: 660327 - protein, 22 aa, Mycobacterium
FPARTCSNGVFKRHSQIDRPCL

SEQ ID NO: 660328 - protein, 21 aa, Mycobacterium
FPARTCSTGVFKRHKQIERPC

SEQ ID NO: 660329 - protein, 17 aa, Mycobacterium
FPARVVAVGTDRPCAAL

SEQ ID NO: 660330 - protein, 19 aa, Mycobacterium
FPASDPVSLSFADDGAPDM

SEQ ID NO: 660331 - protein, 22 aa, Mycobacterium
FPASRRRGWRRPRQLRSPIYDA

SEQ ID NO: 660332 - protein, 17 aa, Mycobacterium
FPASVLATVGLDRPATQ

SEQ ID NO: 660333 - protein, 17 aa, Mycobacterium
FPATHYVAGPERMGKAL

SEQ ID NO: 660334 - protein, 22 aa, Mycobacterium
FPATLTPIGLTLPFGEVMLTPD

SEQ ID NO: 660335 - protein, 17 aa, Mycobacterium
FPAVALAREAGKTGGCM

SEQ ID NO: 660336 - protein, 17 aa, Mycobacterium
FPAVFTLLRGPRSIKPL

SEQ ID NO: 660337 - protein, 17 aa, Mycobacterium
FPAVTRPPVGWIAQDEG

SEQ ID NO: 660338 - protein, 33 aa, Mycobacterium
FPAYGTLDIPVYIPFTGAIGPITIQEFTIPSLP

SEQ ID NO: 660339 - protein, 24 aa, Mycobacterium
FPCGLAELCQRTGLPRATAYRLAA

SEQ ID NO: 660340 - protein, 22 aa, Mycobacterium
FPCLGRGGTDLNTWWDENRYQA

SEQ ID NO: 660341 - protein, 21 aa, Mycobacterium
FPCNPDIPAWSIAGTTGSLTF

SEQ ID NO: 660342 - protein, 26 aa, Mycobacterium
FPCVVFAHGFSGTMDWILPDFAAVFC

SEQ ID NO: 660343 - protein, 18 aa, Mycobacterium
FPDAKLGIGPPITDGFYY

SEQ ID NO: 660344 - protein, 19 aa, Mycobacterium
FPDARIVNVSATPGRADGR

SEQ ID NO: 660345 - protein, 17 aa, Mycobacterium
FPDAVIRTGLDSIVIEA

SEQ ID NO: 660346 - protein, 22 aa, Mycobacterium
FPDAYKAIWDFSGQKATSRHIP

SEQ ID NO: 660347 - protein, 22 aa, Mycobacterium
FPDAYKAIWDFSGQTATSRHVP

SEQ ID NO: 660348 - protein, 19 aa, Mycobacterium
FPDCEGLQRITREIFERGG

SEQ ID NO: 660349 - protein, 22 aa, Mycobacterium
FPDDALKEYSIRALHPDDFLLD

SEQ ID NO: 660350 - protein, 24 aa, Mycobacterium
FPDDTAHYLWAWTDRAAGALRVRM

SEQ ID NO: 660351 - protein, 24 aa, Mycobacterium
FPDDTAHYLWAWTDRNAGSLRARM

SEQ ID NO: 660352 - protein, 17 aa, Mycobacterium
FPDGGGMRTTNYNIAAV

SEQ ID NO: 660353 - protein, 19 aa, Mycobacterium
FPDGMLLVFEPVVWEDGTG

SEQ ID NO: 660354 - protein, 20 aa, Mycobacterium
FPDGMLLVFEPVVWEDGTGG

SEQ ID NO: 660355 - protein, 20 aa, Mycobacterium
FPDGRLPEVGDVVRVATNVF

SEQ ID NO: 660356 - protein, 25 aa, Mycobacterium
FPDHLRPGSVGQRLPYQQVKIARKS

SEQ ID NO: 660357 - protein, 17 aa, Mycobacterium
FPDHPWRSYLQSSALVL

SEQ ID NO: 660358 - protein, 26 aa, Mycobacterium
FPDHRAVFLTSGRRLPVAIKEHDADS

SEQ ID NO: 660359 - protein, 20 aa, Mycobacterium
FPDKERTVVRLALTGTLSVT

SEQ ID NO: 660360 - protein, 24 aa, Mycobacterium
FPDKSELLGAAIVRLNDAFWTESR

SEQ ID NO: 660361 - protein, 18 aa, Mycobacterium
FPDKSVRSAHAVFSRAVT

SEQ ID NO: 660362 - protein, 23 aa, Mycobacterium
FPDLEVCVYAAPSQTVIGGPPAQ

SEQ ID NO: 660363 - protein, 19 aa, Mycobacterium
FPDLRLTAPPQPRGLINLH

SEQ ID NO: 660364 - protein, 20 aa, Mycobacterium
FPDPWPKARHHKRRLIQPST

SEQ ID NO: 660365 - protein, 19 aa, Mycobacterium
FPDPWPKARHHKRRLLQPG

SEQ ID NO: 660366 - protein, 26 aa, Mycobacterium
FPDQMLAYNCSPSFNWKKHLDDATIA

SEQ ID NO: 660367 - protein, 26 aa, Mycobacterium
FPDQMLAYNCSPSFNWKKHLDDETIA

SEQ ID NO: 660368 - protein, 26 aa, Mycobacterium
FPDQMLAYNCSPSFNWKKHLDDSTIA

SEQ ID NO: 660369 - protein, 26 aa, Mycobacterium
FPDQMLAYNCSPSFNWKQHLDDATIA

SEQ ID NO: 660370 - protein, 27 aa, Mycobacterium
FPDQMLAYNCSPSFNWRKHLDDSTIAK

SEQ ID NO: 660371 - protein, 20 aa, Mycobacterium
FPDQRAWLLEDFDNRIGTAV

SEQ ID NO: 660372 - protein, 20 aa, Mycobacterium
FPDQRAWLMEDFDGRIKGAV

SEQ ID NO: 660373 - protein, 19 aa, Mycobacterium
FPDRARIKSRREWEQHPRI

SEQ ID NO: 660374 - protein, 17 aa, Mycobacterium
FPDRFPTVANQLFQLAS

SEQ ID NO: 660375 - protein, 17 aa, Mycobacterium
FPDRGVVVVSGANEVGK

SEQ ID NO: 660376 - protein, 36 aa, Mycobacterium
FPDSAWGWRKFAPILAEHGFRVVAPFSRGYAPTGPA

SEQ ID NO: 660377 - protein, 17 aa, Mycobacterium
FPDTRVRVVDADGGVLP

SEQ ID NO: 660378 - protein, 28 aa, Mycobacterium
FPDVKAWLAEVLPNFPAYYHMLGNVDVR

SEQ ID NO: 660379 - protein, 17 aa, Mycobacterium
FPDVLFIAGKYQIKIPP

SEQ ID NO: 660380 - protein, 20 aa, Mycobacterium
FPDVRAAGAGSRRDTRVLRG

SEQ ID NO: 660381 - protein, 21 aa, Mycobacterium
FPDVVRYTAAGMRRVRSSGQK

SEQ ID NO: 660382 - protein, 17 aa, Mycobacterium
FPDYKPELPGGRPGGGR

SEQ ID NO: 660383 - protein, 25 aa, Mycobacterium
FPDYRPELPGGQPAGGRSLGPAAFE

SEQ ID NO: 660384 - protein, 24 aa, Mycobacterium
FPDYRPELPGGQPAGGRSLSAAPF

SEQ ID NO: 660385 - protein, 22 aa, Mycobacterium
FPEAARLMALGGAQIIASLSAW

SEQ ID NO: 660386 - protein, 18 aa, Mycobacterium
FPEDLKDKAPRIWYEDGA

SEQ ID NO: 660387 - protein, 25 aa, Mycobacterium
FPEDREPRAAIAVGNPDTAEHVTVT

SEQ ID NO: 660388 - protein, 18 aa, Mycobacterium
FPEEFARTQASAFRSGTD

SEQ ID NO: 660389 - protein, 18 aa, Mycobacterium
FPEEHGGMGGDYFALSLA

SEQ ID NO: 660390 - protein, 20 aa, Mycobacterium
FPEEIGKMGFVFNFITYGGH

SEQ ID NO: 660391 - protein, 23 aa, Mycobacterium
FPEELGKMGFVFNFITYGGHQVD

SEQ ID NO: 660392 - protein, 21 aa, Mycobacterium
FPEELKGAAPRIWYEDGAYMV

SEQ ID NO: 660393 - protein, 17 aa, Mycobacterium
FPEFARSRPRFVGATLK

SEQ ID NO: 660394 - protein, 19 aa, Mycobacterium
FPELAAHLPAVPAAARTAP

SEQ ID NO: 660395 - protein, 17 aa, Mycobacterium
FPELKFSLTEGDVGWIP

SEQ ID NO: 660396 - protein, 20 aa, Mycobacterium
FPENARMSALAGAHLLAVPT

SEQ ID NO: 660397 - protein, 22 aa, Mycobacterium
FPEPTRRLLLVAAAEPTGDPLL

SEQ ID NO: 660398 - protein, 18 aa, Mycobacterium
FPEQKALLAQDFDGRIKV

SEQ ID NO: 660399 - protein, 28 aa, Mycobacterium
FPEQPGLYAARGWSMFPTIDRVYVNARA

SEQ ID NO: 660400 - protein, 19 aa, Mycobacterium
FPEQWRTTWQRTLTAAMPG

SEQ ID NO: 660401 - protein, 42 aa, Mycobacterium
FPESHALSFASLVFYSAWFKLHHPAAFCAALLRAQPMGFYSP

SEQ ID NO: 660402 - protein, 43 aa, Mycobacterium
FPESHAQSFASLVFYSSWFKLHHPAAFCAALLRAQPMGFYSPQ

SEQ ID NO: 660403 - protein, 42 aa, Mycobacterium
FPESHSLSFASLVFYSSWFKLHHPAAFCAALLRAQPMGFYSP

SEQ ID NO: 660404 - protein, 43 aa, Mycobacterium
FPESHSLSFASLVFYSSWFKLHHPAAFCAALLRAQPMGFYSPQ

SEQ ID NO: 660405 - protein, 21 aa, Mycobacterium
FPESLPIKGFLSFDDTRIDVI

SEQ ID NO: 660406 - protein, 19 aa, Mycobacterium
FPESSRLVLSVRREDVLGS

SEQ ID NO: 660407 - protein, 22 aa, Mycobacterium
FPESYNRRALMRFVTSVKSGSD

SEQ ID NO: 660408 - protein, 23 aa, Mycobacterium
FPESYNRRALMRFVTSVKSGSEY

SEQ ID NO: 660409 - protein, 18 aa, Mycobacterium
FPEYQPREAAAWLASAVE

SEQ ID NO: 660410 - protein, 20 aa, Mycobacterium
FPFALITGRTLYHFHTRTKT

SEQ ID NO: 660411 - protein, 27 aa, Mycobacterium
FPFAPAGAALLCKWTDDVGGLGPVSWL

SEQ ID NO: 660412 - protein, 27 aa, Mycobacterium
FPFEHARIRLAYGMRLRRLRRYRNARV

SEQ ID NO: 660413 - protein, 20 aa, Mycobacterium
FPFETVRTMARIVSAVEDNS

SEQ ID NO: 660414 - protein, 26 aa, Mycobacterium
FPFLAPEDWNLPTGRFAGATTPDAFR

SEQ ID NO: 660415 - protein, 21 aa, Mycobacterium
FPFLRGLCLTNYVTDPVFQKK

SEQ ID NO: 660416 - protein, 34 aa, Mycobacterium
FPFPDNSGLDWDRLGDCDYLYLSHLHKDHFDAKN

SEQ ID NO: 660417 - protein, 17 aa, Mycobacterium
FPFPDNTGLDWPALGAV

SEQ ID NO: 660418 - protein, 21 aa, Mycobacterium
FPFSAAGAALLCGWSTDDYGL

SEQ ID NO: 660419 - protein, 20 aa, Mycobacterium
FPFVGTEPEFTGYMAHVDIA

SEQ ID NO: 660420 - protein, 26 aa, Mycobacterium
FPGACAGCGETPYLKLLSQLFGDRLM

SEQ ID NO: 660421 - protein, 20 aa, Mycobacterium
FPGALWLQVRDVYETQTELE

SEQ ID NO: 660422 - protein, 17 aa, Mycobacterium
FPGCAVVISHDRWFLDR

SEQ ID NO: 660423 - protein, 18 aa, Mycobacterium
FPGCAVVISHDRWFLDRT

SEQ ID NO: 660424 - protein, 17 aa, Mycobacterium
FPGCDVSADRCDIDHVV

SEQ ID NO: 660425 - protein, 19 aa, Mycobacterium
FPGDPRLARNPVTLEITDS

SEQ ID NO: 660426 - protein, 21 aa, Mycobacterium
FPGDPWTVPKVYWTVFGLSAF

SEQ ID NO: 660427 - protein, 21 aa, Mycobacterium
FPGDWRVIRGLTQPQLAAAAG

SEQ ID NO: 660428 - protein, 25 aa, Mycobacterium
FPGEISGGMRKRAGLARALVLDPEI

SEQ ID NO: 660429 - protein, 22 aa, Mycobacterium
FPGEMFADLFPSRRGRPSVPAE

SEQ ID NO: 660430 - protein, 27 aa, Mycobacterium
FPGEPWQVPKFYWAVMADSAFEAGWRA

SEQ ID NO: 660431 - protein, 26 aa, Mycobacterium
FPGEQEILFPAGSKFYVISKTVDPRT

SEQ ID NO: 660432 - protein, 36 aa, Mycobacterium
FPGGHCKGVCLGGYLLQGGYGWNSRIFGPACESVIG

SEQ ID NO: 660433 - protein, 17 aa, Mycobacterium
FPGGLELPPHYHTGIVI

SEQ ID NO: 660434 - protein, 30 aa, Mycobacterium
FPGGPVSLSRWMMRPNPEFDGRTPREEAIT

SEQ ID NO: 660435 - protein, 24 aa, Mycobacterium
FPGGQLPPIEMVEFHASKMGFNLV

SEQ ID NO: 660436 - protein, 17 aa, Mycobacterium
FPGGRSGGHLSANQVGL

SEQ ID NO: 660437 - protein, 17 aa, Mycobacterium
FPGGVLGVALNLDEHNV

SEQ ID NO: 660438 - protein, 18 aa, Mycobacterium
FPGGVLGVALNLDEHSVG

SEQ ID NO: 660439 - protein, 18 aa, Mycobacterium
FPGGVLGVALNLDERSVG

SEQ ID NO: 660440 - protein, 19 aa, Mycobacterium
FPGIESFGGVVVHPQHWPE

SEQ ID NO: 660441 - protein, 18 aa, Mycobacterium
FPGISWPLTPGHEIAGKV

SEQ ID NO: 660442 - protein, 25 aa, Mycobacterium
FPGKRAPTVQLCRDPKGYVPIGRNP

SEQ ID NO: 660443 - protein, 20 aa, Mycobacterium
FPGKVMKTRAKIAAGAPISD

SEQ ID NO: 660444 - protein, 18 aa, Mycobacterium
FPGLAAEWAEWGDRRPFV

SEQ ID NO: 660445 - protein, 18 aa, Mycobacterium
FPGLDSFAGEVYHTAYWP

SEQ ID NO: 660446 - protein, 26 aa, Mycobacterium
FPGLRWGVTECGAFWANDLLWLMDTR

SEQ ID NO: 660447 - protein, 17 aa, Mycobacterium
FPGMALPHLLGSEDRLH

SEQ ID NO: 660448 - protein, 23 aa, Mycobacterium
FPGNPDPVGFIRRLGDEVIPKLT

SEQ ID NO: 660449 - protein, 17 aa, Mycobacterium
FPGPFPGYSTVKPQSCA

SEQ ID NO: 660450 - protein, 17 aa, Mycobacterium
FPGPQLSTPDGRGPVLI

SEQ ID NO: 660451 - protein, 19 aa, Mycobacterium
FPGQSATGGNGGMGGRGGD

SEQ ID NO: 660452 - protein, 25 aa, Mycobacterium
FPGSDLSLAGWTRKITGIPVIGVGS

SEQ ID NO: 660453 - protein, 17 aa, Mycobacterium
FPGTGFLELVIRAGDVV

SEQ ID NO: 660454 - protein, 20 aa, Mycobacterium
FPGVEQFGGPVIHPQHWPAD

SEQ ID NO: 660455 - protein, 20 aa, Mycobacterium
FPGVFRGALAAGARRITEKM

SEQ ID NO: 660456 - protein, 19 aa, Mycobacterium
FPGVKALDGVDFRLLPGEV

SEQ ID NO: 660457 - protein, 21 aa, Mycobacterium
FPGVVPTGWVPIGRVTVGEPG

SEQ ID NO: 660458 - protein, 19 aa, Mycobacterium
FPGYFLVVHDIARFCRDNN

SEQ ID NO: 660459 - protein, 17 aa, Mycobacterium
FPGYFLVVHDITRFCRE

SEQ ID NO: 660460 - protein, 19 aa, Mycobacterium
FPHAVRWKGTTYLEDGLHR

SEQ ID NO: 660461 - protein, 24 aa, Mycobacterium
FPHHCAYGAAKWALRGLTQTAAAE

SEQ ID NO: 660462 - protein, 17 aa, Mycobacterium
FPHHEFTAAHAECVRGE

SEQ ID NO: 660463 - protein, 17 aa, Mycobacterium
FPHHPLMLARFGTPTVL

SEQ ID NO: 660464 - protein, 25 aa, Mycobacterium
FPHKKIAGPGIEWYIMPGSDKPMRR

SEQ ID NO: 660465 - protein, 18 aa, Mycobacterium
FPHLSVAANVVFGPFSRR

SEQ ID NO: 660466 - protein, 18 aa, Mycobacterium
FPHMRFPSDWTAYDEDND

SEQ ID NO: 660467 - protein, 19 aa, Mycobacterium
FPHMRFPSDWTAYDEDNDA

SEQ ID NO: 660468 - protein, 23 aa, Mycobacterium
FPHPGSNVVLCLGMCGQMIYVNR

SEQ ID NO: 660469 - protein, 21 aa, Mycobacterium
FPHVYCELDFTNPLELAVATI

SEQ ID NO: 660470 - protein, 21 aa, Mycobacterium
FPHVYCELDFTSPLELAVATI

SEQ ID NO: 660471 - protein, 20 aa, Mycobacterium
FPIACTEGALATGKKAAETV

SEQ ID NO: 660472 - protein, 17 aa, Mycobacterium
FPIAVLNLKGGVGKTAV

SEQ ID NO: 660473 - protein, 21 aa, Mycobacterium
FPIDPPFGLVAMAWRDEDFVQ

SEQ ID NO: 660474 - protein, 21 aa, Mycobacterium
FPIEELMYYELLGVCAAGEGD

SEQ ID NO: 660475 - protein, 19 aa, Mycobacterium
FPIEEVVGAFEAVFRAEHM

SEQ ID NO: 660476 - protein, 20 aa, Mycobacterium
FPIEVWKQPRVLDSGAAYIN

SEQ ID NO: 660477 - protein, 21 aa, Mycobacterium
FPIIYRFSQWKANAYDARIAE

SEQ ID NO: 660478 - protein, 18 aa, Mycobacterium
FPIKMPGLGRVGMVSAGM

SEQ ID NO: 660479 - protein, 19 aa, Mycobacterium
FPILRGMSIKRVLINPGAM

SEQ ID NO: 660480 - protein, 34 aa, Mycobacterium
FPISAHYFTVFPLARWSAVLGRRYLRQQVEDPRV

SEQ ID NO: 660481 - protein, 33 aa, Mycobacterium
FPISAHYFTVFPLARWSAVLGRRYLRQRVNDPV

SEQ ID NO: 660482 - protein, 23 aa, Mycobacterium
FPISALTDPLAWYGASDQQQLSE

SEQ ID NO: 660483 - protein, 17 aa, Mycobacterium
FPITPLFPLAGPAGLVP

SEQ ID NO: 660484 - protein, 17 aa, Mycobacterium
FPIVLSAGERRAYTAND

SEQ ID NO: 660485 - protein, 18 aa, Mycobacterium
FPIVLSAGERRAYTANDI

SEQ ID NO: 660486 - protein, 33 aa, Mycobacterium
FPKASVMTHHRWLRALAVFGGLGLRLKSSDTLY

SEQ ID NO: 660487 - protein, 33 aa, Mycobacterium
FPKASVMTHHRWLRALAVFGGMGLRLKSSDTLY

SEQ ID NO: 660488 - protein, 20 aa, Mycobacterium
FPKKRGMRIDFVLGSPEFAK

SEQ ID NO: 660489 - protein, 18 aa, Mycobacterium
FPKPTISQIHGYCMGGGI

SEQ ID NO: 660490 - protein, 18 aa, Mycobacterium
FPKQIWRQIWSNNPQERL

SEQ ID NO: 660491 - protein, 23 aa, Mycobacterium
FPLACPPSAPAEHVASFIETNLS

SEQ ID NO: 660492 - protein, 20 aa, Mycobacterium
FPLCGGRITLMSPVSFVRRP

SEQ ID NO: 660493 - protein, 17 aa, Mycobacterium
FPLFPQGGGFPRNNDDK

SEQ ID NO: 660494 - protein, 21 aa, Mycobacterium
FPLGLGLVSQFFGRYFTPDEA

SEQ ID NO: 660495 - protein, 17 aa, Mycobacterium
FPLHPGFAASWQGLRCA

SEQ ID NO: 660496 - protein, 17 aa, Mycobacterium
FPLIARSYALQYAQNEL

SEQ ID NO: 660497 - protein, 21 aa, Mycobacterium
FPLIRRYALAYHVVFIPSHEV

SEQ ID NO: 660498 - protein, 21 aa, Mycobacterium
FPLIRRYAVAFHVVFIPSVEV

SEQ ID NO: 660499 - protein, 17 aa, Mycobacterium
FPLMPRIFMAVRRESRI

SEQ ID NO: 660500 - protein, 24 aa, Mycobacterium
FPLPRELVGEGSLFLLKVVGDSMV

SEQ ID NO: 660501 - protein, 24 aa, Mycobacterium
FPLPRELVGEGSLFLLKVVGESMV

SEQ ID NO: 660502 - protein, 19 aa, Mycobacterium
FPLPRELVGEGTLFLLKVV

SEQ ID NO: 660503 - protein, 24 aa, Mycobacterium
FPLPRELVGQGTLFLLKVVGESMI

SEQ ID NO: 660504 - protein, 17 aa, Mycobacterium
FPLRAWRSSAQEYLVWR

SEQ ID NO: 660505 - protein, 17 aa, Mycobacterium
FPLRDRVAAMVPDVPVR

SEQ ID NO: 660506 - protein, 21 aa, Mycobacterium
FPLRRGLSWRRYVSELRVEAE

SEQ ID NO: 660507 - protein, 21 aa, Mycobacterium
FPLRRGLVWRRLTSELRTDSS

SEQ ID NO: 660508 - protein, 20 aa, Mycobacterium
FPLRRGLVWRRRASELRTEA

SEQ ID NO: 660509 - protein, 20 aa, Mycobacterium
FPLRRGLVWRRRASELRTEE

SEQ ID NO: 660510 - protein, 17 aa, Mycobacterium
FPLTHMPTGPGEVWTQA

SEQ ID NO: 660511 - protein, 18 aa, Mycobacterium
FPLTNRWWERPYVAAGIF

SEQ ID NO: 660512 - protein, 17 aa, Mycobacterium
FPLVIIVHADPEVRVKR

SEQ ID NO: 660513 - protein, 17 aa, Mycobacterium
FPMASFRPTDIDLDGGK

SEQ ID NO: 660514 - protein, 17 aa, Mycobacterium
FPMAVGVLAALHQRGIA

SEQ ID NO: 660515 - protein, 27 aa, Mycobacterium
FPMKKTPKKVCHRITLGSGRNKVTATF

SEQ ID NO: 660516 - protein, 27 aa, Mycobacterium
FPNADSIAGNGVWVFDAGVTRTADGSG

SEQ ID NO: 660517 - protein, 23 aa, Mycobacterium
FPNAPMRTVHLWAAPEPPIEAPP

SEQ ID NO: 660518 - protein, 18 aa, Mycobacterium
FPNCGHWVMIEAKAAFER

SEQ ID NO: 660519 - protein, 22 aa, Mycobacterium
FPNCNGRIPFDTALLSEVLSEN

SEQ ID NO: 660520 - protein, 17 aa, Mycobacterium
FPNETLEKWLRGDYGNM

SEQ ID NO: 660521 - protein, 21 aa, Mycobacterium
FPNFFTVFGPYGYVGSSYFAL

SEQ ID NO: 660522 - protein, 17 aa, Mycobacterium
FPNGMVITPDRRTLIVA

SEQ ID NO: 660523 - protein, 21 aa, Mycobacterium
FPNLCVPTGGLPPIVGTAGSP

SEQ ID NO: 660524 - protein, 21 aa, Mycobacterium
FPNLFTVFGPYGYVGSSYFAL

SEQ ID NO: 660525 - protein, 18 aa, Mycobacterium
FPNLSWPLTPGHEIAGTI

SEQ ID NO: 660526 - protein, 24 aa, Mycobacterium
FPNMFSITGPYGFVLGSYLWMIEA

SEQ ID NO: 660527 - protein, 26 aa, Mycobacterium
FPNYLSLASPYAFIGLNFFNTMEYQM

SEQ ID NO: 660528 - protein, 17 aa, Mycobacterium
FPPAALPVRAVRAARAH

SEQ ID NO: 660529 - protein, 19 aa, Mycobacterium
FPPAGTLTGIAKRELRGTP

SEQ ID NO: 660530 - protein, 19 aa, Mycobacterium
FPPAGTLTGIAKRELRGVA

SEQ ID NO: 660531 - protein, 20 aa, Mycobacterium
FPPDHMDEMELVQWGIPRLS

SEQ ID NO: 660532 - protein, 23 aa, Mycobacterium
FPPDVVVELDLAGGAWADHLIKL

SEQ ID NO: 660533 - protein, 17 aa, Mycobacterium
FPPERITFHGNNKSVAE

SEQ ID NO: 660534 - protein, 17 aa, Mycobacterium
FPPERITLHGNNKSVAE

SEQ ID NO: 660535 - protein, 21 aa, Mycobacterium
FPPEVHSMLLSSGPGPGPLLA

SEQ ID NO: 660536 - protein, 19 aa, Mycobacterium
FPPGGRFGVPGIDHPEIER

SEQ ID NO: 660537 - protein, 17 aa, Mycobacterium
FPPGQDGGGGGIGGSGG

SEQ ID NO: 660538 - protein, 21 aa, Mycobacterium
FPPHACADCGCPEHRPVETAD

SEQ ID NO: 660539 - protein, 18 aa, Mycobacterium
FPPIPSFSPEHFAVARGT

SEQ ID NO: 660540 - protein, 18 aa, Mycobacterium
FPPIPSFSPEHFSVARGT

SEQ ID NO: 660541 - protein, 17 aa, Mycobacterium
FPPNAEFGPRPFTEQQL

SEQ ID NO: 660542 - protein, 17 aa, Mycobacterium
FPPNAKARMEILVDNLR

SEQ ID NO: 660543 - protein, 25 aa, Mycobacterium
FPPNHPPMRTFLGVPVRIRDEVFGN

SEQ ID NO: 660544 - protein, 28 aa, Mycobacterium
FPPNLGPIWRLERDGMWDELIPLMRAEG

SEQ ID NO: 660545 - protein, 20 aa, Mycobacterium
FPPQPVWASEALDLINDIQP

SEQ ID NO: 660546 - protein, 19 aa, Mycobacterium
FPPRYRVGADGALATHYEL

SEQ ID NO: 660547 - protein, 22 aa, Mycobacterium
FPPSPVRAGGFPARGEIISAYG

SEQ ID NO: 660548 - protein, 25 aa, Mycobacterium
FPPVVAVGAKGAWLTVIDPSDGARI

SEQ ID NO: 660549 - protein, 20 aa, Mycobacterium
FPQDVLELQAFLGDQSRVPG

SEQ ID NO: 660550 - protein, 21 aa, Mycobacterium
FPQELRWEHGRRVVAGQRIMQ

SEQ ID NO: 660551 - protein, 21 aa, Mycobacterium
FPQGAGHWALTRHDDVFYASR

SEQ ID NO: 660552 - protein, 20 aa, Mycobacterium
FPQLAALVKVPAQFIAGDHE

SEQ ID NO: 660553 - protein, 20 aa, Mycobacterium
FPQLRGLCLSNYTSDPIFRA

SEQ ID NO: 660554 - protein, 20 aa, Mycobacterium
FPQLRGLCLSNYTSDPVFRA

SEQ ID NO: 660555 - protein, 28 aa, Mycobacterium
FPQNWWEWRELIGPLAADGYRVLCPDLR

SEQ ID NO: 660556 - protein, 19 aa, Mycobacterium
FPQQPALELDGWAVARPLP

SEQ ID NO: 660557 - protein, 18 aa, Mycobacterium
FPQTFYPTNSFNFASYQP

SEQ ID NO: 660558 - protein, 24 aa, Mycobacterium
FPQYRELGVYLVRGIPPGHVGAAW

SEQ ID NO: 660559 - protein, 19 aa, Mycobacterium
FPRDLRIIDTIEIGSSVRD

SEQ ID NO: 660560 - protein, 29 aa, Mycobacterium
FPRGIPGRLSWLVLRHLYAAALRALARDV

SEQ ID NO: 660561 - protein, 17 aa, Mycobacterium
FPRGMTGPRDARHSFSF

SEQ ID NO: 660562 - protein, 21 aa, Mycobacterium
FPRIGHLPYLLTLPGHGFYWF

SEQ ID NO: 660563 - protein, 22 aa, Mycobacterium
FPRLRAGVACGRAVSRAGDWFG

SEQ ID NO: 660564 - protein, 22 aa, Mycobacterium
FPRPAELTALLTQAGFEQLPRR

SEQ ID NO: 660565 - protein, 19 aa, Mycobacterium
FPRSPFVTAATAWELQEAT

SEQ ID NO: 660566 - protein, 25 aa, Mycobacterium
FPRTADCRILLCSSVAATVGGRGLI

SEQ ID NO: 660567 - protein, 22 aa, Mycobacterium
FPRTDGCRIVLCSSARATIGGR

SEQ ID NO: 660568 - protein, 17 aa, Mycobacterium
FPRTGEHTGRMAVFDLL

SEQ ID NO: 660569 - protein, 17 aa, Mycobacterium
FPRTRMTAVDAATYNES

SEQ ID NO: 660570 - protein, 18 aa, Mycobacterium
FPSACGKTNLAMIQPTIP

SEQ ID NO: 660571 - protein, 18 aa, Mycobacterium
FPSACGKTNLAMLQPTIE

SEQ ID NO: 660572 - protein, 24 aa, Mycobacterium
FPSAREYSVRYGLSEKRQAMLPDR

SEQ ID NO: 660573 - protein, 23 aa, Mycobacterium
FPSGDDLISAWLYRPPGDGPAPL

SEQ ID NO: 660574 - protein, 30 aa, Mycobacterium
FPSIEHWPARAIKHHRRILSALAKHDDKLA

SEQ ID NO: 660575 - protein, 20 aa, Mycobacterium
FPSINWAPIEWSNIKDQEEE

SEQ ID NO: 660576 - protein, 17 aa, Mycobacterium
FPSIPALFDAHVAGTPD

SEQ ID NO: 660577 - protein, 21 aa, Mycobacterium
FPSKDAVLFTLFERVIMEADS

SEQ ID NO: 660578 - protein, 23 aa, Mycobacterium
FPSLPLVRARLDPNYGAPIKGKR

SEQ ID NO: 660579 - protein, 17 aa, Mycobacterium
FPSLPQWPGEPEPVDTT

SEQ ID NO: 660580 - protein, 18 aa, Mycobacterium
FPSLRCELGENGVLTLVL

SEQ ID NO: 660581 - protein, 17 aa, Mycobacterium
FPSSCGKTNMAMLQPAL

SEQ ID NO: 660582 - protein, 23 aa, Mycobacterium
FPSSREYSVRYGLSEKRQSTLAD

SEQ ID NO: 660583 - protein, 24 aa, Mycobacterium
FPSVREYSVRYGLSDRRQAMLPGH

SEQ ID NO: 660584 - protein, 20 aa, Mycobacterium
FPTAPMRAVHLWATPEPLPP

SEQ ID NO: 660585 - protein, 24 aa, Mycobacterium
FPTAYRYGWSEAEATRFALQELDY

SEQ ID NO: 660586 - protein, 19 aa, Mycobacterium
FPTDRGWDVEGLFDPDPDA

SEQ ID NO: 660587 - protein, 18 aa, Mycobacterium
FPTEPVIGVLTFVSHGTD

SEQ ID NO: 660588 - protein, 20 aa, Mycobacterium
FPTFDWPRIDAPYIRPGADV

SEQ ID NO: 660589 - protein, 20 aa, Mycobacterium
FPTGIRRWGGGRSINAMAEE

SEQ ID NO: 660590 - protein, 23 aa, Mycobacterium
FPTGLRIASRLSRRVPSIARKAR

SEQ ID NO: 660591 - protein, 19 aa, Mycobacterium
FPTGPAYYLMDFPIESFTP

SEQ ID NO: 660592 - protein, 24 aa, Mycobacterium
FPTIIDMWLPLSWSLNMVNRSMGH

SEQ ID NO: 660593 - protein, 23 aa, Mycobacterium
FPTKESLVMAVIEWQTEQVMRFY

SEQ ID NO: 660594 - protein, 25 aa, Mycobacterium
FPTKFDAICKPEWIPEGTRVVNELD

SEQ ID NO: 660595 - protein, 18 aa, Mycobacterium
FPTLIDLYLQGRLPLDKF

SEQ ID NO: 660596 - protein, 17 aa, Mycobacterium
FPTLPSWISLRLLENRT

SEQ ID NO: 660597 - protein, 17 aa, Mycobacterium
FPTLRAAQFGGPDSARW

SEQ ID NO: 660598 - protein, 17 aa, Mycobacterium
FPTMPFAALGYDVVHCG

SEQ ID NO: 660599 - protein, 26 aa, Mycobacterium
FPTMVRDFQRIIGMEARVQIQDQAGR

SEQ ID NO: 660600 - protein, 19 aa, Mycobacterium
FPTPAPCGKTPLIAKGLTK

SEQ ID NO: 660601 - protein, 18 aa, Mycobacterium
FPTPEMERRILLSRVPEL

SEQ ID NO: 660602 - protein, 20 aa, Mycobacterium
FPTRIISTLLGLPREDLDLF

SEQ ID NO: 660603 - protein, 22 aa, Mycobacterium
FPTRLERGAGIPAVDRLAYFAE

SEQ ID NO: 660604 - protein, 20 aa, Mycobacterium
FPTRVIARLLGLPADDLPTF

SEQ ID NO: 660605 - protein, 24 aa, Mycobacterium
FPTTTKRLMGWGRTAPTVASVLST

SEQ ID NO: 660606 - protein, 25 aa, Mycobacterium
FPTVTGATIVRWIIYQDTGTAGTSQ

SEQ ID NO: 660607 - protein, 19 aa, Mycobacterium
FPVAAHFHTAIPLASAIER

SEQ ID NO: 660608 - protein, 25 aa, Mycobacterium
FPVDFLRMINDVFLLRNGAREPGAC

SEQ ID NO: 660609 - protein, 17 aa, Mycobacterium
FPVDVPFTTVAKGPIRA

SEQ ID NO: 660610 - protein, 19 aa, Mycobacterium
FPVECWKQPRVPDSGASTL

SEQ ID NO: 660611 - protein, 19 aa, Mycobacterium
FPVECWKQPRVPDSGATWL

SEQ ID NO: 660612 - protein, 20 aa, Mycobacterium
FPVEIFPKAAALGMGGIYVN

SEQ ID NO: 660613 - protein, 18 aa, Mycobacterium
FPVFAGRKDTIVKVAGKR

SEQ ID NO: 660614 - protein, 23 aa, Mycobacterium
FPVGDPRAPLLPLDEAGRGELKG

SEQ ID NO: 660615 - protein, 22 aa, Mycobacterium
FPVGDPRAPLLPLDEEGRARLK

SEQ ID NO: 660616 - protein, 22 aa, Mycobacterium
FPVGDPRPPLLPLDERGRAELR

SEQ ID NO: 660617 - protein, 17 aa, Mycobacterium
FPVGDPWTPGIMQGPQI

SEQ ID NO: 660618 - protein, 18 aa, Mycobacterium
FPVGDPWTPGVMQGPQIS

SEQ ID NO: 660619 - protein, 23 aa, Mycobacterium
FPVHPKNRFDARVVHQWTDYGAL

SEQ ID NO: 660620 - protein, 25 aa, Mycobacterium
FPVIGRGGVDLGRFWSEQRYQSYQG

SEQ ID NO: 660621 - protein, 21 aa, Mycobacterium
FPVKACANAYVARAPDKRTGS

SEQ ID NO: 660622 - protein, 23 aa, Mycobacterium
FPVLTHHGVGLWVPEVGGAVDPG

SEQ ID NO: 660623 - protein, 17 aa, Mycobacterium
FPVNLLSYLAQNTSAQA

SEQ ID NO: 660624 - protein, 18 aa, Mycobacterium
FPVNLVVLPASAAFAAGN

SEQ ID NO: 660625 - protein, 20 aa, Mycobacterium
FPVQGFKRRGDYGIITVLGL

SEQ ID NO: 660626 - protein, 18 aa, Mycobacterium
FPVSLHFEAPYGVSAPAF

SEQ ID NO: 660627 - protein, 17 aa, Mycobacterium
FPVTGDAAVLRETVQDT

SEQ ID NO: 660628 - protein, 26 aa, Mycobacterium
FPVTQWTRWRRPVIGMPATPRFLGHG

SEQ ID NO: 660629 - protein, 17 aa, Mycobacterium
FPVTVGWIHAIRRGQAA

SEQ ID NO: 660630 - protein, 17 aa, Mycobacterium
FPVVTKAPVGWIGQDDG

SEQ ID NO: 660631 - protein, 18 aa, Mycobacterium
FPVWQAQVAVQRRDARAP

SEQ ID NO: 660632 - protein, 20 aa, Mycobacterium
FPWAERRQGVLGEAHVRRAP

SEQ ID NO: 660633 - protein, 21 aa, Mycobacterium
FPWTERRQGVLGEVHLRRAPV

SEQ ID NO: 660634 - protein, 21 aa, Mycobacterium
FPYAGEWKSLVAAMEGTLRLH

SEQ ID NO: 660635 - protein, 20 aa, Mycobacterium
FPYAVMIVIHMSRGAPSLLA

SEQ ID NO: 660636 - protein, 19 aa, Mycobacterium
FPYAWPRKPVLAENVVCTS

SEQ ID NO: 660637 - protein, 18 aa, Mycobacterium
FQAAGGMAFLVRSLLDAG

SEQ ID NO: 660638 - protein, 17 aa, Mycobacterium
FQAASLLDIELETGRTH

SEQ ID NO: 660639 - protein, 25 aa, Mycobacterium
FQAEFARTLAAAGLVYAQSEATNAA

SEQ ID NO: 660640 - protein, 18 aa, Mycobacterium
FQAETGQTPMQWVTGVRI

SEQ ID NO: 660641 - protein, 17 aa, Mycobacterium
FQAFEGIAVPKFPNLLT

SEQ ID NO: 660642 - protein, 19 aa, Mycobacterium
FQAHPIPQMVSAGMIPFSL

SEQ ID NO: 660643 - protein, 19 aa, Mycobacterium
FQAKLDWVEDFCREEIEPL

SEQ ID NO: 660644 - protein, 20 aa, Mycobacterium
FQALACFKSAATWSLIVKHN

SEQ ID NO: 660645 - protein, 19 aa, Mycobacterium
FQALLGFRSLFSGDPLQDT

SEQ ID NO: 660646 - protein, 18 aa, Mycobacterium
FQANAWGLIYAALMAGAE

SEQ ID NO: 660647 - protein, 20 aa, Mycobacterium
FQARVAPFNVNFRYVKSELQ

SEQ ID NO: 660648 - protein, 18 aa, Mycobacterium
FQAVAMLRGKLSEMLRGD

SEQ ID NO: 660649 - protein, 17 aa, Mycobacterium
FQAWIRRSDTVLDLGCG

SEQ ID NO: 660650 - protein, 22 aa, Mycobacterium
FQCGYCTPGQIVSAVACIAEGY

SEQ ID NO: 660651 - protein, 19 aa, Mycobacterium
FQDAFPGYPGRAVSQMWGR

SEQ ID NO: 660652 - protein, 19 aa, Mycobacterium
FQDAISWGRAERAGGELSA

SEQ ID NO: 660653 - protein, 25 aa, Mycobacterium
FQDKALEGFTMFAFNQGEVCTCPSR

SEQ ID NO: 660654 - protein, 17 aa, Mycobacterium
FQDPFASLNPRARVDTS

SEQ ID NO: 660655 - protein, 22 aa, Mycobacterium
FQEAGLPPGVLSVMIGSGSAIG

SEQ ID NO: 660656 - protein, 22 aa, Mycobacterium
FQEISGWSVIAELLRPQADSRV

SEQ ID NO: 660657 - protein, 26 aa, Mycobacterium
FQELMPDVLHWLGIRKIHRLVSMSNM

SEQ ID NO: 660658 - protein, 28 aa, Mycobacterium
FQELMPDVLHWLGIRTIHRLVSMSNMKY

SEQ ID NO: 660659 - protein, 18 aa, Mycobacterium
FQETAFRFTDGSGRDAAT

SEQ ID NO: 660660 - protein, 19 aa, Mycobacterium
FQETAFRFTDGSGRDPATA

SEQ ID NO: 660661 - protein, 23 aa, Mycobacterium
FQEVQELAARFGVLNSGAAAGRP

SEQ ID NO: 660662 - protein, 18 aa, Mycobacterium
FQFVLARLEVLLGPLHVA

SEQ ID NO: 660663 - protein, 24 aa, Mycobacterium
FQGGRVFISMKQPLYIAISPDNMG

SEQ ID NO: 660664 - protein, 25 aa, Mycobacterium
FQGLCANGFPNCFIESIAQAGLTVN

SEQ ID NO: 660665 - protein, 20 aa, Mycobacterium
FQGLCTTEFPNCFIESIAQA

SEQ ID NO: 660666 - protein, 17 aa, Mycobacterium
FQGLIGSIGEKIGLRGF

SEQ ID NO: 660667 - protein, 17 aa, Mycobacterium
FQGRGSFVLAVPEPTAF

SEQ ID NO: 660668 - protein, 19 aa, Mycobacterium
FQHFIARLYGVLVDDAAED

SEQ ID NO: 660669 - protein, 17 aa, Mycobacterium
FQHFNLVGRLSCLENVL

SEQ ID NO: 660670 - protein, 18 aa, Mycobacterium
FQHIEDFMPTAVIPRGAG

SEQ ID NO: 660671 - protein, 17 aa, Mycobacterium
FQHPGTEFIYMLEGVMD

SEQ ID NO: 660672 - protein, 17 aa, Mycobacterium
FQHRMYPPAANFTAPNP

SEQ ID NO: 660673 - protein, 20 aa, Mycobacterium
FQHVEDFMPTALISRGTNPA

SEQ ID NO: 660674 - protein, 33 aa, Mycobacterium
FQHWSEAMMTDGRWDPGKDFAMVSARETGPTQK

SEQ ID NO: 660675 - protein, 17 aa, Mycobacterium
FQIGQGLTSALCYGARP

SEQ ID NO: 660676 - protein, 17 aa, Mycobacterium
FQIGQGLTSALCYSARP

SEQ ID NO: 660677 - protein, 21 aa, Mycobacterium
FQIRCVGTLIFGRPRPLSRSR

SEQ ID NO: 660678 - protein, 28 aa, Mycobacterium
FQISCGHCFMCDMKLYTQCETTQVREQG

SEQ ID NO: 660679 - protein, 25 aa, Mycobacterium
FQKWADKNLREILGDQVGGAISDII

SEQ ID NO: 660680 - protein, 20 aa, Mycobacterium
FQLDIMRVPGIIVARTDAEA

SEQ ID NO: 660681 - protein, 17 aa, Mycobacterium
FQLIDPVSGMSRAAGNI

SEQ ID NO: 660682 - protein, 18 aa, Mycobacterium
FQLLRPIKGENRYFVVTQ

SEQ ID NO: 660683 - protein, 18 aa, Mycobacterium
FQLLRVLMRHPRKALSRD

SEQ ID NO: 660684 - protein, 29 aa, Mycobacterium
FQLSRTNIFTGMVGRTWVTPEGQVIIAYQ

SEQ ID NO: 660685 - protein, 20 aa, Mycobacterium
FQLTDLGARWVGPIRTATKY

SEQ ID NO: 660686 - protein, 17 aa, Mycobacterium
FQMGLSMADALAKLGAV

SEQ ID NO: 660687 - protein, 17 aa, Mycobacterium
FQMKFYGVALFRSRGVL

SEQ ID NO: 660688 - protein, 23 aa, Mycobacterium
FQMMGLCQMLRDGVIPPNRSLDC

SEQ ID NO: 660689 - protein, 17 aa, Mycobacterium
FQNACRHRGNSVCVGSG

SEQ ID NO: 660690 - protein, 28 aa, Mycobacterium
FQNPRVGPLALCYRVFMLPDTKQTMIAY

SEQ ID NO: 660691 - protein, 36 aa, Mycobacterium
FQPDLNVDLVYRFIRDTTWVSVRWYQPGGPLTAQQV

SEQ ID NO: 660692 - protein, 24 aa, Mycobacterium
FQPESKTLYLARWLNRGQRAFQLA

SEQ ID NO: 660693 - protein, 20 aa, Mycobacterium
FQPEWWQRAAELGWASLLVP

SEQ ID NO: 660694 - protein, 19 aa, Mycobacterium
FQPFYRWHVSDDVRQPVQA

SEQ ID NO: 660695 - protein, 20 aa, Mycobacterium
FQPHIAKLKLADGVATVERT

SEQ ID NO: 660696 - protein, 28 aa, Mycobacterium
FQPLLHPRLREFALREGLADAAQRFGHA

SEQ ID NO: 660697 - protein, 17 aa, Mycobacterium
FQPRLGDGRALLLGEIE

SEQ ID NO: 660698 - protein, 17 aa, Mycobacterium
FQQFNLFRSRTVAGNIA

SEQ ID NO: 660699 - protein, 25 aa, Mycobacterium
FQQGLEMWKAIIDGIIEYAESLIKE

SEQ ID NO: 660700 - protein, 17 aa, Mycobacterium
FQQMFWRGGPTPTADFN

SEQ ID NO: 660701 - protein, 22 aa, Mycobacterium
FQQPSPQPGVHWSKDVRIDKVA

SEQ ID NO: 660702 - protein, 23 aa, Mycobacterium
FQQVRAAMIAQGWNEGAPPGQHY

SEQ ID NO: 660703 - protein, 19 aa, Mycobacterium
FQRAKSLAPTRPHPLAPDH

SEQ ID NO: 660704 - protein, 17 aa, Mycobacterium
FQRRRFWLDGTSRAGDV

SEQ ID NO: 660705 - protein, 24 aa, Mycobacterium
FQRRVWRALLTIPYGETRSYGEIA

SEQ ID NO: 660706 - protein, 23 aa, Mycobacterium
FQRRVWRALQTIPYGETRSYGEI

SEQ ID NO: 660707 - protein, 19 aa, Mycobacterium
FQRTPGWVLPRVNFRHPAW

SEQ ID NO: 660708 - protein, 19 aa, Mycobacterium
FQRTPGWVLPRVNLKHPAW

SEQ ID NO: 660709 - protein, 24 aa, Mycobacterium
FQRTPIWCLPKLDFPVPRLARGFL

SEQ ID NO: 660710 - protein, 18 aa, Mycobacterium
FQRTPIWVGPKFDLEIGP

SEQ ID NO: 660711 - protein, 24 aa, Mycobacterium
FQRWLADAELTDWLSSARLNLLAE

SEQ ID NO: 660712 - protein, 28 aa, Mycobacterium
FQRYRLHLRPGWQPRQFFSLSTLVKGGV

SEQ ID NO: 660713 - protein, 23 aa, Mycobacterium
FQSAFAMALSFGGTVALKAAARD

SEQ ID NO: 660714 - protein, 25 aa, Mycobacterium
FQSFALEPGRIWTFVMHGPDGRDYK

SEQ ID NO: 660715 - protein, 24 aa, Mycobacterium
FQSFPAVAGSSLFARLQDSAVPER

SEQ ID NO: 660716 - protein, 18 aa, Mycobacterium
FQSGLAWITILRKREGFR

SEQ ID NO: 660717 - protein, 17 aa, Mycobacterium
FQSLVVHDATGDPVRIL

SEQ ID NO: 660718 - protein, 28 aa, Mycobacterium
FQSQLRAKRAWDEGRFDREISPIEAPVL

SEQ ID NO: 660719 - protein, 22 aa, Mycobacterium
FQSRFETVLARNPGEAEFHQAV

SEQ ID NO: 660720 - protein, 19 aa, Mycobacterium
FQSRRGLARHYALRLTDSI

SEQ ID NO: 660721 - protein, 18 aa, Mycobacterium
FQSRRGLARSYALRLTDT

SEQ ID NO: 660722 - protein, 18 aa, Mycobacterium
FQTISGGAVFAYWVANPS

SEQ ID NO: 660723 - protein, 18 aa, Mycobacterium
FQTLVARTTLFHNEFSRA

SEQ ID NO: 660724 - protein, 24 aa, Mycobacterium
FQTRDEQFYLFGLGHHISVDGLGM

SEQ ID NO: 660725 - protein, 25 aa, Mycobacterium
FQTVGKRISTAWEHNRMTAPLHSSA

SEQ ID NO: 660726 - protein, 17 aa, Mycobacterium
FQVAQVFEKAILDGQLK

SEQ ID NO: 660727 - protein, 20 aa, Mycobacterium
FQVLCQRSGITIDVGPGESI

SEQ ID NO: 660728 - protein, 17 aa, Mycobacterium
FQVLPWVTDAGHHHSAR

SEQ ID NO: 660729 - protein, 22 aa, Mycobacterium
FQVSRPSLREAVRVLESDRLVE

SEQ ID NO: 660730 - protein, 17 aa, Mycobacterium
FQWLDKMPGAWSHGGAR

SEQ ID NO: 660731 - protein, 17 aa, Mycobacterium
FQYACVAAGIPAVTFWA

SEQ ID NO: 660732 - protein, 19 aa, Mycobacterium
FQYAKTWRTLAKLSLPNKY

SEQ ID NO: 660733 - protein, 23 aa, Mycobacterium
FQYCATCQTGGKVLADRRMSRLL

SEQ ID NO: 660734 - protein, 17 aa, Mycobacterium
FQYCPTCQTGGKVLADR

SEQ ID NO: 660735 - protein, 26 aa, Mycobacterium
FQYLFPRLKAGGVYVVEDVCANYWTS

SEQ ID NO: 660736 - protein, 17 aa, Mycobacterium
FRAANFIELAAYPLRPS

SEQ ID NO: 660737 - protein, 19 aa, Mycobacterium
FRAAWSPAPMRSPRGRQRP

SEQ ID NO: 660738 - protein, 19 aa, Mycobacterium
FRADMEALRVLPPHDYVAA

SEQ ID NO: 660739 - protein, 19 aa, Mycobacterium
FRAEGRFKSTSAVLTDIKT

SEQ ID NO: 660740 - protein, 25 aa, Mycobacterium
FRAELERLGRMVFGPTFEVDIDSDL

SEQ ID NO: 660741 - protein, 27 aa, Mycobacterium
FRAEQRWPRYSPASVELGVLSGLSFKL

SEQ ID NO: 660742 - protein, 20 aa, Mycobacterium
FRAEVREFLVSNVPNPPLPS

SEQ ID NO: 660743 - protein, 18 aa, Mycobacterium
FRAEWLWHKDLPDPDQAA

SEQ ID NO: 660744 - protein, 18 aa, Mycobacterium
FRAGCPVVAVAVESGDPD

SEQ ID NO: 660745 - protein, 33 aa, Mycobacterium
FRAGGTEAAFLFAITVGGAMRIEPIEVMTFNAD

SEQ ID NO: 660746 - protein, 17 aa, Mycobacterium
FRAGLDVIIAGIKARAE

SEQ ID NO: 660747 - protein, 29 aa, Mycobacterium
FRAGPGALWRIPKEFEIWESQQTDFGPLL

SEQ ID NO: 660748 - protein, 17 aa, Mycobacterium
FRAGRAICVATFDKLVN

SEQ ID NO: 660749 - protein, 17 aa, Mycobacterium
FRAGVNVGVDISAEQLR

SEQ ID NO: 660750 - protein, 26 aa, Mycobacterium
FRAIDRLGPELSVREIAEEAGTAKPK

SEQ ID NO: 660751 - protein, 17 aa, Mycobacterium
FRAIDVRSILAAGAGTP

SEQ ID NO: 660752 - protein, 17 aa, Mycobacterium
FRALLAGAVDNMPATLD

SEQ ID NO: 660753 - protein, 25 aa, Mycobacterium
FRALSACNRLVCLLSDIGPELLKNQ

SEQ ID NO: 660754 - protein, 17 aa, Mycobacterium
FRALTGLSRKQLMRQLD

SEQ ID NO: 660755 - protein, 18 aa, Mycobacterium
FRALTGRTATTWRAGIEQ

SEQ ID NO: 660756 - protein, 21 aa, Mycobacterium
FRANPWLADHMSQALAVLTQD

SEQ ID NO: 660757 - protein, 23 aa, Mycobacterium
FRANPWLAEHMSGALAVLTEDGG

SEQ ID NO: 660758 - protein, 24 aa, Mycobacterium
FRAPAGELRAHFGALQVIAENERD

SEQ ID NO: 660759 - protein, 24 aa, Mycobacterium
FRAPFVHALAMSWTGRLEQAHQEL

SEQ ID NO: 660760 - protein, 17 aa, Mycobacterium
FRAPQAVVLSRLADIEM

SEQ ID NO: 660761 - protein, 18 aa, Mycobacterium
FRAPQPLQPWSGVREAVE

SEQ ID NO: 660762 - protein, 18 aa, Mycobacterium
FRAQFIKDMGGFMMNGLW

SEQ ID NO: 660763 - protein, 20 aa, Mycobacterium
FRARARPGGEKLRRQKQFGL

SEQ ID NO: 660764 - protein, 26 aa, Mycobacterium
FRASKLRSMCREFGRDPTELKLSVAL

SEQ ID NO: 660765 - protein, 19 aa, Mycobacterium
FRASLKQAQLVKAVVRAGG

SEQ ID NO: 660766 - protein, 18 aa, Mycobacterium
FRASVDIAVEIAKRLGTK

SEQ ID NO: 660767 - protein, 17 aa, Mycobacterium
FRAVTGPLLRTAEQGAD

SEQ ID NO: 660768 - protein, 17 aa, Mycobacterium
FRCEPTRSPDKWIALAH

SEQ ID NO: 660769 - protein, 18 aa, Mycobacterium
FRCHDDSWESLHCATQVV

SEQ ID NO: 660770 - protein, 17 aa, Mycobacterium
FRCHGWDSERTELLDYL

SEQ ID NO: 660771 - protein, 18 aa, Mycobacterium
FRCLTEYRRGGAEQFVGY

SEQ ID NO: 660772 - protein, 17 aa, Mycobacterium
FRCPQSFDETKFYRHRP

SEQ ID NO: 660773 - protein, 20 aa, Mycobacterium
FRDAEAWEYVSTEVIPRMLA

SEQ ID NO: 660774 - protein, 18 aa, Mycobacterium
FRDAGGHVFHSARWDYDY

SEQ ID NO: 660775 - protein, 26 aa, Mycobacterium
FRDATGHAPFNLGLGNIGFGNVGSAN

SEQ ID NO: 660776 - protein, 19 aa, Mycobacterium
FRDDPYGRFREMRESGCPV

SEQ ID NO: 660777 - protein, 17 aa, Mycobacterium
FRDELRSIYTTKIPQEL

SEQ ID NO: 660778 - protein, 19 aa, Mycobacterium
FRDELRTFYRTEIPEDIRA

SEQ ID NO: 660779 - protein, 17 aa, Mycobacterium
FRDELRTFYTTQIPQDI

SEQ ID NO: 660780 - protein, 17 aa, Mycobacterium
FRDELRTIYTTKIPEEL

SEQ ID NO: 660781 - protein, 24 aa, Mycobacterium
FRDEMRLPWDAGRQRCFDRLMAVI

SEQ ID NO: 660782 - protein, 20 aa, Mycobacterium
FRDEVREFLAAVVTDDVIRR

SEQ ID NO: 660783 - protein, 19 aa, Mycobacterium
FRDGGGLHYGEFPRFHALM

SEQ ID NO: 660784 - protein, 26 aa, Mycobacterium
FRDGKSFYRNRFVQTEGFLAENEAGG

SEQ ID NO: 660785 - protein, 20 aa, Mycobacterium
FRDHIYGCFIEDDFGAANLD

SEQ ID NO: 660786 - protein, 17 aa, Mycobacterium
FRDKYGVDGADTRRKAV

SEQ ID NO: 660787 - protein, 17 aa, Mycobacterium
FRDLTRLSAAGIPTIAV

SEQ ID NO: 660788 - protein, 27 aa, Mycobacterium
FRDPALYAHLWKIVQHYDINIISAVPT

SEQ ID NO: 660789 - protein, 18 aa, Mycobacterium
FRDPVGYLARRVPGVRVK

SEQ ID NO: 660790 - protein, 17 aa, Mycobacterium
FRDQRLLSIGGGADEVM

SEQ ID NO: 660791 - protein, 24 aa, Mycobacterium
FRDRFPDRFFDVGIAEQHAMTSAA

SEQ ID NO: 660792 - protein, 18 aa, Mycobacterium
FRDRMLKVLYKRAQGPGH

SEQ ID NO: 660793 - protein, 17 aa, Mycobacterium
FRDSVIPNPALNAVAGR

SEQ ID NO: 660794 - protein, 18 aa, Mycobacterium
FRDVGIAAVSIWMGSLLT

SEQ ID NO: 660795 - protein, 19 aa, Mycobacterium
FRDVVAALGMYPGQAPPLG

SEQ ID NO: 660796 - protein, 24 aa, Mycobacterium
FREAEAYDGPSLVIAYSHCIAHGF

SEQ ID NO: 660797 - protein, 33 aa, Mycobacterium
FREAHLRGAPILAMGVWRWGLGEIRYEQLNRRL

SEQ ID NO: 660798 - protein, 31 aa, Mycobacterium
FREAQLRGAPILAMGVWRWGLGEIAYEQLHR

SEQ ID NO: 660799 - protein, 18 aa, Mycobacterium
FREARLREAPILALGIWR

SEQ ID NO: 660800 - protein, 17 aa, Mycobacterium
FREEAGKTGPFEIHVIS

SEQ ID NO: 660801 - protein, 18 aa, Mycobacterium
FREGIMGPDLMDQMREQA

SEQ ID NO: 660802 - protein, 17 aa, Mycobacterium
FREHGYTGTAMSDVIAE

SEQ ID NO: 660803 - protein, 25 aa, Mycobacterium
FRENRMAVRFQYEWHDEAGQWWRSY

SEQ ID NO: 660804 - protein, 24 aa, Mycobacterium
FREPLPRIGLDSLPDQGAWLQPFR

SEQ ID NO: 660805 - protein, 19 aa, Mycobacterium
FRESAARALLLPRRHPGRR

SEQ ID NO: 660806 - protein, 18 aa, Mycobacterium
FRESLRLIIDPNMLLGAL

SEQ ID NO: 660807 - protein, 19 aa, Mycobacterium
FRESLVWAQAQLPRGARID

SEQ ID NO: 660808 - protein, 19 aa, Mycobacterium
FRESVKAFVQRHVDPRAET

SEQ ID NO: 660809 - protein, 21 aa, Mycobacterium
FRESYRAFLDRHVAPHHDEWE

SEQ ID NO: 660810 - protein, 19 aa, Mycobacterium
FRETGGKAGGLFEGSPLVL

SEQ ID NO: 660811 - protein, 17 aa, Mycobacterium
FRETSRILAGLPDERPD

SEQ ID NO: 660812 - protein, 28 aa, Mycobacterium
FREVAAECARRGIKVVVNAGGLNPAGMA

SEQ ID NO: 660813 - protein, 22 aa, Mycobacterium
FREVEELAARFGVMNSGAAAGR

SEQ ID NO: 660814 - protein, 17 aa, Mycobacterium
FREVGRLAGSPAPTAQE

SEQ ID NO: 660815 - protein, 24 aa, Mycobacterium
FREVIPHLAGQAWVTMDFLGFGLS

SEQ ID NO: 660816 - protein, 31 aa, Mycobacterium
FRFDCAVSSWLYRIVVNACLDRLRRTRTQPS

SEQ ID NO: 660817 - protein, 22 aa, Mycobacterium
FRFDLASTLAREFYDVDRLSAF

SEQ ID NO: 660818 - protein, 19 aa, Mycobacterium
FRFDLASTLARELHDVDRL

SEQ ID NO: 660819 - protein, 25 aa, Mycobacterium
FRFDSWKRGVGIKMRAYDNHWASRP

SEQ ID NO: 660820 - protein, 17 aa, Mycobacterium
FRFELLRTRHDLRQRAH

SEQ ID NO: 660821 - protein, 23 aa, Mycobacterium
FRFFAAPGSWTLRALSAAGNGNA

SEQ ID NO: 660822 - protein, 24 aa, Mycobacterium
FRFFAAPGSWTLRALSAVGNGNAV

SEQ ID NO: 660823 - protein, 22 aa, Mycobacterium
FRFFAAPGTWTLRALSPSGNGD

SEQ ID NO: 660824 - protein, 18 aa, Mycobacterium
FRFFSDHVRLKYGAEPGF

SEQ ID NO: 660825 - protein, 21 aa, Mycobacterium
FRFGCVCGGASLYAPQAQNNL

SEQ ID NO: 660826 - protein, 18 aa, Mycobacterium
FRFGIIQRTDHFTCYMSV

SEQ ID NO: 660827 - protein, 26 aa, Mycobacterium
FRFLKSKLRPGGLLLNHCITRNNNRS

SEQ ID NO: 660828 - protein, 20 aa, Mycobacterium
FRFPRFRAAQYLMKPILVFK

SEQ ID NO: 660829 - protein, 20 aa, Mycobacterium
FRFPYGAVVDDGRLAVADTA

SEQ ID NO: 660830 - protein, 20 aa, Mycobacterium
FRFSSAFGSTLSRLVRHGIG

SEQ ID NO: 660831 - protein, 20 aa, Mycobacterium
FRFTEAVSFMVDCKDQDEVD

SEQ ID NO: 660832 - protein, 19 aa, Mycobacterium
FRFVECSRLVDGRPDGDVT

SEQ ID NO: 660833 - protein, 33 aa, Mycobacterium
FRGAAQHKRCLVPMDGWYEWRANPDVLSGAGSK

SEQ ID NO: 660834 - protein, 17 aa, Mycobacterium
FRGAEMIAEKWDISREE

SEQ ID NO: 660835 - protein, 17 aa, Mycobacterium
FRGAEMIASQWKLSRED

SEQ ID NO: 660836 - protein, 22 aa, Mycobacterium
FRGARGRLAFDTGRQAAEKDGF

SEQ ID NO: 660837 - protein, 17 aa, Mycobacterium
FRGERLVNSMFTLSTMV

SEQ ID NO: 660838 - protein, 17 aa, Mycobacterium
FRGERLVNSMFTLSTVV

SEQ ID NO: 660839 - protein, 18 aa, Mycobacterium
FRGFHRFLEVRKAAEIEA

SEQ ID NO: 660840 - protein, 23 aa, Mycobacterium
FRGFPRRSGLIVPARPVLEPMLE

SEQ ID NO: 660841 - protein, 26 aa, Mycobacterium
FRGFWKIQEMRGMWREMWDLSDQCWA

SEQ ID NO: 660842 - protein, 20 aa, Mycobacterium
FRGGDIYTYLKAARTADARY

SEQ ID NO: 660843 - protein, 18 aa, Mycobacterium
FRGGEPAGLLGGPLDGGP

SEQ ID NO: 660844 - protein, 17 aa, Mycobacterium
FRGGPDYALHLYRTRGP

SEQ ID NO: 660845 - protein, 26 aa, Mycobacterium
FRGHSFHSARWDYEYTGGDSTGGLTG

SEQ ID NO: 660846 - protein, 17 aa, Mycobacterium
FRGMHDVEVGFPLVEDV

SEQ ID NO: 660847 - protein, 17 aa, Mycobacterium
FRGMVDMAKGLSALWHD

SEQ ID NO: 660848 - protein, 18 aa, Mycobacterium
FRGMVDMAKGLSALWHDK

SEQ ID NO: 660849 - protein, 17 aa, Mycobacterium
FRGRGFYWHSDFETWHT

SEQ ID NO: 660850 - protein, 25 aa, Mycobacterium
FRGSAPDGPGFWFPPTVLTPSRDDR

SEQ ID NO: 660851 - protein, 31 aa, Mycobacterium
FRGSWLALIRLLKCGPWHRGGWDPIPERTSH

SEQ ID NO: 660852 - protein, 23 aa, Mycobacterium
FRGTAPSGRGFWFPPTVLTPQRT

SEQ ID NO: 660853 - protein, 18 aa, Mycobacterium
FRGTDTKIAWKGEEAVEL

SEQ ID NO: 660854 - protein, 26 aa, Mycobacterium
FRGTGKYYSGVKWTWYRPIYAGRPVL

SEQ ID NO: 660855 - protein, 28 aa, Mycobacterium
FRGVGQGRLYFGIGLPELTLPPLDVPGI

SEQ ID NO: 660856 - protein, 19 aa, Mycobacterium
FRHGGGLPYSEYPRFHRLM

SEQ ID NO: 660857 - protein, 17 aa, Mycobacterium
FRHNFGVAYDRSLLFGY

SEQ ID NO: 660858 - protein, 18 aa, Mycobacterium
FRHPGIRAATIGEYPLGV

SEQ ID NO: 660859 - protein, 17 aa, Mycobacterium
FRHPLIRAAVYHSSSAA

SEQ ID NO: 660860 - protein, 24 aa, Mycobacterium
FRHRCVGFVFQFFNLLPTLSAWEN

SEQ ID NO: 660861 - protein, 25 aa, Mycobacterium
FRIEDDLYYPALRAATKLIAVAHAE

SEQ ID NO: 660862 - protein, 17 aa, Mycobacterium
FRIEGVRTNIDFLHALL

SEQ ID NO: 660863 - protein, 21 aa, Mycobacterium
FRIELEHFIRLPMTGAVTFNI

SEQ ID NO: 660864 - protein, 30 aa, Mycobacterium
FRIGDEVLCHPVPLRDQGTWAPYLIAPVGS

SEQ ID NO: 660865 - protein, 20 aa, Mycobacterium
FRIGGHSLAALRVIMRVRER

SEQ ID NO: 660866 - protein, 19 aa, Mycobacterium
FRIPELLASTGSRLREVGT

SEQ ID NO: 660867 - protein, 20 aa, Mycobacterium
FRIPGWREALMRMGVVEGTR

SEQ ID NO: 660868 - protein, 20 aa, Mycobacterium
FRIPPPGALGRHFPFDPSQV

SEQ ID NO: 660869 - protein, 21 aa, Mycobacterium
FRIQDAIWRGVYYTPGGAQPS

SEQ ID NO: 660870 - protein, 17 aa, Mycobacterium
FRITIGPGVVRLGWTSP

SEQ ID NO: 660871 - protein, 25 aa, Mycobacterium
FRIVDCPSCGGMLKPDIVYFGENVP

SEQ ID NO: 660872 - protein, 26 aa, Mycobacterium
FRIVNQLPRKLAMELLLTGEPITAAD

SEQ ID NO: 660873 - protein, 18 aa, Mycobacterium
FRKAELELSASGVEVPAA

SEQ ID NO: 660874 - protein, 19 aa, Mycobacterium
FRKCLKRQQNNFLFTPACA

SEQ ID NO: 660875 - protein, 24 aa, Mycobacterium
FRKHPRARAGLDRASGRIPLDTPL

SEQ ID NO: 660876 - protein, 19 aa, Mycobacterium
FRKLVSRGFTPRQVTAVEP

SEQ ID NO: 660877 - protein, 17 aa, Mycobacterium
FRKRAVQLISYHVDYER

SEQ ID NO: 660878 - protein, 24 aa, Mycobacterium
FRKRFPDRFFDVGIAEQHAMTSAA

SEQ ID NO: 660879 - protein, 19 aa, Mycobacterium
FRKVMRFIAVDSGQSIEEL

SEQ ID NO: 660880 - protein, 18 aa, Mycobacterium
FRLARPELEFLCTDSDPI

SEQ ID NO: 660881 - protein, 19 aa, Mycobacterium
FRLDLPPSVSWFDVDQPSV

SEQ ID NO: 660882 - protein, 21 aa, Mycobacterium
FRLDWSSPHDVGRKAIAQNAA

SEQ ID NO: 660883 - protein, 20 aa, Mycobacterium
FRLDWSTPHDVGRKAIAQNA

SEQ ID NO: 660884 - protein, 21 aa, Mycobacterium
FRLEIGGVLVSWAIPSGPSTN

SEQ ID NO: 660885 - protein, 18 aa, Mycobacterium
FRLERDGVLVSWAVPKNL

SEQ ID NO: 660886 - protein, 19 aa, Mycobacterium
FRLERDGVLVSWAVPKNLP

SEQ ID NO: 660887 - protein, 17 aa, Mycobacterium
FRLGGHWEQDYVMVRPA

SEQ ID NO: 660888 - protein, 25 aa, Mycobacterium
FRLGITTDWKSRWYADKQYADYIKE

SEQ ID NO: 660889 - protein, 20 aa, Mycobacterium
FRLGTGAARIDTAAANPFRV

SEQ ID NO: 660890 - protein, 18 aa, Mycobacterium
FRLIAAVAAALAFPAYAR

SEQ ID NO: 660891 - protein, 19 aa, Mycobacterium
FRLIDKVFSQWGIRHTPVP

SEQ ID NO: 660892 - protein, 25 aa, Mycobacterium
FRLKGKRPYTEFDISHSLRAFGWQV

SEQ ID NO: 660893 - protein, 22 aa, Mycobacterium
FRLLDGPNRYRAAVISGSPLIP

SEQ ID NO: 660894 - protein, 25 aa, Mycobacterium
FRLLPEARHALRLSGAFLADSAERK

SEQ ID NO: 660895 - protein, 25 aa, Mycobacterium
FRLLPPRTMRGLIGRICEQEGVVID

SEQ ID NO: 660896 - protein, 25 aa, Mycobacterium
FRLLQRLGADVADYGFVETSAKQDG

SEQ ID NO: 660897 - protein, 19 aa, Mycobacterium
FRLLRELADVIVVGAGTVR

SEQ ID NO: 660898 - protein, 17 aa, Mycobacterium
FRLLSQPCAIDDYSDLR

SEQ ID NO: 660899 - protein, 27 aa, Mycobacterium
FRLLTPRELGGWAAPLPTALSVYEKFG

SEQ ID NO: 660900 - protein, 31 aa, Mycobacterium
FRLMMSTGTGLRWIMQNGMWNFGLDSPAALA

SEQ ID NO: 660901 - protein, 20 aa, Mycobacterium
FRLNDDLLIEWQRDFFDFGH

SEQ ID NO: 660902 - protein, 21 aa, Mycobacterium
FRLNPGPGIEWYDIDYPDVAR

SEQ ID NO: 660903 - protein, 20 aa, Mycobacterium
FRLPAPDVPIVMVGPGTGIA

SEQ ID NO: 660904 - protein, 20 aa, Mycobacterium
FRLPEGFPTTYFEDLTQPFD

SEQ ID NO: 660905 - protein, 17 aa, Mycobacterium
FRLPENVSFEAGAGLLF

SEQ ID NO: 660906 - protein, 21 aa, Mycobacterium
FRLQIDKRKAAALNLFADAPN

SEQ ID NO: 660907 - protein, 17 aa, Mycobacterium
FRLSAYTDRLLALYAER

SEQ ID NO: 660908 - protein, 17 aa, Mycobacterium
FRLSAYTDRLLALYEEH

SEQ ID NO: 660909 - protein, 18 aa, Mycobacterium
FRLSCDPQLVFGPHRGDA

SEQ ID NO: 660910 - protein, 20 aa, Mycobacterium
FRLTEGLAAWEAQLADAPMR

SEQ ID NO: 660911 - protein, 21 aa, Mycobacterium
FRLVAAEALTLTGADGTLVAV

SEQ ID NO: 660912 - protein, 19 aa, Mycobacterium
FRLVDVGSMNRTYLNREPV

SEQ ID NO: 660913 - protein, 18 aa, Mycobacterium
FRLVEQFRYPLGERRWEF

SEQ ID NO: 660914 - protein, 18 aa, Mycobacterium
FRLVEQFRYPVGARRWEF

SEQ ID NO: 660915 - protein, 20 aa, Mycobacterium
FRMIGATGRVYLSGSESDIR

SEQ ID NO: 660916 - protein, 19 aa, Mycobacterium
FRMPRHIDTPLLILTALRD

SEQ ID NO: 660917 - protein, 18 aa, Mycobacterium
FRMRIPKPKFVLMPTPIW

SEQ ID NO: 660918 - protein, 19 aa, Mycobacterium
FRMWLDAVGITEDLQGYLD

SEQ ID NO: 660919 - protein, 26 aa, Mycobacterium
FRNARELREAVPLIPLDQLLVETDAP

SEQ ID NO: 660920 - protein, 23 aa, Mycobacterium
FRNEVQRLGRLVFGEDFEVDVDS

SEQ ID NO: 660921 - protein, 19 aa, Mycobacterium
FRNINEFWIGSADMMHRNL

SEQ ID NO: 660922 - protein, 27 aa, Mycobacterium
FRNRACKGSRSPTWRWRASHCRSPPMR

SEQ ID NO: 660923 - protein, 19 aa, Mycobacterium
FRNRVTWTVTKWDPPHEVA

SEQ ID NO: 660924 - protein, 18 aa, Mycobacterium
FRPADVVIYGTGFRATDF

SEQ ID NO: 660925 - protein, 18 aa, Mycobacterium
FRPATQLERDRYATMVMD

SEQ ID NO: 660926 - protein, 21 aa, Mycobacterium
FRPDEAFPLDRCDPDLLGHDD

SEQ ID NO: 660927 - protein, 18 aa, Mycobacterium
FRPDEVRPSLSQQQALAE

SEQ ID NO: 660928 - protein, 36 aa, Mycobacterium
FRPDIDVDLVYRFIRDTTWVSVRWYQPGGPLTAEQV

SEQ ID NO: 660929 - protein, 21 aa, Mycobacterium
FRPDLDTARIDAVFRKGAYSA

SEQ ID NO: 660930 - protein, 37 aa, Mycobacterium
FRPDLDVAVVYRFIRDATWVSVRWFRPGGSRTAQEVA

SEQ ID NO: 660931 - protein, 23 aa, Mycobacterium
FRPDLEHPTRADAEPVFYVQQAM

SEQ ID NO: 660932 - protein, 18 aa, Mycobacterium
FRPDLRVPLITIITETDL

SEQ ID NO: 660933 - protein, 19 aa, Mycobacterium
FRPDLRVPLLTLITETDLF

SEQ ID NO: 660934 - protein, 17 aa, Mycobacterium
FRPEFFAAMRELCDEFD

SEQ ID NO: 660935 - protein, 22 aa, Mycobacterium
FRPEQLAGLAATIADCLNPDGI

SEQ ID NO: 660936 - protein, 17 aa, Mycobacterium
FRPGATLVGYGHYHETY

SEQ ID NO: 660937 - protein, 29 aa, Mycobacterium
FRPGDERVASLFLWHFVEEVEHRSSALVI

SEQ ID NO: 660938 - protein, 17 aa, Mycobacterium
FRPGEYFGGSLGLHSEV

SEQ ID NO: 660939 - protein, 21 aa, Mycobacterium
FRPGGICLHAAPMFHLADLMS

SEQ ID NO: 660940 - protein, 24 aa, Mycobacterium
FRPGPGRRLGVLVDHLVAGSKEAR

SEQ ID NO: 660941 - protein, 20 aa, Mycobacterium
FRPGSSPAYHIEHLERNRPI

SEQ ID NO: 660942 - protein, 27 aa, Mycobacterium
FRPGTLEKWDLGYDVLRERNPGIILVR

SEQ ID NO: 660943 - protein, 28 aa, Mycobacterium
FRPGTLEKWDLGYDVLRQHNKGVILVRV

SEQ ID NO: 660944 - protein, 28 aa, Mycobacterium
FRPGTLEKWNLGYDVLRERNRGIILVRV

SEQ ID NO: 660945 - protein, 23 aa, Mycobacterium
FRPGTLEKWNLGYDVLSERNPGI

SEQ ID NO: 660946 - protein, 25 aa, Mycobacterium
FRPGTLERWGLGYDVLAQRNKGIIL

SEQ ID NO: 660947 - protein, 20 aa, Mycobacterium
FRPKLKAFMADLCWIENVGA

SEQ ID NO: 660948 - protein, 28 aa, Mycobacterium
FRPKVWPPVRRIDGAYGDRHLVCSCPPV

SEQ ID NO: 660949 - protein, 20 aa, Mycobacterium
FRPLKALAARMACPYANPGR

SEQ ID NO: 660950 - protein, 20 aa, Mycobacterium
FRPLPGNGLSSVAPGEGGLF

SEQ ID NO: 660951 - protein, 18 aa, Mycobacterium
FRPLRPAMTATFTRFEGG

SEQ ID NO: 660952 - protein, 31 aa, Mycobacterium
FRPNPSRLCDWCPHQAHCPAFGGTPPPYPGW

SEQ ID NO: 660953 - protein, 39 aa, Mycobacterium
FRPREYWRGPVWPVLTWLFCWAFERRGWSERAFLLRQEG

SEQ ID NO: 660954 - protein, 25 aa, Mycobacterium
FRPREYWRGPVWPVMTWLFAWCFAR

SEQ ID NO: 660955 - protein, 18 aa, Mycobacterium
FRPSCPIAGSVAVRSNPV

SEQ ID NO: 660956 - protein, 34 aa, Mycobacterium
FRPVLPRVSAFTVRDGRVLAVWDVSNPDKFSGTP

SEQ ID NO: 660957 - protein, 36 aa, Mycobacterium
FRPVNPRIAALAVIGMCNWVAWWFHEDDAASAEQVA

SEQ ID NO: 660958 - protein, 39 aa, Mycobacterium
FRQAAPFLSYGQFTGFAPRDLCALWPVPATSTPHAASPA

SEQ ID NO: 660959 - protein, 20 aa, Mycobacterium
FRQAELRPDAPAVLAGSGDL

SEQ ID NO: 660960 - protein, 30 aa, Mycobacterium
FRQDCAVSSWLYRIVVNACLDRLRRNKTRA

SEQ ID NO: 660961 - protein, 20 aa, Mycobacterium
FRQFEEWDVRIVPRDLLAPL

SEQ ID NO: 660962 - protein, 20 aa, Mycobacterium
FRQFEEWDVRIVPREQLQCL

SEQ ID NO: 660963 - protein, 21 aa, Mycobacterium
FRQFLRRRATLAINTSSTDDD

SEQ ID NO: 660964 - protein, 18 aa, Mycobacterium
FRQFSFPGGIPSHVAAET

SEQ ID NO: 660965 - protein, 19 aa, Mycobacterium
FRQLAPRPVTAAWGAAAGR

SEQ ID NO: 660966 - protein, 21 aa, Mycobacterium
FRQLWFGWSDPARVLVEYAQQ

SEQ ID NO: 660967 - protein, 18 aa, Mycobacterium
FRQQWARHDVRHEVAGGL

SEQ ID NO: 660968 - protein, 18 aa, Mycobacterium
FRQRTGIGPLEFQQQLRM

SEQ ID NO: 660969 - protein, 25 aa, Mycobacterium
FRQRYWARNHVGWRHMDDTLPNAGH

SEQ ID NO: 660970 - protein, 20 aa, Mycobacterium
FRQSFLLSYAARIGERLTAT

SEQ ID NO: 660971 - protein, 17 aa, Mycobacterium
FRQSRVFTKGPFRRFGP

SEQ ID NO: 660972 - protein, 24 aa, Mycobacterium
FRQTELFRLLLPARFGGLQASFPE

SEQ ID NO: 660973 - protein, 18 aa, Mycobacterium
FRQYGAKVQGGGILFNSV

SEQ ID NO: 660974 - protein, 32 aa, Mycobacterium
FRRADRFLPNGWCMLPPLQSCDKGNACLTCSV

SEQ ID NO: 660975 - protein, 22 aa, Mycobacterium
FRRAFAGFDFEKVAGYTEADVQ

SEQ ID NO: 660976 - protein, 20 aa, Mycobacterium
FRRAFSWLPSQFASQSDAPV

SEQ ID NO: 660977 - protein, 19 aa, Mycobacterium
FRRAFSWLPSQSDSPVGPR

SEQ ID NO: 660978 - protein, 19 aa, Mycobacterium
FRRAFSWLPTQFASQSDAP

SEQ ID NO: 660979 - protein, 21 aa, Mycobacterium
FRRARDSAPSLVFLDEVDALA

SEQ ID NO: 660980 - protein, 21 aa, Mycobacterium
FRRDSWGRGWAYAAAAALIGA

SEQ ID NO: 660981 - protein, 20 aa, Mycobacterium
FRREFGLAVDVVRGVAAGEV

SEQ ID NO: 660982 - protein, 24 aa, Mycobacterium
FRREHPGWNGAQLNAAYNKMMFER

SEQ ID NO: 660983 - protein, 17 aa, Mycobacterium
FRRESLRSVDWGGDPHN

SEQ ID NO: 660984 - protein, 17 aa, Mycobacterium
FRRFAALVRALNPLINR

SEQ ID NO: 660985 - protein, 17 aa, Mycobacterium
FRRFGMDIIAASVRHAQ

SEQ ID NO: 660986 - protein, 17 aa, Mycobacterium
FRRGGGLQYQDYPRFHA

SEQ ID NO: 660987 - protein, 17 aa, Mycobacterium
FRRGNLTYRHMLEGEPA

SEQ ID NO: 660988 - protein, 17 aa, Mycobacterium
FRRGVYVAPFWEDDFGK

SEQ ID NO: 660989 - protein, 19 aa, Mycobacterium
FRRHGMSATFMAKVDDHWA

SEQ ID NO: 660990 - protein, 24 aa, Mycobacterium
FRRIAGGDIKAVWIICTNPVASVA

SEQ ID NO: 660991 - protein, 17 aa, Mycobacterium
FRRIEESVIRQALDQQD

SEQ ID NO: 660992 - protein, 17 aa, Mycobacterium
FRRIGALGDGWLGSFLT

SEQ ID NO: 660993 - protein, 19 aa, Mycobacterium
FRRIQCTPDLLPSDIIGTQ

SEQ ID NO: 660994 - protein, 17 aa, Mycobacterium
FRRKLRMRLYGAPSACT

SEQ ID NO: 660995 - protein, 17 aa, Mycobacterium
FRRLAERPIQVHRVHGD

SEQ ID NO: 660996 - protein, 19 aa, Mycobacterium
FRRLDVADLEDWRQFTDWV

SEQ ID NO: 660997 - protein, 19 aa, Mycobacterium
FRRLGVFMGGFDLDACRKV

SEQ ID NO: 660998 - protein, 17 aa, Mycobacterium
FRRLMRADIFGAHSSII

SEQ ID NO: 660999 - protein, 19 aa, Mycobacterium
FRRLPHHHATVLGDRLRRL

SEQ ID NO: 661000 - protein, 22 aa, Mycobacterium
FRRLRSPEPWIERFERCWEVLD

SEQ ID NO: 661001 - protein, 22 aa, Mycobacterium
FRRNIWVSPFWEGCVADVVDTV

SEQ ID NO: 661002 - protein, 22 aa, Mycobacterium
FRRNIWVSPFWEGCVADVVETV

SEQ ID NO: 661003 - protein, 22 aa, Mycobacterium
FRRNIWVSPFWEGCVSDVVTTV

SEQ ID NO: 661004 - protein, 18 aa, Mycobacterium
FRRPILHGLCTYGVAGRA

SEQ ID NO: 661005 - protein, 22 aa, Mycobacterium
FRRPPEYQILPGYDLRRQYLVM

SEQ ID NO: 661006 - protein, 21 aa, Mycobacterium
FRRRAEAGLRVQDRALGSAQP

SEQ ID NO: 661007 - protein, 33 aa, Mycobacterium
FRRRARAWLADNLPRLDSGDAMVLQRDELTSWR

SEQ ID NO: 661008 - protein, 17 aa, Mycobacterium
FRRRGGGLVCALNAGRH

SEQ ID NO: 661009 - protein, 17 aa, Mycobacterium
FRRRQGILGAERAPDSG

SEQ ID NO: 661010 - protein, 19 aa, Mycobacterium
FRRRRCLRANGSNFGTNAP

SEQ ID NO: 661011 - protein, 19 aa, Mycobacterium
FRRRRLWITRPPKPLDRNG

SEQ ID NO: 661012 - protein, 17 aa, Mycobacterium
FRRRVFTPHGGIGPDQI

SEQ ID NO: 661013 - protein, 17 aa, Mycobacterium
FRRSHLEALTTQRMVAG

SEQ ID NO: 661014 - protein, 18 aa, Mycobacterium
FRRSHLEALTTQRTLARL

SEQ ID NO: 661015 - protein, 18 aa, Mycobacterium
FRRTSLWHSTFRHCSFLG

SEQ ID NO: 661016 - protein, 18 aa, Mycobacterium
FRRTTALGRISDPVWSSV

SEQ ID NO: 661017 - protein, 17 aa, Mycobacterium
FRRVEVHEAPRFRGSEV

SEQ ID NO: 661018 - protein, 22 aa, Mycobacterium
FRRYCAPDVKWINTGIPSVEGL

SEQ ID NO: 661019 - protein, 18 aa, Mycobacterium
FRRYGTDDLVWWNSGRGA

SEQ ID NO: 661020 - protein, 21 aa, Mycobacterium
FRRYVEHWTMGPGTVIEGDGA

SEQ ID NO: 661021 - protein, 24 aa, Mycobacterium
FRRYVGVPVKWVLCRYRLQQAALE

SEQ ID NO: 661022 - protein, 17 aa, Mycobacterium
FRSAAAFATEASPDGYI

SEQ ID NO: 661023 - protein, 17 aa, Mycobacterium
FRSALLERWRGELVEVV

SEQ ID NO: 661024 - protein, 19 aa, Mycobacterium
FRSARRLEVAADVPAGDAV

SEQ ID NO: 661025 - protein, 34 aa, Mycobacterium
FRSCRECDSCGRGEYRRCSSNGLATMFGFVDVNI

SEQ ID NO: 661026 - protein, 22 aa, Mycobacterium
FRSDALQIIAFGRYARTVSAAE

SEQ ID NO: 661027 - protein, 17 aa, Mycobacterium
FRSEKNTNWEGAFRIPE

SEQ ID NO: 661028 - protein, 17 aa, Mycobacterium
FRSEVDWDYLTEPQPEL

SEQ ID NO: 661029 - protein, 19 aa, Mycobacterium
FRSGGAWLDALLQGLEDNR

SEQ ID NO: 661030 - protein, 23 aa, Mycobacterium
FRSGRPLLTETFRRPIPAFTDVG

SEQ ID NO: 661031 - protein, 17 aa, Mycobacterium
FRSHGRHAVHLPAIKTF

SEQ ID NO: 661032 - protein, 18 aa, Mycobacterium
FRSIMFERLIPNLEYIGL

SEQ ID NO: 661033 - protein, 27 aa, Mycobacterium
FRSKESCVEPLLARSAERFIEVLRRWP

SEQ ID NO: 661034 - protein, 17 aa, Mycobacterium
FRSLRMWESQAPTPPPE

SEQ ID NO: 661035 - protein, 17 aa, Mycobacterium
FRSMYFPGVLATVQGDT

SEQ ID NO: 661036 - protein, 21 aa, Mycobacterium
FRSRCRDISSAFGGGEYVHYA

SEQ ID NO: 661037 - protein, 21 aa, Mycobacterium
FRSRCRDMAAAFGGAARVHYA

SEQ ID NO: 661038 - protein, 20 aa, Mycobacterium
FRSSCTNGKCVATIVSGPPP

SEQ ID NO: 661039 - protein, 25 aa, Mycobacterium
FRSVIPYLAGQAWLTMDFLGFGLSD

SEQ ID NO: 661040 - protein, 20 aa, Mycobacterium
FRTAEGTKLFLAVTNSPVAF

SEQ ID NO: 661041 - protein, 20 aa, Mycobacterium
FRTAEGTKLFLAVTSSPVAF

SEQ ID NO: 661042 - protein, 19 aa, Mycobacterium
FRTAEQRERACAREVELNS

SEQ ID NO: 661043 - protein, 17 aa, Mycobacterium
FRTAGERGLSILTNLVG

SEQ ID NO: 661044 - protein, 30 aa, Mycobacterium
FRTDIMPISIGFPFGLSVVAPVNMPLPTKI

SEQ ID NO: 661045 - protein, 22 aa, Mycobacterium
FRTFDFLGIRNWTAGKPIIVVM

SEQ ID NO: 661046 - protein, 19 aa, Mycobacterium
FRTGEHYRSLMVSSIKTML

SEQ ID NO: 661047 - protein, 19 aa, Mycobacterium
FRTGGYVIDFWGVGYQVAK

SEQ ID NO: 661048 - protein, 19 aa, Mycobacterium
FRTIHGYQRAYRIAGDGPA

SEQ ID NO: 661049 - protein, 20 aa, Mycobacterium
FRTIHGYRRAYRIAGSGPAI

SEQ ID NO: 661050 - protein, 20 aa, Mycobacterium
FRTLCRDFGSMRGDPLRPAS

SEQ ID NO: 661051 - protein, 19 aa, Mycobacterium
FRTLFPRRSKGLAGALDFA

SEQ ID NO: 661052 - protein, 25 aa, Mycobacterium
FRTLRASLHVRRWPPGNHMHSTMYV

SEQ ID NO: 661053 - protein, 21 aa, Mycobacterium
FRTNVIAPFLLTGALAPAMAE

SEQ ID NO: 661054 - protein, 19 aa, Mycobacterium
FRTRCWKATDICAQTTPPH

SEQ ID NO: 661055 - protein, 17 aa, Mycobacterium
FRTSGGWVVVPAGAMSQ

SEQ ID NO: 661056 - protein, 24 aa, Mycobacterium
FRTSPHLPMSWQRKLFQMMQPLMS

SEQ ID NO: 661057 - protein, 18 aa, Mycobacterium
FRTVALIINRTELVDDEA

SEQ ID NO: 661058 - protein, 29 aa, Mycobacterium
FRTVLYTTLEVVRIASLLLQPVMPESTAK

SEQ ID NO: 661059 - protein, 29 aa, Mycobacterium
FRVAIGLTETHTWWRVDWNTLVDATVPIA

SEQ ID NO: 661060 - protein, 17 aa, Mycobacterium
FRVAILTGAGRGFCAGA

SEQ ID NO: 661061 - protein, 20 aa, Mycobacterium
FRVAYIDTVADFGFYTEVVD

SEQ ID NO: 661062 - protein, 24 aa, Mycobacterium
FRVDAVPFLFARDGAPGDPGVFDP

SEQ ID NO: 661063 - protein, 20 aa, Mycobacterium
FRVEGWGDPIHTWRHGLVAK

SEQ ID NO: 661064 - protein, 20 aa, Mycobacterium
FRVGNLLFLMLSDRNEPTQT

SEQ ID NO: 661065 - protein, 19 aa, Mycobacterium
FRVGVLPTLRAVRAIAGYS

SEQ ID NO: 661066 - protein, 19 aa, Mycobacterium
FRVGVLPTLRAVRAIAGYT

SEQ ID NO: 661067 - protein, 18 aa, Mycobacterium
FRVLLELPGGVAGTAVEE

SEQ ID NO: 661068 - protein, 32 aa, Mycobacterium
FRVLPWADRTGWVLSEMYYRSGERVPFDTRGV

SEQ ID NO: 661069 - protein, 18 aa, Mycobacterium
FRVLRPGGRLHLVDMGGD

SEQ ID NO: 661070 - protein, 18 aa, Mycobacterium
FRVLRPGGRLHLVDVGGD

SEQ ID NO: 661071 - protein, 17 aa, Mycobacterium
FRVMTRLLRAVGQASGL

SEQ ID NO: 661072 - protein, 27 aa, Mycobacterium
FRVPAWSEFVEVHWSRRGEAYVTPVEP

SEQ ID NO: 661073 - protein, 20 aa, Mycobacterium
FRVPCLPSDRLLNLLHYVKW

SEQ ID NO: 661074 - protein, 17 aa, Mycobacterium
FRVRMTAYFIFDDAETL

SEQ ID NO: 661075 - protein, 20 aa, Mycobacterium
FRVSRSGWYGIDQVAGDLVT

SEQ ID NO: 661076 - protein, 19 aa, Mycobacterium
FRVTALRTAANTALIADTC

SEQ ID NO: 661077 - protein, 18 aa, Mycobacterium
FRVVAGRITEVWNCGYQQ

SEQ ID NO: 661078 - protein, 22 aa, Mycobacterium
FRVVLEELFRGTAHIAPDPDRA

SEQ ID NO: 661079 - protein, 17 aa, Mycobacterium
FRVVLGADRPDTRVGAL

SEQ ID NO: 661080 - protein, 21 aa, Mycobacterium
FRVVLRHELFHAAARTVTGDH

SEQ ID NO: 661081 - protein, 26 aa, Mycobacterium
FRWTNSYYDDMAWLALALERAARVAG

SEQ ID NO: 661082 - protein, 18 aa, Mycobacterium
FRYGLKASLNGYLGAHPR

SEQ ID NO: 661083 - protein, 26 aa, Mycobacterium
FRYLDCPRCGGMLKPDIVYFGESVAK

SEQ ID NO: 661084 - protein, 19 aa, Mycobacterium
FRYLDCVRCAGMLKPDIVY

SEQ ID NO: 661085 - protein, 24 aa, Mycobacterium
FRYNEVIHYWALEGGWECFANHYP

SEQ ID NO: 661086 - protein, 19 aa, Mycobacterium
FRYNMVGAYDAVVEVGDAW

SEQ ID NO: 661087 - protein, 17 aa, Mycobacterium
FRYNTIITEETTAGRYS

SEQ ID NO: 661088 - protein, 17 aa, Mycobacterium
FRYNTIITEETTFGRYS

SEQ ID NO: 661089 - protein, 17 aa, Mycobacterium
FRYNTIITEEVTKGRHT

SEQ ID NO: 661090 - protein, 21 aa, Mycobacterium
FRYPHDHGWESVTWEQVGERV

SEQ ID NO: 661091 - protein, 18 aa, Mycobacterium
FRYQDRIFTVPVVSLPIV

SEQ ID NO: 661092 - protein, 19 aa, Mycobacterium
FRYQRRVMQLLQWGEPERP

SEQ ID NO: 661093 - protein, 17 aa, Mycobacterium
FRYRGHDSAMTMSVALA

SEQ ID NO: 661094 - protein, 28 aa, Mycobacterium
FRYYPSKSALPWGDFDAHLDHMRALLAD

SEQ ID NO: 661095 - protein, 23 aa, Mycobacterium
FSAAAARLGNRLSLHDQPNLGGS

SEQ ID NO: 661096 - protein, 24 aa, Mycobacterium
FSAANGMAVLGVWQPGAPAAVLVG

SEQ ID NO: 661097 - protein, 17 aa, Mycobacterium
FSAASFERGETPIRLAY

SEQ ID NO: 661098 - protein, 25 aa, Mycobacterium
FSAATCFPNLSFVHNWPKLPGSDSE

SEQ ID NO: 661099 - protein, 20 aa, Mycobacterium
FSADWYGRVLHFGIREHAMG

SEQ ID NO: 661100 - protein, 26 aa, Mycobacterium
FSAFPRPENYPSLPTVSFVIPNADND

SEQ ID NO: 661101 - protein, 22 aa, Mycobacterium
FSAGGPVLWPDLEAILVVPNNA

SEQ ID NO: 661102 - protein, 20 aa, Mycobacterium
FSALLPRLESIEVDGNIERT

SEQ ID NO: 661103 - protein, 24 aa, Mycobacterium
FSANEFLLYEALGLCGEGEAGKLI

SEQ ID NO: 661104 - protein, 17 aa, Mycobacterium
FSAPVVCAFGMTEATHQ

SEQ ID NO: 661105 - protein, 21 aa, Mycobacterium
FSAQEPWVLAKSFQTDGSAAD

SEQ ID NO: 661106 - protein, 23 aa, Mycobacterium
FSARVCGGDVAIAVTGADTDPAV

SEQ ID NO: 661107 - protein, 20 aa, Mycobacterium
FSASAIWRIRRAAPLLPTVL

SEQ ID NO: 661108 - protein, 18 aa, Mycobacterium
FSAVAARVAAVVSAGDVV

SEQ ID NO: 661109 - protein, 35 aa, Mycobacterium
FSAVRRRIWELEIGRAHTPWFHWGTTAMAAHTVEK

SEQ ID NO: 661110 - protein, 24 aa, Mycobacterium
FSAVTSGLAGQAWQGAASAAMTAA

SEQ ID NO: 661111 - protein, 28 aa, Mycobacterium
FSAWAVRLLSRLPQRAVVALATNVPGPR

SEQ ID NO: 661112 - protein, 17 aa, Mycobacterium
FSAWSLRSGDDATLRLL

SEQ ID NO: 661113 - protein, 23 aa, Mycobacterium
FSDALGVPVANTFHGKGVMPDDH

SEQ ID NO: 661114 - protein, 22 aa, Mycobacterium
FSDCLRAELAHAGIGVTTLCPG

SEQ ID NO: 661115 - protein, 23 aa, Mycobacterium
FSDEFRIQLAWMRQSPPDTPNPG

SEQ ID NO: 661116 - protein, 23 aa, Mycobacterium
FSDELAMTFPQWRTQVRLQHALV

SEQ ID NO: 661117 - protein, 17 aa, Mycobacterium
FSDELQQEWTWTEKYAT

SEQ ID NO: 661118 - protein, 17 aa, Mycobacterium
FSDELQQEWTWTERYAT

SEQ ID NO: 661119 - protein, 27 aa, Mycobacterium
FSDFTELSRWVGRHISETGGFSLERIE

SEQ ID NO: 661120 - protein, 20 aa, Mycobacterium
FSDGLNTLAQFKVKRLDRQT

SEQ ID NO: 661121 - protein, 24 aa, Mycobacterium
FSDGRIAARVCMWVNRFHEETTVT

SEQ ID NO: 661122 - protein, 17 aa, Mycobacterium
FSDHPEWVLPTDWTVAP

SEQ ID NO: 661123 - protein, 26 aa, Mycobacterium
FSDMFGSDFFSAWGKLGAVRTPTIAA

SEQ ID NO: 661124 - protein, 24 aa, Mycobacterium
FSDNLCLRDQLAALQWVRDNIAAF

SEQ ID NO: 661125 - protein, 27 aa, Mycobacterium
FSDPETYRPGAILGRNGFDLASYYGEN

SEQ ID NO: 661126 - protein, 18 aa, Mycobacterium
FSDPGVWLRLQQVDAGHL

SEQ ID NO: 661127 - protein, 18 aa, Mycobacterium
FSDPLVFGTAGLRGPVRG

SEQ ID NO: 661128 - protein, 25 aa, Mycobacterium
FSDPTGPCLEGWVTLTALAQATQRL

SEQ ID NO: 661129 - protein, 25 aa, Mycobacterium
FSDPTGPCLEGWVTLTALAQATTRL

SEQ ID NO: 661130 - protein, 18 aa, Mycobacterium
FSDQVWLVELSELRDGDM

SEQ ID NO: 661131 - protein, 18 aa, Mycobacterium
FSDRHCVALFAPAAAAVP

SEQ ID NO: 661132 - protein, 31 aa, Mycobacterium
FSDRTWWPGISEAITDCWLVTVGGEAVVADD

SEQ ID NO: 661133 - protein, 24 aa, Mycobacterium
FSDSAGPCLEGWTTLTALAQATER

SEQ ID NO: 661134 - protein, 21 aa, Mycobacterium
FSDTAFRIFVLMATRRLEADR

SEQ ID NO: 661135 - protein, 21 aa, Mycobacterium
FSDTAFRIFVLMATRRLKSDR

SEQ ID NO: 661136 - protein, 20 aa, Mycobacterium
FSDTRIADVAKRAGVSSALV

SEQ ID NO: 661137 - protein, 24 aa, Mycobacterium
FSDVDFRPGDVLMFGPEPTGLDAA

SEQ ID NO: 661138 - protein, 17 aa, Mycobacterium
FSDVRVRPHDSGLVTLR

SEQ ID NO: 661139 - protein, 17 aa, Mycobacterium
FSDVVAVRLGMPGVEYY

SEQ ID NO: 661140 - protein, 17 aa, Mycobacterium
FSEAPLVLMEFVDGLVV

SEQ ID NO: 661141 - protein, 18 aa, Mycobacterium
FSECGAGLVVDEVDADLL

SEQ ID NO: 661142 - protein, 18 aa, Mycobacterium
FSECGAGLVVDEVDADLM

SEQ ID NO: 661143 - protein, 26 aa, Mycobacterium
FSEDDLRGKFARMVCGTAEAITAELR

SEQ ID NO: 661144 - protein, 23 aa, Mycobacterium
FSEDPRRGAAILNRPDLVILRGR

SEQ ID NO: 661145 - protein, 19 aa, Mycobacterium
FSEELGLSVPAGHRLDLGQ

SEQ ID NO: 661146 - protein, 24 aa, Mycobacterium
FSEELGVPVANTFHGKGAMPDDHP

SEQ ID NO: 661147 - protein, 17 aa, Mycobacterium
FSEGELFIIGRIKDLLI

SEQ ID NO: 661148 - protein, 18 aa, Mycobacterium
FSEGGCWRNFLTCNANLA

SEQ ID NO: 661149 - protein, 17 aa, Mycobacterium
FSEHGPLGARVDRVASR

SEQ ID NO: 661150 - protein, 20 aa, Mycobacterium
FSEHSGHLLAGTALSVISGR

SEQ ID NO: 661151 - protein, 17 aa, Mycobacterium
FSEIVAYLAALGDALAL

SEQ ID NO: 661152 - protein, 24 aa, Mycobacterium
FSEKVDVVCGIGWDNVDADNPAFR

SEQ ID NO: 661153 - protein, 18 aa, Mycobacterium
FSEMFKFELKSLPFILGA

SEQ ID NO: 661154 - protein, 20 aa, Mycobacterium
FSEPCADCRGTGSIIENPCT

SEQ ID NO: 661155 - protein, 24 aa, Mycobacterium
FSEPCTDCRGSGSIIEHPCEECKG

SEQ ID NO: 661156 - protein, 22 aa, Mycobacterium
FSEPGACAPAWSDVSALLAAAE

SEQ ID NO: 661157 - protein, 19 aa, Mycobacterium
FSESFSYSSAAEVFEEIKR

SEQ ID NO: 661158 - protein, 24 aa, Mycobacterium
FSESMCQAVHDFRIFVNYLRGTGV

SEQ ID NO: 661159 - protein, 28 aa, Mycobacterium
FSETEAALFRGACAAAALAISNATLYRV

SEQ ID NO: 661160 - protein, 17 aa, Mycobacterium
FSETGAIKAKSVIIAAG

SEQ ID NO: 661161 - protein, 17 aa, Mycobacterium
FSETSFRVFQAPYVGAV

SEQ ID NO: 661162 - protein, 25 aa, Mycobacterium
FSEVPRLAAIGARAAELCGLGPHRF

SEQ ID NO: 661163 - protein, 20 aa, Mycobacterium
FSFACANIFSGVSLLGALCS

SEQ ID NO: 661164 - protein, 20 aa, Mycobacterium
FSFAPNASWTRTYARQPEIL

SEQ ID NO: 661165 - protein, 22 aa, Mycobacterium
FSFDNAMCYPKPVGRLPIHIGG

SEQ ID NO: 661166 - protein, 21 aa, Mycobacterium
FSFEKRSSWSRTYAHGNELKD

SEQ ID NO: 661167 - protein, 24 aa, Mycobacterium
FSFEPKADWSHMWSFQPEIQEYLL

SEQ ID NO: 661168 - protein, 19 aa, Mycobacterium
FSFLPRFGPGKGLGVIPRE

SEQ ID NO: 661169 - protein, 18 aa, Mycobacterium
FSFLRLLLPAGVETTYRS

SEQ ID NO: 661170 - protein, 23 aa, Mycobacterium
FSFNHCPELGWLRDELSLPLEQW

SEQ ID NO: 661171 - protein, 35 aa, Mycobacterium
FSFNVADGRCPTCQGEGFVSVELLFLPGTYATCPA

SEQ ID NO: 661172 - protein, 20 aa, Mycobacterium
FSFSGLKTAVARYVEAHPEA

SEQ ID NO: 661173 - protein, 19 aa, Mycobacterium
FSFSGLKTAVARYVESHPE

SEQ ID NO: 661174 - protein, 26 aa, Mycobacterium
FSGACAGCGETPYLKLLSQLFGDRLM

SEQ ID NO: 661175 - protein, 27 aa, Mycobacterium
FSGALPVPLVYSLGGFNFGTEGAGFTL

SEQ ID NO: 661176 - protein, 27 aa, Mycobacterium
FSGAPAVAAGIPWTLVDGTDRAHPELL

SEQ ID NO: 661177 - protein, 23 aa, Mycobacterium
FSGARYMGEMDWDEPLEPDGHAA

SEQ ID NO: 661178 - protein, 19 aa, Mycobacterium
FSGAWPYLRVLSRLTGIAD

SEQ ID NO: 661179 - protein, 19 aa, Mycobacterium
FSGEPLLADVCRVARDAGA

SEQ ID NO: 661180 - protein, 20 aa, Mycobacterium
FSGEVGVCLATSGPGAIHLL

SEQ ID NO: 661181 - protein, 17 aa, Mycobacterium
FSGGHEWLADNGVSVTL

SEQ ID NO: 661182 - protein, 26 aa, Mycobacterium
FSGGMRQRLLIAMAVALNPTVLIADE

SEQ ID NO: 661183 - protein, 20 aa, Mycobacterium
FSGGRGRPSVIANRLTFDRE

SEQ ID NO: 661184 - protein, 20 aa, Mycobacterium
FSGGVFACAALAEYELTGSR

SEQ ID NO: 661185 - protein, 26 aa, Mycobacterium
FSGGYDFGGGFVHWGDAMMTDGRWDP

SEQ ID NO: 661186 - protein, 22 aa, Mycobacterium
FSGHGFKFVPVVGEILADLAIS

SEQ ID NO: 661187 - protein, 20 aa, Mycobacterium
FSGHGFKFVPVVGEILADLV

SEQ ID NO: 661188 - protein, 26 aa, Mycobacterium
FSGHGFKIAPAVGRLVADLVVDGHGS

SEQ ID NO: 661189 - protein, 27 aa, Mycobacterium
FSGHGFKIAPAVGRLVADLVVDGHSSD

SEQ ID NO: 661190 - protein, 25 aa, Mycobacterium
FSGHLPTGFAFIPGHEIIGVIEGIG

SEQ ID NO: 661191 - protein, 22 aa, Mycobacterium
FSGHPPWGIGRPQPQIADLIRQ

SEQ ID NO: 661192 - protein, 23 aa, Mycobacterium
FSGKADILAAGFRRAADRLSADM

SEQ ID NO: 661193 - protein, 17 aa, Mycobacterium
FSGKAGRQLAKDYVAFP

SEQ ID NO: 661194 - protein, 17 aa, Mycobacterium
FSGKAQIGKGMWAMTEL

SEQ ID NO: 661195 - protein, 17 aa, Mycobacterium
FSGKILAPAHLPQEQSQ

SEQ ID NO: 661196 - protein, 17 aa, Mycobacterium
FSGLGMAIELQRRGVDF

SEQ ID NO: 661197 - protein, 19 aa, Mycobacterium
FSGLIERFGTGKGCDICKP

SEQ ID NO: 661198 - protein, 25 aa, Mycobacterium
FSGPLPLPPSKHVAVVACMDARLDV

SEQ ID NO: 661199 - protein, 26 aa, Mycobacterium
FSGPLPLPPSKHVAVVACMDARLDVY

SEQ ID NO: 661200 - protein, 17 aa, Mycobacterium
FSGQAHGGAGGDGSQGG

SEQ ID NO: 661201 - protein, 21 aa, Mycobacterium
FSGRPARSISNAFQRDMEAVA

SEQ ID NO: 661202 - protein, 18 aa, Mycobacterium
FSGRVSDSGEGRWTAIAA

SEQ ID NO: 661203 - protein, 18 aa, Mycobacterium
FSGRVSDSGEGRWTSIAA

SEQ ID NO: 661204 - protein, 18 aa, Mycobacterium
FSGTYPYWGFQKATSEDL

SEQ ID NO: 661205 - protein, 26 aa, Mycobacterium
FSGVDPRWEWDIGLLNLRRRMEEDFL

SEQ ID NO: 661206 - protein, 19 aa, Mycobacterium
FSGVVWRAAGPGATESTTE

SEQ ID NO: 661207 - protein, 19 aa, Mycobacterium
FSGVVWRSTAPNGKESSAD

SEQ ID NO: 661208 - protein, 23 aa, Mycobacterium
FSGWRSTRQRVWGQMDAARCGPI

SEQ ID NO: 661209 - protein, 20 aa, Mycobacterium
FSGWRSTRQRVWGQMDDGRC

SEQ ID NO: 661210 - protein, 17 aa, Mycobacterium
FSHEPNQGFLRCVAALA

SEQ ID NO: 661211 - protein, 30 aa, Mycobacterium
FSHFGHGILTWHVPMLFRTPPGYNLLVRGP

SEQ ID NO: 661212 - protein, 17 aa, Mycobacterium
FSHPGIATAVPRYFHSS

SEQ ID NO: 661213 - protein, 17 aa, Mycobacterium
FSHPLTFGTAGLRGPLR

SEQ ID NO: 661214 - protein, 17 aa, Mycobacterium
FSHPMFGEAVRRRVGTA

SEQ ID NO: 661215 - protein, 20 aa, Mycobacterium
FSIAALRAEPVDRYGVGTSL

SEQ ID NO: 661216 - protein, 24 aa, Mycobacterium
FSIAAQGCTYWNGEAMQGTDYTDL

SEQ ID NO: 661217 - protein, 27 aa, Mycobacterium
FSIEPGIYFPGRWGARIEDIVVVTKDG

SEQ ID NO: 661218 - protein, 28 aa, Mycobacterium
FSIEPGIYVPGRWGARIEDIVVVTEDGA

SEQ ID NO: 661219 - protein, 26 aa, Mycobacterium
FSIEPRPDQTFEFTVDVPGQVDIELH

SEQ ID NO: 661220 - protein, 17 aa, Mycobacterium
FSIPRDDWVPAEGIPGY

SEQ ID NO: 661221 - protein, 25 aa, Mycobacterium
FSISGAPIATLWVSVNGGAPVAVPS

SEQ ID NO: 661222 - protein, 23 aa, Mycobacterium
FSITGRAALPFTGSMRVSADLAL

SEQ ID NO: 661223 - protein, 24 aa, Mycobacterium
FSKAYGLAGLRIGYGLAAAELAAA

SEQ ID NO: 661224 - protein, 24 aa, Mycobacterium
FSKIVAPGLRVGWVDTDPELQPLL

SEQ ID NO: 661225 - protein, 21 aa, Mycobacterium
FSKKRRRGLAFGEAAGGVTYF

SEQ ID NO: 661226 - protein, 19 aa, Mycobacterium
FSKLFRSEVDWDYLTEPQP

SEQ ID NO: 661227 - protein, 25 aa, Mycobacterium
FSKLNPRIPRIWNVISLPVEMALTS

SEQ ID NO: 661228 - protein, 22 aa, Mycobacterium
FSKVRWRASTIGGLPILYEDAH

SEQ ID NO: 661229 - protein, 18 aa, Mycobacterium
FSKYFGAAGFVPLSNATD

SEQ ID NO: 661230 - protein, 18 aa, Mycobacterium
FSKYFGAAGFVPLSNTVE

SEQ ID NO: 661231 - protein, 25 aa, Mycobacterium
FSLADPPAVCDFVRRLAADLHDAAA

SEQ ID NO: 661232 - protein, 21 aa, Mycobacterium
FSLAEICRGLGISRATGHAIL

SEQ ID NO: 661233 - protein, 19 aa, Mycobacterium
FSLAGEFLVHGRIVYAAGP

SEQ ID NO: 661234 - protein, 20 aa, Mycobacterium
FSLALLLATERLKVIAAVHP

SEQ ID NO: 661235 - protein, 25 aa, Mycobacterium
FSLASGRIAYALGVHGPAITVDTAC

SEQ ID NO: 661236 - protein, 26 aa, Mycobacterium
FSLASGRIAYALGVHGPALTVDTACS

SEQ ID NO: 661237 - protein, 18 aa, Mycobacterium
FSLCAKAIQALTRISPRS

SEQ ID NO: 661238 - protein, 23 aa, Mycobacterium
FSLEAPEGMRFLSRGRVFTGEEQ

SEQ ID NO: 661239 - protein, 20 aa, Mycobacterium
FSLEARAMRDWTAGLAGSRY

SEQ ID NO: 661240 - protein, 25 aa, Mycobacterium
FSLGDSRFPPAPAHSASRTTASVGS

SEQ ID NO: 661241 - protein, 19 aa, Mycobacterium
FSLGPALAVVAARTDTARP

SEQ ID NO: 661242 - protein, 17 aa, Mycobacterium
FSLKMIPLRVKQMRLHR

SEQ ID NO: 661243 - protein, 18 aa, Mycobacterium
FSLLRTALVSGTRGARLF

SEQ ID NO: 661244 - protein, 18 aa, Mycobacterium
FSLLTGWGRDRPIPPGPI

SEQ ID NO: 661245 - protein, 24 aa, Mycobacterium
FSLLVSHVLVPPAIAAIMESPTCR

SEQ ID NO: 661246 - protein, 18 aa, Mycobacterium
FSLPSLRRGRDVAAAEIL

SEQ ID NO: 661247 - protein, 17 aa, Mycobacterium
FSLVGFARRDWETQDFR

SEQ ID NO: 661248 - protein, 17 aa, Mycobacterium
FSLWATRTLLSGRGDEL

SEQ ID NO: 661249 - protein, 20 aa, Mycobacterium
FSLWNLPGSEHYQFVANMAT

SEQ ID NO: 661250 - protein, 17 aa, Mycobacterium
FSMAGYSAFLAHNAASI

SEQ ID NO: 661251 - protein, 25 aa, Mycobacterium
FSMASGRISYALGLRGPAVSLDTAC

SEQ ID NO: 661252 - protein, 26 aa, Mycobacterium
FSMASGRVSYALGLRGPAMTVDTACS

SEQ ID NO: 661253 - protein, 19 aa, Mycobacterium
FSMDSAWRGVLPPEKGFVY

SEQ ID NO: 661254 - protein, 19 aa, Mycobacterium
FSNATLWPLYHDVIVKPEY

SEQ ID NO: 661255 - protein, 18 aa, Mycobacterium
FSNEGGRFLSGFENIGQL

SEQ ID NO: 661256 - protein, 24 aa, Mycobacterium
FSNIGVGMSGFFNTAAGGTTNHNI

SEQ ID NO: 661257 - protein, 24 aa, Mycobacterium
FSNIVCLGGPFPPLPFEPEGDDIS

SEQ ID NO: 661258 - protein, 18 aa, Mycobacterium
FSNLIVSGDQAWKTIDDY

SEQ ID NO: 661259 - protein, 23 aa, Mycobacterium
FSNMALSGLAGRAMVPTGGTAAR

SEQ ID NO: 661260 - protein, 17 aa, Mycobacterium
FSNREYNHYPLAVQATP

SEQ ID NO: 661261 - protein, 21 aa, Mycobacterium
FSNRLGVCAATSGPGAIHLLN

SEQ ID NO: 661262 - protein, 24 aa, Mycobacterium
FSPDAVGLWTFRVDGWSDPIATWR

SEQ ID NO: 661263 - protein, 17 aa, Mycobacterium
FSPDPSIRREDFYLCAG

SEQ ID NO: 661264 - protein, 32 aa, Mycobacterium
FSPDSGSTWLLPRLVGLARARRMLLLGEQVTA

SEQ ID NO: 661265 - protein, 18 aa, Mycobacterium
FSPELTRPFEPPPTFMNH

SEQ ID NO: 661266 - protein, 19 aa, Mycobacterium
FSPEVQLILCAGEPDTPEI

SEQ ID NO: 661267 - protein, 18 aa, Mycobacterium
FSPFFNALPIRRLGLHEQ

SEQ ID NO: 661268 - protein, 17 aa, Mycobacterium
FSPFSGYGYFANGLAGF

SEQ ID NO: 661269 - protein, 18 aa, Mycobacterium
FSPGSAERFRESAIEMTN

SEQ ID NO: 661270 - protein, 20 aa, Mycobacterium
FSPLRHWNAGPGKRIAVIGL

SEQ ID NO: 661271 - protein, 20 aa, Mycobacterium
FSPLRHWNAGPGKRVAVVGL

SEQ ID NO: 661272 - protein, 19 aa, Mycobacterium
FSPLVAKLVAELGFDGVYV

SEQ ID NO: 661273 - protein, 24 aa, Mycobacterium
FSPMDIESVHRWDAYTEAKEAMFD

SEQ ID NO: 661274 - protein, 24 aa, Mycobacterium
FSPPGGRVLLVWDAPNLDMGLGSI

SEQ ID NO: 661275 - protein, 23 aa, Mycobacterium
FSPPGVTCRRAELRGQITQLPLG

SEQ ID NO: 661276 - protein, 17 aa, Mycobacterium
FSPPPPMPAACCSTSPR

SEQ ID NO: 661277 - protein, 17 aa, Mycobacterium
FSPPSGHPAEMPAPSGG

SEQ ID NO: 661278 - protein, 18 aa, Mycobacterium
FSPQGWSMHPSLSMFLSR

SEQ ID NO: 661279 - protein, 17 aa, Mycobacterium
FSPRLRADIVLNNLVGH

SEQ ID NO: 661280 - protein, 25 aa, Mycobacterium
FSPSGPRLAGKLGAGLLSLSASIPG

SEQ ID NO: 661281 - protein, 19 aa, Mycobacterium
FSPTGPRGAGRHGIGMLSI

SEQ ID NO: 661282 - protein, 22 aa, Mycobacterium
FSPTRRRLAAAMGAHVTLDPAQ

SEQ ID NO: 661283 - protein, 18 aa, Mycobacterium
FSPVSLGPVTLRNRVIKA

SEQ ID NO: 661284 - protein, 17 aa, Mycobacterium
FSPWYVVESDIKKHARL

SEQ ID NO: 661285 - protein, 26 aa, Mycobacterium
FSQAKTRWSGCANRSLTVTSPGHAPV

SEQ ID NO: 661286 - protein, 19 aa, Mycobacterium
FSQDGWSFLIDAFFHRGLM

SEQ ID NO: 661287 - protein, 21 aa, Mycobacterium
FSQFKRSALPNGPKVSHGGAL

SEQ ID NO: 661288 - protein, 17 aa, Mycobacterium
FSQFKRSAMPNGPKVSH

SEQ ID NO: 661289 - protein, 21 aa, Mycobacterium
FSQIETLVFMAFFERSHAVFC

SEQ ID NO: 661290 - protein, 18 aa, Mycobacterium
FSQIGAGFKSMFGGELQG

SEQ ID NO: 661291 - protein, 18 aa, Mycobacterium
FSQKGWHPVIGPFFNRGL

SEQ ID NO: 661292 - protein, 24 aa, Mycobacterium
FSQMGLSSLLGRAVASSATHSVGA

SEQ ID NO: 661293 - protein, 18 aa, Mycobacterium
FSQRAWDPVIGPFFEGGL

SEQ ID NO: 661294 - protein, 19 aa, Mycobacterium
FSQRGWHPVIGPFFNRGLM

SEQ ID NO: 661295 - protein, 23 aa, Mycobacterium
FSRAEAGSGWSLHAEGVLRAGSV

SEQ ID NO: 661296 - protein, 25 aa, Mycobacterium
FSRCSDCGRIYWAGSHHARLAGLVQ

SEQ ID NO: 661297 - protein, 23 aa, Mycobacterium
FSRDPWRVRCLEIRGTAEQVMTS

SEQ ID NO: 661298 - protein, 19 aa, Mycobacterium
FSREDRARADAAYEAALEA

SEQ ID NO: 661299 - protein, 21 aa, Mycobacterium
FSRFRRAVTDTGLYKDSDRLA

SEQ ID NO: 661300 - protein, 20 aa, Mycobacterium
FSRGAFCARGLAGLLNSVGM

SEQ ID NO: 661301 - protein, 20 aa, Mycobacterium
FSRGGLMVHDVFDHTSQLKL

SEQ ID NO: 661302 - protein, 24 aa, Mycobacterium
FSRGGSLKSSWYGDCLPERDFPTL

SEQ ID NO: 661303 - protein, 25 aa, Mycobacterium
FSRGGSLKSSWYGDCLPERDFPTLI

SEQ ID NO: 661304 - protein, 17 aa, Mycobacterium
FSRMYQEMINFCKTHGQ

SEQ ID NO: 661305 - protein, 18 aa, Mycobacterium
FSRNLKLLAKELEVPVIA

SEQ ID NO: 661306 - protein, 28 aa, Mycobacterium
FSRNWNVDVAQAFHWTRHALRRPLAPGG

SEQ ID NO: 661307 - protein, 26 aa, Mycobacterium
FSRPARGRPVAAWSLAADEAVVTALG

SEQ ID NO: 661308 - protein, 22 aa, Mycobacterium
FSRPLNHPLVWSITQAAASEIG

SEQ ID NO: 661309 - protein, 17 aa, Mycobacterium
FSRPLSHPLVWSITQAA

SEQ ID NO: 661310 - protein, 31 aa, Mycobacterium
FSRRCGTPGAPALVLVHGFPTSSIDYFALAA

SEQ ID NO: 661311 - protein, 19 aa, Mycobacterium
FSRRCRAVRLVPFDPHLEE

SEQ ID NO: 661312 - protein, 21 aa, Mycobacterium
FSRSFFKQQIDYVRALGDTVI

SEQ ID NO: 661313 - protein, 17 aa, Mycobacterium
FSRSMPRQAEIYAKELR

SEQ ID NO: 661314 - protein, 28 aa, Mycobacterium
FSRWNAGKDLSFVPLRPERVVEVRYDHM

SEQ ID NO: 661315 - protein, 17 aa, Mycobacterium
FSSAAAMLGSPGQGAYA

SEQ ID NO: 661316 - protein, 22 aa, Mycobacterium
FSSADPRRGRVLFTDARANPVL

SEQ ID NO: 661317 - protein, 22 aa, Mycobacterium
FSSADPRRGRVLFTDARSNPVL

SEQ ID NO: 661318 - protein, 22 aa, Mycobacterium
FSSADPRRGRVLFTDARTNPVL

SEQ ID NO: 661319 - protein, 19 aa, Mycobacterium
FSSAHIAEFFSSVRHGQDL

SEQ ID NO: 661320 - protein, 18 aa, Mycobacterium
FSSCGYLAGFPGQGAYAC

SEQ ID NO: 661321 - protein, 31 aa, Mycobacterium
FSSDAAMARECVAAGWLLSLSGTVSFRNARE

SEQ ID NO: 661322 - protein, 21 aa, Mycobacterium
FSSEFAIGVGTMMSVRNPDPL

SEQ ID NO: 661323 - protein, 26 aa, Mycobacterium
FSSGELQALAAIRCLDEGVDIPATRR

SEQ ID NO: 661324 - protein, 30 aa, Mycobacterium
FSSGMAATDCALRAVLRPGDHVVIPDDAYG

SEQ ID NO: 661325 - protein, 18 aa, Mycobacterium
FSSGMAATDCVLRALLRP

SEQ ID NO: 661326 - protein, 25 aa, Mycobacterium
FSSIEYRGLLRLQYAVRIGRDPNGF

SEQ ID NO: 661327 - protein, 23 aa, Mycobacterium
FSSKAEIVQACLRDMGATRAVPP

SEQ ID NO: 661328 - protein, 24 aa, Mycobacterium
FSSKLELYLAVLARHVENLVSGVQ

SEQ ID NO: 661329 - protein, 26 aa, Mycobacterium
FSSKLELYLAVLKRHVDNLVCGVQQA

SEQ ID NO: 661330 - protein, 24 aa, Mycobacterium
FSSKLELYLAVLNRHVDKLVAGVQ

SEQ ID NO: 661331 - protein, 25 aa, Mycobacterium
FSSKLELYLAVLQRHVDNLVSGVRQ

SEQ ID NO: 661332 - protein, 25 aa, Mycobacterium
FSSKQDLLDAFVVWERRGYEQAVAQ

SEQ ID NO: 661333 - protein, 25 aa, Mycobacterium
FSSLFPGGEGRLVLTDPNDMLTTGI

SEQ ID NO: 661334 - protein, 22 aa, Mycobacterium
FSSPRRRALVTAELAGLTVAEE

SEQ ID NO: 661335 - protein, 23 aa, Mycobacterium
FSSRLRRWRLAGGADAGLATDYR

SEQ ID NO: 661336 - protein, 23 aa, Mycobacterium
FSSRRLRRVRLLKRVAPADTLLK

SEQ ID NO: 661337 - protein, 20 aa, Mycobacterium
FSSSLDWNIERVKGGSMVAG

SEQ ID NO: 661338 - protein, 19 aa, Mycobacterium
FSSSLDWNIERVRGGSMVA

SEQ ID NO: 661339 - protein, 18 aa, Mycobacterium
FSSSRGCDLAMVKGDEPP

SEQ ID NO: 661340 - protein, 20 aa, Mycobacterium
FSSTVCYKGMMLDGIPNFAF

SEQ ID NO: 661341 - protein, 20 aa, Mycobacterium
FSSVASGLVDGSWRGPASAA

SEQ ID NO: 661342 - protein, 24 aa, Mycobacterium
FSSVEIRVVPKLVGGTLRVLQMIE

SEQ ID NO: 661343 - protein, 25 aa, Mycobacterium
FSSVTAGLASGAWQGPASAAMSAVA

SEQ ID NO: 661344 - protein, 19 aa, Mycobacterium
FSTAALFSAFSMVTHAGQG

SEQ ID NO: 661345 - protein, 29 aa, Mycobacterium
FSTAPLVVAGCIMMRVCHLDTCPVGVATQ

SEQ ID NO: 661346 - protein, 18 aa, Mycobacterium
FSTARLVTLVGVGGVGKT

SEQ ID NO: 661347 - protein, 31 aa, Mycobacterium
FSTDPGRLAAPWEFVDAGWVRAPRGSEPGLR

SEQ ID NO: 661348 - protein, 31 aa, Mycobacterium
FSTDRLESRWCGGDLLLQICADDPLVVAHTA

SEQ ID NO: 661349 - protein, 17 aa, Mycobacterium
FSTGVAALRAITQTGTG

SEQ ID NO: 661350 - protein, 17 aa, Mycobacterium
FSTILAGLGSEVTHLVR

SEQ ID NO: 661351 - protein, 17 aa, Mycobacterium
FSTLGARVTLVIRGSCL

SEQ ID NO: 661352 - protein, 17 aa, Mycobacterium
FSTNPQRVAHRDVLCPL

SEQ ID NO: 661353 - protein, 17 aa, Mycobacterium
FSTPASGTWAATILARQ

SEQ ID NO: 661354 - protein, 19 aa, Mycobacterium
FSTPDGIGCMFRASPNMTP

SEQ ID NO: 661355 - protein, 17 aa, Mycobacterium
FSTPLGLLARRIAFDDP

SEQ ID NO: 661356 - protein, 28 aa, Mycobacterium
FSTRAESRWFASAGFALVNMTGYPEAVL

SEQ ID NO: 661357 - protein, 28 aa, Mycobacterium
FSTRAESRWFASAGFSLVNMTGYPEAVL

SEQ ID NO: 661358 - protein, 27 aa, Mycobacterium
FSTRAESRWFASQGFTLVNMTGYPEAV

SEQ ID NO: 661359 - protein, 30 aa, Mycobacterium
FSTRGCPYRCTFCGTGAMSAMLGRNSYRAK

SEQ ID NO: 661360 - protein, 17 aa, Mycobacterium
FSTRRLVDCIKQGSTDF

SEQ ID NO: 661361 - protein, 17 aa, Mycobacterium
FSTSMKMFGVPYRITST

SEQ ID NO: 661362 - protein, 30 aa, Mycobacterium
FSTTVLRPGTFATMTLDWASFIRAGVPVEQ

SEQ ID NO: 661363 - protein, 17 aa, Mycobacterium
FSTWAHHMSLRYLNASS

SEQ ID NO: 661364 - protein, 21 aa, Mycobacterium
FSTWGNQFISSGFPINMLSYL

SEQ ID NO: 661365 - protein, 17 aa, Mycobacterium
FSTWTPHWFGVVDGPVE

SEQ ID NO: 661366 - protein, 22 aa, Mycobacterium
FSVDLDPRWVKKIATRGVGAEV

SEQ ID NO: 661367 - protein, 28 aa, Mycobacterium
FSVEPGIYFPGQWGARIEDIVVVTADGA

SEQ ID NO: 661368 - protein, 27 aa, Mycobacterium
FSVEPGIYFPGRWGARIEDIVVVTEDG

SEQ ID NO: 661369 - protein, 27 aa, Mycobacterium
FSVEPGVYFPGQWGARIEDIVIVTEDG

SEQ ID NO: 661370 - protein, 19 aa, Mycobacterium
FSVIRAAELSKWIDRGEYG

SEQ ID NO: 661371 - protein, 21 aa, Mycobacterium
FSVITCRDITKLGSDGVIERI

SEQ ID NO: 661372 - protein, 17 aa, Mycobacterium
FSVPHARVEDAELGEPV

SEQ ID NO: 661373 - protein, 17 aa, Mycobacterium
FSVPHGRANGIFLPHVL

SEQ ID NO: 661374 - protein, 25 aa, Mycobacterium
FSVQVEALHDQFVRAVTSGAASYAG

SEQ ID NO: 661375 - protein, 19 aa, Mycobacterium
FSVRLELKYLSEQDETAML

SEQ ID NO: 661376 - protein, 17 aa, Mycobacterium
FSWTWWRSGRGRRLGGR

SEQ ID NO: 661377 - protein, 19 aa, Mycobacterium
FSYAHVMAIMAFIKGIGSG

SEQ ID NO: 661378 - protein, 19 aa, Mycobacterium
FSYDELRALNPRIVLAESS

SEQ ID NO: 661379 - protein, 23 aa, Mycobacterium
FSYGTGVAELFPTVVKQVREAEA

SEQ ID NO: 661380 - protein, 19 aa, Mycobacterium
FSYQFSFEQSRHWSRTYAP

SEQ ID NO: 661381 - protein, 25 aa, Mycobacterium
FTAAAKAFESWRWSTPSERQRALLR

SEQ ID NO: 661382 - protein, 18 aa, Mycobacterium
FTAAGAEWRQAGCSMCLG

SEQ ID NO: 661383 - protein, 19 aa, Mycobacterium
FTAAGAEWRQAGCSMCLGM

SEQ ID NO: 661384 - protein, 25 aa, Mycobacterium
FTAALRAGLGWGMMPEQLGREGLVE

SEQ ID NO: 661385 - protein, 25 aa, Mycobacterium
FTAAMSVQALIDWGIAPDAGDIVVT

SEQ ID NO: 661386 - protein, 24 aa, Mycobacterium
FTAAMSVQALIDWGIAPEAGAVVV

SEQ ID NO: 661387 - protein, 18 aa, Mycobacterium
FTADFPTRNYPGTDEIDF

SEQ ID NO: 661388 - protein, 19 aa, Mycobacterium
FTADGDLLFLAARPTADDD

SEQ ID NO: 661389 - protein, 17 aa, Mycobacterium
FTAEAAWRHEVARLPAE

SEQ ID NO: 661390 - protein, 17 aa, Mycobacterium
FTAEFSGIVRSALDGAR

SEQ ID NO: 661391 - protein, 17 aa, Mycobacterium
FTAELPFALDGFQQRAC

SEQ ID NO: 661392 - protein, 23 aa, Mycobacterium
FTAERLEQVRAWLAENPQTSVLI

SEQ ID NO: 661393 - protein, 24 aa, Mycobacterium
FTAERLRQVESWLADKPETSVLIA

SEQ ID NO: 661394 - protein, 26 aa, Mycobacterium
FTAFAAKLAERVGCRRADDGRIRVGI

SEQ ID NO: 661395 - protein, 20 aa, Mycobacterium
FTAFCGHRFDVRQANCSVSS

SEQ ID NO: 661396 - protein, 23 aa, Mycobacterium
FTAFPKAHWQKIWSNNPIERLNK

SEQ ID NO: 661397 - protein, 23 aa, Mycobacterium
FTAFPRTHWQKIWSNNPIVICSA

SEQ ID NO: 661398 - protein, 24 aa, Mycobacterium
FTAFVPFAARWPVEVHIYPNRFAH

SEQ ID NO: 661399 - protein, 18 aa, Mycobacterium
FTAGCPVAAAALGSADDG

SEQ ID NO: 661400 - protein, 18 aa, Mycobacterium
FTAGDAGYEFALESISKI

SEQ ID NO: 661401 - protein, 18 aa, Mycobacterium
FTAGQLVICPGAWAPQLL

SEQ ID NO: 661402 - protein, 17 aa, Mycobacterium
FTAGRIEILRAFLTTTT

SEQ ID NO: 661403 - protein, 19 aa, Mycobacterium
FTAHWPTSRDVWLPDGTPP

SEQ ID NO: 661404 - protein, 21 aa, Mycobacterium
FTAKFGIPVLTSYAATEFGGG

SEQ ID NO: 661405 - protein, 18 aa, Mycobacterium
FTALCAQSPAVHRFPGSM

SEQ ID NO: 661406 - protein, 18 aa, Mycobacterium
FTALDFIGPYEVLRFIPD

SEQ ID NO: 661407 - protein, 27 aa, Mycobacterium
FTALPEVRSQLALTWGTETFIVPQMSN

SEQ ID NO: 661408 - protein, 19 aa, Mycobacterium
FTANPWLAGYMQEALGLLT

SEQ ID NO: 661409 - protein, 21 aa, Mycobacterium
FTAQLLPRPIGLIIGLQLSAN

SEQ ID NO: 661410 - protein, 18 aa, Mycobacterium
FTARCLGAADCGHLLDEE

SEQ ID NO: 661411 - protein, 21 aa, Mycobacterium
FTARTVPWVVLTSNDTRELSS

SEQ ID NO: 661412 - protein, 17 aa, Mycobacterium
FTATVRGVFTYKVNDAG

SEQ ID NO: 661413 - protein, 25 aa, Mycobacterium
FTAVLPRLTPATGLGAAAVAAYAER

SEQ ID NO: 661414 - protein, 20 aa, Mycobacterium
FTAVTTLRILDGVRLPKGST

SEQ ID NO: 661415 - protein, 25 aa, Mycobacterium
FTAYFIGPLVHRFHSAHPGITLTVR

SEQ ID NO: 661416 - protein, 20 aa, Mycobacterium
FTCTYHGWAYDLEGKLISVP

SEQ ID NO: 661417 - protein, 19 aa, Mycobacterium
FTDAALRVTDEFAALRPPG

SEQ ID NO: 661418 - protein, 24 aa, Mycobacterium
FTDAMRADWMWRVFGEAGHVAVVE

SEQ ID NO: 661419 - protein, 26 aa, Mycobacterium
FTDAVVQHWGPPPGELFVDRSNDPDG

SEQ ID NO: 661420 - protein, 17 aa, Mycobacterium
FTDEGIRAAALLRSQNP

SEQ ID NO: 661421 - protein, 18 aa, Mycobacterium
FTDFTGYQHRVFAMHNGQ

SEQ ID NO: 661422 - protein, 17 aa, Mycobacterium
FTDGWFRTGDLGAIDDD

SEQ ID NO: 661423 - protein, 18 aa, Mycobacterium
FTDIEWRSPFVAKAGLDE

SEQ ID NO: 661424 - protein, 18 aa, Mycobacterium
FTDKDVFVGAVFDRVIAD

SEQ ID NO: 661425 - protein, 26 aa, Mycobacterium
FTDKFVKRMSEFTLGKGLDEKSTLGP

SEQ ID NO: 661426 - protein, 18 aa, Mycobacterium
FTDLGLKYVGPVDGHDER

SEQ ID NO: 661427 - protein, 19 aa, Mycobacterium
FTDPFVRDLLDDWPVTSQR

SEQ ID NO: 661428 - protein, 21 aa, Mycobacterium
FTDQLRWLFGKLIGDRPRWSL

SEQ ID NO: 661429 - protein, 19 aa, Mycobacterium
FTDRAGFRIEIPGPALARF

SEQ ID NO: 661430 - protein, 19 aa, Mycobacterium
FTDVAGLMGPYLMHPIHWA

SEQ ID NO: 661431 - protein, 23 aa, Mycobacterium
FTDVSRADWLWRVVGETGHVALA

SEQ ID NO: 661432 - protein, 24 aa, Mycobacterium
FTDWPDPWVLAGALAQVTTRLRFV

SEQ ID NO: 661433 - protein, 20 aa, Mycobacterium
FTEAKFRSVLEEPTYTEGTG

SEQ ID NO: 661434 - protein, 23 aa, Mycobacterium
FTEELVMWWNFVGRNHDEIVTYR

SEQ ID NO: 661435 - protein, 22 aa, Mycobacterium
FTEELVMWWNFVGRSHDDIVAY

SEQ ID NO: 661436 - protein, 22 aa, Mycobacterium
FTEELVMWWNFVGRSHEDIVNY

SEQ ID NO: 661437 - protein, 19 aa, Mycobacterium
FTEFVPLPFVHQSSPLYLA

SEQ ID NO: 661438 - protein, 17 aa, Mycobacterium
FTEGMGGFTIDKVAALS

SEQ ID NO: 661439 - protein, 17 aa, Mycobacterium
FTEGYWSTAGPSAIRDE

SEQ ID NO: 661440 - protein, 17 aa, Mycobacterium
FTEGYWSTGGPSAIRDE

SEQ ID NO: 661441 - protein, 19 aa, Mycobacterium
FTEHLPATFVYAGIDVERS

SEQ ID NO: 661442 - protein, 25 aa, Mycobacterium
FTEHVVPILVRRGLFRAEYTGSTLR

SEQ ID NO: 661443 - protein, 19 aa, Mycobacterium
FTEIKFRSVLEEPTYEDGI

SEQ ID NO: 661444 - protein, 25 aa, Mycobacterium
FTEILPTPFLPAGVFDLWGLAADDP

SEQ ID NO: 661445 - protein, 27 aa, Mycobacterium
FTEKVLIECCLELYAADLVVGIQDLGG

SEQ ID NO: 661446 - protein, 29 aa, Mycobacterium
FTEKVLIECCLELYAAHLVVGIQDLGGAG

SEQ ID NO: 661447 - protein, 29 aa, Mycobacterium
FTEKVLIECCLELYAGGLVIGIQDLGGAG

SEQ ID NO: 661448 - protein, 25 aa, Mycobacterium
FTELKFPGRLVVGLAVSRLGTSSVT

SEQ ID NO: 661449 - protein, 25 aa, Mycobacterium
FTENPAGSVLIEFGRTKVLCTASVT

SEQ ID NO: 661450 - protein, 25 aa, Mycobacterium
FTENPAGSVLIEFGRTKVMCTASVT

SEQ ID NO: 661451 - protein, 25 aa, Mycobacterium
FTEPDPSYHGVVFAELGAPAYALKA

SEQ ID NO: 661452 - protein, 21 aa, Mycobacterium
FTEPSAEVDIWFPDKKGGPGW

SEQ ID NO: 661453 - protein, 39 aa, Mycobacterium
FTEPSAEVDIWFPGKKGGPGWVEWGGCGMVNPNVLRACG

SEQ ID NO: 661454 - protein, 22 aa, Mycobacterium
FTEPVFRAALISGLGGAEDGEV

SEQ ID NO: 661455 - protein, 21 aa, Mycobacterium
FTERRSFLLPPTWSQLDAVSS

SEQ ID NO: 661456 - protein, 21 aa, Mycobacterium
FTEVHPLPGRNLMPVVDGGPA

SEQ ID NO: 661457 - protein, 27 aa, Mycobacterium
FTEVVERIRCAAGAFAELGIDKGDRVA

SEQ ID NO: 661458 - protein, 20 aa, Mycobacterium
FTEYWPDQGDFEFNYSNEGR

SEQ ID NO: 661459 - protein, 26 aa, Mycobacterium
FTFADCARCVVDLLNGLGIDRAHFVG

SEQ ID NO: 661460 - protein, 20 aa, Mycobacterium
FTFAGLPAYLQKQGRKVRFM

SEQ ID NO: 661461 - protein, 25 aa, Mycobacterium
FTFMPIGELWYRKSGTYRNKVQNLT

SEQ ID NO: 661462 - protein, 28 aa, Mycobacterium
FTFMTPAAFVRRPGRWIREMARKPDDEP

SEQ ID NO: 661463 - protein, 28 aa, Mycobacterium
FTFMTPAAFVRRPGRWIREMARKPEDAP

SEQ ID NO: 661464 - protein, 17 aa, Mycobacterium
FTFNGARGAILADKALR

SEQ ID NO: 661465 - protein, 26 aa, Mycobacterium
FTFRGCEGDALLMLLDANGIECSTGS

SEQ ID NO: 661466 - protein, 27 aa, Mycobacterium
FTFRGCEGDSLLMLLDAKGIECSTGSA

SEQ ID NO: 661467 - protein, 22 aa, Mycobacterium
FTFVGRPKPALVAGEEPAADLA

SEQ ID NO: 661468 - protein, 19 aa, Mycobacterium
FTGAALWLAGQGREQQAYT

SEQ ID NO: 661469 - protein, 18 aa, Mycobacterium
FTGALTYYGLTPRDSRKA

SEQ ID NO: 661470 - protein, 23 aa, Mycobacterium
FTGDRVLAAILFEQTMDREIEGK

SEQ ID NO: 661471 - protein, 23 aa, Mycobacterium
FTGDRVLAAILFEQTMDRQIAGK

SEQ ID NO: 661472 - protein, 24 aa, Mycobacterium
FTGEAPPAAGLEVSVLTEWLRAVP

SEQ ID NO: 661473 - protein, 17 aa, Mycobacterium
FTGELPPAEPIGFTVRT

SEQ ID NO: 661474 - protein, 23 aa, Mycobacterium
FTGELRGAALAAAYASMDVFVHP

SEQ ID NO: 661475 - protein, 19 aa, Mycobacterium
FTGEVGFLHYARSADEACY

SEQ ID NO: 661476 - protein, 19 aa, Mycobacterium
FTGFPRLYITVSDTESLYA

SEQ ID NO: 661477 - protein, 22 aa, Mycobacterium
FTGGEPLIFKDLEKLVAAVAGM

SEQ ID NO: 661478 - protein, 19 aa, Mycobacterium
FTGGPGFNAEGLVYRPDGT

SEQ ID NO: 661479 - protein, 24 aa, Mycobacterium
FTGHPYPRACSGFAASDRLGGEAI

SEQ ID NO: 661480 - protein, 19 aa, Mycobacterium
FTGHRLCLDLSSAPAPSNG

SEQ ID NO: 661481 - protein, 17 aa, Mycobacterium
FTGHSLSINAEFERPLS

SEQ ID NO: 661482 - protein, 19 aa, Mycobacterium
FTGIGDTGADIFLREVQDV

SEQ ID NO: 661483 - protein, 17 aa, Mycobacterium
FTGKAQIGKGMWAMTEL

SEQ ID NO: 661484 - protein, 27 aa, Mycobacterium
FTGLAPRDLCALWPVPATSVPHAASPA

SEQ ID NO: 661485 - protein, 21 aa, Mycobacterium
FTGLDDWTIWWGANLGAAGER

SEQ ID NO: 661486 - protein, 17 aa, Mycobacterium
FTGLEIRADRIVLSPHW

SEQ ID NO: 661487 - protein, 17 aa, Mycobacterium
FTGLEIRGDRIVLSPLW

SEQ ID NO: 661488 - protein, 26 aa, Mycobacterium
FTGLNRPAGLALDVSGGIYLVDAYNN

SEQ ID NO: 661489 - protein, 17 aa, Mycobacterium
FTGPITIVSSETHLPYD

SEQ ID NO: 661490 - protein, 27 aa, Mycobacterium
FTGPSISAPGWFLPTIITPTVSPIPPF

SEQ ID NO: 661491 - protein, 26 aa, Mycobacterium
FTGPSLRPSATLVRRTRPVVEARSES

SEQ ID NO: 661492 - protein, 18 aa, Mycobacterium
FTGRIEAIADDLDVEVVV

SEQ ID NO: 661493 - protein, 23 aa, Mycobacterium
FTGSCKSCPSSAVTLELAVQDAV

SEQ ID NO: 661494 - protein, 19 aa, Mycobacterium
FTGSEAYRADVPVTDPKIL

SEQ ID NO: 661495 - protein, 21 aa, Mycobacterium
FTGSPQVGWGIAEAAPKKKVR

SEQ ID NO: 661496 - protein, 19 aa, Mycobacterium
FTGSTRAGIDVARNAAPTV

SEQ ID NO: 661497 - protein, 29 aa, Mycobacterium
FTGTGRPTGEWARAGARLTAAEDALASAR

SEQ ID NO: 661498 - protein, 26 aa, Mycobacterium
FTGTLPKPGVRAGGLITLAGDQPGDG

SEQ ID NO: 661499 - protein, 19 aa, Mycobacterium
FTGTRSVLLTTMLGEQVTD

SEQ ID NO: 661500 - protein, 23 aa, Mycobacterium
FTGVPCIVDLATMREAIADLGGK

SEQ ID NO: 661501 - protein, 22 aa, Mycobacterium
FTGVPCIVDLATMREAIGELGG

SEQ ID NO: 661502 - protein, 23 aa, Mycobacterium
FTGVPCIVDLATMREAVAALGGD

SEQ ID NO: 661503 - protein, 23 aa, Mycobacterium
FTGVPCVVDLATMREAVAALGGD

SEQ ID NO: 661504 - protein, 17 aa, Mycobacterium
FTGYKLLIADVIGGTLK

SEQ ID NO: 661505 - protein, 17 aa, Mycobacterium
FTHAASLAQLWRSCGVL

SEQ ID NO: 661506 - protein, 24 aa, Mycobacterium
FTHAIEAFQAFAPQIAAFALALPA

SEQ ID NO: 661507 - protein, 18 aa, Mycobacterium
FTHELRMTLRELGSRRVA

SEQ ID NO: 661508 - protein, 19 aa, Mycobacterium
FTHLLGYALVQAIKKFPNM

SEQ ID NO: 661509 - protein, 17 aa, Mycobacterium
FTHLLGYALVQATKQFP

SEQ ID NO: 661510 - protein, 19 aa, Mycobacterium
FTHLLGYALVQAVKKFPNM

SEQ ID NO: 661511 - protein, 19 aa, Mycobacterium
FTHLLGYALVQAVKQFPNM

SEQ ID NO: 661512 - protein, 18 aa, Mycobacterium
FTHRLRKYIGAYLAVLGH

SEQ ID NO: 661513 - protein, 18 aa, Mycobacterium
FTHRLRKYVGAYLAVLGH

SEQ ID NO: 661514 - protein, 18 aa, Mycobacterium
FTHTCFMVTPYEGYVAVA

SEQ ID NO: 661515 - protein, 18 aa, Mycobacterium
FTHTCFMVTPYEQYVAVA

SEQ ID NO: 661516 - protein, 17 aa, Mycobacterium
FTHTCFMVTPYESYVAV

SEQ ID NO: 661517 - protein, 17 aa, Mycobacterium
FTHTCFMVVPYEQYVAV

SEQ ID NO: 661518 - protein, 17 aa, Mycobacterium
FTHVPREQATVGALRKA

SEQ ID NO: 661519 - protein, 25 aa, Mycobacterium
FTIAGVPYLLGIQSYLLPQNVANVA

SEQ ID NO: 661520 - protein, 22 aa, Mycobacterium
FTIANPRTDWCFNTEPDPGLAG

SEQ ID NO: 661521 - protein, 17 aa, Mycobacterium
FTIKPDRWFTADFSGEL

SEQ ID NO: 661522 - protein, 19 aa, Mycobacterium
FTILDGLLAFYATIGSIKN

SEQ ID NO: 661523 - protein, 19 aa, Mycobacterium
FTILDGLLAFYATIGSMQN

SEQ ID NO: 661524 - protein, 21 aa, Mycobacterium
FTINGTKTFRLGAGIENDYVM

SEQ ID NO: 661525 - protein, 26 aa, Mycobacterium
FTIPSLPLDALVYINGTPIPIFYDFG

SEQ ID NO: 661526 - protein, 20 aa, Mycobacterium
FTKARLSDGVLGVRPEYLAA

SEQ ID NO: 661527 - protein, 17 aa, Mycobacterium
FTKGGPYLARGAADLVP

SEQ ID NO: 661528 - protein, 18 aa, Mycobacterium
FTKKCCAPLSIPIGTQTL

SEQ ID NO: 661529 - protein, 21 aa, Mycobacterium
FTKKLWSAAGLPIGPHAVLRP

SEQ ID NO: 661530 - protein, 17 aa, Mycobacterium
FTKPIGVTYPWTPPLAE

SEQ ID NO: 661531 - protein, 26 aa, Mycobacterium
FTKRGLRQGVERCLRALARRATERAH

SEQ ID NO: 661532 - protein, 19 aa, Mycobacterium
FTKTAGRSAIWAKDGSVLA

SEQ ID NO: 661533 - protein, 17 aa, Mycobacterium
FTKVMAFEMLISNLGVQ

SEQ ID NO: 661534 - protein, 18 aa, Mycobacterium
FTKYAGFHLSALRAIVGD

SEQ ID NO: 661535 - protein, 19 aa, Mycobacterium
FTLADSRFLFFPTAVHGHA

SEQ ID NO: 661536 - protein, 20 aa, Mycobacterium
FTLAERKKLAALAFQHTAEY

SEQ ID NO: 661537 - protein, 18 aa, Mycobacterium
FTLDPEANIVFAYLATQS

SEQ ID NO: 661538 - protein, 26 aa, Mycobacterium
FTLEARKVLAAKAFRHTAEYDVAVAG

SEQ ID NO: 661539 - protein, 24 aa, Mycobacterium
FTLKGSHSVRVFIGSGMPAGLWKR

SEQ ID NO: 661540 - protein, 19 aa, Mycobacterium
FTLKMYDFMFGDRDPVAEP

SEQ ID NO: 661541 - protein, 17 aa, Mycobacterium
FTLPELIGLTSSCDVVL

SEQ ID NO: 661542 - protein, 24 aa, Mycobacterium
FTLPPKEFGAAWQVVVYTGPDETT

SEQ ID NO: 661543 - protein, 22 aa, Mycobacterium
FTLPPVEFGSGWRVVVATAAAT

SEQ ID NO: 661544 - protein, 20 aa, Mycobacterium
FTLPTGWRHGHAICLAMAGA

SEQ ID NO: 661545 - protein, 23 aa, Mycobacterium
FTLRRTDGLPVWIYQFKISPHPS

SEQ ID NO: 661546 - protein, 17 aa, Mycobacterium
FTLRVGRPVGPMLAQTA

SEQ ID NO: 661547 - protein, 19 aa, Mycobacterium
FTLRVGRPVGPMLAQTATG

SEQ ID NO: 661548 - protein, 21 aa, Mycobacterium
FTLSGGHLFSVYDGCREEGIR

SEQ ID NO: 661549 - protein, 20 aa, Mycobacterium
FTLTGTKVWCSGAGFCTHAL

SEQ ID NO: 661550 - protein, 20 aa, Mycobacterium
FTLTKGLVFRRRIGEVRAVD

SEQ ID NO: 661551 - protein, 17 aa, Mycobacterium
FTLVLHTHLPWLAHHGR

SEQ ID NO: 661552 - protein, 26 aa, Mycobacterium
FTMNCLSWIEALGFCGIGEAREFLDG

SEQ ID NO: 661553 - protein, 24 aa, Mycobacterium
FTNAARADWLWRVVGESGHVAVLS

SEQ ID NO: 661554 - protein, 19 aa, Mycobacterium
FTNDYEWDLLLSKTGWTEA

SEQ ID NO: 661555 - protein, 19 aa, Mycobacterium
FTNDYEWELLLSKTGWSEA

SEQ ID NO: 661556 - protein, 19 aa, Mycobacterium
FTNHMFLPAPAAVPPPPDP

SEQ ID NO: 661557 - protein, 25 aa, Mycobacterium
FTNICYTGCRFCAFAQRKGDADAFS

SEQ ID NO: 661558 - protein, 20 aa, Mycobacterium
FTNLLPAGSVPELVSQNFTN

SEQ ID NO: 661559 - protein, 27 aa, Mycobacterium
FTNYALRMEAAWGREYRRGRIMHKLIG

SEQ ID NO: 661560 - protein, 18 aa, Mycobacterium
FTPDGWMRMGDICEIDAD

SEQ ID NO: 661561 - protein, 29 aa, Mycobacterium
FTPDYYCLDYRAAGLTPQSWFARQAGLVD

SEQ ID NO: 661562 - protein, 24 aa, Mycobacterium
FTPGDEVYGLIGFDRDGAAAEFVC

SEQ ID NO: 661563 - protein, 18 aa, Mycobacterium
FTPGMSALCQGRMTPQAA

SEQ ID NO: 661564 - protein, 24 aa, Mycobacterium
FTPGSWRSEPLPGVPDNATTQIVA

SEQ ID NO: 661565 - protein, 20 aa, Mycobacterium
FTPGYVLRVLEWMPRQGSRN

SEQ ID NO: 661566 - protein, 24 aa, Mycobacterium
FTPHEVALEYAIAASLVHHGLGTI

SEQ ID NO: 661567 - protein, 22 aa, Mycobacterium
FTPKIGYPATWRDYSTITIRRD

SEQ ID NO: 661568 - protein, 17 aa, Mycobacterium
FTPLGRLTLNRVLGPDQ

SEQ ID NO: 661569 - protein, 18 aa, Mycobacterium
FTPLNFEATDLAWSENDS

SEQ ID NO: 661570 - protein, 27 aa, Mycobacterium
FTPLPEVRSQLALTWGTETFIVPVMET

SEQ ID NO: 661571 - protein, 26 aa, Mycobacterium
FTPPAPRYKTGVLAKYVKLVGSAAIG

SEQ ID NO: 661572 - protein, 19 aa, Mycobacterium
FTPPSPRYQTGVLAKYVKL

SEQ ID NO: 661573 - protein, 18 aa, Mycobacterium
FTPPYAVAHIQLRGADTR

SEQ ID NO: 661574 - protein, 20 aa, Mycobacterium
FTPRLWDAAIHYNLTQVFYL

SEQ ID NO: 661575 - protein, 17 aa, Mycobacterium
FTPRRMAALEDQIRQYC

SEQ ID NO: 661576 - protein, 17 aa, Mycobacterium
FTPSPSLGIPALRQLAA

SEQ ID NO: 661577 - protein, 25 aa, Mycobacterium
FTPTELLRWVHPSLVASTQGTGMGG

SEQ ID NO: 661578 - protein, 17 aa, Mycobacterium
FTPTLAFVRDTVPDAAH

SEQ ID NO: 661579 - protein, 18 aa, Mycobacterium
FTPTPAVSHAILAYNRGR

SEQ ID NO: 661580 - protein, 26 aa, Mycobacterium
FTPVFLRNATAFGFSPRLRADIVLNN

SEQ ID NO: 661581 - protein, 23 aa, Mycobacterium
FTQERLDQVQAWLADKPGTSVLI

SEQ ID NO: 661582 - protein, 19 aa, Mycobacterium
FTQGIPTTAGMAIHRDFRP

SEQ ID NO: 661583 - protein, 18 aa, Mycobacterium
FTQGRALAELEFDGPAEI

SEQ ID NO: 661584 - protein, 20 aa, Mycobacterium
FTQLRPLLFTIAYEILGSAT

SEQ ID NO: 661585 - protein, 24 aa, Mycobacterium
FTQRARAGAVMLIDGAPGIVIAPR

SEQ ID NO: 661586 - protein, 23 aa, Mycobacterium
FTQRLYAVVWHGHRLAKRRSIGF

SEQ ID NO: 661587 - protein, 24 aa, Mycobacterium
FTQRRYNRMTAYRASKLACMLFGS

SEQ ID NO: 661588 - protein, 18 aa, Mycobacterium
FTQVGAPRAGLTCDTDAP

SEQ ID NO: 661589 - protein, 21 aa, Mycobacterium
FTRAALPGMVERGAGAVLNIA

SEQ ID NO: 661590 - protein, 19 aa, Mycobacterium
FTRAGYRCVTFDNRGIGAT

SEQ ID NO: 661591 - protein, 22 aa, Mycobacterium
FTRAQLLHEVWGYDFFGGTRTV

SEQ ID NO: 661592 - protein, 22 aa, Mycobacterium
FTRARISAGLSRQDLARLSRTG

SEQ ID NO: 661593 - protein, 26 aa, Mycobacterium
FTRDSSIWIGPRFVIPSLAMRARVRE

SEQ ID NO: 661594 - protein, 24 aa, Mycobacterium
FTREKPGWLARGWERIAEEVAAGR

SEQ ID NO: 661595 - protein, 17 aa, Mycobacterium
FTRHDFAEPVSFVDFTI

SEQ ID NO: 661596 - protein, 18 aa, Mycobacterium
FTRIAAFRGGVAGNMDAC

SEQ ID NO: 661597 - protein, 22 aa, Mycobacterium
FTRIGCERIIRYAFELAASAGF

SEQ ID NO: 661598 - protein, 17 aa, Mycobacterium
FTRLPVRTAAGSRLAAL

SEQ ID NO: 661599 - protein, 17 aa, Mycobacterium
FTRLWSGARELLRTMSY

SEQ ID NO: 661600 - protein, 18 aa, Mycobacterium
FTRMGADAFAARAHRELL

SEQ ID NO: 661601 - protein, 17 aa, Mycobacterium
FTRMLKLPDRVRNSYDI

SEQ ID NO: 661602 - protein, 19 aa, Mycobacterium
FTRNKIKAAPVLWTQQVLT

SEQ ID NO: 661603 - protein, 24 aa, Mycobacterium
FTRNRLRIGGLDVQLAQLLTDKLG

SEQ ID NO: 661604 - protein, 25 aa, Mycobacterium
FTRPQGKFVIRRGAPYHVFAGEETA

SEQ ID NO: 661605 - protein, 30 aa, Mycobacterium
FTRRCGTPDAPALVLVHGFPTSSIDYFALA

SEQ ID NO: 661606 - protein, 17 aa, Mycobacterium
FTRRGIATELIRHQLRD

SEQ ID NO: 661607 - protein, 17 aa, Mycobacterium
FTRTLRAVVDWRGQIVT

SEQ ID NO: 661608 - protein, 17 aa, Mycobacterium
FTRTMPRVYPCRTCATP

SEQ ID NO: 661609 - protein, 21 aa, Mycobacterium
FTRTRLRQEVLPLLEDVLGGG

SEQ ID NO: 661610 - protein, 17 aa, Mycobacterium
FTRYAFPPNELGYCGPD

SEQ ID NO: 661611 - protein, 40 aa, Mycobacterium
FTSADRWTMFHSIAFDFSVWELWGPLLYGGCVVMVPYLET

SEQ ID NO: 661612 - protein, 18 aa, Mycobacterium
FTSAPGMQCNRRMFEEIV

SEQ ID NO: 661613 - protein, 25 aa, Mycobacterium
FTSDIKNLLPLFAVFKPTVVVSVPR

SEQ ID NO: 661614 - protein, 24 aa, Mycobacterium
FTSDIKNLVPMFAVFQPTLVVSVP

SEQ ID NO: 661615 - protein, 18 aa, Mycobacterium
FTSDPAFRQRYWARNHVG

SEQ ID NO: 661616 - protein, 20 aa, Mycobacterium
FTSDPVFRQRYWARNHVGWR

SEQ ID NO: 661617 - protein, 31 aa, Mycobacterium
FTSDPVFRRRYWARNHLGWRHMDDTQPNAGH

SEQ ID NO: 661618 - protein, 30 aa, Mycobacterium
FTSDQEVRWCPGCGDYVILNTIRGFLPELG

SEQ ID NO: 661619 - protein, 30 aa, Mycobacterium; identical to SEQ ID NO: 79901

SEQ ID NO: 661620 - protein, 18 aa, Mycobacterium
FTSGLLLGSSAQVFNSGQ

SEQ ID NO: 661621 - protein, 17 aa, Mycobacterium
FTSGVFSSGAFTSGFFN

SEQ ID NO: 661622 - protein, 19 aa, Mycobacterium
FTSKEDFAFDLSARNVAAL

SEQ ID NO: 661623 - protein, 24 aa, Mycobacterium
FTSKLELYLAVLARHVENLVSGVQ

SEQ ID NO: 661624 - protein, 17 aa, Mycobacterium
FTSLKIPFFTDGVPPFF

SEQ ID NO: 661625 - protein, 18 aa, Mycobacterium
FTSLMAIYDTMQYVRSDI

SEQ ID NO: 661626 - protein, 27 aa, Mycobacterium
FTSLPEVRSQLALTWGTETFIVPHIDT

SEQ ID NO: 661627 - protein, 29 aa, Mycobacterium
FTSRGGLMGQAWLRAGRRFLAVQTALVDD

SEQ ID NO: 661628 - protein, 17 aa, Mycobacterium
FTSSFVFDEDGAFSYTS

SEQ ID NO: 661629 - protein, 17 aa, Mycobacterium
FTSSIGTIGLRAGGPAD

SEQ ID NO: 661630 - protein, 20 aa, Mycobacterium
FTSSKVMCWVALDRGAKLAA

SEQ ID NO: 661631 - protein, 20 aa, Mycobacterium
FTSSVWRIAQAHQHFAPVYV

SEQ ID NO: 661632 - protein, 24 aa, Mycobacterium
FTSVRGGAYFFLPGISALRYLAAL

SEQ ID NO: 661633 - protein, 25 aa, Mycobacterium
FTTEPRPRIDLEVGSWYVSTHPGSH

SEQ ID NO: 661634 - protein, 19 aa, Mycobacterium
FTTGFPLTLALDALGAPIV

SEQ ID NO: 661635 - protein, 20 aa, Mycobacterium
FTTHCLLRVQGRTSGRTYIK

SEQ ID NO: 661636 - protein, 23 aa, Mycobacterium
FTTHGLPFLHDWTPDAVPPGWSV

SEQ ID NO: 661637 - protein, 17 aa, Mycobacterium
FTTKYPAALSITGGLSW

SEQ ID NO: 661638 - protein, 29 aa, Mycobacterium
FTTLGYRQSLFWAWLIYGGRLLRGRLPRI

SEQ ID NO: 661639 - protein, 17 aa, Mycobacterium
FTTLMGRDSDRMADIKL

SEQ ID NO: 661640 - protein, 17 aa, Mycobacterium
FTTQVLFTPEQLWPFTS

SEQ ID NO: 661641 - protein, 30 aa, Mycobacterium
FTTRGCPYRCTFCGTGAMSAILGRNSYRAK

SEQ ID NO: 661642 - protein, 29 aa, Mycobacterium
FTTRGCPYRCTFCGTGAVSAMLGRTSYRV

SEQ ID NO: 661643 - protein, 20 aa, Mycobacterium
FTTTLFSRFWRVRDISRSGL

SEQ ID NO: 661644 - protein, 20 aa, Mycobacterium
FTTVIWRKLVLNALAGLMAL

SEQ ID NO: 661645 - protein, 17 aa, Mycobacterium
FTTVWNAVVSELNGDPT

SEQ ID NO: 661646 - protein, 18 aa, Mycobacterium
FTVADAYQGKGIGSFLIG

SEQ ID NO: 661647 - protein, 18 aa, Mycobacterium
FTVADAYQGRGIGSFLIG

SEQ ID NO: 661648 - protein, 18 aa, Mycobacterium
FTVADAYQGRGIGTFLIN

SEQ ID NO: 661649 - protein, 17 aa, Mycobacterium
FTVADAYQGRGIGTYLI

SEQ ID NO: 661650 - protein, 25 aa, Mycobacterium
FTVAERELARLGLERTPGSALNVII

SEQ ID NO: 661651 - protein, 18 aa, Mycobacterium
FTVDGRGFIPTKYAQSHW

SEQ ID NO: 661652 - protein, 17 aa, Mycobacterium
FTVDGWDKSFGVNLRGP

SEQ ID NO: 661653 - protein, 17 aa, Mycobacterium
FTVDPFAALILAANIGW

SEQ ID NO: 661654 - protein, 22 aa, Mycobacterium
FTVEGGKLWLLQTRDAERSAQA

SEQ ID NO: 661655 - protein, 19 aa, Mycobacterium
FTVEGLATVIPFHRAVVSD

SEQ ID NO: 661656 - protein, 29 aa, Mycobacterium
FTVEIPDRADLAFLPGQYVNITVPGTDIT

SEQ ID NO: 661657 - protein, 22 aa, Mycobacterium
FTVESGKLWLLQTRAAERSAQA

SEQ ID NO: 661658 - protein, 22 aa, Mycobacterium
FTVESGKLWLLQTRSAERSAQA

SEQ ID NO: 661659 - protein, 18 aa, Mycobacterium
FTVFPGSDADVIGRPDEL

SEQ ID NO: 661660 - protein, 25 aa, Mycobacterium
FTVGDTLWAPTFVRDFPVETTPLTR

SEQ ID NO: 661661 - protein, 18 aa, Mycobacterium
FTVPPAWAAFTGKTLVLV

SEQ ID NO: 661662 - protein, 17 aa, Mycobacterium
FTVRMDLGGAPLFGPVG

SEQ ID NO: 661663 - protein, 18 aa, Mycobacterium
FTVVCKFAAGALTGEQAE

SEQ ID NO: 661664 - protein, 19 aa, Mycobacterium
FTVVLPRSEGIEYAIEHAV

SEQ ID NO: 661665 - protein, 21 aa, Mycobacterium
FTVVWPRRDGVEYSIEHAVVG

SEQ ID NO: 661666 - protein, 31 aa, Mycobacterium
FTWEHPAHLFVRRARTGLQLFGSSAQHRERY

SEQ ID NO: 661667 - protein, 21 aa, Mycobacterium
FTWEHPCHLYVRRARSGLQLF

SEQ ID NO: 661668 - protein, 20 aa, Mycobacterium
FTWENDVQFALKRAKAGELL

SEQ ID NO: 661669 - protein, 17 aa, Mycobacterium
FTWQGRRELVSQIHEQL

SEQ ID NO: 661670 - protein, 17 aa, Mycobacterium
FTYGLLYQREADLAQRC

SEQ ID NO: 661671 - protein, 18 aa, Mycobacterium
FTYLCPGAGHAPHHVFKE

SEQ ID NO: 661672 - protein, 21 aa, Mycobacterium
FTYRFSVPHSGTYWAHPHVGL

SEQ ID NO: 661673 - protein, 25 aa, Mycobacterium
FTYTERKKLAALAFRHTAEYDVAVA

SEQ ID NO: 661674 - protein, 18 aa, Mycobacterium
FVAAAATDLARIGTTITS

SEQ ID NO: 661675 - protein, 28 aa, Mycobacterium
FVAADPSCGWGWLPYRAAPERAVAAVAD

SEQ ID NO: 661676 - protein, 21 aa, Mycobacterium
FVAAGIRKTWIFQAFDDEHEV

SEQ ID NO: 661677 - protein, 21 aa, Mycobacterium
FVAAGPRPAWRARTDGRPTIC

SEQ ID NO: 661678 - protein, 21 aa, Mycobacterium
FVAAHVPYLAWLLQNSANATA

SEQ ID NO: 661679 - protein, 24 aa, Mycobacterium
FVAALERPRRVLIMVKAGDPTDAV

SEQ ID NO: 661680 - protein, 19 aa, Mycobacterium
FVAALHAIWSAWRDGGKLR

SEQ ID NO: 661681 - protein, 20 aa, Mycobacterium
FVAALHAIWSVWKDGGKLRF

SEQ ID NO: 661682 - protein, 31 aa, Mycobacterium
FVAARRFAIPAVESKGSLLLEDVGVPLPALA

SEQ ID NO: 661683 - protein, 21 aa, Mycobacterium
FVAATGRPLIGNGANGAPGTG

SEQ ID NO: 661684 - protein, 17 aa, Mycobacterium
FVACEALGLAGDDPRGV

SEQ ID NO: 661685 - protein, 23 aa, Mycobacterium
FVACLRRELGRFVEAVRGDIDLT

SEQ ID NO: 661686 - protein, 19 aa, Mycobacterium
FVACPFGEPGARMYRTGDL

SEQ ID NO: 661687 - protein, 20 aa, Mycobacterium
FVACPFGEPGTRMYRTGDLV

SEQ ID NO: 661688 - protein, 17 aa, Mycobacterium
FVACPFGGEGARMYRTG

SEQ ID NO: 661689 - protein, 17 aa, Mycobacterium
FVACPFGGTAGSRMYRT

SEQ ID NO: 661690 - protein, 24 aa, Mycobacterium
FVADLLPQVFRWARSVDPIQPLTS

SEQ ID NO: 661691 - protein, 17 aa, Mycobacterium
FVADRCGTGTAALCAFG

SEQ ID NO: 661692 - protein, 17 aa, Mycobacterium
FVADRCRCRVTAVDLTD

SEQ ID NO: 661693 - protein, 18 aa, Mycobacterium
FVADVAGFDAEFFGISAR

SEQ ID NO: 661694 - protein, 23 aa, Mycobacterium
FVADVGAAFARLVRDSLEQPATQ

SEQ ID NO: 661695 - protein, 17 aa, Mycobacterium
FVADVVIRTRAWENQIY

SEQ ID NO: 661696 - protein, 25 aa, Mycobacterium
FVAEFLPHDVLLPLVDVLVTNGGYG

SEQ ID NO: 661697 - protein, 17 aa, Mycobacterium
FVAEMKAAGLSRLLEAK

SEQ ID NO: 661698 - protein, 23 aa, Mycobacterium
FVAESRLGTEIAVARATNALVPE

SEQ ID NO: 661699 - protein, 19 aa, Mycobacterium
FVAEWTMTAEDRWLQFSSV

SEQ ID NO: 661700 - protein, 17 aa, Mycobacterium
FVAGVGRPLSESSQNDE

SEQ ID NO: 661701 - protein, 19 aa, Mycobacterium
FVAHLPAAVDPGTRVAAEK

SEQ ID NO: 661702 - protein, 19 aa, Mycobacterium
FVAHSVWQRMGDAFLGAVA

SEQ ID NO: 661703 - protein, 17 aa, Mycobacterium
FVAIPLANTLKGVHAVR

SEQ ID NO: 661704 - protein, 17 aa, Mycobacterium
FVALPLLAGYDLDDPNP

SEQ ID NO: 661705 - protein, 25 aa, Mycobacterium
FVANPFGGPGARMYRTGDLVCWGED

SEQ ID NO: 661706 - protein, 25 aa, Mycobacterium
FVANPFGGPGARMYRTGDLVCWGPD

SEQ ID NO: 661707 - protein, 18 aa, Mycobacterium
FVAQLGFAVAPRVREAIE

SEQ ID NO: 661708 - protein, 25 aa, Mycobacterium
FVARASTLFLRRGEQPPGPRFTTTV

SEQ ID NO: 661709 - protein, 29 aa, Mycobacterium
FVARRLLAERVMIVFACREKITELRGFPE

SEQ ID NO: 661710 - protein, 18 aa, Mycobacterium
FVASALRAREGGIDGIEL

SEQ ID NO: 661711 - protein, 28 aa, Mycobacterium
FVASEANVIWKLRYTMRSQIFSRGLPLP

SEQ ID NO: 661712 - protein, 17 aa, Mycobacterium
FVASRRWTTSRLAKKYG

SEQ ID NO: 661713 - protein, 27 aa, Mycobacterium
FVATVYERLWRPAAFYLASGVTTRAEQ

SEQ ID NO: 661714 - protein, 17 aa, Mycobacterium
FVAWQAARCVASWNGSR

SEQ ID NO: 661715 - protein, 18 aa, Mycobacterium
FVAYAVRDWCRFNSAGSL

SEQ ID NO: 661716 - protein, 21 aa, Mycobacterium
FVCAVDMPLVAPALIDELAAG

SEQ ID NO: 661717 - protein, 17 aa, Mycobacterium
FVCDQLAAATPWWEPGT

SEQ ID NO: 661718 - protein, 19 aa, Mycobacterium
FVCLLTCPEGIAAVQEAHP

SEQ ID NO: 661719 - protein, 17 aa, Mycobacterium
FVCLVTCPEGVAALTGA

SEQ ID NO: 661720 - protein, 21 aa, Mycobacterium
FVCSIRAWAYQIADLATDYRV

SEQ ID NO: 661721 - protein, 25 aa, Mycobacterium
FVDAGFRTGFVVARNAATGAALADR

SEQ ID NO: 661722 - protein, 17 aa, Mycobacterium
FVDAMVAIRGEIDLVMW

SEQ ID NO: 661723 - protein, 27 aa, Mycobacterium
FVDDISRPGMLHACFVRSPFARATIRG

SEQ ID NO: 661724 - protein, 18 aa, Mycobacterium
FVDEFGRTWQSVIPEETD

SEQ ID NO: 661725 - protein, 24 aa, Mycobacterium
FVDEPRWRRLWVGVQGMVRATWLV

SEQ ID NO: 661726 - protein, 18 aa, Mycobacterium
FVDEYLWALDSLHRHGAR

SEQ ID NO: 661727 - protein, 22 aa, Mycobacterium
FVDFPMDYVFSMSDDDGRPGAL

SEQ ID NO: 661728 - protein, 23 aa, Mycobacterium
FVDGKGVPCLIAIDQDPKGEGQA

SEQ ID NO: 661729 - protein, 17 aa, Mycobacterium
FVDMALAVGDYVGCPAV

SEQ ID NO: 661730 - protein, 17 aa, Mycobacterium
FVDPDVLIRTNWQVTNR

SEQ ID NO: 661731 - protein, 19 aa, Mycobacterium
FVDPFAMVLPIRLSGTRPP

SEQ ID NO: 661732 - protein, 18 aa, Mycobacterium
FVDRARALGISRVALAAA

SEQ ID NO: 661733 - protein, 18 aa, Mycobacterium
FVDRGYHAAGMDEIADRA

SEQ ID NO: 661734 - protein, 17 aa, Mycobacterium
FVDRIKPVGALVVCVDD

SEQ ID NO: 661735 - protein, 26 aa, Mycobacterium
FVDRLVKRAATIVVGPTRDWDTDLGP

SEQ ID NO: 661736 - protein, 20 aa, Mycobacterium
FVDSLLRWGLTRWWQGHRFY

SEQ ID NO: 661737 - protein, 25 aa, Mycobacterium
FVEACKGVSVPLRLTSPAPCTTCHG

SEQ ID NO: 661738 - protein, 22 aa, Mycobacterium
FVEDRLKDMIISGGENIYSIEV

SEQ ID NO: 661739 - protein, 17 aa, Mycobacterium
FVEEFILDQTMEPALAD

SEQ ID NO: 661740 - protein, 22 aa, Mycobacterium
FVEELLARYGIAPSPEAGAERI

SEQ ID NO: 661741 - protein, 18 aa, Mycobacterium
FVEETGTTPMQWITDQRV

SEQ ID NO: 661742 - protein, 18 aa, Mycobacterium
FVEFSRQRGVAVDGRCKS

SEQ ID NO: 661743 - protein, 23 aa, Mycobacterium
FVEHLKGMFAFAIAERDTGRVLL

SEQ ID NO: 661744 - protein, 17 aa, Mycobacterium
FVEHMGLLLQRPVVTIS

SEQ ID NO: 661745 - protein, 19 aa, Mycobacterium
FVEIAGRYGYLLATPEENA

SEQ ID NO: 661746 - protein, 26 aa, Mycobacterium
FVEILPTPFLPAGIFDQWGLDADDRR

SEQ ID NO: 661747 - protein, 22 aa, Mycobacterium
FVEIRRAAGLSAELTVIEAAMA

SEQ ID NO: 661748 - protein, 19 aa, Mycobacterium
FVELPARGDSPGVVRFLPM

SEQ ID NO: 661749 - protein, 18 aa, Mycobacterium
FVELSAYAEGLGFAGVLA

SEQ ID NO: 661750 - protein, 24 aa, Mycobacterium
FVEMFTKLGGLMAERVTDLRDIRD

SEQ ID NO: 661751 - protein, 23 aa, Mycobacterium
FVEQRVRVQLARWTYPLEGEEGA

SEQ ID NO: 661752 - protein, 18 aa, Mycobacterium
FVERAVTFTTCPECDGTR

SEQ ID NO: 661753 - protein, 17 aa, Mycobacterium
FVERIRLHQLAVGNHSA

SEQ ID NO: 661754 - protein, 17 aa, Mycobacterium
FVERLARRIFNFQTRNY

SEQ ID NO: 661755 - protein, 17 aa, Mycobacterium
FVERLTLAPAQQRKKLL

SEQ ID NO: 661756 - protein, 17 aa, Mycobacterium
FVERWRSPVRRVLTADL

SEQ ID NO: 661757 - protein, 24 aa, Mycobacterium
FVESRLAPRLYRRNQYVTVSLPSA

SEQ ID NO: 661758 - protein, 19 aa, Mycobacterium
FVESVPPHILIAIDEAYVE

SEQ ID NO: 661759 - protein, 24 aa, Mycobacterium
FVETLGLGRYVIWLHDYGSQFGFQ

SEQ ID NO: 661760 - protein, 23 aa, Mycobacterium
FVEVRRAGIALAREVERRAPDAV

SEQ ID NO: 661761 - protein, 23 aa, Mycobacterium
FVEVRRAGIALAREVERRAPEAV

SEQ ID NO: 661762 - protein, 27 aa, Mycobacterium
FVEYAEFLPGALLVPAIHLVRAAHLGQ

SEQ ID NO: 661763 - protein, 18 aa, Mycobacterium
FVEYARRRGSVLATGEVL

SEQ ID NO: 661764 - protein, 20 aa, Mycobacterium
FVFAEVWQRPALTRRQRRFV

SEQ ID NO: 661765 - protein, 20 aa, Mycobacterium
FVFAEVWQRPGLTRRERRFV

SEQ ID NO: 661766 - protein, 18 aa, Mycobacterium
FVFARAASTLDNLSNGRI

SEQ ID NO: 661767 - protein, 21 aa, Mycobacterium
FVFDSLADLVAFVRSDTDNDL

SEQ ID NO: 661768 - protein, 17 aa, Mycobacterium
FVFHSAQVREDRLHQQL

SEQ ID NO: 661769 - protein, 25 aa, Mycobacterium
FVFPTHCPECGSELAPAKEGDADIR

SEQ ID NO: 661770 - protein, 23 aa, Mycobacterium
FVFTVPKLRAAEQVTAAVWVCEA

SEQ ID NO: 661771 - protein, 23 aa, Mycobacterium
FVFTVPKLRAGDQVGAAVQLCEA

SEQ ID NO: 661772 - protein, 18 aa, Mycobacterium
FVGAPAHREHWSRLTDAV

SEQ ID NO: 661773 - protein, 36 aa, Mycobacterium
FVGATSRPSALSLDDVVKFLLPRGAAKKAAKGAAST

SEQ ID NO: 661774 - protein, 35 aa, Mycobacterium
FVGATSRPSALTLDDVVKFLLPRGAAKKTAKAAST

SEQ ID NO: 661775 - protein, 36 aa, Mycobacterium
FVGATSRPSALTLDDVVKFLLPRGATKKAAKGAATT

SEQ ID NO: 661776 - protein, 20 aa, Mycobacterium
FVGAWPRSGGKIDYDAMRAE

SEQ ID NO: 661777 - protein, 19 aa, Mycobacterium
FVGECRDGGRLMELPLDGG

SEQ ID NO: 661778 - protein, 23 aa, Mycobacterium
FVGELRAGLRAADCALFVIAANE

SEQ ID NO: 661779 - protein, 24 aa, Mycobacterium
FVGELRAGLRAADCALFVIAANET

SEQ ID NO: 661780 - protein, 20 aa, Mycobacterium
FVGEVEYLLSTGLRDGVTAS

SEQ ID NO: 661781 - protein, 17 aa, Mycobacterium
FVGFRAREIILSLFESI

SEQ ID NO: 661782 - protein, 18 aa, Mycobacterium
FVGFRGREIVLTLFEKIS

SEQ ID NO: 661783 - protein, 18 aa, Mycobacterium
FVGFRGREIVLTLFESIT

SEQ ID NO: 661784 - protein, 23 aa, Mycobacterium
FVGFRRACEAIARVEVPVIAAVE

SEQ ID NO: 661785 - protein, 18 aa, Mycobacterium
FVGHLEHAELLAVLHRAD

SEQ ID NO: 661786 - protein, 24 aa, Mycobacterium
FVGREMKHKLSLRASNTSELHLDD

SEQ ID NO: 661787 - protein, 31 aa, Mycobacterium
FVHAAAVRHLWTLAPGRVFLGLGSGTSRMNK

SEQ ID NO: 661788 - protein, 20 aa, Mycobacterium
FVHAHPRWIAQAFADALGPA

SEQ ID NO: 661789 - protein, 19 aa, Mycobacterium
FVHFQWRAQHDDLKNLPFP

SEQ ID NO: 661790 - protein, 19 aa, Mycobacterium
FVHFQWRAQHEDLKKLPFP

SEQ ID NO: 661791 - protein, 19 aa, Mycobacterium
FVHFQWRAQHEDLKTLPFP

SEQ ID NO: 661792 - protein, 17 aa, Mycobacterium
FVHLTLILLRSMGIPGR

SEQ ID NO: 661793 - protein, 20 aa, Mycobacterium
FVIATPEILTAASSDLAAVG

SEQ ID NO: 661794 - protein, 25 aa, Mycobacterium
FVIEPLEPGFGYTLGNSLRRTLLSS

SEQ ID NO: 661795 - protein, 23 aa, Mycobacterium
FVIGASNRFAHAAALAIAEAPAR

SEQ ID NO: 661796 - protein, 21 aa, Mycobacterium
FVIGASNRFAHAASLAIAEAP

SEQ ID NO: 661797 - protein, 20 aa, Mycobacterium
FVIGASNRFSHAAAVAVSEA

SEQ ID NO: 661798 - protein, 29 aa, Mycobacterium
FVIGHDWGAPVAWTFAWLYPQRCAGVVGI

SEQ ID NO: 661799 - protein, 31 aa, Mycobacterium
FVILNWRAVCGQCRACKRGRPHLCFDTHNAA

SEQ ID NO: 661800 - protein, 18 aa, Mycobacterium
FVILRPAPSGTRLLLSDA

SEQ ID NO: 661801 - protein, 23 aa, Mycobacterium
FVILRPAPSGTRLLLSDATAALD

SEQ ID NO: 661802 - protein, 18 aa, Mycobacterium
FVIRRAILAIERVELRLL

SEQ ID NO: 661803 - protein, 18 aa, Mycobacterium
FVISGRWPDSTKEWAQLL

SEQ ID NO: 661804 - protein, 20 aa, Mycobacterium
FVISPYSRGGLMVHDQFDHT

SEQ ID NO: 661805 - protein, 21 aa, Mycobacterium
FVKAVAGGGGRGMRRVAERDQ

SEQ ID NO: 661806 - protein, 24 aa, Mycobacterium
FVKDKPAWLDRAWRRITEEVSAGR

SEQ ID NO: 661807 - protein, 19 aa, Mycobacterium
FVKEQVCRFTITWLAAEAR

SEQ ID NO: 661808 - protein, 19 aa, Mycobacterium
FVKIFCRPATGVVIGGVVV

SEQ ID NO: 661809 - protein, 24 aa, Mycobacterium
FVKLQEWVRHSGARLVVVFEGRDG

SEQ ID NO: 661810 - protein, 17 aa, Mycobacterium
FVKLVARCANVEGVGEV

SEQ ID NO: 661811 - protein, 26 aa, Mycobacterium
FVKNNGWPLAHTVIRHYKLHARASAD

SEQ ID NO: 661812 - protein, 33 aa, Mycobacterium
FVKPARAGSSFGVSRVTAWEELPAAIAHARQYD

SEQ ID NO: 661813 - protein, 17 aa, Mycobacterium
FVKPVLNLWEFAKPTIA

SEQ ID NO: 661814 - protein, 17 aa, Mycobacterium
FVLADTGLLDGRRATTH

SEQ ID NO: 661815 - protein, 24 aa, Mycobacterium
FVLDGWLRPVPPGTVGELYVAGTG

SEQ ID NO: 661816 - protein, 17 aa, Mycobacterium
FVLDLLADYGLDDFYLE

SEQ ID NO: 661817 - protein, 26 aa, Mycobacterium
FVLDRMRDAAAFVCTDTGIMLAQNAM

SEQ ID NO: 661818 - protein, 19 aa, Mycobacterium
FVLEGRLARHAVYPNLGVE

SEQ ID NO: 661819 - protein, 20 aa, Mycobacterium
FVLEIGWISGGWVPRLRPLV

SEQ ID NO: 661820 - protein, 30 aa, Mycobacterium
FVLGARLTVPVGMIILRKGYGLGAMAMAGG

SEQ ID NO: 661821 - protein, 27 aa, Mycobacterium
FVLLDGWKDLYLPVIELLEPRLSTGAL

SEQ ID NO: 661822 - protein, 31 aa, Mycobacterium
FVLLDGWKDLYLPVVRLLEPVLPAGALILAD

SEQ ID NO: 661823 - protein, 17 aa, Mycobacterium
FVLMLKLVQQMMVSSSA

SEQ ID NO: 661824 - protein, 18 aa, Mycobacterium
FVLPARPAENILFVSGGS

SEQ ID NO: 661825 - protein, 19 aa, Mycobacterium
FVLPLVRSDVRAMHSGATV

SEQ ID NO: 661826 - protein, 20 aa, Mycobacterium
FVLPPAVLEKMRFVHTVIDE

SEQ ID NO: 661827 - protein, 20 aa, Mycobacterium
FVLPPDRLAAAVLALTTAPG

SEQ ID NO: 661828 - protein, 20 aa, Mycobacterium
FVLRELRAGVHFNALSISGI

SEQ ID NO: 661829 - protein, 26 aa, Mycobacterium
FVLRELRGGVHFNLLALSGVTPVEAH

SEQ ID NO: 661830 - protein, 18 aa, Mycobacterium
FVLRGDSTLRGHVFAETE

SEQ ID NO: 661831 - protein, 31 aa, Mycobacterium
FVLRGGKRVRPAFAYWGWRSVIEPADAVAGP

SEQ ID NO: 661832 - protein, 17 aa, Mycobacterium
FVLTAGAGWTLAEAEVD

SEQ ID NO: 661833 - protein, 25 aa, Mycobacterium
FVLTLRLLTVALRRHVVLNATWMET

SEQ ID NO: 661834 - protein, 24 aa, Mycobacterium
FVLTLRLLVIALRHNEILNSAWVE

SEQ ID NO: 661835 - protein, 17 aa, Mycobacterium
FVLTRPCVLFSKLNPRI

SEQ ID NO: 661836 - protein, 17 aa, Mycobacterium
FVMCTNGMFVVPRRTPG

SEQ ID NO: 661837 - protein, 25 aa, Mycobacterium
FVMLAAEFGRWVGPFAAPSANRRRA

SEQ ID NO: 661838 - protein, 34 aa, Mycobacterium
FVMPTKGVWTSGFGYRWGVLHGGIDIANSIGTPI

SEQ ID NO: 661839 - protein, 25 aa, Mycobacterium
FVMPTTCPECGTPLAPEKEGDADIR

SEQ ID NO: 661840 - protein, 24 aa, Mycobacterium
FVMPTTCPECGTTLAPAKEGDADI

SEQ ID NO: 661841 - protein, 25 aa, Mycobacterium
FVMPTTCPECGTVLAPEKEGDADIR

SEQ ID NO: 661842 - protein, 19 aa, Mycobacterium
FVMRGGAFVGELDREALDH

SEQ ID NO: 661843 - protein, 21 aa, Mycobacterium
FVMSEGCVMVLLKRLDDAVRD

SEQ ID NO: 661844 - protein, 19 aa, Mycobacterium
FVNAARLARDAGFDGVEIH

SEQ ID NO: 661845 - protein, 18 aa, Mycobacterium
FVNCEVIGFVVTAPDSPT

SEQ ID NO: 661846 - protein, 20 aa, Mycobacterium
FVNDLLPAPVRAFPFNALLK

SEQ ID NO: 661847 - protein, 22 aa, Mycobacterium
FVNRFIPGFLRQGGSHVLLADV

SEQ ID NO: 661848 - protein, 26 aa, Mycobacterium
FVNRHGWRSLPQWPPATTERVLYLQP

SEQ ID NO: 661849 - protein, 25 aa, Mycobacterium
FVNSRPKPLSAYLFTKRRETRERVI

SEQ ID NO: 661850 - protein, 25 aa, Mycobacterium
FVNSRPKPLSAYLFTKSREIRERVI

SEQ ID NO: 661851 - protein, 25 aa, Mycobacterium
FVNSRPKPLSAYLFTKTRETRERVI

SEQ ID NO: 661852 - protein, 17 aa, Mycobacterium
FVNTFGVFATRRPYEQV

SEQ ID NO: 661853 - protein, 20 aa, Mycobacterium
FVNVCTWALHANTFPRFSAY

SEQ ID NO: 661854 - protein, 25 aa, Mycobacterium
FVNVYRVVSNLGVFDFGGPEHTMRA

SEQ ID NO: 661855 - protein, 25 aa, Mycobacterium
FVNVYRVVTNLGVFDFGGPDHTMRA

SEQ ID NO: 661856 - protein, 25 aa, Mycobacterium
FVNVYRVVTNLGVFDFNGPDHQMRA

SEQ ID NO: 661857 - protein, 24 aa, Mycobacterium
FVPAFSGLFAPYWRSDARGAIVGL

SEQ ID NO: 661858 - protein, 17 aa, Mycobacterium
FVPCHRVFRIGGALGGF

SEQ ID NO: 661859 - protein, 23 aa, Mycobacterium
FVPDPFVPGARMYRTGDVVRRAV

SEQ ID NO: 661860 - protein, 20 aa, Mycobacterium
FVPDVAGFDAEFFGITPREA

SEQ ID NO: 661861 - protein, 25 aa, Mycobacterium
FVPGDEVYGLIAFDRDGAAADFVAV

SEQ ID NO: 661862 - protein, 18 aa, Mycobacterium
FVPMPGLPLEAAITARQA

SEQ ID NO: 661863 - protein, 18 aa, Mycobacterium
FVPNPAAAALEAQVYPSP

SEQ ID NO: 661864 - protein, 25 aa, Mycobacterium
FVPPIPDRVDVVWLEHDEGPARAGG

SEQ ID NO: 661865 - protein, 20 aa, Mycobacterium
FVPPTLRGELTWCQLFSEPG

SEQ ID NO: 661866 - protein, 24 aa, Mycobacterium
FVPSAGAVLAEWGAEVIKVEPREG

SEQ ID NO: 661867 - protein, 18 aa, Mycobacterium
FVPSAGAVLGEWGADVIK

SEQ ID NO: 661868 - protein, 26 aa, Mycobacterium
FVPSHRWAVEGGWNIADCVERAYDLE

SEQ ID NO: 661869 - protein, 25 aa, Mycobacterium
FVPTWAGVAYVCFIVDAYSRMIVGW

SEQ ID NO: 661870 - protein, 19 aa, Mycobacterium
FVPVVGEILADLAISGATA

SEQ ID NO: 661871 - protein, 18 aa, Mycobacterium
FVPYFLGARTPEYPTATS

SEQ ID NO: 661872 - protein, 20 aa, Mycobacterium
FVQDWGSLIGLRIAAEQDAR

SEQ ID NO: 661873 - protein, 17 aa, Mycobacterium
FVQDWGSLIGLRVAAEH

SEQ ID NO: 661874 - protein, 18 aa, Mycobacterium
FVQIGAMTGETISVNAST

SEQ ID NO: 661875 - protein, 17 aa, Mycobacterium
FVQLLAALGRRYDGDER

SEQ ID NO: 661876 - protein, 18 aa, Mycobacterium
FVRDGELFIIGRIKDLLI

SEQ ID NO: 661877 - protein, 24 aa, Mycobacterium
FVRDWSEMFTMWPTKQTPGSRTQL

SEQ ID NO: 661878 - protein, 19 aa, Mycobacterium
FVRFCDSFNTPLVFVVDTP

SEQ ID NO: 661879 - protein, 22 aa, Mycobacterium
FVRGEGAGVVVLKRLTDALRDQ

SEQ ID NO: 661880 - protein, 21 aa, Mycobacterium
FVRGEGAGVVVLKRLTDAQQD

SEQ ID NO: 661881 - protein, 25 aa, Mycobacterium
FVRGLPRDRRPRVVAVDSVPDSVAA

SEQ ID NO: 661882 - protein, 18 aa, Mycobacterium
FVRGRPADFDGWAVSGWS

SEQ ID NO: 661883 - protein, 17 aa, Mycobacterium
FVRKVFNRLAMAANIGE

SEQ ID NO: 661884 - protein, 19 aa, Mycobacterium
FVRLLRYLPGGTLLESGYL

SEQ ID NO: 661885 - protein, 25 aa, Mycobacterium
FVRLQEWVRHAGARVVVIFEGRDAA

SEQ ID NO: 661886 - protein, 26 aa, Mycobacterium
FVRLRARVAAELSTTFASHYTREVSL

SEQ ID NO: 661887 - protein, 19 aa, Mycobacterium
FVRMLKLPKAVRERYDVSS

SEQ ID NO: 661888 - protein, 17 aa, Mycobacterium
FVRRGARWLAYDRETRA

SEQ ID NO: 661889 - protein, 18 aa, Mycobacterium
FVRRLVARASTLVVGDPM

SEQ ID NO: 661890 - protein, 21 aa, Mycobacterium
FVRRLWWRTVVDLPEDPLLHT

SEQ ID NO: 661891 - protein, 25 aa, Mycobacterium
FVRRPERWIRELARKEGDTGGTISV

SEQ ID NO: 661892 - protein, 25 aa, Mycobacterium
FVRRVRAALPPTSWGVRASGDPDAV

SEQ ID NO: 661893 - protein, 26 aa, Mycobacterium
FVRSACRWTPRVAFVNGHGGNVDALR

SEQ ID NO: 661894 - protein, 18 aa, Mycobacterium
FVRSCSAPLDPATAEAAE

SEQ ID NO: 661895 - protein, 24 aa, Mycobacterium
FVRSEGCAMVLLKRLPDALRDGNR

SEQ ID NO: 661896 - protein, 22 aa, Mycobacterium
FVRSPFARARINSIDASAALAL

SEQ ID NO: 661897 - protein, 20 aa, Mycobacterium
FVRSPFARATIRGIDTSAAL

SEQ ID NO: 661898 - protein, 29 aa, Mycobacterium
FVRSRPGLDLPDLELIFAPAPFYDEGLPA

SEQ ID NO: 661899 - protein, 26 aa, Mycobacterium
FVRSRRPGEIASIFVPSVPNLLQLAS

SEQ ID NO: 661900 - protein, 22 aa, Mycobacterium
FVRTSGYLAGPHDVYVSMNMVR

SEQ ID NO: 661901 - protein, 25 aa, Mycobacterium
FVSAIDVLVGLNWLAPSRLDIWRQG

SEQ ID NO: 661902 - protein, 17 aa, Mycobacterium
FVSDTIVLPGMVVPITL

SEQ ID NO: 661903 - protein, 18 aa, Mycobacterium
FVSEELFKVTDRCVQVLG

SEQ ID NO: 661904 - protein, 26 aa, Mycobacterium
FVSEGKCLRSTFMYLGWLCGAGPNNA

SEQ ID NO: 661905 - protein, 17 aa, Mycobacterium
FVSENFLGDTYHGATTH

SEQ ID NO: 661906 - protein, 26 aa, Mycobacterium
FVSGGKCLRSTFVYLGWLCGAPADPA

SEQ ID NO: 661907 - protein, 18 aa, Mycobacterium
FVSGGSRRNLEWVSPHID

SEQ ID NO: 661908 - protein, 23 aa, Mycobacterium
FVSGLGFKVSDLVKGHGAFLRCS

SEQ ID NO: 661909 - protein, 26 aa, Mycobacterium
FVSGPGDRPAWSMIFEDLGHRRRPAP

SEQ ID NO: 661910 - protein, 18 aa, Mycobacterium
FVSMANRIPFPLTAWAVR

SEQ ID NO: 661911 - protein, 17 aa, Mycobacterium
FVSNLRALVALRGAGSR

SEQ ID NO: 661912 - protein, 18 aa, Mycobacterium
FVSQLGFAVAPRVRDAIE

SEQ ID NO: 661913 - protein, 18 aa, Mycobacterium
FVSQLGFSVAPRVLEALI

SEQ ID NO: 661914 - protein, 18 aa, Mycobacterium
FVSQLGFTVAPRVLEALH

SEQ ID NO: 661915 - protein, 18 aa, Mycobacterium
FVSQLGFTVAPRVRAAIE

SEQ ID NO: 661916 - protein, 18 aa, Mycobacterium
FVSQLGFTVAPRVRRALE

SEQ ID NO: 661917 - protein, 18 aa, Mycobacterium
FVSQLGFTVAPRVRTAIE

SEQ ID NO: 661918 - protein, 26 aa, Mycobacterium
FVSRGKCLRSTFMYLGWLCGAAPSRA

SEQ ID NO: 661919 - protein, 22 aa, Mycobacterium
FVSRVGAVLPQTSWGVRAAGDP

SEQ ID NO: 661920 - protein, 19 aa, Mycobacterium
FVSTWKVFEEFARDGRARS

SEQ ID NO: 661921 - protein, 31 aa, Mycobacterium
FVSVWRAGAFGTLEWASLMFASIYLGMQQRI

SEQ ID NO: 661922 - protein, 17 aa, Mycobacterium
FVSYRQQRILAVADIGR

SEQ ID NO: 661923 - protein, 18 aa, Mycobacterium
FVTALGRAVVNRGATLRT

SEQ ID NO: 661924 - protein, 24 aa, Mycobacterium
FVTCTNCGPRFTIIRDLPYDRPGT

SEQ ID NO: 661925 - protein, 27 aa, Mycobacterium
FVTDPDTLRPMGWQDGVGIAFADVVTG

SEQ ID NO: 661926 - protein, 24 aa, Mycobacterium
FVTELRPELSVAVLEAKHVGAGAT

SEQ ID NO: 661927 - protein, 18 aa, Mycobacterium
FVTESYTTLAGRAEDDGE

SEQ ID NO: 661928 - protein, 25 aa, Mycobacterium
FVTGRLKDLIIIRGRNYYPEDIEAA

SEQ ID NO: 661929 - protein, 26 aa, Mycobacterium
FVTKDRWSMEWYYPILGGALRGPRAQ

SEQ ID NO: 661930 - protein, 17 aa, Mycobacterium
FVTKHVSLRGCVFDVAT

SEQ ID NO: 661931 - protein, 17 aa, Mycobacterium
FVTLPMRYLPPEREAEV

SEQ ID NO: 661932 - protein, 18 aa, Mycobacterium
FVTPFIWRMDTFGRPHLE

SEQ ID NO: 661933 - protein, 17 aa, Mycobacterium
FVTSGWFIGHLPLAVPV

SEQ ID NO: 661934 - protein, 19 aa, Mycobacterium
FVTYLGWLYSWGSPLTLIG

SEQ ID NO: 661935 - protein, 18 aa, Mycobacterium
FVVAGGFDDLTLEAIIGF

SEQ ID NO: 661936 - protein, 18 aa, Mycobacterium
FVVAPVRSVPGVASMVGY

SEQ ID NO: 661937 - protein, 29 aa, Mycobacterium
FVVATGRPPRWIRPVVDALGFAPIAVCAN

SEQ ID NO: 661938 - protein, 28 aa, Mycobacterium
FVVATGRPPRWIRPVVDALGFAPTAVCA

SEQ ID NO: 661939 - protein, 27 aa, Mycobacterium
FVVCNEILPRWGVETVFVDGDDLAQWE

SEQ ID NO: 661940 - protein, 27 aa, Mycobacterium
FVVCNEILPRWGVETVFVDGDDLEQWE

SEQ ID NO: 661941 - protein, 27 aa, Mycobacterium
FVVCNEILPRWGVETVFVDGEDISQWE

SEQ ID NO: 661942 - protein, 27 aa, Mycobacterium
FVVCNEILPRWGVETVFVDGEDLAQWE

SEQ ID NO: 661943 - protein, 18 aa, Mycobacterium
FVVDITMWIDLADAARSD

SEQ ID NO: 661944 - protein, 18 aa, Mycobacterium
FVVESGADIGLAFDGDAD

SEQ ID NO: 661945 - protein, 24 aa, Mycobacterium
FVVFEPNLLWGLWEEGVAVRGAAA

SEQ ID NO: 661946 - protein, 19 aa, Mycobacterium
FVVGMSLGGLTAIRLGAVA

SEQ ID NO: 661947 - protein, 18 aa, Mycobacterium
FVVIAGLQDGLWPNTVPR

SEQ ID NO: 661948 - protein, 21 aa, Mycobacterium
FVVINGCRRLAAAHKYGRTDL

SEQ ID NO: 661949 - protein, 17 aa, Mycobacterium
FVVIPARHPGVDHVDDW

SEQ ID NO: 661950 - protein, 18 aa, Mycobacterium
FVVLAGLQEGLWPNVSPR

SEQ ID NO: 661951 - protein, 19 aa, Mycobacterium
FVVLLVVHHICWDDNSWEV

SEQ ID NO: 661952 - protein, 17 aa, Mycobacterium
FVVLRSPEQRAVVAAAA

SEQ ID NO: 661953 - protein, 17 aa, Mycobacterium
FVVPNWMWHAHMNRSSE

SEQ ID NO: 661954 - protein, 26 aa, Mycobacterium
FVVPRGRSVPAFRQLWTSNLPALDDT

SEQ ID NO: 661955 - protein, 23 aa, Mycobacterium
FVVRLKGGDPFVFARGYEEVLAC

SEQ ID NO: 661956 - protein, 17 aa, Mycobacterium
FVVSGRWPDSTKEWAQL

SEQ ID NO: 661957 - protein, 18 aa, Mycobacterium
FVVSGRWPDSTKEWAQLL

SEQ ID NO: 661958 - protein, 18 aa, Mycobacterium
FVVSLEVRRSAVTDRADV

SEQ ID NO: 661959 - protein, 20 aa, Mycobacterium
FVWDAWTVGLQWWRRFGQDR

SEQ ID NO: 661960 - protein, 20 aa, Mycobacterium
FVWDAWTVGLQWWRRFGQER

SEQ ID NO: 661961 - protein, 24 aa, Mycobacterium
FVWIRKRYEVAEGHTPSVQFGNER

SEQ ID NO: 661962 - protein, 17 aa, Mycobacterium
FVYAVVPHDEWSEARPE

SEQ ID NO: 661963 - protein, 20 aa, Mycobacterium
FWAAGALRLPTDDGLTLLAD

SEQ ID NO: 661964 - protein, 25 aa, Mycobacterium
FWAAYCRPCQAFAPIYEKSARTHPD

SEQ ID NO: 661965 - protein, 18 aa, Mycobacterium
FWADPEIFETTDYNFETV

SEQ ID NO: 661966 - protein, 18 aa, Mycobacterium
FWADPEIFETTNYDFETI

SEQ ID NO: 661967 - protein, 18 aa, Mycobacterium
FWADPEIFETTQYDFETV

SEQ ID NO: 661968 - protein, 18 aa, Mycobacterium
FWADPEIFETTTYDFETV

SEQ ID NO: 661969 - protein, 21 aa, Mycobacterium
FWAFPRSCNPTGGLMSTARDQ

SEQ ID NO: 661970 - protein, 17 aa, Mycobacterium
FWAPLSLSAEQKRSIGD

SEQ ID NO: 661971 - protein, 17 aa, Mycobacterium
FWAPLSLTAEQKHSIDD

SEQ ID NO: 661972 - protein, 19 aa, Mycobacterium
FWAQDATAMYCYASTSTSF

SEQ ID NO: 661973 - protein, 18 aa, Mycobacterium
FWASLGWEPFYDSRPGPA

SEQ ID NO: 661974 - protein, 17 aa, Mycobacterium
FWAVTKHADIMAIERAN

SEQ ID NO: 661975 - protein, 22 aa, Mycobacterium
FWDYTGKEYLDFASQLVNLNLG

SEQ ID NO: 661976 - protein, 18 aa, Mycobacterium
FWERSESTVEGFVLPGYA

SEQ ID NO: 661977 - protein, 18 aa, Mycobacterium
FWETVLFRAGLYRGSALH

SEQ ID NO: 661978 - protein, 27 aa, Mycobacterium
FWFDPLCPWAWITSRWILEVEKVRDIE

SEQ ID NO: 661979 - protein, 28 aa, Mycobacterium
FWFDPLCPWAWITSRWVLEAEKVRDIEV

SEQ ID NO: 661980 - protein, 30 aa, Mycobacterium
FWFDPLCPWCWITSRWILEVEKVRDIEVQF

SEQ ID NO: 661981 - protein, 18 aa, Mycobacterium
FWFGEGVVPILRKRGLFD

SEQ ID NO: 661982 - protein, 18 aa, Mycobacterium
FWFSPALLHCQRRTNRVA

SEQ ID NO: 661983 - protein, 20 aa, Mycobacterium
FWFTEERLRTSSDPVSQRWL

SEQ ID NO: 661984 - protein, 17 aa, Mycobacterium
FWGGAGSLACQEFITQL

SEQ ID NO: 661985 - protein, 19 aa, Mycobacterium
FWGGPDGWRERQLPDGTVL

SEQ ID NO: 661986 - protein, 22 aa, Mycobacterium
FWGSLLPAVWSFMLALRSRGLG

SEQ ID NO: 661987 - protein, 34 aa, Mycobacterium
FWGSMEAVGGPSTWRLGGAFNCGKAQPGQVAPVS

SEQ ID NO: 661988 - protein, 25 aa, Mycobacterium
FWHSFRAEIALACGNVAGAKRCADE

SEQ ID NO: 661989 - protein, 17 aa, Mycobacterium
FWHWAVANLPATVTQLP

SEQ ID NO: 661990 - protein, 21 aa, Mycobacterium
FWLDYADGMQPYFTVAATGIE

SEQ ID NO: 661991 - protein, 18 aa, Mycobacterium
FWLLERFAPALGSRWATE

SEQ ID NO: 661992 - protein, 18 aa, Mycobacterium
FWLQQRPGISTAEEAFSG

SEQ ID NO: 661993 - protein, 22 aa, Mycobacterium
FWLREDTELVAPWAGDVVASTG

SEQ ID NO: 661994 - protein, 17 aa, Mycobacterium
FWLTLAPTNRLVTARNR

SEQ ID NO: 661995 - protein, 17 aa, Mycobacterium
FWMLPLDDPLPWLLVDR

SEQ ID NO: 661996 - protein, 24 aa, Mycobacterium
FWMLPVDDLLPWLLVDRRAAKVTR

SEQ ID NO: 661997 - protein, 25 aa, Mycobacterium
FWNGFEMDGCYPASIPIDGVALNIT

SEQ ID NO: 661998 - protein, 21 aa, Mycobacterium
FWNREYDILVCTTIIETGLDI

SEQ ID NO: 661999 - protein, 22 aa, Mycobacterium
FWNREYDILVCTTIVETGLDIS

SEQ ID NO: 662000 - protein, 22 aa, Mycobacterium
FWNRRLTAVEAIVQRALVRGEV

SEQ ID NO: 662001 - protein, 25 aa, Mycobacterium
FWPDFPADGLYKFRVHGADGVVSER

SEQ ID NO: 662002 - protein, 25 aa, Mycobacterium
FWPDFPTNGLYKFRVHGADGVVTER

SEQ ID NO: 662003 - protein, 20 aa, Mycobacterium
FWPHGEVSRAYGVFNDDAGY

SEQ ID NO: 662004 - protein, 18 aa, Mycobacterium
FWPTSAIRAALQGGDIAT

SEQ ID NO: 662005 - protein, 24 aa, Mycobacterium
FWPVVSRPRMRGHDGPSSGPEADG

SEQ ID NO: 662006 - protein, 19 aa, Mycobacterium
FWQSARAGILESLGRPGGE

SEQ ID NO: 662007 - protein, 18 aa, Mycobacterium
FWQSYLQHRDQLLPFYES

SEQ ID NO: 662008 - protein, 17 aa, Mycobacterium
FWRAEVVEVIDPSPDRV

SEQ ID NO: 662009 - protein, 18 aa, Mycobacterium
FWRDNRFQAFEGIAVPKF

SEQ ID NO: 662010 - protein, 21 aa, Mycobacterium
FWREFPLGPAGKILKREIANQ

SEQ ID NO: 662011 - protein, 18 aa, Mycobacterium
FWRGLCPHMTIEGASAVT

SEQ ID NO: 662012 - protein, 20 aa, Mycobacterium
FWRHQLQGLIPCLFPATRSG

SEQ ID NO: 662013 - protein, 20 aa, Mycobacterium
FWRPNYRSTALVDGKASVTA

SEQ ID NO: 662014 - protein, 22 aa, Mycobacterium
FWSELPEVFAALDADRDVRAIV

SEQ ID NO: 662015 - protein, 17 aa, Mycobacterium
FWSELPVVFRELDADPD

SEQ ID NO: 662016 - protein, 18 aa, Mycobacterium
FWSTAAIRAALEGGDIAT

SEQ ID NO: 662017 - protein, 21 aa, Mycobacterium
FWSVVTGVYSPQSWTTIPGGP

SEQ ID NO: 662018 - protein, 18 aa, Mycobacterium
FWTAEPIDLVGPTAARHP

SEQ ID NO: 662019 - protein, 19 aa, Mycobacterium
FWTGDPSNLEWALEQGNSS

SEQ ID NO: 662020 - protein, 17 aa, Mycobacterium
FWTPPGIYTVLDKGNPV

SEQ ID NO: 662021 - protein, 19 aa, Mycobacterium
FWTQFGRVVKEGLLSDFDN

SEQ ID NO: 662022 - protein, 18 aa, Mycobacterium
FWTVMHGFVMLELAGFWG

SEQ ID NO: 662023 - protein, 21 aa, Mycobacterium
FWTYPEWAPRRVGADQFVVHA

SEQ ID NO: 662024 - protein, 20 aa, Mycobacterium
FWVQVGIDPIRIMTSSGTFY

SEQ ID NO: 662025 - protein, 22 aa, Mycobacterium
FWYQIPISLPVIGPRMISDLES

SEQ ID NO: 662026 - protein, 26 aa, Mycobacterium
FYAALEFWSALHGFVLLEMTGVMDDV

SEQ ID NO: 662027 - protein, 17 aa, Mycobacterium
FYAAVLHHWPDSAWWNW

SEQ ID NO: 662028 - protein, 17 aa, Mycobacterium
FYADLIFDRDIKVSARP

SEQ ID NO: 662029 - protein, 28 aa, Mycobacterium
FYAEVAPRLGGPIAPCYHAAVDAQTGAF

SEQ ID NO: 662030 - protein, 17 aa, Mycobacterium
FYAGLLASYPLVSIEDP

SEQ ID NO: 662031 - protein, 21 aa, Mycobacterium
FYAKRGFTVSGTRTFQLGPHQ

SEQ ID NO: 662032 - protein, 19 aa, Mycobacterium
FYAKSGFRISGTRTFRLGA

SEQ ID NO: 662033 - protein, 18 aa, Mycobacterium
FYAQCAIDAKVAFVNALP

SEQ ID NO: 662034 - protein, 18 aa, Mycobacterium
FYAVALLRSREVMPSRLR

SEQ ID NO: 662035 - protein, 19 aa, Mycobacterium
FYAVCGWDAVNDAISRPED

SEQ ID NO: 662036 - protein, 21 aa, Mycobacterium
FYDADREAAAWMRAGAPEGRM

SEQ ID NO: 662037 - protein, 19 aa, Mycobacterium
FYDAIARGGWLGMTIPTEY

SEQ ID NO: 662038 - protein, 18 aa, Mycobacterium
FYDDVRIPLSNVVGDVGE

SEQ ID NO: 662039 - protein, 23 aa, Mycobacterium
FYDELRAAGPLVKGRVSYLTADH

SEQ ID NO: 662040 - protein, 19 aa, Mycobacterium
FYDFLGRHGDSWTIVRRQP

SEQ ID NO: 662041 - protein, 26 aa, Mycobacterium
FYDGVIFHRVIEGFMIQGGDPTGTGR

SEQ ID NO: 662042 - protein, 23 aa, Mycobacterium
FYDIPKTKMCPAPTAPIPILVGG

SEQ ID NO: 662043 - protein, 18 aa, Mycobacterium
FYDLIVVGGGPAGLAAAV

SEQ ID NO: 662044 - protein, 22 aa, Mycobacterium
FYDPQHPYTWGLLGSLPRVEDT

SEQ ID NO: 662045 - protein, 21 aa, Mycobacterium
FYDQLYKLLGLEQLTDAINLL

SEQ ID NO: 662046 - protein, 25 aa, Mycobacterium
FYDRTLEGFTMFALNQGETCTCPSR

SEQ ID NO: 662047 - protein, 18 aa, Mycobacterium
FYDSCRVLPQGDEQPTDL

SEQ ID NO: 662048 - protein, 18 aa, Mycobacterium
FYDVPSMKVCPVPTHPIP

SEQ ID NO: 662049 - protein, 19 aa, Mycobacterium
FYEAALLDALARRRDAELE

SEQ ID NO: 662050 - protein, 31 aa, Mycobacterium
FYELASGRFGWSFEHLHKVQAFHFKGGQGAK

SEQ ID NO: 662051 - protein, 20 aa, Mycobacterium
FYEPRWEPLEEEIEGQPAPT

SEQ ID NO: 662052 - protein, 19 aa, Mycobacterium
FYERDGWNFDGTRRTEIIG

SEQ ID NO: 662053 - protein, 17 aa, Mycobacterium
FYFGGEHGVEGSIARAG

SEQ ID NO: 662054 - protein, 17 aa, Mycobacterium
FYFGGEHGVEGSIAREG

SEQ ID NO: 662055 - protein, 18 aa, Mycobacterium
FYFLEMNTRLQVEHPVTE

SEQ ID NO: 662056 - protein, 17 aa, Mycobacterium
FYFLTGRGALLQLGLLQ

SEQ ID NO: 662057 - protein, 18 aa, Mycobacterium
FYFVYRVDLQTDDGAAQQ

SEQ ID NO: 662058 - protein, 28 aa, Mycobacterium
FYGDIAPRLGGPIAPCYHAAVDTATGVF

SEQ ID NO: 662059 - protein, 28 aa, Mycobacterium
FYGDIAPRLGGPIAPCYHAAVDTSTGVF

SEQ ID NO: 662060 - protein, 24 aa, Mycobacterium
FYGKRAYHALTFGWLLAGLARSVT

SEQ ID NO: 662061 - protein, 20 aa, Mycobacterium
FYGPLHEYFIRRAVDAVRPG

SEQ ID NO: 662062 - protein, 20 aa, Mycobacterium
FYGRRLYDLMSDYWPTADED

SEQ ID NO: 662063 - protein, 17 aa, Mycobacterium
FYHAPVLHQGQYTKDEA

SEQ ID NO: 662064 - protein, 18 aa, Mycobacterium
FYHAPVLHQGQYTKEEAA

SEQ ID NO: 662065 - protein, 24 aa, Mycobacterium
FYHHYNAAFAKRNGMDPLWRDLHT

SEQ ID NO: 662066 - protein, 25 aa, Mycobacterium
FYHLGWLCVWAVLEAVAEPGSAAMA

SEQ ID NO: 662067 - protein, 24 aa, Mycobacterium
FYHYPAEHWIHLRTTNPIESTFAT

SEQ ID NO: 662068 - protein, 40 aa, Mycobacterium
FYLAVEPWVQYGFNLASWAVGWVPWIGILAPQINFFYYLF

SEQ ID NO: 662069 - protein, 20 aa, Mycobacterium
FYLDELEAIIREWIAVIYHH

SEQ ID NO: 662070 - protein, 22 aa, Mycobacterium
FYLEGRLARHAVYPTMGPEPQD

SEQ ID NO: 662071 - protein, 17 aa, Mycobacterium
FYLLAEQKLRGSHHLGH

SEQ ID NO: 662072 - protein, 22 aa, Mycobacterium
FYLSRLQVINWGVFDGYHSIPF

SEQ ID NO: 662073 - protein, 17 aa, Mycobacterium
FYNFPVKLLKRVRDAQR

SEQ ID NO: 662074 - protein, 18 aa, Mycobacterium
FYNLGLAGRAMRRIGAIE

SEQ ID NO: 662075 - protein, 19 aa, Mycobacterium
FYNMCRHRGNKLVWNDYPG

SEQ ID NO: 662076 - protein, 18 aa, Mycobacterium
FYNRRLRAATTRFSVRMK

SEQ ID NO: 662077 - protein, 18 aa, Mycobacterium
FYNSGLRLLRHARDAEKS

SEQ ID NO: 662078 - protein, 17 aa, Mycobacterium
FYNSGLRLLRHVRDAGF

SEQ ID NO: 662079 - protein, 26 aa, Mycobacterium
FYNTRIEALLIAKLGVRFAETPAKRG

SEQ ID NO: 662080 - protein, 18 aa, Mycobacterium
FYNVCRHRGNKLVWNDFP

SEQ ID NO: 662081 - protein, 18 aa, Mycobacterium
FYNVCRHRGNKLVWNDYP

SEQ ID NO: 662082 - protein, 17 aa, Mycobacterium
FYQALGYELDFETDHNS

SEQ ID NO: 662083 - protein, 18 aa, Mycobacterium
FYQCDSHVLALGYIGMTL

SEQ ID NO: 662084 - protein, 25 aa, Mycobacterium
FYQFLGADTGMWAQWLTLPAAAGPI

SEQ ID NO: 662085 - protein, 26 aa, Mycobacterium
FYQVTRLIGALPRLEGTVHVNVAQIL

SEQ ID NO: 662086 - protein, 22 aa, Mycobacterium
FYRELVGLPLFETFGDSFGSNG

SEQ ID NO: 662087 - protein, 23 aa, Mycobacterium
FYRELVGLPLFETFGESYGSNGA

SEQ ID NO: 662088 - protein, 18 aa, Mycobacterium
FYRGVGLTIHEGYGLTET

SEQ ID NO: 662089 - protein, 19 aa, Mycobacterium
FYRGVGLTIHEGYGLTETS

SEQ ID NO: 662090 - protein, 19 aa, Mycobacterium
FYRIAEQKLAAALPAPGTG

SEQ ID NO: 662091 - protein, 17 aa, Mycobacterium
FYRLRHARLDTEPYEGR

SEQ ID NO: 662092 - protein, 17 aa, Mycobacterium
FYRRLDAGQPWTWETVS

SEQ ID NO: 662093 - protein, 19 aa, Mycobacterium
FYRVLELVPQLSWPRPYHP

SEQ ID NO: 662094 - protein, 18 aa, Mycobacterium
FYSFAGMVVDPCAVQDRV

SEQ ID NO: 662095 - protein, 22 aa, Mycobacterium
FYSFRNAYSYPKPVRPQGVPLY

SEQ ID NO: 662096 - protein, 19 aa, Mycobacterium
FYSGADLPELGYTYREYRA

SEQ ID NO: 662097 - protein, 20 aa, Mycobacterium
FYSLDDPWITSAMAEMQQNG

SEQ ID NO: 662098 - protein, 18 aa, Mycobacterium
FYSQFAPGIPEWNLRGTI

SEQ ID NO: 662099 - protein, 22 aa, Mycobacterium
FYSSAPLRFGDYVAKLQYVPLS

SEQ ID NO: 662100 - protein, 21 aa, Mycobacterium
FYSSGVLHIWTRKKLNPSVLR

SEQ ID NO: 662101 - protein, 26 aa, Mycobacterium
FYSTGDAEELLWLQAPPPATGSGTSG

SEQ ID NO: 662102 - protein, 18 aa, Mycobacterium
FYTEGSGYAFEKETRTAE

SEQ ID NO: 662103 - protein, 29 aa, Mycobacterium
FYTPGNFFGTMCDFFGLSSFSAMDAAEDA

SEQ ID NO: 662104 - protein, 18 aa, Mycobacterium
FYTYRYFASEGFLPGYSF

SEQ ID NO: 662105 - protein, 20 aa, Mycobacterium
FYVNIWKLDGVSGDWALVHH

SEQ ID NO: 662106 - protein, 18 aa, Mycobacterium
FYVRAPGGWDIEFGTDGM

SEQ ID NO: 662107 - protein, 18 aa, Mycobacterium
FYWAHATFFMLIIKTAEY

SEQ ID NO: 662108 - protein, 19 aa, Mycobacterium
FYWAHATFFMLIIKTAEYF

SEQ ID NO: 662109 - protein, 17 aa, Mycobacterium
FYYDFDVAEPFTPEHLQ

SEQ ID NO: 662110 - protein, 18 aa, Mycobacterium
GAAAAPYVAWLGATATRA

SEQ ID NO: 662111 - protein, 17 aa, Mycobacterium
GAAAARMQSRIALEELL

SEQ ID NO: 662112 - protein, 24 aa, Mycobacterium
GAAAAVELACWDLAAKLNDEPAYA

SEQ ID NO: 662113 - protein, 25 aa, Mycobacterium
GAAACLRAADWLFPQYRELGVYLVR

SEQ ID NO: 662114 - protein, 26 aa, Mycobacterium
GAAADRLDAILARRPIRLHPDRPNNY

SEQ ID NO: 662115 - protein, 19 aa, Mycobacterium
GAAADSFASVTSGLVGQAW

SEQ ID NO: 662116 - protein, 18 aa, Mycobacterium
GAAADWPLVIADADNPST

SEQ ID NO: 662117 - protein, 19 aa, Mycobacterium
GAAAGRAAVAPSVRQPAGQ

SEQ ID NO: 662118 - protein, 24 aa, Mycobacterium
GAAAGRGGGQLVLPSGKTVQEVLD

SEQ ID NO: 662119 - protein, 17 aa, Mycobacterium
GAAAHLPAAPYLHLFLA

SEQ ID NO: 662120 - protein, 24 aa, Mycobacterium
GAAAHNCRLCRSLREGTALDAGGS

SEQ ID NO: 662121 - protein, 25 aa, Mycobacterium
GAAAIKRRGGLVIAQSPTDALFPAM

SEQ ID NO: 662122 - protein, 23 aa, Mycobacterium
GAAAKLWRGAMQLGIEMRVGPVG

SEQ ID NO: 662123 - protein, 25 aa, Mycobacterium
GAAALLHRVEVDAGRRADELLLAAL

SEQ ID NO: 662124 - protein, 19 aa, Mycobacterium
GAAALWFALETNLPVIVDA

SEQ ID NO: 662125 - protein, 17 aa, Mycobacterium
GAAAMAGGFIYLGGGTA

SEQ ID NO: 662126 - protein, 17 aa, Mycobacterium
GAAAMAGGFIYLGGGTP

SEQ ID NO: 662127 - protein, 20 aa, Mycobacterium
GAAAPLALLARRARGAGAKR

SEQ ID NO: 662128 - protein, 18 aa, Mycobacterium
GAAARIVADMSGPHQVGG

SEQ ID NO: 662129 - protein, 26 aa, Mycobacterium
GAAARVALDIATRYALQRKQFSAPDD

SEQ ID NO: 662130 - protein, 26 aa, Mycobacterium
GAAARVALDIATRYALQRRQFEDPDG

SEQ ID NO: 662131 - protein, 18 aa, Mycobacterium
GAAARYLGAIGMAAVEAH

SEQ ID NO: 662132 - protein, 18 aa, Mycobacterium
GAAATRLRPQDGLYTVTE

SEQ ID NO: 662133 - protein, 27 aa, Mycobacterium
GAAATSRPAVRMGWVSSELAMFRGDGP

SEQ ID NO: 662134 - protein, 20 aa, Mycobacterium
GAAAVVMCRADLAHKYTNKP

SEQ ID NO: 662135 - protein, 22 aa, Mycobacterium
GAAAWRGLFERNDVDPGAVDDV

SEQ ID NO: 662136 - protein, 21 aa, Mycobacterium
GAACAKALAERGVTVTVADID

SEQ ID NO: 662137 - protein, 21 aa, Mycobacterium
GAACPTCAEQPGIAASATVAA

SEQ ID NO: 662138 - protein, 25 aa, Mycobacterium
GAACWDARAWLGRPGLEHGASADLL

SEQ ID NO: 662139 - protein, 17 aa, Mycobacterium
GAADADQGPAWWDGTVI

SEQ ID NO: 662140 - protein, 20 aa, Mycobacterium
GAADKLMRPGGIVDLLTAPG

SEQ ID NO: 662141 - protein, 19 aa, Mycobacterium
GAADLRFGSARVAVTAGYP

SEQ ID NO: 662142 - protein, 19 aa, Mycobacterium
GAADLSFGGAPVVLTAGYP

SEQ ID NO: 662143 - protein, 19 aa, Mycobacterium
GAADLSFGGARVVLTAGYP

SEQ ID NO: 662144 - protein, 25 aa, Mycobacterium
GAADQCPLLAVGHAYSQWLDNSDRV

SEQ ID NO: 662145 - protein, 20 aa, Mycobacterium
GAADRLAAWSQISGLDLTTL

SEQ ID NO: 662146 - protein, 28 aa, Mycobacterium
GAADRLTGRPGYRFVPHDICDPSVVDEV

SEQ ID NO: 662147 - protein, 28 aa, Mycobacterium
GAADRLVMLGLPFLFFIHADYGCAGVLY

SEQ ID NO: 662148 - protein, 18 aa, Mycobacterium
GAADVALFGIQQVVQPTD

SEQ ID NO: 662149 - protein, 19 aa, Mycobacterium
GAADWSKRPLPAEWLNYAA

SEQ ID NO: 662150 - protein, 22 aa, Mycobacterium
GAAEAEAAVLFLGLTADEESEG

SEQ ID NO: 662151 - protein, 17 aa, Mycobacterium
GAAEALIALATLPSTAA

SEQ ID NO: 662152 - protein, 23 aa, Mycobacterium
GAAEALRLGIVDVVAADVHSAAD

SEQ ID NO: 662153 - protein, 22 aa, Mycobacterium
GAAEALRWAMLAGEPHVVLADA

SEQ ID NO: 662154 - protein, 21 aa, Mycobacterium
GAAEALRWAMMAGEPHVVLAD

SEQ ID NO: 662155 - protein, 22 aa, Mycobacterium
GAAEKARFRPGPGPRTIDLDGW

SEQ ID NO: 662156 - protein, 17 aa, Mycobacterium
GAAELPGAVSLDDALAT

SEQ ID NO: 662157 - protein, 25 aa, Mycobacterium
GAAELRARLRLAVTRRRRARKGTLE

SEQ ID NO: 662158 - protein, 22 aa, Mycobacterium
GAAELRSLRIARFGDNMRDVAV

SEQ ID NO: 662159 - protein, 24 aa, Mycobacterium
GAAELSLATAEWVAFYNRQRPNGY

SEQ ID NO: 662160 - protein, 25 aa, Mycobacterium
GAAERALTLAVEWAKDRVQGGQPLI

SEQ ID NO: 662161 - protein, 26 aa, Mycobacterium
GAAERWPRAGALGPLIRDPDGSVYPS

SEQ ID NO: 662162 - protein, 26 aa, Mycobacterium
GAAEYVFRFAPLVGIYGGTLEVFRNM

SEQ ID NO: 662163 - protein, 18 aa, Mycobacterium
GAAFAIELARRGGALVCS

SEQ ID NO: 662164 - protein, 24 aa, Mycobacterium
GAAFDCILAMPVLADRMLRTARQR

SEQ ID NO: 662165 - protein, 17 aa, Mycobacterium
GAAFFMPTLMKGGSMVV

SEQ ID NO: 662166 - protein, 29 aa, Mycobacterium
GAAFGGRLPELAARLSAALSASLSGSLSA

SEQ ID NO: 662167 - protein, 18 aa, Mycobacterium
GAAFRWIRVHLLRRWCRG

SEQ ID NO: 662168 - protein, 29 aa, Mycobacterium
GAAGAAHPACAAVAKQPRTSTATPATATS

SEQ ID NO: 662169 - protein, 19 aa, Mycobacterium
GAAGARLAAAVSEAGGLGM

SEQ ID NO: 662170 - protein, 29 aa, Mycobacterium
GAAGAVTVPVNFLAHAGSDGGIGTGGNGG

SEQ ID NO: 662171 - protein, 24 aa, Mycobacterium
GAAGDLASGVGLPGGAGGHAGLFG

SEQ ID NO: 662172 - protein, 36 aa, Mycobacterium
GAAGEAGETGTWGNAGLPGKAGDAGGAGAVGAAGAA

SEQ ID NO: 662173 - protein, 19 aa, Mycobacterium
GAAGFKLHEDWGTTPAVID

SEQ ID NO: 662174 - protein, 30 aa, Mycobacterium
GAAGGAGGSAWLLGTGGTGGAGGWAAAGAT

SEQ ID NO: 662175 - protein, 29 aa, Mycobacterium
GAAGGKGGNAVLFGAGGNGGIGGTGAVGG

SEQ ID NO: 662176 - protein, 28 aa, Mycobacterium
GAAGGLGGRGGLLLGNGGAGGVGGVGAT

SEQ ID NO: 662177 - protein, 18 aa, Mycobacterium
GAAGGVVRAKYGWTDVSR

SEQ ID NO: 662178 - protein, 19 aa, Mycobacterium
GAAGIALLAGMPPRPGERD

SEQ ID NO: 662179 - protein, 18 aa, Mycobacterium
GAAGLCFGTGDAHDAVPD

SEQ ID NO: 662180 - protein, 19 aa, Mycobacterium
GAAGLECWTGAADGECCGS

SEQ ID NO: 662181 - protein, 25 aa, Mycobacterium
GAAGLLGADPWEWVLTGGEDHALVG

SEQ ID NO: 662182 - protein, 19 aa, Mycobacterium
GAAGLLWGTAGAGGAGGSA

SEQ ID NO: 662183 - protein, 24 aa, Mycobacterium
GAAGLRAAWLTMIAVASTHQGLGV

SEQ ID NO: 662184 - protein, 17 aa, Mycobacterium
GAAGLWGDGGAGGAGGQ

SEQ ID NO: 662185 - protein, 17 aa, Mycobacterium
GAAGLWGTGGTGGAGAR

SEQ ID NO: 662186 - protein, 23 aa, Mycobacterium
GAAGPAGGNGYDGGQGGAGGTGG

SEQ ID NO: 662187 - protein, 20 aa, Mycobacterium
GAAGRAWVTEQWRWDHHAAR

SEQ ID NO: 662188 - protein, 24 aa, Mycobacterium
GAAGRISHGLGLIGPSVCVDSACA

SEQ ID NO: 662189 - protein, 24 aa, Mycobacterium
GAAGRLPVSYSRKVFIPVTHLCRD

SEQ ID NO: 662190 - protein, 20 aa, Mycobacterium
GAAGRSRAQSRFAWERIALD

SEQ ID NO: 662191 - protein, 27 aa, Mycobacterium
GAAGRVALDIATRYALQRRQFSAPDDG

SEQ ID NO: 662192 - protein, 28 aa, Mycobacterium
GAAGTAATARPAISCDATDCVGVTAGAP

SEQ ID NO: 662193 - protein, 17 aa, Mycobacterium
GAAGVAMGTRFLLTSDS

SEQ ID NO: 662194 - protein, 19 aa, Mycobacterium
GAAGVAMGTRFLLTSDSTV

SEQ ID NO: 662195 - protein, 26 aa, Mycobacterium
GAAGVCFPDLLLLRGEYQMRLDPPFI

SEQ ID NO: 662196 - protein, 26 aa, Mycobacterium
GAAGVCFPDLLMLRGEYQMKVPAPFV

SEQ ID NO: 662197 - protein, 18 aa, Mycobacterium
GAAHGGAVAHLFDSLLGF

SEQ ID NO: 662198 - protein, 18 aa, Mycobacterium
GAAHGGLARELLGDFPVR

SEQ ID NO: 662199 - protein, 17 aa, Mycobacterium
GAAIALAFAEAGADVVI

SEQ ID NO: 662200 - protein, 18 aa, Mycobacterium
GAAIFVGRVLARDSYLLT

SEQ ID NO: 662201 - protein, 19 aa, Mycobacterium
GAAIGDVRFEYPIVADAPK

SEQ ID NO: 662202 - protein, 28 aa, Mycobacterium
GAAIKEAICKGTVWSIRHEAAKPGSYFW

SEQ ID NO: 662203 - protein, 18 aa, Mycobacterium
GAAIWHMAWSDKDDAIDW

SEQ ID NO: 662204 - protein, 20 aa, Mycobacterium
GAAKHARKVAAWGADAMIVQ

SEQ ID NO: 662205 - protein, 22 aa, Mycobacterium
GAAKLGNAVGYVYPHNDRDGVV

SEQ ID NO: 662206 - protein, 21 aa, Mycobacterium
GAAKPVMVWLHGGAYMLGSAS

SEQ ID NO: 662207 - protein, 17 aa, Mycobacterium
GAAKRGANVVLLAKTAQ

SEQ ID NO: 662208 - protein, 17 aa, Mycobacterium
GAALAGGLARIGHEVAI

SEQ ID NO: 662209 - protein, 17 aa, Mycobacterium
GAALALVKEITWGVMAD

SEQ ID NO: 662210 - protein, 21 aa, Mycobacterium
GAALARLEARIVLAMLLERTT

SEQ ID NO: 662211 - protein, 25 aa, Mycobacterium
GAALARLESTIALERLLDFMPRYEV

SEQ ID NO: 662212 - protein, 17 aa, Mycobacterium
GAALARMESRIALGALL

SEQ ID NO: 662213 - protein, 23 aa, Mycobacterium
GAALARRGCVYVSVNYRLGALGC

SEQ ID NO: 662214 - protein, 21 aa, Mycobacterium
GAALDHLRVAMAAAQWQPSIS

SEQ ID NO: 662215 - protein, 24 aa, Mycobacterium
GAALEALATILARRGTASPPVASP

SEQ ID NO: 662216 - protein, 20 aa, Mycobacterium
GAALEALATILTRRAVTSPP

SEQ ID NO: 662217 - protein, 18 aa, Mycobacterium
GAALEYKAGERLPVEIPE

SEQ ID NO: 662218 - protein, 24 aa, Mycobacterium
GAALFPVHCWFEGDGWGMRVYPEL

SEQ ID NO: 662219 - protein, 17 aa, Mycobacterium
GAALFPVLGTPTGELNL

SEQ ID NO: 662220 - protein, 19 aa, Mycobacterium
GAALFVLDGWLRPVPPGTV

SEQ ID NO: 662221 - protein, 19 aa, Mycobacterium
GAALGIGGALHPEWDVFNN

SEQ ID NO: 662222 - protein, 24 aa, Mycobacterium
GAALGNGIGRYALNKACTYARERR

SEQ ID NO: 662223 - protein, 18 aa, Mycobacterium
GAALGQRAVALVHERADV

SEQ ID NO: 662224 - protein, 17 aa, Mycobacterium
GAALLQLLLASWADDEI

SEQ ID NO: 662225 - protein, 26 aa, Mycobacterium
GAALPRNSRVLLLWGAANRDPAHFDA

SEQ ID NO: 662226 - protein, 19 aa, Mycobacterium
GAALPYKRRLFGQIVAAAV

SEQ ID NO: 662227 - protein, 20 aa, Mycobacterium
GAALRIAFRALTLAGVHGGQ

SEQ ID NO: 662228 - protein, 26 aa, Mycobacterium
GAALRKARTALAEFRIEGVRTNIDFL

SEQ ID NO: 662229 - protein, 21 aa, Mycobacterium
GAALRRGAPVVVTRHGEPRLC

SEQ ID NO: 662230 - protein, 17 aa, Mycobacterium
GAALRRLDLDDVPAGTP

SEQ ID NO: 662231 - protein, 25 aa, Mycobacterium
GAALRVPLIAVILRRGYGLGAQAMA

SEQ ID NO: 662232 - protein, 20 aa, Mycobacterium
GAALSDWGADVIKVEGVAAG

SEQ ID NO: 662233 - protein, 20 aa, Mycobacterium
GAALSDWGADVIKVEGVASG

SEQ ID NO: 662234 - protein, 20 aa, Mycobacterium
GAALSDWGADVIKVEGVTSG

SEQ ID NO: 662235 - protein, 19 aa, Mycobacterium
GAAMKLGQALSVFEAAIPP

SEQ ID NO: 662236 - protein, 32 aa, Mycobacterium
GAAMSRLSALAGYRWITPMSYTLPFRTPTGVR

SEQ ID NO: 662237 - protein, 20 aa, Mycobacterium
GAANRGDYNTGWYNTGNYST

SEQ ID NO: 662238 - protein, 17 aa, Mycobacterium
GAAPGMPVCHFGVVTGE

SEQ ID NO: 662239 - protein, 17 aa, Mycobacterium
GAAPKLGVVGVLKGPLR

SEQ ID NO: 662240 - protein, 25 aa, Mycobacterium
GAAPLRAAALAWKGLAHELSSHALA

SEQ ID NO: 662241 - protein, 29 aa, Mycobacterium
GAAPSTWMPATRVSRADWRELFTANLETM

SEQ ID NO: 662242 - protein, 21 aa, Mycobacterium
GAAPVRLGPTVLRTSSAAAVA

SEQ ID NO: 662243 - protein, 19 aa, Mycobacterium
GAAPYLIKRGYIEVMVDVR

SEQ ID NO: 662244 - protein, 17 aa, Mycobacterium
GAAQHNCRLCKSLREGT

SEQ ID NO: 662245 - protein, 17 aa, Mycobacterium
GAAQHNCRLCKSLREST

SEQ ID NO: 662246 - protein, 18 aa, Mycobacterium
GAAQHNCRLCNSLREGGA

SEQ ID NO: 662247 - protein, 18 aa, Mycobacterium
GAAQLLGKRCGACRLEID

SEQ ID NO: 662248 - protein, 25 aa, Mycobacterium
GAAQRAGIELLAFGGRFIELGKRDI

SEQ ID NO: 662249 - protein, 29 aa, Mycobacterium
GAAQRAGLELLAWGGRFVEIGKRDIYGDT

SEQ ID NO: 662250 - protein, 30 aa, Mycobacterium
GAAQRAGLELLAWGGRFVEIGKRDIYGDTK

SEQ ID NO: 662251 - protein, 29 aa, Mycobacterium
GAAQRAGLELLSWGGRFVEIGKRDIYGDT

SEQ ID NO: 662252 - protein, 25 aa, Mycobacterium
GAAQRAGVELLAFGGRFVEIGKRDI

SEQ ID NO: 662253 - protein, 26 aa, Mycobacterium
GAAQRAGVELLTFGGRFIEIGKRDIY

SEQ ID NO: 662254 - protein, 17 aa, Mycobacterium
GAAQRCPDRPGLIDELG

SEQ ID NO: 662255 - protein, 17 aa, Mycobacterium
GAAQVIGSGGSGGAAGT

SEQ ID NO: 662256 - protein, 23 aa, Mycobacterium
GAARAAGFALVIGVDRAGHGDAL

SEQ ID NO: 662257 - protein, 17 aa, Mycobacterium
GAARAAGVFDRLPDGVS

SEQ ID NO: 662258 - protein, 17 aa, Mycobacterium
GAARAALDSGPWGKADP

SEQ ID NO: 662259 - protein, 19 aa, Mycobacterium
GAARAIKWAHAIELNDPTP

SEQ ID NO: 662260 - protein, 23 aa, Mycobacterium
GAARGPWTAAVSRCAEYRAETRV

SEQ ID NO: 662261 - protein, 24 aa, Mycobacterium
GAARIAAGFTHWADGNGWTSAAVR

SEQ ID NO: 662262 - protein, 22 aa, Mycobacterium
GAARISHSLGLIGPSISVDTAC

SEQ ID NO: 662263 - protein, 17 aa, Mycobacterium
GAARLYAEMQVRLEELV

SEQ ID NO: 662264 - protein, 17 aa, Mycobacterium
GAARMFGFTAADALGQS

SEQ ID NO: 662265 - protein, 21 aa, Mycobacterium
GAARMFKGYALAAEGISDATV

SEQ ID NO: 662266 - protein, 24 aa, Mycobacterium
GAARRLGVPEERWVFLHGHADMVD

SEQ ID NO: 662267 - protein, 26 aa, Mycobacterium
GAARSGIGIVEGWRGTIVHRVEIDAG

SEQ ID NO: 662268 - protein, 19 aa, Mycobacterium
GAARYRADIGIKDGKIVDV

SEQ ID NO: 662269 - protein, 23 aa, Mycobacterium
GAASAWPVVPWVVSGKSDQALAA

SEQ ID NO: 662270 - protein, 18 aa, Mycobacterium
GAASGFAGDGGRGGQGAV

SEQ ID NO: 662271 - protein, 23 aa, Mycobacterium
GAASGSIGVEWCLSGPGCGAIAF

SEQ ID NO: 662272 - protein, 24 aa, Mycobacterium
GAASNLKAVILFDSVADGDATTGM

SEQ ID NO: 662273 - protein, 24 aa, Mycobacterium
GAASPWPAVPWVVSGKSGQALAAQ

SEQ ID NO: 662274 - protein, 34 aa, Mycobacterium
GAASQFLIGIGTKMAERGVQYGFQLAGIGGDALA

SEQ ID NO: 662275 - protein, 19 aa, Mycobacterium
GAASTPWGLGIAARSAALL

SEQ ID NO: 662276 - protein, 17 aa, Mycobacterium
GAASVAAPRAYRAAGAN

SEQ ID NO: 662277 - protein, 20 aa, Mycobacterium
GAATARLFARHGAHVVIADI

SEQ ID NO: 662278 - protein, 20 aa, Mycobacterium
GAATARLFARHGAHVVIVDI

SEQ ID NO: 662279 - protein, 19 aa, Mycobacterium
GAATARPVIPVFINAIGLP

SEQ ID NO: 662280 - protein, 19 aa, Mycobacterium
GAATARRALAEGADVVISD

SEQ ID NO: 662281 - protein, 24 aa, Mycobacterium
GAATMKRLFLELGGKSATIVLEDA

SEQ ID NO: 662282 - protein, 18 aa, Mycobacterium
GAATRTVIWRGSRREVDI

SEQ ID NO: 662283 - protein, 24 aa, Mycobacterium
GAAVGFGCALALACDLVVAAPASY

SEQ ID NO: 662284 - protein, 25 aa, Mycobacterium
GAAVHSCVFPAFRAAGRTVTTVAGL

SEQ ID NO: 662285 - protein, 19 aa, Mycobacterium
GAAVKAFLATAVNSGQSGL

SEQ ID NO: 662286 - protein, 28 aa, Mycobacterium
GAAVKETICKGTLWALRREAAKPGSYFW

SEQ ID NO: 662287 - protein, 25 aa, Mycobacterium
GAAVKRLKVGAARSFAATTQESLAA

SEQ ID NO: 662288 - protein, 28 aa, Mycobacterium
GAAVLTRLRGMFAFALWDTATLELFCAR

SEQ ID NO: 662289 - protein, 20 aa, Mycobacterium
GAAVPLLVAVVGFPELLVAG

SEQ ID NO: 662290 - protein, 19 aa, Mycobacterium
GAAVQRLAVVAGMDGGVEA

SEQ ID NO: 662291 - protein, 18 aa, Mycobacterium
GAAVRAGLGWGMYPEDLV

SEQ ID NO: 662292 - protein, 18 aa, Mycobacterium
GAAVRCAMPSMGSMRQLG

SEQ ID NO: 662293 - protein, 18 aa, Mycobacterium
GAAVRRYHSGRAEVSGFD

SEQ ID NO: 662294 - protein, 22 aa, Mycobacterium
GAAVSPRRGGNCNPAPSTLLLA

SEQ ID NO: 662295 - protein, 18 aa, Mycobacterium
GAAWGMQRMTDMMAARTR

SEQ ID NO: 662296 - protein, 31 aa, Mycobacterium
GAAWHPRILAELARRLIRDDVKWLVRQIMSL

SEQ ID NO: 662297 - protein, 17 aa, Mycobacterium
GAAYGSRILPGFEDSGA

SEQ ID NO: 662298 - protein, 26 aa, Mycobacterium
GAAYIAGFGWGLARQYSVLVEMDADG

SEQ ID NO: 662299 - protein, 17 aa, Mycobacterium
GACAGFFRHPPRVPPNR

SEQ ID NO: 662300 - protein, 17 aa, Mycobacterium
GACAQVNKDLGLLAAEK

SEQ ID NO: 662301 - protein, 17 aa, Mycobacterium
GACAQVNKDLGLLAPEK

SEQ ID NO: 662302 - protein, 26 aa, Mycobacterium
GACASATRLTPFTSPPPITDPVGLAR

SEQ ID NO: 662303 - protein, 19 aa, Mycobacterium
GACDSTLLIAERVQPYDEV

SEQ ID NO: 662304 - protein, 19 aa, Mycobacterium
GACDSTLLIAERVQPYTDV

SEQ ID NO: 662305 - protein, 20 aa, Mycobacterium
GACDSTLLIAERVQSYADVW

SEQ ID NO: 662306 - protein, 19 aa, Mycobacterium
GACDSTLLIGERVQSYADV

SEQ ID NO: 662307 - protein, 24 aa, Mycobacterium
GACEPVCPVEAIFYEDDVPDQWTG

SEQ ID NO: 662308 - protein, 24 aa, Mycobacterium
GACEPVCPVESIFYEDDLPDEHSG

SEQ ID NO: 662309 - protein, 23 aa, Mycobacterium
GACHCIDLPLLFGDEAAWRNAPM

SEQ ID NO: 662310 - protein, 24 aa, Mycobacterium
GACHCLELPFLFGSPEAWADAAML

SEQ ID NO: 662311 - protein, 20 aa, Mycobacterium
GACHDSCLALVFGNLDAAPA

SEQ ID NO: 662312 - protein, 21 aa, Mycobacterium
GACLNREMSRFIDAVRADIDL

SEQ ID NO: 662313 - protein, 21 aa, Mycobacterium
GACNPPLAHRAIGVNRQIGTL

SEQ ID NO: 662314 - protein, 21 aa, Mycobacterium
GACNPPLAHRAIGVTRQIGTL

SEQ ID NO: 662315 - protein, 20 aa, Mycobacterium
GACNPTLAHRALGIHRQIGQ

SEQ ID NO: 662316 - protein, 20 aa, Mycobacterium
GACPALRKCRRWVDRLDTRQ

SEQ ID NO: 662317 - protein, 22 aa, Mycobacterium
GACPECHGLGRIHRVTEETLVP

SEQ ID NO: 662318 - protein, 22 aa, Mycobacterium
GACPECSGLGIRKEVDPDLVVP

SEQ ID NO: 662319 - protein, 21 aa, Mycobacterium
GACPHDCPDTCAMLYHVEDGK

SEQ ID NO: 662320 - protein, 17 aa, Mycobacterium
GACPIVASFGARDPLGR

SEQ ID NO: 662321 - protein, 22 aa, Mycobacterium
GACPMTWPWNVLGWPSINVPAG

SEQ ID NO: 662322 - protein, 19 aa, Mycobacterium
GACQDCSSGTGGAFRAERP

SEQ ID NO: 662323 - protein, 31 aa, Mycobacterium
GACRAARRLFGFPVVCAEGAALPMAESSFDA

SEQ ID NO: 662324 - protein, 18 aa, Mycobacterium
GACRARGLLDAIIGAAAG

SEQ ID NO: 662325 - protein, 18 aa, Mycobacterium
GACRGGGCEFAMAFDMRY

SEQ ID NO: 662326 - protein, 27 aa, Mycobacterium
GACRYCSSGRPALCPDAAAANGRGDLI

SEQ ID NO: 662327 - protein, 19 aa, Mycobacterium
GACSACRRDLYSLCENSNP

SEQ ID NO: 662328 - protein, 18 aa, Mycobacterium
GACVLPGAAYVELALAAA

SEQ ID NO: 662329 - protein, 21 aa, Mycobacterium
GACWRPELAAMFNQGAVTDDS

SEQ ID NO: 662330 - protein, 20 aa, Mycobacterium
GADAAYVCRGRVCDLPVTGT

SEQ ID NO: 662331 - protein, 21 aa, Mycobacterium
GADAAYVCRGRVCDLPVTSSD

SEQ ID NO: 662332 - protein, 26 aa, Mycobacterium
GADALASILSWENWEQLFTLAKFIGV

SEQ ID NO: 662333 - protein, 35 aa, Mycobacterium
GADALASILSWQGWEELFQLARFVGVSRPGYELRR

SEQ ID NO: 662334 - protein, 30 aa, Mycobacterium
GADALASILSWQNWEEMFAIARFIGVSRPG

SEQ ID NO: 662335 - protein, 28 aa, Mycobacterium
GADALGSILSWQNWEDMFSMAKFVGVSR

SEQ ID NO: 662336 - protein, 18 aa, Mycobacterium
GADARLLYIHRAGRGAYL

SEQ ID NO: 662337 - protein, 25 aa, Mycobacterium
GADARPAPWPVASGVYLVRTLDDSR

SEQ ID NO: 662338 - protein, 26 aa, Mycobacterium
GADARPWGDLSLPALQLLISSLPKFL

SEQ ID NO: 662339 - protein, 28 aa, Mycobacterium
GADARYLWPSMFARVADEYDRRYGLDDA

SEQ ID NO: 662340 - protein, 36 aa, Mycobacterium
GADASRLQPCLSVDFPRPAPRPAYTALDGDHWADAG

SEQ ID NO: 662341 - protein, 23 aa, Mycobacterium
GADATVFEPFAGNGGHGGAGGGG

SEQ ID NO: 662342 - protein, 23 aa, Mycobacterium
GADAVGPPFGIPAGSGGNGGAGG

SEQ ID NO: 662343 - protein, 18 aa, Mycobacterium
GADAVLAASVFHFGDLTI

SEQ ID NO: 662344 - protein, 19 aa, Mycobacterium
GADCAGLVDQVHRAGSQLR

SEQ ID NO: 662345 - protein, 18 aa, Mycobacterium
GADDGRIGIIPLVETAAG

SEQ ID NO: 662346 - protein, 19 aa, Mycobacterium
GADDIRVLSTWNGDRHLRN

SEQ ID NO: 662347 - protein, 29 aa, Mycobacterium
GADEISAAVAALFTGHAQAYQWLGAQAGA

SEQ ID NO: 662348 - protein, 26 aa, Mycobacterium
GADEISAAVAGMFAAHAQAYQALSQQ

SEQ ID NO: 662349 - protein, 25 aa, Mycobacterium
GADERPGWHALRRLAARITTPLLPD

SEQ ID NO: 662350 - protein, 24 aa, Mycobacterium
GADEVFAGYHWYPPMAEPAAASLD

SEQ ID NO: 662351 - protein, 24 aa, Mycobacterium
GADEVFAGYHWYPPMGEPAAASLE

SEQ ID NO: 662352 - protein, 28 aa, Mycobacterium
GADEVIPWQAQRCVSRWDAHKAEKGRRR

SEQ ID NO: 662353 - protein, 57 aa, Mycobacterium
GADEVSAAVAALFSSHARAYQALSVQAGQFHQWFTQTLSGAGLSYASAEAANVSPLQ

SEQ ID NO: 662354 - protein, 25 aa, Mycobacterium
GADEVSAAVAAVFSGHAQAYQALGA

SEQ ID NO: 662355 - protein, 31 aa, Mycobacterium
GADEVSAAVTAMFGNHAQAYQAVSTQAAEFH

SEQ ID NO: 662356 - protein, 24 aa, Mycobacterium
GADEVSAVIAALFDAHAQAYQALS

SEQ ID NO: 662357 - protein, 51 aa, Mycobacterium
GADEVSVAIAGLLRLHGQQYQQFGAHLSEFHARFTQMLSAGANEYSLAEAA

SEQ ID NO: 662358 - protein, 24 aa, Mycobacterium
GADEVVDVVLLWWRDGDGDLVDTL

SEQ ID NO: 662359 - protein, 24 aa, Mycobacterium
GADEWRTAHSWPPSQAPHRELALR

SEQ ID NO: 662360 - protein, 17 aa, Mycobacterium
GADFALREFECGHMVPQ

SEQ ID NO: 662361 - protein, 24 aa, Mycobacterium
GADFRKWCGAAGFRSFEVIALAAG

SEQ ID NO: 662362 - protein, 17 aa, Mycobacterium
GADGELSLAGWTKRLTG

SEQ ID NO: 662363 - protein, 30 aa, Mycobacterium
GADGFLAWRAARCVANWQGARVEKGLRRWR

SEQ ID NO: 662364 - protein, 21 aa, Mycobacterium
GADGGIGGQFFGNGGDGGAGG

SEQ ID NO: 662365 - protein, 18 aa, Mycobacterium
GADGGILIGNGGTGGSGA

SEQ ID NO: 662366 - protein, 21 aa, Mycobacterium
GADGGPYTVIFQGALASQDVP

SEQ ID NO: 662367 - protein, 32 aa, Mycobacterium
GADGGRYAFGANWSLDLPVGGAGGAGGWANSI

SEQ ID NO: 662368 - protein, 26 aa, Mycobacterium
GADGRRWRALFDWTSQRFDMLAEDIM

SEQ ID NO: 662369 - protein, 24 aa, Mycobacterium
GADGRRWRLAVGDLAAGFDELCQD

SEQ ID NO: 662370 - protein, 17 aa, Mycobacterium
GADGRVIVACFASNVDR

SEQ ID NO: 662371 - protein, 21 aa, Mycobacterium
GADHVMPALVAPSVTVPVSGG

SEQ ID NO: 662372 - protein, 26 aa, Mycobacterium
GADIARGAMRLWSQACGSLPGQSPGD

SEQ ID NO: 662373 - protein, 18 aa, Mycobacterium
GADIIAIDVCGPIENLAY

SEQ ID NO: 662374 - protein, 18 aa, Mycobacterium
GADIIALDICAPVHTTIT

SEQ ID NO: 662375 - protein, 23 aa, Mycobacterium
GADIIAVDICKPIREGVTDTAIP

SEQ ID NO: 662376 - protein, 18 aa, Mycobacterium
GADIIAVDICRDIPSNPY

SEQ ID NO: 662377 - protein, 22 aa, Mycobacterium
GADIIAVDVCKPIVANTTIPAS

SEQ ID NO: 662378 - protein, 18 aa, Mycobacterium
GADIIKALALGATAVGIG

SEQ ID NO: 662379 - protein, 21 aa, Mycobacterium
GADINPYLGYAALLAAGLEGI

SEQ ID NO: 662380 - protein, 24 aa, Mycobacterium
GADIPRQHYAFLVSEQEFDTIYDK

SEQ ID NO: 662381 - protein, 25 aa, Mycobacterium
GADIRFWAFDLLYLDGKSLLRTKYR

SEQ ID NO: 662382 - protein, 19 aa, Mycobacterium
GADIRWAKVNTFGSTAADV

SEQ ID NO: 662383 - protein, 18 aa, Mycobacterium
GADIVMIKPALGYLDVVA

SEQ ID NO: 662384 - protein, 19 aa, Mycobacterium
GADKHPVVFTLTRAAEALL

SEQ ID NO: 662385 - protein, 25 aa, Mycobacterium
GADKVARLILGFVRLAGGEARVEPA

SEQ ID NO: 662386 - protein, 28 aa, Mycobacterium
GADLDWRAAFAGLRARTVTLPTYSFARQ

SEQ ID NO: 662387 - protein, 17 aa, Mycobacterium
GADLENIAAALAEAQKS

SEQ ID NO: 662388 - protein, 20 aa, Mycobacterium
GADLERTQVLPAVREVDDVA

SEQ ID NO: 662389 - protein, 18 aa, Mycobacterium
GADLPPLKGVYLAAMAGG

SEQ ID NO: 662390 - protein, 23 aa, Mycobacterium
GADLRAADALPVLVIDGRDDANL

SEQ ID NO: 662391 - protein, 21 aa, Mycobacterium
GADLVGPVLIKFGSQEQKDRY

SEQ ID NO: 662392 - protein, 18 aa, Mycobacterium
GADNALWITTAEVPAVLD

SEQ ID NO: 662393 - protein, 38 aa, Mycobacterium
GADPAPPRWVLGVVRRLPWLSVVPAYFVGVGIRPEHAP

SEQ ID NO: 662394 - protein, 19 aa, Mycobacterium
GADPDGWHGLIPVSTSEPL

SEQ ID NO: 662395 - protein, 28 aa, Mycobacterium
GADPDLTSGAFARYLADYIHEQGWQTYG

SEQ ID NO: 662396 - protein, 26 aa, Mycobacterium
GADPDRAAAIAARLRVGTVNVNGGVW

SEQ ID NO: 662397 - protein, 20 aa, Mycobacterium
GADPESWYGLGDVSDERPLW

SEQ ID NO: 662398 - protein, 18 aa, Mycobacterium
GADPEWALWYSGYLQARL

SEQ ID NO: 662399 - protein, 18 aa, Mycobacterium
GADPFVALFSESAGRVLV

SEQ ID NO: 662400 - protein, 21 aa, Mycobacterium
GADPLRPAGRVNPGSRYAAME

SEQ ID NO: 662401 - protein, 25 aa, Mycobacterium
GADPRLLASFPYPHLLTVTARLADR

SEQ ID NO: 662402 - protein, 17 aa, Mycobacterium
GADPRRAAELASGLVAR

SEQ ID NO: 662403 - protein, 25 aa, Mycobacterium
GADPRRPYVSIAIAHGIRRFEFMIH

SEQ ID NO: 662404 - protein, 20 aa, Mycobacterium
GADPRSGRWAGLSKTECGLH

SEQ ID NO: 662405 - protein, 18 aa, Mycobacterium
GADPRVFRTRAFRDGDDW

SEQ ID NO: 662406 - protein, 23 aa, Mycobacterium
GADPRYTLWQAWHASGLQRRWLA

SEQ ID NO: 662407 - protein, 30 aa, Mycobacterium; identical to SEQ ID NO: 88250

SEQ ID NO: 662408 - protein, 18 aa, Mycobacterium
GADPTLLASFPYPHVLAM

SEQ ID NO: 662409 - protein, 26 aa, Mycobacterium
GADQDFTYRFSVPNAGTYWAHPHVGL

SEQ ID NO: 662410 - protein, 19 aa, Mycobacterium
GADQPVWAAAVKRLQAGTA

SEQ ID NO: 662411 - protein, 37 aa, Mycobacterium
GADRLPGVRLWLYTNFHCNLSCDYCCVSSSPQAAHRE

SEQ ID NO: 662412 - protein, 24 aa, Mycobacterium
GADRPRLVVEPGRLLVGSAGIIAA

SEQ ID NO: 662413 - protein, 31 aa, Mycobacterium
GADRRIGPEFLRPGPGWGGSCLPKDTAALVH

SEQ ID NO: 662414 - protein, 24 aa, Mycobacterium
GADRSRGALMLHGHLDVVPAEASD

SEQ ID NO: 662415 - protein, 17 aa, Mycobacterium
GADSFFGEPELRPDDLL

SEQ ID NO: 662416 - protein, 18 aa, Mycobacterium
GADSGYLRELVDYWVDEF

SEQ ID NO: 662417 - protein, 22 aa, Mycobacterium
GADSIAFRLMFNTLRETYEPVL

SEQ ID NO: 662418 - protein, 22 aa, Mycobacterium
GADSLKGLCPFHDEKSPSFHVR

SEQ ID NO: 662419 - protein, 23 aa, Mycobacterium
GADTEWPRLIARITSPRDGEDQI

SEQ ID NO: 662420 - protein, 17 aa, Mycobacterium
GADTFFGEPELRPDDLI

SEQ ID NO: 662421 - protein, 19 aa, Mycobacterium
GADTLPFEDYRMMPRATFC

SEQ ID NO: 662422 - protein, 23 aa, Mycobacterium
GADVAALCGFLCSDAAGYITGQV

SEQ ID NO: 662423 - protein, 23 aa, Mycobacterium
GADVLLLCCPIPLGITDSDASGR

SEQ ID NO: 662424 - protein, 21 aa, Mycobacterium
GADVNVAWPTAQIAVMGASGA

SEQ ID NO: 662425 - protein, 24 aa, Mycobacterium
GADWFRPKAMRDMKLRTDELANRY

SEQ ID NO: 662426 - protein, 25 aa, Mycobacterium
GADWFRPKAMRVMKRRIDELAKSYV

SEQ ID NO: 662427 - protein, 20 aa, Mycobacterium
GADWFRPKVMRDLKSRVDEL

SEQ ID NO: 662428 - protein, 26 aa, Mycobacterium
GADYRWLNLMARVPRKAVPRIMLRAF

SEQ ID NO: 662429 - protein, 22 aa, Mycobacterium
GADYRWLNLMTRVPRKGLPTIA

SEQ ID NO: 662430 - protein, 23 aa, Mycobacterium
GADYRWMNLVARMPRKGIPTYGK

SEQ ID NO: 662431 - protein, 17 aa, Mycobacterium
GAEAMFRWMSGRDGQNK

SEQ ID NO: 662432 - protein, 22 aa, Mycobacterium
GAEASNAAQAFLDLINAPTQAL

SEQ ID NO: 662433 - protein, 20 aa, Mycobacterium
GAEASRLFLTQMIAHHKGAI

SEQ ID NO: 662434 - protein, 21 aa, Mycobacterium
GAEASRLFLTQMIAHHKGAIM

SEQ ID NO: 662435 - protein, 20 aa, Mycobacterium
GAECPEPLLYHNGAYLGTRP

SEQ ID NO: 662436 - protein, 18 aa, Mycobacterium
GAEDAAVMAAVFADNGAT

SEQ ID NO: 662437 - protein, 25 aa, Mycobacterium
GAEEAWLQGWLLRAGNGVNVAVPLD

SEQ ID NO: 662438 - protein, 31 aa, Mycobacterium
GAEFSRAELIARLGVVPDYHKMVDAFIRILS

SEQ ID NO: 662439 - protein, 23 aa, Mycobacterium
GAEGAVRAIEWLIAEGYEHLIPR

SEQ ID NO: 662440 - protein, 19 aa, Mycobacterium
GAEGAYFNGWDPLLQTGLP

SEQ ID NO: 662441 - protein, 22 aa, Mycobacterium
GAEGDRRLALVDGETGHVASAK

SEQ ID NO: 662442 - protein, 29 aa, Mycobacterium
GAEGEPAWAYSVIALRWAAKYYAAEREFA

SEQ ID NO: 662443 - protein, 25 aa, Mycobacterium
GAEGFPEETFPAIVAVLTNVFDGAA

SEQ ID NO: 662444 - protein, 19 aa, Mycobacterium
GAEGWRVVAPFTRGYAPSE

SEQ ID NO: 662445 - protein, 25 aa, Mycobacterium
GAEHSRYRLGLPHAGTWREVLNTDS

SEQ ID NO: 662446 - protein, 19 aa, Mycobacterium
GAEIACIRDLYAHTNNTAE

SEQ ID NO: 662447 - protein, 18 aa, Mycobacterium
GAEIGRIPVDSIYSPVLK

SEQ ID NO: 662448 - protein, 20 aa, Mycobacterium
GAEIIPVVVGRSGGPEAAAR

SEQ ID NO: 662449 - protein, 19 aa, Mycobacterium
GAEILRPGLLALPVTGAAR

SEQ ID NO: 662450 - protein, 24 aa, Mycobacterium
GAEIPRQHYAFLVSEEDFDAIYGK

SEQ ID NO: 662451 - protein, 18 aa, Mycobacterium
GAEIVFSGRVKSVDADAK

SEQ ID NO: 662452 - protein, 22 aa, Mycobacterium
GAEKRLYALASRVPMGQADRYA

SEQ ID NO: 662453 - protein, 18 aa, Mycobacterium
GAELARGLARRGFPLLLV

SEQ ID NO: 662454 - protein, 21 aa, Mycobacterium
GAELARGLARRGFPLLLVARR

SEQ ID NO: 662455 - protein, 37 aa, Mycobacterium
GAELGDLHWFYVYSGVMWACVFLRTGARRIHFGEIDR

SEQ ID NO: 662456 - protein, 23 aa, Mycobacterium
GAELIKVCCSGGVMSLTGEAGAQ

SEQ ID NO: 662457 - protein, 24 aa, Mycobacterium
GAELIKVCCSGGVMSLTGPPGAQH

SEQ ID NO: 662458 - protein, 26 aa, Mycobacterium
GAELLRRIKGLPGFGEVKAQIFLALL

SEQ ID NO: 662459 - protein, 17 aa, Mycobacterium
GAELSPAAIDWLIGQYT

SEQ ID NO: 662460 - protein, 18 aa, Mycobacterium
GAEMARLASRVAGRAKDA

SEQ ID NO: 662461 - protein, 23 aa, Mycobacterium
GAEMHARISGLADYFAVDELDAI

SEQ ID NO: 662462 - protein, 21 aa, Mycobacterium
GAEMPAAIAYFSMEFGIAEVL

SEQ ID NO: 662463 - protein, 23 aa, Mycobacterium
GAEPDVRIWARCSLRQDGKWVHA

SEQ ID NO: 662464 - protein, 25 aa, Mycobacterium
GAEPIAVVGMGCRFPGGATDPDSYW

SEQ ID NO: 662465 - protein, 27 aa, Mycobacterium
GAEPLPEFPTLFARWPSTLTVDGAQIP

SEQ ID NO: 662466 - protein, 25 aa, Mycobacterium
GAEPLRASTFARFRERFAPHGLQPN

SEQ ID NO: 662467 - protein, 25 aa, Mycobacterium
GAEPLRMARDLVRLGLDTLALDVYR

SEQ ID NO: 662468 - protein, 25 aa, Mycobacterium
GAEPLRMARDLVRRGLDTLAHDVYR

SEQ ID NO: 662469 - protein, 21 aa, Mycobacterium
GAEPRTEWLDGVVVRDDHGFI

SEQ ID NO: 662470 - protein, 28 aa, Mycobacterium
GAEPSTWMPSTRVTRGDWRKIFADNLET

SEQ ID NO: 662471 - protein, 18 aa, Mycobacterium
GAEQMLGDVWEWTSSPLR

SEQ ID NO: 662472 - protein, 25 aa, Mycobacterium
GAERFPEDTFPVFVALMTNVFDGAA

SEQ ID NO: 662473 - protein, 23 aa, Mycobacterium
GAERMTRVSFGFREPDGGGFCPA

SEQ ID NO: 662474 - protein, 23 aa, Mycobacterium
GAERMTRVSFGFREPDGGGFSPP

SEQ ID NO: 662475 - protein, 23 aa, Mycobacterium
GAESAWRLARNGFAVHFVSEAYK

SEQ ID NO: 662476 - protein, 24 aa, Mycobacterium
GAESIPLPLIRRVIDPKRQVTVVG

SEQ ID NO: 662477 - protein, 20 aa, Mycobacterium
GAETADFARRLFGDVDARIK

SEQ ID NO: 662478 - protein, 21 aa, Mycobacterium
GAETALRIGLVSEVVAPQRLW

SEQ ID NO: 662479 - protein, 24 aa, Mycobacterium
GAETGTKYRVVWQDFASGAPLTAQ

SEQ ID NO: 662480 - protein, 23 aa, Mycobacterium
GAETKIVFAQRIYDAMSDIVESR

SEQ ID NO: 662481 - protein, 28 aa, Mycobacterium
GAETLLEIARFWAGLALFSRERGRYVIP

SEQ ID NO: 662482 - protein, 20 aa, Mycobacterium
GAETNAWMDAFRTFTTTLFS

SEQ ID NO: 662483 - protein, 35 aa, Mycobacterium
GAETPVWTFLGPRPAHWWVRRRLHEVVVHRADAAI

SEQ ID NO: 662484 - protein, 19 aa, Mycobacterium
GAETPVWTFLGPRPASWWL

SEQ ID NO: 662485 - protein, 22 aa, Mycobacterium
GAEVAAQGWGWRHAGQNRWATK

SEQ ID NO: 662486 - protein, 19 aa, Mycobacterium
GAEVAARYAAEPGYRLRDH

SEQ ID NO: 662487 - protein, 24 aa, Mycobacterium
GAEVAELLPELTLAQRWDLTVEEL

SEQ ID NO: 662488 - protein, 22 aa, Mycobacterium
GAEVATWLGTLGTLGRSAFQLG

SEQ ID NO: 662489 - protein, 24 aa, Mycobacterium
GAEVGNPLATVFDFFTNVTEGVYK

SEQ ID NO: 662490 - protein, 24 aa, Mycobacterium
GAEVIAVAPSTLWSLTVDPDRPGS

SEQ ID NO: 662491 - protein, 18 aa, Mycobacterium
GAEVIKVEPREGGDPQRG

SEQ ID NO: 662492 - protein, 25 aa, Mycobacterium
GAEYFTVPLSNIWGTTLNILDRTGS

SEQ ID NO: 662493 - protein, 25 aa, Mycobacterium
GAEYFTVPLSNVWGTTLELVDRTGS

SEQ ID NO: 662494 - protein, 19 aa, Mycobacterium
GAFADKTLVHFGQCTKVDP

SEQ ID NO: 662495 - protein, 21 aa, Mycobacterium
GAFAKEIEMWFPAHTTALDGV

SEQ ID NO: 662496 - protein, 20 aa, Mycobacterium
GAFALECAMDDLAHRLRMDP

SEQ ID NO: 662497 - protein, 25 aa, Mycobacterium
GAFDTGRAVGMLIIDFTSRKRMRVN

SEQ ID NO: 662498 - protein, 20 aa, Mycobacterium
GAFEIGGRIAGEQVPIREPI

SEQ ID NO: 662499 - protein, 30 aa, Mycobacterium
GAFEKVSWGRPVFCAPKMFAMYGGNVKGEA

SEQ ID NO: 662500 - protein, 27 aa, Mycobacterium
GAFEVNEAFAPVPMAWLKDIGADEKKL

SEQ ID NO: 662501 - protein, 27 aa, Mycobacterium
GAFEVNEAFAPVPMAWLKDIGADETKL

SEQ ID NO: 662502 - protein, 20 aa, Mycobacterium
GAFGGGPFHTGQGGVGGDGG

SEQ ID NO: 662503 - protein, 23 aa, Mycobacterium
GAFGRFLPAWQMVGADSASGVDG

SEQ ID NO: 662504 - protein, 17 aa, Mycobacterium
GAFHGRSGYTLSLTNTN

SEQ ID NO: 662505 - protein, 18 aa, Mycobacterium
GAFHGRTMGSLALTGQPA

SEQ ID NO: 662506 - protein, 19 aa, Mycobacterium
GAFHGRTMGSLALTGQPSK

SEQ ID NO: 662507 - protein, 26 aa, Mycobacterium
GAFLFSDAWFLIRVVEPMSADELPER

SEQ ID NO: 662508 - protein, 26 aa, Mycobacterium
GAFLRCGAISRILAYVAPILLGGPVT

SEQ ID NO: 662509 - protein, 17 aa, Mycobacterium
GAFMFGQGVSMYSAAKA

SEQ ID NO: 662510 - protein, 18 aa, Mycobacterium
GAFMPMRTIGYLLGIPEE

SEQ ID NO: 662511 - protein, 19 aa, Mycobacterium
GAFPDSHRQHMGMPGMHGT

SEQ ID NO: 662512 - protein, 26 aa, Mycobacterium
GAFRIPEMIRWPGKISAGVVSNEIIQ

SEQ ID NO: 662513 - protein, 18 aa, Mycobacterium
GAFRSRKGLLEVPRLGPK

SEQ ID NO: 662514 - protein, 30 aa, Mycobacterium
GAFRVPALVRWPGVIPAGVASGEFMAMEDW

SEQ ID NO: 662515 - protein, 26 aa, Mycobacterium
GAFTEWPRAGAVLPEPVGQVRMRMVG

SEQ ID NO: 662516 - protein, 25 aa, Mycobacterium
GAFTPRPVPTVGLSHLHIPRVSVPE

SEQ ID NO: 662517 - protein, 24 aa, Mycobacterium
GAFTQVYLVVGVLFHQRRQPGELD

SEQ ID NO: 662518 - protein, 24 aa, Mycobacterium
GAFTVPPNARWELLAAHAEGKSVV

SEQ ID NO: 662519 - protein, 24 aa, Mycobacterium
GAFVECGVSYGFLSSAIMEYLDWD

SEQ ID NO: 662520 - protein, 26 aa, Mycobacterium
GAFYAELLDAYPLVSIEDPLSEDDWD

SEQ ID NO: 662521 - protein, 19 aa, Mycobacterium
GAGAAVFRKNDTALREAFN

SEQ ID NO: 662522 - protein, 34 aa, Mycobacterium
GAGACSVGTIRCWFGVGCNATVPVVRIPIASAIS

SEQ ID NO: 662523 - protein, 25 aa, Mycobacterium
GAGADCGRCRHTIRAILGARRGGAA

SEQ ID NO: 662524 - protein, 22 aa, Mycobacterium
GAGADFCAGADWVAASTGTQRP

SEQ ID NO: 662525 - protein, 25 aa, Mycobacterium
GAGAGERRRSWAVLGEMAELGDDAV

SEQ ID NO: 662526 - protein, 17 aa, Mycobacterium
GAGAGGGGCRRRVRAAR

SEQ ID NO: 662527 - protein, 19 aa, Mycobacterium
GAGAGMPGGMLGRGGASPH

SEQ ID NO: 662528 - protein, 20 aa, Mycobacterium
GAGAGMPGGMLGRGGASPHV

SEQ ID NO: 662529 - protein, 23 aa, Mycobacterium
GAGALEYPAEFQGASEERIADLG

SEQ ID NO: 662530 - protein, 18 aa, Mycobacterium
GAGAMLAMAHDYRVMRED

SEQ ID NO: 662531 - protein, 24 aa, Mycobacterium
GAGAPAMPSLGISAGSGGVGGAGG

SEQ ID NO: 662532 - protein, 28 aa, Mycobacterium
GAGAPVEWHKMGAGWSWTRKAGSDTDHA

SEQ ID NO: 662533 - protein, 23 aa, Mycobacterium
GAGARAAYELGRSGVGATEAAAS

SEQ ID NO: 662534 - protein, 18 aa, Mycobacterium
GAGASAYRALSKALSATF

SEQ ID NO: 662535 - protein, 17 aa, Mycobacterium
GAGASAYRTLSKASSAN

SEQ ID NO: 662536 - protein, 25 aa, Mycobacterium
GAGAVGGTGGWLLGDGGAGGNGGDG

SEQ ID NO: 662537 - protein, 18 aa, Mycobacterium
GAGAWRVVAEHAETAEDR

SEQ ID NO: 662538 - protein, 17 aa, Mycobacterium
GAGCAMCADEHREATST

SEQ ID NO: 662539 - protein, 22 aa, Mycobacterium
GAGCARDRCGPVGARGHHRGAG

SEQ ID NO: 662540 - protein, 19 aa, Mycobacterium
GAGCCDLAFAAPEAARALK

SEQ ID NO: 662541 - protein, 30 aa, Mycobacterium
GAGCKICDRPSCPQRAFPYLGRPVRVDPHT

SEQ ID NO: 662542 - protein, 19 aa, Mycobacterium
GAGCLPDGVPSNWTTFLGA

SEQ ID NO: 662543 - protein, 41 aa, Mycobacterium
GAGCRTRPGRWCGCRSGRSRFCRCGPRGGARLRRGGRRCGG

SEQ ID NO: 662544 - protein, 19 aa, Mycobacterium
GAGDGMRSAFQGVQQGTSS

SEQ ID NO: 662545 - protein, 25 aa, Mycobacterium
GAGETRFSASIFEFYADRGAGLLAD

SEQ ID NO: 662546 - protein, 18 aa, Mycobacterium
GAGEYPTIQSFEYLEEIT

SEQ ID NO: 662547 - protein, 17 aa, Mycobacterium
GAGFGGGRGLLFGSSGL

SEQ ID NO: 662548 - protein, 19 aa, Mycobacterium
GAGFIPGIERLGIPDLQMS

SEQ ID NO: 662549 - protein, 18 aa, Mycobacterium
GAGFRPGGGHYGRTPTDL

SEQ ID NO: 662550 - protein, 19 aa, Mycobacterium
GAGFTLALAADWRVSGDNV

SEQ ID NO: 662551 - protein, 29 aa, Mycobacterium
GAGFTLPSLFGVGLMPSFQLGTAPGANTP

SEQ ID NO: 662552 - protein, 17 aa, Mycobacterium
GAGFVMLTGLGPRDADR

SEQ ID NO: 662553 - protein, 22 aa, Mycobacterium
GAGGAAGLWGNGGAGGHGGSGL

SEQ ID NO: 662554 - protein, 22 aa, Mycobacterium
GAGGAAGLWGSGGTGGAGGAGA

SEQ ID NO: 662555 - protein, 22 aa, Mycobacterium
GAGGAAGWLYGAGGSGGAGGAG

SEQ ID NO: 662556 - protein, 24 aa, Mycobacterium
GAGGAGGHGGWLYGSGGTGGDGGF

SEQ ID NO: 662557 - protein, 26 aa, Mycobacterium
GAGGAGGRAGLLGYGGAGGAGGLGGS

SEQ ID NO: 662558 - protein, 24 aa, Mycobacterium
GAGGAGGSAWLFGTGGVGGTGGIG

SEQ ID NO: 662559 - protein, 28 aa, Mycobacterium
GAGGAGGVGGWLFGAGGGGGAGGAGGAT

SEQ ID NO: 662560 - protein, 19 aa, Mycobacterium
GAGGAGMRAAVEAGPRVRT

SEQ ID NO: 662561 - protein, 21 aa, Mycobacterium
GAGGAGMRAAVEAGPRVRTAV

SEQ ID NO: 662562 - protein, 26 aa, Mycobacterium
GAGGANRQLVSLFGAGGAGGAGGAGA

SEQ ID NO: 662563 - protein, 17 aa, Mycobacterium
GAGGAPGAAGLAGTGGQ

SEQ ID NO: 662564 - protein, 26 aa, Mycobacterium
GAGGDAGGLLALNFAGNGGNAGQGAG

SEQ ID NO: 662565 - protein, 27 aa, Mycobacterium
GAGGDAIDSVGGIGGKGGGGADGGGGG

SEQ ID NO: 662566 - protein, 24 aa, Mycobacterium
GAGGDGGAGGFLLGDGGAGGAGGA

SEQ ID NO: 662567 - protein, 25 aa, Mycobacterium
GAGGDGGRAGWLSGNAGAGGAGGAG

SEQ ID NO: 662568 - protein, 23 aa, Mycobacterium
GAGGESGVIIGYAQSGAGGIGGY

SEQ ID NO: 662569 - protein, 18 aa, Mycobacterium
GAGGFLFGDGGPGYTPIS

SEQ ID NO: 662570 - protein, 24 aa, Mycobacterium
GAGGFPLIVRMLRTAFGEKRVKRS

SEQ ID NO: 662571 - protein, 18 aa, Mycobacterium
GAGGFSHGGFAGGGGTGG

SEQ ID NO: 662572 - protein, 19 aa, Mycobacterium
GAGGGAGWLGDGGAGGTGG

SEQ ID NO: 662573 - protein, 17 aa, Mycobacterium
GAGGGAIMIHQRFGCAV

SEQ ID NO: 662574 - protein, 35 aa, Mycobacterium
GAGGGGCRRRVRAARGVGVFGRRAVGLGAARPGRA

SEQ ID NO: 662575 - protein, 21 aa, Mycobacterium
GAGGHAGAFGGPGGAGGSGGF

SEQ ID NO: 662576 - protein, 18 aa, Mycobacterium
GAGGHGFGAGTPGKGGGG

SEQ ID NO: 662577 - protein, 24 aa, Mycobacterium
GAGGIGGNGGFFGNGGAGGAGGNG

SEQ ID NO: 662578 - protein, 26 aa, Mycobacterium
GAGGIRGPIGLGYRVPGIVISPFSRG

SEQ ID NO: 662579 - protein, 18 aa, Mycobacterium
GAGGKAGLIGNGGAGGAG

SEQ ID NO: 662580 - protein, 26 aa, Mycobacterium
GAGGKGGDADSMGSAGATGGKGGNGG

SEQ ID NO: 662581 - protein, 26 aa, Mycobacterium
GAGGKGGVAAGIFDRGGTGGTGGNGG

SEQ ID NO: 662582 - protein, 25 aa, Mycobacterium
GAGGLAFRCVTPFDAWTMTYEGKAV

SEQ ID NO: 662583 - protein, 18 aa, Mycobacterium
GAGGLALADTGQDGAQGA

SEQ ID NO: 662584 - protein, 18 aa, Mycobacterium
GAGGLLFGNGGDGGAGGD

SEQ ID NO: 662585 - protein, 17 aa, Mycobacterium
GAGGLLFGNGGIGYSQT

SEQ ID NO: 662586 - protein, 17 aa, Mycobacterium
GAGGLLFGTGGAGGAGG

SEQ ID NO: 662587 - protein, 18 aa, Mycobacterium
GAGGLLFGTGGGGGEGGA

SEQ ID NO: 662588 - protein, 18 aa, Mycobacterium
GAGGLLFGTGGSGGAGGG

SEQ ID NO: 662589 - protein, 19 aa, Mycobacterium
GAGGLLWGQGGIGGTGGSG

SEQ ID NO: 662590 - protein, 17 aa, Mycobacterium
GAGGLLYGNGGRGGDST

SEQ ID NO: 662591 - protein, 19 aa, Mycobacterium
GAGGLVLGNGGAGGNGGQG

SEQ ID NO: 662592 - protein, 24 aa, Mycobacterium
GAGGMGGAGGWLIGDGGAGGTGGF

SEQ ID NO: 662593 - protein, 17 aa, Mycobacterium
GAGGMGGAMAGHGGDGG

SEQ ID NO: 662594 - protein, 25 aa, Mycobacterium
GAGGMGGVGMAGVNGGVAGQGGSGG

SEQ ID NO: 662595 - protein, 29 aa, Mycobacterium
GAGGNGGDAIGFGSGNGGLGGGGGAGGTG

SEQ ID NO: 662596 - protein, 24 aa, Mycobacterium
GAGGNGGLFVGVGGAGGQGGAGGA

SEQ ID NO: 662597 - protein, 26 aa, Mycobacterium
GAGGNGGLWGAGGIGGNGGYGTTGGG

SEQ ID NO: 662598 - protein, 26 aa, Mycobacterium
GAGGNGGRGGMFIGNGGAGGAGGTGG

SEQ ID NO: 662599 - protein, 30 aa, Mycobacterium
GAGGNGSSITALWGIYGGGAGGEGGSATGT

SEQ ID NO: 662600 - protein, 24 aa, Mycobacterium
GAGGQAGLFGAQGQQGAGGAGGNG

SEQ ID NO: 662601 - protein, 17 aa, Mycobacterium
GAGGQGGLFGNAGTTGA

SEQ ID NO: 662602 - protein, 29 aa, Mycobacterium
GAGGQGGNARLFGTGGVGGHGGTGAGSGS

SEQ ID NO: 662603 - protein, 17 aa, Mycobacterium
GAGGRAGSGGANGGNGG

SEQ ID NO: 662604 - protein, 18 aa, Mycobacterium
GAGGRLAGHAGSTGSPGT

SEQ ID NO: 662605 - protein, 19 aa, Mycobacterium
GAGGSAAFFGNGGAGGHGG

SEQ ID NO: 662606 - protein, 23 aa, Mycobacterium
GAGGSGGFFAGDGGNGGAGGVGG

SEQ ID NO: 662607 - protein, 27 aa, Mycobacterium
GAGGTGGDGGFLLGQGAAGGAGGNGGA

SEQ ID NO: 662608 - protein, 21 aa, Mycobacterium
GAGGTGGRAGQLIGNGGAGGA

SEQ ID NO: 662609 - protein, 33 aa, Mycobacterium
GAGGTGLPGVPPPFGSGDYLAGSGGNGGNAGAL

SEQ ID NO: 662610 - protein, 18 aa, Mycobacterium
GAGGVDWERLTAVAELAV

SEQ ID NO: 662611 - protein, 24 aa, Mycobacterium
GAGGVGGAGGWLSGNAGAGGAGGP

SEQ ID NO: 662612 - protein, 24 aa, Mycobacterium
GAGGVGGDGGWLIGDGGAGGQGGI

SEQ ID NO: 662613 - protein, 24 aa, Mycobacterium
GAGGVIGWAGSTGATGAGGTGGQG

SEQ ID NO: 662614 - protein, 18 aa, Mycobacterium
GAGGWLSGDGGTGGTGGA

SEQ ID NO: 662615 - protein, 22 aa, Mycobacterium
GAGGYFCAGMDLKAATKKPPGD

SEQ ID NO: 662616 - protein, 23 aa, Mycobacterium
GAGGYFCAGMDLKAATKKPPGES

SEQ ID NO: 662617 - protein, 17 aa, Mycobacterium
GAGHAPHHVFAEWADKY

SEQ ID NO: 662618 - protein, 19 aa, Mycobacterium
GAGHAVATQANWWQGKSLA

SEQ ID NO: 662619 - protein, 17 aa, Mycobacterium
GAGHLWKLVRTFDDPST

SEQ ID NO: 662620 - protein, 18 aa, Mycobacterium
GAGHLWKLVRTFDDPSTW

SEQ ID NO: 662621 - protein, 19 aa, Mycobacterium
GAGHPEIDSGVAYKPYSGL

SEQ ID NO: 662622 - protein, 19 aa, Mycobacterium
GAGIDYGLLRYLRADTAAA

SEQ ID NO: 662623 - protein, 18 aa, Mycobacterium
GAGIGSGDVVCWQTPNWW

SEQ ID NO: 662624 - protein, 26 aa, Mycobacterium
GAGISRPTFYFYFPSKEAVLLSLIDP

SEQ ID NO: 662625 - protein, 26 aa, Mycobacterium
GAGISRPTFYFYFPSKEAVLLTLLDR

SEQ ID NO: 662626 - protein, 24 aa, Mycobacterium
GAGISRPTFYFYFSSKDAVLLALL

SEQ ID NO: 662627 - protein, 25 aa, Mycobacterium
GAGISRPTFYFYFSSKESVLLTLAE

SEQ ID NO: 662628 - protein, 18 aa, Mycobacterium
GAGIVRRLAADGAAVAFT

SEQ ID NO: 662629 - protein, 18 aa, Mycobacterium
GAGIVVLKPLSRALADAD

SEQ ID NO: 662630 - protein, 18 aa, Mycobacterium
GAGKGAIYRRWPSKIEMT

SEQ ID NO: 662631 - protein, 36 aa, Mycobacterium
GAGKGTRVGLFFANGIEWITWWLAVSRIGAVAVPLS

SEQ ID NO: 662632 - protein, 23 aa, Mycobacterium
GAGKSTFLRCLNHLETIDAGQVW

SEQ ID NO: 662633 - protein, 19 aa, Mycobacterium
GAGKWPDKFLAGAASVAHG

SEQ ID NO: 662634 - protein, 24 aa, Mycobacterium
GAGLARYADRLGMTVVLADVDGAA

SEQ ID NO: 662635 - protein, 18 aa, Mycobacterium
GAGLFVADCLARDSALLT

SEQ ID NO: 662636 - protein, 18 aa, Mycobacterium
GAGLGVFGVVPAGAAISA

SEQ ID NO: 662637 - protein, 30 aa, Mycobacterium
GAGLPEAEWLAIANGVSWLSEQLSREDIAD

SEQ ID NO: 662638 - protein, 20 aa, Mycobacterium
GAGLRRGDGVALVLPNRPEF

SEQ ID NO: 662639 - protein, 20 aa, Mycobacterium
GAGLSGLTGGDGYDGGQGGA

SEQ ID NO: 662640 - protein, 21 aa, Mycobacterium
GAGLSRPTFYFYFKSKDAVLL

SEQ ID NO: 662641 - protein, 26 aa, Mycobacterium
GAGMHPWGKWGRDFTEYGVIAARAAL

SEQ ID NO: 662642 - protein, 18 aa, Mycobacterium
GAGMKVAFAQLAQAISGF

SEQ ID NO: 662643 - protein, 17 aa, Mycobacterium
GAGMVLVERESRARQLG

SEQ ID NO: 662644 - protein, 26 aa, Mycobacterium
GAGNCPIEAFIAVANKYGWEHGCELF

SEQ ID NO: 662645 - protein, 25 aa, Mycobacterium
GAGNCPLEAFVAVADLHGWGHSCDL

SEQ ID NO: 662646 - protein, 25 aa, Mycobacterium
GAGNFNLALARAYKAVADATGGNGI

SEQ ID NO: 662647 - protein, 22 aa, Mycobacterium
GAGNIARITAIGGGTVTSSATN

SEQ ID NO: 662648 - protein, 17 aa, Mycobacterium
GAGNIGNVSSALFSNNN

SEQ ID NO: 662649 - protein, 17 aa, Mycobacterium
GAGPAPDSALSWCNPGG

SEQ ID NO: 662650 - protein, 17 aa, Mycobacterium
GAGPAPDSELNWCNPSG

SEQ ID NO: 662651 - protein, 18 aa, Mycobacterium
GAGPAPDSELNWCNPSGR

SEQ ID NO: 662652 - protein, 25 aa, Mycobacterium
GAGPGESVALLFSRSAEAIVAILAV

SEQ ID NO: 662653 - protein, 24 aa, Mycobacterium
GAGPGQAVALLFSRSPQAIVAILA

SEQ ID NO: 662654 - protein, 25 aa, Mycobacterium
GAGPGRGAGDWAMRELVVLHEVAHH

SEQ ID NO: 662655 - protein, 24 aa, Mycobacterium
GAGPGTSVALLFSRSAQAIVAILA

SEQ ID NO: 662656 - protein, 25 aa, Mycobacterium
GAGPIGCMHIRIARGVHNCGPIYLV

SEQ ID NO: 662657 - protein, 18 aa, Mycobacterium
GAGPLRLAGRMDGVGEQR

SEQ ID NO: 662658 - protein, 25 aa, Mycobacterium
GAGPLRPGPDDVRRAIREGREGNLV

SEQ ID NO: 662659 - protein, 24 aa, Mycobacterium
GAGPMLAAAAGWDALAAQLEATAS

SEQ ID NO: 662660 - protein, 19 aa, Mycobacterium
GAGPRGRVVTLEYEPKHAE

SEQ ID NO: 662661 - protein, 22 aa, Mycobacterium
GAGQAGGWLFGDGGPGAAATAT

SEQ ID NO: 662662 - protein, 23 aa, Mycobacterium
GAGQWGSALAFAGAQFGLEIEVW

SEQ ID NO: 662663 - protein, 26 aa, Mycobacterium
GAGRAELQTLLARWSAAAAILQQGKP

SEQ ID NO: 662664 - protein, 20 aa, Mycobacterium
GAGRAVVRLDHRGHGVKTTA

SEQ ID NO: 662665 - protein, 20 aa, Mycobacterium
GAGRHAFEAYRCGADVVAFD

SEQ ID NO: 662666 - protein, 26 aa, Mycobacterium
GAGRIVSFDAAGGWNIEEEGYQSVGS

SEQ ID NO: 662667 - protein, 20 aa, Mycobacterium
GAGRKAHVVVADLAHPDATA

SEQ ID NO: 662668 - protein, 20 aa, Mycobacterium
GAGRNPFKLVLNIIKMLRSV

SEQ ID NO: 662669 - protein, 25 aa, Mycobacterium
GAGRPVVLVHGWPLTGESWGAQVEA

SEQ ID NO: 662670 - protein, 24 aa, Mycobacterium
GAGRTELAMSVFGRSYGRYVSGKV

SEQ ID NO: 662671 - protein, 23 aa, Mycobacterium
GAGRTELLEAIFGARRSTAGDVV

SEQ ID NO: 662672 - protein, 26 aa, Mycobacterium
GAGRTELQILLARWSAAAAILQRGKP

SEQ ID NO: 662673 - protein, 26 aa, Mycobacterium
GAGRTWHPYQVPAFLAAGYRVITFDN

SEQ ID NO: 662674 - protein, 26 aa, Mycobacterium
GAGRTWHPYQVPAFLEAGYRVITFDN

SEQ ID NO: 662675 - protein, 17 aa, Mycobacterium
GAGRVVRPAGSRADTVV

SEQ ID NO: 662676 - protein, 26 aa, Mycobacterium
GAGRYRLKCVMAERIRVLEWLPDDPY

SEQ ID NO: 662677 - protein, 22 aa, Mycobacterium
GAGSFPWVLAITPPYTDSAQRS

SEQ ID NO: 662678 - protein, 29 aa, Mycobacterium
GAGSGAPAGWGWVAPYIGMIWPNGDPAKL

SEQ ID NO: 662679 - protein, 23 aa, Mycobacterium
GAGSGSIAVEWSRSGTGCSASAF

SEQ ID NO: 662680 - protein, 29 aa, Mycobacterium
GAGSGSISVEWCLSWAGCTAVAFERDERR

SEQ ID NO: 662681 - protein, 31 aa, Mycobacterium
GAGSGSVSVEWCLAGTGCRAVAFERDEARRA

SEQ ID NO: 662682 - protein, 20 aa, Mycobacterium
GAGSIGPMSVPPTWTAPAVT

SEQ ID NO: 662683 - protein, 32 aa, Mycobacterium
GAGSLIEAAGAWQRLAVELENSVSTYTSTLTS

SEQ ID NO: 662684 - protein, 24 aa, Mycobacterium
GAGSLIEAAGAWQSLGVELENSVA

SEQ ID NO: 662685 - protein, 20 aa, Mycobacterium
GAGSPLRATMHFGTGSDPAL

SEQ ID NO: 662686 - protein, 23 aa, Mycobacterium
GAGSWPAEFTRFDVGLQDPVARV

SEQ ID NO: 662687 - protein, 19 aa, Mycobacterium
GAGSYWRAYAHYTRWLFTP

SEQ ID NO: 662688 - protein, 22 aa, Mycobacterium
GAGTFPWVLAITTPYSDEAQRS

SEQ ID NO: 662689 - protein, 19 aa, Mycobacterium
GAGTMTHAWLITGPPGSGR

SEQ ID NO: 662690 - protein, 23 aa, Mycobacterium
GAGTRGGVTWSHDIDHQIAYITV

SEQ ID NO: 662691 - protein, 18 aa, Mycobacterium
GAGTRVWAHGDLPAAQSL

SEQ ID NO: 662692 - protein, 18 aa, Mycobacterium
GAGTVGFAGVSATGTKVR

SEQ ID NO: 662693 - protein, 18 aa, Mycobacterium
GAGTVSWTTCHDADGQLL

SEQ ID NO: 662694 - protein, 18 aa, Mycobacterium
GAGVFGGLGGDGGTGGQL

SEQ ID NO: 662695 - protein, 17 aa, Mycobacterium
GAGVPGLGGGAGTNPTG

SEQ ID NO: 662696 - protein, 18 aa, Mycobacterium
GAGVPRLIVVSSTAAHPS

SEQ ID NO: 662697 - protein, 17 aa, Mycobacterium
GAGVTFGGAGGEGGAAA

SEQ ID NO: 662698 - protein, 17 aa, Mycobacterium
GAGVVLDFSRYMNRVLS

SEQ ID NO: 662699 - protein, 30 aa, Mycobacterium
GAGVVSGLSAFPGGIGGAGGAGGQGGQATG

SEQ ID NO: 662700 - protein, 21 aa, Mycobacterium
GAGWHCADLLAAAAVADDFYF

SEQ ID NO: 662701 - protein, 25 aa, Mycobacterium
GAGWNFGFGNSGSFNLGFGNTGDGN

SEQ ID NO: 662702 - protein, 18 aa, Mycobacterium
GAGYDRPGVALVLGAGNV

SEQ ID NO: 662703 - protein, 17 aa, Mycobacterium
GAHALAVDYAKVREQYG

SEQ ID NO: 662704 - protein, 18 aa, Mycobacterium
GAHAMTIVVEFPPGDPGS

SEQ ID NO: 662705 - protein, 21 aa, Mycobacterium
GAHAPYLDWLTRSSAASAAMA

SEQ ID NO: 662706 - protein, 18 aa, Mycobacterium
GAHARSAVGVSELPRNTP

SEQ ID NO: 662707 - protein, 19 aa, Mycobacterium
GAHAVRLGPTVLRTSTAAA

SEQ ID NO: 662708 - protein, 17 aa, Mycobacterium
GAHCGMICDASYPTFLL

SEQ ID NO: 662709 - protein, 18 aa, Mycobacterium
GAHDLLNEYIRHIGSAIF

SEQ ID NO: 662710 - protein, 20 aa, Mycobacterium
GAHDRKRWWTGLPEPAALAL

SEQ ID NO: 662711 - protein, 17 aa, Mycobacterium
GAHDYELADYGLTPEGV

SEQ ID NO: 662712 - protein, 17 aa, Mycobacterium
GAHFCLGAHLARMEARV

SEQ ID NO: 662713 - protein, 18 aa, Mycobacterium
GAHFCLGAPLARLEATVA

SEQ ID NO: 662714 - protein, 23 aa, Mycobacterium
GAHGGPHYLGLAVHEMVSDDASR

SEQ ID NO: 662715 - protein, 19 aa, Mycobacterium
GAHGMFCAGADITAFDEIR

SEQ ID NO: 662716 - protein, 17 aa, Mycobacterium
GAHKCLGMVFGQLEIKT

SEQ ID NO: 662717 - protein, 17 aa, Mycobacterium
GAHLCDRLLGGGVEVVS

SEQ ID NO: 662718 - protein, 18 aa, Mycobacterium
GAHLRRSLNRGLQYRVIA

SEQ ID NO: 662719 - protein, 26 aa, Mycobacterium
GAHPSLCLLASWVPPASPAGERLRAV

SEQ ID NO: 662720 - protein, 25 aa, Mycobacterium
GAHRARETLQRWECGQDRVALIMHN

SEQ ID NO: 662721 - protein, 24 aa, Mycobacterium
GAHRFLQRAWRVVVDEETGKIRVT

SEQ ID NO: 662722 - protein, 19 aa, Mycobacterium
GAHRSCCLYVDPPYLGSSR

SEQ ID NO: 662723 - protein, 19 aa, Mycobacterium
GAHSCPGAPLARAEGRISL

SEQ ID NO: 662724 - protein, 30 aa, Mycobacterium
GAHVRDVFRIFLTRLRLMLAEDDPLFENWD

SEQ ID NO: 662725 - protein, 19 aa, Mycobacterium
GAHYCIGANLARLTINLMF

SEQ ID NO: 662726 - protein, 17 aa, Mycobacterium
GAHYCLGANLAKAELEI

SEQ ID NO: 662727 - protein, 18 aa, Mycobacterium
GAHYCLGANLARREIAEA

SEQ ID NO: 662728 - protein, 18 aa, Mycobacterium
GAHYCLGANLARRELSEA

SEQ ID NO: 662729 - protein, 32 aa, Mycobacterium
GAHYEIFIPEFPVLNFDLNIPVDIPIYLDLGS

SEQ ID NO: 662730 - protein, 18 aa, Mycobacterium
GAHYPGDFIVEYIGQTRG

SEQ ID NO: 662731 - protein, 25 aa, Mycobacterium
GAHYPGDVLAGFGIGAGIAVLGGRL

SEQ ID NO: 662732 - protein, 18 aa, Mycobacterium
GAIAAFLSARNEFIGEPE

SEQ ID NO: 662733 - protein, 17 aa, Mycobacterium
GAIAHVITMLRAQEEGW

SEQ ID NO: 662734 - protein, 18 aa, Mycobacterium
GAIAPRPVCVPDREGNHA

SEQ ID NO: 662735 - protein, 17 aa, Mycobacterium
GAICTRAWCDDDGALHL

SEQ ID NO: 662736 - protein, 20 aa, Mycobacterium
GAIEACARKLFIHPNTVRYR

SEQ ID NO: 662737 - protein, 26 aa, Mycobacterium
GAIEIGIKWLSLYAFSTENWKRSPEE

SEQ ID NO: 662738 - protein, 22 aa, Mycobacterium
GAIEMGIPWLTTYAFSTENWRR

SEQ ID NO: 662739 - protein, 24 aa, Mycobacterium
GAIEMLPRNGFRLNIGLSEITDLV

SEQ ID NO: 662740 - protein, 39 aa, Mycobacterium
GAIFKLAAQTAVDWSRAWDDGRPGLLLRAKHALFDRLVY

SEQ ID NO: 662741 - protein, 25 aa, Mycobacterium
GAIFKRAAQTAVDWSRACDGGGPGL

SEQ ID NO: 662742 - protein, 18 aa, Mycobacterium
GAIGDWLIGPGAQLQAVG

SEQ ID NO: 662743 - protein, 24 aa, Mycobacterium
GAIGMCFTGGYALAMAADDRLLAP

SEQ ID NO: 662744 - protein, 19 aa, Mycobacterium
GAIGRDIHDPYALYEAQAK

SEQ ID NO: 662745 - protein, 20 aa, Mycobacterium
GAIGRIQRRLGMSSELGPAL

SEQ ID NO: 662746 - protein, 23 aa, Mycobacterium
GAIGRPRVPVELNHEPFLTLGIH

SEQ ID NO: 662747 - protein, 23 aa, Mycobacterium
GAIGYTGAGTVEFLADDDGEFYF

SEQ ID NO: 662748 - protein, 18 aa, Mycobacterium
GAIHLLTRIVGLRKATEL

SEQ ID NO: 662749 - protein, 18 aa, Mycobacterium
GAIIEWISSVMTLLPGDL

SEQ ID NO: 662750 - protein, 24 aa, Mycobacterium
GAIIIDHWGIIKADIGIRDGRIVG

SEQ ID NO: 662751 - protein, 25 aa, Mycobacterium
GAIKPGGGSIELFGRNTTRLAPYKI

SEQ ID NO: 662752 - protein, 21 aa, Mycobacterium
GAIKRPEVAWWMLDFAFPGLK

SEQ ID NO: 662753 - protein, 19 aa, Mycobacterium
GAILADWGADVIKIEHPVR

SEQ ID NO: 662754 - protein, 19 aa, Mycobacterium
GAILADWGADVIKVEHPAR

SEQ ID NO: 662755 - protein, 19 aa, Mycobacterium
GAILADWGADVIKVEHPLR

SEQ ID NO: 662756 - protein, 19 aa, Mycobacterium
GAILADWGADVIKVEHPRR

SEQ ID NO: 662757 - protein, 19 aa, Mycobacterium
GAILADWGADVIKVEHPVR

SEQ ID NO: 662758 - protein, 24 aa, Mycobacterium
GAILDFASSFGILVLTRAYADWSA

SEQ ID NO: 662759 - protein, 20 aa, Mycobacterium
GAILDRVRFEVVAERLRAEY

SEQ ID NO: 662760 - protein, 19 aa, Mycobacterium
GAILESFAAYFGDEAKRPL

SEQ ID NO: 662761 - protein, 35 aa, Mycobacterium
GAILNIASILSWKHIPGIGAYAAAKAALWAQTDAV

SEQ ID NO: 662762 - protein, 23 aa, Mycobacterium
GAILNVLSVLSWMHPPTSGAYAS

SEQ ID NO: 662763 - protein, 17 aa, Mycobacterium
GAIMPMKVISALLGIPE

SEQ ID NO: 662764 - protein, 19 aa, Mycobacterium
GAIMVHPYVASKWAVRGLT

SEQ ID NO: 662765 - protein, 25 aa, Mycobacterium
GAINATRIPMTWFQVDQMPLWAKVP

SEQ ID NO: 662766 - protein, 19 aa, Mycobacterium
GAINRRWTENLTELRRYAG

SEQ ID NO: 662767 - protein, 19 aa, Mycobacterium
GAIPGRKGGLVVVRTAVKR

SEQ ID NO: 662768 - protein, 24 aa, Mycobacterium
GAIPRERRLLAAFGPRMLDTARDR

SEQ ID NO: 662769 - protein, 24 aa, Mycobacterium
GAIPRIPLNLVLVKGVQILGFAFQ

SEQ ID NO: 662770 - protein, 24 aa, Mycobacterium
GAIPTNWPGPTFAYRILTRKPRSH

SEQ ID NO: 662771 - protein, 27 aa, Mycobacterium
GAIPVMCLPGHRFAELDHFVGVSGAIG

SEQ ID NO: 662772 - protein, 23 aa, Mycobacterium
GAIPVMCLPGHRLAELHHFAEVS

SEQ ID NO: 662773 - protein, 25 aa, Mycobacterium
GAIQPRARGPVGIGHEPFRGQIRAA

SEQ ID NO: 662774 - protein, 19 aa, Mycobacterium
GAIRGWGVFSHGFTLGKDC

SEQ ID NO: 662775 - protein, 21 aa, Mycobacterium
GAIRREMDRLFANNGPSAVLG

SEQ ID NO: 662776 - protein, 23 aa, Mycobacterium
GAIRRLAAVGPPFVEEIIEYERP

SEQ ID NO: 662777 - protein, 17 aa, Mycobacterium
GAIRRLAGQTVFGPLAE

SEQ ID NO: 662778 - protein, 34 aa, Mycobacterium
GAIRYARSRGLPVLGLCLGLQCIVIEAARSAGLD

SEQ ID NO: 662779 - protein, 21 aa, Mycobacterium
GAISGRIAYVLGLGGPALTID

SEQ ID NO: 662780 - protein, 18 aa, Mycobacterium
GAISRAHRGVLFLDECAE

SEQ ID NO: 662781 - protein, 25 aa, Mycobacterium
GAITATPIIRWLRGVESAGGPVDQF

SEQ ID NO: 662782 - protein, 17 aa, Mycobacterium
GAITPFALLQLADRGQF

SEQ ID NO: 662783 - protein, 22 aa, Mycobacterium
GAITRYAVRLSQPAVVPAEGTE

SEQ ID NO: 662784 - protein, 20 aa, Mycobacterium
GAIVKRPRVIVDEFGNESIG

SEQ ID NO: 662785 - protein, 27 aa, Mycobacterium
GAIVPWNSPLLMLAWKLSPALAGGNTI

SEQ ID NO: 662786 - protein, 29 aa, Mycobacterium
GAIVPWNVPQCLIMPKLIPALIAGCTVIV

SEQ ID NO: 662787 - protein, 25 aa, Mycobacterium
GAIWRLWRAGIVDIRGRGQRRQVRS

SEQ ID NO: 662788 - protein, 21 aa, Mycobacterium
GAIWYPMVYDMPARAKEAFGI

SEQ ID NO: 662789 - protein, 21 aa, Mycobacterium
GAIWYPMVYDMPARAKEAFGT

SEQ ID NO: 662790 - protein, 17 aa, Mycobacterium
GAIYAHFGTKEELFLAV

SEQ ID NO: 662791 - protein, 25 aa, Mycobacterium
GAIYDAWASLSYERGPLGLPTSAEI

SEQ ID NO: 662792 - protein, 19 aa, Mycobacterium
GAIYLTFALPAGARADAYF

SEQ ID NO: 662793 - protein, 35 aa, Mycobacterium
GAKAIATEIGRPVMVKAQVKIGGRGKAGGVKYAAT

SEQ ID NO: 662794 - protein, 18 aa, Mycobacterium
GAKDELRFTAPPRLDLSL

SEQ ID NO: 662795 - protein, 20 aa, Mycobacterium
GAKEAFLAWSDDPLPKGAQV

SEQ ID NO: 662796 - protein, 22 aa, Mycobacterium
GAKEILCIRVLGGSGRRYAGIG

SEQ ID NO: 662797 - protein, 24 aa, Mycobacterium
GAKELSMLIEWRVQDANDQVSQLE

SEQ ID NO: 662798 - protein, 22 aa, Mycobacterium
GAKEQLGILARFAGAALVAKED

SEQ ID NO: 662799 - protein, 24 aa, Mycobacterium
GAKEVAATLARRLPACEPAIITPL

SEQ ID NO: 662800 - protein, 21 aa, Mycobacterium
GAKIVCVRPAPVPGEVRPRSL

SEQ ID NO: 662801 - protein, 18 aa, Mycobacterium
GAKLDWMTATTLLTGRQT

SEQ ID NO: 662802 - protein, 25 aa, Mycobacterium
GAKLGPARTAGICAISPALYTSFAD

SEQ ID NO: 662803 - protein, 23 aa, Mycobacterium
GAKLPVIVYIHGGGWSRGAGSLP

SEQ ID NO: 662804 - protein, 18 aa, Mycobacterium
GAKLQWILENVDGVRDAA

SEQ ID NO: 662805 - protein, 26 aa, Mycobacterium
GAKLVCVRPAPVPGLVRPRSLGDPVH

SEQ ID NO: 662806 - protein, 18 aa, Mycobacterium
GAKNVLLVFFPLAFTGIC

SEQ ID NO: 662807 - protein, 25 aa, Mycobacterium
GAKPHPRGWGTFARYLGHYCRELGL

SEQ ID NO: 662808 - protein, 22 aa, Mycobacterium
GAKQFGGGFSRIHHQRGPVLEV

SEQ ID NO: 662809 - protein, 33 aa, Mycobacterium
GAKSTCGHKKSFVCGFHGWTYDRDGNCIHVPEQ

SEQ ID NO: 662810 - protein, 18 aa, Mycobacterium
GAKSWPVVLATRLGISVK

SEQ ID NO: 662811 - protein, 19 aa, Mycobacterium
GAKYGLYRHVTFNTRVTRG

SEQ ID NO: 662812 - protein, 24 aa, Mycobacterium
GALAADVERLWLALSRLLPPPWRA

SEQ ID NO: 662813 - protein, 19 aa, Mycobacterium
GALADGWLGSFLTPDEARA

SEQ ID NO: 662814 - protein, 18 aa, Mycobacterium
GALAEQWAGLERLLTSGE

SEQ ID NO: 662815 - protein, 19 aa, Mycobacterium
GALAFKTAYARWSEPGDDR

SEQ ID NO: 662816 - protein, 17 aa, Mycobacterium
GALAGAMRPPAPPGAPG

SEQ ID NO: 662817 - protein, 21 aa, Mycobacterium
GALAIRWGAPTAAERGPLIGT

SEQ ID NO: 662818 - protein, 19 aa, Mycobacterium
GALAMDPRRAAIFDEGSPL

SEQ ID NO: 662819 - protein, 19 aa, Mycobacterium
GALARHIAEELPLLGSCTV

SEQ ID NO: 662820 - protein, 19 aa, Mycobacterium
GALARKLRADGPFHIGVLL

SEQ ID NO: 662821 - protein, 19 aa, Mycobacterium
GALATPLRRLLAGADEEAV

SEQ ID NO: 662822 - protein, 20 aa, Mycobacterium
GALCAEARVSITTATLLSIA

SEQ ID NO: 662823 - protein, 26 aa, Mycobacterium
GALCPSHHRGCYGCFGPSAAPRTATL

SEQ ID NO: 662824 - protein, 23 aa, Mycobacterium
GALCPSHHRGCYGCFGPSAVPQT

SEQ ID NO: 662825 - protein, 25 aa, Mycobacterium
GALDAGDVAACWPVPGPDDDKYTQG

SEQ ID NO: 662826 - protein, 23 aa, Mycobacterium
GALDAIAAVLARFHRDAGRSAAI

SEQ ID NO: 662827 - protein, 25 aa, Mycobacterium
GALDDWCYELAWPARPAPDTETSNP

SEQ ID NO: 662828 - protein, 20 aa, Mycobacterium
GALDEFALWATSLTQRAVLR

SEQ ID NO: 662829 - protein, 18 aa, Mycobacterium
GALDEIRLSVAPVALAGG

SEQ ID NO: 662830 - protein, 19 aa, Mycobacterium
GALDIALAWVTAGQAAERG

SEQ ID NO: 662831 - protein, 24 aa, Mycobacterium
GALDLVDICLPEAIPSGYLPILRA

SEQ ID NO: 662832 - protein, 25 aa, Mycobacterium
GALDPRLRELVIMRIGWLTACDYEW

SEQ ID NO: 662833 - protein, 37 aa, Mycobacterium
GALDPRLRELVIMRIGWLTACDYEWTQHWRVASRLGV

SEQ ID NO: 662834 - protein, 19 aa, Mycobacterium
GALDPVKFLVSWQRGDSMT

SEQ ID NO: 662835 - protein, 24 aa, Mycobacterium
GALDRAGDHLGLDRHVVGQVQAVE

SEQ ID NO: 662836 - protein, 19 aa, Mycobacterium
GALDRGLPVLGICRGAQVL

SEQ ID NO: 662837 - protein, 21 aa, Mycobacterium
GALEAGELAVWLAEHSSGKRF

SEQ ID NO: 662838 - protein, 22 aa, Mycobacterium
GALEELAPLVGLGGDHAPGVLE

SEQ ID NO: 662839 - protein, 20 aa, Mycobacterium
GALEELARLIAAGQLRVPIA

SEQ ID NO: 662840 - protein, 22 aa, Mycobacterium
GALEEWSLSPGKVISWHPTAAS

SEQ ID NO: 662841 - protein, 18 aa, Mycobacterium
GALEGLDNLTFVINCNLQ

SEQ ID NO: 662842 - protein, 25 aa, Mycobacterium
GALERMSGPEAKTWEGHAGQPFDPN

SEQ ID NO: 662843 - protein, 29 aa, Mycobacterium
GALERRYLLVPGLRSSATYVLDTKPDPRH

SEQ ID NO: 662844 - protein, 17 aa, Mycobacterium
GALFDVLETSGRDVRDD

SEQ ID NO: 662845 - protein, 17 aa, Mycobacterium
GALGARLSSASSVVLIV

SEQ ID NO: 662846 - protein, 18 aa, Mycobacterium
GALGARMTGGGFGGCVIA

SEQ ID NO: 662847 - protein, 21 aa, Mycobacterium
GALGDLGLACYVQTTGSRGLH

SEQ ID NO: 662848 - protein, 24 aa, Mycobacterium
GALGDLLPILTIPGESAQNVANVV

SEQ ID NO: 662849 - protein, 17 aa, Mycobacterium
GALGGFSPSGGRVLLVW

SEQ ID NO: 662850 - protein, 26 aa, Mycobacterium
GALGIDAATLLAVWTAEGRYDYRNLM

SEQ ID NO: 662851 - protein, 28 aa, Mycobacterium
GALGLRIAQRLADLGARRLVLLSRSGVP

SEQ ID NO: 662852 - protein, 24 aa, Mycobacterium
GALGPTGGGFDCSGLTQYAYAQGS

SEQ ID NO: 662853 - protein, 24 aa, Mycobacterium
GALGRLEDLSAWIASCQGHCPPRQ

SEQ ID NO: 662854 - protein, 24 aa, Mycobacterium
GALGRLEDLSAWVASCQGQCPPRQ

SEQ ID NO: 662855 - protein, 26 aa, Mycobacterium
GALGRMLLGSVCSALLHHAHCPVAVV

SEQ ID NO: 662856 - protein, 20 aa, Mycobacterium
GALGSLPGALGSAIPSLGGG

SEQ ID NO: 662857 - protein, 20 aa, Mycobacterium
GALGTSAAGYRLWQEQIDEF

SEQ ID NO: 662858 - protein, 19 aa, Mycobacterium
GALHPEWDVFRNCYRPQWC

SEQ ID NO: 662859 - protein, 17 aa, Mycobacterium
GALHSRGHEVAWDMVQP

SEQ ID NO: 662860 - protein, 25 aa, Mycobacterium
GALIDKPLIRRKLAEMIVDVESAQA

SEQ ID NO: 662861 - protein, 17 aa, Mycobacterium
GALIGFGVTDVADLRTA

SEQ ID NO: 662862 - protein, 17 aa, Mycobacterium
GALKLGRELGKGAVIVV

SEQ ID NO: 662863 - protein, 17 aa, Mycobacterium
GALKLGVERGPGTVILV

SEQ ID NO: 662864 - protein, 21 aa, Mycobacterium
GALKLKELTYRWAEHYPAGEL

SEQ ID NO: 662865 - protein, 24 aa, Mycobacterium
GALKLKELTYRWAEHYPAGELKHG

SEQ ID NO: 662866 - protein, 24 aa, Mycobacterium
GALKSCLEEIYFGYGEKDWERLAG

SEQ ID NO: 662867 - protein, 17 aa, Mycobacterium
GALLANDVNGLWVTHNS

SEQ ID NO: 662868 - protein, 19 aa, Mycobacterium
GALLARMITDLGIAVHVGT

SEQ ID NO: 662869 - protein, 19 aa, Mycobacterium
GALLARMVGDLGISVHVGT

SEQ ID NO: 662870 - protein, 19 aa, Mycobacterium
GALLARMVSDLGIAVHVGT

SEQ ID NO: 662871 - protein, 23 aa, Mycobacterium
GALLDALTEFGMRGIDLTRIESR

SEQ ID NO: 662872 - protein, 24 aa, Mycobacterium
GALLDERIEAIKALWTDEPAEYHG

SEQ ID NO: 662873 - protein, 24 aa, Mycobacterium
GALLDERIEAIKVLWTQEPAEYHG

SEQ ID NO: 662874 - protein, 18 aa, Mycobacterium
GALLGRMIGELGITVHTD

SEQ ID NO: 662875 - protein, 18 aa, Mycobacterium
GALLHDGKGLLLDFDAHA

SEQ ID NO: 662876 - protein, 26 aa, Mycobacterium
GALLLRGSPFALGWVAGWVSAEFPPH

SEQ ID NO: 662877 - protein, 27 aa, Mycobacterium
GALLLRREIACVPLLHGGGHERDIRSG

SEQ ID NO: 662878 - protein, 22 aa, Mycobacterium
GALLPAGFTRILGYRSGLQGDD

SEQ ID NO: 662879 - protein, 19 aa, Mycobacterium
GALLPLLLFASARAAIPFT

SEQ ID NO: 662880 - protein, 19 aa, Mycobacterium
GALLPLLLFASARAAVPVT

SEQ ID NO: 662881 - protein, 19 aa, Mycobacterium
GALLRAKFAHPLRFDVPIT

SEQ ID NO: 662882 - protein, 21 aa, Mycobacterium
GALLREFVGMTLNLPTPEEAE

SEQ ID NO: 662883 - protein, 17 aa, Mycobacterium
GALLRGRRLLVVPESVA

SEQ ID NO: 662884 - protein, 17 aa, Mycobacterium
GALLVRVARSHLRVGSF

SEQ ID NO: 662885 - protein, 18 aa, Mycobacterium
GALMGALPAGGTMLAARL

SEQ ID NO: 662886 - protein, 27 aa, Mycobacterium
GALMLRECPRLPAVGCETGDWSHVDVY

SEQ ID NO: 662887 - protein, 20 aa, Mycobacterium
GALMTARFVSFDEIAGQLEE

SEQ ID NO: 662888 - protein, 19 aa, Mycobacterium
GALNFSVPSFDEFWDRGYL

SEQ ID NO: 662889 - protein, 17 aa, Mycobacterium
GALNLILITVLARGHVL

SEQ ID NO: 662890 - protein, 19 aa, Mycobacterium
GALNWTAAPVQLPDMPPIQ

SEQ ID NO: 662891 - protein, 23 aa, Mycobacterium
GALPATPIIRWLEGVDGPVEEFN

SEQ ID NO: 662892 - protein, 20 aa, Mycobacterium
GALPDSPAPVVIDPAHPEFH

SEQ ID NO: 662893 - protein, 24 aa, Mycobacterium
GALPELASALWLKGNLLAERHSRG

SEQ ID NO: 662894 - protein, 20 aa, Mycobacterium
GALPEYQPPGLAPIGVDDVA

SEQ ID NO: 662895 - protein, 19 aa, Mycobacterium
GALPFDLTGPAALHAPASA

SEQ ID NO: 662896 - protein, 18 aa, Mycobacterium
GALPGLLPGGRPLADETA

SEQ ID NO: 662897 - protein, 19 aa, Mycobacterium
GALPLLAPMSEVAGRLAAQ

SEQ ID NO: 662898 - protein, 19 aa, Mycobacterium
GALPLLAPMSEVAGRLSAQ

SEQ ID NO: 662899 - protein, 18 aa, Mycobacterium
GALPLLVGGSMLYVQSLL

SEQ ID NO: 662900 - protein, 19 aa, Mycobacterium
GALPRAGVAAQIIEVAPGL

SEQ ID NO: 662901 - protein, 19 aa, Mycobacterium
GALPRPEPLRDFVSRVDAA

SEQ ID NO: 662902 - protein, 21 aa, Mycobacterium
GALPTCFLVAAPRSDNAPAGP

SEQ ID NO: 662903 - protein, 19 aa, Mycobacterium
GALPTRVLLISAHDESAIV

SEQ ID NO: 662904 - protein, 19 aa, Mycobacterium
GALQKHWNAAMEVLGEYSL

SEQ ID NO: 662905 - protein, 20 aa, Mycobacterium
GALQRGLPVLGICRGAQVLN

SEQ ID NO: 662906 - protein, 24 aa, Mycobacterium
GALQSRIVPWFGPGAVITTPRHQV

SEQ ID NO: 662907 - protein, 17 aa, Mycobacterium
GALQVWQALTERVSGRP

SEQ ID NO: 662908 - protein, 24 aa, Mycobacterium
GALRAAGLPEEWSPESESSRELLH

SEQ ID NO: 662909 - protein, 19 aa, Mycobacterium
GALRAGAAGFVLKDSSAEE

SEQ ID NO: 662910 - protein, 17 aa, Mycobacterium
GALRATLGILDRTVRRG

SEQ ID NO: 662911 - protein, 25 aa, Mycobacterium
GALRDLTEWAGIRWGDDTPDEGIVF

SEQ ID NO: 662912 - protein, 20 aa, Mycobacterium
GALRDPRNWWHLRNPRTPSW

SEQ ID NO: 662913 - protein, 24 aa, Mycobacterium
GALRELWAPIARYWPDTSTTLLSL

SEQ ID NO: 662914 - protein, 19 aa, Mycobacterium
GALRFKAPQPVEAWDGVRP

SEQ ID NO: 662915 - protein, 20 aa, Mycobacterium
GALRLAIARALIIVEPEDRP

SEQ ID NO: 662916 - protein, 24 aa, Mycobacterium
GALRMRAIGVVDGREAIVIEHVTR

SEQ ID NO: 662917 - protein, 25 aa, Mycobacterium
GALRRAVAFRRFRAIDVRSILAAGA

SEQ ID NO: 662918 - protein, 22 aa, Mycobacterium
GALRRWAQAILNGRRDGEIYQT

SEQ ID NO: 662919 - protein, 22 aa, Mycobacterium
GALRSAWIGYWVPRAATGGGVA

SEQ ID NO: 662920 - protein, 21 aa, Mycobacterium
GALRSAWIGYWVPRSATGGGV

SEQ ID NO: 662921 - protein, 20 aa, Mycobacterium
GALRVAKAFAPILATNGGGA

SEQ ID NO: 662922 - protein, 25 aa, Mycobacterium
GALSEWRATLIVRESACLDVADRRT

SEQ ID NO: 662923 - protein, 25 aa, Mycobacterium
GALSEWRATLIVRESACLDVEDRRA

SEQ ID NO: 662924 - protein, 18 aa, Mycobacterium
GALSNWVAGQAEIYGTRG

SEQ ID NO: 662925 - protein, 17 aa, Mycobacterium
GALSPFGDVVFPLPAEQ

SEQ ID NO: 662926 - protein, 28 aa, Mycobacterium
GALSVPHNWTLAAPEIKLAVEALPSTSV

SEQ ID NO: 662927 - protein, 19 aa, Mycobacterium
GALSVPQHWATLTSAVSPA

SEQ ID NO: 662928 - protein, 25 aa, Mycobacterium
GALTEPRQALTLLIDAYVATSFANP

SEQ ID NO: 662929 - protein, 19 aa, Mycobacterium
GALTGGVAWEGLNNLGGAD

SEQ ID NO: 662930 - protein, 17 aa, Mycobacterium
GALTGLPTAARPDGDVL

SEQ ID NO: 662931 - protein, 17 aa, Mycobacterium
GALTLSELVRFGSTAES

SEQ ID NO: 662932 - protein, 24 aa, Mycobacterium
GALTRSALRWNYRRIFPDVYLPVD

SEQ ID NO: 662933 - protein, 20 aa, Mycobacterium
GALVRDPHVWARYITEAINL

SEQ ID NO: 662934 - protein, 17 aa, Mycobacterium
GALWLPASPVLGAAGAG

SEQ ID NO: 662935 - protein, 21 aa, Mycobacterium
GALYEAGWMRYGWPTEVGGLG

SEQ ID NO: 662936 - protein, 28 aa, Mycobacterium
GALYGGMNPRTSVPMLLSLYQAGAVKLD

SEQ ID NO: 662937 - protein, 28 aa, Mycobacterium
GALYGGMNPRTSVPMLLSLYQAGELKLD

SEQ ID NO: 662938 - protein, 21 aa, Mycobacterium
GAMAAAVAPYVLWMTATAARA

SEQ ID NO: 662939 - protein, 19 aa, Mycobacterium
GAMAPHVSVWIGRESQAIA

SEQ ID NO: 662940 - protein, 31 aa, Mycobacterium
GAMDWYTVLACFKLGIILEGTHARACAGKAP

SEQ ID NO: 662941 - protein, 17 aa, Mycobacterium
GAMGFRLQIDKRKAAAL

SEQ ID NO: 662942 - protein, 25 aa, Mycobacterium
GAMGRAALVGSMAVPQGWTQAAPAM

SEQ ID NO: 662943 - protein, 24 aa, Mycobacterium
GAMLRDCPGLRLLVTSREPIKVAG

SEQ ID NO: 662944 - protein, 19 aa, Mycobacterium
GAMNECWVRHLGAHADADV

SEQ ID NO: 662945 - protein, 18 aa, Mycobacterium
GAMPYRRARERGVKMIGA

SEQ ID NO: 662946 - protein, 19 aa, Mycobacterium
GAMQLPGPHVFGPPRDHDQ

SEQ ID NO: 662947 - protein, 19 aa, Mycobacterium
GAMRFARVEAYSKITGTAR

SEQ ID NO: 662948 - protein, 20 aa, Mycobacterium
GAMRLTAKGVWGPPDDRDEC

SEQ ID NO: 662949 - protein, 17 aa, Mycobacterium
GAMRLTGKGVWGPPADR

SEQ ID NO: 662950 - protein, 18 aa, Mycobacterium
GAMRRAGALDARLHEVTR

SEQ ID NO: 662951 - protein, 21 aa, Mycobacterium
GAMSKELRRDGIRVTLVVLGA

SEQ ID NO: 662952 - protein, 23 aa, Mycobacterium
GAMSRFPDLKVFCVENGSGWVRN

SEQ ID NO: 662953 - protein, 20 aa, Mycobacterium
GAMVHCNRLGMIYSALVAEE

SEQ ID NO: 662954 - protein, 18 aa, Mycobacterium
GAMYPRRNVATFWRKRTW

SEQ ID NO: 662955 - protein, 24 aa, Mycobacterium
GAMYRIVTLNALRAGVDLDDAAAI

SEQ ID NO: 662956 - protein, 24 aa, Mycobacterium
GANAEIAWEHNIGVLGGRFRVLAP

SEQ ID NO: 662957 - protein, 22 aa, Mycobacterium
GANGGAGGWLIGNGGAGGSGTS

SEQ ID NO: 662958 - protein, 23 aa, Mycobacterium
GANGGDGGILFGNGGAGGSGAVN

SEQ ID NO: 662959 - protein, 24 aa, Mycobacterium
GANGGDGGLLWGNGGNGGSGATGQ

SEQ ID NO: 662960 - protein, 20 aa, Mycobacterium
GANGISAFMVHKDDEGFTVG

SEQ ID NO: 662961 - protein, 19 aa, Mycobacterium
GANGISAFMVHKDDEGFVV

SEQ ID NO: 662962 - protein, 19 aa, Mycobacterium
GANGISSFMVHKDDEGFSV

SEQ ID NO: 662963 - protein, 19 aa, Mycobacterium
GANGISSFMVHKDDEGFTV

SEQ ID NO: 662964 - protein, 27 aa, Mycobacterium
GANGYLGRFLALEWLERLAETGGKLVS

SEQ ID NO: 662965 - protein, 28 aa, Mycobacterium
GANGYLGRFLCLDWLERLAPTGGTVICL

SEQ ID NO: 662966 - protein, 28 aa, Mycobacterium
GANGYLGRFLCLEWLERLAETGGRLVCV

SEQ ID NO: 662967 - protein, 19 aa, Mycobacterium
GANIIGIDICADIPANGYP

SEQ ID NO: 662968 - protein, 18 aa, Mycobacterium
GANKRFGDFAALDDVDFT

SEQ ID NO: 662969 - protein, 19 aa, Mycobacterium
GANLAGLFRDSAGGTTLNV

SEQ ID NO: 662970 - protein, 18 aa, Mycobacterium
GANLARLEGRVALDEILN

SEQ ID NO: 662971 - protein, 19 aa, Mycobacterium
GANLARLEIGIMFDALADR

SEQ ID NO: 662972 - protein, 18 aa, Mycobacterium
GANLARLELRVLFEELLS

SEQ ID NO: 662973 - protein, 18 aa, Mycobacterium
GANLARLELRVLYEELFS

SEQ ID NO: 662974 - protein, 20 aa, Mycobacterium
GANLARLTINLMFNAIADHM

SEQ ID NO: 662975 - protein, 17 aa, Mycobacterium
GANLARMEIKLMFEAIA

SEQ ID NO: 662976 - protein, 18 aa, Mycobacterium
GANLARREITVAFEELHR

SEQ ID NO: 662977 - protein, 17 aa, Mycobacterium
GANLGYGSAVNRAVAQL

SEQ ID NO: 662978 - protein, 25 aa, Mycobacterium
GANMADCHPILFLRMADRLSSGARL

SEQ ID NO: 662979 - protein, 25 aa, Mycobacterium
GANMADCHPILFLRMMERVKSGAKL

SEQ ID NO: 662980 - protein, 25 aa, Mycobacterium
GANMADCHPILFLRMMERVQAGAKL

SEQ ID NO: 662981 - protein, 28 aa, Mycobacterium
GANMGFRADAYWSVGGFRGLKTGEDAEL

SEQ ID NO: 662982 - protein, 24 aa, Mycobacterium
GANNLYLAFGMLSWHLNDRELRSP

SEQ ID NO: 662983 - protein, 22 aa, Mycobacterium
GANPDKLGWYITEVQKIFVRLL

SEQ ID NO: 662984 - protein, 18 aa, Mycobacterium
GANPEGWLEALRVELRLA

SEQ ID NO: 662985 - protein, 18 aa, Mycobacterium
GANPSAYQKVMFDNFEVI

SEQ ID NO: 662986 - protein, 22 aa, Mycobacterium
GANTFKTVGLRLQASGHNYANA

SEQ ID NO: 662987 - protein, 25 aa, Mycobacterium
GANTGINGIALAPAGPGGTGGGGGS

SEQ ID NO: 662988 - protein, 21 aa, Mycobacterium
GANVARATLYRHFSSGNDLLA

SEQ ID NO: 662989 - protein, 18 aa, Mycobacterium
GANVIGRGQDAQFRLPDT

SEQ ID NO: 662990 - protein, 19 aa, Mycobacterium
GANVIPIQLPVGSEGDFEG

SEQ ID NO: 662991 - protein, 21 aa, Mycobacterium
GANVQRPLWASTGVKNPAYPD

SEQ ID NO: 662992 - protein, 26 aa, Mycobacterium
GAPAELDWAGARVRPTMIGHRDVAIA

SEQ ID NO: 662993 - protein, 20 aa, Mycobacterium
GAPAGDWKLFSGWTDDILKA

SEQ ID NO: 662994 - protein, 21 aa, Mycobacterium
GAPAPFGSGGAYGGTGGQGGT

SEQ ID NO: 662995 - protein, 23 aa, Mycobacterium
GAPAPKRSGEFGDGRGLQTVVQH

SEQ ID NO: 662996 - protein, 30 aa, Mycobacterium
GAPARRTIAQWFARRRVDVLENTSVTEVRP

SEQ ID NO: 662997 - protein, 17 aa, Mycobacterium
GAPDAWEVQGRGELALA

SEQ ID NO: 662998 - protein, 17 aa, Mycobacterium
GAPDPGDLSFIMVGAPN

SEQ ID NO: 662999 - protein, 21 aa, Mycobacterium
GAPDPRGGYPPEQGGYPPQQG

SEQ ID NO: 663000 - protein, 19 aa, Mycobacterium
GAPDRLWVADFTYCRTRAG

SEQ ID NO: 663001 - protein, 22 aa, Mycobacterium
GAPDVLRYVMGFGGTPDSALTG

SEQ ID NO: 663002 - protein, 23 aa, Mycobacterium
GAPEAMGSVALRDHVATDSAWTV

SEQ ID NO: 663003 - protein, 25 aa, Mycobacterium
GAPEGLRLWVMMETPRSFLRAEEIA

SEQ ID NO: 663004 - protein, 17 aa, Mycobacterium
GAPELLHASYLVGADGG

SEQ ID NO: 663005 - protein, 23 aa, Mycobacterium
GAPESMGIWWWNARHSGPEQAVG

SEQ ID NO: 663006 - protein, 23 aa, Mycobacterium
GAPETKGPMLINARADKVTTSPA

SEQ ID NO: 663007 - protein, 21 aa, Mycobacterium
GAPFMGVMGVAPSRALFDRTK

SEQ ID NO: 663008 - protein, 24 aa, Mycobacterium
GAPGIRPGAVPVMVRGCVAKEFAA

SEQ ID NO: 663009 - protein, 17 aa, Mycobacterium
GAPGQWWQQQVVLGLQR

SEQ ID NO: 663010 - protein, 18 aa, Mycobacterium
GAPGQWWQQQVVLGLQRR

SEQ ID NO: 663011 - protein, 19 aa, Mycobacterium
GAPGTFLRFGRFIRQGWMG

SEQ ID NO: 663012 - protein, 21 aa, Mycobacterium
GAPHYLRHAIAGDREATRALG

SEQ ID NO: 663013 - protein, 19 aa, Mycobacterium
GAPIPVQYTCKGADVAPPL

SEQ ID NO: 663014 - protein, 18 aa, Mycobacterium
GAPIPVQYTCKGANTAPP

SEQ ID NO: 663015 - protein, 18 aa, Mycobacterium
GAPIRLVATLAVPSDEVL

SEQ ID NO: 663016 - protein, 20 aa, Mycobacterium
GAPITWPVTPYLGANGRSVD

SEQ ID NO: 663017 - protein, 29 aa, Mycobacterium
GAPLARMEMAIAFPALFRRFPSLEPAEDF

SEQ ID NO: 663018 - protein, 18 aa, Mycobacterium
GAPLCANSAVPLDISARP

SEQ ID NO: 663019 - protein, 21 aa, Mycobacterium
GAPLEPGEFILGYPDEFTATP

SEQ ID NO: 663020 - protein, 24 aa, Mycobacterium
GAPLERFDHGMLSPMATIVNAAAW

SEQ ID NO: 663021 - protein, 19 aa, Mycobacterium
GAPLLRHRIELGSGALGDD

SEQ ID NO: 663022 - protein, 21 aa, Mycobacterium
GAPLLRLAAQTALLQAEALAE

SEQ ID NO: 663023 - protein, 29 aa, Mycobacterium
GAPLRCLNEARFGIVFGALGAARDCLETA

SEQ ID NO: 663024 - protein, 24 aa, Mycobacterium
GAPLSELMGGYGLTADGVRDRLRA

SEQ ID NO: 663025 - protein, 28 aa, Mycobacterium
GAPMAKRLLDWPGGLVVYDVRAEAMTPL

SEQ ID NO: 663026 - protein, 27 aa, Mycobacterium
GAPMAKRLVDWPGGLVVFDVRTEAMTP

SEQ ID NO: 663027 - protein, 19 aa, Mycobacterium
GAPMALWVQGPARLDQVVQ

SEQ ID NO: 663028 - protein, 23 aa, Mycobacterium
GAPMEVVGRFLALLELYRSRAVA

SEQ ID NO: 663029 - protein, 18 aa, Mycobacterium
GAPMPWSAYTGGQREALI

SEQ ID NO: 663030 - protein, 20 aa, Mycobacterium
GAPMTYRAAKAFFERLATEC

SEQ ID NO: 663031 - protein, 21 aa, Mycobacterium
GAPMVEFLCLAPLVTAQHRVA

SEQ ID NO: 663032 - protein, 19 aa, Mycobacterium
GAPPEDWEQFRAWSDAAVG

SEQ ID NO: 663033 - protein, 18 aa, Mycobacterium
GAPPEDWEQFSLWAEDIF

SEQ ID NO: 663034 - protein, 20 aa, Mycobacterium
GAPPEDWQLFSGWTDDIKKI

SEQ ID NO: 663035 - protein, 25 aa, Mycobacterium
GAPPFPGALWLQVRDLAATQEQLTQ

SEQ ID NO: 663036 - protein, 26 aa, Mycobacterium
GAPPHGGIAFGWDRITALLAGVDSIR

SEQ ID NO: 663037 - protein, 25 aa, Mycobacterium
GAPPHGGIAFGWDRVTALLAGTSSI

SEQ ID NO: 663038 - protein, 19 aa, Mycobacterium
GAPPHRLPGGPAFGYMIAG

SEQ ID NO: 663039 - protein, 24 aa, Mycobacterium
GAPPMVIETLQWMGGFGAIQYYAN

SEQ ID NO: 663040 - protein, 27 aa, Mycobacterium
GAPPPDVIRRLSALGLLVSVTVTSSYE

SEQ ID NO: 663041 - protein, 23 aa, Mycobacterium
GAPPRPSVGYLVFGIGRHGSDAL

SEQ ID NO: 663042 - protein, 25 aa, Mycobacterium
GAPPTLPPFMLADGVASLNAAYAVM

SEQ ID NO: 663043 - protein, 22 aa, Mycobacterium
GAPPVLPLSYLVGTDGTVRRVT

SEQ ID NO: 663044 - protein, 17 aa, Mycobacterium
GAPPVTGLHLQFGRHAG

SEQ ID NO: 663045 - protein, 26 aa, Mycobacterium
GAPQMTVCVWRGPADVAWRHGNPERT

SEQ ID NO: 663046 - protein, 18 aa, Mycobacterium
GAPRCAALVEQAAAVYAR

SEQ ID NO: 663047 - protein, 23 aa, Mycobacterium
GAPRDEFLLLYGIDEDGQISLQV

SEQ ID NO: 663048 - protein, 20 aa, Mycobacterium
GAPRDEWLQLYGLDQEGRIA

SEQ ID NO: 663049 - protein, 18 aa, Mycobacterium
GAPRGLLLDAARARFARQ

SEQ ID NO: 663050 - protein, 26 aa, Mycobacterium
GAPRGTLRASWHWPDEVDKASKYRCF

SEQ ID NO: 663051 - protein, 17 aa, Mycobacterium
GAPRIAERFTELAREIP

SEQ ID NO: 663052 - protein, 17 aa, Mycobacterium
GAPRIAERFTELTREVP

SEQ ID NO: 663053 - protein, 18 aa, Mycobacterium
GAPRLSAAMEQSFRRGVE

SEQ ID NO: 663054 - protein, 17 aa, Mycobacterium
GAPRRGRKSKRAKRAEY

SEQ ID NO: 663055 - protein, 24 aa, Mycobacterium
GAPRVVATASAWRFQRVPTPTLPE

SEQ ID NO: 663056 - protein, 24 aa, Mycobacterium
GAPRWPTFGIRLSARPGIPPTHPV

SEQ ID NO: 663057 - protein, 29 aa, Mycobacterium
GAPRYPVAEVRQALTLPPHIPVITVDARD

SEQ ID NO: 663058 - protein, 22 aa, Mycobacterium
GAPSAAWLRKCAELNEHAVTAV

SEQ ID NO: 663059 - protein, 33 aa, Mycobacterium
GAPSFAEALRWGAEVYHALKSVLKKEGLSTGLG

SEQ ID NO: 663060 - protein, 33 aa, Mycobacterium; identical to SEQ ID NO: 79989

SEQ ID NO: 663061 - protein, 17 aa, Mycobacterium
GAPSGAYVRRAGDDVQP

SEQ ID NO: 663062 - protein, 22 aa, Mycobacterium
GAPSLDIGLSWSQYQQVNEGII

SEQ ID NO: 663063 - protein, 23 aa, Mycobacterium
GAPSLRPSGPSVFMNLDAGQMEV

SEQ ID NO: 663064 - protein, 32 aa, Mycobacterium
GAPTGRGGLIIGEPVNVFNWLNPPSGNEQSIV

SEQ ID NO: 663065 - protein, 22 aa, Mycobacterium
GAPTLDWLVTRFAREVPGVAHA

SEQ ID NO: 663066 - protein, 24 aa, Mycobacterium
GAPTRFGFFGTPVVPIMYAADTED

SEQ ID NO: 663067 - protein, 26 aa, Mycobacterium
GAPVDEVWPGILGFEDTVLPQLERAL

SEQ ID NO: 663068 - protein, 21 aa, Mycobacterium
GAPVDFPLNGVVAGFQKAIAG

SEQ ID NO: 663069 - protein, 19 aa, Mycobacterium
GAPVGYKIMPKDVIPVMVQ

SEQ ID NO: 663070 - protein, 27 aa, Mycobacterium
GAPVLAICAAIQVLGHWYETSAGERVD

SEQ ID NO: 663071 - protein, 20 aa, Mycobacterium
GAPVVFPLNGVVPGFQKAIA

SEQ ID NO: 663072 - protein, 20 aa, Mycobacterium
GAPVYDAWGYLLAEAGTGGA

SEQ ID NO: 663073 - protein, 24 aa, Mycobacterium
GAPWAEVLARRLRISVGEAQRRIS

SEQ ID NO: 663074 - protein, 24 aa, Mycobacterium
GAPWRSGRSARNYPHLVAEQQRLK

SEQ ID NO: 663075 - protein, 19 aa, Mycobacterium
GAPYAALPTGVHWDPALRA

SEQ ID NO: 663076 - protein, 20 aa, Mycobacterium
GAPYEPGYRVLDGIRAALNS

SEQ ID NO: 663077 - protein, 31 aa, Mycobacterium
GAQAARPVLFSTFLMWILANLFTKLPEIGDV

SEQ ID NO: 663078 - protein, 27 aa, Mycobacterium
GAQAEAFHAQFAQLMANGAGTYASAEA

SEQ ID NO: 663079 - protein, 32 aa, Mycobacterium
GAQAERILKLFGHSDFDNIVSFCGPEQEYFLV

SEQ ID NO: 663080 - protein, 24 aa, Mycobacterium
GAQAGNIARLSWLAAGYPEEVPGV

SEQ ID NO: 663081 - protein, 18 aa, Mycobacterium
GAQARALIRSRLVPPARP

SEQ ID NO: 663082 - protein, 34 aa, Mycobacterium
GAQASLFHDQFVQALNGGGFLYAATEAASASPLQ

SEQ ID NO: 663083 - protein, 22 aa, Mycobacterium
GAQCVLVTTGMTRRQELQETGH

SEQ ID NO: 663084 - protein, 20 aa, Mycobacterium
GAQDTRLTWEERRMRREVRA

SEQ ID NO: 663085 - protein, 24 aa, Mycobacterium
GAQFSAWGALLARTDPDAPKHQGI

SEQ ID NO: 663086 - protein, 25 aa, Mycobacterium
GAQGGRPEALAGLAGAGPGQLLPAV

SEQ ID NO: 663087 - protein, 25 aa, Mycobacterium
GAQGGRPEALGGLGNARRLLPAVSR

SEQ ID NO: 663088 - protein, 19 aa, Mycobacterium
GAQGLGFAIAQRFIAEGAR

SEQ ID NO: 663089 - protein, 19 aa, Mycobacterium
GAQGLGFAIAQRFVDEGAR

SEQ ID NO: 663090 - protein, 17 aa, Mycobacterium
GAQGVVICIGGSMGGWS

SEQ ID NO: 663091 - protein, 17 aa, Mycobacterium
GAQIGMVGATPFSNHPA

SEQ ID NO: 663092 - protein, 21 aa, Mycobacterium
GAQIKRLKVGTTRRFSKTNRR

SEQ ID NO: 663093 - protein, 25 aa, Mycobacterium
GAQIRLEFEPGLLRLSAGADDVGRA

SEQ ID NO: 663094 - protein, 18 aa, Mycobacterium
GAQITIFRLGSDRGLARF

SEQ ID NO: 663095 - protein, 19 aa, Mycobacterium
GAQLADTAEQVWGDADLLL

SEQ ID NO: 663096 - protein, 24 aa, Mycobacterium
GAQLARLEARVMFEVLLGAFPTIE

SEQ ID NO: 663097 - protein, 20 aa, Mycobacterium
GAQLAVWAGTRHKLRDDEVG

SEQ ID NO: 663098 - protein, 26 aa, Mycobacterium
GAQLFRRPGLRIGHHHQPPAVQQRTP

SEQ ID NO: 663099 - protein, 18 aa, Mycobacterium
GAQLGVLVTRAHLQTDDY

SEQ ID NO: 663100 - protein, 23 aa, Mycobacterium
GAQLKKLKVGASRRFSATTRDTL

SEQ ID NO: 663101 - protein, 21 aa, Mycobacterium
GAQLKRLKVGTTRRFSATDRK

SEQ ID NO: 663102 - protein, 21 aa, Mycobacterium
GAQLKRLKVGTTRRFSATTRQ

SEQ ID NO: 663103 - protein, 23 aa, Mycobacterium
GAQLPWSRLATDAVLGIEGDGAV

SEQ ID NO: 663104 - protein, 18 aa, Mycobacterium
GAQLRFTDIDGMRVTAFI

SEQ ID NO: 663105 - protein, 21 aa, Mycobacterium
GAQLRLPRPVGMPADSPDALY

SEQ ID NO: 663106 - protein, 17 aa, Mycobacterium
GAQLRTLFVAKEDITPV

SEQ ID NO: 663107 - protein, 25 aa, Mycobacterium
GAQLWRWLNEGAHLYVCGDASRMAK

SEQ ID NO: 663108 - protein, 23 aa, Mycobacterium
GAQPAQVALAWLISYPGVVAIPG

SEQ ID NO: 663109 - protein, 20 aa, Mycobacterium
GAQPQAAKLTEWLKLALDEP

SEQ ID NO: 663110 - protein, 23 aa, Mycobacterium
GAQPRDWFEVSLIPTTRELTTLG

SEQ ID NO: 663111 - protein, 24 aa, Mycobacterium
GAQPRPFGPPGFLFLDPPDHTRLR

SEQ ID NO: 663112 - protein, 25 aa, Mycobacterium
GAQPVRELSVFTAHGPYVLVQVARC

SEQ ID NO: 663113 - protein, 18 aa, Mycobacterium
GAQPWVRPVFPHINEMVV

SEQ ID NO: 663114 - protein, 20 aa, Mycobacterium
GAQRALHRVISLLADGHSVL

SEQ ID NO: 663115 - protein, 22 aa, Mycobacterium
GAQRALHRVVTLLAGGRAVLTH

SEQ ID NO: 663116 - protein, 23 aa, Mycobacterium
GAQRLRLLGFQRVDLEPGQVVRV

SEQ ID NO: 663117 - protein, 22 aa, Mycobacterium
GAQSSPMWFDWDGERVRFTHTK

SEQ ID NO: 663118 - protein, 18 aa, Mycobacterium
GAQTFDLRVTVHAVTAVE

SEQ ID NO: 663119 - protein, 23 aa, Mycobacterium
GAQVICFQELFYGPYFGIVQDKK

SEQ ID NO: 663120 - protein, 24 aa, Mycobacterium
GAQWRQAGCSMCLGMNPDQLSPGE

SEQ ID NO: 663121 - protein, 25 aa, Mycobacterium
GAQWRQAGCSMCLGMNPDQLSPGQR

SEQ ID NO: 663122 - protein, 17 aa, Mycobacterium
GAQWSRIRLSDRAHLEP

SEQ ID NO: 663123 - protein, 25 aa, Mycobacterium
GAQYMGVNWVGPIIMRYGTEEQQRK

SEQ ID NO: 663124 - protein, 24 aa, Mycobacterium
GAQYSQWGALLARTDPSAPKHQGI

SEQ ID NO: 663125 - protein, 17 aa, Mycobacterium
GARAAALARARTVLAAE

SEQ ID NO: 663126 - protein, 18 aa, Mycobacterium
GARAEAQRLLGRARSELE

SEQ ID NO: 663127 - protein, 19 aa, Mycobacterium
GARALEWIVGHPDRVRSAL

SEQ ID NO: 663128 - protein, 21 aa, Mycobacterium
GARALGCAFALVDPLPTRERS

SEQ ID NO: 663129 - protein, 19 aa, Mycobacterium
GARAVMIGRAYLWGLAASG

SEQ ID NO: 663130 - protein, 26 aa, Mycobacterium
GARDFQRFLIGKLRDIREVVANASLD

SEQ ID NO: 663131 - protein, 17 aa, Mycobacterium
GARDLEPLLARWREHGF

SEQ ID NO: 663132 - protein, 19 aa, Mycobacterium
GAREHALLLALARDPQVSG

SEQ ID NO: 663133 - protein, 19 aa, Mycobacterium
GAREHALLLALARDPQVTH

SEQ ID NO: 663134 - protein, 21 aa, Mycobacterium
GAREHALLLALRKDPQVTALW

SEQ ID NO: 663135 - protein, 21 aa, Mycobacterium
GAREHALLLALRKDPQVTGLA

SEQ ID NO: 663136 - protein, 22 aa, Mycobacterium
GAREHALLLALRRDPEVDALSV

SEQ ID NO: 663137 - protein, 22 aa, Mycobacterium
GAREHALLLALRRDPEVEGLAV

SEQ ID NO: 663138 - protein, 35 aa, Mycobacterium
GAREIATEIGRPVMVKAQVKVGGRGKAGGVKFAAT

SEQ ID NO: 663139 - protein, 35 aa, Mycobacterium
GAREIATEIGRPVMVKAQVKVGGRGKAGGVKYAAT

SEQ ID NO: 663140 - protein, 26 aa, Mycobacterium
GAREPIAIVGMACRYPGGLESPADLW

SEQ ID NO: 663141 - protein, 18 aa, Mycobacterium
GARFCGGVFAISAVVQHE

SEQ ID NO: 663142 - protein, 22 aa, Mycobacterium
GARFEVMPGCGHWPQYEDPATF

SEQ ID NO: 663143 - protein, 21 aa, Mycobacterium
GARFEVMPGCGHWPQYEDPKT

SEQ ID NO: 663144 - protein, 18 aa, Mycobacterium
GARFGVACIGSQLLTGAL

SEQ ID NO: 663145 - protein, 22 aa, Mycobacterium
GARGLPDIVRFIDRVRAVLETP

SEQ ID NO: 663146 - protein, 20 aa, Mycobacterium
GARGLRAIMEEVLLPVMYDI

SEQ ID NO: 663147 - protein, 18 aa, Mycobacterium
GARGMGASHARLLVAEGA

SEQ ID NO: 663148 - protein, 17 aa, Mycobacterium
GARGMGASHARLLVQEG

SEQ ID NO: 663149 - protein, 25 aa, Mycobacterium
GARGRLGLLELRGFEMPPHHQMAMV

SEQ ID NO: 663150 - protein, 18 aa, Mycobacterium
GARGRRIDVRQARTVVHQ

SEQ ID NO: 663151 - protein, 18 aa, Mycobacterium
GARGRRLDPRQARTVVHQ

SEQ ID NO: 663152 - protein, 25 aa, Mycobacterium
GARGVARLKALLPFVDGGAQSPRES

SEQ ID NO: 663153 - protein, 28 aa, Mycobacterium
GARGVLQHDCFIRVGWSRGDHRAVDSVS

SEQ ID NO: 663154 - protein, 19 aa, Mycobacterium
GARGYAHIGVIEALRERGY

SEQ ID NO: 663155 - protein, 20 aa, Mycobacterium
GARGYAHIGVIEALRERGYD

SEQ ID NO: 663156 - protein, 21 aa, Mycobacterium
GARGYRRLYLITGNRQPEAEA

SEQ ID NO: 663157 - protein, 19 aa, Mycobacterium
GARIALCGLISGYNSAEPP

SEQ ID NO: 663158 - protein, 38 aa, Mycobacterium
GARIGLPTCWDEWFPEVARCYSLGGAEIVVYPTAIGSE

SEQ ID NO: 663159 - protein, 20 aa, Mycobacterium
GARKRLALWAIDTGIRAARQ

SEQ ID NO: 663160 - protein, 32 aa, Mycobacterium
GARLAFVCAVDMPFLAVELIDDLARRARETGA

SEQ ID NO: 663161 - protein, 23 aa, Mycobacterium
GARLAWRDDARWAPHGGESRIDV

SEQ ID NO: 663162 - protein, 28 aa, Mycobacterium
GARLEVMDELGIDFALMFPTLASLVEER

SEQ ID NO: 663163 - protein, 21 aa, Mycobacterium
GARLEVMDELGIDYALMFPTL

SEQ ID NO: 663164 - protein, 19 aa, Mycobacterium
GARLLGLERPYGRSGKVYI

SEQ ID NO: 663165 - protein, 24 aa, Mycobacterium
GARLLPAHCWFEPHERWGVRIHQA

SEQ ID NO: 663166 - protein, 20 aa, Mycobacterium
GARLLRRLVSVCAGADVELL

SEQ ID NO: 663167 - protein, 19 aa, Mycobacterium
GARLRLAINAPPPRPLASH

SEQ ID NO: 663168 - protein, 18 aa, Mycobacterium
GARLRRLLSEPDQDVPDE

SEQ ID NO: 663169 - protein, 23 aa, Mycobacterium
GARLRTDDRWVLPELSVDVASPD

SEQ ID NO: 663170 - protein, 18 aa, Mycobacterium
GARLSVVVDAPWRAAALA

SEQ ID NO: 663171 - protein, 25 aa, Mycobacterium
GARLSVVVDQAWRAAALAEMIREAG

SEQ ID NO: 663172 - protein, 19 aa, Mycobacterium
GARLVHHLFVEFAYPRGLF

SEQ ID NO: 663173 - protein, 30 aa, Mycobacterium
GARLVVFPEATMCRFGVPLGPVAQPLDGPW

SEQ ID NO: 663174 - protein, 17 aa, Mycobacterium
GARLYLCTDARRERGDL

SEQ ID NO: 663175 - protein, 21 aa, Mycobacterium
GARLYPQIAARPFGMMIGFQG

SEQ ID NO: 663176 - protein, 22 aa, Mycobacterium
GARLYPQIAARPFGMMIGFQGH

SEQ ID NO: 663177 - protein, 20 aa, Mycobacterium
GARMRWASWVSAPMLAGAFA

SEQ ID NO: 663178 - protein, 20 aa, Mycobacterium
GARMYLQILEDIALSPWDRE

SEQ ID NO: 663179 - protein, 18 aa, Mycobacterium
GARNSRFVLAPGSALAKR

SEQ ID NO: 663180 - protein, 18 aa, Mycobacterium
GARNSRFVLAPGSVLTKR

SEQ ID NO: 663181 - protein, 23 aa, Mycobacterium
GARPAELLGLEWDRVDFDNAVFD

SEQ ID NO: 663182 - protein, 23 aa, Mycobacterium
GARPCTADGLPLIGRTRSSRVFA

SEQ ID NO: 663183 - protein, 27 aa, Mycobacterium
GARPPRIGIPMAAVYAFGSLAGLSNRL

SEQ ID NO: 663184 - protein, 18 aa, Mycobacterium
GARPRGPGMERSDLLEAN

SEQ ID NO: 663185 - protein, 33 aa, Mycobacterium
GARPRRLSIPGADLPGVCYLRTAADVAMIRERT

SEQ ID NO: 663186 - protein, 28 aa, Mycobacterium
GARPVLRYLAPIAIRGELVWIDLQESSG

SEQ ID NO: 663187 - protein, 26 aa, Mycobacterium
GARPWLPHFYLGHGIGVNAAEMPMIG

SEQ ID NO: 663188 - protein, 25 aa, Mycobacterium
GARQEWRIFVDLALAMGKPLFRAKG

SEQ ID NO: 663189 - protein, 18 aa, Mycobacterium
GARQRLAIASALLGDPQV

SEQ ID NO: 663190 - protein, 18 aa, Mycobacterium
GARQWWLAGHRSTEPAHS

SEQ ID NO: 663191 - protein, 17 aa, Mycobacterium
GARRAERVAADRDEVAD

SEQ ID NO: 663192 - protein, 23 aa, Mycobacterium
GARRGTGILDCWLVHEGDHADID

SEQ ID NO: 663193 - protein, 17 aa, Mycobacterium
GARRIYSNHGFTVLAQT

SEQ ID NO: 663194 - protein, 17 aa, Mycobacterium
GARRLVERLLSLRDWGE

SEQ ID NO: 663195 - protein, 24 aa, Mycobacterium
GARRQWRIGIASRFEELVEHAQAR

SEQ ID NO: 663196 - protein, 17 aa, Mycobacterium
GARRYGDLRAELPGIAT

SEQ ID NO: 663197 - protein, 18 aa, Mycobacterium
GARRYRWRERYERPRAEG

SEQ ID NO: 663198 - protein, 20 aa, Mycobacterium
GARSEGRLGGDGGPGGTGHD

SEQ ID NO: 663199 - protein, 24 aa, Mycobacterium
GARSKRAAFLVSVAKAYVGERAPV

SEQ ID NO: 663200 - protein, 19 aa, Mycobacterium
GARSLRTLVPVSVRSNDAA

SEQ ID NO: 663201 - protein, 17 aa, Mycobacterium
GARSVPALVAWKLGCSS

SEQ ID NO: 663202 - protein, 24 aa, Mycobacterium
GARSVPALVAWKLGCSSGNAHTIA

SEQ ID NO: 663203 - protein, 23 aa, Mycobacterium
GARTKYFDEFFLTAGNAGVRQAV

SEQ ID NO: 663204 - protein, 23 aa, Mycobacterium
GARTRAAGGYAEIARIGSNVDAL

SEQ ID NO: 663205 - protein, 19 aa, Mycobacterium
GARTTCPARTAVTADSSVA

SEQ ID NO: 663206 - protein, 17 aa, Mycobacterium
GARVAANIFGRGSLQQK

SEQ ID NO: 663207 - protein, 21 aa, Mycobacterium
GARVAFLIRFGAGVLPEPKTV

SEQ ID NO: 663208 - protein, 19 aa, Mycobacterium
GARVALCGLISGYNAADPP

SEQ ID NO: 663209 - protein, 26 aa, Mycobacterium
GARVDEMIEVIKLVLGGGMVEFHGEF

SEQ ID NO: 663210 - protein, 31 aa, Mycobacterium
GARVERAAMAACCWVTAGKAGRAERRASAAA

SEQ ID NO: 663211 - protein, 24 aa, Mycobacterium
GARVGCGFITWSLARRPGLLDEAL

SEQ ID NO: 663212 - protein, 17 aa, Mycobacterium
GARVGRGAVVRHAILDK

SEQ ID NO: 663213 - protein, 20 aa, Mycobacterium
GARVGWLEVLDRVGHLAPAE

SEQ ID NO: 663214 - protein, 21 aa, Mycobacterium
GARVGYGFITWSLARNPGLLD

SEQ ID NO: 663215 - protein, 26 aa, Mycobacterium
GARVICRRSRLCLRVAGNGAMASVEL

SEQ ID NO: 663216 - protein, 25 aa, Mycobacterium
GARVKRLKVGTARRFSASTERTLVA

SEQ ID NO: 663217 - protein, 20 aa, Mycobacterium
GARVVICGAISQYNAAGELH

SEQ ID NO: 663218 - protein, 27 aa, Mycobacterium
GARVVKAHVPLSEMFGYVGDLRSKTQG

SEQ ID NO: 663219 - protein, 20 aa, Mycobacterium
GARVWPGVSIPDGGIRYSSD

SEQ ID NO: 663220 - protein, 19 aa, Mycobacterium
GARWMIPRLDLPDRQLDTI

SEQ ID NO: 663221 - protein, 27 aa, Mycobacterium
GASAARIFAERGHRVFGTSRNPDTITD

SEQ ID NO: 663222 - protein, 25 aa, Mycobacterium
GASAIPLGPDLIGKGGAGGAGGSGG

SEQ ID NO: 663223 - protein, 17 aa, Mycobacterium
GASAIVFRDTAHAAELA

SEQ ID NO: 663224 - protein, 20 aa, Mycobacterium
GASALPFRYTVNGYRGCSHA

SEQ ID NO: 663225 - protein, 24 aa, Mycobacterium
GASALRYAIRTEIRLITSELAIDL

SEQ ID NO: 663226 - protein, 20 aa, Mycobacterium
GASAPMCRTEYYISRTFAAV

SEQ ID NO: 663227 - protein, 19 aa, Mycobacterium
GASAWRVVIEHAETADDRA

SEQ ID NO: 663228 - protein, 17 aa, Mycobacterium
GASAYCSAEAANVSSFT

SEQ ID NO: 663229 - protein, 24 aa, Mycobacterium
GASEHKYGGLGFANWAYEVAAQEE

SEQ ID NO: 663230 - protein, 21 aa, Mycobacterium
GASFAEFGGWLMPVSYAGTVS

SEQ ID NO: 663231 - protein, 24 aa, Mycobacterium
GASFYASGIFPGFASDQLALLMTT

SEQ ID NO: 663232 - protein, 20 aa, Mycobacterium
GASGAVVDWAPLIEQAHERK

SEQ ID NO: 663233 - protein, 22 aa, Mycobacterium
GASGFKLHEDWGSSPAAIDACL

SEQ ID NO: 663234 - protein, 24 aa, Mycobacterium
GASGGDGGWLWGSGGNGGSGGAGR

SEQ ID NO: 663235 - protein, 18 aa, Mycobacterium
GASGGGWILPGLVDAHCH

SEQ ID NO: 663236 - protein, 24 aa, Mycobacterium
GASGGRGGLLSGAQGVTGTAGDGG

SEQ ID NO: 663237 - protein, 18 aa, Mycobacterium
GASGSSYGSAWELWHRGA

SEQ ID NO: 663238 - protein, 18 aa, Mycobacterium
GASGVRMLLDAAKQVSGA

SEQ ID NO: 663239 - protein, 24 aa, Mycobacterium
GASHAGVTLGGWRGPGPKTPVSGL

SEQ ID NO: 663240 - protein, 22 aa, Mycobacterium
GASIIAVDLCDQIASVPYPLAT

SEQ ID NO: 663241 - protein, 19 aa, Mycobacterium
GASITRTLLLPGNRSDIRE

SEQ ID NO: 663242 - protein, 25 aa, Mycobacterium
GASKWTASRVDLVFGANSELRALAE

SEQ ID NO: 663243 - protein, 18 aa, Mycobacterium
GASLARAEARVSIECILD

SEQ ID NO: 663244 - protein, 18 aa, Mycobacterium
GASLARLEGRVALEEILK

SEQ ID NO: 663245 - protein, 24 aa, Mycobacterium
GASLARLEVLAVLNAVLDRYQKIA

SEQ ID NO: 663246 - protein, 19 aa, Mycobacterium
GASLARVEAAAIFRELITR

SEQ ID NO: 663247 - protein, 28 aa, Mycobacterium
GASLFVLDGWLRPVPVGVVGELYVAGGG

SEQ ID NO: 663248 - protein, 22 aa, Mycobacterium
GASLGVRFTPTLAFARDTVPDA

SEQ ID NO: 663249 - protein, 24 aa, Mycobacterium
GASLPRRHQLVLSRGPYHYDDEVR

SEQ ID NO: 663250 - protein, 28 aa, Mycobacterium
GASNCSGGMMPARGRVLLDLSNLNRIID

SEQ ID NO: 663251 - protein, 18 aa, Mycobacterium
GASNRFWAHGTLEPARAT

SEQ ID NO: 663252 - protein, 18 aa, Mycobacterium
GASPEIAAALGLSEGAPV

SEQ ID NO: 663253 - protein, 19 aa, Mycobacterium
GASPLHLAVGAARTLQTSL

SEQ ID NO: 663254 - protein, 21 aa, Mycobacterium
GASQLKLAWTRSVKGSLAAGP

SEQ ID NO: 663255 - protein, 21 aa, Mycobacterium
GASQLKTLRGMIIDRDEAWRA

SEQ ID NO: 663256 - protein, 24 aa, Mycobacterium
GASRAEQGLPFAREAALAKRLGAD

SEQ ID NO: 663257 - protein, 24 aa, Mycobacterium
GASRAEQGLPFAREAALAKRLGSD

SEQ ID NO: 663258 - protein, 25 aa, Mycobacterium
GASREFAAALGRVGWPVELVELDAD

SEQ ID NO: 663259 - protein, 28 aa, Mycobacterium
GASRRARREGRVPVVLYGHGTDPQHLEL

SEQ ID NO: 663260 - protein, 17 aa, Mycobacterium
GASRWGADMQLHVSAGI

SEQ ID NO: 663261 - protein, 19 aa, Mycobacterium
GASRYTLRPGDFVCIPQGR

SEQ ID NO: 663262 - protein, 24 aa, Mycobacterium
GASSEDARSWWGNYLVQQANSREV

SEQ ID NO: 663263 - protein, 26 aa, Mycobacterium
GASSEQARAWWGNFLMQKANEANVAL

SEQ ID NO: 663264 - protein, 24 aa, Mycobacterium
GASSGIGFELAMLLADDGYDLIVA

SEQ ID NO: 663265 - protein, 24 aa, Mycobacterium
GASVLKQLVAYVGKEEFLSGLRDY

SEQ ID NO: 663266 - protein, 20 aa, Mycobacterium
GASVLKQLVAYVGLDAFLAG

SEQ ID NO: 663267 - protein, 19 aa, Mycobacterium
GASVLKQLVAYVGLEHFLA

SEQ ID NO: 663268 - protein, 20 aa, Mycobacterium
GASVLKQLVAYVGLEHFLAG

SEQ ID NO: 663269 - protein, 19 aa, Mycobacterium
GASVLKQLVAYVGLENFLA

SEQ ID NO: 663270 - protein, 22 aa, Mycobacterium
GASVSPRRGGNCNPAPSTLLLA

SEQ ID NO: 663271 - protein, 19 aa, Mycobacterium
GATAAYLIEQWLGADPADV

SEQ ID NO: 663272 - protein, 34 aa, Mycobacterium
GATACLRKTDWLFPQYRELGAYLVRGIPPGHVGA

SEQ ID NO: 663273 - protein, 19 aa, Mycobacterium
GATAFKCCPPIREASNREL

SEQ ID NO: 663274 - protein, 18 aa, Mycobacterium
GATAFMLSWSVRLLAERP

SEQ ID NO: 663275 - protein, 30 aa, Mycobacterium
GATAPRLLLEVVCARLLLPSATDAESAVLQ

SEQ ID NO: 663276 - protein, 30 aa, Mycobacterium
GATAPRLLLEVVCSRLLLPSASDTESALLQ

SEQ ID NO: 663277 - protein, 22 aa, Mycobacterium
GATAVGCAFALVDPLPTTERPD

SEQ ID NO: 663278 - protein, 18 aa, Mycobacterium
GATAYGHMQIRVEELGEA

SEQ ID NO: 663279 - protein, 18 aa, Mycobacterium
GATCCFATQDKVWVTGPA

SEQ ID NO: 663280 - protein, 23 aa, Mycobacterium
GATEAINLVAYAWGGKNLGHGDE

SEQ ID NO: 663281 - protein, 25 aa, Mycobacterium
GATERRLREGYKVVRMLVDAYDDKT

SEQ ID NO: 663282 - protein, 23 aa, Mycobacterium
GATFPRSTLDKMLDAALGATEQL

SEQ ID NO: 663283 - protein, 24 aa, Mycobacterium
GATFPRSTLDKMLDAAMAACDQLF

SEQ ID NO: 663284 - protein, 18 aa, Mycobacterium
GATFRPSALQTLSHFPIT

SEQ ID NO: 663285 - protein, 17 aa, Mycobacterium
GATGARILATAAHEALR

SEQ ID NO: 663286 - protein, 28 aa, Mycobacterium
GATGFLGRHLVLHWLREMEHAGGTLTCL

SEQ ID NO: 663287 - protein, 23 aa, Mycobacterium
GATGFLGRYLVLEWLEQLEQVEG

SEQ ID NO: 663288 - protein, 36 aa, Mycobacterium
GATGFLGRYLVLEWLRRLRAVGGKLICLVRAASDEQ

SEQ ID NO: 663289 - protein, 22 aa, Mycobacterium
GATGFLGRYLVLQWLRELEQVD

SEQ ID NO: 663290 - protein, 17 aa, Mycobacterium
GATGGWGGQGGLGGVGT

SEQ ID NO: 663291 - protein, 28 aa, Mycobacterium
GATGLKPTWGRVSVHGVFAMAPSLDTIG

SEQ ID NO: 663292 - protein, 25 aa, Mycobacterium
GATGRRFEALSALSAGVKEVRAVIE

SEQ ID NO: 663293 - protein, 25 aa, Mycobacterium
GATGTYDSRLIGGGDGSGGGTYGVD

SEQ ID NO: 663294 - protein, 20 aa, Mycobacterium
GATILSWRAALSPIAAGNTV

SEQ ID NO: 663295 - protein, 21 aa, Mycobacterium
GATIRELFSANGLPPLEDDDM

SEQ ID NO: 663296 - protein, 22 aa, Mycobacterium
GATKRFGLTVTLAERERQLAIA

SEQ ID NO: 663297 - protein, 18 aa, Mycobacterium
GATLKRLPIPASLPSGRG

SEQ ID NO: 663298 - protein, 25 aa, Mycobacterium
GATLKRSVMELGGYNPLIILEDVDL

SEQ ID NO: 663299 - protein, 21 aa, Mycobacterium
GATLRDLFATVIAIATADVNV

SEQ ID NO: 663300 - protein, 18 aa, Mycobacterium
GATLRELLELAGGVLGVA

SEQ ID NO: 663301 - protein, 27 aa, Mycobacterium
GATLRSYLRRWVGAAVKPAQASVQSPR

SEQ ID NO: 663302 - protein, 17 aa, Mycobacterium
GATLVSLAKGIELGTLM

SEQ ID NO: 663303 - protein, 19 aa, Mycobacterium
GATMLPVPVFDVGEVVDLI

SEQ ID NO: 663304 - protein, 20 aa, Mycobacterium
GATMLRMLLRPEDELDDAWV

SEQ ID NO: 663305 - protein, 19 aa, Mycobacterium
GATMLRMLLRPEEELDDAW

SEQ ID NO: 663306 - protein, 29 aa, Mycobacterium
GATPARAFLRMYYLNKACEIQIAASQLGE

SEQ ID NO: 663307 - protein, 20 aa, Mycobacterium
GATPKLGLVGVFKGPLHDGI

SEQ ID NO: 663308 - protein, 17 aa, Mycobacterium
GATPLVQLCDTVVVSGS

SEQ ID NO: 663309 - protein, 20 aa, Mycobacterium
GATPSMRSVLPADLALLTGR

SEQ ID NO: 663310 - protein, 17 aa, Mycobacterium
GATQGRRALTLVPDHHI

SEQ ID NO: 663311 - protein, 22 aa, Mycobacterium
GATRAGMSLGIMHDLAVGVHPD

SEQ ID NO: 663312 - protein, 21 aa, Mycobacterium
GATRTAAWTATDWVDNTLENW

SEQ ID NO: 663313 - protein, 27 aa, Mycobacterium
GATRTVLPGGLNWPLDLTMGDDGRLYV

SEQ ID NO: 663314 - protein, 21 aa, Mycobacterium
GATSAALAWAVHVDFQCGRGL

SEQ ID NO: 663315 - protein, 20 aa, Mycobacterium
GATSGLRAAMQILDNIDDIH

SEQ ID NO: 663316 - protein, 19 aa, Mycobacterium
GATSLYHCALPPMGSWLPT

SEQ ID NO: 663317 - protein, 19 aa, Mycobacterium
GATTRPDTLLGWLQSDLAA

SEQ ID NO: 663318 - protein, 24 aa, Mycobacterium
GATVAGAELVCWRGADGEVHAGPA

SEQ ID NO: 663319 - protein, 18 aa, Mycobacterium
GATVCLTPSFSASRFLSD

SEQ ID NO: 663320 - protein, 24 aa, Mycobacterium
GATVGEFSPYVDMTLWPKFDYASA

SEQ ID NO: 663321 - protein, 18 aa, Mycobacterium
GATVLRGVWGFHGDHPPH

SEQ ID NO: 663322 - protein, 18 aa, Mycobacterium
GATVRRLEHTIGMSRGAI

SEQ ID NO: 663323 - protein, 19 aa, Mycobacterium
GATVRRLTFSGSRVTGVEF

SEQ ID NO: 663324 - protein, 17 aa, Mycobacterium
GATVTLQLDDGSGRTYQ

SEQ ID NO: 663325 - protein, 18 aa, Mycobacterium
GATWGAVKYQFGDIDGFW

SEQ ID NO: 663326 - protein, 23 aa, Mycobacterium
GATWRDAVEAIDWGSGDVLVLGS

SEQ ID NO: 663327 - protein, 24 aa, Mycobacterium
GATYIPPVVFLRKTMPIAGGHDAD

SEQ ID NO: 663328 - protein, 18 aa, Mycobacterium
GAVAAELADLVVVTDDNP

SEQ ID NO: 663329 - protein, 23 aa, Mycobacterium
GAVAAYGARFAGVAFPGETLNVG

SEQ ID NO: 663330 - protein, 34 aa, Mycobacterium
GAVACLRKTDWLFPQYRELGAYLVRGIPPGHVGA

SEQ ID NO: 663331 - protein, 19 aa, Mycobacterium
GAVAHLFDSLLGFTAFKLS

SEQ ID NO: 663332 - protein, 17 aa, Mycobacterium
GAVALGISVARLHGYLL

SEQ ID NO: 663333 - protein, 17 aa, Mycobacterium
GAVALVAGWAARTLPSD

SEQ ID NO: 663334 - protein, 18 aa, Mycobacterium
GAVAPELVDELVVIDVTP

SEQ ID NO: 663335 - protein, 22 aa, Mycobacterium
GAVAQARWAAWRRKEHLESVCE

SEQ ID NO: 663336 - protein, 18 aa, Mycobacterium
GAVARDRRDGFQAAVSGR

SEQ ID NO: 663337 - protein, 18 aa, Mycobacterium
GAVARVRQDFTEWLRRFF

SEQ ID NO: 663338 - protein, 19 aa, Mycobacterium
GAVASVFYRGGLSRAGNLR

SEQ ID NO: 663339 - protein, 19 aa, Mycobacterium
GAVATRLPGLARRVTELLY

SEQ ID NO: 663340 - protein, 18 aa, Mycobacterium
GAVAVPMNPLLKAREVSY

SEQ ID NO: 663341 - protein, 17 aa, Mycobacterium
GAVAVRALPDVAALQSV

SEQ ID NO: 663342 - protein, 26 aa, Mycobacterium
GAVAYRLGRSVARLEASLSAPSIFGR

SEQ ID NO: 663343 - protein, 22 aa, Mycobacterium
GAVCAVGSVGIRLRGDGNDMIG

SEQ ID NO: 663344 - protein, 24 aa, Mycobacterium
GAVDDIYRAFGIEFTDAARDAVVN

SEQ ID NO: 663345 - protein, 30 aa, Mycobacterium
GAVDRLGRHEFPLVLSPAVEEFLTAVAEET

SEQ ID NO: 663346 - protein, 21 aa, Mycobacterium
GAVEAGALPHLLPGGRPVDDV

SEQ ID NO: 663347 - protein, 20 aa, Mycobacterium
GAVEDAWAATLWVAGHAADL

SEQ ID NO: 663348 - protein, 19 aa, Mycobacterium
GAVEEFLRLTSPVQGLART

SEQ ID NO: 663349 - protein, 27 aa, Mycobacterium
GAVEHLSRLSVEAIVMVAAQQDALTLV

SEQ ID NO: 663350 - protein, 26 aa, Mycobacterium
GAVELGIKWLSLYAFSTENWKRSAEE

SEQ ID NO: 663351 - protein, 17 aa, Mycobacterium
GAVELGRLHGPLLGDVS

SEQ ID NO: 663352 - protein, 20 aa, Mycobacterium
GAVESILTLFALRDGVIPPT

SEQ ID NO: 663353 - protein, 17 aa, Mycobacterium
GAVEVWPMFGTFEPSRR

SEQ ID NO: 663354 - protein, 17 aa, Mycobacterium
GAVFGFAALVDGLVNRI

SEQ ID NO: 663355 - protein, 18 aa, Mycobacterium
GAVFGTHWHGLLDNDDFR

SEQ ID NO: 663356 - protein, 20 aa, Mycobacterium
GAVFPLIPGHELVGVVDAVG

SEQ ID NO: 663357 - protein, 18 aa, Mycobacterium
GAVGELDPAAAPFVVVDL

SEQ ID NO: 663358 - protein, 20 aa, Mycobacterium
GAVGGGWFGYLSYPDAGADG

SEQ ID NO: 663359 - protein, 29 aa, Mycobacterium
GAVGGVGGKGIQGGQGLQGGKGGDGGAGG

SEQ ID NO: 663360 - protein, 18 aa, Mycobacterium
GAVGIGLGLVDLSPHWIA

SEQ ID NO: 663361 - protein, 22 aa, Mycobacterium
GAVGLCSLRSAIFQGAATVFAV

SEQ ID NO: 663362 - protein, 25 aa, Mycobacterium
GAVGLCSLRSALFQGAATVFAVDQV

SEQ ID NO: 663363 - protein, 28 aa, Mycobacterium
GAVGLQFARRLAALGARRIVLLSRNGIE

SEQ ID NO: 663364 - protein, 25 aa, Mycobacterium
GAVGPRLPWIPGLPPGMATWTPDQD

SEQ ID NO: 663365 - protein, 29 aa, Mycobacterium
GAVGRATRWRLAGLGLRVIAHDPYNDDAR

SEQ ID NO: 663366 - protein, 27 aa, Mycobacterium
GAVGWPARLSKARLHFVTGKGGTGKST

SEQ ID NO: 663367 - protein, 18 aa, Mycobacterium
GAVHGGALGMLFDSILGL

SEQ ID NO: 663368 - protein, 18 aa, Mycobacterium
GAVHGGALGMLFDTLLGL

SEQ ID NO: 663369 - protein, 18 aa, Mycobacterium
GAVHGGSLGMLFDTVLGL

SEQ ID NO: 663370 - protein, 18 aa, Mycobacterium
GAVICAAGASLAPADRKL

SEQ ID NO: 663371 - protein, 19 aa, Mycobacterium
GAVIELVHLATLYHDDVMD

SEQ ID NO: 663372 - protein, 20 aa, Mycobacterium
GAVIELVHLATLYHDDVMDE

SEQ ID NO: 663373 - protein, 19 aa, Mycobacterium
GAVIEMIHLATLYHDDVMD

SEQ ID NO: 663374 - protein, 17 aa, Mycobacterium
GAVIFVTDLARAIPVPT

SEQ ID NO: 663375 - protein, 23 aa, Mycobacterium
GAVIGGAVLKHSRDFNLMRECVL

SEQ ID NO: 663376 - protein, 17 aa, Mycobacterium
GAVIGHSMGEVAAAVVS

SEQ ID NO: 663377 - protein, 25 aa, Mycobacterium
GAVIIDHWGIIKADIGIRDGRVCAI

SEQ ID NO: 663378 - protein, 24 aa, Mycobacterium
GAVILDHWGIIKADIGIRDGRIVA

SEQ ID NO: 663379 - protein, 25 aa, Mycobacterium
GAVILDHWGIIKADIGIRDGRIVGI

SEQ ID NO: 663380 - protein, 23 aa, Mycobacterium
GAVIYFLRKVIWTVPDFTVDAYR

SEQ ID NO: 663381 - protein, 17 aa, Mycobacterium
GAVKDGFVWGRGAVDMK

SEQ ID NO: 663382 - protein, 17 aa, Mycobacterium
GAVKSAELVPGYTSDLF

SEQ ID NO: 663383 - protein, 25 aa, Mycobacterium
GAVKVRGGTVLAEFATLVDPQRSIP

SEQ ID NO: 663384 - protein, 25 aa, Mycobacterium
GAVKVRGGVILGEFATLVDPQRSIP

SEQ ID NO: 663385 - protein, 19 aa, Mycobacterium
GAVLADWGADVIKIEHPET

SEQ ID NO: 663386 - protein, 19 aa, Mycobacterium
GAVLADWGADVIKVEHAEK

SEQ ID NO: 663387 - protein, 19 aa, Mycobacterium
GAVLAEWGADVVKVEHAVT

SEQ ID NO: 663388 - protein, 17 aa, Mycobacterium
GAVLCNLATHLDDPAQR

SEQ ID NO: 663389 - protein, 20 aa, Mycobacterium
GAVLDHFRVAMAAAGWRSHT

SEQ ID NO: 663390 - protein, 19 aa, Mycobacterium
GAVLDHFRVAMAADGWDSG

SEQ ID NO: 663391 - protein, 20 aa, Mycobacterium
GAVLDHLRVAMAAAGWESVT

SEQ ID NO: 663392 - protein, 25 aa, Mycobacterium
GAVLDHLRVAMSVAGWDTTTERFPD

SEQ ID NO: 663393 - protein, 19 aa, Mycobacterium
GAVLDHLRVATSAAGWDSV

SEQ ID NO: 663394 - protein, 19 aa, Mycobacterium
GAVLDRLARYQARSVDIDG

SEQ ID NO: 663395 - protein, 27 aa, Mycobacterium
GAVLDRNGLRPGRWWRTLDDRLILASE

SEQ ID NO: 663396 - protein, 30 aa, Mycobacterium
GAVLDRNGLRPGRWWRTVDDRVILASEAGV

SEQ ID NO: 663397 - protein, 17 aa, Mycobacterium
GAVLFVTDLARAIPLPT

SEQ ID NO: 663398 - protein, 20 aa, Mycobacterium
GAVLGGFVPAVAKLREVDPV

SEQ ID NO: 663399 - protein, 21 aa, Mycobacterium
GAVLLQLRWLCLEGRDDPVNE

SEQ ID NO: 663400 - protein, 23 aa, Mycobacterium
GAVLLQLRWLCLEGRPDPVDEFE

SEQ ID NO: 663401 - protein, 20 aa, Mycobacterium
GAVLPGWRCNVLDLNTVTAA

SEQ ID NO: 663402 - protein, 18 aa, Mycobacterium
GAVLPILALYVVAAEEQG

SEQ ID NO: 663403 - protein, 24 aa, Mycobacterium
GAVLPLGAGFSFEAAQLLTSATPT

SEQ ID NO: 663404 - protein, 17 aa, Mycobacterium
GAVLPVYDPLFDSQKLR

SEQ ID NO: 663405 - protein, 25 aa, Mycobacterium
GAVLRPSALESLSHFPVTIAAHPTH

SEQ ID NO: 663406 - protein, 24 aa, Mycobacterium
GAVLSRYVDAIVWRTFAQERLTAM

SEQ ID NO: 663407 - protein, 24 aa, Mycobacterium
GAVMRPACMTHRSHECGSDTVASG

SEQ ID NO: 663408 - protein, 18 aa, Mycobacterium
GAVMVLDEKVSWSAVAAV

SEQ ID NO: 663409 - protein, 29 aa, Mycobacterium
GAVNAPTQVLFGRGLIGDGANGTAPGQAG

SEQ ID NO: 663410 - protein, 26 aa, Mycobacterium
GAVNELGVGIGRRFVECTPDSLLADL

SEQ ID NO: 663411 - protein, 27 aa, Mycobacterium
GAVNGHVRAGGFGLVGACDIVVAGPRS

SEQ ID NO: 663412 - protein, 28 aa, Mycobacterium
GAVNIWAGTGFRRARTGSVADIVGSLVG

SEQ ID NO: 663413 - protein, 18 aa, Mycobacterium
GAVNVYPIVVLRKAPQPE

SEQ ID NO: 663414 - protein, 19 aa, Mycobacterium
GAVPAIIAEYLGLPQLTHL

SEQ ID NO: 663415 - protein, 17 aa, Mycobacterium
GAVPGPFVPSVIASALI

SEQ ID NO: 663416 - protein, 24 aa, Mycobacterium
GAVPHPIDPILLGRTVLNLLRTPV

SEQ ID NO: 663417 - protein, 19 aa, Mycobacterium
GAVPVMCLPGHRAAELGHF

SEQ ID NO: 663418 - protein, 26 aa, Mycobacterium
GAVPVMCLPGHRLAELTHFAEVSSAV

SEQ ID NO: 663419 - protein, 23 aa, Mycobacterium
GAVQCGYCTAGMLVAAVDLLTRY

SEQ ID NO: 663420 - protein, 17 aa, Mycobacterium
GAVQRPRNVEVFQQDPP

SEQ ID NO: 663421 - protein, 19 aa, Mycobacterium
GAVRAFIAGMTFDELESPA

SEQ ID NO: 663422 - protein, 23 aa, Mycobacterium
GAVRAPEYLAWLMDCDMRGTYTF

SEQ ID NO: 663423 - protein, 25 aa, Mycobacterium
GAVRDWPKPLGFVWGLADPVATTNV

SEQ ID NO: 663424 - protein, 23 aa, Mycobacterium
GAVRFHDLRHTFATLALSAGEHY

SEQ ID NO: 663425 - protein, 23 aa, Mycobacterium
GAVRPLPMVSWLYEYGNYRRFTH

SEQ ID NO: 663426 - protein, 17 aa, Mycobacterium
GAVRVIVDRDRCEGNAV

SEQ ID NO: 663427 - protein, 23 aa, Mycobacterium
GAVSADIGALVEAVADYPVDLVI

SEQ ID NO: 663428 - protein, 36 aa, Mycobacterium
GAVSCYWDYAPSFGRGPFRNVICLSVNDAVLHGLPH

SEQ ID NO: 663429 - protein, 21 aa, Mycobacterium
GAVSRYAVRLAQPAIVSATHG

SEQ ID NO: 663430 - protein, 19 aa, Mycobacterium
GAVSVRLGPTVLRTSTAAA

SEQ ID NO: 663431 - protein, 18 aa, Mycobacterium
GAVTEIRAALAALGLIEN

SEQ ID NO: 663432 - protein, 17 aa, Mycobacterium
GAVTEPMLFEWTDRDTL

SEQ ID NO: 663433 - protein, 17 aa, Mycobacterium
GAVTEPMLFEWTDRETL

SEQ ID NO: 663434 - protein, 18 aa, Mycobacterium
GAVTLALATPVDHPIPGK

SEQ ID NO: 663435 - protein, 17 aa, Mycobacterium
GAVTQVVRAGVGRTASG

SEQ ID NO: 663436 - protein, 22 aa, Mycobacterium
GAVTRYSIRLSQPAIVSAKEGA

SEQ ID NO: 663437 - protein, 19 aa, Mycobacterium
GAVVELIHLATLYHDDVMD

SEQ ID NO: 663438 - protein, 25 aa, Mycobacterium
GAVVPRLHLVPGMRSRLTTSRTPAL

SEQ ID NO: 663439 - protein, 18 aa, Mycobacterium
GAVVPVRRRPIPAFEGRR

SEQ ID NO: 663440 - protein, 23 aa, Mycobacterium
GAVVWACTSGSFVYGPQGAAEQV

SEQ ID NO: 663441 - protein, 19 aa, Mycobacterium
GAVWEEVILHLPEDVALAS

SEQ ID NO: 663442 - protein, 24 aa, Mycobacterium
GAVWSGWYRWGLRRRTRRVDHPGA

SEQ ID NO: 663443 - protein, 20 aa, Mycobacterium
GAWDPTLPMVPSANIPGDPI

SEQ ID NO: 663444 - protein, 25 aa, Mycobacterium
GAWDSLWVYDHFHTVPMPTGEATHE

SEQ ID NO: 663445 - protein, 19 aa, Mycobacterium
GAWEGLTFAEAAQRDPDVH

SEQ ID NO: 663446 - protein, 26 aa, Mycobacterium
GAWGGEVPTALAAPMALSAAASSPAA

SEQ ID NO: 663447 - protein, 23 aa, Mycobacterium
GAWGSVLPAVWSFMLAARERGLG

SEQ ID NO: 663448 - protein, 22 aa, Mycobacterium
GAWIELRSGWLADADSLFEELM

SEQ ID NO: 663449 - protein, 21 aa, Mycobacterium
GAWPQQRLLANAPIDVDKPLL

SEQ ID NO: 663450 - protein, 31 aa, Mycobacterium
GAWPTFGLNLPEVVPRLTGLTKISRRAMSAP

SEQ ID NO: 663451 - protein, 24 aa, Mycobacterium
GAWPTKHRTVACLPGEYGPNLAVM

SEQ ID NO: 663452 - protein, 21 aa, Mycobacterium
GAWRAIWSYSAKRARRDQKTL

SEQ ID NO: 663453 - protein, 29 aa, Mycobacterium
GAWRDPRVWWQLRNPFRPSWGEPYTEIAA

SEQ ID NO: 663454 - protein, 17 aa, Mycobacterium
GAYDATAFWARGGSADG

SEQ ID NO: 663455 - protein, 19 aa, Mycobacterium
GAYDFAGGGAYGAKDDPRT

SEQ ID NO: 663456 - protein, 18 aa, Mycobacterium
GAYEASIGMEFFDELAVM

SEQ ID NO: 663457 - protein, 19 aa, Mycobacterium
GAYFKGGVNPVSVWVSTEY

SEQ ID NO: 663458 - protein, 19 aa, Mycobacterium
GAYHGKWGFDEFSHRKAVL

SEQ ID NO: 663459 - protein, 19 aa, Mycobacterium
GAYHGKWGFDEFSHRKSVL

SEQ ID NO: 663460 - protein, 18 aa, Mycobacterium
GAYHGWGFHEDGAASGLR

SEQ ID NO: 663461 - protein, 26 aa, Mycobacterium
GAYILPASLFHWINYSVTAYQTGATF

SEQ ID NO: 663462 - protein, 23 aa, Mycobacterium
GAYIPGMCDHVVMIKERSKVFLA

SEQ ID NO: 663463 - protein, 26 aa, Mycobacterium
GAYLLSRAPGALGLHAALTGAPFSGA

SEQ ID NO: 663464 - protein, 26 aa, Mycobacterium
GAYLLSRAPGSLGLHAALTGAPFSGA

SEQ ID NO: 663465 - protein, 33 aa, Mycobacterium
GAYQRKQALLWARRFAEYDVRWFEEPVSSDDLD

SEQ ID NO: 663466 - protein, 18 aa, Mycobacterium
GAYRLRHGLVSGGESFVL

SEQ ID NO: 663467 - protein, 24 aa, Mycobacterium
GAYRLSDLLLEYQITRPGRARDLL

SEQ ID NO: 663468 - protein, 26 aa, Mycobacterium
GAYSAAELVNVLPLQNVEQDLLNLVN

SEQ ID NO: 663469 - protein, 19 aa, Mycobacterium
GAYSSRLWLPLLRAERPVR

SEQ ID NO: 663470 - protein, 26 aa, Mycobacterium
GAYTQLPFKLAWAITIHKSQGQTLER

SEQ ID NO: 663471 - protein, 20 aa, Mycobacterium
GAYVAGWIKRGPTGFIGTNK

SEQ ID NO: 663472 - protein, 21 aa, Mycobacterium
GAYWMPLFITMAPGHTFDDAL

SEQ ID NO: 663473 - protein, 20 aa, Mycobacterium
GCAAGLATVHMGCQSLAAGE

SEQ ID NO: 663474 - protein, 18 aa, Mycobacterium
GCACKIPPGELEEVVRGL

SEQ ID NO: 663475 - protein, 18 aa, Mycobacterium
GCADPLYRRAVRVSMGHA

SEQ ID NO: 663476 - protein, 22 aa, Mycobacterium
GCADSRVAAEIIFDQGLGDMFV

SEQ ID NO: 663477 - protein, 23 aa, Mycobacterium
GCADSRVAAEIIFDQGLGDMFVV

SEQ ID NO: 663478 - protein, 24 aa, Mycobacterium
GCADSRVAAELIFDQGLGDMFVVR

SEQ ID NO: 663479 - protein, 20 aa, Mycobacterium
GCADVRMLVVATFRTTEPDR

SEQ ID NO: 663480 - protein, 17 aa, Mycobacterium
GCAEAMKGQGARVQVTE

SEQ ID NO: 663481 - protein, 19 aa, Mycobacterium
GCAEAMKGQGARVSVTEID

SEQ ID NO: 663482 - protein, 22 aa, Mycobacterium
GCAESVKGQGARVVVTEIDPIN

SEQ ID NO: 663483 - protein, 22 aa, Mycobacterium
GCAFCLRMHVRDALAKGESTDR

SEQ ID NO: 663484 - protein, 20 aa, Mycobacterium
GCAGARLIALGGAGSLRTAS

SEQ ID NO: 663485 - protein, 21 aa, Mycobacterium
GCAGFGYAVGVAADMIRGGSA

SEQ ID NO: 663486 - protein, 21 aa, Mycobacterium
GCAGFGYAVGVAGDMIRGGSA

SEQ ID NO: 663487 - protein, 17 aa, Mycobacterium
GCAGLEVVDSIRGHDGF

SEQ ID NO: 663488 - protein, 30 aa, Mycobacterium
GCANPTRLLLPRSRYDEGVEILKNIYENVT

SEQ ID NO: 663489 - protein, 31 aa, Mycobacterium
GCANPTRMLLPRSRYDEGVAILKSIYDNVMP

SEQ ID NO: 663490 - protein, 30 aa, Mycobacterium
GCANPTRMLLPRSRYDEGVEILKSIYENVT

SEQ ID NO: 663491 - protein, 29 aa, Mycobacterium
GCASSAWTIGFLALHNWMLALFGEQAQAE

SEQ ID NO: 663492 - protein, 18 aa, Mycobacterium
GCAVARPPYAEMYWSPAQ

SEQ ID NO: 663493 - protein, 17 aa, Mycobacterium
GCAVHLLAEPGGAADAL

SEQ ID NO: 663494 - protein, 24 aa, Mycobacterium
GCAVKAIRPGQTFTRTDSGFPGAM

SEQ ID NO: 663495 - protein, 17 aa, Mycobacterium
GCAVSWFTRDESAPGEP

SEQ ID NO: 663496 - protein, 17 aa, Mycobacterium
GCCEAIAALDLRADLAR

SEQ ID NO: 663497 - protein, 24 aa, Mycobacterium
GCDCRKPRPGLVLAAARELGVPPR

SEQ ID NO: 663498 - protein, 17 aa, Mycobacterium
GCDDVYYCVVDTRAWLR

SEQ ID NO: 663499 - protein, 33 aa, Mycobacterium
GCDGVVIGRGCLGRPWLFAELSAAFNNRPIPTP

SEQ ID NO: 663500 - protein, 33 aa, Mycobacterium
GCDGVVIGRGCLGRPWLFAELSAAFTDSPAPTP

SEQ ID NO: 663501 - protein, 34 aa, Mycobacterium
GCDGVVIGRGCLGRPWLFAELSAAFTGATPATPP

SEQ ID NO: 663502 - protein, 33 aa, Mycobacterium
GCDGVVIGRGCLGRPWLFAELSAAFTGRPAPTP

SEQ ID NO: 663503 - protein, 20 aa, Mycobacterium
GCDHEIRSGSAHLVVWPIDS

SEQ ID NO: 663504 - protein, 19 aa, Mycobacterium
GCDHEIRSGTAHLVVWPTD

SEQ ID NO: 663505 - protein, 19 aa, Mycobacterium
GCDHEIRSGTAHVVVWPAE

SEQ ID NO: 663506 - protein, 18 aa, Mycobacterium
GCDHEIRSGTAHVVVWPI

SEQ ID NO: 663507 - protein, 18 aa, Mycobacterium
GCDLAVMCDLRIAAESAF

SEQ ID NO: 663508 - protein, 17 aa, Mycobacterium
GCDLDLVELAGLAHDIG

SEQ ID NO: 663509 - protein, 19 aa, Mycobacterium
GCDLMVCRYNDGIGHPFWF

SEQ ID NO: 663510 - protein, 27 aa, Mycobacterium
GCDPGRPRPSLPLAVRPDGVIDPVPMV

SEQ ID NO: 663511 - protein, 18 aa, Mycobacterium
GCDWSLTQHYIFSRESTL

SEQ ID NO: 663512 - protein, 18 aa, Mycobacterium
GCELAMMCDLLIAADTAK

SEQ ID NO: 663513 - protein, 18 aa, Mycobacterium
GCELHLVEPLGFDLSEPK

SEQ ID NO: 663514 - protein, 18 aa, Mycobacterium
GCELHLVHPLGFDLSEPK

SEQ ID NO: 663515 - protein, 17 aa, Mycobacterium
GCERATVFTSGFTATTA

SEQ ID NO: 663516 - protein, 24 aa, Mycobacterium
GCEVLTLPSGVGIRLFRPPASTTL

SEQ ID NO: 663517 - protein, 20 aa, Mycobacterium
GCFAAGALAAGCEYDIDTAA

SEQ ID NO: 663518 - protein, 21 aa, Mycobacterium
GCFLRAEAMHQLFTTVDGRTP

SEQ ID NO: 663519 - protein, 25 aa, Mycobacterium
GCGALCPSCHRGCYGCFGPAATPNS

SEQ ID NO: 663520 - protein, 18 aa, Mycobacterium
GCGAWSAPRRGGGRARPG

SEQ ID NO: 663521 - protein, 25 aa, Mycobacterium
GCGDACPVFPGRRYLDWTLDDPTGL

SEQ ID NO: 663522 - protein, 21 aa, Mycobacterium
GCGDCGVKSNCLSVQPVDTEF

SEQ ID NO: 663523 - protein, 23 aa, Mycobacterium
GCGDSRVAAEILFDQGLGDMFVV

SEQ ID NO: 663524 - protein, 27 aa, Mycobacterium
GCGDSRVAAEILFDQGLGDMFVVRTAG

SEQ ID NO: 663525 - protein, 26 aa, Mycobacterium
GCGDTCPYFPGVSYRDWKVPDPAGQP

SEQ ID NO: 663526 - protein, 22 aa, Mycobacterium
GCGEAATALYLAERGHTAVGLD

SEQ ID NO: 663527 - protein, 23 aa, Mycobacterium
GCGEAAVSLYLAERGFTTVGLDQ

SEQ ID NO: 663528 - protein, 19 aa, Mycobacterium
GCGEGLLAQRLAPVSRSVV

SEQ ID NO: 663529 - protein, 18 aa, Mycobacterium
GCGGLQVVESICGHDGFL

SEQ ID NO: 663530 - protein, 17 aa, Mycobacterium
GCGHAELSLALAADGYT

SEQ ID NO: 663531 - protein, 19 aa, Mycobacterium
GCGHMGPPADPECALDALT

SEQ ID NO: 663532 - protein, 19 aa, Mycobacterium
GCGHMGPPADPECALDSLS

SEQ ID NO: 663533 - protein, 19 aa, Mycobacterium
GCGHMGPPADPECALDTLT

SEQ ID NO: 663534 - protein, 19 aa, Mycobacterium
GCGHMGPPADPECVLDSLS

SEQ ID NO: 663535 - protein, 19 aa, Mycobacterium
GCGHMGPPADPGCALDALT

SEQ ID NO: 663536 - protein, 19 aa, Mycobacterium
GCGHYCASKFGVVGLTNSL

SEQ ID NO: 663537 - protein, 20 aa, Mycobacterium
GCGHYCASKFGVVGMTNSLA

SEQ ID NO: 663538 - protein, 20 aa, Mycobacterium
GCGKSTILRVLAGLESVESG

SEQ ID NO: 663539 - protein, 20 aa, Mycobacterium
GCGKTRFVEHMGLLLQRPVV

SEQ ID NO: 663540 - protein, 21 aa, Mycobacterium
GCGKTTLLRILAGFEDPDLGT

SEQ ID NO: 663541 - protein, 21 aa, Mycobacterium
GCGKTTLLRIMAGFDDPDAGV

SEQ ID NO: 663542 - protein, 22 aa, Mycobacterium
GCGKTTLMRCIVGTQIVAKGTV

SEQ ID NO: 663543 - protein, 18 aa, Mycobacterium
GCGLNRYRAGSGQPLLSQ

SEQ ID NO: 663544 - protein, 19 aa, Mycobacterium
GCGLVVGIAEGRRTRYELA

SEQ ID NO: 663545 - protein, 22 aa, Mycobacterium
GCGLWPGAVTRLDAPVIPHMGW

SEQ ID NO: 663546 - protein, 20 aa, Mycobacterium
GCGMPDQFTASGLTNLRRRA

SEQ ID NO: 663547 - protein, 23 aa, Mycobacterium
GCGPESIDHLLAWAPQSVLTHRH

SEQ ID NO: 663548 - protein, 20 aa, Mycobacterium
GCGPVGIAVIAALKLLGVED

SEQ ID NO: 663549 - protein, 20 aa, Mycobacterium
GCGQWPGSVTRLDAPVIPHM

SEQ ID NO: 663550 - protein, 22 aa, Mycobacterium
GCGQWPGVVSRLDAPVIPHMGW

SEQ ID NO: 663551 - protein, 20 aa, Mycobacterium
GCGRDAYALLSRTFLGAAVD

SEQ ID NO: 663552 - protein, 19 aa, Mycobacterium
GCGRLKGSCAASYGHRSAI

SEQ ID NO: 663553 - protein, 19 aa, Mycobacterium
GCGTADMKSGDAVFLHLAA

SEQ ID NO: 663554 - protein, 20 aa, Mycobacterium
GCGTGNLSIRIKRSHPRVAV

SEQ ID NO: 663555 - protein, 22 aa, Mycobacterium
GCGTGRVAIELAARGFDVVGLD

SEQ ID NO: 663556 - protein, 21 aa, Mycobacterium
GCGVAELSLALAALGHTVMGV

SEQ ID NO: 663557 - protein, 20 aa, Mycobacterium
GCGVAELSLALAAQGYTVVG

SEQ ID NO: 663558 - protein, 20 aa, Mycobacterium
GCGYAELSLALAAEGYTVVG

SEQ ID NO: 663559 - protein, 20 aa, Mycobacterium
GCHLCARAAEELTVLRDELG

SEQ ID NO: 663560 - protein, 17 aa, Mycobacterium
GCHRAQGFLLSRPIDSA

SEQ ID NO: 663561 - protein, 24 aa, Mycobacterium
GCIAGCLHLAFDYERDHPFLQSGT

SEQ ID NO: 663562 - protein, 21 aa, Mycobacterium
GCIDWAGVVDPTLRVLPDDPD

SEQ ID NO: 663563 - protein, 21 aa, Mycobacterium
GCIGCGCLSMTKCALFNPADI

SEQ ID NO: 663564 - protein, 33 aa, Mycobacterium
GCISYEPAFAIDVEWTLLASMGRLGRPGGTSAY

SEQ ID NO: 663565 - protein, 27 aa, Mycobacterium
GCKAPRTRFSYKLTRRRAPSDPTVSTV

SEQ ID NO: 663566 - protein, 17 aa, Mycobacterium
GCKEALFTLGDRPEQRW

SEQ ID NO: 663567 - protein, 23 aa, Mycobacterium
GCKPGGYFAISFADFQKLLAEQG

SEQ ID NO: 663568 - protein, 23 aa, Mycobacterium
GCLECGCCMTGCRYGAKNTLLKN

SEQ ID NO: 663569 - protein, 20 aa, Mycobacterium
GCLRRGVGVLSARQTHEPVR

SEQ ID NO: 663570 - protein, 24 aa, Mycobacterium
GCLSRPDLIYSDGRFRCIDVNAAH

SEQ ID NO: 663571 - protein, 18 aa, Mycobacterium
GCLYPNRIFLGVGTGEAL

SEQ ID NO: 663572 - protein, 22 aa, Mycobacterium
GCMATSGSLIRWFQTLSGGHDL

SEQ ID NO: 663573 - protein, 20 aa, Mycobacterium
GCMKFLPGSHRTLYYDESKS

SEQ ID NO: 663574 - protein, 17 aa, Mycobacterium
GCMPRPIPGGPRMSICA

SEQ ID NO: 663575 - protein, 19 aa, Mycobacterium
GCNDLGDLLGNFGAHIRVG

SEQ ID NO: 663576 - protein, 19 aa, Mycobacterium
GCNYAKEAPGWKVTAGGED

SEQ ID NO: 663577 - protein, 20 aa, Mycobacterium
GCPPGFCEHVAGFTVRTADL

SEQ ID NO: 663578 - protein, 25 aa, Mycobacterium
GCQAEVIRIPWADGSLVALPGQPDH

SEQ ID NO: 663579 - protein, 17 aa, Mycobacterium
GCQCPKVLWTLDFQFDA

SEQ ID NO: 663580 - protein, 17 aa, Mycobacterium
GCQEVMLGYSDSNKDGG

SEQ ID NO: 663581 - protein, 24 aa, Mycobacterium
GCQPRTAPDWSRRYTGNFRQAGGR

SEQ ID NO: 663582 - protein, 20 aa, Mycobacterium
GCRAFVRNAVRVWAMQPNLA

SEQ ID NO: 663583 - protein, 24 aa, Mycobacterium
GCRCQRGATRRPCFTNNVQNVTLS

SEQ ID NO: 663584 - protein, 18 aa, Mycobacterium
GCRCVPTVRHAVLCEPHA

SEQ ID NO: 663585 - protein, 19 aa, Mycobacterium
GCREALAGAADRLGPSSGG

SEQ ID NO: 663586 - protein, 19 aa, Mycobacterium
GCRGQPASTTRGWKISGRA

SEQ ID NO: 663587 - protein, 24 aa, Mycobacterium
GCRLEKTGALVLGWAEIEVYAQGS

SEQ ID NO: 663588 - protein, 21 aa, Mycobacterium
GCRYVYRVRCEVEVDGVVRLS

SEQ ID NO: 663589 - protein, 28 aa, Mycobacterium
GCSAPGCDVKGYFCVVHHVIPYAQSPSA

SEQ ID NO: 663590 - protein, 24 aa, Mycobacterium
GCSAPGCTVPGYLCQVHHVDDWRD

SEQ ID NO: 663591 - protein, 24 aa, Mycobacterium
GCSHALVCRYHGWIYRLDGSLSHV

SEQ ID NO: 663592 - protein, 18 aa, Mycobacterium
GCSPEHIERGASMHDLGV

SEQ ID NO: 663593 - protein, 17 aa, Mycobacterium
GCSRATLYRYFENREAL

SEQ ID NO: 663594 - protein, 25 aa, Mycobacterium
GCTAPGCTVSGYYCEVHHTTDYSKC

SEQ ID NO: 663595 - protein, 26 aa, Mycobacterium
GCTAPGCTVSGYYCEVHHTTDYSKCH

SEQ ID NO: 663596 - protein, 24 aa, Mycobacterium
GCTAPGCTVSGYYCEVHHVTDYAT

SEQ ID NO: 663597 - protein, 22 aa, Mycobacterium
GCTGWRDSRGRLVIRTSSQTPF

SEQ ID NO: 663598 - protein, 28 aa, Mycobacterium
GCTHPGCDVPGYWCEVHHTDEWAAGGPT

SEQ ID NO: 663599 - protein, 17 aa, Mycobacterium
GCTKEACDFRDNLHDLN

SEQ ID NO: 663600 - protein, 17 aa, Mycobacterium
GCTLGSLASQIIKSDLQ

SEQ ID NO: 663601 - protein, 19 aa, Mycobacterium
GCTVRRSGWDLIVAVDIPT

SEQ ID NO: 663602 - protein, 18 aa, Mycobacterium
GCVAVEIKRRGEIDGVEQ

SEQ ID NO: 663603 - protein, 23 aa, Mycobacterium
GCVDGFGAVAMRAATNGDAVTLS

SEQ ID NO: 663604 - protein, 25 aa, Mycobacterium
GCVIGGTAWDFANPVRIPPGSLDLL

SEQ ID NO: 663605 - protein, 41 aa, Mycobacterium
GCVLEWTVAITPRFVSWMPLRWLQPLLRAVFTWGMRPGLRS

SEQ ID NO: 663606 - protein, 18 aa, Mycobacterium
GCVLRTDLSLAMREGTAH

SEQ ID NO: 663607 - protein, 18 aa, Mycobacterium
GCVLSATIDRYAQGSLAP

SEQ ID NO: 663608 - protein, 18 aa, Mycobacterium
GCVLSATIDRYAQGSLTP

SEQ ID NO: 663609 - protein, 19 aa, Mycobacterium
GCVMPGFVEAHGHPLMEAL

SEQ ID NO: 663610 - protein, 26 aa, Mycobacterium
GCVNQTRILAPRSRYDEIVDAVSTFV

SEQ ID NO: 663611 - protein, 17 aa, Mycobacterium
GCVPSKSLLRPVLAVAD

SEQ ID NO: 663612 - protein, 23 aa, Mycobacterium
GCVQRFGGLHALGPIDLTIRSGE

SEQ ID NO: 663613 - protein, 24 aa, Mycobacterium
GCVSGCLHLAFDYDRDHPFLQSGT

SEQ ID NO: 663614 - protein, 18 aa, Mycobacterium
GCVVGGTAWDFANATKFE

SEQ ID NO: 663615 - protein, 17 aa, Mycobacterium
GCVYDGVALDGVQLRVA

SEQ ID NO: 663616 - protein, 21 aa, Mycobacterium
GCVYDGVPLRGVEVRIAEDGR

SEQ ID NO: 663617 - protein, 19 aa, Mycobacterium
GCVYQDRCPHVADICVTTR

SEQ ID NO: 663618 - protein, 17 aa, Mycobacterium
GCYAVHMVRTFGGSTPE

SEQ ID NO: 663619 - protein, 27 aa, Mycobacterium
GCYVGEVLVRNAGYEWVDTPPDLVRNM

SEQ ID NO: 663620 - protein, 24 aa, Mycobacterium
GDAAERRRLFGMISKVTPERMESD

SEQ ID NO: 663621 - protein, 17 aa, Mycobacterium
GDAAGPTDPVWKDNAYL

SEQ ID NO: 663622 - protein, 23 aa, Mycobacterium
GDAAHLMPPFAGQGLGAGMRDAM

SEQ ID NO: 663623 - protein, 20 aa, Mycobacterium
GDAAITFGIGTLIPVDEALS

SEQ ID NO: 663624 - protein, 30 aa, Mycobacterium
GDAALGTAWRLRSPWHGVRAQLDLARAEAS

SEQ ID NO: 663625 - protein, 21 aa, Mycobacterium
GDAAPARFARYSYETDEHEVH

SEQ ID NO: 663626 - protein, 19 aa, Mycobacterium
GDAAPRVVRPAPLRQAVYD

SEQ ID NO: 663627 - protein, 23 aa, Mycobacterium
GDAARRWPERTAVLDAADGAGLS

SEQ ID NO: 663628 - protein, 18 aa, Mycobacterium
GDAATLFGSGGTGGHGAA

SEQ ID NO: 663629 - protein, 18 aa, Mycobacterium
GDACLYEQAGTVGAAGAP

SEQ ID NO: 663630 - protein, 21 aa, Mycobacterium
GDADAAYVCRGTVCDLPVTGT

SEQ ID NO: 663631 - protein, 20 aa, Mycobacterium
GDADGFWASLGWEPFYDSRP

SEQ ID NO: 663632 - protein, 20 aa, Mycobacterium
GDADLGEWVAQQVIEAVAAE

SEQ ID NO: 663633 - protein, 17 aa, Mycobacterium
GDADVLWHVLRPITGDD

SEQ ID NO: 663634 - protein, 18 aa, Mycobacterium
GDAEERAADFIKANVSKP

SEQ ID NO: 663635 - protein, 27 aa, Mycobacterium
GDAEFPERAAVVLSGLRKLQGSLAEAA

SEQ ID NO: 663636 - protein, 25 aa, Mycobacterium
GDAEGAFLLCGFMMALAEHQLGHAH

SEQ ID NO: 663637 - protein, 26 aa, Mycobacterium
GDAEGAFLLCGFMMALAEHQQGHAHC

SEQ ID NO: 663638 - protein, 17 aa, Mycobacterium
GDAERWELYHIADDFSQ

SEQ ID NO: 663639 - protein, 26 aa, Mycobacterium
GDAEYLLTRFIAWWVNQLEAHDFDTG

SEQ ID NO: 663640 - protein, 21 aa, Mycobacterium
GDAFSAGFILGRALGRDLREA

SEQ ID NO: 663641 - protein, 22 aa, Mycobacterium
GDAGDIAYPYYLVNGRIPAAPT

SEQ ID NO: 663642 - protein, 23 aa, Mycobacterium
GDAGLNNQIFGAKGTPNGAAGGY

SEQ ID NO: 663643 - protein, 24 aa, Mycobacterium
GDAGRSTWYAVDRGVYVALTLPTG

SEQ ID NO: 663644 - protein, 21 aa, Mycobacterium
GDAGSGGLLLGEDGINGEAAP

SEQ ID NO: 663645 - protein, 19 aa, Mycobacterium
GDAGSRQQFAFKRMAPEVV

SEQ ID NO: 663646 - protein, 23 aa, Mycobacterium
GDAGVLASLLLNRIVLQPGEGLY

SEQ ID NO: 663647 - protein, 19 aa, Mycobacterium
GDAGVSFAGMAGPGGNGGD

SEQ ID NO: 663648 - protein, 17 aa, Mycobacterium
GDAGYKFADEFHPELQF

SEQ ID NO: 663649 - protein, 23 aa, Mycobacterium
GDAHRGASLIVWAIAEGRSAAHA

SEQ ID NO: 663650 - protein, 21 aa, Mycobacterium
GDAIFKRLMNTIGRPDLAQNP

SEQ ID NO: 663651 - protein, 31 aa, Mycobacterium
GDAIGGTGGDGGRGFGIGKGGFGGGGGSAGL

SEQ ID NO: 663652 - protein, 20 aa, Mycobacterium
GDAIMVILALAMQEAGELAA

SEQ ID NO: 663653 - protein, 19 aa, Mycobacterium
GDAIMVVLALAMRDAGELA

SEQ ID NO: 663654 - protein, 25 aa, Mycobacterium
GDAIPRLLGAAGFDCSEVAMQRHRI

SEQ ID NO: 663655 - protein, 24 aa, Mycobacterium
GDAIPRLLTTAGFDCAEVDTQRHR

SEQ ID NO: 663656 - protein, 23 aa, Mycobacterium
GDAIRIDLPVALMERAATTGWCA

SEQ ID NO: 663657 - protein, 27 aa, Mycobacterium
GDAITAPAWRNKPSWYQVSTQDRMINP

SEQ ID NO: 663658 - protein, 19 aa, Mycobacterium
GDAKVLVCDRLSRMREAFI

SEQ ID NO: 663659 - protein, 18 aa, Mycobacterium
GDALARRIASETADFLLN

SEQ ID NO: 663660 - protein, 20 aa, Mycobacterium
GDALEPGEFILGYPDESGPV

SEQ ID NO: 663661 - protein, 20 aa, Mycobacterium
GDALESFALGDLPGIAAVLV

SEQ ID NO: 663662 - protein, 22 aa, Mycobacterium
GDALFRAGSERFALSRNAYRYE

SEQ ID NO: 663663 - protein, 19 aa, Mycobacterium
GDALGEVEFAFFVILLAVA

SEQ ID NO: 663664 - protein, 19 aa, Mycobacterium
GDALHGIAIAARKTYLFAF

SEQ ID NO: 663665 - protein, 18 aa, Mycobacterium
GDALLIIDGLFFQQASVR

SEQ ID NO: 663666 - protein, 19 aa, Mycobacterium
GDALLMLLDANGIECSTGS

SEQ ID NO: 663667 - protein, 28 aa, Mycobacterium
GDALLVRRPELFEGIHFAQKQIGHLSSK

SEQ ID NO: 663668 - protein, 21 aa, Mycobacterium
GDALVERWKFVKGRTIPDSET

SEQ ID NO: 663669 - protein, 17 aa, Mycobacterium
GDALVRLPFGQSMRIAD

SEQ ID NO: 663670 - protein, 17 aa, Mycobacterium
GDALWAATFLRRRGAGA

SEQ ID NO: 663671 - protein, 22 aa, Mycobacterium
GDALWAATFVRRRGAAADAILL

SEQ ID NO: 663672 - protein, 26 aa, Mycobacterium
GDALYLKFGEPIPVTSLLGFGSGMLL

SEQ ID NO: 663673 - protein, 18 aa, Mycobacterium
GDAMFPVDFLRMINDVFL

SEQ ID NO: 663674 - protein, 21 aa, Mycobacterium
GDANVGIWNVGFRNVGFVNVG

SEQ ID NO: 663675 - protein, 20 aa, Mycobacterium
GDAPALAAAIGRYLRDADLA

SEQ ID NO: 663676 - protein, 19 aa, Mycobacterium
GDAPEPFELPFLYVPPSAT

SEQ ID NO: 663677 - protein, 22 aa, Mycobacterium
GDAPGYTTVWARMFAGDAAAGQ

SEQ ID NO: 663678 - protein, 19 aa, Mycobacterium
GDAPPFFVLHGEKDELVPS

SEQ ID NO: 663679 - protein, 21 aa, Mycobacterium
GDAQYGLPVNGLWGGTFSELI

SEQ ID NO: 663680 - protein, 23 aa, Mycobacterium
GDARANSLLVRRLRAARPGDAVL

SEQ ID NO: 663681 - protein, 18 aa, Mycobacterium
GDARAPAIYTVERIRDGG

SEQ ID NO: 663682 - protein, 17 aa, Mycobacterium
GDARCVLRMPPPGAPSD

SEQ ID NO: 663683 - protein, 18 aa, Mycobacterium
GDARGCGPLRQVVSRRVA

SEQ ID NO: 663684 - protein, 20 aa, Mycobacterium
GDARIGRLLFSTHLANPVVV

SEQ ID NO: 663685 - protein, 26 aa, Mycobacterium
GDARIGRLLFSTQLANPVVMRKRAES

SEQ ID NO: 663686 - protein, 25 aa, Mycobacterium
GDARLAALMRWRSELIDAGAVPGSS

SEQ ID NO: 663687 - protein, 18 aa, Mycobacterium
GDARLRIKRRRAERERLQ

SEQ ID NO: 663688 - protein, 18 aa, Mycobacterium
GDARLRIKRRRTERERLQ

SEQ ID NO: 663689 - protein, 24 aa, Mycobacterium
GDARSELWFFYHLGRILREKLAGS

SEQ ID NO: 663690 - protein, 25 aa, Mycobacterium
GDARVRFPLSPFMGIMGVAFSQDRD

SEQ ID NO: 663691 - protein, 21 aa, Mycobacterium
GDASIRFQMGLSMADALAKLG

SEQ ID NO: 663692 - protein, 24 aa, Mycobacterium
GDASLWGREVTSLLVAGMTADHVL

SEQ ID NO: 663693 - protein, 22 aa, Mycobacterium
GDASRRLGLTGTPFRSDDSPIP

SEQ ID NO: 663694 - protein, 21 aa, Mycobacterium
GDASSLIALGGTGGVGGVGGA

SEQ ID NO: 663695 - protein, 25 aa, Mycobacterium
GDATRAAQSLAWKASVHTAELAQIM

SEQ ID NO: 663696 - protein, 27 aa, Mycobacterium
GDATRITAIAARFVAPVLPGDTLTTSI

SEQ ID NO: 663697 - protein, 18 aa, Mycobacterium
GDAVELMLADLRADTFKR

SEQ ID NO: 663698 - protein, 17 aa, Mycobacterium
GDAVEWQSHGTTVRGTV

SEQ ID NO: 663699 - protein, 25 aa, Mycobacterium
GDAVFRSRHLLLSAWIKMQDGQLPS

SEQ ID NO: 663700 - protein, 18 aa, Mycobacterium
GDAVKWVAQLGLRNSGNR

SEQ ID NO: 663701 - protein, 17 aa, Mycobacterium
GDAVRCGLSALPADYSG

SEQ ID NO: 663702 - protein, 18 aa, Mycobacterium
GDAVSLVFEVPDALVDAF

SEQ ID NO: 663703 - protein, 27 aa, Mycobacterium
GDAVVDVRPAFLLPGFVDAHIHFPQTY

SEQ ID NO: 663704 - protein, 22 aa, Mycobacterium
GDAYGLILDRVMAYLGAAHRRG

SEQ ID NO: 663705 - protein, 25 aa, Mycobacterium
GDCEAFAAAGARIRLCKGAYDEPAS

SEQ ID NO: 663706 - protein, 21 aa, Mycobacterium
GDCLFTLVWHVSEGHWGDVDL

SEQ ID NO: 663707 - protein, 23 aa, Mycobacterium
GDCLPERDFPTLIDLYLQGRLPL

SEQ ID NO: 663708 - protein, 22 aa, Mycobacterium
GDCLPERDFPTLIDLYQQGRLP

SEQ ID NO: 663709 - protein, 28 aa, Mycobacterium
GDCLPERDFPTLISLYLQGRFPLDKFVS

SEQ ID NO: 663710 - protein, 27 aa, Mycobacterium
GDCLPERDFPTLISLYLQGRLPLEKFV

SEQ ID NO: 663711 - protein, 23 aa, Mycobacterium
GDCLPERDFPTLVSLYQQGRLPL

SEQ ID NO: 663712 - protein, 25 aa, Mycobacterium
GDCLSGRQAYDWGLAVEAPEPDELD

SEQ ID NO: 663713 - protein, 19 aa, Mycobacterium
GDCPRGCGHMGPPADPECV

SEQ ID NO: 663714 - protein, 22 aa, Mycobacterium
GDCRETDDGLLITARPLHGGTW

SEQ ID NO: 663715 - protein, 19 aa, Mycobacterium
GDCRGDRPFPRRRSDRFFR

SEQ ID NO: 663716 - protein, 21 aa, Mycobacterium
GDCRQCSAGAFRAERPYQATA

SEQ ID NO: 663717 - protein, 30 aa, Mycobacterium
GDCTATGAVCLSGFPGAAYYLSDELLPLGD

SEQ ID NO: 663718 - protein, 18 aa, Mycobacterium
GDCVAAYLPDVPDAMVAF

SEQ ID NO: 663719 - protein, 18 aa, Mycobacterium
GDDALAWVRAHNEPTVTE

SEQ ID NO: 663720 - protein, 26 aa, Mycobacterium
GDDALPRLVRRRALTYNVSLLLVLLR

SEQ ID NO: 663721 - protein, 25 aa, Mycobacterium
GDDASGRLGYRFDIHLQGPSETVFL

SEQ ID NO: 663722 - protein, 34 aa, Mycobacterium
GDDASRHAPVRWFEIDPCYVFHPLNGYSEMRNGA

SEQ ID NO: 663723 - protein, 22 aa, Mycobacterium
GDDAVGLTGRMVVAARAGRELL

SEQ ID NO: 663724 - protein, 21 aa, Mycobacterium
GDDAWMFGVRICPDLDTCMYT

SEQ ID NO: 663725 - protein, 24 aa, Mycobacterium
GDDDCPGWLDGYGPVPAGFCRALT

SEQ ID NO: 663726 - protein, 23 aa, Mycobacterium
GDDDCPGWLDGYGPVPAGFCRGL

SEQ ID NO: 663727 - protein, 28 aa, Mycobacterium
GDDFPLARLYAWHRAMRLFDGPDEVHMR

SEQ ID NO: 663728 - protein, 18 aa, Mycobacterium
GDDGAFVVNADWTQAPSG

SEQ ID NO: 663729 - protein, 27 aa, Mycobacterium
GDDGTRIPVSIVHRADIEFPAPAVIYG

SEQ ID NO: 663730 - protein, 17 aa, Mycobacterium
GDDGWRDVIDVNLSGAY

SEQ ID NO: 663731 - protein, 26 aa, Mycobacterium
GDDIAEVLALLGVRPIWDEASRRVVD

SEQ ID NO: 663732 - protein, 25 aa, Mycobacterium
GDDIAEVLALLGVRPVWDDASRRIV

SEQ ID NO: 663733 - protein, 25 aa, Mycobacterium
GDDIAEVLALLGVRPVWDEASRRVV

SEQ ID NO: 663734 - protein, 21 aa, Mycobacterium
GDDIRARFVVMAQGSYNRPKL

SEQ ID NO: 663735 - protein, 24 aa, Mycobacterium
GDDIRARFVVMASGPFHRPKLPGI

SEQ ID NO: 663736 - protein, 25 aa, Mycobacterium
GDDIRARFVVMASGSFNRPKLPGIP

SEQ ID NO: 663737 - protein, 29 aa, Mycobacterium
GDDLDVSLLRPGVVVLVAFDPAAREELSL

SEQ ID NO: 663738 - protein, 19 aa, Mycobacterium
GDDLRLVVIDGKVVAAAIR

SEQ ID NO: 663739 - protein, 22 aa, Mycobacterium
GDDLRPAHPLLLDAVRDALGGP

SEQ ID NO: 663740 - protein, 33 aa, Mycobacterium
GDDNPLPFTIRLAALAQLRIRMLSLVSAENLAE

SEQ ID NO: 663741 - protein, 25 aa, Mycobacterium
GDDNWSLKLSEGWPDDADEDIAAGG

SEQ ID NO: 663742 - protein, 26 aa, Mycobacterium
GDDPEFRLCDYFDLIGGTSTGSIIAT

SEQ ID NO: 663743 - protein, 22 aa, Mycobacterium
GDDPRWRPTLRRVMQAKMNSKH

SEQ ID NO: 663744 - protein, 32 aa, Mycobacterium
GDDQPRLLTPLALAPRGIWLGPKELRSFYRIR

SEQ ID NO: 663745 - protein, 17 aa, Mycobacterium
GDDRAVLHMPFKSELAT

SEQ ID NO: 663746 - protein, 17 aa, Mycobacterium
GDDRGWSFTGWYDTTEA

SEQ ID NO: 663747 - protein, 28 aa, Mycobacterium
GDDRTVCIKAMIEKVVERMYAEIDDNRF

SEQ ID NO: 663748 - protein, 17 aa, Mycobacterium
GDDRYLCINPFFHNFGY

SEQ ID NO: 663749 - protein, 21 aa, Mycobacterium
GDDTATCLRRGHIGAAATLTV

SEQ ID NO: 663750 - protein, 24 aa, Mycobacterium
GDDVALAFACMTFSVALLNRPVAT

SEQ ID NO: 663751 - protein, 22 aa, Mycobacterium
GDDVIAALIRCWVVLERPAGKR

SEQ ID NO: 663752 - protein, 20 aa, Mycobacterium
GDDVLHWFWQAFPVVQESAV

SEQ ID NO: 663753 - protein, 17 aa, Mycobacterium
GDDVLSYNSWRALEAHR

SEQ ID NO: 663754 - protein, 23 aa, Mycobacterium
GDDVLWRMTHPDKDFRTIADGDT

SEQ ID NO: 663755 - protein, 19 aa, Mycobacterium
GDDVRRLAAEAGPVDILVN

SEQ ID NO: 663756 - protein, 19 aa, Mycobacterium
GDDWPHLFLPFREGAAQES

SEQ ID NO: 663757 - protein, 17 aa, Mycobacterium
GDDWTPTGFPVEFLSLG

SEQ ID NO: 663758 - protein, 17 aa, Mycobacterium
GDEAIELTSSTEERVKA

SEQ ID NO: 663759 - protein, 18 aa, Mycobacterium
GDEAILFGPGARGEPTAQ

SEQ ID NO: 663760 - protein, 19 aa, Mycobacterium
GDEAILFGPGTRGEPTAQD

SEQ ID NO: 663761 - protein, 18 aa, Mycobacterium
GDEALDWVRARNEPTLAR

SEQ ID NO: 663762 - protein, 26 aa, Mycobacterium
GDECPPRPSPGWMFAAMPLIFPEGRD

SEQ ID NO: 663763 - protein, 23 aa, Mycobacterium
GDEDFWLEVGIDPIQMITNSGTF

SEQ ID NO: 663764 - protein, 27 aa, Mycobacterium
GDEDFWLKVGIDPIRIMTGAGNLYTLR

SEQ ID NO: 663765 - protein, 27 aa, Mycobacterium
GDEDFWLKVGIDPVRIMTGTGTFYTLR

SEQ ID NO: 663766 - protein, 21 aa, Mycobacterium
GDEDPRRVALLAVHTSPLAQP

SEQ ID NO: 663767 - protein, 28 aa, Mycobacterium
GDEDRLTALFDFYGYRVLSVDAINETSV

SEQ ID NO: 663768 - protein, 21 aa, Mycobacterium
GDEFRWSDIIAQRFDTDHHQI

SEQ ID NO: 663769 - protein, 18 aa, Mycobacterium
GDEFYLHPGQMVLASTLE

SEQ ID NO: 663770 - protein, 21 aa, Mycobacterium
GDEIKRLINGATYLFTNDYEW

SEQ ID NO: 663771 - protein, 20 aa, Mycobacterium
GDEIRLSAGVFTVVTLSGGS

SEQ ID NO: 663772 - protein, 30 aa, Mycobacterium
GDEISAAVATLFACYGQTYQTLGIAAARFH

SEQ ID NO: 663773 - protein, 17 aa, Mycobacterium
GDELAGLFYTGGTTGFP

SEQ ID NO: 663774 - protein, 25 aa, Mycobacterium
GDELREWFAKTGIHYGPAFTGLAAA

SEQ ID NO: 663775 - protein, 18 aa, Mycobacterium
GDELRRWRLHAGSTSLLF

SEQ ID NO: 663776 - protein, 17 aa, Mycobacterium
GDELVKALMHSDLARVY

SEQ ID NO: 663777 - protein, 23 aa, Mycobacterium
GDEMGGTLGRRTDVKIPVVSVTK

SEQ ID NO: 663778 - protein, 30 aa, Mycobacterium
GDEMILTMLHRGCRAIRELGAIDLVRSYQA

SEQ ID NO: 663779 - protein, 22 aa, Mycobacterium
GDEMLWRMTHPDKDFRAVSDVE

SEQ ID NO: 663780 - protein, 18 aa, Mycobacterium
GDERAIYIGHDWGALVGN

SEQ ID NO: 663781 - protein, 22 aa, Mycobacterium
GDERELGVLVSRLHSNHLDLTR

SEQ ID NO: 663782 - protein, 23 aa, Mycobacterium
GDESRGGVDISRPGAVDQMCAQV

SEQ ID NO: 663783 - protein, 22 aa, Mycobacterium
GDESYWNARITEFGGGATTLDA

SEQ ID NO: 663784 - protein, 22 aa, Mycobacterium
GDETGWLLGDYVLSHADPTHAV

SEQ ID NO: 663785 - protein, 18 aa, Mycobacterium
GDETWPLGMVTEFAANAA

SEQ ID NO: 663786 - protein, 19 aa, Mycobacterium
GDEVGAWVRQGIPHDDVAL

SEQ ID NO: 663787 - protein, 21 aa, Mycobacterium
GDEVLLRLFGKAVELAFLAVP

SEQ ID NO: 663788 - protein, 18 aa, Mycobacterium
GDEVNCPVLHELTLMAPL

SEQ ID NO: 663789 - protein, 26 aa, Mycobacterium
GDEVQIGKFRLVFLTGPKQGDDDGGA

SEQ ID NO: 663790 - protein, 26 aa, Mycobacterium
GDEVQIGKFRLVFLTGPKQGDDDGGT

SEQ ID NO: 663791 - protein, 26 aa, Mycobacterium
GDEVQIGKFRLVFLTGPKSAGDDSAS

SEQ ID NO: 663792 - protein, 23 aa, Mycobacterium
GDEVSAAIASLFSTHGQAYQEVA

SEQ ID NO: 663793 - protein, 25 aa, Mycobacterium
GDEVSAAVATLFGTYGQTYQALAAQ

SEQ ID NO: 663794 - protein, 24 aa, Mycobacterium
GDEVSAAVATLFSQHAHAYQAASA

SEQ ID NO: 663795 - protein, 23 aa, Mycobacterium
GDEVSALTAMHFAAHAKAFQAVY

SEQ ID NO: 663796 - protein, 30 aa, Mycobacterium
GDEWLIARWGCLRAANLYWGCGDVESATQV

SEQ ID NO: 663797 - protein, 33 aa, Mycobacterium
GDFAGKLWRGAKEALRQLSYWKMKNRAGVVGKN

SEQ ID NO: 663798 - protein, 20 aa, Mycobacterium
GDFARAYLATGLVPVGKTQM

SEQ ID NO: 663799 - protein, 17 aa, Mycobacterium
GDFARRGLDSELAPLYA

SEQ ID NO: 663800 - protein, 20 aa, Mycobacterium
GDFDGMLDIGVRYLSRQTGS

SEQ ID NO: 663801 - protein, 17 aa, Mycobacterium
GDFEGLVAVLHPDVVLR

SEQ ID NO: 663802 - protein, 23 aa, Mycobacterium
GDFGGVWYWNRYPGIQCDNESYC

SEQ ID NO: 663803 - protein, 23 aa, Mycobacterium
GDFGYRPLFAAVMDTLRELTADG

SEQ ID NO: 663804 - protein, 17 aa, Mycobacterium
GDFKDIRGVMVHHTGSD

SEQ ID NO: 663805 - protein, 18 aa, Mycobacterium
GDFKFYLDYYTKQSAGGV

SEQ ID NO: 663806 - protein, 17 aa, Mycobacterium
GDFPAMMAQISDEHVDA

SEQ ID NO: 663807 - protein, 24 aa, Mycobacterium
GDFPFPRQAALVLDNPIHRKFVNP

SEQ ID NO: 663808 - protein, 22 aa, Mycobacterium
GDFPIPCFPVLGGHEGAGIITE

SEQ ID NO: 663809 - protein, 25 aa, Mycobacterium
GDFREVRATGSMRVLERVSGRPGEL

SEQ ID NO: 663810 - protein, 24 aa, Mycobacterium
GDFRFFAAPGDWTLRALSSAGNGT

SEQ ID NO: 663811 - protein, 18 aa, Mycobacterium
GDFRFYLDYYTKQSAGGL

SEQ ID NO: 663812 - protein, 25 aa, Mycobacterium
GDFSCRSETSGLFCANTKAKSAIRI

SEQ ID NO: 663813 - protein, 19 aa, Mycobacterium
GDFSRRGLDPGLAPLYAQA

SEQ ID NO: 663814 - protein, 18 aa, Mycobacterium
GDFSTGTGLRCPWSSCLP

SEQ ID NO: 663815 - protein, 17 aa, Mycobacterium
GDFTAEFSGIVRSALDG

SEQ ID NO: 663816 - protein, 25 aa, Mycobacterium
GDFVECGVSYGFLSSAIMEYLDWDR

SEQ ID NO: 663817 - protein, 24 aa, Mycobacterium
GDFVKIDFGALVAGYHSDMTRTFV

SEQ ID NO: 663818 - protein, 22 aa, Mycobacterium
GDFVKIDFGALVSGYHSDMTRT

SEQ ID NO: 663819 - protein, 17 aa, Mycobacterium
GDFVNCLDQPLTGTTVD

SEQ ID NO: 663820 - protein, 17 aa, Mycobacterium
GDFVSIDLSATVDGKEV

SEQ ID NO: 663821 - protein, 17 aa, Mycobacterium
GDFVTGLMADWPEFPFA

SEQ ID NO: 663822 - protein, 17 aa, Mycobacterium
GDFWGGAGSTACQEFIT

SEQ ID NO: 663823 - protein, 27 aa, Mycobacterium
GDGAESTDPTLAGQAGGQGGTGGTGGA

SEQ ID NO: 663824 - protein, 23 aa, Mycobacterium
GDGAGARHHLDFTVDRGAALEYY

SEQ ID NO: 663825 - protein, 26 aa, Mycobacterium
GDGAGFEWSFAGTRRLKGIKNEAKLF

SEQ ID NO: 663826 - protein, 20 aa, Mycobacterium
GDGALGFWNAVREVFPATKE

SEQ ID NO: 663827 - protein, 22 aa, Mycobacterium
GDGALGQLLLSHFVIGEAISGL

SEQ ID NO: 663828 - protein, 28 aa, Mycobacterium
GDGALRDPRNWWKLRDPFTPSWGEPYRD

SEQ ID NO: 663829 - protein, 23 aa, Mycobacterium
GDGAPRPARRRRRRRPNKATAAG

SEQ ID NO: 663830 - protein, 23 aa, Mycobacterium
GDGAQRWPAVHRDDAASLFRLAL

SEQ ID NO: 663831 - protein, 17 aa, Mycobacterium
GDGARMPMIPGTWNAKA

SEQ ID NO: 663832 - protein, 33 aa, Mycobacterium
GDGASRPDGKWRAVAKVSAWLLAASDTSDVTTD

SEQ ID NO: 663833 - protein, 28 aa, Mycobacterium
GDGAWRDPRFWWQLRDPFTPSWGEPYAE

SEQ ID NO: 663834 - protein, 25 aa, Mycobacterium
GDGDKGAVGDSGFAGGTGGAGGTGG

SEQ ID NO: 663835 - protein, 25 aa, Mycobacterium
GDGDKGAVGDSGFAGGTGGNGGTGG

SEQ ID NO: 663836 - protein, 19 aa, Mycobacterium
GDGDRPARRRRRGRRGRGR

SEQ ID NO: 663837 - protein, 23 aa, Mycobacterium
GDGEFPDNALLFWEALSAEGAER

SEQ ID NO: 663838 - protein, 22 aa, Mycobacterium
GDGERPWWDAILIVEYPTPQAF

SEQ ID NO: 663839 - protein, 23 aa, Mycobacterium
GDGEVRSGMVLGHALTDGDGYLY

SEQ ID NO: 663840 - protein, 19 aa, Mycobacterium
GDGEWTRRRVGGVAGARRI

SEQ ID NO: 663841 - protein, 17 aa, Mycobacterium
GDGFVLTAGAGWTLAEA

SEQ ID NO: 663842 - protein, 17 aa, Mycobacterium
GDGGAAFSDAAAATGGD

SEQ ID NO: 663843 - protein, 20 aa, Mycobacterium
GDGGAELFAGEGAHVLRPEA

SEQ ID NO: 663844 - protein, 27 aa, Mycobacterium
GDGGAGGRGGWLFGDAGAGGQGGLGGD

SEQ ID NO: 663845 - protein, 27 aa, Mycobacterium
GDGGAGGRGGWLIGTGGAGGLGGVGGV

SEQ ID NO: 663846 - protein, 25 aa, Mycobacterium
GDGGAGGRGGWLVGGGGAGGSAGSG

SEQ ID NO: 663847 - protein, 29 aa, Mycobacterium
GDGGAGGRGGWLWSAGGDGGAGGLGGTGG

SEQ ID NO: 663848 - protein, 20 aa, Mycobacterium
GDGGDARLVGSGGNGGNGGF

SEQ ID NO: 663849 - protein, 18 aa, Mycobacterium
GDGGDCAESNGGIGSGGR

SEQ ID NO: 663850 - protein, 21 aa, Mycobacterium
GDGGDGALHWLVNETQQCVAD

SEQ ID NO: 663851 - protein, 17 aa, Mycobacterium
GDGGDGGNARIIGNGGN

SEQ ID NO: 663852 - protein, 25 aa, Mycobacterium
GDGGDGRNGSTGAIGGNGGTGGTGG

SEQ ID NO: 663853 - protein, 17 aa, Mycobacterium
GDGGDWAGPEALKEMDP

SEQ ID NO: 663854 - protein, 21 aa, Mycobacterium
GDGGFGGLIGSGGAGGVAGTS

SEQ ID NO: 663855 - protein, 20 aa, Mycobacterium
GDGGHGGLLIGNGGIGGIGG

SEQ ID NO: 663856 - protein, 17 aa, Mycobacterium
GDGGLFFSSGGAGGEGG

SEQ ID NO: 663857 - protein, 17 aa, Mycobacterium
GDGGLFPVIARQNHVAN

SEQ ID NO: 663858 - protein, 23 aa, Mycobacterium
GDGGLGGLGGFGGSGGTGGQGGL

SEQ ID NO: 663859 - protein, 26 aa, Mycobacterium
GDGGLGGRGGFLFGDGGLGGQGGDGG

SEQ ID NO: 663860 - protein, 21 aa, Mycobacterium
GDGGLLWGSGGAGARGGQGGA

SEQ ID NO: 663861 - protein, 19 aa, Mycobacterium
GDGGLWLAVLSPAALARVE

SEQ ID NO: 663862 - protein, 19 aa, Mycobacterium
GDGGPWRIGASQLKTLRGM

SEQ ID NO: 663863 - protein, 22 aa, Mycobacterium
GDGGQGGAAYSYGTGDATGSAG

SEQ ID NO: 663864 - protein, 22 aa, Mycobacterium
GDGGSGGLGGHGGTGADNTTAV

SEQ ID NO: 663865 - protein, 30 aa, Mycobacterium
GDGGSPWPSWRTHPLLFPFLHGHSGGILRL

SEQ ID NO: 663866 - protein, 22 aa, Mycobacterium
GDGGTGGLGGHGGAGADNTTTV

SEQ ID NO: 663867 - protein, 35 aa, Mycobacterium
GDGGTRPKGTVFFRSGGDGGFGGWGGNGYGGVGGD

SEQ ID NO: 663868 - protein, 22 aa, Mycobacterium
GDGGTWFLQRIIGYERAAEMTF

SEQ ID NO: 663869 - protein, 26 aa, Mycobacterium
GDGGVGGGGGWLFGDGGVGGIGGNLL

SEQ ID NO: 663870 - protein, 17 aa, Mycobacterium
GDGGWLLTGQKVWTSAA

SEQ ID NO: 663871 - protein, 21 aa, Mycobacterium
GDGGYGGALFGSGGSGGGGGA

SEQ ID NO: 663872 - protein, 19 aa, Mycobacterium
GDGHAKAAGLRCLLAYMWA

SEQ ID NO: 663873 - protein, 17 aa, Mycobacterium
GDGHPVLVLPGLLAGDG

SEQ ID NO: 663874 - protein, 24 aa, Mycobacterium
GDGHSGFDTVLWDVLCNQVGVAGI

SEQ ID NO: 663875 - protein, 27 aa, Mycobacterium
GDGKLEILRRVVAALRSRSGIGILNEA

SEQ ID NO: 663876 - protein, 21 aa, Mycobacterium
GDGLAGSTCNYGFGAHTDLEW

SEQ ID NO: 663877 - protein, 18 aa, Mycobacterium
GDGLDFGLLRYLRDDTAA

SEQ ID NO: 663878 - protein, 21 aa, Mycobacterium
GDGLVIRGEVRAVPAAAQASI

SEQ ID NO: 663879 - protein, 20 aa, Mycobacterium
GDGMAIVFISAELDEVTRIS

SEQ ID NO: 663880 - protein, 26 aa, Mycobacterium
GDGNAVCPPVMIAMMGALNGPDAALG

SEQ ID NO: 663881 - protein, 22 aa, Mycobacterium
GDGNLGFGLTGDNLVGFGNAYY

SEQ ID NO: 663882 - protein, 25 aa, Mycobacterium
GDGNMKIAAVARYLRALGYETQITA

SEQ ID NO: 663883 - protein, 22 aa, Mycobacterium
GDGNVHLAIICKDPAKKKQLMT

SEQ ID NO: 663884 - protein, 33 aa, Mycobacterium
GDGPFPLNLIAAAEKFFFGYVVPTQAFTDLLNH

SEQ ID NO: 663885 - protein, 21 aa, Mycobacterium
GDGPIPLVFVGPFVGHVELFW

SEQ ID NO: 663886 - protein, 18 aa, Mycobacterium
GDGPRRAGVSAFGIGGTN

SEQ ID NO: 663887 - protein, 32 aa, Mycobacterium
GDGPRYAAVQIRLHPAITVFAAIPQVRSSTAE

SEQ ID NO: 663888 - protein, 30 aa, Mycobacterium
GDGPSVIEVDGWRVGMGICRDTGIDDHVRG

SEQ ID NO: 663889 - protein, 25 aa, Mycobacterium
GDGPVAGTVRFEWNALRWFEEDEPI

SEQ ID NO: 663890 - protein, 20 aa, Mycobacterium
GDGPWRGIVMYPDAGGVRPT

SEQ ID NO: 663891 - protein, 18 aa, Mycobacterium
GDGQFGIGGLNSGSGNIG

SEQ ID NO: 663892 - protein, 21 aa, Mycobacterium
GDGQLHGWALGGIVVNSQAQI

SEQ ID NO: 663893 - protein, 19 aa, Mycobacterium
GDGQVGFGALNSGSGNIGL

SEQ ID NO: 663894 - protein, 18 aa, Mycobacterium
GDGQWQLGAGLTELAAHV

SEQ ID NO: 663895 - protein, 21 aa, Mycobacterium
GDGRARLSVTVRFLQLQHRSA

SEQ ID NO: 663896 - protein, 24 aa, Mycobacterium
GDGRARSALLGRMYGDDGVALLAE

SEQ ID NO: 663897 - protein, 22 aa, Mycobacterium
GDGRCKQVPYAKRVPRLARTQT

SEQ ID NO: 663898 - protein, 24 aa, Mycobacterium
GDGRCWSEFTLGPVYEGPPGWVHG

SEQ ID NO: 663899 - protein, 24 aa, Mycobacterium
GDGRCWSEFVLGSAYEGPPKLVHG

SEQ ID NO: 663900 - protein, 18 aa, Mycobacterium
GDGRHFGVNISYATQGRP

SEQ ID NO: 663901 - protein, 25 aa, Mycobacterium
GDGRPVVLIHGWPLHSDSWAHQVDA

SEQ ID NO: 663902 - protein, 20 aa, Mycobacterium
GDGRQWLSWISIDDLVDIYH

SEQ ID NO: 663903 - protein, 18 aa, Mycobacterium
GDGRWTDSAVRRYVTDAG

SEQ ID NO: 663904 - protein, 19 aa, Mycobacterium
GDGRWVVSIRCAQLSADRH

SEQ ID NO: 663905 - protein, 18 aa, Mycobacterium
GDGSFTVVDWKTGEMPTD

SEQ ID NO: 663906 - protein, 24 aa, Mycobacterium
GDGSRPRTGVVFQQPLLMPWLTVA

SEQ ID NO: 663907 - protein, 25 aa, Mycobacterium
GDGSYSLRGHKWFTSAPMCDVFLVL

SEQ ID NO: 663908 - protein, 17 aa, Mycobacterium
GDGTIRAVIAWPTEDIA

SEQ ID NO: 663909 - protein, 24 aa, Mycobacterium
GDGTRLQVMISFDKVGREALDAWK

SEQ ID NO: 663910 - protein, 24 aa, Mycobacterium
GDGTYSLTGHKWFTSAPMCDIFLV

SEQ ID NO: 663911 - protein, 18 aa, Mycobacterium
GDGVAILARNHRWFIIAN

SEQ ID NO: 663912 - protein, 17 aa, Mycobacterium
GDGVAVLRLNRPKQLNA

SEQ ID NO: 663913 - protein, 18 aa, Mycobacterium
GDGVAVLRLNRPQRLNAI

SEQ ID NO: 663914 - protein, 20 aa, Mycobacterium
GDGVDCRRMGVPVVPNTVFV

SEQ ID NO: 663915 - protein, 20 aa, Mycobacterium
GDGVEEWYDWISQRSIYDAR

SEQ ID NO: 663916 - protein, 25 aa, Mycobacterium
GDGVLAVRGLGLWAGVDVDPALGTG

SEQ ID NO: 663917 - protein, 17 aa, Mycobacterium
GDGVLYWQVPKSQTLGS

SEQ ID NO: 663918 - protein, 18 aa, Mycobacterium
GDGVPAYNLAVVVDDAAS

SEQ ID NO: 663919 - protein, 35 aa, Mycobacterium
GDGVRWAMRHLPFYGRWYRFLLLWPGADKGLDAAR

SEQ ID NO: 663920 - protein, 35 aa, Mycobacterium
GDGVRWAMRHLPFYGRWYRFLVLWPGSDKGLDAAE

SEQ ID NO: 663921 - protein, 18 aa, Mycobacterium
GDGVWAIYTVDDEGGAHI

SEQ ID NO: 663922 - protein, 19 aa, Mycobacterium
GDGWRIMREALAFERVGIA

SEQ ID NO: 663923 - protein, 20 aa, Mycobacterium
GDGWRVMREALAFERVGIAR

SEQ ID NO: 663924 - protein, 21 aa, Mycobacterium
GDGWRVMREALAFERVGIARY

SEQ ID NO: 663925 - protein, 21 aa, Mycobacterium
GDGWVHFDAPAGMLIPDSVAT

SEQ ID NO: 663926 - protein, 23 aa, Mycobacterium
GDGWWSQKLVEYAHRLGISDAVT

SEQ ID NO: 663927 - protein, 21 aa, Mycobacterium
GDGYRLTGRLEVRGKSRDHVI

SEQ ID NO: 663928 - protein, 24 aa, Mycobacterium
GDGYRRYPNWTAMDMSAFTQDKTP

SEQ ID NO: 663929 - protein, 17 aa, Mycobacterium
GDHARLLGFYRDLITLR

SEQ ID NO: 663930 - protein, 17 aa, Mycobacterium
GDHAVAGTVLFPGAGFV

SEQ ID NO: 663931 - protein, 24 aa, Mycobacterium
GDHDAVVRACRFYGADTVLHVVLR

SEQ ID NO: 663932 - protein, 25 aa, Mycobacterium
GDHDVAFEHLRRAIALDDNLPYDEP

SEQ ID NO: 663933 - protein, 18 aa, Mycobacterium
GDHFVVFGAVHSLSEVPK

SEQ ID NO: 663934 - protein, 18 aa, Mycobacterium
GDHFVVFGAVNSLSEVPK

SEQ ID NO: 663935 - protein, 20 aa, Mycobacterium
GDHGTFCAGADLKAMGTADS

SEQ ID NO: 663936 - protein, 29 aa, Mycobacterium
GDHLPRPCGNCDRCRDDSRPTSSGTPAIA

SEQ ID NO: 663937 - protein, 24 aa, Mycobacterium
GDHLRSGAAIINLCTLGTRDRSGA

SEQ ID NO: 663938 - protein, 23 aa, Mycobacterium
GDHPAPLLLWIHGGPLASWNAWH

SEQ ID NO: 663939 - protein, 20 aa, Mycobacterium
GDHRCRIRAVTGAAATAVNG

SEQ ID NO: 663940 - protein, 21 aa, Mycobacterium
GDHSHFMFVATLSKPSTETVT

SEQ ID NO: 663941 - protein, 18 aa, Mycobacterium
GDHSITWPSATAVADVHG

SEQ ID NO: 663942 - protein, 17 aa, Mycobacterium
GDHTVGIGLDAQPIPLP

SEQ ID NO: 663943 - protein, 19 aa, Mycobacterium
GDHVGHLLAPVGGSPPREL

SEQ ID NO: 663944 - protein, 18 aa, Mycobacterium
GDHVGLWMPASLDMIAAI

SEQ ID NO: 663945 - protein, 18 aa, Mycobacterium
GDIAAALRKWEPAQLQLS

SEQ ID NO: 663946 - protein, 23 aa, Mycobacterium
GDIAALVAFLLSREGEWINGQVV

SEQ ID NO: 663947 - protein, 25 aa, Mycobacterium
GDIAKAVSRRSVLQAGGMAVLAVGA

SEQ ID NO: 663948 - protein, 19 aa, Mycobacterium
GDICLVWAEQMLRESGVED

SEQ ID NO: 663949 - protein, 19 aa, Mycobacterium
GDIDGFIEAGIRWRNRRDD

SEQ ID NO: 663950 - protein, 17 aa, Mycobacterium
GDIDGFWAAVLHRTAER

SEQ ID NO: 663951 - protein, 17 aa, Mycobacterium
GDIDGLERVRFTSPHPA

SEQ ID NO: 663952 - protein, 17 aa, Mycobacterium
GDIDISAVWGVGDTPAG

SEQ ID NO: 663953 - protein, 17 aa, Mycobacterium
GDIDISAVWGVGDTPER

SEQ ID NO: 663954 - protein, 21 aa, Mycobacterium
GDIDPGVIMYLWRTAGMSVDD

SEQ ID NO: 663955 - protein, 25 aa, Mycobacterium
GDIDRGGVFAAFFGTIALLSAEDQA

SEQ ID NO: 663956 - protein, 25 aa, Mycobacterium
GDIDRGGVFAAFFGTVALLSPQDQA

SEQ ID NO: 663957 - protein, 21 aa, Mycobacterium
GDIEPAVAVGRELQRRGHEVR

SEQ ID NO: 663958 - protein, 24 aa, Mycobacterium
GDIEVPFRFVYSVDAPHLEVIQAV

SEQ ID NO: 663959 - protein, 18 aa, Mycobacterium
GDIFYLGGALGFESLEHT

SEQ ID NO: 663960 - protein, 17 aa, Mycobacterium
GDIGGAVQRLIRRLPAG

SEQ ID NO: 663961 - protein, 17 aa, Mycobacterium
GDIGSLDAAGWLRVTDR

SEQ ID NO: 663962 - protein, 24 aa, Mycobacterium
GDIIPRLVADGMAAVYDFKDNEVP

SEQ ID NO: 663963 - protein, 24 aa, Mycobacterium
GDIIPRLVADGMAAVYDFKNNEVP

SEQ ID NO: 663964 - protein, 23 aa, Mycobacterium
GDIIPRLVADGMAAVYDFSNNEV

SEQ ID NO: 663965 - protein, 23 aa, Mycobacterium
GDIIPRLVADGMASVYDFNNNEV

SEQ ID NO: 663966 - protein, 24 aa, Mycobacterium
GDIKDVRGWLTVVASRLCLDQVRS

SEQ ID NO: 663967 - protein, 24 aa, Mycobacterium
GDILTRLTAPVIRGLGVGIVPAAT

SEQ ID NO: 663968 - protein, 21 aa, Mycobacterium
GDILTRLTASVIRGLGIGIVP

SEQ ID NO: 663969 - protein, 24 aa, Mycobacterium
GDIPGAITELEWLIGELRDKLGSD

SEQ ID NO: 663970 - protein, 23 aa, Mycobacterium
GDIPTLLTGVEWLDTARAAGVDA

SEQ ID NO: 663971 - protein, 18 aa, Mycobacterium
GDIPWPFRSTEMLSTGAV

SEQ ID NO: 663972 - protein, 26 aa, Mycobacterium
GDIQLYYRRVRGWAMVFGEPAVALDR

SEQ ID NO: 663973 - protein, 18 aa, Mycobacterium
GDIRARHTGSLVSDRSGT

SEQ ID NO: 663974 - protein, 17 aa, Mycobacterium
GDIRLVLHGGNIAVNGR

SEQ ID NO: 663975 - protein, 19 aa, Mycobacterium
GDIRRTAAVGKRISEAARL

SEQ ID NO: 663976 - protein, 19 aa, Mycobacterium
GDISGVLSILAFTFTMVTG

SEQ ID NO: 663977 - protein, 18 aa, Mycobacterium
GDISRAYMRLPFGHGSDA

SEQ ID NO: 663978 - protein, 23 aa, Mycobacterium
GDISVGANSVWRAIAGPTPRLNP

SEQ ID NO: 663979 - protein, 20 aa, Mycobacterium
GDIVLCPEFAAGQAAAAGHS

SEQ ID NO: 663980 - protein, 17 aa, Mycobacterium
GDIVLCPEFAAGQADAA

SEQ ID NO: 663981 - protein, 19 aa, Mycobacterium
GDIVSELGGACAKVTTVLA

SEQ ID NO: 663982 - protein, 23 aa, Mycobacterium
GDIWRRIRAANLPVALSDRLTLD

SEQ ID NO: 663983 - protein, 24 aa, Mycobacterium
GDKARPGQRAEAALKSIGNEVNKT

SEQ ID NO: 663984 - protein, 26 aa, Mycobacterium
GDKGGNANLGLWARDDPGYAWARDYL

SEQ ID NO: 663985 - protein, 19 aa, Mycobacterium
GDKLWARMEVHSVDERFGA

SEQ ID NO: 663986 - protein, 21 aa, Mycobacterium
GDKLWFDSYLDSVTESHGAVL

SEQ ID NO: 663987 - protein, 18 aa, Mycobacterium
GDKPFAVMVADLATARAV

SEQ ID NO: 663988 - protein, 17 aa, Mycobacterium
GDKRALAETVQRNAKEA

SEQ ID NO: 663989 - protein, 17 aa, Mycobacterium
GDKTWPAPQGWSSPQQW

SEQ ID NO: 663990 - protein, 19 aa, Mycobacterium
GDKVIAYARRFLDGAAPLA

SEQ ID NO: 663991 - protein, 17 aa, Mycobacterium
GDKVLMWYASGNRDERV

SEQ ID NO: 663992 - protein, 17 aa, Mycobacterium
GDKVTLWYNSANRDEST

SEQ ID NO: 663993 - protein, 17 aa, Mycobacterium
GDLAAAWRSLQAGTPPK

SEQ ID NO: 663994 - protein, 29 aa, Mycobacterium
GDLAAISARSEWAPEFAIYDLPSAEELMS

SEQ ID NO: 663995 - protein, 17 aa, Mycobacterium
GDLAEVMAGVFATRGSS

SEQ ID NO: 663996 - protein, 17 aa, Mycobacterium
GDLAKLRASVVNTQALA

SEQ ID NO: 663997 - protein, 19 aa, Mycobacterium
GDLALWLELRTPRWVSGED

SEQ ID NO: 663998 - protein, 19 aa, Mycobacterium
GDLANWMVPGSMVKGMGGA

SEQ ID NO: 663999 - protein, 18 aa, Mycobacterium
GDLAPLWSDDVLKAAIET

SEQ ID NO: 664000 - protein, 19 aa, Mycobacterium
GDLAPLWSDEVLKAAIDAA

SEQ ID NO: 664001 - protein, 24 aa, Mycobacterium
GDLARGIRICMEHPAALNGDFNLS

SEQ ID NO: 664002 - protein, 25 aa, Mycobacterium
GDLARGIRTCMEHPAALNGDFNLST

SEQ ID NO: 664003 - protein, 18 aa, Mycobacterium
GDLARKMTFRALYRLERR

SEQ ID NO: 664004 - protein, 24 aa, Mycobacterium
GDLARLPPRVWRAVAETRAVLDAV

SEQ ID NO: 664005 - protein, 22 aa, Mycobacterium
GDLARLPPRVWRAVRETRAVLD

SEQ ID NO: 664006 - protein, 23 aa, Mycobacterium
GDLARLPPRVWRAVRETRAVLDL

SEQ ID NO: 664007 - protein, 24 aa, Mycobacterium
GDLARRAAAVIAERTEIDEHDVAI

SEQ ID NO: 664008 - protein, 29 aa, Mycobacterium
GDLARRMLFPSLYRLAAAGRLPADHRIIG

SEQ ID NO: 664009 - protein, 25 aa, Mycobacterium
GDLARYWPDGTIEFLGRADHQVQIR

SEQ ID NO: 664010 - protein, 17 aa, Mycobacterium
GDLARYWPDGTLEFVGR

SEQ ID NO: 664011 - protein, 31 aa, Mycobacterium
GDLATIWRGGCIIRAKFLNRIKDAYDAEPDL

SEQ ID NO: 664012 - protein, 31 aa, Mycobacterium
GDLATIWRGGCIIRAKFLNRIKEAFDADPNL

SEQ ID NO: 664013 - protein, 31 aa, Mycobacterium
GDLATIWRGGCIIRAKFLNRIKEAFDAEPAL

SEQ ID NO: 664014 - protein, 31 aa, Mycobacterium
GDLATIWRGGCIIRAQFLNRVKEAFADRPDL

SEQ ID NO: 664015 - protein, 30 aa, Mycobacterium; identical to SEQ ID NO: 80063

SEQ ID NO: 664016 - protein, 30 aa, Mycobacterium
GDLAYRDADGWIYLAGRTADWMRVDGENMT

SEQ ID NO: 664017 - protein, 29 aa, Mycobacterium
GDLAYRDADGWIYLAGRTSDWMRVDGENL

SEQ ID NO: 664018 - protein, 32 aa, Mycobacterium
GDLAYRDAEGWIYLAGRTADWMRVDGENLAAA

SEQ ID NO: 664019 - protein, 19 aa, Mycobacterium
GDLCLIWAEQMLRDSGIDP

SEQ ID NO: 664020 - protein, 19 aa, Mycobacterium
GDLELDWPAALRTPPIWDA

SEQ ID NO: 664021 - protein, 22 aa, Mycobacterium
GDLELLREAWLTATKARNALVL

SEQ ID NO: 664022 - protein, 25 aa, Mycobacterium
GDLELPAGHGYCWFAGEAAESRAVR

SEQ ID NO: 664023 - protein, 24 aa, Mycobacterium
GDLEPRPPAVILISTYDEQDLSEM

SEQ ID NO: 664024 - protein, 19 aa, Mycobacterium
GDLERAFAVATRMRTGNVT

SEQ ID NO: 664025 - protein, 22 aa, Mycobacterium
GDLESFPGWLHEGDVVTLRAEG

SEQ ID NO: 664026 - protein, 18 aa, Mycobacterium
GDLESLEFVAFDRVPPGP

SEQ ID NO: 664027 - protein, 19 aa, Mycobacterium
GDLFLKQEQLFSVVEAGAA

SEQ ID NO: 664028 - protein, 21 aa, Mycobacterium
GDLFLKQEQLFSVVETGANSL

SEQ ID NO: 664029 - protein, 23 aa, Mycobacterium
GDLFPHAVKWQGVIYLEDGLHRA

SEQ ID NO: 664030 - protein, 25 aa, Mycobacterium
GDLFVDCSGFRGLLINEAMNEPFID

SEQ ID NO: 664031 - protein, 17 aa, Mycobacterium
GDLGEAAVCPRFRVGLL

SEQ ID NO: 664032 - protein, 25 aa, Mycobacterium
GDLGHPLLWCTSGIAEFWALTLDER

SEQ ID NO: 664033 - protein, 24 aa, Mycobacterium
GDLGPWLNQHGWRGDIRDVGQVAA

SEQ ID NO: 664034 - protein, 25 aa, Mycobacterium
GDLHISVIDRGRWKDHREGETGRGR

SEQ ID NO: 664035 - protein, 18 aa, Mycobacterium
GDLHKLWRTRDRKGYHVE

SEQ ID NO: 664036 - protein, 18 aa, Mycobacterium
GDLHRGYDLGAVDFLVKP

SEQ ID NO: 664037 - protein, 20 aa, Mycobacterium
GDLHWDRILFCAKEATYKAW

SEQ ID NO: 664038 - protein, 18 aa, Mycobacterium
GDLIASLDVPDPVSELDG

SEQ ID NO: 664039 - protein, 17 aa, Mycobacterium
GDLIGVAATGAYCYSLS

SEQ ID NO: 664040 - protein, 24 aa, Mycobacterium
GDLKILDSYCRHMGGDLSEGTIKG

SEQ ID NO: 664041 - protein, 17 aa, Mycobacterium
GDLKLYYEDMGDIDDPP

SEQ ID NO: 664042 - protein, 25 aa, Mycobacterium
GDLKPDLAAGCGFENPTLYRCTLKP

SEQ ID NO: 664043 - protein, 18 aa, Mycobacterium
GDLKSDVFALYKPPAPPG

SEQ ID NO: 664044 - protein, 21 aa, Mycobacterium
GDLLCGTAMPDVFAASINDVS

SEQ ID NO: 664045 - protein, 25 aa, Mycobacterium
GDLLFIGCTPIVWSGPIENWIAACD

SEQ ID NO: 664046 - protein, 21 aa, Mycobacterium
GDLLFNDFLALHFSQTRPPTE

SEQ ID NO: 664047 - protein, 23 aa, Mycobacterium
GDLLIGWRLLVQAGVAHRALTDG

SEQ ID NO: 664048 - protein, 22 aa, Mycobacterium
GDLLPGYMIPARIELLEQMPLT

SEQ ID NO: 664049 - protein, 24 aa, Mycobacterium
GDLLRCGLMDWGCVGQMNLAMAIW

SEQ ID NO: 664050 - protein, 22 aa, Mycobacterium
GDLLRFWIGDDLVKTAARTSRG

SEQ ID NO: 664051 - protein, 18 aa, Mycobacterium
GDLLRPVLGVPRHPLRLA

SEQ ID NO: 664052 - protein, 22 aa, Mycobacterium
GDLLSRPGVFVFGSNDYFGPRL

SEQ ID NO: 664053 - protein, 17 aa, Mycobacterium
GDLLTARTGELGTAGIA

SEQ ID NO: 664054 - protein, 25 aa, Mycobacterium
GDLLTRLTAPVIRGLGIGIVPTATR

SEQ ID NO: 664055 - protein, 23 aa, Mycobacterium
GDLNSGWCIVPAPVYDILADFFA

SEQ ID NO: 664056 - protein, 23 aa, Mycobacterium
GDLPAELPAAIVVQQHLGDHDSV

SEQ ID NO: 664057 - protein, 25 aa, Mycobacterium
GDLPARISAWYVERGHTPPADPVQM

SEQ ID NO: 664058 - protein, 17 aa, Mycobacterium
GDLPIAVQIDDDTALFG

SEQ ID NO: 664059 - protein, 21 aa, Mycobacterium
GDLPKASPGVIGDWSEHERAE

SEQ ID NO: 664060 - protein, 17 aa, Mycobacterium
GDLPKIPAQLSVTATTS

SEQ ID NO: 664061 - protein, 30 aa, Mycobacterium
GDLPLAYRDHCPVCAGSLAGARLRETLLGC

SEQ ID NO: 664062 - protein, 17 aa, Mycobacterium
GDLPLDVARDIVGPDVL

SEQ ID NO: 664063 - protein, 23 aa, Mycobacterium
GDLPNVAGLVYVAAFAPDAGESP

SEQ ID NO: 664064 - protein, 35 aa, Mycobacterium
GDLPTRLALLDEFSKVWDYRGRARASATGRLHSQD

SEQ ID NO: 664065 - protein, 22 aa, Mycobacterium
GDLQHRLGRMVASTAAFGANEN

SEQ ID NO: 664066 - protein, 19 aa, Mycobacterium
GDLQSLGFVAFDRVAPGPG

SEQ ID NO: 664067 - protein, 19 aa, Mycobacterium
GDLRAELIAGGRSNLTFLV

SEQ ID NO: 664068 - protein, 19 aa, Mycobacterium
GDLRIRREEVWGPVAGGAA

SEQ ID NO: 664069 - protein, 24 aa, Mycobacterium
GDLRRCVTSLKSRYGDDSGMRRVV

SEQ ID NO: 664070 - protein, 18 aa, Mycobacterium
GDLRRSRLDNTRAREVLG

SEQ ID NO: 664071 - protein, 23 aa, Mycobacterium
GDLRVGDRVVIPFQISCGSCYMC

SEQ ID NO: 664072 - protein, 22 aa, Mycobacterium
GDLSGLPWRHRVTAIADENRAL

SEQ ID NO: 664073 - protein, 18 aa, Mycobacterium
GDLSIRREETWQPVRDGR

SEQ ID NO: 664074 - protein, 17 aa, Mycobacterium
GDLSLVWADDIIAEAPI

SEQ ID NO: 664075 - protein, 18 aa, Mycobacterium
GDLSRAAKDYGNKLKSVK

SEQ ID NO: 664076 - protein, 20 aa, Mycobacterium
GDLTPWAERGVMLLNRVLTV

SEQ ID NO: 664077 - protein, 28 aa, Mycobacterium
GDLTSWTSWQRWRDAVVDRYRRQGQHCP

SEQ ID NO: 664078 - protein, 20 aa, Mycobacterium
GDLVACPQWVVSVTVLGDLD

SEQ ID NO: 664079 - protein, 19 aa, Mycobacterium
GDLVGRARHHPKWPSRPPE

SEQ ID NO: 664080 - protein, 20 aa, Mycobacterium
GDLVRGWGAVRVIDVRTEEL

SEQ ID NO: 664081 - protein, 24 aa, Mycobacterium
GDLVSCPQWVISVTVLGDLGGREP

SEQ ID NO: 664082 - protein, 21 aa, Mycobacterium
GDLVSCPQWVVSVTVLGDLEG

SEQ ID NO: 664083 - protein, 25 aa, Mycobacterium
GDLYFSCTIPNLIVGTVGNGKDLDF

SEQ ID NO: 664084 - protein, 21 aa, Mycobacterium
GDLYGNFRRGYAVDHDRELAK

SEQ ID NO: 664085 - protein, 20 aa, Mycobacterium
GDLYRLDPYSGNTLGKETWN

SEQ ID NO: 664086 - protein, 24 aa, Mycobacterium
GDLYRPHWDRWAAQELEYIARCDP

SEQ ID NO: 664087 - protein, 24 aa, Mycobacterium
GDMAARIADHLGYRVIAVDLVPER

SEQ ID NO: 664088 - protein, 17 aa, Mycobacterium
GDMINGFAPDAAVREHD

SEQ ID NO: 664089 - protein, 25 aa, Mycobacterium
GDMKAGLVANLFAFDALRAARLEPL

SEQ ID NO: 664090 - protein, 22 aa, Mycobacterium
GDMLCRPNNRPLVGAQIDAMVC

SEQ ID NO: 664091 - protein, 20 aa, Mycobacterium
GDMLGCRIVVDGVVKAERVS

SEQ ID NO: 664092 - protein, 21 aa, Mycobacterium
GDMNNGIFFRGVGQGRLYFGI

SEQ ID NO: 664093 - protein, 21 aa, Mycobacterium
GDMPARYVIHAATMELGGPTS

SEQ ID NO: 664094 - protein, 22 aa, Mycobacterium
GDMPARYVIHAATMELGGPTSA

SEQ ID NO: 664095 - protein, 24 aa, Mycobacterium
GDMPNDLPILRWAGHGVAMGNAHP

SEQ ID NO: 664096 - protein, 20 aa, Mycobacterium
GDMPPRYPIVGGHEGSAIVE

SEQ ID NO: 664097 - protein, 18 aa, Mycobacterium
GDMQLELISPVRGENIYS

SEQ ID NO: 664098 - protein, 23 aa, Mycobacterium
GDMQRWMEFSAKSDLLMYGSAYP

SEQ ID NO: 664099 - protein, 20 aa, Mycobacterium
GDMRDWVAALVCPLTDHLAA

SEQ ID NO: 664100 - protein, 18 aa, Mycobacterium
GDMSTNIGQFMRDVISPF

SEQ ID NO: 664101 - protein, 21 aa, Mycobacterium
GDMYLVHPFTVHAADEHRGTR

SEQ ID NO: 664102 - protein, 22 aa, Mycobacterium
GDNAKWFYDFAVPGDVVEVRNS

SEQ ID NO: 664103 - protein, 18 aa, Mycobacterium
GDNARRFMGLPIANPDPE

SEQ ID NO: 664104 - protein, 19 aa, Mycobacterium
GDNAYRCQVGHAWTSQSLL

SEQ ID NO: 664105 - protein, 25 aa, Mycobacterium
GDNDFRLLWQGGLHRWSPQGYTGVI

SEQ ID NO: 664106 - protein, 27 aa, Mycobacterium
GDNDWYQWHWRVHVGLWAAASASKIDG

SEQ ID NO: 664107 - protein, 18 aa, Mycobacterium
GDNNFGWCNSGSGNTGFG

SEQ ID NO: 664108 - protein, 24 aa, Mycobacterium
GDNRKSLTFALRFRAPDRTLTEDD

SEQ ID NO: 664109 - protein, 22 aa, Mycobacterium
GDNWLTPDVFEFQGQRAKQTIP

SEQ ID NO: 664110 - protein, 26 aa, Mycobacterium
GDPAELWRARIEAFFEVSGSHPAVAV

SEQ ID NO: 664111 - protein, 21 aa, Mycobacterium
GDPAESMWIIFDQQYRNSYVF

SEQ ID NO: 664112 - protein, 17 aa, Mycobacterium
GDPAMCRLGPQIFGSGA

SEQ ID NO: 664113 - protein, 25 aa, Mycobacterium
GDPARTPSCPRLSDSIRHAVAEGVL

SEQ ID NO: 664114 - protein, 24 aa, Mycobacterium
GDPASFDDIRWRLDVWNASAQVAG

SEQ ID NO: 664115 - protein, 19 aa, Mycobacterium
GDPAVPWERARAVDATPAA

SEQ ID NO: 664116 - protein, 19 aa, Mycobacterium
GDPDAIEWDAWKVEDGRWT

SEQ ID NO: 664117 - protein, 19 aa, Mycobacterium
GDPDLDHPSAWELHVSGQA

SEQ ID NO: 664118 - protein, 22 aa, Mycobacterium
GDPDLPMTATFIGDFGKALADL

SEQ ID NO: 664119 - protein, 22 aa, Mycobacterium
GDPDRGWAWQVPLLELPQAQFL

SEQ ID NO: 664120 - protein, 17 aa, Mycobacterium
GDPDRVATCAVDLTDDD

SEQ ID NO: 664121 - protein, 22 aa, Mycobacterium
GDPDWRAAVSLVLAEQILAELA

SEQ ID NO: 664122 - protein, 23 aa, Mycobacterium
GDPDYGVGLGLNFLPRATAGLLP

SEQ ID NO: 664123 - protein, 24 aa, Mycobacterium
GDPEAFTALAARFLGPSLDGVRPV

SEQ ID NO: 664124 - protein, 24 aa, Mycobacterium
GDPEAFTALAARFLGPTLDGVRPV

SEQ ID NO: 664125 - protein, 24 aa, Mycobacterium
GDPEAFTRLAARFLGPAITGVEAV

SEQ ID NO: 664126 - protein, 19 aa, Mycobacterium
GDPELPHLFFVEGGALAVE

SEQ ID NO: 664127 - protein, 27 aa, Mycobacterium
GDPEPWPGAGTNWRQGTLFVEIVDKSG

SEQ ID NO: 664128 - protein, 21 aa, Mycobacterium
GDPESWPAFVPSNGGSVNAVA

SEQ ID NO: 664129 - protein, 22 aa, Mycobacterium
GDPETNYRIGFVPQGIGADLIA

SEQ ID NO: 664130 - protein, 17 aa, Mycobacterium
GDPEVRQLMLLDAPSVL

SEQ ID NO: 664131 - protein, 19 aa, Mycobacterium
GDPFLSIGVVHADDTNLRY

SEQ ID NO: 664132 - protein, 17 aa, Mycobacterium
GDPFRLRLLDGLAASIT

SEQ ID NO: 664133 - protein, 23 aa, Mycobacterium
GDPFVLHPGEFVLASTLELFTLP

SEQ ID NO: 664134 - protein, 20 aa, Mycobacterium
GDPGACRRAEAMNFVPGADW

SEQ ID NO: 664135 - protein, 26 aa, Mycobacterium
GDPGESRFYLSLADELMRRFNGATLE

SEQ ID NO: 664136 - protein, 27 aa, Mycobacterium
GDPGESRFYLSLGDELMRRFNGAALEA

SEQ ID NO: 664137 - protein, 27 aa, Mycobacterium
GDPGESRFYLSLGDELMRRFNGAALES

SEQ ID NO: 664138 - protein, 24 aa, Mycobacterium
GDPGESRFYLSLQDELMRRFNGAA

SEQ ID NO: 664139 - protein, 26 aa, Mycobacterium
GDPGGLPVIFSHGFADSAVIRNPDDD

SEQ ID NO: 664140 - protein, 17 aa, Mycobacterium
GDPGSQGGLGGRGGAGG

SEQ ID NO: 664141 - protein, 17 aa, Mycobacterium
GDPGYRPNAAIGPLDTA

SEQ ID NO: 664142 - protein, 18 aa, Mycobacterium
GDPIAWSAPLRWAGVHAA

SEQ ID NO: 664143 - protein, 17 aa, Mycobacterium
GDPIEMRALAGALTTDR

SEQ ID NO: 664144 - protein, 17 aa, Mycobacterium
GDPLALIAPAGTEGGAT

SEQ ID NO: 664145 - protein, 17 aa, Mycobacterium
GDPLALIAPVSGEAPAL

SEQ ID NO: 664146 - protein, 18 aa, Mycobacterium
GDPLDLYFGGNMETFVPL

SEQ ID NO: 664147 - protein, 18 aa, Mycobacterium
GDPLFYSSYMHLHTRLTE

SEQ ID NO: 664148 - protein, 18 aa, Mycobacterium
GDPLFYSSYMHLHTRLTR

SEQ ID NO: 664149 - protein, 25 aa, Mycobacterium
GDPLHPKPVYLFAYDPTAFGGKGRA

SEQ ID NO: 664150 - protein, 22 aa, Mycobacterium
GDPLLDLGWMLATWPSETDDAS

SEQ ID NO: 664151 - protein, 25 aa, Mycobacterium
GDPLLVLRINFLGMRQFTESLLDRM

SEQ ID NO: 664152 - protein, 25 aa, Mycobacterium
GDPLPAERWREYCLSSVTTHDLPPT

SEQ ID NO: 664153 - protein, 18 aa, Mycobacterium
GDPLRIGASLVVRAIRPV

SEQ ID NO: 664154 - protein, 19 aa, Mycobacterium
GDPLRIGASLVVRMIRPVA

SEQ ID NO: 664155 - protein, 30 aa, Mycobacterium
GDPLRLPGFPFQFFCYKRIAAVNAARVTAA

SEQ ID NO: 664156 - protein, 20 aa, Mycobacterium
GDPLVAMAFAGRATSTIELG

SEQ ID NO: 664157 - protein, 25 aa, Mycobacterium
GDPNAVVMDCVWDCAGPITVGDGFD

SEQ ID NO: 664158 - protein, 17 aa, Mycobacterium
GDPNAWQTGLAPTEVSA

SEQ ID NO: 664159 - protein, 21 aa, Mycobacterium
GDPNRCIWHVSSYMYLPPEHR

SEQ ID NO: 664160 - protein, 25 aa, Mycobacterium
GDPPYRGLVSMSFAWPTDDTGGYPA

SEQ ID NO: 664161 - protein, 21 aa, Mycobacterium
GDPQEAFGIAAPDTGAPATHS

SEQ ID NO: 664162 - protein, 19 aa, Mycobacterium
GDPQRGLVTMGIVDEGGGT

SEQ ID NO: 664163 - protein, 21 aa, Mycobacterium
GDPRARIVRLFDFAGEHRAMY

SEQ ID NO: 664164 - protein, 27 aa, Mycobacterium
GDPRIRRLWPDFRAVERAYFEATQIVP

SEQ ID NO: 664165 - protein, 23 aa, Mycobacterium
GDPRKVAEAVLMLAKLDDPPLRL

SEQ ID NO: 664166 - protein, 23 aa, Mycobacterium
GDPRLHRRDALWAAALHTGIARR

SEQ ID NO: 664167 - protein, 17 aa, Mycobacterium
GDPRLPQMPATPEQIDM

SEQ ID NO: 664168 - protein, 19 aa, Mycobacterium
GDPRLRVPRRPEPRTAVPA

SEQ ID NO: 664169 - protein, 21 aa, Mycobacterium
GDPRPATLADHDWLINERGVA

SEQ ID NO: 664170 - protein, 24 aa, Mycobacterium
GDPRPITALGHWVHVYVDRVTRKS

SEQ ID NO: 664171 - protein, 20 aa, Mycobacterium
GDPRRAAVTVRMLLTHTSGI

SEQ ID NO: 664172 - protein, 22 aa, Mycobacterium
GDPRRPGMLPGEIESLYDAFRH

SEQ ID NO: 664173 - protein, 24 aa, Mycobacterium
GDPRSGRELWVYGRHGKPCRRCGT

SEQ ID NO: 664174 - protein, 20 aa, Mycobacterium
GDPRVPFTVTTDGRVHGRAA

SEQ ID NO: 664175 - protein, 17 aa, Mycobacterium
GDPRWRSVLPQDFSNMA

SEQ ID NO: 664176 - protein, 17 aa, Mycobacterium
GDPSGFVKLVADAKHGE

SEQ ID NO: 664177 - protein, 31 aa, Mycobacterium
GDPSLPFAKLRVAPTASWMFEYYPMRDVREL

SEQ ID NO: 664178 - protein, 25 aa, Mycobacterium
GDPSVDLIPAWNLLSAPAREQFRTM

SEQ ID NO: 664179 - protein, 25 aa, Mycobacterium
GDPTGGWTMTSWDGIPVAPASLPTQ

SEQ ID NO: 664180 - protein, 20 aa, Mycobacterium
GDPTLPFTGTPPMPTMPFTP

SEQ ID NO: 664181 - protein, 21 aa, Mycobacterium
GDPTLPFTGTPPMPTMPFTPP

SEQ ID NO: 664182 - protein, 21 aa, Mycobacterium
GDPTLRRLLPDFYKLDPGDPM

SEQ ID NO: 664183 - protein, 27 aa, Mycobacterium
GDPTTARWWPVKDFAGTAAKLIASVPV

SEQ ID NO: 664184 - protein, 17 aa, Mycobacterium
GDPTWPDAITMIEKANG

SEQ ID NO: 664185 - protein, 18 aa, Mycobacterium
GDPVHLAALFKSANVQQV

SEQ ID NO: 664186 - protein, 17 aa, Mycobacterium
GDPVPGQVGLLLRGLLG

SEQ ID NO: 664187 - protein, 17 aa, Mycobacterium
GDPWPADVVVKVNPPTS

SEQ ID NO: 664188 - protein, 17 aa, Mycobacterium
GDPWYSMYTRDPLQAPI

SEQ ID NO: 664189 - protein, 27 aa, Mycobacterium
GDQAVSLQEWCDYLGSLVGKAPIFEPS

SEQ ID NO: 664190 - protein, 24 aa, Mycobacterium
GDQELRGLLGAFMFSGPQLEQPAG

SEQ ID NO: 664191 - protein, 26 aa, Mycobacterium
GDQGGRLLGFHWTKVHLDRPGLGEVY

SEQ ID NO: 664192 - protein, 23 aa, Mycobacterium
GDQHPGDAFLAWQRFSQETPDFP

SEQ ID NO: 664193 - protein, 21 aa, Mycobacterium
GDQLIIEWRALTVALLDEIAP

SEQ ID NO: 664194 - protein, 22 aa, Mycobacterium
GDQLMFRKLFESVIKGHVKVLV

SEQ ID NO: 664195 - protein, 20 aa, Mycobacterium
GDQLPGYGWVFPMGDGIFNI

SEQ ID NO: 664196 - protein, 25 aa, Mycobacterium
GDQMTRLAPIWSRLAVGGVLMTINW

SEQ ID NO: 664197 - protein, 24 aa, Mycobacterium
GDQPCPVCGQGTLDHDWALAARAA

SEQ ID NO: 664198 - protein, 17 aa, Mycobacterium
GDQPFWGAQLKKLKVGA

SEQ ID NO: 664199 - protein, 27 aa, Mycobacterium
GDQRDWDFAKEFGLPIIEVVTGGDISE

SEQ ID NO: 664200 - protein, 23 aa, Mycobacterium
GDQRVSLSTGQTWSVTTTGPAAV

SEQ ID NO: 664201 - protein, 20 aa, Mycobacterium
GDQSWSRAMLNGGVRIDGPA

SEQ ID NO: 664202 - protein, 21 aa, Mycobacterium
GDQTMFRKLFESVVKGQVKVL

SEQ ID NO: 664203 - protein, 21 aa, Mycobacterium
GDQTMFRKVFESVLAGHVKVL

SEQ ID NO: 664204 - protein, 24 aa, Mycobacterium
GDQTMFRKVFESVLAGHVKVLVGN

SEQ ID NO: 664205 - protein, 19 aa, Mycobacterium
GDQVLRLAAQYADTVSIAC

SEQ ID NO: 664206 - protein, 25 aa, Mycobacterium
GDQVSAAVAALFAAHAQGYQSISAQ

SEQ ID NO: 664207 - protein, 17 aa, Mycobacterium
GDRALARVASWGDGWYG

SEQ ID NO: 664208 - protein, 21 aa, Mycobacterium
GDRASALRMVRGVKNRFGAAD

SEQ ID NO: 664209 - protein, 24 aa, Mycobacterium
GDRDSVRTPMQWTPDRNAGFSKAT

SEQ ID NO: 664210 - protein, 22 aa, Mycobacterium
GDRDYRLVLAAAQREALGLLRR

SEQ ID NO: 664211 - protein, 19 aa, Mycobacterium
GDRFIKTAVAILGETGRTD

SEQ ID NO: 664212 - protein, 18 aa, Mycobacterium
GDRFIKTAVGILGETGRT

SEQ ID NO: 664213 - protein, 24 aa, Mycobacterium
GDRGAHRGFACDVADAASVQAAAD

SEQ ID NO: 664214 - protein, 17 aa, Mycobacterium
GDRGARLSRSWAPYASG

SEQ ID NO: 664215 - protein, 21 aa, Mycobacterium
GDRGFYAGAVGWCDQRGDGRW

SEQ ID NO: 664216 - protein, 23 aa, Mycobacterium
GDRGFYAGAVGWCDSAGNGRWVV

SEQ ID NO: 664217 - protein, 21 aa, Mycobacterium
GDRGVHMATLLSGWSDDVVLL

SEQ ID NO: 664218 - protein, 24 aa, Mycobacterium
GDRHLPRPAGPTMTRKARRTDRPV

SEQ ID NO: 664219 - protein, 23 aa, Mycobacterium
GDRHWLVPVTAFWQAHRDAAGTY

SEQ ID NO: 664220 - protein, 24 aa, Mycobacterium
GDRHWPPLCRAVGHPEWLDDPRFA

SEQ ID NO: 664221 - protein, 24 aa, Mycobacterium
GDRIAIWSPNTWHWVVASLATHYA

SEQ ID NO: 664222 - protein, 31 aa, Mycobacterium
GDRIAVLCPQNLDYLIAFFGALYAGRIAVPL

SEQ ID NO: 664223 - protein, 22 aa, Mycobacterium
GDRKRPARAILVFTDEDGQAHR

SEQ ID NO: 664224 - protein, 20 aa, Mycobacterium
GDRLALCRTQTWGRDKRPEA

SEQ ID NO: 664225 - protein, 27 aa, Mycobacterium
GDRLCIPVPFYHCFGMVMGNLGCTTHG

SEQ ID NO: 664226 - protein, 31 aa, Mycobacterium
GDRLIRSGQPWSWDIGFMLGTGLQGKQLGIV

SEQ ID NO: 664227 - protein, 17 aa, Mycobacterium
GDRLIRVTPPAPVRSDV

SEQ ID NO: 664228 - protein, 24 aa, Mycobacterium
GDRLRLALDADLCTAVTGLPAPLA

SEQ ID NO: 664229 - protein, 22 aa, Mycobacterium
GDRLRLPLDADLSSAVTGSTAA

SEQ ID NO: 664230 - protein, 24 aa, Mycobacterium
GDRLSRLAGRWLRVPVQAQSGYSF

SEQ ID NO: 664231 - protein, 18 aa, Mycobacterium
GDRMVVFAGDLVEESADP

SEQ ID NO: 664232 - protein, 35 aa, Mycobacterium
GDRMWEFLDRLISISLPRIRDFRGLSGKQFDGTGN

SEQ ID NO: 664233 - protein, 26 aa, Mycobacterium
GDRPEDRWEEARQWLDERGYDSTLDY

SEQ ID NO: 664234 - protein, 17 aa, Mycobacterium
GDRPGLSGGQFAVDRRR

SEQ ID NO: 664235 - protein, 20 aa, Mycobacterium
GDRPIPSWLQVVGERQRILV

SEQ ID NO: 664236 - protein, 19 aa, Mycobacterium
GDRPLKRLLSALTPKRPKP

SEQ ID NO: 664237 - protein, 23 aa, Mycobacterium
GDRPRIFDGLDRILKANSPEAQL

SEQ ID NO: 664238 - protein, 23 aa, Mycobacterium
GDRQRIATELGYSETVFITLPPE

SEQ ID NO: 664239 - protein, 28 aa, Mycobacterium
GDRRAAIDFATLWARPGDTVLVAGKGHE

SEQ ID NO: 664240 - protein, 26 aa, Mycobacterium
GDRRAAIVHAVQWAREGDIVLIAGKG

SEQ ID NO: 664241 - protein, 19 aa, Mycobacterium
GDRRFGGPGTRVQTFVEDE

SEQ ID NO: 664242 - protein, 18 aa, Mycobacterium
GDRRGCVDIRLRRGETHI

SEQ ID NO: 664243 - protein, 24 aa, Mycobacterium
GDRRLLVRPEFKAMFLDDLLNGSR

SEQ ID NO: 664244 - protein, 23 aa, Mycobacterium
GDRRLTVALLFAALGAKFQTGEA

SEQ ID NO: 664245 - protein, 17 aa, Mycobacterium
GDRRLVLAEARLAAYTR

SEQ ID NO: 664246 - protein, 27 aa, Mycobacterium
GDRRMLGRPEFKAMFLDDLLNGSRKQL

SEQ ID NO: 664247 - protein, 20 aa, Mycobacterium
GDRRTVWDGFRLSIPSRIPR

SEQ ID NO: 664248 - protein, 22 aa, Mycobacterium
GDRRYAYEPTFIMRGLSELHIT

SEQ ID NO: 664249 - protein, 17 aa, Mycobacterium
GDRTAFFFEGRLVEEGP

SEQ ID NO: 664250 - protein, 17 aa, Mycobacterium
GDRTELRSLAQTYGATA

SEQ ID NO: 664251 - protein, 17 aa, Mycobacterium
GDRTELRSLAQTYGDTE

SEQ ID NO: 664252 - protein, 17 aa, Mycobacterium
GDRTELRSLGQTYGDTA

SEQ ID NO: 664253 - protein, 29 aa, Mycobacterium
GDRTVSIAWTAWRGLGMGSTSGFVAAQLE

SEQ ID NO: 664254 - protein, 36 aa, Mycobacterium
GDRVAIEPIYRCGHCAPCRAGNYNVCQQIGFHGLMC

SEQ ID NO: 664255 - protein, 26 aa, Mycobacterium
GDRVAIWSPNTWHWVVACLAIHHAGA

SEQ ID NO: 664256 - protein, 24 aa, Mycobacterium
GDRVAIWSPNTWHWVVASLAIHHA

SEQ ID NO: 664257 - protein, 17 aa, Mycobacterium
GDRVASLRLALADIDAQ

SEQ ID NO: 664258 - protein, 18 aa, Mycobacterium
GDRVAVYAFRSRGRSAVH

SEQ ID NO: 664259 - protein, 33 aa, Mycobacterium; identical to SEQ ID NO: 97154

SEQ ID NO: 664260 - protein, 24 aa, Mycobacterium
GDRVRVGLRPCDLHVTSEAGDLRG

SEQ ID NO: 664261 - protein, 47 aa, Mycobacterium
GDRVVVAAGRPCQRCANCRRGDVVNCLRIQLMAFAYDGAWAEYTLAQ

SEQ ID NO: 664262 - protein, 18 aa, Mycobacterium
GDRVWRFVDTAGLRRKVG

SEQ ID NO: 664263 - protein, 18 aa, Mycobacterium
GDRWCVTALNWLRAHHDG

SEQ ID NO: 664264 - protein, 20 aa, Mycobacterium
GDRWCVTAMNWLRAHHDGCA

SEQ ID NO: 664265 - protein, 21 aa, Mycobacterium
GDRWCVVAVNWLRAHYDGCAA

SEQ ID NO: 664266 - protein, 26 aa, Mycobacterium
GDRWGPLGSVGVRWGPLGKETAGMSP

SEQ ID NO: 664267 - protein, 23 aa, Mycobacterium
GDRYPRLVAAVVRAVGDVAMDEY

SEQ ID NO: 664268 - protein, 20 aa, Mycobacterium
GDSARLVIRGPIVTSDAGHG

SEQ ID NO: 664269 - protein, 17 aa, Mycobacterium
GDSDWLHGMWKGEKFVE

SEQ ID NO: 664270 - protein, 20 aa, Mycobacterium
GDSEISLWSSVSVGGVPAAQ

SEQ ID NO: 664271 - protein, 22 aa, Mycobacterium
GDSGFPMLPPLMPPPISAGSGW

SEQ ID NO: 664272 - protein, 19 aa, Mycobacterium
GDSGRWLDLCAGPGGKTAL

SEQ ID NO: 664273 - protein, 24 aa, Mycobacterium
GDSGYPQMLLRVGWAPINADPLPA

SEQ ID NO: 664274 - protein, 17 aa, Mycobacterium
GDSLLLGTDLVKDTDRL

SEQ ID NO: 664275 - protein, 25 aa, Mycobacterium
GDSLRAVILGGDWVSSDLARRLAAQ

SEQ ID NO: 664276 - protein, 18 aa, Mycobacterium
GDSLTWGWVPVEDGAPTE

SEQ ID NO: 664277 - protein, 20 aa, Mycobacterium
GDSNVRWLQEHGVTIWDEWA

SEQ ID NO: 664278 - protein, 26 aa, Mycobacterium
GDSPLAGTVRFDWDPLRWFEEDEQIY

SEQ ID NO: 664279 - protein, 22 aa, Mycobacterium
GDSPPYGYGNLVGGDGGTGADG

SEQ ID NO: 664280 - protein, 23 aa, Mycobacterium
GDSQPRLCFDGVTRRGKIVCTLG

SEQ ID NO: 664281 - protein, 22 aa, Mycobacterium
GDSRIPAAIGYPLGAQEGDTTL

SEQ ID NO: 664282 - protein, 22 aa, Mycobacterium
GDSRIVPIYLDITDDATVQGAA

SEQ ID NO: 664283 - protein, 18 aa, Mycobacterium
GDSVAGLIRNPAHEDDLR

SEQ ID NO: 664284 - protein, 30 aa, Mycobacterium
GDSVDGVWSRMKFEGGVHRVQRVPVTESQG

SEQ ID NO: 664285 - protein, 17 aa, Mycobacterium
GDSVGLKLHYVSPAGEM

SEQ ID NO: 664286 - protein, 25 aa, Mycobacterium
GDSVSCPRSGELIMRDGNRWYSTGT

SEQ ID NO: 664287 - protein, 17 aa, Mycobacterium
GDSVTITGFGVFEQRRR

SEQ ID NO: 664288 - protein, 18 aa, Mycobacterium
GDSVTITGFGVFEQRRRA

SEQ ID NO: 664289 - protein, 25 aa, Mycobacterium
GDTALRRHFDWVRSWYDFAVPGIGN

SEQ ID NO: 664290 - protein, 18 aa, Mycobacterium
GDTAPGRKVWSQLTDLGV

SEQ ID NO: 664291 - protein, 21 aa, Mycobacterium
GDTAVGWKNRLQPLGIPAAAV

SEQ ID NO: 664292 - protein, 25 aa, Mycobacterium
GDTDLAWSRVTYWRALLAAAVDQEP

SEQ ID NO: 664293 - protein, 26 aa, Mycobacterium
GDTDLSWSRITYWRALLASALDQAPY

SEQ ID NO: 664294 - protein, 17 aa, Mycobacterium
GDTDYYLIGTDLLPLLQ

SEQ ID NO: 664295 - protein, 22 aa, Mycobacterium
GDTEAVERCRPVFETYADPVVH

SEQ ID NO: 664296 - protein, 23 aa, Mycobacterium
GDTEVRPILLWHALEESEHKAVA

SEQ ID NO: 664297 - protein, 18 aa, Mycobacterium
GDTEWTTNTFSWRAEERV

SEQ ID NO: 664298 - protein, 17 aa, Mycobacterium
GDTFAPVRAVLGGGGGR

SEQ ID NO: 664299 - protein, 18 aa, Mycobacterium
GDTFAYRYLDFNANSDGE

SEQ ID NO: 664300 - protein, 28 aa, Mycobacterium
GDTFSGPNMSGWWRSNVLLISTDNVLSD

SEQ ID NO: 664301 - protein, 20 aa, Mycobacterium
GDTILGLSLAHGGHLTHGMR

SEQ ID NO: 664302 - protein, 20 aa, Mycobacterium
GDTITVSGFMPWVGDIALAH

SEQ ID NO: 664303 - protein, 18 aa, Mycobacterium
GDTLKGYFQHQAGKYGTS

SEQ ID NO: 664304 - protein, 17 aa, Mycobacterium
GDTLLIVDGLFFQQASV

SEQ ID NO: 664305 - protein, 20 aa, Mycobacterium
GDTLSLLVIAEEALHKWQRL

SEQ ID NO: 664306 - protein, 24 aa, Mycobacterium
GDTLVEFDEQLTLTLSAPVNATIA

SEQ ID NO: 664307 - protein, 24 aa, Mycobacterium
GDTMKRILLELGGKSASIVLDDAQ

SEQ ID NO: 664308 - protein, 19 aa, Mycobacterium
GDTMLLLLAAAHRDPTIVG

SEQ ID NO: 664309 - protein, 20 aa, Mycobacterium
GDTNTVLAFFVEQMSTEQSA

SEQ ID NO: 664310 - protein, 20 aa, Mycobacterium
GDTPARLALFVTGAHHDKVT

SEQ ID NO: 664311 - protein, 20 aa, Mycobacterium
GDTPLPVRTPLAVQLPEPMA

SEQ ID NO: 664312 - protein, 20 aa, Mycobacterium
GDTPLPVRTPLPVTLPEPMA

SEQ ID NO: 664313 - protein, 19 aa, Mycobacterium
GDTPLPVRTPLTVQLPEPM

SEQ ID NO: 664314 - protein, 24 aa, Mycobacterium
GDTRFLYYMGWNLAVTVPWKNAIG

SEQ ID NO: 664315 - protein, 19 aa, Mycobacterium
GDTRWIHRAAHDLMGVNPE

SEQ ID NO: 664316 - protein, 20 aa, Mycobacterium
GDTSAVMGFVVDQMSAEQWA

SEQ ID NO: 664317 - protein, 30 aa, Mycobacterium
GDTTATFEWAFRWLRARRPPPSTAVLVHGD

SEQ ID NO: 664318 - protein, 19 aa, Mycobacterium
GDTTRSWHVIDATDVVLGR

SEQ ID NO: 664319 - protein, 19 aa, Mycobacterium
GDTTRSWYVIDASDVVLGR

SEQ ID NO: 664320 - protein, 19 aa, Mycobacterium
GDTTRSWYVIDATDVVLGR

SEQ ID NO: 664321 - protein, 21 aa, Mycobacterium
GDTVPCPGLDRLAAGAGALVH

SEQ ID NO: 664322 - protein, 17 aa, Mycobacterium
GDTWVSSEFLFRRDEDG

SEQ ID NO: 664323 - protein, 19 aa, Mycobacterium
GDTYLDWRLDQRLDGFLRH

SEQ ID NO: 664324 - protein, 17 aa, Mycobacterium
GDVAAALGMSRTPVREA

SEQ ID NO: 664325 - protein, 25 aa, Mycobacterium
GDVAELVVSLGYRCQIAKKAVNGRS

SEQ ID NO: 664326 - protein, 19 aa, Mycobacterium
GDVAGAFGAIVDAPAVIAN

SEQ ID NO: 664327 - protein, 18 aa, Mycobacterium
GDVAGLRAAASRWRAFGA

SEQ ID NO: 664328 - protein, 18 aa, Mycobacterium
GDVALWEINEAFASVPIA

SEQ ID NO: 664329 - protein, 20 aa, Mycobacterium
GDVAYGWAMEDSTGFAKLIV

SEQ ID NO: 664330 - protein, 20 aa, Mycobacterium
GDVDAYVHAGGQWEWDSAAP

SEQ ID NO: 664331 - protein, 21 aa, Mycobacterium
GDVDPGVIFYLWREAGMPVED

SEQ ID NO: 664332 - protein, 24 aa, Mycobacterium
GDVDRAVGVARRIRTGQIAVNGCG

SEQ ID NO: 664333 - protein, 17 aa, Mycobacterium
GDVDSVLGIPRRYGDGQ

SEQ ID NO: 664334 - protein, 18 aa, Mycobacterium
GDVELDLVLAILRARQLF

SEQ ID NO: 664335 - protein, 17 aa, Mycobacterium
GDVELKEYPGLYHEVFN

SEQ ID NO: 664336 - protein, 21 aa, Mycobacterium
GDVEVGDWLRFGISHPCTTFD

SEQ ID NO: 664337 - protein, 23 aa, Mycobacterium
GDVFAGVLAAWWPQGAETALRRA

SEQ ID NO: 664338 - protein, 20 aa, Mycobacterium
GDVFDPLPAMGLWQTVLLVD

SEQ ID NO: 664339 - protein, 21 aa, Mycobacterium
GDVGAVVGRYAAGGYEVEFTA

SEQ ID NO: 664340 - protein, 31 aa, Mycobacterium
GDVGWIPYFLWRAEHVYNRHSGWTLAKFPPG

SEQ ID NO: 664341 - protein, 30 aa, Mycobacterium
GDVGWIPYFLWRAEHVYNRHSGWTLATFPP

SEQ ID NO: 664342 - protein, 20 aa, Mycobacterium
GDVGYGWAMEDTTGFLKLIA

SEQ ID NO: 664343 - protein, 25 aa, Mycobacterium
GDVIEVPGLLDLSSLWQIYDLDRPA

SEQ ID NO: 664344 - protein, 31 aa, Mycobacterium
GDVIEVPGLLDLSSLWQIYGLDRPALKDRTF

SEQ ID NO: 664345 - protein, 19 aa, Mycobacterium
GDVIPEVLGPVVDLRDGTE

SEQ ID NO: 664346 - protein, 20 aa, Mycobacterium
GDVIVLRGMGPRGGPGTVFA

SEQ ID NO: 664347 - protein, 19 aa, Mycobacterium
GDVLARLTAYRARSVDIDG

SEQ ID NO: 664348 - protein, 18 aa, Mycobacterium
GDVLGWAVFWLVHAPTGA

SEQ ID NO: 664349 - protein, 23 aa, Mycobacterium
GDVLKIEILQAIPRVPYGVVSSR

SEQ ID NO: 664350 - protein, 20 aa, Mycobacterium
GDVLKIETLQAIPRVPYGVV

SEQ ID NO: 664351 - protein, 20 aa, Mycobacterium
GDVLRRARIEQGRTLREVSD

SEQ ID NO: 664352 - protein, 22 aa, Mycobacterium
GDVLRRYPQVVAPEMNLGQLAL

SEQ ID NO: 664353 - protein, 18 aa, Mycobacterium
GDVLTQYGGITVEVQNTD

SEQ ID NO: 664354 - protein, 24 aa, Mycobacterium
GDVMPPRGVGVIELRGESLTPGYL

SEQ ID NO: 664355 - protein, 25 aa, Mycobacterium
GDVMPPRGVGVIELRGESLTPGYLT

SEQ ID NO: 664356 - protein, 18 aa, Mycobacterium
GDVNLHLVLGSWRILGSV

SEQ ID NO: 664357 - protein, 19 aa, Mycobacterium
GDVNRPTWVISLTDLLMVA

SEQ ID NO: 664358 - protein, 27 aa, Mycobacterium
GDVPVREFAQVMPPAMRPAVRVVGKKA

SEQ ID NO: 664359 - protein, 17 aa, Mycobacterium
GDVPVVLTGAMRGADAP

SEQ ID NO: 664360 - protein, 19 aa, Mycobacterium
GDVRDALQLTRKGGTCVLT

SEQ ID NO: 664361 - protein, 20 aa, Mycobacterium
GDVRDSNIINADHGSNVGVD

SEQ ID NO: 664362 - protein, 21 aa, Mycobacterium
GDVRGLLGIPDRHAVAAVVPL

SEQ ID NO: 664363 - protein, 25 aa, Mycobacterium
GDVRGRGAMIAIELVKSGTAEPDKE

SEQ ID NO: 664364 - protein, 24 aa, Mycobacterium
GDVRGRGAMIAIELVKSGTAEPDR

SEQ ID NO: 664365 - protein, 25 aa, Mycobacterium
GDVRGRGAMIAMELVKAGTTEPDAD

SEQ ID NO: 664366 - protein, 25 aa, Mycobacterium
GDVRGRGAMIAMELVKSGTAEPDAA

SEQ ID NO: 664367 - protein, 18 aa, Mycobacterium
GDVRHGRQSLREAQVLVQ

SEQ ID NO: 664368 - protein, 18 aa, Mycobacterium
GDVRLGWNTFEKTGMKET

SEQ ID NO: 664369 - protein, 27 aa, Mycobacterium
GDVRQRPGIEWVCGRWTGAQVDKGKVV

SEQ ID NO: 664370 - protein, 26 aa, Mycobacterium
GDVRVIGQIPICWDPDRDAAIDRAHD

SEQ ID NO: 664371 - protein, 26 aa, Mycobacterium
GDVRWFDIGPCYIFHVANAYETTSAD

SEQ ID NO: 664372 - protein, 24 aa, Mycobacterium
GDVSRFAATVAWDRLAGGEIEPEP

SEQ ID NO: 664373 - protein, 18 aa, Mycobacterium
GDVTIRSYAYLRISTTGA

SEQ ID NO: 664374 - protein, 18 aa, Mycobacterium
GDVTRTWYVIDATDVVLG

SEQ ID NO: 664375 - protein, 17 aa, Mycobacterium
GDVVAVWGAGPVGLFAI

SEQ ID NO: 664376 - protein, 30 aa, Mycobacterium
GDVVDPRTGLPWLAAHAEEFGLVAPPADQR

SEQ ID NO: 664377 - protein, 19 aa, Mycobacterium
GDVVKRATAVLGNGGDVDM

SEQ ID NO: 664378 - protein, 21 aa, Mycobacterium
GDWALRHSVAAWPAVCSGLRS

SEQ ID NO: 664379 - protein, 18 aa, Mycobacterium
GDWAPFDMATVFGDQKER

SEQ ID NO: 664380 - protein, 21 aa, Mycobacterium
GDWDVPIGGMGSVTAGLAAAA

SEQ ID NO: 664381 - protein, 23 aa, Mycobacterium
GDWDVPVGGMGSVTWALAAAAAR

SEQ ID NO: 664382 - protein, 20 aa, Mycobacterium
GDWGCSIASTARNNIVIEGE

SEQ ID NO: 664383 - protein, 24 aa, Mycobacterium
GDWLVDPQWWAARREHAAATVTHW

SEQ ID NO: 664384 - protein, 26 aa, Mycobacterium
GDWLYIPKACTWRQLPDTATTMLMIE

SEQ ID NO: 664385 - protein, 23 aa, Mycobacterium
GDWPGVRTQPLIPNELVPVVAPH

SEQ ID NO: 664386 - protein, 30 aa, Mycobacterium
GDWRQWWRWVPGACWRHPFGPHSDLTDRAD

SEQ ID NO: 664387 - protein, 22 aa, Mycobacterium
GDWRTKHHFFRDNARLREELAG

SEQ ID NO: 664388 - protein, 18 aa, Mycobacterium
GDWSRPEARVTIPARTTL

SEQ ID NO: 664389 - protein, 26 aa, Mycobacterium
GDWVYIPKACTWRQIPDSETTLLMVE

SEQ ID NO: 664390 - protein, 23 aa, Mycobacterium
GDYAHRLREFTAFDNFSDAELEL

SEQ ID NO: 664391 - protein, 18 aa, Mycobacterium
GDYEFEMGIGKPPEHRPL

SEQ ID NO: 664392 - protein, 17 aa, Mycobacterium
GDYETWKHIAPVQRAAW

SEQ ID NO: 664393 - protein, 20 aa, Mycobacterium
GDYFDGLRAGVWGDNRLSET

SEQ ID NO: 664394 - protein, 18 aa, Mycobacterium
GDYFKYTIDHLFGTIWTR

SEQ ID NO: 664395 - protein, 19 aa, Mycobacterium
GDYFQCGYLIGKGTDSQMR

SEQ ID NO: 664396 - protein, 25 aa, Mycobacterium
GDYFSFYLCDLLLKVNGKGGQPVYI

SEQ ID NO: 664397 - protein, 21 aa, Mycobacterium
GDYGYEITGWATPADHDRSAG

SEQ ID NO: 664398 - protein, 23 aa, Mycobacterium
GDYHAAVNMARRLPGVDPTRIVL

SEQ ID NO: 664399 - protein, 17 aa, Mycobacterium
GDYHLAKIVGWTLLGHP

SEQ ID NO: 664400 - protein, 19 aa, Mycobacterium
GDYIRRWVPELSAATDAHL

SEQ ID NO: 664401 - protein, 22 aa, Mycobacterium
GDYLRAGAIARFAPVMRSVVDA

SEQ ID NO: 664402 - protein, 23 aa, Mycobacterium
GDYLRAGAIASFAPVMGEVVVAA

SEQ ID NO: 664403 - protein, 17 aa, Mycobacterium
GDYLSHWLDEGYAVVGS

SEQ ID NO: 664404 - protein, 29 aa, Mycobacterium
GDYNNGLLWRGDYQGNLGAFNYTVTVPTT

SEQ ID NO: 664405 - protein, 21 aa, Mycobacterium
GDYPAPAGWPADVPGLEIAGE

SEQ ID NO: 664406 - protein, 25 aa, Mycobacterium
GDYRARTAGLGIRGGAVVSGSFQGF

SEQ ID NO: 664407 - protein, 19 aa, Mycobacterium
GDYRFGQQIVVAHDGSDYL

SEQ ID NO: 664408 - protein, 21 aa, Mycobacterium
GDYRWAATLLDHIVFTDEQHA

SEQ ID NO: 664409 - protein, 20 aa, Mycobacterium
GDYWQCGFVIAKGSIEQARR

SEQ ID NO: 664410 - protein, 26 aa, Mycobacterium
GDYYGEQFMQWFLKEQVEEVALMDTL

SEQ ID NO: 664411 - protein, 17 aa, Mycobacterium
GEAAAGVVMLRPASPGT

SEQ ID NO: 664412 - protein, 27 aa, Mycobacterium
GEAAARLRLARALPLRVGDVGLLRDPG

SEQ ID NO: 664413 - protein, 18 aa, Mycobacterium
GEAAARRALSESLLVHPY

SEQ ID NO: 664414 - protein, 24 aa, Mycobacterium
GEAAAYRKLRAVVEPFAAELDAEL

SEQ ID NO: 664415 - protein, 18 aa, Mycobacterium
GEAACGTCHVVVDPQWSD

SEQ ID NO: 664416 - protein, 26 aa, Mycobacterium
GEAAEFLRWTAAQAPDAAGYWPAPAV

SEQ ID NO: 664417 - protein, 19 aa, Mycobacterium
GEAAELLYRESIAHYGHSR

SEQ ID NO: 664418 - protein, 24 aa, Mycobacterium
GEAAEMRDDLALLIKELEQACDKF

SEQ ID NO: 664419 - protein, 32 aa, Mycobacterium
GEAAGPFYDGAIFHRVIDGFMIQGGDPTGTGR

SEQ ID NO: 664420 - protein, 18 aa, Mycobacterium
GEAAISLQLAELGYTTVG

SEQ ID NO: 664421 - protein, 21 aa, Mycobacterium
GEAALLRLAEERQIPVLMNGM

SEQ ID NO: 664422 - protein, 21 aa, Mycobacterium
GEAALSGLRADGQWVELLPRT

SEQ ID NO: 664423 - protein, 20 aa, Mycobacterium
GEAAQFLRWTAAQAPEAAGY

SEQ ID NO: 664424 - protein, 21 aa, Mycobacterium
GEAAQSWPVVSADAGAPATLK

SEQ ID NO: 664425 - protein, 21 aa, Mycobacterium
GEAASLMWRHYLAGQTPSPES

SEQ ID NO: 664426 - protein, 22 aa, Mycobacterium
GEAATAVLAEWQRRSRAMAEPW

SEQ ID NO: 664427 - protein, 29 aa, Mycobacterium
GEAAVCPRFRVGLLRPRTEIVVLDLRSEG

SEQ ID NO: 664428 - protein, 23 aa, Mycobacterium
GEACPPALVDRWATNRTMINAYG

SEQ ID NO: 664429 - protein, 27 aa, Mycobacterium
GEACPPDLAQRWASGRALINAYGPTET

SEQ ID NO: 664430 - protein, 28 aa, Mycobacterium
GEACPPDLAQRWASGRALLNAYGPTETT

SEQ ID NO: 664431 - protein, 19 aa, Mycobacterium
GEACQRFSEIYRRPRGLFV

SEQ ID NO: 664432 - protein, 17 aa, Mycobacterium
GEADCRVVRGEWRGTIL

SEQ ID NO: 664433 - protein, 17 aa, Mycobacterium
GEADLILAKHRNGPTRT

SEQ ID NO: 664434 - protein, 26 aa, Mycobacterium
GEADPAGIIEFCRQHLAGFKCPRTVD

SEQ ID NO: 664435 - protein, 25 aa, Mycobacterium
GEADPRPALGSAYRRVAPVQPNHPT

SEQ ID NO: 664436 - protein, 22 aa, Mycobacterium
GEAEGAFLLCGFLMALADHQQG

SEQ ID NO: 664437 - protein, 19 aa, Mycobacterium
GEAEGVRFAYYEPPAGATV

SEQ ID NO: 664438 - protein, 20 aa, Mycobacterium
GEAEVLWTIAPPVGAEDFCA

SEQ ID NO: 664439 - protein, 26 aa, Mycobacterium
GEAFAPARAGAWLSHHPHTRLINMYG

SEQ ID NO: 664440 - protein, 22 aa, Mycobacterium
GEAFAPTRAHTWLSHHPHTRLI

SEQ ID NO: 664441 - protein, 20 aa, Mycobacterium
GEAFLPYAERITALLREATQ

SEQ ID NO: 664442 - protein, 23 aa, Mycobacterium
GEAFLRQRIAGYLSQRLQVEDWF

SEQ ID NO: 664443 - protein, 18 aa, Mycobacterium
GEAFRADLGKARRDIEAD

SEQ ID NO: 664444 - protein, 19 aa, Mycobacterium
GEAGARVVSVLDYSGMAGQ

SEQ ID NO: 664445 - protein, 21 aa, Mycobacterium
GEAGLPDIAWFAADGSEMADE

SEQ ID NO: 664446 - protein, 17 aa, Mycobacterium
GEAGPRDSRGWETDLLA

SEQ ID NO: 664447 - protein, 17 aa, Mycobacterium
GEAGWRVVSVNQNGVDT

SEQ ID NO: 664448 - protein, 21 aa, Mycobacterium
GEAHEMLSLPGGVSAAASART

SEQ ID NO: 664449 - protein, 20 aa, Mycobacterium
GEAIACAKKIMALPQQAVEA

SEQ ID NO: 664450 - protein, 25 aa, Mycobacterium
GEAIARTLAAQGFHVICVARREGPI

SEQ ID NO: 664451 - protein, 17 aa, Mycobacterium
GEAIPAQAIAQVCELNW

SEQ ID NO: 664452 - protein, 25 aa, Mycobacterium
GEAKDFIAGGAIEIGGKLPINTHGG

SEQ ID NO: 664453 - protein, 26 aa, Mycobacterium
GEAKDFIAGGAIEIGGRLPINTHGGQ

SEQ ID NO: 664454 - protein, 26 aa, Mycobacterium
GEALAADIRRADCQFVVTDAEHRPLL

SEQ ID NO: 664455 - protein, 24 aa, Mycobacterium
GEALAADIRRAECQIIVTDAENRS

SEQ ID NO: 664456 - protein, 22 aa, Mycobacterium
GEALAADVRRAHCQFLVTDAEH

SEQ ID NO: 664457 - protein, 17 aa, Mycobacterium
GEALASIGGAPPELSAI

SEQ ID NO: 664458 - protein, 32 aa, Mycobacterium
GEALESWLGAIARRLETPWGHLLAALEPTPAD

SEQ ID NO: 664459 - protein, 20 aa, Mycobacterium
GEALGKLYVERHFPPQAKAR

SEQ ID NO: 664460 - protein, 17 aa, Mycobacterium
GEALGLRRGDLHLLPDS

SEQ ID NO: 664461 - protein, 25 aa, Mycobacterium
GEALISGLLRAGRQAKDIVVSEKVP

SEQ ID NO: 664462 - protein, 33 aa, Mycobacterium
GEALLAAKFMGRWRSGAPLVLAPECDDPALGAD

SEQ ID NO: 664463 - protein, 25 aa, Mycobacterium
GEALLSGLLRAGRQVKDLVVAERVP

SEQ ID NO: 664464 - protein, 25 aa, Mycobacterium
GEALLSGLLRAGRQVKDLVVVERVP

SEQ ID NO: 664465 - protein, 20 aa, Mycobacterium
GEALPGPVADKFHATFDASL

SEQ ID NO: 664466 - protein, 25 aa, Mycobacterium
GEALREFGVRVLVVRPGQVRTTTTI

SEQ ID NO: 664467 - protein, 26 aa, Mycobacterium
GEALREYGVRVLVIRPGQVRTRMSAH

SEQ ID NO: 664468 - protein, 19 aa, Mycobacterium
GEALRLLGTYLARAVADAS

SEQ ID NO: 664469 - protein, 18 aa, Mycobacterium
GEALRPMDAGVFAQKALR

SEQ ID NO: 664470 - protein, 24 aa, Mycobacterium
GEALRRIGEGAAMIRSKGEAGTGD

SEQ ID NO: 664471 - protein, 22 aa, Mycobacterium
GEALRYVERVGVERIAAYEHAL

SEQ ID NO: 664472 - protein, 19 aa, Mycobacterium
GEALSLVGKRGRVVVTAIG

SEQ ID NO: 664473 - protein, 21 aa, Mycobacterium
GEALVPFVGAIVTSVSLDDRV

SEQ ID NO: 664474 - protein, 18 aa, Mycobacterium
GEALVRRLLADRGESHVL

SEQ ID NO: 664475 - protein, 27 aa, Mycobacterium
GEANRAWRLYRRLGFTDVIREYHFAGD

SEQ ID NO: 664476 - protein, 30 aa, Mycobacterium
GEANRAWRLYRRLGFTDVIRGYHFAGDPRA

SEQ ID NO: 664477 - protein, 31 aa, Mycobacterium
GEAPAKAWEHGRFNAPYLRDALLSAGALCET

SEQ ID NO: 664478 - protein, 19 aa, Mycobacterium
GEAPARVFLEAGYDEDKSL

SEQ ID NO: 664479 - protein, 25 aa, Mycobacterium
GEAPDGRGARPPWSIGEPQPEIAML

SEQ ID NO: 664480 - protein, 25 aa, Mycobacterium
GEAPDLPGAFYRPTLIADVDESSEV

SEQ ID NO: 664481 - protein, 21 aa, Mycobacterium
GEAPDNWQLIISDIADSELPD

SEQ ID NO: 664482 - protein, 17 aa, Mycobacterium
GEAPLAFEGTAEPSAIF

SEQ ID NO: 664483 - protein, 18 aa, Mycobacterium
GEAPPARSAAHVTYGAAL

SEQ ID NO: 664484 - protein, 17 aa, Mycobacterium
GEAPRLLLLGSAMHADA

SEQ ID NO: 664485 - protein, 18 aa, Mycobacterium
GEAPRYIRVIPYVEDHRN

SEQ ID NO: 664486 - protein, 19 aa, Mycobacterium
GEAPWKPMLGMTGPTALEL

SEQ ID NO: 664487 - protein, 20 aa, Mycobacterium
GEAQPLLRPVLRPQSYANQL

SEQ ID NO: 664488 - protein, 22 aa, Mycobacterium
GEARAPALLPGFGPLPTGSLRE

SEQ ID NO: 664489 - protein, 21 aa, Mycobacterium
GEARIEKLVERFKRVLEAMTV

SEQ ID NO: 664490 - protein, 23 aa, Mycobacterium
GEARLAFVCTGMGPQWWQMCRGL

SEQ ID NO: 664491 - protein, 30 aa, Mycobacterium
GEARRRADVAGHFRYPFPAEFGGRDGSNLG

SEQ ID NO: 664492 - protein, 18 aa, Mycobacterium
GEARRTVSVEAFLRQRTV

SEQ ID NO: 664493 - protein, 29 aa, Mycobacterium
GEARTAANVDKSWLGVNVHDIISTELGGQ

SEQ ID NO: 664494 - protein, 21 aa, Mycobacterium
GEARTAIAMASNAQRVVVAVD

SEQ ID NO: 664495 - protein, 18 aa, Mycobacterium
GEARVLVATDIAARGVHV

SEQ ID NO: 664496 - protein, 26 aa, Mycobacterium
GEASDIAEAIAFLVSDRAAWITATNL

SEQ ID NO: 664497 - protein, 19 aa, Mycobacterium
GEASEMWAMEQQKLNSRGE

SEQ ID NO: 664498 - protein, 22 aa, Mycobacterium
GEATARLLAARGASVVLGARRT

SEQ ID NO: 664499 - protein, 18 aa, Mycobacterium
GEATLTITAMPAKHATDG

SEQ ID NO: 664500 - protein, 21 aa, Mycobacterium
GEAVASVHACLAHELGTEEVP

SEQ ID NO: 664501 - protein, 17 aa, Mycobacterium
GEAVLFIAGRGGAGRTW

SEQ ID NO: 664502 - protein, 20 aa, Mycobacterium
GEAVNAIARMYADTDVAVAR

SEQ ID NO: 664503 - protein, 17 aa, Mycobacterium
GEAVTFYAKLFNTQPAK

SEQ ID NO: 664504 - protein, 18 aa, Mycobacterium
GEAYAKYNIRRSVKDREL

SEQ ID NO: 664505 - protein, 25 aa, Mycobacterium
GECADPPKTAWLFTGQGSQYPGMAR

SEQ ID NO: 664506 - protein, 22 aa, Mycobacterium
GECCRLRKVVPLRKSLAGYAAW

SEQ ID NO: 664507 - protein, 17 aa, Mycobacterium
GECDLAIVAGVNLMLTP

SEQ ID NO: 664508 - protein, 21 aa, Mycobacterium
GECDLYLGCDLLVAADAKNLA

SEQ ID NO: 664509 - protein, 21 aa, Mycobacterium
GECDPIRDWGERYADRLRAAR

SEQ ID NO: 664510 - protein, 21 aa, Mycobacterium
GECDPIRDWGERYAQRLRDAR

SEQ ID NO: 664511 - protein, 17 aa, Mycobacterium
GECHVHAGINGDELAGQ

SEQ ID NO: 664512 - protein, 17 aa, Mycobacterium
GECRTRNLPLVGAPANP

SEQ ID NO: 664513 - protein, 19 aa, Mycobacterium
GECSMALAGGVMVMAVPST

SEQ ID NO: 664514 - protein, 17 aa, Mycobacterium
GECSMALAGGVTAMATP

SEQ ID NO: 664515 - protein, 19 aa, Mycobacterium
GECSMALAGGVTVMATPDV

SEQ ID NO: 664516 - protein, 24 aa, Mycobacterium
GECVTARTALTMFLGHSDEPGRAR

SEQ ID NO: 664517 - protein, 20 aa, Mycobacterium
GEDALALLLCYRQRRWYLEG

SEQ ID NO: 664518 - protein, 17 aa, Mycobacterium
GEDCDRLGLLPQYAVNQ

SEQ ID NO: 664519 - protein, 22 aa, Mycobacterium
GEDCLRLNIWAPAGVEPGDGKP

SEQ ID NO: 664520 - protein, 22 aa, Mycobacterium
GEDCLRLNVWASSETRPGDAKP

SEQ ID NO: 664521 - protein, 24 aa, Mycobacterium
GEDDIPGLVLIPAAADKIEIPMIA

SEQ ID NO: 664522 - protein, 25 aa, Mycobacterium
GEDDRFAWSFAGAKHLKGIKSDVKS

SEQ ID NO: 664523 - protein, 25 aa, Mycobacterium
GEDEIAEVLRYCAHRSIAVVPFGGG

SEQ ID NO: 664524 - protein, 24 aa, Mycobacterium
GEDEVRRLARRAVEVAGGHIDILV

SEQ ID NO: 664525 - protein, 18 aa, Mycobacterium
GEDFFIRSVRQYRDQVSD

SEQ ID NO: 664526 - protein, 24 aa, Mycobacterium
GEDGEWPLFLDVWVEHVVEEVATA

SEQ ID NO: 664527 - protein, 17 aa, Mycobacterium
GEDGIRYLYAFGTPSGR

SEQ ID NO: 664528 - protein, 20 aa, Mycobacterium
GEDGPPFFQAYGEWMGTPPP

SEQ ID NO: 664529 - protein, 23 aa, Mycobacterium
GEDGRFRPAAGLAVLGASFDHNV

SEQ ID NO: 664530 - protein, 24 aa, Mycobacterium
GEDGRYRPAAALAVLGSSFDHNLR

SEQ ID NO: 664531 - protein, 24 aa, Mycobacterium
GEDGRYRPAAALAVLGSSFDNNVR

SEQ ID NO: 664532 - protein, 24 aa, Mycobacterium
GEDGRYRPAAGLAVLGASFDRNVR

SEQ ID NO: 664533 - protein, 25 aa, Mycobacterium
GEDGRYRPASGLAVLGASFDRNVRQ

SEQ ID NO: 664534 - protein, 20 aa, Mycobacterium
GEDIPELWKDLGAAGLLGVH

SEQ ID NO: 664535 - protein, 23 aa, Mycobacterium
GEDIRWALVPGTAVHRVLRICDP

SEQ ID NO: 664536 - protein, 20 aa, Mycobacterium
GEDIRYGLGAVRNVGANVVG

SEQ ID NO: 664537 - protein, 20 aa, Mycobacterium
GEDIRYGLGGVRNVGANVVQ

SEQ ID NO: 664538 - protein, 23 aa, Mycobacterium
GEDKAARAMAWARGQMAADPDNT

SEQ ID NO: 664539 - protein, 26 aa, Mycobacterium
GEDLSWLWDVRFEHFAEAFKTTPVVA

SEQ ID NO: 664540 - protein, 22 aa, Mycobacterium
GEDLSWLWDVRFEHFEETAVVA

SEQ ID NO: 664541 - protein, 26 aa, Mycobacterium
GEDLSWLWDVRFEHFEKAQVVAAGER

SEQ ID NO: 664542 - protein, 26 aa, Mycobacterium
GEDRFDAVVCSLVLCSVGDPDRAAAQ

SEQ ID NO: 664543 - protein, 23 aa, Mycobacterium
GEDRKFLGLGPQFAAPREDAIRQ

SEQ ID NO: 664544 - protein, 23 aa, Mycobacterium
GEDRKSLTFALRFRAPDRTLTED

SEQ ID NO: 664545 - protein, 22 aa, Mycobacterium
GEDRRGLVTLGMTPVVNAQLDD

SEQ ID NO: 664546 - protein, 24 aa, Mycobacterium
GEDRRPTLSWPRDVPLAGEPAEVV

SEQ ID NO: 664547 - protein, 24 aa, Mycobacterium
GEEAARKVWLGIAMHTTPGVPEFL

SEQ ID NO: 664548 - protein, 29 aa, Mycobacterium
GEEAIKREIFRLVGLDWKGFTSAVILPQG

SEQ ID NO: 664549 - protein, 17 aa, Mycobacterium
GEECAFDLRLIAPQLPP

SEQ ID NO: 664550 - protein, 19 aa, Mycobacterium
GEEDLFWLGTDEALALGRS

SEQ ID NO: 664551 - protein, 24 aa, Mycobacterium
GEEEAFSHIDLMDFSGNVEGAQQA

SEQ ID NO: 664552 - protein, 24 aa, Mycobacterium
GEEEAFSHIDLVDFSGNIEGARQA

SEQ ID NO: 664553 - protein, 22 aa, Mycobacterium
GEEFARILSQRGYQVVLVARSA

SEQ ID NO: 664554 - protein, 19 aa, Mycobacterium
GEEGIGFTIAMRGLNGGRL

SEQ ID NO: 664555 - protein, 19 aa, Mycobacterium
GEEGKPVFIVYRYEDAQQM

SEQ ID NO: 664556 - protein, 25 aa, Mycobacterium
GEEHPLRPGTMYLLNGHERHRVTCD

SEQ ID NO: 664557 - protein, 20 aa, Mycobacterium
GEEICAWIRMKPGRPPLDAD

SEQ ID NO: 664558 - protein, 21 aa, Mycobacterium
GEEKWRWRLDYPMAASVLATA

SEQ ID NO: 664559 - protein, 23 aa, Mycobacterium
GEELARILAQRGYQVVLVARSAD

SEQ ID NO: 664560 - protein, 19 aa, Mycobacterium
GEELVAWADRALALAERDS

SEQ ID NO: 664561 - protein, 22 aa, Mycobacterium
GEEPFMMVFDLLDLTAYGRQES

SEQ ID NO: 664562 - protein, 24 aa, Mycobacterium
GEEPRHLELPAHDYAAVLRNSGTN

SEQ ID NO: 664563 - protein, 21 aa, Mycobacterium
GEETEAMFARACRAGGSRFHA

SEQ ID NO: 664564 - protein, 28 aa, Mycobacterium
GEEVAPWLDLVRKLGLLVGALSAELPTN

SEQ ID NO: 664565 - protein, 29 aa, Mycobacterium
GEEVAPWLELVRKLGLLVGALADAPPVSL

SEQ ID NO: 664566 - protein, 23 aa, Mycobacterium
GEEYELRQGRRYAVARRLAGLFA

SEQ ID NO: 664567 - protein, 18 aa, Mycobacterium
GEFACSDPDMALRQLIME

SEQ ID NO: 664568 - protein, 18 aa, Mycobacterium
GEFDEWQRLYLFTRADTI

SEQ ID NO: 664569 - protein, 20 aa, Mycobacterium
GEFHRCQRRLLQPAFHHRQT

SEQ ID NO: 664570 - protein, 19 aa, Mycobacterium
GEFMMLYAFGVGEAAISIS

SEQ ID NO: 664571 - protein, 20 aa, Mycobacterium
GEFMMLYAFGVGEAAISISG

SEQ ID NO: 664572 - protein, 17 aa, Mycobacterium
GEFPGAALHEFADSPHD

SEQ ID NO: 664573 - protein, 17 aa, Mycobacterium
GEFQRRASVLGRHLRTR

SEQ ID NO: 664574 - protein, 23 aa, Mycobacterium
GEFRAVGYKSIYEDVEHVALVRG

SEQ ID NO: 664575 - protein, 25 aa, Mycobacterium
GEFRRLAARHSVYWITIKDAPLVGV

SEQ ID NO: 664576 - protein, 23 aa, Mycobacterium
GEFTARFGEIAGRYFREAFDRVD

SEQ ID NO: 664577 - protein, 17 aa, Mycobacterium
GEFTHLLPWEIPALPPA

SEQ ID NO: 664578 - protein, 17 aa, Mycobacterium
GEFTRRDFGLIYQARPR

SEQ ID NO: 664579 - protein, 18 aa, Mycobacterium
GEFVDFDPIYSWPKPVQQ

SEQ ID NO: 664580 - protein, 24 aa, Mycobacterium
GEFVNFGPSWAWPKTVQKHVPVIV

SEQ ID NO: 664581 - protein, 20 aa, Mycobacterium
GEGADLPLWLFGSSKGESAQ

SEQ ID NO: 664582 - protein, 20 aa, Mycobacterium
GEGAELMWRHYLDPKAAPEA

SEQ ID NO: 664583 - protein, 19 aa, Mycobacterium
GEGAGLVLLERLSDARRNR

SEQ ID NO: 664584 - protein, 29 aa, Mycobacterium
GEGARRFGGRWNPPLLFSAIYLADSAQAC

SEQ ID NO: 664585 - protein, 17 aa, Mycobacterium
GEGARWGLTKADIVSNI

SEQ ID NO: 664586 - protein, 23 aa, Mycobacterium
GEGCRCIAPTWPLGAHSTPTGGA

SEQ ID NO: 664587 - protein, 21 aa, Mycobacterium
GEGDTAPGRKVWAQLTDLGVT

SEQ ID NO: 664588 - protein, 33 aa, Mycobacterium
GEGEGFAISQARLGPGRIHHCMRAIGMAERALE

SEQ ID NO: 664589 - protein, 19 aa, Mycobacterium
GEGELPLRDILSVLPSDIV

SEQ ID NO: 664590 - protein, 24 aa, Mycobacterium
GEGELYFPGSPVLSVHGTFGECVV

SEQ ID NO: 664591 - protein, 26 aa, Mycobacterium
GEGERRAEGRFALYSVADAHEDASAL

SEQ ID NO: 664592 - protein, 21 aa, Mycobacterium
GEGEVRRMLLWHAFEEAEHRS

SEQ ID NO: 664593 - protein, 20 aa, Mycobacterium
GEGFAVNVFLRVPDPAGDPD

SEQ ID NO: 664594 - protein, 22 aa, Mycobacterium
GEGFFINQLITWTVGDGETVAE

SEQ ID NO: 664595 - protein, 21 aa, Mycobacterium
GEGFGAWQLGDDDAMLEIVTS

SEQ ID NO: 664596 - protein, 22 aa, Mycobacterium
GEGFGAWRLGDDDAMLDVVTSA

SEQ ID NO: 664597 - protein, 19 aa, Mycobacterium
GEGGAPVWHELNTREYDRA

SEQ ID NO: 664598 - protein, 21 aa, Mycobacterium
GEGGDTLWLAEHGWEVVGVDI

SEQ ID NO: 664599 - protein, 24 aa, Mycobacterium
GEGGGGIPLIAHFTLLGDTKATTI

SEQ ID NO: 664600 - protein, 20 aa, Mycobacterium
GEGGLRAMRGFLSTSPHDKT

SEQ ID NO: 664601 - protein, 22 aa, Mycobacterium
GEGGMGGEGRTDGSSGGTATGG

SEQ ID NO: 664602 - protein, 27 aa, Mycobacterium
GEGGRFRRNHCVPMPVVDSIDELNALL

SEQ ID NO: 664603 - protein, 19 aa, Mycobacterium
GEGGSSWGNQMRSYVLHPY

SEQ ID NO: 664604 - protein, 19 aa, Mycobacterium
GEGGWQIAVVRHGQLAGAA

SEQ ID NO: 664605 - protein, 18 aa, Mycobacterium
GEGHADWVRVNGFGTEWW

SEQ ID NO: 664606 - protein, 22 aa, Mycobacterium
GEGKRLYPLTADRAKPAVPFGG

SEQ ID NO: 664607 - protein, 23 aa, Mycobacterium
GEGKRLYPLTADRAKPAVPFGGG

SEQ ID NO: 664608 - protein, 23 aa, Mycobacterium
GEGLKRVSLELGGKSAAIILDDA

SEQ ID NO: 664609 - protein, 19 aa, Mycobacterium
GEGLLVQRLAAVSHRVVGI

SEQ ID NO: 664610 - protein, 26 aa, Mycobacterium
GEGLTEAIIIKWLVSVGDTVVIDQPV

SEQ ID NO: 664611 - protein, 20 aa, Mycobacterium
GEGLVRRFVAEGAQVMIGDV

SEQ ID NO: 664612 - protein, 19 aa, Mycobacterium
GEGMASLARELRYQDTSQL

SEQ ID NO: 664613 - protein, 25 aa, Mycobacterium
GEGMKLRPGLVIAIEPMLIADGTED

SEQ ID NO: 664614 - protein, 21 aa, Mycobacterium
GEGNMPIAAMGRVGNADEVAG

SEQ ID NO: 664615 - protein, 31 aa, Mycobacterium
GEGPAQAWERGRYAAPYLRDSLLAAGALCET

SEQ ID NO: 664616 - protein, 31 aa, Mycobacterium
GEGPAQSWEHGRFSAPYLRDSLLAAGALCET

SEQ ID NO: 664617 - protein, 22 aa, Mycobacterium
GEGPRGISAFIVEKDSAGLSFG

SEQ ID NO: 664618 - protein, 24 aa, Mycobacterium
GEGQLKALITVAGNPVLSTPGGDK

SEQ ID NO: 664619 - protein, 22 aa, Mycobacterium
GEGRGSLIVKYLAERRLQDDKV

SEQ ID NO: 664620 - protein, 21 aa, Mycobacterium
GEGRKLLAFSDSRQAAAYFAP

SEQ ID NO: 664621 - protein, 23 aa, Mycobacterium
GEGRLLAVLGYFAALLYNGAGRY

SEQ ID NO: 664622 - protein, 17 aa, Mycobacterium
GEGRLLGAMGYAAGVLN

SEQ ID NO: 664623 - protein, 21 aa, Mycobacterium
GEGRLTGLITVKDFAKTEQHP

SEQ ID NO: 664624 - protein, 23 aa, Mycobacterium
GEGRMLKRLRRVADYVNTLSDEI

SEQ ID NO: 664625 - protein, 22 aa, Mycobacterium
GEGRMVKRLKGVADYVNTLSDD

SEQ ID NO: 664626 - protein, 17 aa, Mycobacterium
GEGRQGRRGRRFRDRRR

SEQ ID NO: 664627 - protein, 17 aa, Mycobacterium
GEGRWTVEEAIRLRVPV

SEQ ID NO: 664628 - protein, 30 aa, Mycobacterium
GEGSRGAPKVKIRGFSFWGGVGIKRKARKP

SEQ ID NO: 664629 - protein, 18 aa, Mycobacterium
GEGVGFSGVVLTKLDGDA

SEQ ID NO: 664630 - protein, 18 aa, Mycobacterium
GEGVTFRQLCEVAHEVRE

SEQ ID NO: 664631 - protein, 23 aa, Mycobacterium
GEGWFINQHITWRVGDEDVAEMA

SEQ ID NO: 664632 - protein, 17 aa, Mycobacterium
GEGWRHLSDWPPKTTDH

SEQ ID NO: 664633 - protein, 20 aa, Mycobacterium
GEGYASVSYRALASAAGVTP

SEQ ID NO: 664634 - protein, 23 aa, Mycobacterium
GEGYAVRALRRLEQLRGIAYTNE

SEQ ID NO: 664635 - protein, 17 aa, Mycobacterium
GEGYLAWSQLDTSAARY

SEQ ID NO: 664636 - protein, 17 aa, Mycobacterium
GEGYPVVLNTGRLQHHW

SEQ ID NO: 664637 - protein, 24 aa, Mycobacterium
GEHADRLAALMITYPSTHGVYEHD

SEQ ID NO: 664638 - protein, 27 aa, Mycobacterium
GEHAVHPTMWIRMWFSDGDKSHQRGYT

SEQ ID NO: 664639 - protein, 26 aa, Mycobacterium
GEHCPMCAAAHAWVGLGRIVYATSSA

SEQ ID NO: 664640 - protein, 27 aa, Mycobacterium
GEHCPMCAAAHAWVGLGRVVYAASSVQ

SEQ ID NO: 664641 - protein, 26 aa, Mycobacterium
GEHCPMCSAAHAWVGLGRIVYASSSA

SEQ ID NO: 664642 - protein, 23 aa, Mycobacterium
GEHEAALRIVDWLDAAGAQHARI

SEQ ID NO: 664643 - protein, 18 aa, Mycobacterium
GEHGKYLLAATFGNVHGV

SEQ ID NO: 664644 - protein, 17 aa, Mycobacterium
GEHGVEGSIAREGGLKK

SEQ ID NO: 664645 - protein, 26 aa, Mycobacterium
GEHGVPIYRGREVTGFTSSDDAVRVE

SEQ ID NO: 664646 - protein, 21 aa, Mycobacterium
GEHHPHLLPLADRVLESTDVE

SEQ ID NO: 664647 - protein, 26 aa, Mycobacterium
GEHIACPWHGWQWRGDGTNALIPYSK

SEQ ID NO: 664648 - protein, 18 aa, Mycobacterium
GEHIRAFPLSNWTEFDIW

SEQ ID NO: 664649 - protein, 18 aa, Mycobacterium
GEHIRVFPLSNWTEFDIW

SEQ ID NO: 664650 - protein, 26 aa, Mycobacterium
GEHIVCPWHGWQWRGDGTNALIPYSK

SEQ ID NO: 664651 - protein, 24 aa, Mycobacterium
GEHKRLECLEVTLSEKSQTYPLFQ

SEQ ID NO: 664652 - protein, 22 aa, Mycobacterium
GEHLFDPLIDWHASKELDWLYP

SEQ ID NO: 664653 - protein, 19 aa, Mycobacterium
GEHLKTWSRATGIVLDGPN

SEQ ID NO: 664654 - protein, 17 aa, Mycobacterium
GEIAARLFYAYADILLA

SEQ ID NO: 664655 - protein, 19 aa, Mycobacterium
GEIACKLGRTTGYSCGVTW

SEQ ID NO: 664656 - protein, 19 aa, Mycobacterium
GEIACRPKRAHVMSEGYVG

SEQ ID NO: 664657 - protein, 22 aa, Mycobacterium
GEIAEHPIVVWAPPRHSFYTDL

SEQ ID NO: 664658 - protein, 24 aa, Mycobacterium
GEIAKRTGAEFVVVSGDVFEHNQL

SEQ ID NO: 664659 - protein, 24 aa, Mycobacterium
GEIARCIAEMVSLPVPTVSVLLGQ

SEQ ID NO: 664660 - protein, 23 aa, Mycobacterium
GEIARCLAELVTLDTPTVSVLLG

SEQ ID NO: 664661 - protein, 24 aa, Mycobacterium
GEIARRAGAHLVRHPINLGQGAAI

SEQ ID NO: 664662 - protein, 21 aa, Mycobacterium
GEIATRHRLDLTVVNPLVDAT

SEQ ID NO: 664663 - protein, 25 aa, Mycobacterium
GEIDESLTLRPSRGTHLVFDAAALG

SEQ ID NO: 664664 - protein, 23 aa, Mycobacterium
GEIDGRLYMCMRLIEGRDLQSVL

SEQ ID NO: 664665 - protein, 24 aa, Mycobacterium
GEIDWSKVHIYWGDERFVPQDDDE

SEQ ID NO: 664666 - protein, 17 aa, Mycobacterium
GEIEAGMLILPIDDEDL

SEQ ID NO: 664667 - protein, 21 aa, Mycobacterium
GEIELHAALTVGRVIRRESWV

SEQ ID NO: 664668 - protein, 22 aa, Mycobacterium
GEIEWAKASLIGPEDYPSEVAA

SEQ ID NO: 664669 - protein, 17 aa, Mycobacterium
GEIFALELARPLISLGT

SEQ ID NO: 664670 - protein, 19 aa, Mycobacterium
GEIFSCFSMTEPQGGADPR

SEQ ID NO: 664671 - protein, 23 aa, Mycobacterium
GEIGQDLAALAFDALGGRDTGAP

SEQ ID NO: 664672 - protein, 21 aa, Mycobacterium
GEIHPDLAPRPGDIVAQEHWC

SEQ ID NO: 664673 - protein, 18 aa, Mycobacterium
GEIHVFHGKAIVLATGGS

SEQ ID NO: 664674 - protein, 17 aa, Mycobacterium
GEIKADVDVDVFRRLLG

SEQ ID NO: 664675 - protein, 25 aa, Mycobacterium
GEILERSLVHLGLKHYFLVDFPQEP

SEQ ID NO: 664676 - protein, 26 aa, Mycobacterium
GEILERSLVHLGLKHYFLVDFPQEPG

SEQ ID NO: 664677 - protein, 20 aa, Mycobacterium
GEILMPIFVSEDAKEGAKAF

SEQ ID NO: 664678 - protein, 25 aa, Mycobacterium
GEILWWSQRDGWGHLYLYSADGVQV

SEQ ID NO: 664679 - protein, 19 aa, Mycobacterium
GEINFCGAIEMGGFIDMHV

SEQ ID NO: 664680 - protein, 21 aa, Mycobacterium
GEIPPRLKDLVTLPGIGRKTA

SEQ ID NO: 664681 - protein, 22 aa, Mycobacterium
GEIQLLPVTKFFPASDVEELYR

SEQ ID NO: 664682 - protein, 17 aa, Mycobacterium
GEIRLVLHGGHIAVNGR

SEQ ID NO: 664683 - protein, 17 aa, Mycobacterium
GEIRLVLHGGHISVNGR

SEQ ID NO: 664684 - protein, 21 aa, Mycobacterium
GEIRRRAPLLGEHTDEILEEI

SEQ ID NO: 664685 - protein, 31 aa, Mycobacterium
GEIRTIVWATGFRPDLSWIDAPIFDRKSRAR

SEQ ID NO: 664686 - protein, 27 aa, Mycobacterium
GEIRWFDIDPCYIFHVVNAYEHGNTVV

SEQ ID NO: 664687 - protein, 21 aa, Mycobacterium
GEISLPRWVEICSTTPARMFG

SEQ ID NO: 664688 - protein, 21 aa, Mycobacterium
GEITFCGAIEMGGFIDLHVDV

SEQ ID NO: 664689 - protein, 20 aa, Mycobacterium
GEITFCGAIEMGGFIDVHVD

SEQ ID NO: 664690 - protein, 22 aa, Mycobacterium
GEITNLLLLRGMIGKPGAGVCP

SEQ ID NO: 664691 - protein, 17 aa, Mycobacterium
GEITWEVAGSLAGAGGT

SEQ ID NO: 664692 - protein, 27 aa, Mycobacterium
GEITYAAEFFRHFAAEAVRIDGGYQTA

SEQ ID NO: 664693 - protein, 21 aa, Mycobacterium
GEIVCRGDVVMSGYWNNLGAT

SEQ ID NO: 664694 - protein, 22 aa, Mycobacterium
GEIVDARFAIRDNYTELLIKDG

SEQ ID NO: 664695 - protein, 17 aa, Mycobacterium
GEIVDRFVVGASGSGAA

SEQ ID NO: 664696 - protein, 18 aa, Mycobacterium
GEIVPVFQPIFDLITGEV

SEQ ID NO: 664697 - protein, 20 aa, Mycobacterium
GEIVSLKIGCVEVIDGQHNL

SEQ ID NO: 664698 - protein, 20 aa, Mycobacterium
GEIVVAFVVTNGTPVDAAAL

SEQ ID NO: 664699 - protein, 24 aa, Mycobacterium
GEIWVCGDNVAIGYWNKPEESERT

SEQ ID NO: 664700 - protein, 22 aa, Mycobacterium
GEIYFEGGYDFEYLNDPDKTAS

SEQ ID NO: 664701 - protein, 22 aa, Mycobacterium
GEIYIALAGRVARAVVAESPGV

SEQ ID NO: 664702 - protein, 18 aa, Mycobacterium
GEIYIVMEAGAEMGKYQG

SEQ ID NO: 664703 - protein, 25 aa, Mycobacterium
GEIYKIPEPFLVLATQNPVDQEGTY

SEQ ID NO: 664704 - protein, 21 aa, Mycobacterium
GEIYQRLSSQLSTFHDQFAAA

SEQ ID NO: 664705 - protein, 22 aa, Mycobacterium
GEIYYAGGYPFEYLNDQAKTAA

SEQ ID NO: 664706 - protein, 21 aa, Mycobacterium
GEKAFRIGRLCTKRSARGQGH

SEQ ID NO: 664707 - protein, 22 aa, Mycobacterium
GEKAIWIYAPMVKKVEVEDANG

SEQ ID NO: 664708 - protein, 25 aa, Mycobacterium
GEKDLLRLPGLVAIAYQHETSRAGD

SEQ ID NO: 664709 - protein, 20 aa, Mycobacterium
GEKDLSLALALGGAVSVDLP

SEQ ID NO: 664710 - protein, 21 aa, Mycobacterium
GEKEALIQNWVRSQNVVNTAI

SEQ ID NO: 664711 - protein, 25 aa, Mycobacterium
GEKESRGMLHHRWVEKEAAGVVAAI

SEQ ID NO: 664712 - protein, 26 aa, Mycobacterium
GEKFHFPARIARPLSHDFADDDPAKL

SEQ ID NO: 664713 - protein, 26 aa, Mycobacterium
GEKKTFRIAAHWADHLNIVAALDELP

SEQ ID NO: 664714 - protein, 22 aa, Mycobacterium
GEKLELRRATYFDGQVETYLHK

SEQ ID NO: 664715 - protein, 25 aa, Mycobacterium
GEKLELRRVAIFGGTVETYLHRRAA

SEQ ID NO: 664716 - protein, 25 aa, Mycobacterium
GEKLWEFNCGSGHHGSCSTYSVDGK

SEQ ID NO: 664717 - protein, 19 aa, Mycobacterium
GEKRRCLGDLAYAAMPYLA

SEQ ID NO: 664718 - protein, 24 aa, Mycobacterium
GEKRRVALCKLLLSKPDLLLLDEP

SEQ ID NO: 664719 - protein, 32 aa, Mycobacterium; identical to SEQ ID NO: 144829

SEQ ID NO: 664720 - protein, 32 aa, Mycobacterium
GEKRSWLRTRGLKIFPLVGWAERGGYDAQGHG

SEQ ID NO: 664721 - protein, 21 aa, Mycobacterium
GEKVFRIGRVCTKRSARGQGH

SEQ ID NO: 664722 - protein, 17 aa, Mycobacterium
GELAALYAPDTVVEHPL

SEQ ID NO: 664723 - protein, 25 aa, Mycobacterium
GELACRELVSLLSFVMDAQGALASL

SEQ ID NO: 664724 - protein, 17 aa, Mycobacterium
GELAGGYGLANATRTET

SEQ ID NO: 664725 - protein, 17 aa, Mycobacterium
GELAGRIVDAMVDLLAT

SEQ ID NO: 664726 - protein, 25 aa, Mycobacterium
GELAHLRLGLMHGRLSGDEKDAVMA

SEQ ID NO: 664727 - protein, 18 aa, Mycobacterium
GELALLRLACEAADAALS

SEQ ID NO: 664728 - protein, 18 aa, Mycobacterium
GELALLRLACEAADAALT

SEQ ID NO: 664729 - protein, 19 aa, Mycobacterium
GELALPLIRTLLTEAEENG

SEQ ID NO: 664730 - protein, 25 aa, Mycobacterium
GELANLRLGLMHGRLSAEQKDAAMA

SEQ ID NO: 664731 - protein, 19 aa, Mycobacterium
GELAPAVRLVVVADGPATS

SEQ ID NO: 664732 - protein, 34 aa, Mycobacterium
GELARLNAIYLLWRLKESPHWPAIRDALAALSDY

SEQ ID NO: 664733 - protein, 30 aa, Mycobacterium
GELASLLRFVLELLGDYGLEDFYLELSTKD

SEQ ID NO: 664734 - protein, 28 aa, Mycobacterium
GELAVAIVPVPWRLSLKAVAAALGVPKA

SEQ ID NO: 664735 - protein, 17 aa, Mycobacterium
GELAVALHADFPPERIT

SEQ ID NO: 664736 - protein, 24 aa, Mycobacterium
GELAVALHAGFPAERITVHGNNKS

SEQ ID NO: 664737 - protein, 24 aa, Mycobacterium
GELAVALHAGFPASRITVHGNNKS

SEQ ID NO: 664738 - protein, 29 aa, Mycobacterium
GELAVALHAGFPPERITFHGNNKSVAELT

SEQ ID NO: 664739 - protein, 17 aa, Mycobacterium
GELAVALHANFPPERIT

SEQ ID NO: 664740 - protein, 23 aa, Mycobacterium
GELCVIRSGFGLEVAKTADVKVE

SEQ ID NO: 664741 - protein, 23 aa, Mycobacterium
GELDAGWRVAQFILSCERGPIFW

SEQ ID NO: 664742 - protein, 20 aa, Mycobacterium
GELDETFHLARLDGYDVVYL

SEQ ID NO: 664743 - protein, 17 aa, Mycobacterium
GELDGVRILRPETLRAA

SEQ ID NO: 664744 - protein, 24 aa, Mycobacterium
GELDKRWTIGPKVHGGAMLALCAN

SEQ ID NO: 664745 - protein, 18 aa, Mycobacterium
GELDLGVRIDRMWSAAAL

SEQ ID NO: 664746 - protein, 20 aa, Mycobacterium
GELDWPGTWTDRAGRDRTPS

SEQ ID NO: 664747 - protein, 20 aa, Mycobacterium
GELEKFQWFVRAHLESAGGQ

SEQ ID NO: 664748 - protein, 23 aa, Mycobacterium
GELELALAAGFPAERIVFDSPAK

SEQ ID NO: 664749 - protein, 23 aa, Mycobacterium
GELEPGHGLKLGYFAQEHDTLDD

SEQ ID NO: 664750 - protein, 18 aa, Mycobacterium
GELEVVVMDRIWDRNATT

SEQ ID NO: 664751 - protein, 23 aa, Mycobacterium
GELFADEVIETFGDPVWIISQGP

SEQ ID NO: 664752 - protein, 20 aa, Mycobacterium
GELFADGVIQTFGEPVWIIS

SEQ ID NO: 664753 - protein, 17 aa, Mycobacterium
GELFASFDVDAFEVPHG

SEQ ID NO: 664754 - protein, 21 aa, Mycobacterium
GELFATGLIWCDGAQEMLGQL

SEQ ID NO: 664755 - protein, 18 aa, Mycobacterium
GELFIIGRIEDLLIVDGS

SEQ ID NO: 664756 - protein, 27 aa, Mycobacterium
GELFIMGRIKDLLIVDGRNHYPDDIEA

SEQ ID NO: 664757 - protein, 17 aa, Mycobacterium
GELFKVLDIGAVDVGDD

SEQ ID NO: 664758 - protein, 18 aa, Mycobacterium
GELFRTSRFRVYSTNDVV

SEQ ID NO: 664759 - protein, 17 aa, Mycobacterium
GELFSSFDVNAFEVPGG

SEQ ID NO: 664760 - protein, 23 aa, Mycobacterium
GELGANHALTFLREVDSINMRRR

SEQ ID NO: 664761 - protein, 28 aa, Mycobacterium
GELGATWSRWGQPLFPIGVLYDPFVERA

SEQ ID NO: 664762 - protein, 24 aa, Mycobacterium
GELGEPFTTVGLCYYRDGSDSVAW

SEQ ID NO: 664763 - protein, 24 aa, Mycobacterium
GELGEPFVTAGLCLYRDGDDSVAW

SEQ ID NO: 664764 - protein, 20 aa, Mycobacterium
GELGLRRYLEAHGHELVVTS

SEQ ID NO: 664765 - protein, 23 aa, Mycobacterium
GELGMPVGTPFTFDPTTLTAARA

SEQ ID NO: 664766 - protein, 19 aa, Mycobacterium
GELGVDWAVVASGAVLAEL

SEQ ID NO: 664767 - protein, 17 aa, Mycobacterium
GELHAMMLDMRRTFDEM

SEQ ID NO: 664768 - protein, 20 aa, Mycobacterium
GELHIPGLDFSNLTPELVLS

SEQ ID NO: 664769 - protein, 24 aa, Mycobacterium
GELHLKASNVIPGYFKHPELSAQI

SEQ ID NO: 664770 - protein, 18 aa, Mycobacterium
GELHPAVIERSGLPKRTC

SEQ ID NO: 664771 - protein, 19 aa, Mycobacterium
GELIASFSQDAMIRPLRTV

SEQ ID NO: 664772 - protein, 20 aa, Mycobacterium
GELIEAAWSRRAHHRHRAGV

SEQ ID NO: 664773 - protein, 28 aa, Mycobacterium
GELIEIGDGFRLPALMESTGSRIREVGT

SEQ ID NO: 664774 - protein, 17 aa, Mycobacterium
GELIIAIAMTEPGAGSD

SEQ ID NO: 664775 - protein, 17 aa, Mycobacterium
GELKLVDPLVISSPRRR

SEQ ID NO: 664776 - protein, 17 aa, Mycobacterium
GELLADLGLTDQDVARR

SEQ ID NO: 664777 - protein, 17 aa, Mycobacterium
GELLASLSDEMLARRAQ

SEQ ID NO: 664778 - protein, 17 aa, Mycobacterium
GELLAWAGVHPDYGSLP

SEQ ID NO: 664779 - protein, 20 aa, Mycobacterium
GELLDAWAGVPTVIAVDAAV

SEQ ID NO: 664780 - protein, 18 aa, Mycobacterium
GELLEWAEIHGGLHRSGT

SEQ ID NO: 664781 - protein, 24 aa, Mycobacterium
GELLGPKAHKVWKPVIAALHGIVA

SEQ ID NO: 664782 - protein, 17 aa, Mycobacterium
GELLLFVAGRDQVRVEF

SEQ ID NO: 664783 - protein, 18 aa, Mycobacterium
GELLLGIREEVGFYDPYY

SEQ ID NO: 664784 - protein, 28 aa, Mycobacterium
GELLLKKIWLAALRRGLTAASLGTDINN

SEQ ID NO: 664785 - protein, 17 aa, Mycobacterium
GELLPELGLDAATLEAE

SEQ ID NO: 664786 - protein, 18 aa, Mycobacterium
GELLPYSDLDLMLLHDNM

SEQ ID NO: 664787 - protein, 22 aa, Mycobacterium
GELLSAYVDGVVDWKRVHEQQI

SEQ ID NO: 664788 - protein, 26 aa, Mycobacterium
GELLVRGGVVFNGYWGNEEETRAVFT

SEQ ID NO: 664789 - protein, 24 aa, Mycobacterium
GELLVRGGVVFSGYWRNEQATADA

SEQ ID NO: 664790 - protein, 24 aa, Mycobacterium
GELLVRGGVVFSGYWRNEQATRDA

SEQ ID NO: 664791 - protein, 19 aa, Mycobacterium
GELLYHCRAAKGFVLCSTG

SEQ ID NO: 664792 - protein, 18 aa, Mycobacterium
GELMTRYSVAQVTAVPSL

SEQ ID NO: 664793 - protein, 17 aa, Mycobacterium
GELMVASCLEVFKETAE

SEQ ID NO: 664794 - protein, 20 aa, Mycobacterium
GELNAAAVRSMWPTVRDKVR

SEQ ID NO: 664795 - protein, 20 aa, Mycobacterium
GELNAAAVRSMWPTVREKVR

SEQ ID NO: 664796 - protein, 21 aa, Mycobacterium
GELNAAAVRSMWSTVRDKVRQ

SEQ ID NO: 664797 - protein, 17 aa, Mycobacterium
GELNRFVFAMPEQLGRI

SEQ ID NO: 664798 - protein, 18 aa, Mycobacterium
GELPAAFAELDLVAAGEG

SEQ ID NO: 664799 - protein, 23 aa, Mycobacterium
GELPAGLNPGGIEPWGISNFQIF

SEQ ID NO: 664800 - protein, 21 aa, Mycobacterium
GELPDLSGLVQAGAVLMGGVG

SEQ ID NO: 664801 - protein, 27 aa, Mycobacterium
GELPLPPARKVAVVACMDARLNPYGLL

SEQ ID NO: 664802 - protein, 17 aa, Mycobacterium
GELPPHLEWTAPFGALS

SEQ ID NO: 664803 - protein, 29 aa, Mycobacterium
GELPPNNWPSVFGGPAWTRVTEADGTPGQ

SEQ ID NO: 664804 - protein, 17 aa, Mycobacterium
GELPPPSGETFIVELSD

SEQ ID NO: 664805 - protein, 24 aa, Mycobacterium
GELPQRHIGVGWASLRSLPPPAGH

SEQ ID NO: 664806 - protein, 17 aa, Mycobacterium
GELPRLFVVTRQAQIVR

SEQ ID NO: 664807 - protein, 17 aa, Mycobacterium
GELPRLFVVTRQAQRVR

SEQ ID NO: 664808 - protein, 19 aa, Mycobacterium
GELPRLVAELERGADLVTG

SEQ ID NO: 664809 - protein, 21 aa, Mycobacterium
GELPSGLNPAKCDPWGLDSFQ

SEQ ID NO: 664810 - protein, 26 aa, Mycobacterium
GELPTWQWEGLIGKSTRLVAVASASA

SEQ ID NO: 664811 - protein, 27 aa, Mycobacterium
GELPTWQWEGLIGKSTRLVAVASASAA

SEQ ID NO: 664812 - protein, 25 aa, Mycobacterium
GELPTWQWESLISKSTRLVAVTSAS

SEQ ID NO: 664813 - protein, 26 aa, Mycobacterium
GELPTWQWESLISKSTRLVAVTSASG

SEQ ID NO: 664814 - protein, 30 aa, Mycobacterium
GELPTWQWESLVSRPTRIVAIASASATLGA

SEQ ID NO: 664815 - protein, 25 aa, Mycobacterium
GELPVLRFVPDLLPRMDAEVAALGR

SEQ ID NO: 664816 - protein, 22 aa, Mycobacterium
GELPVPRMGYGAMQLAGPGVLG

SEQ ID NO: 664817 - protein, 21 aa, Mycobacterium
GELPVVDGLLRYRLPDGSALD

SEQ ID NO: 664818 - protein, 21 aa, Mycobacterium
GELQIDFYNWLPIKSQKTQTL

SEQ ID NO: 664819 - protein, 17 aa, Mycobacterium
GELQRIRVAQALASDPS

SEQ ID NO: 664820 - protein, 18 aa, Mycobacterium
GELRGVGVPTLLVDDPAV

SEQ ID NO: 664821 - protein, 25 aa, Mycobacterium
GELRLKGPQCFLGYADAALDADAFD

SEQ ID NO: 664822 - protein, 21 aa, Mycobacterium
GELRLPSARADRLAPPPDCAH

SEQ ID NO: 664823 - protein, 20 aa, Mycobacterium
GELRLSAWSESDTAELRELA

SEQ ID NO: 664824 - protein, 19 aa, Mycobacterium
GELRLVGNPIRVSGYRPEY

SEQ ID NO: 664825 - protein, 20 aa, Mycobacterium
GELRLVYKKVDLVDKDRPIP

SEQ ID NO: 664826 - protein, 17 aa, Mycobacterium
GELRPQLLDRFGLTVDV

SEQ ID NO: 664827 - protein, 20 aa, Mycobacterium
GELRQATILEVQRARTVIDF

SEQ ID NO: 664828 - protein, 18 aa, Mycobacterium
GELRRRLRDRLAPPAPSV

SEQ ID NO: 664829 - protein, 17 aa, Mycobacterium
GELRSGVDAKLFALEFS

SEQ ID NO: 664830 - protein, 22 aa, Mycobacterium
GELRSMAGWLGVPAVEVGDRGD

SEQ ID NO: 664831 - protein, 20 aa, Mycobacterium
GELRSRMFASNLGVEEDEAT

SEQ ID NO: 664832 - protein, 21 aa, Mycobacterium
GELRSSASILGAQRVECLGYA

SEQ ID NO: 664833 - protein, 19 aa, Mycobacterium
GELRVVFSTVQLIADIERM

SEQ ID NO: 664834 - protein, 23 aa, Mycobacterium
GELRWRAPEPPPAWTEPRDATRV

SEQ ID NO: 664835 - protein, 25 aa, Mycobacterium
GELRYPELADWGIPTAEAIVEVRQA

SEQ ID NO: 664836 - protein, 19 aa, Mycobacterium
GELSCAALGADVHSFDEDG

SEQ ID NO: 664837 - protein, 26 aa, Mycobacterium
GELSLRLAVRTPFAFEGLFGHLAASA

SEQ ID NO: 664838 - protein, 21 aa, Mycobacterium
GELSSLVGRIAKIYSGLASGA

SEQ ID NO: 664839 - protein, 27 aa, Mycobacterium
GELTAARAARLKWWTTDLQVRTADRCL

SEQ ID NO: 664840 - protein, 20 aa, Mycobacterium
GELTARWGAPRRHGARLEAG

SEQ ID NO: 664841 - protein, 26 aa, Mycobacterium
GELTEFDFEFELRGSEFQRRVWRALQ

SEQ ID NO: 664842 - protein, 20 aa, Mycobacterium
GELTLPGRSLLFVRNVGHLM

SEQ ID NO: 664843 - protein, 21 aa, Mycobacterium
GELTLPGRSLLFVRNVGHLMT

SEQ ID NO: 664844 - protein, 23 aa, Mycobacterium
GELTQLAGVFGFAECIDLLAHYT

SEQ ID NO: 664845 - protein, 23 aa, Mycobacterium
GELTQLAGVFGFAECIDLLANHT

SEQ ID NO: 664846 - protein, 36 aa, Mycobacterium
GELTQLAGVFGFAECVELLAGYTAVCIDEFELDDPG

SEQ ID NO: 664847 - protein, 22 aa, Mycobacterium
GELTQLAGVFGYNECIDLLAEY

SEQ ID NO: 664848 - protein, 22 aa, Mycobacterium
GELVAACAAGVFTIEEAVQLAA

SEQ ID NO: 664849 - protein, 22 aa, Mycobacterium
GELVCAVVRRSPRHRAVTLDEL

SEQ ID NO: 664850 - protein, 19 aa, Mycobacterium
GELVCTVGISLQTPDDCEA

SEQ ID NO: 664851 - protein, 17 aa, Mycobacterium
GELVPKVPFSFDPTVLR

SEQ ID NO: 664852 - protein, 27 aa, Mycobacterium
GELVSGIANAGMFSSGFFNTGDNQSGF

SEQ ID NO: 664853 - protein, 20 aa, Mycobacterium
GELVTCRKFAPTARNYAVAR

SEQ ID NO: 664854 - protein, 20 aa, Mycobacterium
GELWAIPDGQTWVFPILQFE

SEQ ID NO: 664855 - protein, 24 aa, Mycobacterium
GELWQRPDIALALAQRYSAAYEDL

SEQ ID NO: 664856 - protein, 18 aa, Mycobacterium
GELWRLSPDSLSLSGAAA

SEQ ID NO: 664857 - protein, 25 aa, Mycobacterium
GELWRVDFAWPHMRLAAEYESIDWH

SEQ ID NO: 664858 - protein, 24 aa, Mycobacterium
GELWSRTTSVAAAWHHDAAHPVKA

SEQ ID NO: 664859 - protein, 17 aa, Mycobacterium
GELWYRKSGTYRGKVQN

SEQ ID NO: 664860 - protein, 17 aa, Mycobacterium
GELYEYFLGNFARAEGR

SEQ ID NO: 664861 - protein, 22 aa, Mycobacterium
GELYFEGGPDFAYFKDPAKTAS

SEQ ID NO: 664862 - protein, 28 aa, Mycobacterium
GELYLTGRIKDLIVIDGRNHYPTDIETT

SEQ ID NO: 664863 - protein, 29 aa, Mycobacterium
GELYVCGRIKDLLILAGRNIYPQDIEDSL

SEQ ID NO: 664864 - protein, 25 aa, Mycobacterium
GEMATLWVIEGIATYGAHLASAVKR

SEQ ID NO: 664865 - protein, 24 aa, Mycobacterium
GEMGRCFAEFDWAAHPLGPPADWS

SEQ ID NO: 664866 - protein, 18 aa, Mycobacterium
GEMGRPWYEHGKLLEKKN

SEQ ID NO: 664867 - protein, 17 aa, Mycobacterium
GEMGRRFAEFDWAHHRL

SEQ ID NO: 664868 - protein, 21 aa, Mycobacterium
GEMIKRLRAAVSARRDPNFIV

SEQ ID NO: 664869 - protein, 27 aa, Mycobacterium
GEMKAVWRLNELLNWQVASSGDDISMA

SEQ ID NO: 664870 - protein, 19 aa, Mycobacterium
GEMRARLRGLDAAAQTSSG

SEQ ID NO: 664871 - protein, 22 aa, Mycobacterium
GEMSFSRAVQRAHVVQSALSTS

SEQ ID NO: 664872 - protein, 25 aa, Mycobacterium
GEMTLSYDPPRKWWQAGPGEGSIGF

SEQ ID NO: 664873 - protein, 25 aa, Mycobacterium
GEMTYLQWLQRYVELAIGDGDSTAD

SEQ ID NO: 664874 - protein, 17 aa, Mycobacterium
GEMWSQDAATMYAYAAS

SEQ ID NO: 664875 - protein, 25 aa, Mycobacterium
GENDALLRFACSWIAAEDGTPRTPA

SEQ ID NO: 664876 - protein, 19 aa, Mycobacterium
GENGLKVYAMCEIPNNVIL

SEQ ID NO: 664877 - protein, 17 aa, Mycobacterium
GENGWPMPLPDELKEDL

SEQ ID NO: 664878 - protein, 19 aa, Mycobacterium
GENIGSLAITEPGGGSDVG

SEQ ID NO: 664879 - protein, 20 aa, Mycobacterium
GENIPAWLVFDQRYRDRYIF

SEQ ID NO: 664880 - protein, 26 aa, Mycobacterium
GENIVCPWHGWQWRGDGSNALIPYSK

SEQ ID NO: 664881 - protein, 26 aa, Mycobacterium
GENIVCPWHGWRWRGDGTNALIPYSK

SEQ ID NO: 664882 - protein, 21 aa, Mycobacterium
GENLKGYFEHQAKKYGGTVEQ

SEQ ID NO: 664883 - protein, 19 aa, Mycobacterium
GENLPAWLVFDQEYRNRYI

SEQ ID NO: 664884 - protein, 21 aa, Mycobacterium
GENTLRRWLREQNITNTAAVA

SEQ ID NO: 664885 - protein, 18 aa, Mycobacterium
GENVFFCATGVTDGDLLK

SEQ ID NO: 664886 - protein, 17 aa, Mycobacterium
GENVLLIALHYRVGGSV

SEQ ID NO: 664887 - protein, 24 aa, Mycobacterium
GENWPLCCTEEGGGFIYADGSQAR

SEQ ID NO: 664888 - protein, 23 aa, Mycobacterium
GENWWRVLRLWEKVKSPLLDAMM

SEQ ID NO: 664889 - protein, 19 aa, Mycobacterium
GEPAGTWLIAGFDELAAKV

SEQ ID NO: 664890 - protein, 25 aa, Mycobacterium
GEPALGELWDFLMADWYEIHERRYA

SEQ ID NO: 664891 - protein, 17 aa, Mycobacterium
GEPAMQWIAARFNGEPT

SEQ ID NO: 664892 - protein, 20 aa, Mycobacterium
GEPAPKWWFTVGGEVQQGER

SEQ ID NO: 664893 - protein, 24 aa, Mycobacterium
GEPARLPFWRGDGVGRPVELGAAI

SEQ ID NO: 664894 - protein, 29 aa, Mycobacterium
GEPCPAALLDRWAPGRIMLNAYGPTETTV

SEQ ID NO: 664895 - protein, 30 aa, Mycobacterium
GEPCRRCGTCIECLHAGAGAGRVQFWCPTC

SEQ ID NO: 664896 - protein, 19 aa, Mycobacterium
GEPDRPLLMLLHGSGGHAE

SEQ ID NO: 664897 - protein, 31 aa, Mycobacterium
GEPDWVNTIFLSTRFRAWRVGGYNEYLYTFF

SEQ ID NO: 664898 - protein, 24 aa, Mycobacterium
GEPEDVSAFVLFLASDESSYATAA

SEQ ID NO: 664899 - protein, 23 aa, Mycobacterium
GEPEELDRLLARLKQFREEHAEK

SEQ ID NO: 664900 - protein, 21 aa, Mycobacterium
GEPELRPDDLIRVDSQGRGII

SEQ ID NO: 664901 - protein, 27 aa, Mycobacterium
GEPERLKSGWLNGIKHWQVDYSGKGCP

SEQ ID NO: 664902 - protein, 17 aa, Mycobacterium
GEPFCVREEARVLYHAA

SEQ ID NO: 664903 - protein, 29 aa, Mycobacterium
GEPFPKFRVPGRLVWFAMTIWQFLHFKFG

SEQ ID NO: 664904 - protein, 17 aa, Mycobacterium
GEPGAREYLVLGGGLNR

SEQ ID NO: 664905 - protein, 19 aa, Mycobacterium
GEPGLLLSRVNRLQPFDGY

SEQ ID NO: 664906 - protein, 20 aa, Mycobacterium
GEPHLITSFWFAFGSPEAAR

SEQ ID NO: 664907 - protein, 25 aa, Mycobacterium
GEPIAPTRGAPLCGFRQTSRILAGL

SEQ ID NO: 664908 - protein, 17 aa, Mycobacterium
GEPICFADDDALQRLSG

SEQ ID NO: 664909 - protein, 21 aa, Mycobacterium
GEPIPLLPGGHSLYEYGNPRR

SEQ ID NO: 664910 - protein, 29 aa, Mycobacterium
GEPITTWAPRSTGAIAYRALAREFIDRFG

SEQ ID NO: 664911 - protein, 17 aa, Mycobacterium
GEPLALDLLNTRWMSGD

SEQ ID NO: 664912 - protein, 22 aa, Mycobacterium
GEPLFMAGLWSVWKPAKDASPL

SEQ ID NO: 664913 - protein, 23 aa, Mycobacterium
GEPLFMAGLWSVWKPAKEGSPLL

SEQ ID NO: 664914 - protein, 22 aa, Mycobacterium
GEPLTAAAACEWGLINEVAPQG

SEQ ID NO: 664915 - protein, 25 aa, Mycobacterium
GEPLYTRRGWIRWKGPTSVLAPSGM

SEQ ID NO: 664916 - protein, 21 aa, Mycobacterium
GEPMKAIPAFREPGPRLEVMD

SEQ ID NO: 664917 - protein, 18 aa, Mycobacterium
GEPMKVSWGPNWDDNLAG

SEQ ID NO: 664918 - protein, 20 aa, Mycobacterium
GEPMTAPAIAQWLEFMEHGK

SEQ ID NO: 664919 - protein, 23 aa, Mycobacterium
GEPPEAACPLGMATAYAANAAEG

SEQ ID NO: 664920 - protein, 19 aa, Mycobacterium
GEPPICFATGSIPVQSPTA

SEQ ID NO: 664921 - protein, 18 aa, Mycobacterium
GEPQEFFQYLPATSQAPQ

SEQ ID NO: 664922 - protein, 18 aa, Mycobacterium
GEPQEFFQYLPATSQSPQ

SEQ ID NO: 664923 - protein, 32 aa, Mycobacterium
GEPQLRELRAWLGRRLPRYLMPNAIVAVDRIP

SEQ ID NO: 664924 - protein, 27 aa, Mycobacterium
GEPQWATPPEFAWDYRVFGSGGTAPAA

SEQ ID NO: 664925 - protein, 17 aa, Mycobacterium
GEPRIELMTHLSHPSLD

SEQ ID NO: 664926 - protein, 22 aa, Mycobacterium
GEPRMPMLPGTWDPDGARDAGK

SEQ ID NO: 664927 - protein, 18 aa, Mycobacterium
GEPRRGRYEYAINNSFGF

SEQ ID NO: 664928 - protein, 21 aa, Mycobacterium
GEPRRLAQTEAFRLPEGTTAA

SEQ ID NO: 664929 - protein, 21 aa, Mycobacterium
GEPRVNAYQLLPADSADKNEH

SEQ ID NO: 664930 - protein, 27 aa, Mycobacterium
GEPSWSFLYRKMIPILVAAGHRVICPD

SEQ ID NO: 664931 - protein, 22 aa, Mycobacterium
GEPSYAMDICLSSRKGDHNHAG

SEQ ID NO: 664932 - protein, 21 aa, Mycobacterium
GEPSYAMDLCLSSRRGDHNHA

SEQ ID NO: 664933 - protein, 20 aa, Mycobacterium
GEPVAEVWGTLQAVHAVALD

SEQ ID NO: 664934 - protein, 24 aa, Mycobacterium
GEPVCELAEAFGIGRATAYRYLAG

SEQ ID NO: 664935 - protein, 21 aa, Mycobacterium
GEPVFMAGLWSVWKPDKSAAP

SEQ ID NO: 664936 - protein, 17 aa, Mycobacterium
GEPVILVRDHTRPEDVL

SEQ ID NO: 664937 - protein, 20 aa, Mycobacterium
GEPVIRHQLLVYPVTTTDLT

SEQ ID NO: 664938 - protein, 25 aa, Mycobacterium
GEPVMRRFLQLDGEFTATTEMVAEA

SEQ ID NO: 664939 - protein, 31 aa, Mycobacterium
GEPVNMFEFARPVIEACGRKLPRVRVPGRAV

SEQ ID NO: 664940 - protein, 22 aa, Mycobacterium
GEPVPWRCHRQLIANSLVAQGW

SEQ ID NO: 664941 - protein, 17 aa, Mycobacterium
GEPWIADTTLGRVLFNE

SEQ ID NO: 664942 - protein, 18 aa, Mycobacterium
GEPYPYALCPQSAEVRDY

SEQ ID NO: 664943 - protein, 24 aa, Mycobacterium
GEQALAIRQDIDWIDYMDAPTGPR

SEQ ID NO: 664944 - protein, 19 aa, Mycobacterium
GEQAPVFAAVGPMQFEVAS

SEQ ID NO: 664945 - protein, 17 aa, Mycobacterium
GEQDFAAVWGQGAVIST

SEQ ID NO: 664946 - protein, 21 aa, Mycobacterium
GEQELDLVLAILRARQLFGGE

SEQ ID NO: 664947 - protein, 24 aa, Mycobacterium
GEQELRGLLGAFMFTGPQLDQPAG

SEQ ID NO: 664948 - protein, 19 aa, Mycobacterium
GEQFMQWFLQEQVEEMSLM

SEQ ID NO: 664949 - protein, 19 aa, Mycobacterium
GEQGRFAYLDTEFDQGTVI

SEQ ID NO: 664950 - protein, 25 aa, Mycobacterium
GEQHLSMLRRLMMDDNFFRGELIYV

SEQ ID NO: 664951 - protein, 19 aa, Mycobacterium
GEQKCRWLVEELGFDAAID

SEQ ID NO: 664952 - protein, 24 aa, Mycobacterium
GEQKVGRLTAKPEQQGAGTVFTFE

SEQ ID NO: 664953 - protein, 25 aa, Mycobacterium
GEQLELYRRMWVLRLLDMALEESRI

SEQ ID NO: 664954 - protein, 18 aa, Mycobacterium
GEQLPVMPPWHVQENKWR

SEQ ID NO: 664955 - protein, 17 aa, Mycobacterium
GEQLQVWRSMESANEVP

SEQ ID NO: 664956 - protein, 23 aa, Mycobacterium
GEQLRFRHDLLREATRQSLPKSL

SEQ ID NO: 664957 - protein, 24 aa, Mycobacterium
GEQMPMRVIGMLLGIPEDRQRAIT

SEQ ID NO: 664958 - protein, 25 aa, Mycobacterium
GEQMPMRVIGMLLGLPEDRQRQITD

SEQ ID NO: 664959 - protein, 25 aa, Mycobacterium
GEQPDIRPAPPIPQPVLGRPPSAPA

SEQ ID NO: 664960 - protein, 24 aa, Mycobacterium
GEQPRPVLVWLHFGAFQFGSASNP

SEQ ID NO: 664961 - protein, 17 aa, Mycobacterium
GEQRCFDTPLAESAIVG

SEQ ID NO: 664962 - protein, 18 aa, Mycobacterium
GEQRPGSVRALRRDEIGQ

SEQ ID NO: 664963 - protein, 26 aa, Mycobacterium
GEQRVSLPAGQCWSITAAGPAEVVVP

SEQ ID NO: 664964 - protein, 22 aa, Mycobacterium
GEQTITCSFLMVCTGYYRYDGG

SEQ ID NO: 664965 - protein, 18 aa, Mycobacterium
GEQVRVFPLSNWTELDIW

SEQ ID NO: 664966 - protein, 18 aa, Mycobacterium
GEQWAMGWSDDSTDSALR

SEQ ID NO: 664967 - protein, 29 aa, Mycobacterium
GEQYELVLYWWPRADLSGVENAILAAVAD

SEQ ID NO: 664968 - protein, 24 aa, Mycobacterium
GERAEFHASPAIRIAGTRALELAG

SEQ ID NO: 664969 - protein, 20 aa, Mycobacterium
GERAPECFLNGPDAMVCLVD

SEQ ID NO: 664970 - protein, 23 aa, Mycobacterium
GERARELLSLAVIDIAGGAIRRR

SEQ ID NO: 664971 - protein, 20 aa, Mycobacterium
GERARVAVVFGGRSNEHAIS

SEQ ID NO: 664972 - protein, 22 aa, Mycobacterium
GERAWILLIALASRWWQRGIGS

SEQ ID NO: 664973 - protein, 26 aa, Mycobacterium
GERDGRLALCASPTCRAAFFDTSQSR

SEQ ID NO: 664974 - protein, 21 aa, Mycobacterium
GERFAGLALEGDVRFDAETSR

SEQ ID NO: 664975 - protein, 26 aa, Mycobacterium
GERFFWYSSTSWMMWNLQLSGLLVGT

SEQ ID NO: 664976 - protein, 18 aa, Mycobacterium
GERFKDLIMDSSTYGVAV

SEQ ID NO: 664977 - protein, 19 aa, Mycobacterium
GERGAYRFHGADVEIGVPA

SEQ ID NO: 664978 - protein, 22 aa, Mycobacterium
GERGIAGLMLESFLVAGAQSLS

SEQ ID NO: 664979 - protein, 20 aa, Mycobacterium
GERGLCAGGDVVAVHDSAKI

SEQ ID NO: 664980 - protein, 19 aa, Mycobacterium
GERGLCAGGDVVAVYHSAR

SEQ ID NO: 664981 - protein, 22 aa, Mycobacterium
GERGSAGAYLIGWDPLLQPGLP

SEQ ID NO: 664982 - protein, 18 aa, Mycobacterium
GERIALWAPPGASYYSDF

SEQ ID NO: 664983 - protein, 22 aa, Mycobacterium
GERKRASSGWESLTPAELDVVR

SEQ ID NO: 664984 - protein, 30 aa, Mycobacterium
GERLAAGIPKAFCEIAGRTLLERAVAGLLE

SEQ ID NO: 664985 - protein, 19 aa, Mycobacterium
GERLGLSGYRAMLEADTHA

SEQ ID NO: 664986 - protein, 19 aa, Mycobacterium
GERLIPHSVELGGKDAMIV

SEQ ID NO: 664987 - protein, 20 aa, Mycobacterium
GERLLGLDLANGGHLTHGMK

SEQ ID NO: 664988 - protein, 22 aa, Mycobacterium
GERLPGYMVPAAIVALPELPVT

SEQ ID NO: 664989 - protein, 17 aa, Mycobacterium
GERLRHPTLAWLEPFEP

SEQ ID NO: 664990 - protein, 22 aa, Mycobacterium
GERNRLNLALTLKQGGNLILLD

SEQ ID NO: 664991 - protein, 19 aa, Mycobacterium
GERNWDYRYAWVRDSTFAL

SEQ ID NO: 664992 - protein, 17 aa, Mycobacterium
GERPARVLLLGGTPFTE

SEQ ID NO: 664993 - protein, 25 aa, Mycobacterium
GERPAYDVVRDWLLDNGIVCLMADR

SEQ ID NO: 664994 - protein, 18 aa, Mycobacterium
GERPVVFLCRSGNRSIGA

SEQ ID NO: 664995 - protein, 20 aa, Mycobacterium
GERPYKVVFKDSTEGGYVVT

SEQ ID NO: 664996 - protein, 22 aa, Mycobacterium
GERQLLAVALLWGLAQAAGQPL

SEQ ID NO: 664997 - protein, 23 aa, Mycobacterium
GERQLLAVALLWGLARAAGQPLP

SEQ ID NO: 664998 - protein, 23 aa, Mycobacterium
GERQRLKLAAQMADKGNVYILDE

SEQ ID NO: 664999 - protein, 17 aa, Mycobacterium
GERRFRRRRCLRANGSN

SEQ ID NO: 665000 - protein, 26 aa, Mycobacterium
GERSRLMLDIANWRGRRRDELAALGT

SEQ ID NO: 665001 - protein, 25 aa, Mycobacterium
GERSRLMLDIAQWRRRRRDELAALG

SEQ ID NO: 665002 - protein, 24 aa, Mycobacterium
GERSRLMLDIARWRRRRRDELAAL

SEQ ID NO: 665003 - protein, 22 aa, Mycobacterium
GERSSHTWFVLRELLGHRNVKN

SEQ ID NO: 665004 - protein, 24 aa, Mycobacterium
GERSWRIPATAFWQSHRDAAKVYS

SEQ ID NO: 665005 - protein, 17 aa, Mycobacterium
GERTIASTFLGLVPSPA

SEQ ID NO: 665006 - protein, 19 aa, Mycobacterium
GERTLACLQGEFGPNLAIM

SEQ ID NO: 665007 - protein, 21 aa, Mycobacterium
GERVAMLLPRTGEAVVTILAI

SEQ ID NO: 665008 - protein, 20 aa, Mycobacterium
GERVIPQWVKIRNIDGFNGS

SEQ ID NO: 665009 - protein, 21 aa, Mycobacterium
GERVQAGAGIRIHRRPGEAVA

SEQ ID NO: 665010 - protein, 23 aa, Mycobacterium
GERWALLVVRELLLGPKRFTDLL

SEQ ID NO: 665011 - protein, 18 aa, Mycobacterium
GERYQFLRWGQGAFDDFK

SEQ ID NO: 665012 - protein, 26 aa, Mycobacterium
GESAGAFQAAHARFVETSAKINALLD

SEQ ID NO: 665013 - protein, 19 aa, Mycobacterium
GESAIRPGYFADHQPPALL

SEQ ID NO: 665014 - protein, 19 aa, Mycobacterium
GESALGMSAANFSSAAGAL

SEQ ID NO: 665015 - protein, 17 aa, Mycobacterium
GESALQRAGRYLVIGGL

SEQ ID NO: 665016 - protein, 18 aa, Mycobacterium
GESAPVFTADGDVLFLAV

SEQ ID NO: 665017 - protein, 26 aa, Mycobacterium
GESATAFQAAHARFVEAAGKVNTLLD

SEQ ID NO: 665018 - protein, 24 aa, Mycobacterium
GESAYLRLSTRPVKQELADLPTDP

SEQ ID NO: 665019 - protein, 18 aa, Mycobacterium
GESEGFWMGSLRADRNGL

SEQ ID NO: 665020 - protein, 25 aa, Mycobacterium
GESEWNALNLFTGWVDVDLTDKGRA

SEQ ID NO: 665021 - protein, 20 aa, Mycobacterium
GESFCTLTAIGHDNAGRLIG

SEQ ID NO: 665022 - protein, 25 aa, Mycobacterium
GESFFSAPQLRRWDAAVTSLIRRGQ

SEQ ID NO: 665023 - protein, 24 aa, Mycobacterium
GESGCGKSTLARTLMMLERPDAGT

SEQ ID NO: 665024 - protein, 17 aa, Mycobacterium
GESGFNIGRVVAVALGY

SEQ ID NO: 665025 - protein, 17 aa, Mycobacterium
GESGFNMARVVAVELGY

SEQ ID NO: 665026 - protein, 24 aa, Mycobacterium
GESGWRLEHMPTTMAARTRFFDTF

SEQ ID NO: 665027 - protein, 21 aa, Mycobacterium
GESHAFRSALMRVYYGDEARS

SEQ ID NO: 665028 - protein, 21 aa, Mycobacterium
GESHRVPLIIGYNAEEATLFT

SEQ ID NO: 665029 - protein, 17 aa, Mycobacterium
GESLAEFGLLNDQLVAR

SEQ ID NO: 665030 - protein, 24 aa, Mycobacterium
GESLDWPSNLWMGVSVENADVLPR

SEQ ID NO: 665031 - protein, 19 aa, Mycobacterium
GESLGEVEFAFFVILLAVA

SEQ ID NO: 665032 - protein, 20 aa, Mycobacterium
GESLQSWLTALAHRNDVTWT

SEQ ID NO: 665033 - protein, 18 aa, Mycobacterium
GESLRSPALITAIHLSLE

SEQ ID NO: 665034 - protein, 25 aa, Mycobacterium
GESMIEAAICDGDWVVVRQQNVADN

SEQ ID NO: 665035 - protein, 20 aa, Mycobacterium
GESMPWGNAVIGVRNPTAPP

SEQ ID NO: 665036 - protein, 20 aa, Mycobacterium
GESQLPAGIIEINRENWMLV

SEQ ID NO: 665037 - protein, 23 aa, Mycobacterium
GESRAGYNGALDIDLVFSPFFNA

SEQ ID NO: 665038 - protein, 17 aa, Mycobacterium
GESRFIARRELLSGVLR

SEQ ID NO: 665039 - protein, 25 aa, Mycobacterium
GESTDRIAVIPAWRETAYFTDEERA

SEQ ID NO: 665040 - protein, 18 aa, Mycobacterium
GESTLEYLVEQFLTQFYG

SEQ ID NO: 665041 - protein, 18 aa, Mycobacterium
GESVAEGTVTRWLKKVGD

SEQ ID NO: 665042 - protein, 22 aa, Mycobacterium
GESVLRLKARLWFVHRGIEKLF

SEQ ID NO: 665043 - protein, 24 aa, Mycobacterium
GESWSMALALRLGAYELLCSDGVE

SEQ ID NO: 665044 - protein, 29 aa, Mycobacterium
GESWSMAVALRLAAFALLRADGSEPVLLL

SEQ ID NO: 665045 - protein, 26 aa, Mycobacterium
GESWSMAVALRLAAYELLRVEGSDPV

SEQ ID NO: 665046 - protein, 18 aa, Mycobacterium
GETAFAHYLDAYRAGMAL

SEQ ID NO: 665047 - protein, 27 aa, Mycobacterium
GETALHRHFGWLTRWYAFSSADLGSSP

SEQ ID NO: 665048 - protein, 17 aa, Mycobacterium
GETASIFLPSVPNLLLL

SEQ ID NO: 665049 - protein, 17 aa, Mycobacterium
GETASVFLPSVPNLLQL

SEQ ID NO: 665050 - protein, 21 aa, Mycobacterium
GETCSLGPWSTGVAWSTVKVP

SEQ ID NO: 665051 - protein, 17 aa, Mycobacterium
GETELDLVLAILRARQL

SEQ ID NO: 665052 - protein, 24 aa, Mycobacterium
GETEQRLALIAAWEEAGDLFTERE

SEQ ID NO: 665053 - protein, 35 aa, Mycobacterium
GETFHPRGRAGAALPASASKTWVAAVTTVAALATA

SEQ ID NO: 665054 - protein, 17 aa, Mycobacterium
GETGCRIVLPEGTDPFV

SEQ ID NO: 665055 - protein, 20 aa, Mycobacterium
GETITTIGLLIAEVNISYKA

SEQ ID NO: 665056 - protein, 23 aa, Mycobacterium
GETLSRWTSFTATPSVAMDITRP

SEQ ID NO: 665057 - protein, 18 aa, Mycobacterium
GETPDWWDSLPADRPIVY

SEQ ID NO: 665058 - protein, 18 aa, Mycobacterium
GETPIVLLHCYPYEREAG

SEQ ID NO: 665059 - protein, 18 aa, Mycobacterium
GETPSGIVHLMVEVENSD

SEQ ID NO: 665060 - protein, 24 aa, Mycobacterium
GETRGELGPTFVLDEAVKVNSPTA

SEQ ID NO: 665061 - protein, 19 aa, Mycobacterium
GETRKTLWRALDGVTVESV

SEQ ID NO: 665062 - protein, 30 aa, Mycobacterium
GETRLSDRVLLRFGLHQALRLGKPLQLHVG

SEQ ID NO: 665063 - protein, 30 aa, Mycobacterium
GETRTTLPGGLTWPLGLAVDADGDLYIADG

SEQ ID NO: 665064 - protein, 17 aa, Mycobacterium
GETRVHRLAVGIYDDAG

SEQ ID NO: 665065 - protein, 18 aa, Mycobacterium
GETRVHRLAVGIYDDVDG

SEQ ID NO: 665066 - protein, 33 aa, Mycobacterium
GETSCNSIAWAVLDRASRGWRGLTMTPAGLRQL

SEQ ID NO: 665067 - protein, 23 aa, Mycobacterium
GETTYRLSIPSYRRICTDCPDQV

SEQ ID NO: 665068 - protein, 19 aa, Mycobacterium
GETVASWAVSEPGRGWAPL

SEQ ID NO: 665069 - protein, 19 aa, Mycobacterium
GETVGESWDAEIVPTSAGV

SEQ ID NO: 665070 - protein, 17 aa, Mycobacterium
GETVRPDGGFGLGATKP

SEQ ID NO: 665071 - protein, 31 aa, Mycobacterium
GETVVPIGAPVPAAGLFVLDGWLRPVPPGVV

SEQ ID NO: 665072 - protein, 19 aa, Mycobacterium
GETVWTWTVPMAVARRGDD

SEQ ID NO: 665073 - protein, 23 aa, Mycobacterium
GETWSFDSARLYCERNWGTGFPE

SEQ ID NO: 665074 - protein, 23 aa, Mycobacterium
GEVAEALDARFQVFFTGPLDTID

SEQ ID NO: 665075 - protein, 19 aa, Mycobacterium
GEVALLRLACEAADAALAD

SEQ ID NO: 665076 - protein, 19 aa, Mycobacterium
GEVARRVQVKSSRVPSGMN

SEQ ID NO: 665077 - protein, 26 aa, Mycobacterium
GEVDLLVAAWLPWSHGRYFDPIADHV

SEQ ID NO: 665078 - protein, 20 aa, Mycobacterium
GEVDYGMAVGVEKLSGAGLL

SEQ ID NO: 665079 - protein, 30 aa, Mycobacterium
GEVEAIRGWLRREGTCLLLAPHHDVGDTAD

SEQ ID NO: 665080 - protein, 25 aa, Mycobacterium
GEVFDLRPAAIVRDLDLLRPIYAPT

SEQ ID NO: 665081 - protein, 26 aa, Mycobacterium
GEVFDLRPGAIIRDLDLLRPIYAPTA

SEQ ID NO: 665082 - protein, 26 aa, Mycobacterium
GEVFDLRPGAIIRDLNLLRPIYAPTA

SEQ ID NO: 665083 - protein, 26 aa, Mycobacterium
GEVFDLRPGAIVRDLDLLRPIYAPTA

SEQ ID NO: 665084 - protein, 19 aa, Mycobacterium
GEVFGAWQTVLAGRFRAQG

SEQ ID NO: 665085 - protein, 24 aa, Mycobacterium
GEVIQCPFHGWQWNAEGRNVCIPY

SEQ ID NO: 665086 - protein, 20 aa, Mycobacterium
GEVIRAFGRLDIVVNNAAGN

SEQ ID NO: 665087 - protein, 22 aa, Mycobacterium
GEVKLPGGLWIVTERAVATESG

SEQ ID NO: 665088 - protein, 26 aa, Mycobacterium
GEVLERSLVHLGLKHYFLVDFPQEPG

SEQ ID NO: 665089 - protein, 21 aa, Mycobacterium
GEVLGSPGYRRAAAAAGASVA

SEQ ID NO: 665090 - protein, 17 aa, Mycobacterium
GEVLIKYTAAGLCHSDL

SEQ ID NO: 665091 - protein, 24 aa, Mycobacterium
GEVLPALWHWVYFLDWPPTAALGT

SEQ ID NO: 665092 - protein, 24 aa, Mycobacterium
GEVLQCPFHGWQWSHQGRNVCIPY

SEQ ID NO: 665093 - protein, 24 aa, Mycobacterium
GEVLQCPFHGWQWSQEGRNVCIPY

SEQ ID NO: 665094 - protein, 24 aa, Mycobacterium
GEVLQCPFHGWQWSTDGRNVCIPY

SEQ ID NO: 665095 - protein, 27 aa, Mycobacterium
GEVLRLRWRKGCMPLPRRVIRARVHGR

SEQ ID NO: 665096 - protein, 28 aa, Mycobacterium
GEVLRLRWRKGCMPLPRRVIRARVHGRQ

SEQ ID NO: 665097 - protein, 23 aa, Mycobacterium
GEVLRRGRSLPWQYTGGDTADPT

SEQ ID NO: 665098 - protein, 24 aa, Mycobacterium
GEVLRTYLELVLDGLVARLASGDD

SEQ ID NO: 665099 - protein, 20 aa, Mycobacterium
GEVLTARFVVMATGPLSSPL

SEQ ID NO: 665100 - protein, 27 aa, Mycobacterium
GEVLVKVAFCGICHSDLSLINGTFPAQ

SEQ ID NO: 665101 - protein, 17 aa, Mycobacterium
GEVLVKVAYCGICHSDL

SEQ ID NO: 665102 - protein, 17 aa, Mycobacterium
GEVLVQLSATGLCHSDE

SEQ ID NO: 665103 - protein, 20 aa, Mycobacterium
GEVMIRIEAAGVCHSDLSVV

SEQ ID NO: 665104 - protein, 20 aa, Mycobacterium
GEVMRAGGIGRVIDSRHPDF

SEQ ID NO: 665105 - protein, 22 aa, Mycobacterium
GEVNAGVYAFDIEPLHAALSRL

SEQ ID NO: 665106 - protein, 22 aa, Mycobacterium
GEVNDRLAALGIALEDLDAQVA

SEQ ID NO: 665107 - protein, 19 aa, Mycobacterium
GEVNGGWSVVREPLDAEHG

SEQ ID NO: 665108 - protein, 19 aa, Mycobacterium
GEVPLRRALAYPVSDLAMH

SEQ ID NO: 665109 - protein, 25 aa, Mycobacterium
GEVPPDRWGLVPLLAGVAIVDAVAE

SEQ ID NO: 665110 - protein, 23 aa, Mycobacterium
GEVPQRKSVLVGYGADDSMDASR

SEQ ID NO: 665111 - protein, 17 aa, Mycobacterium
GEVPVFVNTGVRAHNAA

SEQ ID NO: 665112 - protein, 22 aa, Mycobacterium
GEVPVRLEALGALGGLDRAALH

SEQ ID NO: 665113 - protein, 17 aa, Mycobacterium
GEVPVVYLVLREGANPP

SEQ ID NO: 665114 - protein, 18 aa, Mycobacterium
GEVQTRLRLGQEREALEA

SEQ ID NO: 665115 - protein, 21 aa, Mycobacterium
GEVQTRLRLGQESEALAAAAK

SEQ ID NO: 665116 - protein, 21 aa, Mycobacterium
GEVRGAGVFWAVELVADQATR

SEQ ID NO: 665117 - protein, 20 aa, Mycobacterium
GEVRGKLALVTGAGAGIGRA

SEQ ID NO: 665118 - protein, 22 aa, Mycobacterium
GEVRGLGVFWAVELVKDQKTRE

SEQ ID NO: 665119 - protein, 26 aa, Mycobacterium
GEVRGRGAMLAIEIVKPGTLEPDAAL

SEQ ID NO: 665120 - protein, 21 aa, Mycobacterium
GEVRGTLQLGQSAWIAEATGL

SEQ ID NO: 665121 - protein, 17 aa, Mycobacterium
GEVRGWGVFSHGFTLGK

SEQ ID NO: 665122 - protein, 31 aa, Mycobacterium
GEVRLEPGGSGWRWLASALWAEILLSQHADT

SEQ ID NO: 665123 - protein, 17 aa, Mycobacterium
GEVRRLSGVTALHGGWR

SEQ ID NO: 665124 - protein, 18 aa, Mycobacterium
GEVRRPMYESGYQAVLMK

SEQ ID NO: 665125 - protein, 24 aa, Mycobacterium
GEVRRRYGAATARMVRFESDGTAT

SEQ ID NO: 665126 - protein, 17 aa, Mycobacterium
GEVRWWMPDGDVFELRA

SEQ ID NO: 665127 - protein, 21 aa, Mycobacterium
GEVRYNLAVVNWFNEEGGRFA

SEQ ID NO: 665128 - protein, 29 aa, Mycobacterium
GEVSRGVLFPKHRTDLIGCAVTVQRMLSG

SEQ ID NO: 665129 - protein, 29 aa, Mycobacterium
GEVSRGVLFPKHRTDLLGCAISVQRMRTG

SEQ ID NO: 665130 - protein, 29 aa, Mycobacterium
GEVSRGVLFPKHRTDLLGCAVTVRRMLDG

SEQ ID NO: 665131 - protein, 17 aa, Mycobacterium
GEVTLRLTAASDCSDAT

SEQ ID NO: 665132 - protein, 25 aa, Mycobacterium
GEVVGWSAADAREWGETKLGSVGRP

SEQ ID NO: 665133 - protein, 33 aa, Mycobacterium
GEVVKRCYAEVLPAARPGALFIDSSTISVSDAR

SEQ ID NO: 665134 - protein, 21 aa, Mycobacterium
GEVVKTWSWQDFPQLAALVKV

SEQ ID NO: 665135 - protein, 19 aa, Mycobacterium
GEVVVAFVVGDVGVAELDA

SEQ ID NO: 665136 - protein, 19 aa, Mycobacterium
GEWAIPRGYSIIVGIAQIH

SEQ ID NO: 665137 - protein, 23 aa, Mycobacterium
GEWALSPKPPWFVSNATAASTGE

SEQ ID NO: 665138 - protein, 25 aa, Mycobacterium
GEWATRITSFPADWSNVGFDAETRA

SEQ ID NO: 665139 - protein, 25 aa, Mycobacterium
GEWEWEFETDPSLLMRFSAATANAH

SEQ ID NO: 665140 - protein, 26 aa, Mycobacterium
GEWFELIWPLWRSGRSAITRFPGMAL

SEQ ID NO: 665141 - protein, 25 aa, Mycobacterium
GEWIAWRTEDGWGYRFIGDEEPNEW

SEQ ID NO: 665142 - protein, 17 aa, Mycobacterium
GEWKGGEFYTGHKANGF

SEQ ID NO: 665143 - protein, 23 aa, Mycobacterium
GEWKRPARAVLVFTDEDGATHRV

SEQ ID NO: 665144 - protein, 21 aa, Mycobacterium
GEWLPTDHPLASMPNVVLTPH

SEQ ID NO: 665145 - protein, 22 aa, Mycobacterium
GEWLPTDHPLVGMPNVVLTPHI

SEQ ID NO: 665146 - protein, 23 aa, Mycobacterium
GEWSPVCKACWWDEGAGPRVGAW

SEQ ID NO: 665147 - protein, 40 aa, Mycobacterium
GEWTEPTVLPAQWPVLLCNGAVGIAEGWATKVPAHNPREV

SEQ ID NO: 665148 - protein, 23 aa, Mycobacterium
GEYAEPLLAVLQPFTDRIAVIGQ

SEQ ID NO: 665149 - protein, 18 aa, Mycobacterium
GEYAMICAAAANNWIDER

SEQ ID NO: 665150 - protein, 18 aa, Mycobacterium
GEYAMICAAAANSWIDQR

SEQ ID NO: 665151 - protein, 17 aa, Mycobacterium
GEYATWLDAERVVVNVY

SEQ ID NO: 665152 - protein, 22 aa, Mycobacterium
GEYCVVKSGFGLEVAKTADVSV

SEQ ID NO: 665153 - protein, 23 aa, Mycobacterium
GEYDADLVLRPELAPGATGISVH

SEQ ID NO: 665154 - protein, 26 aa, Mycobacterium
GEYEAYLKRFLRWVPHESDADAWKNE

SEQ ID NO: 665155 - protein, 23 aa, Mycobacterium
GEYKYAINNSFGFGGHNVALAFG

SEQ ID NO: 665156 - protein, 21 aa, Mycobacterium
GEYLLPYEIVRQAADPDQVLL

SEQ ID NO: 665157 - protein, 20 aa, Mycobacterium
GEYLLVLTMHHIIVDGWSIG

SEQ ID NO: 665158 - protein, 24 aa, Mycobacterium
GEYLPRLRPGVMEVTIPMPTTGAD

SEQ ID NO: 665159 - protein, 24 aa, Mycobacterium
GEYRPGTLTSARWGLLEPPQPWLP

SEQ ID NO: 665160 - protein, 20 aa, Mycobacterium
GEYRPGTLTTGRWGLLEPPQ

SEQ ID NO: 665161 - protein, 19 aa, Mycobacterium
GFAAAGWPEESIIASMSIL

SEQ ID NO: 665162 - protein, 19 aa, Mycobacterium
GFAAATWLRGIKVVHVPTT

SEQ ID NO: 665163 - protein, 20 aa, Mycobacterium
GFAAHRGMTVLPLAKSASGG

SEQ ID NO: 665164 - protein, 19 aa, Mycobacterium
GFAALDVFAAEPLAPESPL

SEQ ID NO: 665165 - protein, 18 aa, Mycobacterium
GFAAMWADVRRPELRQFE

SEQ ID NO: 665166 - protein, 25 aa, Mycobacterium
GFAARLGLKDVRLALAAAEQLQVPL

SEQ ID NO: 665167 - protein, 18 aa, Mycobacterium
GFAAYHWERTVGGADYLA

SEQ ID NO: 665168 - protein, 18 aa, Mycobacterium
GFACADLTTFCRLDELGL

SEQ ID NO: 665169 - protein, 19 aa, Mycobacterium
GFACQSFAALSLDPPLVLF

SEQ ID NO: 665170 - protein, 20 aa, Mycobacterium
GFACQSFAALSLEPPLVLFC

SEQ ID NO: 665171 - protein, 34 aa, Mycobacterium
GFADFPRYPLNIVSDLNAIAGIAFVHTDTPEINP

SEQ ID NO: 665172 - protein, 34 aa, Mycobacterium
GFADFPRYPLNIVSDLNAIAGIAFVHTDTPTINP

SEQ ID NO: 665173 - protein, 27 aa, Mycobacterium
GFADFPRYPLNVLSDVNAVFGILTVHR

SEQ ID NO: 665174 - protein, 23 aa, Mycobacterium
GFADRVLSTFVFDLLDEAYARTV

SEQ ID NO: 665175 - protein, 20 aa, Mycobacterium
GFADVCQTFGLPCPDTATAE

SEQ ID NO: 665176 - protein, 17 aa, Mycobacterium
GFAEAFNALAEHAPSDA

SEQ ID NO: 665177 - protein, 20 aa, Mycobacterium
GFAECVDLLGAYTAVCIDEF

SEQ ID NO: 665178 - protein, 23 aa, Mycobacterium
GFAEDARVLLVFGGSQGAQSINR

SEQ ID NO: 665179 - protein, 25 aa, Mycobacterium
GFAELSGRLLLSLDPPHHGRLRSIV

SEQ ID NO: 665180 - protein, 19 aa, Mycobacterium
GFAEVGWLWTLNGESACPA

SEQ ID NO: 665181 - protein, 18 aa, Mycobacterium
GFAFRPGGICLHAAPMFH

SEQ ID NO: 665182 - protein, 19 aa, Mycobacterium
GFAGDLLRRAYQHADTADF

SEQ ID NO: 665183 - protein, 18 aa, Mycobacterium
GFAGFECARRLSKQLKRH

SEQ ID NO: 665184 - protein, 19 aa, Mycobacterium
GFAGPRQRYTLAIMNSLNG

SEQ ID NO: 665185 - protein, 20 aa, Mycobacterium
GFAGPRQRYTLAIMNSLNGE

SEQ ID NO: 665186 - protein, 20 aa, Mycobacterium
GFAGTQWQLGLLVKIDGPVH

SEQ ID NO: 665187 - protein, 18 aa, Mycobacterium
GFAPLPMTVRVPGRRDGG

SEQ ID NO: 665188 - protein, 31 aa, Mycobacterium
GFAPPTLHAMGIRVATGFSARLFNLLITNVP

SEQ ID NO: 665189 - protein, 29 aa, Mycobacterium
GFAPPTLHAMGIRVATSFSARQFNLLITN

SEQ ID NO: 665190 - protein, 26 aa, Mycobacterium
GFAPQSRLAIRWALHNRSESECRKIL

SEQ ID NO: 665191 - protein, 22 aa, Mycobacterium
GFARRAANRVVFMSDGAVVEDA

SEQ ID NO: 665192 - protein, 18 aa, Mycobacterium
GFARRASDRVVFMSDGAI

SEQ ID NO: 665193 - protein, 22 aa, Mycobacterium
GFARRLRSPILVQLGTNDRVAP

SEQ ID NO: 665194 - protein, 23 aa, Mycobacterium
GFARSASDTVVFMDRGKVVESGP

SEQ ID NO: 665195 - protein, 17 aa, Mycobacterium
GFARWLRESPAVGVTDT

SEQ ID NO: 665196 - protein, 22 aa, Mycobacterium
GFASFPRYPLNLLSDLNAFLGI

SEQ ID NO: 665197 - protein, 25 aa, Mycobacterium
GFASSRLGVAIALEAMRMVEDDVAS

SEQ ID NO: 665198 - protein, 25 aa, Mycobacterium
GFASSRLGVALGLEAIRMLEEGVAD

SEQ ID NO: 665199 - protein, 18 aa, Mycobacterium
GFATAYEGLRRAGVSGDH

SEQ ID NO: 665200 - protein, 18 aa, Mycobacterium
GFATFFFLLAGDHLVILE

SEQ ID NO: 665201 - protein, 17 aa, Mycobacterium
GFATVWLTEHHFLEEYC

SEQ ID NO: 665202 - protein, 20 aa, Mycobacterium
GFAVPACLPVGNPVAAMTTP

SEQ ID NO: 665203 - protein, 24 aa, Mycobacterium
GFAVSARCGTGAGLATGPGVTGVT

SEQ ID NO: 665204 - protein, 17 aa, Mycobacterium
GFCRSASLDEIRAEGYV

SEQ ID NO: 665205 - protein, 19 aa, Mycobacterium
GFCSTSRLGSRLPRAASPR

SEQ ID NO: 665206 - protein, 17 aa, Mycobacterium
GFDAEFFGISAREAQTM

SEQ ID NO: 665207 - protein, 19 aa, Mycobacterium
GFDAEWRGIAVLMVGGGLV

SEQ ID NO: 665208 - protein, 25 aa, Mycobacterium
GFDAEWRMVLLVAVDGVVNHCEVFD

SEQ ID NO: 665209 - protein, 20 aa, Mycobacterium
GFDAFYRRCRLVTERLWPTL

SEQ ID NO: 665210 - protein, 23 aa, Mycobacterium
GFDAGVSILHFLGGHTADVVGDR

SEQ ID NO: 665211 - protein, 18 aa, Mycobacterium
GFDDVVFHLAITPDRGYC

SEQ ID NO: 665212 - protein, 22 aa, Mycobacterium
GFDFMPVVFAMFQWGKRHLPGG

SEQ ID NO: 665213 - protein, 24 aa, Mycobacterium
GFDFPEIKAPIGRGVASGVAATNG

SEQ ID NO: 665214 - protein, 18 aa, Mycobacterium
GFDGASCGVNVAIGAQSP

SEQ ID NO: 665215 - protein, 20 aa, Mycobacterium
GFDGEALVKALLFSVFEGGL

SEQ ID NO: 665216 - protein, 25 aa, Mycobacterium
GFDGLLWRHYAEIGALGIGVPSDCG

SEQ ID NO: 665217 - protein, 18 aa, Mycobacterium
GFDGLVFHPCVETIDQVD

SEQ ID NO: 665218 - protein, 17 aa, Mycobacterium
GFDHARSQIIGRIDADS

SEQ ID NO: 665219 - protein, 28 aa, Mycobacterium
GFDIFLWELFGPLVAGARLVFMDAARRE

SEQ ID NO: 665220 - protein, 24 aa, Mycobacterium
GFDISPRMAAAISDSAPQLGADPQ

SEQ ID NO: 665221 - protein, 18 aa, Mycobacterium
GFDKNLWERLCGMGATTM

SEQ ID NO: 665222 - protein, 29 aa, Mycobacterium
GFDKSRPTAWIAEGLFGYLPSEAQDRLLD

SEQ ID NO: 665223 - protein, 17 aa, Mycobacterium
GFDKVDSGWEWNAGLLY

SEQ ID NO: 665224 - protein, 21 aa, Mycobacterium
GFDLDFSELVFLGERANVPDY

SEQ ID NO: 665225 - protein, 26 aa, Mycobacterium
GFDPDRPTAWIAEGLLPYLPPDAQDR

SEQ ID NO: 665226 - protein, 19 aa, Mycobacterium
GFDPEGFQIVLFDQRGCGD

SEQ ID NO: 665227 - protein, 18 aa, Mycobacterium
GFDPRRPTSWSAEGLLMY

SEQ ID NO: 665228 - protein, 27 aa, Mycobacterium
GFDPTRPTAWLAEGLLMYLPAEAQDKL

SEQ ID NO: 665229 - protein, 26 aa, Mycobacterium
GFDPVSLCGAIHRAHARWAAGCPAPR

SEQ ID NO: 665230 - protein, 24 aa, Mycobacterium
GFDQFKVSLSIGVMKMVRSDLASS

SEQ ID NO: 665231 - protein, 22 aa, Mycobacterium
GFDRSKYASGEFFDKYTDQVWE

SEQ ID NO: 665232 - protein, 24 aa, Mycobacterium
GFDSADLSLPWGQDAVISAVAAAN

SEQ ID NO: 665233 - protein, 23 aa, Mycobacterium
GFDSADLTLPWGQDAVISAVAAA

SEQ ID NO: 665234 - protein, 22 aa, Mycobacterium
GFDSLFLMDHFYQLPMLGTPDQ

SEQ ID NO: 665235 - protein, 25 aa, Mycobacterium
GFDSSPRTAHEWAPSRDTPALLQYT

SEQ ID NO: 665236 - protein, 25 aa, Mycobacterium
GFDSVFLMDHFYQLPGIGTPDQPML

SEQ ID NO: 665237 - protein, 22 aa, Mycobacterium
GFDSVFLMDHFYQLPMLGDPDQ

SEQ ID NO: 665238 - protein, 26 aa, Mycobacterium
GFDSWDEIPARIAIERVDMAEPKPLP

SEQ ID NO: 665239 - protein, 19 aa, Mycobacterium
GFDSYFYKVVALDCDNTLW

SEQ ID NO: 665240 - protein, 21 aa, Mycobacterium
GFDVLRILAPSVARDDAFRSW

SEQ ID NO: 665241 - protein, 19 aa, Mycobacterium
GFDVLRIMAPSVAHDDAFR

SEQ ID NO: 665242 - protein, 18 aa, Mycobacterium
GFDYSFLAAEAELVGAEL

SEQ ID NO: 665243 - protein, 20 aa, Mycobacterium
GFEGLSRFRCEPTRSPDKWI

SEQ ID NO: 665244 - protein, 24 aa, Mycobacterium
GFEIIGEAGAAVWHQLTTRDYHPA

SEQ ID NO: 665245 - protein, 18 aa, Mycobacterium
GFEIPAALVRTVLRDEEP

SEQ ID NO: 665246 - protein, 20 aa, Mycobacterium
GFELRSRYWIADRAEPRHDP

SEQ ID NO: 665247 - protein, 17 aa, Mycobacterium
GFENVWKNAPLFRELRE

SEQ ID NO: 665248 - protein, 17 aa, Mycobacterium
GFEPFLRRARPFSPFLS

SEQ ID NO: 665249 - protein, 21 aa, Mycobacterium
GFEPIELVMGVSVYHVGYQFT

SEQ ID NO: 665250 - protein, 19 aa, Mycobacterium
GFEPPYIVAMVELAEEPDT

SEQ ID NO: 665251 - protein, 26 aa, Mycobacterium
GFERRRFSMNYVFALYALPGPMTISQ

SEQ ID NO: 665252 - protein, 21 aa, Mycobacterium
GFERSKYASGEFFDKYTEQIW

SEQ ID NO: 665253 - protein, 21 aa, Mycobacterium
GFERSKYASGEFFDKYTEQVW

SEQ ID NO: 665254 - protein, 29 aa, Mycobacterium
GFESAWRVNCLGAFLGMRAALGALSAAEG

SEQ ID NO: 665255 - protein, 17 aa, Mycobacterium
GFESLWVGEHPQIPVAA

SEQ ID NO: 665256 - protein, 27 aa, Mycobacterium
GFESWWRRAESVGFCAHPIQLTGTDEF

SEQ ID NO: 665257 - protein, 18 aa, Mycobacterium
GFETLICALPRIRGAELV

SEQ ID NO: 665258 - protein, 18 aa, Mycobacterium
GFETLWFGDQVVMADEDG

SEQ ID NO: 665259 - protein, 19 aa, Mycobacterium
GFETTLWARRQASLEPYSD

SEQ ID NO: 665260 - protein, 24 aa, Mycobacterium
GFEVSRKLAKMGWRSSDTAELSFV

SEQ ID NO: 665261 - protein, 20 aa, Mycobacterium
GFEWASRIAGHLVGEFPHKK

SEQ ID NO: 665262 - protein, 30 aa, Mycobacterium
GFEYPYAELDEIWKLVLLQQFHDILPGSSI

SEQ ID NO: 665263 - protein, 20 aa, Mycobacterium
GFFEKTFAPLGLRKIQAQVL

SEQ ID NO: 665264 - protein, 20 aa, Mycobacterium
GFFGRMLATIRPYRPSLSAA

SEQ ID NO: 665265 - protein, 19 aa, Mycobacterium
GFFGRMLATIRPYRPSLSH

SEQ ID NO: 665266 - protein, 18 aa, Mycobacterium
GFFHTGDLGRWVDGQYLL

SEQ ID NO: 665267 - protein, 18 aa, Mycobacterium
GFFLTKRDMDWFMDHFLD

SEQ ID NO: 665268 - protein, 25 aa, Mycobacterium
GFFNPLDGKFHWQGTIYAKPEGGEL

SEQ ID NO: 665269 - protein, 23 aa, Mycobacterium
GFFPQRRLRGLALHDGDTGRTWG

SEQ ID NO: 665270 - protein, 28 aa, Mycobacterium
GFFQDIIGRIGIESVRDRLTEAIEQELQ

SEQ ID NO: 665271 - protein, 20 aa, Mycobacterium
GFFRALDVTLPWDVDTVEDE

SEQ ID NO: 665272 - protein, 23 aa, Mycobacterium
GFFRALDYTLPWDVEGVSDVMPV

SEQ ID NO: 665273 - protein, 17 aa, Mycobacterium
GFFSFGIMHYYMTGVHT

SEQ ID NO: 665274 - protein, 22 aa, Mycobacterium
GFFSRPGLLTVGLRPLAPNVPR

SEQ ID NO: 665275 - protein, 17 aa, Mycobacterium
GFFTLLQPEQWGGLQCD

SEQ ID NO: 665276 - protein, 24 aa, Mycobacterium
GFFVDRHTLALGRDKALLDGQIQQ

SEQ ID NO: 665277 - protein, 27 aa, Mycobacterium
GFFWRGDAQGQIGFDYTITIPEIAVGF

SEQ ID NO: 665278 - protein, 27 aa, Mycobacterium
GFFWRGDAQGQIGFDYTITIPEIGLGL

SEQ ID NO: 665279 - protein, 21 aa, Mycobacterium
GFFWRGDAQGQIGFDYTLTVP

SEQ ID NO: 665280 - protein, 25 aa, Mycobacterium
GFGAAFWRRPEAYLDATVRAGISML

SEQ ID NO: 665281 - protein, 18 aa, Mycobacterium
GFGAKGYRINSADELLPT

SEQ ID NO: 665282 - protein, 17 aa, Mycobacterium
GFGARFLAQHRWRDGVM

SEQ ID NO: 665283 - protein, 19 aa, Mycobacterium
GFGAYAAFVPERRIGIVML

SEQ ID NO: 665284 - protein, 18 aa, Mycobacterium
GFGDGRGGLDVLVTKPVV

SEQ ID NO: 665285 - protein, 18 aa, Mycobacterium
GFGDRVLILMLNRPEYVE

SEQ ID NO: 665286 - protein, 19 aa, Mycobacterium
GFGELCDWLIENIDQSHTV

SEQ ID NO: 665287 - protein, 25 aa, Mycobacterium
GFGEQKARIFLALLGKQYGVTPEGW

SEQ ID NO: 665288 - protein, 25 aa, Mycobacterium
GFGEQKARIFLALLGKQYGVTPPGW

SEQ ID NO: 665289 - protein, 24 aa, Mycobacterium
GFGEVVPGLVIPGKIDKLGYKGID

SEQ ID NO: 665290 - protein, 29 aa, Mycobacterium
GFGFTLPSLFTVGVAPSFQVGTAPNQQSP

SEQ ID NO: 665291 - protein, 25 aa, Mycobacterium
GFGGNGGLGSAFGPGGTGGNGGSGG

SEQ ID NO: 665292 - protein, 22 aa, Mycobacterium
GFGGWIRLGLIPNQDHSWINVL

SEQ ID NO: 665293 - protein, 22 aa, Mycobacterium
GFGICAKYAPGYFSLDDWGYAS

SEQ ID NO: 665294 - protein, 19 aa, Mycobacterium
GFGKPRPTPGYWREIEKQV

SEQ ID NO: 665295 - protein, 18 aa, Mycobacterium
GFGLSRQHFVPLFDAELS

SEQ ID NO: 665296 - protein, 19 aa, Mycobacterium
GFGLYIGVEMVRDRKTLEP

SEQ ID NO: 665297 - protein, 19 aa, Mycobacterium
GFGLYLGVEMVRDPQTLEP

SEQ ID NO: 665298 - protein, 22 aa, Mycobacterium
GFGNAGARLTDAFNNIGFGNTG

SEQ ID NO: 665299 - protein, 17 aa, Mycobacterium
GFGNFLGQGNFGFGNRV

SEQ ID NO: 665300 - protein, 20 aa, Mycobacterium
GFGPEVKRRIMIGTYALSAG

SEQ ID NO: 665301 - protein, 17 aa, Mycobacterium
GFGREVVDAYAVQSQSR

SEQ ID NO: 665302 - protein, 17 aa, Mycobacterium
GFGRIGRNFYRALATQK

SEQ ID NO: 665303 - protein, 17 aa, Mycobacterium
GFGRIGRNFYRALLAQR

SEQ ID NO: 665304 - protein, 22 aa, Mycobacterium
GFGRVEGRPVGIVANQPTQFAG

SEQ ID NO: 665305 - protein, 19 aa, Mycobacterium
GFGSEVLRHAAIPQDGSQV

SEQ ID NO: 665306 - protein, 17 aa, Mycobacterium
GFGSLRPLLEVAAAHDR

SEQ ID NO: 665307 - protein, 18 aa, Mycobacterium
GFGSLRPLLEVAAAHDRG

SEQ ID NO: 665308 - protein, 21 aa, Mycobacterium
GFGSVRFRAEVPGSDGINPHD

SEQ ID NO: 665309 - protein, 19 aa, Mycobacterium
GFGVPRLAIDSGLRTDALG

SEQ ID NO: 665310 - protein, 24 aa, Mycobacterium
GFGVRRIEGINAWNGTIGVALAVL

SEQ ID NO: 665311 - protein, 17 aa, Mycobacterium
GFGYPWALGDAGDSLAN

SEQ ID NO: 665312 - protein, 17 aa, Mycobacterium
GFGYRFGSFDGDRPHPF

SEQ ID NO: 665313 - protein, 21 aa, Mycobacterium
GFHAAWCWERTAAALRALGHD

SEQ ID NO: 665314 - protein, 20 aa, Mycobacterium
GFHALDEVRGLLAAPDQDLE

SEQ ID NO: 665315 - protein, 21 aa, Mycobacterium
GFHHIVWALPGGTLFGIHQHD

SEQ ID NO: 665316 - protein, 20 aa, Mycobacterium
GFHIYARISRDWPYAKVRLA

SEQ ID NO: 665317 - protein, 18 aa, Mycobacterium
GFHLSQPAYRVMKANGGG

SEQ ID NO: 665318 - protein, 33 aa, Mycobacterium
GFHLSQPAYRVMKKNGGGRFVFISSSAGIFGQP

SEQ ID NO: 665319 - protein, 19 aa, Mycobacterium
GFHPDDWDSTAVLERWSKE

SEQ ID NO: 665320 - protein, 24 aa, Mycobacterium
GFHQPRPPWLMSRCATAPVCRTAE

SEQ ID NO: 665321 - protein, 20 aa, Mycobacterium
GFHVYARVARRWEFRQVRLA

SEQ ID NO: 665322 - protein, 23 aa, Mycobacterium
GFIAAEFAHVFSGLGSKVTVIAR

SEQ ID NO: 665323 - protein, 24 aa, Mycobacterium
GFIDGMYVLLGIGVPDDGGIINSA

SEQ ID NO: 665324 - protein, 23 aa, Mycobacterium
GFIEMAWKAPIALMADALGVEVT

SEQ ID NO: 665325 - protein, 18 aa, Mycobacterium
GFIPDLYATMADNPTVLL

SEQ ID NO: 665326 - protein, 25 aa, Mycobacterium
GFIPDVGGTFILSRTPGLLGVHAAM

SEQ ID NO: 665327 - protein, 17 aa, Mycobacterium
GFIRKSGSWFTYDGEQL

SEQ ID NO: 665328 - protein, 20 aa, Mycobacterium
GFIRQILGWREYMWHLYWHF

SEQ ID NO: 665329 - protein, 18 aa, Mycobacterium
GFIVPSWSSFLGCATAKV

SEQ ID NO: 665330 - protein, 19 aa, Mycobacterium
GFKESRIAEDTLLWCNRDL

SEQ ID NO: 665331 - protein, 19 aa, Mycobacterium
GFKGSRKSTPFAAQLAAEN

SEQ ID NO: 665332 - protein, 32 aa, Mycobacterium
GFKPPYMAFQTFWRFIDELSGPGLPPVIDRSL

SEQ ID NO: 665333 - protein, 21 aa, Mycobacterium
GFKTFGFGFGREDVWQPEEVM

SEQ ID NO: 665334 - protein, 25 aa, Mycobacterium
GFLDFPIPIGGLYLGGAGCHGGPGI

SEQ ID NO: 665335 - protein, 23 aa, Mycobacterium
GFLEAWYPRQVVSVQHGNPDGRM

SEQ ID NO: 665336 - protein, 20 aa, Mycobacterium
GFLEDLKLGFGTVLPHHSAF

SEQ ID NO: 665337 - protein, 18 aa, Mycobacterium
GFLERQVPRWLKELDSYA

SEQ ID NO: 665338 - protein, 19 aa, Mycobacterium
GFLIESRAGSILCDPWVNP

SEQ ID NO: 665339 - protein, 19 aa, Mycobacterium
GFLLADAFGKLSLLAATTE

SEQ ID NO: 665340 - protein, 17 aa, Mycobacterium
GFLLEMAGTTLADVMTA

SEQ ID NO: 665341 - protein, 17 aa, Mycobacterium
GFLLESMPVQIAFHDGV

SEQ ID NO: 665342 - protein, 17 aa, Mycobacterium
GFLLTKRDIDWFESQYL

SEQ ID NO: 665343 - protein, 18 aa, Mycobacterium
GFLNTGIWESWRHRPQRY

SEQ ID NO: 665344 - protein, 19 aa, Mycobacterium
GFLPTGGRALRVFEPSGDG

SEQ ID NO: 665345 - protein, 26 aa, Mycobacterium
GFLRLLSPKLLRWPDYLGNSMFMTLG

SEQ ID NO: 665346 - protein, 19 aa, Mycobacterium
GFLSEPWWCRMVVLSADRV

SEQ ID NO: 665347 - protein, 20 aa, Mycobacterium
GFLTPGLHRQRHCGAVTDLF

SEQ ID NO: 665348 - protein, 21 aa, Mycobacterium
GFLYFAGRRGDWIRVDGENTS

SEQ ID NO: 665349 - protein, 25 aa, Mycobacterium
GFMPKSVVINPYFDWGNDRPPDHQY

SEQ ID NO: 665350 - protein, 32 aa, Mycobacterium
GFMRDVPCPVCDGARLKPEILSVTLAAGEQDA

SEQ ID NO: 665351 - protein, 19 aa, Mycobacterium
GFNALSYHWDIVEERAATF

SEQ ID NO: 665352 - protein, 17 aa, Mycobacterium
GFNEGFFELASGHEVCA

SEQ ID NO: 665353 - protein, 20 aa, Mycobacterium
GFNIARVVAVALGYDFLPGT

SEQ ID NO: 665354 - protein, 20 aa, Mycobacterium
GFNIGRVVAVALGYDFLPGT

SEQ ID NO: 665355 - protein, 25 aa, Mycobacterium
GFPDYRPELPGGRPTGGRSLSAAPF

SEQ ID NO: 665356 - protein, 23 aa, Mycobacterium
GFPEELMASFTRCFDLIFEEALE

SEQ ID NO: 665357 - protein, 25 aa, Mycobacterium
GFPEELRASFTRTFDLVFAEAAEQG

SEQ ID NO: 665358 - protein, 18 aa, Mycobacterium
GFPEGFAGAGSGSLSSED

SEQ ID NO: 665359 - protein, 44 aa, Mycobacterium; identical to SEQ ID NO: 80150

SEQ ID NO: 665360 - protein, 24 aa, Mycobacterium
GFPESYNRRALMRFVTAVKSGADE

SEQ ID NO: 665361 - protein, 24 aa, Mycobacterium
GFPESYNRRGLLRFVTEVKSGARE

SEQ ID NO: 665362 - protein, 23 aa, Mycobacterium
GFPGMPDLLLVPAVLDLPDAPGA

SEQ ID NO: 665363 - protein, 34 aa, Mycobacterium
GFPKASVMTHLRWLKALAAFGGIGLRLKASDTLY

SEQ ID NO: 665364 - protein, 34 aa, Mycobacterium
GFPKASVMTHLRWLKALAAFGGIGLRLKSSDTLY

SEQ ID NO: 665365 - protein, 20 aa, Mycobacterium
GFPLPAMRDDVTWAADVLEL

SEQ ID NO: 665366 - protein, 23 aa, Mycobacterium
GFPNAPMRAVHLWAAPERVTEAA

SEQ ID NO: 665367 - protein, 22 aa, Mycobacterium
GFPNCNGRIPADTALLSEVLAE

SEQ ID NO: 665368 - protein, 20 aa, Mycobacterium
GFPSRLKIFATQSDSVDLKI

SEQ ID NO: 665369 - protein, 23 aa, Mycobacterium
GFPYYGRWLWAVARVLVEKHHIS

SEQ ID NO: 665370 - protein, 19 aa, Mycobacterium
GFQLLRPVKGEDRYFVVTQ

SEQ ID NO: 665371 - protein, 25 aa, Mycobacterium
GFQRAREVAFALPFTFDEEDYVQIV

SEQ ID NO: 665372 - protein, 25 aa, Mycobacterium
GFQRFADAMAPFGLRASAATPAYGM

SEQ ID NO: 665373 - protein, 23 aa, Mycobacterium
GFQSGCRCPGCSTAEARRLRRIG

SEQ ID NO: 665374 - protein, 20 aa, Mycobacterium
GFQSPKWQRLYAVIINAVTA

SEQ ID NO: 665375 - protein, 20 aa, Mycobacterium
GFQVLCEAGLLPGALTRNAG

SEQ ID NO: 665376 - protein, 20 aa, Mycobacterium
GFQVLCEAGLLPGALTRNTG

SEQ ID NO: 665377 - protein, 20 aa, Mycobacterium
GFQVLCEAGLLPGALTRNVG

SEQ ID NO: 665378 - protein, 25 aa, Mycobacterium
GFQVPEFRRKAVIIAVGGVYDPRIH

SEQ ID NO: 665379 - protein, 23 aa, Mycobacterium
GFRAALRDLTLMLVYEATRELAT

SEQ ID NO: 665380 - protein, 22 aa, Mycobacterium
GFRDRLGFLAADLVAYQNQSYA

SEQ ID NO: 665381 - protein, 23 aa, Mycobacterium
GFRFDLAATLAREFYDVDRLATF

SEQ ID NO: 665382 - protein, 23 aa, Mycobacterium
GFRFDLASTLAREFYDVDRLATF

SEQ ID NO: 665383 - protein, 23 aa, Mycobacterium
GFRFDLASTLAREFYDVDRLSAF

SEQ ID NO: 665384 - protein, 23 aa, Mycobacterium
GFRFDLASTLAREFYDVDRLSTF

SEQ ID NO: 665385 - protein, 23 aa, Mycobacterium
GFRFDLASTLAREFYEVDRLATF

SEQ ID NO: 665386 - protein, 19 aa, Mycobacterium
GFRFGESGLGNWNLDLENL

SEQ ID NO: 665387 - protein, 25 aa, Mycobacterium
GFRGRDTLFGYARHVLETTFVATSS

SEQ ID NO: 665388 - protein, 17 aa, Mycobacterium
GFRHARRAAALITPLMR

SEQ ID NO: 665389 - protein, 23 aa, Mycobacterium
GFRIEIPGPALARFEDAINAGDK

SEQ ID NO: 665390 - protein, 24 aa, Mycobacterium
GFRLNTCGFWSHLPGQRIPLSFGR

SEQ ID NO: 665391 - protein, 33 aa, Mycobacterium
GFRRFRPGTNLRAWLFRIMHNRWISTHRMTQRR

SEQ ID NO: 665392 - protein, 18 aa, Mycobacterium
GFRSALRGSGRPVIEVSD

SEQ ID NO: 665393 - protein, 25 aa, Mycobacterium
GFRTALRRAKILAGLDEDADVRIVT

SEQ ID NO: 665394 - protein, 18 aa, Mycobacterium
GFRTMLLHRGEQPRADSL

SEQ ID NO: 665395 - protein, 23 aa, Mycobacterium
GFRTYARFLARWQIDTTTGGLLD

SEQ ID NO: 665396 - protein, 24 aa, Mycobacterium
GFRVVRTPEDWLFKAYTADDAMVD

SEQ ID NO: 665397 - protein, 19 aa, Mycobacterium
GFRWWTRARALELGLTGFA

SEQ ID NO: 665398 - protein, 23 aa, Mycobacterium
GFRWWTRCRALELGLIGYAANQT

SEQ ID NO: 665399 - protein, 21 aa, Mycobacterium
GFRYFDNRDLLGFVDGTENPD

SEQ ID NO: 665400 - protein, 20 aa, Mycobacterium
GFRYRWRRFRGASDPLTDVL

SEQ ID NO: 665401 - protein, 24 aa, Mycobacterium
GFSAIKLKGGVFAPEEEMAAVEAL

SEQ ID NO: 665402 - protein, 18 aa, Mycobacterium
GFSASCEHPRLGPVRNPW

SEQ ID NO: 665403 - protein, 19 aa, Mycobacterium
GFSAVSWPKEYGGRDVTPL

SEQ ID NO: 665404 - protein, 19 aa, Mycobacterium
GFSDALALAAMQSISKHLR

SEQ ID NO: 665405 - protein, 19 aa, Mycobacterium
GFSEGGGMLVVERLSDAQR

SEQ ID NO: 665406 - protein, 19 aa, Mycobacterium
GFSGGSLNVIARRAGVAKG

SEQ ID NO: 665407 - protein, 25 aa, Mycobacterium
GFSGIGCGISLLKAGFTDFLMVDDA

SEQ ID NO: 665408 - protein, 18 aa, Mycobacterium
GFSHRPTYRRLKAECGRE

SEQ ID NO: 665409 - protein, 18 aa, Mycobacterium
GFSHRPTYRRLKAECSRE

SEQ ID NO: 665410 - protein, 30 aa, Mycobacterium
GFSMDGWYGRIFRGCGFFDPDKPIKKFTKK

SEQ ID NO: 665411 - protein, 19 aa, Mycobacterium
GFSQGAAVMGFVTSSAVPD

SEQ ID NO: 665412 - protein, 17 aa, Mycobacterium
GFSRARAAKDVTEAEAL

SEQ ID NO: 665413 - protein, 17 aa, Mycobacterium
GFSRPGTELTKRTLWSG

SEQ ID NO: 665414 - protein, 26 aa, Mycobacterium
GFSVPEQFGGPGVDDFRYNAILIDEL

SEQ ID NO: 665415 - protein, 26 aa, Mycobacterium
GFTAWPPWRPGVLFAGDSLGAGKPAS

SEQ ID NO: 665416 - protein, 25 aa, Mycobacterium
GFTAWPPWRPGVLFTGDSLGAGKPA

SEQ ID NO: 665417 - protein, 17 aa, Mycobacterium
GFTCARRLARILRRRHA

SEQ ID NO: 665418 - protein, 25 aa, Mycobacterium
GFTETLTWWQVYRRATIVADELRIC

SEQ ID NO: 665419 - protein, 24 aa, Mycobacterium
GFTGSLALELGFFGVRAKLVEPGY

SEQ ID NO: 665420 - protein, 18 aa, Mycobacterium
GFTNGFLMVLHDGAGDMV

SEQ ID NO: 665421 - protein, 19 aa, Mycobacterium
GFTNLVVRSHRELDLTDRA

SEQ ID NO: 665422 - protein, 18 aa, Mycobacterium
GFTPASLHDAYRALGAWG

SEQ ID NO: 665423 - protein, 17 aa, Mycobacterium
GFTQSYTYFTWRTGKSE

SEQ ID NO: 665424 - protein, 25 aa, Mycobacterium
GFTSEVRGIFTYRVDDVGLITNMRG

SEQ ID NO: 665425 - protein, 24 aa, Mycobacterium
GFTSEVRGVFTYRVNDEGLMTNMR

SEQ ID NO: 665426 - protein, 19 aa, Mycobacterium
GFTTFREIIEGIVGDAHQR

SEQ ID NO: 665427 - protein, 25 aa, Mycobacterium
GFTVPEFRRKAVIIAVGGVYDPRIH

SEQ ID NO: 665428 - protein, 19 aa, Mycobacterium
GFTYPRGYHTIAWLQQDIG

SEQ ID NO: 665429 - protein, 19 aa, Mycobacterium
GFVALPLLVGYDLDDPHPE

SEQ ID NO: 665430 - protein, 18 aa, Mycobacterium
GFVAPGFVDSHIHLTATG

SEQ ID NO: 665431 - protein, 18 aa, Mycobacterium
GFVCRAVAALLRSDVVAV

SEQ ID NO: 665432 - protein, 24 aa, Mycobacterium
GFVDAGVSGGIWGLTEGYGLMVGG

SEQ ID NO: 665433 - protein, 17 aa, Mycobacterium
GFVDGFWSTVWDYHREQ

SEQ ID NO: 665434 - protein, 17 aa, Mycobacterium
GFVDSLVHSRFRPGWLA

SEQ ID NO: 665435 - protein, 20 aa, Mycobacterium
GFVESFWKVVHAYQREPTAD

SEQ ID NO: 665436 - protein, 32 aa, Mycobacterium
GFVFEPLQLVELGLDIHLDWNRGIELISPIPG

SEQ ID NO: 665437 - protein, 17 aa, Mycobacterium
GFVGLRVVPWLWNAPPT

SEQ ID NO: 665438 - protein, 25 aa, Mycobacterium
GFVGTEWQLGLLIRIDGPVDRDALG

SEQ ID NO: 665439 - protein, 17 aa, Mycobacterium
GFVHSFPPMPLQPNGFM

SEQ ID NO: 665440 - protein, 20 aa, Mycobacterium
GFVKIFCRPATGVVIGGVVV

SEQ ID NO: 665441 - protein, 18 aa, Mycobacterium
GFVLKRAVKGTVESGLDE

SEQ ID NO: 665442 - protein, 19 aa, Mycobacterium
GFVPFPADRAAAYRAAGYW

SEQ ID NO: 665443 - protein, 18 aa, Mycobacterium
GFVPNMFAMLASNPAVLD

SEQ ID NO: 665444 - protein, 17 aa, Mycobacterium
GFVTAPGQGRCEVICFS

SEQ ID NO: 665445 - protein, 17 aa, Mycobacterium
GFVVRRGAKGVMDTATR

SEQ ID NO: 665446 - protein, 23 aa, Mycobacterium
GFWARLGHSVAFFTGTAYGSTPT

SEQ ID NO: 665447 - protein, 19 aa, Mycobacterium
GFWDGRDAVMAKMRALAEG

SEQ ID NO: 665448 - protein, 23 aa, Mycobacterium
GFWDPDGSLHWGVFEDDDTGFIA

SEQ ID NO: 665449 - protein, 22 aa, Mycobacterium
GFWLHRYYRLRYGWWEHPSPVS

SEQ ID NO: 665450 - protein, 20 aa, Mycobacterium
GFWNAGRVNTGFGNGGNFNL

SEQ ID NO: 665451 - protein, 19 aa, Mycobacterium
GFWPKWAHIGMFARQAAYL

SEQ ID NO: 665452 - protein, 18 aa, Mycobacterium
GFWSLGHTVALTRHLGQR

SEQ ID NO: 665453 - protein, 28 aa, Mycobacterium
GFYDEDRGPAAWVRGRAPEGRMCLEAQV

SEQ ID NO: 665454 - protein, 21 aa, Mycobacterium
GFYQLVCDFLNTFGVTPEDQS

SEQ ID NO: 665455 - protein, 18 aa, Mycobacterium
GFYYPSGRTKEMFKSGGE

SEQ ID NO: 665456 - protein, 18 aa, Mycobacterium
GGAAAAMAIELAAVAATV

SEQ ID NO: 665457 - protein, 22 aa, Mycobacterium
GGAAFLLCRRASRLNSHAAQWA

SEQ ID NO: 665458 - protein, 22 aa, Mycobacterium
GGAAFLLCRRASRLSSHSAQWA

SEQ ID NO: 665459 - protein, 22 aa, Mycobacterium
GGAAFLLCRRASRLTSHAAQWA

SEQ ID NO: 665460 - protein, 23 aa, Mycobacterium
GGAAFLMCRRATRLTSHSAQWAL

SEQ ID NO: 665461 - protein, 19 aa, Mycobacterium
GGAAFPLAVKLRTVRDNGR

SEQ ID NO: 665462 - protein, 19 aa, Mycobacterium
GGAAFPLAVKLTTVRSASL

SEQ ID NO: 665463 - protein, 20 aa, Mycobacterium
GGAAFPLAVKMRAVRDNCRR

SEQ ID NO: 665464 - protein, 19 aa, Mycobacterium
GGAAFPLGVKLRAVRRNGR

SEQ ID NO: 665465 - protein, 17 aa, Mycobacterium
GGAAGFFGHGGNGGAGG

SEQ ID NO: 665466 - protein, 23 aa, Mycobacterium
GGAAGLFAIGGNGGDGGRGGDAL

SEQ ID NO: 665467 - protein, 20 aa, Mycobacterium
GGAAGLWGSGGAGGAGGSTS

SEQ ID NO: 665468 - protein, 18 aa, Mycobacterium
GGAAGLWGTGGTGGAGGR

SEQ ID NO: 665469 - protein, 19 aa, Mycobacterium
GGAAGLWGTGGTGGAGGTS

SEQ ID NO: 665470 - protein, 23 aa, Mycobacterium
GGAAGPALFGIGVDGTAGVGGAG

SEQ ID NO: 665471 - protein, 18 aa, Mycobacterium
GGAALAYRPFALALAEAG

SEQ ID NO: 665472 - protein, 21 aa, Mycobacterium
GGAALPYKRRLFGQIVAAAVR

SEQ ID NO: 665473 - protein, 21 aa, Mycobacterium
GGAALPYKRRLFGQIVSAAVR

SEQ ID NO: 665474 - protein, 17 aa, Mycobacterium
GGAARERAGEFGLDRWY

SEQ ID NO: 665475 - protein, 23 aa, Mycobacterium
GGAARLAAAGVRVSAGVVADAVT

SEQ ID NO: 665476 - protein, 18 aa, Mycobacterium
GGAARLFGDGGSGGNGGV

SEQ ID NO: 665477 - protein, 18 aa, Mycobacterium
GGAARLFGNGGAGGSGGQ

SEQ ID NO: 665478 - protein, 18 aa, Mycobacterium
GGAARLFGTGGTGGAGGV

SEQ ID NO: 665479 - protein, 30 aa, Mycobacterium
GGAAVERRARWAVRVIISLLTFPGRDEADE

SEQ ID NO: 665480 - protein, 19 aa, Mycobacterium
GGADCGSSPAGPAVSAGAS

SEQ ID NO: 665481 - protein, 23 aa, Mycobacterium
GGADDFLAWFFKADRGELEPFVL

SEQ ID NO: 665482 - protein, 23 aa, Mycobacterium
GGADDFLAWFFKAERGELEPFVL

SEQ ID NO: 665483 - protein, 19 aa, Mycobacterium
GGADEARRGRDYVSHLVTI

SEQ ID NO: 665484 - protein, 17 aa, Mycobacterium
GGADIEAVLPKVRPIVQ

SEQ ID NO: 665485 - protein, 22 aa, Mycobacterium
GGADVRSGTGLLGLHDRAEALG

SEQ ID NO: 665486 - protein, 17 aa, Mycobacterium
GGAEGILDVLRRDHDLP

SEQ ID NO: 665487 - protein, 24 aa, Mycobacterium
GGAELGCVAAIKTLEICTRPEVRS

SEQ ID NO: 665488 - protein, 24 aa, Mycobacterium
GGAELGCVAALKTLEITSRPEVRS

SEQ ID NO: 665489 - protein, 22 aa, Mycobacterium
GGAEPLGSIALPKRVEHRQPKV

SEQ ID NO: 665490 - protein, 17 aa, Mycobacterium
GGAEPWAYLIVGGVQLA

SEQ ID NO: 665491 - protein, 21 aa, Mycobacterium
GGAEPWAYLIVGGVQLATHSW

SEQ ID NO: 665492 - protein, 23 aa, Mycobacterium
GGAERWLRRIAALTRDGVRRRLT

SEQ ID NO: 665493 - protein, 23 aa, Mycobacterium
GGAERWLRRVAALTQAGVRRRLD

SEQ ID NO: 665494 - protein, 18 aa, Mycobacterium
GGAETFHAIVSRFYAQVA

SEQ ID NO: 665495 - protein, 18 aa, Mycobacterium
GGAETFHAIVSRFYAQVP

SEQ ID NO: 665496 - protein, 18 aa, Mycobacterium
GGAFARRRTGVAGLRGLG

SEQ ID NO: 665497 - protein, 26 aa, Mycobacterium
GGAFIFPPSFLHWINYSVMAHQTGAT

SEQ ID NO: 665498 - protein, 26 aa, Mycobacterium
GGAFIFPPSFLHWINYSVMAQQTGAT

SEQ ID NO: 665499 - protein, 21 aa, Mycobacterium
GGAFLALLPRIERFWENSSAV

SEQ ID NO: 665500 - protein, 18 aa, Mycobacterium
GGAFTLTGTKVWCSGAGF

SEQ ID NO: 665501 - protein, 18 aa, Mycobacterium
GGAFTRVFRPWTHPAAPE

SEQ ID NO: 665502 - protein, 18 aa, Mycobacterium
GGAFYGPRGFYEAAGGGV

SEQ ID NO: 665503 - protein, 17 aa, Mycobacterium
GGAGAGFLQGNKCGACR

SEQ ID NO: 665504 - protein, 23 aa, Mycobacterium
GGAGAKGGQGYDDDGANNAGVGG

SEQ ID NO: 665505 - protein, 28 aa, Mycobacterium
GGAGASYGVAAIDFVLAGDGGAGGAATT

SEQ ID NO: 665506 - protein, 21 aa, Mycobacterium
GGAGCCDLAFAAPEVARALKA

SEQ ID NO: 665507 - protein, 25 aa, Mycobacterium
GGAGDRPAVRHGPPHVGGELTRAAL

SEQ ID NO: 665508 - protein, 23 aa, Mycobacterium
GGAGEAGGLLFGDGGTGAAATAT

SEQ ID NO: 665509 - protein, 18 aa, Mycobacterium
GGAGFSYPYLIGGGPSIG

SEQ ID NO: 665510 - protein, 25 aa, Mycobacterium
GGAGGAAGLFGRGGAGGAGGAGTAA

SEQ ID NO: 665511 - protein, 24 aa, Mycobacterium
GGAGGAAGWWGAGGAGGQGGTGGM

SEQ ID NO: 665512 - protein, 29 aa, Mycobacterium
GGAGGAGGKAWLMGDGGSGGHGGNGGAGG

SEQ ID NO: 665513 - protein, 21 aa, Mycobacterium
GGAGGAGGWGGDGHANQGDAV

SEQ ID NO: 665514 - protein, 23 aa, Mycobacterium
GGAGGAGGWLFGDGGAGGNGGAA

SEQ ID NO: 665515 - protein, 23 aa, Mycobacterium
GGAGGAGGWLIGSGGAGGTGGIG

SEQ ID NO: 665516 - protein, 24 aa, Mycobacterium
GGAGGAGGWLLGDGGGGGGGGSGG

SEQ ID NO: 665517 - protein, 23 aa, Mycobacterium
GGAGGAGGWLLGTGGAGGAGGYT

SEQ ID NO: 665518 - protein, 24 aa, Mycobacterium
GGAGGAGGWLMGTGGAGGAGGAGG

SEQ ID NO: 665519 - protein, 32 aa, Mycobacterium
GGAGGAGGWLVGNGGTGGRGGLGASATSFAGG

SEQ ID NO: 665520 - protein, 25 aa, Mycobacterium
GGAGGDAGWLGCGGAGGAGGITIGG

SEQ ID NO: 665521 - protein, 25 aa, Mycobacterium
GGAGGDGGAGGWLAGSAGAGGAGGT

SEQ ID NO: 665522 - protein, 26 aa, Mycobacterium
GGAGGDGGRAGWLSGNAGAGGGGGAG

SEQ ID NO: 665523 - protein, 36 aa, Mycobacterium
GGAGGDGGRGGWLLGIGGSGGFGGFGQGPSGGIGGD

SEQ ID NO: 665524 - protein, 17 aa, Mycobacterium
GGAGGELFGANGMDGLT

SEQ ID NO: 665525 - protein, 21 aa, Mycobacterium
GGAGGFLYGNGGNGFSQTTAG

SEQ ID NO: 665526 - protein, 17 aa, Mycobacterium
GGAGGFLYGNGGNGYSF

SEQ ID NO: 665527 - protein, 17 aa, Mycobacterium
GGAGGFYGNGGAGGAGG

SEQ ID NO: 665528 - protein, 25 aa, Mycobacterium
GGAGGGPADGCWVTVATAASAGLGL

SEQ ID NO: 665529 - protein, 22 aa, Mycobacterium
GGAGGHAGLFGIGGAGGEGGNS

SEQ ID NO: 665530 - protein, 21 aa, Mycobacterium
GGAGGHGGLLFGDGGAGGSGG

SEQ ID NO: 665531 - protein, 25 aa, Mycobacterium
GGAGGHGSALFGAAGANGNGGAGGA

SEQ ID NO: 665532 - protein, 24 aa, Mycobacterium
GGAGGIGLNLGNPGTPGSQGATGA

SEQ ID NO: 665533 - protein, 27 aa, Mycobacterium
GGAGGKGGLLLGGGGRGGAGGLGGAGG

SEQ ID NO: 665534 - protein, 24 aa, Mycobacterium
GGAGGKGGNAMFFGTAGNGGNGGY

SEQ ID NO: 665535 - protein, 23 aa, Mycobacterium
GGAGGKGGSEFGNGGNGGAGGAG

SEQ ID NO: 665536 - protein, 24 aa, Mycobacterium
GGAGGLGAFGQHGGGAGGAGGNAG

SEQ ID NO: 665537 - protein, 19 aa, Mycobacterium
GGAGGLLFGNGGAGGTGGS

SEQ ID NO: 665538 - protein, 20 aa, Mycobacterium
GGAGGLLWGNGGNGGSGAAG

SEQ ID NO: 665539 - protein, 28 aa, Mycobacterium
GGAGGMGGSGGWLLGNGGAGGAGGVGGA

SEQ ID NO: 665540 - protein, 25 aa, Mycobacterium
GGAGGNGGDAYVFGNGQPGGSGGAG

SEQ ID NO: 665541 - protein, 26 aa, Mycobacterium
GGAGGNGGNGGWLFSNGGVGGAGGAG

SEQ ID NO: 665542 - protein, 22 aa, Mycobacterium
GGAGGNGGWLLSNGGVGGAGGA

SEQ ID NO: 665543 - protein, 25 aa, Mycobacterium
GGAGGNGGWLWGYGGHGGAGGASLG

SEQ ID NO: 665544 - protein, 25 aa, Mycobacterium
GGAGGPWAGLVGAGGGDGGIGGMGQ

SEQ ID NO: 665545 - protein, 31 aa, Mycobacterium
GGAGGQGAALWGAGFGGDGAVGGNSFVGAGG

SEQ ID NO: 665546 - protein, 22 aa, Mycobacterium
GGAGGRAGLFGNGGAGGAGGTG

SEQ ID NO: 665547 - protein, 24 aa, Mycobacterium
GGAGGRGGLFYGAGGAGGDGGNGQ

SEQ ID NO: 665548 - protein, 23 aa, Mycobacterium
GGAGGRGGVGGQLLGNGGAGGAG

SEQ ID NO: 665549 - protein, 24 aa, Mycobacterium
GGAGGSAGLWGRGGDGGVGGDATI

SEQ ID NO: 665550 - protein, 25 aa, Mycobacterium
GGAGGSGGWLCGNGGAGGQGGAGAA

SEQ ID NO: 665551 - protein, 23 aa, Mycobacterium
GGAGGSGGWLVGNGGAGGIGGIG

SEQ ID NO: 665552 - protein, 20 aa, Mycobacterium
GGAGGTGFDGSAGGAGGNGG

SEQ ID NO: 665553 - protein, 21 aa, Mycobacterium
GGAGGTGGWLYGDGGGGGSGG

SEQ ID NO: 665554 - protein, 23 aa, Mycobacterium
GGAGGTGGWLYGNGGAGGAGGAG

SEQ ID NO: 665555 - protein, 23 aa, Mycobacterium
GGAGGTGGWLYGSGGSGGIGGVG

SEQ ID NO: 665556 - protein, 23 aa, Mycobacterium
GGAGGTGGWWFGNGGVGGAGGAG

SEQ ID NO: 665557 - protein, 25 aa, Mycobacterium
GGAGGVGGTGGWLSGSGGVGGAGGA

SEQ ID NO: 665558 - protein, 22 aa, Mycobacterium
GGAGGWFSGDGGVGGIGGGSTA

SEQ ID NO: 665559 - protein, 19 aa, Mycobacterium
GGAGGWLIGNGGSGAAGQN

SEQ ID NO: 665560 - protein, 25 aa, Mycobacterium
GGAGIPDYRYNVVLQEEAARALVTL

SEQ ID NO: 665561 - protein, 19 aa, Mycobacterium
GGAGIPGFYTRTAYGTNLA

SEQ ID NO: 665562 - protein, 29 aa, Mycobacterium
GGAGITGGFGGRGGQSVFTANAGGTITTS

SEQ ID NO: 665563 - protein, 30 aa, Mycobacterium
GGAGQRAAREWYAAHGLPVFAWSSLARGFF

SEQ ID NO: 665564 - protein, 19 aa, Mycobacterium
GGAGVFWKSDQNLEAPDLQ

SEQ ID NO: 665565 - protein, 21 aa, Mycobacterium
GGAHCGLICDASYPTFLLTHW

SEQ ID NO: 665566 - protein, 19 aa, Mycobacterium
GGAHFCLGANLARREIRVV

SEQ ID NO: 665567 - protein, 19 aa, Mycobacterium
GGAHKCIGMQFGTLEVKAI

SEQ ID NO: 665568 - protein, 18 aa, Mycobacterium
GGAHKCIGMVFGQLEIKT

SEQ ID NO: 665569 - protein, 19 aa, Mycobacterium
GGAHYGMICDSSFPTYLLA

SEQ ID NO: 665570 - protein, 23 aa, Mycobacterium
GGAIALGHPFGMTGARIATTLLN

SEQ ID NO: 665571 - protein, 19 aa, Mycobacterium
GGAIHVVDLATWKVTEATT

SEQ ID NO: 665572 - protein, 17 aa, Mycobacterium
GGAIHWDDLQWERSYNR

SEQ ID NO: 665573 - protein, 18 aa, Mycobacterium
GGAIIPGNGGAGGSAGAG

SEQ ID NO: 665574 - protein, 23 aa, Mycobacterium
GGAILVKCQHDLSLGTHPMDVSA

SEQ ID NO: 665575 - protein, 17 aa, Mycobacterium
GGAIVIISSTNGLRGTP

SEQ ID NO: 665576 - protein, 17 aa, Mycobacterium
GGAIVVHRAALGGRAGD

SEQ ID NO: 665577 - protein, 19 aa, Mycobacterium
GGAKAHYDGIVAFSQTDFT

SEQ ID NO: 665578 - protein, 17 aa, Mycobacterium
GGALAGVHPVDLGALGW

SEQ ID NO: 665579 - protein, 21 aa, Mycobacterium
GGALAPLPVKAFDARSAADAY

SEQ ID NO: 665580 - protein, 17 aa, Mycobacterium
GGALAYRALAREFIDRF

SEQ ID NO: 665581 - protein, 23 aa, Mycobacterium
GGALIRIHPRRIVVWGLDSESPA

SEQ ID NO: 665582 - protein, 25 aa, Mycobacterium
GGALLTRLVTDLGLTVHTSVSTQAI

SEQ ID NO: 665583 - protein, 26 aa, Mycobacterium
GGALPLPFAGGSWVLWERRDESDAAI

SEQ ID NO: 665584 - protein, 27 aa, Mycobacterium
GGALPRWYPGAHIDLHLPSGRIRQYSL

SEQ ID NO: 665585 - protein, 24 aa, Mycobacterium
GGALRGLFDFKKGLREPVPLDEVE

SEQ ID NO: 665586 - protein, 20 aa, Mycobacterium
GGALRRYLLDKGELPESSLV

SEQ ID NO: 665587 - protein, 18 aa, Mycobacterium
GGALRVAHELSQDELAQL

SEQ ID NO: 665588 - protein, 17 aa, Mycobacterium
GGALSAGAMAFEGLHEV

SEQ ID NO: 665589 - protein, 20 aa, Mycobacterium
GGALSLMFDSLLGFTAAKLT

SEQ ID NO: 665590 - protein, 33 aa, Mycobacterium
GGALYPEWDVHTGRYRPEWSHVVDFPLTAGPDA

SEQ ID NO: 665591 - protein, 31 aa, Mycobacterium
GGAMLPLLIFASARAGLPFTSINYRLSADGI

SEQ ID NO: 665592 - protein, 24 aa, Mycobacterium
GGAMMRRAGYMYGSYLPRGPRGQV

SEQ ID NO: 665593 - protein, 17 aa, Mycobacterium
GGANGAFELNVYIPMMA

SEQ ID NO: 665594 - protein, 28 aa, Mycobacterium
GGANSQLLSLWGSAGAGGAGGIGGAGGA

SEQ ID NO: 665595 - protein, 20 aa, Mycobacterium
GGAPARRPAPVRVYVTGVGR

SEQ ID NO: 665596 - protein, 17 aa, Mycobacterium
GGAPARYGEAIRRTITA

SEQ ID NO: 665597 - protein, 24 aa, Mycobacterium
GGAPELLSQLAVALLGSDEHFPPP

SEQ ID NO: 665598 - protein, 18 aa, Mycobacterium
GGAPIHRAIVQRLRQAGT

SEQ ID NO: 665599 - protein, 17 aa, Mycobacterium
GGAPLHLITHLSRAGWL

SEQ ID NO: 665600 - protein, 24 aa, Mycobacterium
GGAPMPLTVIDFMHQRGVPFTEGF

SEQ ID NO: 665601 - protein, 21 aa, Mycobacterium
GGAPNLGDWVMAEGYSRELSS

SEQ ID NO: 665602 - protein, 26 aa, Mycobacterium
GGAPRRAAVCSYGYGGTIAHVLLEEA

SEQ ID NO: 665603 - protein, 19 aa, Mycobacterium
GGAQTGWVGRTLATYRANP

SEQ ID NO: 665604 - protein, 18 aa, Mycobacterium
GGARCCAVKASFRRRWLS

SEQ ID NO: 665605 - protein, 23 aa, Mycobacterium
GGARGYAHIGVIDALRARDYEIV

SEQ ID NO: 665606 - protein, 17 aa, Mycobacterium
GGARRGKAIIILNPADP

SEQ ID NO: 665607 - protein, 19 aa, Mycobacterium
GGARRGKAIIILNPADPPM

SEQ ID NO: 665608 - protein, 20 aa, Mycobacterium
GGARWEKAWHPAPAHPLNQP

SEQ ID NO: 665609 - protein, 20 aa, Mycobacterium
GGASDFQFAGSGGSGGTGGA

SEQ ID NO: 665610 - protein, 20 aa, Mycobacterium
GGASGGDSLIGIGSGGASGG

SEQ ID NO: 665611 - protein, 17 aa, Mycobacterium
GGASLGFIEGPHAPTGL

SEQ ID NO: 665612 - protein, 19 aa, Mycobacterium
GGASLGRSGGSGGAGGNAG

SEQ ID NO: 665613 - protein, 22 aa, Mycobacterium
GGASLRLPLAHGDLLVMGGSCQ

SEQ ID NO: 665614 - protein, 17 aa, Mycobacterium
GGATAFWDAAAFGLIDK

SEQ ID NO: 665615 - protein, 21 aa, Mycobacterium
GGATFRPSALQTLSHFPIAVA

SEQ ID NO: 665616 - protein, 18 aa, Mycobacterium
GGATIRLPGEAGWGNAMR

SEQ ID NO: 665617 - protein, 23 aa, Mycobacterium
GGATIRQLWGLGESMIPSDPEAA

SEQ ID NO: 665618 - protein, 23 aa, Mycobacterium
GGATKLSLQWTRSVKGSLAAGPA

SEQ ID NO: 665619 - protein, 31 aa, Mycobacterium
GGATLPLLIFASARAGLTFTPINYRLSADGI

SEQ ID NO: 665620 - protein, 25 aa, Mycobacterium
GGATLPVLIFAAARAGVAFTPINYR

SEQ ID NO: 665621 - protein, 23 aa, Mycobacterium
GGATQLALRWTRSVKGSLAAGPA

SEQ ID NO: 665622 - protein, 23 aa, Mycobacterium
GGATRLYFCEPIAHRQSGTDAMQ

SEQ ID NO: 665623 - protein, 25 aa, Mycobacterium
GGATTISGHHAGYGGNAGGGGQGAD

SEQ ID NO: 665624 - protein, 21 aa, Mycobacterium
GGAVCKLEAHLGRMAASAASM

SEQ ID NO: 665625 - protein, 26 aa, Mycobacterium
GGAVEWHKMGAGWSWTRKSRKTGSEV

SEQ ID NO: 665626 - protein, 19 aa, Mycobacterium
GGAVKFFAGRLVKAGERES

SEQ ID NO: 665627 - protein, 20 aa, Mycobacterium
GGAVLPGYFFSAGAENRPTL

SEQ ID NO: 665628 - protein, 19 aa, Mycobacterium
GGAVPAIFCAVIETTQRVL

SEQ ID NO: 665629 - protein, 20 aa, Mycobacterium
GGAVPAIIAEYLGLPQLTHV

SEQ ID NO: 665630 - protein, 23 aa, Mycobacterium
GGAVPAWRVERLMSTGFLPAVWR

SEQ ID NO: 665631 - protein, 17 aa, Mycobacterium
GGAVPVRTLHLVEAGVG

SEQ ID NO: 665632 - protein, 18 aa, Mycobacterium
GGAVRFFSGRLVKAAERE

SEQ ID NO: 665633 - protein, 19 aa, Mycobacterium
GGAVWSFSSISYCGSLSHN

SEQ ID NO: 665634 - protein, 19 aa, Mycobacterium
GGAWFPTPQFAQLGLGNLG

SEQ ID NO: 665635 - protein, 24 aa, Mycobacterium
GGAYIPGMCDYVVMVRNRSKVFLG

SEQ ID NO: 665636 - protein, 18 aa, Mycobacterium
GGAYLPTTVYLPSTVRLA

SEQ ID NO: 665637 - protein, 23 aa, Mycobacterium
GGAYLPVDITLPAARIESIVRQA

SEQ ID NO: 665638 - protein, 23 aa, Mycobacterium
GGAYRPDPAADWHLLAGDESALP

SEQ ID NO: 665639 - protein, 28 aa, Mycobacterium
GGAYSRRWRLRWRPGLAARRVEGREVHR

SEQ ID NO: 665640 - protein, 20 aa, Mycobacterium
GGCCDVADLKRCTLAGTSCG

SEQ ID NO: 665641 - protein, 18 aa, Mycobacterium
GGCDPLVVPAVLIPPTSS

SEQ ID NO: 665642 - protein, 25 aa, Mycobacterium
GGCEFAMAFDMRFAALGTTVLGHPE

SEQ ID NO: 665643 - protein, 19 aa, Mycobacterium
GGCELAMMCDVLIAADTAK

SEQ ID NO: 665644 - protein, 19 aa, Mycobacterium
GGCICCLPDGGGLDDALVK

SEQ ID NO: 665645 - protein, 19 aa, Mycobacterium
GGCICCLPDGGGLDEALIK

SEQ ID NO: 665646 - protein, 17 aa, Mycobacterium
GGCKSWVELPLRAPLGP

SEQ ID NO: 665647 - protein, 20 aa, Mycobacterium
GGCSCWIGITPAGPANESMG

SEQ ID NO: 665648 - protein, 24 aa, Mycobacterium
GGDAAGVPPSWRQCVEDVCVVTVG

SEQ ID NO: 665649 - protein, 25 aa, Mycobacterium
GGDADARAAALLQRIEARRAELDEE

SEQ ID NO: 665650 - protein, 19 aa, Mycobacterium
GGDAGMFGNGGAGGAGGDR

SEQ ID NO: 665651 - protein, 28 aa, Mycobacterium
GGDALAEILLPFGVPRFFQTDPSQFMPQ

SEQ ID NO: 665652 - protein, 20 aa, Mycobacterium
GGDALRDVKAGWKVADVYPV

SEQ ID NO: 665653 - protein, 25 aa, Mycobacterium
GGDALRDVKSGWKVVESFPALGADG

SEQ ID NO: 665654 - protein, 21 aa, Mycobacterium
GGDALRPAPVGAYPAGASAYG

SEQ ID NO: 665655 - protein, 28 aa, Mycobacterium
GGDALWALTFLRRRGVSASAVLLNPERA

SEQ ID NO: 665656 - protein, 23 aa, Mycobacterium
GGDAPLLLLRAARRLEPIDARLA

SEQ ID NO: 665657 - protein, 17 aa, Mycobacterium
GGDAREIGNGGNGGNAG

SEQ ID NO: 665658 - protein, 20 aa, Mycobacterium
GGDARFLSVLSIRQLATEPS

SEQ ID NO: 665659 - protein, 23 aa, Mycobacterium
GGDARRPAPVGAYPAGASAYGAE

SEQ ID NO: 665660 - protein, 22 aa, Mycobacterium
GGDARSWARANGFNVDDPSPPN

SEQ ID NO: 665661 - protein, 18 aa, Mycobacterium
GGDASVWEQTVVREEMWA

SEQ ID NO: 665662 - protein, 21 aa, Mycobacterium
GGDATRLLYTLGWHEVAVPPV

SEQ ID NO: 665663 - protein, 24 aa, Mycobacterium
GGDATRLLYTLGWHEVPPPASEEA

SEQ ID NO: 665664 - protein, 24 aa, Mycobacterium
GGDATRLLYTLGWHEVPPPPSADD

SEQ ID NO: 665665 - protein, 24 aa, Mycobacterium
GGDATRLLYTLGWHEVPVPESGDG

SEQ ID NO: 665666 - protein, 27 aa, Mycobacterium
GGDAVFSPRLAGFVLDSFTGRSNAPEP

SEQ ID NO: 665667 - protein, 18 aa, Mycobacterium
GGDAWVRAMMLVDAGADV

SEQ ID NO: 665668 - protein, 19 aa, Mycobacterium
GGDAWVRAMMLVDAGVDVL

SEQ ID NO: 665669 - protein, 19 aa, Mycobacterium
GGDCGRCRRTLRSIIEAYF

SEQ ID NO: 665670 - protein, 17 aa, Mycobacterium
GGDEFCTLVPEYSDGAA

SEQ ID NO: 665671 - protein, 17 aa, Mycobacterium
GGDEFCVLLPDATLVAA

SEQ ID NO: 665672 - protein, 26 aa, Mycobacterium
GGDEISAAVAACFEAQAEAYQTFGAH

SEQ ID NO: 665673 - protein, 31 aa, Mycobacterium
GGDEVSAAIAALFSFHGQSYQTLGAQAEAFH

SEQ ID NO: 665674 - protein, 25 aa, Mycobacterium
GGDEVSAAIAAVFSAHGVQYQAISA

SEQ ID NO: 665675 - protein, 26 aa, Mycobacterium
GGDEVSHAIATMLRNHGAQYQALSAQ

SEQ ID NO: 665676 - protein, 23 aa, Mycobacterium
GGDEWWIDVTLPMLESVRRKLRG

SEQ ID NO: 665677 - protein, 31 aa, Mycobacterium
GGDGGDANYAIPWGNSAYAGDGGYGGDGGTG

SEQ ID NO: 665678 - protein, 26 aa, Mycobacterium
GGDGGIGGHGGWLFGNAGAGGPGGSG

SEQ ID NO: 665679 - protein, 18 aa, Mycobacterium
GGDGGILIGNGGAGGSGA

SEQ ID NO: 665680 - protein, 24 aa, Mycobacterium
GGDGGLGGLVYGNGGGGGAGGVGG

SEQ ID NO: 665681 - protein, 25 aa, Mycobacterium
GGDGGNGGFGYVLIAGPNVTVGSET

SEQ ID NO: 665682 - protein, 22 aa, Mycobacterium
GGDGGNGGVFFGGGGDGGIGGH

SEQ ID NO: 665683 - protein, 18 aa, Mycobacterium
GGDGGRGGAGGFYGNGGA

SEQ ID NO: 665684 - protein, 26 aa, Mycobacterium
GGDGGRGGDALSDYSTVTGPSATGGN

SEQ ID NO: 665685 - protein, 24 aa, Mycobacterium
GGDGGRGGDAVVIGNGGNGGNGGL

SEQ ID NO: 665686 - protein, 25 aa, Mycobacterium
GGDGGRGGDAYAGHNAGNGGNGGVG

SEQ ID NO: 665687 - protein, 33 aa, Mycobacterium
GGDGGRGGLAGGLGGKGGDAGFFGNGGVGGDGQ

SEQ ID NO: 665688 - protein, 19 aa, Mycobacterium
GGDGGRGGTGGGLAGSGGT

SEQ ID NO: 665689 - protein, 22 aa, Mycobacterium
GGDGGSAGLLFSNGGAGGAGGA

SEQ ID NO: 665690 - protein, 25 aa, Mycobacterium
GGDGGVGGDGGRLGNGGTGGAGGAG

SEQ ID NO: 665691 - protein, 22 aa, Mycobacterium
GGDGKCKLVPYAKRTPRLARTR

SEQ ID NO: 665692 - protein, 25 aa, Mycobacterium
GGDGLCMAMGEWWRGAGRNRRFMLG

SEQ ID NO: 665693 - protein, 20 aa, Mycobacterium
GGDGRALYYVGFEGRGPDFK

SEQ ID NO: 665694 - protein, 22 aa, Mycobacterium
GGDGRCKLVPYAKRTPKTARTR

SEQ ID NO: 665695 - protein, 22 aa, Mycobacterium
GGDGRCKLVPYAKRTPRMARTR

SEQ ID NO: 665696 - protein, 22 aa, Mycobacterium
GGDGRCTLVPYAKRTPKLARTR

SEQ ID NO: 665697 - protein, 22 aa, Mycobacterium
GGDGRCTLVPYAKRTPRLARTR

SEQ ID NO: 665698 - protein, 22 aa, Mycobacterium
GGDGRTALAPAIAYGASGEHQS

SEQ ID NO: 665699 - protein, 18 aa, Mycobacterium
GGDGRYSPLPLMVAGRPA

SEQ ID NO: 665700 - protein, 24 aa, Mycobacterium
GGDGVGGAGGRGGDPGLGGAGGAG

SEQ ID NO: 665701 - protein, 24 aa, Mycobacterium
GGDIAVGANSVWRAMAGPTPRLNP

SEQ ID NO: 665702 - protein, 26 aa, Mycobacterium
GGDIKRPVWPMIVLRTPKGWTGPKVV

SEQ ID NO: 665703 - protein, 20 aa, Mycobacterium
GGDIRAALRGDLHVHSNWSD

SEQ ID NO: 665704 - protein, 21 aa, Mycobacterium
GGDIRRALALVSTRAELDTLL

SEQ ID NO: 665705 - protein, 17 aa, Mycobacterium
GGDLEFADELTLGRALS

SEQ ID NO: 665706 - protein, 23 aa, Mycobacterium
GGDLGLRRARAMAMVMLALPGAV

SEQ ID NO: 665707 - protein, 27 aa, Mycobacterium
GGDLLFRTSDTWPRVKALYCHPVGLDE

SEQ ID NO: 665708 - protein, 20 aa, Mycobacterium
GGDLPRPAIRCDAVGTQVAE

SEQ ID NO: 665709 - protein, 20 aa, Mycobacterium
GGDLYGCGAADMKSGDAVFL

SEQ ID NO: 665710 - protein, 25 aa, Mycobacterium
GGDNRCYLVLPPGAGKTMIGLEAAR

SEQ ID NO: 665711 - protein, 18 aa, Mycobacterium
GGDNTWVQFGYKNGGPET

SEQ ID NO: 665712 - protein, 18 aa, Mycobacterium
GGDPAIFGSTPGFDNALD

SEQ ID NO: 665713 - protein, 21 aa, Mycobacterium
GGDPGGMGYMISKRLISEYVH

SEQ ID NO: 665714 - protein, 21 aa, Mycobacterium
GGDPGSFGVGGTGGVAGGQGA

SEQ ID NO: 665715 - protein, 17 aa, Mycobacterium
GGDPLVFSVRTFSKIVA

SEQ ID NO: 665716 - protein, 18 aa, Mycobacterium
GGDRARILAVSPLIREMM

SEQ ID NO: 665717 - protein, 24 aa, Mycobacterium
GGDREFLEAALLAALAERRSAELE

SEQ ID NO: 665718 - protein, 26 aa, Mycobacterium
GGDRHTVVWLPRFFTESAMEDLALLV

SEQ ID NO: 665719 - protein, 26 aa, Mycobacterium
GGDRPAEKRRSWAVLGEMAELGEDAI

SEQ ID NO: 665720 - protein, 21 aa, Mycobacterium
GGDRPRWVTTDSVGHLQITHL

SEQ ID NO: 665721 - protein, 25 aa, Mycobacterium
GGDSLRAAEAFARMWDMGVAESISL

SEQ ID NO: 665722 - protein, 23 aa, Mycobacterium
GGDSRIPPLIGYPLGAQEGDTTL

SEQ ID NO: 665723 - protein, 24 aa, Mycobacterium
GGDTARIRSCPKLTDSIEHAVAEG

SEQ ID NO: 665724 - protein, 18 aa, Mycobacterium
GGDTSKYVDSWGGLMKVK

SEQ ID NO: 665725 - protein, 17 aa, Mycobacterium
GGDTVRRAELARRVAER

SEQ ID NO: 665726 - protein, 25 aa, Mycobacterium
GGDVARLTGRVRFAAPGGDAELLGL

SEQ ID NO: 665727 - protein, 18 aa, Mycobacterium
GGDVRCAEYAASGTPEVG

SEQ ID NO: 665728 - protein, 24 aa, Mycobacterium
GGDYRLVFDTGTWFTDNGIEGFYP

SEQ ID NO: 665729 - protein, 20 aa, Mycobacterium
GGEAARWLHRGLTSQDVVDT

SEQ ID NO: 665730 - protein, 18 aa, Mycobacterium
GGEAAWQAMIERPVGEAI

SEQ ID NO: 665731 - protein, 22 aa, Mycobacterium
GGEADRTGGVGGMGGAGGAAGL

SEQ ID NO: 665732 - protein, 17 aa, Mycobacterium
GGEAIERLMPLVGEGQL

SEQ ID NO: 665733 - protein, 20 aa, Mycobacterium
GGEAIRPGAVDQWVKSTDKN

SEQ ID NO: 665734 - protein, 28 aa, Mycobacterium
GGEAYPAELVDRWAPRRTILSVYGPTES

SEQ ID NO: 665735 - protein, 20 aa, Mycobacterium
GGECHLDAPMVNRALPGLDL

SEQ ID NO: 665736 - protein, 21 aa, Mycobacterium
GGECHLDAPMVNRALPGLDLA

SEQ ID NO: 665737 - protein, 24 aa, Mycobacterium
GGECHLDAPMVNRALPGLDLSALD

SEQ ID NO: 665738 - protein, 21 aa, Mycobacterium
GGECHLDAPMVNRALQGLDLT

SEQ ID NO: 665739 - protein, 27 aa, Mycobacterium
GGEDAVAAILRYCSEHRIAVVPFGGGT

SEQ ID NO: 665740 - protein, 23 aa, Mycobacterium
GGEDFCAGVDWIASNDGRRPRSG

SEQ ID NO: 665741 - protein, 28 aa, Mycobacterium
GGEELAWRLVDEDACLRPRSLYAAGKTA

SEQ ID NO: 665742 - protein, 28 aa, Mycobacterium
GGEELPCGWLKDKYGLAWQVTPSEYYDM

SEQ ID NO: 665743 - protein, 25 aa, Mycobacterium
GGEFSVKDLRTWHGTVLAAIEFSEM

SEQ ID NO: 665744 - protein, 19 aa, Mycobacterium
GGEGRLRLTDPDDMLTTGI

SEQ ID NO: 665745 - protein, 28 aa, Mycobacterium
GGEHAHWARRGGYVLSSFAPASLPAHEI

SEQ ID NO: 665746 - protein, 25 aa, Mycobacterium
GGEHRIEYRFTRTGLLFAGEDQVRL

SEQ ID NO: 665747 - protein, 19 aa, Mycobacterium
GGEILRLGSDSHRFVRAGH

SEQ ID NO: 665748 - protein, 19 aa, Mycobacterium
GGEILRLLLGHPAYADGRL

SEQ ID NO: 665749 - protein, 20 aa, Mycobacterium
GGELAVALHANFPPERITFH

SEQ ID NO: 665750 - protein, 17 aa, Mycobacterium
GGELFAFGHQDGYALYR

SEQ ID NO: 665751 - protein, 23 aa, Mycobacterium
GGELRYADLRKLRGVWLADDADD

SEQ ID NO: 665752 - protein, 20 aa, Mycobacterium
GGELSPYVRRNAELTALNLL

SEQ ID NO: 665753 - protein, 20 aa, Mycobacterium
GGELSPYVRRNAELTATNLL

SEQ ID NO: 665754 - protein, 18 aa, Mycobacterium
GGEMGRLWYEDGKMLHKK

SEQ ID NO: 665755 - protein, 20 aa, Mycobacterium
GGEMGRLWYEHGKLLEKKNT

SEQ ID NO: 665756 - protein, 20 aa, Mycobacterium
GGEMGRLWYEHGKLLQKKNT

SEQ ID NO: 665757 - protein, 20 aa, Mycobacterium
GGEMGRLWYEHGKMLHKKNT

SEQ ID NO: 665758 - protein, 27 aa, Mycobacterium
GGEMLTFADLIPWVKAHGDEHPELINM

SEQ ID NO: 665759 - protein, 21 aa, Mycobacterium
GGENIYPREIEEFLLTHPDIE

SEQ ID NO: 665760 - protein, 19 aa, Mycobacterium
GGENIYPREIEEFLYTHPD

SEQ ID NO: 665761 - protein, 24 aa, Mycobacterium
GGENRWLSAFVERVRASVGMLTDL

SEQ ID NO: 665762 - protein, 27 aa, Mycobacterium
GGEPFDAVVCSLVLCSVHDPGGVLRRL

SEQ ID NO: 665763 - protein, 24 aa, Mycobacterium
GGEPGRAFLRRSIDDAEQYLEDGV

SEQ ID NO: 665764 - protein, 25 aa, Mycobacterium
GGEPLRMARDLVRRGLETLTLDIYR

SEQ ID NO: 665765 - protein, 23 aa, Mycobacterium
GGEPRLVAYVVTRGGEELPVAQT

SEQ ID NO: 665766 - protein, 30 aa, Mycobacterium
GGEQEKLMAFCLAGALSFNLAAPESSDNRP

SEQ ID NO: 665767 - protein, 30 aa, Mycobacterium
GGEQEKLMAFCLAGALSFNLANPETGDNRP

SEQ ID NO: 665768 - protein, 30 aa, Mycobacterium
GGEQEKLMAFCLAGALSFNLASPESDNNKP

SEQ ID NO: 665769 - protein, 30 aa, Mycobacterium
GGEQEKLMAFCLAGALSFNLASPGSADTRP

SEQ ID NO: 665770 - protein, 23 aa, Mycobacterium
GGEQVFLCPLELASFTMATAEDR

SEQ ID NO: 665771 - protein, 26 aa, Mycobacterium
GGERLRVCARRGVLLASGGFEQNADM

SEQ ID NO: 665772 - protein, 20 aa, Mycobacterium
GGERPFSHWYVAKYDRCILS

SEQ ID NO: 665773 - protein, 19 aa, Mycobacterium
GGERRRLQLMLTLLSEPNV

SEQ ID NO: 665774 - protein, 21 aa, Mycobacterium
GGESMVHLAFQLSRISDSIKR

SEQ ID NO: 665775 - protein, 26 aa, Mycobacterium
GGESRASGMFEWRAPFGAMSAANWIG

SEQ ID NO: 665776 - protein, 19 aa, Mycobacterium
GGESTRPGAARVDPAVEAS

SEQ ID NO: 665777 - protein, 19 aa, Mycobacterium
GGESTRPGAARVDPGVETA

SEQ ID NO: 665778 - protein, 21 aa, Mycobacterium
GGESTRPGATRVDARVEASRV

SEQ ID NO: 665779 - protein, 19 aa, Mycobacterium
GGESTRPGATRVDPEVEIS

SEQ ID NO: 665780 - protein, 24 aa, Mycobacterium
GGETRIPIAGVRKHTAAAMVRSAF

SEQ ID NO: 665781 - protein, 32 aa, Mycobacterium
GGEVALHCCAPGVPWDLLQRSAFSAVSVDPGA

SEQ ID NO: 665782 - protein, 20 aa, Mycobacterium
GGEVHIGRQAIAGFYNNISG

SEQ ID NO: 665783 - protein, 24 aa, Mycobacterium
GGEVKLPGGLWIVTERAVATESGE

SEQ ID NO: 665784 - protein, 23 aa, Mycobacterium
GGEVLLVPHFVRRAIGSRVRPLA

SEQ ID NO: 665785 - protein, 18 aa, Mycobacterium
GGEWKFAVTKNGRHSLTH

SEQ ID NO: 665786 - protein, 24 aa, Mycobacterium
GGFALALACDIRFASPAASFGAVF

SEQ ID NO: 665787 - protein, 23 aa, Mycobacterium
GGFAQACALSLQEYQGGLPEVMI

SEQ ID NO: 665788 - protein, 19 aa, Mycobacterium
GGFDAAFGGARRDEERARA

SEQ ID NO: 665789 - protein, 17 aa, Mycobacterium
GGFDDGGFWVVTKHKDV

SEQ ID NO: 665790 - protein, 18 aa, Mycobacterium
GGFDDGGYWVVTKHKDVK

SEQ ID NO: 665791 - protein, 21 aa, Mycobacterium
GGFDHDLGWRKELLPEVDRDW

SEQ ID NO: 665792 - protein, 22 aa, Mycobacterium
GGFDLDACRKVVCDQDLASHQV

SEQ ID NO: 665793 - protein, 17 aa, Mycobacterium
GGFELLDDVGFAEAEET

SEQ ID NO: 665794 - protein, 20 aa, Mycobacterium
GGFGDKGYWAITKHKDVKEI

SEQ ID NO: 665795 - protein, 24 aa, Mycobacterium
GGFGGHGGDALLFGNGGNGANGGN

SEQ ID NO: 665796 - protein, 17 aa, Mycobacterium
GGFGGVDGLRRWLVDER

SEQ ID NO: 665797 - protein, 20 aa, Mycobacterium
GGFIDLRVDVIPGGMETYGV

SEQ ID NO: 665798 - protein, 18 aa, Mycobacterium
GGFIPAQDAQGWYDTGDL

SEQ ID NO: 665799 - protein, 20 aa, Mycobacterium
GGFLDAVRPTFLVLQSAMCI

SEQ ID NO: 665800 - protein, 19 aa, Mycobacterium
GGFLNTGIWESWRHRPERY

SEQ ID NO: 665801 - protein, 19 aa, Mycobacterium
GGFLNTGIWESWRHRPQRY

SEQ ID NO: 665802 - protein, 19 aa, Mycobacterium
GGFLTDWAAPVIEKAYAAG

SEQ ID NO: 665803 - protein, 24 aa, Mycobacterium
GGFLYGNGGNGYSFTSGGTQSGGT

SEQ ID NO: 665804 - protein, 17 aa, Mycobacterium
GGFPEEFVTELSANEPV

SEQ ID NO: 665805 - protein, 22 aa, Mycobacterium
GGFPVCGANGIIGYADQPNARG

SEQ ID NO: 665806 - protein, 26 aa, Mycobacterium
GGFQARLTLAYALGWQGRGREAEDVL

SEQ ID NO: 665807 - protein, 21 aa, Mycobacterium
GGFRNEMTFVLTGLDVEAKAG

SEQ ID NO: 665808 - protein, 21 aa, Mycobacterium
GGFRTPYVWQALIRDQGTPRV

SEQ ID NO: 665809 - protein, 18 aa, Mycobacterium
GGFSARVRGGDVDIAVTG

SEQ ID NO: 665810 - protein, 26 aa, Mycobacterium
GGFSPSGGRVLLVWDAPNLDMGLGSI

SEQ ID NO: 665811 - protein, 28 aa, Mycobacterium
GGFTGPLNWYRCFDRNWELTAETPAPTI

SEQ ID NO: 665812 - protein, 18 aa, Mycobacterium
GGFTGWRPQMPVTQWVMT

SEQ ID NO: 665813 - protein, 21 aa, Mycobacterium
GGFVPRLGDGRALLLGEIADT

SEQ ID NO: 665814 - protein, 24 aa, Mycobacterium
GGFVPRLGDGRALLLGELVDTDGR

SEQ ID NO: 665815 - protein, 22 aa, Mycobacterium
GGFVPRLGDGRALLLGELVGDD

SEQ ID NO: 665816 - protein, 22 aa, Mycobacterium
GGGAAAAHLVDWADDIDPAWLE

SEQ ID NO: 665817 - protein, 33 aa, Mycobacterium
GGGAAGPSGGGFDCSGLTQWAFAQATDGRIILP

SEQ ID NO: 665818 - protein, 21 aa, Mycobacterium
GGGAFDWDSQLFLCPYDVVEP

SEQ ID NO: 665819 - protein, 20 aa, Mycobacterium
GGGAGLPLLVVHGGPGLPHS

SEQ ID NO: 665820 - protein, 20 aa, Mycobacterium
GGGAHFCLGANLARREIRVV

SEQ ID NO: 665821 - protein, 20 aa, Mycobacterium
GGGAHFCLGANLARREITVA

SEQ ID NO: 665822 - protein, 20 aa, Mycobacterium
GGGAHFCLGANLARREITVL

SEQ ID NO: 665823 - protein, 25 aa, Mycobacterium
GGGAHKRIGMHFGTLEVKAILHEML

SEQ ID NO: 665824 - protein, 25 aa, Mycobacterium
GGGALYDYACHAIDLMNFIAGVPLA

SEQ ID NO: 665825 - protein, 28 aa, Mycobacterium
GGGAMRYICAGHPYPLLVSADGRSAYLQ

SEQ ID NO: 665826 - protein, 19 aa, Mycobacterium
GGGAPGFEPDLLVFKELRI

SEQ ID NO: 665827 - protein, 20 aa, Mycobacterium
GGGAPGFEPDLLVFKELRVL

SEQ ID NO: 665828 - protein, 18 aa, Mycobacterium
GGGAPGFEPDTLVYKELH

SEQ ID NO: 665829 - protein, 19 aa, Mycobacterium
GGGAPRIAAGIGQARTRMR

SEQ ID NO: 665830 - protein, 18 aa, Mycobacterium
GGGASVFATAVAQSAPES

SEQ ID NO: 665831 - protein, 18 aa, Mycobacterium
GGGATDWAAAAERAGNAV

SEQ ID NO: 665832 - protein, 23 aa, Mycobacterium
GGGATKPLMKWTDEEWHQVLDLN

SEQ ID NO: 665833 - protein, 18 aa, Mycobacterium
GGGAWCHPMDGPPPPGPG

SEQ ID NO: 665834 - protein, 19 aa, Mycobacterium
GGGAYFFRQLIGDIPDEAA

SEQ ID NO: 665835 - protein, 25 aa, Mycobacterium
GGGCLPKDIRAFMARAGELGANHAL

SEQ ID NO: 665836 - protein, 24 aa, Mycobacterium
GGGCLPKDIRAFMARAGELGASHA

SEQ ID NO: 665837 - protein, 27 aa, Mycobacterium
GGGDGGHWGDGGGPGSGSRRGMSGSHG

SEQ ID NO: 665838 - protein, 19 aa, Mycobacterium
GGGDIRAALRGDLHLHSNW

SEQ ID NO: 665839 - protein, 22 aa, Mycobacterium
GGGDIRAALRGDLHVHSNWSDG

SEQ ID NO: 665840 - protein, 26 aa, Mycobacterium
GGGDPWGGLIGGGWDLPRYRGALAAG

SEQ ID NO: 665841 - protein, 23 aa, Mycobacterium
GGGEARAAVLATYILNADTGYGT

SEQ ID NO: 665842 - protein, 17 aa, Mycobacterium
GGGEGATGFLSGRVTGA

SEQ ID NO: 665843 - protein, 20 aa, Mycobacterium
GGGFGGCVIALVPEDLADSV

SEQ ID NO: 665844 - protein, 22 aa, Mycobacterium
GGGFIGKWLKKMLSSARKTGSG

SEQ ID NO: 665845 - protein, 20 aa, Mycobacterium
GGGFVRLRLDIAYDGTDFAG

SEQ ID NO: 665846 - protein, 19 aa, Mycobacterium
GGGGARVLPTSGGITSGTA

SEQ ID NO: 665847 - protein, 18 aa, Mycobacterium
GGGGDGFLATNADGATGV

SEQ ID NO: 665848 - protein, 22 aa, Mycobacterium
GGGGDGGFFFGNGGKGGAAGSI

SEQ ID NO: 665849 - protein, 29 aa, Mycobacterium
GGGGGGYGGNSIRGTGGVGGEGGTGGNSA

SEQ ID NO: 665850 - protein, 31 aa, Mycobacterium
GGGGGLTLAVDFLGFGLFHGGAGGDGGAATG

SEQ ID NO: 665851 - protein, 22 aa, Mycobacterium
GGGGGTGGWLYGDGGAGGAGGS

SEQ ID NO: 665852 - protein, 22 aa, Mycobacterium
GGGGGTGGWLYGNGGHGGTGAT

SEQ ID NO: 665853 - protein, 18 aa, Mycobacterium
GGGGIGFGSPRPSPNRPG

SEQ ID NO: 665854 - protein, 18 aa, Mycobacterium
GGGGMWFPCNPVLERAGT

SEQ ID NO: 665855 - protein, 19 aa, Mycobacterium
GGGGMWFPCNPVLMRAGVD

SEQ ID NO: 665856 - protein, 25 aa, Mycobacterium
GGGGNFGVTTAMTFETFPVADSDVV

SEQ ID NO: 665857 - protein, 18 aa, Mycobacterium
GGGGQAFAGGAGGAGGTG

SEQ ID NO: 665858 - protein, 17 aa, Mycobacterium
GGGGRAGLIGNGGAGGA

SEQ ID NO: 665859 - protein, 25 aa, Mycobacterium
GGGGRRAIPRGGVFGRRQGAGVELA

SEQ ID NO: 665860 - protein, 18 aa, Mycobacterium
GGGGVWFPCNPVLVRAAP

SEQ ID NO: 665861 - protein, 17 aa, Mycobacterium
GGGHLGGAFAGGGGDGG

SEQ ID NO: 665862 - protein, 18 aa, Mycobacterium
GGGHLWKLVRSFDDPGTW

SEQ ID NO: 665863 - protein, 26 aa, Mycobacterium
GGGIAHRLGMRPSWVLDLNNGGCAAF

SEQ ID NO: 665864 - protein, 35 aa, Mycobacterium
GGGIEAFSGRSGRKRWGEIETVILRGWDGVVDAID

SEQ ID NO: 665865 - protein, 17 aa, Mycobacterium
GGGIGTPERAADYLSGE

SEQ ID NO: 665866 - protein, 20 aa, Mycobacterium
GGGIHRCIGAAFANMEMTTV

SEQ ID NO: 665867 - protein, 17 aa, Mycobacterium
GGGIPWRKQDKFFNAPA

SEQ ID NO: 665868 - protein, 23 aa, Mycobacterium
GGGIRGALTLGYLGRMEDILRDR

SEQ ID NO: 665869 - protein, 20 aa, Mycobacterium
GGGISGLLLGADGFNAPASS

SEQ ID NO: 665870 - protein, 32 aa, Mycobacterium
GGGISRKAAKWIPLLKNRVPVVAAELQNTAGI

SEQ ID NO: 665871 - protein, 18 aa, Mycobacterium
GGGITVDMFCHWNYVMEG

SEQ ID NO: 665872 - protein, 20 aa, Mycobacterium
GGGKGMRVVHDLGGISDALV

SEQ ID NO: 665873 - protein, 24 aa, Mycobacterium
GGGKNLGGLIARDLAANGAGAIAI

SEQ ID NO: 665874 - protein, 26 aa, Mycobacterium
GGGLAFALHCDIRIAAEDARFGSVFI

SEQ ID NO: 665875 - protein, 17 aa, Mycobacterium
GGGLFGSIGDFLRVQPG

SEQ ID NO: 665876 - protein, 31 aa, Mycobacterium
GGGLGGDGGDARWLGRGGVGGVGGAGEGSGN

SEQ ID NO: 665877 - protein, 18 aa, Mycobacterium
GGGLHFCLGAHVARAQLR

SEQ ID NO: 665878 - protein, 19 aa, Mycobacterium
GGGLHFCLGAHVARAQLRA

SEQ ID NO: 665879 - protein, 21 aa, Mycobacterium
GGGLIDFRYNTIITEEVTKGR

SEQ ID NO: 665880 - protein, 28 aa, Mycobacterium
GGGLLRLPERIPYAIAMELALTGDNLPA

SEQ ID NO: 665881 - protein, 28 aa, Mycobacterium
GGGLLRLPERIPYAIAMELALTGDNLSA

SEQ ID NO: 665882 - protein, 23 aa, Mycobacterium
GGGLLRLPKRIPYQKALELALTG

SEQ ID NO: 665883 - protein, 24 aa, Mycobacterium
GGGLLVTRAGKWLAAMTSRELAYV

SEQ ID NO: 665884 - protein, 25 aa, Mycobacterium
GGGLNRGLFNNGFLNIGIANSGDNG

SEQ ID NO: 665885 - protein, 22 aa, Mycobacterium
GGGLPIGACLAIGDTAELLTPG

SEQ ID NO: 665886 - protein, 23 aa, Mycobacterium
GGGLPIGACLAIGPAAELLTPGL

SEQ ID NO: 665887 - protein, 24 aa, Mycobacterium
GGGLPIGACLAVGPAADLMTPGLH

SEQ ID NO: 665888 - protein, 23 aa, Mycobacterium
GGGLPIGACLAVGPAAELMTPGL

SEQ ID NO: 665889 - protein, 23 aa, Mycobacterium
GGGLPIGACLAVGRAAELMTPGL

SEQ ID NO: 665890 - protein, 27 aa, Mycobacterium
GGGLPITYSRKVFIPVTHLCRDNCHYC

SEQ ID NO: 665891 - protein, 18 aa, Mycobacterium
GGGMPGGMLGRGGASPNP

SEQ ID NO: 665892 - protein, 19 aa, Mycobacterium
GGGMRICPAADYTDGLLDI

SEQ ID NO: 665893 - protein, 30 aa, Mycobacterium
GGGMTARLPQLVGAAMARRLSMTGEVVDAA

SEQ ID NO: 665894 - protein, 30 aa, Mycobacterium
GGGMTARLPQVVGAAMARRLSMTGEVVDAS

SEQ ID NO: 665895 - protein, 25 aa, Mycobacterium
GGGNFGVATAFTFRLHPVPTVICGP

SEQ ID NO: 665896 - protein, 24 aa, Mycobacterium
GGGNFGVVVNFEFQAHPIPQMVSA

SEQ ID NO: 665897 - protein, 17 aa, Mycobacterium
GGGNGAFELNVYIPMMA

SEQ ID NO: 665898 - protein, 21 aa, Mycobacterium
GGGNPDFRYNTIITEETSAGR

SEQ ID NO: 665899 - protein, 23 aa, Mycobacterium
GGGNPRAGATVVFPHAGAAAASY

SEQ ID NO: 665900 - protein, 17 aa, Mycobacterium
GGGPGYFASAFADAGAR

SEQ ID NO: 665901 - protein, 18 aa, Mycobacterium
GGGPGYFATAFARAGLDY

SEQ ID NO: 665902 - protein, 21 aa, Mycobacterium
GGGPRSCIGDHFAMLEATLAL

SEQ ID NO: 665903 - protein, 21 aa, Mycobacterium
GGGPRSCIGDHFAMLEVTLAL

SEQ ID NO: 665904 - protein, 17 aa, Mycobacterium
GGGQFAGPRGWFRDINH

SEQ ID NO: 665905 - protein, 19 aa, Mycobacterium
GGGQGGFGVAGGGDGGDGG

SEQ ID NO: 665906 - protein, 24 aa, Mycobacterium
GGGRALRGWQRRALVKYLAGQPRD

SEQ ID NO: 665907 - protein, 22 aa, Mycobacterium
GGGRGGCVLALARDWVQAQVIG

SEQ ID NO: 665908 - protein, 29 aa, Mycobacterium
GGGRGMRIVRELAELPIQVAAARREAQSA

SEQ ID NO: 665909 - protein, 20 aa, Mycobacterium
GGGRLRRPLLGLPMAHPGAV

SEQ ID NO: 665910 - protein, 17 aa, Mycobacterium
GGGRLVVMVTHNADAAA

SEQ ID NO: 665911 - protein, 21 aa, Mycobacterium
GGGRPHIRISYVAAPSPADIS

SEQ ID NO: 665912 - protein, 25 aa, Mycobacterium
GGGRRICIGQSFALMEMVLIAAIMS

SEQ ID NO: 665913 - protein, 19 aa, Mycobacterium
GGGRTSYRGLVQVNKGAHG

SEQ ID NO: 665914 - protein, 27 aa, Mycobacterium
GGGSELRRRISLVFQDPFSSLNPRARV

SEQ ID NO: 665915 - protein, 19 aa, Mycobacterium
GGGSFWTWREDMYAVAECL

SEQ ID NO: 665916 - protein, 18 aa, Mycobacterium
GGGSLGFAGAAATSGAAR

SEQ ID NO: 665917 - protein, 17 aa, Mycobacterium
GGGSLWLQVRDIYAAQQ

SEQ ID NO: 665918 - protein, 18 aa, Mycobacterium
GGGSPHIAHPKLTMEATP

SEQ ID NO: 665919 - protein, 20 aa, Mycobacterium
GGGTCGDCPLERGESASSAS

SEQ ID NO: 665920 - protein, 23 aa, Mycobacterium
GGGTGGNGGWLYGNAGSGGQGGA

SEQ ID NO: 665921 - protein, 19 aa, Mycobacterium
GGGTLIGRRHWRRVAGHGL

SEQ ID NO: 665922 - protein, 23 aa, Mycobacterium
GGGTPGRMSGFFNTASGGTGQSG

SEQ ID NO: 665923 - protein, 24 aa, Mycobacterium
GGGTRGDGWYSFDIAGVHVIALVN

SEQ ID NO: 665924 - protein, 24 aa, Mycobacterium
GGGTRRCLGAAFANMEMNVVLRTV

SEQ ID NO: 665925 - protein, 20 aa, Mycobacterium
GGGTRRCVGAVFANVEMDIV

SEQ ID NO: 665926 - protein, 24 aa, Mycobacterium
GGGTSLRFPLAHGDLLVMGGSCQR

SEQ ID NO: 665927 - protein, 20 aa, Mycobacterium
GGGVHFCLGAHVARAQLRAI

SEQ ID NO: 665928 - protein, 21 aa, Mycobacterium
GGGVRRCIGAAFANMEMNVTL

SEQ ID NO: 665929 - protein, 18 aa, Mycobacterium
GGGYRLSKEAVILYTMRS

SEQ ID NO: 665930 - protein, 20 aa, Mycobacterium
GGHALRLLQRAHLAEVRGYA

SEQ ID NO: 665931 - protein, 24 aa, Mycobacterium
GGHAPDLIRCVSFDNVIPGTTNPT

SEQ ID NO: 665932 - protein, 24 aa, Mycobacterium
GGHAVALLWSMRHIYDIAPGEVFW

SEQ ID NO: 665933 - protein, 27 aa, Mycobacterium
GGHAVALLWSMRNIYGIEPGDVFWTAS

SEQ ID NO: 665934 - protein, 22 aa, Mycobacterium
GGHEWPPFAARTLWEFFRAHPR

SEQ ID NO: 665935 - protein, 23 aa, Mycobacterium
GGHGGVGGFGDIGGKGGSGGTGG

SEQ ID NO: 665936 - protein, 19 aa, Mycobacterium
GGHGGVIDFEVETFMDGVT

SEQ ID NO: 665937 - protein, 17 aa, Mycobacterium
GGHGMEVLGCAQLSAPI

SEQ ID NO: 665938 - protein, 25 aa, Mycobacterium
GGHGQRFRLFIGVGVQDSEFAIAEH

SEQ ID NO: 665939 - protein, 20 aa, Mycobacterium
GGHHSWEDLDDLLISTYGEL

SEQ ID NO: 665940 - protein, 19 aa, Mycobacterium
GGHHSWEDLDDLLLATYSE

SEQ ID NO: 665941 - protein, 20 aa, Mycobacterium
GGHHSWEDLDDLLLTTYSEL

SEQ ID NO: 665942 - protein, 27 aa, Mycobacterium
GGHIAFEVAQRLPVRKLVVSGIVAPSK

SEQ ID NO: 665943 - protein, 20 aa, Mycobacterium
GGHKGCSVLVVRDQGHQGDQ

SEQ ID NO: 665944 - protein, 20 aa, Mycobacterium
GGHLDVCVLGAFQVSERGDL

SEQ ID NO: 665945 - protein, 19 aa, Mycobacterium
GGHLTRQLLYVALTRGRVE

SEQ ID NO: 665946 - protein, 17 aa, Mycobacterium
GGHPAKRTFQALRIAVN

SEQ ID NO: 665947 - protein, 25 aa, Mycobacterium
GGHSAGIGPLRWLPATPALLADDPE

SEQ ID NO: 665948 - protein, 26 aa, Mycobacterium
GGHSAGIGPLRWLPATPTLLANDPAW

SEQ ID NO: 665949 - protein, 24 aa, Mycobacterium
GGHSIRAGQKVQIWEGSANRDAAV

SEQ ID NO: 665950 - protein, 23 aa, Mycobacterium
GGIADCTIALGFEKMQPGSLSGG

SEQ ID NO: 665951 - protein, 27 aa, Mycobacterium
GGIAEGLIHVDGDAGLNGVAGTSGNAG

SEQ ID NO: 665952 - protein, 25 aa, Mycobacterium
GGIAHRLGMRPSWVLDLHNGGCAAF

SEQ ID NO: 665953 - protein, 19 aa, Mycobacterium
GGIARFTASAVFIVVSPEH

SEQ ID NO: 665954 - protein, 18 aa, Mycobacterium
GGIATRLVMYNALGDPGR

SEQ ID NO: 665955 - protein, 21 aa, Mycobacterium
GGICDGVSMAAAFALGAEGVQ

SEQ ID NO: 665956 - protein, 24 aa, Mycobacterium
GGICEINAGPGLRMHIAPSEGTPR

SEQ ID NO: 665957 - protein, 19 aa, Mycobacterium
GGICHWFHADAIYRAVLAL

SEQ ID NO: 665958 - protein, 18 aa, Mycobacterium
GGICHWFHGDAIYRAVLA

SEQ ID NO: 665959 - protein, 30 aa, Mycobacterium
GGIDAPAVWMMAHREIIRSGYAYVGVSAQR

SEQ ID NO: 665960 - protein, 22 aa, Mycobacterium
GGIDAPAVWMMAHREIVRAGYA

SEQ ID NO: 665961 - protein, 25 aa, Mycobacterium
GGIDKRRRAELIERFDLDPHKKART

SEQ ID NO: 665962 - protein, 18 aa, Mycobacterium
GGIDLLMGCENLPGLRWP

SEQ ID NO: 665963 - protein, 20 aa, Mycobacterium
GGIDPCYRVDAAGAIWRTSL

SEQ ID NO: 665964 - protein, 24 aa, Mycobacterium
GGIDRTRRAELIERFDLDPHKKAR

SEQ ID NO: 665965 - protein, 18 aa, Mycobacterium
GGIDSALMGLGRSSIHDL

SEQ ID NO: 665966 - protein, 25 aa, Mycobacterium
GGIELGDTVVLLAHYGITSLMTDTT

SEQ ID NO: 665967 - protein, 24 aa, Mycobacterium
GGIEPWGITNFQIFPNLEILIYHG

SEQ ID NO: 665968 - protein, 19 aa, Mycobacterium
GGIESHVWHLARALIRQGH

SEQ ID NO: 665969 - protein, 23 aa, Mycobacterium
GGIFFDRFREMLGDGLGTCPRSQ

SEQ ID NO: 665970 - protein, 23 aa, Mycobacterium
GGIFTRFPGMHIPFVDLTFTSPT

SEQ ID NO: 665971 - protein, 17 aa, Mycobacterium
GGIGFTWEHPAHLYLKR

SEQ ID NO: 665972 - protein, 17 aa, Mycobacterium
GGIGFTWEHPAHLYYKR

SEQ ID NO: 665973 - protein, 17 aa, Mycobacterium
GGIGFTWEHQAHLYFKR

SEQ ID NO: 665974 - protein, 19 aa, Mycobacterium
GGIGGDGGAAFSDAAAATG

SEQ ID NO: 665975 - protein, 25 aa, Mycobacterium
GGIGGDGGNAGMLFSNGGAGGAGGA

SEQ ID NO: 665976 - protein, 28 aa, Mycobacterium
GGIGGQGGAGGWLYGNGGIGGQGGAGAL

SEQ ID NO: 665977 - protein, 27 aa, Mycobacterium
GGIGSQGGILFSHAGADGSTGAPGAGG

SEQ ID NO: 665978 - protein, 18 aa, Mycobacterium
GGIGWVPYILERTDYVWE

SEQ ID NO: 665979 - protein, 18 aa, Mycobacterium
GGIHDWVLLTPGGLLYWP

SEQ ID NO: 665980 - protein, 17 aa, Mycobacterium
GGIKRMDAGAALRQPDV

SEQ ID NO: 665981 - protein, 18 aa, Mycobacterium
GGILADILNFLDGNDGNP

SEQ ID NO: 665982 - protein, 23 aa, Mycobacterium
GGILRLEVPAARRSTWDGAIAAI

SEQ ID NO: 665983 - protein, 17 aa, Mycobacterium
GGILRVLAPLFRLGLGG

SEQ ID NO: 665984 - protein, 28 aa, Mycobacterium
GGILSRFPGVHLPIADFTFFPATPSNVY

SEQ ID NO: 665985 - protein, 19 aa, Mycobacterium
GGIMIPALWASYPPYHDRR

SEQ ID NO: 665986 - protein, 27 aa, Mycobacterium
GGINDEFPFLLGHEAAGIVETVGQGVT

SEQ ID NO: 665987 - protein, 18 aa, Mycobacterium
GGINIGTGALAFGDGNTV

SEQ ID NO: 665988 - protein, 17 aa, Mycobacterium
GGINVVLMRVEDLFRHH

SEQ ID NO: 665989 - protein, 25 aa, Mycobacterium
GGIPDEYPLRGVVHAAGVLDDGLVL

SEQ ID NO: 665990 - protein, 25 aa, Mycobacterium
GGIPFSRMHIEIINNVGPISVPILH

SEQ ID NO: 665991 - protein, 18 aa, Mycobacterium
GGIPVAWEVAAALHAPLD

SEQ ID NO: 665992 - protein, 23 aa, Mycobacterium
GGIRVTGFVTWPGFARQQQIGTA

SEQ ID NO: 665993 - protein, 24 aa, Mycobacterium
GGIRVVGFLTWPGFERQRQIGTAF

SEQ ID NO: 665994 - protein, 24 aa, Mycobacterium
GGISEKFPLLFSVFSTGVTFVRAE

SEQ ID NO: 665995 - protein, 27 aa, Mycobacterium
GGISRKADKWIPMLKNRTPVVAAALQN

SEQ ID NO: 665996 - protein, 25 aa, Mycobacterium
GGISRKADKWLPLLENRTPVVAAAL

SEQ ID NO: 665997 - protein, 25 aa, Mycobacterium
GGISRKADKWVPLLTNRTPVVAAAL

SEQ ID NO: 665998 - protein, 26 aa, Mycobacterium
GGISRKAEKWLPLLENRTPVVAAALL

SEQ ID NO: 665999 - protein, 18 aa, Mycobacterium
GGISTNWAIARPPGQTKP

SEQ ID NO: 666000 - protein, 20 aa, Mycobacterium
GGITGIITMPWMFYAGPDAT

SEQ ID NO: 666001 - protein, 18 aa, Mycobacterium
GGITVCLNNAVYDSYSGA

SEQ ID NO: 666002 - protein, 17 aa, Mycobacterium
GGIVGTGGTGFAGDGGD

SEQ ID NO: 666003 - protein, 19 aa, Mycobacterium
GGIVPALLNYWPQQLANAI

SEQ ID NO: 666004 - protein, 33 aa, Mycobacterium
GGKAAAKCQQVWCPVCALAAVVGGEQHPLLTVI

SEQ ID NO: 666005 - protein, 28 aa, Mycobacterium
GGKAARFVKRYADIAGELRRAARQYADE

SEQ ID NO: 666006 - protein, 20 aa, Mycobacterium
GGKAKWSGVPGGLSHEVTRG

SEQ ID NO: 666007 - protein, 23 aa, Mycobacterium
GGKALKFYASVRMDVRRIETLKD

SEQ ID NO: 666008 - protein, 22 aa, Mycobacterium
GGKARFGKPHGWNCSEAPNDRR

SEQ ID NO: 666009 - protein, 18 aa, Mycobacterium
GGKDQLMLAVAEHEAQQV

SEQ ID NO: 666010 - protein, 25 aa, Mycobacterium
GGKEVIKVGKRCLLGANSGLGISLG

SEQ ID NO: 666011 - protein, 19 aa, Mycobacterium
GGKGGKGGLLFGSRGTTGT

SEQ ID NO: 666012 - protein, 19 aa, Mycobacterium
GGKINFRIDKQANLHFVIG

SEQ ID NO: 666013 - protein, 18 aa, Mycobacterium
GGKINFRVDKQANLHFII

SEQ ID NO: 666014 - protein, 18 aa, Mycobacterium
GGKINFRVDKQANLHFVI

SEQ ID NO: 666015 - protein, 17 aa, Mycobacterium
GGKIQWILENVPGVRED

SEQ ID NO: 666016 - protein, 25 aa, Mycobacterium
GGKLDLRAAAAFKVTAARLGEEVIS

SEQ ID NO: 666017 - protein, 20 aa, Mycobacterium
GGKLPAPVASFVGRGAETTQ

SEQ ID NO: 666018 - protein, 19 aa, Mycobacterium
GGKLQWILDNVDGVRDAAE

SEQ ID NO: 666019 - protein, 19 aa, Mycobacterium
GGKLQWILDNVDGVREAAE

SEQ ID NO: 666020 - protein, 18 aa, Mycobacterium
GGKLQWILENVEGVRRDA

SEQ ID NO: 666021 - protein, 20 aa, Mycobacterium
GGKLQWLLENVDGLRADAAN

SEQ ID NO: 666022 - protein, 24 aa, Mycobacterium
GGKLSHAIADWALISRTEAARRIK

SEQ ID NO: 666023 - protein, 24 aa, Mycobacterium
GGKMAGRDRLQVIAPDVSAQLARV

SEQ ID NO: 666024 - protein, 20 aa, Mycobacterium
GGKPIHEWLEVRPFLGDSDA

SEQ ID NO: 666025 - protein, 18 aa, Mycobacterium
GGKPRPGNLLRRVPHQAN

SEQ ID NO: 666026 - protein, 25 aa, Mycobacterium
GGKQEGRAGLSWVLDPIDGTVNFVY

SEQ ID NO: 666027 - protein, 24 aa, Mycobacterium
GGKTFPLPSPFLVMATQNPIEQEG

SEQ ID NO: 666028 - protein, 24 aa, Mycobacterium
GGKTGMDCCLWLLRNGVPADAVRW

SEQ ID NO: 666029 - protein, 18 aa, Mycobacterium
GGKVTAWRYIRAAVPAVW

SEQ ID NO: 666030 - protein, 25 aa, Mycobacterium
GGKVTGQRVVARFGGAVPGSDGQAP

SEQ ID NO: 666031 - protein, 20 aa, Mycobacterium
GGKVWRFVDTAGLRRKVGQA

SEQ ID NO: 666032 - protein, 18 aa, Mycobacterium
GGKVYLRKRCRDHGEFEA

SEQ ID NO: 666033 - protein, 19 aa, Mycobacterium
GGLAAWRAAGYRLETGPVE

SEQ ID NO: 666034 - protein, 23 aa, Mycobacterium
GGLADCTVALGFEKMKPGSLSSS

SEQ ID NO: 666035 - protein, 17 aa, Mycobacterium
GGLAFQCLEPFDTWTMS

SEQ ID NO: 666036 - protein, 19 aa, Mycobacterium
GGLALHFEVAPPVGTAPGR

SEQ ID NO: 666037 - protein, 25 aa, Mycobacterium
GGLAPRGAMGVSVLVGKLSIPPAEV

SEQ ID NO: 666038 - protein, 19 aa, Mycobacterium
GGLCLALACDVRVASQDAY

SEQ ID NO: 666039 - protein, 21 aa, Mycobacterium
GGLDLKWSHLGADNTSLFLKD

SEQ ID NO: 666040 - protein, 20 aa, Mycobacterium
GGLDLKWSHLGADNTSLFLR

SEQ ID NO: 666041 - protein, 22 aa, Mycobacterium
GGLDPSSGVALMLDQCHNVEAK

SEQ ID NO: 666042 - protein, 19 aa, Mycobacterium
GGLDRFWLSAAQAHVAGVR

SEQ ID NO: 666043 - protein, 18 aa, Mycobacterium
GGLDRKRTLLALERKRAS

SEQ ID NO: 666044 - protein, 17 aa, Mycobacterium
GGLDTSVAISWIGKETG

SEQ ID NO: 666045 - protein, 22 aa, Mycobacterium
GGLDTSVAISWIGKETGKEVVA

SEQ ID NO: 666046 - protein, 19 aa, Mycobacterium
GGLDVCAAAGCHLAGGHSV

SEQ ID NO: 666047 - protein, 24 aa, Mycobacterium
GGLDVCALAGCHLAGGHSVDDPEP

SEQ ID NO: 666048 - protein, 25 aa, Mycobacterium
GGLDVLVHAAGLWQAGIPGYIGVEE

SEQ ID NO: 666049 - protein, 19 aa, Mycobacterium
GGLEAHVWHLAKALADQGH

SEQ ID NO: 666050 - protein, 17 aa, Mycobacterium
GGLEAKTAVVVGAGAMG

SEQ ID NO: 666051 - protein, 17 aa, Mycobacterium
GGLEGLREFQQVKNIRI

SEQ ID NO: 666052 - protein, 20 aa, Mycobacterium
GGLEKARAKPGLSVLATEDT

SEQ ID NO: 666053 - protein, 24 aa, Mycobacterium
GGLEKLATLGVTWVHVGLPGDGLA

SEQ ID NO: 666054 - protein, 17 aa, Mycobacterium
GGLELAIWCDLRVVEED

SEQ ID NO: 666055 - protein, 24 aa, Mycobacterium
GGLELALWCDLRIVEQDAVLGVFC

SEQ ID NO: 666056 - protein, 19 aa, Mycobacterium
GGLELALWCDLRVAEEDAV

SEQ ID NO: 666057 - protein, 18 aa, Mycobacterium
GGLELALWCDLRVAEQDA

SEQ ID NO: 666058 - protein, 20 aa, Mycobacterium
GGLELALWCDLRVVDEDATM

SEQ ID NO: 666059 - protein, 23 aa, Mycobacterium
GGLEPGHGLKIGYFAQEHDTLDT

SEQ ID NO: 666060 - protein, 19 aa, Mycobacterium
GGLERPAIEVDYEVGESVT

SEQ ID NO: 666061 - protein, 17 aa, Mycobacterium
GGLERPKMPDIPGLDEY

SEQ ID NO: 666062 - protein, 20 aa, Mycobacterium
GGLERPVIEVDFEVGESVTV

SEQ ID NO: 666063 - protein, 18 aa, Mycobacterium
GGLERPVLEVDYEVGESV

SEQ ID NO: 666064 - protein, 21 aa, Mycobacterium
GGLEVKSWCGFVEGSGQAHLV

SEQ ID NO: 666065 - protein, 17 aa, Mycobacterium
GGLEVWAPAVMPPIGVE

SEQ ID NO: 666066 - protein, 19 aa, Mycobacterium
GGLFAGITARYLALVATTL

SEQ ID NO: 666067 - protein, 20 aa, Mycobacterium
GGLFAGITARYLALVATTLP

SEQ ID NO: 666068 - protein, 18 aa, Mycobacterium
GGLFAGITARYLALVTTT

SEQ ID NO: 666069 - protein, 24 aa, Mycobacterium
GGLFGRSRPLFSLGLGARLGNGRW

SEQ ID NO: 666070 - protein, 17 aa, Mycobacterium
GGLGAFMNWPGPTFTDS

SEQ ID NO: 666071 - protein, 17 aa, Mycobacterium
GGLGAPRYGVKPTVMAR

SEQ ID NO: 666072 - protein, 17 aa, Mycobacterium
GGLGEVLGSILGGGSGD

SEQ ID NO: 666073 - protein, 21 aa, Mycobacterium
GGLGFSMKWNMGWMNDTLAYI

SEQ ID NO: 666074 - protein, 20 aa, Mycobacterium
GGLGGCPFAPGASGNIATED

SEQ ID NO: 666075 - protein, 21 aa, Mycobacterium
GGLGGCPFAPGASGNIAVEDL

SEQ ID NO: 666076 - protein, 20 aa, Mycobacterium
GGLGGCPFAPGATGNIATED

SEQ ID NO: 666077 - protein, 21 aa, Mycobacterium
GGLGGCPFAPGATGNIATEDL

SEQ ID NO: 666078 - protein, 23 aa, Mycobacterium
GGLGGDAGLVFGVGGPGGDGGDG

SEQ ID NO: 666079 - protein, 21 aa, Mycobacterium
GGLGGLAYELARMLIERFDGR

SEQ ID NO: 666080 - protein, 20 aa, Mycobacterium
GGLGGLGLFLAEKMADAGAG

SEQ ID NO: 666081 - protein, 20 aa, Mycobacterium
GGLGGLGLFLAEKMATAGAG

SEQ ID NO: 666082 - protein, 25 aa, Mycobacterium
GGLGGNGTDGGWLSGNGGDGGAGGQ

SEQ ID NO: 666083 - protein, 20 aa, Mycobacterium
GGLGHLGLQFARAMGFETIA

SEQ ID NO: 666084 - protein, 25 aa, Mycobacterium
GGLGNAGGHLGRWYMAHVEARVARV

SEQ ID NO: 666085 - protein, 25 aa, Mycobacterium
GGLGNAGGHLGRWYMSHVEGRVARV

SEQ ID NO: 666086 - protein, 18 aa, Mycobacterium
GGLGRAVAQRLAKDGFTL

SEQ ID NO: 666087 - protein, 26 aa, Mycobacterium
GGLGRRELLPYSDLDLMLLHDNKSDD

SEQ ID NO: 666088 - protein, 19 aa, Mycobacterium
GGLGRREMLPYSDLDLVLL

SEQ ID NO: 666089 - protein, 29 aa, Mycobacterium
GGLGTDGYGGWGGEGGWGGDAGTTRLSSA

SEQ ID NO: 666090 - protein, 21 aa, Mycobacterium
GGLHGLPALRAIFGELLGIPV

SEQ ID NO: 666091 - protein, 21 aa, Mycobacterium
GGLHGLPALRAIFGELLGMPV

SEQ ID NO: 666092 - protein, 21 aa, Mycobacterium
GGLHLWLRLPDQTDLDRLVRD

SEQ ID NO: 666093 - protein, 19 aa, Mycobacterium
GGLHPLPARTVNGIPASAS

SEQ ID NO: 666094 - protein, 18 aa, Mycobacterium
GGLHSELRSAAAALGSVN

SEQ ID NO: 666095 - protein, 23 aa, Mycobacterium
GGLKVVTENAWFAARPSGTEDVY

SEQ ID NO: 666096 - protein, 18 aa, Mycobacterium
GGLLAHLHGTVAVLEPAD

SEQ ID NO: 666097 - protein, 19 aa, Mycobacterium
GGLLAPPALLMGWLTTPPW

SEQ ID NO: 666098 - protein, 19 aa, Mycobacterium
GGLLHHAPSLLAFTNPTVN

SEQ ID NO: 666099 - protein, 19 aa, Mycobacterium
GGLLMGIGGAGGAGGVGAD

SEQ ID NO: 666100 - protein, 41 aa, Mycobacterium
GGLLPKERLSDMVRRILRSMFAVGIDRWKPVPAPDMQAHNA

SEQ ID NO: 666101 - protein, 21 aa, Mycobacterium
GGLLRAAAMAGAQVRATAAAL

SEQ ID NO: 666102 - protein, 28 aa, Mycobacterium
GGLLRLPNRIPYQVAMELALTGESFTAE

SEQ ID NO: 666103 - protein, 18 aa, Mycobacterium
GGLLRLQKRIPYQKALEL

SEQ ID NO: 666104 - protein, 23 aa, Mycobacterium
GGLLRLWYDVRIGRDEFGFPLNA

SEQ ID NO: 666105 - protein, 18 aa, Mycobacterium
GGLLRYGIPEFKMEKRHI

SEQ ID NO: 666106 - protein, 20 aa, Mycobacterium
GGLLSGLVGAGGGDGGAGGQ

SEQ ID NO: 666107 - protein, 24 aa, Mycobacterium
GGLMREMTERLAVDEELAAAYRRA

SEQ ID NO: 666108 - protein, 23 aa, Mycobacterium
GGLNLKWGHLDTDNTSLFLKDQS

SEQ ID NO: 666109 - protein, 21 aa, Mycobacterium
GGLNLKWGHLGADNTSLFLKD

SEQ ID NO: 666110 - protein, 21 aa, Mycobacterium
GGLNLKWSHLGADNTSLFLKD

SEQ ID NO: 666111 - protein, 18 aa, Mycobacterium
GGLNSGIGNIGFGNSGNN

SEQ ID NO: 666112 - protein, 17 aa, Mycobacterium
GGLNSGSGNLGFGNSGT

SEQ ID NO: 666113 - protein, 18 aa, Mycobacterium
GGLNSGVGNFGLFNSGTG

SEQ ID NO: 666114 - protein, 26 aa, Mycobacterium
GGLPDLPLKVGDTWEEAGPDGDRIFR

SEQ ID NO: 666115 - protein, 18 aa, Mycobacterium
GGLPGYVAVCDLLHRHGF

SEQ ID NO: 666116 - protein, 18 aa, Mycobacterium
GGLPHDRPDIAYLQYTSG

SEQ ID NO: 666117 - protein, 17 aa, Mycobacterium
GGLPHLVPVVFAVGEDS

SEQ ID NO: 666118 - protein, 17 aa, Mycobacterium
GGLPLAVGISLADSMLK

SEQ ID NO: 666119 - protein, 22 aa, Mycobacterium
GGLPNREWEALLGEARRRADVA

SEQ ID NO: 666120 - protein, 25 aa, Mycobacterium
GGLPPRARMLLGLPWSDKQERRYQR

SEQ ID NO: 666121 - protein, 24 aa, Mycobacterium
GGLPRLPRTALVDVLLRHPPRTRL

SEQ ID NO: 666122 - protein, 25 aa, Mycobacterium
GGLPTRLKVVALMSGRDTYRPPEIL

SEQ ID NO: 666123 - protein, 29 aa, Mycobacterium
GGLQRSRLLAGICDTFGLGLSMHSNSHLG

SEQ ID NO: 666124 - protein, 17 aa, Mycobacterium
GGLQWPFAEDDDPLETA

SEQ ID NO: 666125 - protein, 23 aa, Mycobacterium
GGLRAGAVSSELIAAELTVGHVG

SEQ ID NO: 666126 - protein, 19 aa, Mycobacterium
GGLRDWATYCALAERHGGR

SEQ ID NO: 666127 - protein, 23 aa, Mycobacterium
GGLRLRRRSPLAAAARRVLALLP

SEQ ID NO: 666128 - protein, 23 aa, Mycobacterium
GGLRLRRRSTLAAAARRVLAALG

SEQ ID NO: 666129 - protein, 19 aa, Mycobacterium
GGLRPDMAVGEPVLISDHL

SEQ ID NO: 666130 - protein, 18 aa, Mycobacterium
GGLRPGRTEREVARDLEG

SEQ ID NO: 666131 - protein, 19 aa, Mycobacterium
GGLRPGRTEREVSRELEAL

SEQ ID NO: 666132 - protein, 17 aa, Mycobacterium
GGLRPGTVLDLARETGY

SEQ ID NO: 666133 - protein, 24 aa, Mycobacterium
GGLRRCVGSLKTRYGDSPAMRRIV

SEQ ID NO: 666134 - protein, 26 aa, Mycobacterium
GGLRRRVRLASVLRRCIVLDARLRGS

SEQ ID NO: 666135 - protein, 25 aa, Mycobacterium
GGLRRRVRLASVLRRCTVLDAHLRG

SEQ ID NO: 666136 - protein, 20 aa, Mycobacterium
GGLRRSMAKAGYCDLKEFQK

SEQ ID NO: 666137 - protein, 17 aa, Mycobacterium
GGLRTNFETGPAVVGVA

SEQ ID NO: 666138 - protein, 25 aa, Mycobacterium
GGLRYCINSAALRFVHLDDLEEQGY

SEQ ID NO: 666139 - protein, 25 aa, Mycobacterium
GGLRYLEQFNFSLVFEALRERSLVL

SEQ ID NO: 666140 - protein, 34 aa, Mycobacterium
GGLSANGCWATFLTCDARLAVTLPPGLADDQAAA

SEQ ID NO: 666141 - protein, 17 aa, Mycobacterium
GGLSGVLLGSVSNAVVH

SEQ ID NO: 666142 - protein, 18 aa, Mycobacterium
GGLSGYRSAGNGGAGGAG

SEQ ID NO: 666143 - protein, 17 aa, Mycobacterium
GGLSLLVSDGVYRGAYL

SEQ ID NO: 666144 - protein, 18 aa, Mycobacterium
GGLSRLLAVVSATGASVL

SEQ ID NO: 666145 - protein, 19 aa, Mycobacterium
GGLSRWRTRRVQARNSSRR

SEQ ID NO: 666146 - protein, 20 aa, Mycobacterium
GGLSSQFSSVGYFELEPGQA

SEQ ID NO: 666147 - protein, 30 aa, Mycobacterium
GGLSVPQSWMFPPAVRQVAAMFPGTTPMFM

SEQ ID NO: 666148 - protein, 23 aa, Mycobacterium
GGLTAIRLAAVAPELVNELVLID

SEQ ID NO: 666149 - protein, 28 aa, Mycobacterium
GGLTAIRLGAVAPELVKELVLIDVTPSA

SEQ ID NO: 666150 - protein, 22 aa, Mycobacterium
GGLTELLGRAAARGEVRPDVTA

SEQ ID NO: 666151 - protein, 25 aa, Mycobacterium
GGLTLNPLFWPARHDETLLMKAIYE

SEQ ID NO: 666152 - protein, 20 aa, Mycobacterium
GGLTPILCLTKTDLAPPEPF

SEQ ID NO: 666153 - protein, 19 aa, Mycobacterium
GGLTRTALVEGSRVVNSSQ

SEQ ID NO: 666154 - protein, 20 aa, Mycobacterium
GGLTRTPGSVSFDGLKVGDE

SEQ ID NO: 666155 - protein, 18 aa, Mycobacterium
GGLTRVALVEGSRVVNSS

SEQ ID NO: 666156 - protein, 19 aa, Mycobacterium
GGLTRVALVEGSRVVNSSQ

SEQ ID NO: 666157 - protein, 17 aa, Mycobacterium
GGLTRWRNAATIHARVR

SEQ ID NO: 666158 - protein, 18 aa, Mycobacterium
GGLTSFDDFERWIDLNMR

SEQ ID NO: 666159 - protein, 18 aa, Mycobacterium
GGLVASVVEIARAARVGM

SEQ ID NO: 666160 - protein, 25 aa, Mycobacterium
GGLVEGRRLAKFVGLPGADKGTQKR

SEQ ID NO: 666161 - protein, 17 aa, Mycobacterium
GGLVLGLEDSSSRMSRI

SEQ ID NO: 666162 - protein, 17 aa, Mycobacterium
GGLVLGLEDSSSRMSRL

SEQ ID NO: 666163 - protein, 17 aa, Mycobacterium
GGLVLKVGVHAGPSVVV

SEQ ID NO: 666164 - protein, 22 aa, Mycobacterium
GGLVNHLRRPPGTWTVSSELAI

SEQ ID NO: 666165 - protein, 18 aa, Mycobacterium
GGLVQRVAQFQNDGVTFG

SEQ ID NO: 666166 - protein, 17 aa, Mycobacterium
GGLVRLRLDIAYDGTDF

SEQ ID NO: 666167 - protein, 19 aa, Mycobacterium
GGMAAPPPLAWGVNEMIIC

SEQ ID NO: 666168 - protein, 25 aa, Mycobacterium
GGMAMPPFRIYAGHEVVAERSLVEM

SEQ ID NO: 666169 - protein, 25 aa, Mycobacterium
GGMFRRVDLASALVVPPKVLFLDEP

SEQ ID NO: 666170 - protein, 18 aa, Mycobacterium
GGMGEIYSGADGEATGIS

SEQ ID NO: 666171 - protein, 23 aa, Mycobacterium
GGMGGAGGEGFLTGGAGGKGGNA

SEQ ID NO: 666172 - protein, 28 aa, Mycobacterium
GGMGGAGGQAGWLSGAGGTGGAGGAGDN

SEQ ID NO: 666173 - protein, 18 aa, Mycobacterium
GGMGGAMAGHGGDGGAGG

SEQ ID NO: 666174 - protein, 25 aa, Mycobacterium
GGMGGLGLVVARWLVAQGAGLVVLN

SEQ ID NO: 666175 - protein, 30 aa, Mycobacterium
GGMGGNGGSGSWLIGGGGAGGAGGIGGTGG

SEQ ID NO: 666176 - protein, 21 aa, Mycobacterium
GGMGGPMGMMGGPRGGGGGGT

SEQ ID NO: 666177 - protein, 17 aa, Mycobacterium
GGMGQAIARRLGSGKTV

SEQ ID NO: 666178 - protein, 27 aa, Mycobacterium
GGMGYSFGAGIGMTFHRAARPGPHGQR

SEQ ID NO: 666179 - protein, 26 aa, Mycobacterium
GGMIPLFYDWLFGMMVSTAGTPPTRT

SEQ ID NO: 666180 - protein, 20 aa, Mycobacterium
GGMIYAEFEPGRALLGTIEF

SEQ ID NO: 666181 - protein, 18 aa, Mycobacterium
GGMKICPGADPRDGLLDV

SEQ ID NO: 666182 - protein, 19 aa, Mycobacterium
GGMLPGVLYDAGLKTITDL

SEQ ID NO: 666183 - protein, 18 aa, Mycobacterium
GGMMPPPGMTASPLAPYS

SEQ ID NO: 666184 - protein, 25 aa, Mycobacterium
GGMPIAPGMFAISWLDQSRLPVRID

SEQ ID NO: 666185 - protein, 23 aa, Mycobacterium
GGMPMAPGMFAISWLDQLRLPVR

SEQ ID NO: 666186 - protein, 24 aa, Mycobacterium
GGMRRRLDLAVSLLASPPVLFLDE

SEQ ID NO: 666187 - protein, 23 aa, Mycobacterium
GGMRRRLDVAISLLARPQVLFLD

SEQ ID NO: 666188 - protein, 26 aa, Mycobacterium
GGMRRRVRLASVLRRCIVLDARLSGG

SEQ ID NO: 666189 - protein, 22 aa, Mycobacterium
GGMRRRVRLASVLRRCTVIGAQ

SEQ ID NO: 666190 - protein, 26 aa, Mycobacterium
GGMSFARWSSLLAEHARRPEVVDTAE

SEQ ID NO: 666191 - protein, 24 aa, Mycobacterium
GGMSRNGCWGTFVIADARHAVTLP

SEQ ID NO: 666192 - protein, 17 aa, Mycobacterium
GGMSRSAVFAQVLSDVL

SEQ ID NO: 666193 - protein, 17 aa, Mycobacterium
GGMSVWLSPTSAFTASP

SEQ ID NO: 666194 - protein, 18 aa, Mycobacterium
GGMVKPNTVRSWWRNGSL

SEQ ID NO: 666195 - protein, 19 aa, Mycobacterium
GGMVRCIEDGYLQGLIADE

SEQ ID NO: 666196 - protein, 30 aa, Mycobacterium
GGNAGALGVIPGVQGEYGGAANGINGGSGG

SEQ ID NO: 666197 - protein, 20 aa, Mycobacterium
GGNAGLFGSGGIGGSGAAGA

SEQ ID NO: 666198 - protein, 19 aa, Mycobacterium
GGNAGMLIGAGGAGGNGGF

SEQ ID NO: 666199 - protein, 17 aa, Mycobacterium
GGNAGWLGSGGSGGAGG

SEQ ID NO: 666200 - protein, 23 aa, Mycobacterium
GGNAMCATCHIYVDDADYLRLPP

SEQ ID NO: 666201 - protein, 18 aa, Mycobacterium
GGNARPDIGPLFYEPTVL

SEQ ID NO: 666202 - protein, 21 aa, Mycobacterium
GGNARTWLREHGVDLDNAPPS

SEQ ID NO: 666203 - protein, 17 aa, Mycobacterium
GGNAVLIGNGGNGGNAG

SEQ ID NO: 666204 - protein, 19 aa, Mycobacterium
GGNFGQWSGLRKALRGNAV

SEQ ID NO: 666205 - protein, 18 aa, Mycobacterium
GGNFGRRYGSRIRVTCRP

SEQ ID NO: 666206 - protein, 18 aa, Mycobacterium
GGNGALWHGLLDPLPPGT

SEQ ID NO: 666207 - protein, 20 aa, Mycobacterium
GGNGEPTFAIGVSIVHPTGS

SEQ ID NO: 666208 - protein, 25 aa, Mycobacterium
GGNGGAGGSAWLIGDGGNGGNGGIG

SEQ ID NO: 666209 - protein, 25 aa, Mycobacterium
GGNGGAGRDGAMGGTGGIGGDAGMV

SEQ ID NO: 666210 - protein, 24 aa, Mycobacterium
GGNGGDARGLFGHGGNAGGANDYR

SEQ ID NO: 666211 - protein, 18 aa, Mycobacterium
GGNGGFGAGNSSGSSAGF

SEQ ID NO: 666212 - protein, 20 aa, Mycobacterium
GGNGGFGFSASDGGAGGAGG

SEQ ID NO: 666213 - protein, 24 aa, Mycobacterium
GGNGGFGGMALFIGSGGNGGAGGN

SEQ ID NO: 666214 - protein, 27 aa, Mycobacterium
GGNGGHGPFGEKIPAGGSGGDGGTGGI

SEQ ID NO: 666215 - protein, 18 aa, Mycobacterium
GGNGGIGSVYAYGNNGAV

SEQ ID NO: 666216 - protein, 25 aa, Mycobacterium
GGNGGILGLGLPPGTAGTGGTGGTL

SEQ ID NO: 666217 - protein, 21 aa, Mycobacterium
GGNGGLLFGNGGTGGVGGTGG

SEQ ID NO: 666218 - protein, 21 aa, Mycobacterium
GGNGGNARFLGNGGDGGPGIF

SEQ ID NO: 666219 - protein, 22 aa, Mycobacterium
GGNGGNARWIGDGGDGGDGIFG

SEQ ID NO: 666220 - protein, 17 aa, Mycobacterium
GGNGGNGGNGWVQAYDP

SEQ ID NO: 666221 - protein, 28 aa, Mycobacterium
GGNGGNGGRGGLFGKGGNAGNGADGGTG

SEQ ID NO: 666222 - protein, 25 aa, Mycobacterium
GGNGGQGGDGRLFGNGGAGGVGGAA

SEQ ID NO: 666223 - protein, 24 aa, Mycobacterium
GGNGGRGADGYGTGISGASGGAGG

SEQ ID NO: 666224 - protein, 26 aa, Mycobacterium
GGNGGRGADSVMIGGKGAAGGDGGDG

SEQ ID NO: 666225 - protein, 19 aa, Mycobacterium
GGNGGRGGFAQATSSVAGG

SEQ ID NO: 666226 - protein, 18 aa, Mycobacterium
GGNGGRVGNGGNGGAGGN

SEQ ID NO: 666227 - protein, 19 aa, Mycobacterium
GGNGGRVIGDGGDGGVGGW

SEQ ID NO: 666228 - protein, 33 aa, Mycobacterium
GGNGGSGGFAFTFGTGNIIAGVGGDGGTGSTGV

SEQ ID NO: 666229 - protein, 22 aa, Mycobacterium
GGNGGVRFSGNAGAGGAGGTGG

SEQ ID NO: 666230 - protein, 17 aa, Mycobacterium
GGNGGWFGTAGNGGIGG

SEQ ID NO: 666231 - protein, 22 aa, Mycobacterium
GGNGSLMRTAPVALAYLDDEGA

SEQ ID NO: 666232 - protein, 17 aa, Mycobacterium
GGNGSRTGAPGTTGNTP

SEQ ID NO: 666233 - protein, 20 aa, Mycobacterium
GGNGTNGFDGPFVGSDGGPG

SEQ ID NO: 666234 - protein, 27 aa, Mycobacterium
GGNGVNRYGVLNPGWGGDGGNGGAGGT

SEQ ID NO: 666235 - protein, 17 aa, Mycobacterium
GGNIFHGGLSWPFADDD

SEQ ID NO: 666236 - protein, 24 aa, Mycobacterium
GGNLEFRTLPVVRYDNIDGQDVNI

SEQ ID NO: 666237 - protein, 20 aa, Mycobacterium
GGNPDFRYNTIITEETSAGR

SEQ ID NO: 666238 - protein, 20 aa, Mycobacterium
GGNPDFRYNTIITEETTAGR

SEQ ID NO: 666239 - protein, 20 aa, Mycobacterium
GGNPDFRYNTIITEETTFGR

SEQ ID NO: 666240 - protein, 24 aa, Mycobacterium
GGNRRCLGAGFAMVEMRVVLREIL

SEQ ID NO: 666241 - protein, 19 aa, Mycobacterium
GGNRRCLGATFALVEMRVI

SEQ ID NO: 666242 - protein, 19 aa, Mycobacterium
GGNSGMVYGDGGAGGAGGI

SEQ ID NO: 666243 - protein, 20 aa, Mycobacterium
GGNTDLGWRMEVNDDGQWAH

SEQ ID NO: 666244 - protein, 18 aa, Mycobacterium
GGNVAYLLCNPHNPTGAV

SEQ ID NO: 666245 - protein, 17 aa, Mycobacterium
GGNWSINTGNGYFGGVQ

SEQ ID NO: 666246 - protein, 19 aa, Mycobacterium
GGNYEKFVNMARLFGTDGV

SEQ ID NO: 666247 - protein, 20 aa, Mycobacterium
GGPAAAWVYIDHRVDPGPPR

SEQ ID NO: 666248 - protein, 20 aa, Mycobacterium
GGPADIEWRGGGNTRGPAKL

SEQ ID NO: 666249 - protein, 20 aa, Mycobacterium
GGPAGFGLRIKRAVTASLLL

SEQ ID NO: 666250 - protein, 19 aa, Mycobacterium
GGPAQRIAAGYSVAGQALE

SEQ ID NO: 666251 - protein, 26 aa, Mycobacterium
GGPARAVARVTAWLLAVGDTADVESA

SEQ ID NO: 666252 - protein, 17 aa, Mycobacterium
GGPARAVVHLCRHDDGP

SEQ ID NO: 666253 - protein, 31 aa, Mycobacterium
GGPARLLVPHLYFWKSAKWVRSIELCDSEKL

SEQ ID NO: 666254 - protein, 19 aa, Mycobacterium
GGPAVAWVHGLEYQRLGLP

SEQ ID NO: 666255 - protein, 22 aa, Mycobacterium
GGPAYPRGFMRLGGATGPDAAR

SEQ ID NO: 666256 - protein, 20 aa, Mycobacterium
GGPCVIVRRGRRNRFTGAAF

SEQ ID NO: 666257 - protein, 22 aa, Mycobacterium
GGPDRPGQTLAIYKELENYFGG

SEQ ID NO: 666258 - protein, 17 aa, Mycobacterium
GGPDYALHLYRTRGPLH

SEQ ID NO: 666259 - protein, 24 aa, Mycobacterium
GGPELRRLRTAVVARATEAGEGVV

SEQ ID NO: 666260 - protein, 18 aa, Mycobacterium
GGPEVLSFVETSRPSPGP

SEQ ID NO: 666261 - protein, 18 aa, Mycobacterium
GGPFAGGPGFGFGPDTQR

SEQ ID NO: 666262 - protein, 24 aa, Mycobacterium
GGPFGARPGFGFGPGPGLPPTQRR

SEQ ID NO: 666263 - protein, 21 aa, Mycobacterium
GGPFGQPVLLAFTQRRLFAVV

SEQ ID NO: 666264 - protein, 20 aa, Mycobacterium
GGPFKRWSTFPVVPLDEGDP

SEQ ID NO: 666265 - protein, 18 aa, Mycobacterium
GGPFLKLTPADWDRLLSV

SEQ ID NO: 666266 - protein, 19 aa, Mycobacterium
GGPFLKLTPADWDRLLSVN

SEQ ID NO: 666267 - protein, 26 aa, Mycobacterium
GGPFRGVPFLIKDLYALYAGQPISNG

SEQ ID NO: 666268 - protein, 20 aa, Mycobacterium
GGPGAMGLTGGTGGHGGDNT

SEQ ID NO: 666269 - protein, 24 aa, Mycobacterium
GGPGDYNENGYAGGSGGTGGTGGD

SEQ ID NO: 666270 - protein, 24 aa, Mycobacterium
GGPGGFRADNRFSDSGEQPAQPTP

SEQ ID NO: 666271 - protein, 25 aa, Mycobacterium
GGPGGNGGLLFGHGGVGGLGGNGGD

SEQ ID NO: 666272 - protein, 18 aa, Mycobacterium
GGPGLMWGGGTLAAARRA

SEQ ID NO: 666273 - protein, 25 aa, Mycobacterium
GGPHALKYGVTYNHILGVEVVLPDG

SEQ ID NO: 666274 - protein, 28 aa, Mycobacterium
GGPHFCLGAALARTMLKALLTEVYTRIP

SEQ ID NO: 666275 - protein, 24 aa, Mycobacterium
GGPHFCMGAFMAKMQLESIFRELI

SEQ ID NO: 666276 - protein, 23 aa, Mycobacterium
GGPHLKSPALLGQCLDLVGPHPG

SEQ ID NO: 666277 - protein, 22 aa, Mycobacterium
GGPHPGLALMAARFTNTDRIDY

SEQ ID NO: 666278 - protein, 28 aa, Mycobacterium
GGPIPAGRPGGAPWTYTPDVTFDEPVEI

SEQ ID NO: 666279 - protein, 20 aa, Mycobacterium
GGPKGGVGFLYAWGDEVCPD

SEQ ID NO: 666280 - protein, 17 aa, Mycobacterium
GGPKVVLDFPVSRRTSP

SEQ ID NO: 666281 - protein, 23 aa, Mycobacterium
GGPLARLEVNLALEILLRRVESP

SEQ ID NO: 666282 - protein, 20 aa, Mycobacterium
GGPLARLEVNLAVEIFLRRV

SEQ ID NO: 666283 - protein, 18 aa, Mycobacterium
GGPLARVEGRVSLERILD

SEQ ID NO: 666284 - protein, 33 aa, Mycobacterium
GGPLASWNAWHWRWNPWLMAAGGYAVLLPDPAL

SEQ ID NO: 666285 - protein, 18 aa, Mycobacterium
GGPLAVFARRAARIGRPM

SEQ ID NO: 666286 - protein, 25 aa, Mycobacterium
GGPLEHRMRFALEVTEAVRAAWPDG

SEQ ID NO: 666287 - protein, 20 aa, Mycobacterium
GGPLFERGYHEVRLSPLGER

SEQ ID NO: 666288 - protein, 19 aa, Mycobacterium
GGPLFRNGVAMPPLPRTDL

SEQ ID NO: 666289 - protein, 21 aa, Mycobacterium
GGPLTECLADVVARFVPYYEE

SEQ ID NO: 666290 - protein, 23 aa, Mycobacterium
GGPMGAGIAQVFAAAGANVTIVE

SEQ ID NO: 666291 - protein, 21 aa, Mycobacterium
GGPMSVEFSTILAGLGSEVTH

SEQ ID NO: 666292 - protein, 18 aa, Mycobacterium
GGPPEITASVGITSANRT

SEQ ID NO: 666293 - protein, 21 aa, Mycobacterium
GGPPPRLALSLGDSLAGMFAA

SEQ ID NO: 666294 - protein, 25 aa, Mycobacterium
GGPPPRLALSLGDSLAGMFAAQGAL

SEQ ID NO: 666295 - protein, 21 aa, Mycobacterium
GGPPPRLALSLGDSLAGMFGA

SEQ ID NO: 666296 - protein, 24 aa, Mycobacterium
GGPPPRLALSLGDSLAGMFGAQGA

SEQ ID NO: 666297 - protein, 25 aa, Mycobacterium
GGPPPRMALSIGDTLAGMFAAQGAL

SEQ ID NO: 666298 - protein, 18 aa, Mycobacterium
GGPQPLPFGRSSAGGDTI

SEQ ID NO: 666299 - protein, 17 aa, Mycobacterium
GGPRRAGVSSFGISGTN

SEQ ID NO: 666300 - protein, 19 aa, Mycobacterium
GGPSAWLLRLIETQRERTQ

SEQ ID NO: 666301 - protein, 26 aa, Mycobacterium
GGPTFIECVTFRFRGHYFGDRMPYIP

SEQ ID NO: 666302 - protein, 29 aa, Mycobacterium
GGPTRRRLIDVAIELFKRYSVAGTSLQMI

SEQ ID NO: 666303 - protein, 22 aa, Mycobacterium
GGPVICAQVLMYPGLDRDMAAP

SEQ ID NO: 666304 - protein, 28 aa, Mycobacterium
GGPVKRDAALCLATLRAGVSIDGVKGLR

SEQ ID NO: 666305 - protein, 25 aa, Mycobacterium
GGPVKRDAALCLATLRVGADPGGVS

SEQ ID NO: 666306 - protein, 25 aa, Mycobacterium
GGPVKRDAALCLGTLRVGSDPVGVP

SEQ ID NO: 666307 - protein, 26 aa, Mycobacterium
GGPVKRDSALCLATLRVGMQADGVDG

SEQ ID NO: 666308 - protein, 20 aa, Mycobacterium
GGPYLARGAADLVPTAQLLD

SEQ ID NO: 666309 - protein, 22 aa, Mycobacterium
GGQAFWSFGGLFLVDSPEQRHL

SEQ ID NO: 666310 - protein, 27 aa, Mycobacterium
GGQAIRAITCLPALVGAWRHVGGGTME

SEQ ID NO: 666311 - protein, 20 aa, Mycobacterium
GGQAPDWFCESADLDELSAR

SEQ ID NO: 666312 - protein, 28 aa, Mycobacterium
GGQARALCPQAIVVPPRMAAYTQASRDV

SEQ ID NO: 666313 - protein, 20 aa, Mycobacterium
GGQCLRKNDRVVLSWLSANH

SEQ ID NO: 666314 - protein, 23 aa, Mycobacterium
GGQFLQVFRRRGWINCGQAGPLG

SEQ ID NO: 666315 - protein, 18 aa, Mycobacterium
GGQFVPFDPAADYRQYVD

SEQ ID NO: 666316 - protein, 40 aa, Mycobacterium
GGQGGAAMTGILGGLPGQGGNGGNANWFGSGGAGGQGGTG

SEQ ID NO: 666317 - protein, 19 aa, Mycobacterium
GGQGGFFAGNGGNGGNAGS

SEQ ID NO: 666318 - protein, 20 aa, Mycobacterium
GGQGGLFGNAGTTGAGGDGG

SEQ ID NO: 666319 - protein, 23 aa, Mycobacterium
GGQGGRGGDSLYGTAGDGGDGGR

SEQ ID NO: 666320 - protein, 18 aa, Mycobacterium
GGQHLHSSFAPLFGQFSG

SEQ ID NO: 666321 - protein, 20 aa, Mycobacterium
GGQHVINFGFSQSAVVATQE

SEQ ID NO: 666322 - protein, 27 aa, Mycobacterium
GGQKPWLPHFYLGHGIGTSAAEMPMIG

SEQ ID NO: 666323 - protein, 19 aa, Mycobacterium
GGQLCLPFYGALVTNCELD

SEQ ID NO: 666324 - protein, 23 aa, Mycobacterium
GGQLRVLHTFGLSIAALEERMRM

SEQ ID NO: 666325 - protein, 36 aa, Mycobacterium
GGQMLFDLPPRWFTLFSRLGIRTSLRYKIPPMPFSL

SEQ ID NO: 666326 - protein, 27 aa, Mycobacterium
GGQQGTWDRLWPKLGMQARDEDSQPIT

SEQ ID NO: 666327 - protein, 24 aa, Mycobacterium
GGQQQLLCLARALAVNPDVLLLDE

SEQ ID NO: 666328 - protein, 17 aa, Mycobacterium
GGQRGRRGIAGPVTLQG

SEQ ID NO: 666329 - protein, 23 aa, Mycobacterium
GGQRKVPCPKRIITAAQAGAPNQ

SEQ ID NO: 666330 - protein, 20 aa, Mycobacterium
GGQRQRVWVAMVLAQQTPLI

SEQ ID NO: 666331 - protein, 23 aa, Mycobacterium
GGQRRRLDVALGIIGGPELVFLD

SEQ ID NO: 666332 - protein, 29 aa, Mycobacterium
GGQSLRPVIFSTFLMWLLADLFTVLDEVG

SEQ ID NO: 666333 - protein, 21 aa, Mycobacterium
GGQTQFAAPVWMPRAKRAPIR

SEQ ID NO: 666334 - protein, 21 aa, Mycobacterium
GGQTQFAAPVWMPRAKRPSIR

SEQ ID NO: 666335 - protein, 23 aa, Mycobacterium
GGQTWPLYAPLVVSDARTAASLA

SEQ ID NO: 666336 - protein, 19 aa, Mycobacterium
GGQVCVCPDYVFVPDRHVD

SEQ ID NO: 666337 - protein, 19 aa, Mycobacterium
GGQVFKDYVAWPAITSLSP

SEQ ID NO: 666338 - protein, 17 aa, Mycobacterium
GGQWEWDSAAPAGVVLA

SEQ ID NO: 666339 - protein, 24 aa, Mycobacterium
GGRAGCALEAIEFHNPALKADPNS

SEQ ID NO: 666340 - protein, 27 aa, Mycobacterium
GGRAKIGMYIALRLLRDGAHTTITTRF

SEQ ID NO: 666341 - protein, 20 aa, Mycobacterium
GGRALPDWSPAGSLQAMAEL

SEQ ID NO: 666342 - protein, 20 aa, Mycobacterium
GGRAPSIWDTFSHKPGAVHN

SEQ ID NO: 666343 - protein, 18 aa, Mycobacterium
GGRARCITRMFRDLLTQR

SEQ ID NO: 666344 - protein, 20 aa, Mycobacterium
GGRARLLLESALPVIEDLPG

SEQ ID NO: 666345 - protein, 26 aa, Mycobacterium
GGRDDRLHWWAGPWPVDERWWDPDLG

SEQ ID NO: 666346 - protein, 20 aa, Mycobacterium
GGRFAFYIKVHHTVTDGVAG

SEQ ID NO: 666347 - protein, 19 aa, Mycobacterium
GGRFKHIIMDSSTYGVPVN

SEQ ID NO: 666348 - protein, 17 aa, Mycobacterium
GGRFTVYPRALLSLLAS

SEQ ID NO: 666349 - protein, 23 aa, Mycobacterium
GGRGGDGGDAFLYGFGGAGGPGG

SEQ ID NO: 666350 - protein, 20 aa, Mycobacterium
GGRGGLLGGHGGKGGNAGLG

SEQ ID NO: 666351 - protein, 24 aa, Mycobacterium
GGRGIGLMIARGLLQAGASVYIAG

SEQ ID NO: 666352 - protein, 26 aa, Mycobacterium
GGRGPARLQIHLSWAPTDEEALAIAH

SEQ ID NO: 666353 - protein, 19 aa, Mycobacterium
GGRHRGFVVLRWLDNPSPP

SEQ ID NO: 666354 - protein, 21 aa, Mycobacterium
GGRIEHWRAARGLDERLLEDY

SEQ ID NO: 666355 - protein, 29 aa, Mycobacterium
GGRIGVAFASGWQRNDFILAREPFDRRRE

SEQ ID NO: 666356 - protein, 20 aa, Mycobacterium
GGRIRTRYSTGLELEGAVKR

SEQ ID NO: 666357 - protein, 22 aa, Mycobacterium
GGRLAKLLKIFANPKMPSLADY

SEQ ID NO: 666358 - protein, 18 aa, Mycobacterium
GGRLEALFLDEGFGSLDA

SEQ ID NO: 666359 - protein, 18 aa, Mycobacterium
GGRLFMREGHPFLWSLSD

SEQ ID NO: 666360 - protein, 18 aa, Mycobacterium
GGRLGEWLAGTFAAAAAA

SEQ ID NO: 666361 - protein, 25 aa, Mycobacterium
GGRLGPARTAAICAVSPALWLSLGA

SEQ ID NO: 666362 - protein, 25 aa, Mycobacterium
GGRLGPARTAAICAVSPALWLTAGA

SEQ ID NO: 666363 - protein, 25 aa, Mycobacterium
GGRLGPGRTAAICAVSPALWMSSGA

SEQ ID NO: 666364 - protein, 17 aa, Mycobacterium
GGRLHLVDMGGDLTDRD

SEQ ID NO: 666365 - protein, 20 aa, Mycobacterium
GGRLILGVGAGWYERDYTTY

SEQ ID NO: 666366 - protein, 18 aa, Mycobacterium
GGRLRLEPQRNWECNEPS

SEQ ID NO: 666367 - protein, 20 aa, Mycobacterium
GGRLRPGHHAARVELLINQF

SEQ ID NO: 666368 - protein, 24 aa, Mycobacterium
GGRLSDAAIDWVIQAFTDGRVAPE

SEQ ID NO: 666369 - protein, 23 aa, Mycobacterium
GGRLSDAAIDWVVDAYTAGRVAE

SEQ ID NO: 666370 - protein, 21 aa, Mycobacterium
GGRLVKLPVFGSVTEAMEKTG

SEQ ID NO: 666371 - protein, 24 aa, Mycobacterium
GGRMDWARAFAAWSPHELSGVTTA

SEQ ID NO: 666372 - protein, 24 aa, Mycobacterium
GGRMDWARAFASWSPHELSGIPTA

SEQ ID NO: 666373 - protein, 20 aa, Mycobacterium
GGRMPELMAYAMSKAALDSF

SEQ ID NO: 666374 - protein, 19 aa, Mycobacterium
GGRQLVFCDLGMPRDVDPT

SEQ ID NO: 666375 - protein, 19 aa, Mycobacterium
GGRQPRWLGLDIGRRQFYR

SEQ ID NO: 666376 - protein, 18 aa, Mycobacterium
GGRQRGFIVLRWLDNPSP

SEQ ID NO: 666377 - protein, 29 aa, Mycobacterium
GGRRGGPGRGRRGDVRAAILVLLSEQPMH

SEQ ID NO: 666378 - protein, 17 aa, Mycobacterium
GGRRGRRSKKNRAEEPV

SEQ ID NO: 666379 - protein, 23 aa, Mycobacterium
GGRRICVGAGFAMFEAKLVLATI

SEQ ID NO: 666380 - protein, 19 aa, Mycobacterium
GGRRIEVHFERGYPAAQIF

SEQ ID NO: 666381 - protein, 19 aa, Mycobacterium
GGRRSFILVPGIDVPFHSR

SEQ ID NO: 666382 - protein, 20 aa, Mycobacterium
GGRRSFILVPGIDVPFHSRV

SEQ ID NO: 666383 - protein, 17 aa, Mycobacterium
GGRRSGQRWRVAERSAT

SEQ ID NO: 666384 - protein, 27 aa, Mycobacterium
GGRRYRHPLCLSVHFPAGTLLDETGCV

SEQ ID NO: 666385 - protein, 17 aa, Mycobacterium
GGRSCLGDHFAMLEASL

SEQ ID NO: 666386 - protein, 24 aa, Mycobacterium
GGRSHWLRRVAALTQQGVRRELHI

SEQ ID NO: 666387 - protein, 23 aa, Mycobacterium
GGRSLPHAVLMMIPEAWERHESM

SEQ ID NO: 666388 - protein, 24 aa, Mycobacterium
GGRTRPEERWDFDYFIVRDGSGRP

SEQ ID NO: 666389 - protein, 18 aa, Mycobacterium
GGRTSYRGLVQVNKGAHG

SEQ ID NO: 666390 - protein, 18 aa, Mycobacterium
GGRTVGFASYLDRGSQRV

SEQ ID NO: 666391 - protein, 24 aa, Mycobacterium
GGRVAGLIGTIGIRIDGADIPSAL

SEQ ID NO: 666392 - protein, 31 aa, Mycobacterium; identical to SEQ ID NO: 97360

SEQ ID NO: 666393 - protein, 24 aa, Mycobacterium
GGRVIGQIPVCWDPDRDTAVKRAH

SEQ ID NO: 666394 - protein, 19 aa, Mycobacterium
GGRVIKLPVFGGVAEAMEK

SEQ ID NO: 666395 - protein, 20 aa, Mycobacterium
GGRVSRLHSLLGGRGPSARE

SEQ ID NO: 666396 - protein, 21 aa, Mycobacterium
GGRWRARSAALLAAVTVGGAQ

SEQ ID NO: 666397 - protein, 24 aa, Mycobacterium
GGRWSEWAKPIVLQSSWARQGDPA

SEQ ID NO: 666398 - protein, 22 aa, Mycobacterium
GGRWSRWPEGLRDVAGPDVANA

SEQ ID NO: 666399 - protein, 22 aa, Mycobacterium
GGRYRFNHAIVRQSLLAELPSV

SEQ ID NO: 666400 - protein, 20 aa, Mycobacterium
GGSADVRWFDVEPCYVFHPM

SEQ ID NO: 666401 - protein, 18 aa, Mycobacterium
GGSAGLFFGTGGAGGDGG

SEQ ID NO: 666402 - protein, 19 aa, Mycobacterium
GGSAGLWGAGGTGGAGGSS

SEQ ID NO: 666403 - protein, 18 aa, Mycobacterium
GGSAGMWGAGGAGGAAGT

SEQ ID NO: 666404 - protein, 22 aa, Mycobacterium
GGSAGYSCALRASQLGMSVTLI

SEQ ID NO: 666405 - protein, 18 aa, Mycobacterium
GGSARASFVASLAGTGAV

SEQ ID NO: 666406 - protein, 17 aa, Mycobacterium
GGSARLLGGDPWTDAVA

SEQ ID NO: 666407 - protein, 21 aa, Mycobacterium
GGSAVEAVWIVAQREGLAVRP

SEQ ID NO: 666408 - protein, 18 aa, Mycobacterium
GGSAVGWFGDGGAGGAGG

SEQ ID NO: 666409 - protein, 31 aa, Mycobacterium
GGSAVRLPRQIPYTVACDILLTGRHIKAPEA

SEQ ID NO: 666410 - protein, 23 aa, Mycobacterium
GGSCGMAAVAAIRVAEREGPDAL

SEQ ID NO: 666411 - protein, 19 aa, Mycobacterium
GGSCQRTWEHAVPKTSAPV

SEQ ID NO: 666412 - protein, 18 aa, Mycobacterium
GGSDAGWHLKLPAGPEVR

SEQ ID NO: 666413 - protein, 21 aa, Mycobacterium
GGSDLSKLVGRKGEVLDALQE

SEQ ID NO: 666414 - protein, 18 aa, Mycobacterium
GGSDPGRTLDPCDGTGPA

SEQ ID NO: 666415 - protein, 21 aa, Mycobacterium
GGSFRAPQFTIAWPTGEIGGM

SEQ ID NO: 666416 - protein, 18 aa, Mycobacterium
GGSFSALPNFAFEHCALR

SEQ ID NO: 666417 - protein, 18 aa, Mycobacterium
GGSGARLMTTLLYHMRDK

SEQ ID NO: 666418 - protein, 19 aa, Mycobacterium
GGSGARLMTTLLYHMRDNG

SEQ ID NO: 666419 - protein, 18 aa, Mycobacterium
GGSGFTSAVTTAGGNGGN

SEQ ID NO: 666420 - protein, 25 aa, Mycobacterium
GGSGGAARFFGDGGAAGTGGVGGFG

SEQ ID NO: 666421 - protein, 21 aa, Mycobacterium
GGSGGAGGWVAGNGGAGGAGG

SEQ ID NO: 666422 - protein, 27 aa, Mycobacterium
GGSGGDAGGMFGVRGLFGTGGAGGTGG

SEQ ID NO: 666423 - protein, 28 aa, Mycobacterium
GGSGGDGGDGFGLWNPGEGGRGGSGGDG

SEQ ID NO: 666424 - protein, 19 aa, Mycobacterium
GGSGGFGGTGLTTGGEGGR

SEQ ID NO: 666425 - protein, 22 aa, Mycobacterium
GGSGGKAGILFGNGGGGGTGGF

SEQ ID NO: 666426 - protein, 20 aa, Mycobacterium
GGSGGLLWGNGGAGGAGGLS

SEQ ID NO: 666427 - protein, 23 aa, Mycobacterium
GGSGGNAAWLFGDGGAGGSGGSS

SEQ ID NO: 666428 - protein, 22 aa, Mycobacterium
GGSGGQGGWLYGNGGVGGAGGA

SEQ ID NO: 666429 - protein, 19 aa, Mycobacterium
GGSGGRGGDARLIGNGGDG

SEQ ID NO: 666430 - protein, 24 aa, Mycobacterium
GGSGGSAGLWGRGGNGGLGGTGAD

SEQ ID NO: 666431 - protein, 19 aa, Mycobacterium
GGSGIVWGVLDSGIEASHP

SEQ ID NO: 666432 - protein, 19 aa, Mycobacterium
GGSGLPLLVVHGGPGLPHY

SEQ ID NO: 666433 - protein, 24 aa, Mycobacterium
GGSGLRAEALAVTFAGRTIAELVA

SEQ ID NO: 666434 - protein, 25 aa, Mycobacterium
GGSGMMPMGMMPHNRGGEGDKEAAR

SEQ ID NO: 666435 - protein, 18 aa, Mycobacterium
GGSGSAFGVWINNVPTQD

SEQ ID NO: 666436 - protein, 19 aa, Mycobacterium
GGSHPRFARNLGTGEPQPS

SEQ ID NO: 666437 - protein, 26 aa, Mycobacterium
GGSIGLVPSARCVRLAGDREALRKLA

SEQ ID NO: 666438 - protein, 17 aa, Mycobacterium
GGSIPDCGHWVVEERPD

SEQ ID NO: 666439 - protein, 23 aa, Mycobacterium
GGSIPEYNRDALVSTLTDLYGPA

SEQ ID NO: 666440 - protein, 24 aa, Mycobacterium
GGSIRSIFEPHLLSDLVAQVVRLD

SEQ ID NO: 666441 - protein, 18 aa, Mycobacterium
GGSIVGMDFDPSRAMPAY

SEQ ID NO: 666442 - protein, 18 aa, Mycobacterium
GGSKDTWVLAPRSLATGR

SEQ ID NO: 666443 - protein, 19 aa, Mycobacterium
GGSKDTWVLASRASAGDHE

SEQ ID NO: 666444 - protein, 19 aa, Mycobacterium
GGSKDTWVLASRASVADRE

SEQ ID NO: 666445 - protein, 19 aa, Mycobacterium
GGSKDTWVLASRASVAERE

SEQ ID NO: 666446 - protein, 18 aa, Mycobacterium
GGSKDTWVLASRTSVADR

SEQ ID NO: 666447 - protein, 19 aa, Mycobacterium
GGSKDTWVLASSRTSADEH

SEQ ID NO: 666448 - protein, 33 aa, Mycobacterium
GGSKVALPLVRKALELMPNVGFVNAYGLTETSS

SEQ ID NO: 666449 - protein, 32 aa, Mycobacterium; identical to SEQ ID NO: 97363

SEQ ID NO: 666450 - protein, 33 aa, Mycobacterium
GGSKVGLPLVRRALELLPDVGFVNAYGLTETSS

SEQ ID NO: 666451 - protein, 28 aa, Mycobacterium
GGSKVPLPLVRKALSLLPDVGFVNAYGL

SEQ ID NO: 666452 - protein, 18 aa, Mycobacterium
GGSLAGVHPVDLGALGWR

SEQ ID NO: 666453 - protein, 24 aa, Mycobacterium
GGSLELLASLPIDRKVYIHINNTN

SEQ ID NO: 666454 - protein, 18 aa, Mycobacterium
GGSLEMWRQYLPETTIVG

SEQ ID NO: 666455 - protein, 17 aa, Mycobacterium
GGSLHCALVGDVIAGLA

SEQ ID NO: 666456 - protein, 18 aa, Mycobacterium
GGSLIGIGSGTAVGGSGG

SEQ ID NO: 666457 - protein, 18 aa, Mycobacterium
GGSLKGFVVSGRWPDSTK

SEQ ID NO: 666458 - protein, 17 aa, Mycobacterium
GGSLMRAATAAGRNVWG

SEQ ID NO: 666459 - protein, 24 aa, Mycobacterium
GGSLRFLLEHHGEGLGDRDLGAVS

SEQ ID NO: 666460 - protein, 25 aa, Mycobacterium
GGSLRGFVVCGRWPDSTKEWMQLLI

SEQ ID NO: 666461 - protein, 25 aa, Mycobacterium
GGSLSRIATLAVRCGDEVELRVSGG

SEQ ID NO: 666462 - protein, 25 aa, Mycobacterium
GGSLYGIPMPPGLISHAPQGVHHGA

SEQ ID NO: 666463 - protein, 22 aa, Mycobacterium
GGSNLAGLAFPFLREKIHGRSD

SEQ ID NO: 666464 - protein, 22 aa, Mycobacterium
GGSPAGLAFAGKHAELMFLSAY

SEQ ID NO: 666465 - protein, 22 aa, Mycobacterium
GGSPLSALLHVARTIVRRAERS

SEQ ID NO: 666466 - protein, 20 aa, Mycobacterium
GGSPTAWALPTLPAPTGSPI

SEQ ID NO: 666467 - protein, 18 aa, Mycobacterium
GGSPYLLGVENYLVPQNV

SEQ ID NO: 666468 - protein, 28 aa, Mycobacterium
GGSRPPFLKRLVLRTAARLSRRGRRLGL

SEQ ID NO: 666469 - protein, 22 aa, Mycobacterium
GGSRPTHFAGVLTVVLKLLQIV

SEQ ID NO: 666470 - protein, 24 aa, Mycobacterium
GGSRRFTVESVREHSGRLLIRFAG

SEQ ID NO: 666471 - protein, 19 aa, Mycobacterium
GGSSIGVSRVASWDQLDAA

SEQ ID NO: 666472 - protein, 18 aa, Mycobacterium
GGSSIGVSRVSSWDELPA

SEQ ID NO: 666473 - protein, 27 aa, Mycobacterium
GGSSLRIPNRVGYWYAQGSMVTPTGQC

SEQ ID NO: 666474 - protein, 25 aa, Mycobacterium
GGSSRPCTACMSAAGGGIAKRTLTK

SEQ ID NO: 666475 - protein, 18 aa, Mycobacterium
GGSTAFWDAAAFGLIEKR

SEQ ID NO: 666476 - protein, 18 aa, Mycobacterium
GGSTARSGGGVWIPNNEI

SEQ ID NO: 666477 - protein, 18 aa, Mycobacterium
GGSTARSGGGVWIPNNEV

SEQ ID NO: 666478 - protein, 19 aa, Mycobacterium
GGSTARSGGGVWIPNNEVL

SEQ ID NO: 666479 - protein, 20 aa, Mycobacterium
GGSTARSGGGVWIPNNEVLK

SEQ ID NO: 666480 - protein, 27 aa, Mycobacterium
GGSTFRYAAPAGRDWTIYDIAGKRIAT

SEQ ID NO: 666481 - protein, 24 aa, Mycobacterium
GGSVDIAMALGFDDLNRATRAIGG

SEQ ID NO: 666482 - protein, 32 aa, Mycobacterium
GGSVRFIGVDGYRWMIRCVLQGPAETFDALAD

SEQ ID NO: 666483 - protein, 24 aa, Mycobacterium
GGSVSGTAVNEWLDEDGNPKHEVA

SEQ ID NO: 666484 - protein, 19 aa, Mycobacterium
GGSWCTMSVCGNKLKNRQF

SEQ ID NO: 666485 - protein, 25 aa, Mycobacterium
GGSWFRYAGNGQWNWQRDFFDFGHV

SEQ ID NO: 666486 - protein, 33 aa, Mycobacterium
GGSYAVLVVRELLRRCAIEVACVPSQAGPSRMV

SEQ ID NO: 666487 - protein, 18 aa, Mycobacterium
GGTAELSDALWRLDEDSL

SEQ ID NO: 666488 - protein, 31 aa, Mycobacterium
GGTAGPYTFGFDFVQGPGFFNSTTTPSSGFF

SEQ ID NO: 666489 - protein, 32 aa, Mycobacterium
GGTAINYGAGDAFGGAAGKGGTGVVGGNGGSG

SEQ ID NO: 666490 - protein, 18 aa, Mycobacterium
GGTALGLAHGGDGGTGGT

SEQ ID NO: 666491 - protein, 21 aa, Mycobacterium
GGTATLGFNGGMAGAGGNGGS

SEQ ID NO: 666492 - protein, 19 aa, Mycobacterium
GGTATRIVLYNALANPERF

SEQ ID NO: 666493 - protein, 19 aa, Mycobacterium
GGTAVRFALDNGKRAGKLV

SEQ ID NO: 666494 - protein, 21 aa, Mycobacterium
GGTCPLWNVYETFANPGKIGV

SEQ ID NO: 666495 - protein, 21 aa, Mycobacterium
GGTCPLWNVYETFGNPGKILV

SEQ ID NO: 666496 - protein, 17 aa, Mycobacterium
GGTCVLTGLPAPAMHSI

SEQ ID NO: 666497 - protein, 19 aa, Mycobacterium
GGTDGLLFGKGGAGGDGGA

SEQ ID NO: 666498 - protein, 21 aa, Mycobacterium
GGTDIRWSGSFTEGVRGTGPA

SEQ ID NO: 666499 - protein, 21 aa, Mycobacterium
GGTEITWRWTIHPKSALAAPA

SEQ ID NO: 666500 - protein, 18 aa, Mycobacterium
GGTEQVWTTASTVDEALA

SEQ ID NO: 666501 - protein, 18 aa, Mycobacterium
GGTEYLVGIPEQIAQNVT

SEQ ID NO: 666502 - protein, 20 aa, Mycobacterium
GGTFCAGMDLKGFASGELPH

SEQ ID NO: 666503 - protein, 20 aa, Mycobacterium
GGTFDWTQGRFPEFTTPDPS

SEQ ID NO: 666504 - protein, 18 aa, Mycobacterium
GGTFDWTQGRFPGFTTPD

SEQ ID NO: 666505 - protein, 24 aa, Mycobacterium
GGTFRLIDKVFSLWGISYTAVALS

SEQ ID NO: 666506 - protein, 18 aa, Mycobacterium
GGTGCAIGAVKANIGHLD

SEQ ID NO: 666507 - protein, 24 aa, Mycobacterium
GGTGGAAGWLIGNGGSGGQGGLAG

SEQ ID NO: 666508 - protein, 23 aa, Mycobacterium
GGTGGAGGWLTGAGGTGGAGGTG

SEQ ID NO: 666509 - protein, 25 aa, Mycobacterium
GGTGGDGGRARGLLGDGGTGGDGGF

SEQ ID NO: 666510 - protein, 18 aa, Mycobacterium
GGTGGFGDKGYWAITKHK

SEQ ID NO: 666511 - protein, 21 aa, Mycobacterium
GGTGGHGGWFGAAGTGGSGGF

SEQ ID NO: 666512 - protein, 24 aa, Mycobacterium
GGTGGKSGLFGGTGGTGGTGGNAT

SEQ ID NO: 666513 - protein, 24 aa, Mycobacterium
GGTGGKSLGNLPSGDGGVGGNAGT

SEQ ID NO: 666514 - protein, 20 aa, Mycobacterium
GGTGGLGGHGGAGADNTTTV

SEQ ID NO: 666515 - protein, 22 aa, Mycobacterium
GGTGGMAGLFGAGGAGGEGGGG

SEQ ID NO: 666516 - protein, 24 aa, Mycobacterium
GGTGGMGGTGGWLMGNGGGGGVGG

SEQ ID NO: 666517 - protein, 17 aa, Mycobacterium
GGTGGNLLGVNGFDGLT

SEQ ID NO: 666518 - protein, 21 aa, Mycobacterium
GGTGGRGGLSGGVGGTDGAGG

SEQ ID NO: 666519 - protein, 19 aa, Mycobacterium
GGTGGRSGAGIYNKGGTGG

SEQ ID NO: 666520 - protein, 31 aa, Mycobacterium
GGTGGSAGLVFSDAGAGGFGGFGSTAGGTGG

SEQ ID NO: 666521 - protein, 27 aa, Mycobacterium
GGTGGTGGFSRYGLGGDGGTGGNAGWL

SEQ ID NO: 666522 - protein, 21 aa, Mycobacterium
GGTGGTLFGVPGTHGADGTAT

SEQ ID NO: 666523 - protein, 25 aa, Mycobacterium
GGTGGVPPRVDVDAGVPGDGGTGGV

SEQ ID NO: 666524 - protein, 18 aa, Mycobacterium
GGTGGWSGHGGAGGRGGW

SEQ ID NO: 666525 - protein, 27 aa, Mycobacterium
GGTGHFYRWRTADGFLSDIRSAATAVP

SEQ ID NO: 666526 - protein, 25 aa, Mycobacterium
GGTGRGFCSGAGMSAEDVVRGKSRT

SEQ ID NO: 666527 - protein, 35 aa, Mycobacterium
GGTGSTMGAEGSSGDGGTGGLGGHGGAGADNTTTV

SEQ ID NO: 666528 - protein, 27 aa, Mycobacterium
GGTGTFGWPGAFGTWWHADPKADAILM

SEQ ID NO: 666529 - protein, 19 aa, Mycobacterium
GGTGVPARTMFAVLEDIAA

SEQ ID NO: 666530 - protein, 19 aa, Mycobacterium
GGTGVPVRTIFGVLEDIAA

SEQ ID NO: 666531 - protein, 20 aa, Mycobacterium
GGTGWGCQRALMPRSNVVID

SEQ ID NO: 666532 - protein, 19 aa, Mycobacterium
GGTGWIPYFLDRVDRTFEM

SEQ ID NO: 666533 - protein, 18 aa, Mycobacterium
GGTGWIPYFVDRLDRTYE

SEQ ID NO: 666534 - protein, 19 aa, Mycobacterium
GGTIAHGLLTLSLLPHFQF

SEQ ID NO: 666535 - protein, 24 aa, Mycobacterium
GGTIAHGLLTLSLLPHFTHQLYRV

SEQ ID NO: 666536 - protein, 25 aa, Mycobacterium
GGTIAHGLLTLSLLPRFMHELYSVE

SEQ ID NO: 666537 - protein, 18 aa, Mycobacterium
GGTIAWGNAVVGVRNPLA

SEQ ID NO: 666538 - protein, 20 aa, Mycobacterium
GGTIEAMAGIKPAFKEDGVI

SEQ ID NO: 666539 - protein, 17 aa, Mycobacterium
GGTIGWADPESGSAFGY

SEQ ID NO: 666540 - protein, 19 aa, Mycobacterium
GGTKPHYGPIVMIGDPVAM

SEQ ID NO: 666541 - protein, 19 aa, Mycobacterium
GGTLAGLAHKDFSAVDVDQ

SEQ ID NO: 666542 - protein, 17 aa, Mycobacterium
GGTLAYFAAYDVHHARV

SEQ ID NO: 666543 - protein, 20 aa, Mycobacterium
GGTLIRLFGPEHVRVVPHVS

SEQ ID NO: 666544 - protein, 19 aa, Mycobacterium
GGTLLFGVPTVWSRIVEDG

SEQ ID NO: 666545 - protein, 17 aa, Mycobacterium
GGTLLIPASTFAQVLVA

SEQ ID NO: 666546 - protein, 27 aa, Mycobacterium
GGTLRPLRPAFSVGLGARLGSGRQYMA

SEQ ID NO: 666547 - protein, 18 aa, Mycobacterium
GGTLTCLVRGSSHEEARS

SEQ ID NO: 666548 - protein, 23 aa, Mycobacterium
GGTPFQRLNFMVGKLNRAMQRNP

SEQ ID NO: 666549 - protein, 21 aa, Mycobacterium
GGTPLRSRVGHSYIKAMMADT

SEQ ID NO: 666550 - protein, 24 aa, Mycobacterium
GGTPRIVQTLAPPAAAPTLTGGAP

SEQ ID NO: 666551 - protein, 24 aa, Mycobacterium
GGTPTRWVYYAWRRAVVRVPEPGL

SEQ ID NO: 666552 - protein, 21 aa, Mycobacterium
GGTPVRARVGHSYIKALMAET

SEQ ID NO: 666553 - protein, 21 aa, Mycobacterium
GGTPVRSRVGHSFIKALMAET

SEQ ID NO: 666554 - protein, 24 aa, Mycobacterium
GGTQRLSAQIGIRRAKQIIMLQQT

SEQ ID NO: 666555 - protein, 24 aa, Mycobacterium
GGTRHRGVVINPVLETSEIPETMP

SEQ ID NO: 666556 - protein, 17 aa, Mycobacterium
GGTRLLDNIAIEIETSP

SEQ ID NO: 666557 - protein, 26 aa, Mycobacterium
GGTRLTDRVLLAFGLHQALRLGKPLQ

SEQ ID NO: 666558 - protein, 31 aa, Mycobacterium
GGTRLTDRVLLRFGLHRALRIGKPLQVHVGF

SEQ ID NO: 666559 - protein, 24 aa, Mycobacterium
GGTRNGMAISWPRGITGAGEQRSQ

SEQ ID NO: 666560 - protein, 17 aa, Mycobacterium
GGTRNGMAVSWPRGITC

SEQ ID NO: 666561 - protein, 17 aa, Mycobacterium
GGTRRCVGAAFANMEMD

SEQ ID NO: 666562 - protein, 18 aa, Mycobacterium
GGTRRCVGAAFANMEMDI

SEQ ID NO: 666563 - protein, 19 aa, Mycobacterium
GGTRRCVGAVFANIEMDVV

SEQ ID NO: 666564 - protein, 21 aa, Mycobacterium
GGTRSAWDYGPLGVEFKENIK

SEQ ID NO: 666565 - protein, 20 aa, Mycobacterium
GGTSALFGHDIGFFNAGNHN

SEQ ID NO: 666566 - protein, 22 aa, Mycobacterium
GGTSALWGGRCLEFDPIDFEDR

SEQ ID NO: 666567 - protein, 20 aa, Mycobacterium
GGTSAYLRLSTRPVDQSLAA

SEQ ID NO: 666568 - protein, 21 aa, Mycobacterium
GGTSFARWAALLDEHARSQDV

SEQ ID NO: 666569 - protein, 25 aa, Mycobacterium
GGTSFARWASLLAERAHVPAVTERA

SEQ ID NO: 666570 - protein, 25 aa, Mycobacterium
GGTSFARWSALLADHACRPEVVAQA

SEQ ID NO: 666571 - protein, 26 aa, Mycobacterium
GGTSFARWSALLAEHALSTDVVEQAD

SEQ ID NO: 666572 - protein, 26 aa, Mycobacterium
GGTSFARWSALLAERARRPEVVAQAE

SEQ ID NO: 666573 - protein, 25 aa, Mycobacterium
GGTSFARWSSLLAEHAQSPAVVEQA

SEQ ID NO: 666574 - protein, 24 aa, Mycobacterium
GGTSFRRWAALLAEQAYSATAVDH

SEQ ID NO: 666575 - protein, 27 aa, Mycobacterium
GGTSGDGTQVAWGRGGDGGDGGQGGYG

SEQ ID NO: 666576 - protein, 17 aa, Mycobacterium
GGTSGWFGNGGHGGNGG

SEQ ID NO: 666577 - protein, 18 aa, Mycobacterium
GGTSIDWRDGLRRMAAKF

SEQ ID NO: 666578 - protein, 22 aa, Mycobacterium
GGTSLRRSYKLLGQGGRLVAYG

SEQ ID NO: 666579 - protein, 18 aa, Mycobacterium
GGTSRLALSDVPPELAPL

SEQ ID NO: 666580 - protein, 17 aa, Mycobacterium
GGTSRRLLVVLSDGLAY

SEQ ID NO: 666581 - protein, 18 aa, Mycobacterium
GGTTFSWTSTTPANGGAQ

SEQ ID NO: 666582 - protein, 25 aa, Mycobacterium
GGTTGRPKGVMWRQSDTYVVSMNGA

SEQ ID NO: 666583 - protein, 17 aa, Mycobacterium
GGTTVFFDPVNNVSVVQ

SEQ ID NO: 666584 - protein, 19 aa, Mycobacterium
GGTVEWIMPPAGPALGLRA

SEQ ID NO: 666585 - protein, 21 aa, Mycobacterium
GGTVHWLEPPAGPALGLNLGN

SEQ ID NO: 666586 - protein, 18 aa, Mycobacterium
GGTVIPAGAAVHLIYAAA

SEQ ID NO: 666587 - protein, 20 aa, Mycobacterium
GGTVTARFLISACGVLTVPN

SEQ ID NO: 666588 - protein, 18 aa, Mycobacterium
GGTWDLFRYPGIRSDSDI

SEQ ID NO: 666589 - protein, 18 aa, Mycobacterium
GGTWRINTYPGLACDVKS

SEQ ID NO: 666590 - protein, 24 aa, Mycobacterium
GGTWRINTYPGLACDVKSHLYSYS

SEQ ID NO: 666591 - protein, 17 aa, Mycobacterium
GGVADPLIVSWPAGIAA

SEQ ID NO: 666592 - protein, 18 aa, Mycobacterium
GGVAHKPWRARRAESVLI

SEQ ID NO: 666593 - protein, 18 aa, Mycobacterium
GGVAVWRQIIEIAKDGNA

SEQ ID NO: 666594 - protein, 20 aa, Mycobacterium
GGVDDFRFNAVIDEEIARYG

SEQ ID NO: 666595 - protein, 19 aa, Mycobacterium
GGVDTMLTGAAERWFAPGF

SEQ ID NO: 666596 - protein, 17 aa, Mycobacterium
GGVDVVIVHGGDGTVNE

SEQ ID NO: 666597 - protein, 23 aa, Mycobacterium
GGVEDARTAWQLHTAAGGGQSAP

SEQ ID NO: 666598 - protein, 30 aa, Mycobacterium
GGVEVRGPQRWRIKANWKIGAENFAGDMYH

SEQ ID NO: 666599 - protein, 17 aa, Mycobacterium
GGVFNGGAWLHIDGRDV

SEQ ID NO: 666600 - protein, 18 aa, Mycobacterium
GGVGEAQVGLSHGTYTIT

SEQ ID NO: 666601 - protein, 18 aa, Mycobacterium
GGVGEMFDTLLVYENFPM

SEQ ID NO: 666602 - protein, 31 aa, Mycobacterium
GGVGGAGGRGGWISFLSGQGAGGAGGDGGAG

SEQ ID NO: 666603 - protein, 17 aa, Mycobacterium
GGVGGDAGLLFGSGGAG

SEQ ID NO: 666604 - protein, 22 aa, Mycobacterium
GGVGGHAGLLGGPGGAGGDGGD

SEQ ID NO: 666605 - protein, 17 aa, Mycobacterium
GGVGGIFSPGGTGGTGG

SEQ ID NO: 666606 - protein, 20 aa, Mycobacterium
GGVGGNAFGGGSSGTGGTAG

SEQ ID NO: 666607 - protein, 19 aa, Mycobacterium
GGVGGNIATLANVFGNDNT

SEQ ID NO: 666608 - protein, 18 aa, Mycobacterium
GGVGGNIATLANVIGDGN

SEQ ID NO: 666609 - protein, 18 aa, Mycobacterium
GGVGGNIATLANVIGNNN

SEQ ID NO: 666610 - protein, 26 aa, Mycobacterium
GGVGGTGGDAGWLVGAGGSGGSGGIG

SEQ ID NO: 666611 - protein, 21 aa, Mycobacterium
GGVGGTGGWLLGNGGTGGTGG

SEQ ID NO: 666612 - protein, 29 aa, Mycobacterium
GGVGGVDRALIGWSGGAGGVGGSGGAGGL

SEQ ID NO: 666613 - protein, 17 aa, Mycobacterium
GGVGLAAIQGARLAGAA

SEQ ID NO: 666614 - protein, 17 aa, Mycobacterium
GGVGLACVQGARLAGAS

SEQ ID NO: 666615 - protein, 26 aa, Mycobacterium
GGVGLCPLRPAILGALANRTRYGRLM

SEQ ID NO: 666616 - protein, 22 aa, Mycobacterium
GGVGLCPLRPAVLGALAQRSRY

SEQ ID NO: 666617 - protein, 17 aa, Mycobacterium
GGVGPLLATGRGLRAAA

SEQ ID NO: 666618 - protein, 22 aa, Mycobacterium
GGVGYDCNLIFRTELYARATIE

SEQ ID NO: 666619 - protein, 19 aa, Mycobacterium
GGVHYCLGANLARREIAEA

SEQ ID NO: 666620 - protein, 19 aa, Mycobacterium
GGVHYCLGANLARRELAEA

SEQ ID NO: 666621 - protein, 18 aa, Mycobacterium
GGVLARFPDLTLPSLGFT

SEQ ID NO: 666622 - protein, 19 aa, Mycobacterium
GGVLDLRYADFTSNEVEIR

SEQ ID NO: 666623 - protein, 24 aa, Mycobacterium
GGVLERFNGLYLPIVDVLFNGATP

SEQ ID NO: 666624 - protein, 17 aa, Mycobacterium
GGVLGNLLENALRHTPP

SEQ ID NO: 666625 - protein, 17 aa, Mycobacterium
GGVLLIIDVDALLPATA

SEQ ID NO: 666626 - protein, 20 aa, Mycobacterium
GGVLLVELEVAFGARPYSFP

SEQ ID NO: 666627 - protein, 18 aa, Mycobacterium
GGVLPLLFDNLFGMVSHA

SEQ ID NO: 666628 - protein, 18 aa, Mycobacterium
GGVLPRLAAQGYLPHCRK

SEQ ID NO: 666629 - protein, 23 aa, Mycobacterium
GGVLPRLAERGYLPAELAETLRS

SEQ ID NO: 666630 - protein, 18 aa, Mycobacterium
GGVLPTFYSGTGQEDLSS

SEQ ID NO: 666631 - protein, 21 aa, Mycobacterium
GGVLQLHRWGLLDAVVASGAP

SEQ ID NO: 666632 - protein, 31 aa, Mycobacterium
GGVLRAGPDFRRRSCCLIYRLAEDRTAVCGD

SEQ ID NO: 666633 - protein, 19 aa, Mycobacterium
GGVLYRYWVDTDRAARFLL

SEQ ID NO: 666634 - protein, 26 aa, Mycobacterium
GGVMPRFPLPLGESGPHPERVEVRDV

SEQ ID NO: 666635 - protein, 25 aa, Mycobacterium
GGVMPRFPLPLGKSGPHPERVEVRD

SEQ ID NO: 666636 - protein, 20 aa, Mycobacterium
GGVMSCSALKRVYRDQLRRH

SEQ ID NO: 666637 - protein, 18 aa, Mycobacterium
GGVNTNWAIARPPGQTKP

SEQ ID NO: 666638 - protein, 17 aa, Mycobacterium
GGVNVCLNEAVYEPMSG

SEQ ID NO: 666639 - protein, 17 aa, Mycobacterium
GGVNVCLNEPVYEPLSG

SEQ ID NO: 666640 - protein, 20 aa, Mycobacterium
GGVPADFSFTPGLHDIPEEP

SEQ ID NO: 666641 - protein, 18 aa, Mycobacterium
GGVPALLGELNRAGLLHR

SEQ ID NO: 666642 - protein, 17 aa, Mycobacterium
GGVPDIVGPFLGRAAAA

SEQ ID NO: 666643 - protein, 18 aa, Mycobacterium
GGVPHLHAVRGYGSVYTL

SEQ ID NO: 666644 - protein, 27 aa, Mycobacterium
GGVPLMPASGVGRGMAAHFAAPRYGFK

SEQ ID NO: 666645 - protein, 18 aa, Mycobacterium
GGVPMLLIRGQMSDLVSQ

SEQ ID NO: 666646 - protein, 21 aa, Mycobacterium
GGVPRRWRSAAPLWGDASFAS

SEQ ID NO: 666647 - protein, 22 aa, Mycobacterium
GGVPRVETHLEWQMTPHTDPSW

SEQ ID NO: 666648 - protein, 19 aa, Mycobacterium
GGVPVAWEVAAALRAPLDV

SEQ ID NO: 666649 - protein, 19 aa, Mycobacterium
GGVPVGWEVAQRLKAPLDV

SEQ ID NO: 666650 - protein, 25 aa, Mycobacterium
GGVRDAWCALFDRYQVDLVLQGHNH

SEQ ID NO: 666651 - protein, 27 aa, Mycobacterium
GGVRDVVLCPGSRNAPLAFALQDADRS

SEQ ID NO: 666652 - protein, 22 aa, Mycobacterium
GGVRRRVRLASVLRRCTVLDAQ

SEQ ID NO: 666653 - protein, 22 aa, Mycobacterium
GGVRVALIDGQWVAFPTVEQLE

SEQ ID NO: 666654 - protein, 17 aa, Mycobacterium
GGVRVPLGFLADWMNYA

SEQ ID NO: 666655 - protein, 22 aa, Mycobacterium
GGVSANGCWSNFVTCEADLATK

SEQ ID NO: 666656 - protein, 26 aa, Mycobacterium
GGVSFWASLFPAVWSFCLALRSRGLG

SEQ ID NO: 666657 - protein, 33 aa, Mycobacterium
GGVSGMPKAKCFNEALGYWCVARAERYAYEMQN

SEQ ID NO: 666658 - protein, 23 aa, Mycobacterium
GGVSGRRVCAVVGSGDNGGDALW

SEQ ID NO: 666659 - protein, 25 aa, Mycobacterium
GGVSIGAAVAVAWALAHADKVVAVL

SEQ ID NO: 666660 - protein, 25 aa, Mycobacterium
GGVSIGAAVAVEWAVAHPGCALAVL

SEQ ID NO: 666661 - protein, 25 aa, Mycobacterium
GGVSPTIVVPGRWSSSDIEFQTRHI

SEQ ID NO: 666662 - protein, 24 aa, Mycobacterium
GGVSRHGCWGTFVIADARHAVTLP

SEQ ID NO: 666663 - protein, 20 aa, Mycobacterium
GGVSVPVRLDPAVVAAVQES

SEQ ID NO: 666664 - protein, 22 aa, Mycobacterium
GGVTGLRRARAMAMVILALPGA

SEQ ID NO: 666665 - protein, 21 aa, Mycobacterium
GGVTLPIGVLFADVRGSTALA

SEQ ID NO: 666666 - protein, 19 aa, Mycobacterium
GGVTRVTRMLGIQNGFVTV

SEQ ID NO: 666667 - protein, 17 aa, Mycobacterium
GGVVIVFPGGDYDAYRP

SEQ ID NO: 666668 - protein, 17 aa, Mycobacterium
GGVVLVFPGGDYDAFRP

SEQ ID NO: 666669 - protein, 31 aa, Mycobacterium
GGVVRFIGVDGYRWMVRCVVNGVPETVDALA

SEQ ID NO: 666670 - protein, 19 aa, Mycobacterium
GGVVRPDGIIDFGDLTDSW

SEQ ID NO: 666671 - protein, 27 aa, Mycobacterium
GGVVVSGRWPFCSGINHADMMFAGCFV

SEQ ID NO: 666672 - protein, 28 aa, Mycobacterium
GGVVVSGRWPFCSGISHADMMFAGCFID

SEQ ID NO: 666673 - protein, 19 aa, Mycobacterium
GGVWYSADMPFGGYKQSGI

SEQ ID NO: 666674 - protein, 18 aa, Mycobacterium
GGVYLDIPGEVLGQAMNA

SEQ ID NO: 666675 - protein, 18 aa, Mycobacterium
GGWARPPAPDQVRDRRAE

SEQ ID NO: 666676 - protein, 17 aa, Mycobacterium
GGWEPGNSLFINVNCWG

SEQ ID NO: 666677 - protein, 19 aa, Mycobacterium
GGWETYLREGLQIPNHDPS

SEQ ID NO: 666678 - protein, 20 aa, Mycobacterium
GGWGGWGGPATMFGSGGAGG

SEQ ID NO: 666679 - protein, 18 aa, Mycobacterium
GGWGPSLSGHVVGGLLAW

SEQ ID NO: 666680 - protein, 18 aa, Mycobacterium
GGWGPSLSGHVVGGLLGW

SEQ ID NO: 666681 - protein, 18 aa, Mycobacterium
GGWNRPWAGPPRDVVVAR

SEQ ID NO: 666682 - protein, 17 aa, Mycobacterium
GGWPGFAPTELRGYSVE

SEQ ID NO: 666683 - protein, 23 aa, Mycobacterium
GGWQDLFIRQTLRQYAHLHGRGV

SEQ ID NO: 666684 - protein, 22 aa, Mycobacterium
GGWRYPEPLAPVAAAGRAGAPL

SEQ ID NO: 666685 - protein, 17 aa, Mycobacterium
GGWSRGAGSLPVYDGAA

SEQ ID NO: 666686 - protein, 20 aa, Mycobacterium
GGWYFTSRALQWDSVPSRHP

SEQ ID NO: 666687 - protein, 18 aa, Mycobacterium
GGYACSWLIGDIKTGEIA

SEQ ID NO: 666688 - protein, 18 aa, Mycobacterium
GGYAEFCTAPAALTAKVP

SEQ ID NO: 666689 - protein, 21 aa, Mycobacterium
GGYAQEFQTLVARTTLFHNEF

SEQ ID NO: 666690 - protein, 17 aa, Mycobacterium
GGYCYEHNGLLGYVLEE

SEQ ID NO: 666691 - protein, 34 aa, Mycobacterium
GGYDFEFFRRAALPRLHALAPLRYQLVDIPWKLH

SEQ ID NO: 666692 - protein, 26 aa, Mycobacterium
GGYDMTAFWCRAGTAATITPAGMPGM

SEQ ID NO: 666693 - protein, 25 aa, Mycobacterium
GGYDMTAFWCRAGTAATITPMGYQG

SEQ ID NO: 666694 - protein, 25 aa, Mycobacterium
GGYDRLAGLGYQYGPAFQGLTAVWK

SEQ ID NO: 666695 - protein, 17 aa, Mycobacterium
GGYFAGLALYVQNGLAK

SEQ ID NO: 666696 - protein, 18 aa, Mycobacterium
GGYGEADWLLAQIDETDG

SEQ ID NO: 666697 - protein, 26 aa, Mycobacterium
GGYGGDGGLLFGRGGAGGAGGFGNNT

SEQ ID NO: 666698 - protein, 21 aa, Mycobacterium
GGYHRFAWTGPDADMRAWFSD

SEQ ID NO: 666699 - protein, 20 aa, Mycobacterium
GGYLKAAVDFALERDDYGPE

SEQ ID NO: 666700 - protein, 19 aa, Mycobacterium
GGYLPLSFAASNIAWSEVD

SEQ ID NO: 666701 - protein, 18 aa, Mycobacterium
GGYLSEVYEISFPHTPGI

SEQ ID NO: 666702 - protein, 17 aa, Mycobacterium
GGYPLEFGTISVSDGIS

SEQ ID NO: 666703 - protein, 17 aa, Mycobacterium
GGYQPVLQMVFDVAEDV

SEQ ID NO: 666704 - protein, 37 aa, Mycobacterium
GGYRLRSAMHAWARVVSRPEPELALLDAGKRDVPFDE

SEQ ID NO: 666705 - protein, 29 aa, Mycobacterium
GGYRPETPCAVVAFASWPQEVVLRGTLAD

SEQ ID NO: 666706 - protein, 25 aa, Mycobacterium
GGYRYKRFHAALARHLQAVPEFRMK

SEQ ID NO: 666707 - protein, 19 aa, Mycobacterium
GGYSYGGRIAALADAAREN

SEQ ID NO: 666708 - protein, 17 aa, Mycobacterium
GGYTFPAGTFVVVNTFA

SEQ ID NO: 666709 - protein, 19 aa, Mycobacterium
GGYTYGGRIAALADAARES

SEQ ID NO: 666710 - protein, 22 aa, Mycobacterium
GGYVPRLGDGRALLLGELTDVH

SEQ ID NO: 666711 - protein, 19 aa, Mycobacterium
GGYWMPLFVVLADGVELTD

SEQ ID NO: 666712 - protein, 19 aa, Mycobacterium
GHAAKVLNLRSTLLTLAGG

SEQ ID NO: 666713 - protein, 20 aa, Mycobacterium
GHAALREWAQALDVRIEPGR

SEQ ID NO: 666714 - protein, 32 aa, Mycobacterium
GHAALRRWAEAAGISVTPGRMYVHDGVVVAEQ

SEQ ID NO: 666715 - protein, 24 aa, Mycobacterium
GHAAPRPPGPLLAQFDVFADAVLA

SEQ ID NO: 666716 - protein, 21 aa, Mycobacterium
GHAARLWSPVLACALAHGVLP

SEQ ID NO: 666717 - protein, 21 aa, Mycobacterium
GHAARLWSPVLACVLSQGVVP

SEQ ID NO: 666718 - protein, 27 aa, Mycobacterium
GHAASLGRLSVPPSWAQSVPDLESMPA

SEQ ID NO: 666719 - protein, 21 aa, Mycobacterium
GHAAWALGVAKSMLDDVAELA

SEQ ID NO: 666720 - protein, 18 aa, Mycobacterium
GHACGHNIIAASAVGTAL

SEQ ID NO: 666721 - protein, 18 aa, Mycobacterium
GHACGHNIIAASAVGTGL

SEQ ID NO: 666722 - protein, 26 aa, Mycobacterium
GHACVAVDAGHRWLLHAGDAFYHHSE

SEQ ID NO: 666723 - protein, 20 aa, Mycobacterium
GHADIRWHMVGNLQRNKAKS

SEQ ID NO: 666724 - protein, 23 aa, Mycobacterium
GHADWPHIGVALMQPRARGRLTL

SEQ ID NO: 666725 - protein, 24 aa, Mycobacterium
GHAEAALLRLAEERRIPVLMNGMA

SEQ ID NO: 666726 - protein, 18 aa, Mycobacterium
GHAEAGEELFLVRYDPST

SEQ ID NO: 666727 - protein, 21 aa, Mycobacterium
GHAEISIPIDIPINGTIGDIN

SEQ ID NO: 666728 - protein, 21 aa, Mycobacterium
GHAELLLAGGVLYLADEFPEI

SEQ ID NO: 666729 - protein, 21 aa, Mycobacterium
GHAELRALAGVGELFDTLLVY

SEQ ID NO: 666730 - protein, 24 aa, Mycobacterium
GHAELRALGGVGEMFDTLLVYENF

SEQ ID NO: 666731 - protein, 17 aa, Mycobacterium
GHAELSLALAADGYTVT

SEQ ID NO: 666732 - protein, 17 aa, Mycobacterium
GHAELSLALAADGYTVV

SEQ ID NO: 666733 - protein, 20 aa, Mycobacterium
GHAGDIAAVVSFLAGPESGY

SEQ ID NO: 666734 - protein, 17 aa, Mycobacterium
GHAGFLGAERIRELITD

SEQ ID NO: 666735 - protein, 17 aa, Mycobacterium
GHAGFLGAERIRELMTD

SEQ ID NO: 666736 - protein, 27 aa, Mycobacterium
GHAGKIVFRAAFGARKLDGEPGLDGSP

SEQ ID NO: 666737 - protein, 26 aa, Mycobacterium
GHAGKVVFRRAFGVRKLESEPGLDGA

SEQ ID NO: 666738 - protein, 19 aa, Mycobacterium
GHAHAAPVYLYRFDYSTPL

SEQ ID NO: 666739 - protein, 22 aa, Mycobacterium
GHAHCAMRWFERNRTACGPPGL

SEQ ID NO: 666740 - protein, 19 aa, Mycobacterium
GHAHELRQTVLALLADHNL

SEQ ID NO: 666741 - protein, 26 aa, Mycobacterium
GHAHIDSAWLWPVRETVRKCARTFSN

SEQ ID NO: 666742 - protein, 23 aa, Mycobacterium
GHAHPRIAEVAARQLHRLNTNSR

SEQ ID NO: 666743 - protein, 25 aa, Mycobacterium
GHAHSLRALGFGVLSKSYFRFAQRT

SEQ ID NO: 666744 - protein, 23 aa, Mycobacterium
GHAIRLAATHLKDGLDTELVASF

SEQ ID NO: 666745 - protein, 17 aa, Mycobacterium
GHAKASMTLDVYADLFD

SEQ ID NO: 666746 - protein, 20 aa, Mycobacterium
GHANHYLAVFDRATGSALDL

SEQ ID NO: 666747 - protein, 20 aa, Mycobacterium
GHAPAALARAVRFGDAFLGA

SEQ ID NO: 666748 - protein, 20 aa, Mycobacterium
GHAPFSLAWMTAVGERTTRL

SEQ ID NO: 666749 - protein, 21 aa, Mycobacterium
GHAPLWLPGVTGVVIRGEQVL

SEQ ID NO: 666750 - protein, 21 aa, Mycobacterium
GHAPNAWAVLGAVAHATESAH

SEQ ID NO: 666751 - protein, 17 aa, Mycobacterium
GHAPPWAPLPVQYIDYT

SEQ ID NO: 666752 - protein, 21 aa, Mycobacterium
GHAPVGWSVNLDAARRGDTYL

SEQ ID NO: 666753 - protein, 31 aa, Mycobacterium
GHAQAYQWLGAQAGAFHSQFIQALTGSGIAY

SEQ ID NO: 666754 - protein, 25 aa, Mycobacterium
GHARILCAMPFFWIGGLLAATGALH

SEQ ID NO: 666755 - protein, 21 aa, Mycobacterium
GHASWALGVAKSMLDDVADLA

SEQ ID NO: 666756 - protein, 21 aa, Mycobacterium
GHASWALGVAKSMLDDVTELA

SEQ ID NO: 666757 - protein, 17 aa, Mycobacterium
GHAYEYIATDAIARFKR

SEQ ID NO: 666758 - protein, 19 aa, Mycobacterium
GHCFEILESAGVRTPRTRT

SEQ ID NO: 666759 - protein, 23 aa, Mycobacterium
GHDALDPFVAMGFAAAHTTTLRL

SEQ ID NO: 666760 - protein, 17 aa, Mycobacterium
GHDALLFCDGRREIRVP

SEQ ID NO: 666761 - protein, 20 aa, Mycobacterium
GHDAVVPALRLHDTIKAVDA

SEQ ID NO: 666762 - protein, 24 aa, Mycobacterium
GHDFRPEFRQVPASVATFATRPPR

SEQ ID NO: 666763 - protein, 22 aa, Mycobacterium
GHDGDYRFGQQIVVSHDGGDYL

SEQ ID NO: 666764 - protein, 17 aa, Mycobacterium
GHDGFLIEIEAVGELIR

SEQ ID NO: 666765 - protein, 18 aa, Mycobacterium
GHDGTIWVDIRGLTYAPV

SEQ ID NO: 666766 - protein, 27 aa, Mycobacterium
GHDHQRIAPLVAEWADNLGRGIEVALQ

SEQ ID NO: 666767 - protein, 20 aa, Mycobacterium
GHDIGYRIAHHDDLTAPPPV

SEQ ID NO: 666768 - protein, 17 aa, Mycobacterium
GHDISRVVMPESFTRSK

SEQ ID NO: 666769 - protein, 19 aa, Mycobacterium
GHDITRLGHRDRRAHWKNI

SEQ ID NO: 666770 - protein, 18 aa, Mycobacterium
GHDLLALVPYRQIVERGF

SEQ ID NO: 666771 - protein, 17 aa, Mycobacterium
GHDLPACHVYRTLDDLD

SEQ ID NO: 666772 - protein, 25 aa, Mycobacterium
GHDLSRIHSVASFFVSRVDTEIDNR

SEQ ID NO: 666773 - protein, 21 aa, Mycobacterium
GHDPRRFGTDLLERFRDLIVL

SEQ ID NO: 666774 - protein, 22 aa, Mycobacterium
GHDPRTPGGRGLGVGTRSRSTR

SEQ ID NO: 666775 - protein, 17 aa, Mycobacterium
GHDQLRAAAALTASVPG

SEQ ID NO: 666776 - protein, 24 aa, Mycobacterium
GHDREFLEAALLAALAERRDAELE

SEQ ID NO: 666777 - protein, 17 aa, Mycobacterium
GHDRFTLDRILAEEAAL

SEQ ID NO: 666778 - protein, 26 aa, Mycobacterium
GHDRGARVAHRWALDRPSEISALALL

SEQ ID NO: 666779 - protein, 17 aa, Mycobacterium
GHDTAHRTFFIWEGVTQ

SEQ ID NO: 666780 - protein, 18 aa, Mycobacterium
GHDVRLLVGHSFGGAAVF

SEQ ID NO: 666781 - protein, 24 aa, Mycobacterium
GHEAKLLGFHWTKIHHQPDLGEVY

SEQ ID NO: 666782 - protein, 28 aa, Mycobacterium
GHEALRGCTWLPFFHDMGLITVMVPSML

SEQ ID NO: 666783 - protein, 24 aa, Mycobacterium
GHEALRRWAGSVMVAAELGQMYVH

SEQ ID NO: 666784 - protein, 24 aa, Mycobacterium
GHEEFYLFGCCHHIAIDGLGMALV

SEQ ID NO: 666785 - protein, 26 aa, Mycobacterium
GHEIALRRALPAGVRLYTGDDFNYPE

SEQ ID NO: 666786 - protein, 18 aa, Mycobacterium
GHEPQAGIHFAFISNSNP

SEQ ID NO: 666787 - protein, 17 aa, Mycobacterium
GHEREALEAAAKWREIF

SEQ ID NO: 666788 - protein, 25 aa, Mycobacterium
GHERTMMWLGFADRLDNLIADLHPV

SEQ ID NO: 666789 - protein, 24 aa, Mycobacterium
GHERTMMWLGFADRLDNMIDDFRP

SEQ ID NO: 666790 - protein, 25 aa, Mycobacterium
GHERTMMWLGFADRLENMIDDFQPT

SEQ ID NO: 666791 - protein, 24 aa, Mycobacterium
GHERWPVCRITLTGSTTIRDFNRA

SEQ ID NO: 666792 - protein, 25 aa, Mycobacterium
GHEVELTLQWAYRVGDNEFRVGVDA

SEQ ID NO: 666793 - protein, 19 aa, Mycobacterium
GHEVSGIVVELGYGTTGLT

SEQ ID NO: 666794 - protein, 17 aa, Mycobacterium
GHEWDFVVIAGLQDGLW

SEQ ID NO: 666795 - protein, 17 aa, Mycobacterium
GHEWDLVVIAGLQEGLW

SEQ ID NO: 666796 - protein, 20 aa, Mycobacterium
GHFATMRHAASYWRGLSKAG

SEQ ID NO: 666797 - protein, 22 aa, Mycobacterium
GHFGEGCMHMRIDFDLLSSAGL

SEQ ID NO: 666798 - protein, 25 aa, Mycobacterium
GHFGQGCVHTRIPFVLWTAEGIAKF

SEQ ID NO: 666799 - protein, 24 aa, Mycobacterium
GHFPGLQWPLTLGHEIAGAVAEVG

SEQ ID NO: 666800 - protein, 21 aa, Mycobacterium
GHFPLPMIRNPLWRPAATAAT

SEQ ID NO: 666801 - protein, 23 aa, Mycobacterium
GHFPSLEVPEFFVKDLQEGLSAV

SEQ ID NO: 666802 - protein, 17 aa, Mycobacterium
GHFTRRRSVALTTLDLE

SEQ ID NO: 666803 - protein, 22 aa, Mycobacterium
GHFYLRSHIDAVAALLASSAQC

SEQ ID NO: 666804 - protein, 17 aa, Mycobacterium
GHGAKLLGNGGAGGAGG

SEQ ID NO: 666805 - protein, 25 aa, Mycobacterium
GHGAPRMLGLLAEWLTGEVAAGRVR

SEQ ID NO: 666806 - protein, 19 aa, Mycobacterium
GHGARRGRSTLPFVPAVVD

SEQ ID NO: 666807 - protein, 23 aa, Mycobacterium
GHGDAVGVLAGFPVEIAPTAQGV

SEQ ID NO: 666808 - protein, 19 aa, Mycobacterium
GHGDGYGLRCHNLDGVNLG

SEQ ID NO: 666809 - protein, 22 aa, Mycobacterium
GHGDIALVYGVGRGSLPADLDQ

SEQ ID NO: 666810 - protein, 28 aa, Mycobacterium
GHGEAALLRLAEELQIPVLMNGMARGAV

SEQ ID NO: 666811 - protein, 25 aa, Mycobacterium
GHGEGWALYAERLMAELGWLDDPGN

SEQ ID NO: 666812 - protein, 17 aa, Mycobacterium
GHGELWRGPIRGATDEA

SEQ ID NO: 666813 - protein, 29 aa, Mycobacterium
GHGGAGGAAGWFGHAGVGGDGGTGGAGGN

SEQ ID NO: 666814 - protein, 28 aa, Mycobacterium
GHGGAGGAARLWGTGGHGGSGGAGGVGA

SEQ ID NO: 666815 - protein, 19 aa, Mycobacterium
GHGGIVLEHLKALRLQSDL

SEQ ID NO: 666816 - protein, 24 aa, Mycobacterium
GHGGKGAPGFLGLYGNPGTPGSFS

SEQ ID NO: 666817 - protein, 24 aa, Mycobacterium
GHGGNGGNGGWLYGDAGAGGQGGN

SEQ ID NO: 666818 - protein, 23 aa, Mycobacterium
GHGGQALVWGRDPVDWGQDYYQR

SEQ ID NO: 666819 - protein, 23 aa, Mycobacterium
GHGGQGGYGGWLAGSGGAGGTGG

SEQ ID NO: 666820 - protein, 23 aa, Mycobacterium
GHGGQGGYGGWLGGSGGAGGTGG

SEQ ID NO: 666821 - protein, 18 aa, Mycobacterium
GHGGSLLARRVGGRVNTL

SEQ ID NO: 666822 - protein, 22 aa, Mycobacterium
GHGGSWRPLLAHLGSRPERSRR

SEQ ID NO: 666823 - protein, 25 aa, Mycobacterium
GHGHFSRALMTRWIDLPLEEGTRLG

SEQ ID NO: 666824 - protein, 19 aa, Mycobacterium
GHGHSAWREDGDYSPRLNA

SEQ ID NO: 666825 - protein, 20 aa, Mycobacterium
GHGHSGWREDGDYSPQHNAD

SEQ ID NO: 666826 - protein, 18 aa, Mycobacterium
GHGISGFFNSASGGPLVT

SEQ ID NO: 666827 - protein, 18 aa, Mycobacterium
GHGKRWESLFTRHLSDIP

SEQ ID NO: 666828 - protein, 22 aa, Mycobacterium
GHGKVALLLGHILADRGDQVSS

SEQ ID NO: 666829 - protein, 21 aa, Mycobacterium
GHGKVALQLARILTERGDDVS

SEQ ID NO: 666830 - protein, 21 aa, Mycobacterium
GHGKVALQLARILTERGDGVS

SEQ ID NO: 666831 - protein, 17 aa, Mycobacterium
GHGLAAATVMGQLRSAC

SEQ ID NO: 666832 - protein, 19 aa, Mycobacterium
GHGLKGFRCSHIEASNARR

SEQ ID NO: 666833 - protein, 17 aa, Mycobacterium
GHGLLCAAVEHPDSREV

SEQ ID NO: 666834 - protein, 29 aa, Mycobacterium
GHGLPGRCDERPCRVFAAKQAQDVVDKRG

SEQ ID NO: 666835 - protein, 19 aa, Mycobacterium
GHGLRRGPDLSGMLEPLFG

SEQ ID NO: 666836 - protein, 25 aa, Mycobacterium
GHGLSVTDIGAWVTHPGGPKIINAI

SEQ ID NO: 666837 - protein, 22 aa, Mycobacterium
GHGMSEHFPFSAAGAALLCGWS

SEQ ID NO: 666838 - protein, 25 aa, Mycobacterium
GHGPLVIGVCAEYDALPGIGHACGH

SEQ ID NO: 666839 - protein, 17 aa, Mycobacterium
GHGRITMYHGWESGMDN

SEQ ID NO: 666840 - protein, 21 aa, Mycobacterium
GHGRLTGLITVKDFVKTEQHP

SEQ ID NO: 666841 - protein, 17 aa, Mycobacterium
GHGRPAGSVLVLPGLFP

SEQ ID NO: 666842 - protein, 17 aa, Mycobacterium
GHGRRSVVITGTNGKST

SEQ ID NO: 666843 - protein, 24 aa, Mycobacterium
GHGRSAWCEDGDYGPVLNAVAVEP

SEQ ID NO: 666844 - protein, 26 aa, Mycobacterium
GHGSRTRFGDVLPFLVKVLAADEPLS

SEQ ID NO: 666845 - protein, 17 aa, Mycobacterium
GHGVPAVVGVDWRTSLT

SEQ ID NO: 666846 - protein, 24 aa, Mycobacterium
GHHAANVRRIRVGERIDLSDGAGT

SEQ ID NO: 666847 - protein, 17 aa, Mycobacterium
GHHAFDPFVSLSFAAAA

SEQ ID NO: 666848 - protein, 21 aa, Mycobacterium
GHHAITCAFHPQIGAEILAWL

SEQ ID NO: 666849 - protein, 24 aa, Mycobacterium
GHHALDPFVALAFAAAATTDVKLL

SEQ ID NO: 666850 - protein, 25 aa, Mycobacterium
GHHCAQPILRRMGLEATVRPSFAFY

SEQ ID NO: 666851 - protein, 24 aa, Mycobacterium
GHHCAQPILRRYGLEATVRPSFAF

SEQ ID NO: 666852 - protein, 26 aa, Mycobacterium
GHHCAWPLHRRFGIAASARASFAVYN

SEQ ID NO: 666853 - protein, 24 aa, Mycobacterium
GHHHGCLPTAIGVPAGDQRALGQA

SEQ ID NO: 666854 - protein, 17 aa, Mycobacterium
GHHRIPLTIIRICSTYG

SEQ ID NO: 666855 - protein, 20 aa, Mycobacterium
GHIEMGRGLLAAVLANALPD

SEQ ID NO: 666856 - protein, 24 aa, Mycobacterium
GHIESRPAITLSWIRELPSLGAVA

SEQ ID NO: 666857 - protein, 24 aa, Mycobacterium
GHIGLDCLEELVLQAPLVPEHAAM

SEQ ID NO: 666858 - protein, 17 aa, Mycobacterium
GHIGRAVARRATAFGVR

SEQ ID NO: 666859 - protein, 17 aa, Mycobacterium
GHILWAMLGDGRWSDGR

SEQ ID NO: 666860 - protein, 25 aa, Mycobacterium
GHIPVMLDRCYELLAPALTADSTDG

SEQ ID NO: 666861 - protein, 28 aa, Mycobacterium
GHISRAGWSAVRWRNLTGGIVALHAGYK

SEQ ID NO: 666862 - protein, 20 aa, Mycobacterium
GHITRQAWLHAGLPEATGAT

SEQ ID NO: 666863 - protein, 24 aa, Mycobacterium
GHKLSDDEFGFFVVLLAVAGNETT

SEQ ID NO: 666864 - protein, 25 aa, Mycobacterium
GHKRPEMLRFLPADAQCVLELGCGE

SEQ ID NO: 666865 - protein, 24 aa, Mycobacterium
GHKSPEMTARYAATLAATAEAEFL

SEQ ID NO: 666866 - protein, 24 aa, Mycobacterium
GHKSPEMTARYAATLAATSEAEFL

SEQ ID NO: 666867 - protein, 20 aa, Mycobacterium
GHLADFVFLLARTNPDKPKH

SEQ ID NO: 666868 - protein, 23 aa, Mycobacterium
GHLAEELVRIIGVLRGMQLKKVP

SEQ ID NO: 666869 - protein, 24 aa, Mycobacterium
GHLAFVHAHPRWIGQAFADALGAR

SEQ ID NO: 666870 - protein, 19 aa, Mycobacterium
GHLAWRMRARHRLREPETT

SEQ ID NO: 666871 - protein, 17 aa, Mycobacterium
GHLDGVDADLAWQPELW

SEQ ID NO: 666872 - protein, 19 aa, Mycobacterium
GHLDWYADGMFPPMHIDAE

SEQ ID NO: 666873 - protein, 17 aa, Mycobacterium
GHLEAAAGVAGFMKAVL

SEQ ID NO: 666874 - protein, 25 aa, Mycobacterium
GHLEPAGKALIQWRSPSWFASMQQG

SEQ ID NO: 666875 - protein, 24 aa, Mycobacterium
GHLEQLGRALALLPQGRAAARVPA

SEQ ID NO: 666876 - protein, 17 aa, Mycobacterium
GHLEVVEAFLAASRGGD

SEQ ID NO: 666877 - protein, 19 aa, Mycobacterium
GHLFRAAYEGISFGIRQIL

SEQ ID NO: 666878 - protein, 20 aa, Mycobacterium
GHLGGAFAGGGGDGGAGAVG

SEQ ID NO: 666879 - protein, 24 aa, Mycobacterium
GHLGVQFAAAMGFDTVVIARGRGD

SEQ ID NO: 666880 - protein, 19 aa, Mycobacterium
GHLGVQFSRAMGFETIAIA

SEQ ID NO: 666881 - protein, 23 aa, Mycobacterium
GHLGWPAAVSYRIVALTRPDAVL

SEQ ID NO: 666882 - protein, 19 aa, Mycobacterium
GHLHWLMQHNGGVFLPPWG

SEQ ID NO: 666883 - protein, 24 aa, Mycobacterium
GHLIEVNAGPVLKVHPNLRYATDG

SEQ ID NO: 666884 - protein, 25 aa, Mycobacterium
GHLLEIRGTCVLVDGTVKALSPAAM

SEQ ID NO: 666885 - protein, 18 aa, Mycobacterium
GHLLEYLSDPTIRPLDGE

SEQ ID NO: 666886 - protein, 17 aa, Mycobacterium
GHLLTLVGLHHLAGLGL

SEQ ID NO: 666887 - protein, 22 aa, Mycobacterium
GHLPRFAAFRRDGARVLDLPTY

SEQ ID NO: 666888 - protein, 19 aa, Mycobacterium
GHLQQRWARNSGGLLLVTH

SEQ ID NO: 666889 - protein, 26 aa, Mycobacterium
GHLRITPRSSVVFQEPRLIQAQRVWK

SEQ ID NO: 666890 - protein, 22 aa, Mycobacterium
GHLRKFGLSRVRVRELAHAGQL

SEQ ID NO: 666891 - protein, 21 aa, Mycobacterium
GHLRLGDRADIVILDPERLDA

SEQ ID NO: 666892 - protein, 17 aa, Mycobacterium
GHLSLAIGHVRQFESAR

SEQ ID NO: 666893 - protein, 22 aa, Mycobacterium
GHLTLVRHARKVPGAVVVVSIF

SEQ ID NO: 666894 - protein, 20 aa, Mycobacterium
GHLTSAYSVVILDRYVASNA

SEQ ID NO: 666895 - protein, 17 aa, Mycobacterium
GHLWWIRSQLRSLLVAD

SEQ ID NO: 666896 - protein, 18 aa, Mycobacterium
GHLYRMFAKLGVADRDQL

SEQ ID NO: 666897 - protein, 19 aa, Mycobacterium
GHMEAAAGIGGFIKAVLTL

SEQ ID NO: 666898 - protein, 25 aa, Mycobacterium
GHMRLQRFYSVLFVDCGVDLEHEVM

SEQ ID NO: 666899 - protein, 21 aa, Mycobacterium
GHMTTKWGAFVADIAGFDAEF

SEQ ID NO: 666900 - protein, 24 aa, Mycobacterium
GHNAIDIPARWESMVKAMRNNGRP

SEQ ID NO: 666901 - protein, 17 aa, Mycobacterium
GHNGERALDEIIKGFGG

SEQ ID NO: 666902 - protein, 19 aa, Mycobacterium
GHNLSEIHSVASLFVSRVD

SEQ ID NO: 666903 - protein, 21 aa, Mycobacterium
GHNPIGIIVPCHRVIGANGSL

SEQ ID NO: 666904 - protein, 26 aa, Mycobacterium
GHNRRWLRRAGLLAAGACAGFFRHPP

SEQ ID NO: 666905 - protein, 24 aa, Mycobacterium
GHNSPDGKVRWFLGIPYAAPPVGD

SEQ ID NO: 666906 - protein, 18 aa, Mycobacterium
GHNVMKGYWNRPDATAAA

SEQ ID NO: 666907 - protein, 24 aa, Mycobacterium
GHPAHLLLQLGRPVDHHAVAALIG

SEQ ID NO: 666908 - protein, 18 aa, Mycobacterium
GHPAKLTSPVAFLEKPSR

SEQ ID NO: 666909 - protein, 22 aa, Mycobacterium
GHPDAFVTIKGWQPDSVAAGLQ

SEQ ID NO: 666910 - protein, 19 aa, Mycobacterium
GHPDEFAYALVISHENQHD

SEQ ID NO: 666911 - protein, 23 aa, Mycobacterium
GHPDRVRSALLLAVGARATADQI

SEQ ID NO: 666912 - protein, 24 aa, Mycobacterium
GHPDRVRSGLLLAVGARATADQIG

SEQ ID NO: 666913 - protein, 21 aa, Mycobacterium
GHPEAALAYWTAEAERARRDA

SEQ ID NO: 666914 - protein, 22 aa, Mycobacterium
GHPESLVNWDALAALNGTIVLL

SEQ ID NO: 666915 - protein, 27 aa, Mycobacterium
GHPESLVNWDALAAMRGTIVLLMAVER

SEQ ID NO: 666916 - protein, 17 aa, Mycobacterium
GHPEVIEATALGVDDPE

SEQ ID NO: 666917 - protein, 17 aa, Mycobacterium
GHPGAPIMLVGEQPGDQ

SEQ ID NO: 666918 - protein, 24 aa, Mycobacterium
GHPGCAMTACLHWGALRGPASSAH

SEQ ID NO: 666919 - protein, 24 aa, Mycobacterium
GHPGRVRAGLLLAVGARATADQIG

SEQ ID NO: 666920 - protein, 17 aa, Mycobacterium
GHPHLFPTLATRPPEAP

SEQ ID NO: 666921 - protein, 17 aa, Mycobacterium
GHPIGATGVRILTTMLH

SEQ ID NO: 666922 - protein, 26 aa, Mycobacterium
GHPILYVAQMWDWIFPLGDTPDYEPD

SEQ ID NO: 666923 - protein, 21 aa, Mycobacterium
GHPIPGLYAAGRCAAGLAAWG

SEQ ID NO: 666924 - protein, 23 aa, Mycobacterium
GHPKKLFRPKVPIVVLVGEPIEP

SEQ ID NO: 666925 - protein, 20 aa, Mycobacterium
GHPLAGLVHLGEGCDVRPVL

SEQ ID NO: 666926 - protein, 25 aa, Mycobacterium
GHPLGATGLAQCAELNWQLRGKADK

SEQ ID NO: 666927 - protein, 23 aa, Mycobacterium
GHPLGCSGARLIVTLLNRLEREG

SEQ ID NO: 666928 - protein, 19 aa, Mycobacterium
GHPLNGVAHLLSRQTDTQI

SEQ ID NO: 666929 - protein, 18 aa, Mycobacterium
GHPLRLRVPRYRCVDTAC

SEQ ID NO: 666930 - protein, 25 aa, Mycobacterium
GHPRRAGVSSFGFGGTNAHVVIEQG

SEQ ID NO: 666931 - protein, 20 aa, Mycobacterium
GHPRRGRFLPPIDLPRRMFA

SEQ ID NO: 666932 - protein, 18 aa, Mycobacterium
GHPRRSVIDAAWRAIGPG

SEQ ID NO: 666933 - protein, 20 aa, Mycobacterium
GHPTAGWWDGVAGPGAPIDT

SEQ ID NO: 666934 - protein, 20 aa, Mycobacterium
GHPTPGWWDGVAGPGAPIDT

SEQ ID NO: 666935 - protein, 36 aa, Mycobacterium
GHPVLAAVLRKGYKLGDRVLRTAMVVVTDGDTAQQE

SEQ ID NO: 666936 - protein, 22 aa, Mycobacterium
GHPVLHYLHRPIPREDLVAFFV

SEQ ID NO: 666937 - protein, 18 aa, Mycobacterium
GHPVLVWLHGGAYVTGSG

SEQ ID NO: 666938 - protein, 25 aa, Mycobacterium
GHPYVFVIGDLMSVPGVPGMAQGAI

SEQ ID NO: 666939 - protein, 17 aa, Mycobacterium
GHQFGGYVPRLGDGRAL

SEQ ID NO: 666940 - protein, 25 aa, Mycobacterium
GHQGLCYFAYLAGYRLVHEAAQDPL

SEQ ID NO: 666941 - protein, 25 aa, Mycobacterium
GHQGLCYFGYLAGYRLVHEAAQDPV

SEQ ID NO: 666942 - protein, 26 aa, Mycobacterium
GHQGLCYFGYLAGYRLVHEAAQDPVI

SEQ ID NO: 666943 - protein, 17 aa, Mycobacterium
GHQHAAWSYVDAWTEVS

SEQ ID NO: 666944 - protein, 17 aa, Mycobacterium
GHQLAPGPFLTSVSAAV

SEQ ID NO: 666945 - protein, 26 aa, Mycobacterium
GHQLRYDLSAGFPLLTTKKVHLKSVV

SEQ ID NO: 666946 - protein, 19 aa, Mycobacterium
GHRALGWSTAGRIAPGAAA

SEQ ID NO: 666947 - protein, 17 aa, Mycobacterium
GHRCGLRPAPESGGCSC

SEQ ID NO: 666948 - protein, 24 aa, Mycobacterium
GHRDLRVVFDIGNLLDFGHRPGEF

SEQ ID NO: 666949 - protein, 24 aa, Mycobacterium
GHREIADMLTALICHGTLTRFPRL

SEQ ID NO: 666950 - protein, 19 aa, Mycobacterium
GHRGCPGRTASIRIHGRGP

SEQ ID NO: 666951 - protein, 21 aa, Mycobacterium
GHRISHWLWNRGARLVARILN

SEQ ID NO: 666952 - protein, 24 aa, Mycobacterium
GHRKRADAILARRTDRLPMSAYVD

SEQ ID NO: 666953 - protein, 19 aa, Mycobacterium
GHRKVAPVYLYRFDYSTPL

SEQ ID NO: 666954 - protein, 19 aa, Mycobacterium
GHRLARLVLTLAAPGRVAV

SEQ ID NO: 666955 - protein, 25 aa, Mycobacterium
GHRLAWAHLWERFNIDMGHDPNLLR

SEQ ID NO: 666956 - protein, 19 aa, Mycobacterium
GHRLMENWHPLGVVGVITA

SEQ ID NO: 666957 - protein, 25 aa, Mycobacterium
GHRLMETWHPLGVVGVITAFNFPVA

SEQ ID NO: 666958 - protein, 26 aa, Mycobacterium
GHRMLANWLTYCGWARNDTLVRRLEN

SEQ ID NO: 666959 - protein, 24 aa, Mycobacterium
GHRNGAVVLLMWTGILAYLDRSGY

SEQ ID NO: 666960 - protein, 22 aa, Mycobacterium
GHRNLYRYLAHCSMAENSDGPD

SEQ ID NO: 666961 - protein, 22 aa, Mycobacterium
GHRRAYLQFRWQRADRQLTPAD

SEQ ID NO: 666962 - protein, 23 aa, Mycobacterium
GHRRFGTWHYWWQAHLLDNLVDA

SEQ ID NO: 666963 - protein, 24 aa, Mycobacterium
GHRRGFLKFRWQRTNRPILDEDGP

SEQ ID NO: 666964 - protein, 25 aa, Mycobacterium
GHRRGFLQFRWQRVSRQLTDADGPS

SEQ ID NO: 666965 - protein, 25 aa, Mycobacterium
GHRRGFLQFRWQRVSRQLTEADGPT

SEQ ID NO: 666966 - protein, 24 aa, Mycobacterium
GHRRGILQFRWQRVSRELTEADGP

SEQ ID NO: 666967 - protein, 32 aa, Mycobacterium
GHRRPDCRWPGPRPPRCQRWAVRHPHGGLRRA

SEQ ID NO: 666968 - protein, 24 aa, Mycobacterium
GHRRRAGGVLGGLEPAARRRDRGD

SEQ ID NO: 666969 - protein, 20 aa, Mycobacterium
GHRRRVAALEADRQSVPVVV

SEQ ID NO: 666970 - protein, 24 aa, Mycobacterium
GHRVIKVLADLVVSFDREDEFPSD

SEQ ID NO: 666971 - protein, 20 aa, Mycobacterium
GHSDIRAAVMGLARATDYDE

SEQ ID NO: 666972 - protein, 20 aa, Mycobacterium
GHSDLRAAVLGLDRATDAAV

SEQ ID NO: 666973 - protein, 20 aa, Mycobacterium
GHSDLRAAVLGLDRATDATV

SEQ ID NO: 666974 - protein, 20 aa, Mycobacterium
GHSDLRASVLGLDRATTRGV

SEQ ID NO: 666975 - protein, 20 aa, Mycobacterium
GHSDLRVGVLGLEAATNKHF

SEQ ID NO: 666976 - protein, 24 aa, Mycobacterium
GHSEAIARISWCVNQCAIGVITGE

SEQ ID NO: 666977 - protein, 23 aa, Mycobacterium
GHSEIARELSFCASTMGDGDTLI

SEQ ID NO: 666978 - protein, 20 aa, Mycobacterium
GHSFVIFLREGFPVNVLNPV

SEQ ID NO: 666979 - protein, 19 aa, Mycobacterium
GHSFYFCERRGEWRIELDL

SEQ ID NO: 666980 - protein, 17 aa, Mycobacterium
GHSGGHCSFLVAGHVLV

SEQ ID NO: 666981 - protein, 19 aa, Mycobacterium
GHSGVAFVIVGSGPHGADP

SEQ ID NO: 666982 - protein, 21 aa, Mycobacterium
GHSHWYIERFRAMARAGDDLA

SEQ ID NO: 666983 - protein, 26 aa, Mycobacterium
GHSLGGGVAMQFAYQFPQLVDRLILV

SEQ ID NO: 666984 - protein, 23 aa, Mycobacterium
GHSLGGGVAMQFTYQFPHLVERL

SEQ ID NO: 666985 - protein, 22 aa, Mycobacterium
GHSLLPMMKLRIANPEYLVDIN

SEQ ID NO: 666986 - protein, 18 aa, Mycobacterium
GHSLRLPSWSVHRVVMPV

SEQ ID NO: 666987 - protein, 21 aa, Mycobacterium
GHSMGGIAITSWAQRYPSRVQ

SEQ ID NO: 666988 - protein, 23 aa, Mycobacterium
GHSMGGLHSWCLAAQRPDLVSAL

SEQ ID NO: 666989 - protein, 22 aa, Mycobacterium
GHSRPRAELIDWADERAHLPVD

SEQ ID NO: 666990 - protein, 26 aa, Mycobacterium
GHSRQPRVGACWHVNVAETSQAARQR

SEQ ID NO: 666991 - protein, 19 aa, Mycobacterium
GHSSLTLYLQLYLGGFGLE

SEQ ID NO: 666992 - protein, 17 aa, Mycobacterium
GHSVTVFERADRIGGLL

SEQ ID NO: 666993 - protein, 24 aa, Mycobacterium
GHSYGRVAGRARPLVIGSVKNNFG

SEQ ID NO: 666994 - protein, 18 aa, Mycobacterium
GHTEFRRLVARGFTPRQV

SEQ ID NO: 666995 - protein, 17 aa, Mycobacterium
GHTERLAAVLADARPTV

SEQ ID NO: 666996 - protein, 20 aa, Mycobacterium
GHTHELRQTVLALLADHDLS

SEQ ID NO: 666997 - protein, 18 aa, Mycobacterium
GHTHGFLTSLARPGRTGA

SEQ ID NO: 666998 - protein, 17 aa, Mycobacterium
GHTLYFCSRMCLDSYDT

SEQ ID NO: 666999 - protein, 19 aa, Mycobacterium
GHTSLRTLVPVSVRGMSHF

SEQ ID NO: 667000 - protein, 18 aa, Mycobacterium
GHTSRWIQIAAEWGTRDY

SEQ ID NO: 667001 - protein, 22 aa, Mycobacterium
GHTTLRYAMRALESESLRDLEG

SEQ ID NO: 667002 - protein, 18 aa, Mycobacterium
GHVARPGQYEAPLGITLR

SEQ ID NO: 667003 - protein, 19 aa, Mycobacterium
GHVFAKLAVREGIDEPRSI

SEQ ID NO: 667004 - protein, 18 aa, Mycobacterium
GHVFNALGHCLDKPGYGE

SEQ ID NO: 667005 - protein, 20 aa, Mycobacterium
GHVGFGLGLHRCLGAHFARI

SEQ ID NO: 667006 - protein, 18 aa, Mycobacterium
GHVIVDALTAMGFGDLVT

SEQ ID NO: 667007 - protein, 17 aa, Mycobacterium
GHVKVLVGPKSALLDNS

SEQ ID NO: 667008 - protein, 25 aa, Mycobacterium
GHVLFIADGHLHYVYNFLGEREQVL

SEQ ID NO: 667009 - protein, 27 aa, Mycobacterium
GHVLFIADGRLHYVYNFLGERQQLLSS

SEQ ID NO: 667010 - protein, 19 aa, Mycobacterium
GHVPIVVGGSMLYVQSLLD

SEQ ID NO: 667011 - protein, 20 aa, Mycobacterium
GHVRLRLDIAYDGTDFAGWA

SEQ ID NO: 667012 - protein, 24 aa, Mycobacterium
GHVVKSLPGLLVVLRDGGYRTNEI

SEQ ID NO: 667013 - protein, 18 aa, Mycobacterium
GHWGEILAVAAMSRGIRG

SEQ ID NO: 667014 - protein, 20 aa, Mycobacterium
GHWLAARGGLGIAPLPQYIA

SEQ ID NO: 667015 - protein, 26 aa, Mycobacterium
GHWLLARLGKRVLRPGGLELTTRLLT

SEQ ID NO: 667016 - protein, 25 aa, Mycobacterium
GHWLLARLGKRVLRPGGVELTTRLL

SEQ ID NO: 667017 - protein, 18 aa, Mycobacterium
GHWPQYEDPATFNALHLD

SEQ ID NO: 667018 - protein, 24 aa, Mycobacterium
GHYDGKGRVAEWILLQNQSNAERM

SEQ ID NO: 667019 - protein, 23 aa, Mycobacterium
GHYELRPDQALVINIPVTDAPYL

SEQ ID NO: 667020 - protein, 19 aa, Mycobacterium
GHYFDYLGFDIFYRVEGSG

SEQ ID NO: 667021 - protein, 18 aa, Mycobacterium
GHYGMCGRAYDPRFLFAW

SEQ ID NO: 667022 - protein, 17 aa, Mycobacterium
GHYHYRIVIEGDEPTEL

SEQ ID NO: 667023 - protein, 24 aa, Mycobacterium
GHYRFPQLRFIASVGEPLNPEAVW

SEQ ID NO: 667024 - protein, 19 aa, Mycobacterium
GHYRRRFRHVLVDEYQDTN

SEQ ID NO: 667025 - protein, 20 aa, Mycobacterium
GHYSFLNVFKLFGAGNQAPL

SEQ ID NO: 667026 - protein, 21 aa, Mycobacterium
GHYSFLNVFKLFGPGNRAPLS

SEQ ID NO: 667027 - protein, 20 aa, Mycobacterium
GHYSIGFGNAGDFNVGFANA

SEQ ID NO: 667028 - protein, 17 aa, Mycobacterium
GIAAGELTSMDAPAGLG

SEQ ID NO: 667029 - protein, 21 aa, Mycobacterium
GIAAKIAFFFTKRKLARMAGL

SEQ ID NO: 667030 - protein, 18 aa, Mycobacterium
GIAALRILFGQRRSNYEG

SEQ ID NO: 667031 - protein, 19 aa, Mycobacterium
GIACGPSGLVVLDEDGDGE

SEQ ID NO: 667032 - protein, 21 aa, Mycobacterium
GIADIYPRLNPTMEWDVAAGD

SEQ ID NO: 667033 - protein, 28 aa, Mycobacterium
GIADSGWLKLCFRYYSDWDLQTTSPDAR

SEQ ID NO: 667034 - protein, 17 aa, Mycobacterium
GIAEPPGSSILNISGAE

SEQ ID NO: 667035 - protein, 17 aa, Mycobacterium
GIAEPPGSSILNVSPED

SEQ ID NO: 667036 - protein, 24 aa, Mycobacterium
GIAESQADHILRWIQRWRSSEFDT

SEQ ID NO: 667037 - protein, 17 aa, Mycobacterium
GIAETFANAGVDVVITG

SEQ ID NO: 667038 - protein, 24 aa, Mycobacterium
GIAGFCMGGQFALILSPRGFGASA

SEQ ID NO: 667039 - protein, 24 aa, Mycobacterium
GIAGFCMGGQFALVMSPKGFGAAA

SEQ ID NO: 667040 - protein, 24 aa, Mycobacterium
GIAGFCMGGQFALVMSPKGFGASA

SEQ ID NO: 667041 - protein, 20 aa, Mycobacterium
GIAGFIKACLSMHHRTVPPS

SEQ ID NO: 667042 - protein, 18 aa, Mycobacterium
GIAGPVVVKAIRGGYDGR

SEQ ID NO: 667043 - protein, 18 aa, Mycobacterium
GIAGRAALGVGKRLTGKS

SEQ ID NO: 667044 - protein, 18 aa, Mycobacterium
GIAGVGMGMITLRAPRDG

SEQ ID NO: 667045 - protein, 26 aa, Mycobacterium
GIAHPELYPHLAASPVERLFEFEERF

SEQ ID NO: 667046 - protein, 22 aa, Mycobacterium
GIAHRLGMKPNWVIDLHNGGCA

SEQ ID NO: 667047 - protein, 17 aa, Mycobacterium
GIAIRPIYGAFDIPGAR

SEQ ID NO: 667048 - protein, 22 aa, Mycobacterium
GIAKEVAVQFVLAYEPAEFSET

SEQ ID NO: 667049 - protein, 17 aa, Mycobacterium
GIAKLGLNADGGAGGAG

SEQ ID NO: 667050 - protein, 20 aa, Mycobacterium
GIALAALWQSFGVAPDVVMG

SEQ ID NO: 667051 - protein, 21 aa, Mycobacterium
GIALHCGRSGAVVFDVDDPDA

SEQ ID NO: 667052 - protein, 17 aa, Mycobacterium
GIALRLSPLRAHATGDY

SEQ ID NO: 667053 - protein, 35 aa, Mycobacterium
GIANFPRYPLNVVSDVNAIMGFLYDEHYYAGLTSD

SEQ ID NO: 667054 - protein, 17 aa, Mycobacterium
GIAPFRCTDPLRWVTSS

SEQ ID NO: 667055 - protein, 19 aa, Mycobacterium
GIAPLRCLIMELSQWAENP

SEQ ID NO: 667056 - protein, 23 aa, Mycobacterium
GIAQRDGTSFVMPKHEADAMLEA

SEQ ID NO: 667057 - protein, 17 aa, Mycobacterium
GIARAFVNRPLVLLADE

SEQ ID NO: 667058 - protein, 18 aa, Mycobacterium
GIARLRMLLSDGASPIYR

SEQ ID NO: 667059 - protein, 19 aa, Mycobacterium
GIARLRWLDRPTGRVIRRI

SEQ ID NO: 667060 - protein, 24 aa, Mycobacterium
GIARRVLGGAIAFGGKATEPSFAA

SEQ ID NO: 667061 - protein, 22 aa, Mycobacterium
GIASRLKQVAIRVGNDPARIRK

SEQ ID NO: 667062 - protein, 20 aa, Mycobacterium
GIASTSSWVAEDWLTGVWAF

SEQ ID NO: 667063 - protein, 18 aa, Mycobacterium
GIATAGYFNAGQDCTAAT

SEQ ID NO: 667064 - protein, 20 aa, Mycobacterium
GIATEAWSPLGQGTILEDAT

SEQ ID NO: 667065 - protein, 17 aa, Mycobacterium
GIATYCATKHAVLGYTD

SEQ ID NO: 667066 - protein, 18 aa, Mycobacterium
GIAVLGGRLVPPIVETTL

SEQ ID NO: 667067 - protein, 26 aa, Mycobacterium
GICDAVLCALPARYITPMSPKKPRSL

SEQ ID NO: 667068 - protein, 26 aa, Mycobacterium
GICDAVLCALPARYITPSSKKKPRPL

SEQ ID NO: 667069 - protein, 19 aa, Mycobacterium
GICFPREYGGLGLSYEYKK

SEQ ID NO: 667070 - protein, 18 aa, Mycobacterium
GICFPREYGGQGLAYEYQ

SEQ ID NO: 667071 - protein, 18 aa, Mycobacterium
GICFPREYGGQGLPYEYQ

SEQ ID NO: 667072 - protein, 17 aa, Mycobacterium
GICQGELDQIRDHLPQF

SEQ ID NO: 667073 - protein, 17 aa, Mycobacterium
GICQGELDQVRDHLPEF

SEQ ID NO: 667074 - protein, 18 aa, Mycobacterium
GICSYCVHCCQLNEVMPI

SEQ ID NO: 667075 - protein, 22 aa, Mycobacterium
GIDAARWPFAVRKPRTGPPELL

SEQ ID NO: 667076 - protein, 20 aa, Mycobacterium
GIDAFLRRFLLPALLADTHS

SEQ ID NO: 667077 - protein, 19 aa, Mycobacterium
GIDAGGFRTPAISTVSSTG

SEQ ID NO: 667078 - protein, 18 aa, Mycobacterium
GIDAMPWLLAGAKTLSYA

SEQ ID NO: 667079 - protein, 25 aa, Mycobacterium
GIDANLVAFWAILATRVEAPELANF

SEQ ID NO: 667080 - protein, 29 aa, Mycobacterium
GIDAPAVWMMAHREILRAGYAYVAVSAQR

SEQ ID NO: 667081 - protein, 24 aa, Mycobacterium
GIDAPECLQAVWSNAMTRPKFRGA

SEQ ID NO: 667082 - protein, 17 aa, Mycobacterium
GIDARIERVRWDDIVSR

SEQ ID NO: 667083 - protein, 18 aa, Mycobacterium
GIDARLHWPGLGEVTTQQ

SEQ ID NO: 667084 - protein, 21 aa, Mycobacterium
GIDCGPGDRLLISSDGLFAAA

SEQ ID NO: 667085 - protein, 18 aa, Mycobacterium
GIDDAFAAFTWAYEHAGE

SEQ ID NO: 667086 - protein, 18 aa, Mycobacterium
GIDDAWMRDVLYHNGARL

SEQ ID NO: 667087 - protein, 18 aa, Mycobacterium
GIDDEFFRIGGHSLSASR

SEQ ID NO: 667088 - protein, 23 aa, Mycobacterium
GIDDWRDAEDWDRTLVTSAAQVR

SEQ ID NO: 667089 - protein, 24 aa, Mycobacterium
GIDEKRMFGGLAFLVNGNMSVAVS

SEQ ID NO: 667090 - protein, 22 aa, Mycobacterium
GIDEPRPIASMPGVVQHTRDSL

SEQ ID NO: 667091 - protein, 19 aa, Mycobacterium
GIDEWRAEVLPEDKLQAVR

SEQ ID NO: 667092 - protein, 19 aa, Mycobacterium
GIDHARAAMISAVLEKHAR

SEQ ID NO: 667093 - protein, 19 aa, Mycobacterium
GIDHARAAMITAVLEKHAR

SEQ ID NO: 667094 - protein, 21 aa, Mycobacterium
GIDIHRALPVIRAFSHFALLA

SEQ ID NO: 667095 - protein, 25 aa, Mycobacterium
GIDKFPRMVDYVLPTGVRIADADRV

SEQ ID NO: 667096 - protein, 25 aa, Mycobacterium
GIDKFPRMVDYVVPTGVRIADADRV

SEQ ID NO: 667097 - protein, 21 aa, Mycobacterium
GIDLAFQVLWYPATTFDTTLP

SEQ ID NO: 667098 - protein, 22 aa, Mycobacterium
GIDLRDDWPAALQEAGFDPAHP

SEQ ID NO: 667099 - protein, 27 aa, Mycobacterium
GIDLREDWPAALRGSGFDVTRPTAWSA

SEQ ID NO: 667100 - protein, 23 aa, Mycobacterium
GIDLREDWPTALRDAGFDPDRPT

SEQ ID NO: 667101 - protein, 20 aa, Mycobacterium
GIDMALRLVELLVDRQAAQA

SEQ ID NO: 667102 - protein, 29 aa, Mycobacterium
GIDPAVPAWTWGRRQDVGFIRRRVAHETA

SEQ ID NO: 667103 - protein, 23 aa, Mycobacterium
GIDPEQYSGFAFGMGLERTLQFR

SEQ ID NO: 667104 - protein, 19 aa, Mycobacterium
GIDPFALRGTATGVFAGVI

SEQ ID NO: 667105 - protein, 18 aa, Mycobacterium
GIDPRAANTMVHVFAEPA

SEQ ID NO: 667106 - protein, 25 aa, Mycobacterium
GIDRFPIDMVRLYFDDHLADESASG

SEQ ID NO: 667107 - protein, 26 aa, Mycobacterium
GIDRFPIDMVRLYFDGHLGDDAGKKT

SEQ ID NO: 667108 - protein, 17 aa, Mycobacterium
GIDRGRLALLDSPGEDF

SEQ ID NO: 667109 - protein, 23 aa, Mycobacterium
GIDSARGDAEWLAAHLTGTDRGL

SEQ ID NO: 667110 - protein, 21 aa, Mycobacterium
GIDTDVWYPAGPVRTGSVLTE

SEQ ID NO: 667111 - protein, 17 aa, Mycobacterium
GIDTHLITSHCLLPLLV

SEQ ID NO: 667112 - protein, 17 aa, Mycobacterium
GIDVSFRQVLTRSELPG

SEQ ID NO: 667113 - protein, 23 aa, Mycobacterium
GIDWCDRHREALGNGYQLSKEAI

SEQ ID NO: 667114 - protein, 22 aa, Mycobacterium
GIEAADRLAQRRGQLLAAGLDL

SEQ ID NO: 667115 - protein, 21 aa, Mycobacterium
GIEAWTGIGTSLCGVANRVSH

SEQ ID NO: 667116 - protein, 22 aa, Mycobacterium
GIECLPLPPVNPMPYRQRLAAV

SEQ ID NO: 667117 - protein, 19 aa, Mycobacterium
GIEEFARGFNPASLTDPSE

SEQ ID NO: 667118 - protein, 18 aa, Mycobacterium
GIEFCKLSFAETRKRAQV

SEQ ID NO: 667119 - protein, 19 aa, Mycobacterium
GIEFCKLSFAETRVKAQSL

SEQ ID NO: 667120 - protein, 23 aa, Mycobacterium
GIEFCKLSFAETRVRAQSLVPEL

SEQ ID NO: 667121 - protein, 19 aa, Mycobacterium
GIEFSLRPARRAVTAATVD

SEQ ID NO: 667122 - protein, 23 aa, Mycobacterium
GIEFSSYLAEAVFEPLGMSTSKL

SEQ ID NO: 667123 - protein, 17 aa, Mycobacterium
GIEGFRRSHLEALTTQR

SEQ ID NO: 667124 - protein, 17 aa, Mycobacterium
GIEGLPEGFSFHDLRHY

SEQ ID NO: 667125 - protein, 18 aa, Mycobacterium
GIEGRVPFRGPLGTVIHQ

SEQ ID NO: 667126 - protein, 19 aa, Mycobacterium
GIEGYPFAGPHQVYRFKVE

SEQ ID NO: 667127 - protein, 19 aa, Mycobacterium
GIELALWCDLRVVEEDAVL

SEQ ID NO: 667128 - protein, 23 aa, Mycobacterium
GIELHAAHGYMLLGSFLAPQRNR

SEQ ID NO: 667129 - protein, 18 aa, Mycobacterium
GIELHAGHGYLFSSFLSP

SEQ ID NO: 667130 - protein, 23 aa, Mycobacterium
GIELRYLLTLYVYRFGVTTVAEL

SEQ ID NO: 667131 - protein, 19 aa, Mycobacterium
GIEPEVIYLYNGPNGLVSF

SEQ ID NO: 667132 - protein, 18 aa, Mycobacterium
GIEPPVYVIGTEVPVPGG

SEQ ID NO: 667133 - protein, 19 aa, Mycobacterium
GIEPRSSRIAFFSTVTGNR

SEQ ID NO: 667134 - protein, 18 aa, Mycobacterium
GIEPRVRITLDRASIAQQ

SEQ ID NO: 667135 - protein, 17 aa, Mycobacterium
GIERLDPQVARRLLDRV

SEQ ID NO: 667136 - protein, 24 aa, Mycobacterium
GIERRASLTQAQRPTAVVFGCGDS

SEQ ID NO: 667137 - protein, 17 aa, Mycobacterium
GIESGVFRSVDAELAAL

SEQ ID NO: 667138 - protein, 17 aa, Mycobacterium
GIESLWERSEELLTDPP

SEQ ID NO: 667139 - protein, 17 aa, Mycobacterium
GIESLWERSQELLDDPP

SEQ ID NO: 667140 - protein, 18 aa, Mycobacterium
GIESLWERSTDLLVDPPA

SEQ ID NO: 667141 - protein, 24 aa, Mycobacterium
GIESMIERFERVLGAMTADSSQRL

SEQ ID NO: 667142 - protein, 18 aa, Mycobacterium
GIETMCVGGGQGMAMVVE

SEQ ID NO: 667143 - protein, 17 aa, Mycobacterium
GIEVTVFEKHADFLRDF

SEQ ID NO: 667144 - protein, 18 aa, Mycobacterium
GIFCPPIPANVVYIEPHP

SEQ ID NO: 667145 - protein, 23 aa, Mycobacterium
GIFKPTFIVSVPRIFEKVYNTAR

SEQ ID NO: 667146 - protein, 17 aa, Mycobacterium
GIFLSYAGGFKEAADQV

SEQ ID NO: 667147 - protein, 23 aa, Mycobacterium
GIFRRCRDGRYALTPLADALRSD

SEQ ID NO: 667148 - protein, 18 aa, Mycobacterium
GIFTEVIIAPAYEPGAVD

SEQ ID NO: 667149 - protein, 25 aa, Mycobacterium
GIFYNRELLSSLGLEVPKTLDDLNA

SEQ ID NO: 667150 - protein, 26 aa, Mycobacterium
GIGAGLARYAHRLGMTVVLADVDEAA

SEQ ID NO: 667151 - protein, 29 aa, Mycobacterium
GIGAQMVFWRPEFCQQLADQGYRVIRFDN

SEQ ID NO: 667152 - protein, 19 aa, Mycobacterium
GIGARAVALLAQLPGGLPV

SEQ ID NO: 667153 - protein, 17 aa, Mycobacterium
GIGARWTPANIANALIE

SEQ ID NO: 667154 - protein, 19 aa, Mycobacterium
GIGATLCRALVDAGADVLC

SEQ ID NO: 667155 - protein, 31 aa, Mycobacterium
GIGAWAGPPPQWWAGRFGIEPGLAEALVCAA

SEQ ID NO: 667156 - protein, 18 aa, Mycobacterium
GIGDTGADIYLREVQDVW

SEQ ID NO: 667157 - protein, 18 aa, Mycobacterium
GIGEEFAVQLARRGANLI

SEQ ID NO: 667158 - protein, 25 aa, Mycobacterium
GIGEKRFELAASEFLLFPTVAHSHA

SEQ ID NO: 667159 - protein, 20 aa, Mycobacterium
GIGEKRFEVAAGEFLLFPTV

SEQ ID NO: 667160 - protein, 25 aa, Mycobacterium
GIGEVRRAAQILRYYGAEGDRQAGE

SEQ ID NO: 667161 - protein, 24 aa, Mycobacterium
GIGEVRRAAQILRYYGNEGDRQAG

SEQ ID NO: 667162 - protein, 17 aa, Mycobacterium
GIGFVVWRGKEHLPEDL

SEQ ID NO: 667163 - protein, 17 aa, Mycobacterium
GIGGALLEKLAYDDDGN

SEQ ID NO: 667164 - protein, 25 aa, Mycobacterium
GIGGDATFDYGVAFDRSRKVAEGRV

SEQ ID NO: 667165 - protein, 24 aa, Mycobacterium
GIGGDGGDGGRGFATDVSGGTAGG

SEQ ID NO: 667166 - protein, 21 aa, Mycobacterium
GIGGLGLFLAGKMASRGGAAG

SEQ ID NO: 667167 - protein, 28 aa, Mycobacterium
GIGGQAHAGGAFHDGDAGAGGLGGKGGT

SEQ ID NO: 667168 - protein, 17 aa, Mycobacterium
GIGGRVSDVVSIARYVA

SEQ ID NO: 667169 - protein, 26 aa, Mycobacterium
GIGGVRAIRAFTEIEGLPAPEVFHMN

SEQ ID NO: 667170 - protein, 25 aa, Mycobacterium
GIGISTRTPRGWIANAYGNRPGLQY

SEQ ID NO: 667171 - protein, 24 aa, Mycobacterium
GIGKWANRMLDFFADTPSYCETYV

SEQ ID NO: 667172 - protein, 24 aa, Mycobacterium
GIGLELAKQFARHGYDLVVAADDD

SEQ ID NO: 667173 - protein, 20 aa, Mycobacterium
GIGLLRRVGERGDEIDWSKV

SEQ ID NO: 667174 - protein, 17 aa, Mycobacterium
GIGLLRYLGSQGPQIDW

SEQ ID NO: 667175 - protein, 24 aa, Mycobacterium
GIGLRRGAVYGTHWHGLLDNDALR

SEQ ID NO: 667176 - protein, 19 aa, Mycobacterium
GIGMLRFDALGLGDSDGDW

SEQ ID NO: 667177 - protein, 31 aa, Mycobacterium
GIGNEGVDLSGFFHGGGMVNLGFANVGVSDV

SEQ ID NO: 667178 - protein, 20 aa, Mycobacterium
GIGNFGWSIGQQLTFGPGGS

SEQ ID NO: 667179 - protein, 19 aa, Mycobacterium
GIGPGWRCLEVGAGGGSLL

SEQ ID NO: 667180 - protein, 18 aa, Mycobacterium
GIGPLEFQQQLRMSRARE

SEQ ID NO: 667181 - protein, 18 aa, Mycobacterium
GIGPSRSRLIGGRAQEVL

SEQ ID NO: 667182 - protein, 18 aa, Mycobacterium
GIGPSRTRLISGRAQEVL

SEQ ID NO: 667183 - protein, 23 aa, Mycobacterium
GIGPTRITAVLGILKAYTTRVGS

SEQ ID NO: 667184 - protein, 24 aa, Mycobacterium
GIGQACALRILAEGGRVAAADISG

SEQ ID NO: 667185 - protein, 18 aa, Mycobacterium
GIGRAFAVELARRGGRVV

SEQ ID NO: 667186 - protein, 20 aa, Mycobacterium
GIGRETALEFARQGAEVVLS

SEQ ID NO: 667187 - protein, 25 aa, Mycobacterium
GIGRGIALRLARDGADVALVDVHQD

SEQ ID NO: 667188 - protein, 19 aa, Mycobacterium
GIGRRLLDELLVFADGGAV

SEQ ID NO: 667189 - protein, 27 aa, Mycobacterium
GIGSCRDSAWLLVSILRQLGFAARFVS

SEQ ID NO: 667190 - protein, 27 aa, Mycobacterium
GIGTIAAAFWPKPVVVRMSDFKSNEYA

SEQ ID NO: 667191 - protein, 26 aa, Mycobacterium
GIGVLYGRRALLNALPPFLTGGSMIE

SEQ ID NO: 667192 - protein, 31 aa, Mycobacterium
GIGVLYGRRELLAAMPPFLTGGSMIETVTME

SEQ ID NO: 667193 - protein, 33 aa, Mycobacterium
GIGVLYGRRGLLDAMPPFITGGSMIETVTMEKT

SEQ ID NO: 667194 - protein, 18 aa, Mycobacterium
GIGVPACVASASQAAQAS

SEQ ID NO: 667195 - protein, 18 aa, Mycobacterium
GIGVVGLLNVQYALKDDV

SEQ ID NO: 667196 - protein, 17 aa, Mycobacterium
GIGWIPFYLDRSDRHYT

SEQ ID NO: 667197 - protein, 26 aa, Mycobacterium
GIGYVRRSGLTASRFVANPFGGPGAR

SEQ ID NO: 667198 - protein, 17 aa, Mycobacterium
GIHAELRSAGRALGTIS

SEQ ID NO: 667199 - protein, 30 aa, Mycobacterium
GIHLEGPWLSTLRCGAHQPVLMRDPDPGEI

SEQ ID NO: 667200 - protein, 24 aa, Mycobacterium
GIHLVKGFYRRPLKVSGAEDANGG

SEQ ID NO: 667201 - protein, 18 aa, Mycobacterium
GIHPVFKTVDTCAAEFEA

SEQ ID NO: 667202 - protein, 19 aa, Mycobacterium
GIHQLCLPLLPRLGHLPVP

SEQ ID NO: 667203 - protein, 18 aa, Mycobacterium
GIHSCPGAPLARAETRVG

SEQ ID NO: 667204 - protein, 19 aa, Mycobacterium
GIHSCPGAPLARAETRVGL

SEQ ID NO: 667205 - protein, 17 aa, Mycobacterium
GIHVCLGASLARMEGVV

SEQ ID NO: 667206 - protein, 19 aa, Mycobacterium
GIHVERKRFAVAIHYRNVD

SEQ ID NO: 667207 - protein, 19 aa, Mycobacterium
GIHVTVRYFAAARAAAGIE

SEQ ID NO: 667208 - protein, 18 aa, Mycobacterium
GIIANWWRQGMQGGAKAH

SEQ ID NO: 667209 - protein, 30 aa, Mycobacterium
GIIGYRALLRADLPPGGRLGIYGFGGSAHL

SEQ ID NO: 667210 - protein, 23 aa, Mycobacterium
GIIIADTKFEFGIDGDGNLLLAD

SEQ ID NO: 667211 - protein, 23 aa, Mycobacterium
GIILADTKFEFGVDIEGNLVLAD

SEQ ID NO: 667212 - protein, 19 aa, Mycobacterium
GIIPRDVFTEAGALGLLGF

SEQ ID NO: 667213 - protein, 17 aa, Mycobacterium
GIIRSGMWRGPRVRKPW

SEQ ID NO: 667214 - protein, 24 aa, Mycobacterium
GIISGELIVAVAMTEPGAGSDLAG

SEQ ID NO: 667215 - protein, 17 aa, Mycobacterium
GIISLALQVLAQTDIPL

SEQ ID NO: 667216 - protein, 17 aa, Mycobacterium
GIISLTLTAARALGRYG

SEQ ID NO: 667217 - protein, 18 aa, Mycobacterium
GIKKPSAAVNQWLMDGLD

SEQ ID NO: 667218 - protein, 22 aa, Mycobacterium
GIKPRLPREAVLHHEQYDAQTA

SEQ ID NO: 667219 - protein, 23 aa, Mycobacterium
GIKSREIYEAPGAMVLITAHTEL

SEQ ID NO: 667220 - protein, 17 aa, Mycobacterium
GILACLQTGAALMPQLT

SEQ ID NO: 667221 - protein, 19 aa, Mycobacterium
GILADWGADVIKIEPPTGD

SEQ ID NO: 667222 - protein, 19 aa, Mycobacterium
GILADWGADVVKIEPPGGD

SEQ ID NO: 667223 - protein, 18 aa, Mycobacterium
GILADWGADVVKIEPPTG

SEQ ID NO: 667224 - protein, 24 aa, Mycobacterium
GILAGEIHFAIGYTEPEAGTDLAS

SEQ ID NO: 667225 - protein, 24 aa, Mycobacterium
GILAHAAVVYGYFPAVSEGDEVVV

SEQ ID NO: 667226 - protein, 19 aa, Mycobacterium
GILAPLTRQGCIPLAIHPA

SEQ ID NO: 667227 - protein, 25 aa, Mycobacterium
GILDGKRATTHWLAADLFRERYPAV

SEQ ID NO: 667228 - protein, 24 aa, Mycobacterium
GILDGKRATTHWLAAELLTATYPA

SEQ ID NO: 667229 - protein, 17 aa, Mycobacterium
GILDWAGFMGSVDTGTA

SEQ ID NO: 667230 - protein, 29 aa, Mycobacterium
GILELPGTELLDVFGLVPMVIDVHDERAE

SEQ ID NO: 667231 - protein, 24 aa, Mycobacterium
GILGKGVAYQARFDPQAKGLGEWL

SEQ ID NO: 667232 - protein, 27 aa, Mycobacterium
GILGLVTRPEQRFVLLGGDHTIALPAL

SEQ ID NO: 667233 - protein, 18 aa, Mycobacterium
GILLDRGYPIVCGVPTQT

SEQ ID NO: 667234 - protein, 25 aa, Mycobacterium
GILMERFKVDAVRAFEMMAKLSQDT

SEQ ID NO: 667235 - protein, 31 aa, Mycobacterium
GILNFVFGEMWLRPGLGMKERRLITLACVGF

SEQ ID NO: 667236 - protein, 29 aa, Mycobacterium
GILNFVFGEMWLRPNLGMKERRLITVACV

SEQ ID NO: 667237 - protein, 18 aa, Mycobacterium
GILSAIGLRGESALRCSA

SEQ ID NO: 667238 - protein, 17 aa, Mycobacterium
GILVALAHRDRTGEGQR

SEQ ID NO: 667239 - protein, 24 aa, Mycobacterium
GILYGNGGNGYSFTSGGLQNGGSG

SEQ ID NO: 667240 - protein, 18 aa, Mycobacterium
GIMIGSWTDLSMLTDGSL

SEQ ID NO: 667241 - protein, 24 aa, Mycobacterium
GIMLRNRPEFHLVDTAVLHLGAIP

SEQ ID NO: 667242 - protein, 20 aa, Mycobacterium
GIMQHFTIPISFFDESVFED

SEQ ID NO: 667243 - protein, 20 aa, Mycobacterium
GIMQHFTIPVSFFDESVFED

SEQ ID NO: 667244 - protein, 24 aa, Mycobacterium
GIMRRLNPSGAMCIITARHDCMRL

SEQ ID NO: 667245 - protein, 18 aa, Mycobacterium
GIMTPFRIARLVEQTVRQ

SEQ ID NO: 667246 - protein, 26 aa, Mycobacterium
GINDEFPFLLGHEAAGIVETVGEGVT

SEQ ID NO: 667247 - protein, 25 aa, Mycobacterium
GINDEFPFLLGHEAAGTVEAVGEGV

SEQ ID NO: 667248 - protein, 23 aa, Mycobacterium
GINDEYPFLLGHEAAGTVEAVGP

SEQ ID NO: 667249 - protein, 21 aa, Mycobacterium
GINDRCRALRPHAETLVDGFG

SEQ ID NO: 667250 - protein, 22 aa, Mycobacterium
GINDRCRVLRPHAKTLVDGFGI

SEQ ID NO: 667251 - protein, 22 aa, Mycobacterium
GINDRCRVLRPHARTLVDGFGI

SEQ ID NO: 667252 - protein, 20 aa, Mycobacterium
GINLSFGIMGPIFRHSGVIF

SEQ ID NO: 667253 - protein, 18 aa, Mycobacterium
GINPFLGPFGALFIVLSG

SEQ ID NO: 667254 - protein, 25 aa, Mycobacterium
GINRCLPDLPAEVHFERNIMARNLL

SEQ ID NO: 667255 - protein, 25 aa, Mycobacterium
GINRCLPELPAEVHFERNIMARNLL

SEQ ID NO: 667256 - protein, 19 aa, Mycobacterium
GINTGFGNTGSWNLGMGNI

SEQ ID NO: 667257 - protein, 23 aa, Mycobacterium
GIPARPVVIGPITFLLLSKGVDG

SEQ ID NO: 667258 - protein, 26 aa, Mycobacterium
GIPDDWKIASLLTVGWPKGRHHPVRR

SEQ ID NO: 667259 - protein, 24 aa, Mycobacterium
GIPDIPGYAAKVFRAVAEADVNID

SEQ ID NO: 667260 - protein, 24 aa, Mycobacterium
GIPDIPGYAARVFRALADADVNID

SEQ ID NO: 667261 - protein, 24 aa, Mycobacterium
GIPDIPGYAARVFRAVADAEVNID

SEQ ID NO: 667262 - protein, 22 aa, Mycobacterium
GIPEKGIAVAVDWAVIPRSHWD

SEQ ID NO: 667263 - protein, 21 aa, Mycobacterium
GIPELRTAIAGSYQDRHGLEV

SEQ ID NO: 667264 - protein, 19 aa, Mycobacterium
GIPEVKRGLVAAGGGLLRL

SEQ ID NO: 667265 - protein, 20 aa, Mycobacterium
GIPFRPLLKFLTAGFLAPVF

SEQ ID NO: 667266 - protein, 17 aa, Mycobacterium
GIPGELIDAGFENVAEV

SEQ ID NO: 667267 - protein, 23 aa, Mycobacterium
GIPGPRWMPKPIWNVVSAPLNAY

SEQ ID NO: 667268 - protein, 18 aa, Mycobacterium
GIPIPGFSSALSYYDGLR

SEQ ID NO: 667269 - protein, 18 aa, Mycobacterium
GIPIPVPPGGPARYNPIH

SEQ ID NO: 667270 - protein, 20 aa, Mycobacterium
GIPISIDMIRFVKFIVTEIF

SEQ ID NO: 667271 - protein, 18 aa, Mycobacterium
GIPKAGRHVWYFDAETEH

SEQ ID NO: 667272 - protein, 22 aa, Mycobacterium
GIPKLRIEEAAARTQARIDSGI

SEQ ID NO: 667273 - protein, 24 aa, Mycobacterium
GIPMTARAAWAWFRHLHSLADRTL

SEQ ID NO: 667274 - protein, 18 aa, Mycobacterium
GIPMTSIMAEMFGKQEGC

SEQ ID NO: 667275 - protein, 24 aa, Mycobacterium
GIPPERLRYAPGQFLTLRVPSERT

SEQ ID NO: 667276 - protein, 23 aa, Mycobacterium
GIPPERLRYSPGQFLTLRVPSER

SEQ ID NO: 667277 - protein, 25 aa, Mycobacterium
GIPPPGSTLVSWLPFYHDMGLVLGV

SEQ ID NO: 667278 - protein, 21 aa, Mycobacterium
GIPQTWLLEFGIVDLNRGFNL

SEQ ID NO: 667279 - protein, 19 aa, Mycobacterium
GIPRAELFVTTKLATADHG

SEQ ID NO: 667280 - protein, 18 aa, Mycobacterium
GIPRAELFVTTKLATSDH

SEQ ID NO: 667281 - protein, 19 aa, Mycobacterium
GIPRAELFVTTKLATSDQG

SEQ ID NO: 667282 - protein, 21 aa, Mycobacterium
GIPREELFVATKLGTSRQGFQ

SEQ ID NO: 667283 - protein, 20 aa, Mycobacterium
GIPRSVVCQSALRAKMLDDR

SEQ ID NO: 667284 - protein, 20 aa, Mycobacterium
GIPRVFFIAWYIRDSQRHPG

SEQ ID NO: 667285 - protein, 24 aa, Mycobacterium
GIPTTDYFPLLALLSRTLTEDEVV

SEQ ID NO: 667286 - protein, 24 aa, Mycobacterium
GIPVRRVRATHAFHSSSMEPMLGE

SEQ ID NO: 667287 - protein, 18 aa, Mycobacterium
GIPYRVPFPQSLPSQETT

SEQ ID NO: 667288 - protein, 22 aa, Mycobacterium
GIQAGLKWPNDVLVDGRKLCGI

SEQ ID NO: 667289 - protein, 25 aa, Mycobacterium
GIQAIKGVEIGDGFTTARRRGSAAH

SEQ ID NO: 667290 - protein, 24 aa, Mycobacterium
GIQDGPGWWSARAAIQQTAEAQRQ

SEQ ID NO: 667291 - protein, 20 aa, Mycobacterium
GIQFDDDFIEWSVSYSQKPF

SEQ ID NO: 667292 - protein, 21 aa, Mycobacterium
GIQFKDLTALFADREAMGAVI

SEQ ID NO: 667293 - protein, 17 aa, Mycobacterium
GIQIQWMSDPSIDMGEH

SEQ ID NO: 667294 - protein, 17 aa, Mycobacterium
GIQPVDFKQDSGAPPPF

SEQ ID NO: 667295 - protein, 18 aa, Mycobacterium
GIRAAALLRKQNPESPVL

SEQ ID NO: 667296 - protein, 26 aa, Mycobacterium
GIRAAARVYAGWGFSQAFYWHQEYKK

SEQ ID NO: 667297 - protein, 18 aa, Mycobacterium
GIRALTAYCVAKGGLEAL

SEQ ID NO: 667298 - protein, 23 aa, Mycobacterium
GIRANVICPGFIETPMAHSVFSI

SEQ ID NO: 667299 - protein, 21 aa, Mycobacterium
GIRDARRLAAWHPRLRFLEQT

SEQ ID NO: 667300 - protein, 21 aa, Mycobacterium
GIREWMWVEVASWTDDAITGF

SEQ ID NO: 667301 - protein, 18 aa, Mycobacterium
GIRISVAVMRVGVTDATG

SEQ ID NO: 667302 - protein, 24 aa, Mycobacterium
GIRKLARPKLKAHYAERLEALYAE

SEQ ID NO: 667303 - protein, 24 aa, Mycobacterium
GIRKLARPKLKAHYGERLEQLYTD

SEQ ID NO: 667304 - protein, 21 aa, Mycobacterium
GIRKLAWPKLRQHYGERLEQL

SEQ ID NO: 667305 - protein, 20 aa, Mycobacterium
GIRKRRRGRTRGPVRHDSAQ

SEQ ID NO: 667306 - protein, 20 aa, Mycobacterium
GIRKRVAADLQIMKRGAALL

SEQ ID NO: 667307 - protein, 24 aa, Mycobacterium
GIRKYCRQQALLISRFHARRDVHM

SEQ ID NO: 667308 - protein, 19 aa, Mycobacterium
GIRLGDYDIGIAVGLDKHP

SEQ ID NO: 667309 - protein, 18 aa, Mycobacterium
GIRLKLNPLKEVIRGKRL

SEQ ID NO: 667310 - protein, 19 aa, Mycobacterium
GIRLLRPGGAVVIHGASAG

SEQ ID NO: 667311 - protein, 19 aa, Mycobacterium
GIRLNHRYFVVSALGQPPV

SEQ ID NO: 667312 - protein, 23 aa, Mycobacterium
GIRMPNVEASLYLPDSLAYSGTA

SEQ ID NO: 667313 - protein, 26 aa, Mycobacterium
GIRNWDYRYCWLRDASMTASALVALG

SEQ ID NO: 667314 - protein, 24 aa, Mycobacterium
GIRRGQVCGLKWSDVDLDAGQITV

SEQ ID NO: 667315 - protein, 19 aa, Mycobacterium
GIRRRRTRVYCPRWVALFR

SEQ ID NO: 667316 - protein, 24 aa, Mycobacterium
GIRRRVAADLQILKRFAQAVELAK

SEQ ID NO: 667317 - protein, 24 aa, Mycobacterium
GIRRRVAADLQILKRFAQAVEVAK

SEQ ID NO: 667318 - protein, 23 aa, Mycobacterium
GIRRRVAADLQILKRGARLVEFA

SEQ ID NO: 667319 - protein, 22 aa, Mycobacterium
GIRRTDDGLVFTSLTVILDAED

SEQ ID NO: 667320 - protein, 23 aa, Mycobacterium
GIRTDFALVHAWKGDRHGNLLYR

SEQ ID NO: 667321 - protein, 23 aa, Mycobacterium
GIRTDFALVHAWKGDRHGNLVYR

SEQ ID NO: 667322 - protein, 18 aa, Mycobacterium
GIRVARSLVGPYITSLDM

SEQ ID NO: 667323 - protein, 24 aa, Mycobacterium
GIRVDGNDVLACYAVMAEAAARAR

SEQ ID NO: 667324 - protein, 17 aa, Mycobacterium
GIRVKATGFGRVGLDVR

SEQ ID NO: 667325 - protein, 25 aa, Mycobacterium
GIRVNSVAPGYIWGETLQAYFEHQA

SEQ ID NO: 667326 - protein, 28 aa, Mycobacterium
GIRVNSVLPGYIWGGTLKSYFEHQAGKY

SEQ ID NO: 667327 - protein, 19 aa, Mycobacterium
GIRVVPLHILLDGTDLRDG

SEQ ID NO: 667328 - protein, 28 aa, Mycobacterium
GIRYSALDPELWIWIAASAINATMEAFP

SEQ ID NO: 667329 - protein, 23 aa, Mycobacterium
GISARLMSVIAWRTYLVRDPEAQ

SEQ ID NO: 667330 - protein, 23 aa, Mycobacterium
GISDAAADIGAWQLPSLPDISLS

SEQ ID NO: 667331 - protein, 19 aa, Mycobacterium
GISDFLWLRIMNVPDVLGK

SEQ ID NO: 667332 - protein, 26 aa, Mycobacterium
GISEDAAFELLRWLSQEANIKLRPLA

SEQ ID NO: 667333 - protein, 24 aa, Mycobacterium
GISEFSRYLGPRINPMEGLTTDWI

SEQ ID NO: 667334 - protein, 18 aa, Mycobacterium
GISEKFPLMLSAMSTGVT

SEQ ID NO: 667335 - protein, 30 aa, Mycobacterium
GISEPMPVAASFTWEFEDGTSLGQVARLDT

SEQ ID NO: 667336 - protein, 18 aa, Mycobacterium
GISGIGMACRVTRELPGK

SEQ ID NO: 667337 - protein, 20 aa, Mycobacterium
GISGLRWLQDRGYDGDRVVV

SEQ ID NO: 667338 - protein, 26 aa, Mycobacterium
GISGRVGDLIARRAADLIAFQSEAVA

SEQ ID NO: 667339 - protein, 24 aa, Mycobacterium
GISIGGSVAVAWALAHPDRTLAVL

SEQ ID NO: 667340 - protein, 18 aa, Mycobacterium
GISLSWGCAQEVADLAYR

SEQ ID NO: 667341 - protein, 18 aa, Mycobacterium
GISPRIARNTALIDLAGE

SEQ ID NO: 667342 - protein, 22 aa, Mycobacterium
GISRIGRRTGIPGLELTMEAVR

SEQ ID NO: 667343 - protein, 18 aa, Mycobacterium
GISSILLRGGFSAESTWR

SEQ ID NO: 667344 - protein, 20 aa, Mycobacterium
GISSIPFDQMGQGLGDDQFD

SEQ ID NO: 667345 - protein, 20 aa, Mycobacterium
GISTGARVHAHWVDEPVGAI

SEQ ID NO: 667346 - protein, 25 aa, Mycobacterium
GISTGELMCVYWPSRGQEAIAAAMG

SEQ ID NO: 667347 - protein, 23 aa, Mycobacterium
GISTLWCRDGADALLHIGAEPPD

SEQ ID NO: 667348 - protein, 25 aa, Mycobacterium
GISTTARMLIQFGFIERLAVAGDRR

SEQ ID NO: 667349 - protein, 18 aa, Mycobacterium
GISYAFRLAEDVGVTSID

SEQ ID NO: 667350 - protein, 21 aa, Mycobacterium
GITAELPLPVTISELDDGSVR

SEQ ID NO: 667351 - protein, 20 aa, Mycobacterium
GITAKGAWEAVKRHFREMDV

SEQ ID NO: 667352 - protein, 19 aa, Mycobacterium
GITARGAWEAVKRHFREIG

SEQ ID NO: 667353 - protein, 20 aa, Mycobacterium
GITARGAWEAVKRHFREMGV

SEQ ID NO: 667354 - protein, 20 aa, Mycobacterium
GITARGAWESVKRHFLEIGI

SEQ ID NO: 667355 - protein, 22 aa, Mycobacterium
GITCAIRAWAYQIVDLAGDYRV

SEQ ID NO: 667356 - protein, 20 aa, Mycobacterium
GITDIRQARQARIYPLPSRA

SEQ ID NO: 667357 - protein, 17 aa, Mycobacterium
GITEMYGSLSRRRFVAA

SEQ ID NO: 667358 - protein, 24 aa, Mycobacterium
GITEREWRMCWPSVGAHTQSGVRV

SEQ ID NO: 667359 - protein, 24 aa, Mycobacterium
GITEVKVRSVLTCATGTGVCAMCY

SEQ ID NO: 667360 - protein, 21 aa, Mycobacterium
GITEWRAEVLPEDKLAVVRRL

SEQ ID NO: 667361 - protein, 18 aa, Mycobacterium
GITFFPFRRIFVVARVKN

SEQ ID NO: 667362 - protein, 24 aa, Mycobacterium
GITLNVRAVIAFKVGNDTESIISA

SEQ ID NO: 667363 - protein, 35 aa, Mycobacterium
GITPDWLREGLRFWLRSALTYDLLTWSSVVDRARN

SEQ ID NO: 667364 - protein, 26 aa, Mycobacterium
GITQGRAGMQLSLFSRDVIAMSTAIA

SEQ ID NO: 667365 - protein, 25 aa, Mycobacterium
GITRARTHLALSWALARSPGGRQGR

SEQ ID NO: 667366 - protein, 24 aa, Mycobacterium
GITRARTHLALTWALARSPGGRQG

SEQ ID NO: 667367 - protein, 26 aa, Mycobacterium
GITRARVHLNLSWALSRAAGGRKSRK

SEQ ID NO: 667368 - protein, 19 aa, Mycobacterium
GITRLRLPADNEVVSLVAD

SEQ ID NO: 667369 - protein, 18 aa, Mycobacterium
GITTAPGRHTLFCCYAVT

SEQ ID NO: 667370 - protein, 19 aa, Mycobacterium
GITVADLVSRGRFPHQKVF

SEQ ID NO: 667371 - protein, 26 aa, Mycobacterium
GITVPDFPNLFLIYGPGTHLAHGGSL

SEQ ID NO: 667372 - protein, 19 aa, Mycobacterium
GIVALIALGILEHFDIASF

SEQ ID NO: 667373 - protein, 19 aa, Mycobacterium
GIVALPWHAAYSASKYGLR

SEQ ID NO: 667374 - protein, 19 aa, Mycobacterium
GIVAQQGFGRSVVVFQPHL

SEQ ID NO: 667375 - protein, 25 aa, Mycobacterium
GIVARVVSMPCVEWFESQPDDYRDS

SEQ ID NO: 667376 - protein, 18 aa, Mycobacterium
GIVECREALAFPGDPHRA

SEQ ID NO: 667377 - protein, 24 aa, Mycobacterium
GIVEFPPAGTLVGIAKRELKGTPT

SEQ ID NO: 667378 - protein, 17 aa, Mycobacterium
GIVGLMRAYANHLAPHS

SEQ ID NO: 667379 - protein, 27 aa, Mycobacterium
GIVGQLAAAVWRQAMPETEQLIVGRNR

SEQ ID NO: 667380 - protein, 24 aa, Mycobacterium
GIVHFDGPFLYRSTFHADTEEQET

SEQ ID NO: 667381 - protein, 18 aa, Mycobacterium
GIVHPELITANRGQLVSL

SEQ ID NO: 667382 - protein, 17 aa, Mycobacterium
GIVLSRRQLLEIIRDEP

SEQ ID NO: 667383 - protein, 17 aa, Mycobacterium
GIVLSRRQLLEIVRDGP

SEQ ID NO: 667384 - protein, 19 aa, Mycobacterium
GIVNPEYGDGGAGGNGGNG

SEQ ID NO: 667385 - protein, 17 aa, Mycobacterium
GIVPAAFYRHFDSMDAL

SEQ ID NO: 667386 - protein, 17 aa, Mycobacterium
GIVPAAFYRHFDSMEAL

SEQ ID NO: 667387 - protein, 18 aa, Mycobacterium
GIVQLRLISTAGHDIADV

SEQ ID NO: 667388 - protein, 19 aa, Mycobacterium
GIVQWCLQAVTAHLRSREQ

SEQ ID NO: 667389 - protein, 24 aa, Mycobacterium
GIVRLSVPLSGTWVDIDLTLPTTT

SEQ ID NO: 667390 - protein, 25 aa, Mycobacterium
GIVSGARRHGRWALRDSSGRVFEAA

SEQ ID NO: 667391 - protein, 23 aa, Mycobacterium
GIVTGLRLMARMAQTGRSLADLA

SEQ ID NO: 667392 - protein, 19 aa, Mycobacterium
GIVVRLGDRLIRVTPPAPV

SEQ ID NO: 667393 - protein, 22 aa, Mycobacterium
GIWAPNCPEWVIVQYATAKIGA

SEQ ID NO: 667394 - protein, 18 aa, Mycobacterium
GIWMRPEAVPGFRRLTDA

SEQ ID NO: 667395 - protein, 18 aa, Mycobacterium
GIWMRPEAVPGFRRLTHA

SEQ ID NO: 667396 - protein, 18 aa, Mycobacterium
GIWYPMQGAVYALLATWV

SEQ ID NO: 667397 - protein, 20 aa, Mycobacterium
GIYGRFGYGPATVWENVSVE

SEQ ID NO: 667398 - protein, 27 aa, Mycobacterium
GIYIHVPFCATRCGYCDFNTYTPSELG

SEQ ID NO: 667399 - protein, 27 aa, Mycobacterium
GIYPDGRFSYQLTIYIFRYGQGTEMAI

SEQ ID NO: 667400 - protein, 26 aa, Mycobacterium
GIYPDGRYSYQLTIYIFRYGEGTAMA

SEQ ID NO: 667401 - protein, 22 aa, Mycobacterium
GKAAGMPLYQLLGGAARDGVMV

SEQ ID NO: 667402 - protein, 18 aa, Mycobacterium
GKAAVDWIARSAPTADLE

SEQ ID NO: 667403 - protein, 17 aa, Mycobacterium
GKADAAYRRRNFTPEAT

SEQ ID NO: 667404 - protein, 24 aa, Mycobacterium
GKADGCGCPMWTAPGVHGNPKSAT

SEQ ID NO: 667405 - protein, 21 aa, Mycobacterium
GKAEWARQEFEYLRTFEGSPT

SEQ ID NO: 667406 - protein, 18 aa, Mycobacterium
GKAFCAGADLAALGTATE

SEQ ID NO: 667407 - protein, 18 aa, Mycobacterium
GKAFCAGADLGALGAAGG

SEQ ID NO: 667408 - protein, 18 aa, Mycobacterium
GKAGFPGLATYCATKHAV

SEQ ID NO: 667409 - protein, 17 aa, Mycobacterium
GKAGLIGGGGSGGAGGN

SEQ ID NO: 667410 - protein, 22 aa, Mycobacterium
GKAHWAGVVDCVGGKTLAYALS

SEQ ID NO: 667411 - protein, 25 aa, Mycobacterium
GKAIDAGWIDGPRVIPAGHAITPTG

SEQ ID NO: 667412 - protein, 26 aa, Mycobacterium
GKAIDAGWIDGPRVVPAGHAITPTGG

SEQ ID NO: 667413 - protein, 24 aa, Mycobacterium
GKAIDARPALTAALDAVESAQAAV

SEQ ID NO: 667414 - protein, 28 aa, Mycobacterium
GKAKAALLRRRFTIGLSNCPNSKVLVDD

SEQ ID NO: 667415 - protein, 19 aa, Mycobacterium
GKAKEAAGTVTGRDDLIEE

SEQ ID NO: 667416 - protein, 24 aa, Mycobacterium
GKAKEAVGAVAGRDDLTREGQAQQ

SEQ ID NO: 667417 - protein, 19 aa, Mycobacterium
GKAKETIGTVAGRDDMVQE

SEQ ID NO: 667418 - protein, 18 aa, Mycobacterium
GKAKEVFGAVTGRDDVKR

SEQ ID NO: 667419 - protein, 19 aa, Mycobacterium
GKAKEVVGAVTGNDSLTAE

SEQ ID NO: 667420 - protein, 18 aa, Mycobacterium
GKALALYHSKRLACPAQR

SEQ ID NO: 667421 - protein, 17 aa, Mycobacterium
GKALALYHTKRLASPGQ

SEQ ID NO: 667422 - protein, 24 aa, Mycobacterium
GKALARVCALNALAAVNSLVDIDS

SEQ ID NO: 667423 - protein, 25 aa, Mycobacterium
GKALELACGPGLGSVWLARRGLEVW

SEQ ID NO: 667424 - protein, 20 aa, Mycobacterium
GKALLLRAGVFDDIAAAVML

SEQ ID NO: 667425 - protein, 21 aa, Mycobacterium
GKALRAGIELDDGPARVDEFA

SEQ ID NO: 667426 - protein, 20 aa, Mycobacterium
GKALVGPARVVLRDIDEATA

SEQ ID NO: 667427 - protein, 17 aa, Mycobacterium
GKALVTLEFDSAPDDPF

SEQ ID NO: 667428 - protein, 24 aa, Mycobacterium
GKAMARICALNALAAVDSLVGIDA

SEQ ID NO: 667429 - protein, 29 aa, Mycobacterium
GKAMYANKAVPCWMIFDEGYVRRYVTSAN

SEQ ID NO: 667430 - protein, 33 aa, Mycobacterium
GKAPRFVKRYADVGGELRRAAVQYAQDVAGGVF

SEQ ID NO: 667431 - protein, 20 aa, Mycobacterium
GKAPVRRSCYAADRTGHMIL

SEQ ID NO: 667432 - protein, 19 aa, Mycobacterium
GKARAGITPHLLVMTATPI

SEQ ID NO: 667433 - protein, 23 aa, Mycobacterium
GKARALRVIDWFIGATTERRYEI

SEQ ID NO: 667434 - protein, 20 aa, Mycobacterium
GKARRVRPVGEPAVAAGATS

SEQ ID NO: 667435 - protein, 21 aa, Mycobacterium
GKARWYRNRWVRSLSACAGLG

SEQ ID NO: 667436 - protein, 24 aa, Mycobacterium
GKASLEAVRLISRFAPGEDSATVT

SEQ ID NO: 667437 - protein, 18 aa, Mycobacterium
GKASLTTLASAWGGTGSE

SEQ ID NO: 667438 - protein, 26 aa, Mycobacterium
GKATALREFAQHAGVPMAQTVAVGDG

SEQ ID NO: 667439 - protein, 21 aa, Mycobacterium
GKATGLASGIGGDGGDGGRGF

SEQ ID NO: 667440 - protein, 21 aa, Mycobacterium
GKATLARAVCAARTLIELDGP

SEQ ID NO: 667441 - protein, 23 aa, Mycobacterium
GKATMVRAVCASRRVVELDGPEV

SEQ ID NO: 667442 - protein, 18 aa, Mycobacterium
GKAVKNRIHFDLTPDDQQ

SEQ ID NO: 667443 - protein, 17 aa, Mycobacterium
GKAVLLKLVTRMIRARV

SEQ ID NO: 667444 - protein, 17 aa, Mycobacterium
GKAWEYGVDIDWSLFSG

SEQ ID NO: 667445 - protein, 24 aa, Mycobacterium
GKAWGSRFPVITVRDQVAADVAAL

SEQ ID NO: 667446 - protein, 21 aa, Mycobacterium
GKAYASARGGYFVVDLPSGGI

SEQ ID NO: 667447 - protein, 26 aa, Mycobacterium
GKCHEVPGWEVTPMGPFHQWPTGSGF

SEQ ID NO: 667448 - protein, 37 aa, Mycobacterium
GKDARPGGHFSLPALLLLISGLPKFLSLEEGIGVKTA

SEQ ID NO: 667449 - protein, 18 aa, Mycobacterium
GKDFAARYAEAIFTAQRS

SEQ ID NO: 667450 - protein, 21 aa, Mycobacterium
GKDIFLHIAGTYGEATDHAIE

SEQ ID NO: 667451 - protein, 20 aa, Mycobacterium
GKDIMWWMDAAGLFDERYDE

SEQ ID NO: 667452 - protein, 20 aa, Mycobacterium
GKDISCNLGSLNIARTMDSP

SEQ ID NO: 667453 - protein, 29 aa, Mycobacterium
GKDPLLMPDKWELCDALNKQIHNDNVAAD

SEQ ID NO: 667454 - protein, 23 aa, Mycobacterium
GKDPRDAHFITSRICGICGDNHA

SEQ ID NO: 667455 - protein, 23 aa, Mycobacterium
GKDRPELAAALGAAGQLFTTGVP

SEQ ID NO: 667456 - protein, 17 aa, Mycobacterium
GKDWSFGNPAAMGDGIR

SEQ ID NO: 667457 - protein, 17 aa, Mycobacterium
GKDWTPIQHQIWLDEMQ

SEQ ID NO: 667458 - protein, 19 aa, Mycobacterium
GKDWTPTQHQIWLDEMQLA

SEQ ID NO: 667459 - protein, 23 aa, Mycobacterium
GKEECFLELLAVDIEKLGAKIAA

SEQ ID NO: 667460 - protein, 29 aa, Mycobacterium
GKEGDRGLSWLPFFHDMGLITALLSPVLG

SEQ ID NO: 667461 - protein, 30 aa, Mycobacterium
GKEGDRGLSWLPFFHDMGLITALLSPVLGH

SEQ ID NO: 667462 - protein, 24 aa, Mycobacterium
GKEHAMLLASRGARVLVNDLGGSV

SEQ ID NO: 667463 - protein, 21 aa, Mycobacterium
GKEITARYCVMAVGGLERPKM

SEQ ID NO: 667464 - protein, 24 aa, Mycobacterium
GKEKAQELGVSWLAEIGAHGVVAG

SEQ ID NO: 667465 - protein, 20 aa, Mycobacterium
GKELERLSPFDGTLPKELSL

SEQ ID NO: 667466 - protein, 18 aa, Mycobacterium
GKELKGVFLRRISGVLTV

SEQ ID NO: 667467 - protein, 26 aa, Mycobacterium
GKELLGRLKGLPGFGEQKARIFLALL

SEQ ID NO: 667468 - protein, 26 aa, Mycobacterium
GKENWSGNFPFDWGVSAHPKVDGKTG

SEQ ID NO: 667469 - protein, 18 aa, Mycobacterium
GKEPLKFTAYDGSSAGPE

SEQ ID NO: 667470 - protein, 26 aa, Mycobacterium
GKEVLRRLKALPGFGEQKAKIFLALL

SEQ ID NO: 667471 - protein, 24 aa, Mycobacterium
GKEYDLSSLFLLASTAALFSTSLK

SEQ ID NO: 667472 - protein, 21 aa, Mycobacterium
GKFAIFVGGFPLVYDGQIVGG

SEQ ID NO: 667473 - protein, 24 aa, Mycobacterium
GKFAQNAIVRWMQRESFAELRERR

SEQ ID NO: 667474 - protein, 18 aa, Mycobacterium
GKFAYALGKYFEDVQNSN

SEQ ID NO: 667475 - protein, 19 aa, Mycobacterium
GKFDFMFLAEGLRLREQGG

SEQ ID NO: 667476 - protein, 21 aa, Mycobacterium
GKFDMGYEAYREIVLEKQKSM

SEQ ID NO: 667477 - protein, 17 aa, Mycobacterium
GKFGFRGLIKALAGFPK

SEQ ID NO: 667478 - protein, 18 aa, Mycobacterium
GKFLTRKLGIQDFMLNAH

SEQ ID NO: 667479 - protein, 19 aa, Mycobacterium
GKFLWPGFGENARVLKWAL

SEQ ID NO: 667480 - protein, 25 aa, Mycobacterium
GKFPYRNDGALGWFGTSPVGTFPAN

SEQ ID NO: 667481 - protein, 26 aa, Mycobacterium
GKFPYRNDGALGWKGTSPVGTFPPNR

SEQ ID NO: 667482 - protein, 22 aa, Mycobacterium
GKFSIPVAYLGLWDTVSAPGIF

SEQ ID NO: 667483 - protein, 17 aa, Mycobacterium
GKFVKAADWVGREEAEA

SEQ ID NO: 667484 - protein, 17 aa, Mycobacterium
GKFVRSETIAEFIDALE

SEQ ID NO: 667485 - protein, 18 aa, Mycobacterium
GKGAMRWITVGPPNQPDT

SEQ ID NO: 667486 - protein, 21 aa, Mycobacterium
GKGDVVVLWLPSGIDYATCYA

SEQ ID NO: 667487 - protein, 17 aa, Mycobacterium
GKGEALWRSLAATRGDI

SEQ ID NO: 667488 - protein, 20 aa, Mycobacterium
GKGEASLWLEDFRGETTATM

SEQ ID NO: 667489 - protein, 21 aa, Mycobacterium
GKGEASLWLEEFRGEVTATMV

SEQ ID NO: 667490 - protein, 20 aa, Mycobacterium
GKGFAGTMKRHGFKGQGASH

SEQ ID NO: 667491 - protein, 20 aa, Mycobacterium
GKGFAGTMKRHGFSGQGASH

SEQ ID NO: 667492 - protein, 18 aa, Mycobacterium
GKGFHARSLGVPLLDDRT

SEQ ID NO: 667493 - protein, 25 aa, Mycobacterium
GKGGDGADATGFGQTGGNGGRGGNG

SEQ ID NO: 667494 - protein, 29 aa, Mycobacterium
GKGGDGDDCEFGRTGGNGGTGGRGGDGNF

SEQ ID NO: 667495 - protein, 22 aa, Mycobacterium
GKGGEYFLRHLLGTDANIQAQP

SEQ ID NO: 667496 - protein, 22 aa, Mycobacterium
GKGGEYFLRHLLGTDSNASALP

SEQ ID NO: 667497 - protein, 22 aa, Mycobacterium
GKGGEYFLRHLLGTDSNVQAAP

SEQ ID NO: 667498 - protein, 19 aa, Mycobacterium
GKGHISFGKGIHFCVGAAL

SEQ ID NO: 667499 - protein, 20 aa, Mycobacterium
GKGKPGGALHDVLPADLLAH

SEQ ID NO: 667500 - protein, 18 aa, Mycobacterium
GKGLPWGGSQVRTEATGY

SEQ ID NO: 667501 - protein, 17 aa, Mycobacterium
GKGLRYLTVNQKWEILP

SEQ ID NO: 667502 - protein, 20 aa, Mycobacterium
GKGLSQLVRKTCDAVVSIPM

SEQ ID NO: 667503 - protein, 26 aa, Mycobacterium
GKGLSRLVREHCDAIVSIPMAGPTES

SEQ ID NO: 667504 - protein, 18 aa, Mycobacterium
GKGLSRLVRENCDRIVSI

SEQ ID NO: 667505 - protein, 18 aa, Mycobacterium
GKGLSRLVRQTCDEVVSV

SEQ ID NO: 667506 - protein, 17 aa, Mycobacterium
GKGPEFLITTTLTVPSG

SEQ ID NO: 667507 - protein, 17 aa, Mycobacterium
GKGPIALRVHLGTPGEA

SEQ ID NO: 667508 - protein, 20 aa, Mycobacterium
GKGSMIIGCDTLPILPTDPG

SEQ ID NO: 667509 - protein, 30 aa, Mycobacterium
GKGTLFRRFGSRAGLMLVLLDEEERASQQA

SEQ ID NO: 667510 - protein, 17 aa, Mycobacterium
GKGWTMVPGSYRAAGEA

SEQ ID NO: 667511 - protein, 22 aa, Mycobacterium
GKHDDFTFVWPGAANKELIDRE

SEQ ID NO: 667512 - protein, 17 aa, Mycobacterium
GKHFSVNVMLDRDTIRR

SEQ ID NO: 667513 - protein, 19 aa, Mycobacterium
GKHGMFDLWSFDGIDAVTA

SEQ ID NO: 667514 - protein, 20 aa, Mycobacterium
GKHLFIRTALVSIHSHLKMD

SEQ ID NO: 667515 - protein, 22 aa, Mycobacterium
GKHLGVGVTSIYWYFRKKDDLL

SEQ ID NO: 667516 - protein, 25 aa, Mycobacterium
GKHLLESWIPLLALAAHDPVRDWSA

SEQ ID NO: 667517 - protein, 30 aa, Mycobacterium
GKHLLESWIPLLALFAHAGAHDWSAVCIGR

SEQ ID NO: 667518 - protein, 29 aa, Mycobacterium
GKHLLESWIPLLALFAHDPGRDWSAICIG

SEQ ID NO: 667519 - protein, 24 aa, Mycobacterium
GKHLLQSWIPLLALAAGYPDRDWL

SEQ ID NO: 667520 - protein, 20 aa, Mycobacterium
GKHLRRLATLVGETEAVEVI

SEQ ID NO: 667521 - protein, 20 aa, Mycobacterium
GKHPGLALLAARFTDTDRIE

SEQ ID NO: 667522 - protein, 22 aa, Mycobacterium
GKHVRRLAALVKEYEAVEVIVG

SEQ ID NO: 667523 - protein, 23 aa, Mycobacterium
GKHVRRLAELAAELGAVEVVVGL

SEQ ID NO: 667524 - protein, 26 aa, Mycobacterium
GKHVVVIPEMWRDPATGAVLEDRNLT

SEQ ID NO: 667525 - protein, 20 aa, Mycobacterium
GKIALPRGVNLISDPELLVV

SEQ ID NO: 667526 - protein, 27 aa, Mycobacterium
GKIDMTEWWAYLDGVRSTYPLSYGPQS

SEQ ID NO: 667527 - protein, 27 aa, Mycobacterium
GKIEALLRILEPFGIREIVQSGVVSLS

SEQ ID NO: 667528 - protein, 27 aa, Mycobacterium
GKIEALLRVLEPFGIREIVQSGVVSLS

SEQ ID NO: 667529 - protein, 17 aa, Mycobacterium
GKIGVAIEELLRYDAPV

SEQ ID NO: 667530 - protein, 18 aa, Mycobacterium
GKILMEAMSSFKVADFAP

SEQ ID NO: 667531 - protein, 17 aa, Mycobacterium
GKIMRRLLRDVAEGREL

SEQ ID NO: 667532 - protein, 18 aa, Mycobacterium
GKINFRIDKQANLHFVIG

SEQ ID NO: 667533 - protein, 23 aa, Mycobacterium
GKIPAGGGWRMLGRSAGKRHAQA

SEQ ID NO: 667534 - protein, 19 aa, Mycobacterium
GKIRLDEPVQTYLPDFNPT

SEQ ID NO: 667535 - protein, 21 aa, Mycobacterium
GKIRRRSCVEQYLQHEFIRLD

SEQ ID NO: 667536 - protein, 20 aa, Mycobacterium
GKIRSFEAGINHINPIALGG

SEQ ID NO: 667537 - protein, 27 aa, Mycobacterium
GKISALRWGGAPPRIVFIHGGGQNAHT

SEQ ID NO: 667538 - protein, 23 aa, Mycobacterium
GKISSRGLQHWADPGAKRPGEIN

SEQ ID NO: 667539 - protein, 19 aa, Mycobacterium
GKITAARRKHWVTLIQADP

SEQ ID NO: 667540 - protein, 26 aa, Mycobacterium
GKITLWRDYFDLFDMFKATVRGLAAV

SEQ ID NO: 667541 - protein, 20 aa, Mycobacterium
GKITPREKIAMMSTGATHEL

SEQ ID NO: 667542 - protein, 27 aa, Mycobacterium
GKIVALKEAWKAAGRDGDPLIYVLAGK

SEQ ID NO: 667543 - protein, 27 aa, Mycobacterium
GKKAARRRAVELLDLVGIAQPERRARA

SEQ ID NO: 667544 - protein, 20 aa, Mycobacterium
GKKALLMHGALWQGTVVATM

SEQ ID NO: 667545 - protein, 22 aa, Mycobacterium
GKKAWRELFDPAVNLADRGFDI

SEQ ID NO: 667546 - protein, 26 aa, Mycobacterium
GKKCYSLRIASAMARDEGWLAEHMLI

SEQ ID NO: 667547 - protein, 17 aa, Mycobacterium
GKKFCLFDTWVQAAPAI

SEQ ID NO: 667548 - protein, 20 aa, Mycobacterium
GKKGAFRPLWAHDRRDERKA

SEQ ID NO: 667549 - protein, 23 aa, Mycobacterium
GKKILRLAFHFLDAQSIEQCVLG

SEQ ID NO: 667550 - protein, 20 aa, Mycobacterium
GKKLALIDVRERVEWDIVHI

SEQ ID NO: 667551 - protein, 20 aa, Mycobacterium
GKKLKAGIELDDGPARVDDF

SEQ ID NO: 667552 - protein, 22 aa, Mycobacterium
GKKLRTGIELDDGLARVDGFAV

SEQ ID NO: 667553 - protein, 23 aa, Mycobacterium
GKLADLVLWEPAFFGVRPHAVLK

SEQ ID NO: 667554 - protein, 23 aa, Mycobacterium
GKLADLVLWEPAFFGVRPHAVVK

SEQ ID NO: 667555 - protein, 29 aa, Mycobacterium
GKLAGILAEVAMPYAVIGIGLNVTQAPDE

SEQ ID NO: 667556 - protein, 17 aa, Mycobacterium
GKLALVIHHLAVDGVSW

SEQ ID NO: 667557 - protein, 17 aa, Mycobacterium
GKLAPDFDDEVIAESCV

SEQ ID NO: 667558 - protein, 19 aa, Mycobacterium
GKLARRACRRHYLEGTLGV

SEQ ID NO: 667559 - protein, 17 aa, Mycobacterium
GKLDRIALAAAIGAASP

SEQ ID NO: 667560 - protein, 25 aa, Mycobacterium
GKLEALLRVLEPFGIREIAQSGMVA

SEQ ID NO: 667561 - protein, 25 aa, Mycobacterium
GKLEALLRVLEPFGIREIAQSGMVS

SEQ ID NO: 667562 - protein, 21 aa, Mycobacterium
GKLGARMVLMNTGFAKPQFAE

SEQ ID NO: 667563 - protein, 27 aa, Mycobacterium
GKLGVGWPKEYGGLGFGPIEQQIFVNE

SEQ ID NO: 667564 - protein, 25 aa, Mycobacterium
GKLGVGWPKEYGGLGYGPVEQQIFI

SEQ ID NO: 667565 - protein, 18 aa, Mycobacterium
GKLICLVRAGSDEEARQR

SEQ ID NO: 667566 - protein, 20 aa, Mycobacterium
GKLKEGRRWLDRALSATPES

SEQ ID NO: 667567 - protein, 17 aa, Mycobacterium
GKLKLEPGMTLLDIGCG

SEQ ID NO: 667568 - protein, 20 aa, Mycobacterium
GKLKPTRPGEFMLMDTTPLD

SEQ ID NO: 667569 - protein, 20 aa, Mycobacterium
GKLLADFGVEVVKVEAPERG

SEQ ID NO: 667570 - protein, 17 aa, Mycobacterium
GKLLGIIPRQGYLQIPQ

SEQ ID NO: 667571 - protein, 20 aa, Mycobacterium
GKLLGLPMGVDVCYTNHAEA

SEQ ID NO: 667572 - protein, 24 aa, Mycobacterium
GKLLNAVAVAAGWPDGDGGEFLDN

SEQ ID NO: 667573 - protein, 24 aa, Mycobacterium
GKLLRPSLKARYGERLDAMYDEIE

SEQ ID NO: 667574 - protein, 20 aa, Mycobacterium
GKLLSSFPWPLNKTTTVAKC

SEQ ID NO: 667575 - protein, 25 aa, Mycobacterium
GKLPASLAYPIVKWKNQMVSFISYQ

SEQ ID NO: 667576 - protein, 26 aa, Mycobacterium
GKLPELPLRVGDTWEEAGPEGNRVFT

SEQ ID NO: 667577 - protein, 24 aa, Mycobacterium
GKLPRVASAALAFTVLPANLGAHS

SEQ ID NO: 667578 - protein, 25 aa, Mycobacterium
GKLPSEVFRDHFLTCFISDKVGVAL

SEQ ID NO: 667579 - protein, 17 aa, Mycobacterium
GKLPVVFTPAPGLGTRR

SEQ ID NO: 667580 - protein, 17 aa, Mycobacterium
GKLQWILENVDGVRAAA

SEQ ID NO: 667581 - protein, 22 aa, Mycobacterium
GKLRAALGGRCHAAISGGAPLG

SEQ ID NO: 667582 - protein, 19 aa, Mycobacterium
GKLRASVIDRGTWKDHREG

SEQ ID NO: 667583 - protein, 19 aa, Mycobacterium
GKLRKGQQVAWLREVDGVP

SEQ ID NO: 667584 - protein, 20 aa, Mycobacterium
GKLRRLRKRGGRLVVIDPAR

SEQ ID NO: 667585 - protein, 22 aa, Mycobacterium
GKLSDDEFGFFVIMLAVAGNET

SEQ ID NO: 667586 - protein, 22 aa, Mycobacterium
GKLSEFRPGDVLVADITTPDWE

SEQ ID NO: 667587 - protein, 18 aa, Mycobacterium
GKLSRKEKVMGFGHRVYK

SEQ ID NO: 667588 - protein, 21 aa, Mycobacterium
GKLSVPPSWTGAAPLASPLGS

SEQ ID NO: 667589 - protein, 24 aa, Mycobacterium
GKLTGRPAACFGIAGPGSTNLLTG

SEQ ID NO: 667590 - protein, 19 aa, Mycobacterium
GKLTLKDPVVRWAPELADL

SEQ ID NO: 667591 - protein, 20 aa, Mycobacterium
GKLTLKDPVVRWAPELAGVR

SEQ ID NO: 667592 - protein, 17 aa, Mycobacterium
GKLVTWVVEREPVTSPP

SEQ ID NO: 667593 - protein, 33 aa, Mycobacterium
GKMAAVAKRRGWPILKFNSRGGVGLRRQIRTLA

SEQ ID NO: 667594 - protein, 33 aa, Mycobacterium
GKMAAVAKRRGWPILKFNSRGGVGLRRQLRTLA

SEQ ID NO: 667595 - protein, 33 aa, Mycobacterium
GKMAAVAKRRGWPILRFSSRGPVGLRRQVRTLA

SEQ ID NO: 667596 - protein, 19 aa, Mycobacterium
GKNALARALLATGAGSAPD

SEQ ID NO: 667597 - protein, 17 aa, Mycobacterium
GKNAVIMLRGRGTDPET

SEQ ID NO: 667598 - protein, 23 aa, Mycobacterium
GKNDALDALLWRAARPGEPSWPS

SEQ ID NO: 667599 - protein, 18 aa, Mycobacterium
GKNIRVPRVHWDFTSERV

SEQ ID NO: 667600 - protein, 18 aa, Mycobacterium
GKNLSWADLIVYAGNVAL

SEQ ID NO: 667601 - protein, 18 aa, Mycobacterium
GKNRRPGNIGAEEFAAVV

SEQ ID NO: 667602 - protein, 22 aa, Mycobacterium
GKNTFHGLLLLRHVGDLVDTGW

SEQ ID NO: 667603 - protein, 24 aa, Mycobacterium
GKNTFHGLMLLRHVDDLVKTGWPV

SEQ ID NO: 667604 - protein, 18 aa, Mycobacterium
GKNYYALGGQDWDPEQSQ

SEQ ID NO: 667605 - protein, 19 aa, Mycobacterium
GKPAALLRAARASLCADAT

SEQ ID NO: 667606 - protein, 23 aa, Mycobacterium
GKPAEIAAAVLFLASDQSSFMTG

SEQ ID NO: 667607 - protein, 19 aa, Mycobacterium
GKPAIPAWEDVLLGVRSSG

SEQ ID NO: 667608 - protein, 22 aa, Mycobacterium
GKPDEYARLALAIVENPMLNGQ

SEQ ID NO: 667609 - protein, 22 aa, Mycobacterium
GKPDLGRFGSFGWGVTPQQAKE

SEQ ID NO: 667610 - protein, 22 aa, Mycobacterium
GKPEIEVGKGFSGVMETFDNTR

SEQ ID NO: 667611 - protein, 17 aa, Mycobacterium
GKPELKALGAVSTTTAG

SEQ ID NO: 667612 - protein, 27 aa, Mycobacterium
GKPERLRSGWLNGIKHWQVDYHSTASA

SEQ ID NO: 667613 - protein, 27 aa, Mycobacterium
GKPERLRSGWLNGIKHWQVDYHTDGAA

SEQ ID NO: 667614 - protein, 27 aa, Mycobacterium
GKPERLRSGWLNGIKHWQVDYHTDGKA

SEQ ID NO: 667615 - protein, 24 aa, Mycobacterium
GKPFAEPEILTFGYALEQNTDTVG

SEQ ID NO: 667616 - protein, 17 aa, Mycobacterium
GKPFFGSLLEFITSGPV

SEQ ID NO: 667617 - protein, 25 aa, Mycobacterium
GKPFGEQIVMWWNFVGRDHDEIAAF

SEQ ID NO: 667618 - protein, 17 aa, Mycobacterium
GKPFGLRPSAILPAYGM

SEQ ID NO: 667619 - protein, 19 aa, Mycobacterium
GKPGVAILLTYGPDRDWLK

SEQ ID NO: 667620 - protein, 24 aa, Mycobacterium
GKPHAFRPPFGTLVVQDFCAITDE

SEQ ID NO: 667621 - protein, 17 aa, Mycobacterium
GKPHGWIHSELRRRCGG

SEQ ID NO: 667622 - protein, 21 aa, Mycobacterium
GKPHVTWKFAASVDGRSAAAD

SEQ ID NO: 667623 - protein, 17 aa, Mycobacterium
GKPIIGFVGRLAPEKHV

SEQ ID NO: 667624 - protein, 24 aa, Mycobacterium
GKPKGVVHPVAYLAGFQAYLEYSL

SEQ ID NO: 667625 - protein, 22 aa, Mycobacterium
GKPKRALIRERLLGCAPGADIR

SEQ ID NO: 667626 - protein, 18 aa, Mycobacterium
GKPLALIDVRERVEWDIN

SEQ ID NO: 667627 - protein, 26 aa, Mycobacterium
GKPLAMPRLDMVTGLYYLTTLVEGAT

SEQ ID NO: 667628 - protein, 21 aa, Mycobacterium
GKPLRTGEQIRDIAWFNPSGR

SEQ ID NO: 667629 - protein, 23 aa, Mycobacterium
GKPMPWNAPAVMKRNGVGLTPED

SEQ ID NO: 667630 - protein, 18 aa, Mycobacterium
GKPNYRWAREQVTRQVPA

SEQ ID NO: 667631 - protein, 25 aa, Mycobacterium
GKPPESGQLWGVWAAEAPDAVLTAT

SEQ ID NO: 667632 - protein, 19 aa, Mycobacterium
GKPPICFATGSIPLESPSD

SEQ ID NO: 667633 - protein, 17 aa, Mycobacterium
GKPPIGVLATDDKAAVE

SEQ ID NO: 667634 - protein, 25 aa, Mycobacterium
GKPPQAGQLWGVWVAESADAVLRAS

SEQ ID NO: 667635 - protein, 17 aa, Mycobacterium
GKPQIRASLKLDGDTLR

SEQ ID NO: 667636 - protein, 19 aa, Mycobacterium
GKPQPGYLPVLRAYDYSGD

SEQ ID NO: 667637 - protein, 23 aa, Mycobacterium
GKPRADGIRSFLGSRLIDVDEAT

SEQ ID NO: 667638 - protein, 24 aa, Mycobacterium
GKPRRWIRRPPPLYGQHTGEVLTA

SEQ ID NO: 667639 - protein, 19 aa, Mycobacterium
GKPSPFAWVPFGGGTRRCA

SEQ ID NO: 667640 - protein, 20 aa, Mycobacterium
GKPTRTGWGVERIAAAWETL

SEQ ID NO: 667641 - protein, 28 aa, Mycobacterium
GKPVAAICHGPWTLVEAGVAVGRTLTSY

SEQ ID NO: 667642 - protein, 19 aa, Mycobacterium
GKPVFPMTLLGTFSPYMVV

SEQ ID NO: 667643 - protein, 25 aa, Mycobacterium
GKPVGVFQTHEWAPRVLIANSNLVG

SEQ ID NO: 667644 - protein, 26 aa, Mycobacterium
GKPVWAVGTVIYWHALRAMGIDDQYE

SEQ ID NO: 667645 - protein, 18 aa, Mycobacterium
GKQAHWNVIGSNFRDLHL

SEQ ID NO: 667646 - protein, 26 aa, Mycobacterium
GKQFKSYRGMGSMGAMQGRGATKSYS

SEQ ID NO: 667647 - protein, 24 aa, Mycobacterium
GKQISLRLAERGVLVKDTHGSTLR

SEQ ID NO: 667648 - protein, 20 aa, Mycobacterium
GKQKLFLLGRGEMQFFPVFR

SEQ ID NO: 667649 - protein, 22 aa, Mycobacterium
GKQLRLAQQYFFVSCSLQDILH

SEQ ID NO: 667650 - protein, 23 aa, Mycobacterium
GKQLRLAQQYFFVSCSLQDMLHL

SEQ ID NO: 667651 - protein, 23 aa, Mycobacterium
GKQLRLLQQYFFVSCSLQHVLHI

SEQ ID NO: 667652 - protein, 17 aa, Mycobacterium
GKQRPGSIRALNQGEVG

SEQ ID NO: 667653 - protein, 22 aa, Mycobacterium
GKQRPGSVRALGRDEIGQLYKA

SEQ ID NO: 667654 - protein, 25 aa, Mycobacterium
GKQRSRLALWSRRLLGEAITQAQFL

SEQ ID NO: 667655 - protein, 26 aa, Mycobacterium
GKQSLHKLAAAWGGSGSEAYQGVQQK

SEQ ID NO: 667656 - protein, 27 aa, Mycobacterium
GKQSLHKLAAAWGGSGSEAYRGVQQNW

SEQ ID NO: 667657 - protein, 26 aa, Mycobacterium
GKQSLTKLAAAWGGSGSEAYQGVQQK

SEQ ID NO: 667658 - protein, 27 aa, Mycobacterium
GKQTIYRWWPSRHALVADVILEDADRI

SEQ ID NO: 667659 - protein, 27 aa, Mycobacterium
GKQTIYRWWPSRHALVADVLLEDADKI

SEQ ID NO: 667660 - protein, 27 aa, Mycobacterium
GKQTIYRWWPSRPALVADVMLEDADKL

SEQ ID NO: 667661 - protein, 18 aa, Mycobacterium
GKQVPIFIADYVLAGYGT

SEQ ID NO: 667662 - protein, 21 aa, Mycobacterium
GKRAPAKGRRRAVSKAGDRPA

SEQ ID NO: 667663 - protein, 19 aa, Mycobacterium
GKRCGACRLEIDRGELARI

SEQ ID NO: 667664 - protein, 21 aa, Mycobacterium
GKRDPRDFTLWKGAKPGEPSW

SEQ ID NO: 667665 - protein, 24 aa, Mycobacterium
GKREISTRADIAWVTADIEAFVDE

SEQ ID NO: 667666 - protein, 17 aa, Mycobacterium
GKREVLPGVGLYLDGGF

SEQ ID NO: 667667 - protein, 24 aa, Mycobacterium
GKRFGRLRIATSMLLGRLERSPLY

SEQ ID NO: 667668 - protein, 18 aa, Mycobacterium
GKRGRRVLVVDGDPQANV

SEQ ID NO: 667669 - protein, 25 aa, Mycobacterium
GKRIYRPDHATLYVARWLHPGQRAF

SEQ ID NO: 667670 - protein, 19 aa, Mycobacterium
GKRKIIGRHFIRAFEGAVR

SEQ ID NO: 667671 - protein, 20 aa, Mycobacterium
GKRKRTRTGFGQRKSTKRAI

SEQ ID NO: 667672 - protein, 20 aa, Mycobacterium
GKRKRTRTGYGRRKNTKRAI

SEQ ID NO: 667673 - protein, 20 aa, Mycobacterium
GKRKTANRFAQFAGGDAADI

SEQ ID NO: 667674 - protein, 18 aa, Mycobacterium
GKRLPKRDHKPWIDDGVY

SEQ ID NO: 667675 - protein, 17 aa, Mycobacterium
GKRLRLLQQHFFVSCSL

SEQ ID NO: 667676 - protein, 21 aa, Mycobacterium
GKRMDECIEIIQGLTTGDYFE

SEQ ID NO: 667677 - protein, 20 aa, Mycobacterium
GKRRPAIVIATNRLVYGGAE

SEQ ID NO: 667678 - protein, 17 aa, Mycobacterium
GKRSATIDLRSEGGQAL

SEQ ID NO: 667679 - protein, 18 aa, Mycobacterium
GKRSIGLDMSVPAGREVL

SEQ ID NO: 667680 - protein, 18 aa, Mycobacterium
GKRSIGLDMSVPEGKDVL

SEQ ID NO: 667681 - protein, 17 aa, Mycobacterium
GKRSLGLDMSISEGKEV

SEQ ID NO: 667682 - protein, 17 aa, Mycobacterium
GKRSLGMGARMLDTSAQ

SEQ ID NO: 667683 - protein, 18 aa, Mycobacterium
GKRSMAFGLTEPGHGSDA

SEQ ID NO: 667684 - protein, 18 aa, Mycobacterium
GKRSVGIDVSTPEGQEVL

SEQ ID NO: 667685 - protein, 19 aa, Mycobacterium
GKRSVGIDVSTPGGQEVIY

SEQ ID NO: 667686 - protein, 17 aa, Mycobacterium
GKRSVGLALDNSEARPL

SEQ ID NO: 667687 - protein, 21 aa, Mycobacterium
GKRSYAAAVHRATRPGATLLI

SEQ ID NO: 667688 - protein, 19 aa, Mycobacterium
GKRYLVDFPSPVSYDKCII

SEQ ID NO: 667689 - protein, 20 aa, Mycobacterium
GKSAGCARWVRSVFSEFPAG

SEQ ID NO: 667690 - protein, 23 aa, Mycobacterium
GKSAQNAAVRWMQRRSFAELRER

SEQ ID NO: 667691 - protein, 21 aa, Mycobacterium
GKSATTAWLIERLQRPTLVME

SEQ ID NO: 667692 - protein, 19 aa, Mycobacterium
GKSFREWRTYQMSDHLPMW

SEQ ID NO: 667693 - protein, 23 aa, Mycobacterium
GKSGLFGDYLIKMAQVITWFSLD

SEQ ID NO: 667694 - protein, 18 aa, Mycobacterium
GKSIIAFASTTRGGTISK

SEQ ID NO: 667695 - protein, 23 aa, Mycobacterium
GKSKRIGARLGVILASGGFDHDL

SEQ ID NO: 667696 - protein, 24 aa, Mycobacterium
GKSKRQHVTCVHKCGDACSKPVPN

SEQ ID NO: 667697 - protein, 17 aa, Mycobacterium
GKSLAAFGLTEPGGGTD

SEQ ID NO: 667698 - protein, 21 aa, Mycobacterium
GKSLILRYGPGVGQALDQSYH

SEQ ID NO: 667699 - protein, 18 aa, Mycobacterium
GKSLLSFVIDPTVLHAAA

SEQ ID NO: 667700 - protein, 29 aa, Mycobacterium
GKSLPDFLSIEIFRPLDLAMVVDPISADP

SEQ ID NO: 667701 - protein, 21 aa, Mycobacterium
GKSLWAETRIELFTQSTDTRP

SEQ ID NO: 667702 - protein, 18 aa, Mycobacterium
GKSPAVFYRYFSDKEDLL

SEQ ID NO: 667703 - protein, 19 aa, Mycobacterium
GKSPAVFYRYFTDKEDLLA

SEQ ID NO: 667704 - protein, 22 aa, Mycobacterium
GKSPAVFYRYFTDKEDLLAALA

SEQ ID NO: 667705 - protein, 22 aa, Mycobacterium
GKSQMAAGLMRRLAGEEIDVYS

SEQ ID NO: 667706 - protein, 18 aa, Mycobacterium
GKSRYRWEFQLRADETAA

SEQ ID NO: 667707 - protein, 17 aa, Mycobacterium
GKSTLCRTINRLETIDS

SEQ ID NO: 667708 - protein, 26 aa, Mycobacterium
GKSTLLGFCAAVLFPTSGTVRILGEQ

SEQ ID NO: 667709 - protein, 25 aa, Mycobacterium
GKSTLLLEVAHRWASTGRRALYLSG

SEQ ID NO: 667710 - protein, 27 aa, Mycobacterium
GKSTLLLKVAHRWALSGRRALYISGEE

SEQ ID NO: 667711 - protein, 26 aa, Mycobacterium
GKSTLLLKVVHQWAASGGRALYISGE

SEQ ID NO: 667712 - protein, 19 aa, Mycobacterium
GKSTLLRTLGGILRPASGV

SEQ ID NO: 667713 - protein, 19 aa, Mycobacterium
GKTAAFAIPILSKIDTDSR

SEQ ID NO: 667714 - protein, 19 aa, Mycobacterium
GKTAAFAIPILSKIDTSRR

SEQ ID NO: 667715 - protein, 20 aa, Mycobacterium
GKTAAGYVMRGALTIHGATR

SEQ ID NO: 667716 - protein, 23 aa, Mycobacterium
GKTAGELHALFAKHSKTPVPQAL

SEQ ID NO: 667717 - protein, 27 aa, Mycobacterium
GKTALVAAICRQLRDELSLAVLTNDIY

SEQ ID NO: 667718 - protein, 26 aa, Mycobacterium
GKTALVAALCRQLREDLSLAVLTNDI

SEQ ID NO: 667719 - protein, 25 aa, Mycobacterium
GKTALVAALCRTLRDEISVAVLTND

SEQ ID NO: 667720 - protein, 21 aa, Mycobacterium
GKTAMDVCLWLLRNSVDPGQL

SEQ ID NO: 667721 - protein, 21 aa, Mycobacterium
GKTDFPGLEIIGQFIHEPELR

SEQ ID NO: 667722 - protein, 22 aa, Mycobacterium
GKTDPLIRKWLGFAPAKPKVVF

SEQ ID NO: 667723 - protein, 18 aa, Mycobacterium
GKTDWAAQEFDYLRDTGS

SEQ ID NO: 667724 - protein, 17 aa, Mycobacterium
GKTGWAAEEFDYLRQVG

SEQ ID NO: 667725 - protein, 25 aa, Mycobacterium
GKTKNEIMRCIKRTSPARSTTPSAN

SEQ ID NO: 667726 - protein, 20 aa, Mycobacterium
GKTLAAFLWAIDGLAREPRA

SEQ ID NO: 667727 - protein, 21 aa, Mycobacterium
GKTLAAFLWAIDRLADPAREP

SEQ ID NO: 667728 - protein, 31 aa, Mycobacterium
GKTLAAFLWALDSLARCPDRTAGTRVLYVSP

SEQ ID NO: 667729 - protein, 20 aa, Mycobacterium
GKTLAAFLWALDSLARSADR

SEQ ID NO: 667730 - protein, 17 aa, Mycobacterium
GKTLKAVAEPSGISTAY

SEQ ID NO: 667731 - protein, 18 aa, Mycobacterium
GKTLKSAKAEVLKCAKGF

SEQ ID NO: 667732 - protein, 24 aa, Mycobacterium
GKTMGIPILYPWANRLSANTYTAE

SEQ ID NO: 667733 - protein, 17 aa, Mycobacterium
GKTMVVTGLHLLGGARA

SEQ ID NO: 667734 - protein, 22 aa, Mycobacterium
GKTMVVTGLHLLGGARADATRV

SEQ ID NO: 667735 - protein, 21 aa, Mycobacterium
GKTPWPGGAPYAALPTGVHWD

SEQ ID NO: 667736 - protein, 21 aa, Mycobacterium
GKTRFVEAMAYDLGRPLITVA

SEQ ID NO: 667737 - protein, 21 aa, Mycobacterium
GKTRFVEAVAHELGRDLITVA

SEQ ID NO: 667738 - protein, 18 aa, Mycobacterium
GKTSLLRAIAGLNPLDRG

SEQ ID NO: 667739 - protein, 17 aa, Mycobacterium
GKTTCFNAITGVYKPTS

SEQ ID NO: 667740 - protein, 17 aa, Mycobacterium
GKTTCFNAITGVYRPSS

SEQ ID NO: 667741 - protein, 17 aa, Mycobacterium
GKTTCFNAITGVYRPTS

SEQ ID NO: 667742 - protein, 36 aa, Mycobacterium
GKTVANRAKLNWWESRALYGWTVLVPRTKDQAGEMS

SEQ ID NO: 667743 - protein, 34 aa, Mycobacterium
GKTVIESRVAWYLTDKLNGGWVFDDDHYHVVIAG

SEQ ID NO: 667744 - protein, 26 aa, Mycobacterium
GKTVSRLGFGTMRFTGRGIWGEPADR

SEQ ID NO: 667745 - protein, 19 aa, Mycobacterium
GKTVWGVGIATSITTASLR

SEQ ID NO: 667746 - protein, 17 aa, Mycobacterium
GKTWRFVDTAGLRRKVG

SEQ ID NO: 667747 - protein, 20 aa, Mycobacterium
GKTYCAVGGFLEDAAGFDAG

SEQ ID NO: 667748 - protein, 19 aa, Mycobacterium
GKVALVMLVHHAYVDGVGA

SEQ ID NO: 667749 - protein, 27 aa, Mycobacterium
GKVGEICFKSKIARRSYYKGEQPTAEL

SEQ ID NO: 667750 - protein, 18 aa, Mycobacterium
GKVGPFRVEGTAHPGGPG

SEQ ID NO: 667751 - protein, 19 aa, Mycobacterium
GKVGRLSMRGILDDPRLEL

SEQ ID NO: 667752 - protein, 23 aa, Mycobacterium
GKVIDPHTAFAFHDYCATENTVH

SEQ ID NO: 667753 - protein, 19 aa, Mycobacterium
GKVKEVAGAVAGRDDLMRE

SEQ ID NO: 667754 - protein, 18 aa, Mycobacterium
GKVKRVYYGFVSLDSPPF

SEQ ID NO: 667755 - protein, 18 aa, Mycobacterium
GKVKVELALARGKRAHDK

SEQ ID NO: 667756 - protein, 17 aa, Mycobacterium
GKVMLALPLSIGFTTAI

SEQ ID NO: 667757 - protein, 24 aa, Mycobacterium
GKVMLSLPLLIGFPTAIDGRVDRI

SEQ ID NO: 667758 - protein, 24 aa, Mycobacterium
GKVPEELHLDFSDLAFCDSAGLSG

SEQ ID NO: 667759 - protein, 18 aa, Mycobacterium
GKVQRAFRDMGVLDMAGS

SEQ ID NO: 667760 - protein, 25 aa, Mycobacterium
GKVRRLRRLAGLWLAGQDRGWAAVR

SEQ ID NO: 667761 - protein, 19 aa, Mycobacterium
GKVSAEFKATFDPIDEKLA

SEQ ID NO: 667762 - protein, 17 aa, Mycobacterium
GKVTAWRYIRASVPAVW

SEQ ID NO: 667763 - protein, 22 aa, Mycobacterium
GKVYCMAHHIYLRGKEYRDNTM

SEQ ID NO: 667764 - protein, 17 aa, Mycobacterium
GKWDTLRSMGFDDSRIG

SEQ ID NO: 667765 - protein, 19 aa, Mycobacterium
GKWGSQWLVDNRPDLFEGI

SEQ ID NO: 667766 - protein, 17 aa, Mycobacterium
GKWHLAPEETMTAAGPY

SEQ ID NO: 667767 - protein, 24 aa, Mycobacterium
GKWNLDLGDLLPALSVQGAEATNG

SEQ ID NO: 667768 - protein, 26 aa, Mycobacterium
GKWSEHRSDVVFDFPVSRRVQPESMT

SEQ ID NO: 667769 - protein, 23 aa, Mycobacterium
GKWTAALIGSWWSTPSTELHAGA

SEQ ID NO: 667770 - protein, 19 aa, Mycobacterium
GKWVMPGFIDVHTHYDAEV

SEQ ID NO: 667771 - protein, 37 aa, Mycobacterium
GKWYPGEPLPRWQIALYWRTDGLPLWTDAELLADPWS

SEQ ID NO: 667772 - protein, 30 aa, Mycobacterium
GKWYPGEPLPRWQIGLYWRADGEPLWSDDR

SEQ ID NO: 667773 - protein, 30 aa, Mycobacterium
GKWYPGEPLPRWQIGLYWRRDGQPLWSDPE

SEQ ID NO: 667774 - protein, 17 aa, Mycobacterium
GKYDLATEAVRWADDLT

SEQ ID NO: 667775 - protein, 17 aa, Mycobacterium
GKYDLFRAAVLNLGEQL

SEQ ID NO: 667776 - protein, 17 aa, Mycobacterium
GKYDLFRSAVLALGQRL

SEQ ID NO: 667777 - protein, 17 aa, Mycobacterium
GKYGAQWLVDNRPDLFD

SEQ ID NO: 667778 - protein, 21 aa, Mycobacterium
GKYGFNGLMAVLAEFPKPLIC

SEQ ID NO: 667779 - protein, 19 aa, Mycobacterium
GKYLTEIIWQLPAGLASPS

SEQ ID NO: 667780 - protein, 20 aa, Mycobacterium
GKYNPAAPFGGYKKSGVGRE

SEQ ID NO: 667781 - protein, 17 aa, Mycobacterium
GKYPWGVAVDPNTRTVY

SEQ ID NO: 667782 - protein, 17 aa, Mycobacterium
GKYSWVMSPRWFDGKDH

SEQ ID NO: 667783 - protein, 17 aa, Mycobacterium
GKYSWVMSPRWFDGTDH

SEQ ID NO: 667784 - protein, 18 aa, Mycobacterium
GKYSWVMSPRWFDGTDHL

SEQ ID NO: 667785 - protein, 20 aa, Mycobacterium
GKYYKCRGPLNTAPSPQGRP

SEQ ID NO: 667786 - protein, 18 aa, Mycobacterium
GLAAARATTAAAQAKVAA

SEQ ID NO: 667787 - protein, 18 aa, Mycobacterium
GLAAEYYHRVFGRWPGKG

SEQ ID NO: 667788 - protein, 17 aa, Mycobacterium
GLAAGWLQCDVRDADAV

SEQ ID NO: 667789 - protein, 19 aa, Mycobacterium
GLAAMCAGGGMGSATVIEV

SEQ ID NO: 667790 - protein, 25 aa, Mycobacterium
GLAARLTVGYALAWQGRGREADGVL

SEQ ID NO: 667791 - protein, 20 aa, Mycobacterium
GLAARYGELGLAPVLGYEYE

SEQ ID NO: 667792 - protein, 19 aa, Mycobacterium
GLAASAWTRDVYRAQRASR

SEQ ID NO: 667793 - protein, 27 aa, Mycobacterium
GLAAVLPCYWIYARVGAELMQRGSSDP

SEQ ID NO: 667794 - protein, 18 aa, Mycobacterium
GLAAWGYASGISLGDGSF

SEQ ID NO: 667795 - protein, 24 aa, Mycobacterium
GLACADGVVIPTECEYFSLRGLAL

SEQ ID NO: 667796 - protein, 27 aa, Mycobacterium
GLADAIRRAGLPKVPTSVLSRGVCGVA

SEQ ID NO: 667797 - protein, 19 aa, Mycobacterium
GLADAIRRSGLPAVPTSIL

SEQ ID NO: 667798 - protein, 20 aa, Mycobacterium
GLADAPSWIVDQVFPAQRAA

SEQ ID NO: 667799 - protein, 20 aa, Mycobacterium
GLADCALALGFEKMNPGSLG

SEQ ID NO: 667800 - protein, 24 aa, Mycobacterium
GLADDRWAILMKVHHCIADGIAAM

SEQ ID NO: 667801 - protein, 23 aa, Mycobacterium
GLADEWAKWDGLRPFVGTLTMEL

SEQ ID NO: 667802 - protein, 21 aa, Mycobacterium
GLADGCVTLGIPVTGGNVSFY

SEQ ID NO: 667803 - protein, 22 aa, Mycobacterium
GLADGKAAMLLHVSHAVTDGVG

SEQ ID NO: 667804 - protein, 18 aa, Mycobacterium
GLADIEWTVQLLQLQNAH

SEQ ID NO: 667805 - protein, 18 aa, Mycobacterium
GLADIEWTVQLLQLRFAH

SEQ ID NO: 667806 - protein, 18 aa, Mycobacterium
GLADIEWTVQLLQLRHAH

SEQ ID NO: 667807 - protein, 18 aa, Mycobacterium
GLADIEWTVQLLQLRYAH

SEQ ID NO: 667808 - protein, 19 aa, Mycobacterium
GLADIEWTVQLMQLRYAHE

SEQ ID NO: 667809 - protein, 24 aa, Mycobacterium
GLADLGIRPGERVLLQLPNSCQFA

SEQ ID NO: 667810 - protein, 24 aa, Mycobacterium
GLADRAFGAGQAWVDTDGDGRWDV

SEQ ID NO: 667811 - protein, 24 aa, Mycobacterium
GLADRLRRSLGRMPWTTAQKRLPR

SEQ ID NO: 667812 - protein, 18 aa, Mycobacterium
GLADVEWTVQLLQLRHAH

SEQ ID NO: 667813 - protein, 22 aa, Mycobacterium
GLADVTLALGFEKMQPGSLGAT

SEQ ID NO: 667814 - protein, 25 aa, Mycobacterium
GLAEAAGFHPEWPLIGAAHHLLRAH

SEQ ID NO: 667815 - protein, 25 aa, Mycobacterium
GLAEDLKLGLGMLFQHHSAFKKIAV

SEQ ID NO: 667816 - protein, 18 aa, Mycobacterium
GLAEEIFVIADLARQKAR

SEQ ID NO: 667817 - protein, 21 aa, Mycobacterium
GLAEGCAALGIPVTGGNVSFY

SEQ ID NO: 667818 - protein, 19 aa, Mycobacterium
GLAEGKVALVMLVHHAYVD

SEQ ID NO: 667819 - protein, 17 aa, Mycobacterium
GLAEHLGGIPMPRALQW

SEQ ID NO: 667820 - protein, 32 aa, Mycobacterium
GLAEHWGHTVVHCPYCHGWEVRDEPIGILATG

SEQ ID NO: 667821 - protein, 19 aa, Mycobacterium
GLAEIMRLGIALGATPATL

SEQ ID NO: 667822 - protein, 22 aa, Mycobacterium
GLAEITRLGLALGASHTTLAGL

SEQ ID NO: 667823 - protein, 18 aa, Mycobacterium
GLAELLERAIVPVHVNTH

SEQ ID NO: 667824 - protein, 24 aa, Mycobacterium
GLAEPLPLVRMVLAATAEDRRIGY

SEQ ID NO: 667825 - protein, 18 aa, Mycobacterium
GLAERVEVQVAYAIGKAA

SEQ ID NO: 667826 - protein, 18 aa, Mycobacterium
GLAESLAIPPPVATMGAS

SEQ ID NO: 667827 - protein, 19 aa, Mycobacterium
GLAEVALACLIPGDTLPPG

SEQ ID NO: 667828 - protein, 36 aa, Mycobacterium
GLAFALHCDIRIASELARFGSVFIKAGFSSMDMGTS

SEQ ID NO: 667829 - protein, 26 aa, Mycobacterium
GLAFGEVNVAYGLYPAWRGRGLATRA

SEQ ID NO: 667830 - protein, 22 aa, Mycobacterium
GLAGAGGLLFGNGGVGGQGGDG

SEQ ID NO: 667831 - protein, 19 aa, Mycobacterium
GLAGFPNFFLLIGPNSPIG

SEQ ID NO: 667832 - protein, 18 aa, Mycobacterium
GLAGQAWQGPAAAAMAAA

SEQ ID NO: 667833 - protein, 18 aa, Mycobacterium
GLAGQAWQGPASQAMAAA

SEQ ID NO: 667834 - protein, 18 aa, Mycobacterium
GLAGRVVLVTGGVRGVGA

SEQ ID NO: 667835 - protein, 17 aa, Mycobacterium
GLAGVGVVESWVHLEVV

SEQ ID NO: 667836 - protein, 17 aa, Mycobacterium
GLAHRWPPDDAKGKIIQ

SEQ ID NO: 667837 - protein, 17 aa, Mycobacterium
GLAIALRAARDGANVAI

SEQ ID NO: 667838 - protein, 20 aa, Mycobacterium
GLAICQRYLRNAPARIVLAC

SEQ ID NO: 667839 - protein, 18 aa, Mycobacterium
GLAKAQPVLLVIDEFGKN

SEQ ID NO: 667840 - protein, 30 aa, Mycobacterium
GLAKLPRDRMPVLYCKTGVRSAQALAVLKQ

SEQ ID NO: 667841 - protein, 19 aa, Mycobacterium
GLAKTRLAATVGDVVAAEI

SEQ ID NO: 667842 - protein, 18 aa, Mycobacterium
GLAKVPAYLVGVGPLPEH

SEQ ID NO: 667843 - protein, 20 aa, Mycobacterium
GLALAPIIKLFEAIDIKKFG

SEQ ID NO: 667844 - protein, 23 aa, Mycobacterium
GLALDIGPRLGISPADSETLAQL

SEQ ID NO: 667845 - protein, 24 aa, Mycobacterium
GLALGLRGAESFRVSAETTKALGE

SEQ ID NO: 667846 - protein, 25 aa, Mycobacterium
GLALIKYWASQGWLHRITEQAGDGE

SEQ ID NO: 667847 - protein, 23 aa, Mycobacterium
GLALPMRLALPGAVNRGNAAQAV

SEQ ID NO: 667848 - protein, 23 aa, Mycobacterium
GLALPMRLALPGAVNRGNATQAV

SEQ ID NO: 667849 - protein, 22 aa, Mycobacterium
GLAMRRPMLRWTGGGLAAIAAA

SEQ ID NO: 667850 - protein, 24 aa, Mycobacterium
GLAPERVLGPLAILELAGLVQRQE

SEQ ID NO: 667851 - protein, 20 aa, Mycobacterium
GLAPGCLQATVAAYNAGAAR

SEQ ID NO: 667852 - protein, 21 aa, Mycobacterium
GLAPGHYTLCASVDWQQHKPG

SEQ ID NO: 667853 - protein, 21 aa, Mycobacterium
GLAPHWGRGWLTSATSGDVTA

SEQ ID NO: 667854 - protein, 18 aa, Mycobacterium
GLAPLRDLIHFERVAQLC

SEQ ID NO: 667855 - protein, 24 aa, Mycobacterium
GLAPPAALIGDWFGSRAVIAPSVS

SEQ ID NO: 667856 - protein, 25 aa, Mycobacterium
GLAPPAALIGDWFGSRAVIAPTVTA

SEQ ID NO: 667857 - protein, 25 aa, Mycobacterium
GLAPPTGRVLLVWDAPNLDMGLGSI

SEQ ID NO: 667858 - protein, 17 aa, Mycobacterium
GLAPRFGVGVVATTGAH

SEQ ID NO: 667859 - protein, 19 aa, Mycobacterium
GLAPRLRLVPIHRKGEPGV

SEQ ID NO: 667860 - protein, 18 aa, Mycobacterium
GLAPRRQREVGSWIIDDQ

SEQ ID NO: 667861 - protein, 19 aa, Mycobacterium
GLAPRVALHIPWDTVDDYA

SEQ ID NO: 667862 - protein, 26 aa, Mycobacterium
GLAPVLGYEYELWIFRDGEGTSPPIL

SEQ ID NO: 667863 - protein, 21 aa, Mycobacterium
GLAPVRFAEFEAAEAPFPSVR

SEQ ID NO: 667864 - protein, 25 aa, Mycobacterium
GLAQKEFASRIGVTAEELAAYLDGS

SEQ ID NO: 667865 - protein, 25 aa, Mycobacterium
GLAQRRFEEQLGRPLGEDEFELVNR

SEQ ID NO: 667866 - protein, 19 aa, Mycobacterium
GLAQVQARAVAAVRERDRA

SEQ ID NO: 667867 - protein, 17 aa, Mycobacterium
GLARAFAAELGKHSIRV

SEQ ID NO: 667868 - protein, 18 aa, Mycobacterium
GLARALARRPRVLLLDEP

SEQ ID NO: 667869 - protein, 17 aa, Mycobacterium
GLARAYVSGDIEMQGVH

SEQ ID NO: 667870 - protein, 23 aa, Mycobacterium
GLAREIACAYDLDFVDPADVPAL

SEQ ID NO: 667871 - protein, 23 aa, Mycobacterium
GLAREIACAYDLDFVDPAEVKPL

SEQ ID NO: 667872 - protein, 24 aa, Mycobacterium
GLARELLGDFPVRRVRLQMMQTAA

SEQ ID NO: 667873 - protein, 18 aa, Mycobacterium
GLAREVANAFDLDYTDPA

SEQ ID NO: 667874 - protein, 22 aa, Mycobacterium
GLAREYEEVMLLRSAVGMAAPQ

SEQ ID NO: 667875 - protein, 18 aa, Mycobacterium
GLARKAMDLLGCELQQRY

SEQ ID NO: 667876 - protein, 17 aa, Mycobacterium
GLARLIANRFRRAVPPV

SEQ ID NO: 667877 - protein, 23 aa, Mycobacterium
GLARLRATIGIAVPHTQPPHYYR

SEQ ID NO: 667878 - protein, 22 aa, Mycobacterium
GLARMALATGVPVIPVAMVGTN

SEQ ID NO: 667879 - protein, 18 aa, Mycobacterium
GLARPGEVLACSDSHTCA

SEQ ID NO: 667880 - protein, 19 aa, Mycobacterium
GLARQDAWSGDAFAEAVIT

SEQ ID NO: 667881 - protein, 26 aa, Mycobacterium
GLARRRPDIAVTILRLANMIGPAMDT

SEQ ID NO: 667882 - protein, 17 aa, Mycobacterium
GLARVSLTMIATRGERL

SEQ ID NO: 667883 - protein, 18 aa, Mycobacterium
GLARWRDAFWALADQGES

SEQ ID NO: 667884 - protein, 17 aa, Mycobacterium
GLARYPLPMAPAAAAQQ

SEQ ID NO: 667885 - protein, 24 aa, Mycobacterium
GLASDAQWLPAWESALARVSTAID

SEQ ID NO: 667886 - protein, 18 aa, Mycobacterium
GLASGLGDQGNHEHPSDT

SEQ ID NO: 667887 - protein, 20 aa, Mycobacterium
GLASLHLVHEWNREFVRTSP

SEQ ID NO: 667888 - protein, 20 aa, Mycobacterium
GLATARLFAAEGAKVAVIGR

SEQ ID NO: 667889 - protein, 18 aa, Mycobacterium
GLATFVFHVPWQDQPDRV

SEQ ID NO: 667890 - protein, 27 aa, Mycobacterium
GLAVAAHAAVAWDILQRAKQFRDALAS

SEQ ID NO: 667891 - protein, 29 aa, Mycobacterium
GLAVKLANMPFTWSTRGAERIAEAVRSVR

SEQ ID NO: 667892 - protein, 19 aa, Mycobacterium
GLAVLRLDRMRALVDVYPG

SEQ ID NO: 667893 - protein, 26 aa, Mycobacterium
GLAVRAANLPAQWSTRGIDRAVESIR

SEQ ID NO: 667894 - protein, 28 aa, Mycobacterium
GLAYSRLRRRARPLSIATDVGFRMPSVW

SEQ ID NO: 667895 - protein, 21 aa, Mycobacterium
GLCAEMRRAAGADTRVELLAQ

SEQ ID NO: 667896 - protein, 19 aa, Mycobacterium
GLCEYLRSRIVDIPQSLVG

SEQ ID NO: 667897 - protein, 24 aa, Mycobacterium
GLCGRLRLADFDHLELSNLNRVPA

SEQ ID NO: 667898 - protein, 18 aa, Mycobacterium
GLCHPADNFGPVLAVAEH

SEQ ID NO: 667899 - protein, 25 aa, Mycobacterium
GLCIHCMKCMPTVYSGTHCVVRERI

SEQ ID NO: 667900 - protein, 20 aa, Mycobacterium
GLCLALACDVRIAAHNAYFR

SEQ ID NO: 667901 - protein, 18 aa, Mycobacterium
GLCRGVDSAMFFHPDGER

SEQ ID NO: 667902 - protein, 18 aa, Mycobacterium
GLCSYLCTDAAGYITGQV

SEQ ID NO: 667903 - protein, 24 aa, Mycobacterium
GLCTYGMTCKAIVDTLLDGDAGAV

SEQ ID NO: 667904 - protein, 24 aa, Mycobacterium
GLCTYGMTCKALVDNLLDGDVRGL

SEQ ID NO: 667905 - protein, 19 aa, Mycobacterium
GLDAAQAVVVSYDYTVLAG

SEQ ID NO: 667906 - protein, 28 aa, Mycobacterium
GLDARAYRLDWPAGMTVFEIDQPEVIAF

SEQ ID NO: 667907 - protein, 28 aa, Mycobacterium
GLDARAYRLPWAAGTTVFEIDQPQVIEF

SEQ ID NO: 667908 - protein, 27 aa, Mycobacterium
GLDARAYRLPWPADMTVFEIDQPQVIE

SEQ ID NO: 667909 - protein, 25 aa, Mycobacterium
GLDARAYRLPWPADTVVYELDQPQV

SEQ ID NO: 667910 - protein, 29 aa, Mycobacterium
GLDARAYRLPWPAGSVVFEIDQPDVIEFK

SEQ ID NO: 667911 - protein, 28 aa, Mycobacterium
GLDARAYRLPWPAGTTVFEIDQPQVLEF

SEQ ID NO: 667912 - protein, 29 aa, Mycobacterium
GLDARAYRLPWPAGTVVYELDQPRVAEFK

SEQ ID NO: 667913 - protein, 27 aa, Mycobacterium
GLDARAYRLPWPDGTVVYEIDQPQVIE

SEQ ID NO: 667914 - protein, 25 aa, Mycobacterium
GLDARAYRLPWPPQTVVYEIDLPQV

SEQ ID NO: 667915 - protein, 28 aa, Mycobacterium
GLDARAYRLPWPSGSVVYEVDQPDVIDF

SEQ ID NO: 667916 - protein, 28 aa, Mycobacterium
GLDARAYRLSWPAGTVVFEVDQPEVISF

SEQ ID NO: 667917 - protein, 28 aa, Mycobacterium
GLDARGYRLTWPEGMTLFEIDQPEVIEF

SEQ ID NO: 667918 - protein, 25 aa, Mycobacterium
GLDARLVLAQALSWQGRGREAAAVL

SEQ ID NO: 667919 - protein, 26 aa, Mycobacterium
GLDARSWRLPWPDGTVVYELDQPKVL

SEQ ID NO: 667920 - protein, 26 aa, Mycobacterium
GLDARTWRLPWPDGTVVYELDQPKVL

SEQ ID NO: 667921 - protein, 19 aa, Mycobacterium
GLDAWTYAGPKYIWALELA

SEQ ID NO: 667922 - protein, 24 aa, Mycobacterium
GLDDMVKVAGWLRDSGITVDDIGL

SEQ ID NO: 667923 - protein, 22 aa, Mycobacterium
GLDEIKSLGFPSADTTHTDTAP

SEQ ID NO: 667924 - protein, 22 aa, Mycobacterium
GLDERYVREWLGGMTAGQVIEY

SEQ ID NO: 667925 - protein, 23 aa, Mycobacterium
GLDERYVREWLGGMTTGRVVEYD

SEQ ID NO: 667926 - protein, 31 aa, Mycobacterium
GLDFADALAALWQWGLDIDWRPLYAEHDRVV

SEQ ID NO: 667927 - protein, 31 aa, Mycobacterium; identical to SEQ ID NO: 88506

SEQ ID NO: 667928 - protein, 30 aa, Mycobacterium
GLDFMRSCSIKHQMASVIFSLEMSKTEIVM

SEQ ID NO: 667929 - protein, 17 aa, Mycobacterium
GLDFNRFVDEVSVSSAR

SEQ ID NO: 667930 - protein, 25 aa, Mycobacterium
GLDGLSLPLLRSWLSAGAAAGAART

SEQ ID NO: 667931 - protein, 18 aa, Mycobacterium
GLDGPGWESVTTPHDLAV

SEQ ID NO: 667932 - protein, 20 aa, Mycobacterium
GLDGPWRDNPAFAYIIEDAS

SEQ ID NO: 667933 - protein, 20 aa, Mycobacterium
GLDGPWRDNPAFAYVIEAAA

SEQ ID NO: 667934 - protein, 20 aa, Mycobacterium
GLDGPWRDNPAFAYVIEAAS

SEQ ID NO: 667935 - protein, 19 aa, Mycobacterium
GLDGPWRDNPAFAYVIESA

SEQ ID NO: 667936 - protein, 20 aa, Mycobacterium
GLDGPWRDNPAFAYVIESAA

SEQ ID NO: 667937 - protein, 19 aa, Mycobacterium
GLDGRIAVRHGRLEADLVN

SEQ ID NO: 667938 - protein, 22 aa, Mycobacterium
GLDGRLRHVMIPGMIAEDDDRP

SEQ ID NO: 667939 - protein, 17 aa, Mycobacterium
GLDHCFGPVGLHRVEAT

SEQ ID NO: 667940 - protein, 19 aa, Mycobacterium
GLDHCFGPVMLHRVEATVR

SEQ ID NO: 667941 - protein, 19 aa, Mycobacterium
GLDHCFGRVGLHRVEATVR

SEQ ID NO: 667942 - protein, 19 aa, Mycobacterium
GLDHLRPGTTMTTADLFIR

SEQ ID NO: 667943 - protein, 19 aa, Mycobacterium
GLDHSRLLIASVEVAGRCD

SEQ ID NO: 667944 - protein, 18 aa, Mycobacterium
GLDIPRLAQEQDIGGAVS

SEQ ID NO: 667945 - protein, 24 aa, Mycobacterium
GLDKPSLGLGEWVVPTLLQHGSKE

SEQ ID NO: 667946 - protein, 24 aa, Mycobacterium
GLDKRLADIQIRIASDVTAPLLGP

SEQ ID NO: 667947 - protein, 29 aa, Mycobacterium
GLDLARSQGCGMSYVIAGPAAIAAATTEL

SEQ ID NO: 667948 - protein, 20 aa, Mycobacterium
GLDLKTDLLIEIAVLVTDSE

SEQ ID NO: 667949 - protein, 25 aa, Mycobacterium
GLDLLRGNPLFAMDLVAAALAVSAA

SEQ ID NO: 667950 - protein, 20 aa, Mycobacterium
GLDLLSRPYIRVGTRQAVEA

SEQ ID NO: 667951 - protein, 26 aa, Mycobacterium
GLDLRAVCDLEPYWEAVRKVYAPFES

SEQ ID NO: 667952 - protein, 20 aa, Mycobacterium
GLDLRSATSRAECLRMVGDY

SEQ ID NO: 667953 - protein, 21 aa, Mycobacterium
GLDLSTGVAVAFPRSPFVTAA

SEQ ID NO: 667954 - protein, 20 aa, Mycobacterium
GLDLVSLTQILAWDLPLTKK

SEQ ID NO: 667955 - protein, 19 aa, Mycobacterium
GLDLVSLTQVLAWDLPLDS

SEQ ID NO: 667956 - protein, 27 aa, Mycobacterium
GLDNRIWQCPVVLLADIRSVGVQGDNR

SEQ ID NO: 667957 - protein, 20 aa, Mycobacterium
GLDPEKLWATVYLDDDEAAG

SEQ ID NO: 667958 - protein, 17 aa, Mycobacterium
GLDPGVMIEVLNAGSGA

SEQ ID NO: 667959 - protein, 23 aa, Mycobacterium
GLDPRLAPEPVLERQADQRSDEW

SEQ ID NO: 667960 - protein, 30 aa, Mycobacterium
GLDPSHAVQAPWPLLRTFAAGPALSREAAL

SEQ ID NO: 667961 - protein, 19 aa, Mycobacterium
GLDPVLRADLWEQFTDLAR

SEQ ID NO: 667962 - protein, 17 aa, Mycobacterium
GLDPWVIDFGEPDKVEG

SEQ ID NO: 667963 - protein, 24 aa, Mycobacterium
GLDRALRVAWSLTDLAGGVSPGPA

SEQ ID NO: 667964 - protein, 23 aa, Mycobacterium
GLDREADDFFAFIADVSGANHNE

SEQ ID NO: 667965 - protein, 23 aa, Mycobacterium
GLDREADDFFAFIADVSGANNGQ

SEQ ID NO: 667966 - protein, 23 aa, Mycobacterium
GLDREADDFFAFIADVSGANSNE

SEQ ID NO: 667967 - protein, 23 aa, Mycobacterium
GLDREADDFFSFIADASGANNGE

SEQ ID NO: 667968 - protein, 23 aa, Mycobacterium
GLDREADDFFSFIADVSGANNGE

SEQ ID NO: 667969 - protein, 17 aa, Mycobacterium
GLDRFHLFGNSWGGMLA

SEQ ID NO: 667970 - protein, 17 aa, Mycobacterium
GLDRFHVFGNSWGGMLA

SEQ ID NO: 667971 - protein, 25 aa, Mycobacterium
GLDRFIQQRVDGVTLRDEHIAGKPA

SEQ ID NO: 667972 - protein, 25 aa, Mycobacterium
GLDRFVQQRVDGIRLREEHIAGKPA

SEQ ID NO: 667973 - protein, 18 aa, Mycobacterium
GLDRSGEWCASTLAPSAR

SEQ ID NO: 667974 - protein, 26 aa, Mycobacterium
GLDRTLRVAWSLADLAGRTSPGLDEV

SEQ ID NO: 667975 - protein, 26 aa, Mycobacterium
GLDRVGIELGRGGYLTVDRVSRTSVA

SEQ ID NO: 667976 - protein, 24 aa, Mycobacterium
GLDRVKPFRPFQVNEQLLAAADSE

SEQ ID NO: 667977 - protein, 17 aa, Mycobacterium
GLDSIDALREWAKACGR

SEQ ID NO: 667978 - protein, 24 aa, Mycobacterium
GLDSRAFRLDWPAGTTVFEIDQPK

SEQ ID NO: 667979 - protein, 24 aa, Mycobacterium
GLDSRAFRLEWPDGTRVFEVDLPK

SEQ ID NO: 667980 - protein, 28 aa, Mycobacterium
GLDSRAYRLDWPAGTVVYEIDQPQVMDY

SEQ ID NO: 667981 - protein, 28 aa, Mycobacterium
GLDSRAYRLPWPAGTTVFEVDQPRVIEF

SEQ ID NO: 667982 - protein, 28 aa, Mycobacterium
GLDSRAYRLPWPAGTTVYEIDQPEVIAF

SEQ ID NO: 667983 - protein, 29 aa, Mycobacterium
GLDSRAYRLPWPAGTVVYEVDMPEVIEFK

SEQ ID NO: 667984 - protein, 24 aa, Mycobacterium
GLDSRAYRLPWPAITTVFELDQPK

SEQ ID NO: 667985 - protein, 27 aa, Mycobacterium
GLDSRAYRLPWPDGTTVFELDRPPVLD

SEQ ID NO: 667986 - protein, 26 aa, Mycobacterium
GLDSRAYRLPWPDGTVVYEIDQPDVI

SEQ ID NO: 667987 - protein, 26 aa, Mycobacterium
GLDSRVYRLPWPDGTVVYELDQPKVL

SEQ ID NO: 667988 - protein, 25 aa, Mycobacterium
GLDTCKVLINFKRCGAVAYDGSTYH

SEQ ID NO: 667989 - protein, 26 aa, Mycobacterium
GLDTRAWRLSWPDAVTVYELEQPNVL

SEQ ID NO: 667990 - protein, 25 aa, Mycobacterium
GLDVFKIAPEYAAARVLDGLERDDA

SEQ ID NO: 667991 - protein, 18 aa, Mycobacterium
GLDVLVNAAGLWQAGIPG

SEQ ID NO: 667992 - protein, 19 aa, Mycobacterium
GLDVSGFGVVPLREALSRW

SEQ ID NO: 667993 - protein, 17 aa, Mycobacterium
GLDYAREGRVVRCSWNP

SEQ ID NO: 667994 - protein, 19 aa, Mycobacterium
GLEAAKPFINVLCTAQQEL

SEQ ID NO: 667995 - protein, 18 aa, Mycobacterium
GLEAFHIFGNSWGGMLAQ

SEQ ID NO: 667996 - protein, 18 aa, Mycobacterium
GLEAGPDGRDHLVARAIN

SEQ ID NO: 667997 - protein, 19 aa, Mycobacterium
GLEAVRKRPGMYIGSTGER

SEQ ID NO: 667998 - protein, 20 aa, Mycobacterium
GLEFFEVFCDTPLDDCERRD

SEQ ID NO: 667999 - protein, 21 aa, Mycobacterium
GLEGCVRYKRRGRDILYTQAE

SEQ ID NO: 668000 - protein, 18 aa, Mycobacterium
GLEGGAPEFGRWHTRVRG

SEQ ID NO: 668001 - protein, 21 aa, Mycobacterium
GLEGGLPEFGRWHTRVRGAKE

SEQ ID NO: 668002 - protein, 25 aa, Mycobacterium
GLEGGRFAIYIKMHHSLIDGYTGQK

SEQ ID NO: 668003 - protein, 24 aa, Mycobacterium
GLEGGRFALYMKIHHALVDGYSAM

SEQ ID NO: 668004 - protein, 20 aa, Mycobacterium
GLEIALACHHRIAADTRGVV

SEQ ID NO: 668005 - protein, 19 aa, Mycobacterium
GLEIALACHHRIAADVKGL

SEQ ID NO: 668006 - protein, 20 aa, Mycobacterium
GLEIALACHHRIAADVKGSQ

SEQ ID NO: 668007 - protein, 20 aa, Mycobacterium
GLEIALACHHRIAADVKGSV

SEQ ID NO: 668008 - protein, 19 aa, Mycobacterium
GLEIALACHHRIAADVKGV

SEQ ID NO: 668009 - protein, 17 aa, Mycobacterium
GLEKAKGVLRTKVGASL

SEQ ID NO: 668010 - protein, 18 aa, Mycobacterium
GLEKMNEVYGWEMPNIEG

SEQ ID NO: 668011 - protein, 20 aa, Mycobacterium
GLELALACDVVIAAAGTMIG

SEQ ID NO: 668012 - protein, 19 aa, Mycobacterium
GLELDRRLRAAASPLVTQL

SEQ ID NO: 668013 - protein, 19 aa, Mycobacterium
GLELDRRLRAAGSPVTTYL

SEQ ID NO: 668014 - protein, 19 aa, Mycobacterium
GLELDRRLRAAGSPVVTQL

SEQ ID NO: 668015 - protein, 25 aa, Mycobacterium
GLELIDRIGIDKVMWSSDYPHNEST

SEQ ID NO: 668016 - protein, 32 aa, Mycobacterium
GLELIETHLLFGIPYDRIDVVVHPQSIIHSMV

SEQ ID NO: 668017 - protein, 32 aa, Mycobacterium
GLELIETHLLFGIPYDRIEVVVHPQSVVHSMV

SEQ ID NO: 668018 - protein, 33 aa, Mycobacterium
GLELIETHLLFGIPYERIEVVVHPQSIVHSMVT

SEQ ID NO: 668019 - protein, 33 aa, Mycobacterium
GLELIETHLLFGLPYDRIEVVVHPQSIVHSMVT

SEQ ID NO: 668020 - protein, 22 aa, Mycobacterium
GLELSTGVAVAFPRSPFVTAAA

SEQ ID NO: 668021 - protein, 24 aa, Mycobacterium
GLELSTGVAVAFPRSPFVTAATAW

SEQ ID NO: 668022 - protein, 21 aa, Mycobacterium
GLEMAAFCGWVVARPDSVFGL

SEQ ID NO: 668023 - protein, 17 aa, Mycobacterium
GLENIATLGTVFGDNNT

SEQ ID NO: 668024 - protein, 18 aa, Mycobacterium
GLEPCIARAKAYAPYSDL

SEQ ID NO: 668025 - protein, 19 aa, Mycobacterium
GLEPFALRFAEAGFDVFAF

SEQ ID NO: 668026 - protein, 26 aa, Mycobacterium
GLEPPRFCAECGRRMIVQIRPDGWWA

SEQ ID NO: 668027 - protein, 25 aa, Mycobacterium
GLEPPRFCAECGRRMIVQVRPDGWW

SEQ ID NO: 668028 - protein, 25 aa, Mycobacterium
GLEPPRFCAECGRRMVVQVRPDGWR

SEQ ID NO: 668029 - protein, 26 aa, Mycobacterium
GLEQPRSEILTFLAAREAAHHRLFSH

SEQ ID NO: 668030 - protein, 23 aa, Mycobacterium
GLEQRLGPVLFRELLALHFSPTR

SEQ ID NO: 668031 - protein, 20 aa, Mycobacterium
GLERGMKTFLVRPAPVPSRF

SEQ ID NO: 668032 - protein, 25 aa, Mycobacterium
GLERIGFAAQHIWDGSAERVLAHAT

SEQ ID NO: 668033 - protein, 25 aa, Mycobacterium
GLERIGFAAQHIWNGSAQRVLAHAT

SEQ ID NO: 668034 - protein, 20 aa, Mycobacterium
GLERPMPSYVIAAPEAIAVA

SEQ ID NO: 668035 - protein, 25 aa, Mycobacterium
GLERPRSEILTFLAAREAAHHRLFS

SEQ ID NO: 668036 - protein, 17 aa, Mycobacterium
GLERPVVEVDYEVGESV

SEQ ID NO: 668037 - protein, 26 aa, Mycobacterium
GLERRLGVVLFKDFLALHFSPTRPPA

SEQ ID NO: 668038 - protein, 20 aa, Mycobacterium
GLESARLFASEGATVIVSGR

SEQ ID NO: 668039 - protein, 24 aa, Mycobacterium
GLESLAGPSGRGFDGYGIGGALEK

SEQ ID NO: 668040 - protein, 19 aa, Mycobacterium
GLESLRLWHDGGFLDGLPS

SEQ ID NO: 668041 - protein, 20 aa, Mycobacterium
GLESLRLWRDGGFLDGLPAG

SEQ ID NO: 668042 - protein, 19 aa, Mycobacterium
GLESTALVVAGEACPAEVV

SEQ ID NO: 668043 - protein, 19 aa, Mycobacterium
GLESTALVVAGEACPPEVV

SEQ ID NO: 668044 - protein, 19 aa, Mycobacterium
GLESTALVVAGEACPTDVV

SEQ ID NO: 668045 - protein, 19 aa, Mycobacterium
GLESTALVVGGEACPTDVV

SEQ ID NO: 668046 - protein, 26 aa, Mycobacterium
GLETATCAAGAPVTPSAGDHTVAALA

SEQ ID NO: 668047 - protein, 20 aa, Mycobacterium
GLETLKLRWQAQPAMAGQLR

SEQ ID NO: 668048 - protein, 21 aa, Mycobacterium
GLETLSLRIERHVANAQRVAQ

SEQ ID NO: 668049 - protein, 20 aa, Mycobacterium
GLETLSLRIERHVQNAQRVA

SEQ ID NO: 668050 - protein, 21 aa, Mycobacterium
GLETLSLRIERHVSNAQRVAE

SEQ ID NO: 668051 - protein, 19 aa, Mycobacterium
GLETLSLRVERHVANAQKV

SEQ ID NO: 668052 - protein, 20 aa, Mycobacterium
GLETLSLRVERHVANAQRVA

SEQ ID NO: 668053 - protein, 19 aa, Mycobacterium
GLETMCIGGGQGLAAVFER

SEQ ID NO: 668054 - protein, 18 aa, Mycobacterium
GLETMCVGGGQGMAMIIE

SEQ ID NO: 668055 - protein, 25 aa, Mycobacterium
GLETRIGEIVTRLMARFPDVDPAAV

SEQ ID NO: 668056 - protein, 17 aa, Mycobacterium
GLEVEWAGAGGVVRVRP

SEQ ID NO: 668057 - protein, 20 aa, Mycobacterium
GLEVLKRLRADGNLVGVIMI

SEQ ID NO: 668058 - protein, 19 aa, Mycobacterium
GLEVPGNIYTRIGNPTTDV

SEQ ID NO: 668059 - protein, 24 aa, Mycobacterium
GLEVPLRVAVMGCVVNGPGEAREA

SEQ ID NO: 668060 - protein, 18 aa, Mycobacterium
GLEVPRDALLRLLVDMQY

SEQ ID NO: 668061 - protein, 18 aa, Mycobacterium
GLEYRGAVIGADHGELVA

SEQ ID NO: 668062 - protein, 24 aa, Mycobacterium
GLFAGWRTDPSFILNLEPFNRGTV

SEQ ID NO: 668063 - protein, 26 aa, Mycobacterium
GLFDPRLKRPIPFLPDTIGLITGRAS

SEQ ID NO: 668064 - protein, 29 aa, Mycobacterium
GLFDPRLKRPIPFLPNMVGLITGRASAAE

SEQ ID NO: 668065 - protein, 28 aa, Mycobacterium
GLFDPRLKRPIPFLPNTVGLITGRASAA

SEQ ID NO: 668066 - protein, 25 aa, Mycobacterium
GLFDPRLKRSIPFLPNTIGLITGRA

SEQ ID NO: 668067 - protein, 23 aa, Mycobacterium
GLFFSLPWFYRCGYDVVLYTRQG

SEQ ID NO: 668068 - protein, 24 aa, Mycobacterium
GLFGALRFARNVLLHRDARKRVLA

SEQ ID NO: 668069 - protein, 19 aa, Mycobacterium
GLFGYAVCQALQARDFEVG

SEQ ID NO: 668070 - protein, 31 aa, Mycobacterium
GLFHEVLRVVKFWISHGVKVFRVDNPHTKPP

SEQ ID NO: 668071 - protein, 25 aa, Mycobacterium
GLFIGRAAWQLPGYVRILEMAAAHP

SEQ ID NO: 668072 - protein, 18 aa, Mycobacterium
GLFLRLIADADLVIENFS

SEQ ID NO: 668073 - protein, 21 aa, Mycobacterium
GLGAADWQGPSALSMAAAAAP

SEQ ID NO: 668074 - protein, 23 aa, Mycobacterium
GLGAALLALGGRREPGAAVIAEH

SEQ ID NO: 668075 - protein, 22 aa, Mycobacterium
GLGAALTLLGLHHLESRLTGDG

SEQ ID NO: 668076 - protein, 26 aa, Mycobacterium
GLGAKSWTSIAWRILNREGVRVSADV

SEQ ID NO: 668077 - protein, 28 aa, Mycobacterium
GLGALGFSRGTLFDALSPTAGFARGTLV

SEQ ID NO: 668078 - protein, 18 aa, Mycobacterium
GLGAMFPGLMCHSADTVA

SEQ ID NO: 668079 - protein, 22 aa, Mycobacterium
GLGARLADLVLHGMATDLTRLR

SEQ ID NO: 668080 - protein, 28 aa, Mycobacterium
GLGAYGRWLRRPGRFPAHAQKLKVADAD

SEQ ID NO: 668081 - protein, 25 aa, Mycobacterium
GLGCELRHAHRLVYSEGLDLSGDIA

SEQ ID NO: 668082 - protein, 25 aa, Mycobacterium
GLGCELRHAHRLVYSEGLDLSGEIS

SEQ ID NO: 668083 - protein, 24 aa, Mycobacterium
GLGCELRHAHRLVYSEGLDLSGNV

SEQ ID NO: 668084 - protein, 24 aa, Mycobacterium
GLGCELRHAHRLVYSQGLDLSSEG

SEQ ID NO: 668085 - protein, 17 aa, Mycobacterium
GLGCKRPSMSNDYLRTF

SEQ ID NO: 668086 - protein, 19 aa, Mycobacterium
GLGCKRPSMSNEYLKTFNR

SEQ ID NO: 668087 - protein, 18 aa, Mycobacterium
GLGCLQISTPLRATVILQ

SEQ ID NO: 668088 - protein, 18 aa, Mycobacterium
GLGCRCLFGQSSFGQFEE

SEQ ID NO: 668089 - protein, 21 aa, Mycobacterium
GLGCSLVALSDIVYIAPDAYL

SEQ ID NO: 668090 - protein, 23 aa, Mycobacterium
GLGDAVGVLAGFPVEIAPTAQGL

SEQ ID NO: 668091 - protein, 19 aa, Mycobacterium
GLGDQRSAYCGNLSGGQRT

SEQ ID NO: 668092 - protein, 25 aa, Mycobacterium
GLGDRLNLPDGWRYRARTLDQTVRV

SEQ ID NO: 668093 - protein, 28 aa, Mycobacterium
GLGDRWAYFCGCCWKRIRQMQDRAAELV

SEQ ID NO: 668094 - protein, 20 aa, Mycobacterium
GLGDTRLAAEAKRLAYRLDA

SEQ ID NO: 668095 - protein, 29 aa, Mycobacterium
GLGEAVWNYNEIRAVVDPVGFGRTAEGAL

SEQ ID NO: 668096 - protein, 20 aa, Mycobacterium
GLGEGFARRYAVDGYDLVLV

SEQ ID NO: 668097 - protein, 18 aa, Mycobacterium
GLGEHLRAGPPELLILAG

SEQ ID NO: 668098 - protein, 19 aa, Mycobacterium
GLGEIFTAAGAEWRQAGCS

SEQ ID NO: 668099 - protein, 17 aa, Mycobacterium
GLGEKDLSLALALGESV

SEQ ID NO: 668100 - protein, 17 aa, Mycobacterium
GLGEKDLSLALALGGAV

SEQ ID NO: 668101 - protein, 17 aa, Mycobacterium
GLGEPHPISAMHGRGVA

SEQ ID NO: 668102 - protein, 24 aa, Mycobacterium
GLGERGLACPLLVISDGAPGLIGA

SEQ ID NO: 668103 - protein, 18 aa, Mycobacterium
GLGFAKTGQHNWALLHAL

SEQ ID NO: 668104 - protein, 17 aa, Mycobacterium
GLGFPPQRHLDFLRHDR

SEQ ID NO: 668105 - protein, 23 aa, Mycobacterium
GLGFSMKWNMGWMHDTLDYVGRD

SEQ ID NO: 668106 - protein, 20 aa, Mycobacterium
GLGFSMKWNMGWMHDTLGYL

SEQ ID NO: 668107 - protein, 20 aa, Mycobacterium
GLGFSMKWNMGWMNDTLEFI

SEQ ID NO: 668108 - protein, 19 aa, Mycobacterium
GLGGCPFAPGAAGNIGADD

SEQ ID NO: 668109 - protein, 18 aa, Mycobacterium
GLGGCPFAPGASGNTSSE

SEQ ID NO: 668110 - protein, 21 aa, Mycobacterium
GLGGLECLSGIPGSAGATPVQ

SEQ ID NO: 668111 - protein, 22 aa, Mycobacterium
GLGGLECLSGIPGSAGATPVQN

SEQ ID NO: 668112 - protein, 23 aa, Mycobacterium
GLGGLECLSGIPGTAGATPVQNV

SEQ ID NO: 668113 - protein, 18 aa, Mycobacterium
GLGGLLYGSGGAGGTGGA

SEQ ID NO: 668114 - protein, 26 aa, Mycobacterium
GLGGLTLPMLRSWLAAHAAAGTARST

SEQ ID NO: 668115 - protein, 28 aa, Mycobacterium
GLGGNGGDATGFGMTGGDGAMGGAGGAA

SEQ ID NO: 668116 - protein, 20 aa, Mycobacterium
GLGGRHAAFARLHHAGHQEH

SEQ ID NO: 668117 - protein, 17 aa, Mycobacterium
GLGGRKLGDEWSQGTFA

SEQ ID NO: 668118 - protein, 19 aa, Mycobacterium
GLGGSMGWADPKRKIAVGF

SEQ ID NO: 668119 - protein, 18 aa, Mycobacterium
GLGHPLLPPWTVTESGPN

SEQ ID NO: 668120 - protein, 17 aa, Mycobacterium
GLGIALLPMIGRLPDGL

SEQ ID NO: 668121 - protein, 18 aa, Mycobacterium
GLGIIFRKGLPLEDMEFH

SEQ ID NO: 668122 - protein, 17 aa, Mycobacterium
GLGIWQWASTATGEPDV

SEQ ID NO: 668123 - protein, 19 aa, Mycobacterium
GLGKPQWDLIGIKYYTGGE

SEQ ID NO: 668124 - protein, 24 aa, Mycobacterium
GLGLDLAWRIVVEKHKGNLTVQSQ

SEQ ID NO: 668125 - protein, 21 aa, Mycobacterium
GLGLDLAWRIVVEKHNGDLRV

SEQ ID NO: 668126 - protein, 26 aa, Mycobacterium
GLGLYPCPPFALLDGQDHWLLRPPPK

SEQ ID NO: 668127 - protein, 18 aa, Mycobacterium
GLGMAEAELGAFLRTVDR

SEQ ID NO: 668128 - protein, 17 aa, Mycobacterium
GLGMGGAGFDMGDLGQI

SEQ ID NO: 668129 - protein, 18 aa, Mycobacterium
GLGMGWVSLFDPHRLADL

SEQ ID NO: 668130 - protein, 18 aa, Mycobacterium
GLGMGWVSLFDPRRLAAL

SEQ ID NO: 668131 - protein, 18 aa, Mycobacterium
GLGNCLRRDDGVGVVAAD

SEQ ID NO: 668132 - protein, 25 aa, Mycobacterium
GLGPADTCYLSMPLFHSNAIMAGWA

SEQ ID NO: 668133 - protein, 17 aa, Mycobacterium
GLGPFLLQVGTHEMLLN

SEQ ID NO: 668134 - protein, 25 aa, Mycobacterium
GLGPFPGALWLQVRDIAATQAELES

SEQ ID NO: 668135 - protein, 20 aa, Mycobacterium
GLGPQLRVGQLLDLVGQGVD

SEQ ID NO: 668136 - protein, 24 aa, Mycobacterium
GLGPWDWAAGALIAREAGAVVILP

SEQ ID NO: 668137 - protein, 23 aa, Mycobacterium
GLGRAALVGKLSVPQTWTVANPA

SEQ ID NO: 668138 - protein, 20 aa, Mycobacterium
GLGRACASALIAEGVSVVIN

SEQ ID NO: 668139 - protein, 17 aa, Mycobacterium
GLGREYALTLAKEGASV

SEQ ID NO: 668140 - protein, 18 aa, Mycobacterium
GLGREYALTLAREGASVV

SEQ ID NO: 668141 - protein, 17 aa, Mycobacterium
GLGRGYRLLQLFDGAGL

SEQ ID NO: 668142 - protein, 29 aa, Mycobacterium
GLGRIGQLFAQRLAAFGTHIVAYDPYVSA

SEQ ID NO: 668143 - protein, 20 aa, Mycobacterium
GLGRLRLPRYGALTYPRHMR

SEQ ID NO: 668144 - protein, 18 aa, Mycobacterium
GLGRNFLQQLGILKPDDT

SEQ ID NO: 668145 - protein, 28 aa, Mycobacterium
GLGRRAYRPLRRCIQVVYQNPYSSFDPR

SEQ ID NO: 668146 - protein, 24 aa, Mycobacterium
GLGRRELLPYSDLDLVLVHDGKPV

SEQ ID NO: 668147 - protein, 22 aa, Mycobacterium
GLGRRYHCLAVDLKGYGQSDKR

SEQ ID NO: 668148 - protein, 17 aa, Mycobacterium
GLGRTFQIPALFTNMTV

SEQ ID NO: 668149 - protein, 29 aa, Mycobacterium
GLGRTLIEVPVGFKWFVNGLIDGTIGFGG

SEQ ID NO: 668150 - protein, 18 aa, Mycobacterium
GLGSFPPGGALVVGNHSG

SEQ ID NO: 668151 - protein, 23 aa, Mycobacterium
GLGSLPWEGLKLAPGEPAIPTQT

SEQ ID NO: 668152 - protein, 21 aa, Mycobacterium
GLGTALVEWAHNYGRAHGAQL

SEQ ID NO: 668153 - protein, 22 aa, Mycobacterium
GLGTALVEWAHNYGRAHGAQLA

SEQ ID NO: 668154 - protein, 26 aa, Mycobacterium
GLGTVAVTPIMHWLRDVDGPIVEFNQ

SEQ ID NO: 668155 - protein, 26 aa, Mycobacterium
GLGVDGCRWGAVALRSGERARRREAV

SEQ ID NO: 668156 - protein, 17 aa, Mycobacterium
GLGVGEAGASYLAGDTA

SEQ ID NO: 668157 - protein, 24 aa, Mycobacterium
GLGVHTWGALGFGYAELGTVTAQA

SEQ ID NO: 668158 - protein, 18 aa, Mycobacterium
GLGVKRTPALAARFATEF

SEQ ID NO: 668159 - protein, 19 aa, Mycobacterium
GLGWGGSPLSGLLRGSEPG

SEQ ID NO: 668160 - protein, 26 aa, Mycobacterium
GLGYVRRAGLTGSRFVACPFGAPGAR

SEQ ID NO: 668161 - protein, 27 aa, Mycobacterium
GLGYYGSRWRLAFGYPAARFDALSEDI

SEQ ID NO: 668162 - protein, 23 aa, Mycobacterium
GLHAFCGFDDLFSLADSEPGSQN

SEQ ID NO: 668163 - protein, 17 aa, Mycobacterium
GLHAFVADFARKAENLT

SEQ ID NO: 668164 - protein, 18 aa, Mycobacterium
GLHFCLGSALARLEARVA

SEQ ID NO: 668165 - protein, 24 aa, Mycobacterium
GLHFCLGSALARMEARVAFEEVLK

SEQ ID NO: 668166 - protein, 24 aa, Mycobacterium
GLHFCLGSALARMEGRVALEEVLK

SEQ ID NO: 668167 - protein, 18 aa, Mycobacterium
GLHFFLVVFPQSGRVVNG

SEQ ID NO: 668168 - protein, 23 aa, Mycobacterium
GLHFICRDVWLRVASTSTAWTSR

SEQ ID NO: 668169 - protein, 23 aa, Mycobacterium
GLHFVCRDVWLRVASTSTAWTSR

SEQ ID NO: 668170 - protein, 18 aa, Mycobacterium
GLHGELLPELGLDAATLE

SEQ ID NO: 668171 - protein, 18 aa, Mycobacterium
GLHGLHVHEIGKCEPNSV

SEQ ID NO: 668172 - protein, 18 aa, Mycobacterium
GLHGVSFARPLARMRETV

SEQ ID NO: 668173 - protein, 19 aa, Mycobacterium
GLHLASLAGAWTALVGGFG

SEQ ID NO: 668174 - protein, 17 aa, Mycobacterium
GLHLQALQLRWFEHWLK

SEQ ID NO: 668175 - protein, 18 aa, Mycobacterium
GLHPRLGEHQTFALRADA

SEQ ID NO: 668176 - protein, 17 aa, Mycobacterium
GLHPTNLGRLVLNNPAP

SEQ ID NO: 668177 - protein, 30 aa, Mycobacterium
GLHPYRVRHLLDRYGSLIGEVLACAGTDHS

SEQ ID NO: 668178 - protein, 24 aa, Mycobacterium
GLHPYRVRHLLDRYGSLINEVLEL

SEQ ID NO: 668179 - protein, 17 aa, Mycobacterium
GLHQALRLGKPLQFHVG

SEQ ID NO: 668180 - protein, 20 aa, Mycobacterium
GLHTALGRQGNGGAGGHGGS

SEQ ID NO: 668181 - protein, 21 aa, Mycobacterium
GLHVLRLAASGVFDRHPALQF

SEQ ID NO: 668182 - protein, 24 aa, Mycobacterium
GLHVPALIVDPGLNILAMNPYATV

SEQ ID NO: 668183 - protein, 19 aa, Mycobacterium
GLHYCLGANLARLEGRVAL

SEQ ID NO: 668184 - protein, 26 aa, Mycobacterium
GLIAEYGISWILPRLAGWGAAMDLLL

SEQ ID NO: 668185 - protein, 18 aa, Mycobacterium
GLIAPMRPDRYLKIAAAM

SEQ ID NO: 668186 - protein, 18 aa, Mycobacterium
GLIAQPGLAHYVSAKHGV

SEQ ID NO: 668187 - protein, 17 aa, Mycobacterium
GLICRVSVFFKQRRADA

SEQ ID NO: 668188 - protein, 19 aa, Mycobacterium
GLIDGRFPAGITAWNAAHQ

SEQ ID NO: 668189 - protein, 19 aa, Mycobacterium
GLIDGRPVGVFSHDQTVFG

SEQ ID NO: 668190 - protein, 21 aa, Mycobacterium
GLIDPDAWAFTWVVDAPLFEP

SEQ ID NO: 668191 - protein, 20 aa, Mycobacterium
GLIEELGRVLVPPRGTVKAT

SEQ ID NO: 668192 - protein, 18 aa, Mycobacterium
GLIELTRDRVRGIIHQGG

SEQ ID NO: 668193 - protein, 25 aa, Mycobacterium
GLIEPARAAFEWCRTVQRADGSWPI

SEQ ID NO: 668194 - protein, 17 aa, Mycobacterium
GLIERAAARGLVVKTAD

SEQ ID NO: 668195 - protein, 18 aa, Mycobacterium
GLIGAAPLSSPVPKALAA

SEQ ID NO: 668196 - protein, 17 aa, Mycobacterium
GLIGAPRIRVVCGGQAH

SEQ ID NO: 668197 - protein, 18 aa, Mycobacterium
GLIGGDFSGIVTEVGAGV

SEQ ID NO: 668198 - protein, 25 aa, Mycobacterium
GLIGLKTHCKTCLVVRREGSAIRRY

SEQ ID NO: 668199 - protein, 28 aa, Mycobacterium
GLIGLWPMGFRRLGMRDVDDFARHASYL

SEQ ID NO: 668200 - protein, 17 aa, Mycobacterium
GLIHPRSGLAARVGLSI

SEQ ID NO: 668201 - protein, 18 aa, Mycobacterium
GLIHSVAVNPLFLVLSGG

SEQ ID NO: 668202 - protein, 17 aa, Mycobacterium
GLIKARDPQCVPIADAL

SEQ ID NO: 668203 - protein, 22 aa, Mycobacterium
GLIKTILCLKHQAIPATLHYTS

SEQ ID NO: 668204 - protein, 26 aa, Mycobacterium
GLILSLPGVTQWKSLRRVPVGGEALP

SEQ ID NO: 668205 - protein, 29 aa, Mycobacterium
GLINHAICAARTGLDVYSWTEKQVVGALR

SEQ ID NO: 668206 - protein, 21 aa, Mycobacterium
GLIPEDMFPAIDMNSPADYLP

SEQ ID NO: 668207 - protein, 26 aa, Mycobacterium
GLIRDDLRLLPPWRGSSSFPGKIPVS

SEQ ID NO: 668208 - protein, 25 aa, Mycobacterium
GLIRPSVGIAEWILPTIISAGTEDL

SEQ ID NO: 668209 - protein, 19 aa, Mycobacterium
GLIRRLGVHEVPRLQLRDA

SEQ ID NO: 668210 - protein, 18 aa, Mycobacterium
GLIRRLGVHQVPTRPLRE

SEQ ID NO: 668211 - protein, 18 aa, Mycobacterium
GLIRSAGVLGGLRARHVV

SEQ ID NO: 668212 - protein, 25 aa, Mycobacterium
GLIRSARHARKLGFGGKQVIHPSQI

SEQ ID NO: 668213 - protein, 31 aa, Mycobacterium
GLIRTALFNWAYARHCGGDFVFRIEDTDAGR

SEQ ID NO: 668214 - protein, 18 aa, Mycobacterium
GLIRTDTLLEFARGNGIE

SEQ ID NO: 668215 - protein, 17 aa, Mycobacterium
GLISFLAARGYDCRGTE

SEQ ID NO: 668216 - protein, 19 aa, Mycobacterium
GLISKPTLFNVVPRGKTPP

SEQ ID NO: 668217 - protein, 17 aa, Mycobacterium
GLITPSLTSPAFYPYAI

SEQ ID NO: 668218 - protein, 19 aa, Mycobacterium
GLIYIPGLFAFTDELVALV

SEQ ID NO: 668219 - protein, 17 aa, Mycobacterium
GLIYRALGFPTRMFTVL

SEQ ID NO: 668220 - protein, 18 aa, Mycobacterium
GLIYRALGFPVRMFTVLF

SEQ ID NO: 668221 - protein, 22 aa, Mycobacterium
GLKDEVWPKFLYGNAARILGLT

SEQ ID NO: 668222 - protein, 22 aa, Mycobacterium
GLKGLYEFFTPLLRNLGHSGRV

SEQ ID NO: 668223 - protein, 20 aa, Mycobacterium
GLKPPAPVRYPLSDGVAALQ

SEQ ID NO: 668224 - protein, 18 aa, Mycobacterium
GLKPQLVHYYFRTMDELF

SEQ ID NO: 668225 - protein, 21 aa, Mycobacterium
GLKSYRGDMINGFAPDAAARE

SEQ ID NO: 668226 - protein, 21 aa, Mycobacterium
GLKSYRGDMINGFAPDAAVRE

SEQ ID NO: 668227 - protein, 19 aa, Mycobacterium
GLKSYRGDMVNGFAPDAAV

SEQ ID NO: 668228 - protein, 19 aa, Mycobacterium
GLKSYRGDMVNGFAPDATL

SEQ ID NO: 668229 - protein, 22 aa, Mycobacterium
GLKVFGYHGVFEHERRDGQEFS

SEQ ID NO: 668230 - protein, 19 aa, Mycobacterium
GLKVLTIAPWVSRGSTKLS

SEQ ID NO: 668231 - protein, 22 aa, Mycobacterium
GLKVRGQHGVFDHERASGQDFV

SEQ ID NO: 668232 - protein, 25 aa, Mycobacterium
GLKYPARLIDEYAWETDLGDKVISL

SEQ ID NO: 668233 - protein, 19 aa, Mycobacterium
GLLACNCYVLAPRQGADAI

SEQ ID NO: 668234 - protein, 25 aa, Mycobacterium
GLLAEFKPEVIFHLAAQISVKRSVD

SEQ ID NO: 668235 - protein, 24 aa, Mycobacterium
GLLAFTYRQEWPLVDATQFLVNYI

SEQ ID NO: 668236 - protein, 17 aa, Mycobacterium
GLLAFYATIGSIKNIQS

SEQ ID NO: 668237 - protein, 19 aa, Mycobacterium
GLLAGLFGSGGGNGGNGGF

SEQ ID NO: 668238 - protein, 18 aa, Mycobacterium
GLLAGLVGAGGGHGGTGG

SEQ ID NO: 668239 - protein, 19 aa, Mycobacterium
GLLAGNIRAFFDGKPLRAY

SEQ ID NO: 668240 - protein, 18 aa, Mycobacterium
GLLAKWNAREAALIATDP

SEQ ID NO: 668241 - protein, 32 aa, Mycobacterium
GLLAKYAIEHWTRLPVEIELASEFRYRDPVLD

SEQ ID NO: 668242 - protein, 18 aa, Mycobacterium
GLLALGGRCESGAAIIAH

SEQ ID NO: 668243 - protein, 21 aa, Mycobacterium
GLLAPHWPPPYGRGASAAEQL

SEQ ID NO: 668244 - protein, 33 aa, Mycobacterium
GLLAPLTFICVFGYKAQSAFFKHANIAVQDAQI

SEQ ID NO: 668245 - protein, 27 aa, Mycobacterium
GLLAPLTFICVFGYQAQTAFFKYANVA

SEQ ID NO: 668246 - protein, 26 aa, Mycobacterium
GLLAPPALLMGWLIPPPWEPQGRPPV

SEQ ID NO: 668247 - protein, 26 aa, Mycobacterium
GLLAPPALLMGWLIPPPWQPGGRVPA

SEQ ID NO: 668248 - protein, 25 aa, Mycobacterium
GLLAPPALLMGWLITPPWQPGGRRS

SEQ ID NO: 668249 - protein, 18 aa, Mycobacterium
GLLARAGVAVDERDDLPP

SEQ ID NO: 668250 - protein, 25 aa, Mycobacterium
GLLARRLVDVTGWLAAQPDTTALPV

SEQ ID NO: 668251 - protein, 25 aa, Mycobacterium
GLLARRLVDVTGWLAGQPDTASLPV

SEQ ID NO: 668252 - protein, 30 aa, Mycobacterium
GLLARRRGWFEARWVRIAMYHRAARWSDVV

SEQ ID NO: 668253 - protein, 24 aa, Mycobacterium
GLLAYDICRPFSLAVNGSSISEWR

SEQ ID NO: 668254 - protein, 22 aa, Mycobacterium
GLLCGSEGGFAATLRATVALTP

SEQ ID NO: 668255 - protein, 17 aa, Mycobacterium
GLLCLPTLSTHGYEVIA

SEQ ID NO: 668256 - protein, 25 aa, Mycobacterium
GLLDDRVRFIPGWFKDTLQDAPIES

SEQ ID NO: 668257 - protein, 17 aa, Mycobacterium
GLLDEFPLRDLLTRGTQ

SEQ ID NO: 668258 - protein, 24 aa, Mycobacterium
GLLDGMGAVVVRLLGGRRGWEEGI

SEQ ID NO: 668259 - protein, 25 aa, Mycobacterium
GLLDGQRVTTHWAFAERLASEFPAI

SEQ ID NO: 668260 - protein, 33 aa, Mycobacterium
GLLDGRRATSHWLTIPALKAFGAIPVADERIVH

SEQ ID NO: 668261 - protein, 33 aa, Mycobacterium
GLLDGRRATSHWLTIPALKAFGAVPVADERVVH

SEQ ID NO: 668262 - protein, 26 aa, Mycobacterium
GLLDGRRATTHWAFADRLAREFPAVE

SEQ ID NO: 668263 - protein, 26 aa, Mycobacterium
GLLDGRRATTHWAHCQTLARQYPAVM

SEQ ID NO: 668264 - protein, 25 aa, Mycobacterium
GLLDGRRATTHWHDARLLARAFRDV

SEQ ID NO: 668265 - protein, 33 aa, Mycobacterium
GLLDGRRVTTHWAFADRLAREFPAIDVDADPIF

SEQ ID NO: 668266 - protein, 17 aa, Mycobacterium
GLLDLPALTALVSDSRL

SEQ ID NO: 668267 - protein, 22 aa, Mycobacterium
GLLDLSCLWQVYGVDRPALKDP

SEQ ID NO: 668268 - protein, 19 aa, Mycobacterium
GLLDRALELAGRIAELAPL

SEQ ID NO: 668269 - protein, 23 aa, Mycobacterium
GLLDRLDHMLSYHAMYGTWQALG

SEQ ID NO: 668270 - protein, 17 aa, Mycobacterium
GLLDRLDHMLSYHEMYG

SEQ ID NO: 668271 - protein, 20 aa, Mycobacterium
GLLEACWERLPIGGRMVVNA

SEQ ID NO: 668272 - protein, 28 aa, Mycobacterium
GLLEGYRAASHWAFREFLSAYGAIPDDR

SEQ ID NO: 668273 - protein, 22 aa, Mycobacterium
GLLELCGAPSIPVSRGADEPLH

SEQ ID NO: 668274 - protein, 25 aa, Mycobacterium
GLLEPARAAFDWSRRTQRSDGSWPI

SEQ ID NO: 668275 - protein, 18 aa, Mycobacterium
GLLEQQLGGSLYEVLESQ

SEQ ID NO: 668276 - protein, 24 aa, Mycobacterium
GLLGALRFARNVLVHRDARKRVLT

SEQ ID NO: 668277 - protein, 27 aa, Mycobacterium
GLLGGAALAGWAARGTIGGGRSSATDK

SEQ ID NO: 668278 - protein, 18 aa, Mycobacterium
GLLGGLVGAGGGAGGNGG

SEQ ID NO: 668279 - protein, 18 aa, Mycobacterium
GLLGGLVGAGGGDGGAGG

SEQ ID NO: 668280 - protein, 19 aa, Mycobacterium
GLLGGLVGAGGGDGGAGGA

SEQ ID NO: 668281 - protein, 19 aa, Mycobacterium
GLLGGLVGAGGGDGGAGGY

SEQ ID NO: 668282 - protein, 25 aa, Mycobacterium
GLLGMKWDLLCPNCRGTKVSVATLS

SEQ ID NO: 668283 - protein, 18 aa, Mycobacterium
GLLGRGGAAFPLAVKLRT

SEQ ID NO: 668284 - protein, 19 aa, Mycobacterium
GLLGRIALGSVTDRLVHTA

SEQ ID NO: 668285 - protein, 35 aa, Mycobacterium
GLLGRLDYLQWLGIDCIWLPPFYDSPLRDGGYDIR

SEQ ID NO: 668286 - protein, 25 aa, Mycobacterium
GLLGSLRIGNRFVHTGKPKPEAYAH

SEQ ID NO: 668287 - protein, 24 aa, Mycobacterium
GLLGSLRVGNRFIHTGKPTPEGYA

SEQ ID NO: 668288 - protein, 25 aa, Mycobacterium
GLLGSLRVGNRFVHTGKPTAAGYAQ

SEQ ID NO: 668289 - protein, 25 aa, Mycobacterium
GLLGSLRVGNRFVHTGKPTPAGYAA

SEQ ID NO: 668290 - protein, 24 aa, Mycobacterium
GLLGSLRVGNRFVHTVKPTPEAYA

SEQ ID NO: 668291 - protein, 19 aa, Mycobacterium
GLLGTRPSYELMMGCDTLL

SEQ ID NO: 668292 - protein, 24 aa, Mycobacterium
GLLGTRPSYELMRDCDTLLIVGTN

SEQ ID NO: 668293 - protein, 21 aa, Mycobacterium
GLLGTRPSYELMRDCDTLLTV

SEQ ID NO: 668294 - protein, 17 aa, Mycobacterium
GLLHHAPSLLAFTNPTV

SEQ ID NO: 668295 - protein, 18 aa, Mycobacterium
GLLHLAVLGSPVAHARIV

SEQ ID NO: 668296 - protein, 32 aa, Mycobacterium
GLLINFPASQFLKFAPHPGLGPLPKDALGGGL

SEQ ID NO: 668297 - protein, 32 aa, Mycobacterium
GLLINFPVSQWLKFAPPIAYGALPKDALGAGL

SEQ ID NO: 668298 - protein, 26 aa, Mycobacterium
GLLKGACAQVNMDLGLLAPEKAEAII

SEQ ID NO: 668299 - protein, 25 aa, Mycobacterium
GLLKRYLEVDGAWRDHLLVAITAEE

SEQ ID NO: 668300 - protein, 22 aa, Mycobacterium
GLLLARAGVRVTLMEKHGDFLR

SEQ ID NO: 668301 - protein, 17 aa, Mycobacterium
GLLLGQRIGAAGFTTLY

SEQ ID NO: 668302 - protein, 18 aa, Mycobacterium
GLLLSRGASDITVLCVCA

SEQ ID NO: 668303 - protein, 27 aa, Mycobacterium
GLLLSRKAYLRMLSRIAGMGFLVVAVD

SEQ ID NO: 668304 - protein, 26 aa, Mycobacterium
GLLMAHCRGAKAFLHCSSAAVYDPPD

SEQ ID NO: 668305 - protein, 26 aa, Mycobacterium
GLLNGRRATTHWAHCQTLARNYPHVR

SEQ ID NO: 668306 - protein, 25 aa, Mycobacterium
GLLPERRLRSAMFTCEPFDIAELHS

SEQ ID NO: 668307 - protein, 25 aa, Mycobacterium
GLLPFGEPNPRFGPVGDHDGLFILV

SEQ ID NO: 668308 - protein, 17 aa, Mycobacterium
GLLPGYGHIGLGGTLGW

SEQ ID NO: 668309 - protein, 18 aa, Mycobacterium
GLLPIKIPIIDIAAAPGF

SEQ ID NO: 668310 - protein, 19 aa, Mycobacterium
GLLPPSFALVGFARRDWAN

SEQ ID NO: 668311 - protein, 25 aa, Mycobacterium
GLLPREALNLIRLISEPGLNGIEVV

SEQ ID NO: 668312 - protein, 23 aa, Mycobacterium
GLLPVAEIMIMDFIGIAADQLIN

SEQ ID NO: 668313 - protein, 20 aa, Mycobacterium
GLLPVDCRFCHVRVTVRRLG

SEQ ID NO: 668314 - protein, 17 aa, Mycobacterium
GLLPYLPADAQDRLFEL

SEQ ID NO: 668315 - protein, 26 aa, Mycobacterium
GLLQGGRHVFIPSFEPVTVMQAIAQH

SEQ ID NO: 668316 - protein, 17 aa, Mycobacterium
GLLRAGAVPVMCLPGHR

SEQ ID NO: 668317 - protein, 24 aa, Mycobacterium
GLLRCGRCGNRLYSQARHVNPDNR

SEQ ID NO: 668318 - protein, 21 aa, Mycobacterium
GLLRCRRCGNRLYSQARHSNP

SEQ ID NO: 668319 - protein, 18 aa, Mycobacterium
GLLRCTATADAGRVTIGL

SEQ ID NO: 668320 - protein, 19 aa, Mycobacterium
GLLRDDRLGTGILQHVGHE

SEQ ID NO: 668321 - protein, 18 aa, Mycobacterium
GLLREVFEQYSPVRDVEA

SEQ ID NO: 668322 - protein, 32 aa, Mycobacterium
GLLRLPMAMPMLRLGGAVARATFGRASMARDI

SEQ ID NO: 668323 - protein, 28 aa, Mycobacterium
GLLRLPQRIPSAIAMELALTGDNLPAER

SEQ ID NO: 668324 - protein, 28 aa, Mycobacterium
GLLRLPQRIPSAIAMELALTGENLSAER

SEQ ID NO: 668325 - protein, 18 aa, Mycobacterium
GLLRPQAADTLVRALRSR

SEQ ID NO: 668326 - protein, 23 aa, Mycobacterium
GLLRPVNGTAFALTPMLREAYAE

SEQ ID NO: 668327 - protein, 18 aa, Mycobacterium
GLLRRAGGEIADALLEEI

SEQ ID NO: 668328 - protein, 17 aa, Mycobacterium
GLLRYGIPEFKMEKHHI

SEQ ID NO: 668329 - protein, 17 aa, Mycobacterium
GLLRYGIPEFKMEKRHI

SEQ ID NO: 668330 - protein, 18 aa, Mycobacterium
GLLRYRLPDGSALDDTEV

SEQ ID NO: 668331 - protein, 18 aa, Mycobacterium
GLLSAWRGPNGQDLVSND

SEQ ID NO: 668332 - protein, 25 aa, Mycobacterium
GLLSDARKLLRPKLKDHYGERLEAL

SEQ ID NO: 668333 - protein, 18 aa, Mycobacterium
GLLSGLVGAGGGHGGTGG

SEQ ID NO: 668334 - protein, 20 aa, Mycobacterium
GLLSNAFAGVIPRPATNPTL

SEQ ID NO: 668335 - protein, 28 aa, Mycobacterium
GLLTCAIRPSGIWGRGDQTMFRKLFESV

SEQ ID NO: 668336 - protein, 28 aa, Mycobacterium
GLLTCSIRPSGIWGRGDQTMFRKVFESV

SEQ ID NO: 668337 - protein, 17 aa, Mycobacterium
GLLTIGFAGHDGGRMAA

SEQ ID NO: 668338 - protein, 27 aa, Mycobacterium
GLLTLEGTNTWVLRGPRSDELVVVDPG

SEQ ID NO: 668339 - protein, 24 aa, Mycobacterium
GLLTLEGTNTWVLRGRGSDELVVV

SEQ ID NO: 668340 - protein, 17 aa, Mycobacterium
GLLTQLGIRRYAIYVQD

SEQ ID NO: 668341 - protein, 22 aa, Mycobacterium
GLLTRLMYRYAKKRFGEVPEPF

SEQ ID NO: 668342 - protein, 17 aa, Mycobacterium
GLLTRLSAFKVPHRLAV

SEQ ID NO: 668343 - protein, 32 aa, Mycobacterium
GLLVNFPLSQWLKFAPPIAYGALPKDALGAGL

SEQ ID NO: 668344 - protein, 19 aa, Mycobacterium
GLLVPREYGGSGLSIAQYL

SEQ ID NO: 668345 - protein, 25 aa, Mycobacterium
GLLYAARRSPVAWTDRDRAELLSLA

SEQ ID NO: 668346 - protein, 19 aa, Mycobacterium
GLLYFPVMGANEIWRIDPD

SEQ ID NO: 668347 - protein, 20 aa, Mycobacterium
GLLYFPVMGANEIWRIHPDG

SEQ ID NO: 668348 - protein, 20 aa, Mycobacterium
GLLYFPVMGANEIWRVDPDG

SEQ ID NO: 668349 - protein, 18 aa, Mycobacterium
GLLYGYGGARLLDRQLDL

SEQ ID NO: 668350 - protein, 24 aa, Mycobacterium
GLMADWPEFPFAYGGVDDEHPNAF

SEQ ID NO: 668351 - protein, 18 aa, Mycobacterium
GLMALGVDKGDRVGIWAP

SEQ ID NO: 668352 - protein, 17 aa, Mycobacterium
GLMDKFPIGAVMNRSLT

SEQ ID NO: 668353 - protein, 24 aa, Mycobacterium
GLMDQAWWFPAFAPLPGGEPTVML

SEQ ID NO: 668354 - protein, 18 aa, Mycobacterium
GLMECARVLRPGGSLVLV

SEQ ID NO: 668355 - protein, 18 aa, Mycobacterium
GLMGALCQGGHRVAPFKV

SEQ ID NO: 668356 - protein, 18 aa, Mycobacterium
GLMGASPFSNHPMLGGSG

SEQ ID NO: 668357 - protein, 17 aa, Mycobacterium
GLMGFALRPLRLATVVP

SEQ ID NO: 668358 - protein, 18 aa, Mycobacterium
GLMGPFVVDSQRPVVLSL

SEQ ID NO: 668359 - protein, 18 aa, Mycobacterium
GLMHVKFGQYHVRDVKFV

SEQ ID NO: 668360 - protein, 20 aa, Mycobacterium
GLMHVRFGQYHVRDVKFVAA

SEQ ID NO: 668361 - protein, 20 aa, Mycobacterium
GLMKAIGLAPRRQREVGSWI

SEQ ID NO: 668362 - protein, 17 aa, Mycobacterium
GLMKQKWPERLVLVDEF

SEQ ID NO: 668363 - protein, 21 aa, Mycobacterium
GLMLGEYWDLGPLAADCAADG

SEQ ID NO: 668364 - protein, 19 aa, Mycobacterium
GLMLGEYWDLTALAADCAA

SEQ ID NO: 668365 - protein, 19 aa, Mycobacterium
GLMLGEYWDLTALAADCAT

SEQ ID NO: 668366 - protein, 19 aa, Mycobacterium
GLMLGEYWDLTALADDCAR

SEQ ID NO: 668367 - protein, 17 aa, Mycobacterium
GLMLLDFEEHMFHRRIM

SEQ ID NO: 668368 - protein, 19 aa, Mycobacterium
GLMLSVAVHDRCPGNRTLR

SEQ ID NO: 668369 - protein, 26 aa, Mycobacterium
GLMMSLNMLIEFGDAFDYTGADFRKW

SEQ ID NO: 668370 - protein, 24 aa, Mycobacterium
GLMPRPVYDALIWCTFSGVHLPPP

SEQ ID NO: 668371 - protein, 19 aa, Mycobacterium
GLMSGLVSQLAKSAMPLAM

SEQ ID NO: 668372 - protein, 22 aa, Mycobacterium
GLMTLDGTNTWVLRGPGSDEMV

SEQ ID NO: 668373 - protein, 24 aa, Mycobacterium
GLMTLEGTNTWVLCGPGSDELVIV

SEQ ID NO: 668374 - protein, 27 aa, Mycobacterium
GLMTLEGTNTWVLRAPRSDEIVVVDPG

SEQ ID NO: 668375 - protein, 27 aa, Mycobacterium
GLMTLEGTNTWVLRGPRSDELVIVDPG

SEQ ID NO: 668376 - protein, 19 aa, Mycobacterium
GLMYRCFAEIADPPDGSGC

SEQ ID NO: 668377 - protein, 24 aa, Mycobacterium
GLNAEWRMLQVLTVEGDRVDRCEL

SEQ ID NO: 668378 - protein, 19 aa, Mycobacterium
GLNAIGISAIAGRVSGTIL

SEQ ID NO: 668379 - protein, 19 aa, Mycobacterium
GLNAVIRAVVRTCANRYNS

SEQ ID NO: 668380 - protein, 29 aa, Mycobacterium
GLNAVIRAVVRTCDARYGSSVVGFLDGWR

SEQ ID NO: 668381 - protein, 25 aa, Mycobacterium
GLNAVIRAVVRTCDQRYGSSVVGFL

SEQ ID NO: 668382 - protein, 27 aa, Mycobacterium
GLNAVIRAVVRTCDSRYGSSVVGFQDG

SEQ ID NO: 668383 - protein, 23 aa, Mycobacterium
GLNERYVREWLAGMTTGRVVDYD

SEQ ID NO: 668384 - protein, 24 aa, Mycobacterium
GLNERYVREWLGGLVAAKVIEYAP

SEQ ID NO: 668385 - protein, 23 aa, Mycobacterium
GLNERYVREWLGGVAAGRIVDYD

SEQ ID NO: 668386 - protein, 30 aa, Mycobacterium
GLNFGPKATWAHKSTEDFEPLTATSYLAAV

SEQ ID NO: 668387 - protein, 17 aa, Mycobacterium
GLNHLVSLGLRPPPPQR

SEQ ID NO: 668388 - protein, 24 aa, Mycobacterium
GLNIPTGIPLRYDLDAELRPVVSG

SEQ ID NO: 668389 - protein, 21 aa, Mycobacterium
GLNIPTGIPLRYDLDERLQPV

SEQ ID NO: 668390 - protein, 22 aa, Mycobacterium
GLNIPTGIPLRYDLDESLKPLV

SEQ ID NO: 668391 - protein, 20 aa, Mycobacterium
GLNIPTGVPLRYDLDRQLRP

SEQ ID NO: 668392 - protein, 24 aa, Mycobacterium
GLNLPGIAFGHDWLTSATRYSGLL

SEQ ID NO: 668393 - protein, 26 aa, Mycobacterium
GLNLPGVAFGHDWLTGAARYAGLLEH

SEQ ID NO: 668394 - protein, 25 aa, Mycobacterium
GLNLPGVAFGHEWLAGAARYSNLLE

SEQ ID NO: 668395 - protein, 23 aa, Mycobacterium
GLNPFEQLLALLPNIGIGNKGGT

SEQ ID NO: 668396 - protein, 32 aa, Mycobacterium
GLNPIDWKIVAGFMRELMPVDLPAGVGSDVAG

SEQ ID NO: 668397 - protein, 22 aa, Mycobacterium
GLNPRLGWAEWCAEWGDDIDDH

SEQ ID NO: 668398 - protein, 17 aa, Mycobacterium
GLNSGVGNFGLFNSGTG

SEQ ID NO: 668399 - protein, 28 aa, Mycobacterium
GLNSLMAMAIRREAEMFVGIELSATMLF

SEQ ID NO: 668400 - protein, 18 aa, Mycobacterium
GLNSLPLLIPDQRPDDGG

SEQ ID NO: 668401 - protein, 18 aa, Mycobacterium
GLNWLPGEQLLGPAELAR

SEQ ID NO: 668402 - protein, 26 aa, Mycobacterium
GLNYKDPLKVLGILTERELGKTYFKL

SEQ ID NO: 668403 - protein, 22 aa, Mycobacterium
GLPACPGVAAGLAYTDVDEALD

SEQ ID NO: 668404 - protein, 21 aa, Mycobacterium
GLPACPGVASGRAYTDVEEAL

SEQ ID NO: 668405 - protein, 21 aa, Mycobacterium
GLPADNWPVLGGMGNASWVQL

SEQ ID NO: 668406 - protein, 18 aa, Mycobacterium
GLPAERIGFMLSDAAPMA

SEQ ID NO: 668407 - protein, 20 aa, Mycobacterium
GLPAGSALLVVKRGPNAGSR

SEQ ID NO: 668408 - protein, 17 aa, Mycobacterium
GLPAISLGWGLWDQASN

SEQ ID NO: 668409 - protein, 24 aa, Mycobacterium
GLPANPVWWTWLGNDYLPLVRDYL

SEQ ID NO: 668410 - protein, 18 aa, Mycobacterium
GLPAPGVWTQCHSYAFDV

SEQ ID NO: 668411 - protein, 19 aa, Mycobacterium
GLPAPRLVVEPGRAIAGPG

SEQ ID NO: 668412 - protein, 18 aa, Mycobacterium
GLPAPRQKLVYSVDEAVG

SEQ ID NO: 668413 - protein, 25 aa, Mycobacterium
GLPARCPTNGSSRCCGHITVRAANT

SEQ ID NO: 668414 - protein, 18 aa, Mycobacterium
GLPARPGLVRDRGTQLQR

SEQ ID NO: 668415 - protein, 17 aa, Mycobacterium
GLPARSELLGGTGQLES

SEQ ID NO: 668416 - protein, 18 aa, Mycobacterium
GLPATAIAWGAWAQIGRA

SEQ ID NO: 668417 - protein, 18 aa, Mycobacterium
GLPAVGINWGPWAEVGRA

SEQ ID NO: 668418 - protein, 24 aa, Mycobacterium
GLPDIPGYAAKVFRAIADAEVNID

SEQ ID NO: 668419 - protein, 19 aa, Mycobacterium
GLPDRAPALLWVHGGGTIM

SEQ ID NO: 668420 - protein, 26 aa, Mycobacterium
GLPDREFDALFTPDRPVIFAYHGYPW

SEQ ID NO: 668421 - protein, 21 aa, Mycobacterium
GLPDVPGYAAKVFRAVAEADV

SEQ ID NO: 668422 - protein, 23 aa, Mycobacterium
GLPDVPGYAAQVFRACADADVNL

SEQ ID NO: 668423 - protein, 21 aa, Mycobacterium
GLPECERTWAFDFRATNPSAW

SEQ ID NO: 668424 - protein, 22 aa, Mycobacterium
GLPECPRWKVIDRNDLPHLVDR

SEQ ID NO: 668425 - protein, 21 aa, Mycobacterium
GLPEDLTFTLVEPLRLLFKDE

SEQ ID NO: 668426 - protein, 18 aa, Mycobacterium
GLPEGMLPVELPDVPDYS

SEQ ID NO: 668427 - protein, 24 aa, Mycobacterium
GLPEHSWLRRFVGLGGASRTTQRN

SEQ ID NO: 668428 - protein, 18 aa, Mycobacterium
GLPEKLGNRRAWGLATQL

SEQ ID NO: 668429 - protein, 27 aa, Mycobacterium
GLPELPGVVVRPLLPLTERRLGIAVSA

SEQ ID NO: 668430 - protein, 18 aa, Mycobacterium
GLPELRAIFGEVLGIPVP

SEQ ID NO: 668431 - protein, 22 aa, Mycobacterium
GLPELRSAIAAYHRERSDIAVT

SEQ ID NO: 668432 - protein, 24 aa, Mycobacterium
GLPEPDWQVLLAVPVELAGERSRG

SEQ ID NO: 668433 - protein, 25 aa, Mycobacterium
GLPEPGCLIGRCGLRHIDVAHGVQV

SEQ ID NO: 668434 - protein, 18 aa, Mycobacterium
GLPEPKPFGHFMVVQLEH

SEQ ID NO: 668435 - protein, 19 aa, Mycobacterium
GLPESGWTLFSAIAHPRSR

SEQ ID NO: 668436 - protein, 27 aa, Mycobacterium
GLPESLASLPGRHLLVSPDAMRRDVDL

SEQ ID NO: 668437 - protein, 23 aa, Mycobacterium
GLPEVACTVWSNLVMTAHLGKGQ

SEQ ID NO: 668438 - protein, 24 aa, Mycobacterium
GLPEVACTVWSNLVMTARLRAPEL

SEQ ID NO: 668439 - protein, 21 aa, Mycobacterium
GLPEVACTVWSNVVMTAGLTA

SEQ ID NO: 668440 - protein, 21 aa, Mycobacterium
GLPEVGVPLYALGEFVNTLKL

SEQ ID NO: 668441 - protein, 20 aa, Mycobacterium
GLPFATMFASFYAARGYHVV

SEQ ID NO: 668442 - protein, 23 aa, Mycobacterium
GLPFFGAGIASFFASTAKTMGLI

SEQ ID NO: 668443 - protein, 25 aa, Mycobacterium
GLPFFGAGITSFFAATAKTAGAIGP

SEQ ID NO: 668444 - protein, 18 aa, Mycobacterium
GLPFGGVEGLSWQDKPIG

SEQ ID NO: 668445 - protein, 25 aa, Mycobacterium
GLPGDLKFKLVEPLRLLFKDEVRAV

SEQ ID NO: 668446 - protein, 26 aa, Mycobacterium
GLPGGYREMVGWGRGRTSGALRDRNP

SEQ ID NO: 668447 - protein, 19 aa, Mycobacterium
GLPGHLVEFVEALRGQGIS

SEQ ID NO: 668448 - protein, 25 aa, Mycobacterium
GLPGREGFPDMTLRSDGLAELPATE

SEQ ID NO: 668449 - protein, 22 aa, Mycobacterium
GLPGREGFPEMTLKDDGLTRLP

SEQ ID NO: 668450 - protein, 22 aa, Mycobacterium
GLPGRRYYGGCEYVDVVENIAR

SEQ ID NO: 668451 - protein, 21 aa, Mycobacterium
GLPGVAHQLLLLNAALGGPAL

SEQ ID NO: 668452 - protein, 18 aa, Mycobacterium
GLPILFEALSPILQVGLT

SEQ ID NO: 668453 - protein, 18 aa, Mycobacterium
GLPILGHIIELFRGGPDY

SEQ ID NO: 668454 - protein, 30 aa, Mycobacterium
GLPILGICNGFQVLCEAGLLPGALTRNAGL

SEQ ID NO: 668455 - protein, 25 aa, Mycobacterium
GLPIWGDVELAWRLDASGRYGRPKR

SEQ ID NO: 668456 - protein, 21 aa, Mycobacterium
GLPLAIARPDLQVVLLEPMLR

SEQ ID NO: 668457 - protein, 18 aa, Mycobacterium
GLPLAYMMDDCRERLADR

SEQ ID NO: 668458 - protein, 25 aa, Mycobacterium
GLPLCAVSLALMRTGRTVVAVTHAP

SEQ ID NO: 668459 - protein, 26 aa, Mycobacterium
GLPLFCLPPGGGISWAYRNLSPYLDC

SEQ ID NO: 668460 - protein, 18 aa, Mycobacterium
GLPLPRSPMAADFAELVD

SEQ ID NO: 668461 - protein, 20 aa, Mycobacterium
GLPLQRVRFSLGDSRFPPAP

SEQ ID NO: 668462 - protein, 22 aa, Mycobacterium
GLPLRKVPDGQLLRISEARRAL

SEQ ID NO: 668463 - protein, 18 aa, Mycobacterium
GLPMLRHRVELGAGSLAD

SEQ ID NO: 668464 - protein, 26 aa, Mycobacterium
GLPPNLRSAPMLGVVRAADGWVGINC

SEQ ID NO: 668465 - protein, 25 aa, Mycobacterium
GLPPRARDLLGLPWSERQEQRYQRF

SEQ ID NO: 668466 - protein, 30 aa, Mycobacterium
GLPQAGAVAPGFYGGMPPMGPVASVVNAPR

SEQ ID NO: 668467 - protein, 19 aa, Mycobacterium
GLPQPLGVHATYLVRDGFV

SEQ ID NO: 668468 - protein, 30 aa, Mycobacterium
GLPQRWIDFLHRWDPVHWLQPVSAAASGAG

SEQ ID NO: 668469 - protein, 24 aa, Mycobacterium
GLPQRWIEFLRRWDPMHWPQQTRS

SEQ ID NO: 668470 - protein, 26 aa, Mycobacterium
GLPRGALRVIALRAFVGADRDAALLL

SEQ ID NO: 668471 - protein, 17 aa, Mycobacterium
GLPRLYREAPLMGIWEG

SEQ ID NO: 668472 - protein, 22 aa, Mycobacterium
GLPRNAMRPSWGMSETSSGVVF

SEQ ID NO: 668473 - protein, 24 aa, Mycobacterium
GLPRRWIQFLERWDPANWPQRRED

SEQ ID NO: 668474 - protein, 26 aa, Mycobacterium
GLPRTAFKPSYGIAEGTLLVATIAPT

SEQ ID NO: 668475 - protein, 26 aa, Mycobacterium
GLPSDAKEALAFAVLGFLTFHGLPGT

SEQ ID NO: 668476 - protein, 20 aa, Mycobacterium
GLPSGSALLVVKRGPNAGSR

SEQ ID NO: 668477 - protein, 17 aa, Mycobacterium
GLPSLSVPAAFTADGLP

SEQ ID NO: 668478 - protein, 22 aa, Mycobacterium
GLPTAPFWFVGSLGELEAVAAH

SEQ ID NO: 668479 - protein, 22 aa, Mycobacterium
GLPTDHVRLISPFVGGSFGSAS

SEQ ID NO: 668480 - protein, 23 aa, Mycobacterium
GLPTLKASVLVSRIGEARPDWLD

SEQ ID NO: 668481 - protein, 22 aa, Mycobacterium
GLPTMRGTDAWTPHRADNDSEI

SEQ ID NO: 668482 - protein, 18 aa, Mycobacterium
GLPVREGQRVRLRFINNS

SEQ ID NO: 668483 - protein, 17 aa, Mycobacterium
GLPVRKLLGGARDRVKA

SEQ ID NO: 668484 - protein, 27 aa, Mycobacterium
GLPVTAWQIHRCIGMDGSTLVRTLSGD

SEQ ID NO: 668485 - protein, 26 aa, Mycobacterium
GLPWDVWKRELLGLGTEGLRKNALFP

SEQ ID NO: 668486 - protein, 20 aa, Mycobacterium
GLPWRYHPDGTVALASPAKE

SEQ ID NO: 668487 - protein, 25 aa, Mycobacterium
GLPYFPITPLFPWAGPAGLIPLPSK

SEQ ID NO: 668488 - protein, 24 aa, Mycobacterium
GLPYLGLEHRAAWVEAEADGTITS

SEQ ID NO: 668489 - protein, 25 aa, Mycobacterium
GLPYLGLEHRAAWVEAEADGTITSM

SEQ ID NO: 668490 - protein, 26 aa, Mycobacterium
GLQAFARDFFLLWAPYPNSYKRFRDG

SEQ ID NO: 668491 - protein, 20 aa, Mycobacterium
GLQAGELFLITHLSRAGWLR

SEQ ID NO: 668492 - protein, 18 aa, Mycobacterium
GLQAKALALGARFSPAWL

SEQ ID NO: 668493 - protein, 19 aa, Mycobacterium
GLQAPHWPAPHGRGASPAE

SEQ ID NO: 668494 - protein, 26 aa, Mycobacterium
GLQARLVLGQALAWRGRGREAGQVLT

SEQ ID NO: 668495 - protein, 17 aa, Mycobacterium
GLQDGLALLPFAWSTVD

SEQ ID NO: 668496 - protein, 18 aa, Mycobacterium
GLQGPWRDYVGWALNIEQ

SEQ ID NO: 668497 - protein, 18 aa, Mycobacterium
GLQGSGWAVLGYDSLGGR

SEQ ID NO: 668498 - protein, 19 aa, Mycobacterium
GLQGSGWAVLGYDSLGQKL

SEQ ID NO: 668499 - protein, 18 aa, Mycobacterium
GLQGSGWAVLGYDTLGDR

SEQ ID NO: 668500 - protein, 18 aa, Mycobacterium
GLQGVKLYTAEWHGDSRG

SEQ ID NO: 668501 - protein, 18 aa, Mycobacterium
GLQICYDKAFPEAARLMA

SEQ ID NO: 668502 - protein, 21 aa, Mycobacterium
GLQMLCLPGSVVIDPPAAAPV

SEQ ID NO: 668503 - protein, 19 aa, Mycobacterium
GLQQLEFLAEQPLNVEDWE

SEQ ID NO: 668504 - protein, 20 aa, Mycobacterium
GLQQLLKTLPNLGIGNIGNA

SEQ ID NO: 668505 - protein, 18 aa, Mycobacterium
GLQSQGWVGPSSEAMANS

SEQ ID NO: 668506 - protein, 23 aa, Mycobacterium
GLQSYEIPRDFLVETTPFSLENG

SEQ ID NO: 668507 - protein, 24 aa, Mycobacterium
GLQSYEVPRDFLIETTPFSLENGL

SEQ ID NO: 668508 - protein, 20 aa, Mycobacterium
GLQTMCIGGGQGLAAVFERV

SEQ ID NO: 668509 - protein, 18 aa, Mycobacterium
GLQVALDDAHRWIDQNSI

SEQ ID NO: 668510 - protein, 17 aa, Mycobacterium
GLQWNWPEVDCAHPLDD

SEQ ID NO: 668511 - protein, 19 aa, Mycobacterium
GLQYKAIIAAERMIPRTLM

SEQ ID NO: 668512 - protein, 19 aa, Mycobacterium
GLQYPIVYLPFAFNRNTQD

SEQ ID NO: 668513 - protein, 20 aa, Mycobacterium
GLQYPIVYLPFAFNRNTQDS

SEQ ID NO: 668514 - protein, 19 aa, Mycobacterium
GLRAEARAGRMLPYVIELD

SEQ ID NO: 668515 - protein, 18 aa, Mycobacterium
GLRAELEAAGGVAVDAMC

SEQ ID NO: 668516 - protein, 25 aa, Mycobacterium
GLRARVGYLGALGVDAIWINPWYPS

SEQ ID NO: 668517 - protein, 26 aa, Mycobacterium
GLRASHSIASYPGALAFTEQRVLGTL

SEQ ID NO: 668518 - protein, 18 aa, Mycobacterium
GLRASVRGRTRLLPRRWV

SEQ ID NO: 668519 - protein, 23 aa, Mycobacterium
GLRDELQRCWQRVFDEGHEVGTF

SEQ ID NO: 668520 - protein, 25 aa, Mycobacterium
GLRDKLRLGTSITRAEFDERNSLWR

SEQ ID NO: 668521 - protein, 17 aa, Mycobacterium
GLREARSPLGADFAPLV

SEQ ID NO: 668522 - protein, 17 aa, Mycobacterium
GLRELLLRYDGRADRPI

SEQ ID NO: 668523 - protein, 22 aa, Mycobacterium
GLRERRGPWGPGRRAEAADAFE

SEQ ID NO: 668524 - protein, 20 aa, Mycobacterium
GLRFDITLRPAHGVRVETFV

SEQ ID NO: 668525 - protein, 19 aa, Mycobacterium
GLRFYTDVLGFVLKHDVPV

SEQ ID NO: 668526 - protein, 23 aa, Mycobacterium
GLRGAPMVHPYVASKWAVRGLAK

SEQ ID NO: 668527 - protein, 25 aa, Mycobacterium
GLRGLYEFFTPLLRNLGHSARVAVV

SEQ ID NO: 668528 - protein, 20 aa, Mycobacterium
GLRGPRYLGGAGHWRDSGMA

SEQ ID NO: 668529 - protein, 22 aa, Mycobacterium
GLRGRPAAYLATMGPVRLSDAE

SEQ ID NO: 668530 - protein, 19 aa, Mycobacterium
GLRGTAGFMTGFRRSGARH

SEQ ID NO: 668531 - protein, 19 aa, Mycobacterium
GLRHLRLTVAHVHEGSGAD

SEQ ID NO: 668532 - protein, 24 aa, Mycobacterium
GLRKDDPRIGQWLPEVAPSTELRR

SEQ ID NO: 668533 - protein, 32 aa, Mycobacterium
GLRKDSRLGYSIGIGFPPDWGERTVSLRREDT

SEQ ID NO: 668534 - protein, 18 aa, Mycobacterium
GLRKLFRQFSFPGGIPSH

SEQ ID NO: 668535 - protein, 25 aa, Mycobacterium
GLRKMRRYPFVAAKFPRALRRAMRA

SEQ ID NO: 668536 - protein, 19 aa, Mycobacterium
GLRKYCRIETVVAPRTNVG

SEQ ID NO: 668537 - protein, 20 aa, Mycobacterium
GLRLAGRKVVVVGAGSVAQR

SEQ ID NO: 668538 - protein, 19 aa, Mycobacterium
GLRLLRHVRDAGFMSVEDA

SEQ ID NO: 668539 - protein, 20 aa, Mycobacterium
GLRMCARIAEAPALKRLLGH

SEQ ID NO: 668540 - protein, 19 aa, Mycobacterium
GLRMNHAYIRPGGVAQDLP

SEQ ID NO: 668541 - protein, 20 aa, Mycobacterium
GLRNEIQVVVTILSLDPNDL

SEQ ID NO: 668542 - protein, 23 aa, Mycobacterium
GLRNLCDLGAMLLQGTAVSDNTH

SEQ ID NO: 668543 - protein, 19 aa, Mycobacterium
GLRNLKTRARRAGGSCEIT

SEQ ID NO: 668544 - protein, 17 aa, Mycobacterium
GLRPAFDSRLMKLEDEM

SEQ ID NO: 668545 - protein, 18 aa, Mycobacterium
GLRPHLRLSTEIRSARWE

SEQ ID NO: 668546 - protein, 17 aa, Mycobacterium
GLRPRLGEFAGVVADVD

SEQ ID NO: 668547 - protein, 22 aa, Mycobacterium
GLRPSGVALEFGVGKGESTRII

SEQ ID NO: 668548 - protein, 23 aa, Mycobacterium
GLRPWPQSPWWVFYYYGSPEQPG

SEQ ID NO: 668549 - protein, 18 aa, Mycobacterium
GLRQFCRYAVRRRVMLID

SEQ ID NO: 668550 - protein, 23 aa, Mycobacterium
GLRQVIGCVFQDFRLLQQKTVFE

SEQ ID NO: 668551 - protein, 23 aa, Mycobacterium
GLRRCVTSLKSRYGDDPAMRRIV

SEQ ID NO: 668552 - protein, 20 aa, Mycobacterium
GLRRDIERFPFVPANRERLE

SEQ ID NO: 668553 - protein, 18 aa, Mycobacterium
GLRREHLSLAAGRITGIV

SEQ ID NO: 668554 - protein, 22 aa, Mycobacterium
GLRRELERFPFVPADPQRLQQD

SEQ ID NO: 668555 - protein, 24 aa, Mycobacterium
GLRRLFRQFSFPGGIPSHVAPETP

SEQ ID NO: 668556 - protein, 19 aa, Mycobacterium
GLRRSMAKSGYCDLKEFQK

SEQ ID NO: 668557 - protein, 21 aa, Mycobacterium
GLRRWSSALLAAGITVGLGGC

SEQ ID NO: 668558 - protein, 19 aa, Mycobacterium
GLRSAGYPRLEHITQDNPK

SEQ ID NO: 668559 - protein, 23 aa, Mycobacterium
GLRSRADTELGRMATDYASERAA

SEQ ID NO: 668560 - protein, 23 aa, Mycobacterium
GLRSVTLGHGFRPVIEAVCSAIA

SEQ ID NO: 668561 - protein, 18 aa, Mycobacterium
GLRSYRGDMINGFAPDAA

SEQ ID NO: 668562 - protein, 25 aa, Mycobacterium
GLRTELRRAPHLGFLIDFDEAKISL

SEQ ID NO: 668563 - protein, 24 aa, Mycobacterium
GLRTRLFAAPGWNVSQGTLIALPR

SEQ ID NO: 668564 - protein, 25 aa, Mycobacterium
GLRTRLFAAPGWVVSPGVVKALPDN

SEQ ID NO: 668565 - protein, 20 aa, Mycobacterium
GLRVGPMICFDVEFPEIART

SEQ ID NO: 668566 - protein, 27 aa, Mycobacterium
GLRVHARTGLPCPVCGDTVREVSFADK

SEQ ID NO: 668567 - protein, 26 aa, Mycobacterium
GLRVHARTGLPCPVCVDTVREVSFAD

SEQ ID NO: 668568 - protein, 17 aa, Mycobacterium
GLRWGATECGAFWANDL

SEQ ID NO: 668569 - protein, 24 aa, Mycobacterium
GLRWPDLSLAGGRVGYAALRDALP

SEQ ID NO: 668570 - protein, 33 aa, Mycobacterium
GLRWYRTGDMARYWPDGTIEFLGRADHQVKIRG

SEQ ID NO: 668571 - protein, 25 aa, Mycobacterium
GLRYPARLIDEYAWETDLGDKVISL

SEQ ID NO: 668572 - protein, 21 aa, Mycobacterium
GLRYRIYRPAVVMGDSRTGEM

SEQ ID NO: 668573 - protein, 27 aa, Mycobacterium
GLSADDIAHIWALLGLTVAGPDVPTLS

SEQ ID NO: 668574 - protein, 25 aa, Mycobacterium
GLSAFLAMWRKIVIDSNFHAGCPVL

SEQ ID NO: 668575 - protein, 30 aa, Mycobacterium
GLSANKSIADWVWAGLCVPGARVGGLLHRE

SEQ ID NO: 668576 - protein, 18 aa, Mycobacterium
GLSARTPLLAGLLDKPTV

SEQ ID NO: 668577 - protein, 29 aa, Mycobacterium
GLSAVFCAGASPLGHRWELRGTDNVLLAR

SEQ ID NO: 668578 - protein, 25 aa, Mycobacterium
GLSDGRFAMYAKMHHALIDGVSAAK

SEQ ID NO: 668579 - protein, 22 aa, Mycobacterium
GLSDHRRFLATMSIADRDLTVE

SEQ ID NO: 668580 - protein, 32 aa, Mycobacterium
GLSDLKFRLVRESFADAVSWVAKNLPSRPAVP

SEQ ID NO: 668581 - protein, 32 aa, Mycobacterium
GLSDLKFRLVRESFADAVSWVAKNLPTRPAVP

SEQ ID NO: 668582 - protein, 24 aa, Mycobacterium
GLSDNACVRMGMLGEYGLTWPWES

SEQ ID NO: 668583 - protein, 25 aa, Mycobacterium
GLSDPCGYLAWLRELVGPSAWIVIE

SEQ ID NO: 668584 - protein, 25 aa, Mycobacterium
GLSDPCGYLTWLRELLGPDAWIVIE

SEQ ID NO: 668585 - protein, 19 aa, Mycobacterium
GLSDPGGYLAWLREAVGPQ

SEQ ID NO: 668586 - protein, 25 aa, Mycobacterium
GLSDSAAFELLRWLSQEANVKLRTL

SEQ ID NO: 668587 - protein, 18 aa, Mycobacterium
GLSEALADRASRIRDLGL

SEQ ID NO: 668588 - protein, 29 aa, Mycobacterium
GLSEAQWRAASPLPGWDVKALVSHMIGTE

SEQ ID NO: 668589 - protein, 17 aa, Mycobacterium
GLSELARRLGLSKPTCL

SEQ ID NO: 668590 - protein, 22 aa, Mycobacterium
GLSETELRAWAVPRAANQFWML

SEQ ID NO: 668591 - protein, 29 aa, Mycobacterium
GLSFPHGPFSVGFARFFEIWVDVEAHRFD

SEQ ID NO: 668592 - protein, 24 aa, Mycobacterium
GLSIKRLVINPGAMRTPHWHANAN

SEQ ID NO: 668593 - protein, 18 aa, Mycobacterium
GLSIMPRWLRAVGGKTID

SEQ ID NO: 668594 - protein, 22 aa, Mycobacterium
GLSKARFTGTITVKYLRGTPLG

SEQ ID NO: 668595 - protein, 18 aa, Mycobacterium
GLSLKKPGSSHAWRPDVV

SEQ ID NO: 668596 - protein, 23 aa, Mycobacterium
GLSMRRLGEAVGRDPMALYRHVP

SEQ ID NO: 668597 - protein, 22 aa, Mycobacterium
GLSNTGRLYIDYQTYQTTVNFG

SEQ ID NO: 668598 - protein, 23 aa, Mycobacterium
GLSPEIMGLGPIEAVKKALANAK

SEQ ID NO: 668599 - protein, 24 aa, Mycobacterium
GLSRLDMSSLFRVLRRGELLTILG

SEQ ID NO: 668600 - protein, 17 aa, Mycobacterium
GLSRPTLNYYFATRDEL

SEQ ID NO: 668601 - protein, 22 aa, Mycobacterium
GLSRQMAIILLGGLRELTALIV

SEQ ID NO: 668602 - protein, 22 aa, Mycobacterium
GLSSDAKWVPAWESGLARAKEA

SEQ ID NO: 668603 - protein, 23 aa, Mycobacterium
GLSSIEACGDCPRGIHGSPLAGD

SEQ ID NO: 668604 - protein, 20 aa, Mycobacterium
GLSSQRFATAVGVDIKSVRR

SEQ ID NO: 668605 - protein, 21 aa, Mycobacterium
GLSSQRFATAVGVDIKSVRRW

SEQ ID NO: 668606 - protein, 17 aa, Mycobacterium
GLSTGLGDEGGFAPDVA

SEQ ID NO: 668607 - protein, 27 aa, Mycobacterium
GLSTRPAATCLIDWGTADRHAHREGVL

SEQ ID NO: 668608 - protein, 30 aa, Mycobacterium
GLSTRTIWRYFRCKESCVEPVLALSAKRFI

SEQ ID NO: 668609 - protein, 18 aa, Mycobacterium
GLSTYPAMDAMGMGEGGC

SEQ ID NO: 668610 - protein, 26 aa, Mycobacterium
GLSVAADIPFSGLLSPLQPLSLTATT

SEQ ID NO: 668611 - protein, 25 aa, Mycobacterium
GLSVLRYAIRTEIRLITSELATDLA

SEQ ID NO: 668612 - protein, 20 aa, Mycobacterium
GLSVPEAFVGYTGELGEPQW

SEQ ID NO: 668613 - protein, 18 aa, Mycobacterium
GLSWGHDRIFAVTTNHTV

SEQ ID NO: 668614 - protein, 27 aa, Mycobacterium
GLSYAKLRGGSGIQWPCNTEHPDGTER

SEQ ID NO: 668615 - protein, 19 aa, Mycobacterium
GLSYFAEFRTQSCIAAVAA

SEQ ID NO: 668616 - protein, 24 aa, Mycobacterium
GLSYPAQFWPLTSGLTLNQSVAEG

SEQ ID NO: 668617 - protein, 19 aa, Mycobacterium
GLTAAIEWGALVGGSVGLW

SEQ ID NO: 668618 - protein, 27 aa, Mycobacterium
GLTAGSWQGPAAMAMAAAVAPYANWLS

SEQ ID NO: 668619 - protein, 22 aa, Mycobacterium
GLTAIRLGAVAPELVDELVVID

SEQ ID NO: 668620 - protein, 18 aa, Mycobacterium
GLTALQLVAGSPRGLTMQ

SEQ ID NO: 668621 - protein, 18 aa, Mycobacterium
GLTALRLAVTAPKLVPQL

SEQ ID NO: 668622 - protein, 18 aa, Mycobacterium
GLTARLLLQQATREVLTG

SEQ ID NO: 668623 - protein, 19 aa, Mycobacterium
GLTAWLLLSCEGLHAGARE

SEQ ID NO: 668624 - protein, 17 aa, Mycobacterium
GLTDGYRGSPLRFEVDG

SEQ ID NO: 668625 - protein, 23 aa, Mycobacterium
GLTEFKLATFLLSQLALTPDDRI

SEQ ID NO: 668626 - protein, 17 aa, Mycobacterium
GLTEFKNGLLPRFANAY

SEQ ID NO: 668627 - protein, 25 aa, Mycobacterium
GLTELCGVISHLLPEAHRDPGREER

SEQ ID NO: 668628 - protein, 17 aa, Mycobacterium
GLTELDGYVGLSLLVDR

SEQ ID NO: 668629 - protein, 27 aa, Mycobacterium
GLTEPEAFKWIQRAAMDRRTTMKRVAE

SEQ ID NO: 668630 - protein, 29 aa, Mycobacterium
GLTFSRYELLMLLSFSRAGSMPMAKASAR

SEQ ID NO: 668631 - protein, 28 aa, Mycobacterium
GLTGEAYRGHIFWDELFVAPVVSLRRPA

SEQ ID NO: 668632 - protein, 19 aa, Mycobacterium
GLTGQAWQGAAAKAMAAVA

SEQ ID NO: 668633 - protein, 27 aa, Mycobacterium
GLTGRASYGGIGARRPAAAVASVASGS

SEQ ID NO: 668634 - protein, 18 aa, Mycobacterium
GLTGRGWPTRCMSAQSSA

SEQ ID NO: 668635 - protein, 24 aa, Mycobacterium
GLTGRLRHVMIPGIIAEDDDRPIT

SEQ ID NO: 668636 - protein, 17 aa, Mycobacterium
GLTGRRWGFGRTSAADR

SEQ ID NO: 668637 - protein, 17 aa, Mycobacterium
GLTGSRFVACPFGGAGT

SEQ ID NO: 668638 - protein, 26 aa, Mycobacterium
GLTGSRFVACPSGPPGQRMYRTGDLV

SEQ ID NO: 668639 - protein, 19 aa, Mycobacterium
GLTHRLPTLTAHVVEDQTQ

SEQ ID NO: 668640 - protein, 17 aa, Mycobacterium
GLTHYRRLASPEPWIER

SEQ ID NO: 668641 - protein, 19 aa, Mycobacterium
GLTIRGRHGVFEHERADGQ

SEQ ID NO: 668642 - protein, 23 aa, Mycobacterium
GLTKCAAHDLVGYGITVNAVAPG

SEQ ID NO: 668643 - protein, 23 aa, Mycobacterium
GLTKRFGAVQALDGLDLTVREGE

SEQ ID NO: 668644 - protein, 23 aa, Mycobacterium
GLTKSFGSQRIWENVTLSLPPGE

SEQ ID NO: 668645 - protein, 18 aa, Mycobacterium
GLTKSTFFRHFPDKRDVL

SEQ ID NO: 668646 - protein, 24 aa, Mycobacterium
GLTLDWAGRIAAIGAVTTAWDKAH

SEQ ID NO: 668647 - protein, 17 aa, Mycobacterium
GLTLIGFAVCNIDRDGA

SEQ ID NO: 668648 - protein, 19 aa, Mycobacterium
GLTLLLACAHRLLENHRVT

SEQ ID NO: 668649 - protein, 19 aa, Mycobacterium
GLTLPFGEVMLTPDVQEVI

SEQ ID NO: 668650 - protein, 22 aa, Mycobacterium
GLTLPMTLNLPGTVNRGNATQA

SEQ ID NO: 668651 - protein, 25 aa, Mycobacterium
GLTLRPTRHRFTVAGQELYTWCALD

SEQ ID NO: 668652 - protein, 18 aa, Mycobacterium
GLTLSIWCSEWVPFESAD

SEQ ID NO: 668653 - protein, 21 aa, Mycobacterium
GLTLSLPVGYRLSPRGAEYLA

SEQ ID NO: 668654 - protein, 17 aa, Mycobacterium
GLTLWDLDRLFKVDGCF

SEQ ID NO: 668655 - protein, 21 aa, Mycobacterium
GLTMAHLRGTLDAFARAEFGP

SEQ ID NO: 668656 - protein, 20 aa, Mycobacterium
GLTMAHLRGTLDAFARSEFG

SEQ ID NO: 668657 - protein, 21 aa, Mycobacterium
GLTNGCICCAVDADEAGEMLG

SEQ ID NO: 668658 - protein, 19 aa, Mycobacterium
GLTNSFPGSSGTGGDPGGT

SEQ ID NO: 668659 - protein, 25 aa, Mycobacterium
GLTPAEFAAACGISGDLQPEPDPEP

SEQ ID NO: 668660 - protein, 19 aa, Mycobacterium
GLTPAPCRHVRPPRIAETP

SEQ ID NO: 668661 - protein, 19 aa, Mycobacterium
GLTPILCLTKTDLAPPEPF

SEQ ID NO: 668662 - protein, 17 aa, Mycobacterium
GLTPIVRYRAGAVTGAD

SEQ ID NO: 668663 - protein, 24 aa, Mycobacterium
GLTPLARIRGWASVGVEVEHTGMA

SEQ ID NO: 668664 - protein, 17 aa, Mycobacterium
GLTPLFFTVEGHLSDMY

SEQ ID NO: 668665 - protein, 19 aa, Mycobacterium
GLTPLRDWREALQDAVAAV

SEQ ID NO: 668666 - protein, 18 aa, Mycobacterium
GLTPLVRLVSWGVAGVAP

SEQ ID NO: 668667 - protein, 26 aa, Mycobacterium
GLTPMQYLLEWRVAVAKDLMRSERLS

SEQ ID NO: 668668 - protein, 18 aa, Mycobacterium
GLTPRKAAVPVYSTVTGE

SEQ ID NO: 668669 - protein, 24 aa, Mycobacterium
GLTQRARVDFALRGGRVNADFIDN

SEQ ID NO: 668670 - protein, 18 aa, Mycobacterium
GLTQRGRIAPGWHADLVL

SEQ ID NO: 668671 - protein, 18 aa, Mycobacterium
GLTRDGVYLVRDGQITGA

SEQ ID NO: 668672 - protein, 18 aa, Mycobacterium
GLTRLGPLPPLRMDPQTG

SEQ ID NO: 668673 - protein, 17 aa, Mycobacterium
GLTRLKTKFTLATLSNA

SEQ ID NO: 668674 - protein, 21 aa, Mycobacterium
GLTRPEIAVLLAYSKNVVCQE

SEQ ID NO: 668675 - protein, 21 aa, Mycobacterium
GLTRSCARAVARKGITVNCVI

SEQ ID NO: 668676 - protein, 18 aa, Mycobacterium
GLTSALCYSARPDPSYDP

SEQ ID NO: 668677 - protein, 19 aa, Mycobacterium
GLTSALFHKLRLETSGAGF

SEQ ID NO: 668678 - protein, 21 aa, Mycobacterium
GLTSGRWLGPASLSMASALGP

SEQ ID NO: 668679 - protein, 32 aa, Mycobacterium
GLTSNPGWLQWLIDWYMPISQLIYNTVGLPYF

SEQ ID NO: 668680 - protein, 19 aa, Mycobacterium
GLTSRLADALARTADCTTA

SEQ ID NO: 668681 - protein, 19 aa, Mycobacterium
GLTSSVRGVFTYKVNDAGL

SEQ ID NO: 668682 - protein, 17 aa, Mycobacterium
GLTTAWLGASPALRGLA

SEQ ID NO: 668683 - protein, 30 aa, Mycobacterium
GLTTCYDIRFPGLYTDLARRGAQVITVSAS

SEQ ID NO: 668684 - protein, 19 aa, Mycobacterium
GLTTGRWLGPSSLTMASAF

SEQ ID NO: 668685 - protein, 19 aa, Mycobacterium
GLTTGRWLGPSSLTMASAY

SEQ ID NO: 668686 - protein, 23 aa, Mycobacterium
GLTVCHRCCTRLTRRGMNTAEIA

SEQ ID NO: 668687 - protein, 30 aa, Mycobacterium
GLTVCYDIRFPALYTELARRGAELIVVSAS

SEQ ID NO: 668688 - protein, 31 aa, Mycobacterium
GLTVCYDIRFPELYTELARRGAQVIAVCASW

SEQ ID NO: 668689 - protein, 20 aa, Mycobacterium
GLTVKAMIEKVVDRMYAEID

SEQ ID NO: 668690 - protein, 18 aa, Mycobacterium
GLTVQIQLALAMTLSAAG

SEQ ID NO: 668691 - protein, 17 aa, Mycobacterium
GLTWLPLYHDMGLTFLL

SEQ ID NO: 668692 - protein, 18 aa, Mycobacterium
GLTYPAQFWPLTLNLGNL

SEQ ID NO: 668693 - protein, 18 aa, Mycobacterium
GLTYPGIGFVVWRGKEHL

SEQ ID NO: 668694 - protein, 18 aa, Mycobacterium
GLTYPGIGFVVWRNAEHL

SEQ ID NO: 668695 - protein, 23 aa, Mycobacterium
GLVAADGGPLVWGSQISLLQAKE

SEQ ID NO: 668696 - protein, 18 aa, Mycobacterium
GLVAAIGAADPRKWTPRD

SEQ ID NO: 668697 - protein, 23 aa, Mycobacterium
GLVAAVWAWLGWHHLHSARAARP

SEQ ID NO: 668698 - protein, 20 aa, Mycobacterium
GLVAEEFNSLFFRNAVNAGL

SEQ ID NO: 668699 - protein, 19 aa, Mycobacterium
GLVAEIDRGTWTPAPVFAM

SEQ ID NO: 668700 - protein, 22 aa, Mycobacterium
GLVAGALRLTADYVANRKQFGK

SEQ ID NO: 668701 - protein, 17 aa, Mycobacterium
GLVAGQWLEEHPLGVGH

SEQ ID NO: 668702 - protein, 25 aa, Mycobacterium
GLVAGYRPELDLARIGIATQAFIGL

SEQ ID NO: 668703 - protein, 19 aa, Mycobacterium
GLVALPLLVGYDIDAPDPE

SEQ ID NO: 668704 - protein, 19 aa, Mycobacterium
GLVALPWHAAYSASKYGLR

SEQ ID NO: 668705 - protein, 20 aa, Mycobacterium
GLVALPWHAAYSASKYGLRG

SEQ ID NO: 668706 - protein, 17 aa, Mycobacterium
GLVALPWSQDGRSGIAY

SEQ ID NO: 668707 - protein, 18 aa, Mycobacterium
GLVALPWSQDGRSGIAYR

SEQ ID NO: 668708 - protein, 17 aa, Mycobacterium
GLVARIDAFAGVAKALA

SEQ ID NO: 668709 - protein, 17 aa, Mycobacterium
GLVCALEPIGLMRRVGL

SEQ ID NO: 668710 - protein, 27 aa, Mycobacterium
GLVDDLRINWVWNPPWGPDKITEDGRE

SEQ ID NO: 668711 - protein, 26 aa, Mycobacterium
GLVDEIRINWVWNPPWGPDKITDDGR

SEQ ID NO: 668712 - protein, 17 aa, Mycobacterium
GLVDELGTLTWREIDQQ

SEQ ID NO: 668713 - protein, 17 aa, Mycobacterium
GLVDELGTLTWRQLDER

SEQ ID NO: 668714 - protein, 27 aa, Mycobacterium
GLVDELKINWVWNPPWGPDKITDDGRE

SEQ ID NO: 668715 - protein, 25 aa, Mycobacterium
GLVDELRINWVWNPPWGPDKITDDG

SEQ ID NO: 668716 - protein, 18 aa, Mycobacterium
GLVDVALYALAQVVQPTE

SEQ ID NO: 668717 - protein, 19 aa, Mycobacterium
GLVEGRRLTKVVGLAGADR

SEQ ID NO: 668718 - protein, 30 aa, Mycobacterium
GLVEGRVAVQIPRGWRVERVTDDAGSPRLQ

SEQ ID NO: 668719 - protein, 26 aa, Mycobacterium
GLVELRLVDWHGWLFVDPSGQDADFA

SEQ ID NO: 668720 - protein, 23 aa, Mycobacterium
GLVFAAHTTVVWNLIRRQQQFRS

SEQ ID NO: 668721 - protein, 21 aa, Mycobacterium
GLVFDDFLPAVARMRALDPVT

SEQ ID NO: 668722 - protein, 24 aa, Mycobacterium
GLVGLEVWARGFSPIEFEPDAPRL

SEQ ID NO: 668723 - protein, 17 aa, Mycobacterium
GLVGLKLSRGLSPYGPQ

SEQ ID NO: 668724 - protein, 25 aa, Mycobacterium
GLVGLKTHCKTCLVVRREGSAIRRY

SEQ ID NO: 668725 - protein, 17 aa, Mycobacterium
GLVGLMRSYANMLAPHN

SEQ ID NO: 668726 - protein, 18 aa, Mycobacterium
GLVGRGGAAFPLAVKLRT

SEQ ID NO: 668727 - protein, 17 aa, Mycobacterium
GLVHGLRAQFPLLDRGR

SEQ ID NO: 668728 - protein, 17 aa, Mycobacterium
GLVIARELPVGATVTAA

SEQ ID NO: 668729 - protein, 19 aa, Mycobacterium
GLVKGHGAADWSKRPLPSD

SEQ ID NO: 668730 - protein, 25 aa, Mycobacterium
GLVKKYSDFIAWPIRMQVERREPAS

SEQ ID NO: 668731 - protein, 18 aa, Mycobacterium
GLVKRSRDPSDLRAVLVD

SEQ ID NO: 668732 - protein, 19 aa, Mycobacterium
GLVKRSRDPSDLRAVLVDI

SEQ ID NO: 668733 - protein, 22 aa, Mycobacterium
GLVKRSRDPSDLRAVLVDVTPQ

SEQ ID NO: 668734 - protein, 17 aa, Mycobacterium
GLVLPDVMGTYGDGGNA

SEQ ID NO: 668735 - protein, 26 aa, Mycobacterium
GLVNEIKINWVWNPPWGPDKITEDGR

SEQ ID NO: 668736 - protein, 18 aa, Mycobacterium
GLVPAQLRDGHYSGAAAL

SEQ ID NO: 668737 - protein, 24 aa, Mycobacterium
GLVPEIPVGLDWWDPLADDAVRPE

SEQ ID NO: 668738 - protein, 20 aa, Mycobacterium
GLVPGLLGWDRKRIGDRVDE

SEQ ID NO: 668739 - protein, 19 aa, Mycobacterium
GLVPLVRIVSWGVAGVAPK

SEQ ID NO: 668740 - protein, 19 aa, Mycobacterium
GLVPPHLRDGHYSGAEALG

SEQ ID NO: 668741 - protein, 26 aa, Mycobacterium
GLVPPWCIRRAIGHVVDRAHEFPHER

SEQ ID NO: 668742 - protein, 18 aa, Mycobacterium
GLVQRSRLLDAMLADLYG

SEQ ID NO: 668743 - protein, 23 aa, Mycobacterium
GLVRAAACTMFFGETVETLAAEG

SEQ ID NO: 668744 - protein, 17 aa, Mycobacterium
GLVRGRTGTLLVDSGTT

SEQ ID NO: 668745 - protein, 19 aa, Mycobacterium
GLVSDIAWDATVATLSGGQ

SEQ ID NO: 668746 - protein, 26 aa, Mycobacterium
GLVSDWQVGSTFAWRDGDLSITSPEQ

SEQ ID NO: 668747 - protein, 18 aa, Mycobacterium
GLVSFDVNWREQLWPDAD

SEQ ID NO: 668748 - protein, 18 aa, Mycobacterium
GLVSKPWVKTTMAPGSQV

SEQ ID NO: 668749 - protein, 17 aa, Mycobacterium
GLVSRPAQLTTPEFPIV

SEQ ID NO: 668750 - protein, 19 aa, Mycobacterium
GLVTASIAAAVHRGELMPA

SEQ ID NO: 668751 - protein, 18 aa, Mycobacterium
GLVTFFEFLMRLATVDPN

SEQ ID NO: 668752 - protein, 20 aa, Mycobacterium
GLVWSEFTLGAAYEGPPGHV

SEQ ID NO: 668753 - protein, 19 aa, Mycobacterium
GLVYAVVHHQDWVASRPEE

SEQ ID NO: 668754 - protein, 23 aa, Mycobacterium
GLVYPCGEIYGGTKSAWDYGPLG

SEQ ID NO: 668755 - protein, 20 aa, Mycobacterium
GLWAGLKPAELAAVASAVLY

SEQ ID NO: 668756 - protein, 22 aa, Mycobacterium
GLWANLACRKRFIGDKLAEALG

SEQ ID NO: 668757 - protein, 19 aa, Mycobacterium
GLWANLVCRKRFIGDKLAA

SEQ ID NO: 668758 - protein, 25 aa, Mycobacterium
GLWAQEIYADLGLRFDGEQAQAIGR

SEQ ID NO: 668759 - protein, 19 aa, Mycobacterium
GLWCEDAWLTTAMLVERTE

SEQ ID NO: 668760 - protein, 19 aa, Mycobacterium
GLWFEEFETGVLYQHRPGR

SEQ ID NO: 668761 - protein, 18 aa, Mycobacterium
GLWGAPYEPGYRVLDGIR

SEQ ID NO: 668762 - protein, 19 aa, Mycobacterium
GLWLAVMSPAALARVESVA

SEQ ID NO: 668763 - protein, 17 aa, Mycobacterium
GLWLPARTMAGLADDPA

SEQ ID NO: 668764 - protein, 23 aa, Mycobacterium
GLWNENGDGLALQGTRREILDYL

SEQ ID NO: 668765 - protein, 23 aa, Mycobacterium
GLWQLDARIAYLSGDCVPAGVQG

SEQ ID NO: 668766 - protein, 18 aa, Mycobacterium
GLWSRFGEQTGLLMADSA

SEQ ID NO: 668767 - protein, 21 aa, Mycobacterium
GLWTWLCGLLDSGYVSQVAMD

SEQ ID NO: 668768 - protein, 19 aa, Mycobacterium
GLYAAALSGLAARGSASGR

SEQ ID NO: 668769 - protein, 19 aa, Mycobacterium
GLYAAGACACNIAQDGKGY

SEQ ID NO: 668770 - protein, 24 aa, Mycobacterium
GLYAKARAGEIANFTGIDSPYQPP

SEQ ID NO: 668771 - protein, 23 aa, Mycobacterium
GLYAKARAGEITHFTGIDSPYQR

SEQ ID NO: 668772 - protein, 23 aa, Mycobacterium
GLYAKARAGEITQFTGIDSPYQP

SEQ ID NO: 668773 - protein, 17 aa, Mycobacterium
GLYAVVVDREMQALLDG

SEQ ID NO: 668774 - protein, 17 aa, Mycobacterium
GLYAVVVDREMSVLLDG

SEQ ID NO: 668775 - protein, 19 aa, Mycobacterium
GLYEMTLALWDWGFELEDV

SEQ ID NO: 668776 - protein, 23 aa, Mycobacterium
GLYERGRHGTPVVGIDDVRRVQR

SEQ ID NO: 668777 - protein, 17 aa, Mycobacterium
GLYEWRVEVEGFEHATA

SEQ ID NO: 668778 - protein, 17 aa, Mycobacterium
GLYHTLGLVQAWLSQPE

SEQ ID NO: 668779 - protein, 20 aa, Mycobacterium
GLYLEFRAGGPDDYHLAYAA

SEQ ID NO: 668780 - protein, 18 aa, Mycobacterium
GLYLRHGYHVEEIRVFDS

SEQ ID NO: 668781 - protein, 25 aa, Mycobacterium
GLYYLEMPPALFAPIVENLAKADLL

SEQ ID NO: 668782 - protein, 19 aa, Mycobacterium
GMAAADCALRAMLSPGDHV

SEQ ID NO: 668783 - protein, 24 aa, Mycobacterium
GMAAGLRLAERGVDVVVLEAGICG

SEQ ID NO: 668784 - protein, 19 aa, Mycobacterium
GMAATDCVLRALLRPGDHL

SEQ ID NO: 668785 - protein, 18 aa, Mycobacterium
GMACKAITDALLDADATA

SEQ ID NO: 668786 - protein, 17 aa, Mycobacterium
GMAGASLVECIKVHAPV

SEQ ID NO: 668787 - protein, 18 aa, Mycobacterium
GMAGMWVGPQWLTNASRR

SEQ ID NO: 668788 - protein, 17 aa, Mycobacterium
GMAGRAVLGVGKRLTGT

SEQ ID NO: 668789 - protein, 25 aa, Mycobacterium
GMALMKRLMVRPGQVVSREDLLAAL

SEQ ID NO: 668790 - protein, 23 aa, Mycobacterium
GMAPKLRLVPIQRTYDTPVSAKT

SEQ ID NO: 668791 - protein, 18 aa, Mycobacterium
GMARAFAAELGRYNIRVN

SEQ ID NO: 668792 - protein, 17 aa, Mycobacterium
GMARELFDTEPVFAETL

SEQ ID NO: 668793 - protein, 18 aa, Mycobacterium
GMARKLYDGTDMQEEQKL

SEQ ID NO: 668794 - protein, 18 aa, Mycobacterium
GMARRIDVARVYTRHVVE

SEQ ID NO: 668795 - protein, 18 aa, Mycobacterium
GMASLALVHDWNREFVRT

SEQ ID NO: 668796 - protein, 23 aa, Mycobacterium
GMATCPLTHLIELEESREIVRAL

SEQ ID NO: 668797 - protein, 23 aa, Mycobacterium
GMATGELLGCFGLTEPDVGSDPA

SEQ ID NO: 668798 - protein, 17 aa, Mycobacterium
GMATSFDQARRIAADIG

SEQ ID NO: 668799 - protein, 17 aa, Mycobacterium
GMATVKWELEDLSFAIL

SEQ ID NO: 668800 - protein, 23 aa, Mycobacterium
GMAVVAAIRLAEKVGPDGLVVVL

SEQ ID NO: 668801 - protein, 22 aa, Mycobacterium
GMAYHCPLSYPPLVGRDRRMII

SEQ ID NO: 668802 - protein, 23 aa, Mycobacterium
GMCELARSAGVLAPMQALENINN

SEQ ID NO: 668803 - protein, 19 aa, Mycobacterium
GMCHGAWCFDQLSESLRQR

SEQ ID NO: 668804 - protein, 21 aa, Mycobacterium
GMCHGAWCFDTVTAALRAAGH

SEQ ID NO: 668805 - protein, 19 aa, Mycobacterium
GMCSVTLWVVARWVSGEPV

SEQ ID NO: 668806 - protein, 23 aa, Mycobacterium
GMDGCTVFRGHARFTDPHTLLVD

SEQ ID NO: 668807 - protein, 25 aa, Mycobacterium
GMDLAALHRCCVALDGVGRAAQEAL

SEQ ID NO: 668808 - protein, 19 aa, Mycobacterium
GMDLLLGWEDIPGLRWPDV

SEQ ID NO: 668809 - protein, 25 aa, Mycobacterium
GMDLYKWAFKLGPLIESGLVLDCFE

SEQ ID NO: 668810 - protein, 19 aa, Mycobacterium
GMDLYWPGRLDGCATPAEQ

SEQ ID NO: 668811 - protein, 19 aa, Mycobacterium
GMDPNWRNVLLVCRAAQEA

SEQ ID NO: 668812 - protein, 24 aa, Mycobacterium
GMDRFGIDLILPFEDRVSIVATMC

SEQ ID NO: 668813 - protein, 22 aa, Mycobacterium
GMDRFGLDVILPFEDRVNIVAQ

SEQ ID NO: 668814 - protein, 24 aa, Mycobacterium
GMDRFGVDVFLPFEQRVATVATMC

SEQ ID NO: 668815 - protein, 25 aa, Mycobacterium
GMDSRAFRLPWRAGTTVYEIDQPEV

SEQ ID NO: 668816 - protein, 22 aa, Mycobacterium
GMEGRITVSYHFTRPGQDVTLF

SEQ ID NO: 668817 - protein, 23 aa, Mycobacterium
GMELFCAGTHPFADWSAQKLTDA

SEQ ID NO: 668818 - protein, 22 aa, Mycobacterium
GMELFCAGTHPFAQWSTQKLTD

SEQ ID NO: 668819 - protein, 24 aa, Mycobacterium
GMELFCAGTHPFARWSTQKLTDAP

SEQ ID NO: 668820 - protein, 23 aa, Mycobacterium
GMELFCAGTHPFGKWSAAQLTDA

SEQ ID NO: 668821 - protein, 26 aa, Mycobacterium
GMEPDLKWERFITAVRLLAERLNVRQ

SEQ ID NO: 668822 - protein, 26 aa, Mycobacterium
GMEPDLRWERFVTAIRLLAERLGVRR

SEQ ID NO: 668823 - protein, 20 aa, Mycobacterium
GMEPYDRFWVRDEITGEEYQ

SEQ ID NO: 668824 - protein, 25 aa, Mycobacterium
GMESETFAPHGLWTRNYKEMMNEMA

SEQ ID NO: 668825 - protein, 20 aa, Mycobacterium
GMFAQLCTDLPWTQTLSEVW

SEQ ID NO: 668826 - protein, 32 aa, Mycobacterium
GMFDQLCTELPWAQRLSQVWRMRDPAERDASL

SEQ ID NO: 668827 - protein, 34 aa, Mycobacterium
GMFEQLCADLPWSQRLSEVWRMLDPEERTASLAL

SEQ ID NO: 668828 - protein, 27 aa, Mycobacterium
GMFERLCASPGMARATFEAAFRIDVRP

SEQ ID NO: 668829 - protein, 18 aa, Mycobacterium
GMFFEWLTDSGFTAFCGH

SEQ ID NO: 668830 - protein, 18 aa, Mycobacterium
GMFIHCAKMKVPGWQYPG

SEQ ID NO: 668831 - protein, 19 aa, Mycobacterium
GMFIKPLVKSGHRVIAFDL

SEQ ID NO: 668832 - protein, 17 aa, Mycobacterium
GMFKVNWRVPAGPFQLM

SEQ ID NO: 668833 - protein, 26 aa, Mycobacterium
GMFLLSRAPGGLGLHAALTGAPFSGS

SEQ ID NO: 668834 - protein, 23 aa, Mycobacterium
GMFNAGFANVGWANAGIGNTGAF

SEQ ID NO: 668835 - protein, 19 aa, Mycobacterium
GMFTDRHALAVGPDKALLD

SEQ ID NO: 668836 - protein, 19 aa, Mycobacterium
GMFTFGWGPVLHQLAAGLG

SEQ ID NO: 668837 - protein, 26 aa, Mycobacterium
GMFVNPRLPAGTAYVCQAGNVGTIGF

SEQ ID NO: 668838 - protein, 19 aa, Mycobacterium
GMGAMPLGPRRLRHQRRPP

SEQ ID NO: 668839 - protein, 21 aa, Mycobacterium
GMGASHARLLVAEGAKVVIGD

SEQ ID NO: 668840 - protein, 27 aa, Mycobacterium
GMGDRCFKPTLARRMAQLFPDASIIEV

SEQ ID NO: 668841 - protein, 19 aa, Mycobacterium
GMGELHLDILVDRMRREFK

SEQ ID NO: 668842 - protein, 18 aa, Mycobacterium
GMGFLAQLCVDWEAATLP

SEQ ID NO: 668843 - protein, 23 aa, Mycobacterium
GMGGLGGDARLFGTGGAGGTGGD

SEQ ID NO: 668844 - protein, 24 aa, Mycobacterium
GMGGSIPFIAEFAAAFPDATILVT

SEQ ID NO: 668845 - protein, 24 aa, Mycobacterium
GMGGSIPFIAEFAAAFPQAKILVT

SEQ ID NO: 668846 - protein, 26 aa, Mycobacterium
GMGGTGGHGSFLFGAAGASCNGGAGG

SEQ ID NO: 668847 - protein, 17 aa, Mycobacterium
GMGGVNLIKSWLTTDPT

SEQ ID NO: 668848 - protein, 19 aa, Mycobacterium
GMGKLGLRTALATELETIG

SEQ ID NO: 668849 - protein, 27 aa, Mycobacterium
GMGKRVLSWRGGERMMTDLAHLTELLQ

SEQ ID NO: 668850 - protein, 25 aa, Mycobacterium
GMGLELRPAALAELALRAPARPALR

SEQ ID NO: 668851 - protein, 18 aa, Mycobacterium
GMGLILLRAPAGGEPPEQ

SEQ ID NO: 668852 - protein, 18 aa, Mycobacterium
GMGLQYLLLRSGPLTMPP

SEQ ID NO: 668853 - protein, 26 aa, Mycobacterium
GMGLSEALNLLARRGMTRGAPPKSVV

SEQ ID NO: 668854 - protein, 24 aa, Mycobacterium
GMGMLLALHLGRIKDSVGLRPEQV

SEQ ID NO: 668855 - protein, 18 aa, Mycobacterium
GMGPQWWGMARALLERPG

SEQ ID NO: 668856 - protein, 18 aa, Mycobacterium
GMGRELYDRLPVFAEAFD

SEQ ID NO: 668857 - protein, 25 aa, Mycobacterium
GMGREVALGLARRGAHVAAVDLDEA

SEQ ID NO: 668858 - protein, 19 aa, Mycobacterium
GMGRLFYQTVPAFRAEVNR

SEQ ID NO: 668859 - protein, 23 aa, Mycobacterium
GMGRQLYDRFEVFARTFDEAVEV

SEQ ID NO: 668860 - protein, 17 aa, Mycobacterium
GMGRRRPDIAVTILRLA

SEQ ID NO: 668861 - protein, 26 aa, Mycobacterium
GMGTALRPGLFGSDGPASAHVRALFD

SEQ ID NO: 668862 - protein, 19 aa, Mycobacterium
GMGTQWWAMGRDLLNAGGI

SEQ ID NO: 668863 - protein, 17 aa, Mycobacterium
GMHALICQRGDVIGHAA

SEQ ID NO: 668864 - protein, 17 aa, Mycobacterium
GMHLAYDLLEEWDTLVL

SEQ ID NO: 668865 - protein, 23 aa, Mycobacterium
GMHLKAGTIVMLCLGAANRDPAK

SEQ ID NO: 668866 - protein, 18 aa, Mycobacterium
GMHYRYPDHYEVEREKIR

SEQ ID NO: 668867 - protein, 20 aa, Mycobacterium
GMHYRYPDYYVVEREKIREH

SEQ ID NO: 668868 - protein, 17 aa, Mycobacterium
GMIAQIFAARFAERTNS

SEQ ID NO: 668869 - protein, 18 aa, Mycobacterium
GMIEQIWRAFFSSLAADG

SEQ ID NO: 668870 - protein, 23 aa, Mycobacterium
GMIGGGLARLWRDSGHDVDELGR

SEQ ID NO: 668871 - protein, 26 aa, Mycobacterium
GMIMERYRVDAVRAFELLRKLSQDSN

SEQ ID NO: 668872 - protein, 19 aa, Mycobacterium
GMIRIPLAEVEEFLGKPLT

SEQ ID NO: 668873 - protein, 22 aa, Mycobacterium
GMIWRYPDYFIVGREQLRQFAQ

SEQ ID NO: 668874 - protein, 21 aa, Mycobacterium
GMIWRYPDYFVVGREQLRQFA

SEQ ID NO: 668875 - protein, 22 aa, Mycobacterium
GMIWRYPDYFVVGREQLRQFAL

SEQ ID NO: 668876 - protein, 27 aa, Mycobacterium
GMKDFAFRPGPCLPRMRATFPDHVLVE

SEQ ID NO: 668877 - protein, 26 aa, Mycobacterium
GMKGQSWRGAAGIGEGHLGLPADFLI

SEQ ID NO: 668878 - protein, 26 aa, Mycobacterium
GMKSYGRAPTFLAMTGYEQVRSVAAE

SEQ ID NO: 668879 - protein, 23 aa, Mycobacterium
GMLARGGAIPLGYFNDPDKTAAA

SEQ ID NO: 668880 - protein, 26 aa, Mycobacterium
GMLDAQRFRAARVVIDIGVHCGLTAP

SEQ ID NO: 668881 - protein, 26 aa, Mycobacterium
GMLDERALFLGQWGLRGQRGADGPSY

SEQ ID NO: 668882 - protein, 21 aa, Mycobacterium
GMLIGALSFGHLPAIFVPAGP

SEQ ID NO: 668883 - protein, 18 aa, Mycobacterium
GMLLSPLGARMMPSVGRR

SEQ ID NO: 668884 - protein, 17 aa, Mycobacterium
GMLQCNCYVLAERPGTD

SEQ ID NO: 668885 - protein, 20 aa, Mycobacterium
GMLSAGWGRIVNVTSMTTLG

SEQ ID NO: 668886 - protein, 21 aa, Mycobacterium
GMLSEGFGWTGSRPEVDELVR

SEQ ID NO: 668887 - protein, 27 aa, Mycobacterium
GMLTCAIRPSGIWGRGDQTMFRKLFES

SEQ ID NO: 668888 - protein, 27 aa, Mycobacterium
GMLTCSIRPSGIWGRGDQTMFRKVFES

SEQ ID NO: 668889 - protein, 23 aa, Mycobacterium
GMLTGPVTILAWSFVRDDQALPD

SEQ ID NO: 668890 - protein, 17 aa, Mycobacterium
GMLTGVMVLNTWIRQGL

SEQ ID NO: 668891 - protein, 18 aa, Mycobacterium
GMLTGVTILNNWIRQGVV

SEQ ID NO: 668892 - protein, 24 aa, Mycobacterium
GMLTGVTILNNWIRQGVVERGLVV

SEQ ID NO: 668893 - protein, 21 aa, Mycobacterium
GMLTMGLGAAFVSKWSGDPGA

SEQ ID NO: 668894 - protein, 27 aa, Mycobacterium
GMLTMGLGGGYLTEWIGDPAAVTEYNV

SEQ ID NO: 668895 - protein, 29 aa, Mycobacterium
GMMEGLNLARLDAGCYGVGFMRAALREAT

SEQ ID NO: 668896 - protein, 20 aa, Mycobacterium
GMMRRLARRYGNVFTLNIPI

SEQ ID NO: 668897 - protein, 21 aa, Mycobacterium
GMNDVKSWISFGASPRASLGI

SEQ ID NO: 668898 - protein, 27 aa, Mycobacterium
GMNLPAVAFGHDWLTGVARYSGLLEHL

SEQ ID NO: 668899 - protein, 18 aa, Mycobacterium
GMNTDLRGPEALSLADRS

SEQ ID NO: 668900 - protein, 24 aa, Mycobacterium
GMPAKSAAVAAIFPTVTAPPPEQP

SEQ ID NO: 668901 - protein, 24 aa, Mycobacterium
GMPAMRAVSCSIALTENFPFNGSL

SEQ ID NO: 668902 - protein, 25 aa, Mycobacterium
GMPAYLAICDLMYRRQLAGASVFLG

SEQ ID NO: 668903 - protein, 23 aa, Mycobacterium
GMPEAQLTLAHCTIHLATAPKSN

SEQ ID NO: 668904 - protein, 24 aa, Mycobacterium
GMPEDPEWLLAHMSDFGTRRCENH

SEQ ID NO: 668905 - protein, 24 aa, Mycobacterium
GMPELDPKAANGYAPNFSVNIDSV

SEQ ID NO: 668906 - protein, 21 aa, Mycobacterium
GMPEYRDFLDLAHRFDGVYLD

SEQ ID NO: 668907 - protein, 21 aa, Mycobacterium
GMPFMPLTGMAGRSANGPAAS

SEQ ID NO: 668908 - protein, 24 aa, Mycobacterium
GMPGIPGMPAGIYGHNLGNAPRYG

SEQ ID NO: 668909 - protein, 18 aa, Mycobacterium
GMPHLRSGVRGDLHAHID

SEQ ID NO: 668910 - protein, 17 aa, Mycobacterium
GMPIAWRGKLLTGEPWP

SEQ ID NO: 668911 - protein, 21 aa, Mycobacterium
GMPKAVLWRQHDIFMNSMGGR

SEQ ID NO: 668912 - protein, 26 aa, Mycobacterium
GMPKFIRFMLRWVIKAPEFLQLDVVR

SEQ ID NO: 668913 - protein, 22 aa, Mycobacterium
GMPKGVLWRQHDIFLSSMGGRP

SEQ ID NO: 668914 - protein, 26 aa, Mycobacterium
GMPKGVLWRQHDIFMASFGGRSLYTG

SEQ ID NO: 668915 - protein, 22 aa, Mycobacterium
GMPKGVLWRQHDIFMTSFGGRD

SEQ ID NO: 668916 - protein, 22 aa, Mycobacterium
GMPKGVLWRQHDIFMTSFGGRN

SEQ ID NO: 668917 - protein, 17 aa, Mycobacterium
GMPKILAANGRWLELAV

SEQ ID NO: 668918 - protein, 23 aa, Mycobacterium
GMPKLRSAMHLDTVFTFADRDVV

SEQ ID NO: 668919 - protein, 23 aa, Mycobacterium
GMPLKFRDGAHFAALDAGPVTLA

SEQ ID NO: 668920 - protein, 23 aa, Mycobacterium
GMPLKFRDGAHFAALDGGQVTLA

SEQ ID NO: 668921 - protein, 25 aa, Mycobacterium
GMPLLEIPLRTPFAAVVKAVSTRIA

SEQ ID NO: 668922 - protein, 37 aa, Mycobacterium
GMPLTFEIARFIKFIVTEIFPGGRLPSIEKVADHSSK

SEQ ID NO: 668923 - protein, 26 aa, Mycobacterium
GMPMTFEMARFIKFIVTEIFPGGRLP

SEQ ID NO: 668924 - protein, 24 aa, Mycobacterium
GMPNRIRWTIVRYKPPEGMTLNGD

SEQ ID NO: 668925 - protein, 22 aa, Mycobacterium
GMPPCTGTGMGIDRLLMALTGL

SEQ ID NO: 668926 - protein, 24 aa, Mycobacterium
GMPPCTGTGMGIDRLLMCLTGLSI

SEQ ID NO: 668927 - protein, 22 aa, Mycobacterium
GMPPCTGTGMGIDRLLMSLTGL

SEQ ID NO: 668928 - protein, 20 aa, Mycobacterium
GMPPRPGERDLIAATRERGW

SEQ ID NO: 668929 - protein, 22 aa, Mycobacterium
GMPTGLWGRVVDAFAPAHVVEF

SEQ ID NO: 668930 - protein, 21 aa, Mycobacterium
GMPTGLWGRVVDTFAPAHVVE

SEQ ID NO: 668931 - protein, 22 aa, Mycobacterium
GMPTGLWGRVVEAFAPAHVVEF

SEQ ID NO: 668932 - protein, 19 aa, Mycobacterium
GMPVRVVAGVHELPELPGQ

SEQ ID NO: 668933 - protein, 17 aa, Mycobacterium
GMPYAHPTIEHFAPLFV

SEQ ID NO: 668934 - protein, 26 aa, Mycobacterium
GMPYVNQRWLGGMLTNFSTVHKRLQR

SEQ ID NO: 668935 - protein, 27 aa, Mycobacterium
GMPYVNQRWLGGMLTNFSTVHKRLQRL

SEQ ID NO: 668936 - protein, 18 aa, Mycobacterium
GMQLELSFFPLYEGGMLF

SEQ ID NO: 668937 - protein, 34 aa, Mycobacterium
GMQLGVVTWPPAPGATWFKNWHYWWQAHLQDCLI

SEQ ID NO: 668938 - protein, 19 aa, Mycobacterium
GMQLRPAFDDIDQHADILL

SEQ ID NO: 668939 - protein, 18 aa, Mycobacterium
GMQMRLTFARSLINKPEL

SEQ ID NO: 668940 - protein, 20 aa, Mycobacterium
GMQTAFPLLKDRGGGRIINF

SEQ ID NO: 668941 - protein, 17 aa, Mycobacterium
GMRAKLFDAARLAAGAI

SEQ ID NO: 668942 - protein, 18 aa, Mycobacterium
GMRARWDRYARFAERTFN

SEQ ID NO: 668943 - protein, 19 aa, Mycobacterium
GMRASRRYRVPPMPFSLSV

SEQ ID NO: 668944 - protein, 17 aa, Mycobacterium
GMREGRLSLDQVGVIAA

SEQ ID NO: 668945 - protein, 24 aa, Mycobacterium
GMRMITRFDVDWQRYGYDDAALRD

SEQ ID NO: 668946 - protein, 20 aa, Mycobacterium
GMRPSCVIVHTSVTSEPFAT

SEQ ID NO: 668947 - protein, 25 aa, Mycobacterium
GMRPYDPPWCRPLLGVRRDVTQAAC

SEQ ID NO: 668948 - protein, 19 aa, Mycobacterium
GMRSHPGVTATFCEALAEV

SEQ ID NO: 668949 - protein, 19 aa, Mycobacterium
GMRSHPGVTATFCESLAEV

SEQ ID NO: 668950 - protein, 25 aa, Mycobacterium
GMRVMKLDVAGAFHTSAMDTAISPF

SEQ ID NO: 668951 - protein, 17 aa, Mycobacterium
GMRVVPSAEVWRRIPSW

SEQ ID NO: 668952 - protein, 25 aa, Mycobacterium
GMSDSCQWFKSQFDPLMGQINDFNR

SEQ ID NO: 668953 - protein, 24 aa, Mycobacterium
GMSELRGLITPELRATLEAVLAKL

SEQ ID NO: 668954 - protein, 18 aa, Mycobacterium
GMSELSCVAAVSHPRDAR

SEQ ID NO: 668955 - protein, 19 aa, Mycobacterium
GMSEYLRRFTAALDASIRG

SEQ ID NO: 668956 - protein, 37 aa, Mycobacterium
GMSGARITLHAALELARKGSGYAVAALCGAGGQGDAL

SEQ ID NO: 668957 - protein, 31 aa, Mycobacterium
GMSGARITLHAALELARRGSGYAVAALCGAG

SEQ ID NO: 668958 - protein, 31 aa, Mycobacterium
GMSGARITLHAALELARRGSGYGVAALCGAG

SEQ ID NO: 668959 - protein, 21 aa, Mycobacterium
GMSGARITLHLAQELKRRGGG

SEQ ID NO: 668960 - protein, 25 aa, Mycobacterium
GMSGEATFDYGVAFDRSRKVAEGRV

SEQ ID NO: 668961 - protein, 21 aa, Mycobacterium
GMSGLRWLQDRGFDGERVVIA

SEQ ID NO: 668962 - protein, 22 aa, Mycobacterium
GMSHATEFVMLIAENHWRVAEE

SEQ ID NO: 668963 - protein, 20 aa, Mycobacterium
GMSIPDIKALLSADGAAART

SEQ ID NO: 668964 - protein, 22 aa, Mycobacterium
GMSLRSPARFLAPAERLVAQWK

SEQ ID NO: 668965 - protein, 21 aa, Mycobacterium
GMSLRSPARFLAPAERLVERW

SEQ ID NO: 668966 - protein, 21 aa, Mycobacterium
GMSLRSPARFMAAAQKLVQLW

SEQ ID NO: 668967 - protein, 22 aa, Mycobacterium
GMSPHGCWATFVTCDANLATPI

SEQ ID NO: 668968 - protein, 20 aa, Mycobacterium
GMSQRLGIAAALIGDPPVLL

SEQ ID NO: 668969 - protein, 21 aa, Mycobacterium
GMSRGAIFHHFRDKDTLFFAL

SEQ ID NO: 668970 - protein, 20 aa, Mycobacterium
GMSTESWRPIEVGQTGTIFN

SEQ ID NO: 668971 - protein, 20 aa, Mycobacterium
GMSTFSLGLADIGQANVGFG

SEQ ID NO: 668972 - protein, 23 aa, Mycobacterium
GMSWKYPDCFVVGREQVRGFARS

SEQ ID NO: 668973 - protein, 17 aa, Mycobacterium
GMTAHYLLKSTYPVQPS

SEQ ID NO: 668974 - protein, 18 aa, Mycobacterium
GMTFREYISAYGLTRSEG

SEQ ID NO: 668975 - protein, 20 aa, Mycobacterium
GMTGARYGAIGVWGPEGTLT

SEQ ID NO: 668976 - protein, 20 aa, Mycobacterium
GMTIPEQYGGHGLGITEATI

SEQ ID NO: 668977 - protein, 19 aa, Mycobacterium
GMTLGQLGAEVIRIDPIGG

SEQ ID NO: 668978 - protein, 18 aa, Mycobacterium
GMTNGLPVRVRAAMKPIS

SEQ ID NO: 668979 - protein, 18 aa, Mycobacterium
GMTPARYVELVRIDFARG

SEQ ID NO: 668980 - protein, 24 aa, Mycobacterium
GMTPDERREFLAGLSPETVHEMVL

SEQ ID NO: 668981 - protein, 23 aa, Mycobacterium
GMVADALAALGLEDVVLVGNDTG

SEQ ID NO: 668982 - protein, 20 aa, Mycobacterium
GMVAGTPFALAHTFSQTGPF

SEQ ID NO: 668983 - protein, 18 aa, Mycobacterium
GMVALRSTFFGSVPPPRE

SEQ ID NO: 668984 - protein, 19 aa, Mycobacterium
GMVARRAGGILISGSAAGN

SEQ ID NO: 668985 - protein, 21 aa, Mycobacterium
GMVLGEAGALMLVETEEHAKA

SEQ ID NO: 668986 - protein, 19 aa, Mycobacterium
GMVSFWFGACTEFYPDLQQ

SEQ ID NO: 668987 - protein, 29 aa, Mycobacterium
GMVSPTVFWPIPRVYSGLVRIDRYETSPW

SEQ ID NO: 668988 - protein, 21 aa, Mycobacterium
GMVSQLWAMLLARQGFQVIVQ

SEQ ID NO: 668989 - protein, 24 aa, Mycobacterium
GMVWKYPDPFLIGREQIRQYAKAV

SEQ ID NO: 668990 - protein, 17 aa, Mycobacterium
GMWARSSLTTALLRSHT

SEQ ID NO: 668991 - protein, 20 aa, Mycobacterium
GMWGIPWDKPVRRLNEYLDG

SEQ ID NO: 668992 - protein, 29 aa, Mycobacterium
GMWSTPWTWKSAGTYRVFADFQPAQASSA

SEQ ID NO: 668993 - protein, 20 aa, Mycobacterium
GMYNRIKWTVVRYKPPEGMT

SEQ ID NO: 668994 - protein, 19 aa, Mycobacterium
GMYPWLPTNMGNWHLIGIE

SEQ ID NO: 668995 - protein, 23 aa, Mycobacterium
GMYRSCPDITTLVLADSAHCHNM

SEQ ID NO: 668996 - protein, 26 aa, Mycobacterium
GMYRTAGGATCSWARLGSLDTGDIID

SEQ ID NO: 668997 - protein, 17 aa, Mycobacterium
GNAAGQAYANGWGQSLE

SEQ ID NO: 668998 - protein, 29 aa, Mycobacterium
GNADWVVMSGSLPPGIPASWYADITARLS

SEQ ID NO: 668999 - protein, 20 aa, Mycobacterium
GNAFRPRRSCLVAVALVVCW

SEQ ID NO: 669000 - protein, 27 aa, Mycobacterium
GNAFRRMCRDEFLHYLRIREWQDLVGQ

SEQ ID NO: 669001 - protein, 24 aa, Mycobacterium
GNAGLFGIGGVGGIGGQGSLDGGA

SEQ ID NO: 669002 - protein, 21 aa, Mycobacterium
GNAGLFSGIAGNGGDGGQGGE

SEQ ID NO: 669003 - protein, 18 aa, Mycobacterium
GNAGLLFGNGGHGGSGGA

SEQ ID NO: 669004 - protein, 18 aa, Mycobacterium
GNAGLLGFASGWNTGNSN

SEQ ID NO: 669005 - protein, 18 aa, Mycobacterium
GNAGRFNVGAGNSGLDNM

SEQ ID NO: 669006 - protein, 24 aa, Mycobacterium
GNAGSIPAGFMAPAENGIGGNGGG

SEQ ID NO: 669007 - protein, 17 aa, Mycobacterium
GNAHFTFAGCEGDSLLM

SEQ ID NO: 669008 - protein, 17 aa, Mycobacterium
GNAHFTFGGCEGDALLM

SEQ ID NO: 669009 - protein, 18 aa, Mycobacterium
GNAILGIGVGEREGNEPY

SEQ ID NO: 669010 - protein, 18 aa, Mycobacterium
GNAIRVRAGLVINAAGVW

SEQ ID NO: 669011 - protein, 17 aa, Mycobacterium
GNAKFWDPAGIDFSRDR

SEQ ID NO: 669012 - protein, 18 aa, Mycobacterium
GNAKRWGWVHADLGNGDV

SEQ ID NO: 669013 - protein, 25 aa, Mycobacterium
GNALARLEGRIALEEILKRFPAWEV

SEQ ID NO: 669014 - protein, 25 aa, Mycobacterium
GNALARLEGRIALEEILKRFPTWEV

SEQ ID NO: 669015 - protein, 22 aa, Mycobacterium
GNALKGNLCRCTGYRPIRDAVC

SEQ ID NO: 669016 - protein, 18 aa, Mycobacterium
GNALPLQEGMAFSVEPGI

SEQ ID NO: 669017 - protein, 18 aa, Mycobacterium
GNAMDWVYRDSGYRQFRE

SEQ ID NO: 669018 - protein, 28 aa, Mycobacterium
GNAMGPDFWRELPLIFTELDADPEVRAV

SEQ ID NO: 669019 - protein, 19 aa, Mycobacterium
GNAMLRILTAAGMEHPDTA

SEQ ID NO: 669020 - protein, 19 aa, Mycobacterium
GNAPFRVVTGHGSFVVPFF

SEQ ID NO: 669021 - protein, 22 aa, Mycobacterium
GNAPLLGWGGNGGVGGNAPQGT

SEQ ID NO: 669022 - protein, 20 aa, Mycobacterium
GNAPRYGFRPTIMGRPPAAG

SEQ ID NO: 669023 - protein, 27 aa, Mycobacterium
GNAQELYFPVCFELAITKGPPTADDRE

SEQ ID NO: 669024 - protein, 28 aa, Mycobacterium
GNAQELYFPVCFELAVTKGPPAPQDRDT

SEQ ID NO: 669025 - protein, 17 aa, Mycobacterium
GNARFSLPTMAVEDYPT

SEQ ID NO: 669026 - protein, 25 aa, Mycobacterium
GNARNGTRAKTVFTEIGPVEIEVPR

SEQ ID NO: 669027 - protein, 19 aa, Mycobacterium
GNAVGYKYAHDHPGGVASQ

SEQ ID NO: 669028 - protein, 17 aa, Mycobacterium
GNAWIVIAERFRRRGAK

SEQ ID NO: 669029 - protein, 17 aa, Mycobacterium
GNAWVRAEAELYSWGPS

SEQ ID NO: 669030 - protein, 23 aa, Mycobacterium
GNCARIVSVFGRVQGRDGLDQYV

SEQ ID NO: 669031 - protein, 17 aa, Mycobacterium
GNCDIKPTVAMFMTSDM

SEQ ID NO: 669032 - protein, 21 aa, Mycobacterium
GNCGVGFAPCRPADHDVLVDV

SEQ ID NO: 669033 - protein, 25 aa, Mycobacterium
GNCGVGFAPVRPGREDWLIKLMEGV

SEQ ID NO: 669034 - protein, 24 aa, Mycobacterium
GNCGVGFAPVRPGSEDWLIRLMEG

SEQ ID NO: 669035 - protein, 23 aa, Mycobacterium
GNCGVGFAPVRPGTEQWLIELME

SEQ ID NO: 669036 - protein, 19 aa, Mycobacterium
GNCGVGFAPVRRGTEQWLI

SEQ ID NO: 669037 - protein, 18 aa, Mycobacterium
GNCRACTTTMAGTHADVR

SEQ ID NO: 669038 - protein, 17 aa, Mycobacterium
GNCSGFYGDRISAMHEM

SEQ ID NO: 669039 - protein, 17 aa, Mycobacterium
GNCSGFYGDRMAAMREM

SEQ ID NO: 669040 - protein, 27 aa, Mycobacterium
GNDDVIAWRGDRRFVERLSRATLDAQA

SEQ ID NO: 669041 - protein, 18 aa, Mycobacterium
GNDGSMLACVINFAGSEH

SEQ ID NO: 669042 - protein, 17 aa, Mycobacterium
GNDGSVMACVFNFAGTE

SEQ ID NO: 669043 - protein, 18 aa, Mycobacterium
GNDLPVWHGVARRGHRGL

SEQ ID NO: 669044 - protein, 18 aa, Mycobacterium
GNDPPAAMRYCLTEDALV

SEQ ID NO: 669045 - protein, 22 aa, Mycobacterium
GNDRLRPHMPPLDHLNTAFLAA

SEQ ID NO: 669046 - protein, 18 aa, Mycobacterium
GNDVGFELIFKRQIIAHA

SEQ ID NO: 669047 - protein, 18 aa, Mycobacterium
GNEDVRWFDIEPCYVYHP

SEQ ID NO: 669048 - protein, 21 aa, Mycobacterium
GNEKNFKWIARSADGWITTPR

SEQ ID NO: 669049 - protein, 26 aa, Mycobacterium
GNERLRIEPLLARSATWVTGESAGDV

SEQ ID NO: 669050 - protein, 26 aa, Mycobacterium
GNERRTNWLNNFYFGGEHGVEGSIAR

SEQ ID NO: 669051 - protein, 24 aa, Mycobacterium
GNEYDLSSLFLLASTAALFSPSIK

SEQ ID NO: 669052 - protein, 19 aa, Mycobacterium
GNFASGYRGKTWTFRQYSG

SEQ ID NO: 669053 - protein, 17 aa, Mycobacterium
GNFCAGMDLKAFMAGEV

SEQ ID NO: 669054 - protein, 21 aa, Mycobacterium
GNFCAGMDLKAFVSGEAVLSE

SEQ ID NO: 669055 - protein, 23 aa, Mycobacterium
GNFGDLNLGFGNLNNGNVGFGNF

SEQ ID NO: 669056 - protein, 26 aa, Mycobacterium
GNFGGAAAGLWNPLAAAFPGGVLPTF

SEQ ID NO: 669057 - protein, 24 aa, Mycobacterium
GNFGYRVSRYELDLEYKVASNRLT

SEQ ID NO: 669058 - protein, 24 aa, Mycobacterium
GNFLGQGNFGFGNRVGDANLGSGN

SEQ ID NO: 669059 - protein, 19 aa, Mycobacterium
GNFPSWTLHVQVMPVDEAA

SEQ ID NO: 669060 - protein, 19 aa, Mycobacterium
GNFTWALSRPLPFSAQLGA

SEQ ID NO: 669061 - protein, 23 aa, Mycobacterium
GNFWDRLRQDFDIVTFDPRGVGA

SEQ ID NO: 669062 - protein, 24 aa, Mycobacterium
GNFYLRPIVRPVVLVAGGTGLSAI

SEQ ID NO: 669063 - protein, 32 aa, Mycobacterium
GNGAEGAIGAQFVPASSLPTPSGGAGGDGGNG

SEQ ID NO: 669064 - protein, 21 aa, Mycobacterium
GNGASADWIGNGGSGGAGGSG

SEQ ID NO: 669065 - protein, 24 aa, Mycobacterium
GNGDCIAFFWFRDAPDGVPGLTAP

SEQ ID NO: 669066 - protein, 23 aa, Mycobacterium
GNGDCVAFFWFADAPDRVPGISS

SEQ ID NO: 669067 - protein, 23 aa, Mycobacterium
GNGDCVAFFWFAEAADRVPGISS

SEQ ID NO: 669068 - protein, 23 aa, Mycobacterium
GNGDCVAFFWFAEAPDRVPGISS

SEQ ID NO: 669069 - protein, 19 aa, Mycobacterium
GNGDWDVPIGGMGAVSGAL

SEQ ID NO: 669070 - protein, 19 aa, Mycobacterium
GNGEICWARSESGPLTEAL

SEQ ID NO: 669071 - protein, 24 aa, Mycobacterium
GNGGAGGLFMNGGDGGAGGQGGDG

SEQ ID NO: 669072 - protein, 28 aa, Mycobacterium
GNGGAGGSAGLWGRGGNGGAGGTGVAGG

SEQ ID NO: 669073 - protein, 27 aa, Mycobacterium
GNGGDGGAGGWLFGDAGAGGQGGTGGA

SEQ ID NO: 669074 - protein, 18 aa, Mycobacterium
GNGGFAAGLGAGVGGSGG

SEQ ID NO: 669075 - protein, 20 aa, Mycobacterium
GNGGFLFGSGGTGGFGGVGG

SEQ ID NO: 669076 - protein, 19 aa, Mycobacterium
GNGGFSGPITAGGAGGTGG

SEQ ID NO: 669077 - protein, 19 aa, Mycobacterium
GNGGGFAVGAFNSGSSGTV

SEQ ID NO: 669078 - protein, 22 aa, Mycobacterium
GNGGGGGWLSGDAGAGGQGGAS

SEQ ID NO: 669079 - protein, 18 aa, Mycobacterium
GNGGHGGLLIGTGGNGGA

SEQ ID NO: 669080 - protein, 20 aa, Mycobacterium
GNGGHSGWIYGDGGAGGNSG

SEQ ID NO: 669081 - protein, 19 aa, Mycobacterium
GNGGKALIIGAAGGAGGTG

SEQ ID NO: 669082 - protein, 18 aa, Mycobacterium
GNGGKGGNGGFGAGNSSG

SEQ ID NO: 669083 - protein, 29 aa, Mycobacterium
GNGGLGIAYSPLVTGIGIGGAGGDGGAGT

SEQ ID NO: 669084 - protein, 18 aa, Mycobacterium
GNGGLLMGTGGDGGSGGS

SEQ ID NO: 669085 - protein, 24 aa, Mycobacterium
GNGGLMLPLGVGRIRAYGSTRNAH

SEQ ID NO: 669086 - protein, 20 aa, Mycobacterium
GNGGNAIGLFGQGGTGGTGG

SEQ ID NO: 669087 - protein, 20 aa, Mycobacterium
GNGGNARGLFGHGGNGGDGG

SEQ ID NO: 669088 - protein, 20 aa, Mycobacterium
GNGGNARLIGSGGNGGNAGT

SEQ ID NO: 669089 - protein, 18 aa, Mycobacterium
GNGGNGFLGGAGGAAGSG

SEQ ID NO: 669090 - protein, 24 aa, Mycobacterium
GNGGNGGNGGWFAGNAGAGGNGGV

SEQ ID NO: 669091 - protein, 30 aa, Mycobacterium
GNGGNGGNGGWLYGLGGQGGMGGNGSSAVA

SEQ ID NO: 669092 - protein, 29 aa, Mycobacterium
GNGGPAGLFGIGGTGGFGANIAGSGGAGG

SEQ ID NO: 669093 - protein, 19 aa, Mycobacterium
GNGGPSWVQSGYGSTLGGN

SEQ ID NO: 669094 - protein, 20 aa, Mycobacterium
GNGGQLWGDGGAGGLGAFGQ

SEQ ID NO: 669095 - protein, 19 aa, Mycobacterium
GNGGRGGDAQLFGTGGNGG

SEQ ID NO: 669096 - protein, 21 aa, Mycobacterium
GNGGTAMVVGGTGGNGGAGGS

SEQ ID NO: 669097 - protein, 19 aa, Mycobacterium
GNGGVARNVFGNGDVTGGA

SEQ ID NO: 669098 - protein, 24 aa, Mycobacterium
GNGIALLRYLGASGPRIDWSKIHL

SEQ ID NO: 669099 - protein, 21 aa, Mycobacterium
GNGLARGGLRTPWVDVPVART

SEQ ID NO: 669100 - protein, 34 aa, Mycobacterium
GNGLRPEIWDEFTERFGIARVCEFYAASEGNSAF

SEQ ID NO: 669101 - protein, 24 aa, Mycobacterium
GNGPDGRSALFAFTSNAEIARVHP

SEQ ID NO: 669102 - protein, 18 aa, Mycobacterium
GNGPGFLYVTCRRPGGHF

SEQ ID NO: 669103 - protein, 20 aa, Mycobacterium
GNGPLAAFVDALSTVGYTVN

SEQ ID NO: 669104 - protein, 20 aa, Mycobacterium
GNGPLAAFVHALGSVGFDVA

SEQ ID NO: 669105 - protein, 25 aa, Mycobacterium
GNGRIGRLLIVLQFMIDDLLQEPLL

SEQ ID NO: 669106 - protein, 19 aa, Mycobacterium
GNGYPLGAVVTSRAVAEAF

SEQ ID NO: 669107 - protein, 23 aa, Mycobacterium
GNHCFHVFGVYPWTRFLGRGLDE

SEQ ID NO: 669108 - protein, 17 aa, Mycobacterium
GNHEKFAAISLDLLAEV

SEQ ID NO: 669109 - protein, 22 aa, Mycobacterium
GNHLGPTLSMRGIDNAAYYRLV

SEQ ID NO: 669110 - protein, 20 aa, Mycobacterium
GNHPVQFCSVLLEPPVKHRF

SEQ ID NO: 669111 - protein, 25 aa, Mycobacterium
GNHPVRLFIGSGMPTGLWGRVVDTF

SEQ ID NO: 669112 - protein, 19 aa, Mycobacterium
GNHSKRVFCEAVDVVCGIG

SEQ ID NO: 669113 - protein, 26 aa, Mycobacterium
GNIAGCLVQSGIMRRNAKARLLRDNV

SEQ ID NO: 669114 - protein, 27 aa, Mycobacterium
GNIAGCLVTSGIIRRNAKARLLRDNIV

SEQ ID NO: 669115 - protein, 26 aa, Mycobacterium
GNIAGCLVTSGIMRRNAKARLLRDNV

SEQ ID NO: 669116 - protein, 19 aa, Mycobacterium
GNIDLSFPYLDTAATRAIG

SEQ ID NO: 669117 - protein, 19 aa, Mycobacterium
GNIDLSFPYLDTAATRTIG

SEQ ID NO: 669118 - protein, 17 aa, Mycobacterium
GNIDTGLLISGDMGNGF

SEQ ID NO: 669119 - protein, 21 aa, Mycobacterium
GNIEMSEWLAYLEGVRATYPL

SEQ ID NO: 669120 - protein, 17 aa, Mycobacterium
GNIGFGNAGARLTDAFN

SEQ ID NO: 669121 - protein, 19 aa, Mycobacterium
GNIGIGLSGDGLRGFGALN

SEQ ID NO: 669122 - protein, 17 aa, Mycobacterium
GNIGRNAWLAAGYPEEV

SEQ ID NO: 669123 - protein, 26 aa, Mycobacterium
GNIPFALSAWTIRFLTRLPQKSVTAL

SEQ ID NO: 669124 - protein, 23 aa, Mycobacterium
GNIQRSADELVFMREQAAQAAKK

SEQ ID NO: 669125 - protein, 19 aa, Mycobacterium
GNITAYWRGYNEYHRDGLS

SEQ ID NO: 669126 - protein, 18 aa, Mycobacterium
GNITKLKLAEHMVDGAAI

SEQ ID NO: 669127 - protein, 23 aa, Mycobacterium
GNKISWADLIIFAGNCALESFGF

SEQ ID NO: 669128 - protein, 26 aa, Mycobacterium
GNKRLGWAACRTFLAINAQWISAPED

SEQ ID NO: 669129 - protein, 25 aa, Mycobacterium
GNKRTAWAAAWTFLHINGVQLAADF

SEQ ID NO: 669130 - protein, 29 aa, Mycobacterium
GNKRTAWASAWTFLYINGIELVAGFDVDT

SEQ ID NO: 669131 - protein, 22 aa, Mycobacterium
GNKSLNFRLRFRAADRTLTEDE

SEQ ID NO: 669132 - protein, 22 aa, Mycobacterium
GNKTWFPAWQFDGRRLRADLPR

SEQ ID NO: 669133 - protein, 17 aa, Mycobacterium
GNLAAAVALHYRDAGEP

SEQ ID NO: 669134 - protein, 17 aa, Mycobacterium
GNLAFKQAHVIADADTT

SEQ ID NO: 669135 - protein, 25 aa, Mycobacterium
GNLDPVLLLAGWPVVERAARAVVDD

SEQ ID NO: 669136 - protein, 26 aa, Mycobacterium
GNLDPVVLLAGWPAVERAARAVVDDG

SEQ ID NO: 669137 - protein, 25 aa, Mycobacterium
GNLDPVVLLAGWPVVEKAVRRVVED

SEQ ID NO: 669138 - protein, 26 aa, Mycobacterium
GNLDPVVLLAGWPVVERAARAVVDDG

SEQ ID NO: 669139 - protein, 22 aa, Mycobacterium
GNLDPVVLMAGWPAVERAARAV

SEQ ID NO: 669140 - protein, 22 aa, Mycobacterium
GNLEFAGFIVWLAVAAPDMPGG

SEQ ID NO: 669141 - protein, 27 aa, Mycobacterium
GNLEVDSRAGLLFVDWERGSTLHLTGH

SEQ ID NO: 669142 - protein, 18 aa, Mycobacterium
GNLGDFNLGFGNTGVGNI

SEQ ID NO: 669143 - protein, 21 aa, Mycobacterium
GNLGFGLSGSNLIGFGNAYYN

SEQ ID NO: 669144 - protein, 34 aa, Mycobacterium
GNLHVDPRCGLLIPDWRTGSTLQLTGTARLNWDE

SEQ ID NO: 669145 - protein, 18 aa, Mycobacterium
GNLLDLPHDRWLPRRRTL

SEQ ID NO: 669146 - protein, 28 aa, Mycobacterium
GNLLEYLCLCLTTICGRWQRAGERVTRP

SEQ ID NO: 669147 - protein, 21 aa, Mycobacterium
GNLLGGMPLAGAGAGGHAGVG

SEQ ID NO: 669148 - protein, 21 aa, Mycobacterium
GNLLGGMPLAGVGGGSTGAGP

SEQ ID NO: 669149 - protein, 25 aa, Mycobacterium
GNLLQRPRCLYFRDVSAACNRRGPD

SEQ ID NO: 669150 - protein, 25 aa, Mycobacterium
GNLLQRPRCPYFRDVSAACNRRAPG

SEQ ID NO: 669151 - protein, 27 aa, Mycobacterium
GNLMPPRGVGVIELRGECVTPGYMTMG

SEQ ID NO: 669152 - protein, 25 aa, Mycobacterium
GNLMQRPRCLYFRDVTAACNRREPG

SEQ ID NO: 669153 - protein, 21 aa, Mycobacterium
GNLPAKLAGFVGRQAELAELG

SEQ ID NO: 669154 - protein, 17 aa, Mycobacterium
GNLPPAAKRQVRRKQRQ

SEQ ID NO: 669155 - protein, 18 aa, Mycobacterium
GNLPRLNSAMVRLMGSDL

SEQ ID NO: 669156 - protein, 17 aa, Mycobacterium
GNLRYLSFPSMPPLDGP

SEQ ID NO: 669157 - protein, 17 aa, Mycobacterium
GNLSGILNFGSGNTGSF

SEQ ID NO: 669158 - protein, 17 aa, Mycobacterium
GNLTGLFNTGSNMSGVF

SEQ ID NO: 669159 - protein, 17 aa, Mycobacterium
GNLTRRRVPPLTEPMGE

SEQ ID NO: 669160 - protein, 18 aa, Mycobacterium
GNLTYRHMLEGEPATLST

SEQ ID NO: 669161 - protein, 26 aa, Mycobacterium
GNLVLASRGTPLWATATNGQQVVRAE

SEQ ID NO: 669162 - protein, 25 aa, Mycobacterium
GNLVLTEGGSPVWASDTSGHSAGRA

SEQ ID NO: 669163 - protein, 19 aa, Mycobacterium
GNLVLYARDKAVWSTGTNG

SEQ ID NO: 669164 - protein, 22 aa, Mycobacterium
GNLVMARGVIKTARIMFDSADA

SEQ ID NO: 669165 - protein, 20 aa, Mycobacterium
GNLYASVVDHGQWKDHREGE

SEQ ID NO: 669166 - protein, 29 aa, Mycobacterium
GNMADPGSVAYLFSRKGVVTLEKNGLTED

SEQ ID NO: 669167 - protein, 29 aa, Mycobacterium
GNMADPGSVAYLFTRKGVVTLDKNGLSED

SEQ ID NO: 669168 - protein, 23 aa, Mycobacterium
GNMGFPMACRLIQEKHDVVAFDT

SEQ ID NO: 669169 - protein, 21 aa, Mycobacterium
GNMGFPMARRLIQEGHDVVAF

SEQ ID NO: 669170 - protein, 25 aa, Mycobacterium
GNMSPEYGATCAIFPIDDITLDYLR

SEQ ID NO: 669171 - protein, 20 aa, Mycobacterium
GNNKIALVIDDLVSTQPWSP

SEQ ID NO: 669172 - protein, 18 aa, Mycobacterium
GNNLPLERGMAFSVEPGV

SEQ ID NO: 669173 - protein, 24 aa, Mycobacterium
GNNLSRPKAIFARHNAAVRQGATK

SEQ ID NO: 669174 - protein, 25 aa, Mycobacterium
GNNTPVFFIRDAIKFPDFIRSQKRL

SEQ ID NO: 669175 - protein, 28 aa, Mycobacterium
GNNTPVFFIRDGLKFQHFIRSQKRRADT

SEQ ID NO: 669176 - protein, 17 aa, Mycobacterium
GNPAFRFVNVYRVVTNL

SEQ ID NO: 669177 - protein, 25 aa, Mycobacterium
GNPAHWHDFFASWPLLYVSHLMSLV

SEQ ID NO: 669178 - protein, 19 aa, Mycobacterium
GNPDIDFLVVREGTEGPYT

SEQ ID NO: 669179 - protein, 19 aa, Mycobacterium
GNPDIDFVVVREGTEGPYT

SEQ ID NO: 669180 - protein, 29 aa, Mycobacterium
GNPDYGLRLSWDFLARSTAGLRDWEERLG

SEQ ID NO: 669181 - protein, 31 aa, Mycobacterium
GNPDYSVQMSWDFLARSTAGLWEWAQRLGDD

SEQ ID NO: 669182 - protein, 19 aa, Mycobacterium
GNPEIDFVVVREGTEGPYT

SEQ ID NO: 669183 - protein, 29 aa, Mycobacterium
GNPGDALWGEAFFAPYVDMGAWPVPNLLA

SEQ ID NO: 669184 - protein, 24 aa, Mycobacterium
GNPGRRYPCQDIGLELLDTGSEWL

SEQ ID NO: 669185 - protein, 23 aa, Mycobacterium
GNPHGGLCIDTWHVHRSGTDYRK

SEQ ID NO: 669186 - protein, 18 aa, Mycobacterium
GNPHVARLLGSFETEWEG

SEQ ID NO: 669187 - protein, 20 aa, Mycobacterium
GNPHVARLLGTYEMAAPDGT

SEQ ID NO: 669188 - protein, 21 aa, Mycobacterium
GNPHVARLLGTYEMAGPDAGS

SEQ ID NO: 669189 - protein, 21 aa, Mycobacterium
GNPHVARLLGTYEMTGPGDET

SEQ ID NO: 669190 - protein, 17 aa, Mycobacterium
GNPHVGHAYEYVATDAI

SEQ ID NO: 669191 - protein, 19 aa, Mycobacterium
GNPIEQWRAAKKAACDAIV

SEQ ID NO: 669192 - protein, 22 aa, Mycobacterium
GNPNMIELIAKWRTGASKYGLA

SEQ ID NO: 669193 - protein, 26 aa, Mycobacterium
GNPPDRPWNLPAWVNSLFGAAYYHNT

SEQ ID NO: 669194 - protein, 20 aa, Mycobacterium
GNPPLFHLTLFYRHPVAGYK

SEQ ID NO: 669195 - protein, 18 aa, Mycobacterium
GNPPLQAWTDGINTNLVG

SEQ ID NO: 669196 - protein, 19 aa, Mycobacterium
GNPPWVMAPMIATAEEAKT

SEQ ID NO: 669197 - protein, 34 aa, Mycobacterium
GNPRDGWTLVSWNGKPVWPGWAAKRTDRDPKQPL

SEQ ID NO: 669198 - protein, 22 aa, Mycobacterium
GNPRNAFWRIMGSLYGFAPDAA

SEQ ID NO: 669199 - protein, 24 aa, Mycobacterium
GNPRNPALLLLHGFPTSSHMFRNL

SEQ ID NO: 669200 - protein, 26 aa, Mycobacterium
GNPRRLAVTCVFRLHDGVNRAALEQL

SEQ ID NO: 669201 - protein, 18 aa, Mycobacterium
GNPTPLPAALGVFPASAQ

SEQ ID NO: 669202 - protein, 17 aa, Mycobacterium
GNPTRAALEAALAAVEE

SEQ ID NO: 669203 - protein, 23 aa, Mycobacterium
GNPVCAAAALAVLRVVASEGLVR

SEQ ID NO: 669204 - protein, 19 aa, Mycobacterium
GNPVCTAAALAVLKVLADD

SEQ ID NO: 669205 - protein, 22 aa, Mycobacterium
GNPVCTAAALAVLRTLATEDLV

SEQ ID NO: 669206 - protein, 19 aa, Mycobacterium
GNPVCTAAGLAVLKTLAAE

SEQ ID NO: 669207 - protein, 18 aa, Mycobacterium
GNPVICTQGKVIPGLIEW

SEQ ID NO: 669208 - protein, 23 aa, Mycobacterium
GNPVILPTVWDAWSAHLAVDAGF

SEQ ID NO: 669209 - protein, 25 aa, Mycobacterium
GNPWADVVPPGIERVVLIGMGSSAY

SEQ ID NO: 669210 - protein, 22 aa, Mycobacterium
GNPWLCAQGIKLIDNDLFRDRM

SEQ ID NO: 669211 - protein, 25 aa, Mycobacterium
GNQLRRMGVGASRRFSTTTRDSLVS

SEQ ID NO: 669212 - protein, 25 aa, Mycobacterium
GNQVKRLKVGTARRFSRTTEKSLVS

SEQ ID NO: 669213 - protein, 19 aa, Mycobacterium
GNRDLAIVVANNAQARAFN

SEQ ID NO: 669214 - protein, 24 aa, Mycobacterium
GNRGIGLAIARRLAADGHKVAVTH

SEQ ID NO: 669215 - protein, 21 aa, Mycobacterium
GNRHFSFGIGVHRCIGSNVAR

SEQ ID NO: 669216 - protein, 24 aa, Mycobacterium
GNRINRLRLGVCVTDVGRRNPAVT

SEQ ID NO: 669217 - protein, 18 aa, Mycobacterium
GNRLGRRGAAWGVGVGLA

SEQ ID NO: 669218 - protein, 25 aa, Mycobacterium
GNRLGRRGAKWGAGVGLAVGLFSPA

SEQ ID NO: 669219 - protein, 22 aa, Mycobacterium
GNRLPVPLYPGFDTLGTLEHIT

SEQ ID NO: 669220 - protein, 17 aa, Mycobacterium
GNRMAAAIPTRVGGRQP

SEQ ID NO: 669221 - protein, 25 aa, Mycobacterium
GNRRAREALRLAGHTFPNVTIADAV

SEQ ID NO: 669222 - protein, 20 aa, Mycobacterium
GNSAELRPFVAREVMPGDLS

SEQ ID NO: 669223 - protein, 19 aa, Mycobacterium
GNSAWPRLETDTHLMCVGS

SEQ ID NO: 669224 - protein, 17 aa, Mycobacterium
GNSERPYLLAVIVPTVD

SEQ ID NO: 669225 - protein, 17 aa, Mycobacterium
GNSERPYLLAVVVPTAD

SEQ ID NO: 669226 - protein, 22 aa, Mycobacterium
GNSERSFLLAVVVPTPEALEQY

SEQ ID NO: 669227 - protein, 22 aa, Mycobacterium
GNSERSFLLAVVVPTPEVLERY

SEQ ID NO: 669228 - protein, 20 aa, Mycobacterium
GNSFGAFVPKGITLRIYGDA

SEQ ID NO: 669229 - protein, 22 aa, Mycobacterium
GNSFGAFVPKGITLRVYGDAND

SEQ ID NO: 669230 - protein, 23 aa, Mycobacterium
GNSGEVNTGFGIATDSGATNSGF

SEQ ID NO: 669231 - protein, 20 aa, Mycobacterium
GNSGFFNFGFGNSGTGNTGV

SEQ ID NO: 669232 - protein, 22 aa, Mycobacterium
GNSGFTGNLGVPGSNGLPGTIV

SEQ ID NO: 669233 - protein, 25 aa, Mycobacterium
GNSIITRVAARYGLASTNVPSDGMW

SEQ ID NO: 669234 - protein, 17 aa, Mycobacterium
GNSKWAGEVLLREAHDR

SEQ ID NO: 669235 - protein, 17 aa, Mycobacterium
GNSKWAGEVLLREAHDW

SEQ ID NO: 669236 - protein, 26 aa, Mycobacterium
GNSLFITVNCWGRLVTGVGAALGKGA

SEQ ID NO: 669237 - protein, 20 aa, Mycobacterium
GNSLGGWVAFELERRGRART

SEQ ID NO: 669238 - protein, 26 aa, Mycobacterium
GNSLITSWRALGWIGPAASEISETSA

SEQ ID NO: 669239 - protein, 24 aa, Mycobacterium
GNSLSRPKAIFARHNAAVRRGAVQ

SEQ ID NO: 669240 - protein, 25 aa, Mycobacterium
GNSPARFAIEGGRILPDPGQELAWL

SEQ ID NO: 669241 - protein, 18 aa, Mycobacterium
GNSPPPFLNLLLGQTVQY

SEQ ID NO: 669242 - protein, 27 aa, Mycobacterium
GNSTFRYAAPAGREWTTADLAGKRIAT

SEQ ID NO: 669243 - protein, 17 aa, Mycobacterium
GNSVFYELAHPLVSELL

SEQ ID NO: 669244 - protein, 21 aa, Mycobacterium
GNSWPQTRLTLALSPATLPKM

SEQ ID NO: 669245 - protein, 25 aa, Mycobacterium
GNSYGGSCALRLALDTPHRVGKLVL

SEQ ID NO: 669246 - protein, 23 aa, Mycobacterium
GNTDPQYSEWLAFSGTSVTLDGE

SEQ ID NO: 669247 - protein, 19 aa, Mycobacterium
GNTEFRIWSTTGRDVSSVS

SEQ ID NO: 669248 - protein, 17 aa, Mycobacterium
GNTEKRWDTARVAKLSE

SEQ ID NO: 669249 - protein, 20 aa, Mycobacterium
GNTELGWRMEVNDDGQWAFF

SEQ ID NO: 669250 - protein, 24 aa, Mycobacterium
GNTEVKSFVQKVCNEQLQHWFDSN

SEQ ID NO: 669251 - protein, 17 aa, Mycobacterium
GNTFEWDQDSTYVRKPP

SEQ ID NO: 669252 - protein, 18 aa, Mycobacterium
GNTFEWDQDSTYVRKPPY

SEQ ID NO: 669253 - protein, 25 aa, Mycobacterium
GNTGDHAWSRLLFFEAAEGGAGVLR

SEQ ID NO: 669254 - protein, 17 aa, Mycobacterium
GNTGDWNVGGGNMGSFN

SEQ ID NO: 669255 - protein, 20 aa, Mycobacterium
GNTGEANWGLGNSGSNNVGF

SEQ ID NO: 669256 - protein, 29 aa, Mycobacterium
GNTIAWLYSQRRFEVPSDKIANTMKLAIV

SEQ ID NO: 669257 - protein, 28 aa, Mycobacterium
GNTIAWLYSQRRFEVPSEQIANTMKLAI

SEQ ID NO: 669258 - protein, 21 aa, Mycobacterium
GNTPVGWGISRIVYPAWLNAI

SEQ ID NO: 669259 - protein, 17 aa, Mycobacterium
GNTRFVVLLPLQAPPPD

SEQ ID NO: 669260 - protein, 25 aa, Mycobacterium
GNTSYRLPLMRKLMFTENEDTDTLD

SEQ ID NO: 669261 - protein, 26 aa, Mycobacterium
GNTWECLAHIYLRRVLAATEAWPVTL

SEQ ID NO: 669262 - protein, 19 aa, Mycobacterium
GNTWLEPLWNSSRIDHVQI

SEQ ID NO: 669263 - protein, 22 aa, Mycobacterium
GNVAPQYSEWIAFSGTSVTLDG

SEQ ID NO: 669264 - protein, 28 aa, Mycobacterium
GNVCAHFNMCLHRGMQVCRAEMGNASHF

SEQ ID NO: 669265 - protein, 21 aa, Mycobacterium
GNVDETAWRYSLMNWGHDPTK

SEQ ID NO: 669266 - protein, 18 aa, Mycobacterium
GNVEYFLRLRAETDSPLE

SEQ ID NO: 669267 - protein, 20 aa, Mycobacterium
GNVEYFLRLRAQADRPLAGD

SEQ ID NO: 669268 - protein, 22 aa, Mycobacterium
GNVGLFNSYIGNFGLGNSGLLN

SEQ ID NO: 669269 - protein, 17 aa, Mycobacterium
GNVGVCIATSGPGAIHL

SEQ ID NO: 669270 - protein, 19 aa, Mycobacterium
GNVHLAIICKEPTKKKQLM

SEQ ID NO: 669271 - protein, 18 aa, Mycobacterium
GNVIAWASSGHVGFKGSR

SEQ ID NO: 669272 - protein, 20 aa, Mycobacterium
GNVIRIGAAVGETVEAGQAL

SEQ ID NO: 669273 - protein, 19 aa, Mycobacterium
GNVISWASSGHVGFKGSRK

SEQ ID NO: 669274 - protein, 18 aa, Mycobacterium
GNVLFGFNRLSIIDIAHS

SEQ ID NO: 669275 - protein, 27 aa, Mycobacterium
GNVLKIRPPLVFSMADVDWFCTEFAGA

SEQ ID NO: 669276 - protein, 26 aa, Mycobacterium
GNVLKIRPPLVFSRSDVDWFCTELDD

SEQ ID NO: 669277 - protein, 17 aa, Mycobacterium
GNVMYATGISWPLADAG

SEQ ID NO: 669278 - protein, 19 aa, Mycobacterium
GNVNPIWAYAHVPFGYDGD

SEQ ID NO: 669279 - protein, 23 aa, Mycobacterium
GNVPIAPIWLCPLRLRDHEGWPL

SEQ ID NO: 669280 - protein, 21 aa, Mycobacterium
GNVRAKYGWTDVARFAALGIP

SEQ ID NO: 669281 - protein, 20 aa, Mycobacterium
GNVTAWRFLSPPSAFLEGLT

SEQ ID NO: 669282 - protein, 29 aa, Mycobacterium
GNVTKRGGALWKRVHTTSRVWAFQLQSIL

SEQ ID NO: 669283 - protein, 19 aa, Mycobacterium
GNVTYRHMLDGAPVPLRTE

SEQ ID NO: 669284 - protein, 19 aa, Mycobacterium
GNVVVCGRVKDVIIMAGRN

SEQ ID NO: 669285 - protein, 17 aa, Mycobacterium
GNWCPTVMRPDRTGWAS

SEQ ID NO: 669286 - protein, 18 aa, Mycobacterium
GNWLPEPVVTGFGPPASE

SEQ ID NO: 669287 - protein, 20 aa, Mycobacterium
GNWLPSLLFRRLERLQLAYA

SEQ ID NO: 669288 - protein, 25 aa, Mycobacterium
GNWLSSPYSHWAFQHVEDFMPTALI

SEQ ID NO: 669289 - protein, 40 aa, Mycobacterium
GNWSFSDARLYAERNWGAGFPERWWWGQAHDFPAADVSVA

SEQ ID NO: 669290 - protein, 24 aa, Mycobacterium
GNWSRRAWVGAGYLVARRLDADGV

SEQ ID NO: 669291 - protein, 17 aa, Mycobacterium
GNYATLDYCWLRSDIAD

SEQ ID NO: 669292 - protein, 18 aa, Mycobacterium
GNYLPKFGPYLSSASNPW

SEQ ID NO: 669293 - protein, 19 aa, Mycobacterium
GNYLPRFGPYLSSASNPWG

SEQ ID NO: 669294 - protein, 18 aa, Mycobacterium
GNYMTAPYARGWAANLAL

SEQ ID NO: 669295 - protein, 20 aa, Mycobacterium
GNYRRGYALEYDRDLAKLGG

SEQ ID NO: 669296 - protein, 31 aa, Mycobacterium
GNYSNGLLWRGDYQGLLGFTYESTVPAIPWN

SEQ ID NO: 669297 - protein, 31 aa, Mycobacterium
GNYSNGLLWRGDYQGLWGIDYAITIPDTAIP

SEQ ID NO: 669298 - protein, 18 aa, Mycobacterium
GPAAAKFFAALAVGDTAT

SEQ ID NO: 669299 - protein, 22 aa, Mycobacterium
GPAAEFFNRTGVIRATRANAAA

SEQ ID NO: 669300 - protein, 18 aa, Mycobacterium
GPAAERFQALTLHAEQLR

SEQ ID NO: 669301 - protein, 23 aa, Mycobacterium
GPAALPWGDLGVDVVVESTGLFT

SEQ ID NO: 669302 - protein, 18 aa, Mycobacterium
GPAALRRTPLQAAAGTAV

SEQ ID NO: 669303 - protein, 19 aa, Mycobacterium
GPAAMLNQAEKVWAAAGVS

SEQ ID NO: 669304 - protein, 24 aa, Mycobacterium
GPAAMPWGDLGVDVVVESTGLFTN

SEQ ID NO: 669305 - protein, 19 aa, Mycobacterium
GPAAQRCLERAGMTVADID

SEQ ID NO: 669306 - protein, 20 aa, Mycobacterium
GPAARPAARCTAGNRSETGR

SEQ ID NO: 669307 - protein, 19 aa, Mycobacterium
GPAARVVVTGGWRHSSEVM

SEQ ID NO: 669308 - protein, 19 aa, Mycobacterium
GPAASAFTLPELIGLTSTC

SEQ ID NO: 669309 - protein, 18 aa, Mycobacterium
GPAASRCGGNPAWDLPLV

SEQ ID NO: 669310 - protein, 19 aa, Mycobacterium
GPAATRFKDVIDRWNAESV

SEQ ID NO: 669311 - protein, 19 aa, Mycobacterium
GPADARRVGFGIGAEVTKL

SEQ ID NO: 669312 - protein, 22 aa, Mycobacterium
GPADRLSPLMLAFRRAAVERGF

SEQ ID NO: 669313 - protein, 40 aa, Mycobacterium
GPADTRVAAVAPCTSDTGTAGKCARRASATVASQSTGTAG

SEQ ID NO: 669314 - protein, 22 aa, Mycobacterium
GPAEPLPAVFADAGGYFDAISW

SEQ ID NO: 669315 - protein, 22 aa, Mycobacterium
GPAESYASLGPLLEEISAHVDG

SEQ ID NO: 669316 - protein, 22 aa, Mycobacterium
GPAESYKSLGPLLEEISAHVDG

SEQ ID NO: 669317 - protein, 24 aa, Mycobacterium
GPAEWHDVMEALLLGAFISEGFVS

SEQ ID NO: 669318 - protein, 26 aa, Mycobacterium
GPAFFPPIVAIALPFEHQHPSEFPSL

SEQ ID NO: 669319 - protein, 18 aa, Mycobacterium
GPAGDFFRRTGVIRATRA

SEQ ID NO: 669320 - protein, 20 aa, Mycobacterium
GPAGEFFKRTGVIRATRDNA

SEQ ID NO: 669321 - protein, 20 aa, Mycobacterium
GPAGIFLARYDDWLERAQQM

SEQ ID NO: 669322 - protein, 22 aa, Mycobacterium
GPAGSWGLITCTKPSGKEAEGI

SEQ ID NO: 669323 - protein, 25 aa, Mycobacterium
GPAGTGGHGGWLYGNGGAGGIGGAG

SEQ ID NO: 669324 - protein, 23 aa, Mycobacterium
GPAHLNLRVRAHALAHGIADDEI

SEQ ID NO: 669325 - protein, 18 aa, Mycobacterium
GPAHSAFTLPELIGLTGC

SEQ ID NO: 669326 - protein, 20 aa, Mycobacterium
GPALDASPMGAVYREIAPSD

SEQ ID NO: 669327 - protein, 30 aa, Mycobacterium
GPALERYCKLRDAWLSARRDLLDRRNRMRE

SEQ ID NO: 669328 - protein, 22 aa, Mycobacterium
GPALEVGRRFAIKQPGMAKLTW

SEQ ID NO: 669329 - protein, 32 aa, Mycobacterium
GPALGLRADDDWPRHEMDLPAGHGLLLLTDGL

SEQ ID NO: 669330 - protein, 17 aa, Mycobacterium
GPALLDYIAEYRRRAGI

SEQ ID NO: 669331 - protein, 17 aa, Mycobacterium
GPALLLGARGRRLDPRQ

SEQ ID NO: 669332 - protein, 18 aa, Mycobacterium
GPALLWIHGGGTVMGSAA

SEQ ID NO: 669333 - protein, 17 aa, Mycobacterium
GPAMCAAAAQIVELRAR

SEQ ID NO: 669334 - protein, 18 aa, Mycobacterium
GPANLRAALAVAGSPAAR

SEQ ID NO: 669335 - protein, 19 aa, Mycobacterium
GPAPEVWRPPANGDGVVAS

SEQ ID NO: 669336 - protein, 23 aa, Mycobacterium
GPAPMLAAAAAWDGLAADLQASA

SEQ ID NO: 669337 - protein, 28 aa, Mycobacterium
GPAQRAGLELLAFGGRFVEIGKRDIYAD

SEQ ID NO: 669338 - protein, 18 aa, Mycobacterium
GPARARVADRIRQLDATD

SEQ ID NO: 669339 - protein, 19 aa, Mycobacterium
GPARIEVLEEIFAENDVRA

SEQ ID NO: 669340 - protein, 17 aa, Mycobacterium
GPARLAIDTGARLLPAH

SEQ ID NO: 669341 - protein, 17 aa, Mycobacterium
GPARMYIFTSFHQSPLP

SEQ ID NO: 669342 - protein, 18 aa, Mycobacterium
GPARSMLAEHLSTWEEET

SEQ ID NO: 669343 - protein, 25 aa, Mycobacterium
GPARSRAYDRAWWFTRFVADTYGTT

SEQ ID NO: 669344 - protein, 21 aa, Mycobacterium
GPASARLFVASALARLGPLLV

SEQ ID NO: 669345 - protein, 20 aa, Mycobacterium
GPASHYATTGPEIWADTDGK

SEQ ID NO: 669346 - protein, 19 aa, Mycobacterium
GPASSHFAGGAGGAGGHGG

SEQ ID NO: 669347 - protein, 17 aa, Mycobacterium
GPASVCFTDGTIVGAVL

SEQ ID NO: 669348 - protein, 18 aa, Mycobacterium
GPASVCFTDGTVIGAVLD

SEQ ID NO: 669349 - protein, 17 aa, Mycobacterium
GPASVIWDKGTKNAIGL

SEQ ID NO: 669350 - protein, 22 aa, Mycobacterium
GPASVRYSSRWDVDGWVGYYYY

SEQ ID NO: 669351 - protein, 18 aa, Mycobacterium
GPATAVVACTAELTHEIL

SEQ ID NO: 669352 - protein, 24 aa, Mycobacterium
GPATRAVVIYLEYLGTTLGDLLNA

SEQ ID NO: 669353 - protein, 24 aa, Mycobacterium
GPATRAVVIYLEYVGTTLGDLLNA

SEQ ID NO: 669354 - protein, 24 aa, Mycobacterium
GPATRRPIHLTGLDKTFALYPTLD

SEQ ID NO: 669355 - protein, 24 aa, Mycobacterium
GPATRRPIHLTGLDKTFPLYPALD

SEQ ID NO: 669356 - protein, 23 aa, Mycobacterium
GPATRRPIHLTGLDKTFPLYPTL

SEQ ID NO: 669357 - protein, 24 aa, Mycobacterium
GPATRRPIHLTGLDKTFPLYPTLD

SEQ ID NO: 669358 - protein, 17 aa, Mycobacterium
GPAVLMWPSLLMTGDLW

SEQ ID NO: 669359 - protein, 18 aa, Mycobacterium
GPAVPDWFWVDDEYDEKG

SEQ ID NO: 669360 - protein, 19 aa, Mycobacterium
GPAVVVLRPEQLRVGTDGS

SEQ ID NO: 669361 - protein, 19 aa, Mycobacterium
GPAWPRLETDTHLMAIGSG

SEQ ID NO: 669362 - protein, 22 aa, Mycobacterium
GPAYNTGGPWGYTPKGGTGVPV

SEQ ID NO: 669363 - protein, 21 aa, Mycobacterium
GPAYPRGFMRLGGATGPASAR

SEQ ID NO: 669364 - protein, 20 aa, Mycobacterium
GPCAFMDTFDPATVFSSIDH

SEQ ID NO: 669365 - protein, 18 aa, Mycobacterium
GPCCVEIVAATPLALVSR

SEQ ID NO: 669366 - protein, 21 aa, Mycobacterium
GPCFEVPKEQRIWRVDDVNSE

SEQ ID NO: 669367 - protein, 21 aa, Mycobacterium
GPCHPADLAAVIGLDASAAGR

SEQ ID NO: 669368 - protein, 22 aa, Mycobacterium
GPCPAIRIPLRGDIEVDTPYVL

SEQ ID NO: 669369 - protein, 18 aa, Mycobacterium
GPCVLFAKLNPRIPRIWN

SEQ ID NO: 669370 - protein, 19 aa, Mycobacterium
GPDAARLRELLVGPIDDDE

SEQ ID NO: 669371 - protein, 25 aa, Mycobacterium
GPDALRILRLHLVHLLQTLSPHTAE

SEQ ID NO: 669372 - protein, 23 aa, Mycobacterium
GPDATRTALRFVNDAPWDGTMTT

SEQ ID NO: 669373 - protein, 20 aa, Mycobacterium
GPDDIKAVLLTHAHVDHFGT

SEQ ID NO: 669374 - protein, 18 aa, Mycobacterium
GPDDLFWLGTNEALEQGR

SEQ ID NO: 669375 - protein, 22 aa, Mycobacterium
GPDFPIYLAGAVVESLIPIGPL

SEQ ID NO: 669376 - protein, 29 aa, Mycobacterium
GPDGARLPAHLWAQYGLAGVLEHEGFVRD

SEQ ID NO: 669377 - protein, 17 aa, Mycobacterium
GPDGASHHGMWDLALLT

SEQ ID NO: 669378 - protein, 17 aa, Mycobacterium
GPDGASHNGMWDLSILG

SEQ ID NO: 669379 - protein, 21 aa, Mycobacterium
GPDGIRAGAAMTRAIQTAGLS

SEQ ID NO: 669380 - protein, 18 aa, Mycobacterium
GPDGKRWRRAVGDLAAGF

SEQ ID NO: 669381 - protein, 26 aa, Mycobacterium
GPDGMALCRRLRQNGHYSVPVILLTA

SEQ ID NO: 669382 - protein, 19 aa, Mycobacterium
GPDGQGWRITGQKVWTSYA

SEQ ID NO: 669383 - protein, 25 aa, Mycobacterium
GPDGRAWPALDFVRPWDSLTDDERR

SEQ ID NO: 669384 - protein, 29 aa, Mycobacterium
GPDGRDCPDWVPGELWVGGRGIARGYCAR

SEQ ID NO: 669385 - protein, 22 aa, Mycobacterium
GPDGRHDFVMFGRLNPYKNVDV

SEQ ID NO: 669386 - protein, 21 aa, Mycobacterium
GPDGRMIRLDMGWREQQVAAE

SEQ ID NO: 669387 - protein, 18 aa, Mycobacterium
GPDGRPRYVTAIDAETGT

SEQ ID NO: 669388 - protein, 27 aa, Mycobacterium
GPDGSRLPSLMWAQYGLAGLLEFEGFV

SEQ ID NO: 669389 - protein, 17 aa, Mycobacterium
GPDGTLIRDAHVETSAF

SEQ ID NO: 669390 - protein, 25 aa, Mycobacterium
GPDGVLRWLALDGQPVHQFTVAASE

SEQ ID NO: 669391 - protein, 27 aa, Mycobacterium
GPDGVLRWLALDGRPIHQFTVAASELY

SEQ ID NO: 669392 - protein, 26 aa, Mycobacterium
GPDGVPRWLALDGTPLHHATVAASEF

SEQ ID NO: 669393 - protein, 22 aa, Mycobacterium
GPDIALSMFGTTLFQSGTAHAT

SEQ ID NO: 669394 - protein, 18 aa, Mycobacterium
GPDILDWLYEEHVVKQRT

SEQ ID NO: 669395 - protein, 17 aa, Mycobacterium
GPDISGMLEPLFGAEGL

SEQ ID NO: 669396 - protein, 20 aa, Mycobacterium
GPDLFACLGPFPKATPENIA

SEQ ID NO: 669397 - protein, 27 aa, Mycobacterium
GPDLGFKRRSCCLFYRVPGGGTCGDCP

SEQ ID NO: 669398 - protein, 18 aa, Mycobacterium
GPDLHIYLTKGADQNAVS

SEQ ID NO: 669399 - protein, 34 aa, Mycobacterium
GPDLLAWRTEFFPKFPGTPGTEWHQVRNYQYATG

SEQ ID NO: 669400 - protein, 21 aa, Mycobacterium
GPDLRLAIVAGDRRTVERVQG

SEQ ID NO: 669401 - protein, 21 aa, Mycobacterium
GPDLRLAVLAGDQRTVERVHG

SEQ ID NO: 669402 - protein, 22 aa, Mycobacterium
GPDLRVAVLAGDHRTVERVHGR

SEQ ID NO: 669403 - protein, 20 aa, Mycobacterium
GPDLSLRFFAPKADEDTPES

SEQ ID NO: 669404 - protein, 19 aa, Mycobacterium
GPDNDEWLTAHGIIPVNYG

SEQ ID NO: 669405 - protein, 22 aa, Mycobacterium
GPDQIPALLGILAAGAVYVPVG

SEQ ID NO: 669406 - protein, 18 aa, Mycobacterium
GPDRGRVVGVTYRAQSGE

SEQ ID NO: 669407 - protein, 18 aa, Mycobacterium
GPDRNWRAESWDIDMPNQ

SEQ ID NO: 669408 - protein, 17 aa, Mycobacterium
GPDRPAFVGTFDQIVED

SEQ ID NO: 669409 - protein, 22 aa, Mycobacterium
GPDRPGDTLAIYKDLEDYFGGA

SEQ ID NO: 669410 - protein, 18 aa, Mycobacterium
GPDRSAIRAKSWDIDMPN

SEQ ID NO: 669411 - protein, 18 aa, Mycobacterium
GPDRVPLLELLRSTPLTE

SEQ ID NO: 669412 - protein, 17 aa, Mycobacterium
GPDRVRISGVIGEAPPP

SEQ ID NO: 669413 - protein, 24 aa, Mycobacterium
GPDSAAIWPGILGFDDTVLPQLER

SEQ ID NO: 669414 - protein, 18 aa, Mycobacterium
GPDYGRFIDAVRALQDHA

SEQ ID NO: 669415 - protein, 21 aa, Mycobacterium
GPDYYERIGVSFELPNHYQKL

SEQ ID NO: 669416 - protein, 23 aa, Mycobacterium
GPEAGRLFLTQMITHHEGAIMMA

SEQ ID NO: 669417 - protein, 17 aa, Mycobacterium
GPEAMLEDAERTWKSAG

SEQ ID NO: 669418 - protein, 24 aa, Mycobacterium
GPECDVRAAIARRAIRATGLRSRL

SEQ ID NO: 669419 - protein, 20 aa, Mycobacterium
GPEDAEWRAIWRAVLAAGFE

SEQ ID NO: 669420 - protein, 26 aa, Mycobacterium
GPEEAGWRVGDDVVHRELGHGWVQGA

SEQ ID NO: 669421 - protein, 22 aa, Mycobacterium
GPEFTGERIVGMGFDRDVLLRA

SEQ ID NO: 669422 - protein, 19 aa, Mycobacterium
GPEGFARWMRESKAVGVTD

SEQ ID NO: 669423 - protein, 24 aa, Mycobacterium
GPEGLPYVQTHPWWPDAGDDPEAH

SEQ ID NO: 669424 - protein, 17 aa, Mycobacterium
GPEHAWLKDIGRVTYQP

SEQ ID NO: 669425 - protein, 18 aa, Mycobacterium
GPEHGIDLSDLVLARPVH

SEQ ID NO: 669426 - protein, 21 aa, Mycobacterium
GPEHGRPVMFVHGYLMGGQLW

SEQ ID NO: 669427 - protein, 20 aa, Mycobacterium
GPEHPELLALAAELGEAIAE

SEQ ID NO: 669428 - protein, 18 aa, Mycobacterium
GPEHSAFTLPELLGLVGL

SEQ ID NO: 669429 - protein, 26 aa, Mycobacterium
GPEILKAILDRTPWRAEEPVVIVAPM

SEQ ID NO: 669430 - protein, 30 aa, Mycobacterium
GPEILQLFSALELLHAWALIHDDVIDASST

SEQ ID NO: 669431 - protein, 19 aa, Mycobacterium
GPELGGRLRAGRSRNDQVA

SEQ ID NO: 669432 - protein, 26 aa, Mycobacterium
GPELLKRLKALPGFGEQKAKIFLALL

SEQ ID NO: 669433 - protein, 18 aa, Mycobacterium
GPELYSRQVHYLAQLVAA

SEQ ID NO: 669434 - protein, 26 aa, Mycobacterium
GPEMPIGAVLLSWLPLFHDMGLILGI

SEQ ID NO: 669435 - protein, 18 aa, Mycobacterium
GPENRMIENTGWTTAKNS

SEQ ID NO: 669436 - protein, 24 aa, Mycobacterium
GPEPHLVLPATPWHHTRHWIDVRP

SEQ ID NO: 669437 - protein, 22 aa, Mycobacterium
GPEPPRGDILGVRVSDEGVKFA

SEQ ID NO: 669438 - protein, 19 aa, Mycobacterium
GPEQLRRNLARVVGKPPAD

SEQ ID NO: 669439 - protein, 22 aa, Mycobacterium
GPERFLSTFVLLAACADRMAAN

SEQ ID NO: 669440 - protein, 18 aa, Mycobacterium
GPERFLSTFVLLAATAES

SEQ ID NO: 669441 - protein, 25 aa, Mycobacterium
GPERLPADHPLAVHFDVYQWLTVLQ

SEQ ID NO: 669442 - protein, 20 aa, Mycobacterium
GPERTGCLECGCCMTGCRYG

SEQ ID NO: 669443 - protein, 18 aa, Mycobacterium
GPESGYVTGASWNVDGGY

SEQ ID NO: 669444 - protein, 26 aa, Mycobacterium
GPESHGRGAVNAGLAITTVTANTTIA

SEQ ID NO: 669445 - protein, 18 aa, Mycobacterium
GPESMLNQAEKVWSAAGI

SEQ ID NO: 669446 - protein, 17 aa, Mycobacterium
GPESVAALKTYFDANPK

SEQ ID NO: 669447 - protein, 23 aa, Mycobacterium
GPESYGRFMQIRDFDCWMHELDV

SEQ ID NO: 669448 - protein, 18 aa, Mycobacterium
GPETRFQPTAAMLEALDP

SEQ ID NO: 669449 - protein, 37 aa, Mycobacterium
GPEVLRRLKRLPGFGDQKARIFLALLGKQYGVTPEGW

SEQ ID NO: 669450 - protein, 23 aa, Mycobacterium
GPEVLSYPLARTVLGDPRFGIPP

SEQ ID NO: 669451 - protein, 26 aa, Mycobacterium
GPEVSGWKIGDAVVGMLPLDRPGAAA

SEQ ID NO: 669452 - protein, 27 aa, Mycobacterium
GPEWVGFSVTMPGKFAALRFASTSTER

SEQ ID NO: 669453 - protein, 17 aa, Mycobacterium
GPEYDRRTVLDFDATPV

SEQ ID NO: 669454 - protein, 26 aa, Mycobacterium
GPFAAGGKTLWGIPWTESESQAAGTG

SEQ ID NO: 669455 - protein, 23 aa, Mycobacterium
GPFAGRLLGDMGAEVIKIELPSA

SEQ ID NO: 669456 - protein, 22 aa, Mycobacterium
GPFAGRLLGDMGAEVIKVEPPG

SEQ ID NO: 669457 - protein, 18 aa, Mycobacterium
GPFAGWSPKFLKQGKVTD

SEQ ID NO: 669458 - protein, 20 aa, Mycobacterium
GPFDLLLQLIFAHRLDVTEV

SEQ ID NO: 669459 - protein, 20 aa, Mycobacterium
GPFDLLLQLIFGHRLDVTEV

SEQ ID NO: 669460 - protein, 24 aa, Mycobacterium
GPFFLMDIDSFWTPLGSIPEFNRD

SEQ ID NO: 669461 - protein, 19 aa, Mycobacterium
GPFFRRGLMLLDFEEHMFH

SEQ ID NO: 669462 - protein, 22 aa, Mycobacterium
GPFGCPLGSMAAELKNDPAYQP

SEQ ID NO: 669463 - protein, 24 aa, Mycobacterium
GPFGGRPGFGFGFGSGPVDRRALH

SEQ ID NO: 669464 - protein, 18 aa, Mycobacterium
GPFHFLDPKLGYANDPAW

SEQ ID NO: 669465 - protein, 27 aa, Mycobacterium
GPFHRPKLPGIPGIKDFKGHAFHSSRW

SEQ ID NO: 669466 - protein, 26 aa, Mycobacterium
GPFHRPKLPGIPGIKDFKGHSFHSSR

SEQ ID NO: 669467 - protein, 26 aa, Mycobacterium
GPFHRPKLPGIPGIKDFRGHSFHSAR

SEQ ID NO: 669468 - protein, 20 aa, Mycobacterium
GPFLTDISKAWNLEQASQNP

SEQ ID NO: 669469 - protein, 19 aa, Mycobacterium
GPFLTDISNAWNFEGTDNP

SEQ ID NO: 669470 - protein, 19 aa, Mycobacterium
GPFLTDVSKAWNLDAATQN

SEQ ID NO: 669471 - protein, 20 aa, Mycobacterium
GPFLTDVSKAWNLDQATEKP

SEQ ID NO: 669472 - protein, 25 aa, Mycobacterium
GPFLTDVSKAWNLEAAHGKPFGHLA

SEQ ID NO: 669473 - protein, 18 aa, Mycobacterium
GPFPYPRNDGVVFGNFEG

SEQ ID NO: 669474 - protein, 19 aa, Mycobacterium
GPFRGWSVDRLEDVTPEQA

SEQ ID NO: 669475 - protein, 24 aa, Mycobacterium
GPFSSLCWGERIAFDNPDSLTLLG

SEQ ID NO: 669476 - protein, 24 aa, Mycobacterium
GPFSSLCWGERIAFDNPESLTLLG

SEQ ID NO: 669477 - protein, 20 aa, Mycobacterium
GPFSYLRPGTVLGADGKLGA

SEQ ID NO: 669478 - protein, 22 aa, Mycobacterium
GPFTFLRPGTVLGTGGKLGAFV

SEQ ID NO: 669479 - protein, 25 aa, Mycobacterium
GPFTRTGGFYARSWGTYLDRQPDEL

SEQ ID NO: 669480 - protein, 18 aa, Mycobacterium
GPFWKTNPWSAAYRQERL

SEQ ID NO: 669481 - protein, 28 aa, Mycobacterium
GPFYDGAVFHRVIDGFMIQGGDPTGTGR

SEQ ID NO: 669482 - protein, 28 aa, Mycobacterium
GPFYDGAVFHRVINGFMIQGGDPTGTGR

SEQ ID NO: 669483 - protein, 27 aa, Mycobacterium
GPFYDGAVFHRVIQGFMIQGGDPTGTG

SEQ ID NO: 669484 - protein, 17 aa, Mycobacterium
GPFYDGVIFHRVIEGFM

SEQ ID NO: 669485 - protein, 18 aa, Mycobacterium
GPGAALWVQVEEVTDPEP

SEQ ID NO: 669486 - protein, 17 aa, Mycobacterium
GPGAFKVDFAIEGAVPW

SEQ ID NO: 669487 - protein, 21 aa, Mycobacterium
GPGAGEWGGEVLYSGPVAGLA

SEQ ID NO: 669488 - protein, 24 aa, Mycobacterium
GPGAIRRLCCDAGVLTDTEVRAAA

SEQ ID NO: 669489 - protein, 18 aa, Mycobacterium
GPGAPGMPMPAPGLVAPP

SEQ ID NO: 669490 - protein, 23 aa, Mycobacterium
GPGARLDGAVIFDGVKVEAGSVI

SEQ ID NO: 669491 - protein, 17 aa, Mycobacterium
GPGARLDGAVVFDGARI

SEQ ID NO: 669492 - protein, 23 aa, Mycobacterium
GPGDAVGVLAGFPVEIAPTAQGL

SEQ ID NO: 669493 - protein, 25 aa, Mycobacterium
GPGDGCPICGQTIPAGFKPPRAQRE

SEQ ID NO: 669494 - protein, 18 aa, Mycobacterium
GPGDVSFIAARLVGPTGT

SEQ ID NO: 669495 - protein, 17 aa, Mycobacterium
GPGDVWAGPVSLDRLAR

SEQ ID NO: 669496 - protein, 26 aa, Mycobacterium
GPGDWREVMEALLLGAFISDGFVSES

SEQ ID NO: 669497 - protein, 24 aa, Mycobacterium
GPGEALFAFLRSMVLQWGAADRGL

SEQ ID NO: 669498 - protein, 20 aa, Mycobacterium
GPGEAVAAVSATRYPPNGIR

SEQ ID NO: 669499 - protein, 20 aa, Mycobacterium
GPGECWIKPTVDLVNGETMT

SEQ ID NO: 669500 - protein, 17 aa, Mycobacterium
GPGEGYIGFTESKITKV

SEQ ID NO: 669501 - protein, 17 aa, Mycobacterium
GPGELLDALIEHWEHHG

SEQ ID NO: 669502 - protein, 20 aa, Mycobacterium
GPGERRPLTILGVSADAVSG

SEQ ID NO: 669503 - protein, 19 aa, Mycobacterium
GPGESIALMVPRSDDAIVA

SEQ ID NO: 669504 - protein, 17 aa, Mycobacterium
GPGEVLVKVAFCGICHS

SEQ ID NO: 669505 - protein, 22 aa, Mycobacterium
GPGEVRGQLALVTGAGAGIGRA

SEQ ID NO: 669506 - protein, 29 aa, Mycobacterium
GPGGAPGCWQPITRHLWPAPELVMDTGNS

SEQ ID NO: 669507 - protein, 20 aa, Mycobacterium
GPGGDSVVWFGRLTAEKAPH

SEQ ID NO: 669508 - protein, 23 aa, Mycobacterium
GPGGFRYSDINFILLGALIEKVT

SEQ ID NO: 669509 - protein, 30 aa, Mycobacterium
GPGGGLPITYSRKVFIPVTHLCRDTCHYCT

SEQ ID NO: 669510 - protein, 19 aa, Mycobacterium
GPGGILGLPANPVWWTWLG

SEQ ID NO: 669511 - protein, 18 aa, Mycobacterium
GPGGLLYGNGGRGGDSTL

SEQ ID NO: 669512 - protein, 25 aa, Mycobacterium
GPGGRGGGGGHSLVGPGGDGGLGGT

SEQ ID NO: 669513 - protein, 17 aa, Mycobacterium
GPGGRIIDAEWVQLNLA

SEQ ID NO: 669514 - protein, 24 aa, Mycobacterium
GPGGSIPIRIYWPPISPDATDPLP

SEQ ID NO: 669515 - protein, 28 aa, Mycobacterium
GPGGVGGVGGRVVGLFGSGGGGGAGGDG

SEQ ID NO: 669516 - protein, 19 aa, Mycobacterium
GPGGWLLGNGGNGGSGAVG

SEQ ID NO: 669517 - protein, 21 aa, Mycobacterium
GPGHPTGGWWDGVAGPGAPID

SEQ ID NO: 669518 - protein, 18 aa, Mycobacterium
GPGILYRLHLDLASLSIA

SEQ ID NO: 669519 - protein, 37 aa, Mycobacterium
GPGKADPGLLRWFEDPKIGGIELKGFSRVGGVVAAAS

SEQ ID NO: 669520 - protein, 17 aa, Mycobacterium
GPGKAQYTLCCTESGGV

SEQ ID NO: 669521 - protein, 18 aa, Mycobacterium
GPGLDLLAFSVLRQLDVR

SEQ ID NO: 669522 - protein, 19 aa, Mycobacterium
GPGLLKFGMNAHLRLLAGN

SEQ ID NO: 669523 - protein, 18 aa, Mycobacterium
GPGLWYPIDDSMSGPAPA

SEQ ID NO: 669524 - protein, 19 aa, Mycobacterium
GPGNFTAPLARCLPAGALA

SEQ ID NO: 669525 - protein, 25 aa, Mycobacterium
GPGPARPPQTFALFNTTGVDARQDS

SEQ ID NO: 669526 - protein, 18 aa, Mycobacterium
GPGPDRFLAPEIEAAATM

SEQ ID NO: 669527 - protein, 19 aa, Mycobacterium
GPGPSAGWMPFHKLSQWLT

SEQ ID NO: 669528 - protein, 25 aa, Mycobacterium
GPGQAGGAGGWLYGNGGNGGNGGAG

SEQ ID NO: 669529 - protein, 18 aa, Mycobacterium
GPGQCVALLTERSARAVV

SEQ ID NO: 669530 - protein, 27 aa, Mycobacterium
GPGQGRRALSLVPDVHVCVVRVDQIVD

SEQ ID NO: 669531 - protein, 24 aa, Mycobacterium
GPGRPRFYRPPGRADVIATLDSEG

SEQ ID NO: 669532 - protein, 21 aa, Mycobacterium
GPGRRRWEFMRLPHESREELN

SEQ ID NO: 669533 - protein, 18 aa, Mycobacterium
GPGSARWIDPSEVPGGAE

SEQ ID NO: 669534 - protein, 19 aa, Mycobacterium
GPGSFYRPTLIADVAESSE

SEQ ID NO: 669535 - protein, 20 aa, Mycobacterium
GPGSITCRILLDGNVVTQQT

SEQ ID NO: 669536 - protein, 19 aa, Mycobacterium
GPGTAARMAARRGARVTAV

SEQ ID NO: 669537 - protein, 20 aa, Mycobacterium
GPGTGKCQQVWCPVCALAAL

SEQ ID NO: 669538 - protein, 19 aa, Mycobacterium
GPGTVVFAGGGGSGGTGGA

SEQ ID NO: 669539 - protein, 17 aa, Mycobacterium
GPGVCAGLATANTMHCL

SEQ ID NO: 669540 - protein, 25 aa, Mycobacterium
GPGVHRARFGNVYVPAAGPVVVDAE

SEQ ID NO: 669541 - protein, 17 aa, Mycobacterium
GPGVPPGVPGAGGTGGL

SEQ ID NO: 669542 - protein, 17 aa, Mycobacterium
GPGVPRHHRGDGLQAVS

SEQ ID NO: 669543 - protein, 25 aa, Mycobacterium
GPGVTGWRNFRGVLPAFAERFRCLI

SEQ ID NO: 669544 - protein, 17 aa, Mycobacterium
GPGWLVPIISRFRWLTV

SEQ ID NO: 669545 - protein, 17 aa, Mycobacterium
GPGYQVRFARRIQTETP

SEQ ID NO: 669546 - protein, 17 aa, Mycobacterium
GPHCVLRADALTHNLHT

SEQ ID NO: 669547 - protein, 19 aa, Mycobacterium
GPHEARILLAKNPAGWQEA

SEQ ID NO: 669548 - protein, 21 aa, Mycobacterium
GPHEVRPLQAIVRAIDPTTDV

SEQ ID NO: 669549 - protein, 23 aa, Mycobacterium
GPHFRFSEAVSFTIHCADQDEVD

SEQ ID NO: 669550 - protein, 25 aa, Mycobacterium
GPHFSFTWFRGSPIGRERKTEELSR

SEQ ID NO: 669551 - protein, 23 aa, Mycobacterium
GPHGAPDFFTRSDIDELLSTHYE

SEQ ID NO: 669552 - protein, 17 aa, Mycobacterium
GPHIGMAALTHYSHDGV

SEQ ID NO: 669553 - protein, 18 aa, Mycobacterium
GPHKHIAMAPQWDFLEML

SEQ ID NO: 669554 - protein, 27 aa, Mycobacterium
GPHKIRLNMVVPTWMYGPPIQLYIGLV

SEQ ID NO: 669555 - protein, 18 aa, Mycobacterium
GPHLERFLATLAHATDRP

SEQ ID NO: 669556 - protein, 21 aa, Mycobacterium
GPHMNVVRMIPPLVVTADQIS

SEQ ID NO: 669557 - protein, 31 aa, Mycobacterium; identical to SEQ ID NO: 88578

SEQ ID NO: 669558 - protein, 31 aa, Mycobacterium
GPHPFPAMVRDFQRIIGLEARVQIQAQAGRL

SEQ ID NO: 669559 - protein, 30 aa, Mycobacterium
GPHPFPLMVRDFQRIIGLEARVQVQDQAGR

SEQ ID NO: 669560 - protein, 31 aa, Mycobacterium
GPHPFPVMVRDFQRIIGMEARAQVLDQVGRL

SEQ ID NO: 669561 - protein, 22 aa, Mycobacterium
GPHPIQGIGAGFVPPVLDMDLV

SEQ ID NO: 669562 - protein, 18 aa, Mycobacterium
GPHSGWILNGQKRFITNA

SEQ ID NO: 669563 - protein, 19 aa, Mycobacterium
GPHSTVFRVSSPRAEPAPG

SEQ ID NO: 669564 - protein, 23 aa, Mycobacterium
GPHVDLSRTVGWFTTKYPVALQV

SEQ ID NO: 669565 - protein, 18 aa, Mycobacterium
GPHVLEFLWAPNGKELSW

SEQ ID NO: 669566 - protein, 18 aa, Mycobacterium
GPHVVMTVTMLREAGIAV

SEQ ID NO: 669567 - protein, 25 aa, Mycobacterium
GPIAARLGLAGWPRAAEESIVARDA

SEQ ID NO: 669568 - protein, 24 aa, Mycobacterium
GPIAARLVNRGGFTRGFGKLFSAQ

SEQ ID NO: 669569 - protein, 17 aa, Mycobacterium
GPIAHRAPRIWTGGVNR

SEQ ID NO: 669570 - protein, 18 aa, Mycobacterium
GPIALARLIPAGVDVRGN

SEQ ID NO: 669571 - protein, 19 aa, Mycobacterium
GPIATRTALRFVTDQSRED

SEQ ID NO: 669572 - protein, 23 aa, Mycobacterium
GPIDLRDPYPMFARHRAEGGVFR

SEQ ID NO: 669573 - protein, 27 aa, Mycobacterium
GPIERFLEWYAPFANFFYDTLGLPFFG

SEQ ID NO: 669574 - protein, 17 aa, Mycobacterium
GPIGGLVARVLRSDVEK

SEQ ID NO: 669575 - protein, 17 aa, Mycobacterium
GPIGLAFATADLDTAHA

SEQ ID NO: 669576 - protein, 20 aa, Mycobacterium
GPIGRLVARILRSEVHTSVR

SEQ ID NO: 669577 - protein, 19 aa, Mycobacterium
GPIGVEFAYLLANYGVDVT

SEQ ID NO: 669578 - protein, 20 aa, Mycobacterium
GPINAAGVFGRRNRYVSDWD

SEQ ID NO: 669579 - protein, 20 aa, Mycobacterium
GPINDLSEAFAFAEELGIEA

SEQ ID NO: 669580 - protein, 18 aa, Mycobacterium
GPIPPRQDMAYSIEGDIY

SEQ ID NO: 669581 - protein, 24 aa, Mycobacterium
GPIRGPGIVQHAARPHPPGQPMRQ

SEQ ID NO: 669582 - protein, 20 aa, Mycobacterium
GPIRPARLAPGGAVQTKVEE

SEQ ID NO: 669583 - protein, 17 aa, Mycobacterium
GPIRTPGLEGLAPDGQR

SEQ ID NO: 669584 - protein, 19 aa, Mycobacterium
GPIRVRFLGINARHHSLAI

SEQ ID NO: 669585 - protein, 20 aa, Mycobacterium
GPISRAYMRLPFGKGSDTWL

SEQ ID NO: 669586 - protein, 17 aa, Mycobacterium
GPISRYLGPWIAEPQLW

SEQ ID NO: 669587 - protein, 18 aa, Mycobacterium
GPIWDLDVVAGWNSSGLR

SEQ ID NO: 669588 - protein, 21 aa, Mycobacterium
GPKALAAGRAWGRKVDAELHP

SEQ ID NO: 669589 - protein, 21 aa, Mycobacterium
GPKAPILEYARMRARISEMER

SEQ ID NO: 669590 - protein, 32 aa, Mycobacterium
GPKDPAFPTPGWDVYVYFLKHDCDSLKNVQNP

SEQ ID NO: 669591 - protein, 19 aa, Mycobacterium
GPKEARAWTIHRGDTAPKA

SEQ ID NO: 669592 - protein, 20 aa, Mycobacterium
GPKNGWEGLMSQLKGPFEQT

SEQ ID NO: 669593 - protein, 23 aa, Mycobacterium
GPKRPQDRIPLRVAPQAVAGLLS

SEQ ID NO: 669594 - protein, 18 aa, Mycobacterium
GPKSRWRQLIENARADWR

SEQ ID NO: 669595 - protein, 25 aa, Mycobacterium
GPKTAETAAEFGLRVDVQPETAAVG

SEQ ID NO: 669596 - protein, 25 aa, Mycobacterium
GPKTAETAAEFGLRVDVQPEVAAVG

SEQ ID NO: 669597 - protein, 25 aa, Mycobacterium
GPKTAETAIEFGLRVDVQPETAAVG

SEQ ID NO: 669598 - protein, 17 aa, Mycobacterium
GPKYLRTYADGVWTNNL

SEQ ID NO: 669599 - protein, 19 aa, Mycobacterium
GPLAAAALRAVELLRDRPE

SEQ ID NO: 669600 - protein, 18 aa, Mycobacterium
GPLAGLFGALLDEMSGRN

SEQ ID NO: 669601 - protein, 20 aa, Mycobacterium
GPLAHLAFFVLDRWLRPVPA

SEQ ID NO: 669602 - protein, 17 aa, Mycobacterium
GPLAMAECSTVNPDLPK

SEQ ID NO: 669603 - protein, 24 aa, Mycobacterium
GPLARSVLDAALFLDATSTVPGPE

SEQ ID NO: 669604 - protein, 18 aa, Mycobacterium
GPLATSWHSNKFVNAAKD

SEQ ID NO: 669605 - protein, 24 aa, Mycobacterium
GPLCGRFRPSRVVDAAELLSAAAR

SEQ ID NO: 669606 - protein, 20 aa, Mycobacterium
GPLDARKVISEHGFADAQNT

SEQ ID NO: 669607 - protein, 19 aa, Mycobacterium
GPLDEAIRASIAIPGIIAP

SEQ ID NO: 669608 - protein, 18 aa, Mycobacterium
GPLDEWSLKPGTVTSWQP

SEQ ID NO: 669609 - protein, 26 aa, Mycobacterium
GPLDWAVELDERWVIIGPNGAGKTSL

SEQ ID NO: 669610 - protein, 25 aa, Mycobacterium
GPLDWAVELDERWVILGPNGAGKTS

SEQ ID NO: 669611 - protein, 18 aa, Mycobacterium
GPLEASRPWATKDVVGAH

SEQ ID NO: 669612 - protein, 19 aa, Mycobacterium
GPLEFQLTDLGARWVGPIR

SEQ ID NO: 669613 - protein, 25 aa, Mycobacterium
GPLEILEAGCGLEWPINLDGIDYRL

SEQ ID NO: 669614 - protein, 17 aa, Mycobacterium
GPLFPFTEAVSFTIGCR

SEQ ID NO: 669615 - protein, 18 aa, Mycobacterium
GPLGPSLSKRGRRSVARQ

SEQ ID NO: 669616 - protein, 29 aa, Mycobacterium
GPLGSWNTWHWRWNPWLLTAHGYAVLMPD

SEQ ID NO: 669617 - protein, 17 aa, Mycobacterium
GPLHGGANEAVMRDMLE

SEQ ID NO: 669618 - protein, 17 aa, Mycobacterium
GPLHRKAFAEVPGPTRA

SEQ ID NO: 669619 - protein, 18 aa, Mycobacterium
GPLHRYVMHLTHDSALAE

SEQ ID NO: 669620 - protein, 24 aa, Mycobacterium
GPLIEAMGLSVGWITAESTSEERR

SEQ ID NO: 669621 - protein, 24 aa, Mycobacterium
GPLIEAMGLTVGWITAESTAAERR

SEQ ID NO: 669622 - protein, 24 aa, Mycobacterium
GPLIEAMGLTVGWITAESTSEERR

SEQ ID NO: 669623 - protein, 20 aa, Mycobacterium
GPLIRFARARGFRVVVTIHG

SEQ ID NO: 669624 - protein, 18 aa, Mycobacterium
GPLIRLARAKGFRVIVTL

SEQ ID NO: 669625 - protein, 19 aa, Mycobacterium
GPLKAMVEAEWVFDPGSAT

SEQ ID NO: 669626 - protein, 25 aa, Mycobacterium
GPLLEALGLTVGWITAESTSEDRKA

SEQ ID NO: 669627 - protein, 18 aa, Mycobacterium
GPLLNLGLRRFLRNLRSY

SEQ ID NO: 669628 - protein, 24 aa, Mycobacterium
GPLLRRSGVIFIRRNIGNDQLYKY

SEQ ID NO: 669629 - protein, 23 aa, Mycobacterium
GPLMRRSGMIFIRRNIGDDPLYK

SEQ ID NO: 669630 - protein, 24 aa, Mycobacterium
GPLMRRSGVIFLRRKLDDPLYKFV

SEQ ID NO: 669631 - protein, 33 aa, Mycobacterium
GPLPAEMPAAALWWRLAGTLAPPSLEGTDTKLR

SEQ ID NO: 669632 - protein, 32 aa, Mycobacterium
GPLPDELPAAALWWRISGALSPTATLATTHSR

SEQ ID NO: 669633 - protein, 19 aa, Mycobacterium
GPLPLQVICDMMGIPEEDH

SEQ ID NO: 669634 - protein, 19 aa, Mycobacterium
GPLPQLGRFGEWLHQTAIS

SEQ ID NO: 669635 - protein, 18 aa, Mycobacterium
GPLPRAPQALRIPAKENR

SEQ ID NO: 669636 - protein, 17 aa, Mycobacterium
GPLPVGVLASMAGHGVV

SEQ ID NO: 669637 - protein, 17 aa, Mycobacterium
GPLPYNRMNGILAPGLF

SEQ ID NO: 669638 - protein, 18 aa, Mycobacterium
GPLQWLRPLAPAFEPTRR

SEQ ID NO: 669639 - protein, 20 aa, Mycobacterium
GPLQWSLLAHNEFEDAFLEI

SEQ ID NO: 669640 - protein, 17 aa, Mycobacterium
GPLRDAVAWATVQRPGF

SEQ ID NO: 669641 - protein, 20 aa, Mycobacterium
GPLRDCAAGRAAVLAPRLSV

SEQ ID NO: 669642 - protein, 31 aa, Mycobacterium
GPLRDRLRACPGPGCVLYFLTDGRREWCSKP

SEQ ID NO: 669643 - protein, 17 aa, Mycobacterium
GPLRLIRGLAPGMLARG

SEQ ID NO: 669644 - protein, 24 aa, Mycobacterium
GPLRLQFWVCGVFEVHDGKITLWR

SEQ ID NO: 669645 - protein, 17 aa, Mycobacterium
GPLRPGALTVNLNRRNF

SEQ ID NO: 669646 - protein, 22 aa, Mycobacterium
GPLRPHAAEIFAAVDVAGIPVV

SEQ ID NO: 669647 - protein, 19 aa, Mycobacterium
GPLRRCRALGTVVGNFLAS

SEQ ID NO: 669648 - protein, 25 aa, Mycobacterium
GPLRRWSEGLALLITTGFLPQRFRD

SEQ ID NO: 669649 - protein, 17 aa, Mycobacterium
GPLRSFDLAKWQKVIDV

SEQ ID NO: 669650 - protein, 28 aa, Mycobacterium
GPLRYAGWSSCFRREAGSYGKDTRGIIR

SEQ ID NO: 669651 - protein, 24 aa, Mycobacterium
GPLSGRSLEQWSLGLSSFLFSQRG

SEQ ID NO: 669652 - protein, 23 aa, Mycobacterium
GPLSGVRLGLMHGRLSGDEKDAV

SEQ ID NO: 669653 - protein, 18 aa, Mycobacterium
GPLSIIVRHAPSLSWDLG

SEQ ID NO: 669654 - protein, 19 aa, Mycobacterium
GPLTLGVRPDDLLPTVGAA

SEQ ID NO: 669655 - protein, 24 aa, Mycobacterium
GPLTRTGGFYARTWGTYLDRQPGE

SEQ ID NO: 669656 - protein, 20 aa, Mycobacterium
GPLVQLKSAPAFFDADGIEV

SEQ ID NO: 669657 - protein, 19 aa, Mycobacterium
GPLVRSSYRAGKLYAQAAR

SEQ ID NO: 669658 - protein, 19 aa, Mycobacterium
GPLVRSSYRAGKLYAQTVA

SEQ ID NO: 669659 - protein, 18 aa, Mycobacterium
GPLYDVINFQANWNNSVT

SEQ ID NO: 669660 - protein, 20 aa, Mycobacterium
GPLYPVSVVLAALVECADPQ

SEQ ID NO: 669661 - protein, 26 aa, Mycobacterium
GPLYYPRFLTELPYLGQALLLGIPGP

SEQ ID NO: 669662 - protein, 17 aa, Mycobacterium
GPMAFERSGRAPADIDI

SEQ ID NO: 669663 - protein, 21 aa, Mycobacterium
GPMAGLFARAIVVIGGDGNVA

SEQ ID NO: 669664 - protein, 17 aa, Mycobacterium
GPMARRIVEGGYETTLW

SEQ ID NO: 669665 - protein, 25 aa, Mycobacterium
GPMDRFHRRLLWPIRSSAGEVIGFG

SEQ ID NO: 669666 - protein, 18 aa, Mycobacterium
GPMGLPELTTTKWIVLGD

SEQ ID NO: 669667 - protein, 23 aa, Mycobacterium
GPMGRIAAELADLVVVTDDNPRG

SEQ ID NO: 669668 - protein, 24 aa, Mycobacterium
GPMLEAAAGWSGLAEELEAAAGSF

SEQ ID NO: 669669 - protein, 17 aa, Mycobacterium
GPMPAGMAERAAAGGVR

SEQ ID NO: 669670 - protein, 25 aa, Mycobacterium
GPMQFIPETWRLYGVDANNDGIVSP

SEQ ID NO: 669671 - protein, 25 aa, Mycobacterium
GPMQFIPETWRLYGVDANNDGVVSP

SEQ ID NO: 669672 - protein, 20 aa, Mycobacterium
GPMVHRAMTGWQRLHFRFGL

SEQ ID NO: 669673 - protein, 26 aa, Mycobacterium
GPMWPEPLGRLAFTFRYRGHRLRLTV

SEQ ID NO: 669674 - protein, 23 aa, Mycobacterium
GPNAAVGDILAVSGGIGADGQSG

SEQ ID NO: 669675 - protein, 24 aa, Mycobacterium
GPNAKTMGAWAIQAAESTHAQLST

SEQ ID NO: 669676 - protein, 18 aa, Mycobacterium
GPNAWRLPFEREWRELRD

SEQ ID NO: 669677 - protein, 18 aa, Mycobacterium
GPNDVYVSMNMVRKNGLR

SEQ ID NO: 669678 - protein, 25 aa, Mycobacterium
GPNLDRIRPGAIHRRIQAGSTIRQT

SEQ ID NO: 669679 - protein, 19 aa, Mycobacterium
GPNQFDCSGLVHWSYAQAG

SEQ ID NO: 669680 - protein, 21 aa, Mycobacterium
GPNRPGPRGFLDLPIPIDGLY

SEQ ID NO: 669681 - protein, 19 aa, Mycobacterium
GPNSLPSGISVPGAPITPL

SEQ ID NO: 669682 - protein, 20 aa, Mycobacterium
GPPATWAYKITEDFEPLTAT

SEQ ID NO: 669683 - protein, 22 aa, Mycobacterium
GPPDHWRRSSIRHHATTSDDIN

SEQ ID NO: 669684 - protein, 24 aa, Mycobacterium
GPPDKRSMPIITEPGGLGPPGTIG

SEQ ID NO: 669685 - protein, 19 aa, Mycobacterium
GPPDSRFVYLSDVLPTAWQ

SEQ ID NO: 669686 - protein, 20 aa, Mycobacterium
GPPEGRRTWMAEIAARVDTA

SEQ ID NO: 669687 - protein, 22 aa, Mycobacterium
GPPELYAWLHYDPIPERDDLAK

SEQ ID NO: 669688 - protein, 17 aa, Mycobacterium
GPPEVAELAAFRAQVEA

SEQ ID NO: 669689 - protein, 22 aa, Mycobacterium
GPPGCGKSYLAKAVSGELGASF

SEQ ID NO: 669690 - protein, 19 aa, Mycobacterium
GPPGCVVEWAQADVAVRAD

SEQ ID NO: 669691 - protein, 21 aa, Mycobacterium
GPPGSWRYRLLPMRWKTSDGW

SEQ ID NO: 669692 - protein, 20 aa, Mycobacterium
GPPHRAGWIDGMRDKFADMV

SEQ ID NO: 669693 - protein, 19 aa, Mycobacterium
GPPIRYFLPGADEWRTAEA

SEQ ID NO: 669694 - protein, 22 aa, Mycobacterium
GPPKPFVRKLINTVRLSTFALS

SEQ ID NO: 669695 - protein, 23 aa, Mycobacterium
GPPLHRRDALWAAALRTAIARRS

SEQ ID NO: 669696 - protein, 23 aa, Mycobacterium
GPPPDRMLIGLSVLGLLEEAAGN

SEQ ID NO: 669697 - protein, 19 aa, Mycobacterium
GPPPFRPPSFNPVDGAMVG

SEQ ID NO: 669698 - protein, 19 aa, Mycobacterium
GPPPGESLAEFGLLNDQLV

SEQ ID NO: 669699 - protein, 35 aa, Mycobacterium
GPPPTHRVWALDSGFTFPVLSDFWPHGAVSQSYGV

SEQ ID NO: 669700 - protein, 20 aa, Mycobacterium
GPPQPVGFWAAHKCGDTYAP

SEQ ID NO: 669701 - protein, 23 aa, Mycobacterium
GPPRELQPMWGKAIQTPAAQQAI

SEQ ID NO: 669702 - protein, 20 aa, Mycobacterium
GPPRGFLRRRRVAVTEQGPR

SEQ ID NO: 669703 - protein, 20 aa, Mycobacterium
GPPRKAWPAGGTGIGGGPPG

SEQ ID NO: 669704 - protein, 18 aa, Mycobacterium
GPPRRWLVVTGTNGKTTT

SEQ ID NO: 669705 - protein, 24 aa, Mycobacterium
GPPRSELTCGPSITAVMRFGADQS

SEQ ID NO: 669706 - protein, 23 aa, Mycobacterium
GPPRYRPSTLMRGVERLPVILGY

SEQ ID NO: 669707 - protein, 19 aa, Mycobacterium
GPPVDVIVCHNFRDRRLDA

SEQ ID NO: 669708 - protein, 19 aa, Mycobacterium
GPPVIPRGVCDPIAGLHAA

SEQ ID NO: 669709 - protein, 20 aa, Mycobacterium
GPPVLPQWPLADGVAALAGA

SEQ ID NO: 669710 - protein, 23 aa, Mycobacterium
GPPWNLRACSVVDGVERTVSPVC

SEQ ID NO: 669711 - protein, 26 aa, Mycobacterium
GPQAARAALLFGMRFDADAAVRHGLA

SEQ ID NO: 669712 - protein, 20 aa, Mycobacterium
GPQAGPLRRVRAVLAAAARC

SEQ ID NO: 669713 - protein, 23 aa, Mycobacterium
GPQARWGDWRQAPGLTDADREAV

SEQ ID NO: 669714 - protein, 19 aa, Mycobacterium
GPQASLPRRVVDSSAMKRL

SEQ ID NO: 669715 - protein, 21 aa, Mycobacterium
GPQEWTWDRADAVRRLSEAYG

SEQ ID NO: 669716 - protein, 23 aa, Mycobacterium
GPQFAGAHPLLGLHVELPAGAGH

SEQ ID NO: 669717 - protein, 24 aa, Mycobacterium
GPQGRIRLAQFMMRSDLQPDLEMV

SEQ ID NO: 669718 - protein, 24 aa, Mycobacterium
GPQIDWSKVHLFWGDDRYVPEDDD

SEQ ID NO: 669719 - protein, 19 aa, Mycobacterium
GPQIPGIEDVSSWLERHRP

SEQ ID NO: 669720 - protein, 18 aa, Mycobacterium
GPQLGLDETTAFLVIAAT

SEQ ID NO: 669721 - protein, 25 aa, Mycobacterium
GPQLRVEHRVHLGIATATERGLLVP

SEQ ID NO: 669722 - protein, 18 aa, Mycobacterium
GPQQIEWLSRLTAETPNL

SEQ ID NO: 669723 - protein, 19 aa, Mycobacterium
GPQRFTVVALDLGIKTNTP

SEQ ID NO: 669724 - protein, 20 aa, Mycobacterium
GPQSCARYFSSVTRNDAVQC

SEQ ID NO: 669725 - protein, 19 aa, Mycobacterium
GPQVFFDWMNHGKLSYVAD

SEQ ID NO: 669726 - protein, 19 aa, Mycobacterium
GPRAARLSGALGLDMDPFS

SEQ ID NO: 669727 - protein, 24 aa, Mycobacterium
GPRADEILVRVDAVGICHADTQAQ

SEQ ID NO: 669728 - protein, 19 aa, Mycobacterium
GPRAEFLASVAQMMQPGDT

SEQ ID NO: 669729 - protein, 20 aa, Mycobacterium
GPRAEFLATLAGVMQPGDSL

SEQ ID NO: 669730 - protein, 20 aa, Mycobacterium
GPRAEFLSSLSAQMRPGDSL

SEQ ID NO: 669731 - protein, 25 aa, Mycobacterium
GPRALDKGYTCLRDMADPAAAHCLS

SEQ ID NO: 669732 - protein, 32 aa, Mycobacterium
GPRAQRLSERWRRMGLDLDMAELIYHGDRNTV

SEQ ID NO: 669733 - protein, 18 aa, Mycobacterium
GPRAVAAFRQLAGGTDPV

SEQ ID NO: 669734 - protein, 23 aa, Mycobacterium
GPRCLDCADLGHLEFLPSGDAAL

SEQ ID NO: 669735 - protein, 18 aa, Mycobacterium
GPRDDWFVDPDVLIRTNW

SEQ ID NO: 669736 - protein, 20 aa, Mycobacterium
GPRDRMRFTAVPGALQVVAP

SEQ ID NO: 669737 - protein, 21 aa, Mycobacterium
GPRERHGLPVLSADGKDVEAV

SEQ ID NO: 669738 - protein, 18 aa, Mycobacterium
GPRFAEGDVIGRIESFRR

SEQ ID NO: 669739 - protein, 24 aa, Mycobacterium
GPRGCGKTSSARILARSLNCDQGP

SEQ ID NO: 669740 - protein, 24 aa, Mycobacterium
GPRGCGKTSSARILARSLNCEQGP

SEQ ID NO: 669741 - protein, 23 aa, Mycobacterium
GPRGCGKTSSARILARSLNCVQG

SEQ ID NO: 669742 - protein, 24 aa, Mycobacterium
GPRGCGKTSSARILARSLNCVQGP

SEQ ID NO: 669743 - protein, 26 aa, Mycobacterium
GPRGGAFAVAQTRLGGGRIHHAMRTV

SEQ ID NO: 669744 - protein, 18 aa, Mycobacterium
GPRGGRLAAALGLDLDPR

SEQ ID NO: 669745 - protein, 19 aa, Mycobacterium
GPRGISAFIVEKGTPGLSF

SEQ ID NO: 669746 - protein, 18 aa, Mycobacterium
GPRGISTFIVEKDTPGLS

SEQ ID NO: 669747 - protein, 25 aa, Mycobacterium
GPRGYRELIMLWGQREIALLPYDPG

SEQ ID NO: 669748 - protein, 21 aa, Mycobacterium
GPRLEVMDELGIDYALMFPTL

SEQ ID NO: 669749 - protein, 21 aa, Mycobacterium
GPRLEVMDELGLDYALMFPTL

SEQ ID NO: 669750 - protein, 27 aa, Mycobacterium
GPRLGFRRRSCCLFYRLPDGSLCGDCV

SEQ ID NO: 669751 - protein, 21 aa, Mycobacterium
GPRLIRKIVHLIDASGPVETL

SEQ ID NO: 669752 - protein, 17 aa, Mycobacterium
GPRMLRLAAQRSAGAHP

SEQ ID NO: 669753 - protein, 30 aa, Mycobacterium
GPRPFLRLEGTAVFRWAAFEMGKVGQRALD

SEQ ID NO: 669754 - protein, 23 aa, Mycobacterium
GPRPLRAVPGGGFDDGYADWEAV

SEQ ID NO: 669755 - protein, 17 aa, Mycobacterium
GPRPRPTVPVGEYAEVL

SEQ ID NO: 669756 - protein, 19 aa, Mycobacterium
GPRPVAALLAGLPPADRAS

SEQ ID NO: 669757 - protein, 18 aa, Mycobacterium
GPRRAAVSSFGLGGTNAH

SEQ ID NO: 669758 - protein, 25 aa, Mycobacterium
GPRRAVARVTAWLLAPSDTADAVTD

SEQ ID NO: 669759 - protein, 20 aa, Mycobacterium
GPRRPDGYGGPFIELAPDAR

SEQ ID NO: 669760 - protein, 17 aa, Mycobacterium
GPRRSRHACPHHLRGSA

SEQ ID NO: 669761 - protein, 21 aa, Mycobacterium
GPRSADVLGELGLPTDMDYMA

SEQ ID NO: 669762 - protein, 19 aa, Mycobacterium
GPRSLWRATDPVLYAMCGA

SEQ ID NO: 669763 - protein, 20 aa, Mycobacterium
GPRSPTAIVGRDARHGSAAF

SEQ ID NO: 669764 - protein, 19 aa, Mycobacterium
GPRSSFALTEARIGVAPAI

SEQ ID NO: 669765 - protein, 33 aa, Mycobacterium
GPRSVPELPLFRRVTTRIARAFEAMGLPPSFGT

SEQ ID NO: 669766 - protein, 26 aa, Mycobacterium
GPRTTRFGLTFARRYFDALHRYFGGG

SEQ ID NO: 669767 - protein, 20 aa, Mycobacterium
GPRVKRMLTANGLRQLISFI

SEQ ID NO: 669768 - protein, 19 aa, Mycobacterium
GPRVKRTLTATGLRQLIAF

SEQ ID NO: 669769 - protein, 19 aa, Mycobacterium
GPRVKRTLTATGLRQLINF

SEQ ID NO: 669770 - protein, 18 aa, Mycobacterium
GPRVLKLSAERAAGAHPY

SEQ ID NO: 669771 - protein, 20 aa, Mycobacterium
GPRVLPRVGTICEVFENDSV

SEQ ID NO: 669772 - protein, 19 aa, Mycobacterium
GPSALWSAAAAWRALATQY

SEQ ID NO: 669773 - protein, 19 aa, Mycobacterium
GPSAPRLARDPVNQAMINN

SEQ ID NO: 669774 - protein, 18 aa, Mycobacterium
GPSAQWRYSHNYRHHVFS

SEQ ID NO: 669775 - protein, 24 aa, Mycobacterium
GPSDARPAPGPVPVAPHESPRHSG

SEQ ID NO: 669776 - protein, 17 aa, Mycobacterium
GPSGAGHFVKMVHNGIE

SEQ ID NO: 669777 - protein, 18 aa, Mycobacterium
GPSGCGKTSLLRAIAGLN

SEQ ID NO: 669778 - protein, 18 aa, Mycobacterium
GPSGELWVWGPEDAAQRV

SEQ ID NO: 669779 - protein, 17 aa, Mycobacterium
GPSGGFGDPADALFHDE

SEQ ID NO: 669780 - protein, 18 aa, Mycobacterium
GPSGLRGGHRVRAQLRLD

SEQ ID NO: 669781 - protein, 18 aa, Mycobacterium
GPSGPLWLGSIKSNMGHT

SEQ ID NO: 669782 - protein, 31 aa, Mycobacterium
GPSILSPSLLSPRDNDFLSHNDTDFASHNPI

SEQ ID NO: 669783 - protein, 18 aa, Mycobacterium
GPSKVFRTRALVVPGVGE

SEQ ID NO: 669784 - protein, 17 aa, Mycobacterium
GPSLPVIVDSGSTGLLV

SEQ ID NO: 669785 - protein, 20 aa, Mycobacterium
GPSLSRRGRRSVARRLRGSG

SEQ ID NO: 669786 - protein, 17 aa, Mycobacterium
GPSMLGDIVLCPEFAAK

SEQ ID NO: 669787 - protein, 26 aa, Mycobacterium
GPSMPARLLRFWFGLRNQAAYSLEDM

SEQ ID NO: 669788 - protein, 17 aa, Mycobacterium
GPSMWPQGVTRVRDVFD

SEQ ID NO: 669789 - protein, 20 aa, Mycobacterium
GPSPLRAGDRLPIGEHTADY

SEQ ID NO: 669790 - protein, 20 aa, Mycobacterium
GPSPLRPGDVLPVGEHTDEF

SEQ ID NO: 669791 - protein, 18 aa, Mycobacterium
GPSSFLGITIPQFNYPAP

SEQ ID NO: 669792 - protein, 27 aa, Mycobacterium
GPSSMLMTAAVTPYVAWLQAGAAQAAQ

SEQ ID NO: 669793 - protein, 19 aa, Mycobacterium
GPSSMWFDALGRRLPAPYL

SEQ ID NO: 669794 - protein, 17 aa, Mycobacterium
GPSSVSILQGYELLNHA

SEQ ID NO: 669795 - protein, 24 aa, Mycobacterium
GPSSVWYRVRINLVHVPEGQRPAQ

SEQ ID NO: 669796 - protein, 18 aa, Mycobacterium
GPSTGTNVWGAFGLLAEM

SEQ ID NO: 669797 - protein, 19 aa, Mycobacterium
GPSTGTNVWGAFGLLAEMV

SEQ ID NO: 669798 - protein, 24 aa, Mycobacterium
GPSVKLPGGLWIVTEHGVACESGE

SEQ ID NO: 669799 - protein, 18 aa, Mycobacterium
GPSWLRPLVDNIDRVPDA

SEQ ID NO: 669800 - protein, 25 aa, Mycobacterium
GPSYPELVADFGRIRRIAVAEETAF

SEQ ID NO: 669801 - protein, 20 aa, Mycobacterium
GPSYRSAIFYLDDEQKRIAL

SEQ ID NO: 669802 - protein, 20 aa, Mycobacterium
GPSYRSAIFYLDEEQKRIAL

SEQ ID NO: 669803 - protein, 24 aa, Mycobacterium
GPSYTRPPSWRGMDVPPVLLSGDH

SEQ ID NO: 669804 - protein, 24 aa, Mycobacterium
GPSYTRPPTWRGLQVPEVLLSGDH

SEQ ID NO: 669805 - protein, 19 aa, Mycobacterium
GPTAGYGMWVKIRHADGTV

SEQ ID NO: 669806 - protein, 19 aa, Mycobacterium
GPTAGYGMWVKLRHADGTV

SEQ ID NO: 669807 - protein, 22 aa, Mycobacterium
GPTALLAPKWVPWQERIRPGDL

SEQ ID NO: 669808 - protein, 28 aa, Mycobacterium
GPTATPCGVCESCLALAPNAPGSIDVVE

SEQ ID NO: 669809 - protein, 22 aa, Mycobacterium
GPTDAWSRRDVFDVILTAQRAA

SEQ ID NO: 669810 - protein, 18 aa, Mycobacterium
GPTERARHKSRRRQPRPP

SEQ ID NO: 669811 - protein, 17 aa, Mycobacterium
GPTEWGASAAGVGPWPG

SEQ ID NO: 669812 - protein, 22 aa, Mycobacterium
GPTGCGKTYLAQTLAKMLNVPF

SEQ ID NO: 669813 - protein, 22 aa, Mycobacterium
GPTGERAHCWWYQPFQPQPPPA

SEQ ID NO: 669814 - protein, 17 aa, Mycobacterium
GPTGFPTLVEALLHTGF

SEQ ID NO: 669815 - protein, 21 aa, Mycobacterium
GPTGIFIKVGYRGNLVVSGYT

SEQ ID NO: 669816 - protein, 18 aa, Mycobacterium
GPTGRLAVRCALTAGHAV

SEQ ID NO: 669817 - protein, 20 aa, Mycobacterium
GPTGYRLVLVIPVPADELSP

SEQ ID NO: 669818 - protein, 39 aa, Mycobacterium
GPTHLFTGDCLFPGGVGKTWKPGDFETLLGDVTTKVFDV

SEQ ID NO: 669819 - protein, 24 aa, Mycobacterium
GPTLMVSDLFDFGVYVDARIEDIE

SEQ ID NO: 669820 - protein, 23 aa, Mycobacterium
GPTLMVSDLFDFSIYVDARIEDI

SEQ ID NO: 669821 - protein, 23 aa, Mycobacterium
GPTLRELREFSGKTLKAVAEPSG

SEQ ID NO: 669822 - protein, 19 aa, Mycobacterium
GPTLRRAAADAGREDEVRV

SEQ ID NO: 669823 - protein, 18 aa, Mycobacterium
GPTLSFRGIDNAAYYRLV

SEQ ID NO: 669824 - protein, 17 aa, Mycobacterium
GPTLSFRGIDNRAYYKL

SEQ ID NO: 669825 - protein, 19 aa, Mycobacterium
GPTLSMRGIDNAAYYRLVD

SEQ ID NO: 669826 - protein, 19 aa, Mycobacterium
GPTMLLPHSQRFTGGYIAF

SEQ ID NO: 669827 - protein, 18 aa, Mycobacterium
GPTMSFIRCDRGLSPTDH

SEQ ID NO: 669828 - protein, 19 aa, Mycobacterium
GPTRTCTVASTLHMSSFRD

SEQ ID NO: 669829 - protein, 19 aa, Mycobacterium
GPTRVGVRISPGTSAGDMH

SEQ ID NO: 669830 - protein, 17 aa, Mycobacterium
GPTSMLAVATGWKDWAA

SEQ ID NO: 669831 - protein, 19 aa, Mycobacterium
GPTTAMLTAAADEVSTAIA

SEQ ID NO: 669832 - protein, 24 aa, Mycobacterium
GPTTLRLFGRVGGDGGDGGRGGDA

SEQ ID NO: 669833 - protein, 20 aa, Mycobacterium
GPVAARLVTRGGFRRSFGTL

SEQ ID NO: 669834 - protein, 19 aa, Mycobacterium
GPVADAAAMGAVYREIAPG

SEQ ID NO: 669835 - protein, 20 aa, Mycobacterium
GPVADALLELGLPGLSVNVR

SEQ ID NO: 669836 - protein, 20 aa, Mycobacterium
GPVADALLELGVPGLSVNVR

SEQ ID NO: 669837 - protein, 18 aa, Mycobacterium
GPVADLFGANWMSAVYET

SEQ ID NO: 669838 - protein, 17 aa, Mycobacterium
GPVALALVKRGLPADTA

SEQ ID NO: 669839 - protein, 17 aa, Mycobacterium
GPVALALVKRGLPADTE

SEQ ID NO: 669840 - protein, 18 aa, Mycobacterium
GPVALLRLEPVEVVTAEA

SEQ ID NO: 669841 - protein, 19 aa, Mycobacterium
GPVALRLSFDYDGGGLGKG

SEQ ID NO: 669842 - protein, 18 aa, Mycobacterium
GPVALVHFDAHLDTWDTY

SEQ ID NO: 669843 - protein, 23 aa, Mycobacterium
GPVAPTPIMHWLHSVPGPVERFN

SEQ ID NO: 669844 - protein, 18 aa, Mycobacterium
GPVARPVQPVARGPVQAA

SEQ ID NO: 669845 - protein, 22 aa, Mycobacterium
GPVELRVGPGVFIPRPETEALL

SEQ ID NO: 669846 - protein, 19 aa, Mycobacterium
GPVELVWAGSFASHVELYW

SEQ ID NO: 669847 - protein, 25 aa, Mycobacterium
GPVENVWGGGGFERLDLQPLSRAES

SEQ ID NO: 669848 - protein, 24 aa, Mycobacterium
GPVEPARLLALHGLTGHGRRWAPL

SEQ ID NO: 669849 - protein, 25 aa, Mycobacterium
GPVEWHKMGAGWSWSRKAGSELDHA

SEQ ID NO: 669850 - protein, 26 aa, Mycobacterium
GPVFEQRSRPLIAVAATRGDPNNVDI

SEQ ID NO: 669851 - protein, 17 aa, Mycobacterium
GPVFTNLLLADEINRTP

SEQ ID NO: 669852 - protein, 24 aa, Mycobacterium
GPVGAEFTAAVGEFQQAMLASGTA

SEQ ID NO: 669853 - protein, 17 aa, Mycobacterium
GPVGAPVLLAFSDRRLF

SEQ ID NO: 669854 - protein, 19 aa, Mycobacterium
GPVGLILTRQGLPILEGTS

SEQ ID NO: 669855 - protein, 17 aa, Mycobacterium
GPVGLILTRQGVPILEG

SEQ ID NO: 669856 - protein, 18 aa, Mycobacterium
GPVGLILTRQGVPVLAGT

SEQ ID NO: 669857 - protein, 17 aa, Mycobacterium
GPVGLILTRQGVPVLEG

SEQ ID NO: 669858 - protein, 25 aa, Mycobacterium
GPVHRLGGVAVRFLNEAQALTGPCR

SEQ ID NO: 669859 - protein, 19 aa, Mycobacterium
GPVIKRWYRAEVRNLGNIP

SEQ ID NO: 669860 - protein, 25 aa, Mycobacterium
GPVIRGRVVLLTFDHAVAFDLLRSD

SEQ ID NO: 669861 - protein, 24 aa, Mycobacterium
GPVKRAGGISGWELTPSVDGHFDR

SEQ ID NO: 669862 - protein, 23 aa, Mycobacterium
GPVLATPIIHWLQGVPGPVDQFN

SEQ ID NO: 669863 - protein, 17 aa, Mycobacterium
GPVLCILGYDDLDQAVA

SEQ ID NO: 669864 - protein, 21 aa, Mycobacterium
GPVLDRICGVFAEVLELSSVA

SEQ ID NO: 669865 - protein, 17 aa, Mycobacterium
GPVLSLGEQARCLEALR

SEQ ID NO: 669866 - protein, 20 aa, Mycobacterium
GPVLSRDIMRIFGQAYLGEL

SEQ ID NO: 669867 - protein, 22 aa, Mycobacterium
GPVNGLHGWRSPALPEFDPFWR

SEQ ID NO: 669868 - protein, 23 aa, Mycobacterium
GPVNRLLRPGGLVDQLTAEGGLL

SEQ ID NO: 669869 - protein, 25 aa, Mycobacterium
GPVPADRTGPAVAIQQATVTAIAAS

SEQ ID NO: 669870 - protein, 28 aa, Mycobacterium
GPVPGMDGLWFAGSWCGHGFSTSVDTGW

SEQ ID NO: 669871 - protein, 17 aa, Mycobacterium
GPVPLIVHYGAIAYAPN

SEQ ID NO: 669872 - protein, 19 aa, Mycobacterium
GPVPTPAVAFAVRHLGAAA

SEQ ID NO: 669873 - protein, 24 aa, Mycobacterium
GPVRCARPGIPGHQRAGGGVPRPV

SEQ ID NO: 669874 - protein, 18 aa, Mycobacterium
GPVRLRELFAGRRQLIVY

SEQ ID NO: 669875 - protein, 23 aa, Mycobacterium
GPVRPGWTLSPLRRGRADPCYHD

SEQ ID NO: 669876 - protein, 19 aa, Mycobacterium
GPVRVLIAGHVARRQAVTT

SEQ ID NO: 669877 - protein, 19 aa, Mycobacterium
GPVRVRFLGVNQRHHSLAI

SEQ ID NO: 669878 - protein, 17 aa, Mycobacterium
GPVSAERIAEVLGVDAE

SEQ ID NO: 669879 - protein, 17 aa, Mycobacterium
GPVSALFGPESYVRASA

SEQ ID NO: 669880 - protein, 19 aa, Mycobacterium
GPVSEVPALVGVPRGKLIL

SEQ ID NO: 669881 - protein, 21 aa, Mycobacterium
GPVSGRCLHQGFFEQAAMNPD

SEQ ID NO: 669882 - protein, 17 aa, Mycobacterium
GPVSIGHAFLFRQLTED

SEQ ID NO: 669883 - protein, 22 aa, Mycobacterium
GPVSLEPGISFIIRPSEPTQAV

SEQ ID NO: 669884 - protein, 17 aa, Mycobacterium
GPVSLPLLTRTPYFCSG

SEQ ID NO: 669885 - protein, 19 aa, Mycobacterium
GPVSLTLACDPFAIERPSD

SEQ ID NO: 669886 - protein, 20 aa, Mycobacterium
GPVSNGPVWVMAGFGAQHRK

SEQ ID NO: 669887 - protein, 18 aa, Mycobacterium
GPVSVIGRLTIPDRPTGI

SEQ ID NO: 669888 - protein, 29 aa, Mycobacterium
GPVSVTLPRRILVSRVDVIILHTERPPAN

SEQ ID NO: 669889 - protein, 18 aa, Mycobacterium
GPVTGPLVVGRVVQITEL

SEQ ID NO: 669890 - protein, 18 aa, Mycobacterium
GPVTRPTPTVAQFLNASA

SEQ ID NO: 669891 - protein, 26 aa, Mycobacterium
GPVTWWSTQQMRTWANRPWNNEGKQL

SEQ ID NO: 669892 - protein, 18 aa, Mycobacterium
GPVTYQFGSLAEVLAKAS

SEQ ID NO: 669893 - protein, 25 aa, Mycobacterium
GPVVATPIMRCLRDVEGPIDEFNQT

SEQ ID NO: 669894 - protein, 23 aa, Mycobacterium
GPVVATPIMRWLHSVEGPVEQFN

SEQ ID NO: 669895 - protein, 21 aa, Mycobacterium
GPVVATPIMRWLQSIEGPIEQ

SEQ ID NO: 669896 - protein, 23 aa, Mycobacterium
GPVVATPIMRWLYSLDGPIDEFN

SEQ ID NO: 669897 - protein, 24 aa, Mycobacterium
GPVVKSFWDLFAMIADTQKVPFSK

SEQ ID NO: 669898 - protein, 17 aa, Mycobacterium
GPVVLFFYPAAMTPGCT

SEQ ID NO: 669899 - protein, 22 aa, Mycobacterium
GPVWRRDEVFEFNGSLIDSEEF

SEQ ID NO: 669900 - protein, 24 aa, Mycobacterium
GPWEPWLYSWPEVFTSAGEFTARF

SEQ ID NO: 669901 - protein, 23 aa, Mycobacterium
GPWIADQLLELGVELAHITICGD

SEQ ID NO: 669902 - protein, 21 aa, Mycobacterium
GPWLADQLLELGVELAHITIC

SEQ ID NO: 669903 - protein, 22 aa, Mycobacterium
GPWLRTGDLGFVHAGELYVVGR

SEQ ID NO: 669904 - protein, 21 aa, Mycobacterium
GPWLRTGDLGVMFEGELFITG

SEQ ID NO: 669905 - protein, 17 aa, Mycobacterium
GPWLRTGDSGFITDGKM

SEQ ID NO: 669906 - protein, 17 aa, Mycobacterium
GPWNVGFSAHMLRQELD

SEQ ID NO: 669907 - protein, 17 aa, Mycobacterium
GPWPDPAAHSFRGPGLR

SEQ ID NO: 669908 - protein, 22 aa, Mycobacterium
GPWPVVGTGWGASVVVGTGGAS

SEQ ID NO: 669909 - protein, 18 aa, Mycobacterium
GPWRLGISSAGTFENLQL

SEQ ID NO: 669910 - protein, 20 aa, Mycobacterium
GPWRTPLIAVAHGWCMTLGI

SEQ ID NO: 669911 - protein, 25 aa, Mycobacterium
GPWTDRAATEFTLQAWSGGIVGLGR

SEQ ID NO: 669912 - protein, 18 aa, Mycobacterium
GPWTGPSAIAMAAAAAPY

SEQ ID NO: 669913 - protein, 20 aa, Mycobacterium
GPWTIPEHVLSTPIHLDDIV

SEQ ID NO: 669914 - protein, 19 aa, Mycobacterium
GPYASWLGAAAARAAGASA

SEQ ID NO: 669915 - protein, 20 aa, Mycobacterium
GPYASWLGAAAARAAGASAS

SEQ ID NO: 669916 - protein, 17 aa, Mycobacterium
GPYAVGITGEDAQLFTA

SEQ ID NO: 669917 - protein, 17 aa, Mycobacterium
GPYCAKLLVDLGADVRK

SEQ ID NO: 669918 - protein, 25 aa, Mycobacterium
GPYDNEWGWTWPMEPAGALQPGVGR

SEQ ID NO: 669919 - protein, 23 aa, Mycobacterium
GPYEKRKAFDLLVQGEAGVTLNT

SEQ ID NO: 669920 - protein, 26 aa, Mycobacterium
GPYESEWGWTWPMNRRVLYNRASADP

SEQ ID NO: 669921 - protein, 20 aa, Mycobacterium
GPYEVLRFIPDTEVRFVWHE

SEQ ID NO: 669922 - protein, 18 aa, Mycobacterium
GPYEVLRNLPGAQVRFVW

SEQ ID NO: 669923 - protein, 28 aa, Mycobacterium
GPYGRAFPFSLVFAALYAARGYHVVLQS

SEQ ID NO: 669924 - protein, 25 aa, Mycobacterium
GPYGRRFPFSAIFAEVYAARGYHVV

SEQ ID NO: 669925 - protein, 24 aa, Mycobacterium
GPYGTFKAAIIHYTQGLAYQLAAK

SEQ ID NO: 669926 - protein, 20 aa, Mycobacterium
GPYGTMKAAIIHYTQGLAFK

SEQ ID NO: 669927 - protein, 19 aa, Mycobacterium
GPYPTMYVNQPWTIRQYAG

SEQ ID NO: 669928 - protein, 17 aa, Mycobacterium
GPYPWRNHHNAWRPAHI

SEQ ID NO: 669929 - protein, 30 aa, Mycobacterium
GPYPWRNHHNAWRPAHIHFSLFGTEFTQRM

SEQ ID NO: 669930 - protein, 17 aa, Mycobacterium
GPYPWRNHRNAWRPAHI

SEQ ID NO: 669931 - protein, 23 aa, Mycobacterium
GPYSRPILDDMHMHRLEAFDPQL

SEQ ID NO: 669932 - protein, 17 aa, Mycobacterium
GPYTLACAAAMPDRVVA

SEQ ID NO: 669933 - protein, 22 aa, Mycobacterium
GPYYEEWCGAVQKKAEWISNQI

SEQ ID NO: 669934 - protein, 24 aa, Mycobacterium
GPYYFFGVLARLAALPRFTPMALP

SEQ ID NO: 669935 - protein, 29 aa, Mycobacterium
GPYYFFGVLARLAALPSLTPILLPDTGRT

SEQ ID NO: 669936 - protein, 26 aa, Mycobacterium
GQAAALCPVSRLFAGATISVDAELDA

SEQ ID NO: 669937 - protein, 20 aa, Mycobacterium
GQAAALYSWLGADMDGLTAL

SEQ ID NO: 669938 - protein, 28 aa, Mycobacterium
GQAAHLWSRTDLRPEDVDLALLYDGFTF

SEQ ID NO: 669939 - protein, 24 aa, Mycobacterium
GQAAHLWTRTSLRPADVDVAELYD

SEQ ID NO: 669940 - protein, 24 aa, Mycobacterium
GQAAHLWTRTSLRPDDVDVAELYD

SEQ ID NO: 669941 - protein, 20 aa, Mycobacterium
GQAAHMWTRTSLRPADVDVA

SEQ ID NO: 669942 - protein, 20 aa, Mycobacterium
GQAAHVWTRTSLRPADVDVA

SEQ ID NO: 669943 - protein, 19 aa, Mycobacterium
GQAAKLWAEAIESVIDGEF

SEQ ID NO: 669944 - protein, 17 aa, Mycobacterium
GQAARLAAERAAPSTVR

SEQ ID NO: 669945 - protein, 18 aa, Mycobacterium
GQAAWAMDQIMTGAASAA

SEQ ID NO: 669946 - protein, 24 aa, Mycobacterium
GQAAWIAEKFWAWTDNNGHPEDAV

SEQ ID NO: 669947 - protein, 22 aa, Mycobacterium
GQAELLAPFSGRYFDVIEDVWA

SEQ ID NO: 669948 - protein, 24 aa, Mycobacterium
GQAFPHVYCELDFTNPLELALATI

SEQ ID NO: 669949 - protein, 17 aa, Mycobacterium
GQAGAWKRIAATPPALP

SEQ ID NO: 669950 - protein, 23 aa, Mycobacterium
GQAGGAGGILWGNGGNGGSGGVG

SEQ ID NO: 669951 - protein, 22 aa, Mycobacterium
GQAGGPGGILWGNGGAGGSGAP

SEQ ID NO: 669952 - protein, 19 aa, Mycobacterium
GQAGGWLIGNGGNGAAGAI

SEQ ID NO: 669953 - protein, 21 aa, Mycobacterium
GQAGNIGRLAWLAAGYPEEVP

SEQ ID NO: 669954 - protein, 19 aa, Mycobacterium
GQAGPDVFAVHRIDEQLAK

SEQ ID NO: 669955 - protein, 25 aa, Mycobacterium
GQAGPRFLTAAFRRSGVLPDQGTVV

SEQ ID NO: 669956 - protein, 25 aa, Mycobacterium
GQAHVAGVGMDWRAVYAGWGARLVE

SEQ ID NO: 669957 - protein, 24 aa, Mycobacterium
GQAIDGFFVMHFAPAGQRSDNTSA

SEQ ID NO: 669958 - protein, 18 aa, Mycobacterium
GQAIDVRGPALGVLERMG

SEQ ID NO: 669959 - protein, 17 aa, Mycobacterium
GQAIRAITCLPALVGAW

SEQ ID NO: 669960 - protein, 23 aa, Mycobacterium
GQAIVGALGRLGHKGISDVRQGK

SEQ ID NO: 669961 - protein, 22 aa, Mycobacterium
GQAKASFVAVEFDEFGAGKGAR

SEQ ID NO: 669962 - protein, 18 aa, Mycobacterium
GQAKLANLLFTYELQRRL

SEQ ID NO: 669963 - protein, 19 aa, Mycobacterium
GQALLAMAQRLGGYPDATE

SEQ ID NO: 669964 - protein, 23 aa, Mycobacterium
GQALPALDAVVLRDEVGGVGPLL

SEQ ID NO: 669965 - protein, 24 aa, Mycobacterium
GQALSEWRSTPVFGPGQVGRSQVG

SEQ ID NO: 669966 - protein, 24 aa, Mycobacterium
GQALSRLRTALRLTGELASGTGGL

SEQ ID NO: 669967 - protein, 17 aa, Mycobacterium
GQALSVFEAAIPPAFAE

SEQ ID NO: 669968 - protein, 17 aa, Mycobacterium
GQALTAVGIEWLARRLA

SEQ ID NO: 669969 - protein, 19 aa, Mycobacterium
GQAMLEFTAAYQAAGVAPP

SEQ ID NO: 669970 - protein, 17 aa, Mycobacterium
GQANSWQSLPGIGPKTA

SEQ ID NO: 669971 - protein, 19 aa, Mycobacterium
GQAPGVWRHGDWVTVTERG

SEQ ID NO: 669972 - protein, 19 aa, Mycobacterium
GQAPILWDIGSAARLHQMQ

SEQ ID NO: 669973 - protein, 18 aa, Mycobacterium
GQAPQMFSGMLGPLSSMN

SEQ ID NO: 669974 - protein, 17 aa, Mycobacterium
GQAPSYAIGQRIWQQLR

SEQ ID NO: 669975 - protein, 23 aa, Mycobacterium
GQAQIPFGASVDGAVIGGLSGIS

SEQ ID NO: 669976 - protein, 27 aa, Mycobacterium
GQAREVTWAQLGVRLAAIGAQIQQLAG

SEQ ID NO: 669977 - protein, 24 aa, Mycobacterium
GQARHAFDEAMARFDQEMGDIQKV

SEQ ID NO: 669978 - protein, 23 aa, Mycobacterium
GQARLGSLPANWRERGLRDALTS

SEQ ID NO: 669979 - protein, 19 aa, Mycobacterium
GQARLIVDIMRQICTGLGY

SEQ ID NO: 669980 - protein, 19 aa, Mycobacterium
GQARLVLRRETVEDLLSLE

SEQ ID NO: 669981 - protein, 17 aa, Mycobacterium
GQARPPMDGLIFTDEAA

SEQ ID NO: 669982 - protein, 17 aa, Mycobacterium
GQARQEWQIIEDLTSRL

SEQ ID NO: 669983 - protein, 18 aa, Mycobacterium
GQAVGGAFVRLLDSSDEF

SEQ ID NO: 669984 - protein, 26 aa, Mycobacterium
GQAVLRRLKPFDVRLHYFDTRRLPAE

SEQ ID NO: 669985 - protein, 18 aa, Mycobacterium
GQAVSWLYGTSPRGLAGP

SEQ ID NO: 669986 - protein, 22 aa, Mycobacterium
GQAVVRAALSFLALPPADADEA

SEQ ID NO: 669987 - protein, 22 aa, Mycobacterium
GQAVVRAALSYLALPPSDADEA

SEQ ID NO: 669988 - protein, 21 aa, Mycobacterium
GQAYWSFGGLFFVNSPEQRRL

SEQ ID NO: 669989 - protein, 18 aa, Mycobacterium
GQCGKAVIRAKLWEGDQR

SEQ ID NO: 669990 - protein, 23 aa, Mycobacterium
GQCLGGGGWILGHLIDGTQAEYV

SEQ ID NO: 669991 - protein, 18 aa, Mycobacterium
GQCLVLYSDGLVERRGEV

SEQ ID NO: 669992 - protein, 40 aa, Mycobacterium
GQCMTLRYVFCGGEPLSLALCRRFAAVLPHAELVNLYGPT

SEQ ID NO: 669993 - protein, 19 aa, Mycobacterium
GQCPVAPAGRWIVDPDGAV

SEQ ID NO: 669994 - protein, 24 aa, Mycobacterium
GQCREVLERIYFRTGDTLISNRYN

SEQ ID NO: 669995 - protein, 24 aa, Mycobacterium
GQDAKPVIGTVMRQGYQLGEHVLR

SEQ ID NO: 669996 - protein, 23 aa, Mycobacterium
GQDGGAGGWLLGDGGAGGSGEAG

SEQ ID NO: 669997 - protein, 24 aa, Mycobacterium
GQDGGDPSGQFGGTGGAGGSGGAG

SEQ ID NO: 669998 - protein, 22 aa, Mycobacterium
GQDLPLAGLLVAVKDNIDVAGL

SEQ ID NO: 669999 - protein, 18 aa, Mycobacterium
GQDMAALAFDVLGTRGAG

SEQ ID NO: 670000 - protein, 17 aa, Mycobacterium
GQDNLRESLLIGLLAGG

SEQ ID NO: 670001 - protein, 17 aa, Mycobacterium
GQDPALRANGMIAEVLD

SEQ ID NO: 670002 - protein, 18 aa, Mycobacterium
GQDPDWRAAITHVAIDLS

SEQ ID NO: 670003 - protein, 23 aa, Mycobacterium
GQDPRLAPKPVLERQADQRSDEW

SEQ ID NO: 670004 - protein, 24 aa, Mycobacterium
GQDPRLAPPPVLERQADQRSDDWV

SEQ ID NO: 670005 - protein, 31 aa, Mycobacterium
GQDRLRLALVLCAVRPEIGGVLIRGEKGTAK

SEQ ID NO: 670006 - protein, 25 aa, Mycobacterium
GQDVPDGWHSPDWTSWTPYTYPFNL

SEQ ID NO: 670007 - protein, 24 aa, Mycobacterium
GQDWKHGVCAALGWRHRDQADIAA

SEQ ID NO: 670008 - protein, 18 aa, Mycobacterium
GQEATAYQEYQKAWHQSA

SEQ ID NO: 670009 - protein, 22 aa, Mycobacterium
GQEECRTCPYEQWCADQMGRED

SEQ ID NO: 670010 - protein, 17 aa, Mycobacterium
GQEGMKVVLADVLAEPL

SEQ ID NO: 670011 - protein, 17 aa, Mycobacterium
GQEHLRETLLIGLLTGG

SEQ ID NO: 670012 - protein, 35 aa, Mycobacterium
GQELGWRLARPGDWARHNWIPFSRFRGLDRVRTVH

SEQ ID NO: 670013 - protein, 24 aa, Mycobacterium
GQELVLHAGLGWFGAARITMRLRG

SEQ ID NO: 670014 - protein, 20 aa, Mycobacterium
GQEPPRLAVIAMGKCGAREL

SEQ ID NO: 670015 - protein, 18 aa, Mycobacterium
GQEPRTEWEYTPADSPNW

SEQ ID NO: 670016 - protein, 24 aa, Mycobacterium
GQERARLIAMITLWYSEAGRYNVL

SEQ ID NO: 670017 - protein, 26 aa, Mycobacterium
GQEREALEAAARWREIVGPENYFLEL

SEQ ID NO: 670018 - protein, 19 aa, Mycobacterium
GQERLWLDHIVAGDLFGNA

SEQ ID NO: 670019 - protein, 18 aa, Mycobacterium
GQESEALAAAAKWQDIFG

SEQ ID NO: 670020 - protein, 17 aa, Mycobacterium
GQESVWDYPRPPRLEEF

SEQ ID NO: 670021 - protein, 17 aa, Mycobacterium
GQFAAWFRRESLRSVDW

SEQ ID NO: 670022 - protein, 17 aa, Mycobacterium
GQFADGIAHTLRRCGAD

SEQ ID NO: 670023 - protein, 17 aa, Mycobacterium
GQFCLANTIAVAPAAAN

SEQ ID NO: 670024 - protein, 17 aa, Mycobacterium
GQFCLANTIAVAPASAN

SEQ ID NO: 670025 - protein, 17 aa, Mycobacterium
GQFDDGWDALREQTYAR

SEQ ID NO: 670026 - protein, 18 aa, Mycobacterium
GQFISGFSNEGGRFLSGF

SEQ ID NO: 670027 - protein, 23 aa, Mycobacterium
GQFPEWELGVQLVPESDEFKFPF

SEQ ID NO: 670028 - protein, 17 aa, Mycobacterium
GQFPTIGDDVFISPMAM

SEQ ID NO: 670029 - protein, 18 aa, Mycobacterium
GQFREWLGLLDPDIRYVV

SEQ ID NO: 670030 - protein, 18 aa, Mycobacterium
GQFRMVRARMLKARAQAT

SEQ ID NO: 670031 - protein, 25 aa, Mycobacterium
GQFRRISYAWIPRARNAHADRLANE

SEQ ID NO: 670032 - protein, 20 aa, Mycobacterium
GQFRRPGAVRCEQVRGQRRA

SEQ ID NO: 670033 - protein, 24 aa, Mycobacterium
GQFSDEFLRWLAGVRFTGEVWAVP

SEQ ID NO: 670034 - protein, 24 aa, Mycobacterium
GQFTHCIDIAPTVLAAIGLPEPTS

SEQ ID NO: 670035 - protein, 24 aa, Mycobacterium
GQFVPVMFARMLKLPEDVRKSYDV

SEQ ID NO: 670036 - protein, 25 aa, Mycobacterium
GQGAVGGASGWLLGNGGAGGDGGAG

SEQ ID NO: 670037 - protein, 22 aa, Mycobacterium
GQGAWSLFVCRKRYIDDQLAAS

SEQ ID NO: 670038 - protein, 33 aa, Mycobacterium
GQGCAAPTRMLLPRSRYDEGVAILKNLYENIAA

SEQ ID NO: 670039 - protein, 27 aa, Mycobacterium
GQGCAITTRLLVPRARYDEAVEAAAAT

SEQ ID NO: 670040 - protein, 19 aa, Mycobacterium
GQGDLGFFWVTAVTTDATI

SEQ ID NO: 670041 - protein, 22 aa, Mycobacterium
GQGEGALAFVLQPLSAALAAGR

SEQ ID NO: 670042 - protein, 18 aa, Mycobacterium
GQGGDATALLGVGVGGAG

SEQ ID NO: 670043 - protein, 24 aa, Mycobacterium
GQGGDGGVIFGYGGAGGTGGVTPG

SEQ ID NO: 670044 - protein, 23 aa, Mycobacterium
GQGGHAGLLWSSGGAGGAGAFSV

SEQ ID NO: 670045 - protein, 17 aa, Mycobacterium
GQGGIFLGNGANGGAAG

SEQ ID NO: 670046 - protein, 19 aa, Mycobacterium
GQGGIGFGGSGGSGGGGGV

SEQ ID NO: 670047 - protein, 20 aa, Mycobacterium
GQGGLGYDAAADPMAAAGAS

SEQ ID NO: 670048 - protein, 27 aa, Mycobacterium
GQGGLYLSDCRIREAAPYAADETRALT

SEQ ID NO: 670049 - protein, 22 aa, Mycobacterium
GQGGNGGDAFFIGNGGNGGAGG

SEQ ID NO: 670050 - protein, 23 aa, Mycobacterium
GQGGNGGSAYLFGNGGSGGQGGT

SEQ ID NO: 670051 - protein, 20 aa, Mycobacterium
GQGGYGGWLAGSGGAGGTAG

SEQ ID NO: 670052 - protein, 26 aa, Mycobacterium
GQGHVALDWLDRVDVIGHNKSSARFD

SEQ ID NO: 670053 - protein, 18 aa, Mycobacterium
GQGIRPQFLGPQVGASSP

SEQ ID NO: 670054 - protein, 24 aa, Mycobacterium
GQGMQRFAPINSWPDNVSLDKARR

SEQ ID NO: 670055 - protein, 29 aa, Mycobacterium
GQGMTFTQDWFRFERLMVAARCVGAAQRL

SEQ ID NO: 670056 - protein, 23 aa, Mycobacterium
GQGNIAGAVTRTGGDGGAGGDAV

SEQ ID NO: 670057 - protein, 18 aa, Mycobacterium
GQGQFLYLATVIDCFSRR

SEQ ID NO: 670058 - protein, 20 aa, Mycobacterium
GQGREGLAWLEAGLGNEAGL

SEQ ID NO: 670059 - protein, 32 aa, Mycobacterium
GQGRRDICIYAREPHVLVSKAPAELFIDPSHT

SEQ ID NO: 670060 - protein, 18 aa, Mycobacterium
GQGSCALGAVKTNIGHLE

SEQ ID NO: 670061 - protein, 32 aa, Mycobacterium
GQGSQWIGMGIELLDTAPVFARHIESCGQAFA

SEQ ID NO: 670062 - protein, 22 aa, Mycobacterium
GQGSRTRPGLDVEAVPVRHQGQ

SEQ ID NO: 670063 - protein, 25 aa, Mycobacterium
GQGTPARWAALGIAGWALHVVDPVD

SEQ ID NO: 670064 - protein, 21 aa, Mycobacterium
GQGVLKRRYTGLAEETERALR

SEQ ID NO: 670065 - protein, 26 aa, Mycobacterium
GQGVPRTGAFWHVDYMFMPKPFAFSM

SEQ ID NO: 670066 - protein, 21 aa, Mycobacterium
GQGVPWWPLAVRGARSPGAPT

SEQ ID NO: 670067 - protein, 18 aa, Mycobacterium
GQGVRVPHGFAITAEAYR

SEQ ID NO: 670068 - protein, 18 aa, Mycobacterium
GQGWGYTGIFAKRNGGGF

SEQ ID NO: 670069 - protein, 22 aa, Mycobacterium
GQHGIPAVGWLVGEVHNGIAQM

SEQ ID NO: 670070 - protein, 24 aa, Mycobacterium
GQHGTEILQELGFDDGQIATLRRA

SEQ ID NO: 670071 - protein, 24 aa, Mycobacterium
GQHHADWGLMASMIVRDGQDPEPA

SEQ ID NO: 670072 - protein, 20 aa, Mycobacterium
GQHLEFERCRVIGGCSTHNG

SEQ ID NO: 670073 - protein, 22 aa, Mycobacterium
GQHQLGLRHCPFLEVAESRSAI

SEQ ID NO: 670074 - protein, 21 aa, Mycobacterium
GQIAQCLAELVTLDTPTVSVL

SEQ ID NO: 670075 - protein, 22 aa, Mycobacterium
GQIAQCLAELVTLDTPTVSVLL

SEQ ID NO: 670076 - protein, 22 aa, Mycobacterium
GQIAQCLAELVTLGTPTVSVLL

SEQ ID NO: 670077 - protein, 25 aa, Mycobacterium
GQIERRWQQTWADRGTFHVPNPVGS

SEQ ID NO: 670078 - protein, 23 aa, Mycobacterium
GQIESLGYGAAWIGASPDADLAW

SEQ ID NO: 670079 - protein, 19 aa, Mycobacterium
GQIGAVVAWDLDRLHRRPI

SEQ ID NO: 670080 - protein, 18 aa, Mycobacterium
GQIGIGALNSGIGNAGLF

SEQ ID NO: 670081 - protein, 17 aa, Mycobacterium
GQIHDFQLAAPMVPEAV

SEQ ID NO: 670082 - protein, 17 aa, Mycobacterium
GQILFTYLHLAASLPCT

SEQ ID NO: 670083 - protein, 21 aa, Mycobacterium
GQILGCPAKTYADWVNDHVEL

SEQ ID NO: 670084 - protein, 24 aa, Mycobacterium
GQIMAGPAATPWKGRNKPHRGDRA

SEQ ID NO: 670085 - protein, 23 aa, Mycobacterium
GQIPDLELLFGPLDVCDCAHCAS

SEQ ID NO: 670086 - protein, 24 aa, Mycobacterium
GQIPRNLHFTRWNPAIDASATRLF

SEQ ID NO: 670087 - protein, 19 aa, Mycobacterium
GQKAFRIGRVCTKRTARGH

SEQ ID NO: 670088 - protein, 21 aa, Mycobacterium
GQKHFRMLKGLESGRNLLHLA

SEQ ID NO: 670089 - protein, 20 aa, Mycobacterium
GQKLFRFGFDIVAPAGLELL

SEQ ID NO: 670090 - protein, 17 aa, Mycobacterium
GQKQGFYSISFVETNDE

SEQ ID NO: 670091 - protein, 20 aa, Mycobacterium
GQKVGMVFGELVSGEVNVRI

SEQ ID NO: 670092 - protein, 18 aa, Mycobacterium
GQLAARLGAAAADYREVL

SEQ ID NO: 670093 - protein, 19 aa, Mycobacterium
GQLADWICFMLSDSADFLC

SEQ ID NO: 670094 - protein, 19 aa, Mycobacterium
GQLAFDCYGSIGIKLQKLV

SEQ ID NO: 670095 - protein, 25 aa, Mycobacterium
GQLAGPLERLACYAAQADSNVDVIR

SEQ ID NO: 670096 - protein, 25 aa, Mycobacterium
GQLATCGWVKAGHPLCLIGDSGTGK

SEQ ID NO: 670097 - protein, 24 aa, Mycobacterium
GQLAWVFGVAAGWTDARAARVAET

SEQ ID NO: 670098 - protein, 31 aa, Mycobacterium; identical to SEQ ID NO: 97747

SEQ ID NO: 670099 - protein, 18 aa, Mycobacterium
GQLCLPFYGALVTNCGLD

SEQ ID NO: 670100 - protein, 24 aa, Mycobacterium
GQLDRLKALVLARATLDAADTDGA

SEQ ID NO: 670101 - protein, 24 aa, Mycobacterium
GQLEAPRASHEWARDKREDLIGRA

SEQ ID NO: 670102 - protein, 17 aa, Mycobacterium
GQLEASGLFSVDLQSTE

SEQ ID NO: 670103 - protein, 20 aa, Mycobacterium
GQLEASRSSHDWAKGKREEL

SEQ ID NO: 670104 - protein, 27 aa, Mycobacterium
GQLELGEWMMGWRRRLIVLLAGGKPSA

SEQ ID NO: 670105 - protein, 30 aa, Mycobacterium
GQLEVRGPVRLEVVQFLAGEGMSTRGIAAI

SEQ ID NO: 670106 - protein, 17 aa, Mycobacterium
GQLGEWLAGTFAAVVAA

SEQ ID NO: 670107 - protein, 28 aa, Mycobacterium
GQLGVPGRLVLVGGLHRIEAALAQPLVG

SEQ ID NO: 670108 - protein, 22 aa, Mycobacterium
GQLIRAGEKVVMFYASGNWDED

SEQ ID NO: 670109 - protein, 17 aa, Mycobacterium
GQLKMARDEGQWQVRWA

SEQ ID NO: 670110 - protein, 17 aa, Mycobacterium
GQLLAFGAAELFAADRV

SEQ ID NO: 670111 - protein, 22 aa, Mycobacterium
GQLLDRFARAFSASAHHFPAPA

SEQ ID NO: 670112 - protein, 18 aa, Mycobacterium
GQLLPCNVVVRTDPAESD

SEQ ID NO: 670113 - protein, 18 aa, Mycobacterium
GQLLPRRTARAFADVANR

SEQ ID NO: 670114 - protein, 23 aa, Mycobacterium
GQLLRKNDRVVISWLSANHDEKE

SEQ ID NO: 670115 - protein, 21 aa, Mycobacterium
GQLPAGAAWAVDLVEPADRVR

SEQ ID NO: 670116 - protein, 17 aa, Mycobacterium
GQLPEPSPAVLLDDPVE

SEQ ID NO: 670117 - protein, 23 aa, Mycobacterium
GQLPGHKVYPWVAEVRHSTPGVG

SEQ ID NO: 670118 - protein, 34 aa, Mycobacterium
GQLQRACIARVLIQRARFVLCDEPTAMLDPISTA

SEQ ID NO: 670119 - protein, 17 aa, Mycobacterium
GQLRAGETVLVLGAAGG

SEQ ID NO: 670120 - protein, 21 aa, Mycobacterium
GQLRAVTNWVGPVGTGAKLAN

SEQ ID NO: 670121 - protein, 21 aa, Mycobacterium
GQLRAVTNWVGPVGTGGRLAN

SEQ ID NO: 670122 - protein, 23 aa, Mycobacterium
GQLRIGMAASFVRCEDPALLAQA

SEQ ID NO: 670123 - protein, 22 aa, Mycobacterium
GQLRIGMATSFVRCEDPALLAQ

SEQ ID NO: 670124 - protein, 19 aa, Mycobacterium
GQLSKWSRMDAELIAEHAE

SEQ ID NO: 670125 - protein, 21 aa, Mycobacterium
GQLSRWTRFTAQPVATMDPTR

SEQ ID NO: 670126 - protein, 20 aa, Mycobacterium
GQLTAAQASHDWAQAKRGEL

SEQ ID NO: 670127 - protein, 19 aa, Mycobacterium
GQLTFAKVGARPVLYTLGK

SEQ ID NO: 670128 - protein, 26 aa, Mycobacterium
GQLTRAGLRPGERVALRSGSNLEFVV

SEQ ID NO: 670129 - protein, 20 aa, Mycobacterium
GQLVCPWHGLRLTGRSRPDW

SEQ ID NO: 670130 - protein, 26 aa, Mycobacterium
GQLVERLPGLHLRRDISELTMRGDLL

SEQ ID NO: 670131 - protein, 25 aa, Mycobacterium
GQLVRVARGGVIKVLAGGAITAGDP

SEQ ID NO: 670132 - protein, 23 aa, Mycobacterium
GQMAEWMCFMLSDAADFLCGTVI

SEQ ID NO: 670133 - protein, 17 aa, Mycobacterium
GQMALAGLAGRAIAGTM

SEQ ID NO: 670134 - protein, 17 aa, Mycobacterium
GQMFKFVLFQTGHEEFY

SEQ ID NO: 670135 - protein, 17 aa, Mycobacterium
GQMIAIKKFLQGREIIV

SEQ ID NO: 670136 - protein, 34 aa, Mycobacterium
GQMIFDLPPSWFAAWARKGMRTSRRYRVPPMPFS

SEQ ID NO: 670137 - protein, 18 aa, Mycobacterium
GQMLVVLHGGGFALGSSA

SEQ ID NO: 670138 - protein, 17 aa, Mycobacterium
GQMPRWMDFSDKADLVM

SEQ ID NO: 670139 - protein, 24 aa, Mycobacterium
GQMRRLGDGVAWSRDRFTMDEGLS

SEQ ID NO: 670140 - protein, 24 aa, Mycobacterium
GQMSECYRIRLNYAQADGGPASVV

SEQ ID NO: 670141 - protein, 26 aa, Mycobacterium
GQMSECYRVQLTYAVPGGPSLVVLKV

SEQ ID NO: 670142 - protein, 24 aa, Mycobacterium
GQMSECYRVVPAYAAAAGPQSVVL

SEQ ID NO: 670143 - protein, 19 aa, Mycobacterium
GQNCRRCGAVMRREKFMNR

SEQ ID NO: 670144 - protein, 23 aa, Mycobacterium
GQNGGAGGWLIGNGGAGGSGTPP

SEQ ID NO: 670145 - protein, 24 aa, Mycobacterium
GQNGGDGGLLWGNGGAGGTGTAAH

SEQ ID NO: 670146 - protein, 23 aa, Mycobacterium
GQNGGDGGWLWGNGGNGGSGAPG

SEQ ID NO: 670147 - protein, 21 aa, Mycobacterium
GQNRFSWKKTGQILANEGFHV

SEQ ID NO: 670148 - protein, 21 aa, Mycobacterium
GQNRFSWKKTGQILGEQGLHV

SEQ ID NO: 670149 - protein, 21 aa, Mycobacterium
GQNRFSWKNTGQILADTGLHV

SEQ ID NO: 670150 - protein, 23 aa, Mycobacterium
GQNRHAWATTAHRLHSHGYTVVA

SEQ ID NO: 670151 - protein, 25 aa, Mycobacterium
GQNRWATKEIDLFIGSGERVLLLGP

SEQ ID NO: 670152 - protein, 20 aa, Mycobacterium
GQNRYSWKNTGQILADQGFH

SEQ ID NO: 670153 - protein, 25 aa, Mycobacterium
GQNYWGVRGCDDFLTGMTHVVSPVC

SEQ ID NO: 670154 - protein, 17 aa, Mycobacterium
GQPACRGPATSLGYLGG

SEQ ID NO: 670155 - protein, 17 aa, Mycobacterium
GQPAHWRATDVAPVGAG

SEQ ID NO: 670156 - protein, 22 aa, Mycobacterium
GQPAPDWFPLLGGHEGAGVVEE

SEQ ID NO: 670157 - protein, 21 aa, Mycobacterium
GQPARLPFWRGDSVGRPAELG

SEQ ID NO: 670158 - protein, 23 aa, Mycobacterium
GQPARWRALGSALTFPADAPERQ

SEQ ID NO: 670159 - protein, 24 aa, Mycobacterium
GQPAVILSHGFPELAYSWRHQIPA

SEQ ID NO: 670160 - protein, 22 aa, Mycobacterium
GQPEVIGLMARNHRGFVDSLIA

SEQ ID NO: 670161 - protein, 18 aa, Mycobacterium
GQPGEFCTRGYSVMLGYW

SEQ ID NO: 670162 - protein, 24 aa, Mycobacterium
GQPGEIFFEGGYSFEYLNDPSKTA

SEQ ID NO: 670163 - protein, 21 aa, Mycobacterium
GQPGFPDWVYQLGAAFNLRAS

SEQ ID NO: 670164 - protein, 25 aa, Mycobacterium
GQPGGKRRSWAVLGEMAELGDDAIT

SEQ ID NO: 670165 - protein, 22 aa, Mycobacterium
GQPGQRVRPVIQLGGDAAVAVV

SEQ ID NO: 670166 - protein, 20 aa, Mycobacterium
GQPGRLPFWRGDSVGRPAEL

SEQ ID NO: 670167 - protein, 29 aa, Mycobacterium
GQPHLVAMWYAVLNGEVWFETKAKSQKVV

SEQ ID NO: 670168 - protein, 19 aa, Mycobacterium
GQPLRTAQVSGIMGAGGQD

SEQ ID NO: 670169 - protein, 20 aa, Mycobacterium
GQPNAAAVRSMWSTVREKVR

SEQ ID NO: 670170 - protein, 19 aa, Mycobacterium
GQPPHTFNFGRDVRRTNAG

SEQ ID NO: 670171 - protein, 25 aa, Mycobacterium
GQPRARELLLDRVIDMAVERRGAAS

SEQ ID NO: 670172 - protein, 23 aa, Mycobacterium
GQPREIAHVIASLLHDDAGYITG

SEQ ID NO: 670173 - protein, 21 aa, Mycobacterium
GQPRLQVRLGGFMDGLEPLTN

SEQ ID NO: 670174 - protein, 22 aa, Mycobacterium
GQPRLRPPFPAVAGLYASPTVV

SEQ ID NO: 670175 - protein, 17 aa, Mycobacterium
GQPRPTPITPFEVDGQL

SEQ ID NO: 670176 - protein, 24 aa, Mycobacterium
GQPRVSPLAYLPVDGKILIVGSYA

SEQ ID NO: 670177 - protein, 20 aa, Mycobacterium
GQPSAWPQWAEPDVVRTFTQ

SEQ ID NO: 670178 - protein, 24 aa, Mycobacterium
GQPVCALLAGGGYAEYVAVPAPQV

SEQ ID NO: 670179 - protein, 19 aa, Mycobacterium
GQPVKGRLTMPPSPPAPKP

SEQ ID NO: 670180 - protein, 19 aa, Mycobacterium
GQPVKGRLTVPPSVPVKSV

SEQ ID NO: 670181 - protein, 20 aa, Mycobacterium
GQPVPDWFCESADLAELAAK

SEQ ID NO: 670182 - protein, 19 aa, Mycobacterium
GQPVWGHGWDETSWPDNTP

SEQ ID NO: 670183 - protein, 21 aa, Mycobacterium
GQPVYLRDIWPSIEEITEVIA

SEQ ID NO: 670184 - protein, 19 aa, Mycobacterium
GQQFAPSVFVQWEGYSGTG

SEQ ID NO: 670185 - protein, 20 aa, Mycobacterium
GQQILGRFLHDFAGIGARWT

SEQ ID NO: 670186 - protein, 25 aa, Mycobacterium
GQQIRAGEKVVMFYPSGNWDTEAFD

SEQ ID NO: 670187 - protein, 17 aa, Mycobacterium
GQQLCPGLAGGVEVAIG

SEQ ID NO: 670188 - protein, 22 aa, Mycobacterium
GQQLRAVLVADNPGYWVLHCHN

SEQ ID NO: 670189 - protein, 22 aa, Mycobacterium
GQQPDVWREIAGRSDAETSEFL

SEQ ID NO: 670190 - protein, 21 aa, Mycobacterium
GQQPRRWSTDIVEAVDVVVTM

SEQ ID NO: 670191 - protein, 26 aa, Mycobacterium
GQQRELTCSFLFACTGYYNYDEGYSP

SEQ ID NO: 670192 - protein, 25 aa, Mycobacterium
GQQRLPIVCSLNLTRKVAMTPDILA

SEQ ID NO: 670193 - protein, 26 aa, Mycobacterium
GQQVGPRVARRFGRVLLELGGNNAVI

SEQ ID NO: 670194 - protein, 28 aa, Mycobacterium
GQQVPRSLALRGVRRVFLVDGELVAHPA

SEQ ID NO: 670195 - protein, 25 aa, Mycobacterium
GQQVSQRFQSVIDIMKRSAHQYQET

SEQ ID NO: 670196 - protein, 23 aa, Mycobacterium
GQRADRKLLIGGELRETSRTFPS

SEQ ID NO: 670197 - protein, 19 aa, Mycobacterium
GQRCSAWHFPAGSGGSGNP

SEQ ID NO: 670198 - protein, 18 aa, Mycobacterium
GQRCWIRQLTPYASREQE

SEQ ID NO: 670199 - protein, 20 aa, Mycobacterium
GQRILVDGIWPRGIRKDDPR

SEQ ID NO: 670200 - protein, 20 aa, Mycobacterium
GQRIPCGDWVLMHYLSANRD

SEQ ID NO: 670201 - protein, 18 aa, Mycobacterium
GQRIPLTGPQAFTNAGLV

SEQ ID NO: 670202 - protein, 18 aa, Mycobacterium
GQRIPLTGPQAFTNSELV

SEQ ID NO: 670203 - protein, 23 aa, Mycobacterium
GQRIRAAGMVRRLARRIDYECEL

SEQ ID NO: 670204 - protein, 22 aa, Mycobacterium
GQRLACPHAIFIDRRKTVPELY

SEQ ID NO: 670205 - protein, 26 aa, Mycobacterium
GQRLLESCPVCLYAGSIMPDDLLALC

SEQ ID NO: 670206 - protein, 27 aa, Mycobacterium
GQRLLGTCKVCLYAGSIMPDDLLALCP

SEQ ID NO: 670207 - protein, 24 aa, Mycobacterium
GQRLLKRLDALSVAAASTAIIGPG

SEQ ID NO: 670208 - protein, 17 aa, Mycobacterium
GQRLQKLGMKRIRLSTE

SEQ ID NO: 670209 - protein, 25 aa, Mycobacterium
GQRLSLRGRHVFAVYEWVFILDASG

SEQ ID NO: 670210 - protein, 24 aa, Mycobacterium
GQRLWFPVPGMYGGFRLALRGDEL

SEQ ID NO: 670211 - protein, 28 aa, Mycobacterium
GQRPQLLIPPGHWQRAWPLGDEPTLVSC

SEQ ID NO: 670212 - protein, 21 aa, Mycobacterium
GQRQSIAIARAIAWADKVVIL

SEQ ID NO: 670213 - protein, 18 aa, Mycobacterium
GQRRACAYVLARAAWYRG

SEQ ID NO: 670214 - protein, 23 aa, Mycobacterium
GQRRFWFMWDDLIRGAIGAIILV

SEQ ID NO: 670215 - protein, 22 aa, Mycobacterium
GQRRFWFMWDDLVRGAIGAIIL

SEQ ID NO: 670216 - protein, 22 aa, Mycobacterium
GQRRFWFMWDDLVRGAIGAVVL

SEQ ID NO: 670217 - protein, 21 aa, Mycobacterium
GQRRLGGLVAESHALLVNLKP

SEQ ID NO: 670218 - protein, 23 aa, Mycobacterium
GQRRTEGRFALYSTGTPDSAESE

SEQ ID NO: 670219 - protein, 37 aa, Mycobacterium
GQRSADKAVPEWLWQAPACVKRAFLQALFEGDGSCSV

SEQ ID NO: 670220 - protein, 20 aa, Mycobacterium
GQSAHMWSRTSLRPSDVDVA

SEQ ID NO: 670221 - protein, 18 aa, Mycobacterium
GQSAVALLGQDSRPPVTV

SEQ ID NO: 670222 - protein, 20 aa, Mycobacterium
GQSEINWAREVLKSAQAGAG

SEQ ID NO: 670223 - protein, 18 aa, Mycobacterium
GQSFKVLAEVTVDSAEAQ

SEQ ID NO: 670224 - protein, 21 aa, Mycobacterium
GQSGDDGGLLFGNGGNGAPGT

SEQ ID NO: 670225 - protein, 19 aa, Mycobacterium
GQSGTFLWVDPGASVALIV

SEQ ID NO: 670226 - protein, 18 aa, Mycobacterium
GQSIPTIAGELYVAPSTV

SEQ ID NO: 670227 - protein, 23 aa, Mycobacterium
GQSLAQLALQWVLRHPNVTSALI

SEQ ID NO: 670228 - protein, 26 aa, Mycobacterium
GQSLRPVIFSTFLMWLLADLFAVLPE

SEQ ID NO: 670229 - protein, 23 aa, Mycobacterium
GQSLRPWVPIVSLVKGLEQGSRM

SEQ ID NO: 670230 - protein, 18 aa, Mycobacterium
GQSLSLWGFYPLAATLNS

SEQ ID NO: 670231 - protein, 18 aa, Mycobacterium
GQSRRAARKAAYEVLERV

SEQ ID NO: 670232 - protein, 18 aa, Mycobacterium
GQSRRAARKAAYQVLERV

SEQ ID NO: 670233 - protein, 18 aa, Mycobacterium
GQSSRIENYLGFPDGLSG

SEQ ID NO: 670234 - protein, 17 aa, Mycobacterium
GQSTFPVRDQEEARLST

SEQ ID NO: 670235 - protein, 25 aa, Mycobacterium
GQSYLAALMPMVWTACERDDFVAEV

SEQ ID NO: 670236 - protein, 21 aa, Mycobacterium
GQSYPFAPPVGLMFVLWDDEA

SEQ ID NO: 670237 - protein, 26 aa, Mycobacterium
GQSYPFTPPVGLMFVLWDTDETITSW

SEQ ID NO: 670238 - protein, 32 aa, Mycobacterium
GQTAYACASAWLDGLVAWRRAAGLPAATINWG

SEQ ID NO: 670239 - protein, 17 aa, Mycobacterium
GQTCISIERCYVEAPVY

SEQ ID NO: 670240 - protein, 19 aa, Mycobacterium
GQTDMGWATPIGAAGRYAQ

SEQ ID NO: 670241 - protein, 19 aa, Mycobacterium
GQTEFVERLTLAPAQQRKK

SEQ ID NO: 670242 - protein, 22 aa, Mycobacterium
GQTFPLPSPFLVMATQNPIEQE

SEQ ID NO: 670243 - protein, 22 aa, Mycobacterium
GQTGSLGIGGTGGHGGAGGDGT

SEQ ID NO: 670244 - protein, 23 aa, Mycobacterium
GQTLFEICARLTTKHGICSTRQA

SEQ ID NO: 670245 - protein, 17 aa, Mycobacterium
GQTLRRVYDRLGFLASR

SEQ ID NO: 670246 - protein, 30 aa, Mycobacterium
GQTPAPSRGGSLCTFRETSRILAGLDGPDS

SEQ ID NO: 670247 - protein, 19 aa, Mycobacterium
GQTPMQWLTGVRVRHAQQL

SEQ ID NO: 670248 - protein, 18 aa, Mycobacterium
GQTPMQWVTGVRIRHAQE

SEQ ID NO: 670249 - protein, 23 aa, Mycobacterium
GQTPRAGLALRRFVAQWLGPAIL

SEQ ID NO: 670250 - protein, 24 aa, Mycobacterium
GQTPWRLDRQALFAAGLPGVADAS

SEQ ID NO: 670251 - protein, 22 aa, Mycobacterium
GQTRGWFYVMHVLATALFDRPA

SEQ ID NO: 670252 - protein, 18 aa, Mycobacterium
GQTSRFAELIGMHPQITA

SEQ ID NO: 670253 - protein, 17 aa, Mycobacterium
GQTTFLETFRFLRQFSV

SEQ ID NO: 670254 - protein, 19 aa, Mycobacterium
GQVAAWLLGLSQYRDSALS

SEQ ID NO: 670255 - protein, 25 aa, Mycobacterium
GQVAQRYAAIYGYDERAMAKIVVDQ

SEQ ID NO: 670256 - protein, 24 aa, Mycobacterium
GQVAQRYAAVYGYDERAMAKIVVD

SEQ ID NO: 670257 - protein, 24 aa, Mycobacterium
GQVAQRYASVYGYDERAMAKIVVD

SEQ ID NO: 670258 - protein, 24 aa, Mycobacterium
GQVAQRYAYEYGYDERAMAKIVVD

SEQ ID NO: 670259 - protein, 19 aa, Mycobacterium
GQVCVCPDYVFVPAARIDA

SEQ ID NO: 670260 - protein, 17 aa, Mycobacterium
GQVGCGLGQVPSTGEVA

SEQ ID NO: 670261 - protein, 17 aa, Mycobacterium
GQVGFGALNSGSGNIGL

SEQ ID NO: 670262 - protein, 17 aa, Mycobacterium
GQVGFGALNSGTGNIGL

SEQ ID NO: 670263 - protein, 17 aa, Mycobacterium
GQVGKAFVVRKGEVSAD

SEQ ID NO: 670264 - protein, 19 aa, Mycobacterium
GQVGPDVFAVHRIDEQLAK

SEQ ID NO: 670265 - protein, 17 aa, Mycobacterium
GQVGVDWAPDALEAVIA

SEQ ID NO: 670266 - protein, 25 aa, Mycobacterium
GQVHGGVCALVLDHVLGATAHHRHQ

SEQ ID NO: 670267 - protein, 24 aa, Mycobacterium
GQVIGDSRVGHWVQDVAEKVQDVR

SEQ ID NO: 670268 - protein, 17 aa, Mycobacterium
GQVKIQSFATFRIRTEN

SEQ ID NO: 670269 - protein, 29 aa, Mycobacterium
GQVLKEVQFRLGFLLDVGLQYLSLSRAAG

SEQ ID NO: 670270 - protein, 26 aa, Mycobacterium
GQVLRCPHCATGFDVVHAGLSDSAQL

SEQ ID NO: 670271 - protein, 24 aa, Mycobacterium
GQVLSRYVEAIVWRTYAQERLTAM

SEQ ID NO: 670272 - protein, 21 aa, Mycobacterium
GQVRAKYGWTDVARFAALGIP

SEQ ID NO: 670273 - protein, 22 aa, Mycobacterium
GQVREVATFVLFLASDESSYAT

SEQ ID NO: 670274 - protein, 19 aa, Mycobacterium
GQVRGRYRALASTLLGKSM

SEQ ID NO: 670275 - protein, 21 aa, Mycobacterium
GQVRSDLFGALNNPPGPEPLP

SEQ ID NO: 670276 - protein, 24 aa, Mycobacterium
GQVSDHLCELGFSAAPPDVVTSAQ

SEQ ID NO: 670277 - protein, 27 aa, Mycobacterium
GQVVSRPEPRLALVAMGRRDVSFDQGM

SEQ ID NO: 670278 - protein, 27 aa, Mycobacterium
GQWALPEGVPAHWAVYFGTDDTDAGAA

SEQ ID NO: 670279 - protein, 21 aa, Mycobacterium
GQWGSALSFAGAQFGLEIEVW

SEQ ID NO: 670280 - protein, 26 aa, Mycobacterium
GQWREVSWDAAFRRCTELLTPVIEKY

SEQ ID NO: 670281 - protein, 21 aa, Mycobacterium
GQWRRCARGVYFADDRLFTDE

SEQ ID NO: 670282 - protein, 19 aa, Mycobacterium
GQYAAGWQGGEKVLGLLDE

SEQ ID NO: 670283 - protein, 19 aa, Mycobacterium
GQYAAGWQGGEKVVGLLDE

SEQ ID NO: 670284 - protein, 19 aa, Mycobacterium
GQYAAGWQGSERVPGLLEE

SEQ ID NO: 670285 - protein, 17 aa, Mycobacterium
GQYAARARHELDLLPDV

SEQ ID NO: 670286 - protein, 25 aa, Mycobacterium
GQYAVWFRREVLRSVDWGGDPHNKS

SEQ ID NO: 670287 - protein, 17 aa, Mycobacterium
GQYEAPLGITLRELLAY

SEQ ID NO: 670288 - protein, 19 aa, Mycobacterium
GQYGPGWQGSQQVPGLLEE

SEQ ID NO: 670289 - protein, 19 aa, Mycobacterium
GQYKRFAYGLPESIEVIEV

SEQ ID NO: 670290 - protein, 26 aa, Mycobacterium
GQYLADCGYRRSWGIGRHIQGSQLFD

SEQ ID NO: 670291 - protein, 21 aa, Mycobacterium
GRAAAEVFAAQGFTVQLMSGP

SEQ ID NO: 670292 - protein, 21 aa, Mycobacterium
GRAAAFDMALLDLFWTSVGGF

SEQ ID NO: 670293 - protein, 22 aa, Mycobacterium
GRAAAGGLEILAKGFDKAGSSA

SEQ ID NO: 670294 - protein, 20 aa, Mycobacterium
GRAAALELPHIWGGLADLSG

SEQ ID NO: 670295 - protein, 19 aa, Mycobacterium
GRAAAQLMIGEGARVLIAD

SEQ ID NO: 670296 - protein, 18 aa, Mycobacterium
GRAADAFHVICPSLPGYG

SEQ ID NO: 670297 - protein, 24 aa, Mycobacterium
GRAADLRAAFTIKGITAPLPLSAT

SEQ ID NO: 670298 - protein, 20 aa, Mycobacterium
GRAAERLHIAQPPLSQQIQK

SEQ ID NO: 670299 - protein, 17 aa, Mycobacterium
GRAAGMARQAAPYEPPT

SEQ ID NO: 670300 - protein, 30 aa, Mycobacterium
GRAALCASCRTWSCMACDEIDHQASIGCPG

SEQ ID NO: 670301 - protein, 21 aa, Mycobacterium
GRAALDHLGRNVATLIDLLAP

SEQ ID NO: 670302 - protein, 19 aa, Mycobacterium
GRAAPVSSQPSFRRAPIGE

SEQ ID NO: 670303 - protein, 20 aa, Mycobacterium
GRAARFYQALGYELDFETDH

SEQ ID NO: 670304 - protein, 28 aa, Mycobacterium
GRAARLEALPGWVWRRRDRTPGVYCGWD

SEQ ID NO: 670305 - protein, 29 aa, Mycobacterium
GRAASEFTLQAWAGSPGFRGDPAGPPISI

SEQ ID NO: 670306 - protein, 23 aa, Mycobacterium
GRAASLELPHVWGGLADLSEGGD

SEQ ID NO: 670307 - protein, 18 aa, Mycobacterium
GRAATLLHVSHAVTDGVG

SEQ ID NO: 670308 - protein, 17 aa, Mycobacterium
GRAATPWGAVSAPVVLR

SEQ ID NO: 670309 - protein, 17 aa, Mycobacterium
GRAAVLAAFASVAINAA

SEQ ID NO: 670310 - protein, 19 aa, Mycobacterium
GRAAVWARENIDGVYPDRL

SEQ ID NO: 670311 - protein, 25 aa, Mycobacterium
GRADDAWLAKWSRAEAAVPHPIDPI

SEQ ID NO: 670312 - protein, 18 aa, Mycobacterium
GRADFIAMGRPLLADPDL

SEQ ID NO: 670313 - protein, 20 aa, Mycobacterium
GRADIAAFVGARADDLVFTK

SEQ ID NO: 670314 - protein, 20 aa, Mycobacterium
GRADLLGSLEFTRDFAGPGN

SEQ ID NO: 670315 - protein, 20 aa, Mycobacterium
GRADLLGSLEYTRQRADGAD

SEQ ID NO: 670316 - protein, 23 aa, Mycobacterium
GRADLRRVRDLTDGAVGANIALL

SEQ ID NO: 670317 - protein, 19 aa, Mycobacterium
GRADVLVNNVGHWLRHPGD

SEQ ID NO: 670318 - protein, 20 aa, Mycobacterium
GRAEIRALFRSSKVGLIAGC

SEQ ID NO: 670319 - protein, 21 aa, Mycobacterium
GRAEIRALFRSSKVGLIAGCM

SEQ ID NO: 670320 - protein, 18 aa, Mycobacterium
GRAEPGLELPVVLGGTMA

SEQ ID NO: 670321 - protein, 18 aa, Mycobacterium
GRAEPIRAVGTDGGAGSA

SEQ ID NO: 670322 - protein, 18 aa, Mycobacterium
GRAFCAGADLSALGAAGG

SEQ ID NO: 670323 - protein, 26 aa, Mycobacterium
GRAFFPVLVCALSWAQRWFPSPEGPA

SEQ ID NO: 670324 - protein, 26 aa, Mycobacterium
GRAFGKGSVHGFDLTFCAPKSVSLVR

SEQ ID NO: 670325 - protein, 21 aa, Mycobacterium
GRAFGNRGVHGFDLTFCAPKS

SEQ ID NO: 670326 - protein, 23 aa, Mycobacterium
GRAFGTNGVHGFDLMFAAPKSVS

SEQ ID NO: 670327 - protein, 18 aa, Mycobacterium
GRAGAPIMLVGEQPGDRE

SEQ ID NO: 670328 - protein, 21 aa, Mycobacterium
GRAGAPLPTRTELVGSVRAVD

SEQ ID NO: 670329 - protein, 25 aa, Mycobacterium
GRAGARLFHAKGWRVGAVDRDDTGL

SEQ ID NO: 670330 - protein, 18 aa, Mycobacterium
GRAGGLMNALSPHFEGKI

SEQ ID NO: 670331 - protein, 21 aa, Mycobacterium
GRAGLGRELLGSKGYGIDSMR

SEQ ID NO: 670332 - protein, 18 aa, Mycobacterium
GRAGLLGLTRRGRVSAGG

SEQ ID NO: 670333 - protein, 19 aa, Mycobacterium
GRAGLPCRRCGTPIETDKN

SEQ ID NO: 670334 - protein, 21 aa, Mycobacterium
GRAGNFGFVIGVDRVGQAEDL

SEQ ID NO: 670335 - protein, 27 aa, Mycobacterium
GRAGQVIAMRVCIVIKLDRDGVINRID

SEQ ID NO: 670336 - protein, 18 aa, Mycobacterium
GRAGTPFTLLHGLADDAV

SEQ ID NO: 670337 - protein, 19 aa, Mycobacterium
GRAGVGCRTVAGALAAAGV

SEQ ID NO: 670338 - protein, 21 aa, Mycobacterium
GRAGVQFATFPETVVPYYPYF

SEQ ID NO: 670339 - protein, 21 aa, Mycobacterium
GRAHLGDLARYLIAIRRRLDR

SEQ ID NO: 670340 - protein, 22 aa, Mycobacterium
GRAHNRLHFPRAMFDEPLPQAD

SEQ ID NO: 670341 - protein, 17 aa, Mycobacterium
GRAIGVIYLPATERQSH

SEQ ID NO: 670342 - protein, 19 aa, Mycobacterium
GRAIICALAHLGGHPVAVV

SEQ ID NO: 670343 - protein, 24 aa, Mycobacterium
GRAILAEFNHPLVIQAETMDAGAD

SEQ ID NO: 670344 - protein, 20 aa, Mycobacterium
GRAILERRFAASYRAVGFDP

SEQ ID NO: 670345 - protein, 25 aa, Mycobacterium
GRAILNYRPLHHIRRPQRDIITGLR

SEQ ID NO: 670346 - protein, 27 aa, Mycobacterium
GRAIRQIFFRFGEVIVEVVGAPGAAGD

SEQ ID NO: 670347 - protein, 23 aa, Mycobacterium
GRAKCWSDAFAAAAGGNFSSAAE

SEQ ID NO: 670348 - protein, 17 aa, Mycobacterium
GRAKLTLDTVTAVRTVW

SEQ ID NO: 670349 - protein, 19 aa, Mycobacterium
GRAKVFVGMGGNFASATPD

SEQ ID NO: 670350 - protein, 18 aa, Mycobacterium
GRALCSAVSSAGISLDQF

SEQ ID NO: 670351 - protein, 20 aa, Mycobacterium
GRALDFPALAAISDIFYPRV

SEQ ID NO: 670352 - protein, 24 aa, Mycobacterium
GRALKRLIDTGIIDFSDLPASVRT

SEQ ID NO: 670353 - protein, 19 aa, Mycobacterium
GRALPSYPPGSHVVLQCGD

SEQ ID NO: 670354 - protein, 17 aa, Mycobacterium
GRALVRRIVKEQLIDHV

SEQ ID NO: 670355 - protein, 26 aa, Mycobacterium
GRANGIFLPHVLRYNASLPSKFMPAP

SEQ ID NO: 670356 - protein, 21 aa, Mycobacterium
GRANPRYSIVYVYDIAELAIL

SEQ ID NO: 670357 - protein, 18 aa, Mycobacterium
GRAPARFDGFSLPARVGA

SEQ ID NO: 670358 - protein, 23 aa, Mycobacterium
GRAPAVDGLTCTIEPGVVTGFLG

SEQ ID NO: 670359 - protein, 20 aa, Mycobacterium
GRAPELLALLDAATEAGADI

SEQ ID NO: 670360 - protein, 18 aa, Mycobacterium
GRAPKPGERFSLPHHAAT

SEQ ID NO: 670361 - protein, 20 aa, Mycobacterium
GRAPLGWIDADGLRRHRNGA

SEQ ID NO: 670362 - protein, 17 aa, Mycobacterium
GRAPYRPAHLHFIAEAD

SEQ ID NO: 670363 - protein, 21 aa, Mycobacterium
GRAQAAAFIRTFAGDNRHIVD

SEQ ID NO: 670364 - protein, 19 aa, Mycobacterium
GRAQFTWIVAIEARPAFAV

SEQ ID NO: 670365 - protein, 19 aa, Mycobacterium
GRAQKGFSARKYGPEKVAD

SEQ ID NO: 670366 - protein, 22 aa, Mycobacterium
GRARAAGVLCRPRDIFVEQTVA

SEQ ID NO: 670367 - protein, 18 aa, Mycobacterium
GRARAGRNGATWQVSTVR

SEQ ID NO: 670368 - protein, 20 aa, Mycobacterium
GRARDGRLVHFLPGDNEIRP

SEQ ID NO: 670369 - protein, 22 aa, Mycobacterium
GRARDGRLVHFRAGDGPVRPGD

SEQ ID NO: 670370 - protein, 20 aa, Mycobacterium
GRARDGRLVHFRAGDQHVRP

SEQ ID NO: 670371 - protein, 19 aa, Mycobacterium
GRARDGRLVHFRPQGHVDG

SEQ ID NO: 670372 - protein, 23 aa, Mycobacterium
GRARDLSSLWVLASSAALFSQTV

SEQ ID NO: 670373 - protein, 23 aa, Mycobacterium
GRAREIDTVYALLAETIAQRTTR

SEQ ID NO: 670374 - protein, 20 aa, Mycobacterium
GRARLILRRETVEDLLSLEV

SEQ ID NO: 670375 - protein, 19 aa, Mycobacterium
GRARLSVGIPIAVLTSTGA

SEQ ID NO: 670376 - protein, 23 aa, Mycobacterium
GRASDLAELLLAWQDAGVDGVRL

SEQ ID NO: 670377 - protein, 19 aa, Mycobacterium
GRASIAVGIPTFNRPNDCV

SEQ ID NO: 670378 - protein, 20 aa, Mycobacterium
GRASQRWGQEVVALVAARPG

SEQ ID NO: 670379 - protein, 18 aa, Mycobacterium
GRATLPLVDGRRGPLTES

SEQ ID NO: 670380 - protein, 26 aa, Mycobacterium
GRATQFYSMLGMRALYHQGWLATTLH

SEQ ID NO: 670381 - protein, 26 aa, Mycobacterium
GRATREAMFARIPLRRFAEPEDFVGA

SEQ ID NO: 670382 - protein, 17 aa, Mycobacterium
GRATSGVQGMRFNADDR

SEQ ID NO: 670383 - protein, 17 aa, Mycobacterium
GRATSGVQGMRFNADDY

SEQ ID NO: 670384 - protein, 17 aa, Mycobacterium
GRATSGVQGMRFNTDDY

SEQ ID NO: 670385 - protein, 25 aa, Mycobacterium
GRAVAELLARLGAGVVISGREPDAV

SEQ ID NO: 670386 - protein, 21 aa, Mycobacterium
GRAVAPVPFLSSAVLATVALL

SEQ ID NO: 670387 - protein, 21 aa, Mycobacterium
GRAVAPVPFLSSAVLATVALS

SEQ ID NO: 670388 - protein, 26 aa, Mycobacterium
GRAVARRATAFGVRVVYHARRAQDDG

SEQ ID NO: 670389 - protein, 18 aa, Mycobacterium
GRAVAVIYDEEFTETVDR

SEQ ID NO: 670390 - protein, 19 aa, Mycobacterium
GRAVDWDFAASVGAKLARP

SEQ ID NO: 670391 - protein, 24 aa, Mycobacterium
GRAVFKRLGITDVADLRSHQEVQR

SEQ ID NO: 670392 - protein, 18 aa, Mycobacterium
GRAVIGFGAGRDYAFADF

SEQ ID NO: 670393 - protein, 18 aa, Mycobacterium
GRAVIGFGAGRDYGFEEF

SEQ ID NO: 670394 - protein, 20 aa, Mycobacterium
GRAVLRRLAPFDVNLHYTDT

SEQ ID NO: 670395 - protein, 23 aa, Mycobacterium
GRAVTGLVLKWLAAEKTSDPGSR

SEQ ID NO: 670396 - protein, 23 aa, Mycobacterium
GRAWDPGLGNLWVYFDSEGCIDW

SEQ ID NO: 670397 - protein, 25 aa, Mycobacterium
GRAYDPRFMFSWVNAKLAVMGAQQL

SEQ ID NO: 670398 - protein, 25 aa, Mycobacterium
GRAYLDFGEPLPLRKRLEELRADES

SEQ ID NO: 670399 - protein, 25 aa, Mycobacterium
GRAYLDFGEPLPLRKRLEELRAEES

SEQ ID NO: 670400 - protein, 25 aa, Mycobacterium
GRAYLDFGEPLPLRKRLEELRALQK

SEQ ID NO: 670401 - protein, 25 aa, Mycobacterium
GRAYLDFGEPLPLRKRLEELRTDES

SEQ ID NO: 670402 - protein, 22 aa, Mycobacterium
GRAYLKVLARRGEPVAQLGIDV

SEQ ID NO: 670403 - protein, 18 aa, Mycobacterium
GRCAGLSLVIYDPDQDPD

SEQ ID NO: 670404 - protein, 26 aa, Mycobacterium
GRCAMAYQVHVGRWDQLDGLVAASYE

SEQ ID NO: 670405 - protein, 18 aa, Mycobacterium
GRCIGVGLAQRGDQVALL

SEQ ID NO: 670406 - protein, 18 aa, Mycobacterium
GRCPELYVTILGALRNGS

SEQ ID NO: 670407 - protein, 21 aa, Mycobacterium
GRCQMSFVFAAPEALVAAAGD

SEQ ID NO: 670408 - protein, 19 aa, Mycobacterium
GRCVKTCLILAARADGARV

SEQ ID NO: 670409 - protein, 23 aa, Mycobacterium
GRDAAWIAERIGLRVTPKTRVLI

SEQ ID NO: 670410 - protein, 26 aa, Mycobacterium
GRDADPWVADFVYRLFATTPPTGRGA

SEQ ID NO: 670411 - protein, 22 aa, Mycobacterium
GRDAGRLAGVFADVERGRHASV

SEQ ID NO: 670412 - protein, 31 aa, Mycobacterium
GRDAHLRRARFWWRYCRGPVGALHGRCAAAI

SEQ ID NO: 670413 - protein, 22 aa, Mycobacterium
GRDAKFMWPHMFNAVADEYDRR

SEQ ID NO: 670414 - protein, 19 aa, Mycobacterium
GRDAPKLAGDRAARIAPEI

SEQ ID NO: 670415 - protein, 22 aa, Mycobacterium
GRDAVERWRVKAAQMADDVTAW

SEQ ID NO: 670416 - protein, 24 aa, Mycobacterium
GRDCTAIRWGLWQAAGVVAADEIA

SEQ ID NO: 670417 - protein, 26 aa, Mycobacterium
GRDCTAIRWGLWQGAGVVVGNEITRT

SEQ ID NO: 670418 - protein, 24 aa, Mycobacterium
GRDDICAVIVFGGHEMFSVGADVP

SEQ ID NO: 670419 - protein, 20 aa, Mycobacterium
GRDDLSLRIAVQPGGCAGLR

SEQ ID NO: 670420 - protein, 18 aa, Mycobacterium
GRDDPGWFEHGFLAEEMG

SEQ ID NO: 670421 - protein, 25 aa, Mycobacterium
GRDEDGRWGLGPAITELAAHVDDPL

SEQ ID NO: 670422 - protein, 19 aa, Mycobacterium
GRDEFRGESFHSAAWEPAF

SEQ ID NO: 670423 - protein, 25 aa, Mycobacterium
GRDELAELCGRLIGMPLERSKPLWE

SEQ ID NO: 670424 - protein, 17 aa, Mycobacterium
GRDFAALTGEVVDGTLA

SEQ ID NO: 670425 - protein, 19 aa, Mycobacterium
GRDFREFHIDWDLNAAEKG

SEQ ID NO: 670426 - protein, 21 aa, Mycobacterium
GRDGCRVPLPWSGDAPPFGFS

SEQ ID NO: 670427 - protein, 19 aa, Mycobacterium
GRDGFALIDVIRDWGEVGI

SEQ ID NO: 670428 - protein, 19 aa, Mycobacterium
GRDGFALIDVIREWGDIGI

SEQ ID NO: 670429 - protein, 20 aa, Mycobacterium
GRDGFALIDVIREWGDIGIV

SEQ ID NO: 670430 - protein, 21 aa, Mycobacterium
GRDGGAGGAAGLWGTGGTGGA

SEQ ID NO: 670431 - protein, 21 aa, Mycobacterium
GRDGGIPWHVPEDMARFKELT

SEQ ID NO: 670432 - protein, 29 aa, Mycobacterium
GRDGGYELARPAADISIADVLRCIDGPLA

SEQ ID NO: 670433 - protein, 29 aa, Mycobacterium
GRDGGYELARPGTDISIADVLRCIDGPLA

SEQ ID NO: 670434 - protein, 18 aa, Mycobacterium
GRDGRKLSEEWGDSPRAY

SEQ ID NO: 670435 - protein, 18 aa, Mycobacterium
GRDGSVFDSSYERGAPVV

SEQ ID NO: 670436 - protein, 17 aa, Mycobacterium
GRDGSVFDSSYQRGAPV

SEQ ID NO: 670437 - protein, 17 aa, Mycobacterium
GRDGSVFDSSYTRGTPA

SEQ ID NO: 670438 - protein, 21 aa, Mycobacterium
GRDGVGQPCAAGWYSLNGNGE

SEQ ID NO: 670439 - protein, 19 aa, Mycobacterium
GRDHIAFEQDVVWPKLEAA

SEQ ID NO: 670440 - protein, 17 aa, Mycobacterium
GRDHYLAGIYRTALHTV

SEQ ID NO: 670441 - protein, 24 aa, Mycobacterium
GRDKCYRLGPALIALGHMAQESMR

SEQ ID NO: 670442 - protein, 18 aa, Mycobacterium
GRDLPAAPLPSADPDALR

SEQ ID NO: 670443 - protein, 17 aa, Mycobacterium
GRDLPEQERELLLADKH

SEQ ID NO: 670444 - protein, 19 aa, Mycobacterium
GRDLPGCHVYRTLDDLDAI

SEQ ID NO: 670445 - protein, 19 aa, Mycobacterium
GRDLSGWGQQWLKTTGLNK

SEQ ID NO: 670446 - protein, 19 aa, Mycobacterium
GRDLSTWGQQWLKTTGLNT

SEQ ID NO: 670447 - protein, 31 aa, Mycobacterium
GRDLVRLGVDGGRWGAVPLRSRDRARRRATV

SEQ ID NO: 670448 - protein, 18 aa, Mycobacterium
GRDMPVGVLVGSWHTIEG

SEQ ID NO: 670449 - protein, 25 aa, Mycobacterium
GRDPDSVRVWSCFATVGDHLPEELR

SEQ ID NO: 670450 - protein, 19 aa, Mycobacterium
GRDPQHCRKLCRLIIASID

SEQ ID NO: 670451 - protein, 24 aa, Mycobacterium
GRDPRPAFITATFAAGVEKVADLK

SEQ ID NO: 670452 - protein, 22 aa, Mycobacterium
GRDPRSVKVFTMVTPIVAESHD

SEQ ID NO: 670453 - protein, 26 aa, Mycobacterium
GRDPVLRFLAARAFAKAGDIAMIPTA

SEQ ID NO: 670454 - protein, 26 aa, Mycobacterium
GRDPWAPGASALICIRPHTLSIVGPT

SEQ ID NO: 670455 - protein, 19 aa, Mycobacterium
GRDRLTPFRPFQVNQRLLG

SEQ ID NO: 670456 - protein, 23 aa, Mycobacterium
GRDRTVCRAMNWRSERDAAEVPA

SEQ ID NO: 670457 - protein, 20 aa, Mycobacterium
GRDSLLTAWMSLPLDVGLSV

SEQ ID NO: 670458 - protein, 25 aa, Mycobacterium
GRDWLLRYCDEHGISAQREDDHAYA

SEQ ID NO: 670459 - protein, 19 aa, Mycobacterium
GRDWLLRYCEEHGVPTQTE

SEQ ID NO: 670460 - protein, 28 aa, Mycobacterium
GRDWLVLPGSPPGALLVRPLGGHEDETT

SEQ ID NO: 670461 - protein, 25 aa, Mycobacterium
GRDYLEKMLQLKVAIPPLSAPEAET

SEQ ID NO: 670462 - protein, 22 aa, Mycobacterium
GREARVSPDLARHIAHRREADR

SEQ ID NO: 670463 - protein, 21 aa, Mycobacterium
GREAVPLRGIDMTVRRNAFGR

SEQ ID NO: 670464 - protein, 24 aa, Mycobacterium
GRECLTVGSSWRFVEEQFGGKDSL

SEQ ID NO: 670465 - protein, 20 aa, Mycobacterium
GREDFVSFAPISSVDSLITD

SEQ ID NO: 670466 - protein, 23 aa, Mycobacterium
GREDWAVHVALWQAGELVAGAVA

SEQ ID NO: 670467 - protein, 22 aa, Mycobacterium
GREDWAVHVALWQTDELVAGAV

SEQ ID NO: 670468 - protein, 21 aa, Mycobacterium
GREDWLIKLMEGVEDIPGTAL

SEQ ID NO: 670469 - protein, 23 aa, Mycobacterium
GREEPSMRCARCGSDAIRAVVVG

SEQ ID NO: 670470 - protein, 25 aa, Mycobacterium
GREETKSRMALMAHLLKRGYRHLGE

SEQ ID NO: 670471 - protein, 31 aa, Mycobacterium
GREFFGLLIRICLGIAAWLRGAFATAGPQIQ

SEQ ID NO: 670472 - protein, 26 aa, Mycobacterium
GREGAKLFHAKGWRVGAVDRNDDGLT

SEQ ID NO: 670473 - protein, 25 aa, Mycobacterium
GREGAKLFHAKGWRVGAVDRNGEGL

SEQ ID NO: 670474 - protein, 24 aa, Mycobacterium
GREGEPCRRCGAIMRRDKFMNRSS

SEQ ID NO: 670475 - protein, 18 aa, Mycobacterium
GREGVSIDVPENLDPTRR

SEQ ID NO: 670476 - protein, 25 aa, Mycobacterium
GREHAPLEFGLRVTTFVRDTTDQAW

SEQ ID NO: 670477 - protein, 20 aa, Mycobacterium
GREHIAYEQDVVWPQVELAI

SEQ ID NO: 670478 - protein, 21 aa, Mycobacterium
GREHLRRYYGFKPDYAALNVA

SEQ ID NO: 670479 - protein, 34 aa, Mycobacterium
GREIRRLGVLGADFRPLVFDGLFLQLPIGSVDAL

SEQ ID NO: 670480 - protein, 20 aa, Mycobacterium
GREIYWPRGKVLGGSSSMNA

SEQ ID NO: 670481 - protein, 21 aa, Mycobacterium
GREIYWPRGKVLGGSSSMNAM

SEQ ID NO: 670482 - protein, 18 aa, Mycobacterium
GREKPALMQRLYQASWRL

SEQ ID NO: 670483 - protein, 20 aa, Mycobacterium
GRELECGVLEFPDGDTRASV

SEQ ID NO: 670484 - protein, 20 aa, Mycobacterium
GRELECGVLEFPDGHLEAST

SEQ ID NO: 670485 - protein, 25 aa, Mycobacterium
GRELFIEKVWDWKRESGGTIGGQMR

SEQ ID NO: 670486 - protein, 19 aa, Mycobacterium
GRELLGRRIPRAVLEDDDA

SEQ ID NO: 670487 - protein, 22 aa, Mycobacterium
GRELPATLAMDYPRVADVALYL

SEQ ID NO: 670488 - protein, 19 aa, Mycobacterium
GRELVRYGMAEVVDGRLMM

SEQ ID NO: 670489 - protein, 25 aa, Mycobacterium
GRENCFFLHCSLVPFMAPSGELKTK

SEQ ID NO: 670490 - protein, 21 aa, Mycobacterium
GRENCFFLHVSLVPYLAPSGE

SEQ ID NO: 670491 - protein, 18 aa, Mycobacterium
GREPLVLGAVKTNLGHLE

SEQ ID NO: 670492 - protein, 23 aa, Mycobacterium
GREPRPYPELVLAQRDSIFDYTY

SEQ ID NO: 670493 - protein, 19 aa, Mycobacterium
GREPRRWGRIDYRTLNRRA

SEQ ID NO: 670494 - protein, 17 aa, Mycobacterium
GREPVSGVHFAFVSNSS

SEQ ID NO: 670495 - protein, 23 aa, Mycobacterium
GREPVTEVSFVFVSNASPWTFVG

SEQ ID NO: 670496 - protein, 21 aa, Mycobacterium
GREQFRPVAPMVLAERAAEIF

SEQ ID NO: 670497 - protein, 19 aa, Mycobacterium
GREQWLIELMEGVEDIPGS

SEQ ID NO: 670498 - protein, 17 aa, Mycobacterium
GRERFAGQVVHPQQWPE

SEQ ID NO: 670499 - protein, 18 aa, Mycobacterium
GRERGYCLMIGGDDEAFL

SEQ ID NO: 670500 - protein, 17 aa, Mycobacterium
GRERGYCLMVGGDDEAF

SEQ ID NO: 670501 - protein, 25 aa, Mycobacterium
GRERLICRAMNWRSVREGAGIQHDV

SEQ ID NO: 670502 - protein, 24 aa, Mycobacterium
GRERRRIRDWLAFLYAEPLAPLML

SEQ ID NO: 670503 - protein, 21 aa, Mycobacterium
GRERWCLTGDAGIFLDPLYSS

SEQ ID NO: 670504 - protein, 27 aa, Mycobacterium
GRESYSFPRAMSTLVGLGRLLPTTLRR

SEQ ID NO: 670505 - protein, 27 aa, Mycobacterium
GREVASIQRLRCANGEPLALMTNHLPA

SEQ ID NO: 670506 - protein, 33 aa, Mycobacterium
GREVIEIGGQWRKGQALEPDWPLDMGYTVEVQG

SEQ ID NO: 670507 - protein, 23 aa, Mycobacterium
GREVLRDIEWRIAPGERTGILGA

SEQ ID NO: 670508 - protein, 18 aa, Mycobacterium
GREVLYRLVDHHLAHIVV

SEQ ID NO: 670509 - protein, 28 aa, Mycobacterium
GREVPWLSSQEVVQWAGAGYKAGFAYRD

SEQ ID NO: 670510 - protein, 18 aa, Mycobacterium
GREVQQYIAGLVDQYRLN

SEQ ID NO: 670511 - protein, 18 aa, Mycobacterium
GREWGHHGIEEFTELKSI

SEQ ID NO: 670512 - protein, 22 aa, Mycobacterium
GRFAEMRRLIGDEVVARIGIVG

SEQ ID NO: 670513 - protein, 19 aa, Mycobacterium
GRFAPSIMGSSVFAGLMDE

SEQ ID NO: 670514 - protein, 17 aa, Mycobacterium
GRFARQLGADAWAPDAR

SEQ ID NO: 670515 - protein, 18 aa, Mycobacterium
GRFARTVIEQALRKAKAR

SEQ ID NO: 670516 - protein, 18 aa, Mycobacterium
GRFASNFADRGVRSGFSA

SEQ ID NO: 670517 - protein, 19 aa, Mycobacterium
GRFCPPVPDGLVYVEPHPR

SEQ ID NO: 670518 - protein, 25 aa, Mycobacterium
GRFDEAFAALRGWEAQGRLHHRQTI

SEQ ID NO: 670519 - protein, 20 aa, Mycobacterium
GRFDQGWDVLREEIFARQKR

SEQ ID NO: 670520 - protein, 24 aa, Mycobacterium
GRFEREMMDLYGISPVGHPQPRRL

SEQ ID NO: 670521 - protein, 23 aa, Mycobacterium
GRFEREMMDLYGVVPQGHPQPRR

SEQ ID NO: 670522 - protein, 25 aa, Mycobacterium
GRFFTVRAGSLVAWRTVEDASAPFR

SEQ ID NO: 670523 - protein, 19 aa, Mycobacterium
GRFGEWLHQTAISFPSIAQ

SEQ ID NO: 670524 - protein, 22 aa, Mycobacterium
GRFGLRGGPVLIGRSPVACDYD

SEQ ID NO: 670525 - protein, 22 aa, Mycobacterium
GRFGLRGGPVLIGRTQLACDYD

SEQ ID NO: 670526 - protein, 17 aa, Mycobacterium
GRFGWPVYEISTVSRDG

SEQ ID NO: 670527 - protein, 20 aa, Mycobacterium
GRFILAVGVGYLKREFAALG

SEQ ID NO: 670528 - protein, 17 aa, Mycobacterium
GRFILGVGVGGREHDYR

SEQ ID NO: 670529 - protein, 21 aa, Mycobacterium
GRFIPMAIPAIWNPGLAAAEV

SEQ ID NO: 670530 - protein, 25 aa, Mycobacterium
GRFLCPGAWLARCEMQSLLRGLVTR

SEQ ID NO: 670531 - protein, 25 aa, Mycobacterium
GRFLLEHARIGGGGFADVFRATDRK

SEQ ID NO: 670532 - protein, 18 aa, Mycobacterium
GRFLPAWHQVAGSSSPNH

SEQ ID NO: 670533 - protein, 21 aa, Mycobacterium
GRFLYGGWTRPLSADAVAGLL

SEQ ID NO: 670534 - protein, 34 aa, Mycobacterium
GRFPCDLYDLKTLWTIASTNPWLSVTPVSEYSTD

SEQ ID NO: 670535 - protein, 17 aa, Mycobacterium
GRFPGRWLNEQRKAHRT

SEQ ID NO: 670536 - protein, 25 aa, Mycobacterium
GRFPYRNDGALGWAGTSPVGTFPPN

SEQ ID NO: 670537 - protein, 25 aa, Mycobacterium
GRFPYRNDGALGWTGTSPVGTFPPN

SEQ ID NO: 670538 - protein, 17 aa, Mycobacterium
GRFRITIGPGVVRLGWT

SEQ ID NO: 670539 - protein, 29 aa, Mycobacterium
GRFSEQLLPEHLHKVSLSFLVDDLVVHRG

SEQ ID NO: 670540 - protein, 31 aa, Mycobacterium
GRFSFNVKGGRCEACSGDGTIKIEMNFLPDV

SEQ ID NO: 670541 - protein, 30 aa, Mycobacterium
GRFSFNVKGGRCEACTGDGTIKIEMNFLPD

SEQ ID NO: 670542 - protein, 23 aa, Mycobacterium
GRFSPWGRLDEWRRQYDTIIDRL

SEQ ID NO: 670543 - protein, 23 aa, Mycobacterium
GRFSPWGRLKTYRAHYDAVIGSL

SEQ ID NO: 670544 - protein, 17 aa, Mycobacterium
GRFSVSRASQQAFRTGT

SEQ ID NO: 670545 - protein, 25 aa, Mycobacterium
GRGADGWRLDAAYAVPQHFWASTLP

SEQ ID NO: 670546 - protein, 19 aa, Mycobacterium
GRGADGWTVPEYGNMVGPF

SEQ ID NO: 670547 - protein, 18 aa, Mycobacterium
GRGADVWDDLHPTADQQV

SEQ ID NO: 670548 - protein, 18 aa, Mycobacterium
GRGADVWDELHPTAAQQR

SEQ ID NO: 670549 - protein, 18 aa, Mycobacterium
GRGADVWEDLHPTAEQQV

SEQ ID NO: 670550 - protein, 18 aa, Mycobacterium
GRGADVWEELHPTAAQQV

SEQ ID NO: 670551 - protein, 18 aa, Mycobacterium
GRGADVWEELHPTADQQV

SEQ ID NO: 670552 - protein, 20 aa, Mycobacterium
GRGAIAGRLLGSVSAAVAEG

SEQ ID NO: 670553 - protein, 27 aa, Mycobacterium
GRGARPWLAGVALDWVLDGAVRAGAAL

SEQ ID NO: 670554 - protein, 18 aa, Mycobacterium
GRGARRISADGAPTTVLV

SEQ ID NO: 670555 - protein, 20 aa, Mycobacterium
GRGASALRVALHPTDTGLRL

SEQ ID NO: 670556 - protein, 20 aa, Mycobacterium
GRGAVLALPHSGNWDMAGVW

SEQ ID NO: 670557 - protein, 23 aa, Mycobacterium
GRGAYGSGLIPPARGGDGGNGGD

SEQ ID NO: 670558 - protein, 19 aa, Mycobacterium
GRGDGFCAGFDLSAYADGT

SEQ ID NO: 670559 - protein, 19 aa, Mycobacterium
GRGDGFCGGFDLSAYAEAN

SEQ ID NO: 670560 - protein, 20 aa, Mycobacterium
GRGDLTWGQAAERFCAMVAP

SEQ ID NO: 670561 - protein, 21 aa, Mycobacterium
GRGDPAWRAAADDVIAKDAQM

SEQ ID NO: 670562 - protein, 18 aa, Mycobacterium
GRGDRTWEQAAGRFCDAV

SEQ ID NO: 670563 - protein, 18 aa, Mycobacterium
GRGEILGLAGLLGSGRTE

SEQ ID NO: 670564 - protein, 18 aa, Mycobacterium
GRGEVIASLAREGGLQSA

SEQ ID NO: 670565 - protein, 17 aa, Mycobacterium
GRGFRFVGPTTAYALMQ

SEQ ID NO: 670566 - protein, 25 aa, Mycobacterium
GRGGAACAAVFGRLSGELARQRDAA

SEQ ID NO: 670567 - protein, 21 aa, Mycobacterium
GRGGAAFPLAVKLRTVRENGR

SEQ ID NO: 670568 - protein, 20 aa, Mycobacterium
GRGGAAPSIDTAMHGLVDAA

SEQ ID NO: 670569 - protein, 37 aa, Mycobacterium
GRGGDGGAFDDGFFLIFGDPGIDGDPGGPPDGGAGGG

SEQ ID NO: 670570 - protein, 19 aa, Mycobacterium
GRGGFAGMLLGSVSTAVAH

SEQ ID NO: 670571 - protein, 22 aa, Mycobacterium
GRGGFPGMLLGSVSSTVAHSAK

SEQ ID NO: 670572 - protein, 20 aa, Mycobacterium
GRGGFSGMLLGSVSTAVVHA

SEQ ID NO: 670573 - protein, 21 aa, Mycobacterium
GRGGGIPWNVPEDLARFKEVT

SEQ ID NO: 670574 - protein, 18 aa, Mycobacterium
GRGGGLFVADAGPVVRMR

SEQ ID NO: 670575 - protein, 18 aa, Mycobacterium
GRGGIGATEVRVVGNEDP

SEQ ID NO: 670576 - protein, 19 aa, Mycobacterium
GRGGLGASATSFAGGSGGA

SEQ ID NO: 670577 - protein, 17 aa, Mycobacterium
GRGGPRCMSCPAARDPL

SEQ ID NO: 670578 - protein, 19 aa, Mycobacterium
GRGGRDFWAKTSGTITARG

SEQ ID NO: 670579 - protein, 19 aa, Mycobacterium
GRGGVCIALTMQVEPQGDG

SEQ ID NO: 670580 - protein, 19 aa, Mycobacterium
GRGGVGWLEWNRNLGERSG

SEQ ID NO: 670581 - protein, 19 aa, Mycobacterium
GRGGVKVKLIGKIKPTDNG

SEQ ID NO: 670582 - protein, 18 aa, Mycobacterium
GRGHPDWDSSATDRIAFL

SEQ ID NO: 670583 - protein, 27 aa, Mycobacterium
GRGIAETFARAGINVVITARTQDDIDA

SEQ ID NO: 670584 - protein, 23 aa, Mycobacterium
GRGIGAAAARLFAAEGASVMLAA

SEQ ID NO: 670585 - protein, 20 aa, Mycobacterium
GRGIGRAMMQLLLEYASGGT

SEQ ID NO: 670586 - protein, 22 aa, Mycobacterium
GRGIMFAELPWRGNEIHRVRYF

SEQ ID NO: 670587 - protein, 18 aa, Mycobacterium
GRGIPLMHALTDRAVIDA

SEQ ID NO: 670588 - protein, 20 aa, Mycobacterium
GRGIPLTQLFAFAAELADAD

SEQ ID NO: 670589 - protein, 19 aa, Mycobacterium
GRGIPPERLDEVAEHYFHF

SEQ ID NO: 670590 - protein, 24 aa, Mycobacterium
GRGIPRYLGDYSDVFDELLASVGL

SEQ ID NO: 670591 - protein, 22 aa, Mycobacterium
GRGKGFCAGAYLGAPDSAPSFG

SEQ ID NO: 670592 - protein, 25 aa, Mycobacterium
GRGKIPRADVAAVLVAVLDAPQTAG

SEQ ID NO: 670593 - protein, 23 aa, Mycobacterium
GRGKPTWSMYALGEMQPRFDNRV

SEQ ID NO: 670594 - protein, 31 aa, Mycobacterium
GRGLCGKGTPGWRWLDVRALATRLVTAHSVW

SEQ ID NO: 670595 - protein, 24 aa, Mycobacterium
GRGLGAAMALAFAEAGADVLIAAR

SEQ ID NO: 670596 - protein, 18 aa, Mycobacterium
GRGLLLMRALSSAVDLDP

SEQ ID NO: 670597 - protein, 21 aa, Mycobacterium
GRGLMCAFSMPSARQRDELLA

SEQ ID NO: 670598 - protein, 22 aa, Mycobacterium
GRGLRAARAERIFGGYNASPDL

SEQ ID NO: 670599 - protein, 24 aa, Mycobacterium
GRGNRLRRAVGWYRNHDRLHTGDQ

SEQ ID NO: 670600 - protein, 25 aa, Mycobacterium
GRGNRLRRAVGWYRSHDRLHTGDQV

SEQ ID NO: 670601 - protein, 24 aa, Mycobacterium
GRGNVSGFVRTGLFKRLSSSGHSF

SEQ ID NO: 670602 - protein, 21 aa, Mycobacterium
GRGPAWPVVYPHARPVPLPTY

SEQ ID NO: 670603 - protein, 20 aa, Mycobacterium
GRGPFLRTGDLGFFLDGELF

SEQ ID NO: 670604 - protein, 24 aa, Mycobacterium
GRGPHRYVCGGVMLTFDEMIDALE

SEQ ID NO: 670605 - protein, 25 aa, Mycobacterium
GRGPKRYLCGGVMLSFDEMINALEA

SEQ ID NO: 670606 - protein, 19 aa, Mycobacterium
GRGPLFDSLFVFENAPIDD

SEQ ID NO: 670607 - protein, 22 aa, Mycobacterium
GRGPLTVPIWYYYTAGGELWIP

SEQ ID NO: 670608 - protein, 19 aa, Mycobacterium
GRGPVLIHALEGFSDAGHA

SEQ ID NO: 670609 - protein, 21 aa, Mycobacterium
GRGRAGRLVAPDAGFGGDYED

SEQ ID NO: 670610 - protein, 23 aa, Mycobacterium
GRGRDFASRWAELIFTGDPGLAI

SEQ ID NO: 670611 - protein, 19 aa, Mycobacterium
GRGRFRGRHTMDVLASAAA

SEQ ID NO: 670612 - protein, 20 aa, Mycobacterium
GRGRGFCAGAYLGSADAAAG

SEQ ID NO: 670613 - protein, 22 aa, Mycobacterium
GRGRGFCAGAYLGSPDSAAGYG

SEQ ID NO: 670614 - protein, 19 aa, Mycobacterium
GRGRGGIAAALAGCPVPTV

SEQ ID NO: 670615 - protein, 23 aa, Mycobacterium
GRGRGGVEKALRGCPVPVVVGGI

SEQ ID NO: 670616 - protein, 20 aa, Mycobacterium
GRGRHGRGWSATPRAQITMS

SEQ ID NO: 670617 - protein, 21 aa, Mycobacterium
GRGRIATKWSSIWDTDYHRDS

SEQ ID NO: 670618 - protein, 17 aa, Mycobacterium
GRGRIMFIGLDGDWTVH

SEQ ID NO: 670619 - protein, 28 aa, Mycobacterium
GRGRPFPDLILASLLRLKVNDVREVAVL

SEQ ID NO: 670620 - protein, 21 aa, Mycobacterium
GRGRQVIALDVDVVRTPSDHP

SEQ ID NO: 670621 - protein, 24 aa, Mycobacterium
GRGRYRVRWIPQRAAKGVYYGTPI

SEQ ID NO: 670622 - protein, 19 aa, Mycobacterium
GRGSIRMRGVAEIEEDSKG

SEQ ID NO: 670623 - protein, 20 aa, Mycobacterium
GRGSIRMRGVVEIEEDSRGR

SEQ ID NO: 670624 - protein, 19 aa, Mycobacterium
GRGSIRMRGVVEVEEDSRG

SEQ ID NO: 670625 - protein, 23 aa, Mycobacterium
GRGSPWATPLSWLVPPRVAMQIL

SEQ ID NO: 670626 - protein, 24 aa, Mycobacterium
GRGSPWATPLSWLVPPRVAMQILL

SEQ ID NO: 670627 - protein, 25 aa, Mycobacterium
GRGSPWAVPLSWLLPPRIALQILMT

SEQ ID NO: 670628 - protein, 21 aa, Mycobacterium
GRGSQWAGMGRQLLADEPVFA

SEQ ID NO: 670629 - protein, 20 aa, Mycobacterium
GRGSQWVGMGRQLLADEPAF

SEQ ID NO: 670630 - protein, 24 aa, Mycobacterium
GRGSRLPVWLAQWGYQRPAEDTVD

SEQ ID NO: 670631 - protein, 21 aa, Mycobacterium
GRGTMPAGLTRWADAQLAPAV

SEQ ID NO: 670632 - protein, 24 aa, Mycobacterium
GRGTRLPVWLAQWGFARPVEQAVD

SEQ ID NO: 670633 - protein, 24 aa, Mycobacterium
GRGTRLPVWLAQWGFQRPAEETVD

SEQ ID NO: 670634 - protein, 17 aa, Mycobacterium
GRGVFDLLQRKGLAARV

SEQ ID NO: 670635 - protein, 24 aa, Mycobacterium
GRGVLAVRGRGLWAGVDIDPALGT

SEQ ID NO: 670636 - protein, 27 aa, Mycobacterium
GRGVSSCATCDGFFFRDQDIAVIGGGD

SEQ ID NO: 670637 - protein, 26 aa, Mycobacterium
GRGVVAVRGKGLWAGVDIDPAHGTGK

SEQ ID NO: 670638 - protein, 23 aa, Mycobacterium
GRGWCRLTDVFAAGGLDQPVKGV

SEQ ID NO: 670639 - protein, 39 aa, Mycobacterium
GRGYPAPRPKFRWCTERLKIKPSNSFIRAMVRSHGEAIL

SEQ ID NO: 670640 - protein, 21 aa, Mycobacterium
GRGYVLRRLLRRIIRSTKLLG

SEQ ID NO: 670641 - protein, 23 aa, Mycobacterium
GRHACGQCVGHGHPQPPAHFRRH

SEQ ID NO: 670642 - protein, 17 aa, Mycobacterium
GRHARDLLIKRFKMNQK

SEQ ID NO: 670643 - protein, 20 aa, Mycobacterium
GRHARVFLDSVLPALGEEGI

SEQ ID NO: 670644 - protein, 25 aa, Mycobacterium
GRHAYLAACSLPFDAAVDCYGAFIV

SEQ ID NO: 670645 - protein, 17 aa, Mycobacterium
GRHDAELIAQVWGEDLK

SEQ ID NO: 670646 - protein, 19 aa, Mycobacterium
GRHEFFQGSGLVNLMQALS

SEQ ID NO: 670647 - protein, 23 aa, Mycobacterium
GRHFRLDWSTPHDIGRKAIAQNA

SEQ ID NO: 670648 - protein, 20 aa, Mycobacterium
GRHGALFSFLAGGKRSVVVD

SEQ ID NO: 670649 - protein, 22 aa, Mycobacterium
GRHGLTLNTAVLFAWAVVLSRL

SEQ ID NO: 670650 - protein, 18 aa, Mycobacterium
GRHGVLFRSLETARLAVV

SEQ ID NO: 670651 - protein, 18 aa, Mycobacterium
GRHIPVFAHVTVETTGTM

SEQ ID NO: 670652 - protein, 25 aa, Mycobacterium
GRHLAFSGGRHFCLGAALARAEGEV

SEQ ID NO: 670653 - protein, 19 aa, Mycobacterium
GRHLPRRLAVTYLDALSAA

SEQ ID NO: 670654 - protein, 20 aa, Mycobacterium
GRHLRRLTTLVGEYEAVEVV

SEQ ID NO: 670655 - protein, 17 aa, Mycobacterium
GRHPAAVNYGDTMAYAT

SEQ ID NO: 670656 - protein, 23 aa, Mycobacterium
GRHPERLHRCLVDSPEYARLLRE

SEQ ID NO: 670657 - protein, 18 aa, Mycobacterium
GRHPLKFTAYDGSCAGSK

SEQ ID NO: 670658 - protein, 21 aa, Mycobacterium
GRHQFPLVITDTVAQFLHAVS

SEQ ID NO: 670659 - protein, 25 aa, Mycobacterium
GRHQTLRHAVAWSYDHLSDAEKVLL

SEQ ID NO: 670660 - protein, 18 aa, Mycobacterium
GRHRAEVIAVADGVTYVD

SEQ ID NO: 670661 - protein, 17 aa, Mycobacterium
GRHRCVGAAFATMQIKA

SEQ ID NO: 670662 - protein, 17 aa, Mycobacterium
GRHREFFQRHNVCRHHV

SEQ ID NO: 670663 - protein, 20 aa, Mycobacterium
GRHRGEPVLAPIVYTSALNL

SEQ ID NO: 670664 - protein, 17 aa, Mycobacterium
GRHRGFVILRWLDNPQA

SEQ ID NO: 670665 - protein, 28 aa, Mycobacterium
GRHRLELASPDRWWAQVQAIPEADIATR

SEQ ID NO: 670666 - protein, 21 aa, Mycobacterium
GRHSYGPEFSWVVLADPEGNA

SEQ ID NO: 670667 - protein, 19 aa, Mycobacterium
GRHTGKIVLLPPGVFNSEG

SEQ ID NO: 670668 - protein, 19 aa, Mycobacterium
GRHTLFCCYAVTDLDGARD

SEQ ID NO: 670669 - protein, 24 aa, Mycobacterium
GRHVVYRWLGRRMHPAPPAADSQH

SEQ ID NO: 670670 - protein, 18 aa, Mycobacterium
GRHWLARQLLPADEQASV

SEQ ID NO: 670671 - protein, 17 aa, Mycobacterium
GRIAALLRQAEGTDNAH

SEQ ID NO: 670672 - protein, 26 aa, Mycobacterium
GRIAHLPVRVRDGTGLVGPLVIPGVT

SEQ ID NO: 670673 - protein, 26 aa, Mycobacterium
GRIALIVGDCVGHGLAAATVMGQVRS

SEQ ID NO: 670674 - protein, 17 aa, Mycobacterium
GRIALRFPGDADQKINV

SEQ ID NO: 670675 - protein, 18 aa, Mycobacterium
GRIARIWLNRPEAHNAQN

SEQ ID NO: 670676 - protein, 25 aa, Mycobacterium
GRIARYKYPKNLDVVAALPRNATGK

SEQ ID NO: 670677 - protein, 19 aa, Mycobacterium
GRIDGRSVGIVANQPTQFA

SEQ ID NO: 670678 - protein, 17 aa, Mycobacterium
GRIDIGVGVGWQREEYE

SEQ ID NO: 670679 - protein, 25 aa, Mycobacterium
GRIDPRTRWLLRELVYALLVKKDHA

SEQ ID NO: 670680 - protein, 25 aa, Mycobacterium
GRIDRRGRMLWSLPKGHIELGETAE

SEQ ID NO: 670681 - protein, 27 aa, Mycobacterium
GRIERMHRSCLILTFGGGTNEIQRDII

SEQ ID NO: 670682 - protein, 17 aa, Mycobacterium
GRIETRYSSSLELEEAV

SEQ ID NO: 670683 - protein, 21 aa, Mycobacterium
GRIFAMAVQTAVDWSEASDGG

SEQ ID NO: 670684 - protein, 17 aa, Mycobacterium
GRIGAPMRPDAIGELMA

SEQ ID NO: 670685 - protein, 18 aa, Mycobacterium
GRIGERVVLTFASCGVCD

SEQ ID NO: 670686 - protein, 23 aa, Mycobacterium
GRIGETIARTWQLASHMRATRGP

SEQ ID NO: 670687 - protein, 20 aa, Mycobacterium
GRIGFPAIVGTIADVLHDAD

SEQ ID NO: 670688 - protein, 23 aa, Mycobacterium
GRIGHFGNVLPLRMRPRADESFK

SEQ ID NO: 670689 - protein, 17 aa, Mycobacterium
GRIGIGHGTFYRYFKSK

SEQ ID NO: 670690 - protein, 17 aa, Mycobacterium
GRIGLIVGDCVGHGLAA

SEQ ID NO: 670691 - protein, 30 aa, Mycobacterium
GRIGRGEHPSLCLLASWVSPGSPAGRRLRA

SEQ ID NO: 670692 - protein, 20 aa, Mycobacterium
GRIGRNFYRALATQKAEGKN

SEQ ID NO: 670693 - protein, 17 aa, Mycobacterium
GRIGVIGTRATITSHAY

SEQ ID NO: 670694 - protein, 28 aa, Mycobacterium
GRIGWFVESWLSPRLHRRNQYVTVSLPS

SEQ ID NO: 670695 - protein, 33 aa, Mycobacterium
GRIGWTCRDIWWAATQDPRAWAALPRAGAVIFA

SEQ ID NO: 670696 - protein, 21 aa, Mycobacterium
GRIHGWARFARFHLGRNGAVH

SEQ ID NO: 670697 - protein, 21 aa, Mycobacterium
GRIILPRTTYDQINMGQNIAP

SEQ ID NO: 670698 - protein, 19 aa, Mycobacterium
GRIIPTFIAQALRGEPITV

SEQ ID NO: 670699 - protein, 20 aa, Mycobacterium
GRIKDLVIIDGRNHYPQDLE

SEQ ID NO: 670700 - protein, 28 aa, Mycobacterium
GRIKDMVIRGGENIYPREIEEFLYTHPD

SEQ ID NO: 670701 - protein, 18 aa, Mycobacterium
GRIKKGQQVAWMREVDGH

SEQ ID NO: 670702 - protein, 21 aa, Mycobacterium
GRIKLSTKFTRLTGRSPILLA

SEQ ID NO: 670703 - protein, 20 aa, Mycobacterium
GRILTAMSVFFFGLLTVPNH

SEQ ID NO: 670704 - protein, 22 aa, Mycobacterium
GRILTAMSVFFFGLVDAPNHLA

SEQ ID NO: 670705 - protein, 21 aa, Mycobacterium
GRILTAMSVFFFGLVTAPNHL

SEQ ID NO: 670706 - protein, 18 aa, Mycobacterium
GRILTLVSGLAMSAAHDV

SEQ ID NO: 670707 - protein, 25 aa, Mycobacterium
GRIPDLAGAFYLPTLLADVGEQSQA

SEQ ID NO: 670708 - protein, 21 aa, Mycobacterium
GRIPDPLPCEIYCHSLADPSI

SEQ ID NO: 670709 - protein, 17 aa, Mycobacterium
GRIPGMVNISERPAEAA

SEQ ID NO: 670710 - protein, 17 aa, Mycobacterium
GRIPHTIRYTAEGLRRV

SEQ ID NO: 670711 - protein, 24 aa, Mycobacterium
GRIPLPVPGFGVWALDSLRRANGY

SEQ ID NO: 670712 - protein, 18 aa, Mycobacterium
GRIPVAQFLSDKDIVVNC

SEQ ID NO: 670713 - protein, 24 aa, Mycobacterium
GRIRAGETIALIALASGLEIGVVL

SEQ ID NO: 670714 - protein, 21 aa, Mycobacterium
GRIRELLELTSRWHSSLLDRH

SEQ ID NO: 670715 - protein, 17 aa, Mycobacterium
GRIRKGQQVAWLRENGA

SEQ ID NO: 670716 - protein, 26 aa, Mycobacterium
GRIRNLREVYEWEQTRSQGLLIDVDH

SEQ ID NO: 670717 - protein, 23 aa, Mycobacterium
GRIRRTMPLAGFAARAAGGRMVA

SEQ ID NO: 670718 - protein, 21 aa, Mycobacterium
GRIRSAGAIFVGPWAPVSLGD

SEQ ID NO: 670719 - protein, 17 aa, Mycobacterium
GRIRSAGSIKKITKAQE

SEQ ID NO: 670720 - protein, 17 aa, Mycobacterium
GRIRYQRVCEVDGEVVE

SEQ ID NO: 670721 - protein, 18 aa, Mycobacterium
GRISEFIVRGGKNISAAQ

SEQ ID NO: 670722 - protein, 18 aa, Mycobacterium
GRISFSWYPQLERADLGL

SEQ ID NO: 670723 - protein, 17 aa, Mycobacterium
GRISLRSQVPLLLDEYS

SEQ ID NO: 670724 - protein, 17 aa, Mycobacterium
GRISLRTQVPLLLDEYT

SEQ ID NO: 670725 - protein, 18 aa, Mycobacterium
GRISLRTQVPLLLDEYTR

SEQ ID NO: 670726 - protein, 21 aa, Mycobacterium
GRISLRTRTPLLLDEYSRNPA

SEQ ID NO: 670727 - protein, 22 aa, Mycobacterium
GRISRGLSQLRLAAGSTGPYLP

SEQ ID NO: 670728 - protein, 20 aa, Mycobacterium
GRITDFRAFYWNVAEYVEVT

SEQ ID NO: 670729 - protein, 26 aa, Mycobacterium
GRITEARAGALAELDAAFATDRAPFC

SEQ ID NO: 670730 - protein, 21 aa, Mycobacterium
GRITFGPFLQWALGAQAKEIL

SEQ ID NO: 670731 - protein, 19 aa, Mycobacterium
GRITLWRDYFDFYDMTKAL

SEQ ID NO: 670732 - protein, 19 aa, Mycobacterium
GRIVAILDMGWERHLVAVN

SEQ ID NO: 670733 - protein, 23 aa, Mycobacterium
GRIVSFDVAGGWHVESDGYQAVG

SEQ ID NO: 670734 - protein, 21 aa, Mycobacterium
GRIVTAFCGTAPLAAEMRAFV

SEQ ID NO: 670735 - protein, 17 aa, Mycobacterium
GRIVVVSGAGGGGIGTT

SEQ ID NO: 670736 - protein, 23 aa, Mycobacterium
GRIWRVPVTAFWQAHRDAAAVYS

SEQ ID NO: 670737 - protein, 20 aa, Mycobacterium
GRIWVDANFQTKVDHIYAVG

SEQ ID NO: 670738 - protein, 20 aa, Mycobacterium
GRKAFDLSGKVVVVVGAGQS

SEQ ID NO: 670739 - protein, 19 aa, Mycobacterium
GRKAFRLGRLCTKRSARGQ

SEQ ID NO: 670740 - protein, 21 aa, Mycobacterium
GRKALDLYLGLANYLNNFKRL

SEQ ID NO: 670741 - protein, 17 aa, Mycobacterium
GRKALGVYFNLANYRNN

SEQ ID NO: 670742 - protein, 26 aa, Mycobacterium
GRKALNYYKFRNWDISGSWTGFSEQP

SEQ ID NO: 670743 - protein, 20 aa, Mycobacterium
GRKEIRLAEHEMPGLMELRR

SEQ ID NO: 670744 - protein, 18 aa, Mycobacterium
GRKFLAYLERDGVLTGVV

SEQ ID NO: 670745 - protein, 19 aa, Mycobacterium
GRKGYPVAAGLYIDGSVSE

SEQ ID NO: 670746 - protein, 25 aa, Mycobacterium
GRKLPPVVRRWAGVYSQCTDPDQIV

SEQ ID NO: 670747 - protein, 20 aa, Mycobacterium
GRKLRFGIRLHTISRDTSEE

SEQ ID NO: 670748 - protein, 27 aa, Mycobacterium
GRKPRRIPVWFMRQAGRSLPEYRALRA

SEQ ID NO: 670749 - protein, 21 aa, Mycobacterium
GRKPRTWQDMLLPDGPADAGP

SEQ ID NO: 670750 - protein, 24 aa, Mycobacterium
GRKRGHWMWFVFPQLRGLGSSPTA

SEQ ID NO: 670751 - protein, 27 aa, Mycobacterium
GRKRSEALRNFNLRIARGETVALLGPS

SEQ ID NO: 670752 - protein, 21 aa, Mycobacterium
GRKSPDCYVVPSDLHDILTDK

SEQ ID NO: 670753 - protein, 21 aa, Mycobacterium
GRKSRDVTVAYDLGGGCIVIA

SEQ ID NO: 670754 - protein, 19 aa, Mycobacterium
GRKSTFTDFRERYEALFGQ

SEQ ID NO: 670755 - protein, 34 aa, Mycobacterium
GRKTRIFCPRWVGLFRWLKPVLSTSVGERPIRKI

SEQ ID NO: 670756 - protein, 20 aa, Mycobacterium
GRLAADVAVCRGLIRSHATR

SEQ ID NO: 670757 - protein, 20 aa, Mycobacterium
GRLADFKVPQYVTVVDTALP

SEQ ID NO: 670758 - protein, 19 aa, Mycobacterium
GRLAELRIGDRSAIDVVGN

SEQ ID NO: 670759 - protein, 22 aa, Mycobacterium
GRLAGGAFFWTDFVYDDHGAAG

SEQ ID NO: 670760 - protein, 17 aa, Mycobacterium
GRLAGLGIVSLDAGPDF

SEQ ID NO: 670761 - protein, 19 aa, Mycobacterium
GRLAGRGFAAYGTAKAALA

SEQ ID NO: 670762 - protein, 20 aa, Mycobacterium
GRLAGRGFVAYGTAKAALAH

SEQ ID NO: 670763 - protein, 19 aa, Mycobacterium
GRLAHSMHMYFLRRGDARQ

SEQ ID NO: 670764 - protein, 25 aa, Mycobacterium
GRLALGVGPSHHWIIRDMLGLPYEK

SEQ ID NO: 670765 - protein, 25 aa, Mycobacterium
GRLALGVGPSHHWIIRDMLGLPYER

SEQ ID NO: 670766 - protein, 19 aa, Mycobacterium
GRLALVVGDCVGHGLAAAT

SEQ ID NO: 670767 - protein, 18 aa, Mycobacterium
GRLARFVDIAARHGIKPL

SEQ ID NO: 670768 - protein, 29 aa, Mycobacterium
GRLARRIECSPLPFGRHRWVSSNGPTDLG

SEQ ID NO: 670769 - protein, 17 aa, Mycobacterium
GRLARRLLTREVRHSVS

SEQ ID NO: 670770 - protein, 18 aa, Mycobacterium
GRLARRLLTREVRRAISR

SEQ ID NO: 670771 - protein, 18 aa, Mycobacterium
GRLAVYTKMHHAVIDGVG

SEQ ID NO: 670772 - protein, 19 aa, Mycobacterium
GRLCPHGGIHLVAEAARAA

SEQ ID NO: 670773 - protein, 19 aa, Mycobacterium
GRLDAELVGNVSIRVVDID

SEQ ID NO: 670774 - protein, 20 aa, Mycobacterium
GRLDALAVHAMRHVPPAADQ

SEQ ID NO: 670775 - protein, 20 aa, Mycobacterium
GRLDELRRYGGRPAEADGQA

SEQ ID NO: 670776 - protein, 18 aa, Mycobacterium
GRLDLARLGEEVPDWRDR

SEQ ID NO: 670777 - protein, 20 aa, Mycobacterium
GRLDPAWAQELAKIRLTLTA

SEQ ID NO: 670778 - protein, 23 aa, Mycobacterium
GRLDPKDLFGWQANASADRLTTP

SEQ ID NO: 670779 - protein, 23 aa, Mycobacterium
GRLDPKDLFGWQANASPDRLTTP

SEQ ID NO: 670780 - protein, 24 aa, Mycobacterium
GRLDPKDLFGWQANHARDRLRTPL

SEQ ID NO: 670781 - protein, 25 aa, Mycobacterium
GRLDWPAVRAALPRHRGVSALSGTR

SEQ ID NO: 670782 - protein, 24 aa, Mycobacterium
GRLEAKRFNGMAVKITEEANSLRR

SEQ ID NO: 670783 - protein, 31 aa, Mycobacterium
GRLEHLCGSALGFRDLCRYIARSLLETGGFR

SEQ ID NO: 670784 - protein, 18 aa, Mycobacterium
GRLELPTDFPAPSVASFS

SEQ ID NO: 670785 - protein, 34 aa, Mycobacterium
GRLFDQRTAQRWSTERHLVFACGRYEGIDQRVVD

SEQ ID NO: 670786 - protein, 17 aa, Mycobacterium
GRLFFDAPMSYLHVPVN

SEQ ID NO: 670787 - protein, 17 aa, Mycobacterium
GRLFGWLGKLLGEHPDQ

SEQ ID NO: 670788 - protein, 33 aa, Mycobacterium
GRLGAEGRLPISYSRKVFIPVTHLCRDKCHYCT

SEQ ID NO: 670789 - protein, 19 aa, Mycobacterium
GRLGAKWRGGSNRFSAPPP

SEQ ID NO: 670790 - protein, 18 aa, Mycobacterium
GRLGAVQTSCEMFGLTEE

SEQ ID NO: 670791 - protein, 17 aa, Mycobacterium
GRLGNKAGNGFRTTDSE

SEQ ID NO: 670792 - protein, 21 aa, Mycobacterium
GRLGSGFQPLGLVGDDLTAAV

SEQ ID NO: 670793 - protein, 24 aa, Mycobacterium
GRLGSGKQWLSWIGLDDLIDIYHR

SEQ ID NO: 670794 - protein, 20 aa, Mycobacterium
GRLGTCLDTTLTMAAVLEQA

SEQ ID NO: 670795 - protein, 18 aa, Mycobacterium
GRLHKLDPFRFQLVDIPF

SEQ ID NO: 670796 - protein, 20 aa, Mycobacterium
GRLHPVDAFLDLVLEHGSQL

SEQ ID NO: 670797 - protein, 18 aa, Mycobacterium
GRLHPYKNVEVVLQAWQR

SEQ ID NO: 670798 - protein, 22 aa, Mycobacterium
GRLHRHRCHLLDLVSPTPGRRL

SEQ ID NO: 670799 - protein, 24 aa, Mycobacterium
GRLHSGQTLIGFLAPRNADNSIGA

SEQ ID NO: 670800 - protein, 18 aa, Mycobacterium
GRLHTTVGLGYRTVEYDA

SEQ ID NO: 670801 - protein, 22 aa, Mycobacterium
GRLHTTVGLGYRTVEYGALGAD

SEQ ID NO: 670802 - protein, 24 aa, Mycobacterium
GRLHVEIAQSFPLANGREAFESGR

SEQ ID NO: 670803 - protein, 18 aa, Mycobacterium
GRLIDAVLQALGFTASAN

SEQ ID NO: 670804 - protein, 18 aa, Mycobacterium
GRLIERYFPHAAHQVVLL

SEQ ID NO: 670805 - protein, 24 aa, Mycobacterium
GRLIKLTLHPGVMTGYGHGELADR

SEQ ID NO: 670806 - protein, 25 aa, Mycobacterium
GRLILADAIVRACRDQPDYLIDTAT

SEQ ID NO: 670807 - protein, 17 aa, Mycobacterium
GRLILGIGSGWKQKDYD

SEQ ID NO: 670808 - protein, 20 aa, Mycobacterium
GRLKFLVRLASWPSGEARVL

SEQ ID NO: 670809 - protein, 17 aa, Mycobacterium
GRLKRLLADAELEKDAL

SEQ ID NO: 670810 - protein, 20 aa, Mycobacterium
GRLKVYGIANLRVADASVMP

SEQ ID NO: 670811 - protein, 18 aa, Mycobacterium
GRLLAAVLDVTWRFYSLP

SEQ ID NO: 670812 - protein, 26 aa, Mycobacterium
GRLLHRLRVVPPVFQVVKAVILGVVA

SEQ ID NO: 670813 - protein, 21 aa, Mycobacterium
GRLLPEIAELAPSGQLRMSDN

SEQ ID NO: 670814 - protein, 24 aa, Mycobacterium
GRLLPNLVTVLGWESCDHTGPVHE

SEQ ID NO: 670815 - protein, 19 aa, Mycobacterium
GRLLRRGVADLTILGEENQ

SEQ ID NO: 670816 - protein, 18 aa, Mycobacterium
GRLLRYCTTVGLVRRDKD

SEQ ID NO: 670817 - protein, 30 aa, Mycobacterium
GRLLSLRLGERELLWRNPALLGEDLQPVGG

SEQ ID NO: 670818 - protein, 19 aa, Mycobacterium
GRLLTGRGSFVDDISRPGM

SEQ ID NO: 670819 - protein, 26 aa, Mycobacterium
GRLMFCGSPRRFEPRWFRSPPMAGVK

SEQ ID NO: 670820 - protein, 30 aa, Mycobacterium
GRLMYMGGDGFYWRHTFHPAYGRGEVTEMR

SEQ ID NO: 670821 - protein, 18 aa, Mycobacterium
GRLNCLVHTIGPGDGYFE

SEQ ID NO: 670822 - protein, 17 aa, Mycobacterium
GRLNRSLDIAILEAAFV

SEQ ID NO: 670823 - protein, 18 aa, Mycobacterium
GRLNSIFDPADPASVPAG

SEQ ID NO: 670824 - protein, 22 aa, Mycobacterium
GRLPAGPGVDIALCDTAIAAIL

SEQ ID NO: 670825 - protein, 19 aa, Mycobacterium
GRLPDPLPCEAYCHSLTDP

SEQ ID NO: 670826 - protein, 23 aa, Mycobacterium
GRLPEAGPWLRRAEARAEANGWE

SEQ ID NO: 670827 - protein, 17 aa, Mycobacterium
GRLPEDWFDGDPTVIVD

SEQ ID NO: 670828 - protein, 17 aa, Mycobacterium
GRLPEKWFDGDPTVIVD

SEQ ID NO: 670829 - protein, 17 aa, Mycobacterium
GRLPFGHSRFDRGGVIF

SEQ ID NO: 670830 - protein, 19 aa, Mycobacterium
GRLPFPVMHVDTGHNFEEV

SEQ ID NO: 670831 - protein, 23 aa, Mycobacterium
GRLPGNAHFTFRGCEGDSLLMLL

SEQ ID NO: 670832 - protein, 19 aa, Mycobacterium
GRLPGTIGSVAQRITDEGG

SEQ ID NO: 670833 - protein, 17 aa, Mycobacterium
GRLPHQWHTLTKTGKVA

SEQ ID NO: 670834 - protein, 18 aa, Mycobacterium
GRLPHTIRYTAQGLGRVR

SEQ ID NO: 670835 - protein, 23 aa, Mycobacterium
GRLPRLRCTGSLQGRITDTDTVH

SEQ ID NO: 670836 - protein, 22 aa, Mycobacterium
GRLPRLSNRLGVLTRTNSESIV

SEQ ID NO: 670837 - protein, 18 aa, Mycobacterium
GRLPRRIPEPAPRTSHGP

SEQ ID NO: 670838 - protein, 22 aa, Mycobacterium
GRLPSTLWAQYGLAGILEHEAF

SEQ ID NO: 670839 - protein, 18 aa, Mycobacterium
GRLQAAGHQVVYIGRPSL

SEQ ID NO: 670840 - protein, 18 aa, Mycobacterium
GRLQCPIDCRVYALRSRL

SEQ ID NO: 670841 - protein, 19 aa, Mycobacterium
GRLQPGKMLLIDTAAGRIV

SEQ ID NO: 670842 - protein, 20 aa, Mycobacterium
GRLRAHWHKSALFGMPSLQR

SEQ ID NO: 670843 - protein, 25 aa, Mycobacterium
GRLRDAGCDVVVWDLAGADIVCDVS

SEQ ID NO: 670844 - protein, 17 aa, Mycobacterium
GRLRFSSSYQEAAEFAD

SEQ ID NO: 670845 - protein, 19 aa, Mycobacterium
GRLRIPAPTLARILIATYE

SEQ ID NO: 670846 - protein, 20 aa, Mycobacterium
GRLRQPSWRGLRPDKTPDEV

SEQ ID NO: 670847 - protein, 19 aa, Mycobacterium
GRLRRAGVSSFGISGTNAH

SEQ ID NO: 670848 - protein, 17 aa, Mycobacterium
GRLRRLIAEQASVILRR

SEQ ID NO: 670849 - protein, 17 aa, Mycobacterium
GRLRRPENGAAPAVAVS

SEQ ID NO: 670850 - protein, 33 aa, Mycobacterium
GRLRSVIAGVPWPSEWSRAYFTPVTVLDGRARL

SEQ ID NO: 670851 - protein, 17 aa, Mycobacterium
GRLRTALAELKHHDFDY

SEQ ID NO: 670852 - protein, 19 aa, Mycobacterium
GRLRTVCVHRKGATRSLPP

SEQ ID NO: 670853 - protein, 20 aa, Mycobacterium
GRLSAQVGAYHLMRSYGGRG

SEQ ID NO: 670854 - protein, 18 aa, Mycobacterium
GRLSARVQDRILVPVPTP

SEQ ID NO: 670855 - protein, 20 aa, Mycobacterium
GRLSAYKVPKFIWVTAKQEL

SEQ ID NO: 670856 - protein, 20 aa, Mycobacterium
GRLSDFRPGQVLVADTTTPD

SEQ ID NO: 670857 - protein, 29 aa, Mycobacterium
GRLSTRLISEITWRTGLVADDVIATVDAA

SEQ ID NO: 670858 - protein, 19 aa, Mycobacterium
GRLTAPLRRRPDGTYEEID

SEQ ID NO: 670859 - protein, 25 aa, Mycobacterium
GRLTFKGRIKDMLKVGGENVSALEV

SEQ ID NO: 670860 - protein, 20 aa, Mycobacterium
GRLTGRIARPVIWGKRKAAA

SEQ ID NO: 670861 - protein, 19 aa, Mycobacterium
GRLTLDILGAIPVATVRVR

SEQ ID NO: 670862 - protein, 18 aa, Mycobacterium
GRLTTALVRPSRDADPVA

SEQ ID NO: 670863 - protein, 20 aa, Mycobacterium
GRLTTVWDFETEPEYQAKLD

SEQ ID NO: 670864 - protein, 19 aa, Mycobacterium
GRLTVGIGVGGRHEDYHAV

SEQ ID NO: 670865 - protein, 17 aa, Mycobacterium
GRLTVPLGVAAATDDPI

SEQ ID NO: 670866 - protein, 21 aa, Mycobacterium
GRLVLADAIVRACEDNPDYLI

SEQ ID NO: 670867 - protein, 25 aa, Mycobacterium
GRLVLGVGPSHHWIIDDMLGLPYER

SEQ ID NO: 670868 - protein, 24 aa, Mycobacterium
GRLVLGVGPSHHWIVDDMLGLPYQ

SEQ ID NO: 670869 - protein, 20 aa, Mycobacterium
GRLVTALALAAGHHVTLRDT

SEQ ID NO: 670870 - protein, 21 aa, Mycobacterium
GRLVTALALAAGHRVTAVTRR

SEQ ID NO: 670871 - protein, 22 aa, Mycobacterium
GRLVVFSSIAGARVRRANYVYG

SEQ ID NO: 670872 - protein, 23 aa, Mycobacterium
GRLWAGGAELAWQHFGASRPRVP

SEQ ID NO: 670873 - protein, 19 aa, Mycobacterium
GRLWGRHILNSAVLGELLE

SEQ ID NO: 670874 - protein, 27 aa, Mycobacterium
GRLWPHPPEAIGPRYVAAMGGIDRVVE

SEQ ID NO: 670875 - protein, 17 aa, Mycobacterium
GRLYFGINADRDAMSDV

SEQ ID NO: 670876 - protein, 19 aa, Mycobacterium
GRMAGSLLRQAMMSALGER

SEQ ID NO: 670877 - protein, 17 aa, Mycobacterium
GRMAITLTEGTCLQVPD

SEQ ID NO: 670878 - protein, 19 aa, Mycobacterium
GRMAWRMRARHRLREPETT

SEQ ID NO: 670879 - protein, 21 aa, Mycobacterium
GRMDLVLDYASPVPAILTMKL

SEQ ID NO: 670880 - protein, 20 aa, Mycobacterium
GRMFGRMLGCDLGVNPPFEM

SEQ ID NO: 670881 - protein, 22 aa, Mycobacterium
GRMGANIVRRVVKGGHECVVYD

SEQ ID NO: 670882 - protein, 18 aa, Mycobacterium
GRMGAPMVQRLTAAGHDV

SEQ ID NO: 670883 - protein, 17 aa, Mycobacterium
GRMGIPELAAYNATKWG

SEQ ID NO: 670884 - protein, 34 aa, Mycobacterium; identical to SEQ ID NO: 97851

SEQ ID NO: 670885 - protein, 18 aa, Mycobacterium
GRMPRWYRPVGGLYDQFL

SEQ ID NO: 670886 - protein, 17 aa, Mycobacterium
GRMQSWWAQAATEREPS

SEQ ID NO: 670887 - protein, 20 aa, Mycobacterium
GRMRLGVGVTESIRRHPVLI

SEQ ID NO: 670888 - protein, 18 aa, Mycobacterium
GRMVEMANHTTGWVRMDF

SEQ ID NO: 670889 - protein, 19 aa, Mycobacterium
GRMVKRLRKVADYVNALSD

SEQ ID NO: 670890 - protein, 19 aa, Mycobacterium
GRMYACFAAGALATGCEYD

SEQ ID NO: 670891 - protein, 19 aa, Mycobacterium
GRMYTRRGSFLTQEFRRFD

SEQ ID NO: 670892 - protein, 19 aa, Mycobacterium
GRNAISRVPADRWDADAFY

SEQ ID NO: 670893 - protein, 29 aa, Mycobacterium
GRNALDVIREFPIRAAIEEWQQVLIRLTP

SEQ ID NO: 670894 - protein, 20 aa, Mycobacterium
GRNDIRIEAALAKLWSSEMT

SEQ ID NO: 670895 - protein, 19 aa, Mycobacterium
GRNEVRRPVGIRSDIAQSI

SEQ ID NO: 670896 - protein, 17 aa, Mycobacterium
GRNGVDVDDFLRDVNTT

SEQ ID NO: 670897 - protein, 33 aa, Mycobacterium
GRNHAPVPMGRRELADAIFPPFEVAVTVAGAGS

SEQ ID NO: 670898 - protein, 19 aa, Mycobacterium
GRNLGKWWRETRFQAYQGV

SEQ ID NO: 670899 - protein, 25 aa, Mycobacterium
GRNLPGVAFAHDWITSARRYDGTLE

SEQ ID NO: 670900 - protein, 20 aa, Mycobacterium
GRNPGSPGPARTTGATNTAE

SEQ ID NO: 670901 - protein, 21 aa, Mycobacterium
GRNPIGIIIPCHRVIGTNGSL

SEQ ID NO: 670902 - protein, 18 aa, Mycobacterium
GRNPPARGSRVRLHPEPG

SEQ ID NO: 670903 - protein, 19 aa, Mycobacterium
GRNQLRVAMFPAVEPDDIS

SEQ ID NO: 670904 - protein, 19 aa, Mycobacterium
GRNQLRVAMFPAVEPDDVS

SEQ ID NO: 670905 - protein, 24 aa, Mycobacterium
GRNQLRVGMFPAIDPDDVSALTQC

SEQ ID NO: 670906 - protein, 19 aa, Mycobacterium
GRNQLRVGMFPAVDPDDVS

SEQ ID NO: 670907 - protein, 20 aa, Mycobacterium
GRNQLRVGMFPAVDPEDVSA

SEQ ID NO: 670908 - protein, 18 aa, Mycobacterium
GRNRYWVVPGADHYLQCD

SEQ ID NO: 670909 - protein, 19 aa, Mycobacterium
GRNSGFFNVGTAVSGIFNL

SEQ ID NO: 670910 - protein, 20 aa, Mycobacterium
GRNTVLWCGYTWQYWLATRS

SEQ ID NO: 670911 - protein, 17 aa, Mycobacterium
GRNVLYGRWTFQVVEEF

SEQ ID NO: 670912 - protein, 21 aa, Mycobacterium
GRNVVLEKKWGAPTITNDGVS

SEQ ID NO: 670913 - protein, 23 aa, Mycobacterium
GRPAAEALQAWLADGRPALVTAE

SEQ ID NO: 670914 - protein, 19 aa, Mycobacterium
GRPAEGVPVTFSDAEGTVL

SEQ ID NO: 670915 - protein, 26 aa, Mycobacterium
GRPAFHYPHHWSVYRWLDGTTAAEAI

SEQ ID NO: 670916 - protein, 17 aa, Mycobacterium
GRPAGIGGAVEFRTDVF

SEQ ID NO: 670917 - protein, 18 aa, Mycobacterium
GRPAHWRATDVAPMGAAG

SEQ ID NO: 670918 - protein, 17 aa, Mycobacterium
GRPAISLAVRTDQLTAL

SEQ ID NO: 670919 - protein, 17 aa, Mycobacterium
GRPAKPLAEVVRDELAA

SEQ ID NO: 670920 - protein, 17 aa, Mycobacterium
GRPAKRYRLTPGGRAKL

SEQ ID NO: 670921 - protein, 22 aa, Mycobacterium
GRPALMLGEGLTMYLTETEGLA

SEQ ID NO: 670922 - protein, 17 aa, Mycobacterium
GRPALRISGRRRLSRLV

SEQ ID NO: 670923 - protein, 20 aa, Mycobacterium
GRPARISNLAKAFHDAGQST

SEQ ID NO: 670924 - protein, 19 aa, Mycobacterium
GRPATGFGPEAPRILIAGL

SEQ ID NO: 670925 - protein, 18 aa, Mycobacterium
GRPCADVDGWAADVDALL

SEQ ID NO: 670926 - protein, 43 aa, Mycobacterium
GRPCMSCPNCLRGDIGNCLRIQLMAFAYDGAWAEYTVAQAVGL

SEQ ID NO: 670927 - protein, 24 aa, Mycobacterium
GRPDDAWLASWSRAEAAVPHPIDP

SEQ ID NO: 670928 - protein, 24 aa, Mycobacterium
GRPDDAWLASWSRAEGAVPHPIDP

SEQ ID NO: 670929 - protein, 20 aa, Mycobacterium
GRPDPTLGPWWDSVGEFISE

SEQ ID NO: 670930 - protein, 17 aa, Mycobacterium
GRPDVLTAWMDASVVDE

SEQ ID NO: 670931 - protein, 20 aa, Mycobacterium
GRPDVLTAWMDGAVLDENDP

SEQ ID NO: 670932 - protein, 25 aa, Mycobacterium
GRPEAPMALCLHGFPDTAYGWRKLA

SEQ ID NO: 670933 - protein, 21 aa, Mycobacterium
GRPEFAGPISTVRCFEDNALL

SEQ ID NO: 670934 - protein, 19 aa, Mycobacterium
GRPEQQVAILAVRLEMAAV

SEQ ID NO: 670935 - protein, 23 aa, Mycobacterium
GRPESKGAPLINARAETLTTAAT

SEQ ID NO: 670936 - protein, 19 aa, Mycobacterium
GRPEVLTAWMDAAVVDEND

SEQ ID NO: 670937 - protein, 22 aa, Mycobacterium
GRPEVRIPVVSFVLNGVPAERV

SEQ ID NO: 670938 - protein, 25 aa, Mycobacterium
GRPFGLYLHVPFCVTRCGYCDFNTY

SEQ ID NO: 670939 - protein, 19 aa, Mycobacterium
GRPFLAFVYGIAAHKVADA

SEQ ID NO: 670940 - protein, 26 aa, Mycobacterium
GRPFSRLPSWELIKTALNAPGKNATA

SEQ ID NO: 670941 - protein, 18 aa, Mycobacterium
GRPFSWRPGSDPAVAELV

SEQ ID NO: 670942 - protein, 21 aa, Mycobacterium
GRPFYCGTYYPKAGFLQLLSA

SEQ ID NO: 670943 - protein, 21 aa, Mycobacterium
GRPFYLMGFVEGWSPMDRHGV

SEQ ID NO: 670944 - protein, 20 aa, Mycobacterium
GRPGIAEVRIVDGEIRARGP

SEQ ID NO: 670945 - protein, 19 aa, Mycobacterium
GRPGNVFAHVLLDRTPDVA

SEQ ID NO: 670946 - protein, 25 aa, Mycobacterium
GRPGRRPVFALARFVSGRDIPDIIK

SEQ ID NO: 670947 - protein, 18 aa, Mycobacterium
GRPGSDVDITLNSSAFQH

SEQ ID NO: 670948 - protein, 19 aa, Mycobacterium
GRPGVPVLPAGAPVGARAR

SEQ ID NO: 670949 - protein, 17 aa, Mycobacterium
GRPGWHTECVAMCEAYL

SEQ ID NO: 670950 - protein, 20 aa, Mycobacterium
GRPHLRLENRVLPAGPTVID

SEQ ID NO: 670951 - protein, 27 aa, Mycobacterium
GRPHPRSFGTFPRVLGRYVREQPTISL

SEQ ID NO: 670952 - protein, 23 aa, Mycobacterium
GRPHRFQVTASRFGRSVNVAAAQ

SEQ ID NO: 670953 - protein, 26 aa, Mycobacterium
GRPISRTAFLHVDYRAVTPIDTPLQA

SEQ ID NO: 670954 - protein, 22 aa, Mycobacterium
GRPISRTAFLHVDYRRVTPIDT

SEQ ID NO: 670955 - protein, 21 aa, Mycobacterium
GRPITAEAFGVVAREVAELGV

SEQ ID NO: 670956 - protein, 20 aa, Mycobacterium
GRPKAVMWRQGDIYVSSMNG

SEQ ID NO: 670957 - protein, 24 aa, Mycobacterium
GRPKIVKFSGCYHGHADALLADAG

SEQ ID NO: 670958 - protein, 17 aa, Mycobacterium
GRPKPTPIWGVPDGNRL

SEQ ID NO: 670959 - protein, 19 aa, Mycobacterium
GRPKPTPVWGAPDGDGKLL

SEQ ID NO: 670960 - protein, 19 aa, Mycobacterium
GRPLAKFQAVQNLIADIAA

SEQ ID NO: 670961 - protein, 20 aa, Mycobacterium
GRPLARIAVIGMGRLGGSEL

SEQ ID NO: 670962 - protein, 32 aa, Mycobacterium
GRPLDYQPWIGFPGAIAGEWQGQIRLVADALG

SEQ ID NO: 670963 - protein, 18 aa, Mycobacterium
GRPLGSVSSGLLRYAHCP

SEQ ID NO: 670964 - protein, 22 aa, Mycobacterium
GRPLHHAVLMMIPEAWERHENM

SEQ ID NO: 670965 - protein, 20 aa, Mycobacterium
GRPLIAPSILSADFARLADE

SEQ ID NO: 670966 - protein, 20 aa, Mycobacterium
GRPLPGVEAFIVRRADDDGP

SEQ ID NO: 670967 - protein, 21 aa, Mycobacterium
GRPLRGSTVSVHYDPMLAKVI

SEQ ID NO: 670968 - protein, 23 aa, Mycobacterium
GRPMAGQLVEIWQANAAGRYRHQ

SEQ ID NO: 670969 - protein, 28 aa, Mycobacterium
GRPMILKRFVKGITEEAVFQKRAPAKRP

SEQ ID NO: 670970 - protein, 28 aa, Mycobacterium
GRPNITIVEGPYCDYIRSKAVTAMQDLL

SEQ ID NO: 670971 - protein, 18 aa, Mycobacterium
GRPPAAFICESVYGNAGG

SEQ ID NO: 670972 - protein, 20 aa, Mycobacterium
GRPPASVPIWYDYTPGGNIR

SEQ ID NO: 670973 - protein, 20 aa, Mycobacterium
GRPPASVPIWYDYTPGGNVR

SEQ ID NO: 670974 - protein, 17 aa, Mycobacterium
GRPPCPLCEEPLDPDGH

SEQ ID NO: 670975 - protein, 19 aa, Mycobacterium
GRPPFFALTVFARGLLNRL

SEQ ID NO: 670976 - protein, 23 aa, Mycobacterium
GRPPGRKDPAAFVLENFAKAETD

SEQ ID NO: 670977 - protein, 22 aa, Mycobacterium
GRPPGRKDPAAFVLENFNAAER

SEQ ID NO: 670978 - protein, 22 aa, Mycobacterium
GRPPGRKDPAAFVLENFTAAER

SEQ ID NO: 670979 - protein, 18 aa, Mycobacterium
GRPPRGGAEREYVIESVR

SEQ ID NO: 670980 - protein, 19 aa, Mycobacterium
GRPPRITFGTVLTGDQYLH

SEQ ID NO: 670981 - protein, 21 aa, Mycobacterium
GRPRAAPPVRKLAKELMVDLR

SEQ ID NO: 670982 - protein, 25 aa, Mycobacterium
GRPRAVARASGWRLAQLDTQELRHA

SEQ ID NO: 670983 - protein, 23 aa, Mycobacterium
GRPRFYRPPPRPDVIATLDSAGL

SEQ ID NO: 670984 - protein, 17 aa, Mycobacterium
GRPRLRCEPHTQRHTDR

SEQ ID NO: 670985 - protein, 19 aa, Mycobacterium
GRPRLYRTPARPDVIASLD

SEQ ID NO: 670986 - protein, 23 aa, Mycobacterium
GRPRPVPEDIRRAVREGREGNLV

SEQ ID NO: 670987 - protein, 24 aa, Mycobacterium
GRPRRAGVSSFGFTGTNAHVLVEE

SEQ ID NO: 670988 - protein, 20 aa, Mycobacterium
GRPRSHRICQREWLQHHYIR

SEQ ID NO: 670989 - protein, 17 aa, Mycobacterium
GRPRSRVLHPIWEFDGP

SEQ ID NO: 670990 - protein, 19 aa, Mycobacterium
GRPRYVTAIDAETATVRVG

SEQ ID NO: 670991 - protein, 27 aa, Mycobacterium
GRPSERWGEEIVAIVALRDNHGSDHDV

SEQ ID NO: 670992 - protein, 20 aa, Mycobacterium
GRPSERWGEELVALVELRAD

SEQ ID NO: 670993 - protein, 22 aa, Mycobacterium
GRPSGDLGYGWIKHGAGSAATW

SEQ ID NO: 670994 - protein, 21 aa, Mycobacterium
GRPSLSYAVAPRLDYADVVAL

SEQ ID NO: 670995 - protein, 31 aa, Mycobacterium
GRPSMRSRAAILYEYGHPWTVEEFELDPPRA

SEQ ID NO: 670996 - protein, 21 aa, Mycobacterium
GRPSWQASTVRRIYQSAIAAS

SEQ ID NO: 670997 - protein, 21 aa, Mycobacterium
GRPTGEWAATLARLSGAETAV

SEQ ID NO: 670998 - protein, 20 aa, Mycobacterium
GRPTGEWVAAITRLADAEAA

SEQ ID NO: 670999 - protein, 26 aa, Mycobacterium
GRPVAVICHGPWTLIEAGVAKGRTLT

SEQ ID NO: 671000 - protein, 17 aa, Mycobacterium
GRPVILTAPRRAAPAAA

SEQ ID NO: 671001 - protein, 20 aa, Mycobacterium
GRPVKLQAPGPVTLAAHLEL

SEQ ID NO: 671002 - protein, 17 aa, Mycobacterium
GRPVKPIIRHGGNPLLR

SEQ ID NO: 671003 - protein, 32 aa, Mycobacterium
GRPVLGICVGMQILFSHGIEFGVDTQGCGQWP

SEQ ID NO: 671004 - protein, 23 aa, Mycobacterium
GRPVLRDVEWRIAPGERTGIVGA

SEQ ID NO: 671005 - protein, 19 aa, Mycobacterium
GRPVSSFGCDGVLVSTPTG

SEQ ID NO: 671006 - protein, 26 aa, Mycobacterium
GRPVTRTVLCKGFDAAGVTFFSNYDS

SEQ ID NO: 671007 - protein, 26 aa, Mycobacterium
GRPWAKTRILTALALGRLERSPLYHE

SEQ ID NO: 671008 - protein, 23 aa, Mycobacterium
GRPWRDARRLTVPGIARAKDGLV

SEQ ID NO: 671009 - protein, 18 aa, Mycobacterium
GRPWRDARRLTVPGVACA

SEQ ID NO: 671010 - protein, 24 aa, Mycobacterium
GRPWSERKKLIWWDETKGAKGEWT

SEQ ID NO: 671011 - protein, 28 aa, Mycobacterium
GRPWSERKKLVWWDAELGEWTGHDVPDF

SEQ ID NO: 671012 - protein, 23 aa, Mycobacterium
GRPWSERKKLVWWDEQKGEWTGY

SEQ ID NO: 671013 - protein, 25 aa, Mycobacterium
GRPWSERKKLVWWDPERGEWTGHDI

SEQ ID NO: 671014 - protein, 23 aa, Mycobacterium
GRPWTADILPELSAPPAAEIEKL

SEQ ID NO: 671015 - protein, 26 aa, Mycobacterium
GRPYALGAVAGRAAGLIQAFMPGEEG

SEQ ID NO: 671016 - protein, 19 aa, Mycobacterium
GRPYPDHGLSHRQWAQIPP

SEQ ID NO: 671017 - protein, 20 aa, Mycobacterium
GRPYYNAIVWQDTRTDSIAA

SEQ ID NO: 671018 - protein, 28 aa, Mycobacterium
GRQAARDWHEFVAFRGRELCPGGRLVVM

SEQ ID NO: 671019 - protein, 26 aa, Mycobacterium
GRQGIPLLPPLADRLHTEFAKDPRFD

SEQ ID NO: 671020 - protein, 20 aa, Mycobacterium
GRQGMAHAALFDVCRAVEAT

SEQ ID NO: 671021 - protein, 22 aa, Mycobacterium
GRQGRRGRRFRDRKRRERGGDG

SEQ ID NO: 671022 - protein, 30 aa, Mycobacterium
GRQHRANHVKRCRIALGRLRHKEQRAGQRH

SEQ ID NO: 671023 - protein, 20 aa, Mycobacterium
GRQLAWRVRELESINEFADV

SEQ ID NO: 671024 - protein, 22 aa, Mycobacterium
GRQLKLQIGELVGDNDTERELL

SEQ ID NO: 671025 - protein, 24 aa, Mycobacterium
GRQLPEAMEVLLAQAVRADAAVAR

SEQ ID NO: 671026 - protein, 18 aa, Mycobacterium
GRQLRETVQFARGLTTLC

SEQ ID NO: 671027 - protein, 24 aa, Mycobacterium
GRQLRRWLTQLAVAERVVAAEVAG

SEQ ID NO: 671028 - protein, 19 aa, Mycobacterium
GRQLWVYGRAGQPCRRCAT

SEQ ID NO: 671029 - protein, 21 aa, Mycobacterium
GRQRALGVFSWEAVAAQTVRV

SEQ ID NO: 671030 - protein, 19 aa, Mycobacterium
GRQRCVEEFSWARVAEQTL

SEQ ID NO: 671031 - protein, 23 aa, Mycobacterium
GRQRGLHRWVMAEVPSVVHWLPE

SEQ ID NO: 671032 - protein, 18 aa, Mycobacterium
GRQVGPLAKFYSVPPQQI

SEQ ID NO: 671033 - protein, 27 aa, Mycobacterium
GRQVTAVVCVWDYGTAYDIGDGRYSND

SEQ ID NO: 671034 - protein, 17 aa, Mycobacterium
GRRAEMLLDNPVMPGPD

SEQ ID NO: 671035 - protein, 18 aa, Mycobacterium
GRRAHPFTIADLAAAVLV

SEQ ID NO: 671036 - protein, 18 aa, Mycobacterium
GRRAHRIGIDYQAVRTHF

SEQ ID NO: 671037 - protein, 20 aa, Mycobacterium
GRRALPVACNVSSWEQCDHL

SEQ ID NO: 671038 - protein, 19 aa, Mycobacterium
GRRALVTGGTKGAGAAVVR

SEQ ID NO: 671039 - protein, 17 aa, Mycobacterium
GRRALYISGEESAGQIR

SEQ ID NO: 671040 - protein, 18 aa, Mycobacterium
GRRAVTHVVDVRDEQALS

SEQ ID NO: 671041 - protein, 31 aa, Mycobacterium
GRRAVVLVHHCHREQWPVAGPVMSRIGWFVE

SEQ ID NO: 671042 - protein, 22 aa, Mycobacterium
GRRCTQLLLDRGHTVVAMDLRN

SEQ ID NO: 671043 - protein, 19 aa, Mycobacterium
GRRFAGLGVDVGNPHLACV

SEQ ID NO: 671044 - protein, 19 aa, Mycobacterium
GRRFAYAEQMSCGRSPAAP

SEQ ID NO: 671045 - protein, 21 aa, Mycobacterium
GRRGAPVVILAHGFPELAYSW

SEQ ID NO: 671046 - protein, 23 aa, Mycobacterium
GRRGDIRSAILVLLSERPMHGYE

SEQ ID NO: 671047 - protein, 24 aa, Mycobacterium
GRRGEPGPAFFAAYGEWMGTPPPT

SEQ ID NO: 671048 - protein, 24 aa, Mycobacterium
GRRGEPGPTFFAAYGEWMGTPPPT

SEQ ID NO: 671049 - protein, 18 aa, Mycobacterium
GRRGGACTRRGRLRSGRL

SEQ ID NO: 671050 - protein, 19 aa, Mycobacterium
GRRGIAGPVTLQGRQHLAF

SEQ ID NO: 671051 - protein, 21 aa, Mycobacterium
GRRGIVKVRELLAIADGRAES

SEQ ID NO: 671052 - protein, 19 aa, Mycobacterium
GRRGKYLWLTLDDSAALVV

SEQ ID NO: 671053 - protein, 24 aa, Mycobacterium
GRRGLLYERLFDIAAALEVTVGAL

SEQ ID NO: 671054 - protein, 19 aa, Mycobacterium
GRRGLLYERLFDIADALQV

SEQ ID NO: 671055 - protein, 25 aa, Mycobacterium
GRRGPGAFMDRGFGPGFGRGFGPGF

SEQ ID NO: 671056 - protein, 26 aa, Mycobacterium
GRRGRLLGLRGGRRAGPRTGTCPGSG

SEQ ID NO: 671057 - protein, 17 aa, Mycobacterium
GRRGRRVGGRRCGTTSA

SEQ ID NO: 671058 - protein, 20 aa, Mycobacterium
GRRHHLCWPHGQTLVETLLE

SEQ ID NO: 671059 - protein, 21 aa, Mycobacterium
GRRIASMIPGARFEVMSGCGH

SEQ ID NO: 671060 - protein, 18 aa, Mycobacterium
GRRIFPHTEVLPQYRGRG

SEQ ID NO: 671061 - protein, 25 aa, Mycobacterium
GRRIKLRYLGVDKNHSWLRTRCAAI

SEQ ID NO: 671062 - protein, 37 aa, Mycobacterium
GRRIQRSRLPFGRHRWVLDPACHPIDVELAPLPRAEL

SEQ ID NO: 671063 - protein, 18 aa, Mycobacterium
GRRIWRGVSDAALIVGAE

SEQ ID NO: 671064 - protein, 20 aa, Mycobacterium
GRRKRCVDSTVFDDAVATQD

SEQ ID NO: 671065 - protein, 24 aa, Mycobacterium
GRRLAGTVSPVFGERLVSVTYSRL

SEQ ID NO: 671066 - protein, 28 aa, Mycobacterium
GRRLKWLNFVCADSTGALWCSVSTVADD

SEQ ID NO: 671067 - protein, 19 aa, Mycobacterium
GRRLLDRASRWFLLNRPQP

SEQ ID NO: 671068 - protein, 20 aa, Mycobacterium
GRRLPAWKPFIIRLSNSVTR

SEQ ID NO: 671069 - protein, 24 aa, Mycobacterium
GRRLPPAPIAAAFAELVDAAIVSD

SEQ ID NO: 671070 - protein, 19 aa, Mycobacterium
GRRLRRRRLDAGDQAGFPL

SEQ ID NO: 671071 - protein, 26 aa, Mycobacterium
GRRLSRLRILTALVLGRLTRSPLYHE

SEQ ID NO: 671072 - protein, 25 aa, Mycobacterium
GRRPAVWEPGEYLVIDWAQVAPGLF

SEQ ID NO: 671073 - protein, 31 aa, Mycobacterium
GRRPDEWLQWLHAEHHPRLLAVPGTAGAWTF

SEQ ID NO: 671074 - protein, 32 aa, Mycobacterium
GRRPESPAELALRLIPGYVVTPTIKLLSDELV

SEQ ID NO: 671075 - protein, 17 aa, Mycobacterium
GRRPGARWAADLVAAAD

SEQ ID NO: 671076 - protein, 24 aa, Mycobacterium
GRRPQWRRIGLIDCGERWAVFNTG

SEQ ID NO: 671077 - protein, 20 aa, Mycobacterium
GRRQFGFAFTDPGSVAEPPT

SEQ ID NO: 671078 - protein, 21 aa, Mycobacterium
GRRRALEVFSWESVAAQTVAV

SEQ ID NO: 671079 - protein, 22 aa, Mycobacterium
GRRRFEHPATRAADRAFAAVPA

SEQ ID NO: 671080 - protein, 19 aa, Mycobacterium
GRRRFLSVSLVGAASGAII

SEQ ID NO: 671081 - protein, 17 aa, Mycobacterium
GRRRFRGDRPVLRKAGY

SEQ ID NO: 671082 - protein, 17 aa, Mycobacterium
GRRRIEVIAADVSDPDG

SEQ ID NO: 671083 - protein, 19 aa, Mycobacterium
GRRRPCAFASGPNPICAGC

SEQ ID NO: 671084 - protein, 20 aa, Mycobacterium
GRRRPMVPIRLPGKVFGGIR

SEQ ID NO: 671085 - protein, 22 aa, Mycobacterium
GRRRPRFAHPMLSIHQRPFDPV

SEQ ID NO: 671086 - protein, 27 aa, Mycobacterium
GRRRRLRLPQHWPWNHLIDTGWANPAP

SEQ ID NO: 671087 - protein, 24 aa, Mycobacterium
GRRRVAMLRDWLDAELAEASAKIL

SEQ ID NO: 671088 - protein, 26 aa, Mycobacterium
GRRRVAMLRDWLDAELSDASVTMLDA

SEQ ID NO: 671089 - protein, 23 aa, Mycobacterium
GRRRVAMLRDWLDSELSDASAAV

SEQ ID NO: 671090 - protein, 22 aa, Mycobacterium
GRRRVAMLRDWLTNELSDAAAA

SEQ ID NO: 671091 - protein, 23 aa, Mycobacterium
GRRSAESLYDFNLATYDEGDSFD

SEQ ID NO: 671092 - protein, 26 aa, Mycobacterium
GRRSATPRWRWFVAKADVGRHALFSG

SEQ ID NO: 671093 - protein, 23 aa, Mycobacterium
GRRSSESLYDFNLATYDEGDTFD

SEQ ID NO: 671094 - protein, 20 aa, Mycobacterium
GRRSVLCGNIGDPVLAVLDQ

SEQ ID NO: 671095 - protein, 24 aa, Mycobacterium
GRRSVLCGNIGSPVLEVLDQPADV

SEQ ID NO: 671096 - protein, 18 aa, Mycobacterium
GRRSVLRAGRRLSGKLSA

SEQ ID NO: 671097 - protein, 19 aa, Mycobacterium
GRRSVPVRIYRGGPSPAPV

SEQ ID NO: 671098 - protein, 24 aa, Mycobacterium
GRRTARLDTLFALTKALGAPLSAA

SEQ ID NO: 671099 - protein, 27 aa, Mycobacterium
GRRTPKIACPILFCVCEADSVAPAAAT

SEQ ID NO: 671100 - protein, 19 aa, Mycobacterium
GRRTYYFVWHAQRRPSAAL

SEQ ID NO: 671101 - protein, 20 aa, Mycobacterium
GRRVAVVVCEFDFLAGSIGV

SEQ ID NO: 671102 - protein, 23 aa, Mycobacterium
GRRVAVVVCEFGFLGGSIGVAAA

SEQ ID NO: 671103 - protein, 19 aa, Mycobacterium
GRRVCAVVGSGDNGGDALW

SEQ ID NO: 671104 - protein, 20 aa, Mycobacterium
GRRVECSPLDFFRYATRYTR

SEQ ID NO: 671105 - protein, 17 aa, Mycobacterium
GRRVHKTVHHYLMRFLG

SEQ ID NO: 671106 - protein, 17 aa, Mycobacterium
GRRVHKTVHHYLMRFSG

SEQ ID NO: 671107 - protein, 22 aa, Mycobacterium
GRRVHKTVHHYLMRSLGGELSD

SEQ ID NO: 671108 - protein, 30 aa, Mycobacterium
GRRVLDLGSCFGFFPLRLSRNGFDATATDL

SEQ ID NO: 671109 - protein, 19 aa, Mycobacterium
GRRVLEMLPIPPIALNLRT

SEQ ID NO: 671110 - protein, 19 aa, Mycobacterium
GRRVLITGAGQGVGRGLAL

SEQ ID NO: 671111 - protein, 17 aa, Mycobacterium
GRRVLVVDGDPQANVTV

SEQ ID NO: 671112 - protein, 32 aa, Mycobacterium
GRRVQLEIFNKFNIPINIARVFHRDQKFRFYR

SEQ ID NO: 671113 - protein, 20 aa, Mycobacterium
GRRVRNSECELIQNGVTVAR

SEQ ID NO: 671114 - protein, 22 aa, Mycobacterium
GRRVTSCLTFAVAADGMRVTTA

SEQ ID NO: 671115 - protein, 18 aa, Mycobacterium
GRRYLDWTLDDPTGLDVE

SEQ ID NO: 671116 - protein, 28 aa, Mycobacterium
GRRYRHPLCLCVHFPAGTLLAETGCVIH

SEQ ID NO: 671117 - protein, 22 aa, Mycobacterium
GRRYRSGRVFAGRVPLVPPCWR

SEQ ID NO: 671118 - protein, 21 aa, Mycobacterium
GRSAACWADRLVFVNGHGGNV

SEQ ID NO: 671119 - protein, 21 aa, Mycobacterium
GRSAFQLGVLERGLRMTAEYA

SEQ ID NO: 671120 - protein, 17 aa, Mycobacterium
GRSAIWAKDGSVLAEAD

SEQ ID NO: 671121 - protein, 20 aa, Mycobacterium
GRSALILTFDHTVGDGIATL

SEQ ID NO: 671122 - protein, 19 aa, Mycobacterium
GRSALKIDRLCTRLGVTKG

SEQ ID NO: 671123 - protein, 24 aa, Mycobacterium
GRSASKWTSRIVFVNGHGGNVEAL

SEQ ID NO: 671124 - protein, 21 aa, Mycobacterium
GRSATCWAGRLVFVNGHGGNI

SEQ ID NO: 671125 - protein, 20 aa, Mycobacterium
GRSDDRRSPADAAADPGADA

SEQ ID NO: 671126 - protein, 22 aa, Mycobacterium
GRSDMAMPLMRGMGPTLIPRPQ

SEQ ID NO: 671127 - protein, 22 aa, Mycobacterium
GRSDNIAHFCFAPGAHGGTVTA

SEQ ID NO: 671128 - protein, 23 aa, Mycobacterium
GRSELRLAAEAVLDALDDAGLTP

SEQ ID NO: 671129 - protein, 20 aa, Mycobacterium
GRSELRLAAEAVRDALDDAG

SEQ ID NO: 671130 - protein, 17 aa, Mycobacterium
GRSELRLAAECVLDALD

SEQ ID NO: 671131 - protein, 20 aa, Mycobacterium
GRSEVAMVFGSDATSTSRHF

SEQ ID NO: 671132 - protein, 18 aa, Mycobacterium
GRSFLLPPTWTQLDALNG

SEQ ID NO: 671133 - protein, 18 aa, Mycobacterium
GRSGGKRAVVRDIHEYTT

SEQ ID NO: 671134 - protein, 17 aa, Mycobacterium
GRSGGKRVLVRDISEYT

SEQ ID NO: 671135 - protein, 22 aa, Mycobacterium
GRSGGRPAALFRFTESRYRVTD

SEQ ID NO: 671136 - protein, 19 aa, Mycobacterium
GRSGLNVWIPVPDETAAIT

SEQ ID NO: 671137 - protein, 21 aa, Mycobacterium
GRSGPRLFPPGPASGGDVIAE

SEQ ID NO: 671138 - protein, 26 aa, Mycobacterium
GRSGSPLLDIGIDWKTYRDAIDGLRG

SEQ ID NO: 671139 - protein, 22 aa, Mycobacterium
GRSGYRLASRALALATVIGPRP

SEQ ID NO: 671140 - protein, 29 aa, Mycobacterium
GRSHGLFFRDARVLSRWQLHVDGGEPESL

SEQ ID NO: 671141 - protein, 17 aa, Mycobacterium
GRSITLILADDVDASRG

SEQ ID NO: 671142 - protein, 33 aa, Mycobacterium
GRSKIEIIRLLKRAVAREVFRLLSQPCAIDDYS

SEQ ID NO: 671143 - protein, 21 aa, Mycobacterium
GRSLAHAVLMMIPEAWERNES

SEQ ID NO: 671144 - protein, 26 aa, Mycobacterium
GRSLALEHPEIWGGLIDLDDSVPTAL

SEQ ID NO: 671145 - protein, 19 aa, Mycobacterium
GRSLLRALVMDRRGGHDEA

SEQ ID NO: 671146 - protein, 22 aa, Mycobacterium
GRSLPHAVLMMIPEAWENATTM

SEQ ID NO: 671147 - protein, 22 aa, Mycobacterium
GRSLPHAVLMMIPEAWENSTTM

SEQ ID NO: 671148 - protein, 22 aa, Mycobacterium
GRSLPHAVLMMIPEAWERHEDM

SEQ ID NO: 671149 - protein, 20 aa, Mycobacterium
GRSLRACIDLAALGENTIAI

SEQ ID NO: 671150 - protein, 20 aa, Mycobacterium
GRSLRACIDLAALGENTIAV

SEQ ID NO: 671151 - protein, 20 aa, Mycobacterium
GRSLRACIDLSALGENTIAI

SEQ ID NO: 671152 - protein, 20 aa, Mycobacterium
GRSLREALQIGAACGALNVV

SEQ ID NO: 671153 - protein, 17 aa, Mycobacterium
GRSLVRRAVGIDFPGWD

SEQ ID NO: 671154 - protein, 29 aa, Mycobacterium
GRSMLYLEIRCILVAKGAGVQGLQNGSIS

SEQ ID NO: 671155 - protein, 22 aa, Mycobacterium
GRSNTGIARRLWVAEGTVEKHI

SEQ ID NO: 671156 - protein, 20 aa, Mycobacterium
GRSPAAWTPEYFCGKDVPIL

SEQ ID NO: 671157 - protein, 17 aa, Mycobacterium
GRSPAAWTPEYFGGNAI

SEQ ID NO: 671158 - protein, 18 aa, Mycobacterium
GRSPAAWTPEYFGGNGVP

SEQ ID NO: 671159 - protein, 26 aa, Mycobacterium
GRSPDELTILPGLFVVVGSTEAEALA

SEQ ID NO: 671160 - protein, 26 aa, Mycobacterium
GRSPHRVPVWFMRQAGRSLPEYRELR

SEQ ID NO: 671161 - protein, 17 aa, Mycobacterium
GRSPLLERTFDWLDANW

SEQ ID NO: 671162 - protein, 17 aa, Mycobacterium
GRSPLLERTFDWLEANW

SEQ ID NO: 671163 - protein, 17 aa, Mycobacterium
GRSPQDLAQAWMRGAVI

SEQ ID NO: 671164 - protein, 23 aa, Mycobacterium
GRSPRYLPVYGRLGRAFFADPAL

SEQ ID NO: 671165 - protein, 18 aa, Mycobacterium
GRSPSEIALIVPVMTVVG

SEQ ID NO: 671166 - protein, 21 aa, Mycobacterium
GRSQMALGYFTHLAGDGAVAW

SEQ ID NO: 671167 - protein, 21 aa, Mycobacterium
GRSQMAMGFFTHLAGDAAVAW

SEQ ID NO: 671168 - protein, 17 aa, Mycobacterium
GRSQWREDGDYGPKLNA

SEQ ID NO: 671169 - protein, 19 aa, Mycobacterium
GRSRFYRPLPRPEVIAKLD

SEQ ID NO: 671170 - protein, 21 aa, Mycobacterium
GRSRMSALLAALCADAGFSPR

SEQ ID NO: 671171 - protein, 23 aa, Mycobacterium
GRSRPEALAGMLREYVERMHSNE

SEQ ID NO: 671172 - protein, 19 aa, Mycobacterium
GRSRRFAYPPNLFVVDGGA

SEQ ID NO: 671173 - protein, 19 aa, Mycobacterium
GRSRWRRKNPKNAHVAQDG

SEQ ID NO: 671174 - protein, 22 aa, Mycobacterium
GRSSAYASYFDIDWDLDEDGRI

SEQ ID NO: 671175 - protein, 19 aa, Mycobacterium
GRSSVIYKLAVFKVVDGVV

SEQ ID NO: 671176 - protein, 20 aa, Mycobacterium
GRSSWAAPWTIDANVAALAA

SEQ ID NO: 671177 - protein, 19 aa, Mycobacterium
GRSSWAAPWTIDANVSALA

SEQ ID NO: 671178 - protein, 17 aa, Mycobacterium
GRSTFLFRPKGEPSPAA

SEQ ID NO: 671179 - protein, 26 aa, Mycobacterium
GRSTIFGSGVSPGFAELLAIVSAMVC

SEQ ID NO: 671180 - protein, 20 aa, Mycobacterium
GRSTLPFVPAVVDLASPTPV

SEQ ID NO: 671181 - protein, 30 aa, Mycobacterium
GRSTYKMVFGHRGINIPVVDHITGRVAITA

SEQ ID NO: 671182 - protein, 19 aa, Mycobacterium
GRSVLRPDVDVRRTVGRFT

SEQ ID NO: 671183 - protein, 20 aa, Mycobacterium
GRSVSDLAIIVPVMTIVGDS

SEQ ID NO: 671184 - protein, 18 aa, Mycobacterium
GRSVVRKAAGIEFPGWDA

SEQ ID NO: 671185 - protein, 19 aa, Mycobacterium
GRSVVRKGAGIEFPGWEPT

SEQ ID NO: 671186 - protein, 19 aa, Mycobacterium
GRSVVRTAAGIGFPGWDPT

SEQ ID NO: 671187 - protein, 17 aa, Mycobacterium
GRSVWLSLCGLPIGEVI

SEQ ID NO: 671188 - protein, 29 aa, Mycobacterium
GRSWHLHQVPAFRAAGYRTITFNNRGIPP

SEQ ID NO: 671189 - protein, 22 aa, Mycobacterium
GRSWRHRWALSVLHSALGGGLS

SEQ ID NO: 671190 - protein, 23 aa, Mycobacterium
GRSWRVPATAFWQAHRAAPELYS

SEQ ID NO: 671191 - protein, 17 aa, Mycobacterium
GRSYFWIARTTAPSQSS

SEQ ID NO: 671192 - protein, 23 aa, Mycobacterium
GRSYRLTELLARFLEQLKDDLQH

SEQ ID NO: 671193 - protein, 21 aa, Mycobacterium
GRTAAQWLRHIYTEWAGALNF

SEQ ID NO: 671194 - protein, 20 aa, Mycobacterium
GRTADDLMGRYWRGEQSLSA

SEQ ID NO: 671195 - protein, 19 aa, Mycobacterium
GRTAKRPEWLAAGRFAQAY

SEQ ID NO: 671196 - protein, 21 aa, Mycobacterium
GRTALDLLAPLGLPTLALASR

SEQ ID NO: 671197 - protein, 19 aa, Mycobacterium
GRTALLEALDHAAIEQMRD

SEQ ID NO: 671198 - protein, 18 aa, Mycobacterium
GRTALRFVSESALTGETS

SEQ ID NO: 671199 - protein, 30 aa, Mycobacterium
GRTANVMAALWPQRCSGLVAVSGYIVVNLA

SEQ ID NO: 671200 - protein, 26 aa, Mycobacterium
GRTAPELDALIGFFINIVVLRNDLSG

SEQ ID NO: 671201 - protein, 27 aa, Mycobacterium
GRTASLCPIAGVGGAGCCDLAFAAPEV

SEQ ID NO: 671202 - protein, 18 aa, Mycobacterium
GRTAYLVMELVNGEPLNS

SEQ ID NO: 671203 - protein, 18 aa, Mycobacterium
GRTDCAAGTRRVTSPVVI

SEQ ID NO: 671204 - protein, 19 aa, Mycobacterium
GRTDLRPGHFGENFTVTGL

SEQ ID NO: 671205 - protein, 25 aa, Mycobacterium
GRTDRRGRMLWSLPKGHIELGETAE

SEQ ID NO: 671206 - protein, 25 aa, Mycobacterium
GRTDRRGRMLWSLPKGHIEQGETAE

SEQ ID NO: 671207 - protein, 25 aa, Mycobacterium
GRTFDVPACFIWRVEQGLITHARDY

SEQ ID NO: 671208 - protein, 25 aa, Mycobacterium
GRTGAAIKEMVCKGTLSILATAAKH

SEQ ID NO: 671209 - protein, 17 aa, Mycobacterium
GRTGAFVKEQVCRFTIT

SEQ ID NO: 671210 - protein, 18 aa, Mycobacterium
GRTGAGWIEWNRNLAQPD

SEQ ID NO: 671211 - protein, 22 aa, Mycobacterium
GRTGGLDGLHEFQQIKNIRIGM

SEQ ID NO: 671212 - protein, 28 aa, Mycobacterium
GRTGIYGHARACGWAIRDGVIGNSSTPG

SEQ ID NO: 671213 - protein, 19 aa, Mycobacterium
GRTGMGIQFLIDGKEMNMD

SEQ ID NO: 671214 - protein, 19 aa, Mycobacterium
GRTGPGPVNGVVAGFSDPA

SEQ ID NO: 671215 - protein, 18 aa, Mycobacterium
GRTGRALIQAMLRHKRLT

SEQ ID NO: 671216 - protein, 24 aa, Mycobacterium
GRTGRPDLLIRVAGGYLPADVKHH

SEQ ID NO: 671217 - protein, 24 aa, Mycobacterium
GRTHPEWANMVGPFGGITAAAMLR

SEQ ID NO: 671218 - protein, 22 aa, Mycobacterium
GRTITFPGFLKAYVESIDELAG

SEQ ID NO: 671219 - protein, 27 aa, Mycobacterium
GRTITLEHPEIWGAIIDFDNSVPAQVV

SEQ ID NO: 671220 - protein, 26 aa, Mycobacterium
GRTIYRQEMLRMFGLPESGLAETLRD

SEQ ID NO: 671221 - protein, 17 aa, Mycobacterium
GRTKTWEKFEVPDEGIG

SEQ ID NO: 671222 - protein, 17 aa, Mycobacterium
GRTKVTFRLAYEAPGGL

SEQ ID NO: 671223 - protein, 22 aa, Mycobacterium
GRTLAALTMRLPTRKGRYLDGL

SEQ ID NO: 671224 - protein, 26 aa, Mycobacterium
GRTLALEHPEFWGGLVDVDESLPAEL

SEQ ID NO: 671225 - protein, 25 aa, Mycobacterium
GRTLALEHPEIWGGVLDVDASVPAV

SEQ ID NO: 671226 - protein, 17 aa, Mycobacterium
GRTLDWQPLPGVNVPHV

SEQ ID NO: 671227 - protein, 18 aa, Mycobacterium
GRTLRLHNLVAFGEPLCD

SEQ ID NO: 671228 - protein, 20 aa, Mycobacterium
GRTLSFWTPPGIYTVLDKGN

SEQ ID NO: 671229 - protein, 23 aa, Mycobacterium
GRTLTFPGFLKAYVETVDELVGG

SEQ ID NO: 671230 - protein, 19 aa, Mycobacterium
GRTLWRRRNDILAFFDHHA

SEQ ID NO: 671231 - protein, 21 aa, Mycobacterium
GRTPAQIVLAWTLSVAPNVLL

SEQ ID NO: 671232 - protein, 17 aa, Mycobacterium
GRTQLLCEAIDYASDHV

SEQ ID NO: 671233 - protein, 20 aa, Mycobacterium
GRTQPTWRNWPAKRAGTAAA

SEQ ID NO: 671234 - protein, 20 aa, Mycobacterium
GRTQPTWRNWPAKRAGTATA

SEQ ID NO: 671235 - protein, 22 aa, Mycobacterium
GRTRASMAFLDRLAGFGEVEVL

SEQ ID NO: 671236 - protein, 20 aa, Mycobacterium
GRTRAVDVFSWEAVAAQTVR

SEQ ID NO: 671237 - protein, 20 aa, Mycobacterium
GRTRAVNVFSWEAVAAQTVR

SEQ ID NO: 671238 - protein, 24 aa, Mycobacterium
GRTRERRRVRTLATVTGDTASPAG

SEQ ID NO: 671239 - protein, 26 aa, Mycobacterium
GRTRKSFVCGFHGWTYGLDGACTHIR

SEQ ID NO: 671240 - protein, 19 aa, Mycobacterium
GRTSPPRAKPEDKGPWFDR

SEQ ID NO: 671241 - protein, 17 aa, Mycobacterium
GRTTEIVLAPFKIPAIP

SEQ ID NO: 671242 - protein, 28 aa, Mycobacterium
GRTTKEIRRCLKRYLARQLYRTLERLHA

SEQ ID NO: 671243 - protein, 18 aa, Mycobacterium
GRTTRLGLATGVLVLPNH

SEQ ID NO: 671244 - protein, 25 aa, Mycobacterium
GRTTTRLLPRFDTMTYRELWADVRA

SEQ ID NO: 671245 - protein, 21 aa, Mycobacterium
GRTVLGVGVGWNLGEVRNHGI

SEQ ID NO: 671246 - protein, 23 aa, Mycobacterium
GRTVTGLVLKWLTGESRNDSSSR

SEQ ID NO: 671247 - protein, 24 aa, Mycobacterium
GRTVTGLVLKWLTGESRNDSSSRF

SEQ ID NO: 671248 - protein, 20 aa, Mycobacterium
GRTVWGVGIATSITTASLRA

SEQ ID NO: 671249 - protein, 24 aa, Mycobacterium
GRTWHPHQVPAFLAAGYRCITFDN

SEQ ID NO: 671250 - protein, 23 aa, Mycobacterium
GRTWQVPVTAFWQAHRDAAATYS

SEQ ID NO: 671251 - protein, 20 aa, Mycobacterium
GRTWWEWHQIALDRVGWPFS

SEQ ID NO: 671252 - protein, 21 aa, Mycobacterium
GRTYCAVGGFLEDAAGFDAGF

SEQ ID NO: 671253 - protein, 20 aa, Mycobacterium
GRTYLGYSVVHFVTPERSIP

SEQ ID NO: 671254 - protein, 19 aa, Mycobacterium
GRTYVAVPVNLPALRLTGL

SEQ ID NO: 671255 - protein, 17 aa, Mycobacterium
GRVAALSRSRPADDPDY

SEQ ID NO: 671256 - protein, 19 aa, Mycobacterium
GRVAAVVAERGWQSVTVDL

SEQ ID NO: 671257 - protein, 19 aa, Mycobacterium
GRVAGRGFAAYGTAKAALA

SEQ ID NO: 671258 - protein, 23 aa, Mycobacterium
GRVAPERTCTLCLLHAGVELPFE

SEQ ID NO: 671259 - protein, 23 aa, Mycobacterium
GRVAPEVVAAVFYNFTPERVAKT

SEQ ID NO: 671260 - protein, 19 aa, Mycobacterium
GRVAPPFGSGGRTTSWQIP

SEQ ID NO: 671261 - protein, 24 aa, Mycobacterium
GRVARADEALPFTAIAVGASLART

SEQ ID NO: 671262 - protein, 27 aa, Mycobacterium
GRVAVAVDLRQDWPTALRQAGFDPSVP

SEQ ID NO: 671263 - protein, 20 aa, Mycobacterium
GRVAVPLSVPLGGVSDERVS

SEQ ID NO: 671264 - protein, 17 aa, Mycobacterium
GRVAYALGLQGPAITID

SEQ ID NO: 671265 - protein, 18 aa, Mycobacterium
GRVAYVLGLQGPAVSVDT

SEQ ID NO: 671266 - protein, 23 aa, Mycobacterium
GRVDAFLLPTLSLRGMAQVNKSF

SEQ ID NO: 671267 - protein, 19 aa, Mycobacterium
GRVDDGWGVVGAHPMSGAA

SEQ ID NO: 671268 - protein, 24 aa, Mycobacterium
GRVDGRSGVWLAADAGRPARKVAA

SEQ ID NO: 671269 - protein, 28 aa, Mycobacterium
GRVDPEMLRRAMLYAIERKRAELIAADL

SEQ ID NO: 671270 - protein, 25 aa, Mycobacterium
GRVDRRGRMLWSLPKGHIEMGETAE

SEQ ID NO: 671271 - protein, 17 aa, Mycobacterium
GRVDRRLADADVRLTMG

SEQ ID NO: 671272 - protein, 19 aa, Mycobacterium
GRVDWRAQGLDGFGRPEGF

SEQ ID NO: 671273 - protein, 17 aa, Mycobacterium
GRVELVELLGPRYVLII

SEQ ID NO: 671274 - protein, 27 aa, Mycobacterium
GRVEPEMLRRALLYAIERKRAELIAAD

SEQ ID NO: 671275 - protein, 26 aa, Mycobacterium
GRVEPEMLRRAVLYAIERKRAELTSV

SEQ ID NO: 671276 - protein, 26 aa, Mycobacterium
GRVFALRPHFEWRGLGFISQSALRLH

SEQ ID NO: 671277 - protein, 17 aa, Mycobacterium
GRVGAPMRPDAIGELMA

SEQ ID NO: 671278 - protein, 20 aa, Mycobacterium
GRVGASLADSLARIGHEIAV

SEQ ID NO: 671279 - protein, 18 aa, Mycobacterium
GRVGASLSDSLSRIGHDV

SEQ ID NO: 671280 - protein, 19 aa, Mycobacterium
GRVGLGYEVVVTRLDDEAN

SEQ ID NO: 671281 - protein, 19 aa, Mycobacterium
GRVGNELTVYAEYPAHPVA

SEQ ID NO: 671282 - protein, 19 aa, Mycobacterium
GRVGPHLEIKVVDPATGRI

SEQ ID NO: 671283 - protein, 21 aa, Mycobacterium
GRVGPHLEIKVVDPVTGETVP

SEQ ID NO: 671284 - protein, 25 aa, Mycobacterium
GRVHALFRRVLTFGLPTVAAINGHA

SEQ ID NO: 671285 - protein, 24 aa, Mycobacterium
GRVHFGRGVMPLVLLRTKGAKSGV

SEQ ID NO: 671286 - protein, 21 aa, Mycobacterium
GRVHRFLGLDVDVILGTLTPD

SEQ ID NO: 671287 - protein, 19 aa, Mycobacterium
GRVIGLVAHDVLAEGSSAD

SEQ ID NO: 671288 - protein, 19 aa, Mycobacterium
GRVIVACFASNVDRVQSII

SEQ ID NO: 671289 - protein, 17 aa, Mycobacterium
GRVKAQLGFDVPVRAVF

SEQ ID NO: 671290 - protein, 17 aa, Mycobacterium
GRVKAVGPFQYYDEAMA

SEQ ID NO: 671291 - protein, 26 aa, Mycobacterium
GRVKRARLVLDAGVLKDTQVLEYVWS

SEQ ID NO: 671292 - protein, 18 aa, Mycobacterium
GRVKTSFRMGHGASDNLA

SEQ ID NO: 671293 - protein, 21 aa, Mycobacterium
GRVLARDSYLLTNHNAMDTTA

SEQ ID NO: 671294 - protein, 24 aa, Mycobacterium
GRVLDAEAALACGLVAEVVAEHSA

SEQ ID NO: 671295 - protein, 17 aa, Mycobacterium
GRVLEPLGLRKAATDDL

SEQ ID NO: 671296 - protein, 23 aa, Mycobacterium
GRVLHRPTLLVAPQFALSLIFGE

SEQ ID NO: 671297 - protein, 23 aa, Mycobacterium
GRVLPMCPIPLQIEADVSGLESD

SEQ ID NO: 671298 - protein, 22 aa, Mycobacterium
GRVLTAMSVFFFGLVDSPNHLA

SEQ ID NO: 671299 - protein, 24 aa, Mycobacterium
GRVLTRGAGGWELTDLGRDALAAA

SEQ ID NO: 671300 - protein, 19 aa, Mycobacterium
GRVLVTIGIRQARSIRELL

SEQ ID NO: 671301 - protein, 27 aa, Mycobacterium
GRVNPCGRLPITFPVGLGQTPRPELPG

SEQ ID NO: 671302 - protein, 21 aa, Mycobacterium
GRVPDPLPCEIYCHSLTDPSI

SEQ ID NO: 671303 - protein, 24 aa, Mycobacterium
GRVPRPDGKLVHAALRINGSLVML

SEQ ID NO: 671304 - protein, 21 aa, Mycobacterium
GRVPVAVSVPVVDVRRAREIV

SEQ ID NO: 671305 - protein, 17 aa, Mycobacterium
GRVQAWVIGPGYGTAER

SEQ ID NO: 671306 - protein, 21 aa, Mycobacterium
GRVQPGGKLPVQIPRTPGGQP

SEQ ID NO: 671307 - protein, 25 aa, Mycobacterium
GRVRCSMWSTDLLRISARVVGDLGE

SEQ ID NO: 671308 - protein, 17 aa, Mycobacterium
GRVRLTTGGDAWEGKAG

SEQ ID NO: 671309 - protein, 25 aa, Mycobacterium
GRVRRAGVSSFGFTGTNAHVLVEEA

SEQ ID NO: 671310 - protein, 17 aa, Mycobacterium
GRVRRCAAGAGTALVQY

SEQ ID NO: 671311 - protein, 21 aa, Mycobacterium
GRVRRCALGDLAAGSSGVSSH

SEQ ID NO: 671312 - protein, 24 aa, Mycobacterium
GRVRRSRFLIRDSVISCSRFQPFP

SEQ ID NO: 671313 - protein, 17 aa, Mycobacterium
GRVRTRYSSTLDLEDAA

SEQ ID NO: 671314 - protein, 19 aa, Mycobacterium
GRVSFSRTANDWATLLDGS

SEQ ID NO: 671315 - protein, 20 aa, Mycobacterium
GRVSGLPINTLAPIGAPAAT

SEQ ID NO: 671316 - protein, 17 aa, Mycobacterium
GRVSRRGYADYLLRLRI

SEQ ID NO: 671317 - protein, 25 aa, Mycobacterium
GRVSSWKGVRYAAPPVRGLRFRAPQ

SEQ ID NO: 671318 - protein, 20 aa, Mycobacterium
GRVSYALGLEGPAVSVDTAC

SEQ ID NO: 671319 - protein, 23 aa, Mycobacterium
GRVTGRPGLMLGNRDAEQTHVSL

SEQ ID NO: 671320 - protein, 25 aa, Mycobacterium
GRVTSFKLGPRWLMPPMVLATSPEA

SEQ ID NO: 671321 - protein, 19 aa, Mycobacterium
GRVTYPLSTMVGRFDETAA

SEQ ID NO: 671322 - protein, 24 aa, Mycobacterium
GRVVACLPGEFGPNLMIMNHFGFT

SEQ ID NO: 671323 - protein, 18 aa, Mycobacterium
GRVVALARGMRDLVRAEA

SEQ ID NO: 671324 - protein, 17 aa, Mycobacterium
GRVVAVDLQRLVVEIDR

SEQ ID NO: 671325 - protein, 23 aa, Mycobacterium
GRVVGQIPVCWDPDRDVAIQRAH

SEQ ID NO: 671326 - protein, 20 aa, Mycobacterium
GRVVLCGRPPAADVMVVDDI

SEQ ID NO: 671327 - protein, 18 aa, Mycobacterium
GRVVRPIYGPSLDGTLPG

SEQ ID NO: 671328 - protein, 22 aa, Mycobacterium
GRWADSFGGVVFDATGITEAEG

SEQ ID NO: 671329 - protein, 19 aa, Mycobacterium
GRWALLTKYHHATIDGASG

SEQ ID NO: 671330 - protein, 18 aa, Mycobacterium
GRWGCVLGNDPGRRVTAM

SEQ ID NO: 671331 - protein, 21 aa, Mycobacterium
GRWGLLEPPAPWLPESAVGQA

SEQ ID NO: 671332 - protein, 25 aa, Mycobacterium
GRWIMAGPLKGLRVVELAGIGPGPH

SEQ ID NO: 671333 - protein, 23 aa, Mycobacterium
GRWKTQIGGSWYPWAKGVVPHGG

SEQ ID NO: 671334 - protein, 19 aa, Mycobacterium
GRWLDLCAGPGGKTALLAG

SEQ ID NO: 671335 - protein, 18 aa, Mycobacterium
GRWLLNYRPQPLAVGAEI

SEQ ID NO: 671336 - protein, 18 aa, Mycobacterium
GRWLRSALISNLKIVSSS

SEQ ID NO: 671337 - protein, 21 aa, Mycobacterium
GRWPEELRMYKAPPPEVSSEQ

SEQ ID NO: 671338 - protein, 19 aa, Mycobacterium
GRWPHKLGYMQTLELHTIG

SEQ ID NO: 671339 - protein, 17 aa, Mycobacterium
GRWREVINTDALQYRGG

SEQ ID NO: 671340 - protein, 19 aa, Mycobacterium
GRWRRGYTGRQWDSTTSRN

SEQ ID NO: 671341 - protein, 19 aa, Mycobacterium
GRWTLLDYIDVVVHIQHQD

SEQ ID NO: 671342 - protein, 18 aa, Mycobacterium
GRWTLLDYRDIVVHIQHQ

SEQ ID NO: 671343 - protein, 27 aa, Mycobacterium
GRWTMSVLRWLHLLGWVVRRAASGLPD

SEQ ID NO: 671344 - protein, 17 aa, Mycobacterium
GRWWQPIALAAYEQNPK

SEQ ID NO: 671345 - protein, 29 aa, Mycobacterium
GRWYPGEPLPRWQIALYRRTDGRPLWTDP

SEQ ID NO: 671346 - protein, 30 aa, Mycobacterium
GRWYPGEPLPRWQIALYWRTDGRPLWTDDT

SEQ ID NO: 671347 - protein, 20 aa, Mycobacterium
GRYADAWVPIVIIRPTDYSR

SEQ ID NO: 671348 - protein, 24 aa, Mycobacterium
GRYADAWVPIVLVRPGDYSTALEA

SEQ ID NO: 671349 - protein, 24 aa, Mycobacterium
GRYADGWFPVAIVSPERYATGLEQ

SEQ ID NO: 671350 - protein, 20 aa, Mycobacterium
GRYADGWWPAGAWTPDDYAE

SEQ ID NO: 671351 - protein, 19 aa, Mycobacterium
GRYAMVASKGGDPKHPSWY

SEQ ID NO: 671352 - protein, 20 aa, Mycobacterium
GRYARKVSVACRRERARRLH

SEQ ID NO: 671353 - protein, 24 aa, Mycobacterium
GRYDEPRKGMAVLLAALPAVLQRF

SEQ ID NO: 671354 - protein, 25 aa, Mycobacterium
GRYDEPRKGMAVLLAALPKLVARFP

SEQ ID NO: 671355 - protein, 24 aa, Mycobacterium
GRYDEPRKGMSVLLDALPGVVQRF

SEQ ID NO: 671356 - protein, 23 aa, Mycobacterium
GRYDEPRKGMSVLLEALPKLVER

SEQ ID NO: 671357 - protein, 24 aa, Mycobacterium
GRYDEPRKGVGVLLDALPRLVERF

SEQ ID NO: 671358 - protein, 17 aa, Mycobacterium
GRYEDRSALEMGAVAIS

SEQ ID NO: 671359 - protein, 17 aa, Mycobacterium
GRYELSVGTAEFGNGTT

SEQ ID NO: 671360 - protein, 28 aa, Mycobacterium
GRYERWREAAFQYAWLLAAADRDQYGSG

SEQ ID NO: 671361 - protein, 19 aa, Mycobacterium
GRYEWLDNNAVQWSPDRFW

SEQ ID NO: 671362 - protein, 17 aa, Mycobacterium
GRYFAGPVLPMPPDSSS

SEQ ID NO: 671363 - protein, 19 aa, Mycobacterium
GRYFDVIEDVWARRSSEVA

SEQ ID NO: 671364 - protein, 19 aa, Mycobacterium
GRYGDGWYPVTVVSPQEYA

SEQ ID NO: 671365 - protein, 17 aa, Mycobacterium
GRYGLADNAGTVLVGEQ

SEQ ID NO: 671366 - protein, 22 aa, Mycobacterium
GRYGPPRRWLVVTGTNGKTTTT

SEQ ID NO: 671367 - protein, 17 aa, Mycobacterium
GRYGQTFVLPETFVPKN

SEQ ID NO: 671368 - protein, 20 aa, Mycobacterium
GRYGWPETAGGLGGPDVLRA

SEQ ID NO: 671369 - protein, 34 aa, Mycobacterium
GRYHKVILSRCLEVPFRLDFPSTYRLGRRHNTPV

SEQ ID NO: 671370 - protein, 18 aa, Mycobacterium
GRYIPMVIVPLWDTRLAV

SEQ ID NO: 671371 - protein, 17 aa, Mycobacterium
GRYLLYLDFKVDDTMHT

SEQ ID NO: 671372 - protein, 25 aa, Mycobacterium
GRYPDQRSALLPLLHLVQGEDSYLT

SEQ ID NO: 671373 - protein, 19 aa, Mycobacterium
GRYPECVAGQPGTPIDDEL

SEQ ID NO: 671374 - protein, 25 aa, Mycobacterium
GRYPEKRSALLPLLHLVQAQDSYLT

SEQ ID NO: 671375 - protein, 19 aa, Mycobacterium
GRYQTLFACGAVHKTYLAR

SEQ ID NO: 671376 - protein, 18 aa, Mycobacterium
GRYQVRFTDPDGNYITAP

SEQ ID NO: 671377 - protein, 21 aa, Mycobacterium
GRYQWLDNNVVQWVPDQFWPA

SEQ ID NO: 671378 - protein, 18 aa, Mycobacterium
GRYRDLVAQRARRIPLQH

SEQ ID NO: 671379 - protein, 17 aa, Mycobacterium
GRYRGAVAYARTKRMQV

SEQ ID NO: 671380 - protein, 19 aa, Mycobacterium
GRYRLQRLIATGGMGQVWE

SEQ ID NO: 671381 - protein, 23 aa, Mycobacterium
GRYRLVAARACPWANRTLIVRRL

SEQ ID NO: 671382 - protein, 25 aa, Mycobacterium
GRYRLVVARACPWANRTIIVRRLLG

SEQ ID NO: 671383 - protein, 17 aa, Mycobacterium
GRYRRFCDVESYPKPVQ

SEQ ID NO: 671384 - protein, 19 aa, Mycobacterium
GRYRTVMVGPHEARILLAK

SEQ ID NO: 671385 - protein, 25 aa, Mycobacterium
GRYRWTRSCTIFAYDEPNEFGYITS

SEQ ID NO: 671386 - protein, 20 aa, Mycobacterium
GRYSHQLTIYIFRYGEGTVM

SEQ ID NO: 671387 - protein, 25 aa, Mycobacterium
GRYVIGRLIWQAGLLAPVEGPLRHV

SEQ ID NO: 671388 - protein, 19 aa, Mycobacterium
GSAAALRFEVFGLVNGDPV

SEQ ID NO: 671389 - protein, 20 aa, Mycobacterium
GSAACLAFALAVPDDSTAMM

SEQ ID NO: 671390 - protein, 20 aa, Mycobacterium
GSAAESFGSVTSGLVGSSWQ

SEQ ID NO: 671391 - protein, 18 aa, Mycobacterium
GSAAEVFLANGFHATSLD

SEQ ID NO: 671392 - protein, 22 aa, Mycobacterium
GSAALFSWGLNYLVALGLRPPP

SEQ ID NO: 671393 - protein, 30 aa, Mycobacterium
GSAARARRALAEFRIRGVATNIGFLLAVLD

SEQ ID NO: 671394 - protein, 18 aa, Mycobacterium
GSACGVEAMALYRHVHGR

SEQ ID NO: 671395 - protein, 17 aa, Mycobacterium
GSADKFSVVEALADSLG

SEQ ID NO: 671396 - protein, 19 aa, Mycobacterium
GSADLRYWVVHDLHNAIRA

SEQ ID NO: 671397 - protein, 22 aa, Mycobacterium
GSADPGLHDPFFDQGDLGHHPG

SEQ ID NO: 671398 - protein, 25 aa, Mycobacterium
GSAEKLDFCRDLGADITINYHDEDF

SEQ ID NO: 671399 - protein, 23 aa, Mycobacterium
GSAESVAGQGARVTVTEIDPINA

SEQ ID NO: 671400 - protein, 25 aa, Mycobacterium
GSAEYDWGITPGDLATIWRGGCIIR

SEQ ID NO: 671401 - protein, 20 aa, Mycobacterium
GSAFEQWLAAGPESEADRLQ

SEQ ID NO: 671402 - protein, 29 aa, Mycobacterium
GSAFGLAAADGVMAWLEEQGRGVALDGGV

SEQ ID NO: 671403 - protein, 32 aa, Mycobacterium
GSAFVLATGRPPRWITPIVDALGFAPISVCAN

SEQ ID NO: 671404 - protein, 24 aa, Mycobacterium
GSAGILPITWAYIALMGPDGLATA

SEQ ID NO: 671405 - protein, 22 aa, Mycobacterium
GSAGKSGLLFGAGGAGGQGGGG

SEQ ID NO: 671406 - protein, 21 aa, Mycobacterium
GSAGLLARTSLMAQLVDKPTA

SEQ ID NO: 671407 - protein, 19 aa, Mycobacterium
GSAGLLFSGAGAGGAGGVG

SEQ ID NO: 671408 - protein, 25 aa, Mycobacterium
GSAGNSFGAFVPRGITLRLFGDAND

SEQ ID NO: 671409 - protein, 19 aa, Mycobacterium
GSAGRFSAFLPGWSTATTP

SEQ ID NO: 671410 - protein, 19 aa, Mycobacterium
GSAGRKAVPVIADVRDLAG

SEQ ID NO: 671411 - protein, 24 aa, Mycobacterium
GSAGSACAARAAVDQCRPGRPAAG

SEQ ID NO: 671412 - protein, 30 aa, Mycobacterium
GSAHGRLQRLGMANLDWLVVRDLVEIESAT

SEQ ID NO: 671413 - protein, 31 aa, Mycobacterium
GSAHGRLQRLGMANLDWLVVRDLVMIESATF

SEQ ID NO: 671414 - protein, 20 aa, Mycobacterium
GSAIGQHWMYDGKHVLIVFD

SEQ ID NO: 671415 - protein, 33 aa, Mycobacterium
GSAKLGAVAVPVNWRLTAPEMRHVIADCGASVV

SEQ ID NO: 671416 - protein, 18 aa, Mycobacterium
GSAKWWANRVDALPFHLV

SEQ ID NO: 671417 - protein, 22 aa, Mycobacterium
GSALFRVARRIGPLGPDEVGFD

SEQ ID NO: 671418 - protein, 19 aa, Mycobacterium
GSALLSFGASREVLVAVAN

SEQ ID NO: 671419 - protein, 18 aa, Mycobacterium
GSALSSLTSEEWHGPASA

SEQ ID NO: 671420 - protein, 22 aa, Mycobacterium
GSAMAKIRGDRILAIDADPDGG

SEQ ID NO: 671421 - protein, 18 aa, Mycobacterium
GSAMKLGQLLSMLEVDMV

SEQ ID NO: 671422 - protein, 18 aa, Mycobacterium
GSAMLMLVGAANRDHRRF

SEQ ID NO: 671423 - protein, 23 aa, Mycobacterium
GSANRDGHRWERPEEFDIFRAHV

SEQ ID NO: 671424 - protein, 17 aa, Mycobacterium
GSANVFARALGISPDPI

SEQ ID NO: 671425 - protein, 28 aa, Mycobacterium
GSAPAPAVVYCHAGGFALGNLDTDHRQC

SEQ ID NO: 671426 - protein, 20 aa, Mycobacterium
GSAPLLGWGGNGGAGGDSTQ

SEQ ID NO: 671427 - protein, 19 aa, Mycobacterium
GSAPMCYPRGEFRVGASDV

SEQ ID NO: 671428 - protein, 24 aa, Mycobacterium
GSAPMLEAAVAWDGLSAELGTAAE

SEQ ID NO: 671429 - protein, 25 aa, Mycobacterium
GSAPMLQAAAAWEGLAGELGSAADS

SEQ ID NO: 671430 - protein, 27 aa, Mycobacterium
GSAPMLQAATAWAGLADELGAAADSFA

SEQ ID NO: 671431 - protein, 25 aa, Mycobacterium
GSAPMVAAAAAWDVLANGLETASRG

SEQ ID NO: 671432 - protein, 18 aa, Mycobacterium
GSAPMVAAASAWSGLAAE

SEQ ID NO: 671433 - protein, 23 aa, Mycobacterium
GSAPRTQPLANLVEGGPVAGPAP

SEQ ID NO: 671434 - protein, 28 aa, Mycobacterium
GSAPVVLQFPWKLMPGKYIAGIEEAAAA

SEQ ID NO: 671435 - protein, 19 aa, Mycobacterium
GSAQRFGVPLFFGGPHAGY

SEQ ID NO: 671436 - protein, 19 aa, Mycobacterium
GSARARNMLALKLDAQLID

SEQ ID NO: 671437 - protein, 25 aa, Mycobacterium
GSARASGIGAGFGRAATTATIIVIN

SEQ ID NO: 671438 - protein, 22 aa, Mycobacterium
GSARATGRLLSYVESPRREAVL

SEQ ID NO: 671439 - protein, 17 aa, Mycobacterium
GSARFTPHLTLGYRDAV

SEQ ID NO: 671440 - protein, 20 aa, Mycobacterium
GSARLSHTHWGAFTPEVRDG

SEQ ID NO: 671441 - protein, 17 aa, Mycobacterium
GSARLVAVGAPAQAEPR

SEQ ID NO: 671442 - protein, 17 aa, Mycobacterium
GSARLVAVGAPTQAEPR

SEQ ID NO: 671443 - protein, 22 aa, Mycobacterium
GSARPAAGCPAALGGYEAPPEV

SEQ ID NO: 671444 - protein, 17 aa, Mycobacterium
GSARPAATGGFMLLLHL

SEQ ID NO: 671445 - protein, 21 aa, Mycobacterium
GSARQGLVIAAEFRGADESGA

SEQ ID NO: 671446 - protein, 20 aa, Mycobacterium
GSARSAEELVLLATKYDEFS

SEQ ID NO: 671447 - protein, 17 aa, Mycobacterium
GSARSVLYRRWPSRLDL

SEQ ID NO: 671448 - protein, 29 aa, Mycobacterium
GSASRYLSRWHRRRPLWVGVATGGVVDSA

SEQ ID NO: 671449 - protein, 22 aa, Mycobacterium
GSASYSFNIEWALTGTPEVAPP

SEQ ID NO: 671450 - protein, 21 aa, Mycobacterium
GSASYYLPRLVGMRRAQELML

SEQ ID NO: 671451 - protein, 19 aa, Mycobacterium
GSATARRALAEGADVVISD

SEQ ID NO: 671452 - protein, 21 aa, Mycobacterium
GSATCLAFALAVPDDSTAMMT

SEQ ID NO: 671453 - protein, 21 aa, Mycobacterium
GSATCLAFALAVPDGSTAMMT

SEQ ID NO: 671454 - protein, 19 aa, Mycobacterium
GSATSWPRVLGRLTGGQDL

SEQ ID NO: 671455 - protein, 17 aa, Mycobacterium
GSAVCFISSVAGMGWEN

SEQ ID NO: 671456 - protein, 20 aa, Mycobacterium
GSAVRLPRQIPYTVACDLLL

SEQ ID NO: 671457 - protein, 18 aa, Mycobacterium
GSAVRLVRQIPYTIACDM

SEQ ID NO: 671458 - protein, 34 aa, Mycobacterium
GSCGKLIAAAGWHAWRPAHLHVKVSAPGHELLTA

SEQ ID NO: 671459 - protein, 20 aa, Mycobacterium
GSCKSCPSSAVTLELAVQDA

SEQ ID NO: 671460 - protein, 20 aa, Mycobacterium
GSCLLLRTAAFAQIDGFNER

SEQ ID NO: 671461 - protein, 17 aa, Mycobacterium
GSCPQELHELARRRYDL

SEQ ID NO: 671462 - protein, 17 aa, Mycobacterium
GSCQRTWEHAIPKTSKP

SEQ ID NO: 671463 - protein, 17 aa, Mycobacterium
GSCQRTWEHAVPKTTRP

SEQ ID NO: 671464 - protein, 21 aa, Mycobacterium
GSCSWKIYVKDGIITWENQET

SEQ ID NO: 671465 - protein, 21 aa, Mycobacterium
GSCSWKIYVKDGIITWETQET

SEQ ID NO: 671466 - protein, 20 aa, Mycobacterium
GSCTKSFTATMILQAVDRGL

SEQ ID NO: 671467 - protein, 18 aa, Mycobacterium
GSCTVLVDGRRVTSCLTF

SEQ ID NO: 671468 - protein, 19 aa, Mycobacterium
GSCVFACPVNCIHPTPDEP

SEQ ID NO: 671469 - protein, 19 aa, Mycobacterium
GSCYADRGFSESWLDERLV

SEQ ID NO: 671470 - protein, 20 aa, Mycobacterium
GSDAAEWLLPKAMWLKKHDP

SEQ ID NO: 671471 - protein, 17 aa, Mycobacterium
GSDAFAIVWDGRQLHGL

SEQ ID NO: 671472 - protein, 23 aa, Mycobacterium
GSDAFAVVWDGTRLHGLNASGRS

SEQ ID NO: 671473 - protein, 22 aa, Mycobacterium
GSDAPSALGYIAARTERMQLGS

SEQ ID NO: 671474 - protein, 27 aa, Mycobacterium
GSDASMQYCWVMRVAGDQIVDVIGYYD

SEQ ID NO: 671475 - protein, 19 aa, Mycobacterium
GSDAWDRLFSGPRPAELHP

SEQ ID NO: 671476 - protein, 21 aa, Mycobacterium
GSDAWDRLFSGPRPAELHPFR

SEQ ID NO: 671477 - protein, 21 aa, Mycobacterium
GSDAWDRLFSGPRPAELHPFV

SEQ ID NO: 671478 - protein, 32 aa, Mycobacterium
GSDAWDRLFSGPRPAKLHPFVALHGPRHTAPA

SEQ ID NO: 671479 - protein, 24 aa, Mycobacterium
GSDAWKAYMRRATNTINYSRELPL

SEQ ID NO: 671480 - protein, 24 aa, Mycobacterium
GSDAWKAYMRRATNTINYSTELPL

SEQ ID NO: 671481 - protein, 24 aa, Mycobacterium
GSDAWKAYMRRATNTVNYSSELPL

SEQ ID NO: 671482 - protein, 19 aa, Mycobacterium
GSDCGRCRRTLRAIIAAAA

SEQ ID NO: 671483 - protein, 25 aa, Mycobacterium
GSDDRCVIEFGLLLTDAAKASGLGA

SEQ ID NO: 671484 - protein, 24 aa, Mycobacterium
GSDELKARWLPGIASGEVIMAFAI

SEQ ID NO: 671485 - protein, 31 aa, Mycobacterium
GSDEQKQRWAVPVLRAEMTASLGMSEPSAGS

SEQ ID NO: 671486 - protein, 23 aa, Mycobacterium
GSDERMLILLGRIHAYEGHDLRH

SEQ ID NO: 671487 - protein, 25 aa, Mycobacterium
GSDEVSAGIAAVFGAHGRAYQALAA

SEQ ID NO: 671488 - protein, 23 aa, Mycobacterium
GSDFELARGFLLTEGVIAHRDDV

SEQ ID NO: 671489 - protein, 22 aa, Mycobacterium
GSDGADCPIGIDGEVVVRGPDQ

SEQ ID NO: 671490 - protein, 25 aa, Mycobacterium
GSDGARAEWAMGLWDDPTQSALRAV

SEQ ID NO: 671491 - protein, 17 aa, Mycobacterium
GSDGASHNGMWDLSILN

SEQ ID NO: 671492 - protein, 18 aa, Mycobacterium
GSDGEIWVLGRIDDVMNI

SEQ ID NO: 671493 - protein, 25 aa, Mycobacterium
GSDGQWRLSPKAMRQLGQAALRDVA

SEQ ID NO: 671494 - protein, 25 aa, Mycobacterium
GSDGQWRLSPKAMRQLGQTALRDVA

SEQ ID NO: 671495 - protein, 26 aa, Mycobacterium
GSDGRRWRLDFAWPGLRVAAEYDGVD

SEQ ID NO: 671496 - protein, 17 aa, Mycobacterium
GSDGSVMACIFNFAGSE

SEQ ID NO: 671497 - protein, 17 aa, Mycobacterium
GSDGSVMACVFNFAGSE

SEQ ID NO: 671498 - protein, 29 aa, Mycobacterium
GSDHPRPQGAFVRFLFQPYVWPEDSETAM

SEQ ID NO: 671499 - protein, 23 aa, Mycobacterium
GSDIELAQGFLLTEGVIRRRDDL

SEQ ID NO: 671500 - protein, 18 aa, Mycobacterium
GSDIPGFRGTQGKLPGDT

SEQ ID NO: 671501 - protein, 17 aa, Mycobacterium
GSDITLKAVEMAGTTGY

SEQ ID NO: 671502 - protein, 18 aa, Mycobacterium
GSDLDWSAAFTGLSARRI

SEQ ID NO: 671503 - protein, 24 aa, Mycobacterium
GSDLHAACGHHPFIDLPYRPGHEA

SEQ ID NO: 671504 - protein, 18 aa, Mycobacterium
GSDLHFIDGYLPGMREGD

SEQ ID NO: 671505 - protein, 28 aa, Mycobacterium
GSDLIEEWRFFLGLTKRMGLELWFVNFF

SEQ ID NO: 671506 - protein, 23 aa, Mycobacterium
GSDPGFVSYHLFGPPPTTDHDLL

SEQ ID NO: 671507 - protein, 29 aa, Mycobacterium
GSDPLSSLAPMLPALGGLGGAAGNPLDSL

SEQ ID NO: 671508 - protein, 23 aa, Mycobacterium
GSDSFGDPGVWLRLNQVDAGHLW

SEQ ID NO: 671509 - protein, 17 aa, Mycobacterium
GSDSGDAVWTRMTVPQS

SEQ ID NO: 671510 - protein, 18 aa, Mycobacterium
GSDSLYWVGDTAALLDEV

SEQ ID NO: 671511 - protein, 26 aa, Mycobacterium
GSDVLPWLPVRGVFLLVERGSATTDP

SEQ ID NO: 671512 - protein, 22 aa, Mycobacterium
GSDVMFAQGMIPHHQQAIEMSD

SEQ ID NO: 671513 - protein, 27 aa, Mycobacterium
GSDVNRLKRFAVRFSKMVFPGDDLETR

SEQ ID NO: 671514 - protein, 20 aa, Mycobacterium
GSDVPVEFLVQGTLYPDVVE

SEQ ID NO: 671515 - protein, 20 aa, Mycobacterium
GSDVTAWLRTINTLGRSAFQ

SEQ ID NO: 671516 - protein, 23 aa, Mycobacterium
GSEAIALLRLPLVLPAVQVAGRV

SEQ ID NO: 671517 - protein, 25 aa, Mycobacterium
GSEALRQRFLPGIIDGSQRWCQGFS

SEQ ID NO: 671518 - protein, 37 aa, Mycobacterium
GSEAWDRLFSGSRPARLWPFREVRGERHVAPATPGDL

SEQ ID NO: 671519 - protein, 20 aa, Mycobacterium
GSEDWLIRLMEGVEDIPGTA

SEQ ID NO: 671520 - protein, 19 aa, Mycobacterium
GSEELRQRFLPGMINGTER

SEQ ID NO: 671521 - protein, 21 aa, Mycobacterium
GSEFLEWRASMDLPAVAEVIA

SEQ ID NO: 671522 - protein, 22 aa, Mycobacterium
GSEFLLNLDMRFAVRGKALFNQ

SEQ ID NO: 671523 - protein, 23 aa, Mycobacterium
GSEFQRRVWKALLTIPYGETRSY

SEQ ID NO: 671524 - protein, 19 aa, Mycobacterium
GSEGRRRAATMYQLDKDGT

SEQ ID NO: 671525 - protein, 19 aa, Mycobacterium
GSEILCGSNNLAASESYGV

SEQ ID NO: 671526 - protein, 21 aa, Mycobacterium
GSELRRLDAVRIFEALSAADP

SEQ ID NO: 671527 - protein, 21 aa, Mycobacterium
GSEPLRSAFTFADCARCVVDL

SEQ ID NO: 671528 - protein, 24 aa, Mycobacterium
GSEPWRIPDITTFEPIVHKFAKPD

SEQ ID NO: 671529 - protein, 25 aa, Mycobacterium
GSETVSCAAGAAAAPGASGGTRAAS

SEQ ID NO: 671530 - protein, 24 aa, Mycobacterium
GSEVPRLAAMTQKAIDLLKNGKAG

SEQ ID NO: 671531 - protein, 19 aa, Mycobacterium
GSEYKKLRDVLGLLRDAYC

SEQ ID NO: 671532 - protein, 30 aa, Mycobacterium
GSEYRGRYGLSVGALARWHRPRLETLADAG

SEQ ID NO: 671533 - protein, 19 aa, Mycobacterium
GSFAGLRRWDGNKKVEHLI

SEQ ID NO: 671534 - protein, 17 aa, Mycobacterium
GSFARPLVVGDRLDTDI

SEQ ID NO: 671535 - protein, 19 aa, Mycobacterium
GSFASHVELYWTMPEFGSL

SEQ ID NO: 671536 - protein, 18 aa, Mycobacterium
GSFDARGFLTLRDRSKDV

SEQ ID NO: 671537 - protein, 19 aa, Mycobacterium
GSFEAPLVVGDRLDTDIAC

SEQ ID NO: 671538 - protein, 19 aa, Mycobacterium
GSFEEIDWDTAIVEIAEGF

SEQ ID NO: 671539 - protein, 24 aa, Mycobacterium
GSFFRFSLNGNLSFAYQPVEMDYF

SEQ ID NO: 671540 - protein, 24 aa, Mycobacterium
GSFLCTGMPFAFLDRPRRWIRRVP

SEQ ID NO: 671541 - protein, 25 aa, Mycobacterium
GSFLCTGMPFAFVGKPRRWIRRPPP

SEQ ID NO: 671542 - protein, 18 aa, Mycobacterium
GSFLRAGAVIAADDTAAV

SEQ ID NO: 671543 - protein, 19 aa, Mycobacterium
GSFNPGHVNTGWFNTGDIN

SEQ ID NO: 671544 - protein, 18 aa, Mycobacterium
GSFPFFVGPAGAIAKSAF

SEQ ID NO: 671545 - protein, 17 aa, Mycobacterium
GSFPLQYAKTWRTLAKL

SEQ ID NO: 671546 - protein, 17 aa, Mycobacterium
GSFRAPQFTVAWPTGEI

SEQ ID NO: 671547 - protein, 39 aa, Mycobacterium
GSFRPDLDVDLVYRFIRDTTWVSVRWYKPGGPLSAEQVG

SEQ ID NO: 671548 - protein, 17 aa, Mycobacterium
GSFSGRAKLTLDTVTAV

SEQ ID NO: 671549 - protein, 20 aa, Mycobacterium
GSFTDSFPLFGYDLADYDEL

SEQ ID NO: 671550 - protein, 22 aa, Mycobacterium
GSFTRLRGLLAVHETVEAMVVH

SEQ ID NO: 671551 - protein, 18 aa, Mycobacterium
GSFVLAVPEPTAFTIESA

SEQ ID NO: 671552 - protein, 19 aa, Mycobacterium
GSFVPDLLRRFRAHAPHVQ

SEQ ID NO: 671553 - protein, 19 aa, Mycobacterium
GSFVRNPRDGFLQPAHPYR

SEQ ID NO: 671554 - protein, 24 aa, Mycobacterium
GSFYHPGAKLDWMIATTLLTGRRT

SEQ ID NO: 671555 - protein, 18 aa, Mycobacterium
GSGAAFYRAVIDYWENDV

SEQ ID NO: 671556 - protein, 30 aa, Mycobacterium
GSGAAGTAGGWVFGDGGAGGSGAMSTGADG

SEQ ID NO: 671557 - protein, 26 aa, Mycobacterium
GSGAAIPACAAVAAGTDGLAASAASA

SEQ ID NO: 671558 - protein, 26 aa, Mycobacterium
GSGADGTAGGWLLGDGGAGGSSTAGS

SEQ ID NO: 671559 - protein, 25 aa, Mycobacterium
GSGADGTAGGWLLGNGGAGGSGADG

SEQ ID NO: 671560 - protein, 23 aa, Mycobacterium
GSGADGTLFSSLAGTGGTGGNGG

SEQ ID NO: 671561 - protein, 26 aa, Mycobacterium
GSGADGTPGGWLLGDGGAGGSAVAGS

SEQ ID NO: 671562 - protein, 25 aa, Mycobacterium
GSGAGADGGNGFAGGTGGDGGTGGN

SEQ ID NO: 671563 - protein, 21 aa, Mycobacterium
GSGALALALAQGFPGATVFAV

SEQ ID NO: 671564 - protein, 19 aa, Mycobacterium
GSGALAVALAHEYPAARIV

SEQ ID NO: 671565 - protein, 19 aa, Mycobacterium
GSGARRGGAVSGIGGHNAA

SEQ ID NO: 671566 - protein, 24 aa, Mycobacterium
GSGATLRSPAGWTPPIAAAPQSEL

SEQ ID NO: 671567 - protein, 19 aa, Mycobacterium
GSGAVMVLAGPPGVGKTSL

SEQ ID NO: 671568 - protein, 24 aa, Mycobacterium
GSGAYRFIPVGADLLAFTEFGRDI

SEQ ID NO: 671569 - protein, 24 aa, Mycobacterium
GSGCAALGGYVRYHAILGASRHCV

SEQ ID NO: 671570 - protein, 20 aa, Mycobacterium
GSGCAAYAEQVPEGPGSVAG

SEQ ID NO: 671571 - protein, 18 aa, Mycobacterium
GSGCGWSDLVAAIATAAA

SEQ ID NO: 671572 - protein, 18 aa, Mycobacterium
GSGDEYWARQAQWHQALY

SEQ ID NO: 671573 - protein, 27 aa, Mycobacterium
GSGDIAFCFATGNGFVGDFAAEPGPDV

SEQ ID NO: 671574 - protein, 23 aa, Mycobacterium
GSGDPRAPGIGFRSDNDDRWPFP

SEQ ID NO: 671575 - protein, 25 aa, Mycobacterium
GSGDWRPDVVHAHDWLVAHPAIALA

SEQ ID NO: 671576 - protein, 32 aa, Mycobacterium; identical to SEQ ID NO: 80547

SEQ ID NO: 671577 - protein, 23 aa, Mycobacterium
GSGFRPLARLSLHTVIEDEDVSF

SEQ ID NO: 671578 - protein, 27 aa, Mycobacterium
GSGGAGGECDLGGFGDGGDGGDGGGAM

SEQ ID NO: 671579 - protein, 26 aa, Mycobacterium
GSGGAGGRGGWLIGNGGAGGAGGAGG

SEQ ID NO: 671580 - protein, 26 aa, Mycobacterium
GSGGAGGWAGLIGAGGAGGVGGTGVA

SEQ ID NO: 671581 - protein, 22 aa, Mycobacterium
GSGGFEDHGYWIVTKHADVKEV

SEQ ID NO: 671582 - protein, 19 aa, Mycobacterium
GSGGFGFSIAGGAGGAGGD

SEQ ID NO: 671583 - protein, 20 aa, Mycobacterium
GSGGFGGLIGSGGPGGAGGD

SEQ ID NO: 671584 - protein, 20 aa, Mycobacterium
GSGGHAGLLFGNGGSGGLGG

SEQ ID NO: 671585 - protein, 25 aa, Mycobacterium
GSGGKGGDAGRFGNGGNGGNGGNGA

SEQ ID NO: 671586 - protein, 21 aa, Mycobacterium
GSGGNAGLFGNGGNAGGGGSG

SEQ ID NO: 671587 - protein, 21 aa, Mycobacterium
GSGGNGGWFAGNAGAGGNGGV

SEQ ID NO: 671588 - protein, 42 aa, Mycobacterium
GSGGRIMLPRTTYEQIKVGRQVPMGALAPGDLVFSNFSAPGV

SEQ ID NO: 671589 - protein, 24 aa, Mycobacterium
GSGGSRPSGGWERERAVLAVVDGD

SEQ ID NO: 671590 - protein, 25 aa, Mycobacterium
GSGGVGGTGGWLYGNGGAGGIGGTG

SEQ ID NO: 671591 - protein, 26 aa, Mycobacterium
GSGGYGPLVGGWGGDGGAGGDGGGAG

SEQ ID NO: 671592 - protein, 25 aa, Mycobacterium
GSGHNGGAGGLLWGNGGDGGAGAAG

SEQ ID NO: 671593 - protein, 22 aa, Mycobacterium
GSGHYPAFAGWVGPGMGHGAPC

SEQ ID NO: 671594 - protein, 20 aa, Mycobacterium
GSGKDWQVWAGDQVADLVQL

SEQ ID NO: 671595 - protein, 20 aa, Mycobacterium
GSGKDWQVWSGQKVADLVQL

SEQ ID NO: 671596 - protein, 18 aa, Mycobacterium
GSGKGVRAIVVYPMNALA

SEQ ID NO: 671597 - protein, 26 aa, Mycobacterium
GSGKLAEFGELRWREGAAVAVVLAAE

SEQ ID NO: 671598 - protein, 23 aa, Mycobacterium
GSGKSTFLRCINHLETLDGGQLW

SEQ ID NO: 671599 - protein, 17 aa, Mycobacterium
GSGLGCGAISVITDDCP

SEQ ID NO: 671600 - protein, 17 aa, Mycobacterium
GSGLGIKNMVTGAVALA

SEQ ID NO: 671601 - protein, 33 aa, Mycobacterium
GSGLHALRLAPELRGRLVWAWRADGANPAARVL

SEQ ID NO: 671602 - protein, 21 aa, Mycobacterium
GSGLNRPAAVIVETVQGEGGL

SEQ ID NO: 671603 - protein, 19 aa, Mycobacterium
GSGLRSVHLLPKLAEALSN

SEQ ID NO: 671604 - protein, 25 aa, Mycobacterium
GSGLTRAVLRGGAYVGVHTMGDLAA

SEQ ID NO: 671605 - protein, 31 aa, Mycobacterium
GSGMWAVSVDRQIRWFGLDGVENTSSTGVLV

SEQ ID NO: 671606 - protein, 18 aa, Mycobacterium
GSGNFFGNGNFGFGNSFS

SEQ ID NO: 671607 - protein, 24 aa, Mycobacterium
GSGNGVKVNSFGLENIATLGTVFG

SEQ ID NO: 671608 - protein, 24 aa, Mycobacterium
GSGNRGNGNIGFGNYQSTGGANIG

SEQ ID NO: 671609 - protein, 18 aa, Mycobacterium
GSGNRGSYNIGPGNLGDY

SEQ ID NO: 671610 - protein, 23 aa, Mycobacterium
GSGNYASIRGYSGATVTDGTATG

SEQ ID NO: 671611 - protein, 19 aa, Mycobacterium
GSGPAYFFLLVEALVDAGV

SEQ ID NO: 671612 - protein, 17 aa, Mycobacterium
GSGPAYFFLMAEAMVDA

SEQ ID NO: 671613 - protein, 19 aa, Mycobacterium
GSGPAYFFLMVEALIDAGV

SEQ ID NO: 671614 - protein, 17 aa, Mycobacterium
GSGPAYFFLMVEALVDA

SEQ ID NO: 671615 - protein, 17 aa, Mycobacterium
GSGPFGVAVDPETHTAY

SEQ ID NO: 671616 - protein, 17 aa, Mycobacterium
GSGPLQWVIDPLDGTTN

SEQ ID NO: 671617 - protein, 21 aa, Mycobacterium
GSGPLRPAAAEVFAAVDAAGI

SEQ ID NO: 671618 - protein, 21 aa, Mycobacterium
GSGPLRPAAAEVFAAVHDAGI

SEQ ID NO: 671619 - protein, 24 aa, Mycobacterium
GSGPMLAAAAAWDGLADELSTAAA

SEQ ID NO: 671620 - protein, 24 aa, Mycobacterium
GSGPMLAAAAAWDGLAIELYTTAA

SEQ ID NO: 671621 - protein, 25 aa, Mycobacterium
GSGPMLAAAAAWDVLANGLESAARG

SEQ ID NO: 671622 - protein, 23 aa, Mycobacterium
GSGPMLAAAVVWDELAAELYATA

SEQ ID NO: 671623 - protein, 25 aa, Mycobacterium
GSGPMMAAATSWDMIAAELRSMGTV

SEQ ID NO: 671624 - protein, 23 aa, Mycobacterium
GSGPPLLLIHGYPFNSFDWASIW

SEQ ID NO: 671625 - protein, 23 aa, Mycobacterium
GSGPPLLLIHGYPFNSWDWALIW

SEQ ID NO: 671626 - protein, 23 aa, Mycobacterium
GSGPREPGRIIAIASADTPLKGV

SEQ ID NO: 671627 - protein, 32 aa, Mycobacterium
GSGPRTGAGLLRAVSMPGAGGTLVRTPLIGGL

SEQ ID NO: 671628 - protein, 20 aa, Mycobacterium
GSGPRYGFRPTIMSRPPAAG

SEQ ID NO: 671629 - protein, 27 aa, Mycobacterium
GSGPTFIECVTFRFRGHYFGDRMAYIP

SEQ ID NO: 671630 - protein, 20 aa, Mycobacterium
GSGPVGFILTRQGIPVLEGT

SEQ ID NO: 671631 - protein, 17 aa, Mycobacterium
GSGPVGLILTRQGLPIL

SEQ ID NO: 671632 - protein, 17 aa, Mycobacterium
GSGPVGLILTRQGVPIL

SEQ ID NO: 671633 - protein, 17 aa, Mycobacterium
GSGPVGLILTRQGVPVL

SEQ ID NO: 671634 - protein, 24 aa, Mycobacterium
GSGQRLAAGVPKAFYQLEGQTLVE

SEQ ID NO: 671635 - protein, 20 aa, Mycobacterium
GSGRKYKKCHLGNEQLSLEE

SEQ ID NO: 671636 - protein, 23 aa, Mycobacterium
GSGRLCGTINVLLPVPGDVRGLA

SEQ ID NO: 671637 - protein, 18 aa, Mycobacterium
GSGRLRGRPVGRACRGLH

SEQ ID NO: 671638 - protein, 21 aa, Mycobacterium
GSGRLTGLITVKDFVKTEQHP

SEQ ID NO: 671639 - protein, 22 aa, Mycobacterium
GSGRTELARLLFGADRATSGHV

SEQ ID NO: 671640 - protein, 19 aa, Mycobacterium
GSGRTGGLEGLREFQQVKN

SEQ ID NO: 671641 - protein, 17 aa, Mycobacterium
GSGRTVADTVLWLNVEL

SEQ ID NO: 671642 - protein, 17 aa, Mycobacterium
GSGRWPGRQLGSVSSAV

SEQ ID NO: 671643 - protein, 25 aa, Mycobacterium
GSGSAPQRLWAKPAITVIGIDTTPI

SEQ ID NO: 671644 - protein, 19 aa, Mycobacterium
GSGSEAYRGVQQNWDSTAQ

SEQ ID NO: 671645 - protein, 28 aa, Mycobacterium
GSGSGASAFNGFLNLAIGLTDGVMASAG

SEQ ID NO: 671646 - protein, 23 aa, Mycobacterium
GSGSLRPAAAEVFAAVDDAGIPV

SEQ ID NO: 671647 - protein, 21 aa, Mycobacterium
GSGSSRDWAAKGTRLLGVRAV

SEQ ID NO: 671648 - protein, 22 aa, Mycobacterium
GSGSWPAEFARFDVGQQDPVAR

SEQ ID NO: 671649 - protein, 20 aa, Mycobacterium
GSGTNGFDGAFSGADGSPGG

SEQ ID NO: 671650 - protein, 22 aa, Mycobacterium
GSGVCRDYAHLVVALLRAVNVP

SEQ ID NO: 671651 - protein, 24 aa, Mycobacterium
GSGVKRIPLARALQTAQRHDYLGN

SEQ ID NO: 671652 - protein, 20 aa, Mycobacterium
GSGVLSWWVQFRGKQDGDPC

SEQ ID NO: 671653 - protein, 18 aa, Mycobacterium
GSGVPVRAAIGVQTLPSG

SEQ ID NO: 671654 - protein, 26 aa, Mycobacterium
GSGVRWFRRHPWQFVRTSLSGESLAY

SEQ ID NO: 671655 - protein, 26 aa, Mycobacterium
GSGVTPWITLSCRDRNRVVLEQELRG

SEQ ID NO: 671656 - protein, 19 aa, Mycobacterium
GSHAVTMVPYRGVNIAMMI

SEQ ID NO: 671657 - protein, 23 aa, Mycobacterium
GSHFSGDIFLAFSTAEASGLASA

SEQ ID NO: 671658 - protein, 19 aa, Mycobacterium
GSHGAEFESGFSRDIDRDL

SEQ ID NO: 671659 - protein, 24 aa, Mycobacterium
GSHGAEFTSGFGHDIDTALLQRIT

SEQ ID NO: 671660 - protein, 19 aa, Mycobacterium
GSHGVQMFMIRRETGGLDR

SEQ ID NO: 671661 - protein, 25 aa, Mycobacterium
GSHLARLMAEVMVKAVLDRIPDYRV

SEQ ID NO: 671662 - protein, 26 aa, Mycobacterium
GSHLARLMAEVMVRAVLDRIPDYQVD

SEQ ID NO: 671663 - protein, 18 aa, Mycobacterium
GSHMVAFPSLWSVIDEPT

SEQ ID NO: 671664 - protein, 18 aa, Mycobacterium
GSHMVAFPSLWSVIDEST

SEQ ID NO: 671665 - protein, 22 aa, Mycobacterium
GSHPGMPWDPPDHLGKDHYNRL

SEQ ID NO: 671666 - protein, 24 aa, Mycobacterium
GSHPRSAGVVSGYPGAGLTSYIRP

SEQ ID NO: 671667 - protein, 17 aa, Mycobacterium
GSHRRLGNATVRPLEGV

SEQ ID NO: 671668 - protein, 17 aa, Mycobacterium
GSHWDGKAAQAFDDYSA

SEQ ID NO: 671669 - protein, 22 aa, Mycobacterium
GSIALSITNTFRPWNLTESSGH

SEQ ID NO: 671670 - protein, 24 aa, Mycobacterium
GSIARVALTPAVTRWTESELAAAI

SEQ ID NO: 671671 - protein, 17 aa, Mycobacterium
GSIASEALVGWADSVGV

SEQ ID NO: 671672 - protein, 23 aa, Mycobacterium
GSIASESLVGWAKSVGVDGGDPY

SEQ ID NO: 671673 - protein, 23 aa, Mycobacterium
GSIASESLVGWANSVGVDGHDPY

SEQ ID NO: 671674 - protein, 25 aa, Mycobacterium
GSIASVRGFPFWSVYAASKAVLHAY

SEQ ID NO: 671675 - protein, 19 aa, Mycobacterium
GSIDEPIRRLAHHPDEPPP

SEQ ID NO: 671676 - protein, 23 aa, Mycobacterium
GSIDFNGVVFGHTFNGAVQTMYD

SEQ ID NO: 671677 - protein, 21 aa, Mycobacterium
GSIDRRIVAVFDRAVATIRID

SEQ ID NO: 671678 - protein, 23 aa, Mycobacterium
GSIEIAELYAPFSHQQLILTEAI

SEQ ID NO: 671679 - protein, 22 aa, Mycobacterium
GSIELPKGVTLISDPETLVVNV

SEQ ID NO: 671680 - protein, 24 aa, Mycobacterium
GSIEVAELYAPFSHQQLILAEAIG

SEQ ID NO: 671681 - protein, 24 aa, Mycobacterium
GSIGEWMLNPGVVISWHPTPAARQ

SEQ ID NO: 671682 - protein, 19 aa, Mycobacterium
GSIGLEIAGYLAGRGAKHL

SEQ ID NO: 671683 - protein, 17 aa, Mycobacterium
GSIGLKHARHGATSVAT

SEQ ID NO: 671684 - protein, 21 aa, Mycobacterium
GSIGLMIAMGPAFCSELVLLA

SEQ ID NO: 671685 - protein, 19 aa, Mycobacterium
GSIGMCEHAFYEAITHANN

SEQ ID NO: 671686 - protein, 17 aa, Mycobacterium
GSILDYLAELGIEDNTI

SEQ ID NO: 671687 - protein, 22 aa, Mycobacterium
GSILPSGLIQPATTTANPTVAK

SEQ ID NO: 671688 - protein, 18 aa, Mycobacterium
GSINPVWAYAHVPFGYTG

SEQ ID NO: 671689 - protein, 26 aa, Mycobacterium
GSIPFIAEFARAFPAAKILVTGVEDP

SEQ ID NO: 671690 - protein, 27 aa, Mycobacterium
GSIPVKRLRQAGVLELLLALANEADGS

SEQ ID NO: 671691 - protein, 18 aa, Mycobacterium
GSIRAEWTVRGDGLPTRS

SEQ ID NO: 671692 - protein, 22 aa, Mycobacterium
GSIRIPAIWCGLFGVKPQRDRV

SEQ ID NO: 671693 - protein, 25 aa, Mycobacterium
GSIRIPATWCGVFGLKPQRDRVSLE

SEQ ID NO: 671694 - protein, 26 aa, Mycobacterium
GSIRIPSTWCGVFGLKPQRDRISLEP

SEQ ID NO: 671695 - protein, 26 aa, Mycobacterium
GSIRIPSTWCGVFGLKTQRDRISLEP

SEQ ID NO: 671696 - protein, 25 aa, Mycobacterium
GSIRLPSSFTNLFGLRVTTGLVSRT

SEQ ID NO: 671697 - protein, 25 aa, Mycobacterium
GSIRTGRANPGMFNRINIDYYGSMT

SEQ ID NO: 671698 - protein, 17 aa, Mycobacterium
GSIRVPTLVLARPGDQL

SEQ ID NO: 671699 - protein, 18 aa, Mycobacterium
GSISRLFDIPGLAEHGRG

SEQ ID NO: 671700 - protein, 28 aa, Mycobacterium
GSISYHFGGKRGFYLAVVEQAAEEFWSD

SEQ ID NO: 671701 - protein, 19 aa, Mycobacterium
GSITMAFAITEPDAGSNSH

SEQ ID NO: 671702 - protein, 23 aa, Mycobacterium
GSITRAAAVLGIAQPALSRQIRL

SEQ ID NO: 671703 - protein, 19 aa, Mycobacterium
GSIVLWPQVVKEVAPVPVL

SEQ ID NO: 671704 - protein, 19 aa, Mycobacterium
GSIWAFLQSRGVQLATASH

SEQ ID NO: 671705 - protein, 23 aa, Mycobacterium
GSIYAFECPLLLGTEAVLMQRWD

SEQ ID NO: 671706 - protein, 26 aa, Mycobacterium
GSIYSGGYWLVPLLKSLGGALGALKE

SEQ ID NO: 671707 - protein, 24 aa, Mycobacterium
GSKAALGAVRWAARNAALRNAPLA

SEQ ID NO: 671708 - protein, 17 aa, Mycobacterium
GSKDTWVLAPRASAADR

SEQ ID NO: 671709 - protein, 20 aa, Mycobacterium
GSKEELLWEILRSYIDEMLT

SEQ ID NO: 671710 - protein, 20 aa, Mycobacterium
GSKIAWRPAEPGKQPPGHLW

SEQ ID NO: 671711 - protein, 20 aa, Mycobacterium
GSKISWADLIIFAGNCALDS

SEQ ID NO: 671712 - protein, 22 aa, Mycobacterium
GSKPAIPVMGTFIVDDDGRLTR

SEQ ID NO: 671713 - protein, 17 aa, Mycobacterium
GSKPHYGPIVMIGDPAA

SEQ ID NO: 671714 - protein, 23 aa, Mycobacterium
GSKRAELPAAITADALTWMVERV

SEQ ID NO: 671715 - protein, 17 aa, Mycobacterium
GSKSTVADLNWLRDRGL

SEQ ID NO: 671716 - protein, 19 aa, Mycobacterium
GSKVRGREPLRIHPQDAAT

SEQ ID NO: 671717 - protein, 25 aa, Mycobacterium
GSLAAFCAAIGPSYGWNSRDTILQC

SEQ ID NO: 671718 - protein, 17 aa, Mycobacterium
GSLAGARLRETLLGCPR

SEQ ID NO: 671719 - protein, 25 aa, Mycobacterium
GSLAGPRPVVLHGFDPARATTAEVT

SEQ ID NO: 671720 - protein, 24 aa, Mycobacterium
GSLANRPAIHVATYFGDPGAALGA

SEQ ID NO: 671721 - protein, 17 aa, Mycobacterium
GSLARIAGLGFATELAA

SEQ ID NO: 671722 - protein, 17 aa, Mycobacterium
GSLDFTTGEFQYCTAGH

SEQ ID NO: 671723 - protein, 18 aa, Mycobacterium
GSLDKLLMTWVEQSVGHA

SEQ ID NO: 671724 - protein, 18 aa, Mycobacterium
GSLDLATGEFQYCTAGHP

SEQ ID NO: 671725 - protein, 27 aa, Mycobacterium
GSLDLVVRAGREWKVREIPLAEVEKAV

SEQ ID NO: 671726 - protein, 21 aa, Mycobacterium
GSLDPFAALLPAGSAPPPTAA

SEQ ID NO: 671727 - protein, 17 aa, Mycobacterium
GSLDWLTSRAIDADGPF

SEQ ID NO: 671728 - protein, 24 aa, Mycobacterium
GSLGDYKPGIPLGRVAQPQHIADA

SEQ ID NO: 671729 - protein, 24 aa, Mycobacterium
GSLGHERVMLWTGYVDLLHELSID

SEQ ID NO: 671730 - protein, 18 aa, Mycobacterium
GSLGKLAGILAEVAMPYA

SEQ ID NO: 671731 - protein, 18 aa, Mycobacterium
GSLGMLFDTVLGLTAVLL

SEQ ID NO: 671732 - protein, 25 aa, Mycobacterium
GSLGRIRAALDWTVTYVRERTAFGK

SEQ ID NO: 671733 - protein, 18 aa, Mycobacterium
GSLICRWHGLPLTGKTCE

SEQ ID NO: 671734 - protein, 17 aa, Mycobacterium
GSLIGLRIAAERGDRIA

SEQ ID NO: 671735 - protein, 24 aa, Mycobacterium
GSLKHTVGLLLERGATDITVLCAV

SEQ ID NO: 671736 - protein, 17 aa, Mycobacterium
GSLLAVEYEAFLSGTTE

SEQ ID NO: 671737 - protein, 24 aa, Mycobacterium
GSLLEAGWVDSFRLLHPDVDGPYS

SEQ ID NO: 671738 - protein, 20 aa, Mycobacterium
GSLLGGMPLAGPGAAAAGAG

SEQ ID NO: 671739 - protein, 19 aa, Mycobacterium
GSLLGQMALGSLTGGALGA

SEQ ID NO: 671740 - protein, 26 aa, Mycobacterium
GSLLPIPELIRLAADAHHYLYVYDGH

SEQ ID NO: 671741 - protein, 19 aa, Mycobacterium
GSLMALIRLACQKAMRTGT

SEQ ID NO: 671742 - protein, 19 aa, Mycobacterium
GSLMRTAPVALAYLDDEDA

SEQ ID NO: 671743 - protein, 26 aa, Mycobacterium
GSLNCLINACAHRGAMICRRKTDNRM

SEQ ID NO: 671744 - protein, 23 aa, Mycobacterium
GSLPDFAGLAWRMPRDADGSNPW

SEQ ID NO: 671745 - protein, 21 aa, Mycobacterium
GSLPDGGRMVAVFAEAEQVED

SEQ ID NO: 671746 - protein, 22 aa, Mycobacterium
GSLPEGGRMVAVFADAEHVEQV

SEQ ID NO: 671747 - protein, 22 aa, Mycobacterium
GSLPEGGRMVAVFADAKHVEQA

SEQ ID NO: 671748 - protein, 17 aa, Mycobacterium
GSLPHSVPGQWTPHVTL

SEQ ID NO: 671749 - protein, 23 aa, Mycobacterium
GSLPLKPSQYWARQCYAGASFLR

SEQ ID NO: 671750 - protein, 26 aa, Mycobacterium
GSLPPRFRELMGWSWSGADQRRYELL

SEQ ID NO: 671751 - protein, 22 aa, Mycobacterium
GSLPSGWRNLASGYQAKTYLDA

SEQ ID NO: 671752 - protein, 24 aa, Mycobacterium
GSLQMSSPCQVLWTTLGSPVHRNL

SEQ ID NO: 671753 - protein, 23 aa, Mycobacterium
GSLRAVTLGGDWVGADLARRLAR

SEQ ID NO: 671754 - protein, 23 aa, Mycobacterium
GSLRELWAPITRYWNDTSKVLTT

SEQ ID NO: 671755 - protein, 34 aa, Mycobacterium
GSLRESRKLVREWLTSWSKPGLIPVALVIVNVFV

SEQ ID NO: 671756 - protein, 18 aa, Mycobacterium
GSLRPVNGTAFAVTPTLR

SEQ ID NO: 671757 - protein, 25 aa, Mycobacterium
GSLRRAGAGLAEFTGFGRAATDADG

SEQ ID NO: 671758 - protein, 24 aa, Mycobacterium
GSLRRLGVDHIDLYYQHRVDPNVA

SEQ ID NO: 671759 - protein, 17 aa, Mycobacterium
GSLSGLINLGANNSGFA

SEQ ID NO: 671760 - protein, 18 aa, Mycobacterium
GSLSVLWMGVATLLIDDG

SEQ ID NO: 671761 - protein, 19 aa, Mycobacterium
GSLTMAFAITEPDAGSNSH

SEQ ID NO: 671762 - protein, 20 aa, Mycobacterium
GSLVDGRGGVLVEVGEQSQH

SEQ ID NO: 671763 - protein, 25 aa, Mycobacterium
GSLVELPVSWALDDWQQYCFVPDFS

SEQ ID NO: 671764 - protein, 21 aa, Mycobacterium
GSLVMPFDFVLDEGRRTYYFV

SEQ ID NO: 671765 - protein, 17 aa, Mycobacterium
GSLWGVRVACTTQCPAG

SEQ ID NO: 671766 - protein, 20 aa, Mycobacterium
GSLYCQWVVVSAVNDAGAVV

SEQ ID NO: 671767 - protein, 25 aa, Mycobacterium
GSLYHPSAKLDWMVATTLLSGRRTF

SEQ ID NO: 671768 - protein, 21 aa, Mycobacterium
GSLYPPLIVRGLGTRQVFSAS

SEQ ID NO: 671769 - protein, 24 aa, Mycobacterium
GSLYRPYHMIGLELAVSIASAVLR

SEQ ID NO: 671770 - protein, 29 aa, Mycobacterium
GSMADPGSVSYLFSRKGVVTLEKNSLSED

SEQ ID NO: 671771 - protein, 27 aa, Mycobacterium
GSMARRLRLNSRMGLLADDVRVVDTLS

SEQ ID NO: 671772 - protein, 25 aa, Mycobacterium
GSMEKLRRIPGWSHVYRVADRLGGT

SEQ ID NO: 671773 - protein, 21 aa, Mycobacterium
GSMFGSFGIPGERFAMKAVGA

SEQ ID NO: 671774 - protein, 22 aa, Mycobacterium
GSMGGARALEWAVMHPDAVRAA

SEQ ID NO: 671775 - protein, 18 aa, Mycobacterium
GSMGGARALEWIVGHPDR

SEQ ID NO: 671776 - protein, 19 aa, Mycobacterium
GSMGGARALEWIVGHPDRV

SEQ ID NO: 671777 - protein, 18 aa, Mycobacterium
GSMGGARALEWLVTHPDD

SEQ ID NO: 671778 - protein, 20 aa, Mycobacterium
GSMGGMIAQVFAARHHPRTK

SEQ ID NO: 671779 - protein, 17 aa, Mycobacterium
GSMGGMIAQVFASQHAA

SEQ ID NO: 671780 - protein, 23 aa, Mycobacterium
GSMLNLLRWTSARTIKETFVPAT

SEQ ID NO: 671781 - protein, 18 aa, Mycobacterium
GSMRAVGRLLTLVESDRR

SEQ ID NO: 671782 - protein, 27 aa, Mycobacterium
GSMSKSFWGGLRIGWIRAERSTLATIA

SEQ ID NO: 671783 - protein, 19 aa, Mycobacterium
GSMTPGALAVRERVRPPSM

SEQ ID NO: 671784 - protein, 17 aa, Mycobacterium
GSMVAGAKYRGEFEERL

SEQ ID NO: 671785 - protein, 17 aa, Mycobacterium
GSNAEFVVGLLAASRAI

SEQ ID NO: 671786 - protein, 24 aa, Mycobacterium
GSNFATRWGRFAFFGPLTVTPELW

SEQ ID NO: 671787 - protein, 24 aa, Mycobacterium
GSNGYSPCEGTICTNPNHGAGDQP

SEQ ID NO: 671788 - protein, 19 aa, Mycobacterium
GSNHVLPTAGCARHSSGLS

SEQ ID NO: 671789 - protein, 18 aa, Mycobacterium
GSNIIGRGQDAQFRLPDT

SEQ ID NO: 671790 - protein, 19 aa, Mycobacterium
GSNLARLEFQVGLERVLTR

SEQ ID NO: 671791 - protein, 24 aa, Mycobacterium
GSNLEFALGYSHPVLIEAPEGITF

SEQ ID NO: 671792 - protein, 31 aa, Mycobacterium
GSNLEMANAAAALPTTGLLAAGADEVSAAIA

SEQ ID NO: 671793 - protein, 20 aa, Mycobacterium
GSNLPPRRMGEIAIAGDAVA

SEQ ID NO: 671794 - protein, 26 aa, Mycobacterium
GSNMADCHPILFLRMADRLKAGARLI

SEQ ID NO: 671795 - protein, 28 aa, Mycobacterium
GSNMADCHPILYLRMADRLKAGARLIVV

SEQ ID NO: 671796 - protein, 20 aa, Mycobacterium
GSNSPFFFGHHLWAETRIEL

SEQ ID NO: 671797 - protein, 26 aa, Mycobacterium
GSNVARTVFKSMLSAVADRMPDYRCD

SEQ ID NO: 671798 - protein, 18 aa, Mycobacterium
GSNWGRERHPSWSANLKA

SEQ ID NO: 671799 - protein, 20 aa, Mycobacterium
GSPAAYAVCELLRQHGFAGA

SEQ ID NO: 671800 - protein, 19 aa, Mycobacterium
GSPAKVWSEELFGPVLAVR

SEQ ID NO: 671801 - protein, 19 aa, Mycobacterium
GSPCGRPPVAAAPVTSSVT

SEQ ID NO: 671802 - protein, 19 aa, Mycobacterium
GSPDEYAALAVHIIENPML

SEQ ID NO: 671803 - protein, 19 aa, Mycobacterium
GSPDEYGALAVHIIENPML

SEQ ID NO: 671804 - protein, 17 aa, Mycobacterium
GSPDFGKVVGWTELPIA

SEQ ID NO: 671805 - protein, 27 aa, Mycobacterium
GSPDRLRSGWLNGIKHWQVDYSGRGCP

SEQ ID NO: 671806 - protein, 17 aa, Mycobacterium
GSPDYETAYAFFVSGLG

SEQ ID NO: 671807 - protein, 22 aa, Mycobacterium
GSPEDFHALLIAERVTVLSQTP

SEQ ID NO: 671808 - protein, 21 aa, Mycobacterium
GSPEDIGWAMVYLASDESRYM

SEQ ID NO: 671809 - protein, 24 aa, Mycobacterium
GSPELPPGSTIPLERTEPSFDVTT

SEQ ID NO: 671810 - protein, 23 aa, Mycobacterium
GSPENKGPLLINARAEKVTTSPA

SEQ ID NO: 671811 - protein, 25 aa, Mycobacterium
GSPERRDLLRSWGIKHVYDSRSTDF

SEQ ID NO: 671812 - protein, 23 aa, Mycobacterium
GSPFWLRMAPNLDFDPLTDVNGF

SEQ ID NO: 671813 - protein, 19 aa, Mycobacterium
GSPGAFQGSFSYLLQDEDG

SEQ ID NO: 671814 - protein, 17 aa, Mycobacterium
GSPGGSVIIQFVVKTLV

SEQ ID NO: 671815 - protein, 20 aa, Mycobacterium
GSPGLELYSPAQLGLDHGQA

SEQ ID NO: 671816 - protein, 20 aa, Mycobacterium
GSPHLCSRAFITEQYDRYVR

SEQ ID NO: 671817 - protein, 20 aa, Mycobacterium
GSPLAWLLTMAHRRAIDRVR

SEQ ID NO: 671818 - protein, 20 aa, Mycobacterium
GSPLAWLLTMAHRRAVDRVR

SEQ ID NO: 671819 - protein, 25 aa, Mycobacterium
GSPLLAGDFVRWCRQVLDLLDQVRN

SEQ ID NO: 671820 - protein, 27 aa, Mycobacterium
GSPLNVAVGLARLGRDVDFLTHIGTDD

SEQ ID NO: 671821 - protein, 21 aa, Mycobacterium
GSPLREACCQEASPIGPLASS

SEQ ID NO: 671822 - protein, 24 aa, Mycobacterium
GSPLRLSASVLIRMARPVASPALD

SEQ ID NO: 671823 - protein, 24 aa, Mycobacterium
GSPLSAGDFVRWCRQVLDLLDQVR

SEQ ID NO: 671824 - protein, 21 aa, Mycobacterium
GSPLWARPAGRAAFTAVLLGP

SEQ ID NO: 671825 - protein, 23 aa, Mycobacterium
GSPMGRPAGWRALFENAAIRVLW

SEQ ID NO: 671826 - protein, 17 aa, Mycobacterium
GSPPERFMSQRASHAVT

SEQ ID NO: 671827 - protein, 34 aa, Mycobacterium
GSPQHVGWFRFYFADERWEWSPQVAQMHGYGPDE

SEQ ID NO: 671828 - protein, 19 aa, Mycobacterium
GSPQLAYPSIHVAGTNGKT

SEQ ID NO: 671829 - protein, 20 aa, Mycobacterium
GSPQLSYPSIHIGGTNGKTS

SEQ ID NO: 671830 - protein, 22 aa, Mycobacterium
GSPRLIAVAVEIGEPGNAGTVI

SEQ ID NO: 671831 - protein, 22 aa, Mycobacterium
GSPRPPRWTAPRADEYTADPAP

SEQ ID NO: 671832 - protein, 21 aa, Mycobacterium
GSPRPTLGVEWEFALVDAQTR

SEQ ID NO: 671833 - protein, 22 aa, Mycobacterium
GSPRPTVGVEWEFALVDAKTRE

SEQ ID NO: 671834 - protein, 25 aa, Mycobacterium
GSPRRYGVRWHYRVPVWSEFVEVHW

SEQ ID NO: 671835 - protein, 23 aa, Mycobacterium
GSPRTAQSVAEKFPHVAVVDAPV

SEQ ID NO: 671836 - protein, 23 aa, Mycobacterium
GSPSSLSAVRWAATEAGLRHLRL

SEQ ID NO: 671837 - protein, 24 aa, Mycobacterium
GSPTRFGSPAAQFRAFIDSLGGLW

SEQ ID NO: 671838 - protein, 18 aa, Mycobacterium
GSPTRFGSVAAQLREFLD

SEQ ID NO: 671839 - protein, 27 aa, Mycobacterium
GSPVKRVPLARSLRAAQRHDYLGTYVD

SEQ ID NO: 671840 - protein, 27 aa, Mycobacterium
GSPVPPEWFCELTWPAKPLAAHHDPEG

SEQ ID NO: 671841 - protein, 24 aa, Mycobacterium
GSPWIGNIDLTFPYLDTDATRTIG

SEQ ID NO: 671842 - protein, 22 aa, Mycobacterium
GSPYVTPLVRKLAAENGIDLST

SEQ ID NO: 671843 - protein, 24 aa, Mycobacterium
GSQAGTQGVVWLAGMEATAEPEAT

SEQ ID NO: 671844 - protein, 23 aa, Mycobacterium
GSQARGGGVIVRIDPDDPVEPIR

SEQ ID NO: 671845 - protein, 23 aa, Mycobacterium
GSQLRAALQVNVKIPLVGGKLEK

SEQ ID NO: 671846 - protein, 40 aa, Mycobacterium
GSQLWRELRCPLIHYRMVLLQSFIGRNGWHRRIVMGMSRI

SEQ ID NO: 671847 - protein, 19 aa, Mycobacterium
GSQNWKAMKAYIAGASLGP

SEQ ID NO: 671848 - protein, 23 aa, Mycobacterium
GSQPQAAKLAEWLKLALDEPHLL

SEQ ID NO: 671849 - protein, 23 aa, Mycobacterium
GSQRWPAVHVLDAARLFRLALEG

SEQ ID NO: 671850 - protein, 23 aa, Mycobacterium
GSQWPGMARRLLADEPVFAEALD

SEQ ID NO: 671851 - protein, 17 aa, Mycobacterium
GSRAAGLAMAYKLIDAA

SEQ ID NO: 671852 - protein, 20 aa, Mycobacterium
GSRAEAVLAVRALRAEHPDL

SEQ ID NO: 671853 - protein, 27 aa, Mycobacterium
GSRAEYAGKVVGDWRPLAVGANGSAIS

SEQ ID NO: 671854 - protein, 17 aa, Mycobacterium
GSRAREIAAALPLVPLA

SEQ ID NO: 671855 - protein, 22 aa, Mycobacterium
GSRDLKIWLADGTNYPGQGDIR

SEQ ID NO: 671856 - protein, 20 aa, Mycobacterium
GSREEYAFHHPLIRTVAYES

SEQ ID NO: 671857 - protein, 20 aa, Mycobacterium
GSRELIPRDVLEDLKGAQQV

SEQ ID NO: 671858 - protein, 22 aa, Mycobacterium
GSRFALELVERVVGDDLVDAFD

SEQ ID NO: 671859 - protein, 20 aa, Mycobacterium
GSRFKPSMQGSGVFTGKLAL

SEQ ID NO: 671860 - protein, 19 aa, Mycobacterium
GSRGALLIHGHLDVVPAEP

SEQ ID NO: 671861 - protein, 26 aa, Mycobacterium
GSRGGMVGHAWLRAAQRFLDMQRDAV

SEQ ID NO: 671862 - protein, 25 aa, Mycobacterium
GSRGGWKPFLHHISKHMPSPRRTVS

SEQ ID NO: 671863 - protein, 21 aa, Mycobacterium
GSRGLGRAMVRAFAAHGADVV

SEQ ID NO: 671864 - protein, 22 aa, Mycobacterium
GSRGRSALKKVLLGSVAGATLQ

SEQ ID NO: 671865 - protein, 17 aa, Mycobacterium
GSRHLGFAKALVNEMPH

SEQ ID NO: 671866 - protein, 18 aa, Mycobacterium
GSRHRWRVSQASLDDSGH

SEQ ID NO: 671867 - protein, 19 aa, Mycobacterium
GSRIFTWHLAIAMRPKLWM

SEQ ID NO: 671868 - protein, 24 aa, Mycobacterium
GSRIPASLSDPALRKSHPVLPIEP

SEQ ID NO: 671869 - protein, 28 aa, Mycobacterium
GSRLANPPLLVPVLRAGLGMVDQAHALI

SEQ ID NO: 671870 - protein, 22 aa, Mycobacterium
GSRMIFAPADFRGHDYTSMLRR

SEQ ID NO: 671871 - protein, 22 aa, Mycobacterium
GSRMRPDVVIAFMDRFGDVIYN

SEQ ID NO: 671872 - protein, 20 aa, Mycobacterium
GSRMRPDVVIAFMNQFGDVI

SEQ ID NO: 671873 - protein, 26 aa, Mycobacterium
GSRNALSAALRSRLFEALRQAQADDE

SEQ ID NO: 671874 - protein, 23 aa, Mycobacterium
GSRNKLDLCAELGAEITIDYHHE

SEQ ID NO: 671875 - protein, 18 aa, Mycobacterium
GSRPRMWRSVIKEFDIAE

SEQ ID NO: 671876 - protein, 24 aa, Mycobacterium
GSRQRAQVWQAMWEFEQALTQLGA

SEQ ID NO: 671877 - protein, 24 aa, Mycobacterium
GSRQSKARFSVYIGDLGNDTNAGA

SEQ ID NO: 671878 - protein, 25 aa, Mycobacterium
GSRRKWLNRMFQLLGESDCTEQESQ

SEQ ID NO: 671879 - protein, 22 aa, Mycobacterium
GSRRLDPRLVWQRPAEHRGGHH

SEQ ID NO: 671880 - protein, 20 aa, Mycobacterium
GSRRSRRVLLQGWEQFDEPV

SEQ ID NO: 671881 - protein, 19 aa, Mycobacterium
GSRSFAVLGEMAELGEDTI

SEQ ID NO: 671882 - protein, 25 aa, Mycobacterium
GSRTLRYPRICMVSSHFARKRDRGR

SEQ ID NO: 671883 - protein, 27 aa, Mycobacterium
GSRVEFWAFDLLYLDGRSLLRARYQDR

SEQ ID NO: 671884 - protein, 28 aa, Mycobacterium
GSRVEFWAFDLLYLDGRSLLRARYRDRR

SEQ ID NO: 671885 - protein, 26 aa, Mycobacterium
GSRVVKAHVPLSEMFGYVGDLRSKTQ

SEQ ID NO: 671886 - protein, 25 aa, Mycobacterium
GSRVWRVPVTAFWQAHREAAALYSD

SEQ ID NO: 671887 - protein, 22 aa, Mycobacterium
GSRWRCVNIPAISTAGVPDALQ

SEQ ID NO: 671888 - protein, 22 aa, Mycobacterium
GSRYRCAYFDTYPGVWRHGDWI

SEQ ID NO: 671889 - protein, 17 aa, Mycobacterium
GSSAGRRHLLRFSPAAS

SEQ ID NO: 671890 - protein, 18 aa, Mycobacterium
GSSAQWAQRFSALLRGLE

SEQ ID NO: 671891 - protein, 28 aa, Mycobacterium
GSSDFRRWLPLDMSRPFKSTLITLDVPG

SEQ ID NO: 671892 - protein, 24 aa, Mycobacterium
GSSDLRRWLPMDINRPLKSTLITL

SEQ ID NO: 671893 - protein, 18 aa, Mycobacterium
GSSFSGLLYAGLAITSRG

SEQ ID NO: 671894 - protein, 27 aa, Mycobacterium
GSSFTTNMPFCIAVAVREMHLTPDEAV

SEQ ID NO: 671895 - protein, 26 aa, Mycobacterium
GSSGLGVLRARAGIRPRLTDENKLLV

SEQ ID NO: 671896 - protein, 20 aa, Mycobacterium
GSSGRLRSELDIVPPGDLRM

SEQ ID NO: 671897 - protein, 26 aa, Mycobacterium
GSSIKKVAPLFGFEWRVDDPGGAVSQ

SEQ ID NO: 671898 - protein, 20 aa, Mycobacterium
GSSLKHLRRLVLAGRWTMSV

SEQ ID NO: 671899 - protein, 25 aa, Mycobacterium
GSSLNPRWPIGQSIAEPLTLHTDMD

SEQ ID NO: 671900 - protein, 19 aa, Mycobacterium
GSSLQWCAVDAVRPEGATD

SEQ ID NO: 671901 - protein, 18 aa, Mycobacterium
GSSLRGRMALERAAQALA

SEQ ID NO: 671902 - protein, 26 aa, Mycobacterium
GSSLTVYSGFRFVRHASAKGIPVAII

SEQ ID NO: 671903 - protein, 18 aa, Mycobacterium
GSSPKLGGHRAVLMPGTG

SEQ ID NO: 671904 - protein, 24 aa, Mycobacterium
GSSPMCYPHGDFLVGDRDVLLGVL

SEQ ID NO: 671905 - protein, 23 aa, Mycobacterium
GSSPMCYPLGDFLVGDRDVLLGV

SEQ ID NO: 671906 - protein, 24 aa, Mycobacterium
GSSPMCYPRGDFLVGDRDVLLGTL

SEQ ID NO: 671907 - protein, 20 aa, Mycobacterium
GSSPRGVRFAAENAEAVFTA

SEQ ID NO: 671908 - protein, 17 aa, Mycobacterium
GSSPRPYGFYFDEIADR

SEQ ID NO: 671909 - protein, 22 aa, Mycobacterium
GSSPRSVLRPGAFTPAVLGAGM

SEQ ID NO: 671910 - protein, 18 aa, Mycobacterium
GSSRICPNGGGALLCEPG

SEQ ID NO: 671911 - protein, 27 aa, Mycobacterium
GSSRITLWAMAWLARAHFVSGDWDAAL

SEQ ID NO: 671912 - protein, 20 aa, Mycobacterium
GSSRPEAIEAYDIHQLTADL

SEQ ID NO: 671913 - protein, 22 aa, Mycobacterium
GSSRPGHFAGVLTVVLKLFSIV

SEQ ID NO: 671914 - protein, 23 aa, Mycobacterium
GSSRPPRLVRLAHRGGGRKGKKV

SEQ ID NO: 671915 - protein, 23 aa, Mycobacterium
GSSRPPRLVRLTYRGAKGKKAKS

SEQ ID NO: 671916 - protein, 24 aa, Mycobacterium
GSSRPPRLVRLVYRGSRLAKNAKQ

SEQ ID NO: 671917 - protein, 23 aa, Mycobacterium
GSSSDLRVGQPVLAIGSPLGLAG

SEQ ID NO: 671918 - protein, 23 aa, Mycobacterium
GSSSFRYAGPAQRDWTMADLAGK

SEQ ID NO: 671919 - protein, 23 aa, Mycobacterium
GSSSFYLPRLIGVRRTQELMLTN

SEQ ID NO: 671920 - protein, 22 aa, Mycobacterium
GSSSKAGLGYELVVSRLDEEAN

SEQ ID NO: 671921 - protein, 17 aa, Mycobacterium
GSSSMAMLQAVQPYLIW

SEQ ID NO: 671922 - protein, 20 aa, Mycobacterium
GSSTARRALVEGADVVVSDY

SEQ ID NO: 671923 - protein, 24 aa, Mycobacterium
GSSTNWYARCLKFTSTTRGSLSGT

SEQ ID NO: 671924 - protein, 24 aa, Mycobacterium
GSSTTWYARCVRFTEGVRGSVSGT

SEQ ID NO: 671925 - protein, 18 aa, Mycobacterium
GSSTYTYDGNWKVQAENG

SEQ ID NO: 671926 - protein, 20 aa, Mycobacterium
GSSVFKPMYLFRGDVPVREF

SEQ ID NO: 671927 - protein, 29 aa, Mycobacterium
GSSVLIQMMWAMRGLGMWSDARGTNMLDG

SEQ ID NO: 671928 - protein, 17 aa, Mycobacterium
GSSVLLRIANQVTPATG

SEQ ID NO: 671929 - protein, 23 aa, Mycobacterium
GSSVLRLAPALGAARTIAVVSTE

SEQ ID NO: 671930 - protein, 18 aa, Mycobacterium
GSSVVGFLDGWRGLLEDR

SEQ ID NO: 671931 - protein, 18 aa, Mycobacterium
GSSWEGGWRCGEVVMSMV

SEQ ID NO: 671932 - protein, 17 aa, Mycobacterium
GSSYPHWQCGDITKLPR

SEQ ID NO: 671933 - protein, 18 aa, Mycobacterium
GSSYPHWQFGDAGKLPGA

SEQ ID NO: 671934 - protein, 25 aa, Mycobacterium
GSTAELRSATPLGDVFVSIRPPAGA

SEQ ID NO: 671935 - protein, 25 aa, Mycobacterium
GSTAELRTATPLGDVFVALKPPSAS

SEQ ID NO: 671936 - protein, 17 aa, Mycobacterium
GSTARSGGGVWIPNNEI

SEQ ID NO: 671937 - protein, 24 aa, Mycobacterium
GSTDARTPLTYDFWGFPERFYDVT

SEQ ID NO: 671938 - protein, 18 aa, Mycobacterium
GSTDGFGAYAAFVPERRI

SEQ ID NO: 671939 - protein, 19 aa, Mycobacterium
GSTEWKRSPGGLVTALEPL

SEQ ID NO: 671940 - protein, 23 aa, Mycobacterium
GSTEWRQISGGLLVQERDALDAE

SEQ ID NO: 671941 - protein, 17 aa, Mycobacterium
GSTGAAGATGRAGTGGF

SEQ ID NO: 671942 - protein, 24 aa, Mycobacterium
GSTGERGLHHLVWEVVDNSVDEAM

SEQ ID NO: 671943 - protein, 17 aa, Mycobacterium
GSTGLSGGMVWLPNNPL

SEQ ID NO: 671944 - protein, 21 aa, Mycobacterium
GSTGRSWLFFGDRHRAASFLY

SEQ ID NO: 671945 - protein, 20 aa, Mycobacterium
GSTPKALRLYGIEDSAYSSD

SEQ ID NO: 671946 - protein, 21 aa, Mycobacterium
GSTPKALRLYGIQDDAYSSEE

SEQ ID NO: 671947 - protein, 17 aa, Mycobacterium
GSTPWLITGHEEARALF

SEQ ID NO: 671948 - protein, 19 aa, Mycobacterium
GSTQIAFGGDGGNGGDGGD

SEQ ID NO: 671949 - protein, 20 aa, Mycobacterium
GSTRGALAMDPRGMAELFEA

SEQ ID NO: 671950 - protein, 23 aa, Mycobacterium
GSTRRWIAVHARHLDALDGVAAR

SEQ ID NO: 671951 - protein, 17 aa, Mycobacterium
GSTRSRVLAAFNDRSGL

SEQ ID NO: 671952 - protein, 17 aa, Mycobacterium
GSTRVIDGFHLVVDALM

SEQ ID NO: 671953 - protein, 37 aa, Mycobacterium
GSTSMLEAAAAWGSLADELQVAASSFSSVTAGLASGA

SEQ ID NO: 671954 - protein, 24 aa, Mycobacterium
GSTVCSAGKYARKHVPWVNFSNVP

SEQ ID NO: 671955 - protein, 24 aa, Mycobacterium
GSTVCSAGKYGRKHAPWVNFSNVP

SEQ ID NO: 671956 - protein, 24 aa, Mycobacterium
GSTVPEWANMVGPFGGITAAALIR

SEQ ID NO: 671957 - protein, 18 aa, Mycobacterium
GSTVVYEPLMKRLPADVP

SEQ ID NO: 671958 - protein, 22 aa, Mycobacterium
GSTWVLSLSAGRLVAADHIGGS

SEQ ID NO: 671959 - protein, 19 aa, Mycobacterium
GSVAARKAGQWAFEGKWDG

SEQ ID NO: 671960 - protein, 19 aa, Mycobacterium
GSVAARLTDLLSRDLIINQ

SEQ ID NO: 671961 - protein, 21 aa, Mycobacterium
GSVAHRSRWLVRVMTSLMLFP

SEQ ID NO: 671962 - protein, 23 aa, Mycobacterium
GSVALTPIMRWFNSVASLVAGLH

SEQ ID NO: 671963 - protein, 21 aa, Mycobacterium
GSVAQRLWAKPAITVVGIDTT

SEQ ID NO: 671964 - protein, 23 aa, Mycobacterium
GSVAQRRLPLLIASGADVHVISR

SEQ ID NO: 671965 - protein, 23 aa, Mycobacterium
GSVAQRRLPLLISSGADVHVITR

SEQ ID NO: 671966 - protein, 17 aa, Mycobacterium
GSVARAGEIGYLPQDPK

SEQ ID NO: 671967 - protein, 25 aa, Mycobacterium
GSVARLRFGPATHRKVKKWIAEGDF

SEQ ID NO: 671968 - protein, 25 aa, Mycobacterium
GSVARLRFGPATHRLVKKWIQQGRF

SEQ ID NO: 671969 - protein, 18 aa, Mycobacterium
GSVARPDTLLGWLQSDIG

SEQ ID NO: 671970 - protein, 26 aa, Mycobacterium
GSVAYRLGRGVARVEAALSAPGIFGR

SEQ ID NO: 671971 - protein, 26 aa, Mycobacterium
GSVAYRLGRSFARLEASLSTPSIFGR

SEQ ID NO: 671972 - protein, 20 aa, Mycobacterium
GSVCAHCRPAGATTPPLGVL

SEQ ID NO: 671973 - protein, 27 aa, Mycobacterium
GSVDALRCAYATVLIREANYSQAHELL

SEQ ID NO: 671974 - protein, 25 aa, Mycobacterium
GSVDNIRFFAGAARRLPGQATAEYS

SEQ ID NO: 671975 - protein, 32 aa, Mycobacterium
GSVDPQVLAAVTAWCARIDVLATDMRVEQRSL

SEQ ID NO: 671976 - protein, 29 aa, Mycobacterium
GSVEHFNWLEALGFEFERTYYPGKVVVPP

SEQ ID NO: 671977 - protein, 29 aa, Mycobacterium
GSVEHFNWLEALGFQFERSFYPEKAVIQP

SEQ ID NO: 671978 - protein, 28 aa, Mycobacterium
GSVEHFNWLEALGFQFERSYYPGKVVVP

SEQ ID NO: 671979 - protein, 25 aa, Mycobacterium
GSVEMKQRWLPGIADGSQKMAFSLT

SEQ ID NO: 671980 - protein, 24 aa, Mycobacterium
GSVENYVAVPWFWTHQYSAKLQIA

SEQ ID NO: 671981 - protein, 18 aa, Mycobacterium
GSVFTLRVAGMGTLVYLA

SEQ ID NO: 671982 - protein, 21 aa, Mycobacterium
GSVGEMFGRKVAKLMEWAATN

SEQ ID NO: 671983 - protein, 26 aa, Mycobacterium
GSVGEMFGRKVARLMEWCSMVGCPII

SEQ ID NO: 671984 - protein, 31 aa, Mycobacterium
GSVGEMFGRKVARLMEWVAMVGCPIIGINDS

SEQ ID NO: 671985 - protein, 19 aa, Mycobacterium
GSVGLWGSGGVGGAGTTPD

SEQ ID NO: 671986 - protein, 18 aa, Mycobacterium
GSVGPLSVPPSWATEVQA

SEQ ID NO: 671987 - protein, 20 aa, Mycobacterium
GSVGTRCYLALLTDADGSPL

SEQ ID NO: 671988 - protein, 18 aa, Mycobacterium
GSVGVISDGSFTPTPVGY

SEQ ID NO: 671989 - protein, 18 aa, Mycobacterium
GSVIFGFNRLSIIDIAHS

SEQ ID NO: 671990 - protein, 23 aa, Mycobacterium
GSVIGTLAGQSWLGSAAAAMSAA

SEQ ID NO: 671991 - protein, 18 aa, Mycobacterium
GSVIPGLYAAGACASNIA

SEQ ID NO: 671992 - protein, 18 aa, Mycobacterium
GSVLACIFNFAGVEHSSY

SEQ ID NO: 671993 - protein, 24 aa, Mycobacterium
GSVLEGFETPTLVAPPAQAGPRGV

SEQ ID NO: 671994 - protein, 19 aa, Mycobacterium
GSVLGGLFGAAAFDEVALV

SEQ ID NO: 671995 - protein, 25 aa, Mycobacterium
GSVLKTTWSAEGWVTVAGLVADDGV

SEQ ID NO: 671996 - protein, 26 aa, Mycobacterium
GSVLLGIKSSFNVGGGNLGDFNVGFG

SEQ ID NO: 671997 - protein, 17 aa, Mycobacterium
GSVLMPGVRVGRGAVVR

SEQ ID NO: 671998 - protein, 18 aa, Mycobacterium
GSVLPELIRRAVAVKADV

SEQ ID NO: 671999 - protein, 25 aa, Mycobacterium
GSVLQTTWSAYGWVEVAGRVVDDGQ

SEQ ID NO: 672000 - protein, 18 aa, Mycobacterium
GSVLSRRPPRWVVVADLV

SEQ ID NO: 672001 - protein, 24 aa, Mycobacterium
GSVLVLPGLFPVVGSTEAEALSRL

SEQ ID NO: 672002 - protein, 35 aa, Mycobacterium
GSVLYELPERAILRQRSQVGFVFQNFNLFPHLTVL

SEQ ID NO: 672003 - protein, 22 aa, Mycobacterium
GSVMGAMLGPLGGIVGGVVQAA

SEQ ID NO: 672004 - protein, 24 aa, Mycobacterium
GSVPNLPAGPALSAIPRAIASRLD

SEQ ID NO: 672005 - protein, 18 aa, Mycobacterium
GSVQARLRTIGVLGAKHI

SEQ ID NO: 672006 - protein, 19 aa, Mycobacterium
GSVQPRGVLVVVREPEFEV

SEQ ID NO: 672007 - protein, 24 aa, Mycobacterium
GSVQWHKMGSGWSWSRKAGTETDH

SEQ ID NO: 672008 - protein, 22 aa, Mycobacterium
GSVREACLWSAGLAQPDVRRRA

SEQ ID NO: 672009 - protein, 26 aa, Mycobacterium
GSVREACLWSSGFAADGVRRRATMLD

SEQ ID NO: 672010 - protein, 27 aa, Mycobacterium
GSVREACLWSSGLARPGVTRRASVLDR

SEQ ID NO: 672011 - protein, 18 aa, Mycobacterium
GSVRFRAEVAGSHNVTPW

SEQ ID NO: 672012 - protein, 24 aa, Mycobacterium
GSVRICGSDVPFGPDLLFTASDLP

SEQ ID NO: 672013 - protein, 17 aa, Mycobacterium
GSVRIPAAWTHLVGIKP

SEQ ID NO: 672014 - protein, 27 aa, Mycobacterium
GSVRIPASFCGVVGFKPTHGRIPMYPI

SEQ ID NO: 672015 - protein, 27 aa, Mycobacterium
GSVRNWPWRRWALSWTANTYARLALGI

SEQ ID NO: 672016 - protein, 23 aa, Mycobacterium
GSVSECRRWPAHGCDGDHFEGYL

SEQ ID NO: 672017 - protein, 18 aa, Mycobacterium
GSVSGFGNFAARTSGFLN

SEQ ID NO: 672018 - protein, 24 aa, Mycobacterium
GSVSPRASLLLRMQRLSDRFAKIA

SEQ ID NO: 672019 - protein, 23 aa, Mycobacterium
GSVSRAGGILAMDMVQEAQGWNC

SEQ ID NO: 672020 - protein, 17 aa, Mycobacterium
GSVSRIGEIGYLPQDPK

SEQ ID NO: 672021 - protein, 25 aa, Mycobacterium
GSVTAEEALRCGMVNHVVPLEDLRS

SEQ ID NO: 672022 - protein, 20 aa, Mycobacterium
GSVTEGRRADLLVLDADPLT

SEQ ID NO: 672023 - protein, 18 aa, Mycobacterium
GSVTENFDIPGFVNDSYL

SEQ ID NO: 672024 - protein, 23 aa, Mycobacterium
GSVTLEFPHLMPLIDRTQFDTIY

SEQ ID NO: 672025 - protein, 30 aa, Mycobacterium
GSVTLSVPLSDIWIDIRFTLPAATVDGGAP

SEQ ID NO: 672026 - protein, 18 aa, Mycobacterium
GSVTRLFDVPGLARHARG

SEQ ID NO: 672027 - protein, 18 aa, Mycobacterium
GSVTSGLVGGSWQGPAAA

SEQ ID NO: 672028 - protein, 18 aa, Mycobacterium
GSVVSALILEPWMGSAAA

SEQ ID NO: 672029 - protein, 19 aa, Mycobacterium
GSVWCYATPATREWWGGMW

SEQ ID NO: 672030 - protein, 18 aa, Mycobacterium
GSVWNVACDIALPCATQN

SEQ ID NO: 672031 - protein, 18 aa, Mycobacterium
GSVYEWTQHWRIATLLGV

SEQ ID NO: 672032 - protein, 26 aa, Mycobacterium
GSVYEWTQHWRLARMLDVSERDLLAV

SEQ ID NO: 672033 - protein, 19 aa, Mycobacterium
GSVYRCRLPFCDVTVGLVI

SEQ ID NO: 672034 - protein, 18 aa, Mycobacterium
GSVYYHFGTKNKLFEAVC

SEQ ID NO: 672035 - protein, 19 aa, Mycobacterium
GSWAPYLTMAEGIKIAAQS

SEQ ID NO: 672036 - protein, 19 aa, Mycobacterium
GSWARRDRRTFTASYLILA

SEQ ID NO: 672037 - protein, 19 aa, Mycobacterium
GSWARRDRRTFTATYLILA

SEQ ID NO: 672038 - protein, 26 aa, Mycobacterium
GSWASEIYADLGLRFDGERAAQISEA

SEQ ID NO: 672039 - protein, 25 aa, Mycobacterium
GSWAVAAGILRPSFRNWDHPIRRQI

SEQ ID NO: 672040 - protein, 17 aa, Mycobacterium
GSWDGSTAERFVAAHQP

SEQ ID NO: 672041 - protein, 19 aa, Mycobacterium
GSWPTRAGGTFALATGPHS

SEQ ID NO: 672042 - protein, 19 aa, Mycobacterium
GSWRHPAARNREFKGFDMW

SEQ ID NO: 672043 - protein, 24 aa, Mycobacterium
GSWRRKREFWRQAVARGRAAQNLM

SEQ ID NO: 672044 - protein, 17 aa, Mycobacterium
GSWSGRLQPPLAKNYGY

SEQ ID NO: 672045 - protein, 18 aa, Mycobacterium
GSYAPADRFQAAVRRAKI

SEQ ID NO: 672046 - protein, 27 aa, Mycobacterium
GSYAPKLPWPWGLVDFAARVLKPAPGT

SEQ ID NO: 672047 - protein, 18 aa, Mycobacterium
GSYCGKLLLDAGAQVCKI

SEQ ID NO: 672048 - protein, 17 aa, Mycobacterium
GSYCGKLLVDAGAHVRK

SEQ ID NO: 672049 - protein, 21 aa, Mycobacterium
GSYGKHFGQMIAIKKFLQGRE

SEQ ID NO: 672050 - protein, 17 aa, Mycobacterium
GSYLRYGAYPYAIAVRE

SEQ ID NO: 672051 - protein, 24 aa, Mycobacterium
GSYQLGDVYLQWERGGTPVAMAGV

SEQ ID NO: 672052 - protein, 23 aa, Mycobacterium
GSYQLGPGLLKLGLNNRRQFVAP

SEQ ID NO: 672053 - protein, 25 aa, Mycobacterium
GSYREMADIIAALRQLMAGTLWKSE

SEQ ID NO: 672054 - protein, 17 aa, Mycobacterium
GSYRFVEHRHYLDGLLD

SEQ ID NO: 672055 - protein, 21 aa, Mycobacterium
GSYSGAGCRALLSSRGRHIMV

SEQ ID NO: 672056 - protein, 25 aa, Mycobacterium
GSYTLGGAKAVDWEDIEVATGADGK

SEQ ID NO: 672057 - protein, 18 aa, Mycobacterium
GSYVAGWIKRGPTGFIGT

SEQ ID NO: 672058 - protein, 32 aa, Mycobacterium
GSYVGIAGRFGFKGPPTLSGRAPVACDYADAR

SEQ ID NO: 672059 - protein, 22 aa, Mycobacterium
GSYYCIFAGLGVLPDHTLPAIN

SEQ ID NO: 672060 - protein, 20 aa, Mycobacterium
GTAAALRFEVFGMVNGDPVV

SEQ ID NO: 672061 - protein, 17 aa, Mycobacterium
GTAAAWALSQRGVTDVV

SEQ ID NO: 672062 - protein, 19 aa, Mycobacterium
GTAAESFASVTSGLTGQAW

SEQ ID NO: 672063 - protein, 19 aa, Mycobacterium
GTAAGGVWNPLAQGSGGLL

SEQ ID NO: 672064 - protein, 26 aa, Mycobacterium
GTAAGIRPRPEFDTAKRSLRQRELAK

SEQ ID NO: 672065 - protein, 25 aa, Mycobacterium
GTAAIAVEFARLYAVELEHYEKLEG

SEQ ID NO: 672066 - protein, 18 aa, Mycobacterium
GTAALVLDVKVGAGAFMK

SEQ ID NO: 672067 - protein, 18 aa, Mycobacterium
GTAARLQRDEFWPGARQG

SEQ ID NO: 672068 - protein, 28 aa, Mycobacterium
GTAARPAAMPMDAWRDGEQFVVEFDLPG

SEQ ID NO: 672069 - protein, 24 aa, Mycobacterium
GTAARVGHRLTIAMRSWEATVFWE

SEQ ID NO: 672070 - protein, 25 aa, Mycobacterium
GTACLGDPLIALAWLARTTRKLGRP

SEQ ID NO: 672071 - protein, 22 aa, Mycobacterium
GTADMSIHFLAPIVDGPARAVA

SEQ ID NO: 672072 - protein, 30 aa, Mycobacterium
GTAEALRGPFWRWYPGLYAGSKLMHNSHWP

SEQ ID NO: 672073 - protein, 25 aa, Mycobacterium
GTAEALRLAQQLVMPAGIMAEHLFD

SEQ ID NO: 672074 - protein, 18 aa, Mycobacterium
GTAEGWRAALGPYRATIR

SEQ ID NO: 672075 - protein, 17 aa, Mycobacterium
GTAELLGAMSAALQPAT

SEQ ID NO: 672076 - protein, 18 aa, Mycobacterium
GTAELLYGTALLAEGGAL

SEQ ID NO: 672077 - protein, 17 aa, Mycobacterium
GTAELPALVSDRVKRGS

SEQ ID NO: 672078 - protein, 25 aa, Mycobacterium
GTAEMSGPISYIFRPDGTLSARWGP

SEQ ID NO: 672079 - protein, 18 aa, Mycobacterium
GTAEWRGAVTTQLAGEVA

SEQ ID NO: 672080 - protein, 34 aa, Mycobacterium
GTAFPTTMRLTGRWLRGRLPNAYDWARGIPVVDR

SEQ ID NO: 672081 - protein, 21 aa, Mycobacterium
GTAGFVPPPWWREIERDGTTV

SEQ ID NO: 672082 - protein, 26 aa, Mycobacterium
GTAGPARPLATVGIAGRQRVTAGTTL

SEQ ID NO: 672083 - protein, 20 aa, Mycobacterium
GTAGSWNAPWSKLTPARQAA

SEQ ID NO: 672084 - protein, 17 aa, Mycobacterium
GTAIAQRLKAFRCSIAY

SEQ ID NO: 672085 - protein, 19 aa, Mycobacterium
GTAIMTWPALNHRLPELWT

SEQ ID NO: 672086 - protein, 25 aa, Mycobacterium
GTAIRALCPQARIFGVEPELAGDTA

SEQ ID NO: 672087 - protein, 18 aa, Mycobacterium
GTAKWLVVGDDALADQMR

SEQ ID NO: 672088 - protein, 17 aa, Mycobacterium
GTALARALTAAGVPVQD

SEQ ID NO: 672089 - protein, 35 aa, Mycobacterium
GTALLCPFDPLIFFRPRVERLFGFHYRIEIYTPAD

SEQ ID NO: 672090 - protein, 35 aa, Mycobacterium
GTALLCPFDPLIFFRPRVERLFGGFHYRIEIYVPQ

SEQ ID NO: 672091 - protein, 36 aa, Mycobacterium
GTALLCPFDPLIFFRPRVKRLFGFHYRIEIYTPAPK

SEQ ID NO: 672092 - protein, 33 aa, Mycobacterium
GTALLCPFDPLIFFRPRVQRLFDFHYRIEIYTP

SEQ ID NO: 672093 - protein, 33 aa, Mycobacterium
GTALLCPFDPLIFFRPRVQRLFDFHYRIEIYVP

SEQ ID NO: 672094 - protein, 19 aa, Mycobacterium
GTALLGICAAGGHGASAVL

SEQ ID NO: 672095 - protein, 25 aa, Mycobacterium
GTALPAGDFVRWCRQVVDLLDQIHK

SEQ ID NO: 672096 - protein, 26 aa, Mycobacterium
GTALPDRPSTTFADGRLSGTKVAVPY

SEQ ID NO: 672097 - protein, 18 aa, Mycobacterium
GTALPWYPGQVTLEDASR

SEQ ID NO: 672098 - protein, 24 aa, Mycobacterium
GTALRAGEKMMLLFESANFDEAVF

SEQ ID NO: 672099 - protein, 23 aa, Mycobacterium
GTALTEGITWGWETYPEYLDAID

SEQ ID NO: 672100 - protein, 23 aa, Mycobacterium
GTALTEGITWGWETYPEYLDTIG

SEQ ID NO: 672101 - protein, 19 aa, Mycobacterium
GTAMRWRTTISNHRPEVLK

SEQ ID NO: 672102 - protein, 23 aa, Mycobacterium
GTANHPLLCLVDVGGVPTLLWKL

SEQ ID NO: 672103 - protein, 23 aa, Mycobacterium
GTANHPLLCLVDVGGVPTLLWRL

SEQ ID NO: 672104 - protein, 18 aa, Mycobacterium
GTAPKFSVALMELGATVC

SEQ ID NO: 672105 - protein, 26 aa, Mycobacterium
GTAPKGIFPWYAPGSDTFLGEFPLSN

SEQ ID NO: 672106 - protein, 18 aa, Mycobacterium
GTAPRTPLLSNLLGISGE

SEQ ID NO: 672107 - protein, 17 aa, Mycobacterium
GTAPVFLISLKAGGFGL

SEQ ID NO: 672108 - protein, 25 aa, Mycobacterium
GTAQEKASVLSFVLAGHEPLEVGKA

SEQ ID NO: 672109 - protein, 18 aa, Mycobacterium
GTAQLADINVSPFVGESE

SEQ ID NO: 672110 - protein, 22 aa, Mycobacterium
GTARAGGKFSAHKDATSTGAGL

SEQ ID NO: 672111 - protein, 21 aa, Mycobacterium
GTARAGGKFSAHTDATSTGAG

SEQ ID NO: 672112 - protein, 18 aa, Mycobacterium
GTARILTAYGFPALATTS

SEQ ID NO: 672113 - protein, 17 aa, Mycobacterium
GTARLLSFPVDYASVTR

SEQ ID NO: 672114 - protein, 19 aa, Mycobacterium
GTARLSRLLGELLVSADAS

SEQ ID NO: 672115 - protein, 21 aa, Mycobacterium
GTARVSVCYMGVNGRDGSVFD

SEQ ID NO: 672116 - protein, 17 aa, Mycobacterium
GTASWVLIELLRHPDIQ

SEQ ID NO: 672117 - protein, 23 aa, Mycobacterium
GTASYYFRTRAALLRGVGDRVAE

SEQ ID NO: 672118 - protein, 25 aa, Mycobacterium
GTATEKASVLSFVLAGHEPLEVGKA

SEQ ID NO: 672119 - protein, 20 aa, Mycobacterium
GTATEWFLGPNQLRADPMPI

SEQ ID NO: 672120 - protein, 23 aa, Mycobacterium
GTATGSLFTWSFFIEPSLGFTRH

SEQ ID NO: 672121 - protein, 19 aa, Mycobacterium
GTATWPGARIAQSLLTADE

SEQ ID NO: 672122 - protein, 19 aa, Mycobacterium
GTAVNDWLDEDGNPKHEVP

SEQ ID NO: 672123 - protein, 18 aa, Mycobacterium
GTAVRFALDFPDRAGRLV

SEQ ID NO: 672124 - protein, 19 aa, Mycobacterium
GTAVRYTAKPGAFRRPNGQ

SEQ ID NO: 672125 - protein, 34 aa, Mycobacterium
GTAVSARARAAAACTGCAAGAAVAACAAGPESPV

SEQ ID NO: 672126 - protein, 24 aa, Mycobacterium
GTAWIDPRVRGHVLALADPATGLA

SEQ ID NO: 672127 - protein, 21 aa, Mycobacterium
GTAWQIFPNFQIGQGLTTALC

SEQ ID NO: 672128 - protein, 26 aa, Mycobacterium
GTCDELGRLCCWVLLDATRPVSLTLA

SEQ ID NO: 672129 - protein, 26 aa, Mycobacterium
GTCLNVGCLPTKMFVYAAEVAQTIRG

SEQ ID NO: 672130 - protein, 27 aa, Mycobacterium
GTCPLWNVYETFAYPGKILVQIAQMPD

SEQ ID NO: 672131 - protein, 21 aa, Mycobacterium
GTCPNCPNGGASHVYLHLARV

SEQ ID NO: 672132 - protein, 19 aa, Mycobacterium
GTCRAKGLLDAVIAAAAGR

SEQ ID NO: 672133 - protein, 19 aa, Mycobacterium
GTCRARGLLDAVIEAAAGR

SEQ ID NO: 672134 - protein, 18 aa, Mycobacterium
GTCRTRGLLDAVIGAAAG

SEQ ID NO: 672135 - protein, 19 aa, Mycobacterium
GTCRYLESATNILLIGPPG

SEQ ID NO: 672136 - protein, 18 aa, Mycobacterium
GTCVGRYGTLTSYLLDVV

SEQ ID NO: 672137 - protein, 19 aa, Mycobacterium
GTDDFRFNAIIDEEIAKAG

SEQ ID NO: 672138 - protein, 25 aa, Mycobacterium
GTDDIPGAWGLWFDLWAQAFRHDEV

SEQ ID NO: 672139 - protein, 25 aa, Mycobacterium
GTDEQKHRWAVPILRAEITASLGMS

SEQ ID NO: 672140 - protein, 23 aa, Mycobacterium
GTDEVSRAVAAVFAAHAQSCQAV

SEQ ID NO: 672141 - protein, 18 aa, Mycobacterium
GTDFPYRQFYPPKATVIQ

SEQ ID NO: 672142 - protein, 18 aa, Mycobacterium
GTDGKWRTTRMLDPQNLA

SEQ ID NO: 672143 - protein, 18 aa, Mycobacterium
GTDGQWRIARQVVPDRVI

SEQ ID NO: 672144 - protein, 24 aa, Mycobacterium
GTDGRPLILPVWYRLTDDHLQFVT

SEQ ID NO: 672145 - protein, 24 aa, Mycobacterium
GTDGTPGGWLLGDGGAGGSGAANT

SEQ ID NO: 672146 - protein, 19 aa, Mycobacterium
GTDHCDWIILGAMLGDADG

SEQ ID NO: 672147 - protein, 19 aa, Mycobacterium
GTDIGGWLEGLRAARRALE

SEQ ID NO: 672148 - protein, 21 aa, Mycobacterium
GTDIPVELELKGYSEPIDGVF

SEQ ID NO: 672149 - protein, 18 aa, Mycobacterium
GTDLARSAADFHLDGGQV

SEQ ID NO: 672150 - protein, 21 aa, Mycobacterium
GTDLERTRVLPAIKDEHPGAA

SEQ ID NO: 672151 - protein, 22 aa, Mycobacterium
GTDLGAIAIRAALEKANVPASM

SEQ ID NO: 672152 - protein, 18 aa, Mycobacterium
GTDLLSDIRLDFKPVVQT

SEQ ID NO: 672153 - protein, 21 aa, Mycobacterium
GTDLRAVVTYDTRMAAAAADL

SEQ ID NO: 672154 - protein, 22 aa, Mycobacterium
GTDLRGLAVLGMADRSISKVPG

SEQ ID NO: 672155 - protein, 28 aa, Mycobacterium
GTDPESFTGLVIRWHAPVIIDGADPKRV

SEQ ID NO: 672156 - protein, 22 aa, Mycobacterium
GTDPEYRSPFPPPPSSQSTGYQ

SEQ ID NO: 672157 - protein, 24 aa, Mycobacterium
GTDPMMLDLLRWHGAEEVEHRSLV

SEQ ID NO: 672158 - protein, 23 aa, Mycobacterium
GTDPRPGPDLVDLFPCGKPQPGY

SEQ ID NO: 672159 - protein, 19 aa, Mycobacterium
GTDPRWTYGAGTPGEAVAA

SEQ ID NO: 672160 - protein, 22 aa, Mycobacterium
GTDPRWTYRAATPGEAVDAYRK

SEQ ID NO: 672161 - protein, 19 aa, Mycobacterium
GTDRARNVLGWSPRWSSEA

SEQ ID NO: 672162 - protein, 23 aa, Mycobacterium
GTDRGHAVAFVRRVLGPLAANDE

SEQ ID NO: 672163 - protein, 22 aa, Mycobacterium
GTDRPCPALDIAADAQLPSYMV

SEQ ID NO: 672164 - protein, 26 aa, Mycobacterium
GTDRPWRPDVVHAHDWLVAHPAIALA

SEQ ID NO: 672165 - protein, 17 aa, Mycobacterium
GTDRVLNHILWRDDPPH

SEQ ID NO: 672166 - protein, 20 aa, Mycobacterium
GTDVVAEWADRIRGQLERFV

SEQ ID NO: 672167 - protein, 21 aa, Mycobacterium
GTDYLDMFTFFASSALGMNHP

SEQ ID NO: 672168 - protein, 20 aa, Mycobacterium
GTEAAGGWYFHPDNGAPTLG

SEQ ID NO: 672169 - protein, 17 aa, Mycobacterium
GTEAIKLITGIGEPLLG

SEQ ID NO: 672170 - protein, 24 aa, Mycobacterium
GTEALEWLVCKGLRKTLMRSDHLD

SEQ ID NO: 672171 - protein, 24 aa, Mycobacterium
GTEALRVLLLEYGRSAACWADRLV

SEQ ID NO: 672172 - protein, 23 aa, Mycobacterium
GTECCPDAFQWDRREDCEVRQIL

SEQ ID NO: 672173 - protein, 18 aa, Mycobacterium
GTEDGAADHVVYRLVSTE

SEQ ID NO: 672174 - protein, 24 aa, Mycobacterium
GTEDLAAMMGLGEPAAQLGGQLAE

SEQ ID NO: 672175 - protein, 25 aa, Mycobacterium
GTEDMSWTFWSWNPNSRDTGGILAD

SEQ ID NO: 672176 - protein, 31 aa, Mycobacterium
GTEEQKKWAVICAERGWGSTMVLTEPDAGSD

SEQ ID NO: 672177 - protein, 21 aa, Mycobacterium
GTEEQKKWAVMASERGWGSTM

SEQ ID NO: 672178 - protein, 20 aa, Mycobacterium
GTEFRAGVNVGVDIRAEQLR

SEQ ID NO: 672179 - protein, 25 aa, Mycobacterium
GTELFSRPGVHYLSGFFGPLERALR

SEQ ID NO: 672180 - protein, 18 aa, Mycobacterium
GTELRFVSIIATFGSPLD

SEQ ID NO: 672181 - protein, 19 aa, Mycobacterium
GTELRWRSTTAANEAREVT

SEQ ID NO: 672182 - protein, 18 aa, Mycobacterium
GTELVTYRTGHRGDALLI

SEQ ID NO: 672183 - protein, 25 aa, Mycobacterium
GTEMGRAALDLALFRAWYLHEELGL

SEQ ID NO: 672184 - protein, 26 aa, Mycobacterium
GTEMGRAALDLALFRSWRLHEDLGLN

SEQ ID NO: 672185 - protein, 26 aa, Mycobacterium
GTEMGRAPLDLALFRSWKLHDELGLN

SEQ ID NO: 672186 - protein, 26 aa, Mycobacterium
GTEMGRAPLDLALFRSWKLHRELGLN

SEQ ID NO: 672187 - protein, 24 aa, Mycobacterium
GTEMMAEIARFWVSRATYDAERDR

SEQ ID NO: 672188 - protein, 24 aa, Mycobacterium
GTEMMAEIARFWVSRATYDRDRDR

SEQ ID NO: 672189 - protein, 21 aa, Mycobacterium
GTEPGETLLLLGDTHDEFDGS

SEQ ID NO: 672190 - protein, 19 aa, Mycobacterium
GTERGVRWTGGTAVIGPDG

SEQ ID NO: 672191 - protein, 18 aa, Mycobacterium
GTETPVWTFLGARPAGWW

SEQ ID NO: 672192 - protein, 21 aa, Mycobacterium
GTEVEAFFARRAYLRDTSDEQ

SEQ ID NO: 672193 - protein, 27 aa, Mycobacterium
GTEVLGRLLVEYARSAIQWCRRIVIVN

SEQ ID NO: 672194 - protein, 17 aa, Mycobacterium
GTEVLKHAMTIATDIVE

SEQ ID NO: 672195 - protein, 18 aa, Mycobacterium
GTEVPRDALLRLLVDVQY

SEQ ID NO: 672196 - protein, 31 aa, Mycobacterium
GTEVRVGIGYHIPGGLFGKAAATLFGESPDQ

SEQ ID NO: 672197 - protein, 21 aa, Mycobacterium
GTEVSLRWIFVHMIAEYARHC

SEQ ID NO: 672198 - protein, 18 aa, Mycobacterium
GTEVTLCVQAPAPALLSG

SEQ ID NO: 672199 - protein, 17 aa, Mycobacterium
GTFACGGGRPADRDVGF

SEQ ID NO: 672200 - protein, 24 aa, Mycobacterium
GTFACGGGRPADREVGFFIEPTVI

SEQ ID NO: 672201 - protein, 25 aa, Mycobacterium
GTFAVQRSRIGGVRVVATIPRTEGN

SEQ ID NO: 672202 - protein, 17 aa, Mycobacterium
GTFDWTQGRFPGFTTPD

SEQ ID NO: 672203 - protein, 20 aa, Mycobacterium
GTFGAGVPRPATGEWASTAT

SEQ ID NO: 672204 - protein, 26 aa, Mycobacterium
GTFGNVLRFLPPLAISDDLLLEGLDI

SEQ ID NO: 672205 - protein, 26 aa, Mycobacterium
GTFHTLRAAIPVMRRQRYGRIVVTSS

SEQ ID NO: 672206 - protein, 22 aa, Mycobacterium
GTFRLIDKVFTHWGISHTPAAL

SEQ ID NO: 672207 - protein, 21 aa, Mycobacterium
GTFRLIDKVFTRWNVEYTPVA

SEQ ID NO: 672208 - protein, 24 aa, Mycobacterium
GTFRRRARGRGIGALSGVGSFAQW

SEQ ID NO: 672209 - protein, 19 aa, Mycobacterium
GTFSTRFAELVGMSPRTYK

SEQ ID NO: 672210 - protein, 18 aa, Mycobacterium
GTFTLRYTVMPMTGVPAM

SEQ ID NO: 672211 - protein, 23 aa, Mycobacterium
GTFVRASGMALPFADDSVDICLS

SEQ ID NO: 672212 - protein, 25 aa, Mycobacterium
GTGAAGGDGGWLVGNGGNGGSGAPG

SEQ ID NO: 672213 - protein, 25 aa, Mycobacterium
GTGADGAAGGWLLGNGGAGGSGAAG

SEQ ID NO: 672214 - protein, 26 aa, Mycobacterium
GTGADGAPGGWLLGDGGAGGSGAPGL

SEQ ID NO: 672215 - protein, 25 aa, Mycobacterium
GTGADGAPGGWLLGNGGAGGSGAAG

SEQ ID NO: 672216 - protein, 26 aa, Mycobacterium
GTGAIGTPGGWLLGDGGAGGSGAPGV

SEQ ID NO: 672217 - protein, 20 aa, Mycobacterium
GTGALQIMFCDRGTPSKDPA

SEQ ID NO: 672218 - protein, 18 aa, Mycobacterium
GTGALVLDVKVGSGALLS

SEQ ID NO: 672219 - protein, 25 aa, Mycobacterium
GTGANGAAGGWLLGDGGAGGSGAPG

SEQ ID NO: 672220 - protein, 25 aa, Mycobacterium
GTGANGAAGGWLLGNGGAGGSGAAG

SEQ ID NO: 672221 - protein, 25 aa, Mycobacterium
GTGANGGAGGWLIGNGGAGGSGAPG

SEQ ID NO: 672222 - protein, 25 aa, Mycobacterium
GTGANGGDGGWLLGDGGAGGSGATG

SEQ ID NO: 672223 - protein, 25 aa, Mycobacterium
GTGANGGDGGWLLGDGGIGGSGTPG

SEQ ID NO: 672224 - protein, 31 aa, Mycobacterium
GTGARLSVVVSELWRAVALAEMMRDAGLVAE

SEQ ID NO: 672225 - protein, 23 aa, Mycobacterium
GTGASWGNAGWIAPALTIPANSP

SEQ ID NO: 672226 - protein, 17 aa, Mycobacterium
GTGAWSVSADRIGAALR

SEQ ID NO: 672227 - protein, 19 aa, Mycobacterium
GTGCGSAPVFGRFEAEHPN

SEQ ID NO: 672228 - protein, 23 aa, Mycobacterium
GTGDWDVPIGGMGAVTGALAASA

SEQ ID NO: 672229 - protein, 18 aa, Mycobacterium
GTGERRWLDAATRLLNLA

SEQ ID NO: 672230 - protein, 22 aa, Mycobacterium
GTGEYPTVPSFAYTEEITFGHV

SEQ ID NO: 672231 - protein, 17 aa, Mycobacterium
GTGFNWPTPDHLRIVTL

SEQ ID NO: 672232 - protein, 26 aa, Mycobacterium
GTGGAAGLWGVGGHGGDGAHGGAGAS

SEQ ID NO: 672233 - protein, 27 aa, Mycobacterium
GTGGAGGTGGWLIGHSGTNGIGGTGGA

SEQ ID NO: 672234 - protein, 24 aa, Mycobacterium
GTGGDGALLWGNGGAGGQGGTGMT

SEQ ID NO: 672235 - protein, 26 aa, Mycobacterium
GTGGDGGAGGWLFGDAGAGGQGGTGG

SEQ ID NO: 672236 - protein, 25 aa, Mycobacterium
GTGGDGGRSGWLSGNAGAGGAGGAG

SEQ ID NO: 672237 - protein, 31 aa, Mycobacterium
GTGGDGIDGPADRPGGRGGQGGHGGDGGSGG

SEQ ID NO: 672238 - protein, 18 aa, Mycobacterium
GTGGFGIGGTNGGDGGDG

SEQ ID NO: 672239 - protein, 22 aa, Mycobacterium
GTGGGFRRFAAFGVEKDTYISY

SEQ ID NO: 672240 - protein, 22 aa, Mycobacterium
GTGGGGGWLSGSGGIGGGGGAG

SEQ ID NO: 672241 - protein, 17 aa, Mycobacterium
GTGGGLFRTLQADGCQN

SEQ ID NO: 672242 - protein, 22 aa, Mycobacterium
GTGGIGGHGGFFNGNGGTGGAG

SEQ ID NO: 672243 - protein, 33 aa, Mycobacterium
GTGGKGSNAPIGFSFGGAGGKGGTGGTGGTAHL

SEQ ID NO: 672244 - protein, 20 aa, Mycobacterium
GTGGLLLGDGGAGGMGGVGM

SEQ ID NO: 672245 - protein, 23 aa, Mycobacterium
GTGGLPMMPMMGGIPSMGGMGSA

SEQ ID NO: 672246 - protein, 24 aa, Mycobacterium
GTGGLPMMPMMGGIPSMGGMGSAS

SEQ ID NO: 672247 - protein, 17 aa, Mycobacterium
GTGGLRGLLFGQNGANG

SEQ ID NO: 672248 - protein, 28 aa, Mycobacterium
GTGGNAGEFQSLLGIGKGGDGGTGGDGG

SEQ ID NO: 672249 - protein, 27 aa, Mycobacterium
GTGGNGGNGGWLIGSGGAGGVSGTGGV

SEQ ID NO: 672250 - protein, 27 aa, Mycobacterium
GTGGPAGLGVFVGVPTFGDGGGGGAGG

SEQ ID NO: 672251 - protein, 18 aa, Mycobacterium
GTGGPGYDASLGGEATAG

SEQ ID NO: 672252 - protein, 26 aa, Mycobacterium
GTGGSARLVGFGGAGGGGGLGGVGDA

SEQ ID NO: 672253 - protein, 25 aa, Mycobacterium
GTGGTCATIGRYIRYRRHATRLCVV

SEQ ID NO: 672254 - protein, 26 aa, Mycobacterium
GTGGTGGFFGNGGFGGDGGDGAVGGA

SEQ ID NO: 672255 - protein, 25 aa, Mycobacterium
GTGGTSRFGGLGGNGGVGGKAGLIG

SEQ ID NO: 672256 - protein, 26 aa, Mycobacterium
GTGGYGAFEGGFGGDGGDGGTGGTGG

SEQ ID NO: 672257 - protein, 25 aa, Mycobacterium
GTGIPLFCIHPASGLSWPYHALGNY

SEQ ID NO: 672258 - protein, 23 aa, Mycobacterium
GTGITFDVVYWKPLPDNNDAPGY

SEQ ID NO: 672259 - protein, 30 aa, Mycobacterium
GTGKCQQVWCPVCALAAVATGDQHPLVTVI

SEQ ID NO: 672260 - protein, 27 aa, Mycobacterium
GTGKLAEFGELRWRDGAAVAVVLAAEN

SEQ ID NO: 672261 - protein, 21 aa, Mycobacterium
GTGKQTWQAMETSLRGEAKQL

SEQ ID NO: 672262 - protein, 17 aa, Mycobacterium
GTGKSTLIRRFMADTDR

SEQ ID NO: 672263 - protein, 23 aa, Mycobacterium
GTGKSVFLKSLIGLLRPEHGSIV

SEQ ID NO: 672264 - protein, 23 aa, Mycobacterium
GTGKSVFLKSLIGLLRPEQGAIY

SEQ ID NO: 672265 - protein, 24 aa, Mycobacterium
GTGKSVFLKSLIGLLRPERGKIVV

SEQ ID NO: 672266 - protein, 24 aa, Mycobacterium
GTGKSVFLKSLIGLLRPERGSILI

SEQ ID NO: 672267 - protein, 23 aa, Mycobacterium
GTGKSVFLKSLIGLLRPERGSIV

SEQ ID NO: 672268 - protein, 24 aa, Mycobacterium
GTGKSVFLKSLIGLLRPERGSIVI

SEQ ID NO: 672269 - protein, 18 aa, Mycobacterium
GTGLGGAEALVFAYDGLR

SEQ ID NO: 672270 - protein, 19 aa, Mycobacterium
GTGLPELWETVLRHREVLE

SEQ ID NO: 672271 - protein, 20 aa, Mycobacterium
GTGLPLLVIHGGPGLPHGYL

SEQ ID NO: 672272 - protein, 19 aa, Mycobacterium
GTGLRRLKVTAADLTSSPA

SEQ ID NO: 672273 - protein, 17 aa, Mycobacterium
GTGLWLESAIEQLIPAG

SEQ ID NO: 672274 - protein, 20 aa, Mycobacterium
GTGNDCARMLDIPLSDPVAA

SEQ ID NO: 672275 - protein, 23 aa, Mycobacterium
GTGPDEAWLRRELDAERRHCFEL

SEQ ID NO: 672276 - protein, 22 aa, Mycobacterium
GTGPLRPTAVWAPVLESQIAGN

SEQ ID NO: 672277 - protein, 20 aa, Mycobacterium
GTGPRYGFRLTIMPRPLSGG

SEQ ID NO: 672278 - protein, 25 aa, Mycobacterium
GTGQAGGDGGWLYGNGGAGGSGAAG

SEQ ID NO: 672279 - protein, 24 aa, Mycobacterium
GTGQAGGDGGWLYGNGGAGGSGAS

SEQ ID NO: 672280 - protein, 24 aa, Mycobacterium
GTGQAGGDGGWLYGNGGNGGSGAA

SEQ ID NO: 672281 - protein, 26 aa, Mycobacterium
GTGQAGGPGGWLWGDGGDGGSGTPGT

SEQ ID NO: 672282 - protein, 24 aa, Mycobacterium
GTGQAVVIKANWQRAAKMLGGSRP

SEQ ID NO: 672283 - protein, 25 aa, Mycobacterium
GTGQSGGDGGWLLGNGGNGGSGAAG

SEQ ID NO: 672284 - protein, 24 aa, Mycobacterium
GTGRFLRERVPGIHIVAAEPRYGE

SEQ ID NO: 672285 - protein, 24 aa, Mycobacterium
GTGRGFCAGAYMGEMASLGESISG

SEQ ID NO: 672286 - protein, 23 aa, Mycobacterium
GTGRLGGAWGEIRGANGVIIAAP

SEQ ID NO: 672287 - protein, 25 aa, Mycobacterium
GTGRLLEALPQFGFDDEACQSLAQF

SEQ ID NO: 672288 - protein, 25 aa, Mycobacterium
GTGRLLELLPRFGFDDQACELLAQF

SEQ ID NO: 672289 - protein, 31 aa, Mycobacterium
GTGRMPPLAARWMGSEAFRADVTMNKGVDNR

SEQ ID NO: 672290 - protein, 20 aa, Mycobacterium
GTGRNALALARRGHPVDVVE

SEQ ID NO: 672291 - protein, 32 aa, Mycobacterium
GTGRRIAVAAAERLIPCGLELGGKDAMIVCAD

SEQ ID NO: 672292 - protein, 20 aa, Mycobacterium
GTGRRKVMFGTNFPMIAHAH

SEQ ID NO: 672293 - protein, 27 aa, Mycobacterium
GTGRRVRRLAVSHAFHSASMEPMLAGF

SEQ ID NO: 672294 - protein, 18 aa, Mycobacterium
GTGVKLLIARPGFVVGRM

SEQ ID NO: 672295 - protein, 24 aa, Mycobacterium
GTGVKRFGLRPVVGIDPAAVSPWW

SEQ ID NO: 672296 - protein, 17 aa, Mycobacterium
GTGWIPYFLERADRTFE

SEQ ID NO: 672297 - protein, 17 aa, Mycobacterium
GTGWIPYFLERADRTYE

SEQ ID NO: 672298 - protein, 22 aa, Mycobacterium
GTGYRYAADFEELRDRSDAFLA

SEQ ID NO: 672299 - protein, 18 aa, Mycobacterium
GTHFCLGASLARVEAAAI

SEQ ID NO: 672300 - protein, 19 aa, Mycobacterium
GTHLIKLWFSVSRKEQLAR

SEQ ID NO: 672301 - protein, 24 aa, Mycobacterium
GTHLYVCGPAGFIEFVSATAAALG

SEQ ID NO: 672302 - protein, 17 aa, Mycobacterium
GTHPGALAEQWAALESL

SEQ ID NO: 672303 - protein, 20 aa, Mycobacterium
GTHPQWNWQRDCLQDRPRQP

SEQ ID NO: 672304 - protein, 29 aa, Mycobacterium
GTHRLLQTGVRWKDLGLVIVDEEQRFGVE

SEQ ID NO: 672305 - protein, 27 aa, Mycobacterium
GTHRLLQTGVRWKDLGLVVVDEEQRFG

SEQ ID NO: 672306 - protein, 24 aa, Mycobacterium
GTHRVFGWVAFEFGTYRFNLQHRL

SEQ ID NO: 672307 - protein, 28 aa, Mycobacterium
GTHSSGIGVLRWLPAVPEALAEDPQWGA

SEQ ID NO: 672308 - protein, 30 aa, Mycobacterium
GTIAGIHLEGPWLSRARCGAHDRTQMRDPD

SEQ ID NO: 672309 - protein, 17 aa, Mycobacterium
GTIASVLHNVRRAPKRV

SEQ ID NO: 672310 - protein, 18 aa, Mycobacterium
GTIAWKRSPGGLVTALEP

SEQ ID NO: 672311 - protein, 33 aa, Mycobacterium
GTICSRDGGFLTGWQPSEFDAEFFSISPREAAA

SEQ ID NO: 672312 - protein, 17 aa, Mycobacterium
GTIDILIELPRQSILDI

SEQ ID NO: 672313 - protein, 25 aa, Mycobacterium
GTIDRPGVWWQFQRLRAETSPGPSY

SEQ ID NO: 672314 - protein, 25 aa, Mycobacterium
GTIEPGNSVTVGFQAAQDGAYSPPT

SEQ ID NO: 672315 - protein, 30 aa, Mycobacterium
GTIERLHRLRLPWWHVWRVAEAAGAATPKH

SEQ ID NO: 672316 - protein, 18 aa, Mycobacterium
GTIEYLVDAVFNYPTFSE

SEQ ID NO: 672317 - protein, 26 aa, Mycobacterium
GTIGEHGMAVMLARGDLAIDADIESD

SEQ ID NO: 672318 - protein, 18 aa, Mycobacterium
GTILPSGFEIVVRKTYGR

SEQ ID NO: 672319 - protein, 19 aa, Mycobacterium
GTINLCIISPTGLIRDTFE

SEQ ID NO: 672320 - protein, 18 aa, Mycobacterium
GTINLCIVSPTGYIRDTW

SEQ ID NO: 672321 - protein, 22 aa, Mycobacterium
GTIPDDHRLAAGMAGLQTAHRY

SEQ ID NO: 672322 - protein, 19 aa, Mycobacterium
GTIPEFMWLQVDDVVNACL

SEQ ID NO: 672323 - protein, 17 aa, Mycobacterium
GTIPGIILGTGQTSGVV

SEQ ID NO: 672324 - protein, 17 aa, Mycobacterium
GTIPGVRLPHGVASYTG

SEQ ID NO: 672325 - protein, 19 aa, Mycobacterium
GTIPPGRPGGRSWTHTPPV

SEQ ID NO: 672326 - protein, 19 aa, Mycobacterium
GTIRGDFGLETQFNLVHGS

SEQ ID NO: 672327 - protein, 19 aa, Mycobacterium
GTIRKGTVAAVRFLIEGLV

SEQ ID NO: 672328 - protein, 24 aa, Mycobacterium
GTISARLAATIVWHTDLVKDAETL

SEQ ID NO: 672329 - protein, 25 aa, Mycobacterium
GTISFLPWGRMDTVYAAVVQSVEEA

SEQ ID NO: 672330 - protein, 19 aa, Mycobacterium
GTITELRDAAALINAPTEI

SEQ ID NO: 672331 - protein, 20 aa, Mycobacterium
GTITFSQGLSNFWSATTASV

SEQ ID NO: 672332 - protein, 17 aa, Mycobacterium
GTITWTAPTGHTYITHP

SEQ ID NO: 672333 - protein, 19 aa, Mycobacterium
GTIYLKACVNGARTPDHHP

SEQ ID NO: 672334 - protein, 19 aa, Mycobacterium
GTKETIAYCRIGERSSHTW

SEQ ID NO: 672335 - protein, 25 aa, Mycobacterium
GTKGKRYALPHARILMHQPLGGITG

SEQ ID NO: 672336 - protein, 24 aa, Mycobacterium
GTKHLKAYLELAARGVDTIIDGGK

SEQ ID NO: 672337 - protein, 18 aa, Mycobacterium
GTKHPQWYYNLTAHPECD

SEQ ID NO: 672338 - protein, 21 aa, Mycobacterium
GTKMKSGDKVTLWYNSANRDE

SEQ ID NO: 672339 - protein, 24 aa, Mycobacterium
GTKPSAFAWIPFGGGTRRCVGAAF

SEQ ID NO: 672340 - protein, 24 aa, Mycobacterium
GTKPWKIAVDLGTHGVYVTNYDKD

SEQ ID NO: 672341 - protein, 27 aa, Mycobacterium
GTKVLHLRGAFHGRSGYTMSLTNTDPN

SEQ ID NO: 672342 - protein, 19 aa, Mycobacterium
GTLADCLRLTNPNHECASA

SEQ ID NO: 672343 - protein, 20 aa, Mycobacterium
GTLAGLLVERGFSVVVPDWD

SEQ ID NO: 672344 - protein, 18 aa, Mycobacterium
GTLAQVSIPAGSGFLNSS

SEQ ID NO: 672345 - protein, 25 aa, Mycobacterium
GTLDAAYRKVRRAARAAARAEGEYR

SEQ ID NO: 672346 - protein, 24 aa, Mycobacterium
GTLDELFEALTLVQTRKVTRFPII

SEQ ID NO: 672347 - protein, 24 aa, Mycobacterium
GTLDELRPAAALIGAPVEIVEVTG

SEQ ID NO: 672348 - protein, 17 aa, Mycobacterium
GTLEEGRSWVGRRSEPK

SEQ ID NO: 672349 - protein, 21 aa, Mycobacterium
GTLEHLASWGIVAAAPNTETG

SEQ ID NO: 672350 - protein, 25 aa, Mycobacterium
GTLELLKVRGFAAVSLREVAKSAGL

SEQ ID NO: 672351 - protein, 22 aa, Mycobacterium
GTLELRLQYGVGRPERRYRIAG

SEQ ID NO: 672352 - protein, 27 aa, Mycobacterium
GTLELSEWWAYLEGVRKTYPLSYGPQS

SEQ ID NO: 672353 - protein, 24 aa, Mycobacterium
GTLESKSAITLVGFDMAKLAAQKV

SEQ ID NO: 672354 - protein, 26 aa, Mycobacterium
GTLGARIALMFALGGSRVRIYNRTPD

SEQ ID NO: 672355 - protein, 26 aa, Mycobacterium
GTLGLLRRFAKGWIVRANQVGVDEFA

SEQ ID NO: 672356 - protein, 24 aa, Mycobacterium
GTLGRRIALTFATRGGVVHLYDVS

SEQ ID NO: 672357 - protein, 23 aa, Mycobacterium
GTLGRSAFQLGVLERGLQMTAEY

SEQ ID NO: 672358 - protein, 18 aa, Mycobacterium
GTLGSWLIDVVNTLTGNL

SEQ ID NO: 672359 - protein, 20 aa, Mycobacterium
GTLIPAPCPQNLLDVTATPA

SEQ ID NO: 672360 - protein, 17 aa, Mycobacterium
GTLIRFIHAGMDDDVAR

SEQ ID NO: 672361 - protein, 18 aa, Mycobacterium
GTLKAIRRLGLSIPGDVA

SEQ ID NO: 672362 - protein, 17 aa, Mycobacterium
GTLKALIRVLAYEHPDL

SEQ ID NO: 672363 - protein, 20 aa, Mycobacterium
GTLKASWHWPDDDDKASKYR

SEQ ID NO: 672364 - protein, 19 aa, Mycobacterium
GTLKKVFLELGGKSAAIVL

SEQ ID NO: 672365 - protein, 17 aa, Mycobacterium
GTLKRDYLGMARTAGDI

SEQ ID NO: 672366 - protein, 17 aa, Mycobacterium
GTLLAAVQAGVWRGPSA

SEQ ID NO: 672367 - protein, 20 aa, Mycobacterium
GTLLDRHRPLWEAYLIEGMA

SEQ ID NO: 672368 - protein, 24 aa, Mycobacterium
GTLLRWLRRKNAPAVVLRPDGFIY

SEQ ID NO: 672369 - protein, 17 aa, Mycobacterium
GTLLVKVVRRFGGARCH

SEQ ID NO: 672370 - protein, 18 aa, Mycobacterium
GTLPLLAPMSEVAGRLSA

SEQ ID NO: 672371 - protein, 25 aa, Mycobacterium
GTLQRLLACSPPEWAATTVTTAGFA

SEQ ID NO: 672372 - protein, 19 aa, Mycobacterium
GTLRRLHNAVALGLIDIDE

SEQ ID NO: 672373 - protein, 19 aa, Mycobacterium
GTLRRLHNAVALGLIDIGE

SEQ ID NO: 672374 - protein, 17 aa, Mycobacterium
GTLRRVDVVLRRVDADY

SEQ ID NO: 672375 - protein, 26 aa, Mycobacterium
GTLRVRRRARDWYQRLLTDDPGRDPV

SEQ ID NO: 672376 - protein, 17 aa, Mycobacterium
GTLRVTRALLPKLVESG

SEQ ID NO: 672377 - protein, 20 aa, Mycobacterium
GTLSALALLLRRERAGEGGS

SEQ ID NO: 672378 - protein, 26 aa, Mycobacterium
GTLTCPWHGFCYDATSGECMSAPGVQ

SEQ ID NO: 672379 - protein, 26 aa, Mycobacterium
GTLTLRYRRGTVLGRPLRAEGRVERI

SEQ ID NO: 672380 - protein, 20 aa, Mycobacterium
GTLTTGRWGLLEPPQPWLPA

SEQ ID NO: 672381 - protein, 17 aa, Mycobacterium
GTLTYQMMFELRDFGFT

SEQ ID NO: 672382 - protein, 17 aa, Mycobacterium
GTLTYQMMFELRDLGFS

SEQ ID NO: 672383 - protein, 17 aa, Mycobacterium
GTLVCRWHGLTLDGRAR

SEQ ID NO: 672384 - protein, 25 aa, Mycobacterium
GTLVGKLSVPPSWAVATPDIRAVAA

SEQ ID NO: 672385 - protein, 19 aa, Mycobacterium
GTLVPRSESGAVLHDPDAV

SEQ ID NO: 672386 - protein, 17 aa, Mycobacterium
GTLWQKSLVPVVRAVMR

SEQ ID NO: 672387 - protein, 19 aa, Mycobacterium
GTLYFGVPTVWSRVAADQA

SEQ ID NO: 672388 - protein, 17 aa, Mycobacterium
GTLYRGGVQATPPGWRT

SEQ ID NO: 672389 - protein, 20 aa, Mycobacterium
GTMINIWPGMNHRLPELWTE

SEQ ID NO: 672390 - protein, 18 aa, Mycobacterium
GTMLRHCDDTVCKRFTRI

SEQ ID NO: 672391 - protein, 21 aa, Mycobacterium
GTMPNRLYWISGTVNPDGDKG

SEQ ID NO: 672392 - protein, 20 aa, Mycobacterium
GTMPNRLYWISGTVNPDGDQ

SEQ ID NO: 672393 - protein, 22 aa, Mycobacterium
GTMRMPGVALVCHVLLVETDNG

SEQ ID NO: 672394 - protein, 28 aa, Mycobacterium
GTMTVPLSVPIVDSAVINFPVNGILVPP

SEQ ID NO: 672395 - protein, 19 aa, Mycobacterium
GTNAVLLPGGFPEQFAAEL

SEQ ID NO: 672396 - protein, 25 aa, Mycobacterium
GTNHLGHFEFTRLLFPALVAADGAR

SEQ ID NO: 672397 - protein, 20 aa, Mycobacterium
GTNITIWPGMNHRLPELWTD

SEQ ID NO: 672398 - protein, 20 aa, Mycobacterium
GTNITIWPGMNHRLPELWTE

SEQ ID NO: 672399 - protein, 23 aa, Mycobacterium
GTNLRFGALAPRLEHELGKPVWA

SEQ ID NO: 672400 - protein, 23 aa, Mycobacterium
GTNLWAGTAYRQARPGPAADIVA

SEQ ID NO: 672401 - protein, 27 aa, Mycobacterium
GTNMLRFGRVTVRFGKPMDFSRFDGLA

SEQ ID NO: 672402 - protein, 24 aa, Mycobacterium
GTNPMARRRLEWQIEQSEDSKAKG

SEQ ID NO: 672403 - protein, 18 aa, Mycobacterium
GTNRRARLAVTYRPGPAG

SEQ ID NO: 672404 - protein, 30 aa, Mycobacterium
GTNTARIRGCPRLSDSIAHAIAEGCLDPIC

SEQ ID NO: 672405 - protein, 25 aa, Mycobacterium
GTPADLVGMCLFLLSDEASWITGQI

SEQ ID NO: 672406 - protein, 18 aa, Mycobacterium
GTPAEYADAATFLLSNGY

SEQ ID NO: 672407 - protein, 26 aa, Mycobacterium
GTPAGPWLRTGDLGFVHGGELFIVGR

SEQ ID NO: 672408 - protein, 17 aa, Mycobacterium
GTPAIFLNVRGGRLSRQ

SEQ ID NO: 672409 - protein, 20 aa, Mycobacterium
GTPAPLWLAAFERSPLPALD

SEQ ID NO: 672410 - protein, 28 aa, Mycobacterium
GTPAPVLELRTSWRNPPRTLALANAISA

SEQ ID NO: 672411 - protein, 25 aa, Mycobacterium
GTPARLKDVFFYEPIILPEKASREV

SEQ ID NO: 672412 - protein, 18 aa, Mycobacterium
GTPAWVWNMSSIGGVAVV

SEQ ID NO: 672413 - protein, 20 aa, Mycobacterium
GTPDELRAAAALVTGTTAVV

SEQ ID NO: 672414 - protein, 19 aa, Mycobacterium
GTPDLSWGPAERIGADLPA

SEQ ID NO: 672415 - protein, 23 aa, Mycobacterium
GTPDRLAVVAGHYLEIAAMTDEE

SEQ ID NO: 672416 - protein, 23 aa, Mycobacterium
GTPDRLVELGAFLSLTSGTAGVP

SEQ ID NO: 672417 - protein, 28 aa, Mycobacterium
GTPEAITAWIVFCCQALTAGAAEATSIA

SEQ ID NO: 672418 - protein, 19 aa, Mycobacterium
GTPELRNAYSRAVTAEGNV

SEQ ID NO: 672419 - protein, 30 aa, Mycobacterium
GTPEQKQRWAVPILRAEITASLGMSEPGAG

SEQ ID NO: 672420 - protein, 24 aa, Mycobacterium
GTPEWSMTASLWMRGILGEHHGVD

SEQ ID NO: 672421 - protein, 22 aa, Mycobacterium
GTPFAIRAWGAVFVEVGVDRDL

SEQ ID NO: 672422 - protein, 26 aa, Mycobacterium
GTPGAPALVCVHGFPTAGVDYHALTR

SEQ ID NO: 672423 - protein, 25 aa, Mycobacterium
GTPGKRLALPNARVLIHQPALSGVI

SEQ ID NO: 672424 - protein, 22 aa, Mycobacterium
GTPIGGIVPGLLTYAPQQFANA

SEQ ID NO: 672425 - protein, 33 aa, Mycobacterium
GTPKGAMYPQWLVANLWQKKWLTDDVIPSIGVN

SEQ ID NO: 672426 - protein, 24 aa, Mycobacterium
GTPLFPHALVRLILAAQVASAAGD

SEQ ID NO: 672427 - protein, 20 aa, Mycobacterium
GTPLGGVAPGLLTLLPEQLA

SEQ ID NO: 672428 - protein, 22 aa, Mycobacterium
GTPNGPCTWVSLWSNTTGSGIW

SEQ ID NO: 672429 - protein, 22 aa, Mycobacterium
GTPNRLLLVLSDGYAYDHGYEG

SEQ ID NO: 672430 - protein, 30 aa, Mycobacterium
GTPPPAPFWAARHRLLLGWVKMLDGQLTAA

SEQ ID NO: 672431 - protein, 18 aa, Mycobacterium
GTPPPFGTGAPGGSGGTG

SEQ ID NO: 672432 - protein, 18 aa, Mycobacterium
GTPPPTWEDIAWLREQWD

SEQ ID NO: 672433 - protein, 17 aa, Mycobacterium
GTPPVLLFVGRLEYEKG

SEQ ID NO: 672434 - protein, 21 aa, Mycobacterium
GTPQRPRLVVNRSARHIHVQL

SEQ ID NO: 672435 - protein, 17 aa, Mycobacterium
GTPQVPSPPGFGAANTP

SEQ ID NO: 672436 - protein, 23 aa, Mycobacterium
GTPRCPKCKNPLPWIAVAGDGDF

SEQ ID NO: 672437 - protein, 23 aa, Mycobacterium
GTPREVASVISFLASEASSYITG

SEQ ID NO: 672438 - protein, 25 aa, Mycobacterium
GTPRTAAQMTEFYAGLLGSYPLVSI

SEQ ID NO: 672439 - protein, 17 aa, Mycobacterium
GTPSEADIAKWHGAAKH

SEQ ID NO: 672440 - protein, 17 aa, Mycobacterium
GTPSIFQETAFRFTDGS

SEQ ID NO: 672441 - protein, 28 aa, Mycobacterium
GTPSPDRSTGLFLWQNIFGVWPADGAVT

SEQ ID NO: 672442 - protein, 24 aa, Mycobacterium
GTPTEFFNLVGLAEWSDIEARYAP

SEQ ID NO: 672443 - protein, 17 aa, Mycobacterium
GTPTRAIKSPEDLDGLD

SEQ ID NO: 672444 - protein, 24 aa, Mycobacterium
GTPTRARGYPPYEGEHALIVEVSP

SEQ ID NO: 672445 - protein, 17 aa, Mycobacterium
GTPVFGLFLTAGTTDYG

SEQ ID NO: 672446 - protein, 17 aa, Mycobacterium
GTPVGPWLRTGDLGVMF

SEQ ID NO: 672447 - protein, 21 aa, Mycobacterium
GTPVPGSWLYGKDVLDLVRLG

SEQ ID NO: 672448 - protein, 18 aa, Mycobacterium
GTPVPLWLAAFAESPLPT

SEQ ID NO: 672449 - protein, 28 aa, Mycobacterium
GTPVQVLGFREHASWALASDTLEFVDLE

SEQ ID NO: 672450 - protein, 18 aa, Mycobacterium
GTPWLTSFAQRSRFAEAF

SEQ ID NO: 672451 - protein, 22 aa, Mycobacterium
GTPYQRLNFMVGKLNRAMQRNP

SEQ ID NO: 672452 - protein, 20 aa, Mycobacterium
GTPYVTPLVRKLASQHNIDL

SEQ ID NO: 672453 - protein, 19 aa, Mycobacterium
GTQAAIWFLTNGVELDTAA

SEQ ID NO: 672454 - protein, 21 aa, Mycobacterium
GTQACRVLRAEGLEVSLVNSN

SEQ ID NO: 672455 - protein, 21 aa, Mycobacterium
GTQACRVLRAEGLQVSLINSN

SEQ ID NO: 672456 - protein, 21 aa, Mycobacterium
GTQACRVLRAEGLQVTLINSN

SEQ ID NO: 672457 - protein, 20 aa, Mycobacterium
GTQACRVLRSEGIQVSLVNS

SEQ ID NO: 672458 - protein, 21 aa, Mycobacterium
GTQACRVLRSEGLQVSLVNSN

SEQ ID NO: 672459 - protein, 19 aa, Mycobacterium
GTQAITVAVRFLQLQHRRA

SEQ ID NO: 672460 - protein, 19 aa, Mycobacterium
GTQAVLQFEIRGMVDGQAA

SEQ ID NO: 672461 - protein, 18 aa, Mycobacterium
GTQEWAWDREVAKTRLAD

SEQ ID NO: 672462 - protein, 25 aa, Mycobacterium
GTQFKLDRCRELGAHTLINYREQDF

SEQ ID NO: 672463 - protein, 22 aa, Mycobacterium
GTQKRLAVWLVDDPKHVPGIAA

SEQ ID NO: 672464 - protein, 22 aa, Mycobacterium
GTQKRLAVWLVTDPLAVPQIAS

SEQ ID NO: 672465 - protein, 21 aa, Mycobacterium
GTQKRLAVWLVTDPQTVPGIA

SEQ ID NO: 672466 - protein, 18 aa, Mycobacterium
GTQLPPAYDARARLLESF

SEQ ID NO: 672467 - protein, 19 aa, Mycobacterium
GTQLRWRSTTAANDGAEVS

SEQ ID NO: 672468 - protein, 19 aa, Mycobacterium
GTQNWGWDRASAVSRLAGA

SEQ ID NO: 672469 - protein, 20 aa, Mycobacterium
GTQPQAAKLTEWLKLALDEP

SEQ ID NO: 672470 - protein, 18 aa, Mycobacterium
GTQVGEQHCGVWPGSHAR

SEQ ID NO: 672471 - protein, 19 aa, Mycobacterium
GTQVRPAFEDPLSRLAAAV

SEQ ID NO: 672472 - protein, 18 aa, Mycobacterium
GTRAGGAPARYGEAIRRT

SEQ ID NO: 672473 - protein, 18 aa, Mycobacterium
GTRARLLDRMKDKWRSDL

SEQ ID NO: 672474 - protein, 19 aa, Mycobacterium
GTRCAAWFTRPAGPGPYPL

SEQ ID NO: 672475 - protein, 28 aa, Mycobacterium
GTRCRLRNGGAWGWRADGYEGAYWCGDP

SEQ ID NO: 672476 - protein, 20 aa, Mycobacterium
GTRDHEDWAAVGLDEALGAE

SEQ ID NO: 672477 - protein, 18 aa, Mycobacterium
GTRFSLRDGATCLVTAAG

SEQ ID NO: 672478 - protein, 21 aa, Mycobacterium
GTRFVAVAGIGLLAPGDTGQL

SEQ ID NO: 672479 - protein, 18 aa, Mycobacterium
GTRGLALRIRAFIESRLG

SEQ ID NO: 672480 - protein, 25 aa, Mycobacterium
GTRIGKSFLLLFGFLPFGFDDITIT

SEQ ID NO: 672481 - protein, 20 aa, Mycobacterium
GTRKTVVLDDQWTVITADGS

SEQ ID NO: 672482 - protein, 23 aa, Mycobacterium
GTRLGMCGMEYFGHPWEFGPRRT

SEQ ID NO: 672483 - protein, 24 aa, Mycobacterium
GTRLKDIIDRHGPQSVAFYFSTME

SEQ ID NO: 672484 - protein, 20 aa, Mycobacterium
GTRLKPEILAVSLSAGNRGK

SEQ ID NO: 672485 - protein, 23 aa, Mycobacterium
GTRLNRPWIVAVAARCRTMQLAA

SEQ ID NO: 672486 - protein, 26 aa, Mycobacterium
GTRLPDLKVFICGGASVPPSLIRRAS

SEQ ID NO: 672487 - protein, 26 aa, Mycobacterium
GTRLPDLKVFICGGASVPPTLIRSAA

SEQ ID NO: 672488 - protein, 18 aa, Mycobacterium
GTRLPSSRALAADLGVAR

SEQ ID NO: 672489 - protein, 23 aa, Mycobacterium
GTRLRFAVQVAVKIPLVGRKLEK

SEQ ID NO: 672490 - protein, 26 aa, Mycobacterium
GTRMKLARNLLHFVAFTAAGEAQRLA

SEQ ID NO: 672491 - protein, 26 aa, Mycobacterium
GTRMVGGPEVVVWLDTLAALGRSAFQ

SEQ ID NO: 672492 - protein, 21 aa, Mycobacterium
GTRPFGPMCVLVRATQDIYLN

SEQ ID NO: 672493 - protein, 22 aa, Mycobacterium
GTRPLRSWQRRALVKYLGTQPR

SEQ ID NO: 672494 - protein, 24 aa, Mycobacterium
GTRRAIHFQEWWVRYRADVPTHSF

SEQ ID NO: 672495 - protein, 24 aa, Mycobacterium
GTRRIFDITIDYLKTRIQFGRAIG

SEQ ID NO: 672496 - protein, 23 aa, Mycobacterium
GTRRYARERARAEGLADRDKFRT

SEQ ID NO: 672497 - protein, 22 aa, Mycobacterium
GTRTAAVMGLSAWDYTIVNLER

SEQ ID NO: 672498 - protein, 23 aa, Mycobacterium
GTRTGCLFYEFGCRGPMTHSPCN

SEQ ID NO: 672499 - protein, 18 aa, Mycobacterium
GTSAHAFTMLHARADTPA

SEQ ID NO: 672500 - protein, 18 aa, Mycobacterium
GTSAIAWTRPVVLAPQAA

SEQ ID NO: 672501 - protein, 21 aa, Mycobacterium
GTSALRLAPALGASRTIAVVS

SEQ ID NO: 672502 - protein, 25 aa, Mycobacterium
GTSARVIGEYGAFMLHLEEARVDRR

SEQ ID NO: 672503 - protein, 20 aa, Mycobacterium
GTSAYLRLSTRPVDQALAAV

SEQ ID NO: 672504 - protein, 17 aa, Mycobacterium
GTSEMDSGFGLRTLAAD

SEQ ID NO: 672505 - protein, 17 aa, Mycobacterium
GTSFARWASLLREQALS

SEQ ID NO: 672506 - protein, 20 aa, Mycobacterium
GTSFARWASRLAERASHPDV

SEQ ID NO: 672507 - protein, 19 aa, Mycobacterium
GTSFARWSSLLDEHARRPE

SEQ ID NO: 672508 - protein, 20 aa, Mycobacterium
GTSFARWSTLLQEYAQRPDV

SEQ ID NO: 672509 - protein, 19 aa, Mycobacterium
GTSFLARVCLDWEAATAEA

SEQ ID NO: 672510 - protein, 23 aa, Mycobacterium
GTSGMRKGDLIAAIREHQGALGA

SEQ ID NO: 672511 - protein, 19 aa, Mycobacterium
GTSGMRKNELIAAIKEIRG

SEQ ID NO: 672512 - protein, 23 aa, Mycobacterium
GTSGMRKNELIAAIQEFRDRANG

SEQ ID NO: 672513 - protein, 24 aa, Mycobacterium
GTSGRIGLLDAVECPPTFGTTPDQ

SEQ ID NO: 672514 - protein, 19 aa, Mycobacterium
GTSKPAIYRRWPSKAHLVH

SEQ ID NO: 672515 - protein, 18 aa, Mycobacterium
GTSKPAIYRRWPSKAYLV

SEQ ID NO: 672516 - protein, 17 aa, Mycobacterium
GTSKPAIYRRWRGKAHL

SEQ ID NO: 672517 - protein, 18 aa, Mycobacterium
GTSLARLEGRIALEEILK

SEQ ID NO: 672518 - protein, 18 aa, Mycobacterium
GTSLEVFHGPVLDHSPVV

SEQ ID NO: 672519 - protein, 18 aa, Mycobacterium
GTSLGDGPARAWEHGRFG

SEQ ID NO: 672520 - protein, 18 aa, Mycobacterium
GTSLGEGPARAWERGRFG

SEQ ID NO: 672521 - protein, 23 aa, Mycobacterium
GTSLREGEKIMLLFESGNFDESV

SEQ ID NO: 672522 - protein, 22 aa, Mycobacterium
GTSNHPLLCLVDVGGVPTLLWK

SEQ ID NO: 672523 - protein, 24 aa, Mycobacterium
GTSPYTGEAWIFVQLAPSVDRNAL

SEQ ID NO: 672524 - protein, 25 aa, Mycobacterium
GTSRIADPPAWFGVIRPAQLLASSD

SEQ ID NO: 672525 - protein, 22 aa, Mycobacterium
GTSRIQVLKGFWDNMSGYLGLS

SEQ ID NO: 672526 - protein, 24 aa, Mycobacterium
GTSRLRLAARASLTDDEMALARQV

SEQ ID NO: 672527 - protein, 21 aa, Mycobacterium
GTSRLRLTARASLDAAELEIA

SEQ ID NO: 672528 - protein, 23 aa, Mycobacterium
GTSRLRLTARASLSDDEMALARE

SEQ ID NO: 672529 - protein, 24 aa, Mycobacterium
GTSRLRLTARASLSPDEMELARRV

SEQ ID NO: 672530 - protein, 23 aa, Mycobacterium
GTSRSFAFLTIFNKNRPGGSVVA

SEQ ID NO: 672531 - protein, 18 aa, Mycobacterium
GTSSNMLAANGGDGGGGG

SEQ ID NO: 672532 - protein, 24 aa, Mycobacterium
GTSTARGRWRAVSAQAGYSSHARR

SEQ ID NO: 672533 - protein, 24 aa, Mycobacterium
GTSTLRLAPAFGASRTIAVVSTEE

SEQ ID NO: 672534 - protein, 19 aa, Mycobacterium
GTSTVEFGTLGSWLIDVVN

SEQ ID NO: 672535 - protein, 20 aa, Mycobacterium
GTSYLLPKIVGAGVARELML

SEQ ID NO: 672536 - protein, 23 aa, Mycobacterium
GTTAEHFAKIGFKNHKHSVNNPY

SEQ ID NO: 672537 - protein, 25 aa, Mycobacterium
GTTALWGGRCVPFDPIDFEDRPLTA

SEQ ID NO: 672538 - protein, 18 aa, Mycobacterium
GTTARAVLRAATDNLTPV

SEQ ID NO: 672539 - protein, 17 aa, Mycobacterium
GTTAVYFDCPGHPSSSL

SEQ ID NO: 672540 - protein, 19 aa, Mycobacterium
GTTDSWLLWNLTGGTSGGV

SEQ ID NO: 672541 - protein, 17 aa, Mycobacterium
GTTFPGVIGRTADESTP

SEQ ID NO: 672542 - protein, 24 aa, Mycobacterium
GTTFTIRLPWGAGHLPADAVASQP

SEQ ID NO: 672543 - protein, 17 aa, Mycobacterium
GTTGFGLKHELRSDQSL

SEQ ID NO: 672544 - protein, 26 aa, Mycobacterium
GTTGFTWERIEQVEAWVKAKPGASVL

SEQ ID NO: 672545 - protein, 24 aa, Mycobacterium
GTTGRAMAKLGFSMITLTAEAHAL

SEQ ID NO: 672546 - protein, 17 aa, Mycobacterium
GTTGRPKAVMWRQGDIY

SEQ ID NO: 672547 - protein, 23 aa, Mycobacterium
GTTIAAVCFLDLGNASVTASRRD

SEQ ID NO: 672548 - protein, 17 aa, Mycobacterium
GTTIGGIEVVAWRDRQG

SEQ ID NO: 672549 - protein, 20 aa, Mycobacterium
GTTKETLGWIALNQRANAEL

SEQ ID NO: 672550 - protein, 24 aa, Mycobacterium
GTTKTLPCHAGYLSVSGKNNTITL

SEQ ID NO: 672551 - protein, 19 aa, Mycobacterium
GTTLADWLRERDVDAVDVV

SEQ ID NO: 672552 - protein, 17 aa, Mycobacterium
GTTLVVPADGYYQVRRY

SEQ ID NO: 672553 - protein, 20 aa, Mycobacterium
GTTMAVDWERRIDFDRLRTQ

SEQ ID NO: 672554 - protein, 18 aa, Mycobacterium
GTTMKRAVERFDVNVIGL

SEQ ID NO: 672555 - protein, 24 aa, Mycobacterium
GTTNRPGARFGPRAIRATAYEPGT

SEQ ID NO: 672556 - protein, 18 aa, Mycobacterium
GTTPAERQIALIAFADAI

SEQ ID NO: 672557 - protein, 18 aa, Mycobacterium
GTTPFTAVGELWKAISPH

SEQ ID NO: 672558 - protein, 18 aa, Mycobacterium
GTTPLSARYHLFLRATEG

SEQ ID NO: 672559 - protein, 25 aa, Mycobacterium
GTTPNRLYWMSAWIDPDGTNGGPIL

SEQ ID NO: 672560 - protein, 24 aa, Mycobacterium
GTTPTCYRRQRILLPSHVPLGRHK

SEQ ID NO: 672561 - protein, 18 aa, Mycobacterium
GTTRAVIGAAEFSISGPA

SEQ ID NO: 672562 - protein, 27 aa, Mycobacterium
GTTSFYFRTRRALVHAIATRLAELDVA

SEQ ID NO: 672563 - protein, 21 aa, Mycobacterium
GTTTKISWQYGSHTALNFDPG

SEQ ID NO: 672564 - protein, 18 aa, Mycobacterium
GTTVDEIYKATAAASDLK

SEQ ID NO: 672565 - protein, 18 aa, Mycobacterium
GTTVRFWADPEIFETTTY

SEQ ID NO: 672566 - protein, 18 aa, Mycobacterium
GTTVRFWADPNVFETTEY

SEQ ID NO: 672567 - protein, 17 aa, Mycobacterium
GTTWSFLDMTALGRQET

SEQ ID NO: 672568 - protein, 20 aa, Mycobacterium
GTTYALLWALAHRDRVRSVS

SEQ ID NO: 672569 - protein, 27 aa, Mycobacterium
GTVAAILRYCSDHGIAVVPFGGGTNVV

SEQ ID NO: 672570 - protein, 27 aa, Mycobacterium
GTVAELKRAYSLGVRSIRVAAHCTEAD

SEQ ID NO: 672571 - protein, 22 aa, Mycobacterium
GTVAGGINGISGDGGSGGAGGP

SEQ ID NO: 672572 - protein, 20 aa, Mycobacterium
GTVAHRIRLAAQISAAVRTA

SEQ ID NO: 672573 - protein, 20 aa, Mycobacterium
GTVAKWRLQATRSRVRDVQV

SEQ ID NO: 672574 - protein, 17 aa, Mycobacterium
GTVAPWWDVIDVGETMR

SEQ ID NO: 672575 - protein, 24 aa, Mycobacterium
GTVAQRRLPLLLANGADVHVITRA

SEQ ID NO: 672576 - protein, 25 aa, Mycobacterium
GTVATFCIVSFPFPGQVFTPPYAVA

SEQ ID NO: 672577 - protein, 19 aa, Mycobacterium
GTVCCALLPDVQAEREWIA

SEQ ID NO: 672578 - protein, 19 aa, Mycobacterium
GTVDAWTISGSWHYMEYAD

SEQ ID NO: 672579 - protein, 19 aa, Mycobacterium
GTVDLRFAGEGLAFGEVNV

SEQ ID NO: 672580 - protein, 18 aa, Mycobacterium
GTVEFRSLLDGSVRNTMV

SEQ ID NO: 672581 - protein, 22 aa, Mycobacterium
GTVELVRWAKEQGIAITAEVTP

SEQ ID NO: 672582 - protein, 20 aa, Mycobacterium
GTVFDPFGYAHVRRVERRLL

SEQ ID NO: 672583 - protein, 18 aa, Mycobacterium
GTVGGLYVCEMVTARALV

SEQ ID NO: 672584 - protein, 18 aa, Mycobacterium
GTVGKSFKHRVTCSPSTS

SEQ ID NO: 672585 - protein, 17 aa, Mycobacterium
GTVGRYSPYAVYLPGGD

SEQ ID NO: 672586 - protein, 20 aa, Mycobacterium
GTVIEHLKYLSLQLDLHAGE

SEQ ID NO: 672587 - protein, 18 aa, Mycobacterium
GTVIPAGSAVHLIYAAAN

SEQ ID NO: 672588 - protein, 28 aa, Mycobacterium
GTVKEARRRWELMAGRSAELLTGHCLVR

SEQ ID NO: 672589 - protein, 19 aa, Mycobacterium
GTVKHVWDVLRRVLRYALH

SEQ ID NO: 672590 - protein, 17 aa, Mycobacterium
GTVKPASALVLGVGVAG

SEQ ID NO: 672591 - protein, 17 aa, Mycobacterium
GTVLLMLAALRRLPTLD

SEQ ID NO: 672592 - protein, 17 aa, Mycobacterium
GTVLRPEVAAVLSPLDL

SEQ ID NO: 672593 - protein, 25 aa, Mycobacterium
GTVLTEPGYWPWPDVLANALVIDGA

SEQ ID NO: 672594 - protein, 18 aa, Mycobacterium
GTVLVEWLNVSGGIDAPA

SEQ ID NO: 672595 - protein, 18 aa, Mycobacterium
GTVMAAGFDSLVTDRTNR

SEQ ID NO: 672596 - protein, 18 aa, Mycobacterium
GTVMAARTLAMQAVPTTF

SEQ ID NO: 672597 - protein, 18 aa, Mycobacterium
GTVMLRMPLHPVAIELLR

SEQ ID NO: 672598 - protein, 19 aa, Mycobacterium
GTVPLQWVAARGYKPNPIE

SEQ ID NO: 672599 - protein, 23 aa, Mycobacterium
GTVPQRLWAKPAITVIGIDTTSV

SEQ ID NO: 672600 - protein, 17 aa, Mycobacterium
GTVQACLRSDHQRRAGI

SEQ ID NO: 672601 - protein, 18 aa, Mycobacterium
GTVREVVDAYPFERDADG

SEQ ID NO: 672602 - protein, 24 aa, Mycobacterium
GTVRNWPWRRLVLSKTANTYSRFL

SEQ ID NO: 672603 - protein, 27 aa, Mycobacterium
GTVRNWPWRRWALSWTANTYARLALGI

SEQ ID NO: 672604 - protein, 23 aa, Mycobacterium
GTVRRWTPADLPRDLGGVSSHAL

SEQ ID NO: 672605 - protein, 23 aa, Mycobacterium
GTVRTRLNLVSAIADAVDSGVSD

SEQ ID NO: 672606 - protein, 17 aa, Mycobacterium
GTVSGFGNLGARTSGFL

SEQ ID NO: 672607 - protein, 18 aa, Mycobacterium
GTVSGLYVCEMVTARALV

SEQ ID NO: 672608 - protein, 18 aa, Mycobacterium
GTVSGWVRRTERTADVAS

SEQ ID NO: 672609 - protein, 29 aa, Mycobacterium
GTVSIRPGSVLDFFAKVSPVQRVMLEALA

SEQ ID NO: 672610 - protein, 22 aa, Mycobacterium
GTVSKAVFFGATLNLEYYDSDK

SEQ ID NO: 672611 - protein, 18 aa, Mycobacterium
GTVTDGWAVAHRGALVAE

SEQ ID NO: 672612 - protein, 18 aa, Mycobacterium
GTVTRWLKQEGDTVDIDE

SEQ ID NO: 672613 - protein, 18 aa, Mycobacterium
GTVTRWLKQEGDTVEIDE

SEQ ID NO: 672614 - protein, 19 aa, Mycobacterium
GTVTRWLKQEGDTVELDEP

SEQ ID NO: 672615 - protein, 19 aa, Mycobacterium
GTVVARPKLVHALSLQSYT

SEQ ID NO: 672616 - protein, 26 aa, Mycobacterium
GTVVFPDARVKIFLTASAETRARRRN

SEQ ID NO: 672617 - protein, 20 aa, Mycobacterium
GTVVNAGWPVAVTGFCSGPY

SEQ ID NO: 672618 - protein, 17 aa, Mycobacterium
GTVVPGFVDMHVHGGGG

SEQ ID NO: 672619 - protein, 24 aa, Mycobacterium
GTVWGIDSFDQWGVELGKKQAIAL

SEQ ID NO: 672620 - protein, 20 aa, Mycobacterium
GTVWSTGGCRSWYLDEHGVN

SEQ ID NO: 672621 - protein, 21 aa, Mycobacterium
GTWCEDAWLTAAGLLDQTERL

SEQ ID NO: 672622 - protein, 17 aa, Mycobacterium
GTWDLFRYPGIRSDSDI

SEQ ID NO: 672623 - protein, 25 aa, Mycobacterium
GTWGVMGIGMGYAIAAAVETGDPVV

SEQ ID NO: 672624 - protein, 17 aa, Mycobacterium
GTWHIEGVKRFISGGDV

SEQ ID NO: 672625 - protein, 19 aa, Mycobacterium
GTWHYWWQAHLLDCLIDAE

SEQ ID NO: 672626 - protein, 23 aa, Mycobacterium
GTWNGLRAAAAIMRENKRGVIVN

SEQ ID NO: 672627 - protein, 24 aa, Mycobacterium
GTWNGTRLAAAIMRENKRGAIVNM

SEQ ID NO: 672628 - protein, 24 aa, Mycobacterium
GTWNLFKYPGIRSDSDMYTLGFRF

SEQ ID NO: 672629 - protein, 27 aa, Mycobacterium
GTWNVLRAAIPHLRAARSGHIVNVSSI

SEQ ID NO: 672630 - protein, 18 aa, Mycobacterium
GTWSAAIQHGGPVSALLV

SEQ ID NO: 672631 - protein, 18 aa, Mycobacterium
GTWSDALDCAPFDVVVSN

SEQ ID NO: 672632 - protein, 20 aa, Mycobacterium
GTWVLTCIDFAATDLPQCKK

SEQ ID NO: 672633 - protein, 17 aa, Mycobacterium
GTYAGGVFNRLDDLIGG

SEQ ID NO: 672634 - protein, 22 aa, Mycobacterium
GTYEGMPGGVGGTGGAGGEGGL

SEQ ID NO: 672635 - protein, 23 aa, Mycobacterium
GTYFLCADPRPLGYDDSTAFCAA

SEQ ID NO: 672636 - protein, 22 aa, Mycobacterium
GTYLAWLDCRALGFDERAADGL

SEQ ID NO: 672637 - protein, 21 aa, Mycobacterium
GTYLAWLDCRALGIDEEESDG

SEQ ID NO: 672638 - protein, 27 aa, Mycobacterium
GTYRGESRFTTWVYKFVVFEVLNKLKR

SEQ ID NO: 672639 - protein, 17 aa, Mycobacterium
GTYRIAATLAVYLEENR

SEQ ID NO: 672640 - protein, 24 aa, Mycobacterium
GTYRIDGWSLTSFGFKLTPEQQAA

SEQ ID NO: 672641 - protein, 35 aa, Mycobacterium
GTYSRLVSDWAELEPGMSAWDLYGGVGVFAAALGE

SEQ ID NO: 672642 - protein, 25 aa, Mycobacterium
GTYYKGHLYIAGRIKDLVIIDGRNH

SEQ ID NO: 672643 - protein, 17 aa, Mycobacterium
GVAAAAVRTWEIGHRTA

SEQ ID NO: 672644 - protein, 17 aa, Mycobacterium
GVAACWLGGARAVAAAL

SEQ ID NO: 672645 - protein, 18 aa, Mycobacterium
GVAAFPGAAYCEMALAAA

SEQ ID NO: 672646 - protein, 18 aa, Mycobacterium
GVAAGLHLLVTLLADVDD

SEQ ID NO: 672647 - protein, 18 aa, Mycobacterium
GVAAGTFGVNGSDGADGN

SEQ ID NO: 672648 - protein, 24 aa, Mycobacterium
GVAAKICNNMMLFIDMMANSEGSQ

SEQ ID NO: 672649 - protein, 21 aa, Mycobacterium
GVAAPRGLLVPVVRDAQGMTT

SEQ ID NO: 672650 - protein, 18 aa, Mycobacterium
GVAAPRIAASALTPPVPG

SEQ ID NO: 672651 - protein, 19 aa, Mycobacterium
GVAAPTWLTSATELPPLVR

SEQ ID NO: 672652 - protein, 25 aa, Mycobacterium
GVAAQRFGEFNGFWREDGFEPANGV

SEQ ID NO: 672653 - protein, 18 aa, Mycobacterium
GVAARLRMTCVATGAAGP

SEQ ID NO: 672654 - protein, 25 aa, Mycobacterium
GVAARRVRTAHAFHSRLMDPVVAEF

SEQ ID NO: 672655 - protein, 21 aa, Mycobacterium
GVAATKTFVCQVVSGSALMIS

SEQ ID NO: 672656 - protein, 32 aa, Mycobacterium
GVACEGGIRVTGRWSWATGVMDGNWIMVGALC

SEQ ID NO: 672657 - protein, 19 aa, Mycobacterium
GVACSRLAIHAVTVDGQEL

SEQ ID NO: 672658 - protein, 19 aa, Mycobacterium
GVACTNLLMVMGVSDITVL

SEQ ID NO: 672659 - protein, 17 aa, Mycobacterium
GVADARTAWALHTAAGG

SEQ ID NO: 672660 - protein, 17 aa, Mycobacterium
GVADGERYSLGEVTLEF

SEQ ID NO: 672661 - protein, 20 aa, Mycobacterium
GVADLGDWGAAFTATTTTIE

SEQ ID NO: 672662 - protein, 17 aa, Mycobacterium
GVADRLLAEGGLLDTLT

SEQ ID NO: 672663 - protein, 19 aa, Mycobacterium
GVADRVAALVAELGEDAQV

SEQ ID NO: 672664 - protein, 22 aa, Mycobacterium
GVADRVAAVVAELGSDAQVGFH

SEQ ID NO: 672665 - protein, 19 aa, Mycobacterium
GVADWPVTVSHDLDAELPA

SEQ ID NO: 672666 - protein, 18 aa, Mycobacterium
GVAEAIAAATGRGAFSVV

SEQ ID NO: 672667 - protein, 21 aa, Mycobacterium
GVAEALFPRLLEPLRQIACDA

SEQ ID NO: 672668 - protein, 20 aa, Mycobacterium
GVAEFYGQYFIGHWPDDTRI

SEQ ID NO: 672669 - protein, 18 aa, Mycobacterium
GVAEKFPVLLGGAALTRS

SEQ ID NO: 672670 - protein, 22 aa, Mycobacterium
GVAEQLPGLALRVTEDQTERLL

SEQ ID NO: 672671 - protein, 18 aa, Mycobacterium
GVAEVIWATLRGVVLAQM

SEQ ID NO: 672672 - protein, 20 aa, Mycobacterium
GVAEWTQWWGDLPVFDDTAP

SEQ ID NO: 672673 - protein, 18 aa, Mycobacterium
GVAGGGPVHLLPRTEWDR

SEQ ID NO: 672674 - protein, 19 aa, Mycobacterium
GVAGIWRLLERVDEILDHD

SEQ ID NO: 672675 - protein, 23 aa, Mycobacterium
GVAGQGGAAMLIGNGGAGGNGAT

SEQ ID NO: 672676 - protein, 24 aa, Mycobacterium
GVAHMPRLAPARALTPPPTPHWRL

SEQ ID NO: 672677 - protein, 26 aa, Mycobacterium
GVAHRARLAPVKVHPVLRLPEPPSVW

SEQ ID NO: 672678 - protein, 23 aa, Mycobacterium
GVAIDLFAARGFDAVSVDDVAAA

SEQ ID NO: 672679 - protein, 18 aa, Mycobacterium
GVAILKNLYENIAAGDPQ

SEQ ID NO: 672680 - protein, 25 aa, Mycobacterium
GVAIMSVREGIDFGTAVTTDSAPLH

SEQ ID NO: 672681 - protein, 22 aa, Mycobacterium
GVAKEDFELWSLAVSAINGCGH

SEQ ID NO: 672682 - protein, 25 aa, Mycobacterium
GVAKFKAPEQVVIWDALPKNDAGKI

SEQ ID NO: 672683 - protein, 17 aa, Mycobacterium
GVAKFKIPEQVEIWDAL

SEQ ID NO: 672684 - protein, 25 aa, Mycobacterium
GVAKHYGVSVAVCPARRGNRKGVVE

SEQ ID NO: 672685 - protein, 17 aa, Mycobacterium
GVAKSGALLFDPIREAL

SEQ ID NO: 672686 - protein, 32 aa, Mycobacterium
GVAKYPARVKCALLGWMAFKDALAQAITANAL

SEQ ID NO: 672687 - protein, 18 aa, Mycobacterium
GVALAGYRHPVVVDHIRR

SEQ ID NO: 672688 - protein, 20 aa, Mycobacterium
GVALALVYRDGRLERAATRG

SEQ ID NO: 672689 - protein, 18 aa, Mycobacterium
GVALFRKLVEDYEREHDV

SEQ ID NO: 672690 - protein, 18 aa, Mycobacterium
GVALGRRAVDVGGDHVAD

SEQ ID NO: 672691 - protein, 21 aa, Mycobacterium
GVALLSRYPAVSWQVARLPRI

SEQ ID NO: 672692 - protein, 25 aa, Mycobacterium
GVALPDRPATRFANGRLSGTKLGVA

SEQ ID NO: 672693 - protein, 26 aa, Mycobacterium
GVALPRAMAAAMVRPGTQVVSVSGDG

SEQ ID NO: 672694 - protein, 21 aa, Mycobacterium
GVALRHPRGVLVLYVELPEQR

SEQ ID NO: 672695 - protein, 20 aa, Mycobacterium
GVALSLVYRDGRLERGATRG

SEQ ID NO: 672696 - protein, 25 aa, Mycobacterium
GVAMAAWRLGAGRAQPGEPVQLGAG

SEQ ID NO: 672697 - protein, 26 aa, Mycobacterium
GVAMRPDCFDWDAGLKRYLSTYLGDT

SEQ ID NO: 672698 - protein, 20 aa, Mycobacterium
GVAPDALFALMCGDLSAPVT

SEQ ID NO: 672699 - protein, 23 aa, Mycobacterium
GVAPGDAFIGWLPQEHERIPGET

SEQ ID NO: 672700 - protein, 18 aa, Mycobacterium
GVAPQIVDEPFIIGVVGP

SEQ ID NO: 672701 - protein, 23 aa, Mycobacterium
GVAPRLRNAGMMMVDVRDIADVH

SEQ ID NO: 672702 - protein, 29 aa, Mycobacterium
GVARLIALDWGTTALRAWLLGDNGRVLDA

SEQ ID NO: 672703 - protein, 23 aa, Mycobacterium
GVARQRIAVIRAIRNALERRGFV

SEQ ID NO: 672704 - protein, 25 aa, Mycobacterium
GVARRGLTMALIYRGDYWQIAYLMP

SEQ ID NO: 672705 - protein, 18 aa, Mycobacterium
GVARRHFLNYGQTGFTTI

SEQ ID NO: 672706 - protein, 19 aa, Mycobacterium
GVASAVVCYRAFNERSGFR

SEQ ID NO: 672707 - protein, 24 aa, Mycobacterium
GVASDAAGVVGWWVNPQAPGLDAC

SEQ ID NO: 672708 - protein, 17 aa, Mycobacterium
GVASLQLGLSLIWTEAK

SEQ ID NO: 672709 - protein, 19 aa, Mycobacterium
GVASMAFLPWPLRALAGPF

SEQ ID NO: 672710 - protein, 19 aa, Mycobacterium
GVASMLVYKGLRRRAAAAG

SEQ ID NO: 672711 - protein, 20 aa, Mycobacterium
GVASPRAFDGMRVAHVVTLD

SEQ ID NO: 672712 - protein, 25 aa, Mycobacterium
GVASRALAMAVQWARERHQFGRPIG

SEQ ID NO: 672713 - protein, 44 aa, Mycobacterium
GVATGYARRSGLTASRFVACPFGGPGARMYRTGDLVRWGTDGQL

SEQ ID NO: 672714 - protein, 43 aa, Mycobacterium
GVATGYSRRSGLTASRFVACPFGGPGARMYRTGDLVRWSHDGQ

SEQ ID NO: 672715 - protein, 32 aa, Mycobacterium
GVATSIWPHGRWRLAFRGEANHAGTTRLVDRH

SEQ ID NO: 672716 - protein, 18 aa, Mycobacterium
GVAVDWAAVFAAHRPRRV

SEQ ID NO: 672717 - protein, 19 aa, Mycobacterium
GVAVGGFGIHPVVLDAALH

SEQ ID NO: 672718 - protein, 17 aa, Mycobacterium
GVAYLAFSHDFARTGDV

SEQ ID NO: 672719 - protein, 17 aa, Mycobacterium
GVAYVCFIVDAHSRMIV

SEQ ID NO: 672720 - protein, 19 aa, Mycobacterium
GVCAARIILVGAPTREGDV

SEQ ID NO: 672721 - protein, 18 aa, Mycobacterium
GVCAQLATAHAFASLGED

SEQ ID NO: 672722 - protein, 22 aa, Mycobacterium
GVCGIPGWQAARAVLADKKRAR

SEQ ID NO: 672723 - protein, 23 aa, Mycobacterium
GVCPEAFGRFAVDGYGRLLGASG

SEQ ID NO: 672724 - protein, 29 aa, Mycobacterium
GVCRACKRGRPQYCFDTFNAAQKMTLTDG

SEQ ID NO: 672725 - protein, 17 aa, Mycobacterium
GVCSCAASSSPSGAGDC

SEQ ID NO: 672726 - protein, 18 aa, Mycobacterium
GVDAGLLEAFRGYVDATV

SEQ ID NO: 672727 - protein, 22 aa, Mycobacterium
GVDARLSRYSYLVSLLPRSIVD

SEQ ID NO: 672728 - protein, 19 aa, Mycobacterium
GVDARRRWMAPWLTGDTEG

SEQ ID NO: 672729 - protein, 21 aa, Mycobacterium
GVDASMVLYLFGSKEALFRES

SEQ ID NO: 672730 - protein, 21 aa, Mycobacterium
GVDATQCCVALLFARVHGDTA

SEQ ID NO: 672731 - protein, 23 aa, Mycobacterium
GVDEARALYEWNHAKQILRIQSG

SEQ ID NO: 672732 - protein, 19 aa, Mycobacterium
GVDEHVVFTGGVPWEELPA

SEQ ID NO: 672733 - protein, 24 aa, Mycobacterium
GVDEKRMFGGLAFLIDGHLAVAVS

SEQ ID NO: 672734 - protein, 17 aa, Mycobacterium
GVDESWLGARVAVEPNL

SEQ ID NO: 672735 - protein, 24 aa, Mycobacterium
GVDEVWAVGGAQAVALLAYGGTDT

SEQ ID NO: 672736 - protein, 25 aa, Mycobacterium
GVDEVWPGPGVVYFTRVSAERTRSM

SEQ ID NO: 672737 - protein, 19 aa, Mycobacterium
GVDFSRSLADLGFSSVHTV

SEQ ID NO: 672738 - protein, 29 aa, Mycobacterium
GVDGEPLFMAGLWTTWRPPGAPKDHAPLV

SEQ ID NO: 672739 - protein, 24 aa, Mycobacterium
GVDGFPNLFLISGPGAPAVLANMV

SEQ ID NO: 672740 - protein, 17 aa, Mycobacterium
GVDGLRAAIGNPVDDQP

SEQ ID NO: 672741 - protein, 26 aa, Mycobacterium
GVDGRAAVIPISWAAAGNTSAPPAIW

SEQ ID NO: 672742 - protein, 26 aa, Mycobacterium
GVDGRFGIGLVDWVMRNEAGLLEDAL

SEQ ID NO: 672743 - protein, 26 aa, Mycobacterium
GVDGSVCKWARVLICEPPDRVVFTWD

SEQ ID NO: 672744 - protein, 25 aa, Mycobacterium
GVDICADIASAGYPMAGREELDETV

SEQ ID NO: 672745 - protein, 21 aa, Mycobacterium
GVDICRQLDGVLYAMATPEDL

SEQ ID NO: 672746 - protein, 18 aa, Mycobacterium
GVDIERIILVGGGARSEA

SEQ ID NO: 672747 - protein, 24 aa, Mycobacterium
GVDIQRSLPVFGWQDQHGHCEIVF

SEQ ID NO: 672748 - protein, 30 aa, Mycobacterium
GVDITPEMAHCLYAGLVTDSGSFRWATPRG

SEQ ID NO: 672749 - protein, 25 aa, Mycobacterium
GVDKFPRMVDYVLPSGVRIADADRV

SEQ ID NO: 672750 - protein, 25 aa, Mycobacterium
GVDKFPRMVDYVLPTGVRIADADRV

SEQ ID NO: 672751 - protein, 22 aa, Mycobacterium
GVDLATSVGALWDLTSDTSAYI

SEQ ID NO: 672752 - protein, 18 aa, Mycobacterium
GVDLGWWTGSRLVVDRST

SEQ ID NO: 672753 - protein, 24 aa, Mycobacterium
GVDLRIPNMPPLGVGYTQRDGELV

SEQ ID NO: 672754 - protein, 20 aa, Mycobacterium
GVDLRWGHELTGIRPGAESV

SEQ ID NO: 672755 - protein, 25 aa, Mycobacterium
GVDMKPELLVSMFGDIDNFTMVKES

SEQ ID NO: 672756 - protein, 23 aa, Mycobacterium
GVDMPPELLVRMFDTIENVTMVK

SEQ ID NO: 672757 - protein, 23 aa, Mycobacterium
GVDMPPELLVRMFESIDNVTMVK

SEQ ID NO: 672758 - protein, 18 aa, Mycobacterium
GVDNLRQLYAFLSDTVLM

SEQ ID NO: 672759 - protein, 18 aa, Mycobacterium
GVDPALVMHYFGSKAGLF

SEQ ID NO: 672760 - protein, 34 aa, Mycobacterium
GVDPAWEWNPALLALRAELERVFLAGVRRDVGPI

SEQ ID NO: 672761 - protein, 17 aa, Mycobacterium
GVDPWAQGAEPFREASR

SEQ ID NO: 672762 - protein, 20 aa, Mycobacterium
GVDQLRLVYPNGEKINSESL

SEQ ID NO: 672763 - protein, 20 aa, Mycobacterium
GVDQVRYFLLREVPFGQDGS

SEQ ID NO: 672764 - protein, 17 aa, Mycobacterium
GVDRGFTVARYAQDVYV

SEQ ID NO: 672765 - protein, 20 aa, Mycobacterium
GVDRILRYAFELAQRRPRRL

SEQ ID NO: 672766 - protein, 24 aa, Mycobacterium
GVDRPRYLGGAGRWRDSGMEGTPA

SEQ ID NO: 672767 - protein, 25 aa, Mycobacterium
GVDRVHLLAHDWGSIQGWAAVTADS

SEQ ID NO: 672768 - protein, 17 aa, Mycobacterium
GVDSIREVIAFPKSGGG

SEQ ID NO: 672769 - protein, 21 aa, Mycobacterium
GVDVRLGVGVAEVRGEGRVDT

SEQ ID NO: 672770 - protein, 22 aa, Mycobacterium
GVDVTAWPAVVVRAYTESFVLA

SEQ ID NO: 672771 - protein, 17 aa, Mycobacterium
GVDVYPLQVGVGLEEVE

SEQ ID NO: 672772 - protein, 22 aa, Mycobacterium
GVDWKGTLTGLAGYASGDLDTR

SEQ ID NO: 672773 - protein, 18 aa, Mycobacterium
GVEAGLLGPESFPDTYPW

SEQ ID NO: 672774 - protein, 23 aa, Mycobacterium
GVEAICAMIARYGEHVKASTQTE

SEQ ID NO: 672775 - protein, 26 aa, Mycobacterium
GVEAKWAASISGYWRRGRTEETFRQW

SEQ ID NO: 672776 - protein, 26 aa, Mycobacterium
GVEAKWASSISGYWRRGRTEETFRQW

SEQ ID NO: 672777 - protein, 21 aa, Mycobacterium
GVEALRYRPNLVIATPPDYPP

SEQ ID NO: 672778 - protein, 18 aa, Mycobacterium
GVEASLRALARIAPTQSH

SEQ ID NO: 672779 - protein, 18 aa, Mycobacterium
GVEAYRLDDYRAEVDRCA

SEQ ID NO: 672780 - protein, 19 aa, Mycobacterium
GVEDELLKLGARPGCAVTI

SEQ ID NO: 672781 - protein, 24 aa, Mycobacterium
GVEEKRMFGGLAFLVNGNMSVAVS

SEQ ID NO: 672782 - protein, 19 aa, Mycobacterium
GVEFFEVFCDTPLADCEAR

SEQ ID NO: 672783 - protein, 25 aa, Mycobacterium
GVEFRRRLLATIAHHLKPEGKAIIQ

SEQ ID NO: 672784 - protein, 27 aa, Mycobacterium
GVEGLLASMAFCIDKIVSYGVDIERII

SEQ ID NO: 672785 - protein, 22 aa, Mycobacterium
GVEGWGEAFGFSAVDSAKLAVD

SEQ ID NO: 672786 - protein, 23 aa, Mycobacterium
GVEIKAGTVLMLCLGAANRDPRK

SEQ ID NO: 672787 - protein, 22 aa, Mycobacterium
GVEIPARSVVGVCIGSANRDER

SEQ ID NO: 672788 - protein, 26 aa, Mycobacterium
GVEKVADLKAGMILEGVVTNVAAFGA

SEQ ID NO: 672789 - protein, 26 aa, Mycobacterium
GVEKVADLKPGMILEGVVTNVAAFGA

SEQ ID NO: 672790 - protein, 26 aa, Mycobacterium
GVEKVSDLKAGMVLEGVVTNVAAFGA

SEQ ID NO: 672791 - protein, 19 aa, Mycobacterium
GVELELFERIQRAMGLPRV

SEQ ID NO: 672792 - protein, 21 aa, Mycobacterium
GVELIKSLNYVLARGGNPSPW

SEQ ID NO: 672793 - protein, 17 aa, Mycobacterium
GVELTAKVRARFQAYLD

SEQ ID NO: 672794 - protein, 28 aa, Mycobacterium
GVELVARCNPRRAPKLAQTVRLRKSPDG

SEQ ID NO: 672795 - protein, 30 aa, Mycobacterium
GVEMAGALKNVFAIASGMGYAIGIGENTRA

SEQ ID NO: 672796 - protein, 25 aa, Mycobacterium
GVEMCRRAGAEVGRVEAEWRERLGD

SEQ ID NO: 672797 - protein, 26 aa, Mycobacterium
GVENEKFRAGWCVPGVGQPNHDAVVG

SEQ ID NO: 672798 - protein, 22 aa, Mycobacterium
GVENRWRPGPFGVQVRPGAGVD

SEQ ID NO: 672799 - protein, 20 aa, Mycobacterium
GVENTGVVSAVFGSDNSGVS

SEQ ID NO: 672800 - protein, 24 aa, Mycobacterium
GVEPIAVSGSFLWAPDPGAMQVVT

SEQ ID NO: 672801 - protein, 19 aa, Mycobacterium
GVEPLAAAAARMITAATGT

SEQ ID NO: 672802 - protein, 18 aa, Mycobacterium
GVEPLAAASARMITASTD

SEQ ID NO: 672803 - protein, 17 aa, Mycobacterium
GVEQRCCDEHVALDLNV

SEQ ID NO: 672804 - protein, 20 aa, Mycobacterium
GVEQVWFRDGWVDRFGLDLP

SEQ ID NO: 672805 - protein, 22 aa, Mycobacterium
GVERLARRFWRARKHGASIQLL

SEQ ID NO: 672806 - protein, 25 aa, Mycobacterium
GVERMQFCSEFEWISPSGRGLLTHY

SEQ ID NO: 672807 - protein, 18 aa, Mycobacterium
GVESFRLSEATTRTLGEL

SEQ ID NO: 672808 - protein, 20 aa, Mycobacterium
GVESMSRWGVTAGVPTIDGN

SEQ ID NO: 672809 - protein, 19 aa, Mycobacterium
GVEVAELLVNQILVQDDSF

SEQ ID NO: 672810 - protein, 18 aa, Mycobacterium
GVEVAHRLYAKGANVVLT

SEQ ID NO: 672811 - protein, 17 aa, Mycobacterium
GVEVCLNHAVYDSYSGA

SEQ ID NO: 672812 - protein, 18 aa, Mycobacterium
GVEVGQSYPFAPPVGLMF

SEQ ID NO: 672813 - protein, 25 aa, Mycobacterium
GVEVLGRAGLGVSLAGVGYAAQDAA

SEQ ID NO: 672814 - protein, 19 aa, Mycobacterium
GVEVRPIIQLTGDSEFNEV

SEQ ID NO: 672815 - protein, 17 aa, Mycobacterium
GVEWCGTAGAGGDHNVV

SEQ ID NO: 672816 - protein, 19 aa, Mycobacterium
GVEWRHIIDVALVVREVLE

SEQ ID NO: 672817 - protein, 19 aa, Mycobacterium
GVFARRDRYVTNWDDTPVA

SEQ ID NO: 672818 - protein, 18 aa, Mycobacterium
GVFDGTVRMCLGYTEPEG

SEQ ID NO: 672819 - protein, 28 aa, Mycobacterium
GVFDRFPTLRIVFVEHAFSWILPLMWRM

SEQ ID NO: 672820 - protein, 18 aa, Mycobacterium
GVFEAEFGDGSKLGLQID

SEQ ID NO: 672821 - protein, 29 aa, Mycobacterium
GVFERFADLKFVWADGAADFLTPFIWRMD

SEQ ID NO: 672822 - protein, 28 aa, Mycobacterium
GVFERFAELKFIWADGAADFVTPFIWRM

SEQ ID NO: 672823 - protein, 28 aa, Mycobacterium
GVFERFGNLKFVWADGAADFVTPFIWRM

SEQ ID NO: 672824 - protein, 31 aa, Mycobacterium
GVFERFPRLRWGVTECGAFWANDLLWLMDTR

SEQ ID NO: 672825 - protein, 28 aa, Mycobacterium
GVFERMPALKFVWADGAADLLTPFIWRM

SEQ ID NO: 672826 - protein, 17 aa, Mycobacterium
GVFERMPDLKFVWADGA

SEQ ID NO: 672827 - protein, 24 aa, Mycobacterium
GVFGDAVAMFPSWETLPHERLSPG

SEQ ID NO: 672828 - protein, 24 aa, Mycobacterium
GVFGDAVAVFPSWETLPHERLSPG

SEQ ID NO: 672829 - protein, 25 aa, Mycobacterium
GVFGDSVALFPSWETLPHERLSPGV

SEQ ID NO: 672830 - protein, 25 aa, Mycobacterium
GVFGGGNGGRAWLLGNGGAGGDSSS

SEQ ID NO: 672831 - protein, 26 aa, Mycobacterium
GVFGGSWRFPATDSLASYRIEHYTTI

SEQ ID NO: 672832 - protein, 27 aa, Mycobacterium
GVFGPRIRWRAMLDLLVAEGFPIEVPR

SEQ ID NO: 672833 - protein, 25 aa, Mycobacterium
GVFHTLRAAIPVMRQQRFGRIVATS

SEQ ID NO: 672834 - protein, 26 aa, Mycobacterium
GVFLELFKGPALAEAIGHPFELQQAN

SEQ ID NO: 672835 - protein, 17 aa, Mycobacterium
GVFPRLGAVDGDDALAR

SEQ ID NO: 672836 - protein, 17 aa, Mycobacterium
GVFPRLGVVDGDDALAR

SEQ ID NO: 672837 - protein, 18 aa, Mycobacterium
GVFPSGVAAPTWLTSATE

SEQ ID NO: 672838 - protein, 22 aa, Mycobacterium
GVFPVASWPVTPGHEIAGTVAE

SEQ ID NO: 672839 - protein, 28 aa, Mycobacterium
GVFREPLPRIGLDSLPEQGAWLQPFRPL

SEQ ID NO: 672840 - protein, 27 aa, Mycobacterium
GVFRESLPRIGLDSLPEQGAWLQPFRP

SEQ ID NO: 672841 - protein, 17 aa, Mycobacterium
GVFRGALDAGARRITEK

SEQ ID NO: 672842 - protein, 17 aa, Mycobacterium
GVFRGALDAGARRITQR

SEQ ID NO: 672843 - protein, 17 aa, Mycobacterium
GVFRIVEQLPRKVALEL

SEQ ID NO: 672844 - protein, 19 aa, Mycobacterium
GVFRRLPDVLFDIRIEDQD

SEQ ID NO: 672845 - protein, 19 aa, Mycobacterium
GVFSHGFTLGKDCPAAARI

SEQ ID NO: 672846 - protein, 24 aa, Mycobacterium
GVFVPRPETEAVLEWAGAQQLSEY

SEQ ID NO: 672847 - protein, 22 aa, Mycobacterium
GVGAFARMALAVAKRLQDQGIG

SEQ ID NO: 672848 - protein, 18 aa, Mycobacterium
GVGAFLAWGDPSLYDSTL

SEQ ID NO: 672849 - protein, 24 aa, Mycobacterium
GVGANEILVAAALGNNNSAIANAT

SEQ ID NO: 672850 - protein, 18 aa, Mycobacterium
GVGAPDFAGVPIDVLLDQ

SEQ ID NO: 672851 - protein, 23 aa, Mycobacterium
GVGATRLRVHLARTQSNVVDVQL

SEQ ID NO: 672852 - protein, 20 aa, Mycobacterium
GVGAVEAWTTPFTRDGQPEK

SEQ ID NO: 672853 - protein, 18 aa, Mycobacterium
GVGCTRLAIHAVTANGEQ

SEQ ID NO: 672854 - protein, 24 aa, Mycobacterium
GVGDAFRAGFLTGRSAGLNLERAA

SEQ ID NO: 672855 - protein, 24 aa, Mycobacterium
GVGDAFRAGFLTGRSAGLNLERSA

SEQ ID NO: 672856 - protein, 24 aa, Mycobacterium
GVGDAWRAGFLSARSAGLNLERSA

SEQ ID NO: 672857 - protein, 20 aa, Mycobacterium
GVGDPGYFSRLFGRIHGASP

SEQ ID NO: 672858 - protein, 18 aa, Mycobacterium
GVGDSVIFDATYRSPQAL

SEQ ID NO: 672859 - protein, 19 aa, Mycobacterium
GVGFFDAGVPRRWRSASPL

SEQ ID NO: 672860 - protein, 19 aa, Mycobacterium
GVGFFDGGVPRRWRSAAPL

SEQ ID NO: 672861 - protein, 17 aa, Mycobacterium
GVGFVVGAAHHLDAALR

SEQ ID NO: 672862 - protein, 17 aa, Mycobacterium
GVGFVVWRGPEYLPEEL

SEQ ID NO: 672863 - protein, 28 aa, Mycobacterium
GVGGAGGKGGLLFGAGGEGGAGGTGGAG

SEQ ID NO: 672864 - protein, 24 aa, Mycobacterium
GVGGDGGNAAGLFGDGGTGGNGGL

SEQ ID NO: 672865 - protein, 24 aa, Mycobacterium
GVGGEGGAVFGYAQGGTGGIGGFA

SEQ ID NO: 672866 - protein, 28 aa, Mycobacterium
GVGGEGGRGGQWFGHGGGGGAGGAGGAD

SEQ ID NO: 672867 - protein, 26 aa, Mycobacterium
GVGGEGSGRLFGLGGAGGAGGTGITS

SEQ ID NO: 672868 - protein, 26 aa, Mycobacterium
GVGGIGGRAGLLWGHTGTAGISTLLS

SEQ ID NO: 672869 - protein, 20 aa, Mycobacterium
GVGGLAARLGYTVRQLERVT

SEQ ID NO: 672870 - protein, 25 aa, Mycobacterium
GVGGLRGGFEYARTGNPTRQSLEAA

SEQ ID NO: 672871 - protein, 28 aa, Mycobacterium
GVGGPVEWHKMGSGWSWTRKSGTEVDHA

SEQ ID NO: 672872 - protein, 24 aa, Mycobacterium
GVGGRAAVQIGRRLAKLAHTHQVI

SEQ ID NO: 672873 - protein, 23 aa, Mycobacterium
GVGGRAAVQIGRRLAKLARTHQV

SEQ ID NO: 672874 - protein, 24 aa, Mycobacterium
GVGGRAAVQIGRRLAKLARTHQVI

SEQ ID NO: 672875 - protein, 18 aa, Mycobacterium
GVGGRGTDGVETGSTGLF

SEQ ID NO: 672876 - protein, 18 aa, Mycobacterium
GVGGRLCVGGGGSTTADV

SEQ ID NO: 672877 - protein, 25 aa, Mycobacterium
GVGGTGGAGGWLLGNGGAGGAGGAS

SEQ ID NO: 672878 - protein, 26 aa, Mycobacterium
GVGGTGGNAVMFGNGGAGGMGGAGAD

SEQ ID NO: 672879 - protein, 22 aa, Mycobacterium
GVGGTWHWNTYPGIAVDIPSFS

SEQ ID NO: 672880 - protein, 26 aa, Mycobacterium
GVGHPILYVAQAWDWIFPLTEDPNYE

SEQ ID NO: 672881 - protein, 19 aa, Mycobacterium
GVGIWPWASTATGEPDVVL

SEQ ID NO: 672882 - protein, 17 aa, Mycobacterium
GVGKAAIYRRWSSKVAL

SEQ ID NO: 672883 - protein, 25 aa, Mycobacterium
GVGKGDRVILMLGNQVELWEAMLGI

SEQ ID NO: 672884 - protein, 17 aa, Mycobacterium
GVGKGDVVVLWLPSGID

SEQ ID NO: 672885 - protein, 18 aa, Mycobacterium
GVGKGTIYLYWPSKLELF

SEQ ID NO: 672886 - protein, 17 aa, Mycobacterium
GVGKPTVYRRWGTKEEL

SEQ ID NO: 672887 - protein, 18 aa, Mycobacterium
GVGKSRLAREVVQSLAGA

SEQ ID NO: 672888 - protein, 24 aa, Mycobacterium
GVGKTRLAGEWCRHAYDDGALVIY

SEQ ID NO: 672889 - protein, 25 aa, Mycobacterium
GVGKTRLAGEWSQRAYEMGAVVLYG

SEQ ID NO: 672890 - protein, 23 aa, Mycobacterium
GVGKTRLALEVARREQDRFSDGV

SEQ ID NO: 672891 - protein, 17 aa, Mycobacterium
GVGKTSLLREVQRAAEA

SEQ ID NO: 672892 - protein, 25 aa, Mycobacterium
GVGKWNLDLGDLVPALSVRDAHGSN

SEQ ID NO: 672893 - protein, 17 aa, Mycobacterium
GVGLGMPGVGRPVAADP

SEQ ID NO: 672894 - protein, 23 aa, Mycobacterium
GVGLLFLQWANLLGVNVIGTVSN

SEQ ID NO: 672895 - protein, 18 aa, Mycobacterium
GVGLRYLLQHGYVADFHI

SEQ ID NO: 672896 - protein, 18 aa, Mycobacterium
GVGLSEVMPPVATDGRPD

SEQ ID NO: 672897 - protein, 27 aa, Mycobacterium
GVGLVLRLLPGMRARGSGHIVHSSSIG

SEQ ID NO: 672898 - protein, 17 aa, Mycobacterium
GVGNHWWYQLTAADFQA

SEQ ID NO: 672899 - protein, 19 aa, Mycobacterium
GVGNHWWYQLVAADFQSCQ

SEQ ID NO: 672900 - protein, 31 aa, Mycobacterium
GVGPGDCVAVLFPRCADAIVSMLAVLKTGAA

SEQ ID NO: 672901 - protein, 20 aa, Mycobacterium
GVGPGDVVGIMLRNSPNTVL

SEQ ID NO: 672902 - protein, 20 aa, Mycobacterium
GVGPGDVVGIMLRNSPNTVV

SEQ ID NO: 672903 - protein, 23 aa, Mycobacterium
GVGPGQTVALLFSRSAEAVAAMM

SEQ ID NO: 672904 - protein, 23 aa, Mycobacterium
GVGPKAELTWFIPGSGAVWGPAK

SEQ ID NO: 672905 - protein, 19 aa, Mycobacterium
GVGPRLAMATLAVHDAAAL

SEQ ID NO: 672906 - protein, 25 aa, Mycobacterium
GVGPTIAAAVIDWFTVDWHRAIVDK

SEQ ID NO: 672907 - protein, 17 aa, Mycobacterium
GVGPVLVRHLWERGVPA

SEQ ID NO: 672908 - protein, 19 aa, Mycobacterium
GVGPWELERGLPLPEDPRY

SEQ ID NO: 672909 - protein, 17 aa, Mycobacterium
GVGQWRTLRRVPIGGEA

SEQ ID NO: 672910 - protein, 19 aa, Mycobacterium
GVGRLKRPWLAGYLGPEVM

SEQ ID NO: 672911 - protein, 23 aa, Mycobacterium
GVGRPQFSAVLECSAAARELGGH

SEQ ID NO: 672912 - protein, 23 aa, Mycobacterium
GVGRPQFSAVVECASAAKELGGH

SEQ ID NO: 672913 - protein, 23 aa, Mycobacterium
GVGRPQLSAVIECAAAARELGAH

SEQ ID NO: 672914 - protein, 22 aa, Mycobacterium
GVGRQCGIEGFAQYTETKTIGW

SEQ ID NO: 672915 - protein, 22 aa, Mycobacterium
GVGRQCGIEGFSQYLETKTIAR

SEQ ID NO: 672916 - protein, 19 aa, Mycobacterium
GVGRWNLDLGDVVPALTVA

SEQ ID NO: 672917 - protein, 19 aa, Mycobacterium
GVGSAENFSVVEALADSLG

SEQ ID NO: 672918 - protein, 26 aa, Mycobacterium
GVGSAWAGVCTPEFVDVPTEALLRQL

SEQ ID NO: 672919 - protein, 26 aa, Mycobacterium
GVGSCRDSAWLLVSILRQLGLAARFV

SEQ ID NO: 672920 - protein, 21 aa, Mycobacterium
GVGSKGWYVAPTVLAGVAPQA

SEQ ID NO: 672921 - protein, 17 aa, Mycobacterium
GVGSWPGIAAREAAAVI

SEQ ID NO: 672922 - protein, 24 aa, Mycobacterium
GVGSWPGILARPAAEVVVGELADA

SEQ ID NO: 672923 - protein, 26 aa, Mycobacterium
GVGTFSWPGAYGTWWQADPTADLVLI

SEQ ID NO: 672924 - protein, 18 aa, Mycobacterium
GVGTLDLFYSESLEYARR

SEQ ID NO: 672925 - protein, 21 aa, Mycobacterium
GVGTLELLDIISRGFPAPPEH

SEQ ID NO: 672926 - protein, 17 aa, Mycobacterium
GVGTLVMTHYVPALVPG

SEQ ID NO: 672927 - protein, 24 aa, Mycobacterium
GVGTPGGDGGILYGNGGNGGTSTN

SEQ ID NO: 672928 - protein, 24 aa, Mycobacterium
GVGTRPESLGGMVSEADALRQEAQ

SEQ ID NO: 672929 - protein, 39 aa, Mycobacterium
GVGVGYWRRGALSAARFVACPFGAAGSRMYRTGDLVCWA

SEQ ID NO: 672930 - protein, 39 aa, Mycobacterium
GVGVGYWRRGALSATRFVACPFGAGGSRMYRTGDLVCWG

SEQ ID NO: 672931 - protein, 39 aa, Mycobacterium
GVGVGYWRRGGFSATRFVACPFGAAGSRMYRTGDLVCWG

SEQ ID NO: 672932 - protein, 28 aa, Mycobacterium
GVGVGYWRRGGLSAAQFVACPFGAAGSR

SEQ ID NO: 672933 - protein, 18 aa, Mycobacterium
GVGVLAVRPELAERLQPR

SEQ ID NO: 672934 - protein, 23 aa, Mycobacterium
GVGVMLPVFVVRAGGGILEDADG

SEQ ID NO: 672935 - protein, 24 aa, Mycobacterium
GVGVREFIDYDLAELREYIDWQPF

SEQ ID NO: 672936 - protein, 20 aa, Mycobacterium
GVGWDHGYGDLRFVTDPDTL

SEQ ID NO: 672937 - protein, 27 aa, Mycobacterium
GVGWLKEEYDAIGVPFTKRGRMADEYL

SEQ ID NO: 672938 - protein, 23 aa, Mycobacterium
GVGWLQREFELLGVPFHERGRMA

SEQ ID NO: 672939 - protein, 22 aa, Mycobacterium
GVGYLLKSRIGDVGEFADACTR

SEQ ID NO: 672940 - protein, 37 aa, Mycobacterium
GVGYWRRGALSAARFVACPFGAAGSRMYRTGDLVCWG

SEQ ID NO: 672941 - protein, 37 aa, Mycobacterium
GVGYWRRGGFSAARFVACPFGAAGSRMYRTGDLVCWG

SEQ ID NO: 672942 - protein, 19 aa, Mycobacterium
GVHAFYASSAREWWAPLRA

SEQ ID NO: 672943 - protein, 19 aa, Mycobacterium
GVHALCPGFVRTEFHARAG

SEQ ID NO: 672944 - protein, 24 aa, Mycobacterium
GVHCGLEKCAAASGSSVAARSTVA

SEQ ID NO: 672945 - protein, 17 aa, Mycobacterium
GVHEVRPGVQIVAAPWR

SEQ ID NO: 672946 - protein, 26 aa, Mycobacterium
GVHLAYKCRVRTPWYLVPLVEPADLL

SEQ ID NO: 672947 - protein, 25 aa, Mycobacterium
GVHNPSLLGLVGMGLPGDIGQRHIQ

SEQ ID NO: 672948 - protein, 27 aa, Mycobacterium
GVHPCLQSRIAAAWLWSRGSATVGGAA

SEQ ID NO: 672949 - protein, 17 aa, Mycobacterium
GVHPNGADAWALQDVLA

SEQ ID NO: 672950 - protein, 18 aa, Mycobacterium
GVHPNGADAWALQDVLAL

SEQ ID NO: 672951 - protein, 18 aa, Mycobacterium
GVHRCLGSNLARLEFQVG

SEQ ID NO: 672952 - protein, 17 aa, Mycobacterium
GVHSAWVNSHEGVAITQ

SEQ ID NO: 672953 - protein, 24 aa, Mycobacterium
GVHSCPGAPLARVEGRVSIERILD

SEQ ID NO: 672954 - protein, 24 aa, Mycobacterium
GVHSCPGGPLARVEGRVSLERILD

SEQ ID NO: 672955 - protein, 17 aa, Mycobacterium
GVHSIPIVSQGCRPIGR

SEQ ID NO: 672956 - protein, 19 aa, Mycobacterium
GVHTLPMLYALREPGPAAA

SEQ ID NO: 672957 - protein, 17 aa, Mycobacterium
GVHTLPMVYALREPGPD

SEQ ID NO: 672958 - protein, 20 aa, Mycobacterium
GVHVDLRMDNFYPLTDFFPP

SEQ ID NO: 672959 - protein, 34 aa, Mycobacterium
GVHVWDWAAAALIAAEAGATVWLPAGGGGGKVIA

SEQ ID NO: 672960 - protein, 19 aa, Mycobacterium
GVIACAFGDPRDADAAAIL

SEQ ID NO: 672961 - protein, 26 aa, Mycobacterium
GVIARIDWARFLPLYQQAGKRGFLAE

SEQ ID NO: 672962 - protein, 17 aa, Mycobacterium
GVIAWLGSDEVGRSMFP

SEQ ID NO: 672963 - protein, 17 aa, Mycobacterium
GVIDFCREHLAGFKCPR

SEQ ID NO: 672964 - protein, 30 aa, Mycobacterium
GVIDRLAAVLPGLALEHAEWVAALHAGAGL

SEQ ID NO: 672965 - protein, 27 aa, Mycobacterium
GVIEECLRLSLDYAKSRTLWGKEIAQF

SEQ ID NO: 672966 - protein, 26 aa, Mycobacterium
GVIEECLRLSVDYAKSRKLWGQEIGQ

SEQ ID NO: 672967 - protein, 26 aa, Mycobacterium
GVIEECLRLSVDYAKTRKLWGQEIGQ

SEQ ID NO: 672968 - protein, 17 aa, Mycobacterium
GVIGPRTRMRWEQVADW

SEQ ID NO: 672969 - protein, 19 aa, Mycobacterium
GVIGRLSAPLSEPVAAMYA

SEQ ID NO: 672970 - protein, 22 aa, Mycobacterium
GVIGRLVAVNGMWLTKKSDDYF

SEQ ID NO: 672971 - protein, 17 aa, Mycobacterium
GVIGRWLQKLLSSSRKS

SEQ ID NO: 672972 - protein, 22 aa, Mycobacterium
GVIGVEFASLWTSLGSSVTIVE

SEQ ID NO: 672973 - protein, 17 aa, Mycobacterium
GVIGVMRHFARSLAEKN

SEQ ID NO: 672974 - protein, 17 aa, Mycobacterium
GVIKPGESLIFVVDLLD

SEQ ID NO: 672975 - protein, 23 aa, Mycobacterium
GVIKPGHVAAVRFTINGIYKGET

SEQ ID NO: 672976 - protein, 21 aa, Mycobacterium
GVILATRLAAKIKEFAGEDVP

SEQ ID NO: 672977 - protein, 17 aa, Mycobacterium
GVINYILSNGLDFREYV

SEQ ID NO: 672978 - protein, 17 aa, Mycobacterium
GVIPGSMGTRSYVVRGK

SEQ ID NO: 672979 - protein, 18 aa, Mycobacterium
GVIPLDLSKELGVETGAA

SEQ ID NO: 672980 - protein, 25 aa, Mycobacterium
GVIPRGMLRNVCFLASVCGVDPLTA

SEQ ID NO: 672981 - protein, 17 aa, Mycobacterium
GVITRVRVRVHPVPEST

SEQ ID NO: 672982 - protein, 19 aa, Mycobacterium
GVIVNLPLGNMVLSRGNTG

SEQ ID NO: 672983 - protein, 24 aa, Mycobacterium
GVIWGIDSFDQWGVELGKTQAKAL

SEQ ID NO: 672984 - protein, 19 aa, Mycobacterium
GVIYAEWTEEFVANPDMSL

SEQ ID NO: 672985 - protein, 17 aa, Mycobacterium
GVIYPGLAQRMSAGRGI

SEQ ID NO: 672986 - protein, 18 aa, Mycobacterium
GVKAEYPDQLLAYNCSPS

SEQ ID NO: 672987 - protein, 17 aa, Mycobacterium
GVKEVLDTWLYGKDILD

SEQ ID NO: 672988 - protein, 40 aa, Mycobacterium
GVKFKDAELLGMPWIVVVGRGWADGVVELRDRFSGQTREL

SEQ ID NO: 672989 - protein, 41 aa, Mycobacterium
GVKFKDAELLGMPWIVVVGRGWADGVVELRNRFTGETREIA

SEQ ID NO: 672990 - protein, 27 aa, Mycobacterium
GVKFKDAELLGVPWILVVGRGWANGVV

SEQ ID NO: 672991 - protein, 34 aa, Mycobacterium
GVKFKDAELLGVPWIVVIGRGWADGTIELRNRFT

SEQ ID NO: 672992 - protein, 35 aa, Mycobacterium
GVKFKDAELLGVPWIVVVGRGWADGVVELRDRFGG

SEQ ID NO: 672993 - protein, 40 aa, Mycobacterium
GVKFKDAELLGVPWIVVVGRGWADGVVELRDRFSGEKREI

SEQ ID NO: 672994 - protein, 22 aa, Mycobacterium
GVKLFALLVRFSVRPGHEDAFD

SEQ ID NO: 672995 - protein, 20 aa, Mycobacterium
GVKNYPAYFGFLKSKLRTGG

SEQ ID NO: 672996 - protein, 34 aa, Mycobacterium
GVKNYPAYFGFLKSRLRTGGLLLNHCITRHDNKS

SEQ ID NO: 672997 - protein, 20 aa, Mycobacterium
GVKPRVPAIPGIDHPMVLSY

SEQ ID NO: 672998 - protein, 17 aa, Mycobacterium
GVKPVYLGASWEGGWRC

SEQ ID NO: 672999 - protein, 17 aa, Mycobacterium
GVKQALVYYYFPTMDDL

SEQ ID NO: 673000 - protein, 20 aa, Mycobacterium
GVKTESPPLFGVYNASKAAL

SEQ ID NO: 673001 - protein, 18 aa, Mycobacterium
GVKVALLVGDRAGGELAW

SEQ ID NO: 673002 - protein, 19 aa, Mycobacterium
GVKVCGYVDASYWRDMGTP

SEQ ID NO: 673003 - protein, 26 aa, Mycobacterium
GVKVICRRSQLMLRISGAGAMASVDL

SEQ ID NO: 673004 - protein, 19 aa, Mycobacterium
GVKVTGCTVHLVDAGMDTG

SEQ ID NO: 673005 - protein, 17 aa, Mycobacterium
GVKVTGCTVHLVDAGVD

SEQ ID NO: 673006 - protein, 21 aa, Mycobacterium
GVLAAGWPAGHEHALQRACAA

SEQ ID NO: 673007 - protein, 29 aa, Mycobacterium
GVLAEAKVPWILMHWRSVDADHPHRVPGY

SEQ ID NO: 673008 - protein, 18 aa, Mycobacterium
GVLAGFGLSGVIDRTPGG

SEQ ID NO: 673009 - protein, 23 aa, Mycobacterium
GVLAGKLVRRGRGGYCYEQNGLM

SEQ ID NO: 673010 - protein, 22 aa, Mycobacterium
GVLARAIVRLAMSYVSMPPEAD

SEQ ID NO: 673011 - protein, 18 aa, Mycobacterium
GVLARLAVLPSLTPILLP

SEQ ID NO: 673012 - protein, 18 aa, Mycobacterium
GVLDLRYADFTSTEVEIR

SEQ ID NO: 673013 - protein, 24 aa, Mycobacterium
GVLDLYAPVARYWPEFGQGGKESI

SEQ ID NO: 673014 - protein, 20 aa, Mycobacterium
GVLDRLGIASVRLVAHDWGG

SEQ ID NO: 673015 - protein, 19 aa, Mycobacterium
GVLEAWTGAGLAVIIDAAT

SEQ ID NO: 673016 - protein, 23 aa, Mycobacterium
GVLELAWTTGLIKWEDDPQPGWY

SEQ ID NO: 673017 - protein, 37 aa, Mycobacterium
GVLERGLLLRLRFELDHHINLRPARLYPGVNSPLAGN

SEQ ID NO: 673018 - protein, 46 aa, Mycobacterium
GVLERGLLLRLRFELDHHINLRPGRLYPGVKSPLALEPGNPEIDFV

SEQ ID NO: 673019 - protein, 38 aa, Mycobacterium
GVLERGLLLRLRFELDHHINLRPGRLYPGVNSPLAGNP

SEQ ID NO: 673020 - protein, 27 aa, Mycobacterium
GVLERGLLLRLRFELDHHVNLRPGRLY

SEQ ID NO: 673021 - protein, 40 aa, Mycobacterium
GVLERGMLLKLRFALDHHVNLRPGRLYPGVTGPLVGNPPI

SEQ ID NO: 673022 - protein, 24 aa, Mycobacterium
GVLERLAECGFDLVQPVTTAQETL

SEQ ID NO: 673023 - protein, 22 aa, Mycobacterium
GVLEVLELHPLLNPAGYVRAET

SEQ ID NO: 673024 - protein, 22 aa, Mycobacterium
GVLFPFAATYMKLYAGTSAADQ

SEQ ID NO: 673025 - protein, 21 aa, Mycobacterium
GVLGEAAALVYGHPSDRLTVV

SEQ ID NO: 673026 - protein, 30 aa, Mycobacterium
GVLGFKKSDEIYTFMDLWFYHCNPRHHSIA

SEQ ID NO: 673027 - protein, 18 aa, Mycobacterium
GVLGGLRARHVVALGESQ

SEQ ID NO: 673028 - protein, 20 aa, Mycobacterium
GVLGHGLFTDRWWTEVVEPE

SEQ ID NO: 673029 - protein, 21 aa, Mycobacterium
GVLGKVRFLYFSPREYIVIFG

SEQ ID NO: 673030 - protein, 25 aa, Mycobacterium
GVLGSLKRQGEWTVPTRLALVRRMG

SEQ ID NO: 673031 - protein, 25 aa, Mycobacterium
GVLGSLKRQGEWVVPSRLALHRRMG

SEQ ID NO: 673032 - protein, 17 aa, Mycobacterium
GVLHAAEAHWILVTTDN

SEQ ID NO: 673033 - protein, 17 aa, Mycobacterium
GVLHEFTTVPGVKEDVT

SEQ ID NO: 673034 - protein, 17 aa, Mycobacterium
GVLHRHGPGAVGWYMGN

SEQ ID NO: 673035 - protein, 23 aa, Mycobacterium
GVLIPARPGDTWLCDRSWNRPRW

SEQ ID NO: 673036 - protein, 21 aa, Mycobacterium
GVLKAGAAYVPMDPGLPAGRV

SEQ ID NO: 673037 - protein, 21 aa, Mycobacterium
GVLKDVDFRIARKIVQVATGR

SEQ ID NO: 673038 - protein, 19 aa, Mycobacterium
GVLLAPVPDGWVLVDCAEA

SEQ ID NO: 673039 - protein, 19 aa, Mycobacterium
GVLLDHLRVALAAAGWDTE

SEQ ID NO: 673040 - protein, 19 aa, Mycobacterium
GVLLGEHFELLAMGSTASS

SEQ ID NO: 673041 - protein, 28 aa, Mycobacterium
GVLMERFNIDAGGAFGLLTRLSQQTNTR

SEQ ID NO: 673042 - protein, 17 aa, Mycobacterium
GVLPTFTRRGIATDLMR

SEQ ID NO: 673043 - protein, 19 aa, Mycobacterium
GVLQRLAAMRSYMRDINLG

SEQ ID NO: 673044 - protein, 24 aa, Mycobacterium
GVLQSRIVPWFGPGAVITTPRHHV

SEQ ID NO: 673045 - protein, 19 aa, Mycobacterium
GVLRAAWGAEICGTGDAVP

SEQ ID NO: 673046 - protein, 18 aa, Mycobacterium
GVLRAFQNVCRHRGNSLC

SEQ ID NO: 673047 - protein, 19 aa, Mycobacterium
GVLREARRSAAVVTAENHS

SEQ ID NO: 673048 - protein, 17 aa, Mycobacterium
GVLRFFKYIAAHTDIAL

SEQ ID NO: 673049 - protein, 18 aa, Mycobacterium
GVLRFFRYIASRTDIALG

SEQ ID NO: 673050 - protein, 22 aa, Mycobacterium
GVLRGVHRFGPPPGRVQQREAP

SEQ ID NO: 673051 - protein, 18 aa, Mycobacterium
GVLRLVRDINEIYCDHCA

SEQ ID NO: 673052 - protein, 17 aa, Mycobacterium
GVLRQEDLHLAFASGAG

SEQ ID NO: 673053 - protein, 21 aa, Mycobacterium
GVLRRLAAMRSYMRDVNLGRE

SEQ ID NO: 673054 - protein, 21 aa, Mycobacterium
GVLRSRMFATNLGIREDEATG

SEQ ID NO: 673055 - protein, 19 aa, Mycobacterium
GVLRYQGPQALGMPELHKL

SEQ ID NO: 673056 - protein, 19 aa, Mycobacterium
GVLSARWSGNHGDDAGNTA

SEQ ID NO: 673057 - protein, 18 aa, Mycobacterium
GVLSARWSGRHGDDAANT

SEQ ID NO: 673058 - protein, 19 aa, Mycobacterium
GVLSARWSGTHGDDAANTA

SEQ ID NO: 673059 - protein, 25 aa, Mycobacterium
GVLSEWRATLIVRESACLSVEHRRQ

SEQ ID NO: 673060 - protein, 24 aa, Mycobacterium
GVLSEYRATLIVRESACLSAEHRR

SEQ ID NO: 673061 - protein, 19 aa, Mycobacterium
GVLSFADGGAGGFGGSGAN

SEQ ID NO: 673062 - protein, 17 aa, Mycobacterium
GVLSGLVGAGGGHGGTG

SEQ ID NO: 673063 - protein, 19 aa, Mycobacterium
GVLSLPHGWGHDRDGTGQK

SEQ ID NO: 673064 - protein, 22 aa, Mycobacterium
GVLSRAIVRLAMSYISMPPEAD

SEQ ID NO: 673065 - protein, 20 aa, Mycobacterium
GVLSRPVAALGRGYDLIVNA

SEQ ID NO: 673066 - protein, 24 aa, Mycobacterium
GVLSRSKFDQLLLTAARRAVSSDD

SEQ ID NO: 673067 - protein, 25 aa, Mycobacterium
GVLTEIDMRFTLKAKLGEEIEDYTI

SEQ ID NO: 673068 - protein, 26 aa, Mycobacterium
GVLTPGFHGVHIHKVGKCEPNSVAPT

SEQ ID NO: 673069 - protein, 29 aa, Mycobacterium
GVLVCTRAVYKHMAKRGGGAIVNQSSTAA

SEQ ID NO: 673070 - protein, 18 aa, Mycobacterium
GVLVLPIFRGKRHAQRLV

SEQ ID NO: 673071 - protein, 19 aa, Mycobacterium
GVLVRSVRDCARFFESAEL

SEQ ID NO: 673072 - protein, 18 aa, Mycobacterium
GVMAATLPIARDLSSYLI

SEQ ID NO: 673073 - protein, 25 aa, Mycobacterium
GVMARFPGWHIPILGVTFDGATRTD

SEQ ID NO: 673074 - protein, 17 aa, Mycobacterium
GVMDCHVLLTGHFHYAS

SEQ ID NO: 673075 - protein, 18 aa, Mycobacterium
GVMFGVVPKWGFYLSSKA

SEQ ID NO: 673076 - protein, 18 aa, Mycobacterium
GVMFTPFGRTAEGFETQF

SEQ ID NO: 673077 - protein, 18 aa, Mycobacterium
GVMGGTFDPIHYGHLVAA

SEQ ID NO: 673078 - protein, 25 aa, Mycobacterium
GVMHRLAASVARVGVFRPIARSGES

SEQ ID NO: 673079 - protein, 18 aa, Mycobacterium
GVMKRCAQVMYRFASRRE

SEQ ID NO: 673080 - protein, 22 aa, Mycobacterium
GVMNECWVRYLAAESGADVLKR

SEQ ID NO: 673081 - protein, 24 aa, Mycobacterium
GVMRRPEALAAQVWAEPPDHDAPA

SEQ ID NO: 673082 - protein, 33 aa, Mycobacterium
GVMRYGSAQVRFPLRPFMGMMGVAFTQDREITA

SEQ ID NO: 673083 - protein, 18 aa, Mycobacterium
GVMTPMILNDFVVNRMLE

SEQ ID NO: 673084 - protein, 23 aa, Mycobacterium
GVMVDAPVLRRAERIIQLSALTG

SEQ ID NO: 673085 - protein, 17 aa, Mycobacterium
GVNAGLIFRHIGNKEAL

SEQ ID NO: 673086 - protein, 25 aa, Mycobacterium
GVNARMGRFTNFCNLFDMCAIAIPA

SEQ ID NO: 673087 - protein, 23 aa, Mycobacterium
GVNELFAVLAYGEIAAFYRLTDE

SEQ ID NO: 673088 - protein, 17 aa, Mycobacterium
GVNEVMREMIAAAGLKV

SEQ ID NO: 673089 - protein, 25 aa, Mycobacterium
GVNFELRQGHTLGIVGESGSGKSTT

SEQ ID NO: 673090 - protein, 25 aa, Mycobacterium
GVNLGGLICWENWMPQARHALYADG

SEQ ID NO: 673091 - protein, 24 aa, Mycobacterium
GVNLLLSPAVFRGFDQVGALSPTG

SEQ ID NO: 673092 - protein, 22 aa, Mycobacterium
GVNLRGPVFLVQAALPHLVASP

SEQ ID NO: 673093 - protein, 19 aa, Mycobacterium
GVNPDAWLLALGTELELAA

SEQ ID NO: 673094 - protein, 21 aa, Mycobacterium
GVNPHAWYSPAAVTTVADEVT

SEQ ID NO: 673095 - protein, 26 aa, Mycobacterium
GVNPVRLRLGIGYVIQNAGLMPHQRV

SEQ ID NO: 673096 - protein, 24 aa, Mycobacterium
GVNQLGIGVGRAFSATTQDTLVAD

SEQ ID NO: 673097 - protein, 29 aa, Mycobacterium
GVNQQEVMIWFNHQGPIQPVGSVVGNATI

SEQ ID NO: 673098 - protein, 26 aa, Mycobacterium
GVNRTLWSGMTWQYWLATRRFKESEY

SEQ ID NO: 673099 - protein, 18 aa, Mycobacterium
GVNVLGVAPGIMIKPEMR

SEQ ID NO: 673100 - protein, 24 aa, Mycobacterium
GVPADAVRWVRPRDSWLLNRAHIQ

SEQ ID NO: 673101 - protein, 25 aa, Mycobacterium
GVPAPIPQFEVMYLLAGCDAAAADT

SEQ ID NO: 673102 - protein, 19 aa, Mycobacterium
GVPAVARCGHRLEHLEMVS

SEQ ID NO: 673103 - protein, 24 aa, Mycobacterium
GVPCSRLVFSGGIERNTLWQQVTI

SEQ ID NO: 673104 - protein, 24 aa, Mycobacterium
GVPDLRLADYTGRILEWINVGQPD

SEQ ID NO: 673105 - protein, 25 aa, Mycobacterium
GVPDLRLADYTGRILEWISVGQPDE

SEQ ID NO: 673106 - protein, 22 aa, Mycobacterium
GVPELRQAIAAQRKRVHGVQYD

SEQ ID NO: 673107 - protein, 24 aa, Mycobacterium
GVPERGVIFGVSWNPEAVIEHASQ

SEQ ID NO: 673108 - protein, 22 aa, Mycobacterium
GVPERLELAKAFGADEVIDITA

SEQ ID NO: 673109 - protein, 25 aa, Mycobacterium
GVPFRDIAVVIGRHVGVPAVSIPAE

SEQ ID NO: 673110 - protein, 17 aa, Mycobacterium
GVPGEIYMRPAPGARPT

SEQ ID NO: 673111 - protein, 24 aa, Mycobacterium
GVPGGRLAATVARFNGFAASGVDE

SEQ ID NO: 673112 - protein, 23 aa, Mycobacterium
GVPGIWYAGSHGFELIAPDGTHH

SEQ ID NO: 673113 - protein, 23 aa, Mycobacterium
GVPGREALPLSGIDMTVRRNAFG

SEQ ID NO: 673114 - protein, 25 aa, Mycobacterium
GVPGRSVSRWGAFIDDVAGFDPEFF

SEQ ID NO: 673115 - protein, 24 aa, Mycobacterium
GVPGRSVSRWGGFLDDVAGFDAEF

SEQ ID NO: 673116 - protein, 24 aa, Mycobacterium
GVPGRTVSRWGAFLDDVAGFDAEF

SEQ ID NO: 673117 - protein, 24 aa, Mycobacterium
GVPGRTVSRWGGFIDDVAGFDAEF

SEQ ID NO: 673118 - protein, 39 aa, Mycobacterium
GVPGTWGGAIAPDFRVRFGTAYDIEFQRWVAAVRHGIAT

SEQ ID NO: 673119 - protein, 32 aa, Mycobacterium
GVPGVREAACFEIPDPEFGALVGLAVVAATDM

SEQ ID NO: 673120 - protein, 22 aa, Mycobacterium
GVPHLGEGGAIVIISSTNGLRG

SEQ ID NO: 673121 - protein, 17 aa, Mycobacterium
GVPHMLTADMVRPGAAV

SEQ ID NO: 673122 - protein, 24 aa, Mycobacterium
GVPIPDELAAEWARADELVLSQLR

SEQ ID NO: 673123 - protein, 21 aa, Mycobacterium
GVPISGILFGARRKTTVPLVT

SEQ ID NO: 673124 - protein, 24 aa, Mycobacterium
GVPIWGDVELAWRLDAAGCYGPPR

SEQ ID NO: 673125 - protein, 24 aa, Mycobacterium
GVPKERRVLAALGPKVLKLSADRT

SEQ ID NO: 673126 - protein, 20 aa, Mycobacterium
GVPLLRLAAQTALLESEALA

SEQ ID NO: 673127 - protein, 24 aa, Mycobacterium
GVPLPNNACRVVGPDGRDCPDWVP

SEQ ID NO: 673128 - protein, 18 aa, Mycobacterium
GVPMVFLHGLGLNRRVYI

SEQ ID NO: 673129 - protein, 26 aa, Mycobacterium
GVPPAGWGWLPLLTGLAVAHTLRESY

SEQ ID NO: 673130 - protein, 17 aa, Mycobacterium
GVPPCLLLHTVGAKTGQ

SEQ ID NO: 673131 - protein, 18 aa, Mycobacterium
GVPPDRIVNTWPADRLLE

SEQ ID NO: 673132 - protein, 24 aa, Mycobacterium
GVPPKDYFALLALLKRSLTEDEVV

SEQ ID NO: 673133 - protein, 22 aa, Mycobacterium
GVPPPRLNPADVESFKAMARQT

SEQ ID NO: 673134 - protein, 32 aa, Mycobacterium
GVPPQGWVNLHFSLLPAWRGAAPVQAAIAAGD

SEQ ID NO: 673135 - protein, 25 aa, Mycobacterium
GVPPQRRGIGFVFQHYAAFKHLTVR

SEQ ID NO: 673136 - protein, 21 aa, Mycobacterium
GVPPRRCVMIGDIGADVRAAL

SEQ ID NO: 673137 - protein, 17 aa, Mycobacterium
GVPRARRDPLLAAAAAL

SEQ ID NO: 673138 - protein, 18 aa, Mycobacterium
GVPRFVRSGAGCWLTDVD

SEQ ID NO: 673139 - protein, 24 aa, Mycobacterium
GVPRPDGQPALGIGEVDGPYHQAL

SEQ ID NO: 673140 - protein, 24 aa, Mycobacterium
GVPRPEGHPALGIGEVDGPYHQAL

SEQ ID NO: 673141 - protein, 24 aa, Mycobacterium
GVPRPEGQPALGIGEVDGPYHQAL

SEQ ID NO: 673142 - protein, 18 aa, Mycobacterium
GVPRREWEDLLAEMRRRA

SEQ ID NO: 673143 - protein, 24 aa, Mycobacterium
GVPRRSVIEAGWWARRARRGSAEA

SEQ ID NO: 673144 - protein, 19 aa, Mycobacterium
GVPRRWRSASPLWGDTSFV

SEQ ID NO: 673145 - protein, 23 aa, Mycobacterium
GVPSLRTAIAAQRQRRFGIEYDP

SEQ ID NO: 673146 - protein, 28 aa, Mycobacterium
GVPTGFDVIRYGNGVNILYADFNTTVDF

SEQ ID NO: 673147 - protein, 21 aa, Mycobacterium
GVPTLLWKLIEEIHPDDYVAL

SEQ ID NO: 673148 - protein, 24 aa, Mycobacterium
GVPTLLWKLIEEIRPDDRVVLQRT

SEQ ID NO: 673149 - protein, 26 aa, Mycobacterium
GVPTLLWRLIEEIRPDDCVVMQRTPP

SEQ ID NO: 673150 - protein, 21 aa, Mycobacterium
GVPVKAERWAALATAYFETVG

SEQ ID NO: 673151 - protein, 21 aa, Mycobacterium
GVPVLRNGRRIFKMPRPAYGG

SEQ ID NO: 673152 - protein, 17 aa, Mycobacterium
GVPVNALVRAYRLGHKE

SEQ ID NO: 673153 - protein, 21 aa, Mycobacterium
GVPVRLHPRMQALTLEVILHL

SEQ ID NO: 673154 - protein, 26 aa, Mycobacterium
GVPVRRIGKHMVCTVFDLMLAQYGVA

SEQ ID NO: 673155 - protein, 18 aa, Mycobacterium
GVPVRRVGEHLVCTVFDL

SEQ ID NO: 673156 - protein, 24 aa, Mycobacterium
GVPYELDCLIFATGFEVGTDYCRR

SEQ ID NO: 673157 - protein, 18 aa, Mycobacterium
GVQARRLCPRAVVVPPRM

SEQ ID NO: 673158 - protein, 24 aa, Mycobacterium
GVQCLADLCGVGRGPGSGVPARPN

SEQ ID NO: 673159 - protein, 30 aa, Mycobacterium
GVQDPRLRRWWPRRYRRSSVYSKLVAMDQR

SEQ ID NO: 673160 - protein, 19 aa, Mycobacterium
GVQFKDLTPLFADADGLSR

SEQ ID NO: 673161 - protein, 19 aa, Mycobacterium
GVQGGRPEALGGLGGAAPQ

SEQ ID NO: 673162 - protein, 21 aa, Mycobacterium
GVQGSGWAWLGYDTLGKKLLT

SEQ ID NO: 673163 - protein, 35 aa, Mycobacterium
GVQIPRFCDHPLLDPVGACRQCLVEVEGQRKPLAS

SEQ ID NO: 673164 - protein, 21 aa, Mycobacterium
GVQLYVKRVFIMGDCDQLMPP

SEQ ID NO: 673165 - protein, 24 aa, Mycobacterium
GVQMSELLADFGLDSIPQTNDSVS

SEQ ID NO: 673166 - protein, 18 aa, Mycobacterium
GVQMVAFTQAYRAAGVAP

SEQ ID NO: 673167 - protein, 23 aa, Mycobacterium
GVQPGQVALAWVLSRGQDVVPIP

SEQ ID NO: 673168 - protein, 22 aa, Mycobacterium
GVQPRWITPRWDAQRHISHPPS

SEQ ID NO: 673169 - protein, 19 aa, Mycobacterium
GVQRVFFGWAQVWCTKARE

SEQ ID NO: 673170 - protein, 21 aa, Mycobacterium
GVQRVFFGWAQVWRTKSRDAE

SEQ ID NO: 673171 - protein, 25 aa, Mycobacterium
GVQRWCPPRRWVDIGTFDDATPTRV

SEQ ID NO: 673172 - protein, 17 aa, Mycobacterium
GVQRWVDQRGRIRLAGF

SEQ ID NO: 673173 - protein, 32 aa, Mycobacterium
GVQSSMVSLGWLPPSYIPTGYPYAPSVAPGLN

SEQ ID NO: 673174 - protein, 18 aa, Mycobacterium
GVQVRIPGLPPVTIGPHT

SEQ ID NO: 673175 - protein, 17 aa, Mycobacterium
GVQWAHIDVAAPAYNTG

SEQ ID NO: 673176 - protein, 23 aa, Mycobacterium
GVRAAKQFLSYVGGGPFQPAVAV

SEQ ID NO: 673177 - protein, 25 aa, Mycobacterium
GVRACGICGSDLHFAAHGAQVLEMS

SEQ ID NO: 673178 - protein, 25 aa, Mycobacterium
GVRACGICGSDLHFAAHGAQVLEMT

SEQ ID NO: 673179 - protein, 25 aa, Mycobacterium
GVRACGICGSDLHFAAHGPEVLAMS

SEQ ID NO: 673180 - protein, 18 aa, Mycobacterium
GVRAWRIAAGNHLLAVGT

SEQ ID NO: 673181 - protein, 27 aa, Mycobacterium
GVRDELKLSLAAVMVLRERYLLRDARG

SEQ ID NO: 673182 - protein, 24 aa, Mycobacterium
GVRDELPHSLAVVIDEVSQREDRD

SEQ ID NO: 673183 - protein, 25 aa, Mycobacterium
GVRDWGRAFAWMGMPDEYFASSGNA

SEQ ID NO: 673184 - protein, 23 aa, Mycobacterium
GVRELCDQFGIVFIADEVMAGFG

SEQ ID NO: 673185 - protein, 19 aa, Mycobacterium
GVRELLQPKSVRWQYTHGV

SEQ ID NO: 673186 - protein, 24 aa, Mycobacterium
GVREPGLRLIVPITDRPGRVSTRI

SEQ ID NO: 673187 - protein, 19 aa, Mycobacterium
GVRETLTWSQVSRRTLNVA

SEQ ID NO: 673188 - protein, 21 aa, Mycobacterium
GVRFEIAAGFPDYRPELPGGQ

SEQ ID NO: 673189 - protein, 23 aa, Mycobacterium
GVRFRPALTVTRAEIDAAIAGVR

SEQ ID NO: 673190 - protein, 20 aa, Mycobacterium
GVRFYRGREVAGIAQDGTGV

SEQ ID NO: 673191 - protein, 18 aa, Mycobacterium
GVRGFEVIEQLVFDERRL

SEQ ID NO: 673192 - protein, 17 aa, Mycobacterium
GVRGKEAVGAFFDTNIA

SEQ ID NO: 673193 - protein, 18 aa, Mycobacterium
GVRGRITPFKDLKDATSP

SEQ ID NO: 673194 - protein, 21 aa, Mycobacterium
GVRHGLTLGGPVAIEVGNTEW

SEQ ID NO: 673195 - protein, 27 aa, Mycobacterium
GVRHTIEWYPAGHGFAVPDNVPYDPAA

SEQ ID NO: 673196 - protein, 19 aa, Mycobacterium
GVRHWYSFGDAIAGYQPYD

SEQ ID NO: 673197 - protein, 26 aa, Mycobacterium
GVRIQIPGAPAFSVGYVQDAHGLLTE

SEQ ID NO: 673198 - protein, 25 aa, Mycobacterium
GVRLAKPPLLVPVLRAGLGMVSEAH

SEQ ID NO: 673199 - protein, 18 aa, Mycobacterium
GVRLDVRWDAADVGRRGG

SEQ ID NO: 673200 - protein, 23 aa, Mycobacterium
GVRLHDLRHTFAVLQLSAGTHFM

SEQ ID NO: 673201 - protein, 18 aa, Mycobacterium
GVRLLGCYHPSQQNMFTG

SEQ ID NO: 673202 - protein, 18 aa, Mycobacterium
GVRLPATRTLAGELAVSR

SEQ ID NO: 673203 - protein, 24 aa, Mycobacterium
GVRLPFGTGQVFFFGQPIAVVVAT

SEQ ID NO: 673204 - protein, 20 aa, Mycobacterium
GVRLPGRGASALRVALHPTD

SEQ ID NO: 673205 - protein, 26 aa, Mycobacterium
GVRLSRPQRIAVWKLIEAFRRRSQMD

SEQ ID NO: 673206 - protein, 20 aa, Mycobacterium
GVRMLERFDVDWAEYGFADE

SEQ ID NO: 673207 - protein, 24 aa, Mycobacterium
GVRPAKEYRYLLIASPAGAYFKGG

SEQ ID NO: 673208 - protein, 17 aa, Mycobacterium
GVRPEHFELGGLGVEME

SEQ ID NO: 673209 - protein, 23 aa, Mycobacterium
GVRPRLPDIPGIDHPKVLTYAEV

SEQ ID NO: 673210 - protein, 26 aa, Mycobacterium
GVRQAARARPHFESKVASVADDPTVV

SEQ ID NO: 673211 - protein, 24 aa, Mycobacterium
GVRQRYDSLMAHAAAAPGSSLGQQ

SEQ ID NO: 673212 - protein, 21 aa, Mycobacterium
GVRRPTRRGAQLTAALTAPTA

SEQ ID NO: 673213 - protein, 19 aa, Mycobacterium
GVRRRGCTPVEALKESARL

SEQ ID NO: 673214 - protein, 28 aa, Mycobacterium
GVRSIRAALPLLRAADWARVVTLSAHSI

SEQ ID NO: 673215 - protein, 30 aa, Mycobacterium
GVRSIRASLPLLRSADWARIVTLSAHSIQR

SEQ ID NO: 673216 - protein, 25 aa, Mycobacterium
GVRSRLMLDIASWRRKRREELAALG

SEQ ID NO: 673217 - protein, 25 aa, Mycobacterium
GVRSRLMLDIASWRRRRREELAALG

SEQ ID NO: 673218 - protein, 18 aa, Mycobacterium
GVRTAMGGAQARRLCPHA

SEQ ID NO: 673219 - protein, 24 aa, Mycobacterium
GVRTKSWKGIRYGAPPVGELRFRA

SEQ ID NO: 673220 - protein, 23 aa, Mycobacterium
GVRTLICAKAFKSSDYVAMASQV

SEQ ID NO: 673221 - protein, 17 aa, Mycobacterium
GVRTLPMLYALRDTGPD

SEQ ID NO: 673222 - protein, 24 aa, Mycobacterium
GVRTRLGGVRVRLGDHPYAKELAS

SEQ ID NO: 673223 - protein, 21 aa, Mycobacterium
GVRVALIDGQWVAFPNVEQLE

SEQ ID NO: 673224 - protein, 20 aa, Mycobacterium
GVRVGLKWPNDVLAGPGDSP

SEQ ID NO: 673225 - protein, 25 aa, Mycobacterium
GVRVNCIACGAIRTPGLEADAARQG

SEQ ID NO: 673226 - protein, 25 aa, Mycobacterium
GVRVNCIACGAIRTPGLEADAERQG

SEQ ID NO: 673227 - protein, 24 aa, Mycobacterium
GVRVNCIACGAVRTPGLEADAKRQ

SEQ ID NO: 673228 - protein, 18 aa, Mycobacterium
GVRVPRAVGRPVKRAVRT

SEQ ID NO: 673229 - protein, 26 aa, Mycobacterium
GVRVYRLPMNAARVWRVINDSGGGES

SEQ ID NO: 673230 - protein, 20 aa, Mycobacterium
GVRYRAFDLFEAGPDHIAQI

SEQ ID NO: 673231 - protein, 25 aa, Mycobacterium
GVRYRPGGVSLRLGEHPYAAELSSL

SEQ ID NO: 673232 - protein, 25 aa, Mycobacterium
GVSADRAFDVLKWRSQETNAKLRHI

SEQ ID NO: 673233 - protein, 26 aa, Mycobacterium
GVSAEAALGLLRRHKIEKLPIVDGHG

SEQ ID NO: 673234 - protein, 25 aa, Mycobacterium
GVSAEAALGLLRRNKIEKLPIVDGH

SEQ ID NO: 673235 - protein, 18 aa, Mycobacterium
GVSALRLMQRAFTSDPDD

SEQ ID NO: 673236 - protein, 26 aa, Mycobacterium
GVSARAVLPAAFLGSGLTDSAYRGAE

SEQ ID NO: 673237 - protein, 19 aa, Mycobacterium
GVSARCCFDVVDLDDGLPD

SEQ ID NO: 673238 - protein, 24 aa, Mycobacterium
GVSARSAVALGMNALVAKIAVERM

SEQ ID NO: 673239 - protein, 18 aa, Mycobacterium
GVSARVAIEAGVAQSWYK

SEQ ID NO: 673240 - protein, 20 aa, Mycobacterium
GVSASRLAPHLQRLITDVQS

SEQ ID NO: 673241 - protein, 17 aa, Mycobacterium
GVSAVLIRVGQVGRGGV

SEQ ID NO: 673242 - protein, 35 aa, Mycobacterium
GVSAYPGDGSNRWPAVHRLDAAHLFRLALENAPTG

SEQ ID NO: 673243 - protein, 21 aa, Mycobacterium
GVSCVKPDGALYAFPRLDPEV

SEQ ID NO: 673244 - protein, 24 aa, Mycobacterium
GVSCVKPKGALYAFPRLDPEVYDI

SEQ ID NO: 673245 - protein, 21 aa, Mycobacterium
GVSCVKPQGALYAFPRLDPEV

SEQ ID NO: 673246 - protein, 24 aa, Mycobacterium
GVSCVKPRGALYAFPRLDPEVYDI

SEQ ID NO: 673247 - protein, 19 aa, Mycobacterium
GVSDFLWVRINDVPEVLGV

SEQ ID NO: 673248 - protein, 24 aa, Mycobacterium
GVSDRYKAPFSFTGGTIAQVTVDL

SEQ ID NO: 673249 - protein, 23 aa, Mycobacterium
GVSEINCVPGYFAIHTLSRRWPA

SEQ ID NO: 673250 - protein, 23 aa, Mycobacterium
GVSEIWRRIRAENLPVALSDRLT

SEQ ID NO: 673251 - protein, 18 aa, Mycobacterium
GVSEVKWSLYPMGGSAVR

SEQ ID NO: 673252 - protein, 24 aa, Mycobacterium
GVSFELRQGRTLGIVGESGSGKST

SEQ ID NO: 673253 - protein, 18 aa, Mycobacterium
GVSFSRPLARLSETVDIV

SEQ ID NO: 673254 - protein, 20 aa, Mycobacterium
GVSGEFFCWEGWARGNEVIE

SEQ ID NO: 673255 - protein, 25 aa, Mycobacterium
GVSGGAAFLLCRRASRLTSHAAQWA

SEQ ID NO: 673256 - protein, 24 aa, Mycobacterium
GVSGGTARLSRLLGELLVSADSSA

SEQ ID NO: 673257 - protein, 23 aa, Mycobacterium
GVSIERSLPVFGWQDQHGHCEIT

SEQ ID NO: 673258 - protein, 24 aa, Mycobacterium
GVSIGAAVAVAWALAHPDRCVAVL

SEQ ID NO: 673259 - protein, 21 aa, Mycobacterium
GVSIGERLVFLFGDPAVLRDI

SEQ ID NO: 673260 - protein, 22 aa, Mycobacterium
GVSIGTAVALTWALQNPEATVA

SEQ ID NO: 673261 - protein, 22 aa, Mycobacterium
GVSLALACDVVLASESAFFMLA

SEQ ID NO: 673262 - protein, 25 aa, Mycobacterium
GVSNWLRPWLPSLLALSANSAVYRG

SEQ ID NO: 673263 - protein, 30 aa, Mycobacterium
GVSNYSLARWKKADAALGRPVVSNQVHFSL

SEQ ID NO: 673264 - protein, 26 aa, Mycobacterium
GVSPRWLLRRARVIDAHQLLSETDLD

SEQ ID NO: 673265 - protein, 19 aa, Mycobacterium
GVSRCPFGTDCFAERARDK

SEQ ID NO: 673266 - protein, 23 aa, Mycobacterium
GVSREEMDAWALRSHRNAIAAID

SEQ ID NO: 673267 - protein, 18 aa, Mycobacterium
GVSRKPFRTFDGARGAQI

SEQ ID NO: 673268 - protein, 23 aa, Mycobacterium
GVSRLDPRVGILVTAVGSSRAAA

SEQ ID NO: 673269 - protein, 17 aa, Mycobacterium
GVSRPAVREAIKRLTAA

SEQ ID NO: 673270 - protein, 17 aa, Mycobacterium
GVSRPTIYRRWPDIRWV

SEQ ID NO: 673271 - protein, 18 aa, Mycobacterium
GVSRPTLYKEFGDKQGLG

SEQ ID NO: 673272 - protein, 22 aa, Mycobacterium
GVSRPTLYRYFADKRELLDVFV

SEQ ID NO: 673273 - protein, 21 aa, Mycobacterium
GVSRRGRDRLVSSGRAEQPFV

SEQ ID NO: 673274 - protein, 19 aa, Mycobacterium
GVSRSWLYRHFPDKPTLVG

SEQ ID NO: 673275 - protein, 24 aa, Mycobacterium
GVSRSYRVPFPFTGGEIAQVTVDL

SEQ ID NO: 673276 - protein, 24 aa, Mycobacterium
GVSSPRPLIAFAGGSGITPIMSLV

SEQ ID NO: 673277 - protein, 25 aa, Mycobacterium
GVSSPRVLSDLFWIGRYGERAENMA

SEQ ID NO: 673278 - protein, 24 aa, Mycobacterium
GVSSSVDDMARWLMMLLGNGTYNG

SEQ ID NO: 673279 - protein, 19 aa, Mycobacterium
GVSTAEYFSAATAPVAPRP

SEQ ID NO: 673280 - protein, 23 aa, Mycobacterium
GVSVGWRGVLDGAGFVELPTYAF

SEQ ID NO: 673281 - protein, 17 aa, Mycobacterium
GVSVSGFGVHPVLLDAA

SEQ ID NO: 673282 - protein, 19 aa, Mycobacterium
GVSYGHVWTAPRDTNAALI

SEQ ID NO: 673283 - protein, 24 aa, Mycobacterium
GVSYWARGGIAAMLTEDGDELVRS

SEQ ID NO: 673284 - protein, 17 aa, Mycobacterium
GVTAGSVYYHFGTKNKL

SEQ ID NO: 673285 - protein, 27 aa, Mycobacterium
GVTAPAGFRAAGIAAGIKSSGAPDLAL

SEQ ID NO: 673286 - protein, 26 aa, Mycobacterium
GVTARLRPSMLEFMDSVAINAVEDTM

SEQ ID NO: 673287 - protein, 18 aa, Mycobacterium
GVTARVVPSNVFAVSSVQ

SEQ ID NO: 673288 - protein, 25 aa, Mycobacterium
GVTAVAWARRALRRLLAPTDPALAS

SEQ ID NO: 673289 - protein, 17 aa, Mycobacterium
GVTCMRPTRPGRRTTGD

SEQ ID NO: 673290 - protein, 19 aa, Mycobacterium
GVTCSIFVDQIHYWGDVIV

SEQ ID NO: 673291 - protein, 17 aa, Mycobacterium
GVTCTDLGASVLAPDGK

SEQ ID NO: 673292 - protein, 19 aa, Mycobacterium
GVTDVRFTLAIPTDGDRAV

SEQ ID NO: 673293 - protein, 19 aa, Mycobacterium
GVTEQGWAPIVRWAVAPKV

SEQ ID NO: 673294 - protein, 19 aa, Mycobacterium
GVTEWPVTVSHELDAELPL

SEQ ID NO: 673295 - protein, 24 aa, Mycobacterium
GVTFAAAVTTVWRNVLPHLSGRSL

SEQ ID NO: 673296 - protein, 24 aa, Mycobacterium
GVTGAQVGLAWLLGHTPNTLLIPG

SEQ ID NO: 673297 - protein, 25 aa, Mycobacterium
GVTGKWSSPHLEFLVAAARSCAGHA

SEQ ID NO: 673298 - protein, 21 aa, Mycobacterium
GVTGRGGWSNVLLVVPAATDS

SEQ ID NO: 673299 - protein, 17 aa, Mycobacterium
GVTGYDRETCWRDYRLG

SEQ ID NO: 673300 - protein, 17 aa, Mycobacterium
GVTHSANCKCYCRLHHL

SEQ ID NO: 673301 - protein, 25 aa, Mycobacterium
GVTHYRFSLAWPRLQPDGKGPINTE

SEQ ID NO: 673302 - protein, 17 aa, Mycobacterium
GVTKPIAYRHFKTKDGA

SEQ ID NO: 673303 - protein, 24 aa, Mycobacterium
GVTKPMRLNLAFDVLVTGDVLSGH

SEQ ID NO: 673304 - protein, 17 aa, Mycobacterium
GVTLSGLASSWAAFTVH

SEQ ID NO: 673305 - protein, 22 aa, Mycobacterium
GVTLSWGCADEVAQLADALHAR

SEQ ID NO: 673306 - protein, 25 aa, Mycobacterium
GVTLYRVCSVKTRPNGHTVVAVDGG

SEQ ID NO: 673307 - protein, 19 aa, Mycobacterium
GVTPMRWIIDQRVLRARRL

SEQ ID NO: 673308 - protein, 25 aa, Mycobacterium
GVTRARVHLTLSWALARKPGGRQGR

SEQ ID NO: 673309 - protein, 17 aa, Mycobacterium
GVTRGSFYWHFDDMDSY

SEQ ID NO: 673310 - protein, 23 aa, Mycobacterium
GVTRLGITSIRFTGGEPLVVPHL

SEQ ID NO: 673311 - protein, 21 aa, Mycobacterium
GVTRLVALSAINCDDDFSRQP

SEQ ID NO: 673312 - protein, 32 aa, Mycobacterium
GVTRPTSLGGLGFSMKWNMGWMHDTLDYIRRD

SEQ ID NO: 673313 - protein, 24 aa, Mycobacterium
GVTRSGMSIREWLTVLREAGLDTI

SEQ ID NO: 673314 - protein, 23 aa, Mycobacterium
GVTRSGTSIREWLTALREAGLDT

SEQ ID NO: 673315 - protein, 25 aa, Mycobacterium
GVTRWRDGLPRIVHLLAQAAAAGGG

SEQ ID NO: 673316 - protein, 17 aa, Mycobacterium
GVTRWSLDTAVDYAKVR

SEQ ID NO: 673317 - protein, 27 aa, Mycobacterium
GVTSCLGCADLHRSDRDAAWPAICAQL

SEQ ID NO: 673318 - protein, 28 aa, Mycobacterium
GVTSCLHCADLHRADRDAAWPALAAQLR

SEQ ID NO: 673319 - protein, 18 aa, Mycobacterium
GVTSKVRGVFTYKVNEAG

SEQ ID NO: 673320 - protein, 20 aa, Mycobacterium
GVTTCLDMGVGIFGDPVGET

SEQ ID NO: 673321 - protein, 17 aa, Mycobacterium
GVTTGFWALPDPKKRLR

SEQ ID NO: 673322 - protein, 23 aa, Mycobacterium
GVTTRLGDDIAFVAASGAPHGTT

SEQ ID NO: 673323 - protein, 21 aa, Mycobacterium
GVTVERLERKLGIKASDTAVI

SEQ ID NO: 673324 - protein, 22 aa, Mycobacterium
GVTVGRPLGLLLTRRSENATVT

SEQ ID NO: 673325 - protein, 19 aa, Mycobacterium
GVTVLEFGSMFAGPYGATL

SEQ ID NO: 673326 - protein, 24 aa, Mycobacterium
GVTVLRYAIRTEIRLITSELAIDL

SEQ ID NO: 673327 - protein, 25 aa, Mycobacterium
GVTVVDPRWVLPVPPHVVELAGQHR

SEQ ID NO: 673328 - protein, 19 aa, Mycobacterium
GVTWKHFTETGAIRAKSVI

SEQ ID NO: 673329 - protein, 17 aa, Mycobacterium
GVTYPWTPPLAERVHGR

SEQ ID NO: 673330 - protein, 18 aa, Mycobacterium
GVTYSWETVRRLALMRTA

SEQ ID NO: 673331 - protein, 17 aa, Mycobacterium
GVTYSWETVRRLVQMQT

SEQ ID NO: 673332 - protein, 24 aa, Mycobacterium
GVVACAISAVDIALWDLRARLLDE

SEQ ID NO: 673333 - protein, 20 aa, Mycobacterium
GVVAERLWRDSGLKPQDIQT

SEQ ID NO: 673334 - protein, 18 aa, Mycobacterium
GVVAFIRRARRLLPGDPE

SEQ ID NO: 673335 - protein, 17 aa, Mycobacterium
GVVAFLASDDARWITGQ

SEQ ID NO: 673336 - protein, 18 aa, Mycobacterium
GVVAGCDGCIASHAQGAA

SEQ ID NO: 673337 - protein, 17 aa, Mycobacterium
GVVAKRLDSTYVPGRTQ

SEQ ID NO: 673338 - protein, 17 aa, Mycobacterium
GVVARAASRLVTVSRGL

SEQ ID NO: 673339 - protein, 17 aa, Mycobacterium
GVVARAVSRLVTIASGL

SEQ ID NO: 673340 - protein, 18 aa, Mycobacterium
GVVARAVSRLVTIATGLD

SEQ ID NO: 673341 - protein, 20 aa, Mycobacterium
GVVAVCLAELAAQHAHTAAV

SEQ ID NO: 673342 - protein, 17 aa, Mycobacterium
GVVAVDMYQLAAFAPAA

SEQ ID NO: 673343 - protein, 18 aa, Mycobacterium
GVVAVPHGWGHRRRAGWS

SEQ ID NO: 673344 - protein, 26 aa, Mycobacterium
GVVFKPEFFDEPGWEPMGDQGLMYSG

SEQ ID NO: 673345 - protein, 18 aa, Mycobacterium
GVVFRLGTGAARIDTAAA

SEQ ID NO: 673346 - protein, 26 aa, Mycobacterium
GVVGCPEKPLGPGTVFVYSGRGSQWA

SEQ ID NO: 673347 - protein, 22 aa, Mycobacterium
GVVGFCSGGQFALIMGPKGFAA

SEQ ID NO: 673348 - protein, 26 aa, Mycobacterium
GVVGGNGEDAVGYGATGAAGAAGAAG

SEQ ID NO: 673349 - protein, 18 aa, Mycobacterium
GVVGRIAVQAAKLLGAGR

SEQ ID NO: 673350 - protein, 20 aa, Mycobacterium
GVVGRQLWGQSGLKPSDIQT

SEQ ID NO: 673351 - protein, 20 aa, Mycobacterium
GVVHNARLAPAPPLLALPAE

SEQ ID NO: 673352 - protein, 17 aa, Mycobacterium
GVVHVCIDPKANSEEMP

SEQ ID NO: 673353 - protein, 21 aa, Mycobacterium
GVVKNAWKESLINAAVNPEEF

SEQ ID NO: 673354 - protein, 20 aa, Mycobacterium
GVVKQLRSGEGYQAGVLASF

SEQ ID NO: 673355 - protein, 24 aa, Mycobacterium
GVVKVHAITAVHDCGRVVEPVLVE

SEQ ID NO: 673356 - protein, 22 aa, Mycobacterium
GVVLRPGHRAQLVPGFTGAELT

SEQ ID NO: 673357 - protein, 19 aa, Mycobacterium
GVVLTPARRGFFRSEPERI

SEQ ID NO: 673358 - protein, 19 aa, Mycobacterium
GVVMARYILELEPFKSLPV

SEQ ID NO: 673359 - protein, 18 aa, Mycobacterium
GVVMARYILQLEPFASLP

SEQ ID NO: 673360 - protein, 25 aa, Mycobacterium
GVVMHAGKLLALWEGGRPTRIHPDT

SEQ ID NO: 673361 - protein, 20 aa, Mycobacterium
GVVMTDGLPWTWETFPEFMD

SEQ ID NO: 673362 - protein, 23 aa, Mycobacterium
GVVMTDGLPWTWETFPEYLDALE

SEQ ID NO: 673363 - protein, 22 aa, Mycobacterium
GVVMTDGLPWTWETFPEYMDAL

SEQ ID NO: 673364 - protein, 19 aa, Mycobacterium
GVVNALRWRPHPWGDDLRD

SEQ ID NO: 673365 - protein, 18 aa, Mycobacterium
GVVNCCRAFGRRLVEQGT

SEQ ID NO: 673366 - protein, 24 aa, Mycobacterium
GVVPAHRSGMMFRDLLGTINQRVA

SEQ ID NO: 673367 - protein, 17 aa, Mycobacterium
GVVPEIASRAHLEALGP

SEQ ID NO: 673368 - protein, 19 aa, Mycobacterium
GVVPLLKIDKGLAEEADGV

SEQ ID NO: 673369 - protein, 24 aa, Mycobacterium
GVVPPPLIASNRMQLMTLMARNIY

SEQ ID NO: 673370 - protein, 19 aa, Mycobacterium
GVVPRRLRLLYLSDGEVLD

SEQ ID NO: 673371 - protein, 18 aa, Mycobacterium
GVVPTLITVARRFAKVHG

SEQ ID NO: 673372 - protein, 17 aa, Mycobacterium
GVVPWIHRHVLRFDLGP

SEQ ID NO: 673373 - protein, 18 aa, Mycobacterium
GVVQLRLVSTASHDTADV

SEQ ID NO: 673374 - protein, 21 aa, Mycobacterium
GVVQSRFQFVLARLEVLLGPL

SEQ ID NO: 673375 - protein, 18 aa, Mycobacterium
GVVRAKYGWTDVSRFAAR

SEQ ID NO: 673376 - protein, 23 aa, Mycobacterium
GVVREYPVVPGIDLTGEVVASES

SEQ ID NO: 673377 - protein, 22 aa, Mycobacterium
GVVRLDGFVTMAQRVTVDARAH

SEQ ID NO: 673378 - protein, 26 aa, Mycobacterium
GVVRREVIDILGLRKPVVIASGFDRP

SEQ ID NO: 673379 - protein, 23 aa, Mycobacterium
GVVRYAPLVAMALQIGSQVGSGG

SEQ ID NO: 673380 - protein, 17 aa, Mycobacterium
GVVSARGDSGGSVYTVT

SEQ ID NO: 673381 - protein, 19 aa, Mycobacterium
GVVSGGFRQVIQPLADDLM

SEQ ID NO: 673382 - protein, 25 aa, Mycobacterium
GVVTGNFNSAWAISDIQNADVATAN

SEQ ID NO: 673383 - protein, 22 aa, Mycobacterium
GVVTYPARFQLVLAANPCPCAP

SEQ ID NO: 673384 - protein, 18 aa, Mycobacterium
GVVVDCGETTLAVEHLTR

SEQ ID NO: 673385 - protein, 25 aa, Mycobacterium
GVVVGPRGDCCWMCSPRWDSPAVFS

SEQ ID NO: 673386 - protein, 18 aa, Mycobacterium
GVVVPPEQVEVFRGDGSY

SEQ ID NO: 673387 - protein, 20 aa, Mycobacterium
GVVVPPEWNLDFASALTRLL

SEQ ID NO: 673388 - protein, 20 aa, Mycobacterium
GVVVRLGDRIIRITPPAPVR

SEQ ID NO: 673389 - protein, 23 aa, Mycobacterium
GVVYLCGPTQFMADIREYLVGIG

SEQ ID NO: 673390 - protein, 17 aa, Mycobacterium
GVWAQCYSSAFDLSVWD

SEQ ID NO: 673391 - protein, 24 aa, Mycobacterium
GVWDVRASFLPQIYFAGVNLAGGI

SEQ ID NO: 673392 - protein, 18 aa, Mycobacterium
GVWGDWKASLIGDLVRRC

SEQ ID NO: 673393 - protein, 17 aa, Mycobacterium
GVWGDWKASLIGELVRK

SEQ ID NO: 673394 - protein, 24 aa, Mycobacterium
GVWGEVIFPSLGMWGSTFRTPELL

SEQ ID NO: 673395 - protein, 23 aa, Mycobacterium
GVWHWENKRLGISQSFTYGDEST

SEQ ID NO: 673396 - protein, 25 aa, Mycobacterium
GVWITACRYDFLIPNRGVGVLLPEG

SEQ ID NO: 673397 - protein, 17 aa, Mycobacterium
GVWLRHLMQPLRPGEET

SEQ ID NO: 673398 - protein, 25 aa, Mycobacterium
GVWSATPPPTGWRLIDTADEQTPID

SEQ ID NO: 673399 - protein, 19 aa, Mycobacterium
GVWYCADAPFGGYKQSGIG

SEQ ID NO: 673400 - protein, 25 aa, Mycobacterium
GVYAFDIADLRSALTRLRSDNAQHE

SEQ ID NO: 673401 - protein, 24 aa, Mycobacterium
GVYEVNEAFAPVPLAWLADTGADE

SEQ ID NO: 673402 - protein, 24 aa, Mycobacterium
GVYEVRPGLELVAAPWFSKAPTTD

SEQ ID NO: 673403 - protein, 20 aa, Mycobacterium
GVYIHVPFCITRCGYCDFNT

SEQ ID NO: 673404 - protein, 17 aa, Mycobacterium
GVYLDIPGDVLGQALEA

SEQ ID NO: 673405 - protein, 17 aa, Mycobacterium
GVYLDIPGEVLGQALEV

SEQ ID NO: 673406 - protein, 24 aa, Mycobacterium
GVYPPCSAFETWFVSAALDDDAFA

SEQ ID NO: 673407 - protein, 20 aa, Mycobacterium
GVYRFLLKRNRRLYGVAYTL

SEQ ID NO: 673408 - protein, 23 aa, Mycobacterium
GVYRFLLKRNRRLYGVAYTLDNV

SEQ ID NO: 673409 - protein, 24 aa, Mycobacterium
GVYRMKGTIAVRYRASTRRYTVNV

SEQ ID NO: 673410 - protein, 19 aa, Mycobacterium
GWAAMPFDERAGVFLRAAD

SEQ ID NO: 673411 - protein, 18 aa, Mycobacterium
GWAAPAWPVEHGGCDWSL

SEQ ID NO: 673412 - protein, 19 aa, Mycobacterium
GWAAYVAGVIWALRQADYP

SEQ ID NO: 673413 - protein, 17 aa, Mycobacterium
GWADREGEVPWSADSAP

SEQ ID NO: 673414 - protein, 17 aa, Mycobacterium
GWADRRGEVPWSADSAP

SEQ ID NO: 673415 - protein, 24 aa, Mycobacterium
GWAGSLKRHGEWTVPTRLALVRRL

SEQ ID NO: 673416 - protein, 18 aa, Mycobacterium
GWALPRARTQLERAAACW

SEQ ID NO: 673417 - protein, 26 aa, Mycobacterium
GWANRPLPLPDMCYAAAATGDPDLHD

SEQ ID NO: 673418 - protein, 18 aa, Mycobacterium
GWAPQGYYFADPDGNVIE

SEQ ID NO: 673419 - protein, 20 aa, Mycobacterium
GWASLLCRKRYIDDVLAGAA

SEQ ID NO: 673420 - protein, 18 aa, Mycobacterium
GWATITVRYDRASVRHDE

SEQ ID NO: 673421 - protein, 19 aa, Mycobacterium
GWAVSGWSWAEVRDHFRAI

SEQ ID NO: 673422 - protein, 18 aa, Mycobacterium
GWDAAYRLIADQLGALDS

SEQ ID NO: 673423 - protein, 19 aa, Mycobacterium
GWDDILPIFKRFEDNEFGP

SEQ ID NO: 673424 - protein, 19 aa, Mycobacterium
GWDEAWQITVAAFGYTNHT

SEQ ID NO: 673425 - protein, 25 aa, Mycobacterium
GWDEEFSGRLGAAGFTGLTIPQRYG

SEQ ID NO: 673426 - protein, 19 aa, Mycobacterium
GWDGLAWAVEHIREALLQP

SEQ ID NO: 673427 - protein, 17 aa, Mycobacterium
GWDIMFNYEELFVATMV

SEQ ID NO: 673428 - protein, 19 aa, Mycobacterium
GWDKPSFAKEIFLGRFPLE

SEQ ID NO: 673429 - protein, 18 aa, Mycobacterium
GWDLWQRRHAILRNFPII

SEQ ID NO: 673430 - protein, 24 aa, Mycobacterium
GWDNTGRGKARFEKWYRYTIDQKQ

SEQ ID NO: 673431 - protein, 19 aa, Mycobacterium
GWDSPRSGSALEVVLLDND

SEQ ID NO: 673432 - protein, 18 aa, Mycobacterium
GWEDAPWEPGALTINIGD

SEQ ID NO: 673433 - protein, 21 aa, Mycobacterium
GWEIAGRTAGLVGLGAVGRAT

SEQ ID NO: 673434 - protein, 25 aa, Mycobacterium
GWEVLAGDEVWNWTDELAQLPSLLA

SEQ ID NO: 673435 - protein, 26 aa, Mycobacterium
GWEVLTGDEVWNWTDELAQLPALLAE

SEQ ID NO: 673436 - protein, 27 aa, Mycobacterium
GWFGLNWPREYGGLGLGAVHQHLLMSE

SEQ ID NO: 673437 - protein, 26 aa, Mycobacterium
GWFPFPLPPLPSFPVPGAAGASAESA

SEQ ID NO: 673438 - protein, 17 aa, Mycobacterium
GWFQVAWSDEIGVGDVR

SEQ ID NO: 673439 - protein, 18 aa, Mycobacterium
GWFTAKYPVSLRVGGLSW

SEQ ID NO: 673440 - protein, 18 aa, Mycobacterium
GWFTSKYPVALTVGELPW

SEQ ID NO: 673441 - protein, 18 aa, Mycobacterium
GWFTTKYPVALTIDGLDW

SEQ ID NO: 673442 - protein, 18 aa, Mycobacterium
GWFWPAAAAHPSLPRGAL

SEQ ID NO: 673443 - protein, 23 aa, Mycobacterium
GWFWPAAAAHPSLPRGALLQIAL

SEQ ID NO: 673444 - protein, 23 aa, Mycobacterium
GWFWPAAAAHPSLPRGALLQIAM

SEQ ID NO: 673445 - protein, 24 aa, Mycobacterium
GWGDLRSEAVIDRFDELLRPTRHT

SEQ ID NO: 673446 - protein, 18 aa, Mycobacterium
GWGEFGAFLEYQPPEAAA

SEQ ID NO: 673447 - protein, 20 aa, Mycobacterium
GWGETMWGSPVARLTEQLSS

SEQ ID NO: 673448 - protein, 19 aa, Mycobacterium
GWGGWLEGILPGMLGAGHG

SEQ ID NO: 673449 - protein, 19 aa, Mycobacterium
GWGHCTVGLGLQQKLDRPA

SEQ ID NO: 673450 - protein, 24 aa, Mycobacterium
GWGISGFRRTHVEASHAQRFVSLL

SEQ ID NO: 673451 - protein, 19 aa, Mycobacterium
GWGVVAAMRTPERGMPRLR

SEQ ID NO: 673452 - protein, 20 aa, Mycobacterium
GWHPHAWRYAFAHNATGGGQ

SEQ ID NO: 673453 - protein, 22 aa, Mycobacterium
GWHRRIVMGMSRIPRASQAHPI

SEQ ID NO: 673454 - protein, 18 aa, Mycobacterium
GWHVKKLDFMVGQRAGRG

SEQ ID NO: 673455 - protein, 26 aa, Mycobacterium
GWIAACFHGRLPWVRAQRATPFGDTE

SEQ ID NO: 673456 - protein, 18 aa, Mycobacterium
GWIEGPRIVPAGHAITPT

SEQ ID NO: 673457 - protein, 25 aa, Mycobacterium
GWIGAPIRLVTACALPGSHAASQYD

SEQ ID NO: 673458 - protein, 24 aa, Mycobacterium
GWIHLPCLPSVAALEHNLGAPSMS

SEQ ID NO: 673459 - protein, 18 aa, Mycobacterium
GWILPGLVDAHCHVGLGQ

SEQ ID NO: 673460 - protein, 19 aa, Mycobacterium
GWINDIWAGASPPAPIYGI

SEQ ID NO: 673461 - protein, 21 aa, Mycobacterium
GWIPYYLQRVDEVWEDRRAWG

SEQ ID NO: 673462 - protein, 20 aa, Mycobacterium
GWISGGWVPRLRPLVFRRGP

SEQ ID NO: 673463 - protein, 19 aa, Mycobacterium
GWKGFRNLRVVETRRESPQ

SEQ ID NO: 673464 - protein, 20 aa, Mycobacterium
GWLADTGLHAWVVQREFADP

SEQ ID NO: 673465 - protein, 20 aa, Mycobacterium
GWLAEPFCDDALRARIVAAV

SEQ ID NO: 673466 - protein, 24 aa, Mycobacterium
GWLAQRGYVPLGYKGDAAKTAKTF

SEQ ID NO: 673467 - protein, 24 aa, Mycobacterium
GWLAQRGYVPLGYKGDATKTAATF

SEQ ID NO: 673468 - protein, 18 aa, Mycobacterium
GWLASRQGAGTWVARTEA

SEQ ID NO: 673469 - protein, 19 aa, Mycobacterium
GWLASSAEEHAVWTIELFH

SEQ ID NO: 673470 - protein, 27 aa, Mycobacterium
GWLAWSVDPRPLFGLPALATDSTDADL

SEQ ID NO: 673471 - protein, 29 aa, Mycobacterium
GWLDDRKWAYVRLEGRAFGDVPLNLEYKL

SEQ ID NO: 673472 - protein, 27 aa, Mycobacterium
GWLDIAVDALRAGGCADVVVVLGAARV

SEQ ID NO: 673473 - protein, 23 aa, Mycobacterium
GWLHTHIRPGMVITAAAPRGDFC

SEQ ID NO: 673474 - protein, 19 aa, Mycobacterium
GWLKDRYGLSWQVVPDRLT

SEQ ID NO: 673475 - protein, 17 aa, Mycobacterium
GWLLGDYILSGIADPSK

SEQ ID NO: 673476 - protein, 26 aa, Mycobacterium
GWLLNFTGQRFKGMGKIARGLGEAVW

SEQ ID NO: 673477 - protein, 20 aa, Mycobacterium
GWLSRRSLRMAVAARTPVPA

SEQ ID NO: 673478 - protein, 24 aa, Mycobacterium
GWLTAAMDAHGAWDVGAGAVSADI

SEQ ID NO: 673479 - protein, 25 aa, Mycobacterium
GWLVTAAKFEVEWPAEPERAALVRS

SEQ ID NO: 673480 - protein, 22 aa, Mycobacterium
GWLYDRAMAGWEVTVLLPQGRD

SEQ ID NO: 673481 - protein, 25 aa, Mycobacterium
GWLYGRDVLDLLALADLGADEVIPT

SEQ ID NO: 673482 - protein, 18 aa, Mycobacterium
GWMGVGLGIHGEPGVRDN

SEQ ID NO: 673483 - protein, 29 aa, Mycobacterium
GWMLQLYGLRSSRSWGVGDLGDLREFVNW

SEQ ID NO: 673484 - protein, 22 aa, Mycobacterium
GWMRRVLVDGVDVLPNLLADEH

SEQ ID NO: 673485 - protein, 21 aa, Mycobacterium
GWNIADCVERAYDLEGMDVGV

SEQ ID NO: 673486 - protein, 20 aa, Mycobacterium
GWNNFNLSLQRDIKRFRIFE

SEQ ID NO: 673487 - protein, 18 aa, Mycobacterium
GWNPAACADCGASVAQMP

SEQ ID NO: 673488 - protein, 20 aa, Mycobacterium
GWNVVTGYLPAAARNMGQTD

SEQ ID NO: 673489 - protein, 19 aa, Mycobacterium
GWPAPRYEDYLAEVKAGSL

SEQ ID NO: 673490 - protein, 19 aa, Mycobacterium
GWPLPLRVRNAEQIPGGFR

SEQ ID NO: 673491 - protein, 26 aa, Mycobacterium
GWPRHELELPAGHGLLLLTDGLYEGY

SEQ ID NO: 673492 - protein, 20 aa, Mycobacterium
GWQAKVCRLPNPADPSHLAS

SEQ ID NO: 673493 - protein, 18 aa, Mycobacterium
GWQDWPAFHHVNTEDHVR

SEQ ID NO: 673494 - protein, 17 aa, Mycobacterium
GWQGAVLKLMRAGDYRL

SEQ ID NO: 673495 - protein, 19 aa, Mycobacterium
GWQKLNGTQALSFVRQRHD

SEQ ID NO: 673496 - protein, 29 aa, Mycobacterium
GWQRNPEKVWAWYLWRHYMMARVAPNEAH

SEQ ID NO: 673497 - protein, 19 aa, Mycobacterium
GWQTYGDVVVRFEQSPNLH

SEQ ID NO: 673498 - protein, 19 aa, Mycobacterium
GWQTYGDVVVRFEQSSSLH

SEQ ID NO: 673499 - protein, 18 aa, Mycobacterium
GWQTYGEVVVRFEQSPNL

SEQ ID NO: 673500 - protein, 25 aa, Mycobacterium
GWRAPSAKNRQPWDFVIVTDRAQLR

SEQ ID NO: 673501 - protein, 18 aa, Mycobacterium
GWRAQLPDGFRMSVKAHR

SEQ ID NO: 673502 - protein, 19 aa, Mycobacterium
GWRGIPVHRVPSVSVVRHP

SEQ ID NO: 673503 - protein, 21 aa, Mycobacterium
GWRKRREATGILPEGRVVGQI

SEQ ID NO: 673504 - protein, 22 aa, Mycobacterium
GWRLAQWGSALEVGRGSENDEC

SEQ ID NO: 673505 - protein, 21 aa, Mycobacterium
GWRPRDLRGGNYPQVPSGCLA

SEQ ID NO: 673506 - protein, 26 aa, Mycobacterium
GWRSPEVHEALDLCLSCKGCASDCPT

SEQ ID NO: 673507 - protein, 19 aa, Mycobacterium
GWRSRSLREENVWFVNPPT

SEQ ID NO: 673508 - protein, 19 aa, Mycobacterium
GWRSVARSLARLPATEIKR

SEQ ID NO: 673509 - protein, 21 aa, Mycobacterium
GWRVAEFDVSYGPRTGGKSKV

SEQ ID NO: 673510 - protein, 21 aa, Mycobacterium
GWRVVELDVSYGPRAGGKSKV

SEQ ID NO: 673511 - protein, 18 aa, Mycobacterium
GWSAPAFLRAGRTVPRSD

SEQ ID NO: 673512 - protein, 18 aa, Mycobacterium
GWSAPLYMHDGVMWTVKH

SEQ ID NO: 673513 - protein, 25 aa, Mycobacterium
GWSAYPRILDFAAFRAIADEVDAKL

SEQ ID NO: 673514 - protein, 25 aa, Mycobacterium
GWSAYPRVLDFAAFRSIADEVGAQL

SEQ ID NO: 673515 - protein, 19 aa, Mycobacterium
GWSDFPVYPLNVLALANAV

SEQ ID NO: 673516 - protein, 20 aa, Mycobacterium
GWSEGGAMLVVERLSDAQRL

SEQ ID NO: 673517 - protein, 26 aa, Mycobacterium
GWSGVKDFLGATPFGGPDPTKGFQSP

SEQ ID NO: 673518 - protein, 21 aa, Mycobacterium
GWSHPELREPLQRGRDAQIPR

SEQ ID NO: 673519 - protein, 19 aa, Mycobacterium
GWSLPILLQEVFASYYGER

SEQ ID NO: 673520 - protein, 19 aa, Mycobacterium
GWSNVRWRNLTGGIVALHI

SEQ ID NO: 673521 - protein, 24 aa, Mycobacterium
GWSPHGKPIVGFVGRLAPEKHVER

SEQ ID NO: 673522 - protein, 20 aa, Mycobacterium
GWSSARCREGRQVSWVRLTS

SEQ ID NO: 673523 - protein, 23 aa, Mycobacterium
GWSSWAIQWLSRIPAGAPELTDH

SEQ ID NO: 673524 - protein, 17 aa, Mycobacterium
GWSTLPIALGKARAAVG

SEQ ID NO: 673525 - protein, 18 aa, Mycobacterium
GWSVPILLNETFACYTGQ

SEQ ID NO: 673526 - protein, 18 aa, Mycobacterium
GWSYAKFLLGNERTGITQ

SEQ ID NO: 673527 - protein, 23 aa, Mycobacterium
GWTDDIKKIFDWNVAEDGPAILA

SEQ ID NO: 673528 - protein, 21 aa, Mycobacterium
GWTGAGWGGDPAPLWPDRVGE

SEQ ID NO: 673529 - protein, 17 aa, Mycobacterium
GWTGMFLNETALRPAHW

SEQ ID NO: 673530 - protein, 23 aa, Mycobacterium
GWTKRLTGLPAVAVGSVGLQTEF

SEQ ID NO: 673531 - protein, 19 aa, Mycobacterium
GWTLFTLTICQGVLGNDEA

SEQ ID NO: 673532 - protein, 21 aa, Mycobacterium
GWTLPEAERWLGPNLGYNPED

SEQ ID NO: 673533 - protein, 27 aa, Mycobacterium
GWTSPLRSAGPWAAWAAAARSARLAAE

SEQ ID NO: 673534 - protein, 17 aa, Mycobacterium
GWVAADTMVDGFTSHRD

SEQ ID NO: 673535 - protein, 26 aa, Mycobacterium
GWVAENWPGLLPEMRRLLPDLESAPA

SEQ ID NO: 673536 - protein, 26 aa, Mycobacterium
GWVAREGRIPLGYFDDADATARTFPV

SEQ ID NO: 673537 - protein, 17 aa, Mycobacterium
GWVKDLGNIIGHEDPFA

SEQ ID NO: 673538 - protein, 18 aa, Mycobacterium
GWVKHASATLARHDASDS

SEQ ID NO: 673539 - protein, 19 aa, Mycobacterium
GWVKLVGDWIDRQVGDLAP

SEQ ID NO: 673540 - protein, 20 aa, Mycobacterium
GWVPRLRPLVFRRGPHPRDG

SEQ ID NO: 673541 - protein, 23 aa, Mycobacterium
GWVQPHLPVPWGRAAKPVEQIII

SEQ ID NO: 673542 - protein, 17 aa, Mycobacterium
GWVSGPISRQVHAIESW

SEQ ID NO: 673543 - protein, 18 aa, Mycobacterium
GWYRGAADIVTLIHQQCP

SEQ ID NO: 673544 - protein, 18 aa, Mycobacterium
GYAAASIEGIRSASSNKP

SEQ ID NO: 673545 - protein, 25 aa, Mycobacterium
GYAAELAALTGLAWSGPSALLMTAA

SEQ ID NO: 673546 - protein, 19 aa, Mycobacterium
GYAALRPAVHLLPAPDPDR

SEQ ID NO: 673547 - protein, 17 aa, Mycobacterium
GYAALVFDYRHWGASDG

SEQ ID NO: 673548 - protein, 22 aa, Mycobacterium
GYAARLITRFGLDDLADRYPDE

SEQ ID NO: 673549 - protein, 21 aa, Mycobacterium
GYAASCDREKFVAQMTEQLGQ

SEQ ID NO: 673550 - protein, 24 aa, Mycobacterium
GYAEATSFIAAFKRWTGTTPARHQ

SEQ ID NO: 673551 - protein, 18 aa, Mycobacterium
GYAEDWDLDALWTALKTL

SEQ ID NO: 673552 - protein, 19 aa, Mycobacterium
GYAEPGQVLGLTFTRKAAG

SEQ ID NO: 673553 - protein, 22 aa, Mycobacterium
GYAEPGQVLGLTFTRKAAGQLL

SEQ ID NO: 673554 - protein, 18 aa, Mycobacterium
GYAGATVRHLLDMRSGIA

SEQ ID NO: 673555 - protein, 21 aa, Mycobacterium
GYAGTDWQLGLLIKIEGSIRR

SEQ ID NO: 673556 - protein, 25 aa, Mycobacterium
GYAIPQEWGGLGLDLPQDVELAMEL

SEQ ID NO: 673557 - protein, 25 aa, Mycobacterium
GYAIPQEWGGLGLNLMQDVELAMEL

SEQ ID NO: 673558 - protein, 25 aa, Mycobacterium
GYAIPQRWGGLGLNLMQDVELAMEL

SEQ ID NO: 673559 - protein, 19 aa, Mycobacterium
GYALPFDRCNELVPPGSPN

SEQ ID NO: 673560 - protein, 21 aa, Mycobacterium
GYALRLAHRLVDAVGDAIYAH

SEQ ID NO: 673561 - protein, 25 aa, Mycobacterium
GYANAYDFWNMWRVRPPGLRVIAAG

SEQ ID NO: 673562 - protein, 23 aa, Mycobacterium
GYAPCFAALAGLAPLVGYPGGPP

SEQ ID NO: 673563 - protein, 23 aa, Mycobacterium
GYAPCFAALAGLAPLVGYRGGPP

SEQ ID NO: 673564 - protein, 17 aa, Mycobacterium
GYAPFSLPSAFTDPGER

SEQ ID NO: 673565 - protein, 20 aa, Mycobacterium
GYARLPAFSWDKNAAETARI

SEQ ID NO: 673566 - protein, 18 aa, Mycobacterium
GYASFALVIPAAGAATDR

SEQ ID NO: 673567 - protein, 17 aa, Mycobacterium
GYASWLSQQDWTPAYRR

SEQ ID NO: 673568 - protein, 32 aa, Mycobacterium
GYASWRSVLWRRWPVAGPPPFFLSPDDYDRTV

SEQ ID NO: 673569 - protein, 21 aa, Mycobacterium
GYCFQIDLTWRAINNGFSVVE

SEQ ID NO: 673570 - protein, 17 aa, Mycobacterium
GYCGLPVQQSCPHANAC

SEQ ID NO: 673571 - protein, 17 aa, Mycobacterium
GYCGLPVQQSCPHANAP

SEQ ID NO: 673572 - protein, 22 aa, Mycobacterium
GYCMLANRVSYALDLTGPSMSV

SEQ ID NO: 673573 - protein, 30 aa, Mycobacterium
GYDADSDPSARFGASGGKGGTGGNGGSYGN

SEQ ID NO: 673574 - protein, 19 aa, Mycobacterium
GYDAGFVESFWKVVHAYQR

SEQ ID NO: 673575 - protein, 19 aa, Mycobacterium
GYDAGHVRFVIADAHIGAL

SEQ ID NO: 673576 - protein, 23 aa, Mycobacterium
GYDAVFTAEAWGSDAYTPLAWLG

SEQ ID NO: 673577 - protein, 24 aa, Mycobacterium
GYDEGRWSPWQWSSVLIEGAHCRE

SEQ ID NO: 673578 - protein, 26 aa, Mycobacterium
GYDESLWRLLCEQVGAAALVVPEELG

SEQ ID NO: 673579 - protein, 27 aa, Mycobacterium
GYDETLWRLLCEQVGAAALVIPEELGG

SEQ ID NO: 673580 - protein, 18 aa, Mycobacterium
GYDGASMDAIAKAAGTTR

SEQ ID NO: 673581 - protein, 23 aa, Mycobacterium
GYDIKKWADWSISYFYWSPSFSQ

SEQ ID NO: 673582 - protein, 26 aa, Mycobacterium
GYDIPYPAPRLERWYLPSTDRILDAV

SEQ ID NO: 673583 - protein, 18 aa, Mycobacterium
GYDLRLYATPGYLDDAPP

SEQ ID NO: 673584 - protein, 25 aa, Mycobacterium
GYDMTAFWCRAGTAATITPAGMPGM

SEQ ID NO: 673585 - protein, 24 aa, Mycobacterium
GYDMTAFWCRAGTAATITPMGYAG

SEQ ID NO: 673586 - protein, 18 aa, Mycobacterium
GYDPPRRFVDALGGDGLA

SEQ ID NO: 673587 - protein, 23 aa, Mycobacterium
GYDQPRWWSERGWRHRQAAGLTA

SEQ ID NO: 673588 - protein, 25 aa, Mycobacterium
GYDQPRWWSPRGWAHRQEAGLVAPQ

SEQ ID NO: 673589 - protein, 39 aa, Mycobacterium
GYDRETCWRDYRLGMLQAPLITVLGCAFASSTDRGDDMM

SEQ ID NO: 673590 - protein, 20 aa, Mycobacterium
GYDRPVFLGVGMRDRDVPPG

SEQ ID NO: 673591 - protein, 17 aa, Mycobacterium
GYDRPVYTLGHYGIFMG

SEQ ID NO: 673592 - protein, 22 aa, Mycobacterium
GYDSLFLMDHFYQLPMLGTPDQ

SEQ ID NO: 673593 - protein, 18 aa, Mycobacterium
GYDWAQRFDEAAAARLLD

SEQ ID NO: 673594 - protein, 18 aa, Mycobacterium
GYDYTWFVLNAKIIEKEF

SEQ ID NO: 673595 - protein, 19 aa, Mycobacterium
GYEAIRVGILANQKRMGLL

SEQ ID NO: 673596 - protein, 20 aa, Mycobacterium
GYEAPHGFGDIQGVSTPGLA

SEQ ID NO: 673597 - protein, 17 aa, Mycobacterium
GYEATTIRDIASAAGLG

SEQ ID NO: 673598 - protein, 17 aa, Mycobacterium
GYEEALVRYGLDMCDVW

SEQ ID NO: 673599 - protein, 23 aa, Mycobacterium
GYEGCSFINVLLEVGADHPAGQA

SEQ ID NO: 673600 - protein, 23 aa, Mycobacterium
GYEGEGFPVVRAFAGIGTAALDP

SEQ ID NO: 673601 - protein, 27 aa, Mycobacterium
GYEGEGFPVVRAFAGVGMADLDPFVHM

SEQ ID NO: 673602 - protein, 23 aa, Mycobacterium
GYEGEGFPVVRAFAGVGSAALDP

SEQ ID NO: 673603 - protein, 25 aa, Mycobacterium
GYEGEGFPVVRAFAGVPSSELDPFI

SEQ ID NO: 673604 - protein, 17 aa, Mycobacterium
GYEGFTIEALAARVHCS

SEQ ID NO: 673605 - protein, 18 aa, Mycobacterium
GYEGMRWITVGPAGRPDM

SEQ ID NO: 673606 - protein, 18 aa, Mycobacterium
GYESIKMANVESYRRKVA

SEQ ID NO: 673607 - protein, 17 aa, Mycobacterium
GYETIVASMSWTLALLL

SEQ ID NO: 673608 - protein, 28 aa, Mycobacterium
GYETTLWARRPATLEAFADTKAKVAESP

SEQ ID NO: 673609 - protein, 24 aa, Mycobacterium
GYEVIARTAVRAMADVLVEFLADD

SEQ ID NO: 673610 - protein, 23 aa, Mycobacterium
GYEVRKLDKLGMHASDTGLITFD

SEQ ID NO: 673611 - protein, 25 aa, Mycobacterium
GYFATRTRLGLWFRNMAMRTMNFGP

SEQ ID NO: 673612 - protein, 17 aa, Mycobacterium
GYFMRRLAERPANLAFF

SEQ ID NO: 673613 - protein, 18 aa, Mycobacterium
GYFMRRLAERPANLTFFL

SEQ ID NO: 673614 - protein, 19 aa, Mycobacterium
GYFPPAFTIGDYRARTAGL

SEQ ID NO: 673615 - protein, 17 aa, Mycobacterium
GYFRMIALRTLDVPPGD

SEQ ID NO: 673616 - protein, 39 aa, Mycobacterium
GYFRPDLDVDLVYRFIRDTTWVSVRWYKPGGALTAQQVG

SEQ ID NO: 673617 - protein, 38 aa, Mycobacterium
GYFRPDLDVDLVYRFIRDTTWVSVRWYQPGGPLTAQQV

SEQ ID NO: 673618 - protein, 17 aa, Mycobacterium
GYFYFVYRVDLQTDDGA

SEQ ID NO: 673619 - protein, 20 aa, Mycobacterium
GYGCAGMSAVAYGLACLELE

SEQ ID NO: 673620 - protein, 19 aa, Mycobacterium
GYGDLRFVTDPDTLRPMGW

SEQ ID NO: 673621 - protein, 22 aa, Mycobacterium
GYGFDPEKLWATVYLDDDEAIG

SEQ ID NO: 673622 - protein, 20 aa, Mycobacterium
GYGGADYDYGRQAPRHDDYG

SEQ ID NO: 673623 - protein, 21 aa, Mycobacterium
GYGGNAGLWGNGGAGGHGGFG

SEQ ID NO: 673624 - protein, 17 aa, Mycobacterium
GYGGPAFGGPVFSDDLS

SEQ ID NO: 673625 - protein, 18 aa, Mycobacterium
GYGGYGHGAYGGYGQGGY

SEQ ID NO: 673626 - protein, 24 aa, Mycobacterium
GYGHGMFELGQWRGHGGSWRGYEV

SEQ ID NO: 673627 - protein, 25 aa, Mycobacterium
GYGILTWHLPMLFRTPPGYNLLVRG

SEQ ID NO: 673628 - protein, 21 aa, Mycobacterium
GYGKTSWNVRAIWEMYAGWFR

SEQ ID NO: 673629 - protein, 19 aa, Mycobacterium
GYGKVAWDVRAIWENYSGW

SEQ ID NO: 673630 - protein, 19 aa, Mycobacterium
GYGKVAWDVRAVWENYSGW

SEQ ID NO: 673631 - protein, 27 aa, Mycobacterium
GYGLIEWKMDLELGAHYYVKFNNPDVV

SEQ ID NO: 673632 - protein, 19 aa, Mycobacterium
GYGLNWRFGAENLMLVSAG

SEQ ID NO: 673633 - protein, 18 aa, Mycobacterium
GYGLRLFVYDCADDRGKA

SEQ ID NO: 673634 - protein, 34 aa, Mycobacterium
GYGPAFRGLNAMWRRGDEVFAEVALPADAGVSVA

SEQ ID NO: 673635 - protein, 34 aa, Mycobacterium
GYGPAFRGLNAMWRRGDEVFAEVALPADAGVSVS

SEQ ID NO: 673636 - protein, 26 aa, Mycobacterium
GYGPAFRGLTAMWARGEELFAEVRLP

SEQ ID NO: 673637 - protein, 33 aa, Mycobacterium
GYGPAFRGLTSMWRRGDEIFAEVTLPSDAGVSV

SEQ ID NO: 673638 - protein, 34 aa, Mycobacterium
GYGPAFRGLTSMWRRGDEVFAEVALPADAGVSGV

SEQ ID NO: 673639 - protein, 38 aa, Mycobacterium
GYGQNHSWMTWQAGISVLVWHPALNVYSGYAHLSSTVI

SEQ ID NO: 673640 - protein, 22 aa, Mycobacterium
GYGQTRDEACRRVARALRETRI

SEQ ID NO: 673641 - protein, 17 aa, Mycobacterium
GYGRFWVYRGGARMMVR

SEQ ID NO: 673642 - protein, 18 aa, Mycobacterium
GYGRTGPYAARPAYDDTI

SEQ ID NO: 673643 - protein, 18 aa, Mycobacterium
GYGSLGLMTSVLMTADGK

SEQ ID NO: 673644 - protein, 24 aa, Mycobacterium
GYGWSGPPPHRWAKEDVVTDLVAL

SEQ ID NO: 673645 - protein, 21 aa, Mycobacterium
GYGYGPAFQGLRAVWRRGAET

SEQ ID NO: 673646 - protein, 34 aa, Mycobacterium
GYGYGPAFRGLRAVWRRGAEVFAEVEAPQDAGVA

SEQ ID NO: 673647 - protein, 25 aa, Mycobacterium
GYHEPEILRWLFAGDESLTVSRDGT

SEQ ID NO: 673648 - protein, 23 aa, Mycobacterium
GYHKSDGYALAFDEMFDAQGNVR

SEQ ID NO: 673649 - protein, 18 aa, Mycobacterium
GYHLPYFHQMLAAGAVDC

SEQ ID NO: 673650 - protein, 22 aa, Mycobacterium
GYHMIRCGWRRSAQPLIKPRAV

SEQ ID NO: 673651 - protein, 18 aa, Mycobacterium
GYHRELVEHFILEEQWGR

SEQ ID NO: 673652 - protein, 35 aa, Mycobacterium
GYHREMVEHFSLEIIPWADFIGRWTAEENLHAIAL

SEQ ID NO: 673653 - protein, 19 aa, Mycobacterium
GYHRNGWEQTPTVAEIAGH

SEQ ID NO: 673654 - protein, 17 aa, Mycobacterium
GYHRVCASYHTDENTDI

SEQ ID NO: 673655 - protein, 25 aa, Mycobacterium
GYHSFPIGNLMPGFGHIGMGGSVGW

SEQ ID NO: 673656 - protein, 17 aa, Mycobacterium
GYHSGYFVGAAIDAYCP

SEQ ID NO: 673657 - protein, 18 aa, Mycobacterium
GYHSIPFSPAGTLITGSS

SEQ ID NO: 673658 - protein, 19 aa, Mycobacterium
GYHSIPFSVGGALIAGASG

SEQ ID NO: 673659 - protein, 26 aa, Mycobacterium
GYHSLPAIRSELAWMSALRAETSVVT

SEQ ID NO: 673660 - protein, 24 aa, Mycobacterium
GYHSLPIGNVMPGFGHVGMGGSVG

SEQ ID NO: 673661 - protein, 17 aa, Mycobacterium
GYHTIAWLQQDIGEELR

SEQ ID NO: 673662 - protein, 23 aa, Mycobacterium
GYIAAELAHVFAAAGSRITVIER

SEQ ID NO: 673663 - protein, 25 aa, Mycobacterium
GYIAFYRPEFIEFFAEHHVQLPLRT

SEQ ID NO: 673664 - protein, 24 aa, Mycobacterium
GYIDAGVSGGVWGKENGYGLMVGG

SEQ ID NO: 673665 - protein, 24 aa, Mycobacterium
GYIEARPAITLSWIRELPSLGAAA

SEQ ID NO: 673666 - protein, 24 aa, Mycobacterium
GYIESRPAITLSWIRELPSLGAAA

SEQ ID NO: 673667 - protein, 29 aa, Mycobacterium
GYIGFFLCPGVPELSFRSHVGVKVIEALE

SEQ ID NO: 673668 - protein, 27 aa, Mycobacterium
GYIGKYRKTHLWNEEKLFFSPGDLGYP

SEQ ID NO: 673669 - protein, 18 aa, Mycobacterium
GYIGTALRLLERKIAHLP

SEQ ID NO: 673670 - protein, 19 aa, Mycobacterium
GYIHLRASHHWDPETARRS

SEQ ID NO: 673671 - protein, 22 aa, Mycobacterium
GYIPSGVFVPRSVRMLFADVTL

SEQ ID NO: 673672 - protein, 18 aa, Mycobacterium
GYIRKGIPGPRWIPKPLW

SEQ ID NO: 673673 - protein, 18 aa, Mycobacterium
GYKAQVWIEPGVSAEQTR

SEQ ID NO: 673674 - protein, 21 aa, Mycobacterium
GYKRVLLKLGGEMFGGGAVGL

SEQ ID NO: 673675 - protein, 19 aa, Mycobacterium
GYLAGFPGQGAYACANAFL

SEQ ID NO: 673676 - protein, 17 aa, Mycobacterium
GYLAWSQLDTSAARYRR

SEQ ID NO: 673677 - protein, 27 aa, Mycobacterium
GYLCVPLDGAVCDRLGLLPMYAVNQDK

SEQ ID NO: 673678 - protein, 23 aa, Mycobacterium
GYLDELGRLYVCGRAKDMIVLAG

SEQ ID NO: 673679 - protein, 23 aa, Mycobacterium
GYLDRYSHTFSFSALQAALETTP

SEQ ID NO: 673680 - protein, 24 aa, Mycobacterium
GYLEARLLAALAARRDAEVERGVC

SEQ ID NO: 673681 - protein, 20 aa, Mycobacterium
GYLEKRLGDLTSRTGTKYTV

SEQ ID NO: 673682 - protein, 20 aa, Mycobacterium
GYLEREWKPEAEGGFSRVHR

SEQ ID NO: 673683 - protein, 19 aa, Mycobacterium
GYLGLFVTHDGFWKAFAAE

SEQ ID NO: 673684 - protein, 19 aa, Mycobacterium
GYLGRAAVLEMGYAVACGV

SEQ ID NO: 673685 - protein, 18 aa, Mycobacterium
GYLGRSGLTASRFIACPF

SEQ ID NO: 673686 - protein, 18 aa, Mycobacterium
GYLIARLAIDTSLRGQGF

SEQ ID NO: 673687 - protein, 17 aa, Mycobacterium
GYLLHLLAGDKTYRDFS

SEQ ID NO: 673688 - protein, 19 aa, Mycobacterium
GYLLISAYVPKHWQRLCEI

SEQ ID NO: 673689 - protein, 17 aa, Mycobacterium
GYLLYRVGTVLRPEVAA

SEQ ID NO: 673690 - protein, 23 aa, Mycobacterium
GYLPGMRAGDIFGHEFMGVVAET

SEQ ID NO: 673691 - protein, 19 aa, Mycobacterium
GYLPMLHGHCLANYTSDPR

SEQ ID NO: 673692 - protein, 28 aa, Mycobacterium
GYLPMVELLQYLAGNGFTNYIVSGGGRD

SEQ ID NO: 673693 - protein, 21 aa, Mycobacterium
GYLRCEHGLVPPEMADVVRDI

SEQ ID NO: 673694 - protein, 21 aa, Mycobacterium
GYLRLREWLTRLYRIEFAGFI

SEQ ID NO: 673695 - protein, 20 aa, Mycobacterium
GYLRRPGETSHRFIADPFGS

SEQ ID NO: 673696 - protein, 19 aa, Mycobacterium
GYLSGFGVLPAEEVRAAAR

SEQ ID NO: 673697 - protein, 18 aa, Mycobacterium
GYLSKIFNDGWMSSYGFL

SEQ ID NO: 673698 - protein, 18 aa, Mycobacterium
GYLSKVFNDAWMSSYGFL

SEQ ID NO: 673699 - protein, 18 aa, Mycobacterium
GYLTEAIDAFADRADVVF

SEQ ID NO: 673700 - protein, 18 aa, Mycobacterium
GYLTMRVIGSRQLPEVST

SEQ ID NO: 673701 - protein, 24 aa, Mycobacterium
GYLTYRGIKTLALRMQRHSENAQA

SEQ ID NO: 673702 - protein, 21 aa, Mycobacterium
GYLVEWDLPADLDMESYLARK

SEQ ID NO: 673703 - protein, 24 aa, Mycobacterium
GYMAPPAHRLRAGTLLIANTNLFE

SEQ ID NO: 673704 - protein, 32 aa, Mycobacterium
GYMKEYRVARAWMDARVTKIWAGSNEIMKELI

SEQ ID NO: 673705 - protein, 21 aa, Mycobacterium
GYMRGVPVERIYRDVRLLRLY

SEQ ID NO: 673706 - protein, 23 aa, Mycobacterium
GYMRGVPVERIYRDVRLLRLYEG

SEQ ID NO: 673707 - protein, 20 aa, Mycobacterium
GYMRSAHALAGATILDGPHL

SEQ ID NO: 673708 - protein, 22 aa, Mycobacterium
GYMSGALKHFFDTVYYPSLDHV

SEQ ID NO: 673709 - protein, 17 aa, Mycobacterium
GYMSLPMNGFRGGFGHI

SEQ ID NO: 673710 - protein, 25 aa, Mycobacterium
GYNGCGVVAMFFGLRQALRFKLRQP

SEQ ID NO: 673711 - protein, 25 aa, Mycobacterium
GYNHIKIKEAYGLTKQYVANKLANQ

SEQ ID NO: 673712 - protein, 25 aa, Mycobacterium
GYNHIKIKEAYGLTKQYVAQKLANQ

SEQ ID NO: 673713 - protein, 24 aa, Mycobacterium
GYNVANCLLALAILDSIGVSPEQA

SEQ ID NO: 673714 - protein, 17 aa, Mycobacterium
GYNVYPREIEEVLYEHP

SEQ ID NO: 673715 - protein, 22 aa, Mycobacterium
GYNWLTGIRIQDGLLKQLGSQG

SEQ ID NO: 673716 - protein, 20 aa, Mycobacterium
GYPAKWRDYSTLVIDRDDLY

SEQ ID NO: 673717 - protein, 24 aa, Mycobacterium
GYPDIPTSLRLASRTLVTTIPFVV

SEQ ID NO: 673718 - protein, 26 aa, Mycobacterium
GYPFNSWDWALIWPTLVERFTVIAPD

SEQ ID NO: 673719 - protein, 26 aa, Mycobacterium
GYPFNSWDWSLIWPTLTQRFTVIAPD

SEQ ID NO: 673720 - protein, 17 aa, Mycobacterium
GYPGDRGLADAYQQTVA

SEQ ID NO: 673721 - protein, 20 aa, Mycobacterium
GYPGRAVSQMWGRFIYHDEI

SEQ ID NO: 673722 - protein, 24 aa, Mycobacterium
GYPGRPGLTASRFVACPFGGPDAP

SEQ ID NO: 673723 - protein, 21 aa, Mycobacterium
GYPGRRYYGGCEFVDGVEQLA

SEQ ID NO: 673724 - protein, 20 aa, Mycobacterium
GYPHPRLVWINGPTPHQHHA

SEQ ID NO: 673725 - protein, 35 aa, Mycobacterium
GYPILEHIDRLVPGDIIWAPAIDGAFVLTTRGGDF

SEQ ID NO: 673726 - protein, 36 aa, Mycobacterium
GYPILEHIDRLVPGDIIWAPAIDGAFVLTTRGGDFD

SEQ ID NO: 673727 - protein, 26 aa, Mycobacterium
GYPKVARLVLDAAVLKDTMVLAYRWP

SEQ ID NO: 673728 - protein, 25 aa, Mycobacterium
GYPLELLVRAAAAGWRVAEFDVSYG

SEQ ID NO: 673729 - protein, 17 aa, Mycobacterium
GYPLRRPDGAKVTIAAM

SEQ ID NO: 673730 - protein, 20 aa, Mycobacterium
GYPMCGVLAGSARFTQRLTL

SEQ ID NO: 673731 - protein, 22 aa, Mycobacterium
GYPQPAPAWALRGGVLRRGAPV

SEQ ID NO: 673732 - protein, 21 aa, Mycobacterium
GYPRGKWGVAANRHPVHEVSS

SEQ ID NO: 673733 - protein, 24 aa, Mycobacterium
GYPRGNLAFRWFLADELPTRPEVK

SEQ ID NO: 673734 - protein, 29 aa, Mycobacterium
GYPRGNLAFRWFLADGVPARPQVRLVQVS

SEQ ID NO: 673735 - protein, 22 aa, Mycobacterium
GYPRSGVQVAVLRSDGTPADIG

SEQ ID NO: 673736 - protein, 24 aa, Mycobacterium
GYPSIGCAPCTAKPVLGGDARSGR

SEQ ID NO: 673737 - protein, 24 aa, Mycobacterium
GYPTFPAPVLAALDSAYIQPIFGP

SEQ ID NO: 673738 - protein, 20 aa, Mycobacterium
GYPVRWRDYSKLVIDRGDLY

SEQ ID NO: 673739 - protein, 20 aa, Mycobacterium
GYQAYQWAQQLVFGTGTTAG

SEQ ID NO: 673740 - protein, 38 aa, Mycobacterium
GYQCCDLLDIMKTWWALRNEPNVLLLHYGELKRDLRGQ

SEQ ID NO: 673741 - protein, 19 aa, Mycobacterium
GYQLLKGWLDRRPAEQSLT

SEQ ID NO: 673742 - protein, 24 aa, Mycobacterium
GYQPDYRPPPAFDEYAGGQAQARS

SEQ ID NO: 673743 - protein, 24 aa, Mycobacterium
GYQQSRWWSPRGWAHRQSAGLSAP

SEQ ID NO: 673744 - protein, 19 aa, Mycobacterium
GYQRGCLAGKFSTEVAASS

SEQ ID NO: 673745 - protein, 25 aa, Mycobacterium
GYQVPEFRRKAVFIAVGGVYDPRIH

SEQ ID NO: 673746 - protein, 26 aa, Mycobacterium
GYQVPEFRRKAVMIAVGGVYDPRIHL

SEQ ID NO: 673747 - protein, 27 aa, Mycobacterium
GYRACRRCLPDAAPGSPLWNIKSDLAV

SEQ ID NO: 673748 - protein, 17 aa, Mycobacterium
GYRALPVVFAPGARVGQ

SEQ ID NO: 673749 - protein, 22 aa, Mycobacterium
GYRDLAGFGRRFIDIAAADLYA

SEQ ID NO: 673750 - protein, 23 aa, Mycobacterium
GYRDTEIVRWLFTPDPSLTITHD

SEQ ID NO: 673751 - protein, 22 aa, Mycobacterium
GYRDTEIVRWLFTPDPSLTITR

SEQ ID NO: 673752 - protein, 19 aa, Mycobacterium
GYREPRWWSERGWEHRQRA

SEQ ID NO: 673753 - protein, 20 aa, Mycobacterium
GYRGGPPLGTSMRYGDSTVG

SEQ ID NO: 673754 - protein, 30 aa, Mycobacterium
GYRIGCGIIGGPVEVLSSIGATTNFDQSAV

SEQ ID NO: 673755 - protein, 18 aa, Mycobacterium
GYRLGGQVRPVVHEVSFE

SEQ ID NO: 673756 - protein, 21 aa, Mycobacterium
GYRNGEEGYKEYLDAKTIGMP

SEQ ID NO: 673757 - protein, 22 aa, Mycobacterium
GYRPEQLAKYAQRLMDWLHPDG

SEQ ID NO: 673758 - protein, 23 aa, Mycobacterium
GYRPSAKLAAFVRSRDQLCRFPG

SEQ ID NO: 673759 - protein, 24 aa, Mycobacterium
GYRPWAGEIRARHTGSLVSDRSGT

SEQ ID NO: 673760 - protein, 28 aa, Mycobacterium
GYRQALAPASTWWSWRGHDVHILRAQLP

SEQ ID NO: 673761 - protein, 24 aa, Mycobacterium
GYRRCPHGKPLWCSTTHGEGDIYA

SEQ ID NO: 673762 - protein, 26 aa, Mycobacterium
GYRRCPHGKQLWCSMSHDHGDERVGQ

SEQ ID NO: 673763 - protein, 27 aa, Mycobacterium
GYRREALPRIQVWPVTADGYGSPQEVE

SEQ ID NO: 673764 - protein, 25 aa, Mycobacterium
GYRRSLRLPFGNAIVNLTPAVDHVR

SEQ ID NO: 673765 - protein, 20 aa, Mycobacterium
GYRRYWLAEHHFVAVASTVP

SEQ ID NO: 673766 - protein, 20 aa, Mycobacterium
GYRSLRDIVLPLAQLTVITG

SEQ ID NO: 673767 - protein, 26 aa, Mycobacterium
GYRSLREVILPLGRLSVITGANGSGK

SEQ ID NO: 673768 - protein, 23 aa, Mycobacterium
GYRSLREVILPLGRLSVVTGANG

SEQ ID NO: 673769 - protein, 27 aa, Mycobacterium
GYRVIPSDANFVLFGAFTDAPATWQRY

SEQ ID NO: 673770 - protein, 21 aa, Mycobacterium
GYRVLCPDLRGAGWSSAPRTS

SEQ ID NO: 673771 - protein, 22 aa, Mycobacterium
GYRVPNELPIHVETMLADPRHT

SEQ ID NO: 673772 - protein, 25 aa, Mycobacterium
GYRVVRHPGTLMLPGPVVDARMRRL

SEQ ID NO: 673773 - protein, 21 aa, Mycobacterium
GYRWDLCELREHLRQLSRAMR

SEQ ID NO: 673774 - protein, 18 aa, Mycobacterium
GYSAADCVALLRESALTA

SEQ ID NO: 673775 - protein, 30 aa, Mycobacterium
GYSANFLRMCFGEIPDPVIVKAFEQSMILY

SEQ ID NO: 673776 - protein, 18 aa, Mycobacterium
GYSDEPYELPGLTDEAKR

SEQ ID NO: 673777 - protein, 25 aa, Mycobacterium
GYSELRLNDRWVKATPAFNAELCAR

SEQ ID NO: 673778 - protein, 22 aa, Mycobacterium
GYSEYLLRLRVVYAALEDAMEA

SEQ ID NO: 673779 - protein, 17 aa, Mycobacterium
GYSGLPAPLTFVCVFGY

SEQ ID NO: 673780 - protein, 17 aa, Mycobacterium
GYSGVVAPLTFTSTPAM

SEQ ID NO: 673781 - protein, 28 aa, Mycobacterium
GYSHLWKRWRPALQQALVDAVRSVGVEK

SEQ ID NO: 673782 - protein, 18 aa, Mycobacterium
GYSPELGRIMALPTNPDN

SEQ ID NO: 673783 - protein, 19 aa, Mycobacterium
GYSQNLACEVVFAELAAER

SEQ ID NO: 673784 - protein, 19 aa, Mycobacterium
GYSQNLACEVVIAELVAER

SEQ ID NO: 673785 - protein, 19 aa, Mycobacterium
GYSRIPGYLIARLAIDTSL

SEQ ID NO: 673786 - protein, 20 aa, Mycobacterium
GYSRPRFDDDYGRYEGRDYE

SEQ ID NO: 673787 - protein, 18 aa, Mycobacterium
GYSRPRFEDDYGRYEGRD

SEQ ID NO: 673788 - protein, 19 aa, Mycobacterium
GYSSELAALAGTWQGPSAT

SEQ ID NO: 673789 - protein, 32 aa, Mycobacterium
GYSWHLSANLCWPDDHTWCLATEIDFDSTYLG

SEQ ID NO: 673790 - protein, 24 aa, Mycobacterium
GYSYYGEVLLDWITERLDNQKGSA

SEQ ID NO: 673791 - protein, 25 aa, Mycobacterium
GYSYYGEVLLDWIVERLANQKGSPD

SEQ ID NO: 673792 - protein, 24 aa, Mycobacterium
GYTAADFQAGAWPHEVSGATTTAH

SEQ ID NO: 673793 - protein, 24 aa, Mycobacterium
GYTAKRRAALCTTYRDHEICGMPA

SEQ ID NO: 673794 - protein, 21 aa, Mycobacterium
GYTARAIACFAYRQPVPVVDT

SEQ ID NO: 673795 - protein, 22 aa, Mycobacterium
GYTCAGTVEFLLDERGHHVFIE

SEQ ID NO: 673796 - protein, 21 aa, Mycobacterium
GYTCAGTVEFLLDERGNHVFI

SEQ ID NO: 673797 - protein, 23 aa, Mycobacterium
GYTEVRPILLWHALEECEHKAVA

SEQ ID NO: 673798 - protein, 25 aa, Mycobacterium
GYTFDRLRDALGMRIKAMPQFREKL

SEQ ID NO: 673799 - protein, 25 aa, Mycobacterium
GYTFDRLRDALSLRIKAIPEFREKL

SEQ ID NO: 673800 - protein, 25 aa, Mycobacterium
GYTFDRLRDALSLRIKAMPEFREKL

SEQ ID NO: 673801 - protein, 25 aa, Mycobacterium
GYTFDRLREALSLRVKALPEFREKL

SEQ ID NO: 673802 - protein, 17 aa, Mycobacterium
GYTGELGYEVWVHPGDA

SEQ ID NO: 673803 - protein, 17 aa, Mycobacterium
GYTGLHFMAAYELEECW

SEQ ID NO: 673804 - protein, 23 aa, Mycobacterium
GYTIPDFRRRAVTIASGGVYDPR

SEQ ID NO: 673805 - protein, 20 aa, Mycobacterium
GYTIPGFRRNAVTIATGGVY

SEQ ID NO: 673806 - protein, 23 aa, Mycobacterium
GYTPEYRPAPTLDEHADAPAHSS

SEQ ID NO: 673807 - protein, 23 aa, Mycobacterium
GYTPGLPKMGSFEVMNRTIDIAQ

SEQ ID NO: 673808 - protein, 19 aa, Mycobacterium
GYTSDLFSAFYPLSVASPA

SEQ ID NO: 673809 - protein, 18 aa, Mycobacterium
GYTTLGYLAAHTETVPLG

SEQ ID NO: 673810 - protein, 18 aa, Mycobacterium
GYTYGGRIAALADAAREA

SEQ ID NO: 673811 - protein, 18 aa, Mycobacterium
GYTYGGRIAALADAAREN

SEQ ID NO: 673812 - protein, 25 aa, Mycobacterium
GYVGADWPTEWGGAGTKDALRATVV

SEQ ID NO: 673813 - protein, 25 aa, Mycobacterium
GYVGAGRVEKCWGIIGFVDPHVETA

SEQ ID NO: 673814 - protein, 35 aa, Mycobacterium
GYVGRPGLTASRFVACPFGAPGSRMYRTGDLVCWT

SEQ ID NO: 673815 - protein, 19 aa, Mycobacterium
GYVGTALRLLERKIAQQPP

SEQ ID NO: 673816 - protein, 18 aa, Mycobacterium
GYVLSDGFRVPGLPMPSL

SEQ ID NO: 673817 - protein, 18 aa, Mycobacterium
GYVPRLGDGRALLLGELS

SEQ ID NO: 673818 - protein, 27 aa, Mycobacterium
GYWAANRVMGHLGWRVPSSLSVIEPPV

SEQ ID NO: 673819 - protein, 19 aa, Mycobacterium
GYWAVPYPLAERLAAPTDL

SEQ ID NO: 673820 - protein, 17 aa, Mycobacterium
GYWGRPKETDFSFRNKL

SEQ ID NO: 673821 - protein, 20 aa, Mycobacterium
GYWQRPALTATRFVANPYAL

SEQ ID NO: 673822 - protein, 24 aa, Mycobacterium
GYWRKSPEEQRCFGAQIADPSAGT

SEQ ID NO: 673823 - protein, 17 aa, Mycobacterium
GYWRKTPAEQRCFGATL

SEQ ID NO: 673824 - protein, 18 aa, Mycobacterium
GYYFDWLVVDVKPSHELN

SEQ ID NO: 673825 - protein, 18 aa, Mycobacterium
GYYLPVADQCAGFATGGL

SEQ ID NO: 673826 - protein, 24 aa, Mycobacterium
GYYNTRAAMQWYWDQYLPDPALRD

SEQ ID NO: 673827 - protein, 17 aa, Mycobacterium
GYYPGQFQVGQTGKTVS

SEQ ID NO: 673828 - protein, 25 aa, Mycobacterium
GYYQIRGGIPYAIVKSLAAAPFADI

SEQ ID NO: 673829 - protein, 22 aa, Mycobacterium
GYYTNCIHSAWYQNQTELTAKL

SEQ ID NO: 673830 - protein, 25 aa, Mycobacterium
HAAAKRLVQEGAYVFITGRDRTRAE

SEQ ID NO: 673831 - protein, 20 aa, Mycobacterium
HAAALGQWCGVPDKPESAVV

SEQ ID NO: 673832 - protein, 17 aa, Mycobacterium
HAAAMVVRGLIEKPTRI

SEQ ID NO: 673833 - protein, 17 aa, Mycobacterium
HAAARGWDGRALALAGA

SEQ ID NO: 673834 - protein, 17 aa, Mycobacterium
HAAAYWRAKSKAGETVD

SEQ ID NO: 673835 - protein, 21 aa, Mycobacterium
HAADALVSWADSVYLDGRNPL

SEQ ID NO: 673836 - protein, 17 aa, Mycobacterium
HAADRWAAEPATVDDVL

SEQ ID NO: 673837 - protein, 25 aa, Mycobacterium
HAAEGFPSLSCIVLNGGFELHPSIA

SEQ ID NO: 673838 - protein, 25 aa, Mycobacterium
HAAEGFPSLSGVILNGGLPLHPAID

SEQ ID NO: 673839 - protein, 25 aa, Mycobacterium
HAAEGFPSLSTIILNGGLDLHPAIA

SEQ ID NO: 673840 - protein, 20 aa, Mycobacterium
HAAEVLALLGPNGAGKTTTV

SEQ ID NO: 673841 - protein, 24 aa, Mycobacterium
HAAFAPRVAEILPDLPQLRVLIQI

SEQ ID NO: 673842 - protein, 18 aa, Mycobacterium
HAAFGREDYWLARIAAGA

SEQ ID NO: 673843 - protein, 17 aa, Mycobacterium
HAAFTPRQVRRIEDSIR

SEQ ID NO: 673844 - protein, 18 aa, Mycobacterium
HAAGAAAVRARIMPVGAS

SEQ ID NO: 673845 - protein, 25 aa, Mycobacterium
HAAGEAGYPWWSLSPLGMDNDQAIG

SEQ ID NO: 673846 - protein, 22 aa, Mycobacterium
HAAGIDGTLAWSRSTDDPDIVE

SEQ ID NO: 673847 - protein, 24 aa, Mycobacterium
HAAGLPSLMVLSGVNSARDAVFAP

SEQ ID NO: 673848 - protein, 27 aa, Mycobacterium
HAAGLRQLRYFWPQLVGDTRWELIDSK

SEQ ID NO: 673849 - protein, 25 aa, Mycobacterium
HAAGQQFWVVSPIGSTLGGVINTIS

SEQ ID NO: 673850 - protein, 20 aa, Mycobacterium
HAAGRLDEFSEWAKSLTQRT

SEQ ID NO: 673851 - protein, 17 aa, Mycobacterium
HAAGRLEEFTDWAKSLT

SEQ ID NO: 673852 - protein, 18 aa, Mycobacterium
HAAHLLAALPSSTAELTV

SEQ ID NO: 673853 - protein, 21 aa, Mycobacterium
HAAIRRIRRLYQDFDAKHPNT

SEQ ID NO: 673854 - protein, 20 aa, Mycobacterium
HAAKILNMRSTLLTLAGGDP

SEQ ID NO: 673855 - protein, 17 aa, Mycobacterium
HAAKVLNLRSTLLTLSG

SEQ ID NO: 673856 - protein, 17 aa, Mycobacterium
HAALAAAGGATCRVLVR

SEQ ID NO: 673857 - protein, 20 aa, Mycobacterium
HAALFGLPRCEPVYPTPAGL

SEQ ID NO: 673858 - protein, 25 aa, Mycobacterium
HAALFLRPGGRMALVLPAELLSVNY

SEQ ID NO: 673859 - protein, 17 aa, Mycobacterium
HAALRINGFTVMLNDDF

SEQ ID NO: 673860 - protein, 17 aa, Mycobacterium
HAALRINGSLVMLNDDF

SEQ ID NO: 673861 - protein, 17 aa, Mycobacterium
HAALSVLQHWLAQDQLA

SEQ ID NO: 673862 - protein, 25 aa, Mycobacterium
HAALTELCALSWMVYSLPGTPVLDH

SEQ ID NO: 673863 - protein, 20 aa, Mycobacterium
HAALTRPSRMHRLLHMLEAA

SEQ ID NO: 673864 - protein, 17 aa, Mycobacterium
HAALWLIQRDRADAETL

SEQ ID NO: 673865 - protein, 18 aa, Mycobacterium
HAAMPPPVMATAAITAPT

SEQ ID NO: 673866 - protein, 25 aa, Mycobacterium
HAANLFWRQLIQAHRVLSRFRSRFA

SEQ ID NO: 673867 - protein, 22 aa, Mycobacterium
HAAPDRLLRCIEAVLECREALA

SEQ ID NO: 673868 - protein, 19 aa, Mycobacterium
HAAPGCVRSASAFSQSERW

SEQ ID NO: 673869 - protein, 19 aa, Mycobacterium
HAAPRRFDPAIWPTTASSD

SEQ ID NO: 673870 - protein, 18 aa, Mycobacterium
HAAPSVGMSQPWDFVLVR

SEQ ID NO: 673871 - protein, 17 aa, Mycobacterium
HAAPVWHLLLDAGRADG

SEQ ID NO: 673872 - protein, 29 aa, Mycobacterium
HAAQICGFAKFPPLGDRSFAGGRTSEYRG

SEQ ID NO: 673873 - protein, 18 aa, Mycobacterium
HAAQVCSVYGAGCSVLTV

SEQ ID NO: 673874 - protein, 25 aa, Mycobacterium
HAAQWRGLFDANLLASVLTVQVLGD

SEQ ID NO: 673875 - protein, 23 aa, Mycobacterium
HAARAVRTRLRQWLAEIGATADD

SEQ ID NO: 673876 - protein, 22 aa, Mycobacterium
HAARDWKAFEPLIGDARSDAVR

SEQ ID NO: 673877 - protein, 17 aa, Mycobacterium
HAARGGAMGATQAASSK

SEQ ID NO: 673878 - protein, 17 aa, Mycobacterium
HAARTAYYDAAALMLAG

SEQ ID NO: 673879 - protein, 20 aa, Mycobacterium
HAARVAKVYCGRATRTVCET

SEQ ID NO: 673880 - protein, 22 aa, Mycobacterium
HAARVPVLEIVEARMRELEDGA

SEQ ID NO: 673881 - protein, 24 aa, Mycobacterium
HAARVTLGIALARLGMFAPALSYL

SEQ ID NO: 673882 - protein, 17 aa, Mycobacterium
HAARVVGVLPKVPAELA

SEQ ID NO: 673883 - protein, 20 aa, Mycobacterium
HAASAFAYAFPVESDRGQHG

SEQ ID NO: 673884 - protein, 28 aa, Mycobacterium
HAASLAQLWRSCGVLPDLSIGHSLGEAA

SEQ ID NO: 673885 - protein, 19 aa, Mycobacterium
HAASLSGLSVRDLRDAHAD

SEQ ID NO: 673886 - protein, 20 aa, Mycobacterium
HAASPRFDPAIWPLTAHPDE

SEQ ID NO: 673887 - protein, 22 aa, Mycobacterium
HAASVALFRLGRTLKYKAKPGR

SEQ ID NO: 673888 - protein, 21 aa, Mycobacterium
HAATNPKAFFYGKPITIEDHQ

SEQ ID NO: 673889 - protein, 18 aa, Mycobacterium
HAATRKDLLLDFDAESCR

SEQ ID NO: 673890 - protein, 17 aa, Mycobacterium
HAAVAPHLGINAADAVT

SEQ ID NO: 673891 - protein, 17 aa, Mycobacterium
HAAVAPHLGVNAADALT

SEQ ID NO: 673892 - protein, 17 aa, Mycobacterium
HAAVAPHLGVNAGDAVT

SEQ ID NO: 673893 - protein, 19 aa, Mycobacterium
HAAVFPACRAIAHHGGAGT

SEQ ID NO: 673894 - protein, 20 aa, Mycobacterium
HAAVFPACRAIVHHGGAGTT

SEQ ID NO: 673895 - protein, 18 aa, Mycobacterium
HAAVFPACRAVVHHGGAG

SEQ ID NO: 673896 - protein, 18 aa, Mycobacterium
HAAVIMKLGRSYGAVRQA

SEQ ID NO: 673897 - protein, 22 aa, Mycobacterium
HAAVLWRYAMRLTSDASYADDI

SEQ ID NO: 673898 - protein, 27 aa, Mycobacterium
HAAVTEGMWGIPWDKPVRRLNEYLDGL

SEQ ID NO: 673899 - protein, 22 aa, Mycobacterium
HACADMLVAVEVSRQLVADAVD

SEQ ID NO: 673900 - protein, 20 aa, Mycobacterium
HACAVMVPKAHSADHMRSVA

SEQ ID NO: 673901 - protein, 18 aa, Mycobacterium
HACIAQWNLGDSGKPAVV

SEQ ID NO: 673902 - protein, 19 aa, Mycobacterium
HACLFDLDGVLTDTASVHR

SEQ ID NO: 673903 - protein, 19 aa, Mycobacterium
HACLFDLDGVLTDTASVHT

SEQ ID NO: 673904 - protein, 21 aa, Mycobacterium
HACLPCNDGGLALGQAAVVAA

SEQ ID NO: 673905 - protein, 20 aa, Mycobacterium
HACTVMLRVGHQVVASAGLS

SEQ ID NO: 673906 - protein, 17 aa, Mycobacterium
HADADLALAERILLNSK

SEQ ID NO: 673907 - protein, 27 aa, Mycobacterium
HADAILLPSHYEPFGIVALEAAAAGTP

SEQ ID NO: 673908 - protein, 19 aa, Mycobacterium
HADAVLALREVVRGKGGRA

SEQ ID NO: 673909 - protein, 21 aa, Mycobacterium
HADDIRLWRMAVFDVLVNNAD

SEQ ID NO: 673910 - protein, 24 aa, Mycobacterium
HADDLKVLPGIRIYLGDTDEQAWA

SEQ ID NO: 673911 - protein, 19 aa, Mycobacterium
HADDVWRALTAIVYDNRDS

SEQ ID NO: 673912 - protein, 24 aa, Mycobacterium
HADEVIRHYRLIAAAVDVPVVAYD

SEQ ID NO: 673913 - protein, 17 aa, Mycobacterium
HADEWARFCGYVTDWER

SEQ ID NO: 673914 - protein, 21 aa, Mycobacterium
HADGGLACWATALLHARLVSA

SEQ ID NO: 673915 - protein, 21 aa, Mycobacterium
HADGGLVCWATSVLHPRAVNA

SEQ ID NO: 673916 - protein, 28 aa, Mycobacterium
HADHCLDLPGLFVWRRYHPNPPKGKAIM

SEQ ID NO: 673917 - protein, 27 aa, Mycobacterium
HADHCLDLPGLFVWRRYHPSRPDGKAL

SEQ ID NO: 673918 - protein, 31 aa, Mycobacterium
HADHCLDLPGLFVWRRYHPTPAPERGVVYGP

SEQ ID NO: 673919 - protein, 27 aa, Mycobacterium
HADHCLDLPGLFVWRRYHPTRPLGKAL

SEQ ID NO: 673920 - protein, 18 aa, Mycobacterium
HADLFWHGPGKLTVGDCL

SEQ ID NO: 673921 - protein, 18 aa, Mycobacterium
HADLLAVLVKGLDGFVRR

SEQ ID NO: 673922 - protein, 18 aa, Mycobacterium
HADPHPANFCFGADGTVG

SEQ ID NO: 673923 - protein, 24 aa, Mycobacterium
HADPIGFPPDWPFYEMQTEQTMCR

SEQ ID NO: 673924 - protein, 22 aa, Mycobacterium
HADPRPFVAILKRSLDQGSGAV

SEQ ID NO: 673925 - protein, 28 aa, Mycobacterium
HADRGRWDSLWVYDHFHTVPVPTGEATH

SEQ ID NO: 673926 - protein, 17 aa, Mycobacterium
HADSVVLPFLLPDTPVV

SEQ ID NO: 673927 - protein, 24 aa, Mycobacterium
HADVPWLGPDVDWWAQQFGVTPEL

SEQ ID NO: 673928 - protein, 24 aa, Mycobacterium
HAEACRWEHVMSVDVERRLVQVLN

SEQ ID NO: 673929 - protein, 23 aa, Mycobacterium
HAEAIKKFRILPVDFTEATGEMT

SEQ ID NO: 673930 - protein, 19 aa, Mycobacterium
HAEDTWKLLLEGRSGIRAL

SEQ ID NO: 673931 - protein, 24 aa, Mycobacterium
HAEGASFDPAWWRRAAELGWTGLL

SEQ ID NO: 673932 - protein, 18 aa, Mycobacterium
HAEGIIITTGCPSGEVQT

SEQ ID NO: 673933 - protein, 17 aa, Mycobacterium
HAEKALLARTIAGKVVP

SEQ ID NO: 673934 - protein, 23 aa, Mycobacterium
HAELGDKLIDVWTGTQHRGVQLN

SEQ ID NO: 673935 - protein, 19 aa, Mycobacterium
HAELPKIVTRLADATAAGT

SEQ ID NO: 673936 - protein, 18 aa, Mycobacterium
HAELRLLAVTAPPPLQNR

SEQ ID NO: 673937 - protein, 18 aa, Mycobacterium
HAELTRLRDAIRYVHDQT

SEQ ID NO: 673938 - protein, 26 aa, Mycobacterium
HAEMIAVAPSMLWSMTVDLERPGSLV

SEQ ID NO: 673939 - protein, 33 aa, Mycobacterium
HAEMIAVAPSMLWSMTVDLEWPGSLVQSVEGLA

SEQ ID NO: 673940 - protein, 23 aa, Mycobacterium
HAERFTALRPLLFTIAYEILGTA

SEQ ID NO: 673941 - protein, 23 aa, Mycobacterium
HAESIRKFRILGVDFTEDTGELT

SEQ ID NO: 673942 - protein, 30 aa, Mycobacterium
HAETLWEHWDRCALHWFPGSHVLHVSQLDY

SEQ ID NO: 673943 - protein, 19 aa, Mycobacterium
HAETSLRLAALGHTTVGLD

SEQ ID NO: 673944 - protein, 17 aa, Mycobacterium
HAEVHRICLPYMSKGSL

SEQ ID NO: 673945 - protein, 21 aa, Mycobacterium
HAFAGSLLRDYGLLLPVEPDT

SEQ ID NO: 673946 - protein, 21 aa, Mycobacterium
HAFAGTLLREHGLLLPVEPDT

SEQ ID NO: 673947 - protein, 19 aa, Mycobacterium
HAFANFFPLGGGGAAATTA

SEQ ID NO: 673948 - protein, 22 aa, Mycobacterium
HAFCSACDRTRLTADGQIRSCL

SEQ ID NO: 673949 - protein, 21 aa, Mycobacterium
HAFCSSCDRTRLTADGQIRSC

SEQ ID NO: 673950 - protein, 17 aa, Mycobacterium
HAFFRQYYNLRALLGRI

SEQ ID NO: 673951 - protein, 20 aa, Mycobacterium
HAFHTSRWDYAYTGEGLQDL

SEQ ID NO: 673952 - protein, 23 aa, Mycobacterium
HAFLAACWLPFDAAVDCYGAFIV

SEQ ID NO: 673953 - protein, 17 aa, Mycobacterium
HAFLRPGQQLRIKGPRN

SEQ ID NO: 673954 - protein, 21 aa, Mycobacterium
HAFNRWLLDDWTFNYQDRIFP

SEQ ID NO: 673955 - protein, 19 aa, Mycobacterium
HAGAAFFVPTIVKGGEMIV

SEQ ID NO: 673956 - protein, 19 aa, Mycobacterium
HAGAHDWSAVCIGRQKRGT

SEQ ID NO: 673957 - protein, 17 aa, Mycobacterium
HAGAIAHVITMLRAQEE

SEQ ID NO: 673958 - protein, 20 aa, Mycobacterium
HAGAPDWVALALNGKVTLLE

SEQ ID NO: 673959 - protein, 23 aa, Mycobacterium
HAGCVIGGTAWDFANEQRVPRGS

SEQ ID NO: 673960 - protein, 24 aa, Mycobacterium
HAGDGNVHLAIFCPDPATRKKLLT

SEQ ID NO: 673961 - protein, 23 aa, Mycobacterium
HAGDGNVHLAIFCQDPDTRKKLM

SEQ ID NO: 673962 - protein, 23 aa, Mycobacterium
HAGDGVSYGHRWVADRDTTLGLL

SEQ ID NO: 673963 - protein, 24 aa, Mycobacterium
HAGELETSILLAAHPDYLRDGWAS

SEQ ID NO: 673964 - protein, 21 aa, Mycobacterium
HAGEPAGLLRVCRAAAERGVR

SEQ ID NO: 673965 - protein, 17 aa, Mycobacterium
HAGFPLVVKPVSGAPGE

SEQ ID NO: 673966 - protein, 25 aa, Mycobacterium
HAGGKRFRPLFTVLAAQTGPDPDND

SEQ ID NO: 673967 - protein, 25 aa, Mycobacterium
HAGGLPRPPMVVTMGLPASGKTTLA

SEQ ID NO: 673968 - protein, 23 aa, Mycobacterium
HAGGRLGDIARRFAGLWRGERGQ

SEQ ID NO: 673969 - protein, 19 aa, Mycobacterium
HAGLGWGMYPIALLDGSFV

SEQ ID NO: 673970 - protein, 21 aa, Mycobacterium
HAGLLSLPWEGLGLSHGDPAI

SEQ ID NO: 673971 - protein, 26 aa, Mycobacterium
HAGLSSRAEWLPAWEDGLARAGKAID

SEQ ID NO: 673972 - protein, 25 aa, Mycobacterium
HAGLSSRAEWLPAWQDGLQRAAVAI

SEQ ID NO: 673973 - protein, 18 aa, Mycobacterium
HAGLTCDALRSATVVLPS

SEQ ID NO: 673974 - protein, 25 aa, Mycobacterium
HAGQAAELFGWLGAYPDAVVGAAGA

SEQ ID NO: 673975 - protein, 17 aa, Mycobacterium
HAGQCGVQTRIGMEDTL

SEQ ID NO: 673976 - protein, 28 aa, Mycobacterium
HAGQGCALTSRLLVPAAHKDEIVELIKN

SEQ ID NO: 673977 - protein, 25 aa, Mycobacterium
HAGQGCALTSRLLVPRKHKDEIVEL

SEQ ID NO: 673978 - protein, 26 aa, Mycobacterium
HAGQGCALTSRLLVPRSHHDEIVDLI

SEQ ID NO: 673979 - protein, 26 aa, Mycobacterium
HAGQSISLRVCIVIRVGTDGRIERID

SEQ ID NO: 673980 - protein, 24 aa, Mycobacterium
HAGQSISMRVCIVITVGGDGRLDR

SEQ ID NO: 673981 - protein, 23 aa, Mycobacterium
HAGRRADAMFGDPGDRADGVRGV

SEQ ID NO: 673982 - protein, 22 aa, Mycobacterium
HAGRWSTFVIPGIGDPADMAES

SEQ ID NO: 673983 - protein, 21 aa, Mycobacterium
HAGTPPICFGFGSMPVESPAD

SEQ ID NO: 673984 - protein, 19 aa, Mycobacterium
HAGVAMFARYAYAPNALGF

SEQ ID NO: 673985 - protein, 23 aa, Mycobacterium
HAHGIQGVHFFTRTKAVTSRWLD

SEQ ID NO: 673986 - protein, 17 aa, Mycobacterium
HAHGVAVVARLARHAVE

SEQ ID NO: 673987 - protein, 20 aa, Mycobacterium
HAHMGLGLELYGPALRGLQF

SEQ ID NO: 673988 - protein, 23 aa, Mycobacterium
HAHPRIAEAAARQLRKLNTNSRF

SEQ ID NO: 673989 - protein, 24 aa, Mycobacterium
HAHRSGGIDCLGWAGIGDADPLQS

SEQ ID NO: 673990 - protein, 21 aa, Mycobacterium
HAHSRLGGQLRRFQHYQGEPL

SEQ ID NO: 673991 - protein, 25 aa, Mycobacterium
HAHVADALPVLFGHIGEGNLHLNVL

SEQ ID NO: 673992 - protein, 18 aa, Mycobacterium
HAHVLLQRDVHYIVRDDA

SEQ ID NO: 673993 - protein, 17 aa, Mycobacterium
HAIALLLATARQIPAAD

SEQ ID NO: 673994 - protein, 18 aa, Mycobacterium
HAIAPDARKVVVNARPTV

SEQ ID NO: 673995 - protein, 19 aa, Mycobacterium
HAIDVLGVIVSRVEDKPFH

SEQ ID NO: 673996 - protein, 17 aa, Mycobacterium
HAIEAWIIESSDGTVNY

SEQ ID NO: 673997 - protein, 19 aa, Mycobacterium
HAIELTWSQLGIRLSAVAA

SEQ ID NO: 673998 - protein, 27 aa, Mycobacterium
HAIESDWLKGSTYVWIERGIRFERPQQ

SEQ ID NO: 673999 - protein, 19 aa, Mycobacterium
HAIEYVVAASNSFSMANVG

SEQ ID NO: 674000 - protein, 21 aa, Mycobacterium
HAIGARDAMTFDISNACAGML

SEQ ID NO: 674001 - protein, 24 aa, Mycobacterium
HAIGPHWLSAGGFEATPGDSAGRE

SEQ ID NO: 674002 - protein, 23 aa, Mycobacterium
HAILKTLCDRGWASRDPIAKTFA

SEQ ID NO: 674003 - protein, 23 aa, Mycobacterium
HAILKTLCDRGWASRDPVTKTFS

SEQ ID NO: 674004 - protein, 20 aa, Mycobacterium
HAILRQGLRSLLEREDDLVV

SEQ ID NO: 674005 - protein, 17 aa, Mycobacterium
HAIRLAAAHLKGSLDTE

SEQ ID NO: 674006 - protein, 17 aa, Mycobacterium
HAIRLAASHLKAVLDTE

SEQ ID NO: 674007 - protein, 23 aa, Mycobacterium
HAIRLASSHLKAALDTELVASFA

SEQ ID NO: 674008 - protein, 25 aa, Mycobacterium
HAISSVGALGFRIGDLSNPKPAKPG

SEQ ID NO: 674009 - protein, 21 aa, Mycobacterium
HAISSVGALSFKIGDLSNPKP

SEQ ID NO: 674010 - protein, 22 aa, Mycobacterium
HAIWWQVYPLGFVGAFPANQPP

SEQ ID NO: 674011 - protein, 17 aa, Mycobacterium
HAIWWQVYPLGSVGAFP

SEQ ID NO: 674012 - protein, 25 aa, Mycobacterium
HAKAEVLKLINWELASSDGESLNPA

SEQ ID NO: 674013 - protein, 23 aa, Mycobacterium
HAKAEVLKLINWELASSQDEAPS

SEQ ID NO: 674014 - protein, 24 aa, Mycobacterium
HAKAEVLKLINWELASSTDTAPSP

SEQ ID NO: 674015 - protein, 21 aa, Mycobacterium
HAKDGKGCWQLIVTESTDVSS

SEQ ID NO: 674016 - protein, 23 aa, Mycobacterium
HAKFGKLPFERLFGPAIAYGRNG

SEQ ID NO: 674017 - protein, 21 aa, Mycobacterium
HAKGKLTARERIFALLDEGSF

SEQ ID NO: 674018 - protein, 22 aa, Mycobacterium
HAKGKLTARERILALLDEDSFV

SEQ ID NO: 674019 - protein, 20 aa, Mycobacterium
HAKGLGVLIDAVFNHLGPSG

SEQ ID NO: 674020 - protein, 19 aa, Mycobacterium
HAKGLNVFHASGWGYHTPS

SEQ ID NO: 674021 - protein, 20 aa, Mycobacterium
HAKGMAPVPIFTGGTDESIS

SEQ ID NO: 674022 - protein, 20 aa, Mycobacterium
HAKHPLHLDIPVTIAGMSFG

SEQ ID NO: 674023 - protein, 20 aa, Mycobacterium
HAKHPLHLEIPVTIAGMSFG

SEQ ID NO: 674024 - protein, 19 aa, Mycobacterium
HAKIGAAIHSVRAVPPDSI

SEQ ID NO: 674025 - protein, 20 aa, Mycobacterium
HAKLLSGKGIHMLDCGTSGG

SEQ ID NO: 674026 - protein, 23 aa, Mycobacterium
HAKSLGYDAIVMFLDELVLWLAF

SEQ ID NO: 674027 - protein, 23 aa, Mycobacterium
HAKVEVLKLINWELASNDAAPSP

SEQ ID NO: 674028 - protein, 24 aa, Mycobacterium
HALAAIAHPDFRADLAAAADRAAK

SEQ ID NO: 674029 - protein, 17 aa, Mycobacterium
HALAHAVGAKFGISHGR

SEQ ID NO: 674030 - protein, 24 aa, Mycobacterium
HALAHAVGAKFGISHGRANGIFLP

SEQ ID NO: 674031 - protein, 17 aa, Mycobacterium
HALAHAVGAKFSVPHGR

SEQ ID NO: 674032 - protein, 17 aa, Mycobacterium
HALALGADWVWLADDDG

SEQ ID NO: 674033 - protein, 18 aa, Mycobacterium
HALALLLAAARQIPAADA

SEQ ID NO: 674034 - protein, 17 aa, Mycobacterium
HALALLLSAARQIPAAD

SEQ ID NO: 674035 - protein, 17 aa, Mycobacterium
HALDKIELVSRILQADG

SEQ ID NO: 674036 - protein, 25 aa, Mycobacterium
HALETLRPCGVREVLLAGRRGPLEA

SEQ ID NO: 674037 - protein, 18 aa, Mycobacterium
HALGVPTTRSLAVVGNGR

SEQ ID NO: 674038 - protein, 17 aa, Mycobacterium
HALGVPTTRSLAVVGTG

SEQ ID NO: 674039 - protein, 24 aa, Mycobacterium
HALHIFLLHLPDFLGHPDGISLAR

SEQ ID NO: 674040 - protein, 22 aa, Mycobacterium
HALHSPYWWLKCLVGTEKNDHP

SEQ ID NO: 674041 - protein, 22 aa, Mycobacterium
HALKERYSRITVHDKGKRYNSD

SEQ ID NO: 674042 - protein, 18 aa, Mycobacterium
HALKERYSRITVQDKGKR

SEQ ID NO: 674043 - protein, 19 aa, Mycobacterium
HALLRGIPMTSIMAEMFGK

SEQ ID NO: 674044 - protein, 20 aa, Mycobacterium
HALLRGIPMTSIMAEMFGKQ

SEQ ID NO: 674045 - protein, 18 aa, Mycobacterium
HALNEWLDEVWGFNYQNR

SEQ ID NO: 674046 - protein, 18 aa, Mycobacterium
HALNEWLHEVWGFNYQGR

SEQ ID NO: 674047 - protein, 25 aa, Mycobacterium
HALNTRPRKTLGWKTPAEAFHEQLL

SEQ ID NO: 674048 - protein, 21 aa, Mycobacterium
HALPDRKRRHSLLPLLQNYRE

SEQ ID NO: 674049 - protein, 17 aa, Mycobacterium
HALPELVATGFPVLLGA

SEQ ID NO: 674050 - protein, 26 aa, Mycobacterium
HALPHWAGVVPLALRAGTPEPAADLD

SEQ ID NO: 674051 - protein, 18 aa, Mycobacterium
HALPRLLAALQDAGVTVH

SEQ ID NO: 674052 - protein, 17 aa, Mycobacterium
HALRAKRFASIQFHAES

SEQ ID NO: 674053 - protein, 22 aa, Mycobacterium
HALRLIYSGLFDRFPRLQMILG

SEQ ID NO: 674054 - protein, 17 aa, Mycobacterium
HALRLRRLHYVRTARRR

SEQ ID NO: 674055 - protein, 25 aa, Mycobacterium
HALRRACAAGALATLVPGAGNCAPD

SEQ ID NO: 674056 - protein, 18 aa, Mycobacterium
HALRRACATHNYERGVDL

SEQ ID NO: 674057 - protein, 18 aa, Mycobacterium
HALRVSDDVIGRWRSFSE

SEQ ID NO: 674058 - protein, 17 aa, Mycobacterium
HALRVTAAPAIFSHSSA

SEQ ID NO: 674059 - protein, 22 aa, Mycobacterium
HALSGILAALSYRDRTGQGQRV

SEQ ID NO: 674060 - protein, 18 aa, Mycobacterium
HALSNTGIELFRRLVEDY

SEQ ID NO: 674061 - protein, 22 aa, Mycobacterium
HALTWGPLMREIIWRTTGKEIR

SEQ ID NO: 674062 - protein, 25 aa, Mycobacterium
HALVEWKGNPGLSLLRHMIANRLPF

SEQ ID NO: 674063 - protein, 18 aa, Mycobacterium
HALVLDLRKLEFLGTEGF

SEQ ID NO: 674064 - protein, 19 aa, Mycobacterium
HALYALSLRDPRLHTRLSP

SEQ ID NO: 674065 - protein, 19 aa, Mycobacterium
HAMDRWGAESTRLYHALHT

SEQ ID NO: 674066 - protein, 18 aa, Mycobacterium
HAMHYHKVDVFAVQKELQ

SEQ ID NO: 674067 - protein, 18 aa, Mycobacterium
HAMIDGRPVGVFSHDQTV

SEQ ID NO: 674068 - protein, 19 aa, Mycobacterium
HAMIDGRPVGVFSHDQTVF

SEQ ID NO: 674069 - protein, 19 aa, Mycobacterium
HAMLCGRPVAADRPLIMAI

SEQ ID NO: 674070 - protein, 18 aa, Mycobacterium
HAMLCMTEETFGPTLPIM

SEQ ID NO: 674071 - protein, 21 aa, Mycobacterium
HAMMLVQYLLDRDVEVEIPGI

SEQ ID NO: 674072 - protein, 22 aa, Mycobacterium
HAMNCIEWVDAFYGIMKARAVP

SEQ ID NO: 674073 - protein, 28 aa, Mycobacterium
HAMSPLDFLARPSSWLRLISDVRATHTP

SEQ ID NO: 674074 - protein, 24 aa, Mycobacterium
HAMTKLAPQHLVVVLGHDHQRISP

SEQ ID NO: 674075 - protein, 20 aa, Mycobacterium
HAMYPRIDEWIRIRRSVDPD

SEQ ID NO: 674076 - protein, 23 aa, Mycobacterium
HANACLTCPLFITTAEFLPQHRK

SEQ ID NO: 674077 - protein, 23 aa, Mycobacterium
HANACLTCPMFLTTQEFLPQHRT

SEQ ID NO: 674078 - protein, 24 aa, Mycobacterium
HANACLTCPMFVTTPEFLPQHHEH

SEQ ID NO: 674079 - protein, 23 aa, Mycobacterium
HANAGLARYAAADAMQKGAMSLH

SEQ ID NO: 674080 - protein, 19 aa, Mycobacterium
HANGGLLIRELDLPEVDQY

SEQ ID NO: 674081 - protein, 17 aa, Mycobacterium
HANHYLAVFDRATGSAL

SEQ ID NO: 674082 - protein, 18 aa, Mycobacterium
HANHYLAVFDRATGSALD

SEQ ID NO: 674083 - protein, 19 aa, Mycobacterium
HANRGKRSLGLDMSISEGK

SEQ ID NO: 674084 - protein, 23 aa, Mycobacterium
HANRLKRSIGLDMSVPEGKEVLL

SEQ ID NO: 674085 - protein, 20 aa, Mycobacterium
HAPDADWGVVYARTGEGRHG

SEQ ID NO: 674086 - protein, 25 aa, Mycobacterium
HAPEAPWVRPPLRSLRWMETFLETL

SEQ ID NO: 674087 - protein, 19 aa, Mycobacterium
HAPFSLAWMTAVGERTERI

SEQ ID NO: 674088 - protein, 19 aa, Mycobacterium
HAPFSLAWMTAVGERTQRL

SEQ ID NO: 674089 - protein, 17 aa, Mycobacterium
HAPHAFGNLGLVNIAIW

SEQ ID NO: 674090 - protein, 19 aa, Mycobacterium
HAPNAWTVLGAVAHATERV

SEQ ID NO: 674091 - protein, 30 aa, Mycobacterium
HAPQCPESAELLQLLFLEAGFPQGAYVDIR

SEQ ID NO: 674092 - protein, 21 aa, Mycobacterium
HAPQTRSGRKFDVDADGREKL

SEQ ID NO: 674093 - protein, 25 aa, Mycobacterium
HAPRLWPEYHPGYYGAFVRDPDGNN

SEQ ID NO: 674094 - protein, 19 aa, Mycobacterium
HAPTGIWAPECAYAPGMEE

SEQ ID NO: 674095 - protein, 19 aa, Mycobacterium
HAPTRRRAAAVLADALARA

SEQ ID NO: 674096 - protein, 26 aa, Mycobacterium
HAPWHIVPCNRKWYSRLAITELMIEA

SEQ ID NO: 674097 - protein, 24 aa, Mycobacterium
HAPWTLRNGWWLVARTKIIDDTIA

SEQ ID NO: 674098 - protein, 19 aa, Mycobacterium
HAQDALFRESIRTGLRTIS

SEQ ID NO: 674099 - protein, 23 aa, Mycobacterium
HAQDKLLMRRRLSELGAPVPRFS

SEQ ID NO: 674100 - protein, 26 aa, Mycobacterium
HAQGFAFACRALRVHGRVYVPAKTPK

SEQ ID NO: 674101 - protein, 35 aa, Mycobacterium
HAQGWRVPPGFTRFRWDLDSMFGPQARWGDWRQAP

SEQ ID NO: 674102 - protein, 27 aa, Mycobacterium
HAQLIFGGEPLRWPTVRRVRAARPGLT

SEQ ID NO: 674103 - protein, 26 aa, Mycobacterium
HAQLNWPYGCGGIMLGTHKPDAQWCR

SEQ ID NO: 674104 - protein, 26 aa, Mycobacterium
HAQRHGFEVWALWGMALRATVDALAS

SEQ ID NO: 674105 - protein, 30 aa, Mycobacterium
HAQRLVRAAFRYACTRGYEPQYRCQLDNAA

SEQ ID NO: 674106 - protein, 21 aa, Mycobacterium
HAQSYVRACHALGYQHPDLTA

SEQ ID NO: 674107 - protein, 21 aa, Mycobacterium
HARATARHWLRAVDAEDLAER

SEQ ID NO: 674108 - protein, 25 aa, Mycobacterium
HARDAVVVHPTWWTPNRVTRLRDIA

SEQ ID NO: 674109 - protein, 23 aa, Mycobacterium
HAREFFRKAELDLSQSGVDLPPT

SEQ ID NO: 674110 - protein, 24 aa, Mycobacterium
HARGFSLNVSNFFSTDEEIGYGEA

SEQ ID NO: 674111 - protein, 19 aa, Mycobacterium
HARGKPLIVDEAWGAHLPF

SEQ ID NO: 674112 - protein, 24 aa, Mycobacterium
HARGLPGLSVAWGMWEEPSAMTHH

SEQ ID NO: 674113 - protein, 18 aa, Mycobacterium
HARGRAYLDLSVAHDNAA

SEQ ID NO: 674114 - protein, 24 aa, Mycobacterium
HARGSEVLNRIGALGTLPDESLRA

SEQ ID NO: 674115 - protein, 18 aa, Mycobacterium
HARKVLVATEVGMLHQLR

SEQ ID NO: 674116 - protein, 17 aa, Mycobacterium
HARLRYVAPADKRVALV

SEQ ID NO: 674117 - protein, 19 aa, Mycobacterium
HARLVRRHLERGIYQGWDM

SEQ ID NO: 674118 - protein, 25 aa, Mycobacterium
HARMKRLRGAIAVARDVPAQLERKT

SEQ ID NO: 674119 - protein, 25 aa, Mycobacterium
HARMKRLRGAIAVARTVPAQLHRQT

SEQ ID NO: 674120 - protein, 21 aa, Mycobacterium
HARNPLRFAPRPDVDADGWRG

SEQ ID NO: 674121 - protein, 20 aa, Mycobacterium
HARRAGDRAGRRARLGASPE

SEQ ID NO: 674122 - protein, 18 aa, Mycobacterium
HARRARLTADRILEAAVA

SEQ ID NO: 674123 - protein, 25 aa, Mycobacterium
HARTRLEAKLSYTNIGFALAPNEFA

SEQ ID NO: 674124 - protein, 24 aa, Mycobacterium
HARTRLNAKLSYTNIGFALAPREF

SEQ ID NO: 674125 - protein, 19 aa, Mycobacterium
HARVPDWRDYYLGLDQTRH

SEQ ID NO: 674126 - protein, 17 aa, Mycobacterium
HARVRYTTIQNWSNNVY

SEQ ID NO: 674127 - protein, 26 aa, Mycobacterium
HASARPDVLCTALIRGAFDYQGQKCS

SEQ ID NO: 674128 - protein, 21 aa, Mycobacterium
HASEAWSALAAAATNVDAPLR

SEQ ID NO: 674129 - protein, 21 aa, Mycobacterium
HASGARWILDLGPGDILTRLT

SEQ ID NO: 674130 - protein, 18 aa, Mycobacterium
HASGGWSVGAVALVAGWV

SEQ ID NO: 674131 - protein, 18 aa, Mycobacterium
HASGWGPHLIRLLHHAEH

SEQ ID NO: 674132 - protein, 21 aa, Mycobacterium
HASKGRIGWNVVTSALQNSAR

SEQ ID NO: 674133 - protein, 20 aa, Mycobacterium
HASMMWNAFNILTAAQVAAP

SEQ ID NO: 674134 - protein, 34 aa, Mycobacterium
HASMSISLLRQGRLWGLIACHHYAGPHLPPFGTR

SEQ ID NO: 674135 - protein, 25 aa, Mycobacterium
HASNLKCLCRFHHLLKTFWTGPGGW

SEQ ID NO: 674136 - protein, 26 aa, Mycobacterium
HASNLKCLCRFHHLLKTFWTGPGGWH

SEQ ID NO: 674137 - protein, 26 aa, Mycobacterium
HASNLKCLCRFHHLLKTFWTGRGGWH

SEQ ID NO: 674138 - protein, 18 aa, Mycobacterium
HASPAAVRDVVWSSRFRV

SEQ ID NO: 674139 - protein, 17 aa, Mycobacterium
HASPLLYAAFKAVGVIT

SEQ ID NO: 674140 - protein, 23 aa, Mycobacterium
HASRSELLADLGLTDQDVARRIT

SEQ ID NO: 674141 - protein, 19 aa, Mycobacterium
HASVLSPRPARVGPQASLP

SEQ ID NO: 674142 - protein, 18 aa, Mycobacterium
HATAGHYRSVIAGLTSGR

SEQ ID NO: 674143 - protein, 23 aa, Mycobacterium
HATALWRYALRLTGDPARAEDVV

SEQ ID NO: 674144 - protein, 17 aa, Mycobacterium
HATAWYGLHDLGRIRAG

SEQ ID NO: 674145 - protein, 21 aa, Mycobacterium
HATELLAVFDVYRSRFGKLLA

SEQ ID NO: 674146 - protein, 20 aa, Mycobacterium
HATELLAVFDVYRTRFGALL

SEQ ID NO: 674147 - protein, 21 aa, Mycobacterium
HATELLAVFDVYRTRFGALLT

SEQ ID NO: 674148 - protein, 21 aa, Mycobacterium
HATELPYVWGNLGGPHDPTLR

SEQ ID NO: 674149 - protein, 18 aa, Mycobacterium
HATGRVGVCMATSGPGAT

SEQ ID NO: 674150 - protein, 29 aa, Mycobacterium
HATIAPGARLNIPWRRDFNSLVYVLSGRG

SEQ ID NO: 674151 - protein, 23 aa, Mycobacterium
HATNIWAGTGFRAIGPGTVAEIM

SEQ ID NO: 674152 - protein, 23 aa, Mycobacterium
HATPERLLRCIEAVLNCREALSI

SEQ ID NO: 674153 - protein, 20 aa, Mycobacterium
HATRLWSPVLACAIGHGVLP

SEQ ID NO: 674154 - protein, 19 aa, Mycobacterium
HATTLHRLLGPRPDTSSRF

SEQ ID NO: 674155 - protein, 17 aa, Mycobacterium
HATVFGAFDAVPAGGAL

SEQ ID NO: 674156 - protein, 27 aa, Mycobacterium
HATVLQGRVAFAWRAMDAFYEEEERIV

SEQ ID NO: 674157 - protein, 20 aa, Mycobacterium
HAVAAIVPMGRPLRQVTKLT

SEQ ID NO: 674158 - protein, 18 aa, Mycobacterium
HAVACGLQALPAGFAGTV

SEQ ID NO: 674159 - protein, 18 aa, Mycobacterium
HAVAEVFAGLSPEERDNA

SEQ ID NO: 674160 - protein, 17 aa, Mycobacterium
HAVAGVALFPGAGFAEL

SEQ ID NO: 674161 - protein, 17 aa, Mycobacterium
HAVALIAERARVLGEAV

SEQ ID NO: 674162 - protein, 22 aa, Mycobacterium
HAVARLRVERDLELQLVAKLEP

SEQ ID NO: 674163 - protein, 21 aa, Mycobacterium
HAVARLRVERNLDLQLVSKLE

SEQ ID NO: 674164 - protein, 19 aa, Mycobacterium
HAVATPFLRARGTLKVWRN

SEQ ID NO: 674165 - protein, 24 aa, Mycobacterium
HAVDPRPSVDVALLADELDAEALR

SEQ ID NO: 674166 - protein, 21 aa, Mycobacterium
HAVEFPVLLKEVGHGISGAAA

SEQ ID NO: 674167 - protein, 17 aa, Mycobacterium
HAVEILTRMYGLARPIA

SEQ ID NO: 674168 - protein, 21 aa, Mycobacterium
HAVELPFVFDRLDAEVLRGPD

SEQ ID NO: 674169 - protein, 17 aa, Mycobacterium
HAVELRPGGGAKLARSA

SEQ ID NO: 674170 - protein, 21 aa, Mycobacterium
HAVEQQMHWTRAQIMTAPIAA

SEQ ID NO: 674171 - protein, 19 aa, Mycobacterium
HAVEVKRALARSARTLGND

SEQ ID NO: 674172 - protein, 20 aa, Mycobacterium
HAVFIRAPWVERVGDDVEVL

SEQ ID NO: 674173 - protein, 23 aa, Mycobacterium
HAVGCGLSALPEDYAGVVVVTSG

SEQ ID NO: 674174 - protein, 24 aa, Mycobacterium
HAVGDSAIRACIRAGIDCIEHGFL

SEQ ID NO: 674175 - protein, 24 aa, Mycobacterium
HAVGDTAIRACIRAGIDCIEHGFL

SEQ ID NO: 674176 - protein, 19 aa, Mycobacterium
HAVGGGWIGYLSYPDPGAD

SEQ ID NO: 674177 - protein, 23 aa, Mycobacterium
HAVKSMFFGWPLISEDLALATIT

SEQ ID NO: 674178 - protein, 25 aa, Mycobacterium
HAVLARAGWDVSRDGLIGAPRIRVV

SEQ ID NO: 674179 - protein, 27 aa, Mycobacterium
HAVLDRLDLKSGETLLVHAAAGGVGTF

SEQ ID NO: 674180 - protein, 26 aa, Mycobacterium
HAVLPPRLRSAFDHDFERQPQMMKLF

SEQ ID NO: 674181 - protein, 24 aa, Mycobacterium
HAVNCGLTALPHDFAGMVVVTSGD

SEQ ID NO: 674182 - protein, 35 aa, Mycobacterium
HAVNSGAPLWDWMKSIPGFDGGGLVSGPDVSAAQS

SEQ ID NO: 674183 - protein, 31 aa, Mycobacterium
HAVPASVRRALVARLDRFGIAHAVLAVADGA

SEQ ID NO: 674184 - protein, 23 aa, Mycobacterium
HAVPCLREQDALERLRRLGLPFL

SEQ ID NO: 674185 - protein, 22 aa, Mycobacterium
HAVPELLDLGSPERLAEGARLL

SEQ ID NO: 674186 - protein, 21 aa, Mycobacterium
HAVPGFPLGVTTGFWALPDPK

SEQ ID NO: 674187 - protein, 21 aa, Mycobacterium
HAVPMVPTFDGEWVEPTVLPA

SEQ ID NO: 674188 - protein, 24 aa, Mycobacterium
HAVPRDGRIRLTLNSDRGGERLET

SEQ ID NO: 674189 - protein, 25 aa, Mycobacterium
HAVQARSVLPLSLTFDHRALDGAAA

SEQ ID NO: 674190 - protein, 23 aa, Mycobacterium
HAVRELISGIGLSTFPLTSGSKG

SEQ ID NO: 674191 - protein, 18 aa, Mycobacterium
HAVRGRVDGVDFAQQTLT

SEQ ID NO: 674192 - protein, 20 aa, Mycobacterium
HAVRGRVDGVDFARHTLTWC

SEQ ID NO: 674193 - protein, 28 aa, Mycobacterium
HAVRPGVKLAAWREVASIASAAQPGEAG

SEQ ID NO: 674194 - protein, 20 aa, Mycobacterium
HAVSELYERIAPRPVSPWAQ

SEQ ID NO: 674195 - protein, 21 aa, Mycobacterium
HAVSLGRLGARKGSYDVIAAV

SEQ ID NO: 674196 - protein, 17 aa, Mycobacterium
HAVWALMDFGFRVVISS

SEQ ID NO: 674197 - protein, 23 aa, Mycobacterium
HAVWDIRALLGWIRAENPGADIG

SEQ ID NO: 674198 - protein, 17 aa, Mycobacterium
HAVYPLMSITHNRRIQL

SEQ ID NO: 674199 - protein, 24 aa, Mycobacterium
HAWATGIFGGGAWQDATETGPGYA

SEQ ID NO: 674200 - protein, 26 aa, Mycobacterium
HAWLARTQFSLGEWDAALASVAHGRR

SEQ ID NO: 674201 - protein, 17 aa, Mycobacterium
HAWQHFQAIEARGGFAN

SEQ ID NO: 674202 - protein, 22 aa, Mycobacterium
HAWWFYAHTIVRGGIDKVHVGL

SEQ ID NO: 674203 - protein, 19 aa, Mycobacterium
HAYDDGALVIYGRCDEDLG

SEQ ID NO: 674204 - protein, 17 aa, Mycobacterium
HAYDVLRSIRLPGSHFR

SEQ ID NO: 674205 - protein, 23 aa, Mycobacterium
HAYHPVLRCFLERPVHAAISRDN

SEQ ID NO: 674206 - protein, 23 aa, Mycobacterium
HAYPVELDTLFSLFEGASESFEF

SEQ ID NO: 674207 - protein, 21 aa, Mycobacterium
HAYSAANWLALNCRRHMELYG

SEQ ID NO: 674208 - protein, 26 aa, Mycobacterium
HCADMAVAVEAGRATLWAAALALDTA

SEQ ID NO: 674209 - protein, 20 aa, Mycobacterium
HCAGFLGSLGSYVLLQNAVE

SEQ ID NO: 674210 - protein, 23 aa, Mycobacterium
HCAKELPVRTLADMVGIPDSERH

SEQ ID NO: 674211 - protein, 23 aa, Mycobacterium
HCALPPMGSWLPTYVDLTRSLIT

SEQ ID NO: 674212 - protein, 30 aa, Mycobacterium
HCARTTRHALLYREGDGFKDHAERLERIAL

SEQ ID NO: 674213 - protein, 17 aa, Mycobacterium
HCAVARETCELVISPLV

SEQ ID NO: 674214 - protein, 22 aa, Mycobacterium
HCDAPRAVVLLLHGGGQSRHAW

SEQ ID NO: 674215 - protein, 20 aa, Mycobacterium
HCDPCRKGMFIHCAKMKVPG

SEQ ID NO: 674216 - protein, 22 aa, Mycobacterium
HCDYCRRGDFVNCLDQPLTGTT

SEQ ID NO: 674217 - protein, 26 aa, Mycobacterium
HCEIHAVAGAGHWPWLEQPDTVAGYL

SEQ ID NO: 674218 - protein, 22 aa, Mycobacterium
HCFAGKDRTGFTVATVLDAAGV

SEQ ID NO: 674219 - protein, 23 aa, Mycobacterium
HCFAGKDRTGFTVAVVLEAAGVD

SEQ ID NO: 674220 - protein, 23 aa, Mycobacterium
HCFAGKDRTGFVIATVLETVGID

SEQ ID NO: 674221 - protein, 20 aa, Mycobacterium
HCFGCGEGGDAYTFIQKIEH

SEQ ID NO: 674222 - protein, 24 aa, Mycobacterium
HCFGCGEGGDVYAFIQKIEHVSFV

SEQ ID NO: 674223 - protein, 23 aa, Mycobacterium
HCFGCGEGGDVYAFIQKIEHVTF

SEQ ID NO: 674224 - protein, 25 aa, Mycobacterium
HCFGCGEGGDVYAFLQKIEHVSFVE

SEQ ID NO: 674225 - protein, 20 aa, Mycobacterium
HCFGCGEGGDVYAFVQKIEH

SEQ ID NO: 674226 - protein, 32 aa, Mycobacterium
HCFSSGPAMARTCIDAGWVLSLSGTVSFKNAR

SEQ ID NO: 674227 - protein, 24 aa, Mycobacterium
HCGELYFEGGPAFEYYKDPVKTAS

SEQ ID NO: 674228 - protein, 18 aa, Mycobacterium
HCGLPRDDALSLAVRQAC

SEQ ID NO: 674229 - protein, 17 aa, Mycobacterium
HCGPSGAGHFVKMVHNG

SEQ ID NO: 674230 - protein, 25 aa, Mycobacterium
HCLPPRDWTEPGFMGLGMIYTAMPV

SEQ ID NO: 674231 - protein, 17 aa, Mycobacterium
HCLSGGALEIFLDPQVP

SEQ ID NO: 674232 - protein, 20 aa, Mycobacterium
HCMTRGINAWMLSKITGDYD

SEQ ID NO: 674233 - protein, 17 aa, Mycobacterium
HCPRGCGHMGPPADPEC

SEQ ID NO: 674234 - protein, 19 aa, Mycobacterium
HCPSCATEGITPCAPGSAT

SEQ ID NO: 674235 - protein, 17 aa, Mycobacterium
HCQQVLAGMGFTAEHQL

SEQ ID NO: 674236 - protein, 19 aa, Mycobacterium
HCQQVLGGIGFTAEHPLHH

SEQ ID NO: 674237 - protein, 26 aa, Mycobacterium
HCQRRTVIGDGFWRLIGELDALRLDW

SEQ ID NO: 674238 - protein, 20 aa, Mycobacterium
HCRLPLREVMWGSDAELLQS

SEQ ID NO: 674239 - protein, 18 aa, Mycobacterium
HCRPAGATTPPLGVLELM

SEQ ID NO: 674240 - protein, 21 aa, Mycobacterium
HCRRARLLAYRVVALQSSGRI

SEQ ID NO: 674241 - protein, 27 aa, Mycobacterium
HCRRGESRCPVPIGRPIANIRIHLLDA

SEQ ID NO: 674242 - protein, 17 aa, Mycobacterium
HCRSRLAKYKVPADFLV

SEQ ID NO: 674243 - protein, 18 aa, Mycobacterium
HCRYSTTGSTTWENAQPV

SEQ ID NO: 674244 - protein, 20 aa, Mycobacterium
HCSWTVTGIGQFLPHEGASP

SEQ ID NO: 674245 - protein, 22 aa, Mycobacterium
HCTRGLGIWDWASSDTSGEPDV

SEQ ID NO: 674246 - protein, 21 aa, Mycobacterium
HCTRGLGIWEWASTATDDPDV

SEQ ID NO: 674247 - protein, 17 aa, Mycobacterium
HCTRGLGIWQWASTATG

SEQ ID NO: 674248 - protein, 19 aa, Mycobacterium
HCVAWGGGAPEFVDRLPAM

SEQ ID NO: 674249 - protein, 26 aa, Mycobacterium
HCVRLARAGADIVAIDACAPVAAHNG

SEQ ID NO: 674250 - protein, 26 aa, Mycobacterium
HCVRLARAGADIVAIDACAPVAEHNG

SEQ ID NO: 674251 - protein, 28 aa, Mycobacterium
HCVVALAAMGWRADVHRLPDPADPDHLA

SEQ ID NO: 674252 - protein, 19 aa, Mycobacterium
HDADYIWLACRTDPEAVKH

SEQ ID NO: 674253 - protein, 17 aa, Mycobacterium
HDAELAPGLVAPMPAGV

SEQ ID NO: 674254 - protein, 19 aa, Mycobacterium
HDAELMGSVYFEDGIDEHG

SEQ ID NO: 674255 - protein, 18 aa, Mycobacterium
HDAFPIEELMYYELLGVC

SEQ ID NO: 674256 - protein, 19 aa, Mycobacterium
HDAGCFVGASATGYGPHMA

SEQ ID NO: 674257 - protein, 26 aa, Mycobacterium
HDAGCYIGASGLEYGPPLSEFSHHSG

SEQ ID NO: 674258 - protein, 25 aa, Mycobacterium
HDAHLYLRRAHAIGRFLGGAERWLR

SEQ ID NO: 674259 - protein, 25 aa, Mycobacterium
HDAHLYLRRAHAIGRFLGGPERWQR

SEQ ID NO: 674260 - protein, 21 aa, Mycobacterium
HDAHLYLRRAYGIAHFLGGSR

SEQ ID NO: 674261 - protein, 19 aa, Mycobacterium
HDAHLYLRRAYGIAQFLGG

SEQ ID NO: 674262 - protein, 22 aa, Mycobacterium
HDAIEVLTWVVGNATRLGFDAR

SEQ ID NO: 674263 - protein, 19 aa, Mycobacterium
HDAILPKEFILVGKQLLYV

SEQ ID NO: 674264 - protein, 19 aa, Mycobacterium
HDALDPFVALGFAAATTST

SEQ ID NO: 674265 - protein, 19 aa, Mycobacterium
HDALDPFVALGFAAATTTS

SEQ ID NO: 674266 - protein, 23 aa, Mycobacterium
HDALDPFVAMGFAAARTTTLRLI

SEQ ID NO: 674267 - protein, 17 aa, Mycobacterium
HDAMLTAMRLLLAHKDL

SEQ ID NO: 674268 - protein, 18 aa, Mycobacterium
HDAMLTAMRLLLAHKDLG

SEQ ID NO: 674269 - protein, 24 aa, Mycobacterium
HDARAAVRAGNWACFGASTALFCY

SEQ ID NO: 674270 - protein, 17 aa, Mycobacterium
HDARLVLSTAIPGRLND

SEQ ID NO: 674271 - protein, 21 aa, Mycobacterium
HDATVCFRRNGPRPAKATAGA

SEQ ID NO: 674272 - protein, 27 aa, Mycobacterium
HDCGAPIPGRIFAGPGLAQPPGTSPAE

SEQ ID NO: 674273 - protein, 30 aa, Mycobacterium
HDCKTAMFEWWFRWRCDTQKYIWWHPIDHV

SEQ ID NO: 674274 - protein, 18 aa, Mycobacterium
HDCPRGCGHMGPPADPEC

SEQ ID NO: 674275 - protein, 17 aa, Mycobacterium
HDDGAVLDLSWTSPPAG

SEQ ID NO: 674276 - protein, 24 aa, Mycobacterium
HDDGPRPTLCLIHGFMGSAYLFNG

SEQ ID NO: 674277 - protein, 24 aa, Mycobacterium
HDDGPRPTLCVIHGFMGSSYLANG

SEQ ID NO: 674278 - protein, 25 aa, Mycobacterium
HDDGPRPTLCVIHGFMGSWYLANGR

SEQ ID NO: 674279 - protein, 24 aa, Mycobacterium
HDDHRIGTGVLRQWEKHTAGSFAV

SEQ ID NO: 674280 - protein, 22 aa, Mycobacterium
HDDLRAAIGVQLGDELLTLALT

SEQ ID NO: 674281 - protein, 23 aa, Mycobacterium
HDDPWWSRAVFYQIYPRSFGDSD

SEQ ID NO: 674282 - protein, 19 aa, Mycobacterium
HDDRYLPGLVTFTLENTLE

SEQ ID NO: 674283 - protein, 20 aa, Mycobacterium
HDDVPFPAPVSLVAGGIWLW

SEQ ID NO: 674284 - protein, 23 aa, Mycobacterium
HDELLRYHHAVLYAVGAPSDRRL

SEQ ID NO: 674285 - protein, 20 aa, Mycobacterium
HDERRRLVVASVRHAVSHGS

SEQ ID NO: 674286 - protein, 23 aa, Mycobacterium
HDETRKSFAIAGTRVIDTIKLSV

SEQ ID NO: 674287 - protein, 25 aa, Mycobacterium
HDEVYRAAAALIELGVKPAARVGIW

SEQ ID NO: 674288 - protein, 30 aa, Mycobacterium
HDFAAAKATETWRFPPFFHALLERGVYPPC

SEQ ID NO: 674289 - protein, 38 aa, Mycobacterium
HDFDGGLKWLGAFSAHPKWDFATGDMFNFGLAMFPTPK

SEQ ID NO: 674290 - protein, 21 aa, Mycobacterium
HDFLNTRCLTIAGGTEQILLT

SEQ ID NO: 674291 - protein, 19 aa, Mycobacterium
HDGDCGPDSPMARSTKRVC

SEQ ID NO: 674292 - protein, 18 aa, Mycobacterium
HDGFWKAFAAEAGIHGFE

SEQ ID NO: 674293 - protein, 25 aa, Mycobacterium
HDGGGRCWSEFVLGSAYEGPPKLVH

SEQ ID NO: 674294 - protein, 21 aa, Mycobacterium
HDGRAAIGFGAGRDYGFAEFL

SEQ ID NO: 674295 - protein, 17 aa, Mycobacterium
HDGRITLWRDYFDFYDM

SEQ ID NO: 674296 - protein, 22 aa, Mycobacterium
HDGRITLWRDYFDYLDIFKATV

SEQ ID NO: 674297 - protein, 19 aa, Mycobacterium
HDGRLGVWFETERTREAAE

SEQ ID NO: 674298 - protein, 22 aa, Mycobacterium
HDGRWKFSRRTIVADWAYQNDP

SEQ ID NO: 674299 - protein, 22 aa, Mycobacterium
HDGVLRLTIPIAEKAKPRRIEI

SEQ ID NO: 674300 - protein, 19 aa, Mycobacterium
HDGWFAGAVGPRLPWIPGL

SEQ ID NO: 674301 - protein, 20 aa, Mycobacterium
HDHCSAFHPLGVGSPFWQEI

SEQ ID NO: 674302 - protein, 31 aa, Mycobacterium
HDHERIAPLVADWADALGRPIDVALQDRPRG

SEQ ID NO: 674303 - protein, 22 aa, Mycobacterium
HDHGVEIVGYWGEHVGTAAAAR

SEQ ID NO: 674304 - protein, 21 aa, Mycobacterium
HDHHSRRGLLLLVGRRRRLIK

SEQ ID NO: 674305 - protein, 23 aa, Mycobacterium
HDHHSRRGLLLLVGRRRRLIKYI

SEQ ID NO: 674306 - protein, 21 aa, Mycobacterium
HDHHSRRGLLLLVGRRRRLLK

SEQ ID NO: 674307 - protein, 22 aa, Mycobacterium
HDHHSRRGLLLLVGRRRRLLKY

SEQ ID NO: 674308 - protein, 23 aa, Mycobacterium
HDHHSRRGLLLLVGRRRRLLKYV

SEQ ID NO: 674309 - protein, 19 aa, Mycobacterium
HDHHVHLRSAASALDSFFV

SEQ ID NO: 674310 - protein, 17 aa, Mycobacterium
HDHKSVLGLFETLDGAP

SEQ ID NO: 674311 - protein, 23 aa, Mycobacterium
HDHQRISPLVAELAQTLGRTIDV

SEQ ID NO: 674312 - protein, 27 aa, Mycobacterium
HDHVHRWAEILSIAGLVETPNMQTRRR

SEQ ID NO: 674313 - protein, 27 aa, Mycobacterium
HDIAAARPCFRIAFGVNDYTLDIGVDQ

SEQ ID NO: 674314 - protein, 17 aa, Mycobacterium
HDIGRKAIAQNAADIEA

SEQ ID NO: 674315 - protein, 20 aa, Mycobacterium
HDIQPWVTLYHWDLPQTLED

SEQ ID NO: 674316 - protein, 18 aa, Mycobacterium
HDIRETFARMAMNDEETA

SEQ ID NO: 674317 - protein, 21 aa, Mycobacterium
HDIRPLFVLFDSCWDPHPEAG

SEQ ID NO: 674318 - protein, 23 aa, Mycobacterium
HDIRYYWDRHMSASFMVDPLGLE

SEQ ID NO: 674319 - protein, 29 aa, Mycobacterium
HDISSLRLVACGGSAVPVSLMRGFERDHG

SEQ ID NO: 674320 - protein, 24 aa, Mycobacterium
HDIVLFPAWARRNPLSPSPLDPPS

SEQ ID NO: 674321 - protein, 23 aa, Mycobacterium
HDKEFTAVVIIAEREHGTGVGRT

SEQ ID NO: 674322 - protein, 25 aa, Mycobacterium
HDKGYRALGVPAHMGELGDIDALVT

SEQ ID NO: 674323 - protein, 23 aa, Mycobacterium
HDKYLVTLVFRLGGVDTDAAERF

SEQ ID NO: 674324 - protein, 26 aa, Mycobacterium
HDLADWRWGIDVNVLGVIHGIKAFVP

SEQ ID NO: 674325 - protein, 17 aa, Mycobacterium
HDLAELVTIEVGKTGSE

SEQ ID NO: 674326 - protein, 18 aa, Mycobacterium
HDLAPGRRAPVLIQVPGG

SEQ ID NO: 674327 - protein, 26 aa, Mycobacterium
HDLAQAVTVDAMFGHLRKLQEIADAN

SEQ ID NO: 674328 - protein, 24 aa, Mycobacterium
HDLASRLAAALGLSPVTNPVAGDP

SEQ ID NO: 674329 - protein, 25 aa, Mycobacterium
HDLAYRVAVGLYRYSLLDIIDIADI

SEQ ID NO: 674330 - protein, 24 aa, Mycobacterium
HDLDVWSLTDLVAFSTNASGGSSI

SEQ ID NO: 674331 - protein, 23 aa, Mycobacterium
HDLEAMPDLISRVLASSEPVVAL

SEQ ID NO: 674332 - protein, 18 aa, Mycobacterium
HDLGGALVLSEFTGAAAE

SEQ ID NO: 674333 - protein, 23 aa, Mycobacterium
HDLGPWSPWGRYLRLRRQFDGIV

SEQ ID NO: 674334 - protein, 21 aa, Mycobacterium
HDLGRYLGAYGHRDVASPRLD

SEQ ID NO: 674335 - protein, 22 aa, Mycobacterium
HDLGRYLGAYGHRDVDSPRLDR

SEQ ID NO: 674336 - protein, 17 aa, Mycobacterium
HDLGVTCSLFVDQIHYW

SEQ ID NO: 674337 - protein, 27 aa, Mycobacterium
HDLHLYLRRVALYRAMFGSPEDHHRAV

SEQ ID NO: 674338 - protein, 27 aa, Mycobacterium
HDLHLYLRRVMLYRSMFGTPEEHNLRV

SEQ ID NO: 674339 - protein, 17 aa, Mycobacterium
HDLHMLISSVSRPEHLD

SEQ ID NO: 674340 - protein, 17 aa, Mycobacterium
HDLKRAAVTDILGSELA

SEQ ID NO: 674341 - protein, 19 aa, Mycobacterium
HDLLACWLLEVAGIAVDDN

SEQ ID NO: 674342 - protein, 21 aa, Mycobacterium
HDLMAIMARVTWGCEPEDVSM

SEQ ID NO: 674343 - protein, 25 aa, Mycobacterium
HDLNYPWECLRAEPDGAQALPLLDF

SEQ ID NO: 674344 - protein, 17 aa, Mycobacterium
HDLPECHVYRTLDDLDA

SEQ ID NO: 674345 - protein, 23 aa, Mycobacterium
HDLPLLNPLRAVPILGNPLADLV

SEQ ID NO: 674346 - protein, 19 aa, Mycobacterium
HDLPPWLGDKAFHLSHQSS

SEQ ID NO: 674347 - protein, 19 aa, Mycobacterium
HDLPRQLWDQVIGVLTSNF

SEQ ID NO: 674348 - protein, 21 aa, Mycobacterium
HDLPYDEWECEARRLRELLAP

SEQ ID NO: 674349 - protein, 33 aa, Mycobacterium
HDLQHYRLIGWRRGICGYRRFFSITSLAALRQE

SEQ ID NO: 674350 - protein, 30 aa, Mycobacterium
HDLRPWPTYYRHRLKERICTNVAQHTSPVA

SEQ ID NO: 674351 - protein, 21 aa, Mycobacterium
HDLRSSVWGTGSFAINDFLGW

SEQ ID NO: 674352 - protein, 24 aa, Mycobacterium
HDLRVVEISDRIAGSYCGKLLVDA

SEQ ID NO: 674353 - protein, 19 aa, Mycobacterium
HDLTAGLFAPVELLILEEP

SEQ ID NO: 674354 - protein, 19 aa, Mycobacterium
HDMGLTFLLSAAVGGTETW

SEQ ID NO: 674355 - protein, 20 aa, Mycobacterium
HDMMKWFGPIIHEYYGGTEG

SEQ ID NO: 674356 - protein, 26 aa, Mycobacterium
HDPAAKWLALQKMTFEVAWRILQSTP

SEQ ID NO: 674357 - protein, 27 aa, Mycobacterium
HDPAAVLDWRLPAPIGNTAADLGPLRW

SEQ ID NO: 674358 - protein, 17 aa, Mycobacterium
HDPELFGAYLYSRAQSV

SEQ ID NO: 674359 - protein, 23 aa, Mycobacterium
HDPGRALFKLGLSVEPDAAGGLH

SEQ ID NO: 674360 - protein, 21 aa, Mycobacterium
HDPGRDWSAICIGRRKRGTAP

SEQ ID NO: 674361 - protein, 23 aa, Mycobacterium
HDPGRSLFWLSLSLQSDGTALRL

SEQ ID NO: 674362 - protein, 17 aa, Mycobacterium
HDPRASIAIVAPSAESD

SEQ ID NO: 674363 - protein, 21 aa, Mycobacterium
HDPRFPMRLIGMREARSENSW

SEQ ID NO: 674364 - protein, 31 aa, Mycobacterium
HDPRRFATDLLERFRDLILLQAVPDAAARGV

SEQ ID NO: 674365 - protein, 28 aa, Mycobacterium
HDPRRFATDLLERFRDLIVLQAVPDAVA

SEQ ID NO: 674366 - protein, 28 aa, Mycobacterium
HDPRRFATDLLERFRDLIVLQAVPDAVT

SEQ ID NO: 674367 - protein, 27 aa, Mycobacterium
HDPRRFATDLLERFRDLLVLQAVPDAV

SEQ ID NO: 674368 - protein, 23 aa, Mycobacterium
HDPSFGSMCRIALAPCSPFSVSG

SEQ ID NO: 674369 - protein, 27 aa, Mycobacterium
HDQARRVVTAFPRRPALVAHSVARRAA

SEQ ID NO: 674370 - protein, 26 aa, Mycobacterium
HDQLRLALLLCAVRPEIGGALIRGEK

SEQ ID NO: 674371 - protein, 25 aa, Mycobacterium
HDQPRWSRAGTRAVATGEPFSSRCI

SEQ ID NO: 674372 - protein, 24 aa, Mycobacterium
HDRALDLATNWLFGYVDVVLIRAE

SEQ ID NO: 674373 - protein, 31 aa, Mycobacterium
HDREALEAAARWREIFGPENFFLELMDHGLD

SEQ ID NO: 674374 - protein, 19 aa, Mycobacterium
HDRERIAPEVARLSEELGR

SEQ ID NO: 674375 - protein, 23 aa, Mycobacterium
HDREWPTAIGWYLPDQEPPWGAL

SEQ ID NO: 674376 - protein, 21 aa, Mycobacterium
HDRFRLLTGGSRTAVRRQQTL

SEQ ID NO: 674377 - protein, 23 aa, Mycobacterium
HDRIPLWVEESLRYDTSSQILAR

SEQ ID NO: 674378 - protein, 22 aa, Mycobacterium
HDRLKAELDQLIANRPVIAAEI

SEQ ID NO: 674379 - protein, 26 aa, Mycobacterium
HDRNRISGAFSVRFARPGETVVTLDD

SEQ ID NO: 674380 - protein, 17 aa, Mycobacterium
HDRVCAQLSEVTLTEAL

SEQ ID NO: 674381 - protein, 17 aa, Mycobacterium
HDRWLPRRRTLQPLFTK

SEQ ID NO: 674382 - protein, 20 aa, Mycobacterium
HDRWLRCGRVANRAEPDLKS

SEQ ID NO: 674383 - protein, 17 aa, Mycobacterium
HDSCGAVKAALGAIDDG

SEQ ID NO: 674384 - protein, 22 aa, Mycobacterium
HDSCGAVKAALGALDDGEVPGG

SEQ ID NO: 674385 - protein, 32 aa, Mycobacterium
HDSGFRPGSRLGLLSRNCWQYAVLAFATARAG

SEQ ID NO: 674386 - protein, 24 aa, Mycobacterium
HDTGPRVTMRLMQAVHPVMVAAGG

SEQ ID NO: 674387 - protein, 23 aa, Mycobacterium
HDTIFAWWIRRHLNPPPPLSEWV

SEQ ID NO: 674388 - protein, 26 aa, Mycobacterium
HDTIFYCVANMPGAVPRTSTFALTNS

SEQ ID NO: 674389 - protein, 20 aa, Mycobacterium
HDTLWRPPVLTMSALENNGV

SEQ ID NO: 674390 - protein, 26 aa, Mycobacterium
HDTRTPVWLCAGDAHTAAKLVGLTDV

SEQ ID NO: 674391 - protein, 17 aa, Mycobacterium
HDTTIRFTHDLRMTLRE

SEQ ID NO: 674392 - protein, 17 aa, Mycobacterium
HDTTMRFTHELRMTLRA

SEQ ID NO: 674393 - protein, 17 aa, Mycobacterium
HDTWCYFDALPDELTTA

SEQ ID NO: 674394 - protein, 17 aa, Mycobacterium
HDVAVVLGSGWRPAADA

SEQ ID NO: 674395 - protein, 26 aa, Mycobacterium
HDVFHIDRGYPLFVENLVSLGAEIER

SEQ ID NO: 674396 - protein, 26 aa, Mycobacterium
HDVFHIDRGYPLFVENLVSLGAEVER

SEQ ID NO: 674397 - protein, 17 aa, Mycobacterium
HDVGRKAIAQNAADIEA

SEQ ID NO: 674398 - protein, 25 aa, Mycobacterium
HDVGRWRFVTLRWSVDNARDIADLG

SEQ ID NO: 674399 - protein, 24 aa, Mycobacterium
HDVHKLRHYLPIYERVLTNAGKML

SEQ ID NO: 674400 - protein, 40 aa, Mycobacterium
HDVLPFCAGSPFPKNVCEWDMMGALLGRPVDLVPCESVPL

SEQ ID NO: 674401 - protein, 17 aa, Mycobacterium
HDVPMGDARWITVVSPE

SEQ ID NO: 674402 - protein, 22 aa, Mycobacterium
HDVPMGQFRWITVVSPEDPDGT

SEQ ID NO: 674403 - protein, 30 aa, Mycobacterium
HDVSAAQVILRWHLQLGNVVIPKSVTPARI

SEQ ID NO: 674404 - protein, 19 aa, Mycobacterium
HDVTERWWGVEVDFPPSLD

SEQ ID NO: 674405 - protein, 32 aa, Mycobacterium
HDVYRTGEYIAWRLWLHIAFDLTADPAELREL

SEQ ID NO: 674406 - protein, 23 aa, Mycobacterium
HDWRVGKKLLAWERPLRPSEREA

SEQ ID NO: 674407 - protein, 18 aa, Mycobacterium
HDWSLTLRTAEAMAPLLP

SEQ ID NO: 674408 - protein, 29 aa, Mycobacterium
HDYFWRWDTDWFWCSRAFGAQNPKIRRWW

SEQ ID NO: 674409 - protein, 29 aa, Mycobacterium
HDYFWRWDTDWFWCSRAFGAQNPRLRRWW

SEQ ID NO: 674410 - protein, 29 aa, Mycobacterium
HDYFWRWDTDWFWCSRAFGAQNPTLRRWW

SEQ ID NO: 674411 - protein, 28 aa, Mycobacterium
HDYFWRWDTDWFWCSRAFGVQDPRVRRF

SEQ ID NO: 674412 - protein, 19 aa, Mycobacterium
HDYLGCYFLDDRAAVTALL

SEQ ID NO: 674413 - protein, 28 aa, Mycobacterium
HDYLWRWDSDWFWCSRAFGVQDPRLRRW

SEQ ID NO: 674414 - protein, 24 aa, Mycobacterium
HDYPVQFDVWWFKLPYEDTTEFSL

SEQ ID NO: 674415 - protein, 24 aa, Mycobacterium
HDYRCLDASFGRRHQRLDDQVAEL

SEQ ID NO: 674416 - protein, 25 aa, Mycobacterium
HDYRYRMVVCEEIARINALSFGLTI

SEQ ID NO: 674417 - protein, 21 aa, Mycobacterium
HEAAALGRRVLFLASGGLSHD

SEQ ID NO: 674418 - protein, 20 aa, Mycobacterium
HEAARASIRRRFERIDQTFA

SEQ ID NO: 674419 - protein, 19 aa, Mycobacterium
HEAASVIFREWQRRGYGGK

SEQ ID NO: 674420 - protein, 17 aa, Mycobacterium
HEAAVRLNHAFHRGVNI

SEQ ID NO: 674421 - protein, 25 aa, Mycobacterium
HEADEKFWLGVGLTRSEAYVFIASG

SEQ ID NO: 674422 - protein, 25 aa, Mycobacterium
HEADERFWLGVGLTRSEAYVIIASG

SEQ ID NO: 674423 - protein, 18 aa, Mycobacterium
HEAFGVGDTCEFEGPRNA

SEQ ID NO: 674424 - protein, 20 aa, Mycobacterium
HEAFLRLAAEDLLELLPRRG

SEQ ID NO: 674425 - protein, 20 aa, Mycobacterium
HEAGARWILDLGPGDILTRL

SEQ ID NO: 674426 - protein, 20 aa, Mycobacterium
HEAGGYPLEFGTISVSDGIS

SEQ ID NO: 674427 - protein, 33 aa, Mycobacterium
HEAKRYLEYTLRWRNVPKPSIAAVQGRCISGGL

SEQ ID NO: 674428 - protein, 18 aa, Mycobacterium
HEALMKQAWLAANEDMPV

SEQ ID NO: 674429 - protein, 18 aa, Mycobacterium
HEALMKQAWLAANEDQPV

SEQ ID NO: 674430 - protein, 19 aa, Mycobacterium
HEALWRPPVLTMSAVEGTG

SEQ ID NO: 674431 - protein, 18 aa, Mycobacterium
HEASFELSEHFSRHFGVF

SEQ ID NO: 674432 - protein, 27 aa, Mycobacterium
HEATAGKELDWWVAFSSVASLLGSPGQ

SEQ ID NO: 674433 - protein, 22 aa, Mycobacterium
HEATRVLGTFLRDVIRRNPDRF

SEQ ID NO: 674434 - protein, 18 aa, Mycobacterium
HECAGLRLAFLKRDGEVL

SEQ ID NO: 674435 - protein, 26 aa, Mycobacterium
HEDAFPLLITHGWPGSIVEFHKVIEP

SEQ ID NO: 674436 - protein, 19 aa, Mycobacterium
HEDELCWRINTEGARTVAQ

SEQ ID NO: 674437 - protein, 21 aa, Mycobacterium
HEDLKRFFDGFPRNAHPMPVL

SEQ ID NO: 674438 - protein, 25 aa, Mycobacterium
HEDLKRFFDGFPRNAHPMPVLSSAA

SEQ ID NO: 674439 - protein, 25 aa, Mycobacterium
HEDLKRFFDGFPRNAHPMPVLSSVV

SEQ ID NO: 674440 - protein, 21 aa, Mycobacterium
HEDPNAPGLHQSRHDTPDEST

SEQ ID NO: 674441 - protein, 18 aa, Mycobacterium
HEDRGMMGILLVDPPGQY

SEQ ID NO: 674442 - protein, 18 aa, Mycobacterium
HEDWDFDALWTALKTLYP

SEQ ID NO: 674443 - protein, 23 aa, Mycobacterium
HEEFPRIDAAVICLIHDGGDRAV

SEQ ID NO: 674444 - protein, 25 aa, Mycobacterium
HEEFPRIDPAIICLVHDGHDRAVLA

SEQ ID NO: 674445 - protein, 24 aa, Mycobacterium
HEEFPRIDPAVICLVHDGGDRVVL

SEQ ID NO: 674446 - protein, 23 aa, Mycobacterium
HEELPIELARLHWSVADPARTAR

SEQ ID NO: 674447 - protein, 20 aa, Mycobacterium
HEEMRAWVDRQLALLAAEPG

SEQ ID NO: 674448 - protein, 22 aa, Mycobacterium
HEETVRYFAPFRPAQGSDRGSS

SEQ ID NO: 674449 - protein, 25 aa, Mycobacterium
HEEVICELLAWAGVHPDYRSLPEDE

SEQ ID NO: 674450 - protein, 20 aa, Mycobacterium
HEFAARLGLPRRTAQFPGTW

SEQ ID NO: 674451 - protein, 24 aa, Mycobacterium
HEFAPRVVCRSCTAEASGNDVVAQ

SEQ ID NO: 674452 - protein, 24 aa, Mycobacterium
HEFGGQAYGGFQIESVTWLNGGLF

SEQ ID NO: 674453 - protein, 28 aa, Mycobacterium
HEFGSRSGLLTRAWLRAVHRLQTVLTEL

SEQ ID NO: 674454 - protein, 24 aa, Mycobacterium
HEFNFPVRLFEIGASAGLNLRADR

SEQ ID NO: 674455 - protein, 30 aa, Mycobacterium
HEFQELWADGPVAFVFLRQFGSAFAVRQAQ

SEQ ID NO: 674456 - protein, 24 aa, Mycobacterium
HEFRPELVVLYAPDHYNGFFYKEM

SEQ ID NO: 674457 - protein, 26 aa, Mycobacterium
HEGAFPLVITHGWPGSIVEFHKVIEP

SEQ ID NO: 674458 - protein, 25 aa, Mycobacterium
HEGCVREMLVLAAALSIPDPRERPA

SEQ ID NO: 674459 - protein, 26 aa, Mycobacterium
HEGELAIVIGRPCKDVPAARAAEFIL

SEQ ID NO: 674460 - protein, 17 aa, Mycobacterium
HEGEVPGALVIERNVLE

SEQ ID NO: 674461 - protein, 24 aa, Mycobacterium
HEGKPFFGSLLEFITSAPVVAAIV

SEQ ID NO: 674462 - protein, 24 aa, Mycobacterium
HEGKPFFGSLLEFITSGPVVAAVV

SEQ ID NO: 674463 - protein, 27 aa, Mycobacterium
HEGRLPKARLSEMVRRILRSMFAVGVD

SEQ ID NO: 674464 - protein, 23 aa, Mycobacterium
HEGSLRLGDKVVFGKDNVVNAYI

SEQ ID NO: 674465 - protein, 30 aa, Mycobacterium
HEHWEVVRIALPPALSRYVVEKGSITVDGV

SEQ ID NO: 674466 - protein, 24 aa, Mycobacterium
HEIAIGVAHVVVWPAEGNPESGME

SEQ ID NO: 674467 - protein, 25 aa, Mycobacterium
HEIDVLICATGFKLWEAGAVPPFPV

SEQ ID NO: 674468 - protein, 24 aa, Mycobacterium
HEIDVLVCATGFKVMEKGATPPFP

SEQ ID NO: 674469 - protein, 26 aa, Mycobacterium
HEIKDLNVGSALRGDFAAAYTDGDQR

SEQ ID NO: 674470 - protein, 17 aa, Mycobacterium
HEIRKRFLDHFVKAGHT

SEQ ID NO: 674471 - protein, 23 aa, Mycobacterium
HEIRWDADISRWIIRTNHGDRMR

SEQ ID NO: 674472 - protein, 25 aa, Mycobacterium
HEIRWPRSAKLLDVLLDKGLDAPFS

SEQ ID NO: 674473 - protein, 17 aa, Mycobacterium
HEITRWPGPKLRREINH

SEQ ID NO: 674474 - protein, 31 aa, Mycobacterium
HEIVEFSKFILAEIFPGGWLPTPQTVGEYGV

SEQ ID NO: 674475 - protein, 30 aa, Mycobacterium
HEIVGAYFPFGWPMACHVQGDAGVDTILDV

SEQ ID NO: 674476 - protein, 19 aa, Mycobacterium
HEIWACWRDGTRLNFEGEF

SEQ ID NO: 674477 - protein, 20 aa, Mycobacterium
HEIWGALLHGGRLVVVPESV

SEQ ID NO: 674478 - protein, 20 aa, Mycobacterium
HEKAGLPFVEVFVDTPVEIC

SEQ ID NO: 674479 - protein, 19 aa, Mycobacterium
HEKLLKAGVPAVVLNAKND

SEQ ID NO: 674480 - protein, 23 aa, Mycobacterium
HEKRPRGPLLVRRGSGTGPWGVD

SEQ ID NO: 674481 - protein, 17 aa, Mycobacterium
HELAALVAGLAATGSVR

SEQ ID NO: 674482 - protein, 24 aa, Mycobacterium
HELDVWSLTDLVAFSTNASGGCSI

SEQ ID NO: 674483 - protein, 23 aa, Mycobacterium
HELEAMPDVVARVLATIKPVAAL

SEQ ID NO: 674484 - protein, 23 aa, Mycobacterium
HELEHRASVAAARVKVAIEEPAL

SEQ ID NO: 674485 - protein, 19 aa, Mycobacterium
HELFFSNLVEHCLGYTRDE

SEQ ID NO: 674486 - protein, 19 aa, Mycobacterium
HELFFSNLVEHCLSYTRDE

SEQ ID NO: 674487 - protein, 21 aa, Mycobacterium
HELHLWLPHPSDRLWRALAGT

SEQ ID NO: 674488 - protein, 21 aa, Mycobacterium
HELIAEAFGGKGYHVTTPTEL

SEQ ID NO: 674489 - protein, 24 aa, Mycobacterium
HELIPEARVGFVGVARNEETHQPT

SEQ ID NO: 674490 - protein, 24 aa, Mycobacterium
HELLKRSVIVLNDIHDCASKAFIS

SEQ ID NO: 674491 - protein, 21 aa, Mycobacterium
HELMLPFLEHFVMKSRYADDP

SEQ ID NO: 674492 - protein, 17 aa, Mycobacterium
HELMRYYPVVFGTIRLA

SEQ ID NO: 674493 - protein, 22 aa, Mycobacterium
HELPVYIVSIGRTFRTDELDAT

SEQ ID NO: 674494 - protein, 24 aa, Mycobacterium
HELRDLLLRFPVSVDVHLLTPDEA

SEQ ID NO: 674495 - protein, 21 aa, Mycobacterium
HELRGKIRFNTRVVRQDFDES

SEQ ID NO: 674496 - protein, 24 aa, Mycobacterium
HELRTKCYWPVPWGNDDQLTYFGY

SEQ ID NO: 674497 - protein, 17 aa, Mycobacterium
HELRVIEQLNFPGYFLV

SEQ ID NO: 674498 - protein, 18 aa, Mycobacterium
HELSGVVVELGYGTTRFT

SEQ ID NO: 674499 - protein, 22 aa, Mycobacterium
HELTCDLDVSAFVMFSSMAGLV

SEQ ID NO: 674500 - protein, 17 aa, Mycobacterium
HELTGALTYYGLTPRDS

SEQ ID NO: 674501 - protein, 17 aa, Mycobacterium
HELTPGVAQTVHRDFWM

SEQ ID NO: 674502 - protein, 17 aa, Mycobacterium
HELTRGLDLSAFVMFSS

SEQ ID NO: 674503 - protein, 20 aa, Mycobacterium
HELYHPQPLRGKKIDKYYGE

SEQ ID NO: 674504 - protein, 17 aa, Mycobacterium
HELYHPQPLRGKKLDRY

SEQ ID NO: 674505 - protein, 19 aa, Mycobacterium
HEMMLPFLEHFVMKTRYAQ

SEQ ID NO: 674506 - protein, 25 aa, Mycobacterium
HEMQQRCPIAWTDTYGGHWVAAGGD

SEQ ID NO: 674507 - protein, 18 aa, Mycobacterium
HEMRSRIITAPSFTGDRV

SEQ ID NO: 674508 - protein, 25 aa, Mycobacterium
HENAMRWYSFDPFTHISREQATVGA

SEQ ID NO: 674509 - protein, 22 aa, Mycobacterium
HENLSWGVSDGVHLDRFEPAQT

SEQ ID NO: 674510 - protein, 19 aa, Mycobacterium
HENTVRYRLRRMAEVTNLE

SEQ ID NO: 674511 - protein, 18 aa, Mycobacterium
HENWRTTFEVDLMGTVGM

SEQ ID NO: 674512 - protein, 23 aa, Mycobacterium
HEPDDCRGRLFGGVDDLLGRLQM

SEQ ID NO: 674513 - protein, 19 aa, Mycobacterium
HEPGAYWVPHRLGGTAPTR

SEQ ID NO: 674514 - protein, 17 aa, Mycobacterium
HEPGCERWTDSPDPPLH

SEQ ID NO: 674515 - protein, 24 aa, Mycobacterium
HEPSFEPGQGWAYVNSNYFLLGMI

SEQ ID NO: 674516 - protein, 23 aa, Mycobacterium
HEQRRADALAAIMNKADRLSCLC

SEQ ID NO: 674517 - protein, 27 aa, Mycobacterium
HEQVGLPVKVFRSGMIMVDTSYAGQVN

SEQ ID NO: 674518 - protein, 28 aa, Mycobacterium
HERAKFGLPEVKRGLIAAAGGVFRIVNQ

SEQ ID NO: 674519 - protein, 18 aa, Mycobacterium
HERAMLWLDYADMLHALT

SEQ ID NO: 674520 - protein, 24 aa, Mycobacterium
HERFTGVAAQLGWEVEKRINKDVR

SEQ ID NO: 674521 - protein, 23 aa, Mycobacterium
HERGKLLARERIELLIDPDSPFL

SEQ ID NO: 674522 - protein, 18 aa, Mycobacterium
HERGKLTARERIELLVDA

SEQ ID NO: 674523 - protein, 20 aa, Mycobacterium
HERIPLWVEETLRYDTSSQI

SEQ ID NO: 674524 - protein, 22 aa, Mycobacterium
HERKVNALKFIAFITNAANTAY

SEQ ID NO: 674525 - protein, 29 aa, Mycobacterium
HERLRAAGAPECLWRADGEAWTVSDVPLL

SEQ ID NO: 674526 - protein, 21 aa, Mycobacterium
HERLWRARLTPGERPYPVAHR

SEQ ID NO: 674527 - protein, 18 aa, Mycobacterium
HERRAVGGGSEFASGTGA

SEQ ID NO: 674528 - protein, 18 aa, Mycobacterium
HERRCLARTLSRFLTDAH

SEQ ID NO: 674529 - protein, 23 aa, Mycobacterium
HERRPWRRWIGGRAAQLGTSGAR

SEQ ID NO: 674530 - protein, 24 aa, Mycobacterium
HERRRLEHVVIRFAGDSGDGMQLT

SEQ ID NO: 674531 - protein, 33 aa, Mycobacterium
HERTMMWLGFADRIANCIADFVPRTPLERDALA

SEQ ID NO: 674532 - protein, 25 aa, Mycobacterium
HERTMMWLGFADRIDNMLADFNPRT

SEQ ID NO: 674533 - protein, 21 aa, Mycobacterium
HERTMMWLGFADRLDNLLADF

SEQ ID NO: 674534 - protein, 27 aa, Mycobacterium
HERVLKLAGIQPVWLREGLRFWMRTAI

SEQ ID NO: 674535 - protein, 24 aa, Mycobacterium
HERWGERPLAFVVPAAGHDATPDL

SEQ ID NO: 674536 - protein, 22 aa, Mycobacterium
HERWRGSICLAIEEPEASVREI

SEQ ID NO: 674537 - protein, 22 aa, Mycobacterium
HERWRGSICLAIEEPEESVREI

SEQ ID NO: 674538 - protein, 22 aa, Mycobacterium
HERWRGSICLAIEEPEHSVAEI

SEQ ID NO: 674539 - protein, 19 aa, Mycobacterium
HERWRGSICLAVEAPELAA

SEQ ID NO: 674540 - protein, 25 aa, Mycobacterium
HESAKRICKEAHYYGAGTVEYLVGQ

SEQ ID NO: 674541 - protein, 25 aa, Mycobacterium
HESCGKCTPCREGTFWLDKIYARLE

SEQ ID NO: 674542 - protein, 25 aa, Mycobacterium
HESCGKCTPCREGTFWLDKIYERLE

SEQ ID NO: 674543 - protein, 26 aa, Mycobacterium
HESCGKCTPCREGTFWLDQIYERLET

SEQ ID NO: 674544 - protein, 25 aa, Mycobacterium
HESEKLLKLSFPFDVHADRSASETQ

SEQ ID NO: 674545 - protein, 17 aa, Mycobacterium
HESGLEVATAWHADAGL

SEQ ID NO: 674546 - protein, 18 aa, Mycobacterium
HESRLPIRLFEIGSSAGL

SEQ ID NO: 674547 - protein, 19 aa, Mycobacterium
HETEAAVLMRSDLDTPAGA

SEQ ID NO: 674548 - protein, 20 aa, Mycobacterium
HETLQHLLSLAARNFDEDHT

SEQ ID NO: 674549 - protein, 19 aa, Mycobacterium
HETNVASVALAWVRAQRAV

SEQ ID NO: 674550 - protein, 18 aa, Mycobacterium
HETREFGVRVSVVEPGFT

SEQ ID NO: 674551 - protein, 22 aa, Mycobacterium
HETRLLLRKCLHLLADKQINRV

SEQ ID NO: 674552 - protein, 24 aa, Mycobacterium
HETRLLLRRSMHILRDKQQWQRLG

SEQ ID NO: 674553 - protein, 23 aa, Mycobacterium
HETRPWGWQVFGHHLAVNCFVVD

SEQ ID NO: 674554 - protein, 24 aa, Mycobacterium
HETWHPFKPVGKARRRVVTIFDMI

SEQ ID NO: 674555 - protein, 19 aa, Mycobacterium
HEVDGRLLADGGILDPLPM

SEQ ID NO: 674556 - protein, 23 aa, Mycobacterium
HEVDVLICATGFAIWDHMPAFPT

SEQ ID NO: 674557 - protein, 26 aa, Mycobacterium
HEVDVLICATGFKLWDTGAVPPFPVI

SEQ ID NO: 674558 - protein, 20 aa, Mycobacterium
HEVELRKKVKEYLKDHDTEG

SEQ ID NO: 674559 - protein, 20 aa, Mycobacterium
HEVELRKKVKEYLKEHDTEG

SEQ ID NO: 674560 - protein, 19 aa, Mycobacterium
HEVELRKKVKEYLQDHDTE

SEQ ID NO: 674561 - protein, 20 aa, Mycobacterium
HEVGHAIGYVRHEPCEQQGA

SEQ ID NO: 674562 - protein, 20 aa, Mycobacterium
HEVGIALMAEFDSIAERVGH

SEQ ID NO: 674563 - protein, 23 aa, Mycobacterium
HEVPGDSFWDLVRKGAEAAAKKD

SEQ ID NO: 674564 - protein, 22 aa, Mycobacterium
HEVPMSPAIRLFRSRPATWAAK

SEQ ID NO: 674565 - protein, 18 aa, Mycobacterium
HEVRELITDIGLTTFPLT

SEQ ID NO: 674566 - protein, 19 aa, Mycobacterium
HEVRVMRKERKGWKAEVNS

SEQ ID NO: 674567 - protein, 23 aa, Mycobacterium
HEWHHGWLLRSGRGATRRANSAV

SEQ ID NO: 674568 - protein, 24 aa, Mycobacterium
HEWIRRTAEDTVRVGITDFAQSAL

SEQ ID NO: 674569 - protein, 19 aa, Mycobacterium
HEWSWLVINQWRPGGPAWF

SEQ ID NO: 674570 - protein, 24 aa, Mycobacterium
HEWVRRSGEDTVRVGITDFAQSAL

SEQ ID NO: 674571 - protein, 23 aa, Mycobacterium
HEWVRRTADDTVRVGITDFAQSA

SEQ ID NO: 674572 - protein, 17 aa, Mycobacterium
HEYCAKNQDPACPAGTF

SEQ ID NO: 674573 - protein, 22 aa, Mycobacterium
HEYDRIPYLVAYQNNSTVRDVY

SEQ ID NO: 674574 - protein, 17 aa, Mycobacterium
HEYFIRRAVDAVRPGGY

SEQ ID NO: 674575 - protein, 22 aa, Mycobacterium
HEYRPFRALIRAVLRHAGGVRI

SEQ ID NO: 674576 - protein, 22 aa, Mycobacterium
HFADRGFTFYALDLQKCGRSRR

SEQ ID NO: 674577 - protein, 19 aa, Mycobacterium
HFAEAFKTTPVVAAGERGT

SEQ ID NO: 674578 - protein, 17 aa, Mycobacterium
HFAHIEERLRLDSELRQ

SEQ ID NO: 674579 - protein, 17 aa, Mycobacterium
HFANECFNDLATNHQAS

SEQ ID NO: 674580 - protein, 20 aa, Mycobacterium
HFARRCRAVRLVPFDPHLEE

SEQ ID NO: 674581 - protein, 18 aa, Mycobacterium
HFDADRWELFHIAQDRSQ

SEQ ID NO: 674582 - protein, 20 aa, Mycobacterium
HFDADRWELFHIEKDRSQCH

SEQ ID NO: 674583 - protein, 21 aa, Mycobacterium
HFDAEKWVRLVADEGVTSATV

SEQ ID NO: 674584 - protein, 17 aa, Mycobacterium
HFDDIRKLLKVINGLVD

SEQ ID NO: 674585 - protein, 21 aa, Mycobacterium
HFDEPLLIRAGRAFQSATDWH

SEQ ID NO: 674586 - protein, 18 aa, Mycobacterium
HFDFSGIRLRNADQTFDH

SEQ ID NO: 674587 - protein, 17 aa, Mycobacterium
HFDRMVGPGAWPETEES

SEQ ID NO: 674588 - protein, 17 aa, Mycobacterium
HFDRWARQFLAVHPEAV

SEQ ID NO: 674589 - protein, 25 aa, Mycobacterium
HFDSMLIKLSCRGRDFPTAVRRARR

SEQ ID NO: 674590 - protein, 20 aa, Mycobacterium
HFDTLLVMSVEPGFGGQKFI

SEQ ID NO: 674591 - protein, 20 aa, Mycobacterium
HFDTLLVMSVEPGFGGQSFI

SEQ ID NO: 674592 - protein, 19 aa, Mycobacterium
HFDVSLAMFTHVAAAAPGD

SEQ ID NO: 674593 - protein, 17 aa, Mycobacterium
HFEDIRKLLKVINGLVD

SEQ ID NO: 674594 - protein, 18 aa, Mycobacterium
HFEDIRKLLKVINGLVDK

SEQ ID NO: 674595 - protein, 35 aa, Mycobacterium
HFEDRFGVVLFFRGAWCPYCVAQLRAFDHATDKLR

SEQ ID NO: 674596 - protein, 19 aa, Mycobacterium
HFEEIPLLLFVFAIDDLGG

SEQ ID NO: 674597 - protein, 28 aa, Mycobacterium
HFEGELAVVIGRPCKDVPAAQAADNILG

SEQ ID NO: 674598 - protein, 22 aa, Mycobacterium
HFELRPDQALVITVPVSDAPYL

SEQ ID NO: 674599 - protein, 23 aa, Mycobacterium
HFESKSAILVALFDQVIDDLIAE

SEQ ID NO: 674600 - protein, 17 aa, Mycobacterium
HFFEVNRALRFDRAVTF

SEQ ID NO: 674601 - protein, 21 aa, Mycobacterium
HFFRISREITCAQANLMPATA

SEQ ID NO: 674602 - protein, 22 aa, Mycobacterium
HFGAPRPGRRIGLVYRSSTGRD

SEQ ID NO: 674603 - protein, 25 aa, Mycobacterium
HFGARRKAFNWGLGRVKADLDAKSA

SEQ ID NO: 674604 - protein, 22 aa, Mycobacterium
HFGGGRAQTWLTPNGPVDAKII

SEQ ID NO: 674605 - protein, 21 aa, Mycobacterium
HFGGGRASTWLTPNGPVDAKI

SEQ ID NO: 674606 - protein, 28 aa, Mycobacterium
HFGIRSGHVLHWWFPVYDPAFAQLSPGW

SEQ ID NO: 674607 - protein, 22 aa, Mycobacterium
HFGQAGGFIWADPEIELALVVL

SEQ ID NO: 674608 - protein, 24 aa, Mycobacterium
HFGRNRYTDFFAMAYRVLPADGMM

SEQ ID NO: 674609 - protein, 23 aa, Mycobacterium
HFGRQRYPRFFKMAYNVLPSDGV

SEQ ID NO: 674610 - protein, 24 aa, Mycobacterium
HFGWGSGIHTCMGGPLARLEVNLA

SEQ ID NO: 674611 - protein, 17 aa, Mycobacterium
HFHKPNFSRIVDAMPVL

SEQ ID NO: 674612 - protein, 25 aa, Mycobacterium
HFIPPGEPWRNGYVESFNSRIRDEC

SEQ ID NO: 674613 - protein, 19 aa, Mycobacterium
HFIRLPMTGAVTFNIRTFM

SEQ ID NO: 674614 - protein, 22 aa, Mycobacterium
HFKCPRDVHFVAELPRNATGKL

SEQ ID NO: 674615 - protein, 25 aa, Mycobacterium
HFKCPREVHLLPELPRNATGKLLKT

SEQ ID NO: 674616 - protein, 19 aa, Mycobacterium
HFMPKSVMDKVWRYFDDAG

SEQ ID NO: 674617 - protein, 18 aa, Mycobacterium
HFNEVFFDDVFVPDADVV

SEQ ID NO: 674618 - protein, 23 aa, Mycobacterium
HFPEGWREFGLAGAEIVFNPSAT

SEQ ID NO: 674619 - protein, 17 aa, Mycobacterium
HFPETREIWSFGSGYGG

SEQ ID NO: 674620 - protein, 20 aa, Mycobacterium
HFPIKSGVVIDREVARVRAV

SEQ ID NO: 674621 - protein, 20 aa, Mycobacterium
HFPQELVVGLAVTRLGRSSV

SEQ ID NO: 674622 - protein, 22 aa, Mycobacterium
HFPQSFGYSTLGGWLATRSGGH

SEQ ID NO: 674623 - protein, 23 aa, Mycobacterium
HFPRKVHFLEEWTLRRRLRASQT

SEQ ID NO: 674624 - protein, 23 aa, Mycobacterium
HFQHLSLRGSEFIMVTYWAEPCS

SEQ ID NO: 674625 - protein, 17 aa, Mycobacterium
HFREQSFGRVVVATSTS

SEQ ID NO: 674626 - protein, 28 aa, Mycobacterium
HFRFPGLKPGDRWCVTAANWLRAHQDGF

SEQ ID NO: 674627 - protein, 28 aa, Mycobacterium
HFSEQLLPEHLHKVSLSFLVDDLVVHRG

SEQ ID NO: 674628 - protein, 18 aa, Mycobacterium
HFSLEHGYELRIIEQMPL

SEQ ID NO: 674629 - protein, 23 aa, Mycobacterium
HFSRRCRAVRLVPFDPHLEEGAE

SEQ ID NO: 674630 - protein, 24 aa, Mycobacterium
HFSRRCRAVRLVPFDPHLEEGAEI

SEQ ID NO: 674631 - protein, 19 aa, Mycobacterium
HFSSVNFKDALALTPGGGV

SEQ ID NO: 674632 - protein, 17 aa, Mycobacterium
HFTCLPDDMARISTKLF

SEQ ID NO: 674633 - protein, 24 aa, Mycobacterium
HFTPKSRWHMVSFLRRIHTSGQKY

SEQ ID NO: 674634 - protein, 20 aa, Mycobacterium
HFTRKFKAAYGLTPAAWSGA

SEQ ID NO: 674635 - protein, 22 aa, Mycobacterium
HFTRRCRAVCQVPFDAHLEEGA

SEQ ID NO: 674636 - protein, 17 aa, Mycobacterium
HFVKRSAEVYAEAQRLA

SEQ ID NO: 674637 - protein, 20 aa, Mycobacterium
HFYDRLQAVIAEKGLADQLR

SEQ ID NO: 674638 - protein, 20 aa, Mycobacterium
HFYGALGWTPLLDVEGEIIF

SEQ ID NO: 674639 - protein, 17 aa, Mycobacterium
HFYGRKELAHILSTAKP

SEQ ID NO: 674640 - protein, 23 aa, Mycobacterium
HGAADPVGTWGPDGRPINGGPAG

SEQ ID NO: 674641 - protein, 24 aa, Mycobacterium
HGAAPWRELFTPAVQLADDGFEIS

SEQ ID NO: 674642 - protein, 26 aa, Mycobacterium
HGAAQGHDALRRWAASRQGTAELGRM

SEQ ID NO: 674643 - protein, 19 aa, Mycobacterium
HGAAQGHEALRRWASSLQT

SEQ ID NO: 674644 - protein, 23 aa, Mycobacterium
HGAASFTRTFVRYEPMPEAAATR

SEQ ID NO: 674645 - protein, 17 aa, Mycobacterium
HGAAVSVGLVFAAELGR

SEQ ID NO: 674646 - protein, 17 aa, Mycobacterium
HGACGACTVLLDGAAVR

SEQ ID NO: 674647 - protein, 17 aa, Mycobacterium
HGACGACTVLLDGEAVR

SEQ ID NO: 674648 - protein, 21 aa, Mycobacterium
HGADALVCALHRAVAFRRFRA

SEQ ID NO: 674649 - protein, 22 aa, Mycobacterium
HGADGLAAIARRVHAHAEAIAA

SEQ ID NO: 674650 - protein, 19 aa, Mycobacterium
HGADHVMPGLVSPSVTIPV

SEQ ID NO: 674651 - protein, 24 aa, Mycobacterium
HGADIRIPLGLAHRPDPANVAWVL

SEQ ID NO: 674652 - protein, 22 aa, Mycobacterium
HGADVRVLLTWGPPGVDADTIA

SEQ ID NO: 674653 - protein, 17 aa, Mycobacterium
HGADWPTDVLLGSTAEN

SEQ ID NO: 674654 - protein, 26 aa, Mycobacterium
HGAEMGRAALDLMLFHAWHLYSDLGL

SEQ ID NO: 674655 - protein, 31 aa, Mycobacterium
HGAEMGRAGLDLMLFHAWYLYRNLDLNVVLP

SEQ ID NO: 674656 - protein, 21 aa, Mycobacterium
HGAEVSLRWIYLHMIGEYARH

SEQ ID NO: 674657 - protein, 19 aa, Mycobacterium
HGAHGYLLDEFLWDRTNQR

SEQ ID NO: 674658 - protein, 17 aa, Mycobacterium
HGAIRKKPKPRKRGGGG

SEQ ID NO: 674659 - protein, 18 aa, Mycobacterium
HGALAITGLPAFKAPFEP

SEQ ID NO: 674660 - protein, 19 aa, Mycobacterium
HGALCIVEPATGVIVAEHE

SEQ ID NO: 674661 - protein, 21 aa, Mycobacterium
HGALCLLEPATGVIVAEHELV

SEQ ID NO: 674662 - protein, 18 aa, Mycobacterium
HGALERVLLGSVSTGLVH

SEQ ID NO: 674663 - protein, 21 aa, Mycobacterium
HGALRSAWIGYWVVSTVTRQG

SEQ ID NO: 674664 - protein, 19 aa, Mycobacterium
HGALSRKLLDWHPTARLTV

SEQ ID NO: 674665 - protein, 26 aa, Mycobacterium
HGANLHGRYLLPHFIIHDIAQVAADL

SEQ ID NO: 674666 - protein, 25 aa, Mycobacterium
HGANLHGRYLLPHFLIHDIAEVAAD

SEQ ID NO: 674667 - protein, 29 aa, Mycobacterium
HGANLHGRYLLPHFLIRDIADVAADLRAH

SEQ ID NO: 674668 - protein, 24 aa, Mycobacterium
HGAPARLAAIVDWEMTTVGDPLLD

SEQ ID NO: 674669 - protein, 18 aa, Mycobacterium
HGAQCATMSWPEHTDHAG

SEQ ID NO: 674670 - protein, 19 aa, Mycobacterium
HGARLIVVTAHLPVPKERG

SEQ ID NO: 674671 - protein, 26 aa, Mycobacterium
HGARPGESVALLFSRSAEAIVSILAV

SEQ ID NO: 674672 - protein, 21 aa, Mycobacterium
HGASGLAFCTILYGLSLIDDV

SEQ ID NO: 674673 - protein, 20 aa, Mycobacterium
HGASILPVHPLLGAHVHLHE

SEQ ID NO: 674674 - protein, 27 aa, Mycobacterium
HGASSEQARAWWGNFLVQKANEANVAL

SEQ ID NO: 674675 - protein, 25 aa, Mycobacterium
HGATLRFAPPLVITEGEIDWAVDQF

SEQ ID NO: 674676 - protein, 18 aa, Mycobacterium
HGATWLRAGAGIIAESTP

SEQ ID NO: 674677 - protein, 21 aa, Mycobacterium
HGAVLEGAWGSWGAGADRGTV

SEQ ID NO: 674678 - protein, 19 aa, Mycobacterium
HGCDIRPALHTLGAREGGG

SEQ ID NO: 674679 - protein, 17 aa, Mycobacterium
HGCDIRPSLTTFDPRQD

SEQ ID NO: 674680 - protein, 18 aa, Mycobacterium
HGCGEYVPKLAMYPPAPI

SEQ ID NO: 674681 - protein, 25 aa, Mycobacterium
HGCRRAQGFLLSRPVPADAMEALLS

SEQ ID NO: 674682 - protein, 17 aa, Mycobacterium
HGDFDFSQALYSYDLEA

SEQ ID NO: 674683 - protein, 24 aa, Mycobacterium
HGDFKYAINNSFGFGGHNVALAFG

SEQ ID NO: 674684 - protein, 25 aa, Mycobacterium
HGDFPWRPEPGYGRTSPVGSFEPNG

SEQ ID NO: 674685 - protein, 31 aa, Mycobacterium
HGDFRLPHEVPRGICGHLSYTEIIGAAVIAD

SEQ ID NO: 674686 - protein, 23 aa, Mycobacterium
HGDGPFPAVVLLGPYSFEKEQAP

SEQ ID NO: 674687 - protein, 24 aa, Mycobacterium
HGDLRRARAAAINIVPTSTGAAKA

SEQ ID NO: 674688 - protein, 18 aa, Mycobacterium
HGDPKPAHIALRSARDHG

SEQ ID NO: 674689 - protein, 18 aa, Mycobacterium
HGDPWTAMRAAVYRTTPS

SEQ ID NO: 674690 - protein, 17 aa, Mycobacterium
HGDRIGGVIGFSGAAKV

SEQ ID NO: 674691 - protein, 25 aa, Mycobacterium
HGDRLRCYVVGVARGAREPVITLSR

SEQ ID NO: 674692 - protein, 17 aa, Mycobacterium
HGDRPGWFRRLPHHHAT

SEQ ID NO: 674693 - protein, 17 aa, Mycobacterium
HGDRVAIHWEGEPTDHR

SEQ ID NO: 674694 - protein, 24 aa, Mycobacterium
HGDTPLHLGFSCYLFDSSGRVLLT

SEQ ID NO: 674695 - protein, 18 aa, Mycobacterium
HGDVFTLNLPIYGRVVVV

SEQ ID NO: 674696 - protein, 31 aa, Mycobacterium
HGDVPGPYSWWSWRGKAFDNDAGWRIDYHLV

SEQ ID NO: 674697 - protein, 22 aa, Mycobacterium
HGEAGLRYDDWTMRRPETVDLV

SEQ ID NO: 674698 - protein, 20 aa, Mycobacterium
HGEARFARFHLGRNGAVHGG

SEQ ID NO: 674699 - protein, 32 aa, Mycobacterium
HGEAYRGHVFWDELFVFPVLNMRLPKVTRSLL

SEQ ID NO: 674700 - protein, 17 aa, Mycobacterium
HGEDIRRPLGISHAYPP

SEQ ID NO: 674701 - protein, 21 aa, Mycobacterium
HGEFRAIGYASIYEDVEHVAL

SEQ ID NO: 674702 - protein, 23 aa, Mycobacterium
HGEFRAIGYASIYEEVEHVALVR

SEQ ID NO: 674703 - protein, 21 aa, Mycobacterium
HGEFRAIGYTSIYEDVEHVAL

SEQ ID NO: 674704 - protein, 24 aa, Mycobacterium
HGEFRAVGYTSIYDDVEHVALVLG

SEQ ID NO: 674705 - protein, 24 aa, Mycobacterium
HGEFRAVGYTSIYEDVEHVALVKG

SEQ ID NO: 674706 - protein, 17 aa, Mycobacterium
HGEFYLDHCGALLDVEP

SEQ ID NO: 674707 - protein, 20 aa, Mycobacterium
HGEHGKYLLAATFGNVHGVY

SEQ ID NO: 674708 - protein, 18 aa, Mycobacterium
HGEIGASVIEFFQAAELA

SEQ ID NO: 674709 - protein, 18 aa, Mycobacterium
HGELPFETLMTGYGLTEA

SEQ ID NO: 674710 - protein, 18 aa, Mycobacterium
HGELPFQTLMTGYGLTEA

SEQ ID NO: 674711 - protein, 22 aa, Mycobacterium
HGELYFAVGAGIEIYTSKIFAG

SEQ ID NO: 674712 - protein, 24 aa, Mycobacterium
HGEPARLAAIVDWEMTTIGDPLLD

SEQ ID NO: 674713 - protein, 24 aa, Mycobacterium
HGEPARLAAIVDWEMTTVGDPLLD

SEQ ID NO: 674714 - protein, 22 aa, Mycobacterium
HGEPHVRLWAKLEDRNPTGSIK

SEQ ID NO: 674715 - protein, 22 aa, Mycobacterium
HGEPSWSYLYRKMIPILVADGH

SEQ ID NO: 674716 - protein, 19 aa, Mycobacterium
HGEPSWSYLYRKMIPVLAA

SEQ ID NO: 674717 - protein, 18 aa, Mycobacterium
HGEPTAWAAEGLYADLPE

SEQ ID NO: 674718 - protein, 18 aa, Mycobacterium
HGESWSGGAAVAMTNAVT

SEQ ID NO: 674719 - protein, 19 aa, Mycobacterium
HGEVYCLVFHTFAGPDHDV

SEQ ID NO: 674720 - protein, 18 aa, Mycobacterium
HGFAHTYGAPVLTEAETW

SEQ ID NO: 674721 - protein, 21 aa, Mycobacterium
HGFGCRTIVFSGVAGGLDPDL

SEQ ID NO: 674722 - protein, 19 aa, Mycobacterium
HGFMGSPYLANGLFLSLPW

SEQ ID NO: 674723 - protein, 25 aa, Mycobacterium
HGFQSPRETATFLIFDQAYNDAHDG

SEQ ID NO: 674724 - protein, 22 aa, Mycobacterium
HGFRFFDNRDLLGFVDGTENPS

SEQ ID NO: 674725 - protein, 20 aa, Mycobacterium
HGFRFFDNRDLMGFVDGTEN

SEQ ID NO: 674726 - protein, 22 aa, Mycobacterium
HGFRYFDNRDLLGFVDGTENPD

SEQ ID NO: 674727 - protein, 24 aa, Mycobacterium
HGFTSCGFPNQFFTGFTQVGISAN

SEQ ID NO: 674728 - protein, 23 aa, Mycobacterium
HGGAGGQGGRLYGNGGVGGNGGF

SEQ ID NO: 674729 - protein, 19 aa, Mycobacterium
HGGDARLFGNGGNGGAGAV

SEQ ID NO: 674730 - protein, 22 aa, Mycobacterium
HGGDFPAIVPMLPTGDAAGTPH

SEQ ID NO: 674731 - protein, 25 aa, Mycobacterium
HGGEFGVSAELGWERTIGALATDHH

SEQ ID NO: 674732 - protein, 20 aa, Mycobacterium
HGGEIRFRAKVEQILVDHGA

SEQ ID NO: 674733 - protein, 29 aa, Mycobacterium
HGGFGLATGRWLVRRGARHLVLASRSGAT

SEQ ID NO: 674734 - protein, 17 aa, Mycobacterium
HGGFKYSGYGKDLSAYS

SEQ ID NO: 674735 - protein, 25 aa, Mycobacterium
HGGFPADDPAIWDHPIIHPHTADPD

SEQ ID NO: 674736 - protein, 25 aa, Mycobacterium
HGGFTLQRFEAWLTTTLQNAILRDP

SEQ ID NO: 674737 - protein, 18 aa, Mycobacterium
HGGGEFAPAAYLATKEEQ

SEQ ID NO: 674738 - protein, 22 aa, Mycobacterium
HGGGFLPYAAHRFAALAPEQVD

SEQ ID NO: 674739 - protein, 18 aa, Mycobacterium
HGGHPPGTVFLGIAGPID

SEQ ID NO: 674740 - protein, 17 aa, Mycobacterium
HGGICATLLDSVLGCAV

SEQ ID NO: 674741 - protein, 24 aa, Mycobacterium
HGGIKKLSVRVGIVPPGKNSAPTV

SEQ ID NO: 674742 - protein, 17 aa, Mycobacterium
HGGILLITHYTRILRYI

SEQ ID NO: 674743 - protein, 17 aa, Mycobacterium
HGGIRHVLARHVEGASH

SEQ ID NO: 674744 - protein, 17 aa, Mycobacterium
HGGKYGAQWLVDNRPDL

SEQ ID NO: 674745 - protein, 18 aa, Mycobacterium
HGGLQFSPSTWSGHGGGE

SEQ ID NO: 674746 - protein, 22 aa, Mycobacterium
HGGLRYLEQLEFGLVQEALRER

SEQ ID NO: 674747 - protein, 25 aa, Mycobacterium
HGGLRYLEQLEFGLVREALFERELS

SEQ ID NO: 674748 - protein, 23 aa, Mycobacterium
HGGLRYLEQLEFGLVREALYERE

SEQ ID NO: 674749 - protein, 24 aa, Mycobacterium
HGGLRYLEQLEFGLVREALYEREL

SEQ ID NO: 674750 - protein, 28 aa, Mycobacterium
HGGMIPLFYDWLFGMVVSTADIRPTRTA

SEQ ID NO: 674751 - protein, 17 aa, Mycobacterium
HGGRRWSTADGYLKPGL

SEQ ID NO: 674752 - protein, 18 aa, Mycobacterium
HGGVLLITHYTRILRYIQ

SEQ ID NO: 674753 - protein, 21 aa, Mycobacterium
HGGVRPFGWLYAASRDPSVPL

SEQ ID NO: 674754 - protein, 20 aa, Mycobacterium
HGGWFPEEWTGEVDGHSFYF

SEQ ID NO: 674755 - protein, 29 aa, Mycobacterium
HGGWWRAPLRWTLRGSLAVRSRLMVRSSR

SEQ ID NO: 674756 - protein, 30 aa, Mycobacterium
HGHFKCNWYKLSEMPVLWAYARDLFQTPGF

SEQ ID NO: 674757 - protein, 18 aa, Mycobacterium
HGHFSRAVITRWIEQPVY

SEQ ID NO: 674758 - protein, 19 aa, Mycobacterium
HGHFSRAVITRWVELPLVE

SEQ ID NO: 674759 - protein, 23 aa, Mycobacterium
HGHFSRAVLARWVELPVTHGIRI

SEQ ID NO: 674760 - protein, 24 aa, Mycobacterium
HGHIPRLERFHMIVDGPATVVPGR

SEQ ID NO: 674761 - protein, 18 aa, Mycobacterium
HGHSMPDDNVWLIRRRAE

SEQ ID NO: 674762 - protein, 20 aa, Mycobacterium
HGIALWDVLHTCRRRGSSDS

SEQ ID NO: 674763 - protein, 25 aa, Mycobacterium
HGIAMSRCSGLWVAMKVVTNVADGS

SEQ ID NO: 674764 - protein, 25 aa, Mycobacterium
HGIAMSRFSGLWVGMKLATNVVDGS

SEQ ID NO: 674765 - protein, 19 aa, Mycobacterium
HGIASCPQALLSFYADTVR

SEQ ID NO: 674766 - protein, 20 aa, Mycobacterium
HGIASILRRGLLMNPVADDH

SEQ ID NO: 674767 - protein, 25 aa, Mycobacterium
HGIATIVVGWGYGRTDFAGRESGAL

SEQ ID NO: 674768 - protein, 24 aa, Mycobacterium
HGIAYTAIMNPVFRVRRGLDGELL

SEQ ID NO: 674769 - protein, 24 aa, Mycobacterium
HGIDRGWHPKGQAIDIGFPGNDPQ

SEQ ID NO: 674770 - protein, 19 aa, Mycobacterium
HGIENLWVIDGSVLPTITS

SEQ ID NO: 674771 - protein, 23 aa, Mycobacterium
HGIERLRIADASIMPRITTGNTM

SEQ ID NO: 674772 - protein, 19 aa, Mycobacterium
HGIGRGHALELAKHGATVI

SEQ ID NO: 674773 - protein, 25 aa, Mycobacterium
HGIGYLLKSRVTDVSDFVETLERIA

SEQ ID NO: 674774 - protein, 23 aa, Mycobacterium
HGILKTERLLSFHIDYASVTRVL

SEQ ID NO: 674775 - protein, 18 aa, Mycobacterium
HGISEVQALLLRALTSTP

SEQ ID NO: 674776 - protein, 23 aa, Mycobacterium
HGITCAIPVWAHQIADLSRDHRV

SEQ ID NO: 674777 - protein, 23 aa, Mycobacterium
HGITCAIRAWAYQIADLAGDYRV

SEQ ID NO: 674778 - protein, 21 aa, Mycobacterium
HGITLRQVWRDGAHAYLGMAM

SEQ ID NO: 674779 - protein, 25 aa, Mycobacterium
HGKDPRYWIDVTKIIHVGEGEKAPY

SEQ ID NO: 674780 - protein, 19 aa, Mycobacterium
HGKEMTWSQVVMAANTPML

SEQ ID NO: 674781 - protein, 20 aa, Mycobacterium
HGKIALITSRLLSARGDSVA

SEQ ID NO: 674782 - protein, 24 aa, Mycobacterium
HGKIDRFGVRLIRNPLGLSETKVF

SEQ ID NO: 674783 - protein, 17 aa, Mycobacterium
HGKIDWSALPAPTFASA

SEQ ID NO: 674784 - protein, 23 aa, Mycobacterium
HGKPCRRCGTPIARDQGLPRVAY

SEQ ID NO: 674785 - protein, 17 aa, Mycobacterium
HGKPLGLVTEAACTGID

SEQ ID NO: 674786 - protein, 17 aa, Mycobacterium
HGKRITGRYALIRTNGK

SEQ ID NO: 674787 - protein, 26 aa, Mycobacterium
HGKVIPGREGEAWYLDEFGGWGKIKL

SEQ ID NO: 674788 - protein, 26 aa, Mycobacterium
HGLALPRRLQIEFSQAIQKITEGEGG

SEQ ID NO: 674789 - protein, 27 aa, Mycobacterium
HGLALPRRLQIEFSRAIQEIAEGSAGE

SEQ ID NO: 674790 - protein, 17 aa, Mycobacterium
HGLALSVVNPLVDATWR

SEQ ID NO: 674791 - protein, 26 aa, Mycobacterium
HGLASLPARIAVRWRHTHDFEDAGAG

SEQ ID NO: 674792 - protein, 19 aa, Mycobacterium
HGLDVADALGVRRPATDRL

SEQ ID NO: 674793 - protein, 26 aa, Mycobacterium
HGLEPRPWILDTLPIVLSAAEWEVLE

SEQ ID NO: 674794 - protein, 31 aa, Mycobacterium
HGLEVRGPQRWRIKANWKIGVENFSGDMYHT

SEQ ID NO: 674795 - protein, 23 aa, Mycobacterium
HGLEVSAGAPLAVRMRPESLDEV

SEQ ID NO: 674796 - protein, 21 aa, Mycobacterium
HGLFDLRALDWIIPLIRAKRM

SEQ ID NO: 674797 - protein, 20 aa, Mycobacterium
HGLGALRWRDFPDYRRGYSV

SEQ ID NO: 674798 - protein, 21 aa, Mycobacterium
HGLGLVTWVKPAGEIDGFIDE

SEQ ID NO: 674799 - protein, 22 aa, Mycobacterium
HGLHARPAARFVAEVRRRDARV

SEQ ID NO: 674800 - protein, 20 aa, Mycobacterium
HGLHSGMWGGVVPDALTVLV

SEQ ID NO: 674801 - protein, 20 aa, Mycobacterium
HGLKVWDRAAGALIAAEAGA

SEQ ID NO: 674802 - protein, 20 aa, Mycobacterium
HGLKWLLDYMPNGEVDLHRA

SEQ ID NO: 674803 - protein, 20 aa, Mycobacterium
HGLLTLSLLPHFQFELIRVD

SEQ ID NO: 674804 - protein, 19 aa, Mycobacterium
HGLMLPFLEQFVVKARYAD

SEQ ID NO: 674805 - protein, 24 aa, Mycobacterium
HGLMVPNWPVEWGGKDWTPIQHQI

SEQ ID NO: 674806 - protein, 17 aa, Mycobacterium
HGLNAGGLFGVLTNVVW

SEQ ID NO: 674807 - protein, 23 aa, Mycobacterium
HGLNNAIALPRVWEYNLPARYER

SEQ ID NO: 674808 - protein, 17 aa, Mycobacterium
HGLPIAIKAAFGGGGRG

SEQ ID NO: 674809 - protein, 19 aa, Mycobacterium
HGLPMPTIMDTKGRIADTG

SEQ ID NO: 674810 - protein, 27 aa, Mycobacterium
HGLPNRWTLCGPYSWTGSGWHAFMEMT

SEQ ID NO: 674811 - protein, 27 aa, Mycobacterium
HGLPPRWLEFLRRWDPAGWPRPKSSAA

SEQ ID NO: 674812 - protein, 17 aa, Mycobacterium
HGLPWYPLLRLPVNLAR

SEQ ID NO: 674813 - protein, 29 aa, Mycobacterium
HGLRDVGRWRIPVILGLRSDVGEDDVRAV

SEQ ID NO: 674814 - protein, 17 aa, Mycobacterium
HGLRPGDRIAVVADNAP

SEQ ID NO: 674815 - protein, 17 aa, Mycobacterium
HGLRYLLVINGSLVNPS

SEQ ID NO: 674816 - protein, 26 aa, Mycobacterium
HGLSNAMLLPAVTRFSVESAIGRYAD

SEQ ID NO: 674817 - protein, 17 aa, Mycobacterium
HGLSWEMLPDAALAQPA

SEQ ID NO: 674818 - protein, 24 aa, Mycobacterium
HGLSWGFDRIFAVTMNHSVWFHRP

SEQ ID NO: 674819 - protein, 20 aa, Mycobacterium
HGLVAEIDRGTWTPAPVFAM

SEQ ID NO: 674820 - protein, 19 aa, Mycobacterium
HGLVPAAVARRLISEAVSA

SEQ ID NO: 674821 - protein, 17 aa, Mycobacterium
HGMATCTMGSFRFPSQA

SEQ ID NO: 674822 - protein, 18 aa, Mycobacterium
HGMRRACATHNYERGVDL

SEQ ID NO: 674823 - protein, 20 aa, Mycobacterium
HGNAKRWGWIHADLGGGDVV

SEQ ID NO: 674824 - protein, 20 aa, Mycobacterium
HGNAKRWGWIHADLGHGDVL

SEQ ID NO: 674825 - protein, 21 aa, Mycobacterium
HGNCSSCKHWLIDGDVDDSAA

SEQ ID NO: 674826 - protein, 17 aa, Mycobacterium
HGNFSFEYCDVLADFTR

SEQ ID NO: 674827 - protein, 24 aa, Mycobacterium
HGNHPVRLFIGSGMPTGLWERVVE

SEQ ID NO: 674828 - protein, 17 aa, Mycobacterium
HGNLEWLPGKTLGMSAG

SEQ ID NO: 674829 - protein, 18 aa, Mycobacterium
HGNLEWLPGKTVGLSADC

SEQ ID NO: 674830 - protein, 32 aa, Mycobacterium
HGNLRLGSFRFWFVGQRWEWSDEVARMHGYEP

SEQ ID NO: 674831 - protein, 25 aa, Mycobacterium
HGNSVPRFHIAWGTGTGVVEPFVDS

SEQ ID NO: 674832 - protein, 26 aa, Mycobacterium
HGPEVLSYELVRTVLRDSRFVTAHGL

SEQ ID NO: 674833 - protein, 18 aa, Mycobacterium
HGPHRYYIAVHAVDVDKL

SEQ ID NO: 674834 - protein, 27 aa, Mycobacterium
HGPKRYNWAQLAGSVKYTLWRLQERVV

SEQ ID NO: 674835 - protein, 20 aa, Mycobacterium
HGPLKAPQRILPPINNRGVV

SEQ ID NO: 674836 - protein, 25 aa, Mycobacterium
HGPLPYRPLALAWRTANQSPSVRCF

SEQ ID NO: 674837 - protein, 22 aa, Mycobacterium
HGPMGHFGLFFIGAGEELFLST

SEQ ID NO: 674838 - protein, 21 aa, Mycobacterium
HGPMGHFGLFFIGASDQLVLS

SEQ ID NO: 674839 - protein, 21 aa, Mycobacterium
HGPRNAFPLTVPGYGSPTQRF

SEQ ID NO: 674840 - protein, 24 aa, Mycobacterium
HGPSYQHPPAWDLAGRRDRHVNGV

SEQ ID NO: 674841 - protein, 26 aa, Mycobacterium
HGPTMARRVARWMVVFLQRPGGQAQF

SEQ ID NO: 674842 - protein, 24 aa, Mycobacterium
HGPVEVKALQGWQPTDASLVTYQG

SEQ ID NO: 674843 - protein, 17 aa, Mycobacterium
HGPVRFPGVPTGFSRTP

SEQ ID NO: 674844 - protein, 17 aa, Mycobacterium
HGPVRRRPIADVVFHNH

SEQ ID NO: 674845 - protein, 32 aa, Mycobacterium
HGQCGFWLQAFAGRRRPPGFVSGLRTRRRLLR

SEQ ID NO: 674846 - protein, 17 aa, Mycobacterium
HGQCGSCTVLVDGRRVT

SEQ ID NO: 674847 - protein, 19 aa, Mycobacterium
HGQFGKWLEGARDWSVSRN

SEQ ID NO: 674848 - protein, 17 aa, Mycobacterium
HGQGMSFGSRGAAQAAR

SEQ ID NO: 674849 - protein, 18 aa, Mycobacterium
HGQIKRIYTGGGVWLARC

SEQ ID NO: 674850 - protein, 20 aa, Mycobacterium
HGQLPNMRAIVGFAAETGDA

SEQ ID NO: 674851 - protein, 19 aa, Mycobacterium
HGQLRAGVATSFLRCDDVA

SEQ ID NO: 674852 - protein, 24 aa, Mycobacterium
HGQLRIGMAASFVRCEDPALLAQA

SEQ ID NO: 674853 - protein, 27 aa, Mycobacterium
HGQRLAIWSPNSWHWPIACLGGQYAGA

SEQ ID NO: 674854 - protein, 23 aa, Mycobacterium
HGQTLRMYEEWATLADLREGDRY

SEQ ID NO: 674855 - protein, 18 aa, Mycobacterium
HGQWDWMNDPAIHSSTWE

SEQ ID NO: 674856 - protein, 21 aa, Mycobacterium
HGRANSWQSLPGVGPKTAKVI

SEQ ID NO: 674857 - protein, 26 aa, Mycobacterium
HGRDEIWRFTPLRRLRGLHDGSAHAT

SEQ ID NO: 674858 - protein, 27 aa, Mycobacterium
HGRDEIWRFTPLRRLRGLHNGTAGADG

SEQ ID NO: 674859 - protein, 25 aa, Mycobacterium
HGRDELWRFTPLKRLRGLHDGSAAA

SEQ ID NO: 674860 - protein, 25 aa, Mycobacterium
HGRDELWRFTPLKRLRGLHDGSAPA

SEQ ID NO: 674861 - protein, 28 aa, Mycobacterium
HGRDLVIGMVRCRIPVIAAVNGPAVGLG

SEQ ID NO: 674862 - protein, 17 aa, Mycobacterium
HGREGGMATREVTPELV

SEQ ID NO: 674863 - protein, 17 aa, Mycobacterium
HGREIVLGMTRCRVPVV

SEQ ID NO: 674864 - protein, 20 aa, Mycobacterium
HGREKPALMQRFYTTSWRFA

SEQ ID NO: 674865 - protein, 22 aa, Mycobacterium
HGRGGFPGMLLGSVSRAVINSA

SEQ ID NO: 674866 - protein, 22 aa, Mycobacterium
HGRGGFPGMLLGSVSRAVVNSA

SEQ ID NO: 674867 - protein, 21 aa, Mycobacterium
HGRGGFTGMLLGSVGSQIVQS

SEQ ID NO: 674868 - protein, 22 aa, Mycobacterium
HGRGGFTGMLLGSVSSAVAQAA

SEQ ID NO: 674869 - protein, 23 aa, Mycobacterium
HGRGLPFSGVVWRAARSDGDESD

SEQ ID NO: 674870 - protein, 25 aa, Mycobacterium
HGRIPRTGSVFGDALGVFSPFVCYG

SEQ ID NO: 674871 - protein, 21 aa, Mycobacterium
HGRKGFPVSPIVAAQWEAQVP

SEQ ID NO: 674872 - protein, 17 aa, Mycobacterium
HGRLRRMAMRHFGPPHR

SEQ ID NO: 674873 - protein, 17 aa, Mycobacterium
HGRLWATILQHRFGGDG

SEQ ID NO: 674874 - protein, 24 aa, Mycobacterium
HGRPVTGAHRWGKYLGLQAGELFL

SEQ ID NO: 674875 - protein, 20 aa, Mycobacterium
HGRRLLRIAASSTFAEHAAP

SEQ ID NO: 674876 - protein, 26 aa, Mycobacterium
HGRSGMKISVQFGGLLVMRSLPIDAT

SEQ ID NO: 674877 - protein, 21 aa, Mycobacterium
HGRSLPARLTRRGSTQLEKAV

SEQ ID NO: 674878 - protein, 21 aa, Mycobacterium
HGRSSWAAPWSIDANVSALAA

SEQ ID NO: 674879 - protein, 21 aa, Mycobacterium
HGRSSWAAPWTIDANVSALAA

SEQ ID NO: 674880 - protein, 24 aa, Mycobacterium
HGRTGLKVPWAHAILPKRLVFAAA

SEQ ID NO: 674881 - protein, 23 aa, Mycobacterium
HGRTGLKVPWAHAVLPKRVVYAA

SEQ ID NO: 674882 - protein, 24 aa, Mycobacterium
HGRTLRFGIRLHVISRDTSADAWT

SEQ ID NO: 674883 - protein, 19 aa, Mycobacterium
HGRVRLVAPPGWDLGADEL

SEQ ID NO: 674884 - protein, 20 aa, Mycobacterium
HGSAVLSDWLLYDRSSPSSA

SEQ ID NO: 674885 - protein, 22 aa, Mycobacterium
HGSCVVQTAWALARALGTIEGT

SEQ ID NO: 674886 - protein, 17 aa, Mycobacterium
HGSDMVQTGWALARALG

SEQ ID NO: 674887 - protein, 22 aa, Mycobacterium
HGSEFAQRFGLGFSAQDREENI

SEQ ID NO: 674888 - protein, 22 aa, Mycobacterium
HGSGRWPGRPLGSVSSGLLRYA

SEQ ID NO: 674889 - protein, 18 aa, Mycobacterium
HGSIEVDEPYVLILPTYG

SEQ ID NO: 674890 - protein, 24 aa, Mycobacterium
HGSLFEFRCDACGSAFEGNLPEMP

SEQ ID NO: 674891 - protein, 20 aa, Mycobacterium
HGSLLDRHRPLWEAHLVEGL

SEQ ID NO: 674892 - protein, 26 aa, Mycobacterium
HGSLLYARTGQWPSPLATAARLRWLA

SEQ ID NO: 674893 - protein, 18 aa, Mycobacterium
HGSLPPAAGSIIRLSMAE

SEQ ID NO: 674894 - protein, 18 aa, Mycobacterium
HGSLRFAALQGEFADGVL

SEQ ID NO: 674895 - protein, 24 aa, Mycobacterium
HGSPARLAAIVDWEMTTVGDPLLD

SEQ ID NO: 674896 - protein, 17 aa, Mycobacterium
HGSRPGVDLMVAAESGM

SEQ ID NO: 674897 - protein, 21 aa, Mycobacterium
HGSRRRVEPVLTRLAELAQGD

SEQ ID NO: 674898 - protein, 20 aa, Mycobacterium
HGSSVLLRIAHEVVAATGLS

SEQ ID NO: 674899 - protein, 20 aa, Mycobacterium
HGSSVLLRIAHQVTAATWLA

SEQ ID NO: 674900 - protein, 20 aa, Mycobacterium
HGSSVLLRIAQQVAAAAWLA

SEQ ID NO: 674901 - protein, 25 aa, Mycobacterium
HGSTLRFAPPLVVTEQEIDWAVGQF

SEQ ID NO: 674902 - protein, 17 aa, Mycobacterium
HGSTVTAAHRWGKYLGM

SEQ ID NO: 674903 - protein, 18 aa, Mycobacterium
HGSYSWQGVGTVWYEALT

SEQ ID NO: 674904 - protein, 19 aa, Mycobacterium
HGTDAWTRRDAVADSVFTQ

SEQ ID NO: 674905 - protein, 19 aa, Mycobacterium
HGTDVLMFVVVFTGPQSDS

SEQ ID NO: 674906 - protein, 24 aa, Mycobacterium
HGTELRAGEKIMLMFESANFDESV

SEQ ID NO: 674907 - protein, 20 aa, Mycobacterium
HGTEVRILFDPAIAPDSTLD

SEQ ID NO: 674908 - protein, 17 aa, Mycobacterium
HGTKVLMASRIVDAVAG

SEQ ID NO: 674909 - protein, 19 aa, Mycobacterium
HGTLVRALRNDGLDPTRDV

SEQ ID NO: 674910 - protein, 22 aa, Mycobacterium
HGTNLWAGTAYRAAQAGPAADI

SEQ ID NO: 674911 - protein, 21 aa, Mycobacterium
HGTPPICFGFGSIPVESPAET

SEQ ID NO: 674912 - protein, 22 aa, Mycobacterium
HGTQFTSWVFGEKIRAAGLVPS

SEQ ID NO: 674913 - protein, 23 aa, Mycobacterium
HGTSVRMPLALSIPPGIPLEPGL

SEQ ID NO: 674914 - protein, 18 aa, Mycobacterium
HGTVWLNDFGYYTAAAEW

SEQ ID NO: 674915 - protein, 18 aa, Mycobacterium
HGTYRIVIEGEPHIHCDL

SEQ ID NO: 674916 - protein, 18 aa, Mycobacterium
HGVAGLWPGPGRGADRAV

SEQ ID NO: 674917 - protein, 21 aa, Mycobacterium
HGVAVVARLARHAVEYRDVVM

SEQ ID NO: 674918 - protein, 24 aa, Mycobacterium
HGVAYCRGIEPTAMLQFWRGSTQS

SEQ ID NO: 674919 - protein, 19 aa, Mycobacterium
HGVDAELAVKVNDLMLPVV

SEQ ID NO: 674920 - protein, 24 aa, Mycobacterium
HGVDLRVGVGVAEFVGNGHVEAVR

SEQ ID NO: 674921 - protein, 18 aa, Mycobacterium
HGVFRSGVRAELAGESDI

SEQ ID NO: 674922 - protein, 22 aa, Mycobacterium
HGVGRLKKPWLGDQVGPEVLEV

SEQ ID NO: 674923 - protein, 20 aa, Mycobacterium
HGVGRLKRPWLAGYLGPEVM

SEQ ID NO: 674924 - protein, 23 aa, Mycobacterium
HGVGRLKRPWLANQIGPDAMELN

SEQ ID NO: 674925 - protein, 20 aa, Mycobacterium
HGVKLLNLRSTLLTLAGGDP

SEQ ID NO: 674926 - protein, 17 aa, Mycobacterium
HGVLFERVHALSPPASW

SEQ ID NO: 674927 - protein, 18 aa, Mycobacterium
HGVLPAADPAIWDHPVDH

SEQ ID NO: 674928 - protein, 19 aa, Mycobacterium
HGVLSAFGLTGEVTRRLDD

SEQ ID NO: 674929 - protein, 20 aa, Mycobacterium
HGVLSAFGLVGEILREPGDD

SEQ ID NO: 674930 - protein, 17 aa, Mycobacterium
HGVLVCAPTGAGKTVVG

SEQ ID NO: 674931 - protein, 17 aa, Mycobacterium
HGVNCDHVLISETAHTA

SEQ ID NO: 674932 - protein, 17 aa, Mycobacterium
HGVNCDHVLISQTAHTA

SEQ ID NO: 674933 - protein, 26 aa, Mycobacterium
HGVNNPKARLRFEITMEQALNAPTVV

SEQ ID NO: 674934 - protein, 20 aa, Mycobacterium
HGVPAKGWLVGEVHNGIAQM

SEQ ID NO: 674935 - protein, 26 aa, Mycobacterium
HGVPLLRELALRLGNAYTLAAPVIAT

SEQ ID NO: 674936 - protein, 18 aa, Mycobacterium
HGVPPRWIEMVRHTLQTL

SEQ ID NO: 674937 - protein, 26 aa, Mycobacterium
HGVPTYRWPMVPALALTASMPVLGAA

SEQ ID NO: 674938 - protein, 18 aa, Mycobacterium
HGVRCNAIAPGLVRTPRL

SEQ ID NO: 674939 - protein, 34 aa, Mycobacterium
HGVSGYDVETCWQDYRLGVFQAPLITALGFAFAA

SEQ ID NO: 674940 - protein, 18 aa, Mycobacterium
HGVSRAGYIEAPREPDFA

SEQ ID NO: 674941 - protein, 17 aa, Mycobacterium
HGVSRGKLILVNDDDLT

SEQ ID NO: 674942 - protein, 26 aa, Mycobacterium
HGVSSEAARAWWGNFLVQKANEAGVE

SEQ ID NO: 674943 - protein, 25 aa, Mycobacterium
HGVSSWPALCSGLRAEARKGRMIPC

SEQ ID NO: 674944 - protein, 36 aa, Mycobacterium
HGVTARYNDITAWRWTELPAALGVPDALTFRCATYG

SEQ ID NO: 674945 - protein, 25 aa, Mycobacterium
HGVTAVALACGWAAPSAFIDTYRRA

SEQ ID NO: 674946 - protein, 17 aa, Mycobacterium
HGVTAVFGPSGSGKSTL

SEQ ID NO: 674947 - protein, 22 aa, Mycobacterium
HGVTEVRSLGLWAGVDIDPNLA

SEQ ID NO: 674948 - protein, 19 aa, Mycobacterium
HGVTLGGPIAIEIGNTEWP

SEQ ID NO: 674949 - protein, 18 aa, Mycobacterium
HGVTLGGPIAVEIGNTEW

SEQ ID NO: 674950 - protein, 23 aa, Mycobacterium
HGVVEVRRGRGLFVGTFSFGPLI

SEQ ID NO: 674951 - protein, 20 aa, Mycobacterium
HGWEAKFFAAYGVAPDPRRI

SEQ ID NO: 674952 - protein, 26 aa, Mycobacterium
HGWGHVLFGKIPDWLGITDPSTGLDK

SEQ ID NO: 674953 - protein, 19 aa, Mycobacterium
HGWIYRLDGSLSHVPHAEA

SEQ ID NO: 674954 - protein, 19 aa, Mycobacterium
HGWLDRPEAFFAAPPPLAD

SEQ ID NO: 674955 - protein, 20 aa, Mycobacterium
HGWSPMHVVGLTYPLSNLLL

SEQ ID NO: 674956 - protein, 17 aa, Mycobacterium
HGWTGAQAETFAAMCES

SEQ ID NO: 674957 - protein, 17 aa, Mycobacterium
HGWWVKGEFDLDSPKGK

SEQ ID NO: 674958 - protein, 21 aa, Mycobacterium
HGYCSDFGRTWVVGERPTPRQ

SEQ ID NO: 674959 - protein, 24 aa, Mycobacterium
HGYEVIPRSAIDDMASVVVEFVLQ

SEQ ID NO: 674960 - protein, 22 aa, Mycobacterium
HGYGRPGRWTRDRIYLTDTHPG

SEQ ID NO: 674961 - protein, 25 aa, Mycobacterium
HGYIPPNLHFSRWNPAIDASSTRLF

SEQ ID NO: 674962 - protein, 25 aa, Mycobacterium
HGYVRRPGLTASRFVANPFGGPGAR

SEQ ID NO: 674963 - protein, 22 aa, Mycobacterium
HHAALLALRYRLWHGRGPGLPP

SEQ ID NO: 674964 - protein, 19 aa, Mycobacterium
HHAFGHRPTYRRIKAQCGR

SEQ ID NO: 674965 - protein, 17 aa, Mycobacterium
HHAKASGDLAMFEAPVE

SEQ ID NO: 674966 - protein, 17 aa, Mycobacterium
HHARLGKDSVLGHVNVT

SEQ ID NO: 674967 - protein, 18 aa, Mycobacterium
HHAVCTRCGAIIEVPARQ

SEQ ID NO: 674968 - protein, 19 aa, Mycobacterium
HHAYLSLMLWLAGPGSQQF

SEQ ID NO: 674969 - protein, 19 aa, Mycobacterium
HHCAAALLNGPRYWLMSRI

SEQ ID NO: 674970 - protein, 23 aa, Mycobacterium
HHCMGTGMAYMMAQYLLAIIFQR

SEQ ID NO: 674971 - protein, 19 aa, Mycobacterium
HHDALRAALRSTLVSTELG

SEQ ID NO: 674972 - protein, 26 aa, Mycobacterium
HHDGVGLDEYVDWLVDAGCPIRRIPD

SEQ ID NO: 674973 - protein, 18 aa, Mycobacterium
HHDHRSLVAKAFRATALE

SEQ ID NO: 674974 - protein, 28 aa, Mycobacterium
HHDRGRLLARERIELLLDRDAPFLELSS

SEQ ID NO: 674975 - protein, 24 aa, Mycobacterium
HHEKHPLPTWIVVGAGTGGTSATI

SEQ ID NO: 674976 - protein, 18 aa, Mycobacterium
HHEPRGAQYMGVNWVGPI

SEQ ID NO: 674977 - protein, 19 aa, Mycobacterium
HHERIGATHLRQFFDEDPD

SEQ ID NO: 674978 - protein, 19 aa, Mycobacterium
HHERRAVGGGSEFASGTAA

SEQ ID NO: 674979 - protein, 22 aa, Mycobacterium
HHFLGAPYWVGRGFGLNLSVVT

SEQ ID NO: 674980 - protein, 22 aa, Mycobacterium
HHFNTVWSRRQLPNVSMFHYTD

SEQ ID NO: 674981 - protein, 21 aa, Mycobacterium
HHFPHGLPLHPARRTAVVDWA

SEQ ID NO: 674982 - protein, 23 aa, Mycobacterium
HHFRPEFFHAMRALCHENDALFI

SEQ ID NO: 674983 - protein, 21 aa, Mycobacterium
HHGAALLKALVERLKDRHTLA

SEQ ID NO: 674984 - protein, 17 aa, Mycobacterium
HHGMLSFAAPPMRRTGD

SEQ ID NO: 674985 - protein, 19 aa, Mycobacterium
HHGMLSVFGSPTWRTVTGG

SEQ ID NO: 674986 - protein, 25 aa, Mycobacterium
HHGMLSVFGSPTWRTVTGGSATYVQ

SEQ ID NO: 674987 - protein, 17 aa, Mycobacterium
HHGPIFPLIEDLFGLSI

SEQ ID NO: 674988 - protein, 19 aa, Mycobacterium
HHHELGWFARTALRMLDDL

SEQ ID NO: 674989 - protein, 25 aa, Mycobacterium
HHHLVCQSCGFAVEVQAGAVEKWAT

SEQ ID NO: 674990 - protein, 17 aa, Mycobacterium
HHHLVCRVCGRVADVDC

SEQ ID NO: 674991 - protein, 19 aa, Mycobacterium
HHIAGPGRAGRSGTSGAAI

SEQ ID NO: 674992 - protein, 26 aa, Mycobacterium
HHIAWDDGCWRVFFADLTRAYTGAEL

SEQ ID NO: 674993 - protein, 27 aa, Mycobacterium
HHIDKWKFTVPFVCGATNLGEALRRIG

SEQ ID NO: 674994 - protein, 27 aa, Mycobacterium
HHIDKWKFTVPFVCGATNLGEALRRIN

SEQ ID NO: 674995 - protein, 27 aa, Mycobacterium
HHIDKWKFTVPFVCGATNLGEALRRIS

SEQ ID NO: 674996 - protein, 19 aa, Mycobacterium
HHIHLYVRHAWQGAAQLGD

SEQ ID NO: 674997 - protein, 18 aa, Mycobacterium
HHLAEGLGLEVVMGNQID

SEQ ID NO: 674998 - protein, 26 aa, Mycobacterium
HHLDVPLFWQCWKLDSPLVQAITDAV

SEQ ID NO: 674999 - protein, 18 aa, Mycobacterium
HHLFARMPDAKVHLYGKE

SEQ ID NO: 675000 - protein, 17 aa, Mycobacterium
HHLGRRAAGALQRDGVT

SEQ ID NO: 675001 - protein, 27 aa, Mycobacterium
HHLHGSLFEFRCDRCGMPYTGTLPKMS

SEQ ID NO: 675002 - protein, 32 aa, Mycobacterium
HHLKPSVPEDLAFAESRIRPSTIAAEDLLHDI

SEQ ID NO: 675003 - protein, 25 aa, Mycobacterium
HHLRPGGQAIIEWVPPSMLASRQEG

SEQ ID NO: 675004 - protein, 25 aa, Mycobacterium
HHLRQLKNAFLVSSRRQGKLVMYQL

SEQ ID NO: 675005 - protein, 19 aa, Mycobacterium
HHLTRLAATPFELADAAAA

SEQ ID NO: 675006 - protein, 21 aa, Mycobacterium
HHLVCRVCGSTVEIQGGQVES

SEQ ID NO: 675007 - protein, 23 aa, Mycobacterium
HHLWAETRIELFAQATDTRPDEL

SEQ ID NO: 675008 - protein, 18 aa, Mycobacterium
HHLWAETRIELFTQATDT

SEQ ID NO: 675009 - protein, 24 aa, Mycobacterium
HHPDLVVSAGFMKILGAEFLSRFP

SEQ ID NO: 675010 - protein, 17 aa, Mycobacterium
HHPHLLPLAQRILEPTE

SEQ ID NO: 675011 - protein, 17 aa, Mycobacterium
HHPRSGAVRGLEQRDRV

SEQ ID NO: 675012 - protein, 32 aa, Mycobacterium
HHPYFPRLRLELEQGLGWKAGVEAALERLLES

SEQ ID NO: 675013 - protein, 20 aa, Mycobacterium
HHQAACAARPARAAADAAGA

SEQ ID NO: 675014 - protein, 22 aa, Mycobacterium
HHQAVMAHADWIIDLGPGAGHD

SEQ ID NO: 675015 - protein, 21 aa, Mycobacterium
HHRDADCVAMGYRIHKSGDGI

SEQ ID NO: 675016 - protein, 21 aa, Mycobacterium
HHRDADCVAMGYRIHKSGEGI

SEQ ID NO: 675017 - protein, 21 aa, Mycobacterium
HHRGPFLVCAALRDSIQAAVA

SEQ ID NO: 675018 - protein, 17 aa, Mycobacterium
HHRKLMVAAAVHEQMLG

SEQ ID NO: 675019 - protein, 18 aa, Mycobacterium
HHRKLMVAGAVHETMIDR

SEQ ID NO: 675020 - protein, 23 aa, Mycobacterium
HHRLDPCSPWGGVRESGQGREGG

SEQ ID NO: 675021 - protein, 23 aa, Mycobacterium
HHRPADCLRPLQVHALVSEVLRT

SEQ ID NO: 675022 - protein, 25 aa, Mycobacterium
HHRPERYEFCVTLPRTMPGQRAGMT

SEQ ID NO: 675023 - protein, 18 aa, Mycobacterium
HHRRGTLRSGRRQQRESA

SEQ ID NO: 675024 - protein, 23 aa, Mycobacterium
HHRRVPQDIHCCAVARLDEFVGP

SEQ ID NO: 675025 - protein, 26 aa, Mycobacterium
HHRSRFPTIATVCARTHAEAVAGLRA

SEQ ID NO: 675026 - protein, 23 aa, Mycobacterium
HHRTAALNLRRLLTMGLTHTGTT

SEQ ID NO: 675027 - protein, 26 aa, Mycobacterium
HHRVGFGSVCEFPGPFPGYSTVKPQS

SEQ ID NO: 675028 - protein, 18 aa, Mycobacterium
HHSARMFCDITMPDGSPS

SEQ ID NO: 675029 - protein, 24 aa, Mycobacterium
HHSFHVFVVYPWIRFLDRNPEPAL

SEQ ID NO: 675030 - protein, 17 aa, Mycobacterium
HHSWPDMLDEMRATAGW

SEQ ID NO: 675031 - protein, 17 aa, Mycobacterium
HHTEVFAHMGVSLERAM

SEQ ID NO: 675032 - protein, 17 aa, Mycobacterium
HHTRLRKIISRGFTPRA

SEQ ID NO: 675033 - protein, 22 aa, Mycobacterium
HHTRLRKIISRGFTPRAIGRLH

SEQ ID NO: 675034 - protein, 22 aa, Mycobacterium
HHTRLRKIISRGFTPRAIGRLR

SEQ ID NO: 675035 - protein, 22 aa, Mycobacterium
HHVAAWRAARLLVLDAFTTAEA

SEQ ID NO: 675036 - protein, 23 aa, Mycobacterium
HHVAAWRAARLLVLDAFTTAEAA

SEQ ID NO: 675037 - protein, 18 aa, Mycobacterium
HHVFIECNPRIQVEHTVT

SEQ ID NO: 675038 - protein, 25 aa, Mycobacterium
HHVFKEWADRYAGRFDMGYEAYREI

SEQ ID NO: 675039 - protein, 23 aa, Mycobacterium
HHVSGWRNTHCTDIHDLTLACGV

SEQ ID NO: 675040 - protein, 23 aa, Mycobacterium
HHVVCRSCGAIADVDCAVGAAPC

SEQ ID NO: 675041 - protein, 25 aa, Mycobacterium
HHVWPEWSDRFAGHFDDGWDALRER

SEQ ID NO: 675042 - protein, 27 aa, Mycobacterium
HHVWPEWSDRFAGQFDDGWDALREQTY

SEQ ID NO: 675043 - protein, 30 aa, Mycobacterium
HHVWPEWSDRFAGQFDEGWDALREQTYARQ

SEQ ID NO: 675044 - protein, 23 aa, Mycobacterium
HHWPDSAWWNWNRTFDAIETDEG

SEQ ID NO: 675045 - protein, 22 aa, Mycobacterium
HHWTPATAPAWAKPVLAANRPL

SEQ ID NO: 675046 - protein, 18 aa, Mycobacterium
HHYLQLQYFERFFLPSLA

SEQ ID NO: 675047 - protein, 30 aa, Mycobacterium
HHYPFRLLAPRTMRPLLERICAEENVEVDD

SEQ ID NO: 675048 - protein, 24 aa, Mycobacterium
HHYPRRYSTDFSLRDEQDGESAKP

SEQ ID NO: 675049 - protein, 22 aa, Mycobacterium
HIAAALGLGGCESYPGVFQPFG

SEQ ID NO: 675050 - protein, 18 aa, Mycobacterium
HIAAGIGLSRSYRTQQMR

SEQ ID NO: 675051 - protein, 21 aa, Mycobacterium
HIAAGLGLGGCESYPGVFQPF

SEQ ID NO: 675052 - protein, 23 aa, Mycobacterium
HIACLDCRSVAAVSPNAGAAHMN

SEQ ID NO: 675053 - protein, 20 aa, Mycobacterium
HIAEELPLLGSCTVNAAGHV

SEQ ID NO: 675054 - protein, 22 aa, Mycobacterium
HIAEELVRIIGVLRGMQLKKLP

SEQ ID NO: 675055 - protein, 18 aa, Mycobacterium
HIAEVVADLIGRKETLIL

SEQ ID NO: 675056 - protein, 18 aa, Mycobacterium
HIAGRPVTRKRWPNGVAE

SEQ ID NO: 675057 - protein, 18 aa, Mycobacterium
HIAGRRVVDVSGPNGPTT

SEQ ID NO: 675058 - protein, 22 aa, Mycobacterium
HIAQPALSYAIRQLENSLDATL

SEQ ID NO: 675059 - protein, 17 aa, Mycobacterium
HIARAVLEATAWQIRDV

SEQ ID NO: 675060 - protein, 21 aa, Mycobacterium
HIARTKWPTLLNPSTYRGMLT

SEQ ID NO: 675061 - protein, 20 aa, Mycobacterium
HIASELVRIIGVLRGMQLKK

SEQ ID NO: 675062 - protein, 29 aa, Mycobacterium
HIASLPLDRARPLWEMWVIETGDTNRLVV

SEQ ID NO: 675063 - protein, 17 aa, Mycobacterium
HIATIFVGGLKHLPIRY

SEQ ID NO: 675064 - protein, 20 aa, Mycobacterium
HIAVTLGGDVVRLTGTVRFG

SEQ ID NO: 675065 - protein, 18 aa, Mycobacterium
HICLRKIDSAEIWRWLRG

SEQ ID NO: 675066 - protein, 28 aa, Mycobacterium
HICVPAGYFCGLPVGLSLFAGAFQEPKL

SEQ ID NO: 675067 - protein, 20 aa, Mycobacterium
HIDAWLRAFATAGIDVETWR

SEQ ID NO: 675068 - protein, 27 aa, Mycobacterium
HIDDIRWFDFYSCFPSAVEAAIDALDL

SEQ ID NO: 675069 - protein, 24 aa, Mycobacterium
HIDECPPCLVYLQQMLDLKVLLNH

SEQ ID NO: 675070 - protein, 23 aa, Mycobacterium
HIDGAWWPRSRSLADELPGLVAA

SEQ ID NO: 675071 - protein, 23 aa, Mycobacterium
HIDKVRWPDIVERVFGRIDPIAA

SEQ ID NO: 675072 - protein, 18 aa, Mycobacterium
HIDPRLLDTPNLVLTPHI

SEQ ID NO: 675073 - protein, 24 aa, Mycobacterium
HIDRRPPHLERLLDITGILEYLTA

SEQ ID NO: 675074 - protein, 17 aa, Mycobacterium
HIEAVPLVDHHVHGCWL

SEQ ID NO: 675075 - protein, 18 aa, Mycobacterium
HIEFAHAVAEAYDELADP

SEQ ID NO: 675076 - protein, 19 aa, Mycobacterium
HIEGVKRFISGGDVGDTSE

SEQ ID NO: 675077 - protein, 23 aa, Mycobacterium
HIEPGELVALLGPSGGGKTTALR

SEQ ID NO: 675078 - protein, 23 aa, Mycobacterium
HIGCGGALDHLRVGMAAAGWIAD

SEQ ID NO: 675079 - protein, 17 aa, Mycobacterium
HIGEIYEDLSWFCIRAW

SEQ ID NO: 675080 - protein, 31 aa, Mycobacterium
HIGHVRSGVAFDILRRWLIARGCDVAFIRNV

SEQ ID NO: 675081 - protein, 35 aa, Mycobacterium
HIGHVRSGVAFDILRRWLIARGFDVAFIRNVTDID

SEQ ID NO: 675082 - protein, 29 aa, Mycobacterium
HIGHVRSGVAFDILRRWLMARGCDVAFIR

SEQ ID NO: 675083 - protein, 35 aa, Mycobacterium
HIGHVRSGVAFDILRRWLMARGFDVAFIRNVTDID

SEQ ID NO: 675084 - protein, 35 aa, Mycobacterium
HIGHVRSGVAFDVLRRWLSARAYDVLFVRNVTDID

SEQ ID NO: 675085 - protein, 35 aa, Mycobacterium
HIGHVRSGVAFDVLRRWLTAKGFDVAFIRNVTDID

SEQ ID NO: 675086 - protein, 34 aa, Mycobacterium
HIGHVRSGVAFDVLRRWLTANGYDVAFIRNVTDI

SEQ ID NO: 675087 - protein, 19 aa, Mycobacterium
HIGLLPDPRRVGGQRRYDD

SEQ ID NO: 675088 - protein, 34 aa, Mycobacterium
HIGNLRTAVLAWLFARSTGRRFLMRVEDLDDRTH

SEQ ID NO: 675089 - protein, 28 aa, Mycobacterium
HIGNLRTAVLAWLFARSTGRRFLVRVED

SEQ ID NO: 675090 - protein, 22 aa, Mycobacterium
HIGRAKVPIVVQVGPRLPAAGD

SEQ ID NO: 675091 - protein, 22 aa, Mycobacterium
HIGRLAVRLDVSRLVVVGTGRS

SEQ ID NO: 675092 - protein, 25 aa, Mycobacterium
HIGRNEGKAPLVLEVTYVDPAGAPT

SEQ ID NO: 675093 - protein, 24 aa, Mycobacterium
HIGRTSWKLLRAFGADAVAVTGTG

SEQ ID NO: 675094 - protein, 19 aa, Mycobacterium
HIGRWRFVTLHNQVDTSRD

SEQ ID NO: 675095 - protein, 18 aa, Mycobacterium
HIHFPQTYCTDSYGGGQL

SEQ ID NO: 675096 - protein, 18 aa, Mycobacterium
HIHLAYRPGVPLVAAVLR

SEQ ID NO: 675097 - protein, 18 aa, Mycobacterium
HIIDVALVVREVLEDYGL

SEQ ID NO: 675098 - protein, 20 aa, Mycobacterium
HIIRMARDVAPDWPASDFDA

SEQ ID NO: 675099 - protein, 31 aa, Mycobacterium
HIKKLVGRLEKRFSPKMRLAVTAALEHYTAT

SEQ ID NO: 675100 - protein, 19 aa, Mycobacterium
HIKPGLPRTLIHVSGSEVL

SEQ ID NO: 675101 - protein, 20 aa, Mycobacterium
HIKPLFVFFDSCWDPQPRAG

SEQ ID NO: 675102 - protein, 17 aa, Mycobacterium
HILGMLGAEVIHVESTV

SEQ ID NO: 675103 - protein, 18 aa, Mycobacterium
HILRALRINLTVRGYEVI

SEQ ID NO: 675104 - protein, 24 aa, Mycobacterium
HINELAPRLIAVVDRMEGIVTRVE

SEQ ID NO: 675105 - protein, 18 aa, Mycobacterium
HIPCWLITDHRSWNRYVI

SEQ ID NO: 675106 - protein, 18 aa, Mycobacterium
HIPCWLLTDHRSWTRYVV

SEQ ID NO: 675107 - protein, 24 aa, Mycobacterium
HIPDEVPGVLLARGLAEESGKRIR

SEQ ID NO: 675108 - protein, 17 aa, Mycobacterium
HIPERIRAASTREPLKP

SEQ ID NO: 675109 - protein, 23 aa, Mycobacterium
HIPGAIRLDWRSDLQDPVKRDFV

SEQ ID NO: 675110 - protein, 17 aa, Mycobacterium
HIPIAASTRESFTVNET

SEQ ID NO: 675111 - protein, 25 aa, Mycobacterium
HIPKGSAAALRFEVLGLVDGAPAVV

SEQ ID NO: 675112 - protein, 24 aa, Mycobacterium
HIPLFAMYPEWGWGTDDSAQALSY

SEQ ID NO: 675113 - protein, 24 aa, Mycobacterium
HIPLFAMYPQWGWGTDDAAQALSY

SEQ ID NO: 675114 - protein, 25 aa, Mycobacterium
HIPRCVRPAFVKRVSILSADPTEAG

SEQ ID NO: 675115 - protein, 21 aa, Mycobacterium
HIPSLFGVYPTVDWHERETYD

SEQ ID NO: 675116 - protein, 24 aa, Mycobacterium
HIPVLLDRCVELLAPALTRTDPDG

SEQ ID NO: 675117 - protein, 21 aa, Mycobacterium
HIPVPPNWGGYLIGPEVVEFW

SEQ ID NO: 675118 - protein, 25 aa, Mycobacterium
HIPWDRLAVEVVKEATPWKRNGQRR

SEQ ID NO: 675119 - protein, 19 aa, Mycobacterium
HIQRGDIVFPKSVTLQRIK

SEQ ID NO: 675120 - protein, 18 aa, Mycobacterium
HIRANIRALLQMAVVLTY

SEQ ID NO: 675121 - protein, 18 aa, Mycobacterium
HIRAVVCEDSLGIADELE

SEQ ID NO: 675122 - protein, 24 aa, Mycobacterium
HIRNWRWAGVPFYLRTGKRMSQRF

SEQ ID NO: 675123 - protein, 20 aa, Mycobacterium
HIRPIAWLCVGPVREFAERP

SEQ ID NO: 675124 - protein, 26 aa, Mycobacterium
HIRPWRLPPPGGRRELDEAIGQIAST

SEQ ID NO: 675125 - protein, 25 aa, Mycobacterium
HIRPWRVSPPGGRRELDEAIGQIAS

SEQ ID NO: 675126 - protein, 28 aa, Mycobacterium
HIRQILPERLHSFFFFNGERIEHLVQAS

SEQ ID NO: 675127 - protein, 19 aa, Mycobacterium
HIRRDRGFQGIYVQHSDPK

SEQ ID NO: 675128 - protein, 18 aa, Mycobacterium
HIRRFLAERTQHLASPPE

SEQ ID NO: 675129 - protein, 19 aa, Mycobacterium
HIRSAVSPEAEWQDQIDQA

SEQ ID NO: 675130 - protein, 19 aa, Mycobacterium
HIRSLASFHQTFDCLLTPT

SEQ ID NO: 675131 - protein, 26 aa, Mycobacterium
HIRSTAELTIVSWLPFYHDMGLVLGV

SEQ ID NO: 675132 - protein, 28 aa, Mycobacterium
HISARPAITLCWIREAPALGAVARPLHR

SEQ ID NO: 675133 - protein, 24 aa, Mycobacterium
HISCGAALDHLRVAMAAAGWVIHV

SEQ ID NO: 675134 - protein, 25 aa, Mycobacterium
HISGRARIAGALAHIDKAAFTRADV

SEQ ID NO: 675135 - protein, 17 aa, Mycobacterium
HISHGRAGWQVRVSATA

SEQ ID NO: 675136 - protein, 25 aa, Mycobacterium
HISQNWRLSGLAGEYITPVPAQQRL

SEQ ID NO: 675137 - protein, 28 aa, Mycobacterium
HISTLLLTLLFRFMRPLIENGHVFLAQP

SEQ ID NO: 675138 - protein, 29 aa, Mycobacterium
HISTLLLTLLFRFMRPLVEHGHIFLAQPP

SEQ ID NO: 675139 - protein, 25 aa, Mycobacterium
HITDPRLRRVFTFQSLYAGVAPQDA

SEQ ID NO: 675140 - protein, 24 aa, Mycobacterium
HITRLRPDLRPDWAQPAAGGGSYR

SEQ ID NO: 675141 - protein, 25 aa, Mycobacterium
HITRLRPDLRPDWPQPASGGGSYRI

SEQ ID NO: 675142 - protein, 24 aa, Mycobacterium
HIVGCGLCDNCRRGFYISCSGDRA

SEQ ID NO: 675143 - protein, 22 aa, Mycobacterium
HIVKIEPFASLPADQVAQAIAP

SEQ ID NO: 675144 - protein, 24 aa, Mycobacterium
HIVLDGWSKPILLQEIFVSYFGQR

SEQ ID NO: 675145 - protein, 17 aa, Mycobacterium
HIVNLCWHGLKHLEADP

SEQ ID NO: 675146 - protein, 20 aa, Mycobacterium
HIVPELPKTRSGKIMRRLLR

SEQ ID NO: 675147 - protein, 17 aa, Mycobacterium
HIVRERVLEIGYDSSSK

SEQ ID NO: 675148 - protein, 24 aa, Mycobacterium
HIVVCSGFTQGLRLVCEALANGGA

SEQ ID NO: 675149 - protein, 17 aa, Mycobacterium
HIVWDWNGTLLDDNPAM

SEQ ID NO: 675150 - protein, 35 aa, Mycobacterium
HIYLEEVFLFPPLREAGIVMPIFVMMREHGQLWHT

SEQ ID NO: 675151 - protein, 19 aa, Mycobacterium
HKAAEFGREVIRQFEQDIQ

SEQ ID NO: 675152 - protein, 24 aa, Mycobacterium
HKAINRGAAVFTFALGDRKTYEFM

SEQ ID NO: 675153 - protein, 20 aa, Mycobacterium
HKARSRFGPVSAAPGALTLR

SEQ ID NO: 675154 - protein, 26 aa, Mycobacterium
HKASLPQDRMRTWKISGTALVTGVTG

SEQ ID NO: 675155 - protein, 18 aa, Mycobacterium
HKDAIAAAAVEFLPLSGA

SEQ ID NO: 675156 - protein, 18 aa, Mycobacterium
HKDARLALAAGEATGVNL

SEQ ID NO: 675157 - protein, 19 aa, Mycobacterium
HKDGHYLDAIHAYKERGGR

SEQ ID NO: 675158 - protein, 17 aa, Mycobacterium
HKDRLVLDFYRCAMLPL

SEQ ID NO: 675159 - protein, 19 aa, Mycobacterium
HKDRMVFVEVVLPRLEIPH

SEQ ID NO: 675160 - protein, 24 aa, Mycobacterium
HKDTRAGSSFAEFAASAKELTGNK

SEQ ID NO: 675161 - protein, 24 aa, Mycobacterium
HKESVGFIINRVWAAVKREALAVV

SEQ ID NO: 675162 - protein, 21 aa, Mycobacterium
HKFADMKLWLEACRATTAAAV

SEQ ID NO: 675163 - protein, 26 aa, Mycobacterium
HKFGGPRGVGALAVRNGHPLVPMVRG

SEQ ID NO: 675164 - protein, 20 aa, Mycobacterium
HKFRAAVGAGGFGVVLNSLA

SEQ ID NO: 675165 - protein, 19 aa, Mycobacterium
HKGQLLALHLGRLKDRVGL

SEQ ID NO: 675166 - protein, 20 aa, Mycobacterium
HKGRLARALVETRAEPKDCG

SEQ ID NO: 675167 - protein, 21 aa, Mycobacterium
HKHAAMAEMFIRATSTPSADE

SEQ ID NO: 675168 - protein, 21 aa, Mycobacterium
HKHFDHVLGSAGFAGAQIYAA

SEQ ID NO: 675169 - protein, 23 aa, Mycobacterium
HKHFDHVLGSSAFVGAEIYCAPE

SEQ ID NO: 675170 - protein, 21 aa, Mycobacterium
HKHFDHVLGSSFFGRAKIYCA

SEQ ID NO: 675171 - protein, 20 aa, Mycobacterium
HKHFDHVLGSSVFTGAEIYC

SEQ ID NO: 675172 - protein, 24 aa, Mycobacterium
HKHGIFCSAVTYPVVPPGIVQLRL

SEQ ID NO: 675173 - protein, 26 aa, Mycobacterium
HKILHKHGLAVPNWPVEWGGKDWTPT

SEQ ID NO: 675174 - protein, 25 aa, Mycobacterium
HKITWENACRFFSWDPFARTAREEA

SEQ ID NO: 675175 - protein, 20 aa, Mycobacterium
HKKAWKAMFDDYLRARAQST

SEQ ID NO: 675176 - protein, 17 aa, Mycobacterium
HKKHRYAFAPFGGGAHK

SEQ ID NO: 675177 - protein, 17 aa, Mycobacterium
HKLAPDPGIRRAILVAA

SEQ ID NO: 675178 - protein, 18 aa, Mycobacterium
HKLDMGPIIDDIRAAIAV

SEQ ID NO: 675179 - protein, 33 aa, Mycobacterium
HKLRQKRLMTLIHLWLVHRFKADAVYYVTPTED

SEQ ID NO: 675180 - protein, 23 aa, Mycobacterium
HKLSDDEFGFFMVLLAVAGNETT

SEQ ID NO: 675181 - protein, 30 aa, Mycobacterium
HKMADYGADVWRWLDDGAHFYVCGDATRMA

SEQ ID NO: 675182 - protein, 17 aa, Mycobacterium
HKMSTIEAVLRLARKDM

SEQ ID NO: 675183 - protein, 23 aa, Mycobacterium
HKMSYGFAPMCAFVDHGEHGTGE

SEQ ID NO: 675184 - protein, 27 aa, Mycobacterium
HKMTEPEAFKWIQRAAMDRRTTMKRVA

SEQ ID NO: 675185 - protein, 25 aa, Mycobacterium
HKPGLRKLAPLAFVRFRIDGKDWPA

SEQ ID NO: 675186 - protein, 18 aa, Mycobacterium
HKPIGLLGAMLAAHGDLR

SEQ ID NO: 675187 - protein, 20 aa, Mycobacterium
HKPQMAAWLNQWAAQFAAQT

SEQ ID NO: 675188 - protein, 25 aa, Mycobacterium
HKPWLPHFYLGHGIGTGAAEMPMIG

SEQ ID NO: 675189 - protein, 25 aa, Mycobacterium
HKPWLPHFYLGHGIGTYPAEAPMIG

SEQ ID NO: 675190 - protein, 17 aa, Mycobacterium
HKPWPGLIAAYRDRLPV

SEQ ID NO: 675191 - protein, 19 aa, Mycobacterium
HKPWRARRAEQMLAGAEAT

SEQ ID NO: 675192 - protein, 20 aa, Mycobacterium
HKPWRARRAESVLIGDQPSD

SEQ ID NO: 675193 - protein, 24 aa, Mycobacterium
HKRAMPRPSATTVYALTADGRALE

SEQ ID NO: 675194 - protein, 26 aa, Mycobacterium
HKRHNFLGAPFWVGRGFGLNLSVVTD

SEQ ID NO: 675195 - protein, 22 aa, Mycobacterium
HKRIAVRRCDTFVGLGDRYLRA

SEQ ID NO: 675196 - protein, 20 aa, Mycobacterium
HKRLECLHVTLTEKSQTYPL

SEQ ID NO: 675197 - protein, 21 aa, Mycobacterium
HKRLTLFLIPMDRPGFTVRPI

SEQ ID NO: 675198 - protein, 20 aa, Mycobacterium
HKRMVARPMTNVFPSGRKEV

SEQ ID NO: 675199 - protein, 17 aa, Mycobacterium
HKRRRASDLAARLKAAW

SEQ ID NO: 675200 - protein, 25 aa, Mycobacterium
HKRRYRPQWCRVIDYPFTGRAEVSA

SEQ ID NO: 675201 - protein, 22 aa, Mycobacterium
HKRYPTVDWQRAFDGAREEVDW

SEQ ID NO: 675202 - protein, 23 aa, Mycobacterium
HKSAFSALVLSGAMPVYVEPDYD

SEQ ID NO: 675203 - protein, 23 aa, Mycobacterium
HKSERWYLEQLYAAVGIQGSSAA

SEQ ID NO: 675204 - protein, 25 aa, Mycobacterium
HKSLRGPRGGLVLATAEYSDAVDKG

SEQ ID NO: 675205 - protein, 25 aa, Mycobacterium
HKSLRGPRGGLVLATEEFAPAVDKG

SEQ ID NO: 675206 - protein, 23 aa, Mycobacterium
HKSPEMTARYAATLAATAEAEFL

SEQ ID NO: 675207 - protein, 29 aa, Mycobacterium
HKTLSGWRRTGALCPNAILPTGERLDAVL

SEQ ID NO: 675208 - protein, 25 aa, Mycobacterium
HKTMGIPILYPWANRLSSMGYGVDG

SEQ ID NO: 675209 - protein, 23 aa, Mycobacterium
HKVEAALEFKNQVLVKIYNRKAL

SEQ ID NO: 675210 - protein, 19 aa, Mycobacterium
HKVGIEFDGAQHWTSAQQR

SEQ ID NO: 675211 - protein, 28 aa, Mycobacterium
HKVILSRRVEVPFAMDFPSTYRLGRHNN

SEQ ID NO: 675212 - protein, 17 aa, Mycobacterium
HKVLLRASQRAVQEQLH

SEQ ID NO: 675213 - protein, 18 aa, Mycobacterium
HKVMGVNVLGVMAGTREA

SEQ ID NO: 675214 - protein, 24 aa, Mycobacterium
HKVRDPRALAAVRELWTTRDQIAR

SEQ ID NO: 675215 - protein, 19 aa, Mycobacterium
HKWTRRPSPVTARELAETP

SEQ ID NO: 675216 - protein, 26 aa, Mycobacterium
HKYDLRAAAALGFRTAFVARPLEFGA

SEQ ID NO: 675217 - protein, 17 aa, Mycobacterium
HKYGFRYSVLTRPPSAG

SEQ ID NO: 675218 - protein, 18 aa, Mycobacterium
HKYIYSHIGYNLKATDMQ

SEQ ID NO: 675219 - protein, 17 aa, Mycobacterium
HKYWIDTRLQWYVDLGI

SEQ ID NO: 675220 - protein, 17 aa, Mycobacterium
HLAAKLWRTPVVAEALW

SEQ ID NO: 675221 - protein, 19 aa, Mycobacterium
HLAALKMITMQGGVFGAHA

SEQ ID NO: 675222 - protein, 18 aa, Mycobacterium
HLAALRAIPNLSVVRPGD

SEQ ID NO: 675223 - protein, 19 aa, Mycobacterium
HLAALRAIPQLSVVRPGDA

SEQ ID NO: 675224 - protein, 28 aa, Mycobacterium
HLAAVPAARYYIDYSDFTLWVLRVSRVR

SEQ ID NO: 675225 - protein, 17 aa, Mycobacterium
HLACLDPGLTPEQLAAL

SEQ ID NO: 675226 - protein, 22 aa, Mycobacterium
HLADLKAAAGLVDSALSEATRA

SEQ ID NO: 675227 - protein, 21 aa, Mycobacterium
HLADLKIGIKSVGQAVETLSG

SEQ ID NO: 675228 - protein, 17 aa, Mycobacterium
HLAEAFHAAGRCTAEAD

SEQ ID NO: 675229 - protein, 20 aa, Mycobacterium
HLAEELWSLLGRDDSLAHGP

SEQ ID NO: 675230 - protein, 17 aa, Mycobacterium
HLAEIDLVIGHNLLEFD

SEQ ID NO: 675231 - protein, 28 aa, Mycobacterium
HLAELCQRADLLPGIDGRTFVDIDSLLR

SEQ ID NO: 675232 - protein, 22 aa, Mycobacterium
HLAGHALHSIFWTNLSPEAAER

SEQ ID NO: 675233 - protein, 21 aa, Mycobacterium
HLAGLAFARYQLKIEPIASTG

SEQ ID NO: 675234 - protein, 21 aa, Mycobacterium
HLAGLAFARYQLKIEPLASTS

SEQ ID NO: 675235 - protein, 18 aa, Mycobacterium
HLAGLPGPTLLAASMATE

SEQ ID NO: 675236 - protein, 18 aa, Mycobacterium
HLAGRRVVDVSGPGGPAS

SEQ ID NO: 675237 - protein, 25 aa, Mycobacterium
HLAIAMRPKLWMFNSVGNLGHDSDG

SEQ ID NO: 675238 - protein, 19 aa, Mycobacterium
HLAIGFAVMDMLGTRKFSR

SEQ ID NO: 675239 - protein, 25 aa, Mycobacterium
HLAKESFRLLGRVDVVFSNAGIVVA

SEQ ID NO: 675240 - protein, 18 aa, Mycobacterium
HLANFKAPRSVRFVDALP

SEQ ID NO: 675241 - protein, 19 aa, Mycobacterium
HLANFKAPRSVRFVDALPR

SEQ ID NO: 675242 - protein, 17 aa, Mycobacterium
HLAPATLYRRFYTARER

SEQ ID NO: 675243 - protein, 23 aa, Mycobacterium
HLAPEAQVAFSRRLGAVDHSADG

SEQ ID NO: 675244 - protein, 26 aa, Mycobacterium
HLAPRPGTDAALLFAIVHVLFDENLV

SEQ ID NO: 675245 - protein, 17 aa, Mycobacterium
HLARAARRLYVFQRTPS

SEQ ID NO: 675246 - protein, 17 aa, Mycobacterium
HLARLELNVAFQMLYAR

SEQ ID NO: 675247 - protein, 26 aa, Mycobacterium
HLARPKRYIPGFAIELEDESQLPAAV

SEQ ID NO: 675248 - protein, 21 aa, Mycobacterium
HLARRAQQILGDIDIVVNNAG

SEQ ID NO: 675249 - protein, 29 aa, Mycobacterium
HLASSARDLVRLGSVVADANAAAAAPTTG

SEQ ID NO: 675250 - protein, 19 aa, Mycobacterium
HLASSYGHWVHAIRTGDGA

SEQ ID NO: 675251 - protein, 24 aa, Mycobacterium
HLASWRPGLNYRDLARELTEYVLA

SEQ ID NO: 675252 - protein, 20 aa, Mycobacterium
HLAVLKRHHVVSGKRTGNAV

SEQ ID NO: 675253 - protein, 24 aa, Mycobacterium
HLAVRRWAIDLPALYAEVRKTRPV

SEQ ID NO: 675254 - protein, 18 aa, Mycobacterium
HLCGESGASLLERFRNVT

SEQ ID NO: 675255 - protein, 25 aa, Mycobacterium
HLCRDKCHYCTFVTVPGKLRAEGKG

SEQ ID NO: 675256 - protein, 26 aa, Mycobacterium
HLCRDKCHYCTFVTVPGKLRAQGQGM

SEQ ID NO: 675257 - protein, 18 aa, Mycobacterium
HLCVDMFETVELARSGVI

SEQ ID NO: 675258 - protein, 22 aa, Mycobacterium
HLCYGDSKFGASPFMGDPPDAE

SEQ ID NO: 675259 - protein, 19 aa, Mycobacterium
HLDASMVHRAIDALDPSPG

SEQ ID NO: 675260 - protein, 26 aa, Mycobacterium
HLDDEIRRIITWLGIGDEFAAISRPA

SEQ ID NO: 675261 - protein, 20 aa, Mycobacterium
HLDDRLAVTVKRTADGYGSN

SEQ ID NO: 675262 - protein, 17 aa, Mycobacterium
HLDGYEVHDCFTPSEYL

SEQ ID NO: 675263 - protein, 23 aa, Mycobacterium
HLDHRRLAHVVSHAAAALVTPSW

SEQ ID NO: 675264 - protein, 25 aa, Mycobacterium
HLDKKFKRRGVQMLSDGKRTWAVIG

SEQ ID NO: 675265 - protein, 31 aa, Mycobacterium
HLDLGLEIFDWLEVVDFGDAYCPHGQTEVSH

SEQ ID NO: 675266 - protein, 18 aa, Mycobacterium
HLDLPLATMHYFPMRPNG

SEQ ID NO: 675267 - protein, 23 aa, Mycobacterium
HLDLPPVYLMMFRVLGSLSGILA

SEQ ID NO: 675268 - protein, 36 aa, Mycobacterium
HLDMILDGCSIWFDEVLVFSDGRWDRVALDSQSQGH

SEQ ID NO: 675269 - protein, 18 aa, Mycobacterium
HLDPALLDIGDNVRDDAA

SEQ ID NO: 675270 - protein, 19 aa, Mycobacterium
HLDSLRAAVVAHRADLGLA

SEQ ID NO: 675271 - protein, 19 aa, Mycobacterium
HLDVKLLYYDLGIEHRDRT

SEQ ID NO: 675272 - protein, 17 aa, Mycobacterium
HLDVRHTFDVLALPATL

SEQ ID NO: 675273 - protein, 19 aa, Mycobacterium
HLDVYQWLTVLQEYLVVSL

SEQ ID NO: 675274 - protein, 23 aa, Mycobacterium
HLDWMVCRTVATLLRSRVSAQPM

SEQ ID NO: 675275 - protein, 18 aa, Mycobacterium
HLDWYAEGMFPPMHLDAE

SEQ ID NO: 675276 - protein, 18 aa, Mycobacterium
HLEACPGCFKHYGLEERI

SEQ ID NO: 675277 - protein, 20 aa, Mycobacterium
HLEACPGCLKHYGLEERIKL

SEQ ID NO: 675278 - protein, 23 aa, Mycobacterium
HLEDARAVFIFRPSRPLDYDHRD

SEQ ID NO: 675279 - protein, 22 aa, Mycobacterium
HLEGPAAVPGFRSAKSALMQNF

SEQ ID NO: 675280 - protein, 19 aa, Mycobacterium
HLEHAVAVLREAGMSNTSM

SEQ ID NO: 675281 - protein, 21 aa, Mycobacterium
HLEHRAALVVNTREAALDLLG

SEQ ID NO: 675282 - protein, 25 aa, Mycobacterium
HLEIAESTWHRWLAQYGGMKANDAK

SEQ ID NO: 675283 - protein, 25 aa, Mycobacterium
HLEIAESTWHRWLAQYGGMKASDAK

SEQ ID NO: 675284 - protein, 17 aa, Mycobacterium
HLEIFNAEDRFWARFQS

SEQ ID NO: 675285 - protein, 20 aa, Mycobacterium
HLEIRWDGQVALLADLNSTN

SEQ ID NO: 675286 - protein, 19 aa, Mycobacterium
HLEIRWDGQVALLSDLNST

SEQ ID NO: 675287 - protein, 18 aa, Mycobacterium
HLEIRWDGQVALLTDLNS

SEQ ID NO: 675288 - protein, 17 aa, Mycobacterium
HLELDWWTAPFEVSEGI

SEQ ID NO: 675289 - protein, 21 aa, Mycobacterium
HLELPGHDFAAVLRHAGTNAV

SEQ ID NO: 675290 - protein, 22 aa, Mycobacterium
HLELPGHDFAAVLRHAGTNAVL

SEQ ID NO: 675291 - protein, 20 aa, Mycobacterium
HLELPGHDFAAVLRHSGTNA

SEQ ID NO: 675292 - protein, 24 aa, Mycobacterium
HLELPRSRVELISGRTSRLKRFRV

SEQ ID NO: 675293 - protein, 22 aa, Mycobacterium
HLEPLAGITAMGVWGARHAPEA

SEQ ID NO: 675294 - protein, 23 aa, Mycobacterium
HLEPLGGLTAMGIWGARHAPDFF

SEQ ID NO: 675295 - protein, 23 aa, Mycobacterium
HLEPYAWCEPGFLARGLESGPSS

SEQ ID NO: 675296 - protein, 23 aa, Mycobacterium
HLEQWLNHWLETIQKPRVRPTTY

SEQ ID NO: 675297 - protein, 23 aa, Mycobacterium
HLERALEISRVFIAASSLGTSER

SEQ ID NO: 675298 - protein, 19 aa, Mycobacterium
HLERLWTPYRMNYLAEAPL

SEQ ID NO: 675299 - protein, 17 aa, Mycobacterium
HLERMLSLDNAFNTEEL

SEQ ID NO: 675300 - protein, 18 aa, Mycobacterium
HLERMLSLDNAFSAAELA

SEQ ID NO: 675301 - protein, 18 aa, Mycobacterium
HLERMLSLDNVFDLEELA

SEQ ID NO: 675302 - protein, 27 aa, Mycobacterium
HLESLRFGHRPRLRVFAMSPTADYDAG

SEQ ID NO: 675303 - protein, 21 aa, Mycobacterium
HLFEGTLYFPAPRTPRERVAQ

SEQ ID NO: 675304 - protein, 17 aa, Mycobacterium
HLFGNSWGGMLAQQYML

SEQ ID NO: 675305 - protein, 22 aa, Mycobacterium
HLFRSLWRLDFIAVALNTGPAG

SEQ ID NO: 675306 - protein, 17 aa, Mycobacterium
HLGCGLDSRVFRVDPGP

SEQ ID NO: 675307 - protein, 23 aa, Mycobacterium
HLGDLPITVVIEVDSGHHRTGVA

SEQ ID NO: 675308 - protein, 21 aa, Mycobacterium
HLGDSLVRCISMQPTDGLVRG

SEQ ID NO: 675309 - protein, 26 aa, Mycobacterium
HLGEIRLSEFMLPPIHLNPVDGNSLT

SEQ ID NO: 675310 - protein, 17 aa, Mycobacterium
HLGFGVTAATSFEHPYS

SEQ ID NO: 675311 - protein, 18 aa, Mycobacterium
HLGFGVTTGTGFEHPYPF

SEQ ID NO: 675312 - protein, 18 aa, Mycobacterium
HLGGFWIINAPDLDAALK

SEQ ID NO: 675313 - protein, 19 aa, Mycobacterium
HLGGGHRRDRFGVGEHELD

SEQ ID NO: 675314 - protein, 27 aa, Mycobacterium
HLGGIPMPRALQWALIEHILGANPAAY

SEQ ID NO: 675315 - protein, 18 aa, Mycobacterium
HLGGRPLHHAVLMMIPEA

SEQ ID NO: 675316 - protein, 27 aa, Mycobacterium
HLGGTLGFELSDNFVTYLGWLYSWGSP

SEQ ID NO: 675317 - protein, 21 aa, Mycobacterium
HLGGVLPYLAQRLIDQSGRGA

SEQ ID NO: 675318 - protein, 19 aa, Mycobacterium
HLGGVLYLFVRGMCGAATP

SEQ ID NO: 675319 - protein, 19 aa, Mycobacterium
HLGGVLYLFVRGMCGADTP

SEQ ID NO: 675320 - protein, 17 aa, Mycobacterium
HLGHAASLGRLSVPPSW

SEQ ID NO: 675321 - protein, 25 aa, Mycobacterium
HLGIDRWLLYGGSWASTLILAYAQR

SEQ ID NO: 675322 - protein, 18 aa, Mycobacterium
HLGKGSAVGTVIPTKGAV

SEQ ID NO: 675323 - protein, 19 aa, Mycobacterium
HLGKRLVAYLTPIGGHVVD

SEQ ID NO: 675324 - protein, 18 aa, Mycobacterium
HLGLDYSTAYSWAPGAQP

SEQ ID NO: 675325 - protein, 20 aa, Mycobacterium
HLGLGAFHRAHQAIYTEDAM

SEQ ID NO: 675326 - protein, 19 aa, Mycobacterium
HLGNRRGIGLFEFSDNSAA

SEQ ID NO: 675327 - protein, 25 aa, Mycobacterium
HLGPGLKELWVWPSGGIGQDQLFEN

SEQ ID NO: 675328 - protein, 24 aa, Mycobacterium
HLGPRAEVLISLHGNVFPGLARSL

SEQ ID NO: 675329 - protein, 20 aa, Mycobacterium
HLGPTLSMRGIDNAAYYRLV

SEQ ID NO: 675330 - protein, 20 aa, Mycobacterium
HLGPYCWPAAIKMIESGALP

SEQ ID NO: 675331 - protein, 28 aa, Mycobacterium
HLGQGRVALDWLDRVDVIGHTQSSSRFD

SEQ ID NO: 675332 - protein, 27 aa, Mycobacterium
HLGQGRVALDWLDRVDVIGQTNASGRF

SEQ ID NO: 675333 - protein, 18 aa, Mycobacterium
HLGRDAEHLFVFQRTPSS

SEQ ID NO: 675334 - protein, 19 aa, Mycobacterium
HLGRELSVLDLISADSAAY

SEQ ID NO: 675335 - protein, 23 aa, Mycobacterium
HLGSWRPGLNYRQLAEELTNYVV

SEQ ID NO: 675336 - protein, 24 aa, Mycobacterium
HLGSWRPGLNYRQLARELTDYVVE

SEQ ID NO: 675337 - protein, 24 aa, Mycobacterium
HLGSWRPGLSYRQLARELTDYVVE

SEQ ID NO: 675338 - protein, 21 aa, Mycobacterium
HLGSWRPGLSYRQLATELTDY

SEQ ID NO: 675339 - protein, 23 aa, Mycobacterium
HLGSWRPGLSYTELAEQLTEYLV

SEQ ID NO: 675340 - protein, 24 aa, Mycobacterium
HLGVPAPVPGDWLLLVELAADHDQ

SEQ ID NO: 675341 - protein, 23 aa, Mycobacterium
HLGVPRSRIELVSGATSRHKRFR

SEQ ID NO: 675342 - protein, 17 aa, Mycobacterium
HLGVPVAALLGDGQQRN

SEQ ID NO: 675343 - protein, 24 aa, Mycobacterium
HLGVPVPVAGSWLLLIELAGDTDQ

SEQ ID NO: 675344 - protein, 20 aa, Mycobacterium
HLHGMFAFAIVERDSGRVLL

SEQ ID NO: 675345 - protein, 19 aa, Mycobacterium
HLHIPRTTWHDEVRFEEVS

SEQ ID NO: 675346 - protein, 19 aa, Mycobacterium
HLHIPRTTWHDGVRFEEVS

SEQ ID NO: 675347 - protein, 23 aa, Mycobacterium
HLHIPRTTWYDGVRFEEVSVGYP

SEQ ID NO: 675348 - protein, 18 aa, Mycobacterium
HLHLRRALVDAALLGAEA

SEQ ID NO: 675349 - protein, 17 aa, Mycobacterium
HLHLRRALVTAGVLGGD

SEQ ID NO: 675350 - protein, 24 aa, Mycobacterium
HLHLRRAVVTTALFGGDAPAADVF

SEQ ID NO: 675351 - protein, 18 aa, Mycobacterium
HLHPALNLNRARPQAQVL

SEQ ID NO: 675352 - protein, 25 aa, Mycobacterium
HLHSGDKVMLCFGAANRDDEVFPEP

SEQ ID NO: 675353 - protein, 24 aa, Mycobacterium
HLHTCPLCEAMCGLEIRVADGPSG

SEQ ID NO: 675354 - protein, 22 aa, Mycobacterium
HLIAGQWRPGHGEALRSVNPAH

SEQ ID NO: 675355 - protein, 32 aa, Mycobacterium
HLIALPGGRYGWRVSLPAMMSYWSELARDAVL

SEQ ID NO: 675356 - protein, 17 aa, Mycobacterium
HLIDTARSFIFDTGLAP

SEQ ID NO: 675357 - protein, 23 aa, Mycobacterium
HLIDVKRAIAWVRENIADYGGDP

SEQ ID NO: 675358 - protein, 23 aa, Mycobacterium
HLIDVKRAIAWVRQNIADYGGDP

SEQ ID NO: 675359 - protein, 21 aa, Mycobacterium
HLIELGHRVAVLAVDPSSTRT

SEQ ID NO: 675360 - protein, 19 aa, Mycobacterium
HLIERGHRVAVLAVDPSST

SEQ ID NO: 675361 - protein, 28 aa, Mycobacterium
HLIGGKCTHCATIVFPPRANNCPNPSCD

SEQ ID NO: 675362 - protein, 17 aa, Mycobacterium
HLIGHFVDQARRSGASW

SEQ ID NO: 675363 - protein, 18 aa, Mycobacterium
HLIRASAIQAMLDGTEHI

SEQ ID NO: 675364 - protein, 25 aa, Mycobacterium
HLITPRLDPGVPVLSLGRYAGARRN

SEQ ID NO: 675365 - protein, 23 aa, Mycobacterium
HLKAQFAKWQLPDEYAYIVEVPK

SEQ ID NO: 675366 - protein, 31 aa, Mycobacterium
HLKAQGWGRIINISGLGYWQTHSIVRSIRNV

SEQ ID NO: 675367 - protein, 17 aa, Mycobacterium
HLKGHFATMRHAASYWR

SEQ ID NO: 675368 - protein, 26 aa, Mycobacterium
HLKGTWNGIRLAAAIMRENKRGAIVN

SEQ ID NO: 675369 - protein, 29 aa, Mycobacterium
HLKPEGKAIIQWRPLQWFAQRPPGRYQRS

SEQ ID NO: 675370 - protein, 21 aa, Mycobacterium
HLKQRMVRRGAHRVELLDQSL

SEQ ID NO: 675371 - protein, 22 aa, Mycobacterium
HLKSVIYELLWFLRGESNVRWL

SEQ ID NO: 675372 - protein, 22 aa, Mycobacterium
HLLAAHRLELPWGFAVPERSRN

SEQ ID NO: 675373 - protein, 24 aa, Mycobacterium
HLLAMKVLAARAVRDGDDVQFLLG

SEQ ID NO: 675374 - protein, 17 aa, Mycobacterium
HLLAMLGAEVIHVESTR

SEQ ID NO: 675375 - protein, 19 aa, Mycobacterium
HLLANLASLLVKSTAEEEV

SEQ ID NO: 675376 - protein, 18 aa, Mycobacterium
HLLARAAVDLVEHPKARQ

SEQ ID NO: 675377 - protein, 26 aa, Mycobacterium
HLLASPDLWAAVVLVDITPRMEFDGA

SEQ ID NO: 675378 - protein, 18 aa, Mycobacterium
HLLATTWLDLPARPALIG

SEQ ID NO: 675379 - protein, 22 aa, Mycobacterium
HLLDIRIAFTDVHIFNTPTGMR

SEQ ID NO: 675380 - protein, 23 aa, Mycobacterium
HLLDIRIEFEAVQIFDTPVGRRL

SEQ ID NO: 675381 - protein, 22 aa, Mycobacterium
HLLDRLSAALVYQLTVSGAAKL

SEQ ID NO: 675382 - protein, 26 aa, Mycobacterium
HLLDRVEWDRVIGINLTGTFLVAKAA

SEQ ID NO: 675383 - protein, 17 aa, Mycobacterium
HLLEPRDIFAALPDKRW

SEQ ID NO: 675384 - protein, 20 aa, Mycobacterium
HLLIERAYLLGVTAPEMTVL

SEQ ID NO: 675385 - protein, 17 aa, Mycobacterium
HLLLRFDQGRWLAIDNG

SEQ ID NO: 675386 - protein, 23 aa, Mycobacterium
HLLMDSRAGYKYGDVTILDHMAY

SEQ ID NO: 675387 - protein, 24 aa, Mycobacterium
HLLPKSRAGFKYGDVTLIDHMAFD

SEQ ID NO: 675388 - protein, 17 aa, Mycobacterium
HLLSEVGPEGFARWMRE

SEQ ID NO: 675389 - protein, 25 aa, Mycobacterium
HLLTRLDSLLIRPVCGGKPIVGPEL

SEQ ID NO: 675390 - protein, 17 aa, Mycobacterium
HLLVRVRDGTGLVGPLV

SEQ ID NO: 675391 - protein, 20 aa, Mycobacterium
HLMDAVPITLGQEFSGYARQ

SEQ ID NO: 675392 - protein, 23 aa, Mycobacterium
HLMGDGYWVWLIRLASGATSVGI

SEQ ID NO: 675393 - protein, 19 aa, Mycobacterium
HLMPDGWRAEEPEAVAGGD

SEQ ID NO: 675394 - protein, 18 aa, Mycobacterium
HLMPSRKEGWGLAVTEAA

SEQ ID NO: 675395 - protein, 25 aa, Mycobacterium
HLMRNRGAQLWSWLQDGAQLYVCGT

SEQ ID NO: 675396 - protein, 19 aa, Mycobacterium
HLMWHRVAPALAEDFFIVA

SEQ ID NO: 675397 - protein, 19 aa, Mycobacterium
HLNAMRWYSFDPFSRIPRE

SEQ ID NO: 675398 - protein, 18 aa, Mycobacterium
HLNLPAHDFAAVLRHSGT

SEQ ID NO: 675399 - protein, 19 aa, Mycobacterium
HLNPFPANLGDVLRRYPMV

SEQ ID NO: 675400 - protein, 20 aa, Mycobacterium
HLNPFPANLGEVLARYPKVV

SEQ ID NO: 675401 - protein, 18 aa, Mycobacterium
HLNPRIPEDLAFAESRIR

SEQ ID NO: 675402 - protein, 21 aa, Mycobacterium
HLNSVCQRLGISIQPARLRQP

SEQ ID NO: 675403 - protein, 25 aa, Mycobacterium
HLPAKQRAVLVLREVLQWKAQEVAE

SEQ ID NO: 675404 - protein, 19 aa, Mycobacterium
HLPALRAALEREVAEHVVP

SEQ ID NO: 675405 - protein, 22 aa, Mycobacterium
HLPCILKATASLVYVRLHGPDP

SEQ ID NO: 675406 - protein, 28 aa, Mycobacterium
HLPDGISCLRFRLRWKGFRVTVQANHSD

SEQ ID NO: 675407 - protein, 23 aa, Mycobacterium
HLPDWSVRVRFDRNLYLAESVDR

SEQ ID NO: 675408 - protein, 29 aa, Mycobacterium
HLPEGMPAGAMPVPGVLPGPVNAPETPEI

SEQ ID NO: 675409 - protein, 17 aa, Mycobacterium
HLPGYRVGGTIHIIANN

SEQ ID NO: 675410 - protein, 17 aa, Mycobacterium
HLPLPAKIRTEFLDPVY

SEQ ID NO: 675411 - protein, 20 aa, Mycobacterium
HLPQRLRTTVGRRMTDAYHA

SEQ ID NO: 675412 - protein, 21 aa, Mycobacterium
HLPQRLRTTVGRRMTDAYHAG

SEQ ID NO: 675413 - protein, 28 aa, Mycobacterium
HLPVFRPPLDMARLFGAPTLGPTEDGIG

SEQ ID NO: 675414 - protein, 28 aa, Mycobacterium
HLPVFRPPLDMARLFGHPELSSRSGDGI

SEQ ID NO: 675415 - protein, 26 aa, Mycobacterium
HLPVFRPPLDMARLFGQPELGPTDDG

SEQ ID NO: 675416 - protein, 24 aa, Mycobacterium
HLPWLAHHGRWPVGEEWLYQSWSA

SEQ ID NO: 675417 - protein, 19 aa, Mycobacterium
HLQAALALIDDWPSDQGHN

SEQ ID NO: 675418 - protein, 19 aa, Mycobacterium
HLQAARPGEDWTGSEQFSG

SEQ ID NO: 675419 - protein, 23 aa, Mycobacterium
HLQDCPPCLVYLQQMLDLKILLN

SEQ ID NO: 675420 - protein, 17 aa, Mycobacterium
HLQFRRFAGCPICNLHL

SEQ ID NO: 675421 - protein, 20 aa, Mycobacterium
HLQFSMKNVDSFYATAEALQ

SEQ ID NO: 675422 - protein, 18 aa, Mycobacterium
HLQLRPGTNVAVVNAMAH

SEQ ID NO: 675423 - protein, 26 aa, Mycobacterium
HLQQRVARWWIPDDIVIVDELPKTAT

SEQ ID NO: 675424 - protein, 23 aa, Mycobacterium
HLQRAPAGFYRWLASEVGNDALL

SEQ ID NO: 675425 - protein, 19 aa, Mycobacterium
HLQRLWSPHRMSYIAEAVK

SEQ ID NO: 675426 - protein, 18 aa, Mycobacterium
HLQVASLDHAMWFMRAFR

SEQ ID NO: 675427 - protein, 22 aa, Mycobacterium
HLQWDREALVALIARRIATRQG

SEQ ID NO: 675428 - protein, 23 aa, Mycobacterium
HLRARGHTRLAFAYTTDEQLRPL

SEQ ID NO: 675429 - protein, 31 aa, Mycobacterium
HLRASKPLVRLRVPFTLSRNEIDDVERGSQD

SEQ ID NO: 675430 - protein, 31 aa, Mycobacterium
HLRASKPLVRLRVPFTLSRYEIDNVERGAQD

SEQ ID NO: 675431 - protein, 25 aa, Mycobacterium
HLRDPRLQRVFTFQSLYAGVSPQRA

SEQ ID NO: 675432 - protein, 17 aa, Mycobacterium
HLRDVYVSFTIRLYRVR

SEQ ID NO: 675433 - protein, 19 aa, Mycobacterium
HLRGFQWFLDRAADGGIPL

SEQ ID NO: 675434 - protein, 24 aa, Mycobacterium
HLRGHTPGSVALAFTAAGVTHLFT

SEQ ID NO: 675435 - protein, 23 aa, Mycobacterium
HLRGKGFDAHGVMCDVRHLSEVN

SEQ ID NO: 675436 - protein, 25 aa, Mycobacterium
HLRGRLADRLPNYMVPAAIVALDDI

SEQ ID NO: 675437 - protein, 18 aa, Mycobacterium
HLRGRRVLGIFTRPDDET

SEQ ID NO: 675438 - protein, 23 aa, Mycobacterium
HLRGSRTPDRVVFRAELPTNATG

SEQ ID NO: 675439 - protein, 19 aa, Mycobacterium
HLRIDWAYDTRNFDRYTVE

SEQ ID NO: 675440 - protein, 22 aa, Mycobacterium
HLRKFGLSRVRVREMAHRGELP

SEQ ID NO: 675441 - protein, 21 aa, Mycobacterium
HLRNMAFYNFALRMLKRTQDA

SEQ ID NO: 675442 - protein, 36 aa, Mycobacterium
HLRQKRLMDVIHLWLIHRFKAEIVYYVTPTEDNIYQ

SEQ ID NO: 675443 - protein, 24 aa, Mycobacterium
HLRRHARPVLPLVCDVADEQATTA

SEQ ID NO: 675444 - protein, 21 aa, Mycobacterium
HLRSAKLWGRETRLYYIHRPG

SEQ ID NO: 675445 - protein, 24 aa, Mycobacterium
HLRSRGSMKAGIFSGEQADASVDD

SEQ ID NO: 675446 - protein, 17 aa, Mycobacterium
HLRSTTRFTTFSFLHQV

SEQ ID NO: 675447 - protein, 20 aa, Mycobacterium
HLRSVAFQLLGSVADADDAV

SEQ ID NO: 675448 - protein, 24 aa, Mycobacterium
HLRTCPLCEAMCGLEIQVDDGRVT

SEQ ID NO: 675449 - protein, 20 aa, Mycobacterium
HLRTRRLLGADGKTNPVALG

SEQ ID NO: 675450 - protein, 17 aa, Mycobacterium
HLRVECDELSAAQLATA

SEQ ID NO: 675451 - protein, 23 aa, Mycobacterium
HLRVRGVDGLRVVDCSVMPTIVA

SEQ ID NO: 675452 - protein, 20 aa, Mycobacterium
HLRVTRLSYVMSLMPPTIVR

SEQ ID NO: 675453 - protein, 26 aa, Mycobacterium
HLRYISEGALIMFAGGDPWKINSTLQ

SEQ ID NO: 675454 - protein, 17 aa, Mycobacterium
HLSAALTAFDRAGAVPF

SEQ ID NO: 675455 - protein, 17 aa, Mycobacterium
HLSALFPGLEIVEHHAF

SEQ ID NO: 675456 - protein, 24 aa, Mycobacterium
HLSASGFADLYCELAGRPPLTVPA

SEQ ID NO: 675457 - protein, 18 aa, Mycobacterium
HLSATFTFDPNIRAALIT

SEQ ID NO: 675458 - protein, 17 aa, Mycobacterium
HLSDGRAAWNMVTSSDA

SEQ ID NO: 675459 - protein, 22 aa, Mycobacterium
HLSDGRAGWNIVTSSDAFTGAN

SEQ ID NO: 675460 - protein, 22 aa, Mycobacterium
HLSDGRAGWNMVTSSDAFTGEN

SEQ ID NO: 675461 - protein, 25 aa, Mycobacterium
HLSDPRLQRVFTFQSLYAGVAPRNA

SEQ ID NO: 675462 - protein, 21 aa, Mycobacterium
HLSFVPGWNRIQLRHLVRDLK

SEQ ID NO: 675463 - protein, 22 aa, Mycobacterium
HLSFVPGWNRRQLLRVIHDLRG

SEQ ID NO: 675464 - protein, 28 aa, Mycobacterium
HLSGGRAGWNLVTSFARAAADNFSARGV

SEQ ID NO: 675465 - protein, 21 aa, Mycobacterium
HLSGGRVGWNIVTSANERAFR

SEQ ID NO: 675466 - protein, 19 aa, Mycobacterium
HLSLAIGHVRQFESARETS

SEQ ID NO: 675467 - protein, 23 aa, Mycobacterium
HLSMLRRLMMDDSYFRGELIYVF

SEQ ID NO: 675468 - protein, 32 aa, Mycobacterium
HLSPRQRAVLVMREVLQWKASEVGEAIGASTA

SEQ ID NO: 675469 - protein, 23 aa, Mycobacterium
HLSSGRAGWNLVTSFAQAAAANF

SEQ ID NO: 675470 - protein, 19 aa, Mycobacterium
HLSSIYRKLGVSDRTAAVA

SEQ ID NO: 675471 - protein, 19 aa, Mycobacterium
HLSTLTARHLLAGRQQAPV

SEQ ID NO: 675472 - protein, 17 aa, Mycobacterium
HLSVPAISIPGINTGFG

SEQ ID NO: 675473 - protein, 28 aa, Mycobacterium
HLTALRRTRVGGFGLDQARTLEQLADAA

SEQ ID NO: 675474 - protein, 19 aa, Mycobacterium
HLTFGKGLHYCLGANLARL

SEQ ID NO: 675475 - protein, 30 aa, Mycobacterium
HLTGRAATRLRLADRGYIRPGYAADLVLFD

SEQ ID NO: 675476 - protein, 22 aa, Mycobacterium
HLTKGRVGWNIVTGYLESAARN

SEQ ID NO: 675477 - protein, 24 aa, Mycobacterium
HLTLPRPGDWRQLCEQVSQLHAQR

SEQ ID NO: 675478 - protein, 19 aa, Mycobacterium
HLTLVPALRDALAEVGRPD

SEQ ID NO: 675479 - protein, 20 aa, Mycobacterium
HLTLVPALRDALAEVGRPDI

SEQ ID NO: 675480 - protein, 20 aa, Mycobacterium
HLTLVPALRDALAGVGRPDI

SEQ ID NO: 675481 - protein, 20 aa, Mycobacterium
HLTLVPALRQALAEVGRPDI

SEQ ID NO: 675482 - protein, 17 aa, Mycobacterium
HLTPHKVPQRWFSTEDL

SEQ ID NO: 675483 - protein, 29 aa, Mycobacterium
HLTREFTRFAGAPPRRWLAEEFRNIQDGG

SEQ ID NO: 675484 - protein, 18 aa, Mycobacterium
HLTREWGDDIARHGHPLP

SEQ ID NO: 675485 - protein, 23 aa, Mycobacterium
HLTRGRIGWNIVTSLLDSAARNI

SEQ ID NO: 675486 - protein, 25 aa, Mycobacterium
HLTTAIDVLKNFPFSEHKGETLIAK

SEQ ID NO: 675487 - protein, 19 aa, Mycobacterium
HLTVRDNVAFGLKIRKKPK

SEQ ID NO: 675488 - protein, 18 aa, Mycobacterium
HLTVWENVAFGLKIRKKP

SEQ ID NO: 675489 - protein, 17 aa, Mycobacterium
HLTVYAFSTENWKRSTE

SEQ ID NO: 675490 - protein, 24 aa, Mycobacterium
HLVARAWLDPEFRQLALTDALAAS

SEQ ID NO: 675491 - protein, 17 aa, Mycobacterium
HLVCDGDGPWPVLDRAA

SEQ ID NO: 675492 - protein, 20 aa, Mycobacterium
HLVCRSCGSTIEVGDHEVEE

SEQ ID NO: 675493 - protein, 21 aa, Mycobacterium
HLVCRSCGSTIEVGDHEVEEW

SEQ ID NO: 675494 - protein, 19 aa, Mycobacterium
HLVCRVCGRVADVDCAVGE

SEQ ID NO: 675495 - protein, 22 aa, Mycobacterium
HLVDPAWRRDLPQLLDQLETAG

SEQ ID NO: 675496 - protein, 24 aa, Mycobacterium
HLVEMLVAVVWGMGFYAGFVGDRS

SEQ ID NO: 675497 - protein, 26 aa, Mycobacterium
HLVEQFRYPIGLRRWEFPQGTAPDRA

SEQ ID NO: 675498 - protein, 31 aa, Mycobacterium
HLVEQYRYPLGLRRWEFPQGTAPDRQDLEPH

SEQ ID NO: 675499 - protein, 18 aa, Mycobacterium
HLVEVMYRPMPWDRNNEQ

SEQ ID NO: 675500 - protein, 22 aa, Mycobacterium
HLVGAFRLASTVLPGMLERRRG

SEQ ID NO: 675501 - protein, 18 aa, Mycobacterium
HLVGYGAVAQARWAAWRR

SEQ ID NO: 675502 - protein, 17 aa, Mycobacterium
HLVKPPLALMKPGIASR

SEQ ID NO: 675503 - protein, 19 aa, Mycobacterium
HLVLPMFVADGLDEPRDIA

SEQ ID NO: 675504 - protein, 31 aa, Mycobacterium
HLVLPMFVADGVDEPRPIVSMPGVVQHTRDS

SEQ ID NO: 675505 - protein, 21 aa, Mycobacterium
HLVRKGFEFKELEAAGLSRQG

SEQ ID NO: 675506 - protein, 21 aa, Mycobacterium
HLVSSTFIYGWSVKPVVGESD

SEQ ID NO: 675507 - protein, 24 aa, Mycobacterium
HLVVDEVRRARAWVNVPGQLPEGF

SEQ ID NO: 675508 - protein, 24 aa, Mycobacterium
HLWPGARPKDWPLQVIPRTSWAEQ

SEQ ID NO: 675509 - protein, 25 aa, Mycobacterium
HLYGELPARAVISVAAYPPAADGTF

SEQ ID NO: 675510 - protein, 21 aa, Mycobacterium
HLYLDRTRCVTRTDGAGREAI

SEQ ID NO: 675511 - protein, 19 aa, Mycobacterium
HLYYKRAVSNSALFGGRAV

SEQ ID NO: 675512 - protein, 23 aa, Mycobacterium
HMADLGFLPGVTRILAATPSGGQ

SEQ ID NO: 675513 - protein, 23 aa, Mycobacterium
HMADLGFLPVVTRLLAATPSSGQ

SEQ ID NO: 675514 - protein, 17 aa, Mycobacterium
HMADWMCFMLSESADFL

SEQ ID NO: 675515 - protein, 18 aa, Mycobacterium
HMALNAMGALLAALEIGA

SEQ ID NO: 675516 - protein, 20 aa, Mycobacterium
HMAQLIPWIEANFRTYAEYD

SEQ ID NO: 675517 - protein, 21 aa, Mycobacterium
HMDGLRIGRPTAMTQPFAAGH

SEQ ID NO: 675518 - protein, 31 aa, Mycobacterium
HMDLGLEIFDWLEVVDFGDAYCPHGQTEVSH

SEQ ID NO: 675519 - protein, 24 aa, Mycobacterium
HMEMPAMPLIKFIDGYETVEEMAT

SEQ ID NO: 675520 - protein, 25 aa, Mycobacterium
HMFFHRLGPVLARRLLLTGDVIEAG

SEQ ID NO: 675521 - protein, 24 aa, Mycobacterium
HMFLPMELEDALPPPPDAALPPDA

SEQ ID NO: 675522 - protein, 21 aa, Mycobacterium
HMHVVPRWGGDANFITIIGGS

SEQ ID NO: 675523 - protein, 22 aa, Mycobacterium
HMHVVPRWGGDANFITVIGDSK

SEQ ID NO: 675524 - protein, 22 aa, Mycobacterium
HMIFPKPGVDLSDPASFASIGM

SEQ ID NO: 675525 - protein, 18 aa, Mycobacterium
HMKSLKAVIGDSFSWLAA

SEQ ID NO: 675526 - protein, 25 aa, Mycobacterium
HMLGCEVKAMYPLGPIFHGSGLNIT

SEQ ID NO: 675527 - protein, 20 aa, Mycobacterium
HMLGQRYGRIINISSVAADK

SEQ ID NO: 675528 - protein, 26 aa, Mycobacterium
HMLMARGAIEFENLFPGLLDDMVAAG

SEQ ID NO: 675529 - protein, 21 aa, Mycobacterium
HMMARLRTGQPLVPLDLVEDA

SEQ ID NO: 675530 - protein, 20 aa, Mycobacterium
HMMKSDRGGAIVATSSMAGL

SEQ ID NO: 675531 - protein, 19 aa, Mycobacterium
HMNGFPGGPPPRLALSLGD

SEQ ID NO: 675532 - protein, 24 aa, Mycobacterium
HMPNLRCLMLTSFTSDEAMLDAIL

SEQ ID NO: 675533 - protein, 20 aa, Mycobacterium
HMRAACWDAMVTLMREMATA

SEQ ID NO: 675534 - protein, 19 aa, Mycobacterium
HMRLRLDGVARYIQEVGAE

SEQ ID NO: 675535 - protein, 22 aa, Mycobacterium
HMRMKKDWNPHDYIPWSDGKNY

SEQ ID NO: 675536 - protein, 22 aa, Mycobacterium
HMRVACWDAMLTLMREMSSAYP

SEQ ID NO: 675537 - protein, 34 aa, Mycobacterium
HMSGPRPRWVPMLDGLDVLLQWFLADVRPKFPNS

SEQ ID NO: 675538 - protein, 17 aa, Mycobacterium
HMSILSLFYRWAMDEGY

SEQ ID NO: 675539 - protein, 25 aa, Mycobacterium
HMTSEALGGIVMRCAAGMLIESTVR

SEQ ID NO: 675540 - protein, 25 aa, Mycobacterium
HMTTFGFIMGEVFRRVTGRTIGQYL

SEQ ID NO: 675541 - protein, 29 aa, Mycobacterium
HMTYVICEVLAWRGIWLSEERRRIGNVDV

SEQ ID NO: 675542 - protein, 29 aa, Mycobacterium
HMTYVLCEVLAWRGIWLSEERRRIGNVDV

SEQ ID NO: 675543 - protein, 25 aa, Mycobacterium
HMVEMFRGGIDWVLNMYQERGPVSW

SEQ ID NO: 675544 - protein, 24 aa, Mycobacterium
HMVFQELAGLAMLPGLPEVMREED

SEQ ID NO: 675545 - protein, 20 aa, Mycobacterium
HMVHLYRYRDMLPLPARATV

SEQ ID NO: 675546 - protein, 23 aa, Mycobacterium
HMVRGYAGLAVRNRALVSVLAGD

SEQ ID NO: 675547 - protein, 28 aa, Mycobacterium
HNADEWLRERGFLPGAGGPGDFRVGFNA

SEQ ID NO: 675548 - protein, 17 aa, Mycobacterium
HNAEVLGALGLSAQEIA

SEQ ID NO: 675549 - protein, 24 aa, Mycobacterium
HNAGRSQMALGFFQAVAGDSAVAW

SEQ ID NO: 675550 - protein, 18 aa, Mycobacterium
HNAHMYYVLLAPGTDRAG

SEQ ID NO: 675551 - protein, 26 aa, Mycobacterium
HNALRAIEWTGPYLAVLPELATSGYV

SEQ ID NO: 675552 - protein, 17 aa, Mycobacterium
HNATSFMVVQAALAVLL

SEQ ID NO: 675553 - protein, 21 aa, Mycobacterium
HNCRLCKSLREGTALDAGGSE

SEQ ID NO: 675554 - protein, 20 aa, Mycobacterium
HNCRLCKSLRESTALDAGGS

SEQ ID NO: 675555 - protein, 21 aa, Mycobacterium
HNEEAGLHWNAPIAAPTRAAI

SEQ ID NO: 675556 - protein, 21 aa, Mycobacterium
HNEHIRYSFELAQRSSELHGS

SEQ ID NO: 675557 - protein, 17 aa, Mycobacterium
HNEPGCQLYSLHQSGET

SEQ ID NO: 675558 - protein, 31 aa, Mycobacterium
HNEVPHGLAVMWGMDLINFLGVKWGLTSPAT

SEQ ID NO: 675559 - protein, 23 aa, Mycobacterium
HNGAFLPAIRFSEGVQAHLNADI

SEQ ID NO: 675560 - protein, 18 aa, Mycobacterium
HNGLRVFNRTVANGLNIT

SEQ ID NO: 675561 - protein, 19 aa, Mycobacterium
HNGLRVIAVQAFVGVDRDA

SEQ ID NO: 675562 - protein, 23 aa, Mycobacterium
HNGTIYRWNRPVYDIVNERPHLR

SEQ ID NO: 675563 - protein, 18 aa, Mycobacterium
HNGVEWLTFYSVGRTDFC

SEQ ID NO: 675564 - protein, 17 aa, Mycobacterium
HNICRHRGNKLVWNDFP

SEQ ID NO: 675565 - protein, 17 aa, Mycobacterium
HNIGFMVADVLADRMGE

SEQ ID NO: 675566 - protein, 17 aa, Mycobacterium
HNIRVAVDHLRQRGVQD

SEQ ID NO: 675567 - protein, 19 aa, Mycobacterium
HNLIHGFILAAQHLVPGGT

SEQ ID NO: 675568 - protein, 22 aa, Mycobacterium
HNLLDNRVLFGLGLVTDTTTSH

SEQ ID NO: 675569 - protein, 17 aa, Mycobacterium
HNLPAHPAFDWYTERIS

SEQ ID NO: 675570 - protein, 24 aa, Mycobacterium
HNLREIDVSFPLGVLTSVTGVSGS

SEQ ID NO: 675571 - protein, 25 aa, Mycobacterium
HNLRELAEAVFWCLENHDADEEATL

SEQ ID NO: 675572 - protein, 18 aa, Mycobacterium
HNLVHGFILAAEHLTPNG

SEQ ID NO: 675573 - protein, 18 aa, Mycobacterium
HNLVHGFILAAEHLVEGG

SEQ ID NO: 675574 - protein, 18 aa, Mycobacterium
HNPDLRKAMQDEFVHQHK

SEQ ID NO: 675575 - protein, 22 aa, Mycobacterium
HNPFPRTGIRLDRAGVPHYDEI

SEQ ID NO: 675576 - protein, 17 aa, Mycobacterium
HNPHCARIQPAALARGL

SEQ ID NO: 675577 - protein, 20 aa, Mycobacterium
HNPIAIVVPCHRVIGANGSL

SEQ ID NO: 675578 - protein, 19 aa, Mycobacterium
HNPIAIVVPCHRVIGSNGS

SEQ ID NO: 675579 - protein, 19 aa, Mycobacterium
HNPIWPGHGIRILPGPSSL

SEQ ID NO: 675580 - protein, 20 aa, Mycobacterium
HNPRPGVAFETARTWGDDED

SEQ ID NO: 675581 - protein, 18 aa, Mycobacterium
HNPTAVIAWMGYDAPNGF

SEQ ID NO: 675582 - protein, 25 aa, Mycobacterium
HNQIEAFKQVFGREPTSAADWKTAA

SEQ ID NO: 675583 - protein, 21 aa, Mycobacterium
HNRAIAWLLRGSGYIYCDPME

SEQ ID NO: 675584 - protein, 24 aa, Mycobacterium
HNRPEIIELMFAIWAAECVVVPIN

SEQ ID NO: 675585 - protein, 26 aa, Mycobacterium
HNRPKLPRLINMYGITETTVHASFRE

SEQ ID NO: 675586 - protein, 19 aa, Mycobacterium
HNRRVPIHTFGHSMGAVVS

SEQ ID NO: 675587 - protein, 19 aa, Mycobacterium
HNRSWNCGVEGPTDDPDIT

SEQ ID NO: 675588 - protein, 19 aa, Mycobacterium
HNRSWNCGVEGPTDDPEIL

SEQ ID NO: 675589 - protein, 17 aa, Mycobacterium
HNRVRMIAASFLVKDLH

SEQ ID NO: 675590 - protein, 20 aa, Mycobacterium
HNRWHPDIPPAAVVKPGTSF

SEQ ID NO: 675591 - protein, 17 aa, Mycobacterium
HNSPLMWFNGYTNAPDK

SEQ ID NO: 675592 - protein, 18 aa, Mycobacterium
HNSQPWRWVADATAVMLF

SEQ ID NO: 675593 - protein, 17 aa, Mycobacterium
HNSQPWRWVDHGTSVDL

SEQ ID NO: 675594 - protein, 18 aa, Mycobacterium
HNTRGAGLASAYAAVCSG

SEQ ID NO: 675595 - protein, 18 aa, Mycobacterium
HNTRGAGLASAYAAVQAG

SEQ ID NO: 675596 - protein, 18 aa, Mycobacterium
HNTRGSGLASAYAAVQSG

SEQ ID NO: 675597 - protein, 18 aa, Mycobacterium
HNTRGSGLASAYAAVTAG

SEQ ID NO: 675598 - protein, 23 aa, Mycobacterium
HNTWRFGIDRILTGVAMSDDSRA

SEQ ID NO: 675599 - protein, 29 aa, Mycobacterium
HNTYVLCEVLGWRGIWLSEERRRMGNVDL

SEQ ID NO: 675600 - protein, 22 aa, Mycobacterium
HNVAFSKPPIGKRGYNEDEVDA

SEQ ID NO: 675601 - protein, 25 aa, Mycobacterium
HNVGGLPGDLTFKLVEPLRLLFKDE

SEQ ID NO: 675602 - protein, 18 aa, Mycobacterium
HNVILLRAKGIPVIVGAG

SEQ ID NO: 675603 - protein, 25 aa, Mycobacterium
HNVNALRGSRLWDVVGQRSADKAVP

SEQ ID NO: 675604 - protein, 25 aa, Mycobacterium
HNVSCAGLVIGSWPERPGLAETSNR

SEQ ID NO: 675605 - protein, 23 aa, Mycobacterium
HNYWRWTGDPVLPPGLVELIESR

SEQ ID NO: 675606 - protein, 18 aa, Mycobacterium
HPAAIVWAAQMGTVTLHP

SEQ ID NO: 675607 - protein, 34 aa, Mycobacterium
HPAALGAPGRQVWPEIWTAIGPMLAGVVATGRAT

SEQ ID NO: 675608 - protein, 19 aa, Mycobacterium
HPAAMAFDLPAGGNRILQG

SEQ ID NO: 675609 - protein, 17 aa, Mycobacterium
HPAARKRVLGMRRTFNR

SEQ ID NO: 675610 - protein, 23 aa, Mycobacterium
HPACRRAVSCATFDTMEAMARNR

SEQ ID NO: 675611 - protein, 17 aa, Mycobacterium
HPACVELTFAAASLGAA

SEQ ID NO: 675612 - protein, 24 aa, Mycobacterium
HPADRLPIVLGCDAAGFDQDGNEV

SEQ ID NO: 675613 - protein, 31 aa, Mycobacterium
HPAEVFLDLAATWRDKLRWYTVVGNHRPDIV

SEQ ID NO: 675614 - protein, 21 aa, Mycobacterium
HPAEVSRLLSTVARGEANRLI

SEQ ID NO: 675615 - protein, 19 aa, Mycobacterium
HPAHMPRAGLPEEIGPVAA

SEQ ID NO: 675616 - protein, 23 aa, Mycobacterium
HPAKLALELARACTEAGVQIYEH

SEQ ID NO: 675617 - protein, 21 aa, Mycobacterium
HPALRTGLRAALDGLRQEVGD

SEQ ID NO: 675618 - protein, 27 aa, Mycobacterium
HPALVAINRTRLVSLVTSNLLGLNAPA

SEQ ID NO: 675619 - protein, 18 aa, Mycobacterium
HPAPDWTAAALAKAAAAD

SEQ ID NO: 675620 - protein, 18 aa, Mycobacterium
HPAPEGAPTVLLYAHHDV

SEQ ID NO: 675621 - protein, 17 aa, Mycobacterium
HPAPLLFVHGAWHAAWC

SEQ ID NO: 675622 - protein, 18 aa, Mycobacterium
HPARELYARNGFEFPEDE

SEQ ID NO: 675623 - protein, 24 aa, Mycobacterium
HPARPGMFTHWGAGFKFGASLLGL

SEQ ID NO: 675624 - protein, 18 aa, Mycobacterium
HPARWASAQLNLANSLVY

SEQ ID NO: 675625 - protein, 24 aa, Mycobacterium
HPASGAARLLADWTAGQSDGGPSV

SEQ ID NO: 675626 - protein, 25 aa, Mycobacterium
HPASGAARLLADWTRNGEDGPSVIN

SEQ ID NO: 675627 - protein, 27 aa, Mycobacterium
HPATLRRFTGRFTRFNLPDKAVRPAYG

SEQ ID NO: 675628 - protein, 23 aa, Mycobacterium
HPATWRLFLFPPQGAPPELYARL

SEQ ID NO: 675629 - protein, 17 aa, Mycobacterium
HPAVCAAVSALAYEGRL

SEQ ID NO: 675630 - protein, 22 aa, Mycobacterium
HPAVRERLGFEWTDRDEWLHRR

SEQ ID NO: 675631 - protein, 22 aa, Mycobacterium
HPAYDLAAALGLPPTLIRHRKS

SEQ ID NO: 675632 - protein, 21 aa, Mycobacterium
HPCDVFRRHVWINPFHEEDMS

SEQ ID NO: 675633 - protein, 19 aa, Mycobacterium
HPCDVGRAGLPEEVASVTA

SEQ ID NO: 675634 - protein, 25 aa, Mycobacterium
HPDAELCAVGSPVFDELLGLLRMRG

SEQ ID NO: 675635 - protein, 24 aa, Mycobacterium
HPDDARLGPPLQVVVTAARSLLQP

SEQ ID NO: 675636 - protein, 22 aa, Mycobacterium
HPDDVRAGLVLAVGARATADQI

SEQ ID NO: 675637 - protein, 20 aa, Mycobacterium
HPDEACGLLAGPEGSDRPQR

SEQ ID NO: 675638 - protein, 23 aa, Mycobacterium
HPDEPRISAMRAFYRETGQGALA

SEQ ID NO: 675639 - protein, 19 aa, Mycobacterium
HPDERWPAGEFVNQSGPGL

SEQ ID NO: 675640 - protein, 22 aa, Mycobacterium
HPDERWPAGEFVNQSVRDTGLG

SEQ ID NO: 675641 - protein, 34 aa, Mycobacterium
HPDEWKRMGIPLLMSRVRFIYFIGTEIFPGGRLP

SEQ ID NO: 675642 - protein, 24 aa, Mycobacterium
HPDHALAASAAWETFGHDLVRIDD

SEQ ID NO: 675643 - protein, 23 aa, Mycobacterium
HPDHGRPALGFATYGKVKLANLR

SEQ ID NO: 675644 - protein, 19 aa, Mycobacterium
HPDILILEGLNVLQTGPAL

SEQ ID NO: 675645 - protein, 19 aa, Mycobacterium
HPDIVKAYFRARAAPGGQR

SEQ ID NO: 675646 - protein, 18 aa, Mycobacterium
HPDLAWTYHYPLPAVASI

SEQ ID NO: 675647 - protein, 25 aa, Mycobacterium
HPDLEILNHGLTLWDLDRVFKVDGF

SEQ ID NO: 675648 - protein, 25 aa, Mycobacterium
HPDLEILNHGLTLWDLDRVFKVNGF

SEQ ID NO: 675649 - protein, 18 aa, Mycobacterium
HPDLFWSPINSMEDVIGD

SEQ ID NO: 675650 - protein, 18 aa, Mycobacterium
HPDLGWVEPFVAFEGLEY

SEQ ID NO: 675651 - protein, 18 aa, Mycobacterium
HPDLKFVFADGGYDILTP

SEQ ID NO: 675652 - protein, 23 aa, Mycobacterium
HPDLRCLMLTSFTSDEAMLEAIL

SEQ ID NO: 675653 - protein, 17 aa, Mycobacterium
HPDQWRLLGERPDLGGK

SEQ ID NO: 675654 - protein, 24 aa, Mycobacterium
HPDRRIALEIPEMLADIRALADAA

SEQ ID NO: 675655 - protein, 19 aa, Mycobacterium
HPDRVELPYVRDPDTDTPL

SEQ ID NO: 675656 - protein, 22 aa, Mycobacterium
HPDRVRSALLLAVGARATADQI

SEQ ID NO: 675657 - protein, 31 aa, Mycobacterium
HPDVDGPYSWWSWRGKAFDNDAGWRIDYHLA

SEQ ID NO: 675658 - protein, 21 aa, Mycobacterium
HPDVFRKASPMARIHSEAPPF

SEQ ID NO: 675659 - protein, 22 aa, Mycobacterium
HPDVGLVWCELIQGMSCVAIPA

SEQ ID NO: 675660 - protein, 17 aa, Mycobacterium
HPDVIAALARRGITDMD

SEQ ID NO: 675661 - protein, 19 aa, Mycobacterium
HPDVLRYIVALAAATRSHS

SEQ ID NO: 675662 - protein, 17 aa, Mycobacterium
HPDVPFRFYYGARFVRD

SEQ ID NO: 675663 - protein, 25 aa, Mycobacterium
HPDWPRRRAAGMATLIVAFMDGLVL

SEQ ID NO: 675664 - protein, 23 aa, Mycobacterium
HPDWSVPFVAWGYHPLWHGPIGR

SEQ ID NO: 675665 - protein, 20 aa, Mycobacterium
HPEAPLPAVHLSDKLLTDAE

SEQ ID NO: 675666 - protein, 18 aa, Mycobacterium
HPEAVFGSAFGLAQEKQV

SEQ ID NO: 675667 - protein, 18 aa, Mycobacterium
HPECAAVIAEVWTLLDGE

SEQ ID NO: 675668 - protein, 21 aa, Mycobacterium
HPECFLRGAYTPVLASGTAED

SEQ ID NO: 675669 - protein, 21 aa, Mycobacterium
HPECGCATSALYLAGEGAVPA

SEQ ID NO: 675670 - protein, 21 aa, Mycobacterium
HPECGCATSALYLAGEGAVPE

SEQ ID NO: 675671 - protein, 25 aa, Mycobacterium
HPEDTRLGPPLRVVVTAVRSLLQPM

SEQ ID NO: 675672 - protein, 32 aa, Mycobacterium
HPEELSEAFAKAWYKLLHRDMGPISRYLGPWV

SEQ ID NO: 675673 - protein, 17 aa, Mycobacterium
HPEFIGPDARRNEIVSF

SEQ ID NO: 675674 - protein, 25 aa, Mycobacterium
HPEFRPLVRRLSRFLPSDVRVIDIV

SEQ ID NO: 675675 - protein, 17 aa, Mycobacterium
HPEGGWYGETWRSDVVF

SEQ ID NO: 675676 - protein, 19 aa, Mycobacterium
HPEGVLVVWIDLAEQRPFT

SEQ ID NO: 675677 - protein, 21 aa, Mycobacterium
HPEHPEYGFAGYVSHFIDKPT

SEQ ID NO: 675678 - protein, 17 aa, Mycobacterium
HPEIEFFLLKAGADDGT

SEQ ID NO: 675679 - protein, 24 aa, Mycobacterium
HPEIFKEYFGSVIPAGDNKFSALN

SEQ ID NO: 675680 - protein, 24 aa, Mycobacterium
HPEIREVRRPDFCGHYIGESGPKT

SEQ ID NO: 675681 - protein, 21 aa, Mycobacterium
HPELFSSASGIVIGDQTPELA

SEQ ID NO: 675682 - protein, 22 aa, Mycobacterium
HPELRARHLALAASSGDDEIFA

SEQ ID NO: 675683 - protein, 19 aa, Mycobacterium
HPEMPDWHLHLASVDDPLW

SEQ ID NO: 675684 - protein, 20 aa, Mycobacterium
HPEMPEWHLHLASIHDPLWQ

SEQ ID NO: 675685 - protein, 18 aa, Mycobacterium
HPEPAGAAGRVRQPHLGE

SEQ ID NO: 675686 - protein, 24 aa, Mycobacterium
HPEPVDGSALGWLVDGHATLPPER

SEQ ID NO: 675687 - protein, 18 aa, Mycobacterium
HPEQEWIVGASYDGSLAS

SEQ ID NO: 675688 - protein, 26 aa, Mycobacterium
HPETGRKVLLLGHFVKHFVGLGQAES

SEQ ID NO: 675689 - protein, 21 aa, Mycobacterium
HPEVDSLLLAAGQLFASGADL

SEQ ID NO: 675690 - protein, 19 aa, Mycobacterium
HPEVGAAMAERAEVLATQR

SEQ ID NO: 675691 - protein, 17 aa, Mycobacterium
HPEVIAALLGRGITDIG

SEQ ID NO: 675692 - protein, 18 aa, Mycobacterium
HPEVVSWADFFAAQRKHR

SEQ ID NO: 675693 - protein, 31 aa, Mycobacterium
HPFAILAPVLRFPLEPILGFVYRRLGDTQAS

SEQ ID NO: 675694 - protein, 24 aa, Mycobacterium
HPFATRYRRQWDWFSYFYNALAAR

SEQ ID NO: 675695 - protein, 20 aa, Mycobacterium
HPFDLLARARFRVTVNTDNR

SEQ ID NO: 675696 - protein, 22 aa, Mycobacterium
HPFDLLARLRFRVTVNTDNRLM

SEQ ID NO: 675697 - protein, 20 aa, Mycobacterium
HPFDLLARSRFRVTVNTDNR

SEQ ID NO: 675698 - protein, 18 aa, Mycobacterium
HPFEKLWRDKLSALAETA

SEQ ID NO: 675699 - protein, 20 aa, Mycobacterium
HPFGGSWGYQVTSYYAPSSR

SEQ ID NO: 675700 - protein, 20 aa, Mycobacterium
HPFGGSWGYQVTSYYAPTSR

SEQ ID NO: 675701 - protein, 20 aa, Mycobacterium
HPFKRARTTFTYIAVAIAGN

SEQ ID NO: 675702 - protein, 19 aa, Mycobacterium
HPFKRARTTFTYLAVATNG

SEQ ID NO: 675703 - protein, 26 aa, Mycobacterium
HPFLSGRPGRMLALRRFIEYALECGD

SEQ ID NO: 675704 - protein, 17 aa, Mycobacterium
HPFVTCTNCGPRLTVIR

SEQ ID NO: 675705 - protein, 18 aa, Mycobacterium
HPGACALARGQPALGDEF

SEQ ID NO: 675706 - protein, 19 aa, Mycobacterium
HPGALRLYGTVYDGAGDGV

SEQ ID NO: 675707 - protein, 24 aa, Mycobacterium
HPGAPGWVSTRGWIYSRRRNAYAL

SEQ ID NO: 675708 - protein, 23 aa, Mycobacterium
HPGCDAPGYWCEVHHLDEWATGG

SEQ ID NO: 675709 - protein, 25 aa, Mycobacterium
HPGCVVGGTAWDFANGNRVPPGSLD

SEQ ID NO: 675710 - protein, 17 aa, Mycobacterium
HPGDAFCYDIFSQIGGL

SEQ ID NO: 675711 - protein, 19 aa, Mycobacterium
HPGEFIYRVWTPMNSPIKD

SEQ ID NO: 675712 - protein, 19 aa, Mycobacterium
HPGEIAFIHYARTADEACY

SEQ ID NO: 675713 - protein, 24 aa, Mycobacterium
HPGERRLAVELALELTHHIGPRVL

SEQ ID NO: 675714 - protein, 30 aa, Mycobacterium
HPGGSLVAFGWFSWRSAIGTAGFDTTGVST

SEQ ID NO: 675715 - protein, 17 aa, Mycobacterium
HPGGVVVFAHGSGSSRH

SEQ ID NO: 675716 - protein, 28 aa, Mycobacterium
HPGHLVTRWLATYGFHRRALAVAGPRIL

SEQ ID NO: 675717 - protein, 21 aa, Mycobacterium
HPGHYAVMFDWSLIDRTDSDL

SEQ ID NO: 675718 - protein, 18 aa, Mycobacterium
HPGIGCFVVRNGRFLMGR

SEQ ID NO: 675719 - protein, 24 aa, Mycobacterium
HPGKTWTGLSLRWLQERGQDASYD

SEQ ID NO: 675720 - protein, 31 aa, Mycobacterium
HPGLDRILQWDLRFGMDVVDALGPHVTDPAL

SEQ ID NO: 675721 - protein, 24 aa, Mycobacterium
HPGLLRFTLGLGQTLALIMNADVA

SEQ ID NO: 675722 - protein, 21 aa, Mycobacterium
HPGLLRFTSGFGQTTSRLLRG

SEQ ID NO: 675723 - protein, 23 aa, Mycobacterium
HPGLPRLINLYGITETTVHASFR

SEQ ID NO: 675724 - protein, 19 aa, Mycobacterium
HPGLPRLINMYGTTETTVH

SEQ ID NO: 675725 - protein, 25 aa, Mycobacterium
HPGNYRFGLDGSLGIVDFGSVKNLR

SEQ ID NO: 675726 - protein, 17 aa, Mycobacterium
HPGPRLRDYVLAVKACF

SEQ ID NO: 675727 - protein, 21 aa, Mycobacterium
HPGPRWLVGDLAELDLPARGI

SEQ ID NO: 675728 - protein, 22 aa, Mycobacterium
HPGPRWLVGDLAELDLPARGIA

SEQ ID NO: 675729 - protein, 22 aa, Mycobacterium
HPGPRWLVGDLAELDLPSRGIS

SEQ ID NO: 675730 - protein, 25 aa, Mycobacterium
HPGPTRTSMGWSLPAEKIGPALEDW

SEQ ID NO: 675731 - protein, 19 aa, Mycobacterium
HPGQEPVAVFALDRPALEA

SEQ ID NO: 675732 - protein, 21 aa, Mycobacterium
HPGQRVLPVPQLRGDGAARIV

SEQ ID NO: 675733 - protein, 22 aa, Mycobacterium
HPGTDALLLFAILHTLAERGWI

SEQ ID NO: 675734 - protein, 19 aa, Mycobacterium
HPGTGALLRAVWAESTNQL

SEQ ID NO: 675735 - protein, 22 aa, Mycobacterium
HPGVCFRYLDLPAESPFPDAPS

SEQ ID NO: 675736 - protein, 20 aa, Mycobacterium
HPGVDFIWVTGGPKIVALAN

SEQ ID NO: 675737 - protein, 19 aa, Mycobacterium
HPGVDWAEVVTRWRAGYFT

SEQ ID NO: 675738 - protein, 24 aa, Mycobacterium
HPGVFAVGDVVRWRHPGHKEDVRV

SEQ ID NO: 675739 - protein, 22 aa, Mycobacterium
HPGVRYRAFDLFEAGPDRIARI

SEQ ID NO: 675740 - protein, 19 aa, Mycobacterium
HPGYVRRAKGITVPGRQLF

SEQ ID NO: 675741 - protein, 17 aa, Mycobacterium
HPHGVPASGEYRIDDLA

SEQ ID NO: 675742 - protein, 20 aa, Mycobacterium
HPHHRGLREPFAAEVHHVNP

SEQ ID NO: 675743 - protein, 19 aa, Mycobacterium
HPHPRYDRHRTLQRIRDRE

SEQ ID NO: 675744 - protein, 19 aa, Mycobacterium
HPHRDMEIITWVLHGSLVH

SEQ ID NO: 675745 - protein, 17 aa, Mycobacterium
HPHSRMLNRVKVHPQMI

SEQ ID NO: 675746 - protein, 21 aa, Mycobacterium
HPHTWSSAPNFAFDLAARKTT

SEQ ID NO: 675747 - protein, 21 aa, Mycobacterium
HPHVERPRRVRQPGEPLRVGV

SEQ ID NO: 675748 - protein, 18 aa, Mycobacterium
HPHVRDCAVVGADDPQWG

SEQ ID NO: 675749 - protein, 27 aa, Mycobacterium
HPHWWQAPLRWSIRGALAARSAIVVRA

SEQ ID NO: 675750 - protein, 21 aa, Mycobacterium
HPIAQGGMQWVGRAELVAAVA

SEQ ID NO: 675751 - protein, 27 aa, Mycobacterium
HPIEPGRPCWLVGLLFPGADGCAGHSD

SEQ ID NO: 675752 - protein, 27 aa, Mycobacterium
HPIEPGRPCWLVGLLFPSADGCAGHSD

SEQ ID NO: 675753 - protein, 20 aa, Mycobacterium
HPIGGWRGGVAHIYGHGNAK

SEQ ID NO: 675754 - protein, 19 aa, Mycobacterium
HPIGLDFAALIVESEAALK

SEQ ID NO: 675755 - protein, 19 aa, Mycobacterium
HPIKRARTTFTYLAVSTNG

SEQ ID NO: 675756 - protein, 18 aa, Mycobacterium
HPIKRARTTFTYVAVASA

SEQ ID NO: 675757 - protein, 25 aa, Mycobacterium
HPILYVAQMWDWIYPLGEDPDYEPD

SEQ ID NO: 675758 - protein, 27 aa, Mycobacterium
HPIPPGSLIWKYWGRLDVSFFGNAAMG

SEQ ID NO: 675759 - protein, 17 aa, Mycobacterium
HPIRLPLRVFRRRRARI

SEQ ID NO: 675760 - protein, 18 aa, Mycobacterium
HPIVARLAAVSGEAAVVH

SEQ ID NO: 675761 - protein, 19 aa, Mycobacterium
HPKALEVVDALPRNPSGKV

SEQ ID NO: 675762 - protein, 24 aa, Mycobacterium
HPKALRRRLAAEGTNFNAVVDDVR

SEQ ID NO: 675763 - protein, 19 aa, Mycobacterium
HPKARRLVRHAHWPEDWHP

SEQ ID NO: 675764 - protein, 22 aa, Mycobacterium
HPKIRVVTTALRLRRSRPESFR

SEQ ID NO: 675765 - protein, 21 aa, Mycobacterium
HPKIRVVTTALRVRRAHPDSF

SEQ ID NO: 675766 - protein, 25 aa, Mycobacterium
HPKKLLRPKVPIAVVVGEPIEPTLG

SEQ ID NO: 675767 - protein, 26 aa, Mycobacterium
HPKMARRFLTFNGWLLQRGELPLRLR

SEQ ID NO: 675768 - protein, 17 aa, Mycobacterium
HPKMRVVRAALQARAER

SEQ ID NO: 675769 - protein, 18 aa, Mycobacterium
HPKYDPIWAAATKHDITV

SEQ ID NO: 675770 - protein, 19 aa, Mycobacterium
HPLAGFLVGVIGRAQSAGQ

SEQ ID NO: 675771 - protein, 20 aa, Mycobacterium
HPLAGIVYLAAQPLPVSDHR

SEQ ID NO: 675772 - protein, 17 aa, Mycobacterium
HPLAGLVHLGEGCDVRP

SEQ ID NO: 675773 - protein, 19 aa, Mycobacterium
HPLAGLVHLGEGCDVRPVL

SEQ ID NO: 675774 - protein, 26 aa, Mycobacterium
HPLAHLRAFVLIPWLAVDPDARLTVA

SEQ ID NO: 675775 - protein, 20 aa, Mycobacterium
HPLDCLTCPANGDCELQDMA

SEQ ID NO: 675776 - protein, 19 aa, Mycobacterium
HPLDVEGWRGDNFPFTFNI

SEQ ID NO: 675777 - protein, 23 aa, Mycobacterium
HPLEVGRDWAAWAPRAALRTFTL

SEQ ID NO: 675778 - protein, 18 aa, Mycobacterium
HPLFAHITLLRSERSPIA

SEQ ID NO: 675779 - protein, 19 aa, Mycobacterium
HPLFPAVVGTAARVAWARA

SEQ ID NO: 675780 - protein, 24 aa, Mycobacterium
HPLGATGLAQCAELTWQLRGTAEA

SEQ ID NO: 675781 - protein, 20 aa, Mycobacterium
HPLGATGLAQCSELTWQLRG

SEQ ID NO: 675782 - protein, 24 aa, Mycobacterium
HPLGATGLAQCSELTWQLRGTADK

SEQ ID NO: 675783 - protein, 19 aa, Mycobacterium
HPLGDCWPHDAVPGPGPSA

SEQ ID NO: 675784 - protein, 18 aa, Mycobacterium
HPLGHRWRWEFVALSPTS

SEQ ID NO: 675785 - protein, 19 aa, Mycobacterium
HPLGYIATDVYARFHRMRG

SEQ ID NO: 675786 - protein, 19 aa, Mycobacterium
HPLHKVGRAVNKFNDKVPY

SEQ ID NO: 675787 - protein, 17 aa, Mycobacterium
HPLIRMVALESQLKSDR

SEQ ID NO: 675788 - protein, 19 aa, Mycobacterium
HPLISRAHLLLRFDQGRWL

SEQ ID NO: 675789 - protein, 26 aa, Mycobacterium
HPLLASVPVSFDFSRDRISGNYFTGV

SEQ ID NO: 675790 - protein, 17 aa, Mycobacterium
HPLLRGDSLVARMTAVE

SEQ ID NO: 675791 - protein, 28 aa, Mycobacterium
HPLMVAINRNRFVQLVASNVLGLNAPAI

SEQ ID NO: 675792 - protein, 17 aa, Mycobacterium
HPLPDDRVEAIFTTGKR

SEQ ID NO: 675793 - protein, 28 aa, Mycobacterium
HPLQGCYRIAVLSLKGGVGKTTITATLG

SEQ ID NO: 675794 - protein, 24 aa, Mycobacterium
HPLQGPELLAAAVLESQKMIEQRD

SEQ ID NO: 675795 - protein, 19 aa, Mycobacterium
HPLQQLIRRLWACRDQKHW

SEQ ID NO: 675796 - protein, 25 aa, Mycobacterium
HPLVGRWVPDFAVANSRGTTRVAEL

SEQ ID NO: 675797 - protein, 25 aa, Mycobacterium
HPLVTREVFGPVVGVIDVADYQEGL

SEQ ID NO: 675798 - protein, 25 aa, Mycobacterium
HPMAGYRSAEPFALDAGRMCVTMTR

SEQ ID NO: 675799 - protein, 19 aa, Mycobacterium
HPMCLEIRPYTTGFAAMAG

SEQ ID NO: 675800 - protein, 24 aa, Mycobacterium
HPMEVPAFALALMRRSLSGSNIGG

SEQ ID NO: 675801 - protein, 18 aa, Mycobacterium
HPMFRDGVVRALQSSGAI

SEQ ID NO: 675802 - protein, 21 aa, Mycobacterium
HPMFVPWLVGPLLTREGIHLV

SEQ ID NO: 675803 - protein, 18 aa, Mycobacterium
HPMHVGGLQLFELPNGAG

SEQ ID NO: 675804 - protein, 24 aa, Mycobacterium
HPMLRAMLAHRWLAGVALGVFDRR

SEQ ID NO: 675805 - protein, 38 aa, Mycobacterium
HPMLVLGPEVDRAGAWDAGIEFAEKLGAPVHASALPDR

SEQ ID NO: 675806 - protein, 24 aa, Mycobacterium
HPMSPDFDDSIAFLAAQDLILSGA

SEQ ID NO: 675807 - protein, 31 aa, Mycobacterium
HPNEVIWGHGWDESRWPDGRPLTTTELDTAA

SEQ ID NO: 675808 - protein, 24 aa, Mycobacterium
HPNLAARFCPQFGEPVQVIPADPV

SEQ ID NO: 675809 - protein, 25 aa, Mycobacterium
HPNLAARFCPQFGQPVQVIPADPAM

SEQ ID NO: 675810 - protein, 24 aa, Mycobacterium
HPNLVARFCTRFGEPVQVIPADPM

SEQ ID NO: 675811 - protein, 26 aa, Mycobacterium
HPNRSARNHLRWIAAANDISAQRVDE

SEQ ID NO: 675812 - protein, 31 aa, Mycobacterium
HPNRSARSHLRWIAAANRIPASRVDEVLEMV

SEQ ID NO: 675813 - protein, 28 aa, Mycobacterium
HPNTVRYRLRRIADFTGRDPAVPRDAYV

SEQ ID NO: 675814 - protein, 21 aa, Mycobacterium
HPNVLRFIVHGHFINSSDGTE

SEQ ID NO: 675815 - protein, 25 aa, Mycobacterium
HPPAPVCRYCRSRDVGLRAVSGRAA

SEQ ID NO: 675816 - protein, 17 aa, Mycobacterium
HPPDVVILDLGLPDISG

SEQ ID NO: 675817 - protein, 21 aa, Mycobacterium
HPPEAIGPRYVEAIGGIDRTL

SEQ ID NO: 675818 - protein, 26 aa, Mycobacterium
HPPEELAPRYVEAMGGIDQVVELAQQ

SEQ ID NO: 675819 - protein, 25 aa, Mycobacterium
HPPEGFLLDRRWEHLVPDAPYEVRF

SEQ ID NO: 675820 - protein, 22 aa, Mycobacterium
HPPEVPADLVARALTVPLVRRG

SEQ ID NO: 675821 - protein, 17 aa, Mycobacterium
HPPFAAFDPVLAVALAK

SEQ ID NO: 675822 - protein, 21 aa, Mycobacterium
HPPFRWQRRYAEGFGEQVAAL

SEQ ID NO: 675823 - protein, 20 aa, Mycobacterium
HPPFRWQRRYAEGFSDQVAA

SEQ ID NO: 675824 - protein, 21 aa, Mycobacterium
HPPFRWQRRYAEGFSEQVAAL

SEQ ID NO: 675825 - protein, 21 aa, Mycobacterium
HPPFRWQRRYAEGFSEQVAKL

SEQ ID NO: 675826 - protein, 19 aa, Mycobacterium
HPPPLLVGGEGSRYLEPSG

SEQ ID NO: 675827 - protein, 23 aa, Mycobacterium
HPPPPPRPAAFAPPARGATPNRH

SEQ ID NO: 675828 - protein, 17 aa, Mycobacterium
HPPPRRVMRGHVVGEQA

SEQ ID NO: 675829 - protein, 26 aa, Mycobacterium
HPPRSLWCDGRAGGGGPDIAQFMLVH

SEQ ID NO: 675830 - protein, 25 aa, Mycobacterium
HPPTRPDVLFVWQVAVARSAQGTGL

SEQ ID NO: 675831 - protein, 18 aa, Mycobacterium
HPQFDPAQHMQRMALPSP

SEQ ID NO: 675832 - protein, 17 aa, Mycobacterium
HPQGRELFCELVEKSDI

SEQ ID NO: 675833 - protein, 19 aa, Mycobacterium
HPQHRGLREPFGAQVSHVN

SEQ ID NO: 675834 - protein, 19 aa, Mycobacterium
HPQHRGLREPFGAQVYHVN

SEQ ID NO: 675835 - protein, 26 aa, Mycobacterium
HPQLSLLRLGATLGFTVVALDRPGHG

SEQ ID NO: 675836 - protein, 19 aa, Mycobacterium
HPQPPRPGGASSPSPPLDL

SEQ ID NO: 675837 - protein, 23 aa, Mycobacterium
HPQQRVAMRVAWQALENAGVNPG

SEQ ID NO: 675838 - protein, 17 aa, Mycobacterium
HPQSLPYAGRWVGHEGV

SEQ ID NO: 675839 - protein, 19 aa, Mycobacterium
HPRAARCSAEAARVLAEAA

SEQ ID NO: 675840 - protein, 25 aa, Mycobacterium
HPRAHLRAFVLVPWLALEPGAVLTV

SEQ ID NO: 675841 - protein, 31 aa, Mycobacterium
HPRDKVGYHWSRPEYWRDLGRTMERGLFDAM

SEQ ID NO: 675842 - protein, 17 aa, Mycobacterium
HPRGELRLKSETMFPGY

SEQ ID NO: 675843 - protein, 24 aa, Mycobacterium
HPRGRGLMCAFDLPTTADRDELIQ

SEQ ID NO: 675844 - protein, 24 aa, Mycobacterium
HPRGRGLMCAFSLPTTADRDDVIR

SEQ ID NO: 675845 - protein, 20 aa, Mycobacterium
HPRLRRFLRRLPQVDGVAAF

SEQ ID NO: 675846 - protein, 17 aa, Mycobacterium
HPRLVVLDMSRRYGGDF

SEQ ID NO: 675847 - protein, 17 aa, Mycobacterium
HPRLVVVDMSRRYAADF

SEQ ID NO: 675848 - protein, 26 aa, Mycobacterium
HPRPDFKNRILRAFFEGNRHRPRSTF

SEQ ID NO: 675849 - protein, 25 aa, Mycobacterium
HPRPGWAEQDPRDWWAAITAATREL

SEQ ID NO: 675850 - protein, 24 aa, Mycobacterium
HPRPLSSPHPPIWIGGNTTASRQR

SEQ ID NO: 675851 - protein, 18 aa, Mycobacterium
HPRRAAVSSYGLSGTNVH

SEQ ID NO: 675852 - protein, 17 aa, Mycobacterium
HPRRAVIDRAWRAIGPG

SEQ ID NO: 675853 - protein, 18 aa, Mycobacterium
HPRRFAYGVPTESVHWVT

SEQ ID NO: 675854 - protein, 26 aa, Mycobacterium
HPRTRVLELCRSWAADLVVVGTGARS

SEQ ID NO: 675855 - protein, 19 aa, Mycobacterium
HPRVLAALDRLLMPNYLLS

SEQ ID NO: 675856 - protein, 18 aa, Mycobacterium
HPRVTFVGVAARDQVSAM

SEQ ID NO: 675857 - protein, 28 aa, Mycobacterium
HPSAAYLFRCVQRAMAAGRIDGSPEDAA

SEQ ID NO: 675858 - protein, 23 aa, Mycobacterium
HPSAIAALGIREWDAVSLTGSRT

SEQ ID NO: 675859 - protein, 25 aa, Mycobacterium
HPSAWRHQRDPLAFLTPDYFVEIGQ

SEQ ID NO: 675860 - protein, 17 aa, Mycobacterium
HPSEDRGGWTFQVHSRP

SEQ ID NO: 675861 - protein, 19 aa, Mycobacterium
HPSEIRVGDVIGTVRPTHV

SEQ ID NO: 675862 - protein, 21 aa, Mycobacterium
HPSFEVPKTYVATVMGTVPRG

SEQ ID NO: 675863 - protein, 23 aa, Mycobacterium
HPSKPDCPILRDIETAAATTSTA

SEQ ID NO: 675864 - protein, 20 aa, Mycobacterium
HPSLPRGSLLQVVDEERPSL

SEQ ID NO: 675865 - protein, 20 aa, Mycobacterium
HPSLWRMDALYAKTRGHSPQ

SEQ ID NO: 675866 - protein, 21 aa, Mycobacterium
HPSMKALVVCIELSSVNAVFA

SEQ ID NO: 675867 - protein, 23 aa, Mycobacterium
HPSRSRLAMAMGAIRARQSLDSA

SEQ ID NO: 675868 - protein, 25 aa, Mycobacterium
HPSTLCVAGLVAIWRYHRGDEGSVD

SEQ ID NO: 675869 - protein, 32 aa, Mycobacterium
HPTARISVVVDELWRAHGLAEMIEQAGLTAEI

SEQ ID NO: 675870 - protein, 28 aa, Mycobacterium
HPTAWLAEGVLIGWLPPEAELRLLDSII

SEQ ID NO: 675871 - protein, 28 aa, Mycobacterium
HPTDPGFLLGHNVAGLWAERTRIPASVV

SEQ ID NO: 675872 - protein, 18 aa, Mycobacterium
HPTLDWTYGVDMLTLESA

SEQ ID NO: 675873 - protein, 18 aa, Mycobacterium
HPTLPTTPWQHTRHWVDA

SEQ ID NO: 675874 - protein, 23 aa, Mycobacterium
HPTMWDALCWAMREAKAGRFPAR

SEQ ID NO: 675875 - protein, 18 aa, Mycobacterium
HPTPGWWDGVAGPGAPID

SEQ ID NO: 675876 - protein, 26 aa, Mycobacterium
HPTRLHWYVPPSVRWIDRLKGVSPEF

SEQ ID NO: 675877 - protein, 26 aa, Mycobacterium
HPTRLHWYVPQSIRWIDRLKGVSPEL

SEQ ID NO: 675878 - protein, 20 aa, Mycobacterium
HPTSLMLPGPGVRRRMVDLI

SEQ ID NO: 675879 - protein, 22 aa, Mycobacterium
HPTSQFRDLICSRAVDIAIGPA

SEQ ID NO: 675880 - protein, 18 aa, Mycobacterium
HPVAFPIGFGRVGDELVI

SEQ ID NO: 675881 - protein, 17 aa, Mycobacterium
HPVDAWLQRALDIAADH

SEQ ID NO: 675882 - protein, 17 aa, Mycobacterium
HPVDGWMSATWFQGPAA

SEQ ID NO: 675883 - protein, 24 aa, Mycobacterium
HPVDKLRYSVFSWQRVTLLERTHM

SEQ ID NO: 675884 - protein, 30 aa, Mycobacterium
HPVEMLLPLHHLKAAGFGIDVATVSGNPAK

SEQ ID NO: 675885 - protein, 19 aa, Mycobacterium
HPVEVWGWDEAYVGARVSD

SEQ ID NO: 675886 - protein, 17 aa, Mycobacterium
HPVGFQWVIEAKARGTE

SEQ ID NO: 675887 - protein, 17 aa, Mycobacterium
HPVGFQWVIEAKTRGAQ

SEQ ID NO: 675888 - protein, 17 aa, Mycobacterium
HPVGFQWVMEAKANGAE

SEQ ID NO: 675889 - protein, 17 aa, Mycobacterium
HPVGFQWVMEAKSRGTE

SEQ ID NO: 675890 - protein, 17 aa, Mycobacterium
HPVIGPFFNRGLMMLDF

SEQ ID NO: 675891 - protein, 18 aa, Mycobacterium
HPVKRARTTFTYLAVATR

SEQ ID NO: 675892 - protein, 23 aa, Mycobacterium
HPVLEWITGTALVPVRERLDDAG

SEQ ID NO: 675893 - protein, 23 aa, Mycobacterium
HPVLEWITGTALVPVRERLDDDT

SEQ ID NO: 675894 - protein, 25 aa, Mycobacterium
HPVMVKAQVKIGGRGKAGGVKYAAT

SEQ ID NO: 675895 - protein, 28 aa, Mycobacterium
HPVPEVTRYEAWSFPDFATGADALRAVV

SEQ ID NO: 675896 - protein, 17 aa, Mycobacterium
HPVPVLLSALSPRMLRV

SEQ ID NO: 675897 - protein, 20 aa, Mycobacterium
HPVTGWRGGVAHIYGHGNAK

SEQ ID NO: 675898 - protein, 24 aa, Mycobacterium
HPVVAELKAAGALDEAGNVDPMIR

SEQ ID NO: 675899 - protein, 20 aa, Mycobacterium
HPVVCSLGVPTRHLDLQFVA

SEQ ID NO: 675900 - protein, 20 aa, Mycobacterium
HPVYYLPQWDTFAISRFDDI

SEQ ID NO: 675901 - protein, 21 aa, Mycobacterium
HPWEDARVVPLPLDLTDPQSI

SEQ ID NO: 675902 - protein, 25 aa, Mycobacterium
HPWEREWSYGWSLMRIGALLRRTDM

SEQ ID NO: 675903 - protein, 23 aa, Mycobacterium
HPWLPGFEPPYVIAVVALDECAE

SEQ ID NO: 675904 - protein, 17 aa, Mycobacterium
HPWRRAGSGEVRPGDLV

SEQ ID NO: 675905 - protein, 26 aa, Mycobacterium
HPYCPAVTVACGFSGHGFKFVPVVGE

SEQ ID NO: 675906 - protein, 18 aa, Mycobacterium
HPYIELYLGESFFSAPQL

SEQ ID NO: 675907 - protein, 21 aa, Mycobacterium
HPYLDTVLFLLGITRGEIEAA

SEQ ID NO: 675908 - protein, 22 aa, Mycobacterium
HPYRVRHLLDRYGSMIGDVLGL

SEQ ID NO: 675909 - protein, 24 aa, Mycobacterium
HQACQALRLGECDLALAGGANVIL

SEQ ID NO: 675910 - protein, 24 aa, Mycobacterium
HQACQALRLGECDLALAGGANVLL

SEQ ID NO: 675911 - protein, 18 aa, Mycobacterium
HQACQALRLNECDLALAG

SEQ ID NO: 675912 - protein, 20 aa, Mycobacterium
HQAIGVAFGGTVDRAPELLH

SEQ ID NO: 675913 - protein, 26 aa, Mycobacterium
HQAVGPRCRRVWLVTMCGEQVDARAP

SEQ ID NO: 675914 - protein, 26 aa, Mycobacterium
HQDAFPLLITHGWPGSVVEFHKVIEP

SEQ ID NO: 675915 - protein, 19 aa, Mycobacterium
HQDAGGPAVAWVHGLEYQR

SEQ ID NO: 675916 - protein, 23 aa, Mycobacterium
HQDLPFDRVVDAVSPVRSLSRNP

SEQ ID NO: 675917 - protein, 18 aa, Mycobacterium
HQDTTPMYREWADKIRNY

SEQ ID NO: 675918 - protein, 27 aa, Mycobacterium
HQDYPFALLVERLRPSRDLSYTPLVQV

SEQ ID NO: 675919 - protein, 18 aa, Mycobacterium
HQFIKEEVGAIVAALDAA

SEQ ID NO: 675920 - protein, 17 aa, Mycobacterium
HQFPDNRGLKGLAKDLG

SEQ ID NO: 675921 - protein, 23 aa, Mycobacterium
HQGHSYWWGGNLMGVKDRPIVLN

SEQ ID NO: 675922 - protein, 20 aa, Mycobacterium
HQGLSHPLAHAKIQLELARL

SEQ ID NO: 675923 - protein, 23 aa, Mycobacterium
HQGQHAYLGYGLMSKRLRDPAYS

SEQ ID NO: 675924 - protein, 17 aa, Mycobacterium
HQHAQWWDQEGPRVRER

SEQ ID NO: 675925 - protein, 25 aa, Mycobacterium
HQHFPRLRLELDRGLGWKAEVEAAL

SEQ ID NO: 675926 - protein, 19 aa, Mycobacterium
HQHRCLRLDVPRANLHVFG

SEQ ID NO: 675927 - protein, 20 aa, Mycobacterium
HQIDPALPFGGYKQSGLGRE

SEQ ID NO: 675928 - protein, 17 aa, Mycobacterium
HQIGRKAIAQNAADIEA

SEQ ID NO: 675929 - protein, 27 aa, Mycobacterium
HQIVLWCMGEAHAGVVLDGLANRYGVT

SEQ ID NO: 675930 - protein, 23 aa, Mycobacterium
HQLCPSCAALNRAKRDARTDLTG

SEQ ID NO: 675931 - protein, 20 aa, Mycobacterium
HQLFPLLAHVVLFGGGHAQR

SEQ ID NO: 675932 - protein, 20 aa, Mycobacterium
HQLFPLLAHVVLFGGGYARQ

SEQ ID NO: 675933 - protein, 17 aa, Mycobacterium
HQLGADIIFAFDELTTL

SEQ ID NO: 675934 - protein, 18 aa, Mycobacterium
HQLGYGVESVRSWVRQAD

SEQ ID NO: 675935 - protein, 25 aa, Mycobacterium
HQLHALSLRDARVHARLSPRHLEDA

SEQ ID NO: 675936 - protein, 18 aa, Mycobacterium
HQLPVPPAFCITTAVGLR

SEQ ID NO: 675937 - protein, 19 aa, Mycobacterium
HQLREFMVDAGFLTADSGL

SEQ ID NO: 675938 - protein, 17 aa, Mycobacterium
HQLRRAAPEVDFLAVND

SEQ ID NO: 675939 - protein, 23 aa, Mycobacterium
HQLWAETRIELFAQSTDTRPEEL

SEQ ID NO: 675940 - protein, 20 aa, Mycobacterium
HQLWAETRIELFTQSTDTRP

SEQ ID NO: 675941 - protein, 19 aa, Mycobacterium
HQLWAETRIEVFTQSTDTR

SEQ ID NO: 675942 - protein, 21 aa, Mycobacterium
HQMGAMCLLIAQSTIQSAQMV

SEQ ID NO: 675943 - protein, 22 aa, Mycobacterium
HQMPGRDMGKMPGMGGSGHGMM

SEQ ID NO: 675944 - protein, 18 aa, Mycobacterium
HQMRRALADLPAIRVDAS

SEQ ID NO: 675945 - protein, 17 aa, Mycobacterium
HQMRYDLNAGFPLITTK

SEQ ID NO: 675946 - protein, 24 aa, Mycobacterium
HQMRYDLSAGFPLITTKKVHTKSV

SEQ ID NO: 675947 - protein, 24 aa, Mycobacterium
HQNAMRWYSFDPFTHVPREQATVG

SEQ ID NO: 675948 - protein, 24 aa, Mycobacterium
HQNSRWIIEPVLRLLDCCQESDGG

SEQ ID NO: 675949 - protein, 24 aa, Mycobacterium
HQNSRWIVEPVLRLLDCCQESDGG

SEQ ID NO: 675950 - protein, 23 aa, Mycobacterium
HQPCADELVRVCRPGGVIGLISW

SEQ ID NO: 675951 - protein, 17 aa, Mycobacterium
HQPERFDEFAARYEAEL

SEQ ID NO: 675952 - protein, 18 aa, Mycobacterium
HQPFLDWLAQAAAVANAA

SEQ ID NO: 675953 - protein, 17 aa, Mycobacterium
HQPRAFLQTRLYEGLNS

SEQ ID NO: 675954 - protein, 26 aa, Mycobacterium
HQPRAPWLMSACAPAAPGVSPVLGEA

SEQ ID NO: 675955 - protein, 27 aa, Mycobacterium
HQPRPPWLMSACAPARVGATPSLGEDD

SEQ ID NO: 675956 - protein, 18 aa, Mycobacterium
HQPWPGLIEAYRDRLPIG

SEQ ID NO: 675957 - protein, 17 aa, Mycobacterium
HQPWPGLIEAYRDRLPV

SEQ ID NO: 675958 - protein, 24 aa, Mycobacterium
HQQCARKLSDLGLDSLTTVEDIRA

SEQ ID NO: 675959 - protein, 22 aa, Mycobacterium
HQQECLILWPFRGRLFGGVAPD

SEQ ID NO: 675960 - protein, 25 aa, Mycobacterium
HQQLRDGHLVAVRRGEGVVVPQVFF

SEQ ID NO: 675961 - protein, 22 aa, Mycobacterium
HQQLRDGHLVAVRRNGVIAVPK

SEQ ID NO: 675962 - protein, 24 aa, Mycobacterium
HQQSRWIIEPVLRLLDCCQESDGG

SEQ ID NO: 675963 - protein, 25 aa, Mycobacterium
HQQTLRCCIDWSYQRCSTAEQQLWA

SEQ ID NO: 675964 - protein, 18 aa, Mycobacterium
HQQVEVFDGGVWSGGAAS

SEQ ID NO: 675965 - protein, 18 aa, Mycobacterium
HQQVEVFDGGVWTGGAAN

SEQ ID NO: 675966 - protein, 32 aa, Mycobacterium
HQRCARPDAFPLLLTHGWPGSIVEFHKVIEPL

SEQ ID NO: 675967 - protein, 20 aa, Mycobacterium
HQREPLVFSIGAWQGVRRYV

SEQ ID NO: 675968 - protein, 23 aa, Mycobacterium
HQREVFERDGILLATSEYATPTG

SEQ ID NO: 675969 - protein, 20 aa, Mycobacterium
HQRGEFRPRVRFLSPGKKIL

SEQ ID NO: 675970 - protein, 20 aa, Mycobacterium
HQRHLLLSGWIKMQEGQLPS

SEQ ID NO: 675971 - protein, 18 aa, Mycobacterium
HQRPDQRRLLADNPNLIP

SEQ ID NO: 675972 - protein, 19 aa, Mycobacterium
HQRTADCVVAGYRLHKSGA

SEQ ID NO: 675973 - protein, 17 aa, Mycobacterium
HQRWPIVMVDEFQDTDP

SEQ ID NO: 675974 - protein, 27 aa, Mycobacterium
HQSFPLVWPACRRRIEAIAPRPQSRAK

SEQ ID NO: 675975 - protein, 20 aa, Mycobacterium
HQSLIWARVRHTNALRSALR

SEQ ID NO: 675976 - protein, 28 aa, Mycobacterium
HQTRLLLRKSMKLLRDKQLWFRTARKHG

SEQ ID NO: 675977 - protein, 18 aa, Mycobacterium
HQVAARLASVGWPLAAPA

SEQ ID NO: 675978 - protein, 17 aa, Mycobacterium
HQVGNTDGVPWDMRVAA

SEQ ID NO: 675979 - protein, 18 aa, Mycobacterium
HQVNPVLVRRRFDATAMF

SEQ ID NO: 675980 - protein, 17 aa, Mycobacterium
HQWRYNTLFRSQDRDLG

SEQ ID NO: 675981 - protein, 23 aa, Mycobacterium
HQWSPRSWEVRQFLARNQHTYRA

SEQ ID NO: 675982 - protein, 19 aa, Mycobacterium
HQYGYPHWVIYDEAHLLSG

SEQ ID NO: 675983 - protein, 20 aa, Mycobacterium
HRAACIRTDLVNGRSAADIY

SEQ ID NO: 675984 - protein, 21 aa, Mycobacterium
HRAALDFYREVLGWRTEDISD

SEQ ID NO: 675985 - protein, 24 aa, Mycobacterium
HRAALDILGRVGLLPHVVRRMMPR

SEQ ID NO: 675986 - protein, 20 aa, Mycobacterium
HRAARLAGLVVHDVTCSVGA

SEQ ID NO: 675987 - protein, 18 aa, Mycobacterium
HRAARPGPHGQRRTVVIA

SEQ ID NO: 675988 - protein, 19 aa, Mycobacterium
HRAASSVKERKDWSYSRWS

SEQ ID NO: 675989 - protein, 17 aa, Mycobacterium
HRAAVKFADLANARTAA

SEQ ID NO: 675990 - protein, 19 aa, Mycobacterium
HRADAAIALKAEFSLPAEQ

SEQ ID NO: 675991 - protein, 31 aa, Mycobacterium
HRADAAVFPSHYEPFGLVALEAAAAGTPLVT

SEQ ID NO: 675992 - protein, 29 aa, Mycobacterium
HRAEAVPFAPDCIRIEMGLKTGRSGDHLR

SEQ ID NO: 675993 - protein, 18 aa, Mycobacterium
HRAEFCIDKLYSPDGARG

SEQ ID NO: 675994 - protein, 18 aa, Mycobacterium
HRAEFCIDKLYSPDSARG

SEQ ID NO: 675995 - protein, 18 aa, Mycobacterium
HRAEFCIDKLYSPDSPRG

SEQ ID NO: 675996 - protein, 18 aa, Mycobacterium
HRAEFCIDKLYSPEGTRG

SEQ ID NO: 675997 - protein, 22 aa, Mycobacterium
HRAEGKAAFSVEAEKSGYSPQV

SEQ ID NO: 675998 - protein, 27 aa, Mycobacterium
HRAEVAADLRADWPTPLKAAGFDPRQP

SEQ ID NO: 675999 - protein, 32 aa, Mycobacterium
HRAFAKAMGTQFCGSALWKHAPSRSRLHRAAS

SEQ ID NO: 676000 - protein, 20 aa, Mycobacterium
HRAGAAPSRGAIMLVDTDPQ

SEQ ID NO: 676001 - protein, 19 aa, Mycobacterium
HRAGIDMAPQFDMDARVLR

SEQ ID NO: 676002 - protein, 20 aa, Mycobacterium
HRAGLAAFRKAGGRVVSVVP

SEQ ID NO: 676003 - protein, 18 aa, Mycobacterium
HRAGWRGHWGVEIISEEH

SEQ ID NO: 676004 - protein, 24 aa, Mycobacterium
HRAIRPGGIAAFAIDAGNTEALAV

SEQ ID NO: 676005 - protein, 19 aa, Mycobacterium
HRAKAGAAVARMQGRGETL

SEQ ID NO: 676006 - protein, 17 aa, Mycobacterium
HRAKLESLLTIPLAESR

SEQ ID NO: 676007 - protein, 19 aa, Mycobacterium
HRAKLPAAQIHRVLTQVAR

SEQ ID NO: 676008 - protein, 17 aa, Mycobacterium
HRALWHLIFSGALDRHP

SEQ ID NO: 676009 - protein, 17 aa, Mycobacterium
HRALWHLIFSGVLDRYP

SEQ ID NO: 676010 - protein, 25 aa, Mycobacterium
HRALYRAGFFGLSWPREYGGQELPP

SEQ ID NO: 676011 - protein, 17 aa, Mycobacterium
HRAPGLGPSAQPPSAYP

SEQ ID NO: 676012 - protein, 19 aa, Mycobacterium
HRARHLCERLLSFASPLHL

SEQ ID NO: 676013 - protein, 28 aa, Mycobacterium
HRARITGPAVRRGWLRDGPGPSTERGAD

SEQ ID NO: 676014 - protein, 23 aa, Mycobacterium
HRARPNVRMQLDFQQLHEQHGYD

SEQ ID NO: 676015 - protein, 17 aa, Mycobacterium
HRARRLAGAIVHDATCS

SEQ ID NO: 676016 - protein, 18 aa, Mycobacterium
HRARVGGAGVKLLYNIVP

SEQ ID NO: 676017 - protein, 19 aa, Mycobacterium
HRASALIGTLMRDLTSDWD

SEQ ID NO: 676018 - protein, 20 aa, Mycobacterium
HRASAPGARYFVLVFAKGAF

SEQ ID NO: 676019 - protein, 21 aa, Mycobacterium
HRATPELLDIVPRGNRQVYDM

SEQ ID NO: 676020 - protein, 25 aa, Mycobacterium
HRAVAFRRFRAADVRSILAAGTGTP

SEQ ID NO: 676021 - protein, 24 aa, Mycobacterium
HRAVGWQIPQPWVIDGNGATARLD

SEQ ID NO: 676022 - protein, 19 aa, Mycobacterium
HRAVLVLRYMDGCSVPECA

SEQ ID NO: 676023 - protein, 18 aa, Mycobacterium
HRAVRASLEITREVSKLS

SEQ ID NO: 676024 - protein, 17 aa, Mycobacterium
HRAWLLVVSEDARREHT

SEQ ID NO: 676025 - protein, 17 aa, Mycobacterium
HRAWPADLMLAAPPAPR

SEQ ID NO: 676026 - protein, 21 aa, Mycobacterium
HRCQHEGLKVIGMRFTTDKLV

SEQ ID NO: 676027 - protein, 27 aa, Mycobacterium
HRDAIAPWQCVHHGVAMLKSADVRFTT

SEQ ID NO: 676028 - protein, 19 aa, Mycobacterium
HRDALRLVNVAPKLDAAQQ

SEQ ID NO: 676029 - protein, 17 aa, Mycobacterium
HRDCGSYASGGFASGAD

SEQ ID NO: 676030 - protein, 18 aa, Mycobacterium
HRDCGSYASGGFATGADY

SEQ ID NO: 676031 - protein, 23 aa, Mycobacterium
HRDECGRWWPDWADTEPDPIPVP

SEQ ID NO: 676032 - protein, 30 aa, Mycobacterium
HRDGRWIINGAKTWSTWAFAADYGLCLART

SEQ ID NO: 676033 - protein, 26 aa, Mycobacterium
HRDHFGYRPGQFLTLRIPSERTGSVA

SEQ ID NO: 676034 - protein, 18 aa, Mycobacterium
HRDIRLTAFGNRVQEAGA

SEQ ID NO: 676035 - protein, 17 aa, Mycobacterium
HRDLDIVLGAAVLRDLE

SEQ ID NO: 676036 - protein, 21 aa, Mycobacterium
HRDLLHGLGLAGTRILDTATP

SEQ ID NO: 676037 - protein, 25 aa, Mycobacterium
HRDLRLLAADMVFDLPVVGEAARKA

SEQ ID NO: 676038 - protein, 24 aa, Mycobacterium
HRDQKLIFHRPIVVGDKLWFDSYL

SEQ ID NO: 676039 - protein, 19 aa, Mycobacterium
HRDRFRCAYCGGRADTIDH

SEQ ID NO: 676040 - protein, 19 aa, Mycobacterium
HRDRFRCAYCGGRADTVDH

SEQ ID NO: 676041 - protein, 23 aa, Mycobacterium
HRDRFRCAYCGSKADTVDHVIPR

SEQ ID NO: 676042 - protein, 20 aa, Mycobacterium
HRDRFSCAYCGAKADTVDHV

SEQ ID NO: 676043 - protein, 27 aa, Mycobacterium
HRDRGRRAWSIAWSRWAGPGMSLDVAG

SEQ ID NO: 676044 - protein, 23 aa, Mycobacterium
HRDRIAYARVCSGTFERGDVLTH

SEQ ID NO: 676045 - protein, 18 aa, Mycobacterium
HRDRLWLGLTQCGSPRLI

SEQ ID NO: 676046 - protein, 24 aa, Mycobacterium
HRDVCAGKTAFPGMATVYQLLHEP

SEQ ID NO: 676047 - protein, 17 aa, Mycobacterium
HRDYWKKAVVERTGLPF

SEQ ID NO: 676048 - protein, 17 aa, Mycobacterium
HREAFDIGEPTAADFTG

SEQ ID NO: 676049 - protein, 18 aa, Mycobacterium
HREELDAYVVRRLNLPFR

SEQ ID NO: 676050 - protein, 21 aa, Mycobacterium
HREGVAIGLIFPYTRGADGAY

SEQ ID NO: 676051 - protein, 23 aa, Mycobacterium
HREHYGLPALRDWLRRQRDERGG

SEQ ID NO: 676052 - protein, 25 aa, Mycobacterium
HRELAESFATQGARMADALTDAVRS

SEQ ID NO: 676053 - protein, 18 aa, Mycobacterium
HRELPLRADYVGKNVPTA

SEQ ID NO: 676054 - protein, 18 aa, Mycobacterium
HRELPLRADYVGKNVPTS

SEQ ID NO: 676055 - protein, 20 aa, Mycobacterium
HRELPLRLVHVTPQTEFPEF

SEQ ID NO: 676056 - protein, 23 aa, Mycobacterium
HREMLDAFLMRDAERLVAASEAH

SEQ ID NO: 676057 - protein, 17 aa, Mycobacterium
HREWFRATVAALLREAG

SEQ ID NO: 676058 - protein, 17 aa, Mycobacterium
HRFAGLATRAIHSGYRP

SEQ ID NO: 676059 - protein, 17 aa, Mycobacterium
HRFDLATEIPLRAMLFR

SEQ ID NO: 676060 - protein, 18 aa, Mycobacterium
HRFDVDWRLHGFDTTALS

SEQ ID NO: 676061 - protein, 17 aa, Mycobacterium
HRFEIIVIGAGFSGIGM

SEQ ID NO: 676062 - protein, 22 aa, Mycobacterium
HRFGNKAARRRHVLELLEAVGV

SEQ ID NO: 676063 - protein, 18 aa, Mycobacterium
HRFLEIIDGGWLSELDQW

SEQ ID NO: 676064 - protein, 17 aa, Mycobacterium
HRFLSYKAMNDHTAGGL

SEQ ID NO: 676065 - protein, 18 aa, Mycobacterium
HRFPGSMSKRVQALAQVI

SEQ ID NO: 676066 - protein, 17 aa, Mycobacterium
HRFPPPWCVALSGGPDS

SEQ ID NO: 676067 - protein, 25 aa, Mycobacterium
HRFPTRAALCGELWVRTEERFQEEL

SEQ ID NO: 676068 - protein, 17 aa, Mycobacterium
HRFPVYKPIVAAVNGTC

SEQ ID NO: 676069 - protein, 17 aa, Mycobacterium
HRFQVAVVTGGGGGIGR

SEQ ID NO: 676070 - protein, 20 aa, Mycobacterium
HRFQVTASRFGRSVDVAAAR

SEQ ID NO: 676071 - protein, 21 aa, Mycobacterium
HRFSLPGLPAPYVIAQVAIAE

SEQ ID NO: 676072 - protein, 20 aa, Mycobacterium
HRFSLPGLPAPYVVAQVSIA

SEQ ID NO: 676073 - protein, 21 aa, Mycobacterium
HRFYDACRVLPQGDEAPGDLH

SEQ ID NO: 676074 - protein, 17 aa, Mycobacterium
HRGAALVEILQDCPIFN

SEQ ID NO: 676075 - protein, 18 aa, Mycobacterium
HRGAAVVEILQDCPIFND

SEQ ID NO: 676076 - protein, 19 aa, Mycobacterium
HRGAREVQVGLSMLARLVD

SEQ ID NO: 676077 - protein, 20 aa, Mycobacterium
HRGDLCIRREETWGPVNDGT

SEQ ID NO: 676078 - protein, 19 aa, Mycobacterium
HRGGPPGFVRVGSPTRLWW

SEQ ID NO: 676079 - protein, 20 aa, Mycobacterium
HRGGSISVRAIRTCAPAVTP

SEQ ID NO: 676080 - protein, 25 aa, Mycobacterium
HRGHDWKFAVVEGGRHSVTHYDTLE

SEQ ID NO: 676081 - protein, 21 aa, Mycobacterium
HRGKEAIAAFWDNIIAPTEKL

SEQ ID NO: 676082 - protein, 17 aa, Mycobacterium
HRGLLMLRLRWHERRDL

SEQ ID NO: 676083 - protein, 24 aa, Mycobacterium
HRGLQWSWSRYLAGAAVRAAALIA

SEQ ID NO: 676084 - protein, 25 aa, Mycobacterium
HRGLRVSIYRPGFIQGDSRTGTANV

SEQ ID NO: 676085 - protein, 17 aa, Mycobacterium
HRGMAVCRYDEGRALQF

SEQ ID NO: 676086 - protein, 19 aa, Mycobacterium
HRGMPVLGICNGFQVLCEA

SEQ ID NO: 676087 - protein, 20 aa, Mycobacterium
HRGRHLPVRIQPRQPGQPQR

SEQ ID NO: 676088 - protein, 17 aa, Mycobacterium
HRGRLNVLANIVGKPYK

SEQ ID NO: 676089 - protein, 17 aa, Mycobacterium
HRGRRPAVWEPGEYLVI

SEQ ID NO: 676090 - protein, 21 aa, Mycobacterium
HRGSALWVRRGEVLAVHASGN

SEQ ID NO: 676091 - protein, 17 aa, Mycobacterium
HRGYAPFSLPSAFTDPG

SEQ ID NO: 676092 - protein, 19 aa, Mycobacterium
HRHAIAGLQAAAAIEAGIT

SEQ ID NO: 676093 - protein, 21 aa, Mycobacterium
HRHDGPIFPLIEDLFGLGIVE

SEQ ID NO: 676094 - protein, 20 aa, Mycobacterium
HRHGESILDAVKISRDEHAG

SEQ ID NO: 676095 - protein, 27 aa, Mycobacterium
HRHLFSVLMDREWKYGVAAAVDVTLLG

SEQ ID NO: 676096 - protein, 21 aa, Mycobacterium
HRHLFTLLMDHHWQDGVSCAV

SEQ ID NO: 676097 - protein, 27 aa, Mycobacterium
HRHLFTVLMDREWKYGVAAAVDVTLLG

SEQ ID NO: 676098 - protein, 18 aa, Mycobacterium
HRHMRSLLNKVFTPRAIQ

SEQ ID NO: 676099 - protein, 22 aa, Mycobacterium
HRIECGEVTAALTALDGVDQAV

SEQ ID NO: 676100 - protein, 23 aa, Mycobacterium
HRIECGEVTAALTALDGVDQAVV

SEQ ID NO: 676101 - protein, 28 aa, Mycobacterium
HRIEKAFPGRFLLGVGVGHPEHTQEYTK

SEQ ID NO: 676102 - protein, 19 aa, Mycobacterium
HRIEPLCPIAHSAVGSGCC

SEQ ID NO: 676103 - protein, 20 aa, Mycobacterium
HRIHYDWPYATRVEGYPGLV

SEQ ID NO: 676104 - protein, 20 aa, Mycobacterium
HRILAAIHFDDLQWERRYNR

SEQ ID NO: 676105 - protein, 20 aa, Mycobacterium
HRILDMRGLYQLLTGSSAPP

SEQ ID NO: 676106 - protein, 20 aa, Mycobacterium
HRIPLLPVSMFKQAGAHVLM

SEQ ID NO: 676107 - protein, 19 aa, Mycobacterium
HRIPLTIIRICSTYGPEGG

SEQ ID NO: 676108 - protein, 17 aa, Mycobacterium
HRIPWPAQYVRVPTSAS

SEQ ID NO: 676109 - protein, 17 aa, Mycobacterium
HRIRIVLETADTRAIGI

SEQ ID NO: 676110 - protein, 31 aa, Mycobacterium
HRIRRMMTGNFTFRRCESMRPQIQEMVDHFL

SEQ ID NO: 676111 - protein, 18 aa, Mycobacterium
HRITPRFIRVTEGERSTH

SEQ ID NO: 676112 - protein, 17 aa, Mycobacterium
HRIVAPWCLSHHPASPP

SEQ ID NO: 676113 - protein, 17 aa, Mycobacterium
HRIVVNACLDRLRRTKA

SEQ ID NO: 676114 - protein, 25 aa, Mycobacterium
HRIWDRVLFDAGLSVITWPKKYGGR

SEQ ID NO: 676115 - protein, 17 aa, Mycobacterium
HRIWPKDHPRNLLRNKV

SEQ ID NO: 676116 - protein, 29 aa, Mycobacterium
HRIWSLESGFTFPVLSDFWPHGEVSRAYG

SEQ ID NO: 676117 - protein, 18 aa, Mycobacterium
HRKFLVRHLAAKRIRAIE

SEQ ID NO: 676118 - protein, 25 aa, Mycobacterium
HRKGGHLSFGLGLHFCLGSALARLE

SEQ ID NO: 676119 - protein, 18 aa, Mycobacterium
HRKGLLVDLVTAISVGNE

SEQ ID NO: 676120 - protein, 28 aa, Mycobacterium
HRKKGYGTAALRKSRSVMAAYFPAVPMV

SEQ ID NO: 676121 - protein, 18 aa, Mycobacterium
HRKLPKRRPVPLRLRDWK

SEQ ID NO: 676122 - protein, 19 aa, Mycobacterium
HRKVKKWLAEGDFDVLHLH

SEQ ID NO: 676123 - protein, 18 aa, Mycobacterium
HRKVLAARLSELDLRLRV

SEQ ID NO: 676124 - protein, 25 aa, Mycobacterium
HRKVVVFRPLYAVGGQELGYLPGSE

SEQ ID NO: 676125 - protein, 17 aa, Mycobacterium
HRLAAQAYSDWFGPQQI

SEQ ID NO: 676126 - protein, 19 aa, Mycobacterium
HRLADMGARVMIADLDGAA

SEQ ID NO: 676127 - protein, 28 aa, Mycobacterium
HRLAVLWPEVYPRLLRVMDADPICQDRI

SEQ ID NO: 676128 - protein, 18 aa, Mycobacterium
HRLAWPAGVTVYELDQPQ

SEQ ID NO: 676129 - protein, 19 aa, Mycobacterium
HRLDSGTWGVMGIGMGYAI

SEQ ID NO: 676130 - protein, 18 aa, Mycobacterium
HRLDSGTWGVMGVGMGYA

SEQ ID NO: 676131 - protein, 19 aa, Mycobacterium
HRLEAMFDAAGWQVITVNF

SEQ ID NO: 676132 - protein, 22 aa, Mycobacterium
HRLFLQCAWHALEDAGCDPAQF

SEQ ID NO: 676133 - protein, 20 aa, Mycobacterium
HRLFLQTVFHAFEDAGYDPK

SEQ ID NO: 676134 - protein, 33 aa, Mycobacterium
HRLGFPLRSGFEFFLRKGLQLGLGDRRLATTCR

SEQ ID NO: 676135 - protein, 19 aa, Mycobacterium
HRLHIPAGTAVRFEPGVAQ

SEQ ID NO: 676136 - protein, 19 aa, Mycobacterium
HRLIFPLNTILALDDAPEE

SEQ ID NO: 676137 - protein, 18 aa, Mycobacterium
HRLIFPLNTILELDELPE

SEQ ID NO: 676138 - protein, 19 aa, Mycobacterium
HRLIFPLNTIMELDTAPED

SEQ ID NO: 676139 - protein, 19 aa, Mycobacterium
HRLIGIKVRISFEHDAAMY

SEQ ID NO: 676140 - protein, 24 aa, Mycobacterium
HRLIRERGYLAFGLKLFTQTRKQF

SEQ ID NO: 676141 - protein, 19 aa, Mycobacterium
HRLLRACVRDRALVPPERS

SEQ ID NO: 676142 - protein, 23 aa, Mycobacterium
HRLLRRYRIELARPGYQPRWDYG

SEQ ID NO: 676143 - protein, 23 aa, Mycobacterium
HRLLRRYRLELARPGYEPHWDYG

SEQ ID NO: 676144 - protein, 18 aa, Mycobacterium
HRLLSMLQYRGFVRQDPA

SEQ ID NO: 676145 - protein, 17 aa, Mycobacterium
HRLLVKIPAGWSDTAAA

SEQ ID NO: 676146 - protein, 17 aa, Mycobacterium
HRLLVKVPAGWSHTAAA

SEQ ID NO: 676147 - protein, 22 aa, Mycobacterium
HRLQARLGVDFQDLPAPEDTPI

SEQ ID NO: 676148 - protein, 20 aa, Mycobacterium
HRLRALLVELERLYNHATDL

SEQ ID NO: 676149 - protein, 19 aa, Mycobacterium
HRLRALLVELERLYNHVTD

SEQ ID NO: 676150 - protein, 21 aa, Mycobacterium
HRLRAVSAIGVRFPLNGTANG

SEQ ID NO: 676151 - protein, 17 aa, Mycobacterium
HRLRCTQKFLTRPKLPL

SEQ ID NO: 676152 - protein, 23 aa, Mycobacterium
HRLSKLLLRHGIVYYGRAAWTGA

SEQ ID NO: 676153 - protein, 18 aa, Mycobacterium
HRLTEAVEARRDCRLVSP

SEQ ID NO: 676154 - protein, 19 aa, Mycobacterium
HRLTGLILAVWEFTHAEMA

SEQ ID NO: 676155 - protein, 20 aa, Mycobacterium
HRLVAMHLPHLAMLQTMVTA

SEQ ID NO: 676156 - protein, 21 aa, Mycobacterium
HRLYRRWIHELWSGRRVAEQL

SEQ ID NO: 676157 - protein, 17 aa, Mycobacterium
HRMADLYVTVAAAKAVV

SEQ ID NO: 676158 - protein, 19 aa, Mycobacterium
HRMAIEYVSLAAADFRAEH

SEQ ID NO: 676159 - protein, 23 aa, Mycobacterium
HRMAKLYGRDKVLAWQKALNEAV

SEQ ID NO: 676160 - protein, 27 aa, Mycobacterium
HRMARGMACRTRFYDDFFLEAARSGIG

SEQ ID NO: 676161 - protein, 27 aa, Mycobacterium
HRMKDQRPAGSMPVGLAPMLPTTGSVA

SEQ ID NO: 676162 - protein, 25 aa, Mycobacterium
HRMKGRNVLHALGFDAFGLPAEQYA

SEQ ID NO: 676163 - protein, 19 aa, Mycobacterium
HRMLCITSHSVVEVDPPAP

SEQ ID NO: 676164 - protein, 19 aa, Mycobacterium
HRMQAEGFGPILAAAAGSA

SEQ ID NO: 676165 - protein, 19 aa, Mycobacterium
HRMVIEPIDVMAFDEDGKV

SEQ ID NO: 676166 - protein, 18 aa, Mycobacterium
HRNAERFAAAAVAETQMG

SEQ ID NO: 676167 - protein, 27 aa, Mycobacterium
HRNEITEIIPLDGFDGFDELELADLDE

SEQ ID NO: 676168 - protein, 25 aa, Mycobacterium
HRNEVTEIIPLDGFDELDELELADL

SEQ ID NO: 676169 - protein, 25 aa, Mycobacterium
HRNEVTEILPLDGFNFDDLDWRDEA

SEQ ID NO: 676170 - protein, 17 aa, Mycobacterium
HRNGAVVLLMWAGILAY

SEQ ID NO: 676171 - protein, 19 aa, Mycobacterium
HRNGIPLIVDNTIATPYLI

SEQ ID NO: 676172 - protein, 19 aa, Mycobacterium
HRNGLPLIVDNTIATPYLI

SEQ ID NO: 676173 - protein, 17 aa, Mycobacterium
HRNIVAITAAMPGPTGL

SEQ ID NO: 676174 - protein, 20 aa, Mycobacterium
HRNLHRWVMAEVPSVVHWLP

SEQ ID NO: 676175 - protein, 18 aa, Mycobacterium
HRNRPLAELGVMSRQVIA

SEQ ID NO: 676176 - protein, 21 aa, Mycobacterium
HRNRPLAELGVMSRQVIATLL

SEQ ID NO: 676177 - protein, 22 aa, Mycobacterium
HRNRPLVELGVMSRQVMATMLS

SEQ ID NO: 676178 - protein, 25 aa, Mycobacterium
HRNTRGHLGFGYGVHQCIGANLARV

SEQ ID NO: 676179 - protein, 21 aa, Mycobacterium
HRPAMEVLLMGGRPIREPTFQ

SEQ ID NO: 676180 - protein, 21 aa, Mycobacterium
HRPDKVWRYRVGSGAESELVY

SEQ ID NO: 676181 - protein, 20 aa, Mycobacterium
HRPDKVWRYRVGSGEPSELV

SEQ ID NO: 676182 - protein, 22 aa, Mycobacterium
HRPEGRPLWLGSLKSNTGHTLA

SEQ ID NO: 676183 - protein, 18 aa, Mycobacterium
HRPELVRTWVSDVVGIFD

SEQ ID NO: 676184 - protein, 21 aa, Mycobacterium
HRPGAELLRLNPRNVDQLLFD

SEQ ID NO: 676185 - protein, 18 aa, Mycobacterium
HRPGRKAGALVVLIDGEL

SEQ ID NO: 676186 - protein, 24 aa, Mycobacterium
HRPGTELRRLTPRNSDQLLFDGLP

SEQ ID NO: 676187 - protein, 17 aa, Mycobacterium
HRPHLLSPHHYRLSSPR

SEQ ID NO: 676188 - protein, 20 aa, Mycobacterium
HRPIPREDLVAFFVAADVML

SEQ ID NO: 676189 - protein, 20 aa, Mycobacterium
HRPKSIKFVCLVTCPEGVAA

SEQ ID NO: 676190 - protein, 19 aa, Mycobacterium
HRPLDWIVNGQKVWTSMAQ

SEQ ID NO: 676191 - protein, 24 aa, Mycobacterium
HRPPWDCYFIDGLGKIEGFPDGAF

SEQ ID NO: 676192 - protein, 22 aa, Mycobacterium
HRPRLAFPTPLRRAVFHPRPHT

SEQ ID NO: 676193 - protein, 22 aa, Mycobacterium
HRPRSGLLRRVTSFVGRQRELA

SEQ ID NO: 676194 - protein, 18 aa, Mycobacterium
HRPSIAYVLTKLAIVLFT

SEQ ID NO: 676195 - protein, 20 aa, Mycobacterium
HRPSRLAVVAGWVKSPFQQD

SEQ ID NO: 676196 - protein, 17 aa, Mycobacterium
HRPSWLPIPLRSIARLT

SEQ ID NO: 676197 - protein, 17 aa, Mycobacterium
HRPVALYESGFAPRWYV

SEQ ID NO: 676198 - protein, 22 aa, Mycobacterium
HRPVGPCLLITPWNFPLAMGTR

SEQ ID NO: 676199 - protein, 21 aa, Mycobacterium
HRPVSIAPRIAVTAHAINSVA

SEQ ID NO: 676200 - protein, 22 aa, Mycobacterium
HRQCREECIATLRGRSVTAPVA

SEQ ID NO: 676201 - protein, 17 aa, Mycobacterium
HRQSLSASASWAANGKI

SEQ ID NO: 676202 - protein, 19 aa, Mycobacterium
HRQTLRMYEEWATLADLRE

SEQ ID NO: 676203 - protein, 26 aa, Mycobacterium
HRQWLLIELRTDWTLGATTYTAGCLL

SEQ ID NO: 676204 - protein, 21 aa, Mycobacterium
HRRADGLGWASADWRLRRGRI

SEQ ID NO: 676205 - protein, 17 aa, Mycobacterium
HRRAGMIEQIWREFFGA

SEQ ID NO: 676206 - protein, 23 aa, Mycobacterium
HRRAHGLAGLSLAWGLWEQASAM

SEQ ID NO: 676207 - protein, 21 aa, Mycobacterium
HRRALDLGRARSRRAVPTDSV

SEQ ID NO: 676208 - protein, 19 aa, Mycobacterium
HRRCEDVRYLGSWPRGTTA

SEQ ID NO: 676209 - protein, 22 aa, Mycobacterium
HRREDGSGWASADWRLRRGRLV

SEQ ID NO: 676210 - protein, 23 aa, Mycobacterium
HRRERHGAPGRHHGAPHGGLGVV

SEQ ID NO: 676211 - protein, 18 aa, Mycobacterium
HRRFGDLVRLIFALVPSR

SEQ ID NO: 676212 - protein, 18 aa, Mycobacterium
HRRFGGGALAVYLNGEPV

SEQ ID NO: 676213 - protein, 19 aa, Mycobacterium
HRRGEIFDAVMAHVLEHGI

SEQ ID NO: 676214 - protein, 17 aa, Mycobacterium
HRRGLGLRATVERIERV

SEQ ID NO: 676215 - protein, 17 aa, Mycobacterium
HRRIIQPVFARRHLNAF

SEQ ID NO: 676216 - protein, 19 aa, Mycobacterium
HRRIREELRYSADRTMAAE

SEQ ID NO: 676217 - protein, 24 aa, Mycobacterium
HRRKVFKRDGMLLAVDRHMQPGAD

SEQ ID NO: 676218 - protein, 24 aa, Mycobacterium
HRRLAPLCRFSRSRTRADAGCTIG

SEQ ID NO: 676219 - protein, 27 aa, Mycobacterium
HRRLGRRGPVHIVDWQFVHGLTPSALA

SEQ ID NO: 676220 - protein, 27 aa, Mycobacterium
HRRLGRRGPVHVVDWQSVQGLTPSALA

SEQ ID NO: 676221 - protein, 21 aa, Mycobacterium
HRRLIGLSINPGILGMGAHDV

SEQ ID NO: 676222 - protein, 32 aa, Mycobacterium
HRRLLGVLIDQEWKYGVATGVETALLARFYER

SEQ ID NO: 676223 - protein, 18 aa, Mycobacterium
HRRLRGAAIGHFAATEIT

SEQ ID NO: 676224 - protein, 18 aa, Mycobacterium
HRRLRGYAIAPLVVATQA

SEQ ID NO: 676225 - protein, 22 aa, Mycobacterium
HRRPVSWCRGLLTATSRSSDFA

SEQ ID NO: 676226 - protein, 20 aa, Mycobacterium
HRRRVGLMPQEGALFPHLSV

SEQ ID NO: 676227 - protein, 22 aa, Mycobacterium
HRRTGIVKVLRYAVSHEGGREI

SEQ ID NO: 676228 - protein, 24 aa, Mycobacterium
HRRTPDWCRELLTATARSSDFAAA

SEQ ID NO: 676229 - protein, 17 aa, Mycobacterium
HRRWLNNHVPFHANWVR

SEQ ID NO: 676230 - protein, 19 aa, Mycobacterium
HRSAERMLRAMGLPDLPVF

SEQ ID NO: 676231 - protein, 25 aa, Mycobacterium
HRSAMARLGYARGRLLGARGELSAA

SEQ ID NO: 676232 - protein, 18 aa, Mycobacterium
HRSASPIIQRLAAWSDPQ

SEQ ID NO: 676233 - protein, 19 aa, Mycobacterium
HRSFWWFVRDLIYTYRQQP

SEQ ID NO: 676234 - protein, 21 aa, Mycobacterium
HRSGIEFPAPALVYGYGAYEI

SEQ ID NO: 676235 - protein, 18 aa, Mycobacterium
HRSGILGLAGERDFRRLH

SEQ ID NO: 676236 - protein, 19 aa, Mycobacterium
HRSGTILARVAEAFVAARA

SEQ ID NO: 676237 - protein, 17 aa, Mycobacterium
HRSGVLFRDLLGTVNQR

SEQ ID NO: 676238 - protein, 18 aa, Mycobacterium
HRSLPVLLVLVTDGHPLP

SEQ ID NO: 676239 - protein, 18 aa, Mycobacterium
HRSLRGAAIGHFASTEIT

SEQ ID NO: 676240 - protein, 18 aa, Mycobacterium
HRSPAIRIAGRRVLELAG

SEQ ID NO: 676241 - protein, 26 aa, Mycobacterium
HRSPAIRLAGRRAFEIAGLGTDDVEL

SEQ ID NO: 676242 - protein, 25 aa, Mycobacterium
HRSPEGLDAFLRRFLLPALLADTQR

SEQ ID NO: 676243 - protein, 24 aa, Mycobacterium
HRSRPGACVRATWLKVVPDQLNRS

SEQ ID NO: 676244 - protein, 17 aa, Mycobacterium
HRSSALIIYDAVADDPW

SEQ ID NO: 676245 - protein, 18 aa, Mycobacterium
HRSSALIIYDAVVDDPWY

SEQ ID NO: 676246 - protein, 18 aa, Mycobacterium
HRSSALVIYDAVIGDPWY

SEQ ID NO: 676247 - protein, 17 aa, Mycobacterium
HRSSVRPVWCPRLRRVF

SEQ ID NO: 676248 - protein, 18 aa, Mycobacterium
HRSVAMAEALAARLAGSD

SEQ ID NO: 676249 - protein, 20 aa, Mycobacterium
HRSVLCGNIGSPVLDVLEEP

SEQ ID NO: 676250 - protein, 21 aa, Mycobacterium
HRTAALWLKEHDRLHDAVKHA

SEQ ID NO: 676251 - protein, 23 aa, Mycobacterium
HRTACSFCGVGCGIEVDTTVEHG

SEQ ID NO: 676252 - protein, 18 aa, Mycobacterium
HRTALALPTLTEYQGRLA

SEQ ID NO: 676253 - protein, 19 aa, Mycobacterium
HRTALCGNLSGGQRTRVSL

SEQ ID NO: 676254 - protein, 19 aa, Mycobacterium
HRTAVWLPVVDRVIVLGAA

SEQ ID NO: 676255 - protein, 30 aa, Mycobacterium
HRTDASALLARFPNVLVVRTFSKAYGLAGL

SEQ ID NO: 676256 - protein, 26 aa, Mycobacterium
HRTDRELSRYADWSLLEELTRDEASS

SEQ ID NO: 676257 - protein, 19 aa, Mycobacterium
HRTKVWLPVIDRVVVLGAD

SEQ ID NO: 676258 - protein, 19 aa, Mycobacterium
HRTLMAAGVGCTRLAIHAV

SEQ ID NO: 676259 - protein, 26 aa, Mycobacterium
HRTLYEILRFCAFFAATGDTDGDTAL

SEQ ID NO: 676260 - protein, 31 aa, Mycobacterium
HRTPDKRGLLPFRVWQFYDAMVGFAKSRQVD

SEQ ID NO: 676261 - protein, 26 aa, Mycobacterium
HRVAAKLRAGTVWINAYRVVAPHVPF

SEQ ID NO: 676262 - protein, 19 aa, Mycobacterium
HRVAARLGLTEHHRTRREL

SEQ ID NO: 676263 - protein, 20 aa, Mycobacterium
HRVAPFKVGPDFIDPGYHAL

SEQ ID NO: 676264 - protein, 19 aa, Mycobacterium
HRVASRFEQGIVWVNDHHR

SEQ ID NO: 676265 - protein, 21 aa, Mycobacterium
HRVFHYPGGLVDFVKHINRTK

SEQ ID NO: 676266 - protein, 25 aa, Mycobacterium
HRVGPAPWKPLLGMTGPTTLSIEFT

SEQ ID NO: 676267 - protein, 19 aa, Mycobacterium
HRVLEIYWQQVRPFDGHEL

SEQ ID NO: 676268 - protein, 19 aa, Mycobacterium
HRVLIDLVALFPREAHCDG

SEQ ID NO: 676269 - protein, 22 aa, Mycobacterium
HRVLQHRLILGFEAASAGVTPN

SEQ ID NO: 676270 - protein, 23 aa, Mycobacterium
HRVLRIAAQPGTPVICTQGRVIP

SEQ ID NO: 676271 - protein, 17 aa, Mycobacterium
HRVLRTGLVDKLESGSR

SEQ ID NO: 676272 - protein, 26 aa, Mycobacterium
HRVMWPLDMLQEFLVGQRMAVPATGA

SEQ ID NO: 676273 - protein, 17 aa, Mycobacterium
HRVPILLSALSPRMLRI

SEQ ID NO: 676274 - protein, 27 aa, Mycobacterium
HRVPMPVIAASLFARFASRQEDSPTMK

SEQ ID NO: 676275 - protein, 19 aa, Mycobacterium
HRVPTGLFIGGDWRTTDST

SEQ ID NO: 676276 - protein, 19 aa, Mycobacterium
HRVPVAVDLRQDWPEALRQ

SEQ ID NO: 676277 - protein, 18 aa, Mycobacterium
HRVQFRANPWLAEHMSGA

SEQ ID NO: 676278 - protein, 18 aa, Mycobacterium
HRVRIEAVRALVSVDDAG

SEQ ID NO: 676279 - protein, 18 aa, Mycobacterium
HRVRRARNRIIAEHGAST

SEQ ID NO: 676280 - protein, 19 aa, Mycobacterium
HRVRSWAQLTPEFDVAAAQ

SEQ ID NO: 676281 - protein, 17 aa, Mycobacterium
HRVSLAYTPDSQWRNRG

SEQ ID NO: 676282 - protein, 24 aa, Mycobacterium
HRVSRCAIGLLGLGATPRRATAAE

SEQ ID NO: 676283 - protein, 17 aa, Mycobacterium
HRVSVLCCVSTQLTMLM

SEQ ID NO: 676284 - protein, 24 aa, Mycobacterium
HRVTRAGVQPAVIRMLLDAKVPAE

SEQ ID NO: 676285 - protein, 17 aa, Mycobacterium
HRVTVLCCVSTQLTMLM

SEQ ID NO: 676286 - protein, 18 aa, Mycobacterium
HRVVPVIRKVLADSETPL

SEQ ID NO: 676287 - protein, 20 aa, Mycobacterium
HRVVVRWTLNRIARAAELAD

SEQ ID NO: 676288 - protein, 22 aa, Mycobacterium
HRWPEGWEVVELNPAHVAEQRR

SEQ ID NO: 676289 - protein, 21 aa, Mycobacterium
HRWRWEFEALSPTLTRVTETF

SEQ ID NO: 676290 - protein, 18 aa, Mycobacterium
HRWRWEFVALSPTSTRVT

SEQ ID NO: 676291 - protein, 19 aa, Mycobacterium
HRWSERTLIALVMQHLDNS

SEQ ID NO: 676292 - protein, 20 aa, Mycobacterium
HRYDDFFKFAYHAMPGDGVM

SEQ ID NO: 676293 - protein, 19 aa, Mycobacterium
HRYGARVLIDGAQSVPHLA

SEQ ID NO: 676294 - protein, 20 aa, Mycobacterium
HRYSGAFAYEGDDWYERSPI

SEQ ID NO: 676295 - protein, 24 aa, Mycobacterium
HSAAAARQRVWWALISDATPYNLG

SEQ ID NO: 676296 - protein, 25 aa, Mycobacterium
HSAARRARVAARTLATLSAEAKNRA

SEQ ID NO: 676297 - protein, 19 aa, Mycobacterium
HSAASMYRSVVMDLTSMQW

SEQ ID NO: 676298 - protein, 18 aa, Mycobacterium
HSADGHWLACEVAPEGAT

SEQ ID NO: 676299 - protein, 24 aa, Mycobacterium
HSADGSPPYVVRWLDTDHVATVVP

SEQ ID NO: 676300 - protein, 23 aa, Mycobacterium
HSAEVKFAAPSVFQTRPAGLPGL

SEQ ID NO: 676301 - protein, 19 aa, Mycobacterium
HSAFAPRLAEVLADLPSLK

SEQ ID NO: 676302 - protein, 20 aa, Mycobacterium
HSAFTLPELIGLTGCAEVVL

SEQ ID NO: 676303 - protein, 26 aa, Mycobacterium
HSAFTLPELLGLVGLPDMTVVVDQET

SEQ ID NO: 676304 - protein, 23 aa, Mycobacterium
HSAIRRRPNVVARFYEEFGEPVQ

SEQ ID NO: 676305 - protein, 34 aa, Mycobacterium
HSALDFREAAAIAIARAVWRGEIDSLAAQAPALD

SEQ ID NO: 676306 - protein, 20 aa, Mycobacterium
HSALDFREPAALAIAEAVCR

SEQ ID NO: 676307 - protein, 20 aa, Mycobacterium
HSALDFREPAALAIAGAVCR

SEQ ID NO: 676308 - protein, 18 aa, Mycobacterium
HSALDFREPVALAAAEAV

SEQ ID NO: 676309 - protein, 24 aa, Mycobacterium
HSAMFPGSFGGPLFAEQTELSVRN

SEQ ID NO: 676310 - protein, 18 aa, Mycobacterium
HSAMLRECLGAEPIGTDG

SEQ ID NO: 676311 - protein, 23 aa, Mycobacterium
HSARAAEVLARFPAAERIEVPSH

SEQ ID NO: 676312 - protein, 18 aa, Mycobacterium
HSARMFCDIKLPDGSPSW

SEQ ID NO: 676313 - protein, 21 aa, Mycobacterium
HSASPSCRWCGRVDADLRCAR

SEQ ID NO: 676314 - protein, 24 aa, Mycobacterium
HSATFPAIHFDTFGLLPQSNGTFG

SEQ ID NO: 676315 - protein, 19 aa, Mycobacterium
HSAVSWVKYPFLESHPQYD

SEQ ID NO: 676316 - protein, 23 aa, Mycobacterium
HSCAPELPWELLRRSAIGAVSVD

SEQ ID NO: 676317 - protein, 22 aa, Mycobacterium
HSDAERAAARWVLAEVPLAAFL

SEQ ID NO: 676318 - protein, 20 aa, Mycobacterium
HSDALLGIFAAIYPAASTAL

SEQ ID NO: 676319 - protein, 24 aa, Mycobacterium
HSDFYVLFVEYWLRAQRDNQLRER

SEQ ID NO: 676320 - protein, 29 aa, Mycobacterium
HSDLVGANPLEWLDEKFIGYLEDRRKEPR

SEQ ID NO: 676321 - protein, 25 aa, Mycobacterium
HSDPEFAAAAGFPAPILHGLCTYGM

SEQ ID NO: 676322 - protein, 25 aa, Mycobacterium
HSDPEFAAAAGFPRPILHGLCTYGM

SEQ ID NO: 676323 - protein, 20 aa, Mycobacterium
HSDYGHAFVSFLDKFPNVLS

SEQ ID NO: 676324 - protein, 20 aa, Mycobacterium
HSDYGHAFVSFLDKYPNALS

SEQ ID NO: 676325 - protein, 21 aa, Mycobacterium
HSDYPRFPDGGGMRTTNYNIA

SEQ ID NO: 676326 - protein, 22 aa, Mycobacterium
HSEAGLYLWATRDEPCRDTLAW

SEQ ID NO: 676327 - protein, 21 aa, Mycobacterium
HSEAGLYLWATRGEACRDTLR

SEQ ID NO: 676328 - protein, 21 aa, Mycobacterium
HSEAGLYLWATRGEGCRDTVA

SEQ ID NO: 676329 - protein, 22 aa, Mycobacterium
HSEAGLYLWATRGEPCHDTVAW

SEQ ID NO: 676330 - protein, 26 aa, Mycobacterium
HSEIDYRSSVRWRDAVRVTAECGRVG

SEQ ID NO: 676331 - protein, 23 aa, Mycobacterium
HSELAGIITIVARFPRTVHLVAQ

SEQ ID NO: 676332 - protein, 28 aa, Mycobacterium
HSELAGRWALLWPRDAPAPGASLLARLG

SEQ ID NO: 676333 - protein, 23 aa, Mycobacterium
HSENIVRRWWIREDVMAGTENLP

SEQ ID NO: 676334 - protein, 17 aa, Mycobacterium
HSETEMMRYLRALSDKD

SEQ ID NO: 676335 - protein, 24 aa, Mycobacterium
HSEVMRFLSHIGLFIRGDRTDTGH

SEQ ID NO: 676336 - protein, 17 aa, Mycobacterium
HSEYARMGSNGELRMSG

SEQ ID NO: 676337 - protein, 23 aa, Mycobacterium
HSFDLASEIPLWAKLFRIAKDEH

SEQ ID NO: 676338 - protein, 22 aa, Mycobacterium
HSFGAPMDVWWFRLPRHPGDPR

SEQ ID NO: 676339 - protein, 26 aa, Mycobacterium
HSFRGPGLRNSVMFGPPGRLYTYRSH

SEQ ID NO: 676340 - protein, 22 aa, Mycobacterium
HSFSLARYAGVLLGMSGMPVTY

SEQ ID NO: 676341 - protein, 17 aa, Mycobacterium
HSFSLARYAGVLMGMSG

SEQ ID NO: 676342 - protein, 25 aa, Mycobacterium
HSFVRRHVAAMPDWRPEEWGLPVNQ

SEQ ID NO: 676343 - protein, 17 aa, Mycobacterium
HSGAFALGAATNFVVMP

SEQ ID NO: 676344 - protein, 20 aa, Mycobacterium
HSGAVSWFTPIAHIVDTDPT

SEQ ID NO: 676345 - protein, 29 aa, Mycobacterium
HSGDGRRWCDLFEQWLKIKDGLISSLFTP

SEQ ID NO: 676346 - protein, 23 aa, Mycobacterium
HSGDPSWRSGGDGGNGGNGAYGG

SEQ ID NO: 676347 - protein, 19 aa, Mycobacterium
HSGETFVFIEQWADEEALK

SEQ ID NO: 676348 - protein, 28 aa, Mycobacterium
HSGLQVCRYRPGRAMVILMLMRYVDGDL

SEQ ID NO: 676349 - protein, 24 aa, Mycobacterium
HSGLRFEVADGFPDYRPELPGGQP

SEQ ID NO: 676350 - protein, 17 aa, Mycobacterium
HSGNWDMAGVWLAQTYG

SEQ ID NO: 676351 - protein, 27 aa, Mycobacterium
HSGQGCALATRMLVPRSHYDQAVEVAS

SEQ ID NO: 676352 - protein, 17 aa, Mycobacterium
HSGRSSVIYKLAVFKVV

SEQ ID NO: 676353 - protein, 17 aa, Mycobacterium
HSGRVAGVLGLLWSAPR

SEQ ID NO: 676354 - protein, 27 aa, Mycobacterium
HSGTDELTAWLDVVVEGFAAPDGQGVP

SEQ ID NO: 676355 - protein, 30 aa, Mycobacterium
HSGWWRAPLRWMLRASLALRSRLMVRGALR

SEQ ID NO: 676356 - protein, 17 aa, Mycobacterium
HSHELRQTVLALLADHD

SEQ ID NO: 676357 - protein, 23 aa, Mycobacterium
HSHFSRSVITRWVELALVEGSRF

SEQ ID NO: 676358 - protein, 18 aa, Mycobacterium
HSHFSRSVITRWVELPLV

SEQ ID NO: 676359 - protein, 25 aa, Mycobacterium
HSHLKMDGSWRVGERPVRVDHRARI

SEQ ID NO: 676360 - protein, 19 aa, Mycobacterium
HSHRPRRVRQPGEPLRIGI

SEQ ID NO: 676361 - protein, 20 aa, Mycobacterium
HSHWSFQHIEDFMPTAVIPR

SEQ ID NO: 676362 - protein, 24 aa, Mycobacterium
HSIAETLLGLGFGEHAVLPVLRRD

SEQ ID NO: 676363 - protein, 17 aa, Mycobacterium
HSIAPVRMATVYHSDSG

SEQ ID NO: 676364 - protein, 22 aa, Mycobacterium
HSIPGCLAVAIHTGAGTVLHTG

SEQ ID NO: 676365 - protein, 20 aa, Mycobacterium
HSIPNAPDTFGFLSEGQAGD

SEQ ID NO: 676366 - protein, 17 aa, Mycobacterium
HSIRNCYSDILQKGQTN

SEQ ID NO: 676367 - protein, 17 aa, Mycobacterium
HSISVGARRGVILATGG

SEQ ID NO: 676368 - protein, 21 aa, Mycobacterium
HSIWWKNLSPHGGDKPEGELG

SEQ ID NO: 676369 - protein, 19 aa, Mycobacterium
HSKLKANIAQILKSEGYIS

SEQ ID NO: 676370 - protein, 26 aa, Mycobacterium
HSKRLACPAQRIMLFAKDRGCTKPGC

SEQ ID NO: 676371 - protein, 29 aa, Mycobacterium
HSKVLPVTFGFPFGLSIVVPVNMPLPTKI

SEQ ID NO: 676372 - protein, 19 aa, Mycobacterium
HSLAHCLAVEDALGLDVPE

SEQ ID NO: 676373 - protein, 18 aa, Mycobacterium
HSLALVMVVRAMLEAEGA

SEQ ID NO: 676374 - protein, 23 aa, Mycobacterium
HSLARIDDWARWLRAAGVDTTGA

SEQ ID NO: 676375 - protein, 24 aa, Mycobacterium
HSLDEVFGLLAALGDPLLWSIPLH

SEQ ID NO: 676376 - protein, 18 aa, Mycobacterium
HSLGFTFGAKLTVPGTGV

SEQ ID NO: 676377 - protein, 21 aa, Mycobacterium
HSLGGGVAMQFVYQHPDYAKR

SEQ ID NO: 676378 - protein, 29 aa, Mycobacterium
HSLHAIKIAARIRKVFGRRVRIRDVFDSQ

SEQ ID NO: 676379 - protein, 17 aa, Mycobacterium
HSLKAGHDYGQYVRDAK

SEQ ID NO: 676380 - protein, 27 aa, Mycobacterium
HSLKELRPAGTSIRILFIFDPRRQAIL

SEQ ID NO: 676381 - protein, 25 aa, Mycobacterium
HSLLMYRYLVPLVLVVGSLVPVPQA

SEQ ID NO: 676382 - protein, 21 aa, Mycobacterium
HSLNQWYRMFGPAFETSLGLE

SEQ ID NO: 676383 - protein, 19 aa, Mycobacterium
HSLPMPSIMDTKGRIAGTG

SEQ ID NO: 676384 - protein, 17 aa, Mycobacterium
HSLQLIMDSLRYWVTEM

SEQ ID NO: 676385 - protein, 18 aa, Mycobacterium
HSLQLIMDSLRYWVTEMH

SEQ ID NO: 676386 - protein, 17 aa, Mycobacterium
HSLQLLMDSLRYWVTEM

SEQ ID NO: 676387 - protein, 23 aa, Mycobacterium
HSLRELAARTGVDPVQVDDVIAG

SEQ ID NO: 676388 - protein, 17 aa, Mycobacterium
HSLRTSRKDAPAVILDV

SEQ ID NO: 676389 - protein, 19 aa, Mycobacterium
HSLTPWFTDHAHYYDVGSE

SEQ ID NO: 676390 - protein, 19 aa, Mycobacterium
HSLVATKLVAAIRSECGAE

SEQ ID NO: 676391 - protein, 28 aa, Mycobacterium
HSLWPSFADRPAGWRVVYGEATRAECLD

SEQ ID NO: 676392 - protein, 28 aa, Mycobacterium
HSLWPVFADIPAGWRVVYGEATRAECLD

SEQ ID NO: 676393 - protein, 17 aa, Mycobacterium
HSLWPVFAGVPAGWTVA

SEQ ID NO: 676394 - protein, 28 aa, Mycobacterium
HSMGALHSWCLAAARPDLVTAVVVEDMA

SEQ ID NO: 676395 - protein, 23 aa, Mycobacterium
HSMGGLHSWCLAAERPELVTALV

SEQ ID NO: 676396 - protein, 21 aa, Mycobacterium
HSNGCTLLAVGGDWEGASVRL

SEQ ID NO: 676397 - protein, 18 aa, Mycobacterium
HSPALALAALTARLGRAC

SEQ ID NO: 676398 - protein, 19 aa, Mycobacterium
HSPASWKYPDERGQRTNDY

SEQ ID NO: 676399 - protein, 20 aa, Mycobacterium
HSPATAVGLVPEFSYQDDDD

SEQ ID NO: 676400 - protein, 20 aa, Mycobacterium
HSPEAKMFLHYGDLSDGARL

SEQ ID NO: 676401 - protein, 23 aa, Mycobacterium
HSPEDLRALLIRERVSVLSQTPS

SEQ ID NO: 676402 - protein, 17 aa, Mycobacterium
HSPFSGFGFFAGGLSGF

SEQ ID NO: 676403 - protein, 25 aa, Mycobacterium
HSPGAVALVRRARRLLPGDPEFGDP

SEQ ID NO: 676404 - protein, 19 aa, Mycobacterium
HSPGAVCYLVTGAAGRYLF

SEQ ID NO: 676405 - protein, 25 aa, Mycobacterium
HSPGSVCWFAPELGVVFSGDTLFSG

SEQ ID NO: 676406 - protein, 20 aa, Mycobacterium
HSPGSVCWHAPELNAVFSGD

SEQ ID NO: 676407 - protein, 19 aa, Mycobacterium
HSPHGMPLHPSRRSEVIEW

SEQ ID NO: 676408 - protein, 17 aa, Mycobacterium
HSPLRGVARGQTLVLYR

SEQ ID NO: 676409 - protein, 26 aa, Mycobacterium
HSPMAGTGWLHGWRLTFGGEDIGWEG

SEQ ID NO: 676410 - protein, 25 aa, Mycobacterium
HSPMAGTGWLNGWRLTFGGEDLGWD

SEQ ID NO: 676411 - protein, 29 aa, Mycobacterium
HSPMAGTGWLPGWRLTFGGEDIGWEGALA

SEQ ID NO: 676412 - protein, 24 aa, Mycobacterium
HSPMLRLLCTAWAERGWLAIRFDM

SEQ ID NO: 676413 - protein, 34 aa, Mycobacterium
HSPNAVDAWARLAAEPRFPLDAVDSLHEAKGQNQ

SEQ ID NO: 676414 - protein, 23 aa, Mycobacterium
HSPQRLDSELTWISEQTGGKPFG

SEQ ID NO: 676415 - protein, 22 aa, Mycobacterium
HSPRLAEFLDHVDVAVSLHGYG

SEQ ID NO: 676416 - protein, 17 aa, Mycobacterium
HSPRLLNQIKQVARVVP

SEQ ID NO: 676417 - protein, 17 aa, Mycobacterium
HSPSVDIGRVIPAIHLQ

SEQ ID NO: 676418 - protein, 20 aa, Mycobacterium
HSQEILLWRAHNAVDADAQR

SEQ ID NO: 676419 - protein, 20 aa, Mycobacterium
HSQIPLWVEETLRYDTSSQI

SEQ ID NO: 676420 - protein, 17 aa, Mycobacterium
HSQRIDLRWQHKETHGI

SEQ ID NO: 676421 - protein, 23 aa, Mycobacterium
HSQRTGILRVFGRQFLPSSSGPR

SEQ ID NO: 676422 - protein, 36 aa, Mycobacterium
HSQRWTRPAGFGRFSWDWEHCLGDTPRWGRWQDAEG

SEQ ID NO: 676423 - protein, 21 aa, Mycobacterium
HSRDRNDCTARCNATNDDEHA

SEQ ID NO: 676424 - protein, 25 aa, Mycobacterium
HSRFDRGGVIFAEFEPGRSMLGTIE

SEQ ID NO: 676425 - protein, 32 aa, Mycobacterium
HSRFSTNTFPSWPLAHPYRRVAHNGEINTVAG

SEQ ID NO: 676426 - protein, 25 aa, Mycobacterium
HSRGPFPGALWLQVRDIEATQAELR

SEQ ID NO: 676427 - protein, 25 aa, Mycobacterium
HSRGPFPGALWLQVRDLEATQAELR

SEQ ID NO: 676428 - protein, 22 aa, Mycobacterium
HSRLRHIISRGFTPRAISRLRD

SEQ ID NO: 676429 - protein, 28 aa, Mycobacterium
HSRPLDRGRPLWELYLIQGLSGGRVAIM

SEQ ID NO: 676430 - protein, 25 aa, Mycobacterium
HSRRLWTVLIFMLWHAIFVEQSVRP

SEQ ID NO: 676431 - protein, 22 aa, Mycobacterium
HSRRVFFFGALQGRRRGLQPDL

SEQ ID NO: 676432 - protein, 26 aa, Mycobacterium
HSRSEKRPAMTVALDFAMLPPEINSA

SEQ ID NO: 676433 - protein, 36 aa, Mycobacterium
HSRSIPLLVWQFREPRLCISSGPLGGGVGARDWLVN

SEQ ID NO: 676434 - protein, 24 aa, Mycobacterium
HSRVLRVGVAEFRRSLDRVMPRDA

SEQ ID NO: 676435 - protein, 24 aa, Mycobacterium
HSRVLRVGVAEFRRSLDRVMPRDK

SEQ ID NO: 676436 - protein, 26 aa, Mycobacterium
HSRVLRVGVAEFRRSLERVMPRDKNP

SEQ ID NO: 676437 - protein, 22 aa, Mycobacterium
HSRVRSGGLLVRTRVPGNRFED

SEQ ID NO: 676438 - protein, 27 aa, Mycobacterium
HSSAMKSRNGWDLVVCVTELARRLDRT

SEQ ID NO: 676439 - protein, 17 aa, Mycobacterium
HSSHYGRMCPIETPEGP

SEQ ID NO: 676440 - protein, 28 aa, Mycobacterium
HSSIEPSARLNVSWNRDFNALVYVLSGR

SEQ ID NO: 676441 - protein, 20 aa, Mycobacterium
HSSLLDRHRPLWETHIIEGL

SEQ ID NO: 676442 - protein, 17 aa, Mycobacterium
HSSLRRLVSSVFTPRQV

SEQ ID NO: 676443 - protein, 18 aa, Mycobacterium
HSSLTLYIQLYLGGFGLE

SEQ ID NO: 676444 - protein, 17 aa, Mycobacterium
HSSRACPRTLPAEMPCR

SEQ ID NO: 676445 - protein, 22 aa, Mycobacterium
HSSSHLLAATFERLLPQVTTPA

SEQ ID NO: 676446 - protein, 22 aa, Mycobacterium
HSSVVRDGRRLRLVDAVMTQND

SEQ ID NO: 676447 - protein, 27 aa, Mycobacterium
HSTAPPPTEIYGGAGGPGGGGSLDSLN

SEQ ID NO: 676448 - protein, 17 aa, Mycobacterium
HSTDCPVCGGSGLRAEA

SEQ ID NO: 676449 - protein, 22 aa, Mycobacterium
HSTFRHCSFLGSTFTECRLRPL

SEQ ID NO: 676450 - protein, 18 aa, Mycobacterium
HSTLLDRHRPLWETHIVE

SEQ ID NO: 676451 - protein, 19 aa, Mycobacterium
HSTMFGRLVNKMGVEPYTY

SEQ ID NO: 676452 - protein, 19 aa, Mycobacterium
HSTPGWWDGMVGPGAPIDT

SEQ ID NO: 676453 - protein, 19 aa, Mycobacterium
HSVAAWPAVCSGLRSEARK

SEQ ID NO: 676454 - protein, 25 aa, Mycobacterium
HSVALSAFFRWHFETTGRIDRKAGA

SEQ ID NO: 676455 - protein, 20 aa, Mycobacterium
HSVDLKGKRVALVGAGASGF

SEQ ID NO: 676456 - protein, 19 aa, Mycobacterium
HSVGAVILGEFEKIEEGQQ

SEQ ID NO: 676457 - protein, 21 aa, Mycobacterium
HSVHIEALLTVFPDARLIWAH

SEQ ID NO: 676458 - protein, 21 aa, Mycobacterium
HSVKKAWPFEVLPRTAWARQS

SEQ ID NO: 676459 - protein, 23 aa, Mycobacterium
HSVLKCYEVFGPGPLSRAEEDRY

SEQ ID NO: 676460 - protein, 25 aa, Mycobacterium
HSVRALSVPPTWGVSPTISGASNAV

SEQ ID NO: 676461 - protein, 17 aa, Mycobacterium
HSVRTSARYGVDAHIDK

SEQ ID NO: 676462 - protein, 25 aa, Mycobacterium
HSVSAWPSVCSGLRSEARKGRMLPY

SEQ ID NO: 676463 - protein, 18 aa, Mycobacterium
HSVSRWGGFLDDVAGFDP

SEQ ID NO: 676464 - protein, 17 aa, Mycobacterium
HSVVIPFLLPDTPVVAW

SEQ ID NO: 676465 - protein, 17 aa, Mycobacterium
HSVVLRVMQGHMTDPAR

SEQ ID NO: 676466 - protein, 25 aa, Mycobacterium
HSVVRRPNPGGGYGATLHRDYAGEF

SEQ ID NO: 676467 - protein, 36 aa, Mycobacterium
HSVVVAADWPLLAAAYRTRGSLRIVDDVLPVSDETT

SEQ ID NO: 676468 - protein, 20 aa, Mycobacterium
HSWDLCVGHASRITAPKGWE

SEQ ID NO: 676469 - protein, 18 aa, Mycobacterium
HSWFSRPVIDDGALKGVV

SEQ ID NO: 676470 - protein, 20 aa, Mycobacterium
HSYAELRAYLPGVTPAQRRK

SEQ ID NO: 676471 - protein, 21 aa, Mycobacterium
HSYDARFVLIGTMNPEEGELR

SEQ ID NO: 676472 - protein, 17 aa, Mycobacterium
HSYPSCGPLIEPLLGEH

SEQ ID NO: 676473 - protein, 21 aa, Mycobacterium
HSYSGLIADLYARMHPETVGA

SEQ ID NO: 676474 - protein, 19 aa, Mycobacterium
HSYTYLIVRSFPPFNHEGG

SEQ ID NO: 676475 - protein, 22 aa, Mycobacterium
HTAAIKWPPPVTFSQLRELVRE

SEQ ID NO: 676476 - protein, 24 aa, Mycobacterium
HTAAPWRVGFNGFSPGFAYLIGGD

SEQ ID NO: 676477 - protein, 20 aa, Mycobacterium
HTAAQRWWRTLADDMTVEAA

SEQ ID NO: 676478 - protein, 21 aa, Mycobacterium
HTAAVLAFRGAHVVLAVRSPE

SEQ ID NO: 676479 - protein, 19 aa, Mycobacterium
HTADCLLVADWNRPYTREE

SEQ ID NO: 676480 - protein, 21 aa, Mycobacterium
HTADWYRHWLEFGEVRSADQL

SEQ ID NO: 676481 - protein, 22 aa, Mycobacterium
HTAEALAGRGAHVVLAVRNPEK

SEQ ID NO: 676482 - protein, 17 aa, Mycobacterium
HTAECLVIGEWDHPYTR

SEQ ID NO: 676483 - protein, 21 aa, Mycobacterium
HTAELKRIWTDAAHRRRGYAR

SEQ ID NO: 676484 - protein, 24 aa, Mycobacterium
HTAELRIGASLVHLGHAARLWSPV

SEQ ID NO: 676485 - protein, 23 aa, Mycobacterium
HTAEVARLLATVARGDGNRHLAL

SEQ ID NO: 676486 - protein, 17 aa, Mycobacterium
HTAGLIGTIGIRIDGAD

SEQ ID NO: 676487 - protein, 20 aa, Mycobacterium
HTAGQAWIGSPLGQLLDPVI

SEQ ID NO: 676488 - protein, 18 aa, Mycobacterium
HTAGVPVMRLEAQGTTAT

SEQ ID NO: 676489 - protein, 32 aa, Mycobacterium
HTAKAEAEIACGRAAAVITELEALTAEHPYRE

SEQ ID NO: 676490 - protein, 30 aa, Mycobacterium
HTAKAEAEIACGRAAEVITELEALTVEHPY

SEQ ID NO: 676491 - protein, 17 aa, Mycobacterium
HTALARRAKSAGGESRA

SEQ ID NO: 676492 - protein, 25 aa, Mycobacterium
HTALKAITIDAAWILRKEDELGSIR

SEQ ID NO: 676493 - protein, 23 aa, Mycobacterium
HTALPLSRYGHLSGFTEANDAWV

SEQ ID NO: 676494 - protein, 17 aa, Mycobacterium
HTARPGIVIGRRGTEAD

SEQ ID NO: 676495 - protein, 18 aa, Mycobacterium
HTARPVLFNFGARQILNV

SEQ ID NO: 676496 - protein, 23 aa, Mycobacterium
HTARWDHSIPLAGKKIAVLGTGS

SEQ ID NO: 676497 - protein, 19 aa, Mycobacterium
HTATKHLFVTGGVVSSLGK

SEQ ID NO: 676498 - protein, 18 aa, Mycobacterium
HTAVAVAVETSVPALATV

SEQ ID NO: 676499 - protein, 25 aa, Mycobacterium
HTAVAVDAGHRWVLHAGDAFYHPGT

SEQ ID NO: 676500 - protein, 18 aa, Mycobacterium
HTAVKISPRRKGPVVWVK

SEQ ID NO: 676501 - protein, 24 aa, Mycobacterium
HTCSDSFHLGDWVSAQRRKHHRGE

SEQ ID NO: 676502 - protein, 17 aa, Mycobacterium
HTDAGFDFVEVFCDTPL

SEQ ID NO: 676503 - protein, 25 aa, Mycobacterium
HTDDLRFLVHWSAEVFSDFDELKKN

SEQ ID NO: 676504 - protein, 26 aa, Mycobacterium
HTDEGIRVAIELRRATPGLPVVILSQ

SEQ ID NO: 676505 - protein, 25 aa, Mycobacterium
HTDELRFLVHWSAEVFSDFDELKKN

SEQ ID NO: 676506 - protein, 26 aa, Mycobacterium
HTDELRFLVHWSAEVFTDFDELKKNM

SEQ ID NO: 676507 - protein, 29 aa, Mycobacterium
HTDGSSILLHFHATAFLNASGWSSAPAGY

SEQ ID NO: 676508 - protein, 24 aa, Mycobacterium
HTDITADLGVPVYFCDSRSPWQRG

SEQ ID NO: 676509 - protein, 26 aa, Mycobacterium
HTDPSWKIKGCYITRIQGDPCVYNKH

SEQ ID NO: 676510 - protein, 21 aa, Mycobacterium
HTDPSWNIKGCYITQIKGDPC

SEQ ID NO: 676511 - protein, 24 aa, Mycobacterium
HTDQLRFLVHWSAEVFTDHDELKK

SEQ ID NO: 676512 - protein, 24 aa, Mycobacterium
HTDSGVALSSRLAHGIGEASEAAL

SEQ ID NO: 676513 - protein, 24 aa, Mycobacterium
HTEEILLELGVDWDGIARAKDARA

SEQ ID NO: 676514 - protein, 32 aa, Mycobacterium
HTEFHARAGIDMTKLPSFMWLDVDDVIQESLA

SEQ ID NO: 676515 - protein, 20 aa, Mycobacterium
HTEFHERAGIEMGTIPEFMW

SEQ ID NO: 676516 - protein, 20 aa, Mycobacterium
HTEGAFTLSMFDGGHFYIND

SEQ ID NO: 676517 - protein, 21 aa, Mycobacterium
HTEGECARCLTAISGDVEIDL

SEQ ID NO: 676518 - protein, 22 aa, Mycobacterium
HTEGRWYVRAETLGQLAEIERK

SEQ ID NO: 676519 - protein, 19 aa, Mycobacterium
HTEGTPSHSDRCWPQRRGR

SEQ ID NO: 676520 - protein, 18 aa, Mycobacterium
HTEIARMLDIPVVTLELV

SEQ ID NO: 676521 - protein, 21 aa, Mycobacterium
HTEICDALLEGARKVAADAGI

SEQ ID NO: 676522 - protein, 21 aa, Mycobacterium
HTEIRALGGIGELFDTLLVYE

SEQ ID NO: 676523 - protein, 19 aa, Mycobacterium
HTEKATLWKLMDVHERTGI

SEQ ID NO: 676524 - protein, 17 aa, Mycobacterium
HTEKVTLFDLLDVTKRT

SEQ ID NO: 676525 - protein, 25 aa, Mycobacterium
HTEMPAMPLIRFLDGYETIAEMEAA

SEQ ID NO: 676526 - protein, 23 aa, Mycobacterium
HTENSWLRHLVMQGARERYGPPE

SEQ ID NO: 676527 - protein, 24 aa, Mycobacterium
HTEPWVQHCRRWAPALDARRSRRR

SEQ ID NO: 676528 - protein, 25 aa, Mycobacterium
HTERFWVGLSTYRPGGIAEKAAARE

SEQ ID NO: 676529 - protein, 25 aa, Mycobacterium
HTETVLLELGMDWDRIDQLKRSGAI

SEQ ID NO: 676530 - protein, 31 aa, Mycobacterium
HTFDIEPRPDQAFEFSVDVPGQVDVELHDLN

SEQ ID NO: 676531 - protein, 20 aa, Mycobacterium
HTFGLKAGLVTSFLRGATML

SEQ ID NO: 676532 - protein, 26 aa, Mycobacterium
HTFGYKAGCIASLIRGATVLPVAVFD

SEQ ID NO: 676533 - protein, 28 aa, Mycobacterium
HTFWDMTIAGYWAWSAWDPQQGEFHSAQ

SEQ ID NO: 676534 - protein, 17 aa, Mycobacterium
HTGEFTAPEAYRAIDSA

SEQ ID NO: 676535 - protein, 20 aa, Mycobacterium
HTGGALPRTRPFRVSYGITT

SEQ ID NO: 676536 - protein, 28 aa, Mycobacterium
HTGGFNRNTWGVAMIGNFDDVPPTPTQL

SEQ ID NO: 676537 - protein, 17 aa, Mycobacterium
HTGKAALYRRWDTKCEL

SEQ ID NO: 676538 - protein, 18 aa, Mycobacterium
HTGLPWPDVHNVGTVSLL

SEQ ID NO: 676539 - protein, 25 aa, Mycobacterium
HTGPAISAFNAWVLLKGLETLAVRV

SEQ ID NO: 676540 - protein, 25 aa, Mycobacterium
HTGPAMSAFNAWVLLKGLETLAVRV

SEQ ID NO: 676541 - protein, 26 aa, Mycobacterium
HTGPAMSAFNAWVLLKGLETMAIRVE

SEQ ID NO: 676542 - protein, 20 aa, Mycobacterium
HTGPLARFGAELDDAATRAA

SEQ ID NO: 676543 - protein, 21 aa, Mycobacterium
HTGRLARIFPEVSVEPDAIFV

SEQ ID NO: 676544 - protein, 18 aa, Mycobacterium
HTGRVRCSMWSPRLLQIS

SEQ ID NO: 676545 - protein, 17 aa, Mycobacterium
HTGSRGFPADQVAGPVH

SEQ ID NO: 676546 - protein, 23 aa, Mycobacterium
HTGTPVLRKGRRRFTMPRPLSGG

SEQ ID NO: 676547 - protein, 25 aa, Mycobacterium
HTHADFYTCEGLRAASALLVPGGTF

SEQ ID NO: 676548 - protein, 26 aa, Mycobacterium
HTHANEIYVAWALSQHNAFGGDLAVL

SEQ ID NO: 676549 - protein, 18 aa, Mycobacterium
HTHELRQTVLALLAGHEL

SEQ ID NO: 676550 - protein, 26 aa, Mycobacterium
HTHLPWLANHGRWPVGEEWLYQSWSA

SEQ ID NO: 676551 - protein, 18 aa, Mycobacterium
HTHRVTPRAQIRATAAIG

SEQ ID NO: 676552 - protein, 27 aa, Mycobacterium
HTHSFRWDHAIAFARWALADDCPTDIT

SEQ ID NO: 676553 - protein, 23 aa, Mycobacterium
HTIALPALQAMHAIHGPVALVHF

SEQ ID NO: 676554 - protein, 24 aa, Mycobacterium
HTICGFHPNHFREAGIPMTMEMAK

SEQ ID NO: 676555 - protein, 18 aa, Mycobacterium
HTIRGRVSGLPINTLAPI

SEQ ID NO: 676556 - protein, 24 aa, Mycobacterium
HTIWWKNLSPHGGDKPTGDLAAAI

SEQ ID NO: 676557 - protein, 19 aa, Mycobacterium
HTKALPGDRVAILGVGGLG

SEQ ID NO: 676558 - protein, 20 aa, Mycobacterium
HTKAWKAMFDDYLSDRAKRT

SEQ ID NO: 676559 - protein, 18 aa, Mycobacterium
HTKGPKIRIHKFKNKTGY

SEQ ID NO: 676560 - protein, 18 aa, Mycobacterium
HTKGPKIRIHKFRNKTGY

SEQ ID NO: 676561 - protein, 19 aa, Mycobacterium
HTKGPKIRIHKFRNKTGYH

SEQ ID NO: 676562 - protein, 18 aa, Mycobacterium
HTKGRMLQWGSFFDEHGQ

SEQ ID NO: 676563 - protein, 19 aa, Mycobacterium
HTKICDALLAGARNTAADS

SEQ ID NO: 676564 - protein, 18 aa, Mycobacterium
HTKIRRLLASAFTPKQMR

SEQ ID NO: 676565 - protein, 24 aa, Mycobacterium
HTKPPDFWQWLIGEVKAADPDVLF

SEQ ID NO: 676566 - protein, 23 aa, Mycobacterium
HTKSIVYELLWFLRGDSNVRWLQ

SEQ ID NO: 676567 - protein, 21 aa, Mycobacterium
HTKSVIYELLWFLRGDSNVRW

SEQ ID NO: 676568 - protein, 19 aa, Mycobacterium
HTLARLTLREDLYRSVRLL

SEQ ID NO: 676569 - protein, 17 aa, Mycobacterium
HTLELHPQYVLENGVDF

SEQ ID NO: 676570 - protein, 17 aa, Mycobacterium
HTLIWPNLFLAEMNVMF

SEQ ID NO: 676571 - protein, 25 aa, Mycobacterium
HTLPMPLPTLFSRWYGPISPVKQVR

SEQ ID NO: 676572 - protein, 21 aa, Mycobacterium
HTLPRLLLPLWDSELGKGFIA

SEQ ID NO: 676573 - protein, 24 aa, Mycobacterium
HTLTLCLQAGFSPAEAIRIYMTLG

SEQ ID NO: 676574 - protein, 21 aa, Mycobacterium
HTMARWCAARGMELAPHGKTH

SEQ ID NO: 676575 - protein, 24 aa, Mycobacterium
HTMLKRHPNVVAHFVEDFGEPVQV

SEQ ID NO: 676576 - protein, 19 aa, Mycobacterium
HTNLGLAIDLPGKDGKRTL

SEQ ID NO: 676577 - protein, 18 aa, Mycobacterium
HTNLGLAIDLQGKDGKRS

SEQ ID NO: 676578 - protein, 18 aa, Mycobacterium
HTNLGLAIDLQGKDGNRS

SEQ ID NO: 676579 - protein, 33 aa, Mycobacterium
HTNPRAKMSGLRRGFVKIFCRPATGVVIGGVVV

SEQ ID NO: 676580 - protein, 26 aa, Mycobacterium
HTNPWLRNGNALTYVPDFRVLRKLLA

SEQ ID NO: 676581 - protein, 24 aa, Mycobacterium
HTNRGDIKIALFGNHAPKTVNNFV

SEQ ID NO: 676582 - protein, 24 aa, Mycobacterium
HTNRGDIKIALFGNHAPKTVSNFV

SEQ ID NO: 676583 - protein, 24 aa, Mycobacterium
HTNRGDVVIALFGNHAPKTVANFV

SEQ ID NO: 676584 - protein, 20 aa, Mycobacterium
HTNSLAGWYAVPLQGPYSAA

SEQ ID NO: 676585 - protein, 26 aa, Mycobacterium
HTPADRLAGLFAEFSRVLADPGWLLL

SEQ ID NO: 676586 - protein, 20 aa, Mycobacterium
HTPELFFAVGQGYRNFAQIS

SEQ ID NO: 676587 - protein, 17 aa, Mycobacterium
HTPGRTGVWTRYLEEVQ

SEQ ID NO: 676588 - protein, 26 aa, Mycobacterium
HTQNFMAMSAFRWMVLGHREIADMIT

SEQ ID NO: 676589 - protein, 23 aa, Mycobacterium
HTQTARMDLVFSLGERFTDTGAP

SEQ ID NO: 676590 - protein, 20 aa, Mycobacterium
HTRARPGDRVAVLGVGGLGH

SEQ ID NO: 676591 - protein, 18 aa, Mycobacterium
HTRFHGVALDPGRYRRGP

SEQ ID NO: 676592 - protein, 22 aa, Mycobacterium
HTRGPTQMGLAWQVETGPAQII

SEQ ID NO: 676593 - protein, 21 aa, Mycobacterium
HTRGSVCFRVPQAAKDDRDVV

SEQ ID NO: 676594 - protein, 25 aa, Mycobacterium
HTRILKVRASELTFHAVPGHDWSYR

SEQ ID NO: 676595 - protein, 18 aa, Mycobacterium
HTRIRTIVVDGRRWAVAA

SEQ ID NO: 676596 - protein, 17 aa, Mycobacterium
HTRLRRLVVQAFTPKAL

SEQ ID NO: 676597 - protein, 17 aa, Mycobacterium
HTRMRPHYFPFTEPSAE

SEQ ID NO: 676598 - protein, 17 aa, Mycobacterium
HTRRIGLIEVRGQARNQ

SEQ ID NO: 676599 - protein, 24 aa, Mycobacterium
HTSEALTPLLWVPGVAAELAEAAS

SEQ ID NO: 676600 - protein, 19 aa, Mycobacterium
HTSGIARINFDVEHVFVRP

SEQ ID NO: 676601 - protein, 29 aa, Mycobacterium
HTSGRIERFLLLWAEGSMTIAVPSTPANY

SEQ ID NO: 676602 - protein, 17 aa, Mycobacterium
HTSLFFLGNSVYLPTGF

SEQ ID NO: 676603 - protein, 26 aa, Mycobacterium
HTSWREHLRHGAAIAAALRDRLDPAK

SEQ ID NO: 676604 - protein, 25 aa, Mycobacterium
HTSYRRWAGALVERARRLDTVEFWA

SEQ ID NO: 676605 - protein, 20 aa, Mycobacterium
HTTAWPCGVTHSANCKCYCR

SEQ ID NO: 676606 - protein, 20 aa, Mycobacterium
HTTFTPKHMGVMFGAPGGDY

SEQ ID NO: 676607 - protein, 25 aa, Mycobacterium
HTTFTPKHMGVMFGAPGGDYCHGLL

SEQ ID NO: 676608 - protein, 18 aa, Mycobacterium
HTTPPRLVLDGFLASGQP

SEQ ID NO: 676609 - protein, 19 aa, Mycobacterium
HTTPWPFGVTHASGTKHYC

SEQ ID NO: 676610 - protein, 25 aa, Mycobacterium
HTVADCLRYEVAPFGITVSTVEPGV

SEQ ID NO: 676611 - protein, 20 aa, Mycobacterium
HTVAPFKVGPDFIDPGYHAV

SEQ ID NO: 676612 - protein, 17 aa, Mycobacterium
HTVCLAGAFMVPDPLSG

SEQ ID NO: 676613 - protein, 17 aa, Mycobacterium
HTVEFYVAGTAVRRGGE

SEQ ID NO: 676614 - protein, 17 aa, Mycobacterium
HTVFAVDFVPERLARAK

SEQ ID NO: 676615 - protein, 24 aa, Mycobacterium
HTVGLNHEFHRAINIAADSPKLAQ

SEQ ID NO: 676616 - protein, 17 aa, Mycobacterium
HTVLLRLPSGIDRSSIE

SEQ ID NO: 676617 - protein, 32 aa, Mycobacterium
HTVPYRANMWALRKLGVRRVLAPCAVGSLKPE

SEQ ID NO: 676618 - protein, 20 aa, Mycobacterium
HTVRGRVSVIDAKTHKVTAT

SEQ ID NO: 676619 - protein, 19 aa, Mycobacterium
HTVRPALQIIRTVPGVSTV

SEQ ID NO: 676620 - protein, 23 aa, Mycobacterium
HTVRYGRSRLLLPVGPRDLSANG

SEQ ID NO: 676621 - protein, 24 aa, Mycobacterium
HTVWFELHEELILAVGLTREQAAR

SEQ ID NO: 676622 - protein, 19 aa, Mycobacterium
HTWAHDQWEEVARKGEGLY

SEQ ID NO: 676623 - protein, 19 aa, Mycobacterium
HTWKRSSFSGTEIFGKTVG

SEQ ID NO: 676624 - protein, 17 aa, Mycobacterium
HTWRCQWDETGMRFWQD

SEQ ID NO: 676625 - protein, 22 aa, Mycobacterium
HTWTETRRGFFGADVHVRKEPV

SEQ ID NO: 676626 - protein, 25 aa, Mycobacterium
HTYFPRLRLELDKGLGWKAEVEAAL

SEQ ID NO: 676627 - protein, 17 aa, Mycobacterium
HTYLRGFALEVMANSDN

SEQ ID NO: 676628 - protein, 24 aa, Mycobacterium
HTYRGRDEILAWMQRVSTEYSYTT

SEQ ID NO: 676629 - protein, 17 aa, Mycobacterium
HTYVNIGFWSSVPVGPE

SEQ ID NO: 676630 - protein, 17 aa, Mycobacterium
HVAARIGTLSALALLLR

SEQ ID NO: 676631 - protein, 19 aa, Mycobacterium
HVADRVTVMYLGRMIESGR

SEQ ID NO: 676632 - protein, 21 aa, Mycobacterium
HVAEAMAVVAAETIAGAETLP

SEQ ID NO: 676633 - protein, 20 aa, Mycobacterium
HVAEAMGVVAAETIAGADTL

SEQ ID NO: 676634 - protein, 19 aa, Mycobacterium
HVAEAMGVVAAETIAGAET

SEQ ID NO: 676635 - protein, 28 aa, Mycobacterium
HVAEGFPSLSAIILNGGLKLHPRIADLV

SEQ ID NO: 676636 - protein, 23 aa, Mycobacterium
HVAELSSALARRGHDVVVYTRRD

SEQ ID NO: 676637 - protein, 17 aa, Mycobacterium
HVAFGLGPHRCIGSHLA

SEQ ID NO: 676638 - protein, 26 aa, Mycobacterium
HVAGAFTLDGLGGWFIDGIDGDPSNV

SEQ ID NO: 676639 - protein, 25 aa, Mycobacterium
HVAGGFTLDGLGGWFVDGIDGDPSN

SEQ ID NO: 676640 - protein, 17 aa, Mycobacterium
HVAIDFELISAAMRRAG

SEQ ID NO: 676641 - protein, 22 aa, Mycobacterium
HVAKFSQFFGFLWPGEYRAFSN

SEQ ID NO: 676642 - protein, 18 aa, Mycobacterium
HVAPEWSDPFRGRFDQGW

SEQ ID NO: 676643 - protein, 24 aa, Mycobacterium
HVARQVLPMLIAKAVPGELKIVHS

SEQ ID NO: 676644 - protein, 25 aa, Mycobacterium
HVARRLTPPVARPALGLVGMVPGPL

SEQ ID NO: 676645 - protein, 18 aa, Mycobacterium
HVASALGVEPGQCTMVAS

SEQ ID NO: 676646 - protein, 22 aa, Mycobacterium
HVASLRAIRALIDIRPPSHPFR

SEQ ID NO: 676647 - protein, 17 aa, Mycobacterium
HVAVMLGGEVVRMAANV

SEQ ID NO: 676648 - protein, 18 aa, Mycobacterium
HVAVVACMDARLDVYRLL

SEQ ID NO: 676649 - protein, 20 aa, Mycobacterium
HVAVVACMDARLDVYRLLGL

SEQ ID NO: 676650 - protein, 20 aa, Mycobacterium
HVAVVPLDFVASRFPESTRL

SEQ ID NO: 676651 - protein, 17 aa, Mycobacterium
HVDAGAILNELGGKPPQ

SEQ ID NO: 676652 - protein, 21 aa, Mycobacterium
HVDALRRRGWLDGAGELTEAG

SEQ ID NO: 676653 - protein, 23 aa, Mycobacterium
HVDECWYCGPCAARCPTGAVTVN

SEQ ID NO: 676654 - protein, 24 aa, Mycobacterium
HVDEEWRFLTGWPDARSDDPDKMA

SEQ ID NO: 676655 - protein, 24 aa, Mycobacterium
HVDEEWRFLTGWPDARSDDPNKMA

SEQ ID NO: 676656 - protein, 29 aa, Mycobacterium
HVDEIKCNVLRPWLEKALADMNVLMNGLA

SEQ ID NO: 676657 - protein, 19 aa, Mycobacterium
HVDGVPCCTHIGPDGSGHF

SEQ ID NO: 676658 - protein, 20 aa, Mycobacterium
HVDGVPCCTHIGPDGSGHFV

SEQ ID NO: 676659 - protein, 18 aa, Mycobacterium
HVDHDAGAEVRRMRRLTL

SEQ ID NO: 676660 - protein, 21 aa, Mycobacterium
HVDPGFPCRLGTGVTVGHNVV

SEQ ID NO: 676661 - protein, 24 aa, Mycobacterium
HVDPGFPVRIGAGVSVGHNAVLHG

SEQ ID NO: 676662 - protein, 22 aa, Mycobacterium
HVDRIISFEAFDAFKKERWPAF

SEQ ID NO: 676663 - protein, 17 aa, Mycobacterium
HVDRYAEAYAEWRTLGD

SEQ ID NO: 676664 - protein, 25 aa, Mycobacterium
HVDVFGEIGIPFTRVMITNGGSRST

SEQ ID NO: 676665 - protein, 21 aa, Mycobacterium
HVDVPELLRVLDFAPTAASDL

SEQ ID NO: 676666 - protein, 21 aa, Mycobacterium
HVDVPELLRVLDFAPTAESAL

SEQ ID NO: 676667 - protein, 21 aa, Mycobacterium
HVDVPELLRVLDFAPTTEERL

SEQ ID NO: 676668 - protein, 21 aa, Mycobacterium
HVDVPELLRVLDFTPAEDVLV

SEQ ID NO: 676669 - protein, 21 aa, Mycobacterium
HVDVPELLRVLDFTPTPEDRL

SEQ ID NO: 676670 - protein, 21 aa, Mycobacterium
HVDVPELLRVLDFTPTTEAQV

SEQ ID NO: 676671 - protein, 19 aa, Mycobacterium
HVDWSRVYPAATFALVPLP

SEQ ID NO: 676672 - protein, 18 aa, Mycobacterium
HVEARKGVLLAAGGFGHN

SEQ ID NO: 676673 - protein, 24 aa, Mycobacterium
HVEFGFAAHRGMTVLPLAKSASGG

SEQ ID NO: 676674 - protein, 31 aa, Mycobacterium
HVEGALVGLAWVDARLVAAAVSFDVCTAADP

SEQ ID NO: 676675 - protein, 21 aa, Mycobacterium
HVEGLKCRSIIEVASQGEDRL

SEQ ID NO: 676676 - protein, 19 aa, Mycobacterium
HVEIGSRAGALPTTVTGVA

SEQ ID NO: 676677 - protein, 24 aa, Mycobacterium
HVEPAWRVGDDVSHTEFGHGWVQG

SEQ ID NO: 676678 - protein, 30 aa, Mycobacterium
HVETLKFTYVVGWPHLWRAYKKFSDPDATY

SEQ ID NO: 676679 - protein, 22 aa, Mycobacterium
HVETLTGFKWLARADARVPDGT

SEQ ID NO: 676680 - protein, 19 aa, Mycobacterium
HVFGIPGQNALGLFDAVRR

SEQ ID NO: 676681 - protein, 19 aa, Mycobacterium
HVFHAKAVVLATGGSGRMY

SEQ ID NO: 676682 - protein, 20 aa, Mycobacterium
HVFHGKAIVLATGGSGRMYK

SEQ ID NO: 676683 - protein, 31 aa, Mycobacterium
HVGALCARIPSAPIRLLWRLVYATPVRNFDV

SEQ ID NO: 676684 - protein, 19 aa, Mycobacterium
HVGCLRECGLVAGRPQGRQ

SEQ ID NO: 676685 - protein, 31 aa, Mycobacterium
HVGEAYEDLAWFCVRAWRFGAPASLGAGGLG

SEQ ID NO: 676686 - protein, 19 aa, Mycobacterium
HVGHAYEYIATDAIARFKR

SEQ ID NO: 676687 - protein, 20 aa, Mycobacterium
HVGKPFLSYVQRTRAADDGR

SEQ ID NO: 676688 - protein, 23 aa, Mycobacterium
HVGRYAAPRVVDFVSELPRTEVG

SEQ ID NO: 676689 - protein, 20 aa, Mycobacterium
HVGSASRVLLAWNPELAERI

SEQ ID NO: 676690 - protein, 18 aa, Mycobacterium
HVGTVFLIPGRGDTLRIN

SEQ ID NO: 676691 - protein, 18 aa, Mycobacterium
HVHAWRRAFDAEGIVVAS

SEQ ID NO: 676692 - protein, 17 aa, Mycobacterium
HVHFRKLINQGFTVRNV

SEQ ID NO: 676693 - protein, 17 aa, Mycobacterium
HVHLARHLICPDCDAPA

SEQ ID NO: 676694 - protein, 24 aa, Mycobacterium
HVHPHRLRHSFSMQTLEYLVTGYY

SEQ ID NO: 676695 - protein, 23 aa, Mycobacterium
HVIDVKRAIAWVRENIGDYGGDS

SEQ ID NO: 676696 - protein, 18 aa, Mycobacterium
HVIGRAGSYDELSALAQG

SEQ ID NO: 676697 - protein, 20 aa, Mycobacterium
HVIHLAAIVGGIANFHRLPH

SEQ ID NO: 676698 - protein, 21 aa, Mycobacterium
HVINISSVFGLFSCAGQAAYN

SEQ ID NO: 676699 - protein, 20 aa, Mycobacterium
HVIRRLSQIMPLLRERLQRL

SEQ ID NO: 676700 - protein, 18 aa, Mycobacterium
HVITGMKLTTGVGDPENG

SEQ ID NO: 676701 - protein, 17 aa, Mycobacterium
HVIWLPRGLTRDAERFG

SEQ ID NO: 676702 - protein, 22 aa, Mycobacterium
HVKAWLADVLPNFANYAHMLGL

SEQ ID NO: 676703 - protein, 19 aa, Mycobacterium
HVKEVRLSTRLTDSPACLI

SEQ ID NO: 676704 - protein, 22 aa, Mycobacterium
HVKEVRLSTRLTDSPACLITDT

SEQ ID NO: 676705 - protein, 18 aa, Mycobacterium
HVKLALKDDLLAGELPDQ

SEQ ID NO: 676706 - protein, 18 aa, Mycobacterium
HVKLALKETMLTTELPDQ

SEQ ID NO: 676707 - protein, 27 aa, Mycobacterium
HVKNNRLAAVGFVWAFIAAGCEGPTRA

SEQ ID NO: 676708 - protein, 18 aa, Mycobacterium
HVLAAFGLTGVEPASLGA

SEQ ID NO: 676709 - protein, 18 aa, Mycobacterium
HVLAAFGLTGVQPASLGS

SEQ ID NO: 676710 - protein, 18 aa, Mycobacterium
HVLAAFGLTGVQPVYLGA

SEQ ID NO: 676711 - protein, 35 aa, Mycobacterium
HVLALGGAVGDEWGSRAIAVFGHRPYVGVSVNMVA

SEQ ID NO: 676712 - protein, 18 aa, Mycobacterium
HVLARAITIGAFANKVTL

SEQ ID NO: 676713 - protein, 17 aa, Mycobacterium
HVLARALTIGAFSNGVT

SEQ ID NO: 676714 - protein, 23 aa, Mycobacterium
HVLEAVSVAHSWRHGDVLVVDNV

SEQ ID NO: 676715 - protein, 24 aa, Mycobacterium
HVLFPSGFLNTGIWESWRHRPERY

SEQ ID NO: 676716 - protein, 24 aa, Mycobacterium
HVLGIVGQRCEPVFVMAAQGQPLP

SEQ ID NO: 676717 - protein, 19 aa, Mycobacterium
HVLHALAWLVPGEIAVFGL

SEQ ID NO: 676718 - protein, 18 aa, Mycobacterium
HVLHPGCLERVPAESHIA

SEQ ID NO: 676719 - protein, 17 aa, Mycobacterium
HVLIFIKHGLWKSWSEN

SEQ ID NO: 676720 - protein, 25 aa, Mycobacterium
HVLLDELRRNLCIETEFLSEEKFDA

SEQ ID NO: 676721 - protein, 27 aa, Mycobacterium
HVLLFPFAAGVPTWWRTMEAKVAKLSN

SEQ ID NO: 676722 - protein, 17 aa, Mycobacterium
HVLLTHLMPAGAPRGLT

SEQ ID NO: 676723 - protein, 17 aa, Mycobacterium
HVLPIKSVRSLRKKDMV

SEQ ID NO: 676724 - protein, 17 aa, Mycobacterium
HVLRGSTIVEGEDVAVQ

SEQ ID NO: 676725 - protein, 25 aa, Mycobacterium
HVLRHFCASQLYLAGMNLFAIQELL

SEQ ID NO: 676726 - protein, 25 aa, Mycobacterium
HVLRHFCASQLYLGGMNLFAIQELC

SEQ ID NO: 676727 - protein, 18 aa, Mycobacterium
HVLSDVNAVMGYFYLHDT

SEQ ID NO: 676728 - protein, 17 aa, Mycobacterium
HVLSRPDLELVGVRVYD

SEQ ID NO: 676729 - protein, 25 aa, Mycobacterium
HVLTRYQDVSAFVLFSSMAGIMGTP

SEQ ID NO: 676730 - protein, 20 aa, Mycobacterium
HVLWWQVYPLGFVGVHPADT

SEQ ID NO: 676731 - protein, 24 aa, Mycobacterium
HVLYRRLGYVAVRDEYAYRIDADG

SEQ ID NO: 676732 - protein, 17 aa, Mycobacterium
HVMGRGILYGTLGHGGT

SEQ ID NO: 676733 - protein, 17 aa, Mycobacterium
HVMGRQILYGTLCNGGT

SEQ ID NO: 676734 - protein, 24 aa, Mycobacterium
HVMSEGYVGQGMRVDPHPEWFRTG

SEQ ID NO: 676735 - protein, 20 aa, Mycobacterium
HVNFPLRNMHAMPNSESEYG

SEQ ID NO: 676736 - protein, 24 aa, Mycobacterium
HVNGRWLAEYAIPADRAVDGAFRT

SEQ ID NO: 676737 - protein, 18 aa, Mycobacterium
HVNGRWLAEYEIPADRAT

SEQ ID NO: 676738 - protein, 26 aa, Mycobacterium
HVNGRYIFHKDLRRAVIFGRNDLVKD

SEQ ID NO: 676739 - protein, 34 aa, Mycobacterium
HVNKLPGRHIPSLRQVIGCVFQDFRLLQQKTVFE

SEQ ID NO: 676740 - protein, 30 aa, Mycobacterium
HVNKLRGRHVPKLRQVIGTVFQDFRLLQQK

SEQ ID NO: 676741 - protein, 31 aa, Mycobacterium
HVNKLRGRHVPKLRQVIGTVFQDFRLLQQKT

SEQ ID NO: 676742 - protein, 30 aa, Mycobacterium
HVPAESLALVNLMSMFGLHRKLRGAAAGHF

SEQ ID NO: 676743 - protein, 28 aa, Mycobacterium
HVPAHAELAWVLGCLTGYGEAARMTQFK

SEQ ID NO: 676744 - protein, 27 aa, Mycobacterium
HVPALRALPEYDLRAVATSRPESAERA

SEQ ID NO: 676745 - protein, 22 aa, Mycobacterium
HVPASAVEYVIMGQVLTAGAGQ

SEQ ID NO: 676746 - protein, 18 aa, Mycobacterium
HVPERLGGQGGELADMAC

SEQ ID NO: 676747 - protein, 26 aa, Mycobacterium
HVPGRAPVVPALGLAVLGARAAGKVI

SEQ ID NO: 676748 - protein, 25 aa, Mycobacterium
HVPLIKRIVLKTVVLLSPRTRRLNL

SEQ ID NO: 676749 - protein, 27 aa, Mycobacterium
HVPNFPWPWGLIDLAARVVLPVSATVR

SEQ ID NO: 676750 - protein, 17 aa, Mycobacterium
HVPPAVISARFHQAVAD

SEQ ID NO: 676751 - protein, 19 aa, Mycobacterium
HVPQPDFFNAIVVADGREP

SEQ ID NO: 676752 - protein, 24 aa, Mycobacterium
HVPQWRFVAEWTRSEAEQLKPGPA

SEQ ID NO: 676753 - protein, 24 aa, Mycobacterium
HVPQWRFVAEWTRSKAEELKPGPA

SEQ ID NO: 676754 - protein, 24 aa, Mycobacterium
HVPQWRFVAEWTRSRAEELKPGPA

SEQ ID NO: 676755 - protein, 17 aa, Mycobacterium
HVPRAVVNRDTRGFIKL

SEQ ID NO: 676756 - protein, 24 aa, Mycobacterium
HVPVLLDRCVELLAPALTREGATL

SEQ ID NO: 676757 - protein, 30 aa, Mycobacterium
HVPWFPKDVPAWSVRWVFFHMIEELARHAG

SEQ ID NO: 676758 - protein, 28 aa, Mycobacterium
HVQGVGFRWWTRCRALELGLTGYAANHA

SEQ ID NO: 676759 - protein, 22 aa, Mycobacterium
HVQVFRMWLDAVGITEDLHYFL

SEQ ID NO: 676760 - protein, 22 aa, Mycobacterium
HVQVFRMWLDAVGVTEDLHQYL

SEQ ID NO: 676761 - protein, 22 aa, Mycobacterium
HVRADLPAHVELSGHPDVIVAP

SEQ ID NO: 676762 - protein, 23 aa, Mycobacterium
HVRAEAYGPVVLRQKGSTWRGLK

SEQ ID NO: 676763 - protein, 22 aa, Mycobacterium
HVRDDVDYCCMPLFHGNAIMAL

SEQ ID NO: 676764 - protein, 17 aa, Mycobacterium
HVREMTANAPVMLDHLS

SEQ ID NO: 676765 - protein, 39 aa, Mycobacterium
HVRGGFDGLNSWLTGMFDRGAWRPAAVVVVGSDTDVEEF

SEQ ID NO: 676766 - protein, 28 aa, Mycobacterium
HVRGRGLLCGVVLTAARAKDAEAAAREA

SEQ ID NO: 676767 - protein, 22 aa, Mycobacterium
HVRHRYPRVEVMQANLADLPLP

SEQ ID NO: 676768 - protein, 20 aa, Mycobacterium
HVRKAALDALRRAHVSLDDL

SEQ ID NO: 676769 - protein, 18 aa, Mycobacterium
HVRLRLRLSQSGASAYLS

SEQ ID NO: 676770 - protein, 21 aa, Mycobacterium
HVRPGRHGRLGLTLEGRNYPE

SEQ ID NO: 676771 - protein, 18 aa, Mycobacterium
HVRPVAWLCVGPVADLPD

SEQ ID NO: 676772 - protein, 17 aa, Mycobacterium
HVRRLRAKLGPEYEALI

SEQ ID NO: 676773 - protein, 29 aa, Mycobacterium
HVRVDGWPGQRFALIFRDWLRSDHQACAE

SEQ ID NO: 676774 - protein, 21 aa, Mycobacterium
HVRVIRDFVRHLPVEVDIETL

SEQ ID NO: 676775 - protein, 20 aa, Mycobacterium
HVRVRLSAIAANFRDVMIAL

SEQ ID NO: 676776 - protein, 17 aa, Mycobacterium
HVSEADAAVHLPGTSSA

SEQ ID NO: 676777 - protein, 22 aa, Mycobacterium
HVSEVLRSWDLVDELYERERPD

SEQ ID NO: 676778 - protein, 26 aa, Mycobacterium
HVSGHAYAGELLFLYNGIRPRHVMPV

SEQ ID NO: 676779 - protein, 27 aa, Mycobacterium
HVSGHAYAGELLYLYNAVRPRNVMPVH

SEQ ID NO: 676780 - protein, 21 aa, Mycobacterium
HVSGPRYLLTVTLESTSDGGT

SEQ ID NO: 676781 - protein, 17 aa, Mycobacterium
HVSMGWSSARKLRRAVD

SEQ ID NO: 676782 - protein, 21 aa, Mycobacterium
HVSTVLGRRVGPSTGTNLWGA

SEQ ID NO: 676783 - protein, 27 aa, Mycobacterium
HVSVGIDLRLDWPKALAQAGFDASAPT

SEQ ID NO: 676784 - protein, 17 aa, Mycobacterium
HVTAATVLRDWRLSLAP

SEQ ID NO: 676785 - protein, 20 aa, Mycobacterium
HVTALDICPRAVEYATANAA

SEQ ID NO: 676786 - protein, 22 aa, Mycobacterium
HVTEALAPLRQKIFDEIKARTK

SEQ ID NO: 676787 - protein, 27 aa, Mycobacterium
HVTELDRRFTLAAGLLELADREFSEIR

SEQ ID NO: 676788 - protein, 24 aa, Mycobacterium
HVTFGVLPPLDWVDPVNGALNVPG

SEQ ID NO: 676789 - protein, 23 aa, Mycobacterium
HVTKRFGDYLAVSDADFSIASGE

SEQ ID NO: 676790 - protein, 18 aa, Mycobacterium
HVTMWRNGINVFFETFGS

SEQ ID NO: 676791 - protein, 31 aa, Mycobacterium
HVTQPRFGSACARALPDPASFVRFELSLNVV

SEQ ID NO: 676792 - protein, 26 aa, Mycobacterium
HVTRLREDLCPDWPQPAQPGGSYRIE

SEQ ID NO: 676793 - protein, 25 aa, Mycobacterium
HVTRLRGDLRPDWPQPAQSGGSYRV

SEQ ID NO: 676794 - protein, 28 aa, Mycobacterium
HVVAKIRYSMWLGEDGWIVDRFLGGNAP

SEQ ID NO: 676795 - protein, 23 aa, Mycobacterium
HVVCRSCGAIADIDCAVGEAPCL

SEQ ID NO: 676796 - protein, 24 aa, Mycobacterium
HVVDGRLRRACLGGVVGDSAAILE

SEQ ID NO: 676797 - protein, 19 aa, Mycobacterium
HVVDIPSFRIGRVPVTNAE

SEQ ID NO: 676798 - protein, 20 aa, Mycobacterium
HVVDVPAFRIGRVPVTNGEW

SEQ ID NO: 676799 - protein, 19 aa, Mycobacterium
HVVELITRHGFRVGNAAVQ

SEQ ID NO: 676800 - protein, 19 aa, Mycobacterium
HVVELPAFRIGRVPVTNGE

SEQ ID NO: 676801 - protein, 29 aa, Mycobacterium
HVVGFRDGKAFYRNRFIQTDGFQAENEAG

SEQ ID NO: 676802 - protein, 30 aa, Mycobacterium
HVVGFRDGKAFYRNRFIRTDGFLAENEAGG

SEQ ID NO: 676803 - protein, 30 aa, Mycobacterium
HVVGFRDGKAFYRNRFVRTDGFLAENEAGG

SEQ ID NO: 676804 - protein, 19 aa, Mycobacterium
HVVGMAFHRVKATAPDGTS

SEQ ID NO: 676805 - protein, 18 aa, Mycobacterium
HVVGRIVAVLALAALIHR

SEQ ID NO: 676806 - protein, 37 aa, Mycobacterium
HVVLSWVPGCGECRYCKAGRPAQCSLVASVVAVKGTL

SEQ ID NO: 676807 - protein, 24 aa, Mycobacterium
HVVNVSSLFGVLSMPGQSAYNSAK

SEQ ID NO: 676808 - protein, 17 aa, Mycobacterium
HVVPCGRGLGSSAAVVR

SEQ ID NO: 676809 - protein, 23 aa, Mycobacterium
HVVPELPKTRSGKIMRRLLRDVA

SEQ ID NO: 676810 - protein, 23 aa, Mycobacterium
HVVPEYLEDAGFALRRLDRINDW

SEQ ID NO: 676811 - protein, 23 aa, Mycobacterium
HVVPILQRRGLFRTEYTATTLRG

SEQ ID NO: 676812 - protein, 17 aa, Mycobacterium
HVVPRWGGDANFITIIG

SEQ ID NO: 676813 - protein, 27 aa, Mycobacterium
HVVPVVYNRALHLFWLVITDKPQKVRR

SEQ ID NO: 676814 - protein, 26 aa, Mycobacterium
HVVQQVWMPYHWGYTGLVEGDVVNDL

SEQ ID NO: 676815 - protein, 18 aa, Mycobacterium
HVVRLRPAPHCRTPIDAY

SEQ ID NO: 676816 - protein, 26 aa, Mycobacterium
HVVVWNRHCEDLWGLRADETVGTPLT

SEQ ID NO: 676817 - protein, 23 aa, Mycobacterium
HVWADARGPAHISYFDPAPLLTA

SEQ ID NO: 676818 - protein, 19 aa, Mycobacterium
HVYAKLGISSRVELIKDQH

SEQ ID NO: 676819 - protein, 19 aa, Mycobacterium
HVYAKLGLTSRMQLAQEAA

SEQ ID NO: 676820 - protein, 22 aa, Mycobacterium
HVYRTLFGFLYGHVLTELQEIV

SEQ ID NO: 676821 - protein, 19 aa, Mycobacterium
HVYTKLGLTSRVQLAQEAA

SEQ ID NO: 676822 - protein, 19 aa, Mycobacterium
HWAAAQRGLARRGVASIAV

SEQ ID NO: 676823 - protein, 22 aa, Mycobacterium
HWAANNAKRKWVLVEQDPTAIG

SEQ ID NO: 676824 - protein, 24 aa, Mycobacterium
HWADGYKTLHGMASRGFPNQFFTG

SEQ ID NO: 676825 - protein, 23 aa, Mycobacterium
HWARRTGDELARRVAAQTAGFLL

SEQ ID NO: 676826 - protein, 21 aa, Mycobacterium
HWATALAPYGLRWYEEPGDPL

SEQ ID NO: 676827 - protein, 20 aa, Mycobacterium
HWATRGSAWLRGRSAMTELA

SEQ ID NO: 676828 - protein, 18 aa, Mycobacterium
HWAYRPVSLDAPRGDAEQ

SEQ ID NO: 676829 - protein, 17 aa, Mycobacterium
HWDIKGCYITQIKGDPC

SEQ ID NO: 676830 - protein, 17 aa, Mycobacterium
HWDRWPTSVTWSADGST

SEQ ID NO: 676831 - protein, 18 aa, Mycobacterium
HWFERVLDDSGGGLNHPA

SEQ ID NO: 676832 - protein, 25 aa, Mycobacterium
HWFHVYSAVVWCCVFMRTGTRRVHF

SEQ ID NO: 676833 - protein, 19 aa, Mycobacterium
HWGPPPGELFVDRSNDPDG

SEQ ID NO: 676834 - protein, 19 aa, Mycobacterium
HWGPPPGELFVDRSRDPEG

SEQ ID NO: 676835 - protein, 21 aa, Mycobacterium
HWHVRRWPHVPILLVCDEPAR

SEQ ID NO: 676836 - protein, 25 aa, Mycobacterium
HWITMPYAVAWLWCYSMETIAKLRR

SEQ ID NO: 676837 - protein, 23 aa, Mycobacterium
HWKSRSGVVKINLALAELPNFTA

SEQ ID NO: 676838 - protein, 23 aa, Mycobacterium
HWLGLKALMGHPDWLDAFDDDWL

SEQ ID NO: 676839 - protein, 26 aa, Mycobacterium
HWLGRDRFVLSCGHSSLTLYIQLYLG

SEQ ID NO: 676840 - protein, 24 aa, Mycobacterium
HWLPRLAPQLPLPIPQPVAMGRPA

SEQ ID NO: 676841 - protein, 24 aa, Mycobacterium
HWLRRAVAAAAAWVRGGYDQDAPR

SEQ ID NO: 676842 - protein, 23 aa, Mycobacterium
HWMEKQTYLALGMTMMAAAELGF

SEQ ID NO: 676843 - protein, 20 aa, Mycobacterium
HWNAGPGKRIAVIGLGGLGH

SEQ ID NO: 676844 - protein, 25 aa, Mycobacterium
HWNDPEFGIVWPLPVTVISEQDASW

SEQ ID NO: 676845 - protein, 22 aa, Mycobacterium
HWPEPESLLLHALALRPGDDGS

SEQ ID NO: 676846 - protein, 18 aa, Mycobacterium
HWPIACLGGQYAGAAVVP

SEQ ID NO: 676847 - protein, 17 aa, Mycobacterium
HWPWTDHWLALWRNTIG

SEQ ID NO: 676848 - protein, 18 aa, Mycobacterium
HWQFQAFASVDTKRMPNG

SEQ ID NO: 676849 - protein, 25 aa, Mycobacterium
HWQMLPRILAITVRDGKVCALWDIA

SEQ ID NO: 676850 - protein, 18 aa, Mycobacterium
HWRHAGLLQRAYRDVSVE

SEQ ID NO: 676851 - protein, 19 aa, Mycobacterium
HWRHPHIGGHPRFIQEDVR

SEQ ID NO: 676852 - protein, 19 aa, Mycobacterium
HWSLGMARTVEFRAAATGD

SEQ ID NO: 676853 - protein, 19 aa, Mycobacterium
HWSLIADYVKKEWADCDEE

SEQ ID NO: 676854 - protein, 23 aa, Mycobacterium
HWSPDYRSILGLAEACDVPTRFS

SEQ ID NO: 676855 - protein, 17 aa, Mycobacterium
HWTAHPLCPCGAYFAGN

SEQ ID NO: 676856 - protein, 18 aa, Mycobacterium
HWTLPRLVGTAVAAELLL

SEQ ID NO: 676857 - protein, 21 aa, Mycobacterium
HWTTLIPRGATLVSLAKGIEL

SEQ ID NO: 676858 - protein, 20 aa, Mycobacterium
HWTTVPFGRPLRNVRCRVVA

SEQ ID NO: 676859 - protein, 20 aa, Mycobacterium
HWVDELRPLTGQDPAVSEYV

SEQ ID NO: 676860 - protein, 20 aa, Mycobacterium
HWVDELRPLTGQHPAVRDYV

SEQ ID NO: 676861 - protein, 20 aa, Mycobacterium
HWVDELRPLTGQHQAVSDYV

SEQ ID NO: 676862 - protein, 19 aa, Mycobacterium
HWYNLAAELDEPIPPHLHP

SEQ ID NO: 676863 - protein, 19 aa, Mycobacterium
HYAEMWAQDAAAMYAYAGA

SEQ ID NO: 676864 - protein, 17 aa, Mycobacterium
HYAEMWAQDAAAMYGYA

SEQ ID NO: 676865 - protein, 23 aa, Mycobacterium
HYAGAFPVWLAPVQVVGIPVADA

SEQ ID NO: 676866 - protein, 18 aa, Mycobacterium
HYAGGWWMDSSATLQEAE

SEQ ID NO: 676867 - protein, 17 aa, Mycobacterium
HYAIALRERLPRVAEVF

SEQ ID NO: 676868 - protein, 28 aa, Mycobacterium
HYASKAFLCTEVARWIKDEGLGLDVCSA

SEQ ID NO: 676869 - protein, 23 aa, Mycobacterium
HYAWTRDRLVIVSLVDVASRVEI

SEQ ID NO: 676870 - protein, 19 aa, Mycobacterium
HYDAVAGWVNGRRLTFHGS

SEQ ID NO: 676871 - protein, 29 aa, Mycobacterium
HYDCRSTQELRNWLMLRAYESGVVPIGAQ

SEQ ID NO: 676872 - protein, 29 aa, Mycobacterium
HYDCRSTQELRNWLMLRAYESGVVPVGAQ

SEQ ID NO: 676873 - protein, 32 aa, Mycobacterium
HYDCRSTRELRDWLLIRAWEAGVTPIGVQPVP

SEQ ID NO: 676874 - protein, 33 aa, Mycobacterium
HYDCRSTRELRDWLLMRAWEAGVTPIGVQPVAD

SEQ ID NO: 676875 - protein, 23 aa, Mycobacterium
HYDEGLKVGYKWYDAENRTPLFP

SEQ ID NO: 676876 - protein, 24 aa, Mycobacterium
HYDGKGRVGEWILFQNQVNRSRMG

SEQ ID NO: 676877 - protein, 24 aa, Mycobacterium
HYDKIHLYDAFGFTESRTVAPGHE

SEQ ID NO: 676878 - protein, 29 aa, Mycobacterium
HYDKSNEFFKLWLDPSMTYSCAYFEERPN

SEQ ID NO: 676879 - protein, 27 aa, Mycobacterium
HYDVSNTFYSWVLGPSMTYTCACYPHP

SEQ ID NO: 676880 - protein, 19 aa, Mycobacterium
HYEKLEGVQLTFNGKANRL

SEQ ID NO: 676881 - protein, 21 aa, Mycobacterium
HYELPEGHGLLLLTDGLFEGH

SEQ ID NO: 676882 - protein, 18 aa, Mycobacterium
HYEVPADMAADVEQSLPG

SEQ ID NO: 676883 - protein, 25 aa, Mycobacterium
HYFASWFERFARSFSGTIAGGTSEI

SEQ ID NO: 676884 - protein, 25 aa, Mycobacterium
HYFASWFERYCRSFGGTIAGGTSEI

SEQ ID NO: 676885 - protein, 23 aa, Mycobacterium
HYFFQFDQRYMFAGYGGGNDAPQ

SEQ ID NO: 676886 - protein, 19 aa, Mycobacterium
HYFKRLTALQFEFGSTDHH

SEQ ID NO: 676887 - protein, 24 aa, Mycobacterium
HYFTFMTPAAFVRRPERWIRELAR

SEQ ID NO: 676888 - protein, 19 aa, Mycobacterium
HYGDFVALDHVDFVVPTGS

SEQ ID NO: 676889 - protein, 24 aa, Mycobacterium
HYGEFPRFHALMAEQSGVVYDKAL

SEQ ID NO: 676890 - protein, 24 aa, Mycobacterium
HYGEPEAFAALGFAVVAIDGRGSA

SEQ ID NO: 676891 - protein, 19 aa, Mycobacterium
HYGSWFDRYARSFAGTIAG

SEQ ID NO: 676892 - protein, 18 aa, Mycobacterium
HYGVCVAICPPRRGNRKG

SEQ ID NO: 676893 - protein, 18 aa, Mycobacterium
HYHGEPLGGFTGWRPQMP

SEQ ID NO: 676894 - protein, 17 aa, Mycobacterium
HYIKTLGIWADRLEANK

SEQ ID NO: 676895 - protein, 23 aa, Mycobacterium
HYKGGAMSLLLDQVRELGARIPD

SEQ ID NO: 676896 - protein, 18 aa, Mycobacterium
HYKRMPHDRLVKRQQTFG

SEQ ID NO: 676897 - protein, 19 aa, Mycobacterium
HYLASLLIARGCDVKTVQA

SEQ ID NO: 676898 - protein, 19 aa, Mycobacterium
HYLDLVGLSHCADRFPAQL

SEQ ID NO: 676899 - protein, 23 aa, Mycobacterium
HYLESWLLPSFGLRATVFHFNPG

SEQ ID NO: 676900 - protein, 22 aa, Mycobacterium
HYLESWLLPSLGLRATVFHFNP

SEQ ID NO: 676901 - protein, 20 aa, Mycobacterium
HYLRIREWQDLVGQLRGIAR

SEQ ID NO: 676902 - protein, 21 aa, Mycobacterium
HYLRIREWQDLVGQLRSIAGD

SEQ ID NO: 676903 - protein, 20 aa, Mycobacterium
HYLRIREWQDLVGQLRSIAR

SEQ ID NO: 676904 - protein, 17 aa, Mycobacterium
HYLRTPFVLTKASVPQM

SEQ ID NO: 676905 - protein, 17 aa, Mycobacterium
HYMHFGGVSPINGINRA

SEQ ID NO: 676906 - protein, 18 aa, Mycobacterium
HYMTPAAIMVVDRLPLTV

SEQ ID NO: 676907 - protein, 24 aa, Mycobacterium
HYNGFFYKAMPPFCIGMHANGVGD

SEQ ID NO: 676908 - protein, 25 aa, Mycobacterium
HYNGFFYKEMPPFCLATEAHAVGDF

SEQ ID NO: 676909 - protein, 25 aa, Mycobacterium
HYNKIHLYDAFGFRESATVAPGHEP

SEQ ID NO: 676910 - protein, 21 aa, Mycobacterium
HYPEHEQLWGLAGADRESFVV

SEQ ID NO: 676911 - protein, 18 aa, Mycobacterium
HYPFPTKDLVALDDALVY

SEQ ID NO: 676912 - protein, 19 aa, Mycobacterium
HYPLETFIAVNPLAGLESM

SEQ ID NO: 676913 - protein, 17 aa, Mycobacterium
HYPLRDVGWRGSLQSDK

SEQ ID NO: 676914 - protein, 19 aa, Mycobacterium
HYPRVVLVTGASRFLGGYL

SEQ ID NO: 676915 - protein, 19 aa, Mycobacterium
HYPSRIVAEGRLHDFVECY

SEQ ID NO: 676916 - protein, 19 aa, Mycobacterium
HYPVLARALLSGASGQLRN

SEQ ID NO: 676917 - protein, 25 aa, Mycobacterium
HYQKLTGLENLRFFASLYAQPTLDP

SEQ ID NO: 676918 - protein, 24 aa, Mycobacterium
HYQKLTGLENLRFFASLYSGATAD

SEQ ID NO: 676919 - protein, 19 aa, Mycobacterium
HYQNHNWWLRARTPSDIDG

SEQ ID NO: 676920 - protein, 33 aa, Mycobacterium
HYRGEAVGTFTGWRPAMPVTQWSVTKAVSMPDT

SEQ ID NO: 676921 - protein, 21 aa, Mycobacterium
HYRLLAEILTMAFATERDPGP

SEQ ID NO: 676922 - protein, 19 aa, Mycobacterium
HYRPIDWDDAYALIADEIR

SEQ ID NO: 676923 - protein, 20 aa, Mycobacterium
HYTLPRLGISTTFVEDPDDL

SEQ ID NO: 676924 - protein, 17 aa, Mycobacterium
HYTPCSKRIERVGRSIA

SEQ ID NO: 676925 - protein, 17 aa, Mycobacterium
HYTRLAALDLCPRIRVN

SEQ ID NO: 676926 - protein, 18 aa, Mycobacterium
HYTRRWLQRMTVSQIDRS

SEQ ID NO: 676927 - protein, 24 aa, Mycobacterium
HYTYKLDWLAALRDTAQCWLKNDP

SEQ ID NO: 676928 - protein, 18 aa, Mycobacterium
HYVCQRRSVALDRTLISN

SEQ ID NO: 676929 - protein, 26 aa, Mycobacterium
HYVDLVCSWGPMILGHAHPAVVDAVA

SEQ ID NO: 676930 - protein, 23 aa, Mycobacterium
HYVMECLQLMAIREATTLEVTEE

SEQ ID NO: 676931 - protein, 23 aa, Mycobacterium
HYWHPVGTCTMGMPATGGVVDHR

SEQ ID NO: 676932 - protein, 24 aa, Mycobacterium
HYYNVPIVLHFRGAVRRDALQRAL

SEQ ID NO: 676933 - protein, 17 aa, Mycobacterium
IAAAALDVWYRYPGPDG

SEQ ID NO: 676934 - protein, 20 aa, Mycobacterium
IAAACQDLWLTGVQGEQLAF

SEQ ID NO: 676935 - protein, 23 aa, Mycobacterium
IAAACVAGALSLRDGAAVVALRS

SEQ ID NO: 676936 - protein, 19 aa, Mycobacterium
IAAAFGGGHNVYYAAKAFL

SEQ ID NO: 676937 - protein, 19 aa, Mycobacterium
IAAAGRFGAMTSRCDDDQI

SEQ ID NO: 676938 - protein, 17 aa, Mycobacterium
IAAAGTRFSQLEVQRGI

SEQ ID NO: 676939 - protein, 20 aa, Mycobacterium
IAAAIDWYRDVFGFECVMGP

SEQ ID NO: 676940 - protein, 17 aa, Mycobacterium
IAAAIGRIRAMRMALLP

SEQ ID NO: 676941 - protein, 25 aa, Mycobacterium
IAAALALGAEGVWCGSVWLTTEEAE

SEQ ID NO: 676942 - protein, 19 aa, Mycobacterium
IAAAMARYADWNTGRNCRP

SEQ ID NO: 676943 - protein, 20 aa, Mycobacterium
IAAAMARYADWSTGRNCRPT

SEQ ID NO: 676944 - protein, 26 aa, Mycobacterium
IAAAREPGCLAVAALLDAYRAAATVS

SEQ ID NO: 676945 - protein, 24 aa, Mycobacterium
IAAARIRKKLSWSDIADEIDAPLV

SEQ ID NO: 676946 - protein, 17 aa, Mycobacterium
IAAARPCVVRDPGLYRM

SEQ ID NO: 676947 - protein, 19 aa, Mycobacterium
IAAASRLGWDHGCDLHLLE

SEQ ID NO: 676948 - protein, 19 aa, Mycobacterium
IAAATPVFTCQGRGHVITV

SEQ ID NO: 676949 - protein, 18 aa, Mycobacterium
IAAAVFGAMEVWMLGEDS

SEQ ID NO: 676950 - protein, 19 aa, Mycobacterium
IAAAVGFLCSEEARYITGQ

SEQ ID NO: 676951 - protein, 25 aa, Mycobacterium
IAAAVPGAMPVLFGHVGEGNLHLNV

SEQ ID NO: 676952 - protein, 17 aa, Mycobacterium
IAAAVSMTPATDGLAAL

SEQ ID NO: 676953 - protein, 24 aa, Mycobacterium
IAAAWDELMVRLGYDRYGAQGGDW

SEQ ID NO: 676954 - protein, 31 aa, Mycobacterium
IAACALLVHRWCGGGSWVMVLLPVVRQNPGA

SEQ ID NO: 676955 - protein, 22 aa, Mycobacterium
IAACGLRRLLPMYSSVEAALSP

SEQ ID NO: 676956 - protein, 22 aa, Mycobacterium
IAACGLRRLLPMYSSVENALAP

SEQ ID NO: 676957 - protein, 26 aa, Mycobacterium
IAACKSGGLLPFANFNRIHVVPPCNV

SEQ ID NO: 676958 - protein, 24 aa, Mycobacterium
IAACPLTWAWNLLGWPSINVPAGF

SEQ ID NO: 676959 - protein, 20 aa, Mycobacterium
IAADAARAAHRLVNASAAAR

SEQ ID NO: 676960 - protein, 17 aa, Mycobacterium
IAADDVLGFTWGPEQVG

SEQ ID NO: 676961 - protein, 19 aa, Mycobacterium
IAADLAVRLHDWRQRTGDV

SEQ ID NO: 676962 - protein, 19 aa, Mycobacterium
IAADLENIAAMLAAAQKEG

SEQ ID NO: 676963 - protein, 27 aa, Mycobacterium
IAADLGATCVSLWSGYSVDYSDPETTR

SEQ ID NO: 676964 - protein, 22 aa, Mycobacterium
IAADLLLHLAGPYRRHHDWYNN

SEQ ID NO: 676965 - protein, 19 aa, Mycobacterium
IAADLTWKGLFDVVQEQPH

SEQ ID NO: 676966 - protein, 19 aa, Mycobacterium
IAAEAGARVVLPAHDATGA

SEQ ID NO: 676967 - protein, 22 aa, Mycobacterium
IAAEAGARVVLPASDVVGAGLV

SEQ ID NO: 676968 - protein, 17 aa, Mycobacterium
IAAEAGVTLGLVQHHFK

SEQ ID NO: 676969 - protein, 17 aa, Mycobacterium
IAAEATRRRTFAVISHP

SEQ ID NO: 676970 - protein, 24 aa, Mycobacterium
IAAELFKPLPSMVVAHYLGVPEED

SEQ ID NO: 676971 - protein, 26 aa, Mycobacterium
IAAELGATCVSLWSGYSVSYSDAATT

SEQ ID NO: 676972 - protein, 23 aa, Mycobacterium
IAAELRELAALRDSGILTEEEFT

SEQ ID NO: 676973 - protein, 23 aa, Mycobacterium
IAAELRELAGLRDSGILTDEEFA

SEQ ID NO: 676974 - protein, 20 aa, Mycobacterium
IAAELVRFGQAIRRLETGGL

SEQ ID NO: 676975 - protein, 17 aa, Mycobacterium
IAAEQRNALGIEVSMRQ

SEQ ID NO: 676976 - protein, 17 aa, Mycobacterium
IAAERGVAVEWVEADAE

SEQ ID NO: 676977 - protein, 28 aa, Mycobacterium
IAAESAFFAESFVQLGLIPGDGGTWFLP

SEQ ID NO: 676978 - protein, 24 aa, Mycobacterium
IAAETKAFGLLVGLPGAYVANTIA

SEQ ID NO: 676979 - protein, 20 aa, Mycobacterium
IAAEYPRFMNISPRGAAVER

SEQ ID NO: 676980 - protein, 22 aa, Mycobacterium
IAAFAIRASQAFIYVRGEVISV

SEQ ID NO: 676981 - protein, 18 aa, Mycobacterium
IAAFAQMRIVMSTKNDDP

SEQ ID NO: 676982 - protein, 19 aa, Mycobacterium
IAAFIICADLVRQFEFAQN

SEQ ID NO: 676983 - protein, 26 aa, Mycobacterium
IAAFPRYHPRWAWWMTSVPMLREFLV

SEQ ID NO: 676984 - protein, 20 aa, Mycobacterium
IAAFRVGRHRAEVIAVADGV

SEQ ID NO: 676985 - protein, 45 aa, Mycobacterium
IAAFSAAKPSLAWAETYPGTLSYYLASAFREVWMQPSGSVGLIGF

SEQ ID NO: 676986 - protein, 30 aa, Mycobacterium
IAAGAGRSPWSLLRRRRGVLPSIEEALETT

SEQ ID NO: 676987 - protein, 17 aa, Mycobacterium
IAAGAPVAAHWTADRQV

SEQ ID NO: 676988 - protein, 18 aa, Mycobacterium
IAAGFGCRTATVESTDML

SEQ ID NO: 676989 - protein, 21 aa, Mycobacterium
IAAGGLLRFATRPLQLANVVP

SEQ ID NO: 676990 - protein, 17 aa, Mycobacterium
IAAGIGIIAHFLATHPA

SEQ ID NO: 676991 - protein, 20 aa, Mycobacterium
IAAGKVLIVPGVQYKAITSV

SEQ ID NO: 676992 - protein, 21 aa, Mycobacterium
IAAGLAALGVERGHTVGIMLR

SEQ ID NO: 676993 - protein, 19 aa, Mycobacterium
IAAGLGLPGTQVRPAFEDP

SEQ ID NO: 676994 - protein, 20 aa, Mycobacterium
IAAGLYRFSLLDIIDIGDIN

SEQ ID NO: 676995 - protein, 30 aa, Mycobacterium
IAAGNLKGIRKWVWERLGGTLYAQKAADAL

SEQ ID NO: 676996 - protein, 20 aa, Mycobacterium
IAAGPPPIYFGFGSSARVAS

SEQ ID NO: 676997 - protein, 17 aa, Mycobacterium
IAAHAFRPLHYPMTSAI

SEQ ID NO: 676998 - protein, 24 aa, Mycobacterium
IAAHNKLLGSFELTGIPPAPRGVP

SEQ ID NO: 676999 - protein, 25 aa, Mycobacterium
IAAHWRYKEAKGRNGVPHPHATAEI

SEQ ID NO: 677000 - protein, 25 aa, Mycobacterium
IAAHWRYKEAKGRNGVPHSHAAAEI

SEQ ID NO: 677001 - protein, 24 aa, Mycobacterium
IAAHWRYKEAKGRNGVPPTHAAAE

SEQ ID NO: 677002 - protein, 26 aa, Mycobacterium
IAAHWRYKEVKGRNGVPAGSAATEID

SEQ ID NO: 677003 - protein, 17 aa, Mycobacterium
IAAIAARAADLEVVGGD

SEQ ID NO: 677004 - protein, 23 aa, Mycobacterium
IAAICPNYRVAIIAPTTTLAMFN

SEQ ID NO: 677005 - protein, 24 aa, Mycobacterium
IAAKDKRVALVFSAYPTKHARIGN

SEQ ID NO: 677006 - protein, 24 aa, Mycobacterium
IAAKGEGIDELMGVIEDHRRTDSR

SEQ ID NO: 677007 - protein, 19 aa, Mycobacterium
IAAKLGRLVEIGFGQIVLF

SEQ ID NO: 677008 - protein, 24 aa, Mycobacterium
IAAKLRRRRLRFMIKAEMQEVKAV

SEQ ID NO: 677009 - protein, 25 aa, Mycobacterium
IAAKNYWATLPFDDRAAVFLRAADL

SEQ ID NO: 677010 - protein, 18 aa, Mycobacterium
IAAKRGGRIRGVRTAVVV

SEQ ID NO: 677011 - protein, 17 aa, Mycobacterium
IAALAAMRRSEPEAPPA

SEQ ID NO: 677012 - protein, 17 aa, Mycobacterium
IAALARRGITDMDLVFM

SEQ ID NO: 677013 - protein, 17 aa, Mycobacterium
IAALARRGITDMDNVFM

SEQ ID NO: 677014 - protein, 19 aa, Mycobacterium
IAALCGEGLKRVSLELGGK

SEQ ID NO: 677015 - protein, 18 aa, Mycobacterium
IAALCGEQLKRVSLELGG

SEQ ID NO: 677016 - protein, 17 aa, Mycobacterium
IAALELMDSRLGVPSPL

SEQ ID NO: 677017 - protein, 17 aa, Mycobacterium
IAALHIWTAESIRADRL

SEQ ID NO: 677018 - protein, 19 aa, Mycobacterium
IAALKAKYLTREDVPADVV

SEQ ID NO: 677019 - protein, 19 aa, Mycobacterium
IAALKARYLSRDDVPEDVV

SEQ ID NO: 677020 - protein, 19 aa, Mycobacterium
IAALKARYLSREDVPEDLV

SEQ ID NO: 677021 - protein, 17 aa, Mycobacterium
IAALKLLGVEDIVASDF

SEQ ID NO: 677022 - protein, 26 aa, Mycobacterium
IAALLGRGITDIGLVFFDTWTYGDAV

SEQ ID NO: 677023 - protein, 17 aa, Mycobacterium
IAALPRRGKPINTAIPG

SEQ ID NO: 677024 - protein, 17 aa, Mycobacterium
IAALQRFSHWAFDGGGL

SEQ ID NO: 677025 - protein, 20 aa, Mycobacterium
IAALRAGQRVLIHSGAGAVG

SEQ ID NO: 677026 - protein, 21 aa, Mycobacterium
IAALRPPRRGIYDAVIDLGGR

SEQ ID NO: 677027 - protein, 22 aa, Mycobacterium
IAALSRLGAIVVLMRQDVDLAA

SEQ ID NO: 677028 - protein, 24 aa, Mycobacterium
IAALSRLGAVAVLIPPDVDLAEAI

SEQ ID NO: 677029 - protein, 24 aa, Mycobacterium
IAALSRLGAVAVLLPPDADLEVAV

SEQ ID NO: 677030 - protein, 20 aa, Mycobacterium
IAALSRLGAVAVLMPPDSDL

SEQ ID NO: 677031 - protein, 23 aa, Mycobacterium
IAALSRLGAVAVLMRQDVDLAAQ

SEQ ID NO: 677032 - protein, 17 aa, Mycobacterium
IAALVARLQRVLTAMTV

SEQ ID NO: 677033 - protein, 34 aa, Mycobacterium
IAALYACARIGVIAVPVSPPLPMSFESGLAKLSF

SEQ ID NO: 677034 - protein, 17 aa, Mycobacterium
IAAMAAMAAIAHDSVVT

SEQ ID NO: 677035 - protein, 23 aa, Mycobacterium
IAAMKGQPAMQAWTDGINTNFVG

SEQ ID NO: 677036 - protein, 18 aa, Mycobacterium
IAAMPLNQLMMIKLACNS

SEQ ID NO: 677037 - protein, 17 aa, Mycobacterium
IAANMLGFGNRAPDGGH

SEQ ID NO: 677038 - protein, 24 aa, Mycobacterium
IAANPPAILGIRIKGLTSLHLRRS

SEQ ID NO: 677039 - protein, 25 aa, Mycobacterium
IAANRAELLALIATNFFGQNTAAIA

SEQ ID NO: 677040 - protein, 18 aa, Mycobacterium
IAANRAHLAALIATNLLG

SEQ ID NO: 677041 - protein, 17 aa, Mycobacterium
IAANRLLLMTLIATNFF

SEQ ID NO: 677042 - protein, 31 aa, Mycobacterium
IAAPLNELRTKCGLPLDLAQVVNGGGLNPAA

SEQ ID NO: 677043 - protein, 24 aa, Mycobacterium
IAAPRACISEMRYPEPTFDAPDQL

SEQ ID NO: 677044 - protein, 25 aa, Mycobacterium
IAAQLKFLADEGVDLIITSGGLGPT

SEQ ID NO: 677045 - protein, 17 aa, Mycobacterium
IAARAKLQIGRSGRHIA

SEQ ID NO: 677046 - protein, 28 aa, Mycobacterium
IAARELPVGLALRARLGAIGRAGEHRMS

SEQ ID NO: 677047 - protein, 22 aa, Mycobacterium
IAARGVAVGQILAITFTNKAAA

SEQ ID NO: 677048 - protein, 18 aa, Mycobacterium
IAARGVGVGQVLAITFTN

SEQ ID NO: 677049 - protein, 26 aa, Mycobacterium
IAARIAMRVLTYRPGRLAAKVRCPIL

SEQ ID NO: 677050 - protein, 22 aa, Mycobacterium
IAARKTYLFAFLDDHSRLLPGY

SEQ ID NO: 677051 - protein, 19 aa, Mycobacterium
IAARLAAAGADVILPVRNE

SEQ ID NO: 677052 - protein, 17 aa, Mycobacterium
IAARLLWIVGKLTEMSR

SEQ ID NO: 677053 - protein, 18 aa, Mycobacterium
IAARLPAGAIITRNLEHF

SEQ ID NO: 677054 - protein, 25 aa, Mycobacterium
IAARSAQGINVRWWSPQKVKQRKDF

SEQ ID NO: 677055 - protein, 27 aa, Mycobacterium
IAARTGLQAGTQWLSVRGYRQAEGASA

SEQ ID NO: 677056 - protein, 19 aa, Mycobacterium
IAARTGMMGAYADLLPAHT

SEQ ID NO: 677057 - protein, 17 aa, Mycobacterium
IAARVGFSLAVGEHLEY

SEQ ID NO: 677058 - protein, 31 aa, Mycobacterium
IAASERARWATYPVMAVQGWAAHHNATLRAI

SEQ ID NO: 677059 - protein, 17 aa, Mycobacterium
IAASGIPRAELFVTTKL

SEQ ID NO: 677060 - protein, 22 aa, Mycobacterium
IAASGLVGFAARSWRLVNVLSL

SEQ ID NO: 677061 - protein, 23 aa, Mycobacterium
IAASGRPGAVLVDIPKDVLQAQC

SEQ ID NO: 677062 - protein, 25 aa, Mycobacterium
IAASGRWVPDFLSLPIAVDNSLKNQ

SEQ ID NO: 677063 - protein, 26 aa, Mycobacterium
IAASLTRLLGCPVFVDHRARLQVLGD

SEQ ID NO: 677064 - protein, 17 aa, Mycobacterium
IAASVDPDADWHAQIRQ

SEQ ID NO: 677065 - protein, 23 aa, Mycobacterium
IAATEAHYAEMWAQDAAAMYGYA

SEQ ID NO: 677066 - protein, 26 aa, Mycobacterium
IAATEARYGQMWAQDAATMYAYAASS

SEQ ID NO: 677067 - protein, 24 aa, Mycobacterium
IAATGARMVVSIVHELARRDSRIG

SEQ ID NO: 677068 - protein, 23 aa, Mycobacterium
IAATIRPLGCVIGLRSDDGTPRV

SEQ ID NO: 677069 - protein, 17 aa, Mycobacterium
IAATLIVPGCDHASLLV

SEQ ID NO: 677070 - protein, 19 aa, Mycobacterium
IAATLSRRRLGAVLDAAAE

SEQ ID NO: 677071 - protein, 21 aa, Mycobacterium
IAAVARKGGLKLCTVDFSPTF

SEQ ID NO: 677072 - protein, 17 aa, Mycobacterium
IAAVPALAREYHRGVDD

SEQ ID NO: 677073 - protein, 25 aa, Mycobacterium
IAAVREPGCLAVAALLEAYRVSATV

SEQ ID NO: 677074 - protein, 24 aa, Mycobacterium
IAAYRTGFDIDWARPGDDDVAARA

SEQ ID NO: 677075 - protein, 29 aa, Mycobacterium
IACGAIELGIKWLSLYAFSTENWKRSAEE

SEQ ID NO: 677076 - protein, 21 aa, Mycobacterium
IACGIEAMSRVGLGANAGPDR

SEQ ID NO: 677077 - protein, 26 aa, Mycobacterium
IACGLFGLELSRLSNTAGWGITSNIA

SEQ ID NO: 677078 - protein, 26 aa, Mycobacterium
IACNRCWYCDHELYSCCDTTNPNAEL

SEQ ID NO: 677079 - protein, 19 aa, Mycobacterium
IACPEIFIAAAAERTKHIR

SEQ ID NO: 677080 - protein, 17 aa, Mycobacterium
IACSLGMLTEEQVQRLA

SEQ ID NO: 677081 - protein, 23 aa, Mycobacterium
IADAAVDIQVVWARSMAHAEREL

SEQ ID NO: 677082 - protein, 20 aa, Mycobacterium
IADAAVWLASDESRFVTASR

SEQ ID NO: 677083 - protein, 18 aa, Mycobacterium
IADAELLAPRRAITGEQL

SEQ ID NO: 677084 - protein, 18 aa, Mycobacterium
IADAGVDIDVVWAESMAK

SEQ ID NO: 677085 - protein, 24 aa, Mycobacterium
IADAKAAQVLAEIDKVVSLDTDRV

SEQ ID NO: 677086 - protein, 22 aa, Mycobacterium
IADARAVVRAGLAQALEVVPVN

SEQ ID NO: 677087 - protein, 22 aa, Mycobacterium
IADARLSYSYFHELWELYTEIV

SEQ ID NO: 677088 - protein, 18 aa, Mycobacterium
IADATAFGPVCPQPVLAN

SEQ ID NO: 677089 - protein, 18 aa, Mycobacterium
IADATVWPRLFGNCHTHR

SEQ ID NO: 677090 - protein, 19 aa, Mycobacterium
IADAVAWGAIGARTTESQV

SEQ ID NO: 677091 - protein, 21 aa, Mycobacterium
IADCGAGLFDPVTRSVLETSS

SEQ ID NO: 677092 - protein, 19 aa, Mycobacterium
IADDIRAAIAVGHGVTVRD

SEQ ID NO: 677093 - protein, 23 aa, Mycobacterium
IADDIRAAIAVRHGVTVRDLLLV

SEQ ID NO: 677094 - protein, 17 aa, Mycobacterium
IADEIDAPLVWCVAALL

SEQ ID NO: 677095 - protein, 17 aa, Mycobacterium
IADEIGYPVLVRPSYVL

SEQ ID NO: 677096 - protein, 18 aa, Mycobacterium
IADEKVEYVDVRFCDLPG

SEQ ID NO: 677097 - protein, 17 aa, Mycobacterium
IADELRTGLSPPLTGDD

SEQ ID NO: 677098 - protein, 18 aa, Mycobacterium
IADEVGATLMVDMAHFAG

SEQ ID NO: 677099 - protein, 27 aa, Mycobacterium
IADEVIPLLQCRTGFRSTYRPGETLRG

SEQ ID NO: 677100 - protein, 22 aa, Mycobacterium
IADFMLTGMAYRQFAIDYPHMY

SEQ ID NO: 677101 - protein, 20 aa, Mycobacterium
IADFVPRVRAGLEALGVGAQ

SEQ ID NO: 677102 - protein, 20 aa, Mycobacterium
IADFVPRVRAGLEALGVGSQ

SEQ ID NO: 677103 - protein, 32 aa, Mycobacterium
IADFWFDPLCPWCWITSRWILEVEKVRDIEVN

SEQ ID NO: 677104 - protein, 18 aa, Mycobacterium
IADGEALVRVDWISLDPT

SEQ ID NO: 677105 - protein, 20 aa, Mycobacterium
IADGEFFVILGPSGAGKTTT

SEQ ID NO: 677106 - protein, 23 aa, Mycobacterium
IADGEIIMAYGYDETVMPDGRTL

SEQ ID NO: 677107 - protein, 19 aa, Mycobacterium
IADGGWLGMTIPTEYGGHG

SEQ ID NO: 677108 - protein, 19 aa, Mycobacterium
IADHMGFRIDPNIRTIQDV

SEQ ID NO: 677109 - protein, 24 aa, Mycobacterium
IADILLRVAVGIIMFPTERLDTSD

SEQ ID NO: 677110 - protein, 22 aa, Mycobacterium
IADKMFDEFKEPLYAAPPLLLR

SEQ ID NO: 677111 - protein, 26 aa, Mycobacterium
IADLEFALRLGVDLIALSFVRSPSDV

SEQ ID NO: 677112 - protein, 18 aa, Mycobacterium
IADLEWDKGSFHIKGDPS

SEQ ID NO: 677113 - protein, 18 aa, Mycobacterium
IADLIEWRRKHEKHIARI

SEQ ID NO: 677114 - protein, 19 aa, Mycobacterium
IADLIEWRRKHEKHIARVA

SEQ ID NO: 677115 - protein, 19 aa, Mycobacterium
IADLIEWRRKHEKHVQRIA

SEQ ID NO: 677116 - protein, 23 aa, Mycobacterium
IADLPWPAAGEWLAAVRASPLVG

SEQ ID NO: 677117 - protein, 18 aa, Mycobacterium
IADLRRWAIDQDTPNGVF

SEQ ID NO: 677118 - protein, 22 aa, Mycobacterium
IADLSLPWGQDALIAAVSAANA

SEQ ID NO: 677119 - protein, 24 aa, Mycobacterium
IADMRRAIAVLGQISAEGMRLRGI

SEQ ID NO: 677120 - protein, 24 aa, Mycobacterium
IADMTYLQWLQRYVELAIGEGNST

SEQ ID NO: 677121 - protein, 19 aa, Mycobacterium
IADNAWRTLTVDRLCADAG

SEQ ID NO: 677122 - protein, 19 aa, Mycobacterium
IADPLGVDGIHLGRPPRTA

SEQ ID NO: 677123 - protein, 24 aa, Mycobacterium
IADPMGTVADIYRHFGMTLTEEAK

SEQ ID NO: 677124 - protein, 19 aa, Mycobacterium
IADQPDLELIGVHCYSPEK

SEQ ID NO: 677125 - protein, 19 aa, Mycobacterium
IADRGGRRGVIAGAVSTGQ

SEQ ID NO: 677126 - protein, 18 aa, Mycobacterium
IADRHLRAANAQEFLRRL

SEQ ID NO: 677127 - protein, 17 aa, Mycobacterium
IADRIYLSHRTVAAHLY

SEQ ID NO: 677128 - protein, 17 aa, Mycobacterium
IADRLEVEIPRDRGYGH

SEQ ID NO: 677129 - protein, 21 aa, Mycobacterium
IADRLSDRFGLLTRGQRGAPT

SEQ ID NO: 677130 - protein, 19 aa, Mycobacterium
IADSEFKAAGAQLADTAEQ

SEQ ID NO: 677131 - protein, 19 aa, Mycobacterium
IADSSGCEELMAFATSAVR

SEQ ID NO: 677132 - protein, 18 aa, Mycobacterium
IADSVARLDGGRIIESGR

SEQ ID NO: 677133 - protein, 33 aa, Mycobacterium
IADSWIEMESFRLLVLRTAWLIDKHQDYLKVRK

SEQ ID NO: 677134 - protein, 20 aa, Mycobacterium
IADTCFFGAEAEFYIFDSVT

SEQ ID NO: 677135 - protein, 20 aa, Mycobacterium
IADTCYFGAEAEFYIFDSVT

SEQ ID NO: 677136 - protein, 22 aa, Mycobacterium
IADVCFTAGVGRSHFEHRAALV

SEQ ID NO: 677137 - protein, 17 aa, Mycobacterium
IADVIKLQENLGIDVLV

SEQ ID NO: 677138 - protein, 17 aa, Mycobacterium
IADWPGMTLCFLEESLG

SEQ ID NO: 677139 - protein, 25 aa, Mycobacterium
IAEAARRVFSGDIVNSIAIAGILAA

SEQ ID NO: 677140 - protein, 24 aa, Mycobacterium
IAEADRILAIVPMFQANAWGLIYA

SEQ ID NO: 677141 - protein, 17 aa, Mycobacterium
IAEADWFTRAEVRSALE

SEQ ID NO: 677142 - protein, 23 aa, Mycobacterium
IAEAEGLEVLGWREVPTDDSSLG

SEQ ID NO: 677143 - protein, 23 aa, Mycobacterium
IAEAEGLHVLGWRNVPTDDSSLG

SEQ ID NO: 677144 - protein, 23 aa, Mycobacterium
IAEAEGLQVLGWRNVPTDDSSLG

SEQ ID NO: 677145 - protein, 24 aa, Mycobacterium
IAEAEGLRVLGWRDVPTDDSSLGA

SEQ ID NO: 677146 - protein, 24 aa, Mycobacterium
IAEAEGLSVLGWRNVPIDDSSLGA

SEQ ID NO: 677147 - protein, 23 aa, Mycobacterium
IAEAEGLTVLGWRNVPTDDSSLG

SEQ ID NO: 677148 - protein, 24 aa, Mycobacterium
IAEAEIRAGVKVEHRKAHVWPGHH

SEQ ID NO: 677149 - protein, 24 aa, Mycobacterium
IAEAFRFAERLGLDVAVTVPGSPE

SEQ ID NO: 677150 - protein, 17 aa, Mycobacterium
IAEAGWFTRDEVRAALD

SEQ ID NO: 677151 - protein, 23 aa, Mycobacterium
IAEAISAVAPRSGRRRLSAVRAD

SEQ ID NO: 677152 - protein, 18 aa, Mycobacterium
IAEALAIALLPPSDDLDS

SEQ ID NO: 677153 - protein, 24 aa, Mycobacterium
IAEALKGALVSPVITAHPTETRRR

SEQ ID NO: 677154 - protein, 21 aa, Mycobacterium
IAEALPALGTVVAVTANDAAL

SEQ ID NO: 677155 - protein, 17 aa, Mycobacterium
IAEAMELAVRWTEVSPP

SEQ ID NO: 677156 - protein, 26 aa, Mycobacterium
IAEANVLALKAGWNFGETTEAFGTTY

SEQ ID NO: 677157 - protein, 19 aa, Mycobacterium
IAEANVLALKAGWNYGETT

SEQ ID NO: 677158 - protein, 24 aa, Mycobacterium
IAEARLRGANLLVINATAGESYVD

SEQ ID NO: 677159 - protein, 27 aa, Mycobacterium
IAEATGARWLCETFPTRLERGAGVPAV

SEQ ID NO: 677160 - protein, 28 aa, Mycobacterium
IAEATGARWLCETFPTRLERGAGVPSVE

SEQ ID NO: 677161 - protein, 17 aa, Mycobacterium
IAEATLFIANIAPDAEP

SEQ ID NO: 677162 - protein, 17 aa, Mycobacterium
IAEDFPNPDGFVPDRYE

SEQ ID NO: 677163 - protein, 20 aa, Mycobacterium
IAEDGTFEWRITPTSPSQLV

SEQ ID NO: 677164 - protein, 23 aa, Mycobacterium
IAEDIRFAAPLFFNPADGAIVRT

SEQ ID NO: 677165 - protein, 22 aa, Mycobacterium
IAEDSVRRFAGAMLGLGPQGPN

SEQ ID NO: 677166 - protein, 22 aa, Mycobacterium
IAEEALHKWQRLNLARIEAKEP

SEQ ID NO: 677167 - protein, 20 aa, Mycobacterium
IAEEGPLPAARRARTYVAEL

SEQ ID NO: 677168 - protein, 18 aa, Mycobacterium
IAEEHGIALVVGIPEAVG

SEQ ID NO: 677169 - protein, 17 aa, Mycobacterium
IAEEIGLTVTDVQYLGS

SEQ ID NO: 677170 - protein, 26 aa, Mycobacterium
IAEELGQPLPLFIKWDDAEYGLRAGE

SEQ ID NO: 677171 - protein, 20 aa, Mycobacterium
IAEELIALVIAKAASIRIGY

SEQ ID NO: 677172 - protein, 28 aa, Mycobacterium
IAEELSRRFGLPLWRFANSGTEATMDAV

SEQ ID NO: 677173 - protein, 22 aa, Mycobacterium
IAEESLHKWQRLSLARIESTQP

SEQ ID NO: 677174 - protein, 22 aa, Mycobacterium
IAEEYYISFLLDRANRTYLAMC

SEQ ID NO: 677175 - protein, 23 aa, Mycobacterium
IAEEYYISFLLDRSNRTYLAMCS

SEQ ID NO: 677176 - protein, 25 aa, Mycobacterium
IAEFAFPVAPWMFGAAGREHMQQYG

SEQ ID NO: 677177 - protein, 26 aa, Mycobacterium
IAEFARRFGCRVVDSFGSSEFAVIVV

SEQ ID NO: 677178 - protein, 21 aa, Mycobacterium
IAEGCAIAGCALLGGETAEHP

SEQ ID NO: 677179 - protein, 22 aa, Mycobacterium
IAEGGFPFGPSVDGNYLPKKPV

SEQ ID NO: 677180 - protein, 17 aa, Mycobacterium
IAEGGYATTLWARRPAT

SEQ ID NO: 677181 - protein, 20 aa, Mycobacterium
IAEGLLANTVIEDWTVTRED

SEQ ID NO: 677182 - protein, 27 aa, Mycobacterium
IAEGMGVPARRVGSCEEFADALRGAFN

SEQ ID NO: 677183 - protein, 23 aa, Mycobacterium
IAEGYHPIVFCRFIPTADYLAEH

SEQ ID NO: 677184 - protein, 24 aa, Mycobacterium
IAEHEMPGLMSLRREYAEVQPLKG

SEQ ID NO: 677185 - protein, 26 aa, Mycobacterium
IAEHGLSLSDYLGWSAAIPASECAFS

SEQ ID NO: 677186 - protein, 22 aa, Mycobacterium
IAEHRARREAAIALCEQQGVDP

SEQ ID NO: 677187 - protein, 25 aa, Mycobacterium
IAEHVVSFTAEWSMTADDRMLQSTS

SEQ ID NO: 677188 - protein, 17 aa, Mycobacterium
IAEICRRLDGIPLAIEL

SEQ ID NO: 677189 - protein, 20 aa, Mycobacterium
IAEIDPYLRVRVDLGGAQPE

SEQ ID NO: 677190 - protein, 24 aa, Mycobacterium
IAEIERLHRELARQPHPLLGAATW

SEQ ID NO: 677191 - protein, 22 aa, Mycobacterium
IAEIPFRPSPRAIIGGELTISP

SEQ ID NO: 677192 - protein, 19 aa, Mycobacterium
IAEKGRFDVVGDFAYPLPV

SEQ ID NO: 677193 - protein, 20 aa, Mycobacterium
IAELAAVAAEFGVPMHSDAV

SEQ ID NO: 677194 - protein, 24 aa, Mycobacterium
IAELDAALARRIVKWMRFSKDKLR

SEQ ID NO: 677195 - protein, 19 aa, Mycobacterium
IAELLRRAGREDVAIVVSW

SEQ ID NO: 677196 - protein, 17 aa, Mycobacterium
IAELRGSLIEGVIEESE

SEQ ID NO: 677197 - protein, 18 aa, Mycobacterium
IAELRPGDEDALIAIPGI

SEQ ID NO: 677198 - protein, 19 aa, Mycobacterium
IAELVALPLTTLAEVLEPA

SEQ ID NO: 677199 - protein, 18 aa, Mycobacterium
IAELVCKDDGDLLDLLNL

SEQ ID NO: 677200 - protein, 21 aa, Mycobacterium
IAELVPRYLDRDAIAVVEGDG

SEQ ID NO: 677201 - protein, 24 aa, Mycobacterium
IAEMFRVLVPGGRIGISDVVAEDH

SEQ ID NO: 677202 - protein, 22 aa, Mycobacterium
IAEPGMVLTIRYDDTGEVETFL

SEQ ID NO: 677203 - protein, 29 aa, Mycobacterium
IAEPLPRTLAWSAAWEMTRDAELRARDFV

SEQ ID NO: 677204 - protein, 27 aa, Mycobacterium
IAEPLPRTLAWSAAWEMTREAELRARD

SEQ ID NO: 677205 - protein, 17 aa, Mycobacterium
IAEPLRLLDCCQETDGG

SEQ ID NO: 677206 - protein, 18 aa, Mycobacterium
IAEQLFATPQEGRVLGVD

SEQ ID NO: 677207 - protein, 19 aa, Mycobacterium
IAEQLLRVLARRLRRTNDA

SEQ ID NO: 677208 - protein, 21 aa, Mycobacterium
IAEQLMPHWLLALQDAAKRRG

SEQ ID NO: 677209 - protein, 17 aa, Mycobacterium
IAERERVSAELTRMGYR

SEQ ID NO: 677210 - protein, 18 aa, Mycobacterium
IAERGPWGLRSAPESAQM

SEQ ID NO: 677211 - protein, 18 aa, Mycobacterium
IAERHLGGLEAKTAVVVG

SEQ ID NO: 677212 - protein, 20 aa, Mycobacterium
IAERPTMASLLIKDSVNAAS

SEQ ID NO: 677213 - protein, 27 aa, Mycobacterium
IAERRPLRAALLWGRIGDHLSGQARIE

SEQ ID NO: 677214 - protein, 25 aa, Mycobacterium
IAETELRRRLQLLADEGLLRIDVDD

SEQ ID NO: 677215 - protein, 22 aa, Mycobacterium
IAETLCGYGKFGVESTKQVLWA

SEQ ID NO: 677216 - protein, 23 aa, Mycobacterium
IAETLCNYGKFGVESTKQVLWAN

SEQ ID NO: 677217 - protein, 20 aa, Mycobacterium
IAEVFARDGARVVAVDVESA

SEQ ID NO: 677218 - protein, 17 aa, Mycobacterium
IAEVKRASPSRGALAEI

SEQ ID NO: 677219 - protein, 17 aa, Mycobacterium
IAEVKRASPSRGALASI

SEQ ID NO: 677220 - protein, 17 aa, Mycobacterium
IAEVKRASPSRGELASI

SEQ ID NO: 677221 - protein, 23 aa, Mycobacterium
IAEVPTMAALLIKESVNQSVDNM

SEQ ID NO: 677222 - protein, 22 aa, Mycobacterium
IAEVRRAAQILRYYGNEGDRQT

SEQ ID NO: 677223 - protein, 23 aa, Mycobacterium
IAEVSARAGVDVLVYDTTDAFVT

SEQ ID NO: 677224 - protein, 18 aa, Mycobacterium
IAEVVARAGVPADAIGEV

SEQ ID NO: 677225 - protein, 17 aa, Mycobacterium
IAEYGDRALLLEFDSSA

SEQ ID NO: 677226 - protein, 25 aa, Mycobacterium
IAFAREQLAGFKLPKSVDFVDALPR

SEQ ID NO: 677227 - protein, 17 aa, Mycobacterium
IAFARERLAAYKCPKSV

SEQ ID NO: 677228 - protein, 19 aa, Mycobacterium
IAFEGTWAALPKAGAGADD

SEQ ID NO: 677229 - protein, 19 aa, Mycobacterium
IAFGLAWNEFLGVSGAPIA

SEQ ID NO: 677230 - protein, 19 aa, Mycobacterium
IAFLRRTRRALPGDPDFGD

SEQ ID NO: 677231 - protein, 24 aa, Mycobacterium
IAFSPRPVPTVSVAHLHEVQVSVP

SEQ ID NO: 677232 - protein, 24 aa, Mycobacterium
IAFTRSMAIEWARDNIQVNAIAPG

SEQ ID NO: 677233 - protein, 17 aa, Mycobacterium
IAGAFELAEEIGISGLS

SEQ ID NO: 677234 - protein, 17 aa, Mycobacterium
IAGAGFGVAAMVLSPHA

SEQ ID NO: 677235 - protein, 18 aa, Mycobacterium
IAGAHSFGGKIQRPTDWD

SEQ ID NO: 677236 - protein, 17 aa, Mycobacterium
IAGAHVVVIGRGVTVGR

SEQ ID NO: 677237 - protein, 19 aa, Mycobacterium
IAGALAIVAVDPVKFKREQ

SEQ ID NO: 677238 - protein, 19 aa, Mycobacterium
IAGALGALVDAPAVLANGF

SEQ ID NO: 677239 - protein, 29 aa, Mycobacterium
IAGALKNVYAIAVGMGYSLGIGENTRAMV

SEQ ID NO: 677240 - protein, 17 aa, Mycobacterium
IAGALNIVAVDPVAFKR

SEQ ID NO: 677241 - protein, 21 aa, Mycobacterium
IAGALRNWLMSRGEPVTTAST

SEQ ID NO: 677242 - protein, 21 aa, Mycobacterium
IAGALRRWLLAHSELPDHSLV

SEQ ID NO: 677243 - protein, 18 aa, Mycobacterium
IAGARVRRANYVYGSAKA

SEQ ID NO: 677244 - protein, 20 aa, Mycobacterium
IAGARYTGWQGLLDAQREYL

SEQ ID NO: 677245 - protein, 18 aa, Mycobacterium
IAGDELWATGQNNARMED

SEQ ID NO: 677246 - protein, 17 aa, Mycobacterium
IAGDVYWTTIGNQTTPD

SEQ ID NO: 677247 - protein, 19 aa, Mycobacterium
IAGEIDRLLGAPWTDERGT

SEQ ID NO: 677248 - protein, 17 aa, Mycobacterium
IAGELVSLYAKRQASSG

SEQ ID NO: 677249 - protein, 21 aa, Mycobacterium
IAGETIASWATYEPKRPFAPT

SEQ ID NO: 677250 - protein, 17 aa, Mycobacterium
IAGFAVTVTDLMPRTDA

SEQ ID NO: 677251 - protein, 17 aa, Mycobacterium
IAGFPAPVVAALNGHAL

SEQ ID NO: 677252 - protein, 20 aa, Mycobacterium
IAGFSSWLAEHLQRLRREPS

SEQ ID NO: 677253 - protein, 26 aa, Mycobacterium
IAGGCVLACACDRRLIGAEAAIGASE

SEQ ID NO: 677254 - protein, 25 aa, Mycobacterium
IAGGHEYLACGIDFTTEVIIFRNSW

SEQ ID NO: 677255 - protein, 24 aa, Mycobacterium
IAGGWWQDAFLYSRALTIAGGANE

SEQ ID NO: 677256 - protein, 18 aa, Mycobacterium
IAGHGVATGYSRRSGLTA

SEQ ID NO: 677257 - protein, 17 aa, Mycobacterium
IAGHSMGGIAITSWAQR

SEQ ID NO: 677258 - protein, 19 aa, Mycobacterium
IAGHVRRLLPDTEVRVAFC

SEQ ID NO: 677259 - protein, 18 aa, Mycobacterium
IAGIDCIEHGFLVDDEAI

SEQ ID NO: 677260 - protein, 18 aa, Mycobacterium
IAGIGMGLILLRAPAGGE

SEQ ID NO: 677261 - protein, 17 aa, Mycobacterium
IAGIPVTEDQWWEKSPI

SEQ ID NO: 677262 - protein, 17 aa, Mycobacterium
IAGITYRQLDYWARTSL

SEQ ID NO: 677263 - protein, 19 aa, Mycobacterium
IAGITYRQLDYWARTSLVV

SEQ ID NO: 677264 - protein, 23 aa, Mycobacterium
IAGKAVCEDLCFSGASHTSATGP

SEQ ID NO: 677265 - protein, 24 aa, Mycobacterium
IAGKGPGGKCCFVMMNAEIQALAR

SEQ ID NO: 677266 - protein, 20 aa, Mycobacterium
IAGLLFISARTVEWHLSKIF

SEQ ID NO: 677267 - protein, 17 aa, Mycobacterium
IAGMYDRVYEWASKPGP

SEQ ID NO: 677268 - protein, 33 aa, Mycobacterium
IAGNGLRPEIWGEFTKRFDIDRVCEFYAASEGN

SEQ ID NO: 677269 - protein, 24 aa, Mycobacterium
IAGNRIQLLTLIASNLFGQNTPAI

SEQ ID NO: 677270 - protein, 26 aa, Mycobacterium
IAGPAALFDARFQKLGLHPGGGATWM

SEQ ID NO: 677271 - protein, 18 aa, Mycobacterium
IAGPAPWKPMGTLSGPLS

SEQ ID NO: 677272 - protein, 29 aa, Mycobacterium
IAGPDRSPRAWLFTVARNMIIDERRSARF

SEQ ID NO: 677273 - protein, 17 aa, Mycobacterium
IAGPGVYICDECIDLCN

SEQ ID NO: 677274 - protein, 27 aa, Mycobacterium
IAGPHALFDPRFQKLGIHPGGGATWML

SEQ ID NO: 677275 - protein, 17 aa, Mycobacterium
IAGPHLALRARAESAVA

SEQ ID NO: 677276 - protein, 32 aa, Mycobacterium
IAGPRPALVPLSFAQSRLWFLEQLQGPSAVYN

SEQ ID NO: 677277 - protein, 23 aa, Mycobacterium
IAGPVYMRLKRGEIPVLFDEDHR

SEQ ID NO: 677278 - protein, 20 aa, Mycobacterium
IAGPYARWDDVYSDDHGDIP

SEQ ID NO: 677279 - protein, 23 aa, Mycobacterium
IAGQLASWRGALQGVAGQVGGAV

SEQ ID NO: 677280 - protein, 17 aa, Mycobacterium
IAGQMLYAAAGITTAHE

SEQ ID NO: 677281 - protein, 20 aa, Mycobacterium
IAGRAMRRIGAIEFATTIAP

SEQ ID NO: 677282 - protein, 26 aa, Mycobacterium
IAGRWPDPICGIGIIPTALDPSQAPA

SEQ ID NO: 677283 - protein, 20 aa, Mycobacterium
IAGTFPLERGREAFESRNRP

SEQ ID NO: 677284 - protein, 25 aa, Mycobacterium
IAGTPPEAFSLGYLGSCLGLGRRSA

SEQ ID NO: 677285 - protein, 26 aa, Mycobacterium
IAGTRPFGPMCVMMRGSGEIYLNSTD

SEQ ID NO: 677286 - protein, 17 aa, Mycobacterium
IAGVIKVVMALENETLP

SEQ ID NO: 677287 - protein, 17 aa, Mycobacterium
IAGWRITHRDTEYLRLQ

SEQ ID NO: 677288 - protein, 23 aa, Mycobacterium
IAGYKVPRSIWIVDSVKRNPAGK

SEQ ID NO: 677289 - protein, 25 aa, Mycobacterium
IAGYKVPRSLWLVDEIKRSPAGKPD

SEQ ID NO: 677290 - protein, 22 aa, Mycobacterium
IAGYLRPSGSLMIWQVGVDEAY

SEQ ID NO: 677291 - protein, 18 aa, Mycobacterium
IAHALRWQFDGVERCGPD

SEQ ID NO: 677292 - protein, 23 aa, Mycobacterium
IAHARRADISGVAHVYVWTPLGE

SEQ ID NO: 677293 - protein, 22 aa, Mycobacterium
IAHDPYCADARHGLAELLAESD

SEQ ID NO: 677294 - protein, 22 aa, Mycobacterium
IAHEQCDAWTGLAAAGDVSLRV

SEQ ID NO: 677295 - protein, 17 aa, Mycobacterium
IAHGIRRFEFMIHPDET

SEQ ID NO: 677296 - protein, 18 aa, Mycobacterium
IAHGMAPEMLAMAQTANL

SEQ ID NO: 677297 - protein, 18 aa, Mycobacterium
IAHHADLNAPPAVEVHEC

SEQ ID NO: 677298 - protein, 18 aa, Mycobacterium
IAHISPALLRFVQQRTAD

SEQ ID NO: 677299 - protein, 19 aa, Mycobacterium
IAHLSGLVRWATLARGLGM

SEQ ID NO: 677300 - protein, 17 aa, Mycobacterium
IAHLSPDLLRFVAQRTL

SEQ ID NO: 677301 - protein, 17 aa, Mycobacterium
IAHRAPRIWTGGVNRRM

SEQ ID NO: 677302 - protein, 17 aa, Mycobacterium
IAHRPAVRAKDLESCSR

SEQ ID NO: 677303 - protein, 25 aa, Mycobacterium
IAHSVCPFCAVGCAQKVYVKDEKVI

SEQ ID NO: 677304 - protein, 25 aa, Mycobacterium
IAHSVCPFCAVGCAQKVYVKDGKVT

SEQ ID NO: 677305 - protein, 17 aa, Mycobacterium
IAHTLGLHGPAMTVDTA

SEQ ID NO: 677306 - protein, 18 aa, Mycobacterium
IAHVRGGGEMGRPWYEHG

SEQ ID NO: 677307 - protein, 17 aa, Mycobacterium
IAIALNLINQAMMRATF

SEQ ID NO: 677308 - protein, 24 aa, Mycobacterium
IAIDLAARRRLRVNGELVDADGGG

SEQ ID NO: 677309 - protein, 20 aa, Mycobacterium
IAIDLCEQIASVPYPLGTAD

SEQ ID NO: 677310 - protein, 17 aa, Mycobacterium
IAIDLEVIAATLAEVQW

SEQ ID NO: 677311 - protein, 23 aa, Mycobacterium
IAIDLHESRRKLAIDLGATHAID

SEQ ID NO: 677312 - protein, 17 aa, Mycobacterium
IAIDVCGPISTHTDIPP

SEQ ID NO: 677313 - protein, 17 aa, Mycobacterium
IAIEGGHWVVTSRPDVV

SEQ ID NO: 677314 - protein, 19 aa, Mycobacterium
IAIEKIFKVKVDSVNTANR

SEQ ID NO: 677315 - protein, 18 aa, Mycobacterium
IAIGLTETDTWWRIDWNT

SEQ ID NO: 677316 - protein, 20 aa, Mycobacterium
IAINGGEPVDCEGFQRFADA

SEQ ID NO: 677317 - protein, 23 aa, Mycobacterium
IAIRYLGEEAGREFARSYDNTDT

SEQ ID NO: 677318 - protein, 18 aa, Mycobacterium
IAISEFFGTYGKQFQTFS

SEQ ID NO: 677319 - protein, 24 aa, Mycobacterium
IAITPWRSVLVFDLDEAIADTALR

SEQ ID NO: 677320 - protein, 19 aa, Mycobacterium
IAITSGDPVPAGWQDYAHW

SEQ ID NO: 677321 - protein, 23 aa, Mycobacterium
IAKADWTGALVAHHYVRYLGDLS

SEQ ID NO: 677322 - protein, 33 aa, Mycobacterium
IAKAFAGKPFDYWRQHLKTMKGQWAPFQSLLDL

SEQ ID NO: 677323 - protein, 20 aa, Mycobacterium
IAKDETISWDDVRVDESQFA

SEQ ID NO: 677324 - protein, 25 aa, Mycobacterium
IAKDRPDVVLALPWNLETELTEQLS

SEQ ID NO: 677325 - protein, 17 aa, Mycobacterium
IAKDRYRVIIGTDAHVL

SEQ ID NO: 677326 - protein, 18 aa, Mycobacterium
IAKDTWHPLAQALSDLPS

SEQ ID NO: 677327 - protein, 25 aa, Mycobacterium
IAKEARVGIATVYRHFPTREVLARA

SEQ ID NO: 677328 - protein, 17 aa, Mycobacterium
IAKEINVQFVLAYTPEE

SEQ ID NO: 677329 - protein, 17 aa, Mycobacterium
IAKELGYSETIFIDLPG

SEQ ID NO: 677330 - protein, 25 aa, Mycobacterium
IAKFKGEEYHLNWNGRNGFARIAAE

SEQ ID NO: 677331 - protein, 23 aa, Mycobacterium
IAKFLDKRGPGIQQMAVRVSDLD

SEQ ID NO: 677332 - protein, 23 aa, Mycobacterium
IAKFLDKRGPGLQQLAYRTSDID

SEQ ID NO: 677333 - protein, 26 aa, Mycobacterium
IAKFLHKRGPGIQQFACRVRNLEKLS

SEQ ID NO: 677334 - protein, 24 aa, Mycobacterium
IAKGSLRGGLVLGLEDSASRMHRI

SEQ ID NO: 677335 - protein, 24 aa, Mycobacterium
IAKGSLRGGLVLGLEDSGSRMNRI

SEQ ID NO: 677336 - protein, 24 aa, Mycobacterium
IAKGSLRGGLVLGLEDSGSRMSRL

SEQ ID NO: 677337 - protein, 24 aa, Mycobacterium
IAKGSLRGGLVLGLEDSSSRMSRI

SEQ ID NO: 677338 - protein, 23 aa, Mycobacterium
IAKKWGFSRTRLDEYSAESHERA

SEQ ID NO: 677339 - protein, 19 aa, Mycobacterium
IAKLADFRRPNLFVNTPDI

SEQ ID NO: 677340 - protein, 23 aa, Mycobacterium
IAKLRAARQLWARVAEVVGDADA

SEQ ID NO: 677341 - protein, 20 aa, Mycobacterium
IAKRELRGVATRAVKAPADL

SEQ ID NO: 677342 - protein, 22 aa, Mycobacterium
IAKRELRGVPTHAVKSPADLDE

SEQ ID NO: 677343 - protein, 22 aa, Mycobacterium
IAKRELRGVPTRAVKSPADLDE

SEQ ID NO: 677344 - protein, 20 aa, Mycobacterium
IAKRELRGVTARAVKSPADL

SEQ ID NO: 677345 - protein, 17 aa, Mycobacterium
IAKRLTYRPHSVPIMSN

SEQ ID NO: 677346 - protein, 18 aa, Mycobacterium
IAKRLTYRPHSVPIMSNL

SEQ ID NO: 677347 - protein, 25 aa, Mycobacterium
IAKSFAAALGLEFTRVQFTPDLLPA

SEQ ID NO: 677348 - protein, 19 aa, Mycobacterium
IAKSISAVAEFIRKRMTGD

SEQ ID NO: 677349 - protein, 17 aa, Mycobacterium
IALAESWDNGKPIRETL

SEQ ID NO: 677350 - protein, 21 aa, Mycobacterium
IALAEWREGAGRAFDDLLVIK

SEQ ID NO: 677351 - protein, 17 aa, Mycobacterium
IALAGPAPRIQLVHDDR

SEQ ID NO: 677352 - protein, 18 aa, Mycobacterium
IALAHKIIAIGIDDTKNI

SEQ ID NO: 677353 - protein, 17 aa, Mycobacterium
IALCFDRDRDGVAESTN

SEQ ID NO: 677354 - protein, 22 aa, Mycobacterium
IALDICAPASPTLTYPPATPED

SEQ ID NO: 677355 - protein, 17 aa, Mycobacterium
IALDIPVDLPRTGVDPE

SEQ ID NO: 677356 - protein, 26 aa, Mycobacterium
IALDLKIRLPGLLERQLKKTQVGFVK

SEQ ID NO: 677357 - protein, 26 aa, Mycobacterium
IALEIPEMLAELAGLAQAPPRLTTPE

SEQ ID NO: 677358 - protein, 17 aa, Mycobacterium
IALELSSAPHLRVGLDL

SEQ ID NO: 677359 - protein, 17 aa, Mycobacterium
IALERDLYKAAGVTDGD

SEQ ID NO: 677360 - protein, 17 aa, Mycobacterium
IALIHKRAHGVAVVVSE

SEQ ID NO: 677361 - protein, 23 aa, Mycobacterium
IALIKYWGKRDEEFMLPMTSSLS

SEQ ID NO: 677362 - protein, 21 aa, Mycobacterium
IALLMRHHLVLMSRFDPVQFL

SEQ ID NO: 677363 - protein, 17 aa, Mycobacterium
IALLPNAHWLYEFGDPR

SEQ ID NO: 677364 - protein, 19 aa, Mycobacterium
IALLSGRRSAAVHPDDEAD

SEQ ID NO: 677365 - protein, 24 aa, Mycobacterium
IALLSRGKLLYGVVDDENQPPGSR

SEQ ID NO: 677366 - protein, 18 aa, Mycobacterium
IALMSGELGQLNGLPVSV

SEQ ID NO: 677367 - protein, 18 aa, Mycobacterium
IALMTAVLDAIAKRAPDT

SEQ ID NO: 677368 - protein, 18 aa, Mycobacterium
IALNSRAIALLFFGDLDG

SEQ ID NO: 677369 - protein, 17 aa, Mycobacterium
IALPDMVDAHWGRIVMI

SEQ ID NO: 677370 - protein, 18 aa, Mycobacterium
IALPEFFTTGIAFDPALR

SEQ ID NO: 677371 - protein, 19 aa, Mycobacterium
IALPQRVVVRYQPDDSEAI

SEQ ID NO: 677372 - protein, 17 aa, Mycobacterium
IALPSIYYAHRRKVFRR

SEQ ID NO: 677373 - protein, 35 aa, Mycobacterium
IALPTYPFRQTRYWPRLRAAGGAPFLSPVRLASVV

SEQ ID NO: 677374 - protein, 20 aa, Mycobacterium
IALQAVRRGRPVAGELALVL

SEQ ID NO: 677375 - protein, 21 aa, Mycobacterium
IALQLAERGVDVVVHGRSAER

SEQ ID NO: 677376 - protein, 25 aa, Mycobacterium
IALQLGWRLFGPFLRAATGLDDNHP

SEQ ID NO: 677377 - protein, 17 aa, Mycobacterium
IALQTWVGQSCPVHATS

SEQ ID NO: 677378 - protein, 17 aa, Mycobacterium
IALRAAEYGRNVCVLTI

SEQ ID NO: 677379 - protein, 22 aa, Mycobacterium
IALRAAEYGRTVVVLTIDPAKR

SEQ ID NO: 677380 - protein, 19 aa, Mycobacterium
IALRAARDGANVAIMAKTA

SEQ ID NO: 677381 - protein, 18 aa, Mycobacterium
IALRARWTDAIGGQYRGG

SEQ ID NO: 677382 - protein, 17 aa, Mycobacterium
IALRCQVRIDPLRRAYT

SEQ ID NO: 677383 - protein, 24 aa, Mycobacterium
IALRGARLAFGDRVLWEDLDLSVS

SEQ ID NO: 677384 - protein, 17 aa, Mycobacterium
IALRLKALADPARVKLM

SEQ ID NO: 677385 - protein, 25 aa, Mycobacterium
IALRMSRPHATLSYQIQQIGPRPSR

SEQ ID NO: 677386 - protein, 17 aa, Mycobacterium
IALRRAARNDGWIGDLI

SEQ ID NO: 677387 - protein, 17 aa, Mycobacterium
IALRRAARYDGWIGDLI

SEQ ID NO: 677388 - protein, 19 aa, Mycobacterium
IALRSTLRLAPMLIDTPGT

SEQ ID NO: 677389 - protein, 18 aa, Mycobacterium
IALSEGGTGWIPYFLDRV

SEQ ID NO: 677390 - protein, 25 aa, Mycobacterium
IALSRGLCADRFVAEVRRYGVTVVS

SEQ ID NO: 677391 - protein, 17 aa, Mycobacterium
IALSRGLDPDRFVQEIH

SEQ ID NO: 677392 - protein, 17 aa, Mycobacterium
IALSRGLDRDRFVQEVR

SEQ ID NO: 677393 - protein, 17 aa, Mycobacterium
IALSRGLQPNRFLQEIR

SEQ ID NO: 677394 - protein, 26 aa, Mycobacterium
IALSSYRFPTGWFIVAFASDLAPGDV

SEQ ID NO: 677395 - protein, 26 aa, Mycobacterium
IALSTRFPYTGFRPKLHPEILAATRA

SEQ ID NO: 677396 - protein, 26 aa, Mycobacterium
IALSTYRFPTGWFIVAFGSDLAAGQV

SEQ ID NO: 677397 - protein, 26 aa, Mycobacterium
IALSTYRFPTGWFIVAFGSDLAPGQV

SEQ ID NO: 677398 - protein, 17 aa, Mycobacterium
IALTLAEHRGGRVGPDQ

SEQ ID NO: 677399 - protein, 18 aa, Mycobacterium
IALTPARLLMVVITDTGR

SEQ ID NO: 677400 - protein, 23 aa, Mycobacterium
IALTRPGGVVLYATCSPHLAETV

SEQ ID NO: 677401 - protein, 17 aa, Mycobacterium
IALVDMYNLAGSSALYR

SEQ ID NO: 677402 - protein, 20 aa, Mycobacterium
IALVNGWAAGGGHSLHVVCD

SEQ ID NO: 677403 - protein, 24 aa, Mycobacterium
IAMAGAITPYVAWALTTAAQAEQI

SEQ ID NO: 677404 - protein, 20 aa, Mycobacterium
IAMAQQRAAAAAAQASAYSM

SEQ ID NO: 677405 - protein, 17 aa, Mycobacterium
IAMGWEVADGPEVETEH

SEQ ID NO: 677406 - protein, 17 aa, Mycobacterium
IAMLAARKVTAPAAAPG

SEQ ID NO: 677407 - protein, 18 aa, Mycobacterium
IAMLAPRSRPCVATALTL

SEQ ID NO: 677408 - protein, 18 aa, Mycobacterium
IAMLSQWRAPDPAQDSLR

SEQ ID NO: 677409 - protein, 24 aa, Mycobacterium
IAMRSRFGLRECVVVPGPDAPDVD

SEQ ID NO: 677410 - protein, 23 aa, Mycobacterium
IAMRSWEATVFWEGDGAGAEPVK

SEQ ID NO: 677411 - protein, 23 aa, Mycobacterium
IAMTRWQATVNWVADEPATAELA

SEQ ID NO: 677412 - protein, 18 aa, Mycobacterium
IANASLFLASDEARYITS

SEQ ID NO: 677413 - protein, 18 aa, Mycobacterium
IANCSGFYGDRLSAMHEM

SEQ ID NO: 677414 - protein, 25 aa, Mycobacterium
IANDSRYGLVGAVWSADTERAAAVA

SEQ ID NO: 677415 - protein, 19 aa, Mycobacterium
IANELGVTGCLAVELFETN

SEQ ID NO: 677416 - protein, 19 aa, Mycobacterium
IANERVRPVIGTRLPIQQA

SEQ ID NO: 677417 - protein, 22 aa, Mycobacterium
IANEVAKSYGFWLGDAFASGGS

SEQ ID NO: 677418 - protein, 23 aa, Mycobacterium
IANEVANSYGFWLGDAFASGGSV

SEQ ID NO: 677419 - protein, 17 aa, Mycobacterium
IANGGWDSLWYKTTDGH

SEQ ID NO: 677420 - protein, 28 aa, Mycobacterium
IANGIDAPALWPGLPVRPVKGEVLRLRW

SEQ ID NO: 677421 - protein, 17 aa, Mycobacterium
IANLRVADASVMPRITS

SEQ ID NO: 677422 - protein, 17 aa, Mycobacterium
IANMFPNSFIIVTGGNP

SEQ ID NO: 677423 - protein, 19 aa, Mycobacterium
IANPPLVPVQAVWLPHSVS

SEQ ID NO: 677424 - protein, 20 aa, Mycobacterium
IANRLCAQILLLSAEDPTKD

SEQ ID NO: 677425 - protein, 21 aa, Mycobacterium
IANRLCAQILLLSAEDPTKDI

SEQ ID NO: 677426 - protein, 27 aa, Mycobacterium
IANRLLPCLPTLLALSASSPFWADGSD

SEQ ID NO: 677427 - protein, 25 aa, Mycobacterium
IANRLPMMVVCKLLGLPDDDVDKLI

SEQ ID NO: 677428 - protein, 29 aa, Mycobacterium
IANSDGRLLKLRLHPGVMTGYSHGELADR

SEQ ID NO: 677429 - protein, 19 aa, Mycobacterium
IANSFVYNLVDPILNDPSF

SEQ ID NO: 677430 - protein, 22 aa, Mycobacterium
IANSGTGNWGIGNSGSYNTGIG

SEQ ID NO: 677431 - protein, 18 aa, Mycobacterium
IAPAFPSSVTPFGHKFGC

SEQ ID NO: 677432 - protein, 18 aa, Mycobacterium
IAPAGGWTKYSPLKAEIV

SEQ ID NO: 677433 - protein, 25 aa, Mycobacterium
IAPANIRPGDLVFSNFSAPGVPEHV

SEQ ID NO: 677434 - protein, 28 aa, Mycobacterium
IAPARAAGRGVAAFNVITLEHAHGIVDG

SEQ ID NO: 677435 - protein, 24 aa, Mycobacterium
IAPARLRAKVLAAMRAAHPYEEPA

SEQ ID NO: 677436 - protein, 19 aa, Mycobacterium
IAPDAHRALLAAIADGLGL

SEQ ID NO: 677437 - protein, 20 aa, Mycobacterium
IAPDIMKIDLGLVQRQPDQW

SEQ ID NO: 677438 - protein, 17 aa, Mycobacterium
IAPDLVDMIGYQRRLVS

SEQ ID NO: 677439 - protein, 17 aa, Mycobacterium
IAPDWLHLVARYYEAYG

SEQ ID NO: 677440 - protein, 19 aa, Mycobacterium
IAPELRKKAEVVFPQAQAM

SEQ ID NO: 677441 - protein, 19 aa, Mycobacterium
IAPELTGLWTAGFMMAPTN

SEQ ID NO: 677442 - protein, 17 aa, Mycobacterium
IAPEVAELVVFQRTPNF

SEQ ID NO: 677443 - protein, 17 aa, Mycobacterium
IAPEVVEFWQGRENRLH

SEQ ID NO: 677444 - protein, 25 aa, Mycobacterium
IAPFIRFLVSDGWWITGQTILINGG

SEQ ID NO: 677445 - protein, 20 aa, Mycobacterium
IAPGLFKTPLLGSLPEEAQA

SEQ ID NO: 677446 - protein, 18 aa, Mycobacterium
IAPGLPTNVIKIAESGVR

SEQ ID NO: 677447 - protein, 22 aa, Mycobacterium
IAPGLWCSPGLSNSYLLTTGEG

SEQ ID NO: 677448 - protein, 25 aa, Mycobacterium
IAPGPWFQWHFDRWTVPPGATEIAR

SEQ ID NO: 677449 - protein, 20 aa, Mycobacterium
IAPGRCVLAHADAFEVISPH

SEQ ID NO: 677450 - protein, 37 aa, Mycobacterium
IAPIGAPSFKEALRWGAEVYHSLKSVLKKQGLSTGLG

SEQ ID NO: 677451 - protein, 17 aa, Mycobacterium
IAPIVARLTVFQRTPIW

SEQ ID NO: 677452 - protein, 28 aa, Mycobacterium
IAPKPLPPLLVRESEGFIEVFAPARPDR

SEQ ID NO: 677453 - protein, 19 aa, Mycobacterium
IAPLEFPPYVQSVLPPAPP

SEQ ID NO: 677454 - protein, 17 aa, Mycobacterium
IAPLELLSYAAAVTTRL

SEQ ID NO: 677455 - protein, 17 aa, Mycobacterium
IAPLVPLLDGDRIYIFG

SEQ ID NO: 677456 - protein, 26 aa, Mycobacterium
IAPMPSARLGRGWSDERIEATLNEAA

SEQ ID NO: 677457 - protein, 19 aa, Mycobacterium
IAPNAWRLPFEREWRDARP

SEQ ID NO: 677458 - protein, 27 aa, Mycobacterium
IAPNFAIGAVLSMHFARQAAPFFDSAE

SEQ ID NO: 677459 - protein, 17 aa, Mycobacterium
IAPNGACGRAFGKGSVH

SEQ ID NO: 677460 - protein, 19 aa, Mycobacterium
IAPQWHLRMQAAVQRHVDA

SEQ ID NO: 677461 - protein, 23 aa, Mycobacterium
IAPRGHARVLLRITVGADDRIHA

SEQ ID NO: 677462 - protein, 19 aa, Mycobacterium
IAPRHLGLLAVIAKSFARI

SEQ ID NO: 677463 - protein, 17 aa, Mycobacterium
IAPRISWADAARILRTT

SEQ ID NO: 677464 - protein, 18 aa, Mycobacterium
IAPRKVLILVEWESKDAF

SEQ ID NO: 677465 - protein, 24 aa, Mycobacterium
IAPRLDYADIVALFARHLGGTVEE

SEQ ID NO: 677466 - protein, 17 aa, Mycobacterium
IAPRLEDRYPAYGVLAS

SEQ ID NO: 677467 - protein, 25 aa, Mycobacterium
IAPRTLLCLSTWRAGGHLSDTGFDE

SEQ ID NO: 677468 - protein, 17 aa, Mycobacterium
IAPSAAIAPPPPGIVMA

SEQ ID NO: 677469 - protein, 20 aa, Mycobacterium
IAPSAAKLYCTEMAGTVADL

SEQ ID NO: 677470 - protein, 25 aa, Mycobacterium
IAPSPRSRAEIMGWLDERAQIPVDP

SEQ ID NO: 677471 - protein, 18 aa, Mycobacterium
IAPSRFHVVPVLAYSADP

SEQ ID NO: 677472 - protein, 17 aa, Mycobacterium
IAPSVALPSKEAIGQTA

SEQ ID NO: 677473 - protein, 23 aa, Mycobacterium
IAPTPKIEFVFRDTYQCGNEEAN

SEQ ID NO: 677474 - protein, 21 aa, Mycobacterium
IAPWNFPLMLETWKVAPALAW

SEQ ID NO: 677475 - protein, 26 aa, Mycobacterium
IAPWNFPMPIACWGFAPALAAGNAVL

SEQ ID NO: 677476 - protein, 19 aa, Mycobacterium
IAPWNYPLLQMSWKVAPAL

SEQ ID NO: 677477 - protein, 19 aa, Mycobacterium
IAPYGRRVYTKGGYLSELS

SEQ ID NO: 677478 - protein, 20 aa, Mycobacterium
IAQAGGDPWAIDRSLQAGNP

SEQ ID NO: 677479 - protein, 20 aa, Mycobacterium
IAQAGGDPWAVNRSLQAGNP

SEQ ID NO: 677480 - protein, 19 aa, Mycobacterium
IAQAGLYPTNCRLLDPAEA

SEQ ID NO: 677481 - protein, 18 aa, Mycobacterium
IAQALSFRAAGLTLPTAE

SEQ ID NO: 677482 - protein, 17 aa, Mycobacterium
IAQARPRGKTVWFTGLS

SEQ ID NO: 677483 - protein, 19 aa, Mycobacterium
IAQCARALADYGVEPRHLR

SEQ ID NO: 677484 - protein, 26 aa, Mycobacterium
IAQEFGPDMLFGFKSIHLDQARLLQV

SEQ ID NO: 677485 - protein, 18 aa, Mycobacterium
IAQFYRRKFRHILVDEYQ

SEQ ID NO: 677486 - protein, 18 aa, Mycobacterium
IAQLLVQRVELVDLVEVS

SEQ ID NO: 677487 - protein, 18 aa, Mycobacterium
IAQLLVQRVELVELVEVS

SEQ ID NO: 677488 - protein, 35 aa, Mycobacterium
IAQMGWPLADAIRWPAQLIPTFQWERMLDQDAKMG

SEQ ID NO: 677489 - protein, 20 aa, Mycobacterium
IAQMLTELMTMFAAGALQPL

SEQ ID NO: 677490 - protein, 17 aa, Mycobacterium
IAQPERRARAFPHELSG

SEQ ID NO: 677491 - protein, 18 aa, Mycobacterium
IAQPRAGATTAWVPSPTA

SEQ ID NO: 677492 - protein, 18 aa, Mycobacterium
IAQPRFGVYQSLHTTVVG

SEQ ID NO: 677493 - protein, 19 aa, Mycobacterium
IAQPRFGVYQSLHTTVVGP

SEQ ID NO: 677494 - protein, 43 aa, Mycobacterium
IAQQLAPWQQALALPAADADFSLSIFGLQLVKTGTANATTTFG

SEQ ID NO: 677495 - protein, 25 aa, Mycobacterium
IAQRFNGRFPDTFVVPDVLIPKITA

SEQ ID NO: 677496 - protein, 23 aa, Mycobacterium
IAQRHKGRIVAVEISEGVQIGPA

SEQ ID NO: 677497 - protein, 22 aa, Mycobacterium
IAQRTALRQVLVRSGADGTEID

SEQ ID NO: 677498 - protein, 27 aa, Mycobacterium
IAQSALDMACRWARDRDVFGGRLADKQ

SEQ ID NO: 677499 - protein, 18 aa, Mycobacterium
IAQVHGWCVGGASDYALC

SEQ ID NO: 677500 - protein, 19 aa, Mycobacterium
IAQVRFSWVRPALAGPPAW

SEQ ID NO: 677501 - protein, 23 aa, Mycobacterium
IARAAEILRLLQAHPGGLSQAEI

SEQ ID NO: 677502 - protein, 22 aa, Mycobacterium
IARAARVGMELDEANIPVPESV

SEQ ID NO: 677503 - protein, 22 aa, Mycobacterium
IARAEPFAGPYTITSHTKNQLI

SEQ ID NO: 677504 - protein, 18 aa, Mycobacterium
IARAEVEIACGRAQSVTG

SEQ ID NO: 677505 - protein, 23 aa, Mycobacterium
IARAIGARRAMTFDVSNACAGML

SEQ ID NO: 677506 - protein, 18 aa, Mycobacterium
IARALAMRPKVMLFDEPT

SEQ ID NO: 677507 - protein, 19 aa, Mycobacterium
IARALAMRPKVVLFDEPTS

SEQ ID NO: 677508 - protein, 18 aa, Mycobacterium
IARALRWQFDGIDRVGPD

SEQ ID NO: 677509 - protein, 20 aa, Mycobacterium
IARALVRTPSAFLFDEPLSN

SEQ ID NO: 677510 - protein, 25 aa, Mycobacterium
IARARKLGVPCAWPDDAVTVCSFGD

SEQ ID NO: 677511 - protein, 23 aa, Mycobacterium
IARARVALPLVDKGAESPRETWL

SEQ ID NO: 677512 - protein, 17 aa, Mycobacterium
IARCLSMDPDLILADEP

SEQ ID NO: 677513 - protein, 21 aa, Mycobacterium
IARCRHCTGPLSLPERGAPGA

SEQ ID NO: 677514 - protein, 27 aa, Mycobacterium
IARDLSREFIRVCTIAPGLFKTPLLGS

SEQ ID NO: 677515 - protein, 21 aa, Mycobacterium
IARDLSSYLIRVNTIAPGLFE

SEQ ID NO: 677516 - protein, 17 aa, Mycobacterium
IAREEIFGPVITVIPYR

SEQ ID NO: 677517 - protein, 17 aa, Mycobacterium
IAREEIFGPVLTVIPYR

SEQ ID NO: 677518 - protein, 25 aa, Mycobacterium
IAREPRGDGGFGYDPVFIPDGYQRT

SEQ ID NO: 677519 - protein, 25 aa, Mycobacterium
IAREPRGHGGFGYDPVFVPNGYERT

SEQ ID NO: 677520 - protein, 21 aa, Mycobacterium
IARGGWLGMTIPTEYGGHGLG

SEQ ID NO: 677521 - protein, 25 aa, Mycobacterium
IARGIAEPYLRAGQIEEHLVYPVTT

SEQ ID NO: 677522 - protein, 20 aa, Mycobacterium
IARGQYWIHPALPEVIENAL

SEQ ID NO: 677523 - protein, 17 aa, Mycobacterium
IARGRVIAMDTNLARAV

SEQ ID NO: 677524 - protein, 23 aa, Mycobacterium
IARGVPLAAPWDARRARELDGLS

SEQ ID NO: 677525 - protein, 22 aa, Mycobacterium
IARILFHDWEHEMSPDLHIVQI

SEQ ID NO: 677526 - protein, 20 aa, Mycobacterium
IARILKFAATEVVPRLAGTE

SEQ ID NO: 677527 - protein, 17 aa, Mycobacterium
IARLARMLVLGPLGESV

SEQ ID NO: 677528 - protein, 17 aa, Mycobacterium
IARLAWAYDDEVDMDYH

SEQ ID NO: 677529 - protein, 21 aa, Mycobacterium
IARLKEVFTPKEAAAPNTEPE

SEQ ID NO: 677530 - protein, 25 aa, Mycobacterium
IARLNARKGFDHWFEVYRGTLPSPQ

SEQ ID NO: 677531 - protein, 25 aa, Mycobacterium
IARLNRWVSSYADLPVPTGQARLLA

SEQ ID NO: 677532 - protein, 23 aa, Mycobacterium
IARLPFVPSSLEWLHAGRTSVVM

SEQ ID NO: 677533 - protein, 20 aa, Mycobacterium
IARLRAQMEFSHSRREDSGP

SEQ ID NO: 677534 - protein, 29 aa, Mycobacterium
IARLSLLDRGMVFAIAHVRGGGEMGRPWY

SEQ ID NO: 677535 - protein, 17 aa, Mycobacterium
IARLSRMLVLGPLGESF

SEQ ID NO: 677536 - protein, 17 aa, Mycobacterium
IARLVLEDGRVFTGTPF

SEQ ID NO: 677537 - protein, 27 aa, Mycobacterium
IARMQARAHTARLAYYHAAALLLAGKP

SEQ ID NO: 677538 - protein, 23 aa, Mycobacterium
IARNCSPASLAVIKRQAYGDALR

SEQ ID NO: 677539 - protein, 25 aa, Mycobacterium
IARNPRQHLAFGFGPHLCLGHNLAR

SEQ ID NO: 677540 - protein, 19 aa, Mycobacterium
IARPDCVLLDLHLHDTTGI

SEQ ID NO: 677541 - protein, 24 aa, Mycobacterium
IARPDLLEEMARQFGSQCIVLSVD

SEQ ID NO: 677542 - protein, 24 aa, Mycobacterium
IARPPRSAFAPVLRARRHLLVAAG

SEQ ID NO: 677543 - protein, 18 aa, Mycobacterium
IARQGRREAAQSWIDDVG

SEQ ID NO: 677544 - protein, 23 aa, Mycobacterium
IARQITGWVAAIGTRSAAEDEVG

SEQ ID NO: 677545 - protein, 26 aa, Mycobacterium
IARQLPLRLVYVIPRREKHREPATSS

SEQ ID NO: 677546 - protein, 25 aa, Mycobacterium
IARQRVAVMRAIRDAMHRRDFLELE

SEQ ID NO: 677547 - protein, 20 aa, Mycobacterium
IARRAEAGIGLTSPELATLM

SEQ ID NO: 677548 - protein, 18 aa, Mycobacterium
IARRAGVNEVTLFRRYGN

SEQ ID NO: 677549 - protein, 21 aa, Mycobacterium
IARRELLSGVLRRGLRAAALF

SEQ ID NO: 677550 - protein, 23 aa, Mycobacterium
IARREVAQQIAFYASVRTYEPLL

SEQ ID NO: 677551 - protein, 17 aa, Mycobacterium
IARRGRRDQPPAGVDKL

SEQ ID NO: 677552 - protein, 21 aa, Mycobacterium
IARRIRESRVYSEVIPHTTAI

SEQ ID NO: 677553 - protein, 21 aa, Mycobacterium
IARRRADELGRTVSLQRADAH

SEQ ID NO: 677554 - protein, 17 aa, Mycobacterium
IARRVREARVYSEVVPH

SEQ ID NO: 677555 - protein, 25 aa, Mycobacterium
IARSFAAALGLEFKRVQFTPDLLPA

SEQ ID NO: 677556 - protein, 26 aa, Mycobacterium
IARSFAAALGLEFKRVQFTPDLLPAD

SEQ ID NO: 677557 - protein, 20 aa, Mycobacterium
IARSGVPVQVGYQRRFDTAF

SEQ ID NO: 677558 - protein, 20 aa, Mycobacterium
IARSNCTVFDAFGPHHRLIF

SEQ ID NO: 677559 - protein, 20 aa, Mycobacterium
IARSNCTVFDSFGPHHRLIF

SEQ ID NO: 677560 - protein, 18 aa, Mycobacterium
IARSRRRVRVQYRVADGG

SEQ ID NO: 677561 - protein, 19 aa, Mycobacterium
IARSSGCTEIMAFATSAVR

SEQ ID NO: 677562 - protein, 19 aa, Mycobacterium
IARTFTRKQAVVSFDHAYH

SEQ ID NO: 677563 - protein, 26 aa, Mycobacterium
IARTGLRWLDIPAEPDFARLRRDVSA

SEQ ID NO: 677564 - protein, 19 aa, Mycobacterium
IARTVIDAAVFLDATSTVP

SEQ ID NO: 677565 - protein, 29 aa, Mycobacterium
IARVRTELGWEFIQIYGLTETAPLITMNR

SEQ ID NO: 677566 - protein, 23 aa, Mycobacterium
IARVVSMPCVEWFESQPPDYRDS

SEQ ID NO: 677567 - protein, 24 aa, Mycobacterium
IARWTDPDGGFFLWVTLDGDVDAT

SEQ ID NO: 677568 - protein, 21 aa, Mycobacterium
IARYRHPALDAGVDFVCASLR

SEQ ID NO: 677569 - protein, 17 aa, Mycobacterium
IASAGWSNVRWRNLTGG

SEQ ID NO: 677570 - protein, 23 aa, Mycobacterium
IASCPPGRVEVVANYTAFLQLQR

SEQ ID NO: 677571 - protein, 22 aa, Mycobacterium
IASDGSFQWRLRPTSNGQLVIR

SEQ ID NO: 677572 - protein, 17 aa, Mycobacterium
IASEALVGWADSVGVDG

SEQ ID NO: 677573 - protein, 17 aa, Mycobacterium
IASEHRRGLGLRATVER

SEQ ID NO: 677574 - protein, 17 aa, Mycobacterium
IASEILEHVPADDKAIS

SEQ ID NO: 677575 - protein, 18 aa, Mycobacterium
IASELALLLNAWRQETND

SEQ ID NO: 677576 - protein, 18 aa, Mycobacterium
IASELTVGVEPVGASTFG

SEQ ID NO: 677577 - protein, 22 aa, Mycobacterium
IASETGLSCSIGISDNKQRAKV

SEQ ID NO: 677578 - protein, 18 aa, Mycobacterium
IASFCTSIAQQLTFGPGG

SEQ ID NO: 677579 - protein, 23 aa, Mycobacterium
IASGEIIMSFAITEPDAGSNSHN

SEQ ID NO: 677580 - protein, 24 aa, Mycobacterium
IASGEVIMAFAITEPDAGSNSHNI

SEQ ID NO: 677581 - protein, 18 aa, Mycobacterium
IASGLPMGGDLEFADELT

SEQ ID NO: 677582 - protein, 24 aa, Mycobacterium
IASGNLRKVIRLMKYLRDHKNSFT

SEQ ID NO: 677583 - protein, 22 aa, Mycobacterium
IASGRLRFTTSYAEAAEFADVH

SEQ ID NO: 677584 - protein, 23 aa, Mycobacterium
IASGVRRFVFTSSIATIGLPESG

SEQ ID NO: 677585 - protein, 28 aa, Mycobacterium
IASHLPRAVGVAFAIARARKLGVPCAWP

SEQ ID NO: 677586 - protein, 24 aa, Mycobacterium
IASIPEFAKMVARLKSELDPATQA

SEQ ID NO: 677587 - protein, 36 aa, Mycobacterium
IASKGDSADGVWARLKFEGGVHRVQRVPVTESQGRV

SEQ ID NO: 677588 - protein, 23 aa, Mycobacterium
IASKRIAPIVILTAFSQRELVER

SEQ ID NO: 677589 - protein, 18 aa, Mycobacterium
IASLEMQKLAALGPAAPT

SEQ ID NO: 677590 - protein, 18 aa, Mycobacterium
IASLEMQKLAALGPSAPT

SEQ ID NO: 677591 - protein, 18 aa, Mycobacterium
IASLGRYGYGWADSDVAG

SEQ ID NO: 677592 - protein, 21 aa, Mycobacterium
IASLIMRRRILAARLDAAAAR

SEQ ID NO: 677593 - protein, 20 aa, Mycobacterium
IASLNYLLSSHVWRQDHNGA

SEQ ID NO: 677594 - protein, 24 aa, Mycobacterium
IASLNYLLSSHVWRQDHNGFSHQD

SEQ ID NO: 677595 - protein, 20 aa, Mycobacterium
IASLNYLLTSHVWRQDHNGA

SEQ ID NO: 677596 - protein, 20 aa, Mycobacterium
IASMTDFWLTGAGLAISETT

SEQ ID NO: 677597 - protein, 19 aa, Mycobacterium
IASNGSVEWMCVPRPDSPS

SEQ ID NO: 677598 - protein, 17 aa, Mycobacterium
IASNLYLGREIRRKGVA

SEQ ID NO: 677599 - protein, 17 aa, Mycobacterium
IASPGWTWSSAREAFDN

SEQ ID NO: 677600 - protein, 19 aa, Mycobacterium
IASRAKLQIGRSGRHIAQE

SEQ ID NO: 677601 - protein, 17 aa, Mycobacterium
IASRHGLALSVVNPLVD

SEQ ID NO: 677602 - protein, 18 aa, Mycobacterium
IASRLMEVYAGFLAHTDH

SEQ ID NO: 677603 - protein, 19 aa, Mycobacterium
IASRVGVTAASLYRHYSGK

SEQ ID NO: 677604 - protein, 23 aa, Mycobacterium
IASSFSELCHRAGLDLVVDCSPA

SEQ ID NO: 677605 - protein, 25 aa, Mycobacterium
IASTKGDGLLVVFGHRAGQHNDAHR

SEQ ID NO: 677606 - protein, 17 aa, Mycobacterium
IASVCRELGLSVTVAER

SEQ ID NO: 677607 - protein, 20 aa, Mycobacterium
IASVPVILRRGAEWFRTMGT

SEQ ID NO: 677608 - protein, 19 aa, Mycobacterium
IASVVKLFIADDLLLQESE

SEQ ID NO: 677609 - protein, 17 aa, Mycobacterium
IASWRRARAQNPASGAL

SEQ ID NO: 677610 - protein, 26 aa, Mycobacterium
IASWTEPKGGYFISLDVLPGTARRTV

SEQ ID NO: 677611 - protein, 17 aa, Mycobacterium
IASYCLTEPDAGSDASA

SEQ ID NO: 677612 - protein, 17 aa, Mycobacterium
IASYCLTEPGAGSDASA

SEQ ID NO: 677613 - protein, 18 aa, Mycobacterium
IASYSGAVALGISVARLH

SEQ ID NO: 677614 - protein, 19 aa, Mycobacterium
IATAAARLVASRGLAGATV

SEQ ID NO: 677615 - protein, 22 aa, Mycobacterium
IATALLHRGASVLLTDVLGDVL

SEQ ID NO: 677616 - protein, 17 aa, Mycobacterium
IATCAGLALAVGVIAGR

SEQ ID NO: 677617 - protein, 23 aa, Mycobacterium
IATDHLMKFPGKFSEQLLADHLQ

SEQ ID NO: 677618 - protein, 21 aa, Mycobacterium
IATDHLMNFPGKFSEQLLVEH

SEQ ID NO: 677619 - protein, 24 aa, Mycobacterium
IATDHLMRFPGHFSEQLLPEHLHK

SEQ ID NO: 677620 - protein, 25 aa, Mycobacterium
IATDHLMRFPGKFSEQLLADHLQKV

SEQ ID NO: 677621 - protein, 25 aa, Mycobacterium
IATDHLMRFPGRFSEQLLPEHLHKV

SEQ ID NO: 677622 - protein, 17 aa, Mycobacterium
IATDIAGAPAFLGADLF

SEQ ID NO: 677623 - protein, 24 aa, Mycobacterium
IATDNLMRFPGRFSEHLLAEHLQK

SEQ ID NO: 677624 - protein, 17 aa, Mycobacterium
IATDPRGLLLVADTRGD

SEQ ID NO: 677625 - protein, 24 aa, Mycobacterium
IATDPYGAGWLYSVQPTAVGELLT

SEQ ID NO: 677626 - protein, 19 aa, Mycobacterium
IATDWAGPGSRVVRRSMRL

SEQ ID NO: 677627 - protein, 19 aa, Mycobacterium
IATDWAGPSSRVVRRSLRL

SEQ ID NO: 677628 - protein, 18 aa, Mycobacterium
IATGAPVLHLERVLLADD

SEQ ID NO: 677629 - protein, 17 aa, Mycobacterium
IATGIYLLSAADRDEAV

SEQ ID NO: 677630 - protein, 25 aa, Mycobacterium
IATGRLALGVQGWLGAHRVGDVVVL

SEQ ID NO: 677631 - protein, 22 aa, Mycobacterium
IATGWTRCRPGDRFIVAPQSDG

SEQ ID NO: 677632 - protein, 23 aa, Mycobacterium
IATHAALMWSLMRRDEQFRSALA

SEQ ID NO: 677633 - protein, 18 aa, Mycobacterium
IATILACKGGRVADITVG

SEQ ID NO: 677634 - protein, 19 aa, Mycobacterium
IATILLTRIATCWRTGEHC

SEQ ID NO: 677635 - protein, 24 aa, Mycobacterium
IATKKAGAGQYVFLLYSTLQQVGD

SEQ ID NO: 677636 - protein, 19 aa, Mycobacterium
IATKYPWLQAVPAYGVAIG

SEQ ID NO: 677637 - protein, 21 aa, Mycobacterium
IATLIPDEWLEPSATGSAQQC

SEQ ID NO: 677638 - protein, 21 aa, Mycobacterium
IATLIPDEWLEPSATGSPQQC

SEQ ID NO: 677639 - protein, 20 aa, Mycobacterium
IATLKLDYTIVIVTHNMQQA

SEQ ID NO: 677640 - protein, 18 aa, Mycobacterium
IATLTLDLEKGVKLPKNA

SEQ ID NO: 677641 - protein, 18 aa, Mycobacterium
IATMRAAIDIARGRGWLG

SEQ ID NO: 677642 - protein, 17 aa, Mycobacterium
IATRHARVFLDSVRPAL

SEQ ID NO: 677643 - protein, 17 aa, Mycobacterium
IATRSPIALSVTLEAVR

SEQ ID NO: 677644 - protein, 22 aa, Mycobacterium
IATRSRLMARLSGQGAMALLEL

SEQ ID NO: 677645 - protein, 24 aa, Mycobacterium
IATRTIRAVLDWMTDYPHRYEFMR

SEQ ID NO: 677646 - protein, 22 aa, Mycobacterium
IATRTLAEWSERFATLSGPWAP

SEQ ID NO: 677647 - protein, 19 aa, Mycobacterium
IATSGLMGFALRPLRLATV

SEQ ID NO: 677648 - protein, 25 aa, Mycobacterium
IATTCGIGRVVSRADALGADATGAS

SEQ ID NO: 677649 - protein, 25 aa, Mycobacterium
IATTNRPGARFGPRAIRATAYEPGT

SEQ ID NO: 677650 - protein, 17 aa, Mycobacterium
IATTTAEEWARANLDAG

SEQ ID NO: 677651 - protein, 17 aa, Mycobacterium
IATTVLLPAGPNDPKDS

SEQ ID NO: 677652 - protein, 25 aa, Mycobacterium
IATTWPDKRVELYFPGDRALAGHHP

SEQ ID NO: 677653 - protein, 17 aa, Mycobacterium
IATVALPPHAPRAVDAD

SEQ ID NO: 677654 - protein, 17 aa, Mycobacterium
IATVALPPQVPRAVDAD

SEQ ID NO: 677655 - protein, 26 aa, Mycobacterium
IATVSGPNFLGWEHPPAAAVPATTPT

SEQ ID NO: 677656 - protein, 26 aa, Mycobacterium
IATVSGPSFLGWEHPPAAAATAPAKP

SEQ ID NO: 677657 - protein, 23 aa, Mycobacterium
IATWKRIAGALKRDPYGRTARQV

SEQ ID NO: 677658 - protein, 17 aa, Mycobacterium
IATYLGIDHVIGASSGT

SEQ ID NO: 677659 - protein, 20 aa, Mycobacterium
IAVADLDAAIAWYHDHLGMV

SEQ ID NO: 677660 - protein, 19 aa, Mycobacterium
IAVADRGATVFALARNGDA

SEQ ID NO: 677661 - protein, 24 aa, Mycobacterium
IAVARLGITSVRFTGGEPLVVRHL

SEQ ID NO: 677662 - protein, 22 aa, Mycobacterium
IAVAVEELMRYLSIIQTGQRRI

SEQ ID NO: 677663 - protein, 20 aa, Mycobacterium
IAVCAALQLGHENLRDIAEF

SEQ ID NO: 677664 - protein, 20 aa, Mycobacterium
IAVDGRGFFGPVLTGIPGSD

SEQ ID NO: 677665 - protein, 18 aa, Mycobacterium
IAVDLCDQIASVPYSLAT

SEQ ID NO: 677666 - protein, 27 aa, Mycobacterium
IAVDLRDDWPAALLAAGFDPEVPTAWS

SEQ ID NO: 677667 - protein, 20 aa, Mycobacterium
IAVDLTWKGLFDAVREQPHV

SEQ ID NO: 677668 - protein, 22 aa, Mycobacterium
IAVDMDPAPGFFNFTNNDSSGF

SEQ ID NO: 677669 - protein, 26 aa, Mycobacterium
IAVDTARRRLYWSSEGERLTDRQSGL

SEQ ID NO: 677670 - protein, 29 aa, Mycobacterium
IAVEARLTLEMGTTVILPAAMRYQTELAQ

SEQ ID NO: 677671 - protein, 22 aa, Mycobacterium
IAVESRSGIAPLTIDLSAVTQL

SEQ ID NO: 677672 - protein, 23 aa, Mycobacterium
IAVESRSGVAPLTIDLSAVTHLG

SEQ ID NO: 677673 - protein, 25 aa, Mycobacterium
IAVGLRLYRSAFFKVVPQVNAEVRG

SEQ ID NO: 677674 - protein, 17 aa, Mycobacterium
IAVILRRGYGLGAQAMC

SEQ ID NO: 677675 - protein, 20 aa, Mycobacterium
IAVIRRFWDRVPRTVDVQTR

SEQ ID NO: 677676 - protein, 21 aa, Mycobacterium
IAVKDGRIVGVRGRADDRVNH

SEQ ID NO: 677677 - protein, 22 aa, Mycobacterium
IAVKDGRIVGVRGRAVDRVNHG

SEQ ID NO: 677678 - protein, 22 aa, Mycobacterium
IAVKQGRIVGVRGRAVDRVNHG

SEQ ID NO: 677679 - protein, 19 aa, Mycobacterium
IAVKQLRMVAIGVAGWKSR

SEQ ID NO: 677680 - protein, 24 aa, Mycobacterium
IAVLARPSIDTVLAVVAGLIAGVP

SEQ ID NO: 677681 - protein, 25 aa, Mycobacterium
IAVLCDGNRRWARSAGYTDVSHGYR

SEQ ID NO: 677682 - protein, 23 aa, Mycobacterium
IAVLRPTQRRGFGGYGPPLLVGG

SEQ ID NO: 677683 - protein, 25 aa, Mycobacterium
IAVLSARPRMLFDYFQQLFAQVTNP

SEQ ID NO: 677684 - protein, 24 aa, Mycobacterium
IAVLSRLAGEVAISEVPVPTELAK

SEQ ID NO: 677685 - protein, 20 aa, Mycobacterium
IAVMLRRRMQEVGMDTGGVE

SEQ ID NO: 677686 - protein, 24 aa, Mycobacterium
IAVMRRAVELGVQFIDTANSYGPY

SEQ ID NO: 677687 - protein, 30 aa, Mycobacterium
IAVNEFQYFVEMWNRAAGVMESYASATGVN

SEQ ID NO: 677688 - protein, 21 aa, Mycobacterium
IAVNFPLYVILSLLGLPEEDF

SEQ ID NO: 677689 - protein, 26 aa, Mycobacterium
IAVNGCGPGGAPFGGFKLSGLGREGG

SEQ ID NO: 677690 - protein, 26 aa, Mycobacterium
IAVNGHVRAGGFGLVGAADIAVAGPD

SEQ ID NO: 677691 - protein, 18 aa, Mycobacterium
IAVNLGAPVVLAVKAADR

SEQ ID NO: 677692 - protein, 18 aa, Mycobacterium
IAVPDLDAAIKWYHDHLG

SEQ ID NO: 677693 - protein, 25 aa, Mycobacterium
IAVPDRDTAGWAMRELVVLHEVAHH

SEQ ID NO: 677694 - protein, 24 aa, Mycobacterium
IAVPGHTPGSIALYLPAADAVLTG

SEQ ID NO: 677695 - protein, 25 aa, Mycobacterium
IAVPKFPNLLTLNGPYSYSGLSYFD

SEQ ID NO: 677696 - protein, 17 aa, Mycobacterium
IAVQAFVGVDRDAALLL

SEQ ID NO: 677697 - protein, 17 aa, Mycobacterium
IAVQRWGKLSPNRDNVV

SEQ ID NO: 677698 - protein, 27 aa, Mycobacterium
IAVQSLRLYERYGLLTPARSDGGTRRY

SEQ ID NO: 677699 - protein, 25 aa, Mycobacterium
IAVREYRLALVLADTAIPAYLSAPS

SEQ ID NO: 677700 - protein, 17 aa, Mycobacterium
IAVRFQYECRDHTGQWY

SEQ ID NO: 677701 - protein, 19 aa, Mycobacterium
IAVRGFRFGTGSSDDEQRD

SEQ ID NO: 677702 - protein, 18 aa, Mycobacterium
IAVRRAGIALAREVERRA

SEQ ID NO: 677703 - protein, 27 aa, Mycobacterium
IAVRVIRTLRRLGIRSVAVYSDPDAEA

SEQ ID NO: 677704 - protein, 27 aa, Mycobacterium
IAVRVIRTLRRLGIRSVAVYSDPDAGA

SEQ ID NO: 677705 - protein, 26 aa, Mycobacterium
IAVRVMRTLRRLRIRSVAVYSDPDAN

SEQ ID NO: 677706 - protein, 20 aa, Mycobacterium
IAVSAGLPWHDVEQHIADLV

SEQ ID NO: 677707 - protein, 20 aa, Mycobacterium
IAVSRWVRRHAVLPEWAGAG

SEQ ID NO: 677708 - protein, 20 aa, Mycobacterium
IAVSRWVRRHAVLPEWAGSG

SEQ ID NO: 677709 - protein, 21 aa, Mycobacterium
IAVSRWVRRTAVSAAWAGAGI

SEQ ID NO: 677710 - protein, 24 aa, Mycobacterium
IAVSSLKGANLWNEVKDRLDKPGG

SEQ ID NO: 677711 - protein, 20 aa, Mycobacterium
IAVTACGICGTDRAFVNGGF

SEQ ID NO: 677712 - protein, 17 aa, Mycobacterium
IAVTAWSAARTGFEALA

SEQ ID NO: 677713 - protein, 30 aa, Mycobacterium
IAVTDWFGGEPFGVWPWAQRQLAGAQPAVL

SEQ ID NO: 677714 - protein, 20 aa, Mycobacterium
IAVTGALKWASRPLKFAKLL

SEQ ID NO: 677715 - protein, 17 aa, Mycobacterium
IAVTKSWGMIDNRTISA

SEQ ID NO: 677716 - protein, 19 aa, Mycobacterium
IAVTRLGIDSVRFTGGEPL

SEQ ID NO: 677717 - protein, 24 aa, Mycobacterium
IAVTRLGVTNVRFTGGEPLLARHL

SEQ ID NO: 677718 - protein, 21 aa, Mycobacterium
IAVTRWARRTAVLPEWAGAGI

SEQ ID NO: 677719 - protein, 19 aa, Mycobacterium
IAVVNRLGWTHGCELNALE

SEQ ID NO: 677720 - protein, 18 aa, Mycobacterium
IAVVRDGHRVRVAECEVV

SEQ ID NO: 677721 - protein, 26 aa, Mycobacterium
IAWAGPPPLWWAQRFGTEPDLAEALV

SEQ ID NO: 677722 - protein, 17 aa, Mycobacterium
IAYALAVMAKCLEDDEL

SEQ ID NO: 677723 - protein, 20 aa, Mycobacterium
IAYEPALPVDRAFLHQRMPS

SEQ ID NO: 677724 - protein, 24 aa, Mycobacterium
IAYILEILPALSYLHSIGLVYNDL

SEQ ID NO: 677725 - protein, 20 aa, Mycobacterium
IAYLKTRFQFGRAIGSFQAL

SEQ ID NO: 677726 - protein, 24 aa, Mycobacterium
IAYLLEILPALSYLHSIGLVYNDL

SEQ ID NO: 677727 - protein, 21 aa, Mycobacterium
IAYRLLLTLTQFRLVAKGEDG

SEQ ID NO: 677728 - protein, 31 aa, Mycobacterium
IAYSHCIAHGFELRYGLDQQYRAVASGHWPL

SEQ ID NO: 677729 - protein, 27 aa, Mycobacterium
IAYSHCIAHGFELRYGLEQQYRAVASG

SEQ ID NO: 677730 - protein, 17 aa, Mycobacterium
IAYSIAFLASPRAAYLN

SEQ ID NO: 677731 - protein, 17 aa, Mycobacterium
IAYTLAWMRDVGARMGC

SEQ ID NO: 677732 - protein, 24 aa, Mycobacterium
IAYVSARAGFEVVLKDVTLEAAER

SEQ ID NO: 677733 - protein, 21 aa, Mycobacterium
ICAAKEPPPSIVLSAGLRRDP

SEQ ID NO: 677734 - protein, 21 aa, Mycobacterium
ICAFSHCRDVVAAVTNAGGFG

SEQ ID NO: 677735 - protein, 20 aa, Mycobacterium
ICAPANRWSVRTVGDLGLIG

SEQ ID NO: 677736 - protein, 18 aa, Mycobacterium
ICARRGPTLQWVRSEATA

SEQ ID NO: 677737 - protein, 21 aa, Mycobacterium
ICARRVPTLQWVRSEATASDI

SEQ ID NO: 677738 - protein, 25 aa, Mycobacterium
ICASYRPSVAMDCFVRMRDMTCRFP

SEQ ID NO: 677739 - protein, 18 aa, Mycobacterium
ICAVLGCGVDELLIPEPE

SEQ ID NO: 677740 - protein, 24 aa, Mycobacterium
ICAVPEMLDFGGAGFLVEPVSALG

SEQ ID NO: 677741 - protein, 24 aa, Mycobacterium
ICAVPEMLDFGGAGFVVEPVTVSA

SEQ ID NO: 677742 - protein, 19 aa, Mycobacterium
ICCAVDADEAGEMLGKLAA

SEQ ID NO: 677743 - protein, 17 aa, Mycobacterium
ICDCGRTDCPAAGAPQQ

SEQ ID NO: 677744 - protein, 19 aa, Mycobacterium
ICDDRWLDRPGPIPLGRTG

SEQ ID NO: 677745 - protein, 20 aa, Mycobacterium
ICDMGSRFRLVANHVTVVEP

SEQ ID NO: 677746 - protein, 18 aa, Mycobacterium
ICDQFGISISEVALRNES

SEQ ID NO: 677747 - protein, 17 aa, Mycobacterium
ICDRLRAAYPEWTGEQI

SEQ ID NO: 677748 - protein, 17 aa, Mycobacterium
ICDVRLPGADRWGICDF

SEQ ID NO: 677749 - protein, 18 aa, Mycobacterium
ICFQELFHGPYFGIVQDA

SEQ ID NO: 677750 - protein, 21 aa, Mycobacterium
ICGGATTWQGLPLTLVLDHVD

SEQ ID NO: 677751 - protein, 22 aa, Mycobacterium
ICGKDLRRSPAVILDGDDAILH

SEQ ID NO: 677752 - protein, 24 aa, Mycobacterium
ICGPETLRSFQLLGRHVTGGSAHA

SEQ ID NO: 677753 - protein, 27 aa, Mycobacterium
ICGPETLRSLYFLGARVTGGSPHAIRE

SEQ ID NO: 677754 - protein, 25 aa, Mycobacterium
ICGPETLRSLYFLGSRVTGGSPHAI

SEQ ID NO: 677755 - protein, 26 aa, Mycobacterium
ICGPETLRSLYFLSSRVTGGSPHAIR

SEQ ID NO: 677756 - protein, 26 aa, Mycobacterium
ICGPETLRSLYFLSSRVTGGSPHALR

SEQ ID NO: 677757 - protein, 19 aa, Mycobacterium
ICGPIRPGAETAIPASTSD

SEQ ID NO: 677758 - protein, 21 aa, Mycobacterium
ICGSDLHFLDGHYPIDQPVPI

SEQ ID NO: 677759 - protein, 18 aa, Mycobacterium
ICHTARFDTTWTDPATAI

SEQ ID NO: 677760 - protein, 22 aa, Mycobacterium
ICKRRSRLGLVAVHPATRLAES

SEQ ID NO: 677761 - protein, 19 aa, Mycobacterium
ICLNVLQSARARHETYIGP

SEQ ID NO: 677762 - protein, 17 aa, Mycobacterium
ICNECVATAAAIMDTYR

SEQ ID NO: 677763 - protein, 18 aa, Mycobacterium
ICNECVGVADAIMEKYRD

SEQ ID NO: 677764 - protein, 17 aa, Mycobacterium
ICNHCPYVQHVAAGLAQ

SEQ ID NO: 677765 - protein, 23 aa, Mycobacterium
ICNHRLDLDLARHGVNRSEFSVL

SEQ ID NO: 677766 - protein, 20 aa, Mycobacterium
ICPGGMLTPQIEHFSAPEDP

SEQ ID NO: 677767 - protein, 30 aa, Mycobacterium
ICPGVVRTRLAEALWKDHEDPLAATIALGR

SEQ ID NO: 677768 - protein, 30 aa, Mycobacterium
ICPGVVRTRLAEALWKDHEDPLASSIALGR

SEQ ID NO: 677769 - protein, 20 aa, Mycobacterium
ICPTCGSSFSFLPQLNPGDV

SEQ ID NO: 677770 - protein, 25 aa, Mycobacterium
ICPVCHFELPGGWRQGQAVCIAMAG

SEQ ID NO: 677771 - protein, 18 aa, Mycobacterium
ICQFAVGLSRQLYGKTMA

SEQ ID NO: 677772 - protein, 18 aa, Mycobacterium
ICQIGYVVADLDDAISRW

SEQ ID NO: 677773 - protein, 17 aa, Mycobacterium
ICQTCVVSLVQGHARDL

SEQ ID NO: 677774 - protein, 18 aa, Mycobacterium
ICQVVRVFADDDVVHVDG

SEQ ID NO: 677775 - protein, 18 aa, Mycobacterium
ICRHCPVMQECGADALDH

SEQ ID NO: 677776 - protein, 17 aa, Mycobacterium
ICRSCPVRVECLTYAIV

SEQ ID NO: 677777 - protein, 18 aa, Mycobacterium
ICRYQLPVTVVILNNGGV

SEQ ID NO: 677778 - protein, 17 aa, Mycobacterium
ICSCNAVTKGAICAAIC

SEQ ID NO: 677779 - protein, 20 aa, Mycobacterium
ICSDDFRIHFLISDSDGSNP

SEQ ID NO: 677780 - protein, 38 aa, Mycobacterium
ICSHDVLLCQLEIPVRVALTAARWAAEAGKQFVLNASP

SEQ ID NO: 677781 - protein, 25 aa, Mycobacterium
ICSQGKVIPDLIAWWCERDGVRADK

SEQ ID NO: 677782 - protein, 25 aa, Mycobacterium
ICSQGKVIPDLIAWWCERDGVRSDR

SEQ ID NO: 677783 - protein, 19 aa, Mycobacterium
ICSYGQAWTLLGVTAAVGR

SEQ ID NO: 677784 - protein, 25 aa, Mycobacterium
ICTPHALCWTADFTRDVSRSVIDAL

SEQ ID NO: 677785 - protein, 23 aa, Mycobacterium
ICTQGKVIPGLIEWWCERAKVRP

SEQ ID NO: 677786 - protein, 17 aa, Mycobacterium
ICTYVRATGEIHLNSTW

SEQ ID NO: 677787 - protein, 25 aa, Mycobacterium
ICVFLPNVRGSGGFGRSFMHADDRE

SEQ ID NO: 677788 - protein, 22 aa, Mycobacterium
ICVHDPLIMRRALEYATGLGVL

SEQ ID NO: 677789 - protein, 21 aa, Mycobacterium
ICVSDLAAALGRSENTVSQAL

SEQ ID NO: 677790 - protein, 20 aa, Mycobacterium
IDAAAGANVLAYGSGAQATV

SEQ ID NO: 677791 - protein, 19 aa, Mycobacterium
IDAAAVLACALADEKPGGH

SEQ ID NO: 677792 - protein, 19 aa, Mycobacterium
IDAAFQEIADWSIVAELLR

SEQ ID NO: 677793 - protein, 18 aa, Mycobacterium
IDAAGLLVTPGFVDLHTH

SEQ ID NO: 677794 - protein, 18 aa, Mycobacterium
IDAAGLRITVMATPGHTA

SEQ ID NO: 677795 - protein, 17 aa, Mycobacterium
IDAAGLSRTQARTAEAG

SEQ ID NO: 677796 - protein, 21 aa, Mycobacterium
IDAAHIWHPYSPIGDGALAPV

SEQ ID NO: 677797 - protein, 18 aa, Mycobacterium
IDAAHLWHPYSTIGAEAV

SEQ ID NO: 677798 - protein, 25 aa, Mycobacterium
IDAARADAELVAWVKAVAGHARRMV

SEQ ID NO: 677799 - protein, 25 aa, Mycobacterium
IDAARARCVLLGLVAATTAGIVQWC

SEQ ID NO: 677800 - protein, 18 aa, Mycobacterium
IDAASLSPFVTWGTNPGQ

SEQ ID NO: 677801 - protein, 17 aa, Mycobacterium
IDAATALEWGMVSRVVP

SEQ ID NO: 677802 - protein, 23 aa, Mycobacterium
IDAATRPPRIVVIADGDRGLDLD

SEQ ID NO: 677803 - protein, 17 aa, Mycobacterium
IDAAVGLLGNARVRFPD

SEQ ID NO: 677804 - protein, 17 aa, Mycobacterium
IDAAVVCAGHYQETPAL

SEQ ID NO: 677805 - protein, 17 aa, Mycobacterium
IDACYDAGVLRLRIPVA

SEQ ID NO: 677806 - protein, 17 aa, Mycobacterium
IDADGFLRITDRKKDMF

SEQ ID NO: 677807 - protein, 17 aa, Mycobacterium
IDADITLAAFGNTCSYG

SEQ ID NO: 677808 - protein, 23 aa, Mycobacterium
IDADWARLSSRFEGAGHVVGTQA

SEQ ID NO: 677809 - protein, 22 aa, Mycobacterium
IDAEAARRGWAVEHHADEGASG

SEQ ID NO: 677810 - protein, 17 aa, Mycobacterium
IDAEALGAMKPGSYLIN

SEQ ID NO: 677811 - protein, 33 aa, Mycobacterium
IDAEEALRMGLVWRICSPEELLPEARRHAEILA

SEQ ID NO: 677812 - protein, 27 aa, Mycobacterium
IDAEFRARLPLIRDLPVVLAYAASATE

SEQ ID NO: 677813 - protein, 19 aa, Mycobacterium
IDAEGYLTVTGRISEFIVR

SEQ ID NO: 677814 - protein, 18 aa, Mycobacterium
IDAEPGKKFHTLWSGDHS

SEQ ID NO: 677815 - protein, 17 aa, Mycobacterium
IDAFADRADVVFASHHW

SEQ ID NO: 677816 - protein, 20 aa, Mycobacterium
IDAFAEFYHAPVLHQGQYTK

SEQ ID NO: 677817 - protein, 21 aa, Mycobacterium
IDAFAEFYHAPVLHQGQYTKE

SEQ ID NO: 677818 - protein, 18 aa, Mycobacterium
IDAFAGRADVVFASHHWP

SEQ ID NO: 677819 - protein, 20 aa, Mycobacterium
IDAFFHRGLMLMSFDEHLMH

SEQ ID NO: 677820 - protein, 25 aa, Mycobacterium
IDAFGRIAAAPGLPAVPAVVLSADK

SEQ ID NO: 677821 - protein, 17 aa, Mycobacterium
IDAFGYPIAATVGLLTI

SEQ ID NO: 677822 - protein, 18 aa, Mycobacterium
IDAFRAAKTLNLNFFVHD

SEQ ID NO: 677823 - protein, 25 aa, Mycobacterium
IDAFTRACAIEWGPDGVRVNVVAPG

SEQ ID NO: 677824 - protein, 20 aa, Mycobacterium
IDAFVEFYHAPILHMKQAEK

SEQ ID NO: 677825 - protein, 17 aa, Mycobacterium
IDAGHRIQRIADYGEWL

SEQ ID NO: 677826 - protein, 29 aa, Mycobacterium
IDAGILPNRYARGWHCLGVAKDFMDGKPH

SEQ ID NO: 677827 - protein, 18 aa, Mycobacterium
IDAGRAFQELGFDSLTAV

SEQ ID NO: 677828 - protein, 18 aa, Mycobacterium
IDAGTVWINTHGVYATEM

SEQ ID NO: 677829 - protein, 25 aa, Mycobacterium
IDAGVRRFVHFSSVAAYGFEFPDGA

SEQ ID NO: 677830 - protein, 19 aa, Mycobacterium
IDAGYKIARIDDYDQWLAR

SEQ ID NO: 677831 - protein, 22 aa, Mycobacterium
IDAICERGYRTAQTVTNQSDLY

SEQ ID NO: 677832 - protein, 18 aa, Mycobacterium
IDAIRRARLASSRSGRRC

SEQ ID NO: 677833 - protein, 17 aa, Mycobacterium
IDAKRLAAQRLLNTVPD

SEQ ID NO: 677834 - protein, 19 aa, Mycobacterium
IDAKVAFVNALPVFIASDP

SEQ ID NO: 677835 - protein, 18 aa, Mycobacterium
IDALAAQGCEVRAVTADV

SEQ ID NO: 677836 - protein, 26 aa, Mycobacterium
IDALFWSGGLPTSGITDLIVSRRDQV

SEQ ID NO: 677837 - protein, 18 aa, Mycobacterium
IDALLNLGADCVVYTSQG

SEQ ID NO: 677838 - protein, 18 aa, Mycobacterium
IDALRFGTDVLTHFLTHC

SEQ ID NO: 677839 - protein, 23 aa, Mycobacterium
IDALRPMMRLVVTNGTAKEIAGC

SEQ ID NO: 677840 - protein, 19 aa, Mycobacterium
IDALVLRRRSEHVAAVRRL

SEQ ID NO: 677841 - protein, 18 aa, Mycobacterium
IDAMAAQSFMGRVAHTDE

SEQ ID NO: 677842 - protein, 24 aa, Mycobacterium
IDAMPSLLSVAGRPRYVVAGRTHP

SEQ ID NO: 677843 - protein, 27 aa, Mycobacterium
IDAMSSRCFPSYALRRGAKAIGSLTQL

SEQ ID NO: 677844 - protein, 17 aa, Mycobacterium
IDAPAAFVLLTQLSAKY

SEQ ID NO: 677845 - protein, 25 aa, Mycobacterium
IDAPGFPGWDSFGAMVTHFRFVRDH

SEQ ID NO: 677846 - protein, 26 aa, Mycobacterium
IDAPGRRLLLGSGFELDYDYLIYAVG

SEQ ID NO: 677847 - protein, 18 aa, Mycobacterium
IDAPSVRSGANIEALEAE

SEQ ID NO: 677848 - protein, 25 aa, Mycobacterium
IDAPVCGSCVNLADFLRLQAIANMV

SEQ ID NO: 677849 - protein, 25 aa, Mycobacterium
IDAQLRFLADQGVDLIVTSGGLGPT

SEQ ID NO: 677850 - protein, 32 aa, Mycobacterium
IDAQLWPFARRCPRTGPPRLLYVGRLEYEKGI

SEQ ID NO: 677851 - protein, 26 aa, Mycobacterium
IDAQQALEMGLVWRLCEPDQLDDEVR

SEQ ID NO: 677852 - protein, 24 aa, Mycobacterium
IDARFKGACPYVSEIVVYGEGKPY

SEQ ID NO: 677853 - protein, 19 aa, Mycobacterium
IDASGLLVTPGFVDLHTHY

SEQ ID NO: 677854 - protein, 23 aa, Mycobacterium
IDATRAAVMFAQLCAAGGDELHA

SEQ ID NO: 677855 - protein, 31 aa, Mycobacterium
IDATVCWFTNGPLRAGDRLALKQGTRTVRAT

SEQ ID NO: 677856 - protein, 28 aa, Mycobacterium
IDAVAGRCFPSYALRRGAKALGAVAQFE

SEQ ID NO: 677857 - protein, 25 aa, Mycobacterium
IDAVLRAKVDGAWHLHELTKELGLA

SEQ ID NO: 677858 - protein, 25 aa, Mycobacterium
IDAWPRARTVLAFRLAGVAPKAARW

SEQ ID NO: 677859 - protein, 26 aa, Mycobacterium
IDAYLALNIAHPWVPPKVMAPHLWRF

SEQ ID NO: 677860 - protein, 18 aa, Mycobacterium
IDAYLVAAVDMFIGEVGV

SEQ ID NO: 677861 - protein, 25 aa, Mycobacterium
IDAYREFLTEIGYLLPEPADFTITT

SEQ ID NO: 677862 - protein, 18 aa, Mycobacterium
IDCDEWHFTIFFDQPTPG

SEQ ID NO: 677863 - protein, 19 aa, Mycobacterium
IDCEAWGPGAAEFTEGLPA

SEQ ID NO: 677864 - protein, 27 aa, Mycobacterium
IDCGADFRLAEAADWEKFYGSAHAGTW

SEQ ID NO: 677865 - protein, 18 aa, Mycobacterium
IDDAFRWSEENPNLQRKA

SEQ ID NO: 677866 - protein, 18 aa, Mycobacterium
IDDAFRWSEENSNLQRKA

SEQ ID NO: 677867 - protein, 18 aa, Mycobacterium
IDDARLVAAVARTAAQYG

SEQ ID NO: 677868 - protein, 17 aa, Mycobacterium
IDDARLVVAVARTAAQH

SEQ ID NO: 677869 - protein, 18 aa, Mycobacterium
IDDAWLRKVLHDNAAHVF

SEQ ID NO: 677870 - protein, 18 aa, Mycobacterium
IDDCFARDTVEDIVAALA

SEQ ID NO: 677871 - protein, 27 aa, Mycobacterium
IDDCLDGYRWLRAQGYAAEQIVLAGDS

SEQ ID NO: 677872 - protein, 17 aa, Mycobacterium
IDDDAVMGIMNGKGVLD

SEQ ID NO: 677873 - protein, 17 aa, Mycobacterium
IDDFHRLPGDEPQRDTT

SEQ ID NO: 677874 - protein, 20 aa, Mycobacterium
IDDGKLVLAQRVRTVKHAMA

SEQ ID NO: 677875 - protein, 21 aa, Mycobacterium
IDDGKLVLAQRVRTVTHATEA

SEQ ID NO: 677876 - protein, 27 aa, Mycobacterium
IDDGLLWPEPWLALNPAFEPGGSVGEL

SEQ ID NO: 677877 - protein, 26 aa, Mycobacterium
IDDHHWRFVLRRGVTFHNGERFDAQT

SEQ ID NO: 677878 - protein, 18 aa, Mycobacterium
IDDHTAWRLLEGLDDIAL

SEQ ID NO: 677879 - protein, 17 aa, Mycobacterium
IDDIFAMLRAHVSTGGY

SEQ ID NO: 677880 - protein, 17 aa, Mycobacterium
IDDIIVFHQLTREEIIR

SEQ ID NO: 677881 - protein, 18 aa, Mycobacterium
IDDILRLVTPLLRSLIDP

SEQ ID NO: 677882 - protein, 19 aa, Mycobacterium
IDDLCVLPGSAYAEVALAA

SEQ ID NO: 677883 - protein, 20 aa, Mycobacterium
IDDLLARLRLDHLADRSPYT

SEQ ID NO: 677884 - protein, 19 aa, Mycobacterium
IDDLLLPIVKGVSSERAYE

SEQ ID NO: 677885 - protein, 25 aa, Mycobacterium
IDDLVIPPAWKTVWICPHASGHIQA

SEQ ID NO: 677886 - protein, 24 aa, Mycobacterium
IDDNMPRVRLLDRYVSGDAPLPEQ

SEQ ID NO: 677887 - protein, 23 aa, Mycobacterium
IDDNSRFVVCAAVVARATARPVC

SEQ ID NO: 677888 - protein, 18 aa, Mycobacterium
IDDPRRWVLGWANERKIA

SEQ ID NO: 677889 - protein, 17 aa, Mycobacterium
IDDQFAIVDDHFVTVED

SEQ ID NO: 677890 - protein, 24 aa, Mycobacterium
IDDRLATLPARYAVSVGDKNLIRH

SEQ ID NO: 677891 - protein, 22 aa, Mycobacterium
IDDSFLLCFNAHYEPIDFMLPA

SEQ ID NO: 677892 - protein, 25 aa, Mycobacterium
IDDTRPTIIIAYTIKGFGLPTQGHP

SEQ ID NO: 677893 - protein, 24 aa, Mycobacterium
IDDTRPTVIIAYTIKGFGLPTEGH

SEQ ID NO: 677894 - protein, 23 aa, Mycobacterium
IDDTRPTVIIAYTVKGHGLPTEG

SEQ ID NO: 677895 - protein, 17 aa, Mycobacterium
IDDVIWGCVSQVGDQSS

SEQ ID NO: 677896 - protein, 24 aa, Mycobacterium
IDDVPRGISFLLNRNRLNVAVSRA

SEQ ID NO: 677897 - protein, 17 aa, Mycobacterium
IDDVYAVCAPLVDRTME

SEQ ID NO: 677898 - protein, 25 aa, Mycobacterium
IDDYTRWRLLEGLDDIGLTLRKVDE

SEQ ID NO: 677899 - protein, 25 aa, Mycobacterium
IDEAFKLGEVVAVFAPGGRLQQCDQ

SEQ ID NO: 677900 - protein, 20 aa, Mycobacterium
IDEALYWFACDIAFDIGGSY

SEQ ID NO: 677901 - protein, 17 aa, Mycobacterium
IDEARPWTNRRATDSSD

SEQ ID NO: 677902 - protein, 23 aa, Mycobacterium
IDEARRNAELECERLLGDAKQGA

SEQ ID NO: 677903 - protein, 19 aa, Mycobacterium
IDEASVRAAAAAALADPSQ

SEQ ID NO: 677904 - protein, 31 aa, Mycobacterium
IDEAVRRFHLADAREAVNLALRTLLTEADTG

SEQ ID NO: 677905 - protein, 21 aa, Mycobacterium
IDECHRLCVDYAKSRTLWGKN

SEQ ID NO: 677906 - protein, 20 aa, Mycobacterium
IDEEGLSLDVCTGGELAVAL

SEQ ID NO: 677907 - protein, 22 aa, Mycobacterium
IDEFAFPVAPWMFGAAGREHMK

SEQ ID NO: 677908 - protein, 19 aa, Mycobacterium
IDEFGRLDSWIAVAVTTDD

SEQ ID NO: 677909 - protein, 19 aa, Mycobacterium
IDEFGRLDSWVAIAVATDD

SEQ ID NO: 677910 - protein, 19 aa, Mycobacterium
IDEFGRLDSWVAIAVSTDQ

SEQ ID NO: 677911 - protein, 24 aa, Mycobacterium
IDEFIARYGLDLDVAPEAMAMSDI

SEQ ID NO: 677912 - protein, 19 aa, Mycobacterium
IDEIFATDGEREFRRIEED

SEQ ID NO: 677913 - protein, 21 aa, Mycobacterium
IDEIRSGIESGVFRSVDAELA

SEQ ID NO: 677914 - protein, 17 aa, Mycobacterium
IDELGMYGASITTSVLG

SEQ ID NO: 677915 - protein, 26 aa, Mycobacterium
IDELKELNLPIGSVIVNRNIPAYLSP

SEQ ID NO: 677916 - protein, 20 aa, Mycobacterium
IDELLGPDVTREWIKDFSSY

SEQ ID NO: 677917 - protein, 18 aa, Mycobacterium
IDELRPHVVVTYDPNGGY

SEQ ID NO: 677918 - protein, 21 aa, Mycobacterium
IDELRYGRAPSRVSGPDPVPG

SEQ ID NO: 677919 - protein, 24 aa, Mycobacterium
IDENAAFDLLKWLSQENNVKLRVL

SEQ ID NO: 677920 - protein, 26 aa, Mycobacterium
IDENELALNPFRVFTSMLATADRRFF

SEQ ID NO: 677921 - protein, 24 aa, Mycobacterium
IDEPRAWLSVVVGRLCLDQLRSAR

SEQ ID NO: 677922 - protein, 18 aa, Mycobacterium
IDEPRLGLLVELAAAAGL

SEQ ID NO: 677923 - protein, 17 aa, Mycobacterium
IDERGRSARAWLFTVAR

SEQ ID NO: 677924 - protein, 27 aa, Mycobacterium
IDESFVFDVGSSFARLIKAERDDSADS

SEQ ID NO: 677925 - protein, 17 aa, Mycobacterium
IDESVAVTAARQYRIDD

SEQ ID NO: 677926 - protein, 22 aa, Mycobacterium
IDETDRAAGIVVADHEYFDNLI

SEQ ID NO: 677927 - protein, 24 aa, Mycobacterium
IDEVPPLVCRGVLVDVPKLRGVDR

SEQ ID NO: 677928 - protein, 23 aa, Mycobacterium
IDEWPARIAETAMFLVDRQCDLK

SEQ ID NO: 677929 - protein, 25 aa, Mycobacterium
IDFAAALAHQAAFLGYRVTVCDARP

SEQ ID NO: 677930 - protein, 19 aa, Mycobacterium
IDFAAGPYGTFKAAIIHYT

SEQ ID NO: 677931 - protein, 19 aa, Mycobacterium
IDFAAPVRWRDDVRVAVTC

SEQ ID NO: 677932 - protein, 20 aa, Mycobacterium
IDFAHIWRNLPKVVFSRTLE

SEQ ID NO: 677933 - protein, 27 aa, Mycobacterium
IDFDDCGFGWYFYDFGTAVSFIEHDPR

SEQ ID NO: 677934 - protein, 21 aa, Mycobacterium
IDFDEGVGWHNPRVIGYGPIE

SEQ ID NO: 677935 - protein, 18 aa, Mycobacterium
IDFERLWTVRALLPALSL

SEQ ID NO: 677936 - protein, 17 aa, Mycobacterium
IDFHLDFALDESDLIRI

SEQ ID NO: 677937 - protein, 18 aa, Mycobacterium
IDFLRRWDPSRWPRRASA

SEQ ID NO: 677938 - protein, 18 aa, Mycobacterium
IDFMLPAAEFGGAWQPVI

SEQ ID NO: 677939 - protein, 17 aa, Mycobacterium
IDFMTRWATGDLAAADV

SEQ ID NO: 677940 - protein, 24 aa, Mycobacterium
IDFPSRIGVWWASDTWSMRDAQEV

SEQ ID NO: 677941 - protein, 18 aa, Mycobacterium
IDFVLARGARLVHVRPAP

SEQ ID NO: 677942 - protein, 25 aa, Mycobacterium
IDGADLWKLPRKRAAQRVAAVLQEM

SEQ ID NO: 677943 - protein, 23 aa, Mycobacterium
IDGAEIPPQIALGMVQLTVLAGH

SEQ ID NO: 677944 - protein, 18 aa, Mycobacterium
IDGAFVLSTRGGDFDLQL

SEQ ID NO: 677945 - protein, 26 aa, Mycobacterium
IDGAFVLTCRGGDFDLQLGTDVTIGY

SEQ ID NO: 677946 - protein, 20 aa, Mycobacterium
IDGAMRLVLDVGGRQRSLAI

SEQ ID NO: 677947 - protein, 18 aa, Mycobacterium
IDGARLVLFDGMGHDLPQ

SEQ ID NO: 677948 - protein, 19 aa, Mycobacterium
IDGEIPGLFTYTQTLTLWH

SEQ ID NO: 677949 - protein, 23 aa, Mycobacterium
IDGEPIISVPGFTIPALHLDGTA

SEQ ID NO: 677950 - protein, 27 aa, Mycobacterium
IDGERRLRIGAALGITGDVAAKARALA

SEQ ID NO: 677951 - protein, 22 aa, Mycobacterium
IDGFCDALRRWAGDHDAAADEF

SEQ ID NO: 677952 - protein, 17 aa, Mycobacterium
IDGFRLDVAHGMAKPPG

SEQ ID NO: 677953 - protein, 26 aa, Mycobacterium
IDGGIEIPSILAIIAYYAPKAAEFLA

SEQ ID NO: 677954 - protein, 21 aa, Mycobacterium
IDGGIPLDRAALIGCGVTTGY

SEQ ID NO: 677955 - protein, 17 aa, Mycobacterium
IDGGLLLGAAQGFQARP

SEQ ID NO: 677956 - protein, 25 aa, Mycobacterium
IDGGNGGYGGWGFNGGNGGNGGDGG

SEQ ID NO: 677957 - protein, 25 aa, Mycobacterium
IDGGPLTECLKDVVERFVPYYESAI

SEQ ID NO: 677958 - protein, 24 aa, Mycobacterium
IDGHVRAGGLGLVGACDVVVAGPG

SEQ ID NO: 677959 - protein, 20 aa, Mycobacterium
IDGKLIVIGSFAGAPVSPAW

SEQ ID NO: 677960 - protein, 18 aa, Mycobacterium
IDGLFVIDGSILPTIPSR

SEQ ID NO: 677961 - protein, 20 aa, Mycobacterium
IDGLGMALVCRRVATIYSAM

SEQ ID NO: 677962 - protein, 19 aa, Mycobacterium
IDGLHPAGVVNFFGQLLQL

SEQ ID NO: 677963 - protein, 24 aa, Mycobacterium
IDGLQRPQGLHVRDNRLYIVDAGA

SEQ ID NO: 677964 - protein, 18 aa, Mycobacterium
IDGLRPMMQLVVTNGTAK

SEQ ID NO: 677965 - protein, 17 aa, Mycobacterium
IDGLTGFAGPVLHTAQW

SEQ ID NO: 677966 - protein, 22 aa, Mycobacterium
IDGNDYWVWRGLTAVRPGIAII

SEQ ID NO: 677967 - protein, 19 aa, Mycobacterium
IDGNFDWNQSLFSYNFGDP

SEQ ID NO: 677968 - protein, 20 aa, Mycobacterium
IDGPAGWGEFGAFPEYQPAE

SEQ ID NO: 677969 - protein, 20 aa, Mycobacterium
IDGPEPLNWHAATIAPESAC

SEQ ID NO: 677970 - protein, 24 aa, Mycobacterium
IDGPLPDRMRTLVLTTDVERAAVA

SEQ ID NO: 677971 - protein, 26 aa, Mycobacterium
IDGPLPPRLRVLAIILAAEQTVVAAR

SEQ ID NO: 677972 - protein, 25 aa, Mycobacterium
IDGPLRRLECRIAPTQTGGIYYTGP

SEQ ID NO: 677973 - protein, 25 aa, Mycobacterium
IDGPRGGVKVAFFRKGIACTPDTID

SEQ ID NO: 677974 - protein, 26 aa, Mycobacterium
IDGPRGGVKVAFFRKGVECTPETIDR

SEQ ID NO: 677975 - protein, 25 aa, Mycobacterium
IDGQFDWGQPLFSYNFGDPDSRNDD

SEQ ID NO: 677976 - protein, 18 aa, Mycobacterium
IDGQKMWLTNGATATLVA

SEQ ID NO: 677977 - protein, 21 aa, Mycobacterium
IDGRRFTRCYSPANAEGARHL

SEQ ID NO: 677978 - protein, 25 aa, Mycobacterium
IDGSAKGATGWFGASRATVYVDHPV

SEQ ID NO: 677979 - protein, 23 aa, Mycobacterium
IDGSCRRFGAGAGNAPVEALIGV

SEQ ID NO: 677980 - protein, 28 aa, Mycobacterium
IDGSGKGATGWFGASRATVYVDHPVHAP

SEQ ID NO: 677981 - protein, 22 aa, Mycobacterium
IDGSICATITMPGSKSQTNRAL

SEQ ID NO: 677982 - protein, 19 aa, Mycobacterium
IDGSLRPRSLREFIGQPRV

SEQ ID NO: 677983 - protein, 18 aa, Mycobacterium
IDGSPLFHIISGNLGYQV

SEQ ID NO: 677984 - protein, 25 aa, Mycobacterium
IDGSRSAVRAALWAVDEALHRELPL

SEQ ID NO: 677985 - protein, 18 aa, Mycobacterium
IDGVDTWIYDQARASVMG

SEQ ID NO: 677986 - protein, 18 aa, Mycobacterium
IDGVRWDDIVSRVFGRID

SEQ ID NO: 677987 - protein, 25 aa, Mycobacterium
IDGVYPRAVPAPALGDDTDSVLGDW

SEQ ID NO: 677988 - protein, 26 aa, Mycobacterium
IDGWPERGCRGCSMMADHVGNLAHLN

SEQ ID NO: 677989 - protein, 17 aa, Mycobacterium
IDGWSLPILLQEIFASY

SEQ ID NO: 677990 - protein, 27 aa, Mycobacterium
IDGWSLPVFAAEMIALYGAGGDPDALP

SEQ ID NO: 677991 - protein, 25 aa, Mycobacterium
IDGWSLPVFVGEYITLYAADGDTAV

SEQ ID NO: 677992 - protein, 20 aa, Mycobacterium
IDGWSLPVLLREVFAGYYGQ

SEQ ID NO: 677993 - protein, 25 aa, Mycobacterium
IDGYPQRFGIPDGIPGEPVAVKQGW

SEQ ID NO: 677994 - protein, 23 aa, Mycobacterium
IDHAALRLHKPVIAYDLPAGGRR

SEQ ID NO: 677995 - protein, 22 aa, Mycobacterium
IDHAALRLHKPVITYDLPAGGR

SEQ ID NO: 677996 - protein, 24 aa, Mycobacterium
IDHGEIKLSGGIEDVVRAYEGEDA

SEQ ID NO: 677997 - protein, 20 aa, Mycobacterium
IDHIIGLFRLWWIPKGALPL

SEQ ID NO: 677998 - protein, 19 aa, Mycobacterium
IDHIIGLFRLWWIPQGLPP

SEQ ID NO: 677999 - protein, 19 aa, Mycobacterium
IDHILSILRDHIVALGMPL

SEQ ID NO: 678000 - protein, 17 aa, Mycobacterium
IDHPRAGELVAVAEPAA

SEQ ID NO: 678001 - protein, 19 aa, Mycobacterium
IDHRGSYVQMHFALDGPPT

SEQ ID NO: 678002 - protein, 35 aa, Mycobacterium
IDHSRAAMIGAVLEKHGRLAIGVNDIYLSTVGGMR

SEQ ID NO: 678003 - protein, 17 aa, Mycobacterium
IDHTIPFNHTDPGAGGR

SEQ ID NO: 678004 - protein, 20 aa, Mycobacterium
IDHTVSWPLGPTHPSNLKCA

SEQ ID NO: 678005 - protein, 23 aa, Mycobacterium
IDHVAGLWRLWWIPPGDGPDKGT

SEQ ID NO: 678006 - protein, 23 aa, Mycobacterium
IDHVAGLWRLWWIPPGDGPDRGT

SEQ ID NO: 678007 - protein, 24 aa, Mycobacterium
IDHVKPRLLGHWGTTPGLNLVYAH

SEQ ID NO: 678008 - protein, 20 aa, Mycobacterium
IDIAEHWRRVHPAGTEPNES

SEQ ID NO: 678009 - protein, 17 aa, Mycobacterium
IDIAEWIAEAMELAVRW

SEQ ID NO: 678010 - protein, 17 aa, Mycobacterium
IDIALDRLRAATVQLVI

SEQ ID NO: 678011 - protein, 18 aa, Mycobacterium
IDIARARGVFAMEAMWTR

SEQ ID NO: 678012 - protein, 19 aa, Mycobacterium
IDIARRWVRVLGKGGKERS

SEQ ID NO: 678013 - protein, 17 aa, Mycobacterium
IDIASWAGRVRVVDAKH

SEQ ID NO: 678014 - protein, 18 aa, Mycobacterium
IDICADIPANGYPMASRQ

SEQ ID NO: 678015 - protein, 19 aa, Mycobacterium
IDIDPRWVKKLAARGAAAE

SEQ ID NO: 678016 - protein, 26 aa, Mycobacterium
IDIELPKRRLTVFTGVSGSGKSSLVF

SEQ ID NO: 678017 - protein, 26 aa, Mycobacterium
IDIGKAWWVGNIVYLWDGEHYVQKQM

SEQ ID NO: 678018 - protein, 27 aa, Mycobacterium
IDIGKIVIESFTLPKITANLDGKIKYK

SEQ ID NO: 678019 - protein, 17 aa, Mycobacterium
IDIGVGVGWQREEYEAA

SEQ ID NO: 678020 - protein, 20 aa, Mycobacterium
IDIIKSALLTAYRHTDGHEP

SEQ ID NO: 678021 - protein, 17 aa, Mycobacterium
IDILEWYGNGSWPSATT

SEQ ID NO: 678022 - protein, 25 aa, Mycobacterium
IDIPDPLELLSFVAAATTTLGLSTG

SEQ ID NO: 678023 - protein, 17 aa, Mycobacterium
IDIPGDWVDLVVAADRP

SEQ ID NO: 678024 - protein, 23 aa, Mycobacterium
IDIPLHRGRGIWKFVNSKRLDRG

SEQ ID NO: 678025 - protein, 17 aa, Mycobacterium
IDIRETFGRMAMNDEET

SEQ ID NO: 678026 - protein, 31 aa, Mycobacterium
IDIRGRDGLSLNEVWGDAAYAYLGMTVTGFP

SEQ ID NO: 678027 - protein, 17 aa, Mycobacterium
IDISAVWGVGDTPERKR

SEQ ID NO: 678028 - protein, 21 aa, Mycobacterium
IDISNAVLFFASDEARYITGV

SEQ ID NO: 678029 - protein, 20 aa, Mycobacterium
IDISNAVLFFASDESRYITG

SEQ ID NO: 678030 - protein, 20 aa, Mycobacterium
IDISNAVLFLASDEARYITG

SEQ ID NO: 678031 - protein, 24 aa, Mycobacterium
IDISQRYTWESSLAAHLDDLPFQF

SEQ ID NO: 678032 - protein, 17 aa, Mycobacterium
IDITGEFVKPGPTKSSR

SEQ ID NO: 678033 - protein, 25 aa, Mycobacterium
IDITKEVLGALGITVLAEAGFEADD

SEQ ID NO: 678034 - protein, 25 aa, Mycobacterium
IDITKEVLGALGITVLAEPGFEADD

SEQ ID NO: 678035 - protein, 25 aa, Mycobacterium
IDITKEVLQALGITVLAEEGFEADD

SEQ ID NO: 678036 - protein, 24 aa, Mycobacterium
IDKAPAEAVGRTFGVKQRMAHEYV

SEQ ID NO: 678037 - protein, 27 aa, Mycobacterium
IDKAYPGRFLLGIGVGHPEAHTEYRKP

SEQ ID NO: 678038 - protein, 23 aa, Mycobacterium
IDKELQWLAAMRDDGVRRIAERS

SEQ ID NO: 678039 - protein, 17 aa, Mycobacterium
IDKENWSASGTDLKGDA

SEQ ID NO: 678040 - protein, 22 aa, Mycobacterium
IDKFPRMVDYVTPSGVRIADAD

SEQ ID NO: 678041 - protein, 18 aa, Mycobacterium
IDKLICAWAGRRPVAEAV

SEQ ID NO: 678042 - protein, 24 aa, Mycobacterium
IDKPWRKLPKRQREWILFTEDQPT

SEQ ID NO: 678043 - protein, 23 aa, Mycobacterium
IDKVFVVACGTAYHSGLLAKYAI

SEQ ID NO: 678044 - protein, 24 aa, Mycobacterium
IDKVFVVACGTAYHSGLLAKYAIE

SEQ ID NO: 678045 - protein, 26 aa, Mycobacterium
IDLALARCSLASWLALQGALFELQRH

SEQ ID NO: 678046 - protein, 17 aa, Mycobacterium
IDLALNCTYDFEVAASK

SEQ ID NO: 678047 - protein, 17 aa, Mycobacterium
IDLAPRPALPDITEKAL

SEQ ID NO: 678048 - protein, 23 aa, Mycobacterium
IDLARFPALNTWSSEDLNILASV

SEQ ID NO: 678049 - protein, 25 aa, Mycobacterium
IDLATFDGWLQRWRDLGPDADAMDR

SEQ ID NO: 678050 - protein, 26 aa, Mycobacterium
IDLCEGWAAGVILTAMALRDGTAPEA

SEQ ID NO: 678051 - protein, 24 aa, Mycobacterium
IDLDLPRDSLIVFTGLSGSGKSSL

SEQ ID NO: 678052 - protein, 17 aa, Mycobacterium
IDLDPMPGVEWRRILDV

SEQ ID NO: 678053 - protein, 22 aa, Mycobacterium
IDLEALGASGFVTFEEAREAAR

SEQ ID NO: 678054 - protein, 17 aa, Mycobacterium
IDLELWASASSENPVYY

SEQ ID NO: 678055 - protein, 25 aa, Mycobacterium
IDLFEVNEAFAPVVLAWAKDTGADL

SEQ ID NO: 678056 - protein, 21 aa, Mycobacterium
IDLFSRPAVHSALSGLMAELP

SEQ ID NO: 678057 - protein, 23 aa, Mycobacterium
IDLGDAILMPGLMDMEVNLLMGG

SEQ ID NO: 678058 - protein, 18 aa, Mycobacterium
IDLGDGVLHRYDPASKTL

SEQ ID NO: 678059 - protein, 19 aa, Mycobacterium
IDLGFPVSLHFEAPYGVSA

SEQ ID NO: 678060 - protein, 18 aa, Mycobacterium
IDLGGPVVQTLAFGNTVP

SEQ ID NO: 678061 - protein, 21 aa, Mycobacterium
IDLGVHVFRSIFDRVDVDPGA

SEQ ID NO: 678062 - protein, 24 aa, Mycobacterium
IDLIRRYAPKIALIVTSHQHFDHW

SEQ ID NO: 678063 - protein, 23 aa, Mycobacterium
IDLLEFFAELTIYTSTSCLIGTK

SEQ ID NO: 678064 - protein, 17 aa, Mycobacterium
IDLLERIAPTALDEDTP

SEQ ID NO: 678065 - protein, 18 aa, Mycobacterium
IDLLGGVLRRGAVVALKS

SEQ ID NO: 678066 - protein, 17 aa, Mycobacterium
IDLLGPVPVTDELWVQA

SEQ ID NO: 678067 - protein, 17 aa, Mycobacterium
IDLLHMLSEGTFPDVGD

SEQ ID NO: 678068 - protein, 25 aa, Mycobacterium
IDLLPAGKIPAGFLPVLQAYDYAGD

SEQ ID NO: 678069 - protein, 26 aa, Mycobacterium
IDLLPVPEFYGGAVYFAADDVADVLR

SEQ ID NO: 678070 - protein, 24 aa, Mycobacterium
IDLLVKRADALGVQTRYETGATNL

SEQ ID NO: 678071 - protein, 19 aa, Mycobacterium
IDLLVKRADELGVQMRYET

SEQ ID NO: 678072 - protein, 24 aa, Mycobacterium
IDLNMRYLRRIGFVGTPTYHALAA

SEQ ID NO: 678073 - protein, 24 aa, Mycobacterium
IDLQSCGLVAVGHRVVHGGKDFYE

SEQ ID NO: 678074 - protein, 19 aa, Mycobacterium
IDLRDDWPNALRHSGFDTA

SEQ ID NO: 678075 - protein, 19 aa, Mycobacterium
IDLREDWPSALRQRGFDAG

SEQ ID NO: 678076 - protein, 19 aa, Mycobacterium
IDLRIDRPRFMVFGEIALR

SEQ ID NO: 678077 - protein, 22 aa, Mycobacterium
IDLRIGGPFRLFPKAAAPGALH

SEQ ID NO: 678078 - protein, 20 aa, Mycobacterium
IDLRIGGPFRLFPKAENPGA

SEQ ID NO: 678079 - protein, 17 aa, Mycobacterium
IDLRTIRYGKVDEESLR

SEQ ID NO: 678080 - protein, 20 aa, Mycobacterium
IDLSAEFVRRAFELGATTNM

SEQ ID NO: 678081 - protein, 19 aa, Mycobacterium
IDLSALAPYVARPGTVSRN

SEQ ID NO: 678082 - protein, 21 aa, Mycobacterium
IDLSASFLRRAFELGATASML

SEQ ID NO: 678083 - protein, 31 aa, Mycobacterium
IDLSCGVRVWGHSGGIPGFHTLMIAPQGGPA

SEQ ID NO: 678084 - protein, 18 aa, Mycobacterium
IDLSCWNVALNGAEPIRA

SEQ ID NO: 678085 - protein, 18 aa, Mycobacterium
IDLSKVWESLPAKTKDAA

SEQ ID NO: 678086 - protein, 25 aa, Mycobacterium
IDLSRLSEDIILWGTTEFGYVTLDD

SEQ ID NO: 678087 - protein, 20 aa, Mycobacterium
IDLSRTVGWFTAKYPAALSV

SEQ ID NO: 678088 - protein, 20 aa, Mycobacterium
IDLSRTVGWFTTKYPVALTV

SEQ ID NO: 678089 - protein, 17 aa, Mycobacterium
IDLSVPLPGFLLKRTMK

SEQ ID NO: 678090 - protein, 17 aa, Mycobacterium
IDLTAFWAGPAATHLLA

SEQ ID NO: 678091 - protein, 18 aa, Mycobacterium
IDLTCTFADVTRAHAAAL

SEQ ID NO: 678092 - protein, 31 aa, Mycobacterium
IDLTDEIWRVRGFGDFFSYCLVAEGAVDIAA

SEQ ID NO: 678093 - protein, 18 aa, Mycobacterium
IDLTLEMAAEAGLSVDEE

SEQ ID NO: 678094 - protein, 18 aa, Mycobacterium
IDLTLEMAAEAGLSVDQE

SEQ ID NO: 678095 - protein, 17 aa, Mycobacterium
IDLVAGIAPRGYGQGNH

SEQ ID NO: 678096 - protein, 27 aa, Mycobacterium
IDLVIKEALRLLAPVPLVMRKTVRDVA

SEQ ID NO: 678097 - protein, 26 aa, Mycobacterium
IDLVPEYIGNLLLYFQPDSTATMLDA

SEQ ID NO: 678098 - protein, 23 aa, Mycobacterium
IDLWSRMSRELGLPSLLVPEEYG

SEQ ID NO: 678099 - protein, 28 aa, Mycobacterium
IDLYLRIAPELFLKKALVGGFDKIFELN

SEQ ID NO: 678100 - protein, 33 aa, Mycobacterium
IDLYLRIAPELFLKRCIVGGFDRVFELNRVFRN

SEQ ID NO: 678101 - protein, 31 aa, Mycobacterium
IDLYLRIAPELFLKRCLVGGFEKVFELNRNF

SEQ ID NO: 678102 - protein, 30 aa, Mycobacterium
IDLYLRIAPELFLKRCVVGGFDKVFEVNRV

SEQ ID NO: 678103 - protein, 31 aa, Mycobacterium
IDLYLRIAPELFLKRCVVGGFDRVFELNRVF

SEQ ID NO: 678104 - protein, 18 aa, Mycobacterium
IDMAEALRFERIHEDSYR

SEQ ID NO: 678105 - protein, 23 aa, Mycobacterium
IDMAGTAGFLWLEVDDVVRETMA

SEQ ID NO: 678106 - protein, 18 aa, Mycobacterium
IDMALRLVELLVDREAAQ

SEQ ID NO: 678107 - protein, 19 aa, Mycobacterium
IDMAWKRTSYSGLLRAAET

SEQ ID NO: 678108 - protein, 18 aa, Mycobacterium
IDMGLRLVELLVDREAAQ

SEQ ID NO: 678109 - protein, 26 aa, Mycobacterium
IDMLRGGFELAYRLLSFPKPVVMACT

SEQ ID NO: 678110 - protein, 25 aa, Mycobacterium
IDMLRGGFELAYRLLSHPKPVVMAC

SEQ ID NO: 678111 - protein, 25 aa, Mycobacterium
IDMLRGGFELSYRLLSYPKPVVIAC

SEQ ID NO: 678112 - protein, 17 aa, Mycobacterium
IDMPNQFEAAERIAQRR

SEQ ID NO: 678113 - protein, 17 aa, Mycobacterium
IDMPSLVYTGARTPVMD

SEQ ID NO: 678114 - protein, 18 aa, Mycobacterium
IDMQLPRHRIDTGTWGVM

SEQ ID NO: 678115 - protein, 20 aa, Mycobacterium
IDMRQACNCYHTYEQAVEAA

SEQ ID NO: 678116 - protein, 27 aa, Mycobacterium
IDMTMRESVDWPKAFGGGGVFSSVPFL

SEQ ID NO: 678117 - protein, 17 aa, Mycobacterium
IDMWVARIDPVGVRVPG

SEQ ID NO: 678118 - protein, 17 aa, Mycobacterium
IDNICWEADYPHSDSMW

SEQ ID NO: 678119 - protein, 20 aa, Mycobacterium
IDNLRPLQFRDYSIASSPVV

SEQ ID NO: 678120 - protein, 25 aa, Mycobacterium
IDNPDRWAPGYAEAGAHNVTFHAEA

SEQ ID NO: 678121 - protein, 25 aa, Mycobacterium
IDNPDRWAPPYAEAGAYNVTFHAEA

SEQ ID NO: 678122 - protein, 19 aa, Mycobacterium
IDNRGKISLVLVAEEEAGA

SEQ ID NO: 678123 - protein, 20 aa, Mycobacterium
IDNRGKISLVLVAEESAESA

SEQ ID NO: 678124 - protein, 21 aa, Mycobacterium
IDNRTGAALGRSVTLDAAYWR

SEQ ID NO: 678125 - protein, 17 aa, Mycobacterium
IDNRVALITVNDPDRRN

SEQ ID NO: 678126 - protein, 20 aa, Mycobacterium
IDNTQPWRWRVDRTSLHLYT

SEQ ID NO: 678127 - protein, 19 aa, Mycobacterium
IDNVEFFAGAARHLEGKAT

SEQ ID NO: 678128 - protein, 18 aa, Mycobacterium
IDNVRYFAALYGYNRQAA

SEQ ID NO: 678129 - protein, 26 aa, Mycobacterium
IDPALPAARIEFMLSDTAPVAALTTA

SEQ ID NO: 678130 - protein, 26 aa, Mycobacterium
IDPALPAARIEFMLSDTAPVAAVSTA

SEQ ID NO: 678131 - protein, 20 aa, Mycobacterium
IDPARWGFDADGFAAAGIGA

SEQ ID NO: 678132 - protein, 21 aa, Mycobacterium
IDPATRLPWFGPPMSAVSSLT

SEQ ID NO: 678133 - protein, 17 aa, Mycobacterium
IDPAVAMSLLQRAAKDE

SEQ ID NO: 678134 - protein, 27 aa, Mycobacterium
IDPAVPVARLEFMLADAAPIAVATTAE

SEQ ID NO: 678135 - protein, 26 aa, Mycobacterium
IDPDAVELPAWYRQNPGLARDLAFIA

SEQ ID NO: 678136 - protein, 26 aa, Mycobacterium
IDPDAVELPGWYRPDPGQARDLAFVM

SEQ ID NO: 678137 - protein, 33 aa, Mycobacterium; identical to SEQ ID NO: 81021

SEQ ID NO: 678138 - protein, 33 aa, Mycobacterium
IDPDAVELPGWYRPNPGLARDLAFIAFSSAGGE

SEQ ID NO: 678139 - protein, 28 aa, Mycobacterium
IDPDLRAGSQWPALAARVLTETPVHGIM

SEQ ID NO: 678140 - protein, 17 aa, Mycobacterium
IDPEAVHAPAWITDGVR

SEQ ID NO: 678141 - protein, 18 aa, Mycobacterium
IDPELLAAVVKAADAPVI

SEQ ID NO: 678142 - protein, 26 aa, Mycobacterium
IDPELRRPITDLGMVKSIDTEPDGSV

SEQ ID NO: 678143 - protein, 26 aa, Mycobacterium
IDPELRRPITELGMVKGIDISPQGEV

SEQ ID NO: 678144 - protein, 26 aa, Mycobacterium
IDPELRRPITELGMVKSIDTEPDGGV

SEQ ID NO: 678145 - protein, 25 aa, Mycobacterium
IDPELRRPITELGMVKSISIEPDHS

SEQ ID NO: 678146 - protein, 24 aa, Mycobacterium
IDPELRRPITEVGMVKNVTVDSDA

SEQ ID NO: 678147 - protein, 22 aa, Mycobacterium
IDPEVGPGWHMGVLSMTDGSTA

SEQ ID NO: 678148 - protein, 27 aa, Mycobacterium
IDPGALPTRYARGWHCLGVAKDFQDGK

SEQ ID NO: 678149 - protein, 29 aa, Mycobacterium
IDPGALPTRYARGWHCLGVAKDFQDGKPH

SEQ ID NO: 678150 - protein, 18 aa, Mycobacterium
IDPGDTFLVPSPIAHIGG

SEQ ID NO: 678151 - protein, 19 aa, Mycobacterium
IDPGFPMDSAWRGALPPEN

SEQ ID NO: 678152 - protein, 17 aa, Mycobacterium
IDPGGLVLTNFHVVQGA

SEQ ID NO: 678153 - protein, 17 aa, Mycobacterium
IDPGLGFAKTGQHNWAL

SEQ ID NO: 678154 - protein, 26 aa, Mycobacterium
IDPGLPAARIAFMLSDSAPVAVLTTS

SEQ ID NO: 678155 - protein, 26 aa, Mycobacterium
IDPGLPAARIDFMLADAAPAAVLTTA

SEQ ID NO: 678156 - protein, 18 aa, Mycobacterium
IDPGSPWQNAWIESFNGR

SEQ ID NO: 678157 - protein, 17 aa, Mycobacterium
IDPGYWIRHSREPVQLA

SEQ ID NO: 678158 - protein, 20 aa, Mycobacterium
IDPHFPGFTTQVLFTPEQLW

SEQ ID NO: 678159 - protein, 25 aa, Mycobacterium
IDPHPELLNAWGLTVDAEGLRAFCD

SEQ ID NO: 678160 - protein, 25 aa, Mycobacterium
IDPHPELLRAWGFDADAAGLARFSD

SEQ ID NO: 678161 - protein, 42 aa, Mycobacterium
IDPIAVQLIKWLPTRSADFVNRWKNILLAVAQYRLARRFPRS

SEQ ID NO: 678162 - protein, 24 aa, Mycobacterium
IDPIGRPIFYGRLTEMTDTDFQVL

SEQ ID NO: 678163 - protein, 22 aa, Mycobacterium
IDPIPHGLLFERFLNPERPSAP

SEQ ID NO: 678164 - protein, 18 aa, Mycobacterium
IDPIYVWTHDSIGLGEDG

SEQ ID NO: 678165 - protein, 17 aa, Mycobacterium
IDPKDLMLTIGMTTYEG

SEQ ID NO: 678166 - protein, 17 aa, Mycobacterium
IDPLDWVEMFGADALRF

SEQ ID NO: 678167 - protein, 26 aa, Mycobacterium
IDPLLPEVAWSWLVEALESRTEHVTA

SEQ ID NO: 678168 - protein, 26 aa, Mycobacterium
IDPPVCPCSGLIRPSVVWFGEPLPDA

SEQ ID NO: 678169 - protein, 25 aa, Mycobacterium
IDPQHRMLLETAWEAMEHGGLTPEQ

SEQ ID NO: 678170 - protein, 17 aa, Mycobacterium
IDPRFTRTSALADRHVP

SEQ ID NO: 678171 - protein, 23 aa, Mycobacterium
IDPRRCIGVPDWRNPVRLSAALV

SEQ ID NO: 678172 - protein, 21 aa, Mycobacterium
IDPRRPTVLAIHGYPDNHHVW

SEQ ID NO: 678173 - protein, 18 aa, Mycobacterium
IDPRSAFYSEEVLRRDVG

SEQ ID NO: 678174 - protein, 19 aa, Mycobacterium
IDPRSAFYSEEVLRRDVGI

SEQ ID NO: 678175 - protein, 19 aa, Mycobacterium
IDPRVVSIRVMEPTAQYPH

SEQ ID NO: 678176 - protein, 19 aa, Mycobacterium
IDPSFPLIGNEGYFPPAFT

SEQ ID NO: 678177 - protein, 17 aa, Mycobacterium
IDPSLVMRYYGNKGKLF

SEQ ID NO: 678178 - protein, 21 aa, Mycobacterium
IDPSRLRECVDAFSSALRDRV

SEQ ID NO: 678179 - protein, 17 aa, Mycobacterium
IDPSVAVAAARQYQIDN

SEQ ID NO: 678180 - protein, 21 aa, Mycobacterium
IDPTRRCARCGSDAVRAVVVG

SEQ ID NO: 678181 - protein, 18 aa, Mycobacterium
IDPVALHHYMTFHSVVPA

SEQ ID NO: 678182 - protein, 19 aa, Mycobacterium
IDPVARVAFTAGHCRGSGS

SEQ ID NO: 678183 - protein, 17 aa, Mycobacterium
IDPVRFIGNRSSGKQGY

SEQ ID NO: 678184 - protein, 17 aa, Mycobacterium
IDPWLDRAVEIAAGHGG

SEQ ID NO: 678185 - protein, 23 aa, Mycobacterium
IDPYLRPLYDALHDMMDTELIPK

SEQ ID NO: 678186 - protein, 23 aa, Mycobacterium
IDPYLRPLYDALYDMMDAELIPK

SEQ ID NO: 678187 - protein, 24 aa, Mycobacterium
IDPYLRPLYDALYDMMDPELIAKL

SEQ ID NO: 678188 - protein, 21 aa, Mycobacterium
IDQAAAVAILQAWLDQRRTLA

SEQ ID NO: 678189 - protein, 21 aa, Mycobacterium
IDQAAAVAILQSWLDQRRATL

SEQ ID NO: 678190 - protein, 21 aa, Mycobacterium
IDQAAAVAILQTWLDQRRSTA

SEQ ID NO: 678191 - protein, 21 aa, Mycobacterium
IDQAAAVGILQNWLDQRRAAL

SEQ ID NO: 678192 - protein, 17 aa, Mycobacterium
IDQAWRAIGPGVELLSS

SEQ ID NO: 678193 - protein, 17 aa, Mycobacterium
IDQCAQILVQHCDIDLR

SEQ ID NO: 678194 - protein, 25 aa, Mycobacterium
IDQGLPQFVGFAVIRPAQPGGDQPV

SEQ ID NO: 678195 - protein, 18 aa, Mycobacterium
IDQIGGLVTRLTLSSDGD

SEQ ID NO: 678196 - protein, 19 aa, Mycobacterium
IDQINGLPFSTRRLVDCIK

SEQ ID NO: 678197 - protein, 19 aa, Mycobacterium
IDQLPTMRHLPGAAVIAKV

SEQ ID NO: 678198 - protein, 17 aa, Mycobacterium
IDQLVLLGAGFDTTSLR

SEQ ID NO: 678199 - protein, 24 aa, Mycobacterium
IDQNGVHSWGYWDAQLSAMKPDMQ

SEQ ID NO: 678200 - protein, 21 aa, Mycobacterium
IDQVAAVGILQGWLDQRRAAL

SEQ ID NO: 678201 - protein, 27 aa, Mycobacterium
IDRAHDQFRWFAGGWAVNADLPTTAGF

SEQ ID NO: 678202 - protein, 18 aa, Mycobacterium
IDRARRLGLCGFGQYVDR

SEQ ID NO: 678203 - protein, 17 aa, Mycobacterium
IDRATAAFVALIEAQRT

SEQ ID NO: 678204 - protein, 25 aa, Mycobacterium
IDRCWAPKVHGAWNLHQATAGEPLD

SEQ ID NO: 678205 - protein, 23 aa, Mycobacterium
IDRDRLSACADQLMTTSPSVLLY

SEQ ID NO: 678206 - protein, 25 aa, Mycobacterium
IDRDWSPKVFGSWNLHRAMSGQPLD

SEQ ID NO: 678207 - protein, 25 aa, Mycobacterium
IDREAARAGAQFAEAIAGLDAVAED

SEQ ID NO: 678208 - protein, 21 aa, Mycobacterium
IDREIRRPTYVFAAVDHAGAD

SEQ ID NO: 678209 - protein, 23 aa, Mycobacterium
IDRELADVWKIRRYGFHGTSHEY

SEQ ID NO: 678210 - protein, 21 aa, Mycobacterium
IDRFPAEMVERYFGPDGPSVG

SEQ ID NO: 678211 - protein, 22 aa, Mycobacterium
IDRFPVDMVKRYFGSPPGGPAD

SEQ ID NO: 678212 - protein, 19 aa, Mycobacterium
IDRFPVDMVQRYFGDDEAR

SEQ ID NO: 678213 - protein, 20 aa, Mycobacterium
IDRFPVEMVQRYFADDEPTL

SEQ ID NO: 678214 - protein, 24 aa, Mycobacterium
IDRGELPADCDVDMLLTTFRAPLF

SEQ ID NO: 678215 - protein, 18 aa, Mycobacterium
IDRGFEWLRENWPEESLS

SEQ ID NO: 678216 - protein, 22 aa, Mycobacterium
IDRGGLLAHLFGTVAVLEPEDQ

SEQ ID NO: 678217 - protein, 18 aa, Mycobacterium
IDRGPRVGTHVAQRKYAH

SEQ ID NO: 678218 - protein, 26 aa, Mycobacterium
IDRGRPAPPHHRWARYLRWVAEQIDM

SEQ ID NO: 678219 - protein, 26 aa, Mycobacterium
IDRHRPRTLVLCAGAAPRMAPLQDQT

SEQ ID NO: 678220 - protein, 19 aa, Mycobacterium
IDRIIAMCIAPFELFAEIA

SEQ ID NO: 678221 - protein, 26 aa, Mycobacterium
IDRIRRAHLLLAMFNALQPGVFALSG

SEQ ID NO: 678222 - protein, 25 aa, Mycobacterium
IDRKKARARRAVWFSAIGALSNGKV

SEQ ID NO: 678223 - protein, 20 aa, Mycobacterium
IDRKVIPLVVPKPIGIAVIE

SEQ ID NO: 678224 - protein, 25 aa, Mycobacterium
IDRLCTRLGVTKGSFYWHFRDMAAY

SEQ ID NO: 678225 - protein, 23 aa, Mycobacterium
IDRLDAEILAAVKRRTEVSQAIG

SEQ ID NO: 678226 - protein, 25 aa, Mycobacterium
IDRLEHPLAEAFGLLDALGKPVLWS

SEQ ID NO: 678227 - protein, 18 aa, Mycobacterium
IDRLGPRLRAEFEQLHRS

SEQ ID NO: 678228 - protein, 18 aa, Mycobacterium
IDRLKGVSPELVRRLIIK

SEQ ID NO: 678229 - protein, 23 aa, Mycobacterium
IDRLKVAIQLLFESSRPDPSAKR

SEQ ID NO: 678230 - protein, 23 aa, Mycobacterium
IDRMGRRPGARWAADLVAASEAI

SEQ ID NO: 678231 - protein, 23 aa, Mycobacterium
IDRMRAWPLWWGSSAAWHGPQVL

SEQ ID NO: 678232 - protein, 18 aa, Mycobacterium
IDRPHARNAIALDTMDQL

SEQ ID NO: 678233 - protein, 19 aa, Mycobacterium
IDRPHARNAIGLETMAQLQ

SEQ ID NO: 678234 - protein, 25 aa, Mycobacterium
IDRPLRPSFVDGLRNEIQIVVTILS

SEQ ID NO: 678235 - protein, 24 aa, Mycobacterium
IDRPLRPSFVDGLRNEIQVVVTVM

SEQ ID NO: 678236 - protein, 24 aa, Mycobacterium
IDRPLRPTFISGLRNEIQVVVTVL

SEQ ID NO: 678237 - protein, 18 aa, Mycobacterium
IDRPVVWTTAALLGQHPI

SEQ ID NO: 678238 - protein, 19 aa, Mycobacterium
IDRRDWPLFRSVFTDDCEL

SEQ ID NO: 678239 - protein, 20 aa, Mycobacterium
IDRRDWPLFRTVFTADCELD

SEQ ID NO: 678240 - protein, 23 aa, Mycobacterium
IDRREGYFLWDMSGRRLIDLHLN

SEQ ID NO: 678241 - protein, 24 aa, Mycobacterium
IDRRPDLPSGKGLVIAEGVLVVQR

SEQ ID NO: 678242 - protein, 21 aa, Mycobacterium
IDRRPDVWHVRQILDDPAGDH

SEQ ID NO: 678243 - protein, 21 aa, Mycobacterium
IDRRRVSTGVSRRSVGAQRAL

SEQ ID NO: 678244 - protein, 20 aa, Mycobacterium
IDRSGMAWCISNFGREEMVQ

SEQ ID NO: 678245 - protein, 17 aa, Mycobacterium
IDRSLAEVVLRDLIADA

SEQ ID NO: 678246 - protein, 17 aa, Mycobacterium
IDRTEMARMFDGIDIHR

SEQ ID NO: 678247 - protein, 23 aa, Mycobacterium
IDRTMASLRQSWHGEASDAQAHA

SEQ ID NO: 678248 - protein, 25 aa, Mycobacterium
IDRVQFGLRWNKFGILAVTATASGE

SEQ ID NO: 678249 - protein, 17 aa, Mycobacterium
IDRVRMFFVNDPDGTPV

SEQ ID NO: 678250 - protein, 17 aa, Mycobacterium
IDRYRYGLIPVALTEWL

SEQ ID NO: 678251 - protein, 25 aa, Mycobacterium
IDSAFSGRCTLILIGDPKQAIYAFR

SEQ ID NO: 678252 - protein, 26 aa, Mycobacterium
IDSARQAAIALEWLRHNGYQDLLNRA

SEQ ID NO: 678253 - protein, 25 aa, Mycobacterium
IDSFEWLIGAPRWREAAAARGDGKP

SEQ ID NO: 678254 - protein, 25 aa, Mycobacterium
IDSFEWLIGSPRWREAAAARGDVKP

SEQ ID NO: 678255 - protein, 27 aa, Mycobacterium
IDSFLFFPNFMLLIWEPGWYLTYHYWP

SEQ ID NO: 678256 - protein, 20 aa, Mycobacterium
IDSGVVPYLLAHLVDVDMPF

SEQ ID NO: 678257 - protein, 23 aa, Mycobacterium
IDSKSAAMGTGFTVLAAARAAAA

SEQ ID NO: 678258 - protein, 23 aa, Mycobacterium
IDSKSAAMGTGFVALAAARAAAA

SEQ ID NO: 678259 - protein, 24 aa, Mycobacterium
IDSKSAAMGTGFVALAAARAAATG

SEQ ID NO: 678260 - protein, 33 aa, Mycobacterium
IDSLPLEVFLPFAPFYILYDFGPVTVDATTYDP

SEQ ID NO: 678261 - protein, 23 aa, Mycobacterium
IDSLQRFLIDRAIAKVGVPPAEM

SEQ ID NO: 678262 - protein, 24 aa, Mycobacterium
IDSNRYDPLVPWTAANQLGRDWCA

SEQ ID NO: 678263 - protein, 18 aa, Mycobacterium
IDSNWKLGADNFVGDAYH

SEQ ID NO: 678264 - protein, 19 aa, Mycobacterium
IDSPEKFWTALLRGDDLIT

SEQ ID NO: 678265 - protein, 20 aa, Mycobacterium
IDSPFPWQYDGPRYAWLREV

SEQ ID NO: 678266 - protein, 28 aa, Mycobacterium
IDSPIDFLLLDGWPDLDLTILNIVEDKL

SEQ ID NO: 678267 - protein, 29 aa, Mycobacterium
IDSPLWRDGLWLRLALPRALAGADPAAPP

SEQ ID NO: 678268 - protein, 17 aa, Mycobacterium
IDSSASVLAATGGAGGD

SEQ ID NO: 678269 - protein, 19 aa, Mycobacterium
IDSSDEWIYTRTGIKTRRF

SEQ ID NO: 678270 - protein, 19 aa, Mycobacterium
IDSVLRWTYGGTEAVAEGN

SEQ ID NO: 678271 - protein, 24 aa, Mycobacterium
IDTDGWPFAARRAHSGPAELLYFG

SEQ ID NO: 678272 - protein, 20 aa, Mycobacterium
IDTDLGWSRDVWSQLADTGI

SEQ ID NO: 678273 - protein, 25 aa, Mycobacterium
IDTDLRWRIVTALASAGEIDADGPA

SEQ ID NO: 678274 - protein, 25 aa, Mycobacterium
IDTDLRWRIVTALATAGDIDADGPA

SEQ ID NO: 678275 - protein, 18 aa, Mycobacterium
IDTDNCRVVETIAGVNEP

SEQ ID NO: 678276 - protein, 19 aa, Mycobacterium
IDTDNMFGFWDWVGGRYSV

SEQ ID NO: 678277 - protein, 35 aa, Mycobacterium
IDTDRARLLPGVRAVLCYRDDPGVPFSTARHHERT

SEQ ID NO: 678278 - protein, 27 aa, Mycobacterium
IDTEVFEPPAYMGFHLANVWGESHDYA

SEQ ID NO: 678279 - protein, 23 aa, Mycobacterium
IDTGAPGPHWFVIDPTGEKGYAS

SEQ ID NO: 678280 - protein, 31 aa, Mycobacterium
IDTGLLISGDMGNGFAWRGDQQGQVSASYVI

SEQ ID NO: 678281 - protein, 17 aa, Mycobacterium
IDTGRAFEDVGFESMTG

SEQ ID NO: 678282 - protein, 17 aa, Mycobacterium
IDTGWALDQLREVDTAQ

SEQ ID NO: 678283 - protein, 18 aa, Mycobacterium
IDTIYVWTHDSIGLGEDG

SEQ ID NO: 678284 - protein, 19 aa, Mycobacterium
IDTIYVWTHDSIGLGEDGP

SEQ ID NO: 678285 - protein, 18 aa, Mycobacterium
IDTLAGICYRAIYSKEVC

SEQ ID NO: 678286 - protein, 18 aa, Mycobacterium
IDTLPAMRAGSMFEPQSA

SEQ ID NO: 678287 - protein, 17 aa, Mycobacterium
IDTLVLISNCPQINNPC

SEQ ID NO: 678288 - protein, 25 aa, Mycobacterium
IDTNTRFCAHWGLARNGRVAYVNGF

SEQ ID NO: 678289 - protein, 18 aa, Mycobacterium
IDTPLGTFADFGNYLTPR

SEQ ID NO: 678290 - protein, 32 aa, Mycobacterium
IDTPPQRYAMFMSFSLAAGAGRAELQTLLARW

SEQ ID NO: 678291 - protein, 28 aa, Mycobacterium
IDTPTGERVFLTFLRNQVAAVNELVADG

SEQ ID NO: 678292 - protein, 17 aa, Mycobacterium
IDTRDADGWTVVLTDVD

SEQ ID NO: 678293 - protein, 24 aa, Mycobacterium
IDTRVRFGHPLVRSVAYADADADQ

SEQ ID NO: 678294 - protein, 19 aa, Mycobacterium
IDTSVCGLATRLPAPTCTP

SEQ ID NO: 678295 - protein, 17 aa, Mycobacterium
IDTTVWYPAEPGPDESV

SEQ ID NO: 678296 - protein, 30 aa, Mycobacterium
IDTVDILRFLAGDWHCCFDPAQHRTAPQAT

SEQ ID NO: 678297 - protein, 17 aa, Mycobacterium
IDTVLGLTVGADDYITK

SEQ ID NO: 678298 - protein, 21 aa, Mycobacterium
IDTVLRAKVDAAWNLHEATRG

SEQ ID NO: 678299 - protein, 29 aa, Mycobacterium
IDVAEIYVPFSWFEPMWLENLGFAAEGEG

SEQ ID NO: 678300 - protein, 18 aa, Mycobacterium
IDVAEPFVRQLLDSPVAG

SEQ ID NO: 678301 - protein, 29 aa, Mycobacterium
IDVAEVYVPFSWFEPMWLENLGFAPEGEG

SEQ ID NO: 678302 - protein, 31 aa, Mycobacterium
IDVAEVYVPFSWYEPMWLESLGFAPEGEGWK

SEQ ID NO: 678303 - protein, 18 aa, Mycobacterium
IDVAHGMAKPAGLPDAAD

SEQ ID NO: 678304 - protein, 19 aa, Mycobacterium
IDVAYRYFATPKRSFILAD

SEQ ID NO: 678305 - protein, 17 aa, Mycobacterium
IDVCGPIENLAYPHSTP

SEQ ID NO: 678306 - protein, 17 aa, Mycobacterium
IDVCGPISTHTDIPPAT

SEQ ID NO: 678307 - protein, 27 aa, Mycobacterium
IDVEAIRWTTWHAAWLIAEGRPAAREA

SEQ ID NO: 678308 - protein, 30 aa, Mycobacterium
IDVFAPRLSFFWAIGMNFFMEVAKLRAGRL

SEQ ID NO: 678309 - protein, 17 aa, Mycobacterium
IDVFLVMPFTTDFMKLT

SEQ ID NO: 678310 - protein, 20 aa, Mycobacterium
IDVFRTAYRRWLAADEGDAE

SEQ ID NO: 678311 - protein, 17 aa, Mycobacterium
IDVGKLTLDRNVTDYHT

SEQ ID NO: 678312 - protein, 18 aa, Mycobacterium
IDVGKLTLDRNVTDYHTE

SEQ ID NO: 678313 - protein, 21 aa, Mycobacterium
IDVHGRRCLDAGASTGGFTDV

SEQ ID NO: 678314 - protein, 30 aa, Mycobacterium
IDVHLMGTVWMCRAAWPHMRDAGYGRIVNT

SEQ ID NO: 678315 - protein, 29 aa, Mycobacterium
IDVICAKGFPSYFLIVADLIGYAKSVGIR

SEQ ID NO: 678316 - protein, 18 aa, Mycobacterium
IDVIREWGDIGIVLITAR

SEQ ID NO: 678317 - protein, 27 aa, Mycobacterium
IDVKGLCLTLWQAAWRVSEDLPSDVDV

SEQ ID NO: 678318 - protein, 20 aa, Mycobacterium
IDVKGLRLTLTQAAWKVAED

SEQ ID NO: 678319 - protein, 18 aa, Mycobacterium
IDVLDAMASWWTAVHGHG

SEQ ID NO: 678320 - protein, 18 aa, Mycobacterium
IDVPCISFASPAFADSDE

SEQ ID NO: 678321 - protein, 19 aa, Mycobacterium
IDVPDVLAALAGGIPGLAG

SEQ ID NO: 678322 - protein, 22 aa, Mycobacterium
IDVPDVVNLVFFKLVRSKTKFW

SEQ ID NO: 678323 - protein, 21 aa, Mycobacterium
IDVRLGLTLKEAHADHVVLSD

SEQ ID NO: 678324 - protein, 18 aa, Mycobacterium
IDVRMLEAGRRWSRTRIL

SEQ ID NO: 678325 - protein, 25 aa, Mycobacterium
IDVRRCGICGSDLHARFHCDELADV

SEQ ID NO: 678326 - protein, 26 aa, Mycobacterium
IDVRSELRCAPPVPTLVEMSKEAEMV

SEQ ID NO: 678327 - protein, 22 aa, Mycobacterium
IDVSRLHPLATMERMFIAPSQF

SEQ ID NO: 678328 - protein, 23 aa, Mycobacterium
IDVSRLRPLVTMERTFIAPSRFH

SEQ ID NO: 678329 - protein, 30 aa, Mycobacterium
IDVSSIKELCRRWYPRIYFGQPEKGLAHRA

SEQ ID NO: 678330 - protein, 22 aa, Mycobacterium
IDVTAWPAVVVRAYTESFLLAS

SEQ ID NO: 678331 - protein, 32 aa, Mycobacterium
IDVTLRAARYLPWHPGRCAEVLVGESSIGHAG

SEQ ID NO: 678332 - protein, 26 aa, Mycobacterium
IDVVHWRGDIPLQDVMRLIPDRHRRR

SEQ ID NO: 678333 - protein, 25 aa, Mycobacterium
IDVVKRWAPGRVMLNSYGPTETTIT

SEQ ID NO: 678334 - protein, 24 aa, Mycobacterium
IDVVRFAGGWIFDRSMAGWDVTVL

SEQ ID NO: 678335 - protein, 25 aa, Mycobacterium
IDWLPATGDALVFRRRGGGLVCALN

SEQ ID NO: 678336 - protein, 18 aa, Mycobacterium
IDWPLSYEDVMPYYDIVE

SEQ ID NO: 678337 - protein, 17 aa, Mycobacterium
IDWPMLQMITIRDRLIG

SEQ ID NO: 678338 - protein, 20 aa, Mycobacterium
IDWQAYFHLRNRLVVAALHW

SEQ ID NO: 678339 - protein, 19 aa, Mycobacterium
IDYFAEVNLAGFYDLAQTL

SEQ ID NO: 678340 - protein, 19 aa, Mycobacterium
IDYFAEVNLAGFYDLTQTL

SEQ ID NO: 678341 - protein, 17 aa, Mycobacterium
IDYHLATADLGRRAHSA

SEQ ID NO: 678342 - protein, 21 aa, Mycobacterium
IDYLADHGWRVRARTFEEMHA

SEQ ID NO: 678343 - protein, 18 aa, Mycobacterium
IDYLLGCRDEISWRYFPG

SEQ ID NO: 678344 - protein, 17 aa, Mycobacterium
IDYPAHRAALQAGTDAK

SEQ ID NO: 678345 - protein, 25 aa, Mycobacterium
IDYPEPARAAAIVRRTVPGASAALI

SEQ ID NO: 678346 - protein, 25 aa, Mycobacterium
IDYPEPARAAAIVRRTVPGATAPLI

SEQ ID NO: 678347 - protein, 18 aa, Mycobacterium
IDYQAAWDLQRELAEERI

SEQ ID NO: 678348 - protein, 18 aa, Mycobacterium
IDYRAMGGIDGEYPDVKA

SEQ ID NO: 678349 - protein, 17 aa, Mycobacterium
IDYRAMGGIDGHYPEVK

SEQ ID NO: 678350 - protein, 17 aa, Mycobacterium
IDYRKFLDRSLIGRVPL

SEQ ID NO: 678351 - protein, 35 aa, Mycobacterium
IDYSDFSVWVLRVQRVRWVGGYGRMDSTTGEAYAA

SEQ ID NO: 678352 - protein, 18 aa, Mycobacterium
IEAAALGAILARGRMPDS

SEQ ID NO: 678353 - protein, 19 aa, Mycobacterium
IEAAARLMFERGVANTSID

SEQ ID NO: 678354 - protein, 27 aa, Mycobacterium
IEAACPGRFLLGIGVGHREAHVEYRKP

SEQ ID NO: 678355 - protein, 17 aa, Mycobacterium
IEAARRAFDDSGWSRDV

SEQ ID NO: 678356 - protein, 23 aa, Mycobacterium
IEAAWRAAMWSKPAGHGINDPDF

SEQ ID NO: 678357 - protein, 23 aa, Mycobacterium
IEAAWRSAMWAKPAGHGINNPDF

SEQ ID NO: 678358 - protein, 22 aa, Mycobacterium
IEAAWRVAMWGKPAGHGINDPS

SEQ ID NO: 678359 - protein, 25 aa, Mycobacterium
IEAAYPGRFLLGVGAGHPEASAEYR

SEQ ID NO: 678360 - protein, 25 aa, Mycobacterium
IEACAKRFPGGQMMFDSIPHWFSRR

SEQ ID NO: 678361 - protein, 23 aa, Mycobacterium
IEACMAVSLGLANHVVVYRSVWE

SEQ ID NO: 678362 - protein, 22 aa, Mycobacterium
IEADAPNVVWAIDFQFDSTIDG

SEQ ID NO: 678363 - protein, 17 aa, Mycobacterium
IEAEIVRRGWATGESLG

SEQ ID NO: 678364 - protein, 21 aa, Mycobacterium
IEAFWPGPLSIIVRHAPSLSW

SEQ ID NO: 678365 - protein, 17 aa, Mycobacterium
IEAGAPVDLVFQSIAGT

SEQ ID NO: 678366 - protein, 23 aa, Mycobacterium
IEAGESLPVMPPWHVQENKWRAA

SEQ ID NO: 678367 - protein, 17 aa, Mycobacterium
IEAGMVFVNAVGAEGAE

SEQ ID NO: 678368 - protein, 18 aa, Mycobacterium
IEAGRAWARFEDGRVIFK

SEQ ID NO: 678369 - protein, 20 aa, Mycobacterium
IEAGRPCRLLCLEFDDADGC

SEQ ID NO: 678370 - protein, 20 aa, Mycobacterium
IEAGRPCRLLCLLFDDGDGC

SEQ ID NO: 678371 - protein, 23 aa, Mycobacterium
IEAHGGFTEAVDFIAAQIGEIAA

SEQ ID NO: 678372 - protein, 19 aa, Mycobacterium
IEAHGKYVIPGGIDAHTHM

SEQ ID NO: 678373 - protein, 24 aa, Mycobacterium
IEAHSGLQFEIATGFPDYRPELPG

SEQ ID NO: 678374 - protein, 26 aa, Mycobacterium
IEAIDAEIPLLVVITEGIPVQDSAYA

SEQ ID NO: 678375 - protein, 18 aa, Mycobacterium
IEAKAVIISDPFMAAAPV

SEQ ID NO: 678376 - protein, 24 aa, Mycobacterium
IEAKAVVVSEPFLVAIPVLEEKGI

SEQ ID NO: 678377 - protein, 20 aa, Mycobacterium
IEALGLTAGERVDLVSEYHD

SEQ ID NO: 678378 - protein, 21 aa, Mycobacterium
IEALGYGAVWVGGSPPAELAW

SEQ ID NO: 678379 - protein, 17 aa, Mycobacterium
IEALKPDVVITIYSGDS

SEQ ID NO: 678380 - protein, 19 aa, Mycobacterium
IEALLAAHACRLDGDELRE

SEQ ID NO: 678381 - protein, 18 aa, Mycobacterium
IEALLALKPDCVVYNPMF

SEQ ID NO: 678382 - protein, 18 aa, Mycobacterium
IEALNARADECWSQIQKL

SEQ ID NO: 678383 - protein, 20 aa, Mycobacterium
IEALQTLGLRVDGTGSELTV

SEQ ID NO: 678384 - protein, 17 aa, Mycobacterium
IEALRAGGFKHRAKVEI

SEQ ID NO: 678385 - protein, 19 aa, Mycobacterium
IEALRERHGCEVRVVTADV

SEQ ID NO: 678386 - protein, 17 aa, Mycobacterium
IEALVRVVREFRPHVIT

SEQ ID NO: 678387 - protein, 17 aa, Mycobacterium
IEALVRVVREFRPHVMT

SEQ ID NO: 678388 - protein, 27 aa, Mycobacterium
IEALVTRLRGRGCRAIAPAWGAWTDDR

SEQ ID NO: 678389 - protein, 22 aa, Mycobacterium
IEAPALPIARHRWVIDHGPADI

SEQ ID NO: 678390 - protein, 19 aa, Mycobacterium
IEAQGRPGLELPGDLAEPG

SEQ ID NO: 678391 - protein, 25 aa, Mycobacterium
IEAQLRFLADQGMDLIVTSGGLGPT

SEQ ID NO: 678392 - protein, 24 aa, Mycobacterium
IEAQLRFLADQGVDLIITSGGLGP

SEQ ID NO: 678393 - protein, 24 aa, Mycobacterium
IEAQLRFLADQGVDLIVTSGGLGP

SEQ ID NO: 678394 - protein, 25 aa, Mycobacterium
IEARAKSGINGAAWQTRTVSALERR

SEQ ID NO: 678395 - protein, 21 aa, Mycobacterium
IEARCVSMVADLFHAEDLRDD

SEQ ID NO: 678396 - protein, 20 aa, Mycobacterium
IEARLKWPNDVLAGSAAAMG

SEQ ID NO: 678397 - protein, 18 aa, Mycobacterium
IEARRRARTELPRSPGTV

SEQ ID NO: 678398 - protein, 18 aa, Mycobacterium
IEATADWFAASAARTRDP

SEQ ID NO: 678399 - protein, 25 aa, Mycobacterium
IEAVKTALWLPGQVHVFIHGEAQAV

SEQ ID NO: 678400 - protein, 26 aa, Mycobacterium
IEAVLECREALAINVKPKFAVDAMVA

SEQ ID NO: 678401 - protein, 32 aa, Mycobacterium
IEAVLECREALAVNVKPKFAIDALVATAGQAL

SEQ ID NO: 678402 - protein, 32 aa, Mycobacterium
IEAVLNCREALSINVKPKFAVDAMVAAIGQQL

SEQ ID NO: 678403 - protein, 19 aa, Mycobacterium
IEAVNLFRAKVIDVSPEAL

SEQ ID NO: 678404 - protein, 19 aa, Mycobacterium
IEAVNLFRAKVIDVSTEAL

SEQ ID NO: 678405 - protein, 19 aa, Mycobacterium
IEAVNLFRGKIIDVSPESL

SEQ ID NO: 678406 - protein, 18 aa, Mycobacterium
IEAYAKYNIRRSVKDREL

SEQ ID NO: 678407 - protein, 22 aa, Mycobacterium
IECAQACGLTLLGGPPTVRTAV

SEQ ID NO: 678408 - protein, 17 aa, Mycobacterium
IECEIRATGLMVTTNFD

SEQ ID NO: 678409 - protein, 19 aa, Mycobacterium
IECEVRATGIMVVSNFTEG

SEQ ID NO: 678410 - protein, 19 aa, Mycobacterium
IECPVLLKEVGHGIGGAAA

SEQ ID NO: 678411 - protein, 17 aa, Mycobacterium
IECSEQLSAVLATMARH

SEQ ID NO: 678412 - protein, 19 aa, Mycobacterium
IECVLDLRDGTGWDSEYQR

SEQ ID NO: 678413 - protein, 17 aa, Mycobacterium
IEDAAAMVDRIGDQLAS

SEQ ID NO: 678414 - protein, 17 aa, Mycobacterium
IEDARFDLVGVWVSTPA

SEQ ID NO: 678415 - protein, 23 aa, Mycobacterium
IEDFPTRHPYALGLLQHYTEKTL

SEQ ID NO: 678416 - protein, 26 aa, Mycobacterium
IEDFSGSMSLSFSDPRFDEVKASVDE

SEQ ID NO: 678417 - protein, 20 aa, Mycobacterium
IEDGLLRLGAETVEHRLNEA

SEQ ID NO: 678418 - protein, 18 aa, Mycobacterium
IEDGVPWTNPDAGRAGTV

SEQ ID NO: 678419 - protein, 24 aa, Mycobacterium
IEDLAARVGLRVSAPRAAHEREGH

SEQ ID NO: 678420 - protein, 19 aa, Mycobacterium
IEDLPAWTSANWEWFDPVY

SEQ ID NO: 678421 - protein, 27 aa, Mycobacterium
IEDMGRWAGKEWDHFLHGTPVGRILNH

SEQ ID NO: 678422 - protein, 25 aa, Mycobacterium
IEDPDRWAPGYAEAGAYNVTFHAEA

SEQ ID NO: 678423 - protein, 25 aa, Mycobacterium
IEDPDRWAPPYAEAGAYNVTFHAEA

SEQ ID NO: 678424 - protein, 21 aa, Mycobacterium
IEDRLKDMIITGGENVYGPEV

SEQ ID NO: 678425 - protein, 25 aa, Mycobacterium
IEDRLKLAGLDARCASVRASGLAVL

SEQ ID NO: 678426 - protein, 25 aa, Mycobacterium
IEDSWKRLLGKGIHPEQHIPPDVDT

SEQ ID NO: 678427 - protein, 19 aa, Mycobacterium
IEDVARTWHLTRYAAVADE

SEQ ID NO: 678428 - protein, 23 aa, Mycobacterium
IEDWSQRPARVIGITGPPGAGKS

SEQ ID NO: 678429 - protein, 20 aa, Mycobacterium
IEDWSRRAVPPALPQTEGAT

SEQ ID NO: 678430 - protein, 17 aa, Mycobacterium
IEDYDWTAFGFEGSGAE

SEQ ID NO: 678431 - protein, 21 aa, Mycobacterium
IEEAALWPVKPLLNLSGLETQ

SEQ ID NO: 678432 - protein, 17 aa, Mycobacterium
IEEAERLLGYEVTRTGD

SEQ ID NO: 678433 - protein, 18 aa, Mycobacterium
IEEAMRIAAEMGGDHGPD

SEQ ID NO: 678434 - protein, 19 aa, Mycobacterium
IEEAMRLAAEMGIDHGPDT

SEQ ID NO: 678435 - protein, 23 aa, Mycobacterium
IEEFRAGRIATIPLGRFADPIEI

SEQ ID NO: 678436 - protein, 17 aa, Mycobacterium
IEEGFSLYDPMPFGLSV

SEQ ID NO: 678437 - protein, 19 aa, Mycobacterium
IEEGLRLRVSLIAESGQLC

SEQ ID NO: 678438 - protein, 20 aa, Mycobacterium
IEEGVGFSRFVDTFAARALF

SEQ ID NO: 678439 - protein, 19 aa, Mycobacterium
IEEGVRWNPPLLTITRTTT

SEQ ID NO: 678440 - protein, 24 aa, Mycobacterium
IEEIKARDPLALVLSGGPASVYAE

SEQ ID NO: 678441 - protein, 24 aa, Mycobacterium
IEEIKARDPLALVLSGGPASVYAP

SEQ ID NO: 678442 - protein, 27 aa, Mycobacterium
IEEKGFCAVAAEADWPDAYRVNRYVRG

SEQ ID NO: 678443 - protein, 27 aa, Mycobacterium
IEEKGFCGVAAEADWPDAYRVNRYVRG

SEQ ID NO: 678444 - protein, 19 aa, Mycobacterium
IEELGRSGIGVAESGVSYA

SEQ ID NO: 678445 - protein, 23 aa, Mycobacterium
IEELGVGVGQPFSATTSESLAAG

SEQ ID NO: 678446 - protein, 25 aa, Mycobacterium
IEELMAGSGLRVGRLTLDILGAIPV

SEQ ID NO: 678447 - protein, 17 aa, Mycobacterium
IEELYALDPPPEVYEPS

SEQ ID NO: 678448 - protein, 21 aa, Mycobacterium
IEEMLRWTAPVKNMARTITAD

SEQ ID NO: 678449 - protein, 22 aa, Mycobacterium
IEEMLRWTAPVKNMARTMTADL

SEQ ID NO: 678450 - protein, 29 aa, Mycobacterium
IEEPGRTGFRFAPCGSGGRSLDARITDGV

SEQ ID NO: 678451 - protein, 20 aa, Mycobacterium
IEEPRPIASMPGVMQHTRDS

SEQ ID NO: 678452 - protein, 20 aa, Mycobacterium
IEEQHFWPLVREALEDGDEL

SEQ ID NO: 678453 - protein, 30 aa, Mycobacterium
IEEQPRIVVARKWLGLQGLFGRGTVLAADD

SEQ ID NO: 678454 - protein, 18 aa, Mycobacterium
IEERFWAIDGSVYHVDPT

SEQ ID NO: 678455 - protein, 24 aa, Mycobacterium
IEERLRLDSELRQKGIDLALSGKL

SEQ ID NO: 678456 - protein, 27 aa, Mycobacterium
IEESIYGWKEFELELMRDGHDNVVVVC

SEQ ID NO: 678457 - protein, 23 aa, Mycobacterium
IEESMALGAISWIGWGVAGITEF

SEQ ID NO: 678458 - protein, 23 aa, Mycobacterium
IEEVARLGARLLLQTAIEAEVAA

SEQ ID NO: 678459 - protein, 35 aa, Mycobacterium
IEEVCNRWASGRFDAGVFKEDWRFSTKVESQYLAQ

SEQ ID NO: 678460 - protein, 21 aa, Mycobacterium
IEEWAETWPAEGLTYPKALAD

SEQ ID NO: 678461 - protein, 30 aa, Mycobacterium
IEFARQRAAGGLGLLIAHPFYVNPFGDYPT

SEQ ID NO: 678462 - protein, 17 aa, Mycobacterium
IEFCKLSFAETRSRSQV

SEQ ID NO: 678463 - protein, 17 aa, Mycobacterium
IEFDGFIAANFDSPLSL

SEQ ID NO: 678464 - protein, 18 aa, Mycobacterium
IEFDINWQAAEARADIAG

SEQ ID NO: 678465 - protein, 18 aa, Mycobacterium
IEFGRYLTEAVFEPLGMS

SEQ ID NO: 678466 - protein, 20 aa, Mycobacterium
IEFKDSWRNAIEDVKNAGGT

SEQ ID NO: 678467 - protein, 17 aa, Mycobacterium
IEFPDRGVVVVSGANEV

SEQ ID NO: 678468 - protein, 22 aa, Mycobacterium
IEFPGCTSATVGRLAHVQLPDE

SEQ ID NO: 678469 - protein, 19 aa, Mycobacterium
IEFPLRGLIQGWQDGIPGM

SEQ ID NO: 678470 - protein, 27 aa, Mycobacterium
IEFTLPPAKFGEKWRTVVYTGARQLAP

SEQ ID NO: 678471 - protein, 20 aa, Mycobacterium
IEFVQFHPTMLFGAAAGGRR

SEQ ID NO: 678472 - protein, 18 aa, Mycobacterium
IEGAVAFAEAGTWEDVAD

SEQ ID NO: 678473 - protein, 17 aa, Mycobacterium
IEGAVLIAEHQTAGRGR

SEQ ID NO: 678474 - protein, 19 aa, Mycobacterium
IEGDIPWTNPDCARAGTVH

SEQ ID NO: 678475 - protein, 19 aa, Mycobacterium
IEGDIPWTNPDCRRAGTVH

SEQ ID NO: 678476 - protein, 18 aa, Mycobacterium
IEGFTRDGVNRWRSIPYA

SEQ ID NO: 678477 - protein, 24 aa, Mycobacterium
IEGFYPEVIISFRADGTAGHLHVP

SEQ ID NO: 678478 - protein, 18 aa, Mycobacterium
IEGGDFAAWRTFLHPEQR

SEQ ID NO: 678479 - protein, 24 aa, Mycobacterium
IEGGRIAIMLKVHHALIDGEGGLR

SEQ ID NO: 678480 - protein, 17 aa, Mycobacterium
IEGGVAALRVWGAGATG

SEQ ID NO: 678481 - protein, 19 aa, Mycobacterium
IEGHIPWTNPDCGHAGTVH

SEQ ID NO: 678482 - protein, 23 aa, Mycobacterium
IEGHYRRPMDIEWAKDGLDGKLY

SEQ ID NO: 678483 - protein, 25 aa, Mycobacterium
IEGIGRPRVEPSFLPSVVDRMEQIP

SEQ ID NO: 678484 - protein, 24 aa, Mycobacterium
IEGIGRPRVEPSFMPEVVDRMIAV

SEQ ID NO: 678485 - protein, 23 aa, Mycobacterium
IEGIRVLRSYDECMALRSHASAA

SEQ ID NO: 678486 - protein, 17 aa, Mycobacterium
IEGLKAMLAAFSDRVLV

SEQ ID NO: 678487 - protein, 24 aa, Mycobacterium
IEGLRGAPAVHPYVASKWAVRGLT

SEQ ID NO: 678488 - protein, 34 aa, Mycobacterium
IEGMLALTGYYAWHKICVEHGILPGMQQLIRHIG

SEQ ID NO: 678489 - protein, 35 aa, Mycobacterium
IEGMMALTGYYAWHRICVDRHILPGMQELVRRIGD

SEQ ID NO: 678490 - protein, 23 aa, Mycobacterium
IEGPMDPRLACLTIGDAGAAVIL

SEQ ID NO: 678491 - protein, 29 aa, Mycobacterium
IEGQLLPAFKKAWSAGGGAYDTLINGLKQ

SEQ ID NO: 678492 - protein, 17 aa, Mycobacterium
IEGQPLDRPFAWALIKL

SEQ ID NO: 678493 - protein, 17 aa, Mycobacterium
IEGRCRIVGVVDDYTPP

SEQ ID NO: 678494 - protein, 21 aa, Mycobacterium
IEGRDGLSLFDHWRDGYKTLH

SEQ ID NO: 678495 - protein, 22 aa, Mycobacterium
IEGRIRHVMIPGMIDEDDDRPI

SEQ ID NO: 678496 - protein, 21 aa, Mycobacterium
IEGRLPFPFPFPFSFPFPFSA

SEQ ID NO: 678497 - protein, 17 aa, Mycobacterium
IEGRRGAQRAEWLAAAR

SEQ ID NO: 678498 - protein, 17 aa, Mycobacterium
IEGSGWLGVCRRRSGRA

SEQ ID NO: 678499 - protein, 21 aa, Mycobacterium
IEGTESLFLGFGMQTYCNQRL

SEQ ID NO: 678500 - protein, 20 aa, Mycobacterium
IEGTPSIFQETAFRFTDGSG

SEQ ID NO: 678501 - protein, 21 aa, Mycobacterium
IEGYLKWNRTRGWRGQRAAAG

SEQ ID NO: 678502 - protein, 25 aa, Mycobacterium
IEHAEGIAIDMLVPYRIDSDGATIN

SEQ ID NO: 678503 - protein, 20 aa, Mycobacterium
IEHCAGFLGILGLYTLGQAP

SEQ ID NO: 678504 - protein, 17 aa, Mycobacterium
IEHDRVPLAGSVLLVSG

SEQ ID NO: 678505 - protein, 19 aa, Mycobacterium
IEHGLKGVEFIAINTDAQA

SEQ ID NO: 678506 - protein, 18 aa, Mycobacterium
IEHIGGWANRPLPLPDMC

SEQ ID NO: 678507 - protein, 17 aa, Mycobacterium
IEHIVCIDGSPPGTLSV

SEQ ID NO: 678508 - protein, 25 aa, Mycobacterium
IEHLDALGFDEVWLGEHHSAGSEII

SEQ ID NO: 678509 - protein, 20 aa, Mycobacterium
IEHLPDIQVPTVFTHGTSDA

SEQ ID NO: 678510 - protein, 17 aa, Mycobacterium
IEHPDILILEGLNVLQT

SEQ ID NO: 678511 - protein, 22 aa, Mycobacterium
IEHRNRFGPAPKRLSPVAQLVH

SEQ ID NO: 678512 - protein, 17 aa, Mycobacterium
IEHRPAYEHAIFDRWGA

SEQ ID NO: 678513 - protein, 18 aa, Mycobacterium
IEHTNLPFVIVFSREAGA

SEQ ID NO: 678514 - protein, 24 aa, Mycobacterium
IEIAKSLFAERGFDGTSIEEIALR

SEQ ID NO: 678515 - protein, 24 aa, Mycobacterium
IEIAKSLFAERGYDGTSIEEVAQR

SEQ ID NO: 678516 - protein, 17 aa, Mycobacterium
IEIANAAVFLASDLSSF

SEQ ID NO: 678517 - protein, 24 aa, Mycobacterium
IEIDPGSWWFGRDHSWGIRNGPGG

SEQ ID NO: 678518 - protein, 25 aa, Mycobacterium
IEIDRLDAIAGRAGVVQDVLVRVTV

SEQ ID NO: 678519 - protein, 18 aa, Mycobacterium
IEIGEIQSALAALDGVEQ

SEQ ID NO: 678520 - protein, 18 aa, Mycobacterium
IEIGESWPELAATEEPTG

SEQ ID NO: 678521 - protein, 26 aa, Mycobacterium
IEIGNTEWPKWEAVMAADPLDPAAAA

SEQ ID NO: 678522 - protein, 17 aa, Mycobacterium
IEILEQLMGVYRDLDGV

SEQ ID NO: 678523 - protein, 17 aa, Mycobacterium
IEILGPVGVAARTAATV

SEQ ID NO: 678524 - protein, 25 aa, Mycobacterium
IEILPVAGLPEFRPGDDLGAAVAAA

SEQ ID NO: 678525 - protein, 25 aa, Mycobacterium
IEILPVAGLPEFRPGDDLTAALAAA

SEQ ID NO: 678526 - protein, 25 aa, Mycobacterium
IEILPVEGLPEFRPGDELSAAIATA

SEQ ID NO: 678527 - protein, 23 aa, Mycobacterium
IEIMGAEVLPEFIERDAKAVADK

SEQ ID NO: 678528 - protein, 23 aa, Mycobacterium
IEIMGKEILPEFIERDEKAVKDK

SEQ ID NO: 678529 - protein, 19 aa, Mycobacterium
IEINEAFAAVALASTKELG

SEQ ID NO: 678530 - protein, 20 aa, Mycobacterium
IEINEAFAAVALASTRELGV

SEQ ID NO: 678531 - protein, 17 aa, Mycobacterium
IEIPNRGELAFLPGQYV

SEQ ID NO: 678532 - protein, 18 aa, Mycobacterium
IEIVGRWAETVGLDVELA

SEQ ID NO: 678533 - protein, 17 aa, Mycobacterium
IEIWECLNTTYNALPER

SEQ ID NO: 678534 - protein, 24 aa, Mycobacterium
IEIYSRSASGWRRHAVAKAETSTP

SEQ ID NO: 678535 - protein, 27 aa, Mycobacterium
IEKAYPGRFLLGIGVGHPEHTEQYAKP

SEQ ID NO: 678536 - protein, 27 aa, Mycobacterium
IEKGNRYAAKFTRMMRRAYDKWWAAEL

SEQ ID NO: 678537 - protein, 18 aa, Mycobacterium
IEKIVPEVFDLRPGAIIR

SEQ ID NO: 678538 - protein, 19 aa, Mycobacterium
IEKIVPEVFDLRPGAIIRD

SEQ ID NO: 678539 - protein, 25 aa, Mycobacterium
IEKLDYLVDLGIDFVELMPVNSFAG

SEQ ID NO: 678540 - protein, 25 aa, Mycobacterium
IEKLKRVRDLGCEYAILYFPEAAYD

SEQ ID NO: 678541 - protein, 29 aa, Mycobacterium
IEKPEGFGEVLPGLTIPGKLDKLGYKGID

SEQ ID NO: 678542 - protein, 36 aa, Mycobacterium
IEKQEMTEVPAPVVRKIPKEWLDVASEIGAKGTLVV

SEQ ID NO: 678543 - protein, 23 aa, Mycobacterium
IEKRFGADFERPVGRMRELIGAL

SEQ ID NO: 678544 - protein, 26 aa, Mycobacterium
IEKSDLRMRFKWMGLYTQREEGYDGS

SEQ ID NO: 678545 - protein, 19 aa, Mycobacterium
IEKYWRTTLRRGLSKKEAA

SEQ ID NO: 678546 - protein, 35 aa, Mycobacterium
IELACGTGAAAVWLARRGLRVWACDISPVAVAAAT

SEQ ID NO: 678547 - protein, 17 aa, Mycobacterium
IELAEALHAARAHPRSF

SEQ ID NO: 678548 - protein, 17 aa, Mycobacterium
IELAGALATLPEQFRLA

SEQ ID NO: 678549 - protein, 17 aa, Mycobacterium
IELAKPVVQAVVERSGL

SEQ ID NO: 678550 - protein, 23 aa, Mycobacterium
IELALRLGASVERVAEASGVDPW

SEQ ID NO: 678551 - protein, 24 aa, Mycobacterium
IELARRLGDRFDVRAVRLDSGDLG

SEQ ID NO: 678552 - protein, 23 aa, Mycobacterium
IELDARFGVFVAPGVLPRGPDSP

SEQ ID NO: 678553 - protein, 26 aa, Mycobacterium
IELDGLRLITWRGAARAEQGLPFARE

SEQ ID NO: 678554 - protein, 36 aa, Mycobacterium
IELDGLRLITWRGAARAEQGLPFIREAALAKRLGAD

SEQ ID NO: 678555 - protein, 35 aa, Mycobacterium
IELDGLRLITWRGAARAEQGLPFVREAALAKRLGA

SEQ ID NO: 678556 - protein, 25 aa, Mycobacterium
IELDGLRLITWRGASRAEQGLPFAR

SEQ ID NO: 678557 - protein, 26 aa, Mycobacterium
IELDGLRLITWRGASRAEQGLPFARE

SEQ ID NO: 678558 - protein, 25 aa, Mycobacterium
IELDGLRLITWRGASRAEQGLSFAR

SEQ ID NO: 678559 - protein, 18 aa, Mycobacterium
IELDMKFGSLDLRLPEGA

SEQ ID NO: 678560 - protein, 20 aa, Mycobacterium
IELDSAVAEYVRWSRGGASL

SEQ ID NO: 678561 - protein, 22 aa, Mycobacterium
IELEPVKPFVALRHLRFHSLPN

SEQ ID NO: 678562 - protein, 24 aa, Mycobacterium
IELEVAWPRLFERIPDLRLATSVD

SEQ ID NO: 678563 - protein, 25 aa, Mycobacterium
IELGCGPGRLVARLIQRGIPALGID

SEQ ID NO: 678564 - protein, 18 aa, Mycobacterium
IELGEIQAALSRLDGVEQ

SEQ ID NO: 678565 - protein, 19 aa, Mycobacterium
IELGEVHAALARVAGVDQA

SEQ ID NO: 678566 - protein, 18 aa, Mycobacterium
IELGGPVVDAFAVENIAK

SEQ ID NO: 678567 - protein, 19 aa, Mycobacterium
IELHFFDYQFGHGLPVITV

SEQ ID NO: 678568 - protein, 23 aa, Mycobacterium
IELHRRGCVVQRLILLDPPQLPG

SEQ ID NO: 678569 - protein, 17 aa, Mycobacterium
IELIKSLNYVLSRGGNP

SEQ ID NO: 678570 - protein, 26 aa, Mycobacterium
IELIYKCPRPPSGIVARNDRIDPDEW

SEQ ID NO: 678571 - protein, 24 aa, Mycobacterium
IELKAVIISEPFLVATPVLEEKGI

SEQ ID NO: 678572 - protein, 23 aa, Mycobacterium
IELLAWQFASPVRWIETQDLLFI

SEQ ID NO: 678573 - protein, 24 aa, Mycobacterium
IELLAWQFASPVRWIETQDLLFTE

SEQ ID NO: 678574 - protein, 23 aa, Mycobacterium
IELLEPRLSMGALVIADNASSAD

SEQ ID NO: 678575 - protein, 17 aa, Mycobacterium
IELLPITKFFPATDVAI

SEQ ID NO: 678576 - protein, 26 aa, Mycobacterium
IELLPSCWRRINAYGIRVNNRSYDAK

SEQ ID NO: 678577 - protein, 25 aa, Mycobacterium
IELMGKEVLPEFIERDAKAVADKAV

SEQ ID NO: 678578 - protein, 25 aa, Mycobacterium
IELMGKEVLPEFIERDAKAVAEKAK

SEQ ID NO: 678579 - protein, 17 aa, Mycobacterium
IELMSSFTTAEGFVYDS

SEQ ID NO: 678580 - protein, 25 aa, Mycobacterium
IELPERIEAALVRMARSRHVPLKST

SEQ ID NO: 678581 - protein, 19 aa, Mycobacterium
IELPNFDAAAIKRHLNHFV

SEQ ID NO: 678582 - protein, 25 aa, Mycobacterium
IELPQPECFESFLNHHWAFDAARTT

SEQ ID NO: 678583 - protein, 17 aa, Mycobacterium
IELQFGFFQTSLDDPRD

SEQ ID NO: 678584 - protein, 24 aa, Mycobacterium
IELQRRAAALAAGFDHVDYTWIPR

SEQ ID NO: 678585 - protein, 27 aa, Mycobacterium
IELQRRGCEIGRLILLDAQPGLDGGMA

SEQ ID NO: 678586 - protein, 18 aa, Mycobacterium
IELRNRLAAATGLTLSRT

SEQ ID NO: 678587 - protein, 22 aa, Mycobacterium
IELSEQIIPGFLSFHPMGAQVG

SEQ ID NO: 678588 - protein, 19 aa, Mycobacterium
IELTLEMAAEAGLQVDEIG

SEQ ID NO: 678589 - protein, 19 aa, Mycobacterium
IELTLEMAAESGLRVDEAG

SEQ ID NO: 678590 - protein, 19 aa, Mycobacterium
IELTLEMASEAGLQVDEVG

SEQ ID NO: 678591 - protein, 19 aa, Mycobacterium
IELTLEMASEAGLTVDEGG

SEQ ID NO: 678592 - protein, 23 aa, Mycobacterium
IELVKRVGIDPGMVLLDHLNEVT

SEQ ID NO: 678593 - protein, 18 aa, Mycobacterium
IEMFRGGPDYALHLYRTR

SEQ ID NO: 678594 - protein, 25 aa, Mycobacterium
IEMIGEIKPGIKGVGVVVPGTNTNL

SEQ ID NO: 678595 - protein, 20 aa, Mycobacterium
IEMINLAAIEQFRSEGAGWL

SEQ ID NO: 678596 - protein, 21 aa, Mycobacterium
IEMLEQLGWIVIRVVAEDRPA

SEQ ID NO: 678597 - protein, 33 aa, Mycobacterium
IEMLRAWSATMADAGWAAVSWPREYGGRGATVL

SEQ ID NO: 678598 - protein, 18 aa, Mycobacterium
IEMLRGGPDYLMFLYNTK

SEQ ID NO: 678599 - protein, 19 aa, Mycobacterium
IEMPSRPNSEPIKGERGDP

SEQ ID NO: 678600 - protein, 17 aa, Mycobacterium
IEMSDMLLGKQGIDPEV

SEQ ID NO: 678601 - protein, 21 aa, Mycobacterium
IEMVDLMIGRVGKQLKTKDMA

SEQ ID NO: 678602 - protein, 20 aa, Mycobacterium
IEMWLPLAWSLNMVNRSMGH

SEQ ID NO: 678603 - protein, 35 aa, Mycobacterium
IENAMALTVAGLWEPARAAFEWSRTTQRADGTWPI

SEQ ID NO: 678604 - protein, 24 aa, Mycobacterium
IENAMWPDLFIAGGGISRKADKWL

SEQ ID NO: 678605 - protein, 24 aa, Mycobacterium
IENAMWPDLFIAGGGISRKADKWV

SEQ ID NO: 678606 - protein, 20 aa, Mycobacterium
IENDGAWVYPAIQFEFNLKT

SEQ ID NO: 678607 - protein, 25 aa, Mycobacterium
IENFRPGTLEKWGLDPEDLIAANPK

SEQ ID NO: 678608 - protein, 18 aa, Mycobacterium
IENGASWVPYLFYQFEDV

SEQ ID NO: 678609 - protein, 18 aa, Mycobacterium
IENLGGFTGSSWNAAETA

SEQ ID NO: 678610 - protein, 19 aa, Mycobacterium
IENMTRFSLELGGKSAQVV

SEQ ID NO: 678611 - protein, 25 aa, Mycobacterium
IENPDRWAPPYAEAGAHNVTFHAEA

SEQ ID NO: 678612 - protein, 24 aa, Mycobacterium
IENPERWAPGYAEAGAYNVTFHAE

SEQ ID NO: 678613 - protein, 23 aa, Mycobacterium
IENPERWAPPYAEAGAYNVTIHA

SEQ ID NO: 678614 - protein, 17 aa, Mycobacterium
IENQAAAESTQWERVIK

SEQ ID NO: 678615 - protein, 21 aa, Mycobacterium
IENRFGAAFDHPVARMTELIA

SEQ ID NO: 678616 - protein, 18 aa, Mycobacterium
IENWYISRFLKMREGAFA

SEQ ID NO: 678617 - protein, 18 aa, Mycobacterium
IENYLGFPDGVSGGQLAD

SEQ ID NO: 678618 - protein, 18 aa, Mycobacterium
IENYLGFPTGISGAELAT

SEQ ID NO: 678619 - protein, 25 aa, Mycobacterium
IENYNLNMAIPWIAAERGFIDAVID

SEQ ID NO: 678620 - protein, 24 aa, Mycobacterium
IEPAELPDGWVITSSGRISGVTEP

SEQ ID NO: 678621 - protein, 18 aa, Mycobacterium
IEPAWKRATTAGHFAHSR

SEQ ID NO: 678622 - protein, 17 aa, Mycobacterium
IEPDGRASVAAWLLSAH

SEQ ID NO: 678623 - protein, 26 aa, Mycobacterium
IEPDLRARLQLMVDFMATRTAFFDEF

SEQ ID NO: 678624 - protein, 19 aa, Mycobacterium
IEPEGAVPTALDLVEPAVS

SEQ ID NO: 678625 - protein, 21 aa, Mycobacterium
IEPEHAPTMFLIDVATPGVKI

SEQ ID NO: 678626 - protein, 17 aa, Mycobacterium
IEPETQGLLALVGVTHD

SEQ ID NO: 678627 - protein, 25 aa, Mycobacterium
IEPEVGVACQVVWNGDTVARLEPFA

SEQ ID NO: 678628 - protein, 18 aa, Mycobacterium
IEPGLPPTLIHVSGSEAL

SEQ ID NO: 678629 - protein, 24 aa, Mycobacterium
IEPGRPCSLLGLLFADADGCAGHS

SEQ ID NO: 678630 - protein, 18 aa, Mycobacterium
IEPGRRTLVGTGIAVAIP

SEQ ID NO: 678631 - protein, 18 aa, Mycobacterium
IEPHEWDEVFAVNVRGVY

SEQ ID NO: 678632 - protein, 18 aa, Mycobacterium
IEPIEFPNEVAFSRWCSG

SEQ ID NO: 678633 - protein, 17 aa, Mycobacterium
IEPKIAVLRSICEDIGR

SEQ ID NO: 678634 - protein, 21 aa, Mycobacterium
IEPLPPQRAGLLVRAMYRVAK

SEQ ID NO: 678635 - protein, 17 aa, Mycobacterium
IEPMFAIAYIRAVIGRR

SEQ ID NO: 678636 - protein, 21 aa, Mycobacterium
IEPNMRILVNLGYGDPNYGYS

SEQ ID NO: 678637 - protein, 25 aa, Mycobacterium
IEPRLSMQWWVKVESLARKAGDAVR

SEQ ID NO: 678638 - protein, 24 aa, Mycobacterium
IEPTDLPKGWVITSSGRISGVTEP

SEQ ID NO: 678639 - protein, 23 aa, Mycobacterium
IEPWEGVLPCHRFRYCAPQPRKY

SEQ ID NO: 678640 - protein, 18 aa, Mycobacterium
IEPWFRYFQKVAAFPQMT

SEQ ID NO: 678641 - protein, 23 aa, Mycobacterium
IEPWLMMNWHRTMDWLLLAPTLS

SEQ ID NO: 678642 - protein, 21 aa, Mycobacterium
IEQADSVAIDFHKLLFQAISC

SEQ ID NO: 678643 - protein, 17 aa, Mycobacterium
IEQEAGHRIRMAIEPEP

SEQ ID NO: 678644 - protein, 26 aa, Mycobacterium
IEQFRLLVLRTAWLIDKHHDYQKVRR

SEQ ID NO: 678645 - protein, 17 aa, Mycobacterium
IEQGCRMLRLPTIRDRF

SEQ ID NO: 678646 - protein, 19 aa, Mycobacterium
IEQGSVCFIPGGYRHNETG

SEQ ID NO: 678647 - protein, 22 aa, Mycobacterium
IEQGWHPGPRIYPAGHAVTPYG

SEQ ID NO: 678648 - protein, 25 aa, Mycobacterium
IEQLRFQIGRWAYRDLIREQIGPWL

SEQ ID NO: 678649 - protein, 26 aa, Mycobacterium
IEQMPLDAGHQWRRGAALSADDVLAA

SEQ ID NO: 678650 - protein, 23 aa, Mycobacterium
IEQMQAWLTQWGMSTMPMMPGMD

SEQ ID NO: 678651 - protein, 18 aa, Mycobacterium
IEQRLCLGFKESRIAEDT

SEQ ID NO: 678652 - protein, 25 aa, Mycobacterium
IEQRRFAAAYGYRGRIVGAVTFDHG

SEQ ID NO: 678653 - protein, 20 aa, Mycobacterium
IEQRTDWGYDYNVKLARTAE

SEQ ID NO: 678654 - protein, 26 aa, Mycobacterium
IEQRVYGLDAWRAWRALVTKFGTPAP

SEQ ID NO: 678655 - protein, 19 aa, Mycobacterium
IEQTRIAEIAARAGVHETS

SEQ ID NO: 678656 - protein, 17 aa, Mycobacterium
IEQYGLELARHFVDDYE

SEQ ID NO: 678657 - protein, 17 aa, Mycobacterium
IERAEAIGGLAVAPDAD

SEQ ID NO: 678658 - protein, 21 aa, Mycobacterium
IERAEALGFDTVWVRQRHLQP

SEQ ID NO: 678659 - protein, 17 aa, Mycobacterium
IERARAGKFVVRLKGGD

SEQ ID NO: 678660 - protein, 19 aa, Mycobacterium
IERARAGSFVVRLKGGDPF

SEQ ID NO: 678661 - protein, 20 aa, Mycobacterium
IERARLISVATRIAKEDHEI

SEQ ID NO: 678662 - protein, 26 aa, Mycobacterium
IERAYPGRFLLGIGVGHSEATAEYRN

SEQ ID NO: 678663 - protein, 25 aa, Mycobacterium
IERDWRPKVHGAWHLHQATATQPLD

SEQ ID NO: 678664 - protein, 25 aa, Mycobacterium
IERELPEWLSADVAILGEPTSGYIE

SEQ ID NO: 678665 - protein, 17 aa, Mycobacterium
IERELRKLAPAVRAIGL

SEQ ID NO: 678666 - protein, 25 aa, Mycobacterium
IEREPFGAVGVIAPWNGSLVVAASC

SEQ ID NO: 678667 - protein, 18 aa, Mycobacterium
IERFAHLIGGARMGTGPQ

SEQ ID NO: 678668 - protein, 20 aa, Mycobacterium
IERFERCWQLLGDRHGVLLV

SEQ ID NO: 678669 - protein, 18 aa, Mycobacterium
IERFYDARLRAVAGDAPP

SEQ ID NO: 678670 - protein, 19 aa, Mycobacterium
IERGPRTGTHVALRKYEHG

SEQ ID NO: 678671 - protein, 18 aa, Mycobacterium
IERLADGVALRIGDERAA

SEQ ID NO: 678672 - protein, 22 aa, Mycobacterium
IERLADGVALRIGDERAAHQRE

SEQ ID NO: 678673 - protein, 27 aa, Mycobacterium
IERLESGRLTLPYWMVYDSRAGDVPPV

SEQ ID NO: 678674 - protein, 24 aa, Mycobacterium
IERLRRHPAARALRVDKLTLAALE

SEQ ID NO: 678675 - protein, 24 aa, Mycobacterium
IERLSRLGGIVGTAFQIADDIIDI

SEQ ID NO: 678676 - protein, 19 aa, Mycobacterium
IERNVSFVFTPSVTEQPDG

SEQ ID NO: 678677 - protein, 22 aa, Mycobacterium
IERPGLPLPQIIETVMTGYADR

SEQ ID NO: 678678 - protein, 26 aa, Mycobacterium
IERPRGMSYLVIRGRRGGSAMAAAAV

SEQ ID NO: 678679 - protein, 21 aa, Mycobacterium
IERRFTPGWTLLFSGDEQELD

SEQ ID NO: 678680 - protein, 27 aa, Mycobacterium
IERRGDIVDVRFNWHTMYFRYKTVDPY

SEQ ID NO: 678681 - protein, 33 aa, Mycobacterium
IERRQGLKIGVPEEIAWRAGFINDDQLAARAQK

SEQ ID NO: 678682 - protein, 26 aa, Mycobacterium
IERRVREGLLEIGRKLGIPPLATNDC

SEQ ID NO: 678683 - protein, 24 aa, Mycobacterium
IERRVREGLLHIGRTLNIPPLATN

SEQ ID NO: 678684 - protein, 17 aa, Mycobacterium
IERRWHLEDGRLRVTAA

SEQ ID NO: 678685 - protein, 25 aa, Mycobacterium
IERSPLPFARHRWISPGVSPDIDIA

SEQ ID NO: 678686 - protein, 17 aa, Mycobacterium
IERSRLAVNQGRTADDL

SEQ ID NO: 678687 - protein, 18 aa, Mycobacterium
IERTDLLVIMGANPAASQ

SEQ ID NO: 678688 - protein, 19 aa, Mycobacterium
IERTWPAVMRVARRLYDTG

SEQ ID NO: 678689 - protein, 26 aa, Mycobacterium
IERVELRLLGPEYKSPQLIKPEVLAS

SEQ ID NO: 678690 - protein, 34 aa, Mycobacterium
IERVELRLLGPEYKSPRLVKPEMMASSRFREGLA

SEQ ID NO: 678691 - protein, 19 aa, Mycobacterium
IERVRWDDIVSRVFGRIDP

SEQ ID NO: 678692 - protein, 20 aa, Mycobacterium
IERYLCTRGRRYFRGQHDGE

SEQ ID NO: 678693 - protein, 17 aa, Mycobacterium
IERYPAARGIRAARAVL

SEQ ID NO: 678694 - protein, 19 aa, Mycobacterium
IERYVRPTLAGKMIGSLGV

SEQ ID NO: 678695 - protein, 18 aa, Mycobacterium
IESALRLQPDIQTAAVTV

SEQ ID NO: 678696 - protein, 25 aa, Mycobacterium
IESDLLPYCHAHDIGVMVYGPLAHG

SEQ ID NO: 678697 - protein, 17 aa, Mycobacterium
IESELAALVGEVELLLE

SEQ ID NO: 678698 - protein, 19 aa, Mycobacterium
IESELDWLAALRTDSDVTV

SEQ ID NO: 678699 - protein, 23 aa, Mycobacterium
IESELMWLDALRRDSDVTVPTVI

SEQ ID NO: 678700 - protein, 26 aa, Mycobacterium
IESFLPRGIAGLFFFDGEQIEALADL

SEQ ID NO: 678701 - protein, 20 aa, Mycobacterium
IESGSAWVFHLFEKLAKSYG

SEQ ID NO: 678702 - protein, 19 aa, Mycobacterium
IESGYGLPADRLIEGLLSV

SEQ ID NO: 678703 - protein, 23 aa, Mycobacterium
IESIKQLKARYCRHLDAKDWAAW

SEQ ID NO: 678704 - protein, 17 aa, Mycobacterium
IESLGEYQTFGFAGFFA

SEQ ID NO: 678705 - protein, 19 aa, Mycobacterium
IESLPEWSSVHQKVEVLER

SEQ ID NO: 678706 - protein, 17 aa, Mycobacterium
IESLVTRLHVTWTGEGA

SEQ ID NO: 678707 - protein, 24 aa, Mycobacterium
IESMLNRRSGVLGLGGASDFRKLR

SEQ ID NO: 678708 - protein, 23 aa, Mycobacterium
IESPEQFWQALLRGEDFITEVPP

SEQ ID NO: 678709 - protein, 18 aa, Mycobacterium
IESPTYWGAIIAAAQAGV

SEQ ID NO: 678710 - protein, 23 aa, Mycobacterium
IESRCVAMVADLFHADNLSTEDP

SEQ ID NO: 678711 - protein, 19 aa, Mycobacterium
IESRCVSMVADLFHAEGLR

SEQ ID NO: 678712 - protein, 23 aa, Mycobacterium
IESRPASVARMFLDRVAATPHAE

SEQ ID NO: 678713 - protein, 17 aa, Mycobacterium
IESRYFVGLVTGQTAKN

SEQ ID NO: 678714 - protein, 25 aa, Mycobacterium
IESVLPSFLEFCRGAVLVAHNAGFD

SEQ ID NO: 678715 - protein, 20 aa, Mycobacterium
IESYAPMMAYLVRSMQSGGE

SEQ ID NO: 678716 - protein, 25 aa, Mycobacterium
IETARGRVIVACFASNVARVQQIID

SEQ ID NO: 678717 - protein, 20 aa, Mycobacterium
IETEILWGRPLTKLLEESRT

SEQ ID NO: 678718 - protein, 24 aa, Mycobacterium
IETGLREGFDFVAMGRALLREPDL

SEQ ID NO: 678719 - protein, 24 aa, Mycobacterium
IETLPQQRIRDICDYHSSVQEAAA

SEQ ID NO: 678720 - protein, 32 aa, Mycobacterium
IETLQWRYYLAWWLWNGHEFDPAAARTRKLID

SEQ ID NO: 678721 - protein, 19 aa, Mycobacterium
IETLSLRIERHVVNAQRVA

SEQ ID NO: 678722 - protein, 18 aa, Mycobacterium
IETLSLRVERHVANAQRV

SEQ ID NO: 678723 - protein, 25 aa, Mycobacterium
IETNVEFWAAVILDFAGVPANMMPA

SEQ ID NO: 678724 - protein, 26 aa, Mycobacterium
IETNVEFWAAVILDFAQVPANMMPAM

SEQ ID NO: 678725 - protein, 25 aa, Mycobacterium
IETNVEFWAAVILDFAQVPASMMPA

SEQ ID NO: 678726 - protein, 26 aa, Mycobacterium
IETNVEFWAAVILDFAQVPTRMMPAM

SEQ ID NO: 678727 - protein, 25 aa, Mycobacterium
IETRDGAVIPGRLYVPAEGDDLPLT

SEQ ID NO: 678728 - protein, 23 aa, Mycobacterium
IETRGRFGTFVARYDPTDAAMAA

SEQ ID NO: 678729 - protein, 19 aa, Mycobacterium
IETSEWLWVLDPIDGTSNF

SEQ ID NO: 678730 - protein, 25 aa, Mycobacterium
IETSKKFYEAIGFTEAKRLTLPDKI

SEQ ID NO: 678731 - protein, 17 aa, Mycobacterium
IETTGIPFLPMSMAKGL

SEQ ID NO: 678732 - protein, 23 aa, Mycobacterium
IETTRPAPPQPLSPVAQLLELPG

SEQ ID NO: 678733 - protein, 23 aa, Mycobacterium
IEVADRVGIDPGLVLLDHLNEVT

SEQ ID NO: 678734 - protein, 20 aa, Mycobacterium
IEVARRLLPDIPHIAVFDTG

SEQ ID NO: 678735 - protein, 17 aa, Mycobacterium
IEVARRLLPDVPQVAVF

SEQ ID NO: 678736 - protein, 27 aa, Mycobacterium
IEVAVCSTGLIGDRLPMDKVLAGVRTI

SEQ ID NO: 678737 - protein, 27 aa, Mycobacterium
IEVAVCSTGLIGDRLPMDKVLAGVTEI

SEQ ID NO: 678738 - protein, 26 aa, Mycobacterium
IEVAVCSTGLIGDRLPMDKVLNGVRD

SEQ ID NO: 678739 - protein, 26 aa, Mycobacterium
IEVAVCSTGLIGDRLPMDKVLSGVRA

SEQ ID NO: 678740 - protein, 24 aa, Mycobacterium
IEVAVCSTGLIGDRLPMDKVSAGV

SEQ ID NO: 678741 - protein, 20 aa, Mycobacterium
IEVDPAQAWLGIVAVGTAYD

SEQ ID NO: 678742 - protein, 22 aa, Mycobacterium
IEVDTLIAVPCRELLLTEEVRQ

SEQ ID NO: 678743 - protein, 23 aa, Mycobacterium
IEVFGVACPRFVDFVERGVTSGR

SEQ ID NO: 678744 - protein, 18 aa, Mycobacterium
IEVGEIQVALAALDGVDQ

SEQ ID NO: 678745 - protein, 26 aa, Mycobacterium
IEVGKVCGSTAWTFCIYGIHNWLAGL

SEQ ID NO: 678746 - protein, 19 aa, Mycobacterium
IEVGLRYYPAALFEVIPQV

SEQ ID NO: 678747 - protein, 17 aa, Mycobacterium
IEVGTRVSALIKVKGFR

SEQ ID NO: 678748 - protein, 18 aa, Mycobacterium
IEVIEFCIGIPHLLKGEY

SEQ ID NO: 678749 - protein, 26 aa, Mycobacterium
IEVIPDVLRHRLVMSYDALADEVSAD

SEQ ID NO: 678750 - protein, 20 aa, Mycobacterium
IEVKRIRTAATLSLADSIEC

SEQ ID NO: 678751 - protein, 25 aa, Mycobacterium
IEVLNRLKPGIIMCREKQDTTSAQL

SEQ ID NO: 678752 - protein, 20 aa, Mycobacterium
IEVLRRWPHELSLSEHLAVN

SEQ ID NO: 678753 - protein, 18 aa, Mycobacterium
IEVMRLGAAYWLEACSDH

SEQ ID NO: 678754 - protein, 20 aa, Mycobacterium
IEVNEAFAAQVLAVLAEWKI

SEQ ID NO: 678755 - protein, 20 aa, Mycobacterium
IEVNEYISRLTIMHQSGLND

SEQ ID NO: 678756 - protein, 20 aa, Mycobacterium
IEVPAAALLAERILEHVEFL

SEQ ID NO: 678757 - protein, 23 aa, Mycobacterium
IEVPEQMTAPLLTAAVVLVFSVD

SEQ ID NO: 678758 - protein, 19 aa, Mycobacterium
IEVPLNFHHPMWRENCEVD

SEQ ID NO: 678759 - protein, 22 aa, Mycobacterium
IEVPSDGVAAVMGHNGAGKTTL

SEQ ID NO: 678760 - protein, 27 aa, Mycobacterium
IEVPSRLRPAMTAMLSGVVVVNDLSEA

SEQ ID NO: 678761 - protein, 39 aa, Mycobacterium
IEVRCMSESLPTLFRQAGGYRRQLTFTPKGVIAEETTDD

SEQ ID NO: 678762 - protein, 24 aa, Mycobacterium
IEVRFKGLCPYVGELIVIGEAKPY

SEQ ID NO: 678763 - protein, 18 aa, Mycobacterium
IEVSARLKSAGEVCSGES

SEQ ID NO: 678764 - protein, 17 aa, Mycobacterium
IEVTSRWNLLPEPGGTR

SEQ ID NO: 678765 - protein, 25 aa, Mycobacterium
IEVVECSPPYDWAEQTALMSSRVIL

SEQ ID NO: 678766 - protein, 20 aa, Mycobacterium
IEVYRPRLSGPVPSEEDVVA

SEQ ID NO: 678767 - protein, 21 aa, Mycobacterium
IEWAESAGLDTAWMPQVPDDF

SEQ ID NO: 678768 - protein, 17 aa, Mycobacterium
IEWAKASLITPEAYGAA

SEQ ID NO: 678769 - protein, 17 aa, Mycobacterium
IEWAKASLITPEQYPAA

SEQ ID NO: 678770 - protein, 23 aa, Mycobacterium
IEWKHGICEALGWPHADQADIAR

SEQ ID NO: 678771 - protein, 24 aa, Mycobacterium
IEWKHGICQALGWPHGSQTEIAEA

SEQ ID NO: 678772 - protein, 18 aa, Mycobacterium
IEWQRDFFDFGHVAKGYA

SEQ ID NO: 678773 - protein, 17 aa, Mycobacterium
IEWQRDFFDFGHVAYMY

SEQ ID NO: 678774 - protein, 17 aa, Mycobacterium
IEWRRTAPAPSFSAPVS

SEQ ID NO: 678775 - protein, 18 aa, Mycobacterium
IEWTEFDYSCERYAKTGA

SEQ ID NO: 678776 - protein, 17 aa, Mycobacterium
IEYCNRPGLYQVEDAPG

SEQ ID NO: 678777 - protein, 18 aa, Mycobacterium
IEYDGQWNSWARVGAAAR

SEQ ID NO: 678778 - protein, 19 aa, Mycobacterium
IEYEIKDPGLAGVTITDAK

SEQ ID NO: 678779 - protein, 25 aa, Mycobacterium
IEYEIKDPRLAGVTITDAKVSGDLH

SEQ ID NO: 678780 - protein, 25 aa, Mycobacterium
IEYEIKDPRLAGVTITDAKVTNDLH

SEQ ID NO: 678781 - protein, 17 aa, Mycobacterium
IEYGRIDALVTLAGVME

SEQ ID NO: 678782 - protein, 22 aa, Mycobacterium
IEYHLYGPSGIRYYKGPSSPPE

SEQ ID NO: 678783 - protein, 23 aa, Mycobacterium
IEYLRPHYARTLEMWAANLEANR

SEQ ID NO: 678784 - protein, 24 aa, Mycobacterium
IEYMEGPYRYRGMLHGEPVTAFAF

SEQ ID NO: 678785 - protein, 23 aa, Mycobacterium
IEYRERLGFEVLPLSGGGKPPFE

SEQ ID NO: 678786 - protein, 21 aa, Mycobacterium
IEYSAGTLLAARYRDYVAGDR

SEQ ID NO: 678787 - protein, 25 aa, Mycobacterium
IEYTCSFLFCCSGYYDYDQGYSPEF

SEQ ID NO: 678788 - protein, 17 aa, Mycobacterium
IFAARAAMGLPLPGAIA

SEQ ID NO: 678789 - protein, 18 aa, Mycobacterium
IFAGHLRSIIGSMTVEEI

SEQ ID NO: 678790 - protein, 24 aa, Mycobacterium
IFAGRRLTDRFALTVQDTCYVSMP

SEQ ID NO: 678791 - protein, 21 aa, Mycobacterium
IFAGYFRERMPAAAPYRRYLT

SEQ ID NO: 678792 - protein, 19 aa, Mycobacterium
IFATPGYQRYAWRLWHLAQ

SEQ ID NO: 678793 - protein, 18 aa, Mycobacterium
IFDAASIEALVDRLRRVL

SEQ ID NO: 678794 - protein, 20 aa, Mycobacterium
IFDEGKVWYGLYGVSDRAQP

SEQ ID NO: 678795 - protein, 26 aa, Mycobacterium
IFDIRIPKPRFVLMPTPIWDQIFKPL

SEQ ID NO: 678796 - protein, 22 aa, Mycobacterium
IFDKGKALALYHTKRLASPGQR

SEQ ID NO: 678797 - protein, 19 aa, Mycobacterium
IFDLPVGGWRCRPDAAFGY

SEQ ID NO: 678798 - protein, 23 aa, Mycobacterium
IFDRAAIFKAFRRVSSGINPDIE

SEQ ID NO: 678799 - protein, 23 aa, Mycobacterium
IFDRAIHVFQVFAMTNPDARRAV

SEQ ID NO: 678800 - protein, 18 aa, Mycobacterium
IFDVLDLKPTFISDETQK

SEQ ID NO: 678801 - protein, 31 aa, Mycobacterium
IFDVNLWAPLLWTSLAVKGWMGEHGGVVINT

SEQ ID NO: 678802 - protein, 26 aa, Mycobacterium
IFDVNLWAPLLWTSLAVKSWMGEHGG

SEQ ID NO: 678803 - protein, 31 aa, Mycobacterium
IFDVNLWAPLLWTSLVVKSWMGEHGGAIVNT

SEQ ID NO: 678804 - protein, 27 aa, Mycobacterium
IFEELQYLGPRTIVLAARMIALPEWLR

SEQ ID NO: 678805 - protein, 18 aa, Mycobacterium
IFELALKTGNLFAQNAAH

SEQ ID NO: 678806 - protein, 22 aa, Mycobacterium
IFEPPGVLGLIDWALETIAAQE

SEQ ID NO: 678807 - protein, 22 aa, Mycobacterium
IFEPRYSALVRACLAAEDPVFG

SEQ ID NO: 678808 - protein, 20 aa, Mycobacterium
IFEQSARGAFYLLTQPEYVG

SEQ ID NO: 678809 - protein, 23 aa, Mycobacterium
IFERAAAVGGTWRDNVYPGIGVD

SEQ ID NO: 678810 - protein, 20 aa, Mycobacterium
IFFAPPRIWEKLRAITASDL

SEQ ID NO: 678811 - protein, 19 aa, Mycobacterium
IFFGHSMGGMLAFEVALRF

SEQ ID NO: 678812 - protein, 19 aa, Mycobacterium
IFGALLRGGRLVVVPDAVV

SEQ ID NO: 678813 - protein, 19 aa, Mycobacterium
IFGALLRGGRLVVVPESVA

SEQ ID NO: 678814 - protein, 19 aa, Mycobacterium
IFGALLRGGRLVVVSDAVV

SEQ ID NO: 678815 - protein, 29 aa, Mycobacterium
IFGGMKLDFLITVDWDYYKKFMSVNLDGA

SEQ ID NO: 678816 - protein, 27 aa, Mycobacterium
IFGGMKLDFLLTVDWDYYKKFMSVNLD

SEQ ID NO: 678817 - protein, 24 aa, Mycobacterium
IFGGPFRWDDLEWLRAETDLPLMV

SEQ ID NO: 678818 - protein, 20 aa, Mycobacterium
IFGGVAGALAQGFRGRDTLF

SEQ ID NO: 678819 - protein, 18 aa, Mycobacterium
IFGIPGGAVLPVYDPLYD

SEQ ID NO: 678820 - protein, 20 aa, Mycobacterium
IFGPAALRIHRRISMPDGMF

SEQ ID NO: 678821 - protein, 19 aa, Mycobacterium
IFGPILPVLTVKSLDEAIG

SEQ ID NO: 678822 - protein, 18 aa, Mycobacterium
IFGPILPVLTVQNLDEAI

SEQ ID NO: 678823 - protein, 19 aa, Mycobacterium
IFGPLLPIITYRSVDQAVD

SEQ ID NO: 678824 - protein, 17 aa, Mycobacterium
IFGPPGTTADISYFDVD

SEQ ID NO: 678825 - protein, 39 aa, Mycobacterium
IFGPTRDWECYCGKYKRVRFKGIICERCGVEVTRAKVRR

SEQ ID NO: 678826 - protein, 18 aa, Mycobacterium
IFGPVLVVIKCADDAEAV

SEQ ID NO: 678827 - protein, 26 aa, Mycobacterium
IFGSPTRFGSPAAQLRAFLDSLGGLW

SEQ ID NO: 678828 - protein, 30 aa, Mycobacterium
IFGTEGWIDILPRFHHPREIVLHRKGAAPE

SEQ ID NO: 678829 - protein, 24 aa, Mycobacterium
IFGTPCPRVCAGLLTDPSLQTEVT

SEQ ID NO: 678830 - protein, 23 aa, Mycobacterium
IFGTPFFVCTSSAGLMMSAMSAF

SEQ ID NO: 678831 - protein, 18 aa, Mycobacterium
IFGYDHFHWPAGTLSSQG

SEQ ID NO: 678832 - protein, 23 aa, Mycobacterium
IFHPVGTCAMGAFDARGLPRSAT

SEQ ID NO: 678833 - protein, 23 aa, Mycobacterium
IFHPVGTCAMGAFDARGRPRSAA

SEQ ID NO: 678834 - protein, 23 aa, Mycobacterium
IFHPVGTCAMGAFDTHGLPTSAT

SEQ ID NO: 678835 - protein, 20 aa, Mycobacterium
IFIADFVPRVRAGLQALGVG

SEQ ID NO: 678836 - protein, 18 aa, Mycobacterium
IFIAEAWVSSNERLARYL

SEQ ID NO: 678837 - protein, 23 aa, Mycobacterium
IFKKEMRGAHGIEHPVISGAGHF

SEQ ID NO: 678838 - protein, 19 aa, Mycobacterium
IFLAAGGFIGRFKRQTPVP

SEQ ID NO: 678839 - protein, 25 aa, Mycobacterium
IFLGRFPLELIHPFPKPSEAEEARI

SEQ ID NO: 678840 - protein, 18 aa, Mycobacterium
IFLHVGVYAGIPAAVDSF

SEQ ID NO: 678841 - protein, 23 aa, Mycobacterium
IFLPSVPNLLLLASEMEAQRNHV

SEQ ID NO: 678842 - protein, 31 aa, Mycobacterium
IFLVDYLINFFQYHLPGVQAYHLDVVPDPGM

SEQ ID NO: 678843 - protein, 17 aa, Mycobacterium
IFNEGKIWYSLYGVSDR

SEQ ID NO: 678844 - protein, 27 aa, Mycobacterium
IFNRELEYLFPRSWLFVGHASQVSAPG

SEQ ID NO: 678845 - protein, 18 aa, Mycobacterium
IFPTVAFVAEVGRSTQTA

SEQ ID NO: 678846 - protein, 25 aa, Mycobacterium
IFQGEGAPAWAVPETRLPNPQFGFP

SEQ ID NO: 678847 - protein, 18 aa, Mycobacterium
IFQREMRGAQGIDHPVIR

SEQ ID NO: 678848 - protein, 20 aa, Mycobacterium
IFRLARHPRSFVSLEGSDHF

SEQ ID NO: 678849 - protein, 20 aa, Mycobacterium
IFRLARHPRSFVSLEGSDHL

SEQ ID NO: 678850 - protein, 23 aa, Mycobacterium
IFRLGSDPGLARFIDQVARRVEG

SEQ ID NO: 678851 - protein, 23 aa, Mycobacterium
IFRLGSDPGLARFIDQVARRVGG

SEQ ID NO: 678852 - protein, 23 aa, Mycobacterium
IFRLGSDPGLARFIDQVARRVQG

SEQ ID NO: 678853 - protein, 19 aa, Mycobacterium
IFRNMCASIFAVGSEDLPA

SEQ ID NO: 678854 - protein, 24 aa, Mycobacterium
IFRREMDTIFKTGWVYVAHESEVS

SEQ ID NO: 678855 - protein, 21 aa, Mycobacterium
IFRYGEGTAMAIMHPDNPIAE

SEQ ID NO: 678856 - protein, 21 aa, Mycobacterium
IFRYGEGTVMAIMHPDNPVAR

SEQ ID NO: 678857 - protein, 18 aa, Mycobacterium
IFSALIGGATLVLGQREE

SEQ ID NO: 678858 - protein, 26 aa, Mycobacterium
IFSDPSGPCLEGWTTLTALAQATRRL

SEQ ID NO: 678859 - protein, 27 aa, Mycobacterium
IFSETIDGFGYSDCGGHPQWYEPTEWL

SEQ ID NO: 678860 - protein, 19 aa, Mycobacterium
IFSFLRLLLPAGLETTYRS

SEQ ID NO: 678861 - protein, 22 aa, Mycobacterium
IFSKRIEELTGLLEPGRQIQFN

SEQ ID NO: 678862 - protein, 19 aa, Mycobacterium
IFTAAGAEWRQAGCSMCLG

SEQ ID NO: 678863 - protein, 18 aa, Mycobacterium
IFTEALRTPAEFEQFRAA

SEQ ID NO: 678864 - protein, 23 aa, Mycobacterium
IFTEMDLPINVARVLHRDQKLKF

SEQ ID NO: 678865 - protein, 17 aa, Mycobacterium
IFTEVIVAPGYADGAVE

SEQ ID NO: 678866 - protein, 34 aa, Mycobacterium
IFTIRRLRFADGVPLSVDLACFVAGRMNDLLEQP

SEQ ID NO: 678867 - protein, 22 aa, Mycobacterium
IFTKQRVAGFAGHMSEAANHIL

SEQ ID NO: 678868 - protein, 18 aa, Mycobacterium
IFTPENFTFGLRVPEGTH

SEQ ID NO: 678869 - protein, 17 aa, Mycobacterium
IFTRLMRDVGFDYYWTD

SEQ ID NO: 678870 - protein, 18 aa, Mycobacterium
IFTRLVAESDAVFANFKP

SEQ ID NO: 678871 - protein, 19 aa, Mycobacterium
IFTTKELAGAIAFASPLSY

SEQ ID NO: 678872 - protein, 19 aa, Mycobacterium
IFVCAGIPGPRLPFRPQEV

SEQ ID NO: 678873 - protein, 20 aa, Mycobacterium
IFVEFSRMRGLSVDGRCKAY

SEQ ID NO: 678874 - protein, 17 aa, Mycobacterium
IFVGRVLARDSYLLTNH

SEQ ID NO: 678875 - protein, 27 aa, Mycobacterium
IFVKDKPTWLGRAWQRISEEVAAGRQA

SEQ ID NO: 678876 - protein, 17 aa, Mycobacterium
IFVMSRITGWTAHIMEQ

SEQ ID NO: 678877 - protein, 17 aa, Mycobacterium
IFVPQPSVADWLQLEYY

SEQ ID NO: 678878 - protein, 17 aa, Mycobacterium
IFVSARWQVDTPQHVPI

SEQ ID NO: 678879 - protein, 19 aa, Mycobacterium
IFWQDSCGLANSYYFDKNG

SEQ ID NO: 678880 - protein, 20 aa, Mycobacterium
IFYLTGYAAWSFYTPQCLVV

SEQ ID NO: 678881 - protein, 18 aa, Mycobacterium
IFYRNMVSAGLEIAPNQA

SEQ ID NO: 678882 - protein, 18 aa, Mycobacterium
IFYTPRMADTYNEWLDEG

SEQ ID NO: 678883 - protein, 19 aa, Mycobacterium
IFYTPRMADTYNEWLDEGF

SEQ ID NO: 678884 - protein, 23 aa, Mycobacterium
IGAAAAWMFDYYPLRDITERPDG

SEQ ID NO: 678885 - protein, 34 aa, Mycobacterium
IGAAACLRKTDWLFPQYREIGAFLLRGITPAQMG

SEQ ID NO: 678886 - protein, 36 aa, Mycobacterium
IGAAACLRKTDWLFPQYRELGAFLVRGIPPGHVGAV

SEQ ID NO: 678887 - protein, 24 aa, Mycobacterium
IGAAFALELGRRGSAVVCSDIDEV

SEQ ID NO: 678888 - protein, 20 aa, Mycobacterium
IGAAGRQQGVSYAWGGNKSV

SEQ ID NO: 678889 - protein, 20 aa, Mycobacterium
IGAAGRRRAATMYKLTAENT

SEQ ID NO: 678890 - protein, 24 aa, Mycobacterium
IGAALRIGDRFDLARMLSDAARTI

SEQ ID NO: 678891 - protein, 24 aa, Mycobacterium
IGAALRIGDRFDLARMLSDAARTV

SEQ ID NO: 678892 - protein, 17 aa, Mycobacterium
IGAALVRAACAYAESAG

SEQ ID NO: 678893 - protein, 24 aa, Mycobacterium
IGAASLDEAVRWAASARAVVVVLR

SEQ ID NO: 678894 - protein, 20 aa, Mycobacterium
IGAAVKAFLTTAVHNGQTGL

SEQ ID NO: 678895 - protein, 18 aa, Mycobacterium
IGACRGFVYAASTMGVTG

SEQ ID NO: 678896 - protein, 18 aa, Mycobacterium
IGACSLAVPVERSSDGRV

SEQ ID NO: 678897 - protein, 22 aa, Mycobacterium
IGADACYKHLPLDRESSSAMPP

SEQ ID NO: 678898 - protein, 18 aa, Mycobacterium
IGADLENIAAALAEAQKA

SEQ ID NO: 678899 - protein, 18 aa, Mycobacterium
IGADLVVIGPEVPLVLGV

SEQ ID NO: 678900 - protein, 18 aa, Mycobacterium
IGADRLPIVDTWWQTETG

SEQ ID NO: 678901 - protein, 21 aa, Mycobacterium
IGADRRPAWASTLVAESAGKL

SEQ ID NO: 678902 - protein, 25 aa, Mycobacterium
IGAECGRLIRPVTLELGGKSAAVIL

SEQ ID NO: 678903 - protein, 22 aa, Mycobacterium
IGAETAELWSLIAELPEGQAGW

SEQ ID NO: 678904 - protein, 26 aa, Mycobacterium
IGAEVARRLAAKGAKLVLTDLNEADL

SEQ ID NO: 678905 - protein, 24 aa, Mycobacterium
IGAFLDDRVNAILGLAEDEQALCL

SEQ ID NO: 678906 - protein, 29 aa, Mycobacterium
IGAGIVRRLAEDGARVVFTYSSSVQQAAD

SEQ ID NO: 678907 - protein, 17 aa, Mycobacterium
IGAGLAIPDRADVIDAT

SEQ ID NO: 678908 - protein, 24 aa, Mycobacterium
IGAGLARHAHRLGMTVVLADIDAD

SEQ ID NO: 678909 - protein, 25 aa, Mycobacterium
IGAGLARYASSLGMTVVLVDIDAGA

SEQ ID NO: 678910 - protein, 18 aa, Mycobacterium
IGAHWNATIGPEIRSGIR

SEQ ID NO: 678911 - protein, 29 aa, Mycobacterium
IGAIEFMVELVLFDWPTHIAQIIQALAQS

SEQ ID NO: 678912 - protein, 17 aa, Mycobacterium
IGAILAVGGVRGALRTT

SEQ ID NO: 678913 - protein, 19 aa, Mycobacterium
IGAIPFVLKQRADIPIVGS

SEQ ID NO: 678914 - protein, 20 aa, Mycobacterium
IGALGDGWLGSFLTPAEART

SEQ ID NO: 678915 - protein, 19 aa, Mycobacterium
IGALGERFERVLVAMTADP

SEQ ID NO: 678916 - protein, 18 aa, Mycobacterium
IGALIANGATMTRVPART

SEQ ID NO: 678917 - protein, 17 aa, Mycobacterium
IGALPLVMSQAAGVHSV

SEQ ID NO: 678918 - protein, 17 aa, Mycobacterium
IGALVTRLHRAEGVDVR

SEQ ID NO: 678919 - protein, 19 aa, Mycobacterium
IGANLARMEIRLMFDEIAD

SEQ ID NO: 678920 - protein, 17 aa, Mycobacterium
IGAPASWAQAVAAQQQS

SEQ ID NO: 678921 - protein, 17 aa, Mycobacterium
IGAPILVVSQFTLYGNT

SEQ ID NO: 678922 - protein, 19 aa, Mycobacterium
IGAPPADATLAWAYTGVVE

SEQ ID NO: 678923 - protein, 35 aa, Mycobacterium
IGAPSFGEALRWGAEVYHSLKSVLKKQGLSTGLGD

SEQ ID NO: 678924 - protein, 39 aa, Mycobacterium
IGAPSFSEALRWGAEVYHALKAVLKKAGLSTGLGDEGGF

SEQ ID NO: 678925 - protein, 19 aa, Mycobacterium
IGAPSVIRKVDRLSCVRYA

SEQ ID NO: 678926 - protein, 22 aa, Mycobacterium
IGAPVLRRVYYSVGGGFVVDED

SEQ ID NO: 678927 - protein, 21 aa, Mycobacterium
IGAPVPGAALFVLDRWLRPVP

SEQ ID NO: 678928 - protein, 26 aa, Mycobacterium
IGAPWLPDLVRRSPWGEMFQSAGQGS

SEQ ID NO: 678929 - protein, 40 aa, Mycobacterium
IGAQAATFHDGFVQALSRAASRYAATEVANVEQNLLGLIN

SEQ ID NO: 678930 - protein, 28 aa, Mycobacterium
IGAQLPSFTWDYCVSDPASSAPNRGPDR

SEQ ID NO: 678931 - protein, 23 aa, Mycobacterium
IGAQRWIAAGVFDPVVRERAGMR

SEQ ID NO: 678932 - protein, 19 aa, Mycobacterium
IGAQSAYPGRQVIALAGDG

SEQ ID NO: 678933 - protein, 18 aa, Mycobacterium
IGAQSAYRGRQVIALAGD

SEQ ID NO: 678934 - protein, 17 aa, Mycobacterium
IGARCLVAAHSLVVGGT

SEQ ID NO: 678935 - protein, 17 aa, Mycobacterium
IGARHGVILASGGFDHD

SEQ ID NO: 678936 - protein, 22 aa, Mycobacterium
IGARLDRLGLRPLRTVETAEYL

SEQ ID NO: 678937 - protein, 23 aa, Mycobacterium
IGASEVLVGVAFPVVALEVMRYA

SEQ ID NO: 678938 - protein, 18 aa, Mycobacterium
IGASGLRQVHELVRQLRG

SEQ ID NO: 678939 - protein, 23 aa, Mycobacterium
IGASLRIGDRFDLARTLSDAART

SEQ ID NO: 678940 - protein, 24 aa, Mycobacterium
IGASSVREAVQWAASARAVVVLMR

SEQ ID NO: 678941 - protein, 20 aa, Mycobacterium
IGASVIEFFQAAELATTPLG

SEQ ID NO: 678942 - protein, 25 aa, Mycobacterium
IGATAERHKDGLLFIAVCGHAGDGD

SEQ ID NO: 678943 - protein, 21 aa, Mycobacterium
IGATDLCEFVEFPTELLQVCG

SEQ ID NO: 678944 - protein, 20 aa, Mycobacterium
IGATGARILATAAYEARRRD

SEQ ID NO: 678945 - protein, 22 aa, Mycobacterium
IGATIAILGARIVPTIPAASLP

SEQ ID NO: 678946 - protein, 28 aa, Mycobacterium
IGATSAQVALAWLLARGDDIVPIPGTTK

SEQ ID NO: 678947 - protein, 18 aa, Mycobacterium
IGAVHLDKGCYRGQETVA

SEQ ID NO: 678948 - protein, 25 aa, Mycobacterium
IGAVLHGRSNWHVVEIGGGNGALWH

SEQ ID NO: 678949 - protein, 24 aa, Mycobacterium
IGAVSKLFCEAGVIALTAFISPYR

SEQ ID NO: 678950 - protein, 22 aa, Mycobacterium
IGAWNFPFALTLGPAVGAIAAG

SEQ ID NO: 678951 - protein, 24 aa, Mycobacterium
IGAWNFPFYLTIGPLVGAVAAGNT

SEQ ID NO: 678952 - protein, 17 aa, Mycobacterium
IGAWPTTAALFVGSTGD

SEQ ID NO: 678953 - protein, 20 aa, Mycobacterium
IGCDSMLYIDGRLCGKPETV

SEQ ID NO: 678954 - protein, 27 aa, Mycobacterium
IGCGPIGLAVICMLKAHGVRTVIASDF

SEQ ID NO: 678955 - protein, 17 aa, Mycobacterium
IGCLKARVVPVNVNHHY

SEQ ID NO: 678956 - protein, 17 aa, Mycobacterium
IGCSFSFEAALLDSGVP

SEQ ID NO: 678957 - protein, 20 aa, Mycobacterium
IGCVGMRACHTNACPAGIAT

SEQ ID NO: 678958 - protein, 24 aa, Mycobacterium
IGDAFRAGFLTGRDAGLSLERSAQ

SEQ ID NO: 678959 - protein, 24 aa, Mycobacterium
IGDAFRAGFLTGRSAGLSLERSAQ

SEQ ID NO: 678960 - protein, 17 aa, Mycobacterium
IGDAGALRSLRPADFAD

SEQ ID NO: 678961 - protein, 24 aa, Mycobacterium
IGDDPRPAALVSERDIVRAVAAGR

SEQ ID NO: 678962 - protein, 18 aa, Mycobacterium
IGDDVTHRELGHGWVQGA

SEQ ID NO: 678963 - protein, 17 aa, Mycobacterium
IGDEAALDEAIDRAFEG

SEQ ID NO: 678964 - protein, 18 aa, Mycobacterium
IGDEFWFVSEFGDRSQYV

SEQ ID NO: 678965 - protein, 23 aa, Mycobacterium
IGDEVRAGSALVHGGGRPGDLRA

SEQ ID NO: 678966 - protein, 18 aa, Mycobacterium
IGDEWRIGEVDGGWQVLS

SEQ ID NO: 678967 - protein, 24 aa, Mycobacterium
IGDGDPRIGMWVASGSGYVTEICA

SEQ ID NO: 678968 - protein, 22 aa, Mycobacterium
IGDGHARYGVLPGAGGVARLVN

SEQ ID NO: 678969 - protein, 21 aa, Mycobacterium
IGDGSFQYSIQAIWTAAQHKL

SEQ ID NO: 678970 - protein, 18 aa, Mycobacterium
IGDHARTAAIIIGDGVSP

SEQ ID NO: 678971 - protein, 18 aa, Mycobacterium
IGDLFGGLFGQRAQPRAS

SEQ ID NO: 678972 - protein, 21 aa, Mycobacterium
IGDLFGGLFGRGAGARPSRPR

SEQ ID NO: 678973 - protein, 21 aa, Mycobacterium
IGDLFGGLFGRGAGGRPSRPR

SEQ ID NO: 678974 - protein, 22 aa, Mycobacterium
IGDLFGGLFGRGAQQPRPSRPR

SEQ ID NO: 678975 - protein, 23 aa, Mycobacterium
IGDLLRARGLRRMSSRIQVLAVL

SEQ ID NO: 678976 - protein, 18 aa, Mycobacterium
IGDLRVKLGPVYLDAAVK

SEQ ID NO: 678977 - protein, 26 aa, Mycobacterium
IGDMAARIAHHLGHRVIGVDLVGERL

SEQ ID NO: 678978 - protein, 25 aa, Mycobacterium
IGDMAARIAHHLGYEVFAVDRIPER

SEQ ID NO: 678979 - protein, 26 aa, Mycobacterium
IGDPLLVVRINFLGTRQFTEALVDRI

SEQ ID NO: 678980 - protein, 23 aa, Mycobacterium
IGDPLLVVTINFLGLRQLTEALL

SEQ ID NO: 678981 - protein, 18 aa, Mycobacterium
IGDQWRLSQVLAQQSNTA

SEQ ID NO: 678982 - protein, 19 aa, Mycobacterium
IGDRLGLAAAGVRRHLDAL

SEQ ID NO: 678983 - protein, 18 aa, Mycobacterium
IGDRLGLSAAGVRRHLDA

SEQ ID NO: 678984 - protein, 24 aa, Mycobacterium
IGDRLRLSLDAELSSAVTGEPGPL

SEQ ID NO: 678985 - protein, 18 aa, Mycobacterium
IGDRTGALKAWFDVHTES

SEQ ID NO: 678986 - protein, 26 aa, Mycobacterium
IGDRVDELLDLVGLEPAQYAERYPRQ

SEQ ID NO: 678987 - protein, 24 aa, Mycobacterium
IGDSRFYAVSSWTAVNEAVARCAD

SEQ ID NO: 678988 - protein, 25 aa, Mycobacterium
IGDSTRSTGLFGFIVDWANDPNVLG

SEQ ID NO: 678989 - protein, 27 aa, Mycobacterium
IGDTALRKHFNWVRSWYDFAVPDIGRS

SEQ ID NO: 678990 - protein, 19 aa, Mycobacterium
IGDVLPLTPLQQGLLYYAG

SEQ ID NO: 678991 - protein, 34 aa, Mycobacterium; identical to SEQ ID NO: 81089

SEQ ID NO: 678992 - protein, 34 aa, Mycobacterium
IGEACRRARRKGIKVAHAHLRYLSPLPANLGDVL

SEQ ID NO: 678993 - protein, 27 aa, Mycobacterium
IGEACRRARRKGIKVAHAQVRHLNPFP

SEQ ID NO: 678994 - protein, 28 aa, Mycobacterium
IGEACRRARRKGIKVAQAHLRHLNPFPA

SEQ ID NO: 678995 - protein, 32 aa, Mycobacterium
IGEACRRARRKGLKVAHAHLRHLNPFPQNLGE

SEQ ID NO: 678996 - protein, 29 aa, Mycobacterium
IGEACRRARRKGVKVAHAHLRHLNPFPAN

SEQ ID NO: 678997 - protein, 34 aa, Mycobacterium; identical to SEQ ID NO: 201139

SEQ ID NO: 678998 - protein, 20 aa, Mycobacterium
IGEAGTPVWHQLTTRDHRAA

SEQ ID NO: 678999 - protein, 26 aa, Mycobacterium
IGEALLAGLLRAGRQVKDLVVAEKSP

SEQ ID NO: 679000 - protein, 21 aa, Mycobacterium
IGEANWRFHQAIHRAAHSPRL

SEQ ID NO: 679001 - protein, 18 aa, Mycobacterium
IGECPTVGVGGLVLGGGF

SEQ ID NO: 679002 - protein, 18 aa, Mycobacterium
IGEETGFRSHLGRRLPTV

SEQ ID NO: 679003 - protein, 24 aa, Mycobacterium
IGEGITCVLQRTGSYGCSGPIPAA

SEQ ID NO: 679004 - protein, 18 aa, Mycobacterium
IGEIAIRGHNVMKGYWNR

SEQ ID NO: 679005 - protein, 17 aa, Mycobacterium
IGEICRYLLNQPRKVTD

SEQ ID NO: 679006 - protein, 24 aa, Mycobacterium
IGEIFGILSCGGRLVIPRPGGLTD

SEQ ID NO: 679007 - protein, 17 aa, Mycobacterium
IGEKGWFGLNWPREYGG

SEQ ID NO: 679008 - protein, 23 aa, Mycobacterium
IGELDAIGLYIAVIASGSIALSI

SEQ ID NO: 679009 - protein, 18 aa, Mycobacterium
IGELGVQVLRAVKATLDP

SEQ ID NO: 679010 - protein, 21 aa, Mycobacterium
IGELLYWIGEDKILFASDYAL

SEQ ID NO: 679011 - protein, 24 aa, Mycobacterium
IGELMGGPVARWAEETDRNPPRLQ

SEQ ID NO: 679012 - protein, 18 aa, Mycobacterium
IGELRFEVIHLRGHTPGS

SEQ ID NO: 679013 - protein, 23 aa, Mycobacterium
IGELRWRAPEPPASWHDVFDATR

SEQ ID NO: 679014 - protein, 19 aa, Mycobacterium
IGEMGKKLNAQRVHSLTRG

SEQ ID NO: 679015 - protein, 18 aa, Mycobacterium
IGEPGRDAPKLAGDRAAR

SEQ ID NO: 679016 - protein, 30 aa, Mycobacterium
IGEPLAALVQPDLKVLVNLGYGDPNYGYST

SEQ ID NO: 679017 - protein, 18 aa, Mycobacterium
IGERCIVAGRVLDGGGRP

SEQ ID NO: 679018 - protein, 24 aa, Mycobacterium
IGERSSHTWFVLTYLLGKPGVRNY

SEQ ID NO: 679019 - protein, 22 aa, Mycobacterium
IGERVAEGFAVCIEIVNHPLLR

SEQ ID NO: 679020 - protein, 24 aa, Mycobacterium
IGESAFYAVCGWDAVQEAVNRVDD

SEQ ID NO: 679021 - protein, 19 aa, Mycobacterium
IGEVARWRTRAEDIVTSTA

SEQ ID NO: 679022 - protein, 21 aa, Mycobacterium
IGEVIKTQFGRVIAAQEPLLR

SEQ ID NO: 679023 - protein, 18 aa, Mycobacterium
IGEYPAATLAGVFDLDTA

SEQ ID NO: 679024 - protein, 17 aa, Mycobacterium
IGFADLVGFTRLGEALP

SEQ ID NO: 679025 - protein, 18 aa, Mycobacterium
IGFEPLQWVRALAAEDAV

SEQ ID NO: 679026 - protein, 18 aa, Mycobacterium
IGFEPLQWVRALAAEDPV

SEQ ID NO: 679027 - protein, 18 aa, Mycobacterium
IGFEPLQWVRALAAEEPV

SEQ ID NO: 679028 - protein, 18 aa, Mycobacterium
IGFFATRTRFGLCFRDLA

SEQ ID NO: 679029 - protein, 34 aa, Mycobacterium
IGFFLCPVVPELFFRSGIGVKLVGAFERIGQSST

SEQ ID NO: 679030 - protein, 17 aa, Mycobacterium
IGFGRRWVLSAWGRAGA

SEQ ID NO: 679031 - protein, 19 aa, Mycobacterium
IGFRGWLAAAEGWGLVNPL

SEQ ID NO: 679032 - protein, 17 aa, Mycobacterium
IGFRGWVAAADGWGLAT

SEQ ID NO: 679033 - protein, 18 aa, Mycobacterium
IGFRGWVAAAEGWGLAGE

SEQ ID NO: 679034 - protein, 18 aa, Mycobacterium
IGFRRVFISERWDLKEAD

SEQ ID NO: 679035 - protein, 18 aa, Mycobacterium
IGFVLALTPRRNLTADAA

SEQ ID NO: 679036 - protein, 19 aa, Mycobacterium
IGFYSSFMVADKVELLTRK

SEQ ID NO: 679037 - protein, 24 aa, Mycobacterium
IGGAALPSVISWALQEHILGANPA

SEQ ID NO: 679038 - protein, 27 aa, Mycobacterium
IGGAAYPRPGLRGKFYDARARPLVEVV

SEQ ID NO: 679039 - protein, 28 aa, Mycobacterium
IGGAGGFLYGLGGNGGIGGHGGDGGAAI

SEQ ID NO: 679040 - protein, 30 aa, Mycobacterium
IGGAGGRGGNAGLLFSDAGVGGFGGFGGTG

SEQ ID NO: 679041 - protein, 26 aa, Mycobacterium
IGGAGVRGGAMGMGGMGMAPMGGAHG

SEQ ID NO: 679042 - protein, 18 aa, Mycobacterium
IGGARRCAAQSWDIDRVE

SEQ ID NO: 679043 - protein, 25 aa, Mycobacterium
IGGARRCAAQSWSLQRIKDVKNAAG

SEQ ID NO: 679044 - protein, 18 aa, Mycobacterium
IGGAVEFLTIAAAAQTTV

SEQ ID NO: 679045 - protein, 17 aa, Mycobacterium
IGGCGGAGIAVSDDGGE

SEQ ID NO: 679046 - protein, 17 aa, Mycobacterium
IGGDFAGIVTQLGEGVT

SEQ ID NO: 679047 - protein, 17 aa, Mycobacterium
IGGDGFRIVLSADIATI

SEQ ID NO: 679048 - protein, 29 aa, Mycobacterium
IGGDGSRGDTPLGPFNVDGHSGGDGGRGG

SEQ ID NO: 679049 - protein, 18 aa, Mycobacterium
IGGDRLHFELVRELLDIE

SEQ ID NO: 679050 - protein, 17 aa, Mycobacterium
IGGEGRVAEPLRAALAK

SEQ ID NO: 679051 - protein, 18 aa, Mycobacterium
IGGEIRRLTSLSEDELYV

SEQ ID NO: 679052 - protein, 24 aa, Mycobacterium
IGGEVLFRAGVQATFEFFEADKAT

SEQ ID NO: 679053 - protein, 19 aa, Mycobacterium
IGGFANDFGGAGGQGGQGA

SEQ ID NO: 679054 - protein, 18 aa, Mycobacterium
IGGFGDGGFWVVTKHHDV

SEQ ID NO: 679055 - protein, 28 aa, Mycobacterium
IGGFRAFGRDEVTGWLRAQGWTDIDQTV

SEQ ID NO: 679056 - protein, 24 aa, Mycobacterium
IGGGEIYRLFLPLAQRCEVTVVEA

SEQ ID NO: 679057 - protein, 19 aa, Mycobacterium
IGGGFGNKVPIYPGYVCAI

SEQ ID NO: 679058 - protein, 31 aa, Mycobacterium
IGGGGGYGGTGFDAAGAMGGIGGTGGTGGNP

SEQ ID NO: 679059 - protein, 19 aa, Mycobacterium
IGGGGRYDGLMAQLGGQSL

SEQ ID NO: 679060 - protein, 20 aa, Mycobacterium
IGGGGRYDGLMAQLGGRDLS

SEQ ID NO: 679061 - protein, 19 aa, Mycobacterium
IGGGGRYDGLMKQLGGQDL

SEQ ID NO: 679062 - protein, 19 aa, Mycobacterium
IGGGGRYDGLMRQLGGQDV

SEQ ID NO: 679063 - protein, 19 aa, Mycobacterium
IGGGGRYDGLMRQLGGQNL

SEQ ID NO: 679064 - protein, 18 aa, Mycobacterium
IGGGLCLALAADIRVAST

SEQ ID NO: 679065 - protein, 19 aa, Mycobacterium
IGGGLSLLVSDGVYRGAYL

SEQ ID NO: 679066 - protein, 17 aa, Mycobacterium
IGGHQFGLLAGVVASIE

SEQ ID NO: 679067 - protein, 17 aa, Mycobacterium
IGGHQHAAWSYVDAWTE

SEQ ID NO: 679068 - protein, 19 aa, Mycobacterium
IGGICAALGAAYGGAIGVT

SEQ ID NO: 679069 - protein, 19 aa, Mycobacterium
IGGICAALGAAYGGALGVT

SEQ ID NO: 679070 - protein, 25 aa, Mycobacterium
IGGIPPRQGRMPLGHEPAGEVVEVG

SEQ ID NO: 679071 - protein, 17 aa, Mycobacterium
IGGLFFGLIPGYLSAAS

SEQ ID NO: 679072 - protein, 17 aa, Mycobacterium
IGGLFLGLVPGYLSAAS

SEQ ID NO: 679073 - protein, 24 aa, Mycobacterium
IGGMPAPPPLTWAVNEMIFCANPS

SEQ ID NO: 679074 - protein, 23 aa, Mycobacterium
IGGPAARLARDFITSVETLEYGE

SEQ ID NO: 679075 - protein, 18 aa, Mycobacterium
IGGPGGFAVAASGNGGQG

SEQ ID NO: 679076 - protein, 29 aa, Mycobacterium
IGGPTVFNHFPWGWTHAGNTPFRRWKRET

SEQ ID NO: 679077 - protein, 26 aa, Mycobacterium
IGGPVKRDAALCLAALRVGADPQGVA

SEQ ID NO: 679078 - protein, 26 aa, Mycobacterium
IGGPVKRDAALCLATLRVGADPHDVP

SEQ ID NO: 679079 - protein, 25 aa, Mycobacterium
IGGPVKRDAALCLAVLRVGADPDGV

SEQ ID NO: 679080 - protein, 20 aa, Mycobacterium
IGGQGIRLSSYLPTRTFELA

SEQ ID NO: 679081 - protein, 17 aa, Mycobacterium
IGGQYSIEDGAGGSGKG

SEQ ID NO: 679082 - protein, 17 aa, Mycobacterium
IGGRMMGTLGITAPNDT

SEQ ID NO: 679083 - protein, 18 aa, Mycobacterium
IGGRSGERQVVFSASGRT

SEQ ID NO: 679084 - protein, 18 aa, Mycobacterium
IGGRSIAVPTWYYGNEPM

SEQ ID NO: 679085 - protein, 17 aa, Mycobacterium
IGGSDAGISAALRIREL

SEQ ID NO: 679086 - protein, 24 aa, Mycobacterium
IGGSEFYAVCGWDAVQEAVERVED

SEQ ID NO: 679087 - protein, 21 aa, Mycobacterium
IGGSFGQYGGVWAHDETRKSF

SEQ ID NO: 679088 - protein, 19 aa, Mycobacterium
IGGSLPAALGADWLVSAWD

SEQ ID NO: 679089 - protein, 24 aa, Mycobacterium
IGGSMGRYGGVWAHDETRKSFAIA

SEQ ID NO: 679090 - protein, 19 aa, Mycobacterium
IGGSVGFLRGFRGSGSAGK

SEQ ID NO: 679091 - protein, 19 aa, Mycobacterium
IGGTARFVADRCRCRVTAV

SEQ ID NO: 679092 - protein, 19 aa, Mycobacterium
IGGTGERGGNSGLFGNGGD

SEQ ID NO: 679093 - protein, 20 aa, Mycobacterium
IGGTGGDGGDSFTPSAKGGN

SEQ ID NO: 679094 - protein, 26 aa, Mycobacterium
IGGTGGGLFGLLGHSGSTGAAGAAGN

SEQ ID NO: 679095 - protein, 21 aa, Mycobacterium
IGGTLFERWAYSEAGQPQSTT

SEQ ID NO: 679096 - protein, 21 aa, Mycobacterium
IGGTLHPEWDVHKRRYRPQWC

SEQ ID NO: 679097 - protein, 21 aa, Mycobacterium
IGGVMAALGFAERELTGTDTY

SEQ ID NO: 679098 - protein, 20 aa, Mycobacterium
IGGWAPQGGVGQALSVGGLK

SEQ ID NO: 679099 - protein, 25 aa, Mycobacterium
IGGYMRVLLKPGGLAQLPMDRINFR

SEQ ID NO: 679100 - protein, 19 aa, Mycobacterium
IGHAKIRRLLIDFVGHNAT

SEQ ID NO: 679101 - protein, 20 aa, Mycobacterium
IGHGIAMLFRDAGAQVTVTG

SEQ ID NO: 679102 - protein, 24 aa, Mycobacterium
IGHGIYQPGWKWSVHVGPTTGRAS

SEQ ID NO: 679103 - protein, 19 aa, Mycobacterium
IGHLDRPFEVMLAHPDDVQ

SEQ ID NO: 679104 - protein, 23 aa, Mycobacterium
IGHLEAAAGIAGFIKAALAVQHA

SEQ ID NO: 679105 - protein, 18 aa, Mycobacterium
IGHLSARLATLGPAATLA

SEQ ID NO: 679106 - protein, 23 aa, Mycobacterium
IGHPFWFSRRLFGELTQLHGDKG

SEQ ID NO: 679107 - protein, 17 aa, Mycobacterium
IGHRTVLEHFGYTTEEQ

SEQ ID NO: 679108 - protein, 20 aa, Mycobacterium
IGHVPGAVKIDWHVDLNDST

SEQ ID NO: 679109 - protein, 23 aa, Mycobacterium
IGHWTCPVPTFLEPLDQARIDLL

SEQ ID NO: 679110 - protein, 24 aa, Mycobacterium
IGIAAGKEFFAWDQLTGENPGRGI

SEQ ID NO: 679111 - protein, 24 aa, Mycobacterium
IGIAEPDTALGIRHVAWVKERGLP

SEQ ID NO: 679112 - protein, 17 aa, Mycobacterium
IGIAGGEQKCRWLVEEL

SEQ ID NO: 679113 - protein, 17 aa, Mycobacterium
IGIAGLLLLAGHETTSN

SEQ ID NO: 679114 - protein, 17 aa, Mycobacterium
IGIELTPEQVWTQFHSY

SEQ ID NO: 679115 - protein, 25 aa, Mycobacterium
IGIGLLVDGRWRWRSYSLTSSPAKT

SEQ ID NO: 679116 - protein, 25 aa, Mycobacterium
IGIGLLVDGRWRWRSYSLTSSPVGG

SEQ ID NO: 679117 - protein, 25 aa, Mycobacterium
IGIGLLVDGRWRWRSYSLTSSPVGT

SEQ ID NO: 679118 - protein, 17 aa, Mycobacterium
IGIGNSLITSWRALGWI

SEQ ID NO: 679119 - protein, 19 aa, Mycobacterium
IGIIAARLGAYFDEPDGSP

SEQ ID NO: 679120 - protein, 20 aa, Mycobacterium
IGILPNHIPLVAQLVDDAMV

SEQ ID NO: 679121 - protein, 22 aa, Mycobacterium
IGILPRHIPLVAQLVDDAMVRV

SEQ ID NO: 679122 - protein, 20 aa, Mycobacterium
IGIMPRHIPLVAQLVDDAMV

SEQ ID NO: 679123 - protein, 17 aa, Mycobacterium
IGIPGERKALIERKYSL

SEQ ID NO: 679124 - protein, 24 aa, Mycobacterium
IGIPLERLTGISSRRVVAPGEFSI

SEQ ID NO: 679125 - protein, 18 aa, Mycobacterium
IGIRSELHLSLQHTPAFL

SEQ ID NO: 679126 - protein, 23 aa, Mycobacterium
IGISRIGRRTGIPGLDLTMEAVR

SEQ ID NO: 679127 - protein, 24 aa, Mycobacterium
IGISRIGRRTGIPGLELTMEAVRG

SEQ ID NO: 679128 - protein, 19 aa, Mycobacterium
IGIVPYSPLGRGWLTGRVQ

SEQ ID NO: 679129 - protein, 28 aa, Mycobacterium
IGIYPDGRFSYQLTIYIFRYGEGTAMAI

SEQ ID NO: 679130 - protein, 18 aa, Mycobacterium
IGKAAPVGLFVDTFGTAT

SEQ ID NO: 679131 - protein, 20 aa, Mycobacterium
IGKACGRKLAELGYDVVLAA

SEQ ID NO: 679132 - protein, 17 aa, Mycobacterium
IGKAIGMLMALNDLTEA

SEQ ID NO: 679133 - protein, 19 aa, Mycobacterium
IGKAQARLEAARPYAFQIT

SEQ ID NO: 679134 - protein, 18 aa, Mycobacterium
IGKDIIRFHAVYWPAFLM

SEQ ID NO: 679135 - protein, 23 aa, Mycobacterium
IGKEVDLRFVFGYTPLEFRDTLH

SEQ ID NO: 679136 - protein, 20 aa, Mycobacterium
IGKGCARKLVERGYDVVLSA

SEQ ID NO: 679137 - protein, 19 aa, Mycobacterium
IGKHFSVNVMLDRDTVRRR

SEQ ID NO: 679138 - protein, 20 aa, Mycobacterium
IGKRAARFAYDVGRTAGKDP

SEQ ID NO: 679139 - protein, 17 aa, Mycobacterium
IGKRCLLGANAGLGISL

SEQ ID NO: 679140 - protein, 18 aa, Mycobacterium
IGKRCLLGANAGLGISLG

SEQ ID NO: 679141 - protein, 25 aa, Mycobacterium
IGKYNARCGRTFVLPTEQGAYDACI

SEQ ID NO: 679142 - protein, 20 aa, Mycobacterium
IGLAAVLRERGHTIVFAAES

SEQ ID NO: 679143 - protein, 19 aa, Mycobacterium
IGLACRFPAAPGPGEFWQV

SEQ ID NO: 679144 - protein, 18 aa, Mycobacterium
IGLAERWPAELSLAEHMA

SEQ ID NO: 679145 - protein, 21 aa, Mycobacterium
IGLAICERYLRNAPARIVLAC

SEQ ID NO: 679146 - protein, 22 aa, Mycobacterium
IGLAICERYLRNASARIVLAVM

SEQ ID NO: 679147 - protein, 17 aa, Mycobacterium
IGLAKRLEEVWVPGEPD

SEQ ID NO: 679148 - protein, 17 aa, Mycobacterium
IGLAKRLEEVWVPSEPD

SEQ ID NO: 679149 - protein, 26 aa, Mycobacterium
IGLALNCEITPWGRFARKNYFYPDQP

SEQ ID NO: 679150 - protein, 18 aa, Mycobacterium
IGLDGEWMRDIADDMLSS

SEQ ID NO: 679151 - protein, 24 aa, Mycobacterium
IGLDLFKTKWEDVGDAIKNLDLPS

SEQ ID NO: 679152 - protein, 24 aa, Mycobacterium
IGLELALACDFIWSAENVSMGLVE

SEQ ID NO: 679153 - protein, 19 aa, Mycobacterium
IGLELPESALREFDASDVA

SEQ ID NO: 679154 - protein, 26 aa, Mycobacterium
IGLEMAEGLTARGIKVTQIEALPEVL

SEQ ID NO: 679155 - protein, 19 aa, Mycobacterium
IGLESTYLAAARFGRFEHD

SEQ ID NO: 679156 - protein, 24 aa, Mycobacterium
IGLGDAVGVLAGFPVEIAPTAQGL

SEQ ID NO: 679157 - protein, 18 aa, Mycobacterium
IGLGRGYRWLQLIDAAGL

SEQ ID NO: 679158 - protein, 21 aa, Mycobacterium
IGLGRYIPRIARIAAATDLNI

SEQ ID NO: 679159 - protein, 20 aa, Mycobacterium
IGLHARPAAIISEAAVEAGV

SEQ ID NO: 679160 - protein, 21 aa, Mycobacterium
IGLLAKFMPNFLFAPNSELPV

SEQ ID NO: 679161 - protein, 19 aa, Mycobacterium
IGLLGDWDSTQAFQTLGDP

SEQ ID NO: 679162 - protein, 21 aa, Mycobacterium
IGLLGKFMPNFLFAPNDALPS

SEQ ID NO: 679163 - protein, 20 aa, Mycobacterium
IGLLGKFMPNYLFAPDAALP

SEQ ID NO: 679164 - protein, 18 aa, Mycobacterium
IGLLLPCNVLVRADPDRP

SEQ ID NO: 679165 - protein, 18 aa, Mycobacterium
IGLLLPCNVLVRADPGEP

SEQ ID NO: 679166 - protein, 19 aa, Mycobacterium
IGLLPRLEGTVHINIGLLA

SEQ ID NO: 679167 - protein, 19 aa, Mycobacterium
IGLLPRLEGTVHINIGLLG

SEQ ID NO: 679168 - protein, 17 aa, Mycobacterium
IGLLRPERGSIVIDGTD

SEQ ID NO: 679169 - protein, 33 aa, Mycobacterium
IGLLTMRLGRDWPHGDPRPALADPERVLSPHFH

SEQ ID NO: 679170 - protein, 24 aa, Mycobacterium
IGLQRPQGILALGRHVFVVDSGAK

SEQ ID NO: 679171 - protein, 17 aa, Mycobacterium
IGLRAAAALPELDHACG

SEQ ID NO: 679172 - protein, 26 aa, Mycobacterium
IGLRDRLCELDFEFPLAGGDAAADSF

SEQ ID NO: 679173 - protein, 17 aa, Mycobacterium
IGLRGWIAAADGWGLAG

SEQ ID NO: 679174 - protein, 17 aa, Mycobacterium
IGLRLKSSDTLYCCLPL

SEQ ID NO: 679175 - protein, 18 aa, Mycobacterium
IGLSCRFPGAADPEAFWH

SEQ ID NO: 679176 - protein, 17 aa, Mycobacterium
IGLSEGGTGWIPYFLER

SEQ ID NO: 679177 - protein, 23 aa, Mycobacterium
IGLSGDGKIGFGSLNSGSGNIGL

SEQ ID NO: 679178 - protein, 24 aa, Mycobacterium
IGLSGDGLRGFGALNTGSGNVGLF

SEQ ID NO: 679179 - protein, 22 aa, Mycobacterium
IGLSLAEGFVLAGARVVVASRK

SEQ ID NO: 679180 - protein, 25 aa, Mycobacterium
IGLSLPEYICMRILRTYPGMSNSEL

SEQ ID NO: 679181 - protein, 24 aa, Mycobacterium
IGLSRPSLDDVFLMLTGHRTDDTE

SEQ ID NO: 679182 - protein, 20 aa, Mycobacterium
IGLTLPFGEVMLTPEVREVI

SEQ ID NO: 679183 - protein, 19 aa, Mycobacterium
IGLTLPPQRTYFFDAESGD

SEQ ID NO: 679184 - protein, 18 aa, Mycobacterium
IGLTRARMEILPISIGFP

SEQ ID NO: 679185 - protein, 25 aa, Mycobacterium
IGLTYPAVFGFLRIVTNARILTEPL

SEQ ID NO: 679186 - protein, 17 aa, Mycobacterium
IGMANNFIQMSKTLGLL

SEQ ID NO: 679187 - protein, 32 aa, Mycobacterium
IGMGVARDIGFRMPTLWFADGHSTSAPVYLYR

SEQ ID NO: 679188 - protein, 28 aa, Mycobacterium
IGMGVARKQPRVIGLVVEMLTRRRIFVP

SEQ ID NO: 679189 - protein, 18 aa, Mycobacterium
IGMLKRKAERKITDSALK

SEQ ID NO: 679190 - protein, 22 aa, Mycobacterium
IGMPFLRRRKSTLIDGAAADAA

SEQ ID NO: 679191 - protein, 17 aa, Mycobacterium
IGMQKAKEMAFFGEKLS

SEQ ID NO: 679192 - protein, 32 aa, Mycobacterium
IGMSGARIALHAALELARRGSGYAVAALCGAG

SEQ ID NO: 679193 - protein, 24 aa, Mycobacterium
IGMSTELMAAWSSRRLAIEARTAE

SEQ ID NO: 679194 - protein, 17 aa, Mycobacterium
IGMTFLDQRVREVADGT

SEQ ID NO: 679195 - protein, 17 aa, Mycobacterium
IGMTIPYAAMEVLKLRL

SEQ ID NO: 679196 - protein, 17 aa, Mycobacterium
IGMTWEYPAHLYLKRAK

SEQ ID NO: 679197 - protein, 19 aa, Mycobacterium
IGMTWEYPAHLYLKRAKSD

SEQ ID NO: 679198 - protein, 18 aa, Mycobacterium
IGNAALFFATDEAAYITG

SEQ ID NO: 679199 - protein, 19 aa, Mycobacterium
IGNAALFFATDEAAYVTGQ

SEQ ID NO: 679200 - protein, 18 aa, Mycobacterium
IGNAMSIVAEQTGGIETE

SEQ ID NO: 679201 - protein, 26 aa, Mycobacterium
IGNDAMWLRFCAAIDLPDLASDPDLA

SEQ ID NO: 679202 - protein, 30 aa, Mycobacterium
IGNEQQRHWAGLMIERAWGATMVLTEPDAG

SEQ ID NO: 679203 - protein, 21 aa, Mycobacterium
IGNGDGRLRVSAMVGTNPHCD

SEQ ID NO: 679204 - protein, 31 aa, Mycobacterium
IGNGDSAPPGWGWVAPYIGMIWPNGDSGKLR

SEQ ID NO: 679205 - protein, 17 aa, Mycobacterium
IGNIGFGNTGSYNIGFG

SEQ ID NO: 679206 - protein, 18 aa, Mycobacterium
IGNLMLVRRRPFDPRKRD

SEQ ID NO: 679207 - protein, 24 aa, Mycobacterium
IGNLVPSSAGFYWMTAPAEAGQFL

SEQ ID NO: 679208 - protein, 18 aa, Mycobacterium
IGNMVPITVVARLIGFRD

SEQ ID NO: 679209 - protein, 18 aa, Mycobacterium
IGNPALVVTINFLGLRHF

SEQ ID NO: 679210 - protein, 19 aa, Mycobacterium
IGNPAPFGFEAPDVIMRDI

SEQ ID NO: 679211 - protein, 19 aa, Mycobacterium
IGNPAPFGFEAPDVIMRDM

SEQ ID NO: 679212 - protein, 17 aa, Mycobacterium
IGNRIVPIIPDEARTFG

SEQ ID NO: 679213 - protein, 21 aa, Mycobacterium
IGNRIVPIIPDEARTFGMDSW

SEQ ID NO: 679214 - protein, 18 aa, Mycobacterium
IGNSGAYGTGLFNSGQAN

SEQ ID NO: 679215 - protein, 17 aa, Mycobacterium
IGNSGFRNTGIGNSGAG

SEQ ID NO: 679216 - protein, 23 aa, Mycobacterium
IGNTEWPKWETVMAPDPVDPGEL

SEQ ID NO: 679217 - protein, 31 aa, Mycobacterium
IGNTWDCLVHVYLRRALISAELWPVALKEID

SEQ ID NO: 679218 - protein, 23 aa, Mycobacterium
IGNTWDCLVHVYLRRALTSTELW

SEQ ID NO: 679219 - protein, 24 aa, Mycobacterium
IGNTWECLAHVYLRRALTSTELWP

SEQ ID NO: 679220 - protein, 25 aa, Mycobacterium
IGNTWECVAHVYLRRALTSTELWPV

SEQ ID NO: 679221 - protein, 22 aa, Mycobacterium
IGNWGCFCIVASITAASRTKQI

SEQ ID NO: 679222 - protein, 19 aa, Mycobacterium
IGNWHGWSRQRIVNAVDAA

SEQ ID NO: 679223 - protein, 18 aa, Mycobacterium
IGPALAVRAEHVLKRRGV

SEQ ID NO: 679224 - protein, 26 aa, Mycobacterium
IGPANRWARHLGQLTCARQRDMSVDL

SEQ ID NO: 679225 - protein, 25 aa, Mycobacterium
IGPANRWARRLGELTCTQTRDMSVN

SEQ ID NO: 679226 - protein, 18 aa, Mycobacterium
IGPARSALPLGQKYIDST

SEQ ID NO: 679227 - protein, 24 aa, Mycobacterium
IGPDMDGFFAAWRQAVLPELRGET

SEQ ID NO: 679228 - protein, 20 aa, Mycobacterium
IGPDRVGLRISPGNSAGDMR

SEQ ID NO: 679229 - protein, 19 aa, Mycobacterium
IGPDTRFGLHPDKVLAELK

SEQ ID NO: 679230 - protein, 24 aa, Mycobacterium
IGPEHEPRIALRADMDALPMAERT

SEQ ID NO: 679231 - protein, 17 aa, Mycobacterium
IGPELVRPGDHILVSGN

SEQ ID NO: 679232 - protein, 17 aa, Mycobacterium
IGPFASGVLSGFNSGIF

SEQ ID NO: 679233 - protein, 24 aa, Mycobacterium
IGPFFRRGLMLLDFEEHMFHRRIM

SEQ ID NO: 679234 - protein, 20 aa, Mycobacterium
IGPGDRWILEQIRSVAPGTT

SEQ ID NO: 679235 - protein, 26 aa, Mycobacterium
IGPGDRWIYQQIRAVAPRTTLIGIVT

SEQ ID NO: 679236 - protein, 18 aa, Mycobacterium
IGPGKAQYTLCCTEDGGV

SEQ ID NO: 679237 - protein, 18 aa, Mycobacterium
IGPGPGIFSVHIASRLPS

SEQ ID NO: 679238 - protein, 21 aa, Mycobacterium
IGPHRRFAFASVPLADVKAVK

SEQ ID NO: 679239 - protein, 18 aa, Mycobacterium
IGPHTDFGTVTILDREPG

SEQ ID NO: 679240 - protein, 18 aa, Mycobacterium
IGPHTDFGTVTVLDREPG

SEQ ID NO: 679241 - protein, 17 aa, Mycobacterium
IGPILQIPGIRGALRST

SEQ ID NO: 679242 - protein, 26 aa, Mycobacterium
IGPKAKLAAFGMKWGYKAQLDKLDKL

SEQ ID NO: 679243 - protein, 24 aa, Mycobacterium
IGPKPPVVVGVDFAGVVEAVGPGV

SEQ ID NO: 679244 - protein, 24 aa, Mycobacterium
IGPKTIRSAAAWAAGLAGTTLDLD

SEQ ID NO: 679245 - protein, 24 aa, Mycobacterium
IGPKTIRSAAAWADGLAGTTLDLD

SEQ ID NO: 679246 - protein, 25 aa, Mycobacterium
IGPKTLRSAAAWADGLAGTTLDLDV

SEQ ID NO: 679247 - protein, 25 aa, Mycobacterium
IGPKTLRSAAPWADGLAGTTLDLDA

SEQ ID NO: 679248 - protein, 18 aa, Mycobacterium
IGPLNRYQFAGGTVLSVN

SEQ ID NO: 679249 - protein, 24 aa, Mycobacterium
IGPRPAMLRLMHPIVARLAAVSGE

SEQ ID NO: 679250 - protein, 22 aa, Mycobacterium
IGPRTRMRWEQVADWDYVCEQL

SEQ ID NO: 679251 - protein, 20 aa, Mycobacterium
IGPSEFLGITIPQFNFPAPA

SEQ ID NO: 679252 - protein, 17 aa, Mycobacterium
IGPSRTRLIGGRAQEVL

SEQ ID NO: 679253 - protein, 23 aa, Mycobacterium
IGPTLRAAWTGAVLGQANASAER

SEQ ID NO: 679254 - protein, 17 aa, Mycobacterium
IGPVAAFLASRRNSYMT

SEQ ID NO: 679255 - protein, 22 aa, Mycobacterium
IGPVCPVFLALSVSDAAEDVIA

SEQ ID NO: 679256 - protein, 24 aa, Mycobacterium
IGPVVATPIMRWLHSVDGPVEQFN

SEQ ID NO: 679257 - protein, 23 aa, Mycobacterium
IGPVVATPIMRWLQNMDGPVEQF

SEQ ID NO: 679258 - protein, 21 aa, Mycobacterium
IGPVVATPIMRWLQQVDGPTD

SEQ ID NO: 679259 - protein, 21 aa, Mycobacterium
IGPVVATPIMRWLQTIDGPID

SEQ ID NO: 679260 - protein, 22 aa, Mycobacterium
IGPVVATPIMRWLQTVDGPIDD

SEQ ID NO: 679261 - protein, 20 aa, Mycobacterium
IGQACVLRILAEGAQVVAAD

SEQ ID NO: 679262 - protein, 22 aa, Mycobacterium
IGQCFTGGFALAAAVDDAVLAP

SEQ ID NO: 679263 - protein, 18 aa, Mycobacterium
IGQFPEWDQVFNREITAG

SEQ ID NO: 679264 - protein, 20 aa, Mycobacterium
IGQISIRLAEAISVDEYVDD

SEQ ID NO: 679265 - protein, 25 aa, Mycobacterium
IGQLGRLAHRPVLRARVRVTEHRDP

SEQ ID NO: 679266 - protein, 19 aa, Mycobacterium
IGQLLPCNVVVRSDPAGDA

SEQ ID NO: 679267 - protein, 18 aa, Mycobacterium
IGQPEWLSMFTVHRRLAQ

SEQ ID NO: 679268 - protein, 17 aa, Mycobacterium
IGQPGGPGGLLYGNGGR

SEQ ID NO: 679269 - protein, 17 aa, Mycobacterium
IGQPVIRKESRAKVTGA

SEQ ID NO: 679270 - protein, 24 aa, Mycobacterium
IGQPWWDGKVIEFHRTSRDLALIR

SEQ ID NO: 679271 - protein, 17 aa, Mycobacterium
IGQQLGDLVARLHRNEG

SEQ ID NO: 679272 - protein, 22 aa, Mycobacterium
IGQSRYRWEFQLRPGERTEDFN

SEQ ID NO: 679273 - protein, 21 aa, Mycobacterium
IGQTIAEVFARDGASVVAIDV

SEQ ID NO: 679274 - protein, 21 aa, Mycobacterium
IGRAAVRLDVSRLVVVGTGRS

SEQ ID NO: 679275 - protein, 21 aa, Mycobacterium
IGRAIARRLAAEGATVAVTAR

SEQ ID NO: 679276 - protein, 18 aa, Mycobacterium
IGRALPATLIFDHPTPAA

SEQ ID NO: 679277 - protein, 25 aa, Mycobacterium
IGRARRPSLSELLGQVPGHRGRQIR

SEQ ID NO: 679278 - protein, 24 aa, Mycobacterium
IGRATALEFARLGAEIVVSDIDEA

SEQ ID NO: 679279 - protein, 22 aa, Mycobacterium
IGRAVAPVPFLSSAVLATVALL

SEQ ID NO: 679280 - protein, 22 aa, Mycobacterium
IGRAVAPVPFLSSAVLSTVALL

SEQ ID NO: 679281 - protein, 25 aa, Mycobacterium
IGRDRFVLSCGHSSLTLYLQLYLGG

SEQ ID NO: 679282 - protein, 22 aa, Mycobacterium
IGRELECGVLEFPDGRLEASTV

SEQ ID NO: 679283 - protein, 28 aa, Mycobacterium
IGRELVEVPVGFKWFVDGLIGGTIGFGG

SEQ ID NO: 679284 - protein, 17 aa, Mycobacterium
IGRFSKPYVALMDGIVM

SEQ ID NO: 679285 - protein, 27 aa, Mycobacterium
IGRGDVVALLLPRSGRAIIAILAALKV

SEQ ID NO: 679286 - protein, 23 aa, Mycobacterium
IGRGQHPSLCLLATRMPENSKAG

SEQ ID NO: 679287 - protein, 26 aa, Mycobacterium
IGRGRLIAATSMHEFVSRAGADVVRV

SEQ ID NO: 679288 - protein, 25 aa, Mycobacterium
IGRGVTVGRPLGLLLTRRSENATVT

SEQ ID NO: 679289 - protein, 38 aa, Mycobacterium
IGRGYPAPRPKFRWCTERLKIKPSNTFIRDMVTTHGEA

SEQ ID NO: 679290 - protein, 17 aa, Mycobacterium
IGRHGRGSFLDRFPLDD

SEQ ID NO: 679291 - protein, 18 aa, Mycobacterium
IGRIGWTSRDVWWAATQD

SEQ ID NO: 679292 - protein, 22 aa, Mycobacterium
IGRIKDLLIVDGRNHYPDDIEA

SEQ ID NO: 679293 - protein, 20 aa, Mycobacterium
IGRIRAMRLALLADRLTATD

SEQ ID NO: 679294 - protein, 22 aa, Mycobacterium
IGRKKIPINVCVGPPIEASGSP

SEQ ID NO: 679295 - protein, 23 aa, Mycobacterium
IGRKRELAVATDLLADVAAGETR

SEQ ID NO: 679296 - protein, 26 aa, Mycobacterium
IGRLDRRGRMLWSLPKGHIELGETAE

SEQ ID NO: 679297 - protein, 17 aa, Mycobacterium
IGRLRWQFDRIARGVPL

SEQ ID NO: 679298 - protein, 35 aa, Mycobacterium
IGRMSSVPPSIWGGMAAARFKGVVDRWHAESTRLY

SEQ ID NO: 679299 - protein, 19 aa, Mycobacterium
IGRNFYRALLAQREQGTAD

SEQ ID NO: 679300 - protein, 20 aa, Mycobacterium
IGRPDAWEVQGRGELALAIL

SEQ ID NO: 679301 - protein, 23 aa, Mycobacterium
IGRPEELTGLYLYLASEASSYMT

SEQ ID NO: 679302 - protein, 24 aa, Mycobacterium
IGRPRLKTSLLAAADMKSTPGGMW

SEQ ID NO: 679303 - protein, 18 aa, Mycobacterium
IGRQCLNAGLGFGGGCLP

SEQ ID NO: 679304 - protein, 18 aa, Mycobacterium
IGRRARAAQLLRSVMTRH

SEQ ID NO: 679305 - protein, 20 aa, Mycobacterium
IGRRHWRRVAGHGLKLTGTH

SEQ ID NO: 679306 - protein, 17 aa, Mycobacterium
IGRRLAKALGVGFLDTD

SEQ ID NO: 679307 - protein, 17 aa, Mycobacterium
IGRRLAKALGVGLLDTD

SEQ ID NO: 679308 - protein, 18 aa, Mycobacterium
IGRRLLDELLTFADGGVV

SEQ ID NO: 679309 - protein, 17 aa, Mycobacterium
IGRRLRRVSNKGGVAKT

SEQ ID NO: 679310 - protein, 26 aa, Mycobacterium
IGRSGAKAVLVEKGFLGMDFTAPAGI

SEQ ID NO: 679311 - protein, 19 aa, Mycobacterium
IGRSGGIFISHAQVQRSLT

SEQ ID NO: 679312 - protein, 36 aa, Mycobacterium
IGRTVANRAKLNWWESRALYGWTVLVPRTKDQAGEM

SEQ ID NO: 679313 - protein, 23 aa, Mycobacterium
IGRVALDILGPVPLEPVRVRAWI

SEQ ID NO: 679314 - protein, 19 aa, Mycobacterium
IGRVIPAIHLQYMPLSHVY

SEQ ID NO: 679315 - protein, 25 aa, Mycobacterium
IGRVPRPDGKLVHAALRINGFTVML

SEQ ID NO: 679316 - protein, 37 aa, Mycobacterium
IGRVVAGRSKLNWWESRALYGWTVLVPRTKDQAGEMS

SEQ ID NO: 679317 - protein, 24 aa, Mycobacterium
IGRYLRYRRYPTRLCVVDPENSAF

SEQ ID NO: 679318 - protein, 18 aa, Mycobacterium
IGSAAWILASRPDIQEHL

SEQ ID NO: 679319 - protein, 18 aa, Mycobacterium
IGSAISEANSAAVAQTTA

SEQ ID NO: 679320 - protein, 20 aa, Mycobacterium
IGSALATAAWGWHAETGLHV

SEQ ID NO: 679321 - protein, 26 aa, Mycobacterium
IGSALPRTALFVLDPWLRPVPTGVAG

SEQ ID NO: 679322 - protein, 17 aa, Mycobacterium
IGSCAYAVLAQESVRCR

SEQ ID NO: 679323 - protein, 17 aa, Mycobacterium
IGSCRDTAWLLVSILRQ

SEQ ID NO: 679324 - protein, 21 aa, Mycobacterium
IGSDAWDRLFSGPKPAELHPF

SEQ ID NO: 679325 - protein, 32 aa, Mycobacterium
IGSDAWDRLFSGPRPAELHRFIELNGPRHNAP

SEQ ID NO: 679326 - protein, 19 aa, Mycobacterium
IGSDLGWSREVWSQLADTG

SEQ ID NO: 679327 - protein, 22 aa, Mycobacterium
IGSEFFRRLAPLHGDPVTAVIE

SEQ ID NO: 679328 - protein, 17 aa, Mycobacterium
IGSEGVFGVITKVRLRV

SEQ ID NO: 679329 - protein, 21 aa, Mycobacterium
IGSELRQLVTLEQRFTTQWIA

SEQ ID NO: 679330 - protein, 21 aa, Mycobacterium
IGSFAGAPVSPAWVHNLRANP

SEQ ID NO: 679331 - protein, 24 aa, Mycobacterium
IGSFAGSPVSPAWVHNLRANPQAR

SEQ ID NO: 679332 - protein, 20 aa, Mycobacterium
IGSGIPVDWQLMNLAVLNEG

SEQ ID NO: 679333 - protein, 24 aa, Mycobacterium
IGSGPRPPAGAAHHILWVDSDDPM

SEQ ID NO: 679334 - protein, 19 aa, Mycobacterium
IGSHLARLMSAVMVKAVLD

SEQ ID NO: 679335 - protein, 20 aa, Mycobacterium
IGSILGWAVTRLHACSFGGR

SEQ ID NO: 679336 - protein, 25 aa, Mycobacterium
IGSKCPECGTYVFPPRANNCPNPGC

SEQ ID NO: 679337 - protein, 18 aa, Mycobacterium
IGSLDLIRILPASRRHLG

SEQ ID NO: 679338 - protein, 17 aa, Mycobacterium
IGSLRAGLDADLVVLDR

SEQ ID NO: 679339 - protein, 17 aa, Mycobacterium
IGSLSPPGGLELGDADP

SEQ ID NO: 679340 - protein, 19 aa, Mycobacterium
IGSMLFRVAAEPGLKDRLL

SEQ ID NO: 679341 - protein, 26 aa, Mycobacterium
IGSMSKSFWGGMRVGWIRADRTTIAR

SEQ ID NO: 679342 - protein, 24 aa, Mycobacterium
IGSNLRPGNVWQNIEIPRLMENLN

SEQ ID NO: 679343 - protein, 25 aa, Mycobacterium
IGSNVARTVFKSMLTAVLDRMPDYH

SEQ ID NO: 679344 - protein, 17 aa, Mycobacterium
IGSPASWNSAVEAQQQS

SEQ ID NO: 679345 - protein, 18 aa, Mycobacterium
IGSPASWSGAVAAQQESG

SEQ ID NO: 679346 - protein, 17 aa, Mycobacterium
IGSPASWSSAVEAQQQS

SEQ ID NO: 679347 - protein, 17 aa, Mycobacterium
IGSPASWTSAVEAQQQS

SEQ ID NO: 679348 - protein, 20 aa, Mycobacterium
IGSPIAGAAMFVLDKWLQPV

SEQ ID NO: 679349 - protein, 25 aa, Mycobacterium
IGSPKGEGLLAVFGYPQAHEDDARR

SEQ ID NO: 679350 - protein, 17 aa, Mycobacterium
IGSPVRGGATFVLDGWL

SEQ ID NO: 679351 - protein, 19 aa, Mycobacterium
IGSRAFVKERLAAYREAGV

SEQ ID NO: 679352 - protein, 20 aa, Mycobacterium
IGSRKRPYLQMSREDTDIAV

SEQ ID NO: 679353 - protein, 28 aa, Mycobacterium
IGSYRGADLLGMRYLPPFAYFMDSPNAF

SEQ ID NO: 679354 - protein, 19 aa, Mycobacterium
IGTAASWLGTALALKPLLQ

SEQ ID NO: 679355 - protein, 24 aa, Mycobacterium
IGTARWDFRRYLLGTADLHLGYAV

SEQ ID NO: 679356 - protein, 17 aa, Mycobacterium
IGTASAWGGNPEKDALY

SEQ ID NO: 679357 - protein, 19 aa, Mycobacterium
IGTCLGSPVSMDYRERAPF

SEQ ID NO: 679358 - protein, 21 aa, Mycobacterium
IGTDATHAWAAVWTPQQPGQF

SEQ ID NO: 679359 - protein, 19 aa, Mycobacterium
IGTDLGWSREVWSQLADTG

SEQ ID NO: 679360 - protein, 31 aa, Mycobacterium
IGTDLMIKVIRRSRILSMGAMVGIDPTSDGL

SEQ ID NO: 679361 - protein, 17 aa, Mycobacterium
IGTDWLRSYLALPNYAN

SEQ ID NO: 679362 - protein, 20 aa, Mycobacterium
IGTEAARYRPNIVITTPPDY

SEQ ID NO: 679363 - protein, 18 aa, Mycobacterium
IGTEIFPGGQLPAQGDIF

SEQ ID NO: 679364 - protein, 20 aa, Mycobacterium
IGTEIFPGGRLPSVPMVDKH

SEQ ID NO: 679365 - protein, 18 aa, Mycobacterium
IGTFLRRNPHLMAIQTAI

SEQ ID NO: 679366 - protein, 24 aa, Mycobacterium
IGTFNISRIAAWHMSKNEPVDDEA

SEQ ID NO: 679367 - protein, 19 aa, Mycobacterium
IGTGALAFGDGNTVNASSI

SEQ ID NO: 679368 - protein, 21 aa, Mycobacterium
IGTGCPEYAKQNPSGPGSVAG

SEQ ID NO: 679369 - protein, 19 aa, Mycobacterium
IGTGLGWRQLDVVEQTGST

SEQ ID NO: 679370 - protein, 24 aa, Mycobacterium
IGTGMPAPTMPGGGLSPTTAGQGI

SEQ ID NO: 679371 - protein, 17 aa, Mycobacterium
IGTGRLRLDVELAAVKQ

SEQ ID NO: 679372 - protein, 18 aa, Mycobacterium
IGTMIKQLLEEVRAAPLD

SEQ ID NO: 679373 - protein, 18 aa, Mycobacterium
IGTNVMRGIAQVAPGAAG

SEQ ID NO: 679374 - protein, 19 aa, Mycobacterium
IGTPESWHAALGPYRATIR

SEQ ID NO: 679375 - protein, 20 aa, Mycobacterium
IGTPESWRAALGPYRATIRN

SEQ ID NO: 679376 - protein, 21 aa, Mycobacterium
IGTPESWRAALGTYRATLRNT

SEQ ID NO: 679377 - protein, 24 aa, Mycobacterium
IGTPFLKDRILTGAINGDITIALG

SEQ ID NO: 679378 - protein, 17 aa, Mycobacterium
IGTPIPGAALFVLDSWL

SEQ ID NO: 679379 - protein, 17 aa, Mycobacterium
IGTRFVYEGQIIDVVQL

SEQ ID NO: 679380 - protein, 18 aa, Mycobacterium
IGTRGLVSPEFLRTETGL

SEQ ID NO: 679381 - protein, 25 aa, Mycobacterium
IGTSAGRYGGIWAIDETRKAAGIAT

SEQ ID NO: 679382 - protein, 19 aa, Mycobacterium
IGTTCCFATQDKVWVTAPD

SEQ ID NO: 679383 - protein, 17 aa, Mycobacterium
IGTVAGRDDMVREGKAQ

SEQ ID NO: 679384 - protein, 19 aa, Mycobacterium
IGTVEAWTTPFTREGRPEK

SEQ ID NO: 679385 - protein, 20 aa, Mycobacterium
IGTYCGKSTLLLGAAAQQCS

SEQ ID NO: 679386 - protein, 17 aa, Mycobacterium
IGVAATGAYCYSMSSRY

SEQ ID NO: 679387 - protein, 18 aa, Mycobacterium
IGVALSAMKINAVVEGRP

SEQ ID NO: 679388 - protein, 17 aa, Mycobacterium
IGVAPAIISLTLLPKLS

SEQ ID NO: 679389 - protein, 33 aa, Mycobacterium
IGVCAGIVPWNFPLLLAVWKLGPALAAGNTIVL

SEQ ID NO: 679390 - protein, 17 aa, Mycobacterium
IGVCVLIAPWNYPLLQM

SEQ ID NO: 679391 - protein, 17 aa, Mycobacterium
IGVDGVIERVLERVGDH

SEQ ID NO: 679392 - protein, 18 aa, Mycobacterium
IGVDLENIAAALAEVQRS

SEQ ID NO: 679393 - protein, 17 aa, Mycobacterium
IGVDRVILRGGFERHSP

SEQ ID NO: 679394 - protein, 19 aa, Mycobacterium
IGVDVNRFRRRVFVYARDW

SEQ ID NO: 679395 - protein, 20 aa, Mycobacterium
IGVEIHRRIASAIGPGAEPT

SEQ ID NO: 679396 - protein, 25 aa, Mycobacterium
IGVFEVNEAFAPVPLAWQAETGADP

SEQ ID NO: 679397 - protein, 20 aa, Mycobacterium
IGVGCAESAMLRETARRLGV

SEQ ID NO: 679398 - protein, 21 aa, Mycobacterium
IGVGGMGRVIARRQGIGKALL

SEQ ID NO: 679399 - protein, 17 aa, Mycobacterium
IGVGPGRDQTIVRRDIL

SEQ ID NO: 679400 - protein, 17 aa, Mycobacterium
IGVGVGWQREEYEAAGA

SEQ ID NO: 679401 - protein, 18 aa, Mycobacterium
IGVIALRTGDFEVVVYPH

SEQ ID NO: 679402 - protein, 20 aa, Mycobacterium
IGVIPTRYYVNMNVKDRPGV

SEQ ID NO: 679403 - protein, 22 aa, Mycobacterium
IGVLILLWPTPRQFDAAELDMF

SEQ ID NO: 679404 - protein, 18 aa, Mycobacterium
IGVLPSFTRRGIATELIR

SEQ ID NO: 679405 - protein, 17 aa, Mycobacterium
IGVLRAVLFAPEDLALV

SEQ ID NO: 679406 - protein, 22 aa, Mycobacterium
IGVLTLLWPTPRQFDASELEMF

SEQ ID NO: 679407 - protein, 19 aa, Mycobacterium
IGVLYGRRDVLAAMPPFLT

SEQ ID NO: 679408 - protein, 17 aa, Mycobacterium
IGVPACVAAADLAVTGI

SEQ ID NO: 679409 - protein, 17 aa, Mycobacterium
IGVPACVGAAGRAVEAL

SEQ ID NO: 679410 - protein, 20 aa, Mycobacterium
IGVPEPLKLAGSPEQKRKFL

SEQ ID NO: 679411 - protein, 19 aa, Mycobacterium
IGVPGERLAATVKRFNGFA

SEQ ID NO: 679412 - protein, 17 aa, Mycobacterium
IGVPVPDAALFVLDRWM

SEQ ID NO: 679413 - protein, 17 aa, Mycobacterium
IGVRRPLSRLGMGLHRR

SEQ ID NO: 679414 - protein, 27 aa, Mycobacterium
IGVSGVDGAAGIGGRAGAGGAGGALGA

SEQ ID NO: 679415 - protein, 17 aa, Mycobacterium
IGVSPVYDGYPPPGPPL

SEQ ID NO: 679416 - protein, 17 aa, Mycobacterium
IGVSRLVAVIAEQHHDE

SEQ ID NO: 679417 - protein, 17 aa, Mycobacterium
IGVSRLVAVIAEQHHDN

SEQ ID NO: 679418 - protein, 18 aa, Mycobacterium
IGVSRLVAVIAEQQHDQL

SEQ ID NO: 679419 - protein, 17 aa, Mycobacterium
IGVSRLVAVVAEQHHDE

SEQ ID NO: 679420 - protein, 17 aa, Mycobacterium
IGVSRLVAVVAEQQHDE

SEQ ID NO: 679421 - protein, 19 aa, Mycobacterium
IGVTELRRQFGRILGEVTQ

SEQ ID NO: 679422 - protein, 17 aa, Mycobacterium
IGVVGLLNVQYALKDDI

SEQ ID NO: 679423 - protein, 19 aa, Mycobacterium
IGVYRCDYPGLAAIMPTAL

SEQ ID NO: 679424 - protein, 21 aa, Mycobacterium
IGVYRCDYPGLAAVMPTALAE

SEQ ID NO: 679425 - protein, 22 aa, Mycobacterium
IGWFSRLAVRLARQQMFSQVGA

SEQ ID NO: 679426 - protein, 22 aa, Mycobacterium
IGWGSVEWTNLVTLYLRAYESR

SEQ ID NO: 679427 - protein, 19 aa, Mycobacterium
IGWIRAERSTLATIATLRP

SEQ ID NO: 679428 - protein, 25 aa, Mycobacterium
IGWLAQRGYVPLGYKGDAAKTAATF

SEQ ID NO: 679429 - protein, 22 aa, Mycobacterium
IGWSRARLAQRFRSQVGLTPKA

SEQ ID NO: 679430 - protein, 23 aa, Mycobacterium
IGYCLGRRWWGLGLMSEALGVLL

SEQ ID NO: 679431 - protein, 18 aa, Mycobacterium
IGYLMDFRLPEGFPTTYF

SEQ ID NO: 679432 - protein, 17 aa, Mycobacterium
IGYMKGLNSGQVCLAPD

SEQ ID NO: 679433 - protein, 23 aa, Mycobacterium
IGYPNTWRDYSALVIERDDLYGN

SEQ ID NO: 679434 - protein, 21 aa, Mycobacterium
IGYSCAGTVEFLLDQRGEYVF

SEQ ID NO: 679435 - protein, 27 aa, Mycobacterium
IGYSSDGGMSWALPRVVGKARAADILL

SEQ ID NO: 679436 - protein, 22 aa, Mycobacterium
IGYTCAGTVEFLLDQSGEYVFI

SEQ ID NO: 679437 - protein, 21 aa, Mycobacterium
IGYTGAGTVEFLADDDGEFYF

SEQ ID NO: 679438 - protein, 25 aa, Mycobacterium
IHAALRINGFLVMLNDDFPETCGGK

SEQ ID NO: 679439 - protein, 24 aa, Mycobacterium
IHAALRPGGTFLMVDIKSSSRLEN

SEQ ID NO: 679440 - protein, 23 aa, Mycobacterium
IHAARAIRSRLRQWLSEIGADSS

SEQ ID NO: 679441 - protein, 18 aa, Mycobacterium
IHAECAGLTYLVDELDGH

SEQ ID NO: 679442 - protein, 23 aa, Mycobacterium
IHAEELFDWLAHTTVAEIRELAS

SEQ ID NO: 679443 - protein, 17 aa, Mycobacterium
IHAEFGVRLNVRAVFDT

SEQ ID NO: 679444 - protein, 17 aa, Mycobacterium
IHAEFPDQMLAYNLSPS

SEQ ID NO: 679445 - protein, 18 aa, Mycobacterium
IHAEFRRVHVGAIRLVIQ

SEQ ID NO: 679446 - protein, 20 aa, Mycobacterium
IHAFMADKMVDGFASLDEVA

SEQ ID NO: 679447 - protein, 22 aa, Mycobacterium
IHAGCVWINDHIPIISEMPHGG

SEQ ID NO: 679448 - protein, 17 aa, Mycobacterium
IHAGDWVEPALLELLSA

SEQ ID NO: 679449 - protein, 24 aa, Mycobacterium
IHALKERYSRISVHDKGKRFNSDL

SEQ ID NO: 679450 - protein, 23 aa, Mycobacterium
IHALKERYSRITVHDKGKRYNSD

SEQ ID NO: 679451 - protein, 18 aa, Mycobacterium
IHAPVILPGSRFTPFLTV

SEQ ID NO: 679452 - protein, 20 aa, Mycobacterium
IHASLIEWHAGTGQHRAPDP

SEQ ID NO: 679453 - protein, 25 aa, Mycobacterium
IHATWRINELLNWQVAAAGEDINVA

SEQ ID NO: 679454 - protein, 25 aa, Mycobacterium
IHATWRINELLNWQVAAAGENINVA

SEQ ID NO: 679455 - protein, 17 aa, Mycobacterium
IHAVERFLGDTAREKQW

SEQ ID NO: 679456 - protein, 17 aa, Mycobacterium
IHAVNCHFGELGPARAF

SEQ ID NO: 679457 - protein, 17 aa, Mycobacterium
IHCAMDVPFGFYACSIA

SEQ ID NO: 679458 - protein, 18 aa, Mycobacterium
IHDGRITSLYAIANPDKL

SEQ ID NO: 679459 - protein, 28 aa, Mycobacterium
IHDRMPLMLSEGDWDAWLNPDAPLDPAL

SEQ ID NO: 679460 - protein, 29 aa, Mycobacterium
IHDRMPLTISEPDWDRWLDPDAPIDEGLL

SEQ ID NO: 679461 - protein, 27 aa, Mycobacterium
IHDRMPLVMPERDWDRWLDPDAPIDEK

SEQ ID NO: 679462 - protein, 27 aa, Mycobacterium
IHDRMPLVVPEGEWDRWLDPDGPIDQA

SEQ ID NO: 679463 - protein, 17 aa, Mycobacterium
IHDYCSAIHPMAVGSPV

SEQ ID NO: 679464 - protein, 30 aa, Mycobacterium
IHDYLWRWDTDWFWCSRAFGAQHPVIRRFW

SEQ ID NO: 679465 - protein, 30 aa, Mycobacterium
IHDYLWRWDTDWFWCSRAFGAQNPGIRRLW

SEQ ID NO: 679466 - protein, 21 aa, Mycobacterium
IHEIIGRMLPLVLLEGRAWDV

SEQ ID NO: 679467 - protein, 18 aa, Mycobacterium
IHEKRFEVAAGDFLLFPT

SEQ ID NO: 679468 - protein, 17 aa, Mycobacterium
IHELFKPPMAKLAIAAK

SEQ ID NO: 679469 - protein, 26 aa, Mycobacterium
IHESAKRICKEAGYYGAGTVEYLVGQ

SEQ ID NO: 679470 - protein, 24 aa, Mycobacterium
IHEVLGFASWTAYLADALGGQLEV

SEQ ID NO: 679471 - protein, 17 aa, Mycobacterium
IHFAVAILRDPGGPVPA

SEQ ID NO: 679472 - protein, 17 aa, Mycobacterium
IHFGGGYGGSPDWLHGT

SEQ ID NO: 679473 - protein, 21 aa, Mycobacterium
IHFKERSASGFGLRHSLTNGP

SEQ ID NO: 679474 - protein, 17 aa, Mycobacterium
IHFQQWWVQHRAQVPTH

SEQ ID NO: 679475 - protein, 18 aa, Mycobacterium
IHGADPWWDIAIRMLIKY

SEQ ID NO: 679476 - protein, 17 aa, Mycobacterium
IHGDFRMGNLIVDGSDL

SEQ ID NO: 679477 - protein, 17 aa, Mycobacterium
IHGGIGFTWEHPAHLYL

SEQ ID NO: 679478 - protein, 17 aa, Mycobacterium
IHGIIAYPVTPFSGDGI

SEQ ID NO: 679479 - protein, 17 aa, Mycobacterium
IHGIKAFVPILLEQGEG

SEQ ID NO: 679480 - protein, 25 aa, Mycobacterium
IHGPVPRLRETGVITRARQFLMRLQ

SEQ ID NO: 679481 - protein, 18 aa, Mycobacterium
IHGVNLSLGCDWIPRYYA

SEQ ID NO: 679482 - protein, 19 aa, Mycobacterium
IHGVQICQHHCPVAHVAEE

SEQ ID NO: 679483 - protein, 20 aa, Mycobacterium
IHGVQICQHHCPVSHVAEEF

SEQ ID NO: 679484 - protein, 17 aa, Mycobacterium
IHHCIADGIATAQMLAK

SEQ ID NO: 679485 - protein, 17 aa, Mycobacterium
IHHCMADGIAATHMLAG

SEQ ID NO: 679486 - protein, 30 aa, Mycobacterium
IHHLPVRRDGRFLVALGMGGMGYSFGAGIG

SEQ ID NO: 679487 - protein, 19 aa, Mycobacterium
IHHNWKAAVVAARETDTVL

SEQ ID NO: 679488 - protein, 21 aa, Mycobacterium
IHIPGVVAPAVKDYKAASRTT

SEQ ID NO: 679489 - protein, 17 aa, Mycobacterium
IHKIWSSYSGFTFPILS

SEQ ID NO: 679490 - protein, 18 aa, Mycobacterium
IHKRCTEFWHSLKGNEPP

SEQ ID NO: 679491 - protein, 17 aa, Mycobacterium
IHLACQSLRMGDSDLAI

SEQ ID NO: 679492 - protein, 17 aa, Mycobacterium
IHLATLYHDDVMDEAQK

SEQ ID NO: 679493 - protein, 33 aa, Mycobacterium; identical to SEQ ID NO: 98739

SEQ ID NO: 679494 - protein, 18 aa, Mycobacterium
IHLDRKKVSVPRVPGETL

SEQ ID NO: 679495 - protein, 18 aa, Mycobacterium
IHLLRNVMILAGAGVGGG

SEQ ID NO: 679496 - protein, 31 aa, Mycobacterium
IHLMIPFVRTRWELEECLALVDASPLRRHRN

SEQ ID NO: 679497 - protein, 27 aa, Mycobacterium
IHLNLRFTDLFQWPKVFGGGGVFSSIP

SEQ ID NO: 679498 - protein, 24 aa, Mycobacterium
IHLRDRLLWALLWDTGIRIGEALG

SEQ ID NO: 679499 - protein, 19 aa, Mycobacterium
IHLRGHTPGSIALALDGAA

SEQ ID NO: 679500 - protein, 26 aa, Mycobacterium
IHLSRIGFDGLLRVCDELIGMTKEQR

SEQ ID NO: 679501 - protein, 17 aa, Mycobacterium
IHLTVPHVDDWFGRAVD

SEQ ID NO: 679502 - protein, 18 aa, Mycobacterium
IHLVRGMLGRPGCGLLQM

SEQ ID NO: 679503 - protein, 24 aa, Mycobacterium
IHMPQMMLAKAWLVAARGSDRGAV

SEQ ID NO: 679504 - protein, 18 aa, Mycobacterium
IHNMCAWMVDSFGTEEQR

SEQ ID NO: 679505 - protein, 19 aa, Mycobacterium
IHNPRWISRFSDMTRQADR

SEQ ID NO: 679506 - protein, 17 aa, Mycobacterium
IHPCMADGISAAQLLTG

SEQ ID NO: 679507 - protein, 23 aa, Mycobacterium
IHPDGFLTYRVMGGKPHAFRPPF

SEQ ID NO: 679508 - protein, 28 aa, Mycobacterium
IHPDLVWDFRLPRVVSINVSGHKYGLTY

SEQ ID NO: 679509 - protein, 23 aa, Mycobacterium
IHPKDGGGVLIELVEPASDGSGS

SEQ ID NO: 679510 - protein, 22 aa, Mycobacterium
IHPPSLEPRWFAWVDNMHDWCI

SEQ ID NO: 679511 - protein, 22 aa, Mycobacterium
IHPRVRREIVAGDEIADARLRE

SEQ ID NO: 679512 - protein, 25 aa, Mycobacterium
IHQACQSLRGGECSMALAGGVTAMA

SEQ ID NO: 679513 - protein, 25 aa, Mycobacterium
IHQACQSLRGGECSMALAGGVTVMA

SEQ ID NO: 679514 - protein, 20 aa, Mycobacterium
IHQAMEFLPWANRFATGDLK

SEQ ID NO: 679515 - protein, 20 aa, Mycobacterium
IHQAMEFLPWANRVQLGDPV

SEQ ID NO: 679516 - protein, 17 aa, Mycobacterium
IHQFLAWAVHRGYAHDV

SEQ ID NO: 679517 - protein, 19 aa, Mycobacterium
IHQTREWILRNSPVPVGTV

SEQ ID NO: 679518 - protein, 24 aa, Mycobacterium
IHRALRPGGVFLMVDIKASTHVEN

SEQ ID NO: 679519 - protein, 24 aa, Mycobacterium
IHRALRPGGVLLMADIKASSRLED

SEQ ID NO: 679520 - protein, 24 aa, Mycobacterium
IHRALRPGGVLLMVDIKASSRLEE

SEQ ID NO: 679521 - protein, 24 aa, Mycobacterium
IHRARLRCPSDLAVMGVDASPMGM

SEQ ID NO: 679522 - protein, 25 aa, Mycobacterium
IHRAVRPHLTFSMGTHFCLGSALAR

SEQ ID NO: 679523 - protein, 17 aa, Mycobacterium
IHRAWRSKLPETLEKGT

SEQ ID NO: 679524 - protein, 17 aa, Mycobacterium
IHRCPERELSPCPATQS

SEQ ID NO: 679525 - protein, 18 aa, Mycobacterium
IHRDRLAKLVAGAFGLGR

SEQ ID NO: 679526 - protein, 17 aa, Mycobacterium
IHRDRRLSVATSDRREG

SEQ ID NO: 679527 - protein, 22 aa, Mycobacterium
IHRILLQRSWLSIFRGAFDEAT

SEQ ID NO: 679528 - protein, 28 aa, Mycobacterium
IHRLLRLSRHVPWDLWELDLLVRTTHLG

SEQ ID NO: 679529 - protein, 17 aa, Mycobacterium
IHRLLWVLAPEKLAGIA

SEQ ID NO: 679530 - protein, 31 aa, Mycobacterium
IHRLPLAIMRLRRIRRRTARFFGTYDAVLTP

SEQ ID NO: 679531 - protein, 19 aa, Mycobacterium
IHRPARPHLTFSVGAHFCL

SEQ ID NO: 679532 - protein, 17 aa, Mycobacterium
IHRPRYDDWSLPKGKLD

SEQ ID NO: 679533 - protein, 17 aa, Mycobacterium
IHRPRYDDWSLPKGKVD

SEQ ID NO: 679534 - protein, 18 aa, Mycobacterium
IHRPRYDDWSLPKGKVDP

SEQ ID NO: 679535 - protein, 24 aa, Mycobacterium
IHRYPDKIAICRTLSQAFTFAGGK

SEQ ID NO: 679536 - protein, 18 aa, Mycobacterium
IHSACAAAGFTPSVVYET

SEQ ID NO: 679537 - protein, 21 aa, Mycobacterium
IHSEAPPFLVIHGTGDSVIPV

SEQ ID NO: 679538 - protein, 25 aa, Mycobacterium
IHSEVFTPALADLVRRGVVTGRHKA

SEQ ID NO: 679539 - protein, 27 aa, Mycobacterium
IHSFVRRHVSAMPDWRADEWGLPVNQT

SEQ ID NO: 679540 - protein, 17 aa, Mycobacterium
IHSGHWDPMMAACAETG

SEQ ID NO: 679541 - protein, 25 aa, Mycobacterium
IHSHLKMDGAWVIGRVRVPTYKIRI

SEQ ID NO: 679542 - protein, 19 aa, Mycobacterium
IHSMPYWDSIFNEIAAEYP

SEQ ID NO: 679543 - protein, 17 aa, Mycobacterium
IHSVGKCEANSVAPTGG

SEQ ID NO: 679544 - protein, 17 aa, Mycobacterium
IHSYATWQVLRRLRVTA

SEQ ID NO: 679545 - protein, 17 aa, Mycobacterium
IHTAARRGLFRSNPERI

SEQ ID NO: 679546 - protein, 18 aa, Mycobacterium
IHTARSVVRPSLDPVQVA

SEQ ID NO: 679547 - protein, 32 aa, Mycobacterium
IHTERLPLLEPLRFIPVVGNPLADLLQPDLTT

SEQ ID NO: 679548 - protein, 24 aa, Mycobacterium
IHTEVYHAGSLVQRGCAIGPVEEL

SEQ ID NO: 679549 - protein, 19 aa, Mycobacterium
IHTIIDCSEGGVLIPGGVD

SEQ ID NO: 679550 - protein, 19 aa, Mycobacterium
IHTPGRTGVWTRYLEEIEK

SEQ ID NO: 679551 - protein, 18 aa, Mycobacterium
IHTRRIGLMEARGQTRNQ

SEQ ID NO: 679552 - protein, 21 aa, Mycobacterium
IHTVCMRGGIMSAVLEAIAEE

SEQ ID NO: 679553 - protein, 25 aa, Mycobacterium
IHVFDPRTPYVVFWVIDPETGERVP

SEQ ID NO: 679554 - protein, 24 aa, Mycobacterium
IHVFPTRSLRDFGFANVDRNPSPE

SEQ ID NO: 679555 - protein, 19 aa, Mycobacterium
IHVGGGYGGDSDWLHGMWK

SEQ ID NO: 679556 - protein, 19 aa, Mycobacterium
IHVGGGYGGDSDWLHGVWK

SEQ ID NO: 679557 - protein, 19 aa, Mycobacterium
IHVRIGDQTNTHFLQAVLD

SEQ ID NO: 679558 - protein, 27 aa, Mycobacterium
IHVSNWLRPWLPSLLALSANSRVYRNA

SEQ ID NO: 679559 - protein, 21 aa, Mycobacterium
IHVVDHFGPQFGVHGVAALPA

SEQ ID NO: 679560 - protein, 25 aa, Mycobacterium
IHWAVASLRTEQRWLGRIAPQLPVA

SEQ ID NO: 679561 - protein, 19 aa, Mycobacterium
IHWDDEIAKLVGLDTAIAH

SEQ ID NO: 679562 - protein, 17 aa, Mycobacterium
IHYGLECVGIDLQNRAK

SEQ ID NO: 679563 - protein, 19 aa, Mycobacterium
IHYGVKYSNAFWNGSQMAY

SEQ ID NO: 679564 - protein, 17 aa, Mycobacterium
IHYNLTQVFYLFQAAAK

SEQ ID NO: 679565 - protein, 25 aa, Mycobacterium
IHYREGADIGYRWFATTGEVPNFAF

SEQ ID NO: 679566 - protein, 36 aa, Mycobacterium
IIAACPLTWPWNLLGWPSINVPAGFTVDGLPIGVQL

SEQ ID NO: 679567 - protein, 23 aa, Mycobacterium
IIAACPYTWPWNLLGWPAINVPA

SEQ ID NO: 679568 - protein, 20 aa, Mycobacterium
IIAADLRRLLVGEAPLHVLN

SEQ ID NO: 679569 - protein, 18 aa, Mycobacterium
IIAAGGICDGVSMAAAFA

SEQ ID NO: 679570 - protein, 23 aa, Mycobacterium
IIAAPAAGVWKIVGDFGSLPVWF

SEQ ID NO: 679571 - protein, 18 aa, Mycobacterium
IIAASKWVHSELDYMPGT

SEQ ID NO: 679572 - protein, 24 aa, Mycobacterium
IIADHSRTAAILIADGVSPGNDGR

SEQ ID NO: 679573 - protein, 24 aa, Mycobacterium
IIADHSRTAAILIGDGVSPGNDGR

SEQ ID NO: 679574 - protein, 18 aa, Mycobacterium
IIADHTRTAAIIIADGVS

SEQ ID NO: 679575 - protein, 21 aa, Mycobacterium
IIAESLLSFGTEEQKRRWAVP

SEQ ID NO: 679576 - protein, 19 aa, Mycobacterium
IIAGFPQWSSTMEVHEYYT

SEQ ID NO: 679577 - protein, 23 aa, Mycobacterium
IIAGGLPINLLSYIAQLTAAQAL

SEQ ID NO: 679578 - protein, 17 aa, Mycobacterium
IIAILGIDELSEEDKQL

SEQ ID NO: 679579 - protein, 18 aa, Mycobacterium
IIAKIAVPAVRERLTDAI

SEQ ID NO: 679580 - protein, 25 aa, Mycobacterium
IIAPDARGVFYGRLSEMTSTDFQVL

SEQ ID NO: 679581 - protein, 19 aa, Mycobacterium
IIARIACEMGFSESFSYSS

SEQ ID NO: 679582 - protein, 19 aa, Mycobacterium
IIARIACEMGYSESFSYQS

SEQ ID NO: 679583 - protein, 18 aa, Mycobacterium
IIARLAAAGVTWLTIAPS

SEQ ID NO: 679584 - protein, 24 aa, Mycobacterium
IIATAWDCPFDGPTAPQRVIDIVT

SEQ ID NO: 679585 - protein, 24 aa, Mycobacterium
IIATAWDCPFDGPTDPQRVLDIVS

SEQ ID NO: 679586 - protein, 17 aa, Mycobacterium
IIATVVKRGYRLAVDTQ

SEQ ID NO: 679587 - protein, 17 aa, Mycobacterium
IIDAEWVQLNLARVHAK

SEQ ID NO: 679588 - protein, 23 aa, Mycobacterium
IIDDIRAAIAVRHGVTVRDVLLT

SEQ ID NO: 679589 - protein, 18 aa, Mycobacterium
IIDDVIWGCVSQVGDQSS

SEQ ID NO: 679590 - protein, 18 aa, Mycobacterium
IIDDVVWGCVSQVGDQSS

SEQ ID NO: 679591 - protein, 24 aa, Mycobacterium
IIDFAAQLLTGFSPPGATAAVYTL

SEQ ID NO: 679592 - protein, 23 aa, Mycobacterium
IIDIGLPVGCEFLEPTSPQYIAD

SEQ ID NO: 679593 - protein, 24 aa, Mycobacterium
IIDIGLPVGCEFLEPTSPQYIADA

SEQ ID NO: 679594 - protein, 23 aa, Mycobacterium
IIDLDLLGCFAMTETGHGSDVQS

SEQ ID NO: 679595 - protein, 17 aa, Mycobacterium
IIDPRILLGSLMYIPLL

SEQ ID NO: 679596 - protein, 26 aa, Mycobacterium
IIDQMWKGCREVLAATADRLGTVGGE

SEQ ID NO: 679597 - protein, 19 aa, Mycobacterium
IIDRPGGGTILRWTAPLPD

SEQ ID NO: 679598 - protein, 20 aa, Mycobacterium
IIDRVAPVEMMRFVNSGTEA

SEQ ID NO: 679599 - protein, 19 aa, Mycobacterium
IIDRVAPVERVRLVNSGTE

SEQ ID NO: 679600 - protein, 17 aa, Mycobacterium
IIDRYWGPESSWHELKA

SEQ ID NO: 679601 - protein, 24 aa, Mycobacterium
IIDVGLPVGCEFLEPTSPQYIADA

SEQ ID NO: 679602 - protein, 21 aa, Mycobacterium
IIEAVNLFRAKVVDVSTESLT

SEQ ID NO: 679603 - protein, 20 aa, Mycobacterium
IIEIRPGRGGGLFVADAGPV

SEQ ID NO: 679604 - protein, 24 aa, Mycobacterium
IIELFRGGPDYALYLYRNKGPLIY

SEQ ID NO: 679605 - protein, 28 aa, Mycobacterium
IIEMGGDFGGVWYWNRYPGIQCDNESYC

SEQ ID NO: 679606 - protein, 23 aa, Mycobacterium
IIEPLEDLLGLGLITADVLSPSQ

SEQ ID NO: 679607 - protein, 25 aa, Mycobacterium
IIEQMPLDAGHSWQRDRALSADDIL

SEQ ID NO: 679608 - protein, 26 aa, Mycobacterium
IIEQMPLDAGHSWSRARMVTADEIHA

SEQ ID NO: 679609 - protein, 25 aa, Mycobacterium
IIEQMPLDASHSWQRDNVIDADRIL

SEQ ID NO: 679610 - protein, 25 aa, Mycobacterium
IIERTARRSLVWSIINGLEFTTGPT

SEQ ID NO: 679611 - protein, 19 aa, Mycobacterium
IIERVPPVERVRLVNSGTE

SEQ ID NO: 679612 - protein, 24 aa, Mycobacterium
IIGAEPAGRCEFLTAYAKPFSLLV

SEQ ID NO: 679613 - protein, 17 aa, Mycobacterium
IIGAIAFCQPIVTADLC

SEQ ID NO: 679614 - protein, 18 aa, Mycobacterium
IIGCPLANALAVRGIARY

SEQ ID NO: 679615 - protein, 19 aa, Mycobacterium
IIGDHSRTAAIIIGDGVTP

SEQ ID NO: 679616 - protein, 19 aa, Mycobacterium
IIGELLPEISVPYGVNVLW

SEQ ID NO: 679617 - protein, 18 aa, Mycobacterium
IIGERAFDGAPGLRLALA

SEQ ID NO: 679618 - protein, 18 aa, Mycobacterium
IIGFIRDFVSAITVLVEI

SEQ ID NO: 679619 - protein, 23 aa, Mycobacterium
IIGGGLRRFLDELGELPDKSLIA

SEQ ID NO: 679620 - protein, 18 aa, Mycobacterium
IIGIRARAADGFAAGDYA

SEQ ID NO: 679621 - protein, 24 aa, Mycobacterium
IIGRIKDLLIVYGRNHSPDDIEAT

SEQ ID NO: 679622 - protein, 20 aa, Mycobacterium
IIGYRALMRTRLPASGRLGI

SEQ ID NO: 679623 - protein, 26 aa, Mycobacterium
IIHSLNLWLDEVWGFNYKNRIFTTPV

SEQ ID NO: 679624 - protein, 33 aa, Mycobacterium
IIIDKLETLRGWTFHRLEVLAVRLRGQSKATIR

SEQ ID NO: 679625 - protein, 19 aa, Mycobacterium
IIIGTGFSGLGMAIKLQQQ

SEQ ID NO: 679626 - protein, 18 aa, Mycobacterium
IIIPSYLMVTVQITGYAA

SEQ ID NO: 679627 - protein, 27 aa, Mycobacterium
IIIQAARPGHEWLPLSLQLILAEILTP

SEQ ID NO: 679628 - protein, 22 aa, Mycobacterium
IIKAGAILINVNFRYVEGELKY

SEQ ID NO: 679629 - protein, 23 aa, Mycobacterium
IIKCDIGIRDGRIVGIGKAGNPD

SEQ ID NO: 679630 - protein, 25 aa, Mycobacterium
IIKSWKGVPYAAAPVGELRWRAPEP

SEQ ID NO: 679631 - protein, 17 aa, Mycobacterium
IIKTAIDEFGKIDGVVS

SEQ ID NO: 679632 - protein, 17 aa, Mycobacterium
IILPRPEPDAVLRTIAR

SEQ ID NO: 679633 - protein, 25 aa, Mycobacterium
IILSYEVDKVLARRLPWGDRIRKGI

SEQ ID NO: 679634 - protein, 17 aa, Mycobacterium
IILTARWQRDGGPTEQK

SEQ ID NO: 679635 - protein, 27 aa, Mycobacterium
IINECHRRCLDYAKMRTLWGQNIGQFQ

SEQ ID NO: 679636 - protein, 20 aa, Mycobacterium
IINGSKCWITNGGKSSWYTV

SEQ ID NO: 679637 - protein, 24 aa, Mycobacterium
IINSGFGWHEARIPTIVTSVPSGA

SEQ ID NO: 679638 - protein, 24 aa, Mycobacterium
IIPEGADPFVFLFSESSGRVLVAV

SEQ ID NO: 679639 - protein, 22 aa, Mycobacterium
IIPGHEFAGVIAAVGADVSGWQ

SEQ ID NO: 679640 - protein, 18 aa, Mycobacterium
IIPVLRTIDYRAALPGGP

SEQ ID NO: 679641 - protein, 21 aa, Mycobacterium
IIPYNHPILFAAAKVGAPLIT

SEQ ID NO: 679642 - protein, 17 aa, Mycobacterium
IIQPLIQAMAFGLPAQD

SEQ ID NO: 679643 - protein, 17 aa, Mycobacterium
IIQPLIQAMSFGLTALQ

SEQ ID NO: 679644 - protein, 25 aa, Mycobacterium
IIQPVFARRHLNAFAPEIVAAAQRR

SEQ ID NO: 679645 - protein, 18 aa, Mycobacterium
IIQVTWLYSHAIDLDALQ

SEQ ID NO: 679646 - protein, 19 aa, Mycobacterium
IIRCQKRYLAREIFHSLRA

SEQ ID NO: 679647 - protein, 20 aa, Mycobacterium
IIRDGRLMRDPSLLVTRPTA

SEQ ID NO: 679648 - protein, 24 aa, Mycobacterium
IIRDGRLMRDPSLLVTRPTAGDPA

SEQ ID NO: 679649 - protein, 19 aa, Mycobacterium
IIRDGRLMTDPSLLVTRPT

SEQ ID NO: 679650 - protein, 25 aa, Mycobacterium
IIRDRLRHLRPFFLSPLATPNLGHP

SEQ ID NO: 679651 - protein, 28 aa, Mycobacterium
IIRFHAVYWPAFLMSAGIELPKKVFAHG

SEQ ID NO: 679652 - protein, 28 aa, Mycobacterium
IIRFHAVYWPAFLMSAGIELPRRVFAHG

SEQ ID NO: 679653 - protein, 25 aa, Mycobacterium
IIRHGGNPLLRWMVDNFAVAMDPAG

SEQ ID NO: 679654 - protein, 23 aa, Mycobacterium
IIRPELPSISGLCTQVTAFMDES

SEQ ID NO: 679655 - protein, 19 aa, Mycobacterium
IIRPLRRFLNALGDRNARK

SEQ ID NO: 679656 - protein, 27 aa, Mycobacterium
IIRRSGARAVLFEKGFLGMDFTVPDGI

SEQ ID NO: 679657 - protein, 19 aa, Mycobacterium
IIRYRTRDLTKLLPGTARS

SEQ ID NO: 679658 - protein, 27 aa, Mycobacterium
IISATELRTFSGLLERFGRGKGCDICK

SEQ ID NO: 679659 - protein, 19 aa, Mycobacterium
IISCGAALDHFRVAMASAG

SEQ ID NO: 679660 - protein, 18 aa, Mycobacterium
IISCPQLLPDLAVLADDF

SEQ ID NO: 679661 - protein, 27 aa, Mycobacterium
IISEGRLDLGLGAGWFEREFTAYGIPF

SEQ ID NO: 679662 - protein, 18 aa, Mycobacterium
IISGDLVLAIAMTEPGTG

SEQ ID NO: 679663 - protein, 20 aa, Mycobacterium
IISRAEWGADESLRCGSPQY

SEQ ID NO: 679664 - protein, 24 aa, Mycobacterium
IITAGWRKLLTNALAGFMALSRRR

SEQ ID NO: 679665 - protein, 17 aa, Mycobacterium
IITPFNHPMLILARSLS

SEQ ID NO: 679666 - protein, 18 aa, Mycobacterium
IITPNLFPGVSISADLGN

SEQ ID NO: 679667 - protein, 18 aa, Mycobacterium
IITSPAFTGDRVLAAILF

SEQ ID NO: 679668 - protein, 18 aa, Mycobacterium
IITSPSFDGERILGAILF

SEQ ID NO: 679669 - protein, 18 aa, Mycobacterium
IITSPSFGGDRVLAAILF

SEQ ID NO: 679670 - protein, 18 aa, Mycobacterium
IIVKPGGRCRYTTIQNWS

SEQ ID NO: 679671 - protein, 19 aa, Mycobacterium
IIVKPGGRCRYTTIQNWSN

SEQ ID NO: 679672 - protein, 17 aa, Mycobacterium
IIVNCAGVSDGTKTVSK

SEQ ID NO: 679673 - protein, 17 aa, Mycobacterium
IIVNSAADWGRSDPLKT

SEQ ID NO: 679674 - protein, 28 aa, Mycobacterium
IIVSDSAALGVIWIADWADDMVNVSAHH

SEQ ID NO: 679675 - protein, 19 aa, Mycobacterium
IIVSMKFPGGLELPPHYHT

SEQ ID NO: 679676 - protein, 18 aa, Mycobacterium
IIVTWRRGTAKGPAGQNF

SEQ ID NO: 679677 - protein, 25 aa, Mycobacterium
IIYDEVHLLPAPVFRMTADLQSRRR

SEQ ID NO: 679678 - protein, 19 aa, Mycobacterium
IIYRMGVKPPEPKGILTTA

SEQ ID NO: 679679 - protein, 19 aa, Mycobacterium
IIYRMGVKPPEPKQILTTG

SEQ ID NO: 679680 - protein, 18 aa, Mycobacterium
IIYRMGVTPPEPKQILSS

SEQ ID NO: 679681 - protein, 19 aa, Mycobacterium
IIYRMGVTPPQPKQILGTG

SEQ ID NO: 679682 - protein, 19 aa, Mycobacterium
IIYRMGVTPPQPKQILNTG

SEQ ID NO: 679683 - protein, 19 aa, Mycobacterium
IKAAGGRAVANYDSVATEE

SEQ ID NO: 679684 - protein, 26 aa, Mycobacterium
IKAARRLVAMLARRGYGQSMAYDVVK

SEQ ID NO: 679685 - protein, 29 aa, Mycobacterium
IKACIANSFLPSVLEPWTGLWPPSLAGLR

SEQ ID NO: 679686 - protein, 17 aa, Mycobacterium
IKADPNWQGGDYHDTGR

SEQ ID NO: 679687 - protein, 18 aa, Mycobacterium
IKADPNWRNGDYHETGCK

SEQ ID NO: 679688 - protein, 20 aa, Mycobacterium
IKADVDVDVFRRLLGADFTS

SEQ ID NO: 679689 - protein, 17 aa, Mycobacterium
IKAEPRPSWGDPKYDPL

SEQ ID NO: 679690 - protein, 24 aa, Mycobacterium
IKAEPRPSWGHPMYNPIWAAATKH

SEQ ID NO: 679691 - protein, 19 aa, Mycobacterium
IKAEVAAAIGATPPTTTPA

SEQ ID NO: 679692 - protein, 17 aa, Mycobacterium
IKAEVAAAIGTDAPTTA

SEQ ID NO: 679693 - protein, 25 aa, Mycobacterium
IKAGDELYCDVWIDSIRKAHGTDII

SEQ ID NO: 679694 - protein, 22 aa, Mycobacterium
IKAGEGHAFISAGVETVSRFAK

SEQ ID NO: 679695 - protein, 22 aa, Mycobacterium
IKAGEGHAFISAGVETVSRFGK

SEQ ID NO: 679696 - protein, 22 aa, Mycobacterium
IKAGEGHAFISAGVETVSRFPK

SEQ ID NO: 679697 - protein, 36 aa, Mycobacterium
IKAGEIRGGAMPRPERLRWYVYTDELPPLTVTAPPP

SEQ ID NO: 679698 - protein, 21 aa, Mycobacterium
IKAGLFLTSIGYRGVPMPDVP

SEQ ID NO: 679699 - protein, 17 aa, Mycobacterium
IKAGWVYAGTGYYRYDK

SEQ ID NO: 679700 - protein, 19 aa, Mycobacterium
IKAISDWLSTVDKYLKAPT

SEQ ID NO: 679701 - protein, 17 aa, Mycobacterium
IKAPLGLGQAGQFNAHV

SEQ ID NO: 679702 - protein, 18 aa, Mycobacterium
IKAPPAGGTPVGLPSGKP

SEQ ID NO: 679703 - protein, 19 aa, Mycobacterium
IKAQAYRLQTFGTVTRLAG

SEQ ID NO: 679704 - protein, 19 aa, Mycobacterium
IKAQAYRLQTFGTVTRLAL

SEQ ID NO: 679705 - protein, 21 aa, Mycobacterium
IKARDPLALVLSGGPSSVYAD

SEQ ID NO: 679706 - protein, 18 aa, Mycobacterium
IKASAGGGGRGMRIVREL

SEQ ID NO: 679707 - protein, 24 aa, Mycobacterium
IKAVDRAAGIDGIRVLRKEGGKTG

SEQ ID NO: 679708 - protein, 21 aa, Mycobacterium
IKAVGRLARRNVRHAQAQLPA

SEQ ID NO: 679709 - protein, 20 aa, Mycobacterium
IKAVNFEAPLPLGPAPSEGP

SEQ ID NO: 679710 - protein, 25 aa, Mycobacterium
IKAWKANQKKAGFLPEERAWVGSLL

SEQ ID NO: 679711 - protein, 17 aa, Mycobacterium
IKAWSQRSTRLREWAKD

SEQ ID NO: 679712 - protein, 19 aa, Mycobacterium
IKAYHHWGDRFVEHLKGMF

SEQ ID NO: 679713 - protein, 18 aa, Mycobacterium
IKDAGGRAVANYDSVAEP

SEQ ID NO: 679714 - protein, 22 aa, Mycobacterium
IKDAGLRSRILLQVHDELLFEV

SEQ ID NO: 679715 - protein, 24 aa, Mycobacterium
IKDAKARLGYQKVVLAGWSGGGSL

SEQ ID NO: 679716 - protein, 26 aa, Mycobacterium
IKDAKKRLGYQKVVLAGWSGGGSLSV

SEQ ID NO: 679717 - protein, 25 aa, Mycobacterium
IKDAKKRLGYSKVVLAGWSGGGSLS

SEQ ID NO: 679718 - protein, 26 aa, Mycobacterium
IKDAKKRLGYSKVVLAGWSGGGSLSV

SEQ ID NO: 679719 - protein, 22 aa, Mycobacterium
IKDAKNRLGYQKVVLAGWSGGG

SEQ ID NO: 679720 - protein, 21 aa, Mycobacterium
IKDAWAELSTVIYAGEASPPA

SEQ ID NO: 679721 - protein, 38 aa, Mycobacterium
IKDGRPVDFGSFLIPRTEYRIDDVWHVVGLRGTGSNTV

SEQ ID NO: 679722 - protein, 20 aa, Mycobacterium
IKDIKGMELISAVRTVGAGR

SEQ ID NO: 679723 - protein, 21 aa, Mycobacterium
IKDKIWNTQEVVIGGWRQGEG

SEQ ID NO: 679724 - protein, 21 aa, Mycobacterium
IKDMGGFMMNGLWNRRFDEAV

SEQ ID NO: 679725 - protein, 17 aa, Mycobacterium
IKDPRLTMVTVTDTRVT

SEQ ID NO: 679726 - protein, 17 aa, Mycobacterium
IKDRPALRMIEDAEREG

SEQ ID NO: 679727 - protein, 20 aa, Mycobacterium
IKDVELATARRIDWFNHRRL

SEQ ID NO: 679728 - protein, 17 aa, Mycobacterium
IKDVVIIRGRNHYPDDI

SEQ ID NO: 679729 - protein, 23 aa, Mycobacterium
IKDWQIKICDTIADNASAAGFVL

SEQ ID NO: 679730 - protein, 21 aa, Mycobacterium
IKEARDLGPRHGLTGEPLPPA

SEQ ID NO: 679731 - protein, 26 aa, Mycobacterium
IKEFPDLKIALSEGGTGWIPYFLERA

SEQ ID NO: 679732 - protein, 18 aa, Mycobacterium
IKEFPTLKIALSEGGTGW

SEQ ID NO: 679733 - protein, 27 aa, Mycobacterium
IKEGGTVFCCRFGLGLHGGREEDLIEG

SEQ ID NO: 679734 - protein, 26 aa, Mycobacterium
IKEGRGTPRGGVWLDVSHLPRTQIMQ

SEQ ID NO: 679735 - protein, 21 aa, Mycobacterium
IKEHAVAVALAMREQGREPDL

SEQ ID NO: 679736 - protein, 22 aa, Mycobacterium
IKEHAVAVALAMRERGAEPDLL

SEQ ID NO: 679737 - protein, 21 aa, Mycobacterium
IKEHLLYEVHDPFCYLLPDGV

SEQ ID NO: 679738 - protein, 19 aa, Mycobacterium
IKEKNDWSYEKWTKQVTRV

SEQ ID NO: 679739 - protein, 21 aa, Mycobacterium
IKELLERPGTLDVLRLIANAP

SEQ ID NO: 679740 - protein, 22 aa, Mycobacterium
IKELSRMFAAGTVRPYIGAQFP

SEQ ID NO: 679741 - protein, 23 aa, Mycobacterium
IKEMSRSLILRFGQTTFLETFRF

SEQ ID NO: 679742 - protein, 22 aa, Mycobacterium
IKENGRVAGAFGYYRETGKFVL

SEQ ID NO: 679743 - protein, 25 aa, Mycobacterium
IKEPRITALSGLWFEAARQVGFDIA

SEQ ID NO: 679744 - protein, 18 aa, Mycobacterium
IKEQWPGKLVVKGIQTLD

SEQ ID NO: 679745 - protein, 25 aa, Mycobacterium
IKEWRHHGQKFAWMRETKFLVDDEP

SEQ ID NO: 679746 - protein, 25 aa, Mycobacterium
IKFPTPAACGRVPLVVKGLSKTYGS

SEQ ID NO: 679747 - protein, 21 aa, Mycobacterium
IKFTTGGGLPFKIRDIPVSPD

SEQ ID NO: 679748 - protein, 22 aa, Mycobacterium
IKGERPTFSGKWYQVREALANP

SEQ ID NO: 679749 - protein, 17 aa, Mycobacterium
IKGHVKVLVGPKSALLD

SEQ ID NO: 679750 - protein, 18 aa, Mycobacterium
IKGIRGIYHDDWMACTYH

SEQ ID NO: 679751 - protein, 19 aa, Mycobacterium
IKGLRLRATDVDWTHGSGP

SEQ ID NO: 679752 - protein, 18 aa, Mycobacterium
IKGLRLTVTQAAWRVSED

SEQ ID NO: 679753 - protein, 25 aa, Mycobacterium
IKGPVAGTGAEMWVKVNPQAYRELA

SEQ ID NO: 679754 - protein, 19 aa, Mycobacterium
IKGRVGYDYNEHGRAGNSH

SEQ ID NO: 679755 - protein, 17 aa, Mycobacterium
IKGSVLAALGRIDYWFV

SEQ ID NO: 679756 - protein, 27 aa, Mycobacterium
IKHGAALIKVCVSGGVMSLTGEAGAQH

SEQ ID NO: 679757 - protein, 28 aa, Mycobacterium
IKHKCADMLVDLEWARSASQAALEALDD

SEQ ID NO: 679758 - protein, 22 aa, Mycobacterium
IKHLCAEMLCRAEQADVAAADA

SEQ ID NO: 679759 - protein, 22 aa, Mycobacterium
IKHLCAEMLCRAEQAEVAASDA

SEQ ID NO: 679760 - protein, 21 aa, Mycobacterium
IKHLRVIRGKHSALHDFSVDI

SEQ ID NO: 679761 - protein, 20 aa, Mycobacterium
IKHMCAEMLCRVEQADVAVW

SEQ ID NO: 679762 - protein, 21 aa, Mycobacterium
IKHRCAEMAIELDSARAVTLY

SEQ ID NO: 679763 - protein, 21 aa, Mycobacterium
IKHRLADLWFDVGAAAAAARY

SEQ ID NO: 679764 - protein, 20 aa, Mycobacterium
IKIEAPGGEAARHITAVLPG

SEQ ID NO: 679765 - protein, 17 aa, Mycobacterium
IKIFAECTITDLLLDST

SEQ ID NO: 679766 - protein, 24 aa, Mycobacterium
IKILCGDGPLAMAAMAGTDPESDG

SEQ ID NO: 679767 - protein, 23 aa, Mycobacterium
IKINLIGTFNVVRLGAYAMSQND

SEQ ID NO: 679768 - protein, 19 aa, Mycobacterium
IKKALRLKAAFSEMLDQMQ

SEQ ID NO: 679769 - protein, 22 aa, Mycobacterium
IKKGVLELADIVVVNKADGEHA

SEQ ID NO: 679770 - protein, 22 aa, Mycobacterium
IKKGVLELADIVVVNKADGEHL

SEQ ID NO: 679771 - protein, 22 aa, Mycobacterium
IKKGVLELADIVVVNKADGNHL

SEQ ID NO: 679772 - protein, 25 aa, Mycobacterium
IKKHARLNMMAHLLSTIDYHDVERP

SEQ ID NO: 679773 - protein, 25 aa, Mycobacterium
IKKHARLNMMAHLLSTIDYRDVEKP

SEQ ID NO: 679774 - protein, 25 aa, Mycobacterium
IKKHARLNMMAHLLSTIDYRPVEMP

SEQ ID NO: 679775 - protein, 25 aa, Mycobacterium
IKKQFKGANPWVMISNFHVKIDGCV

SEQ ID NO: 679776 - protein, 17 aa, Mycobacterium
IKLAKAIPQRRTDRRIY

SEQ ID NO: 679777 - protein, 22 aa, Mycobacterium
IKLATRRVAAWATRAKVVLVDG

SEQ ID NO: 679778 - protein, 17 aa, Mycobacterium
IKLGLRMAIACPADGAG

SEQ ID NO: 679779 - protein, 20 aa, Mycobacterium
IKLGTGGLRDVEFAVQLLQL

SEQ ID NO: 679780 - protein, 20 aa, Mycobacterium
IKLGTMLTPLSRRKPWDLAS

SEQ ID NO: 679781 - protein, 18 aa, Mycobacterium
IKLHQLGLSLKDSPASFD

SEQ ID NO: 679782 - protein, 17 aa, Mycobacterium
IKLHQLGLSLKDSPATF

SEQ ID NO: 679783 - protein, 17 aa, Mycobacterium
IKLHQLGLSLKDSPTSF

SEQ ID NO: 679784 - protein, 21 aa, Mycobacterium
IKLKPDCVVYAAMSDEMDAAA

SEQ ID NO: 679785 - protein, 22 aa, Mycobacterium
IKLLHRVEIRGGAGSGKTFLAM

SEQ ID NO: 679786 - protein, 18 aa, Mycobacterium
IKLMEGVEDIPGTALTEG

SEQ ID NO: 679787 - protein, 17 aa, Mycobacterium
IKLPHRVPSGFHGNWVP

SEQ ID NO: 679788 - protein, 20 aa, Mycobacterium
IKLPSIYYAHERKVFERDGM

SEQ ID NO: 679789 - protein, 17 aa, Mycobacterium
IKLPWPVLDNDELGKIV

SEQ ID NO: 679790 - protein, 25 aa, Mycobacterium
IKLSDDMPGFGLVMFGAIREAGAAA

SEQ ID NO: 679791 - protein, 22 aa, Mycobacterium
IKLSGESLGGWVAARAAIDHPD

SEQ ID NO: 679792 - protein, 17 aa, Mycobacterium
IKLSLGVVVLVAATEAE

SEQ ID NO: 679793 - protein, 20 aa, Mycobacterium
IKLSTLIALCTALECTPGDL

SEQ ID NO: 679794 - protein, 19 aa, Mycobacterium
IKLTVADLIGLTAQDISDG

SEQ ID NO: 679795 - protein, 17 aa, Mycobacterium
IKLYAEYQETSEKVLSE

SEQ ID NO: 679796 - protein, 17 aa, Mycobacterium
IKMALQYWRSLGLPAKH

SEQ ID NO: 679797 - protein, 19 aa, Mycobacterium
IKNFRFRLTKPVFVGDAIR

SEQ ID NO: 679798 - protein, 17 aa, Mycobacterium
IKNIEVAARTGGGDPAG

SEQ ID NO: 679799 - protein, 18 aa, Mycobacterium
IKNIEVAARTGGGDPAGN

SEQ ID NO: 679800 - protein, 20 aa, Mycobacterium
IKNRLGLLPAETVVYTGHGD

SEQ ID NO: 679801 - protein, 18 aa, Mycobacterium
IKNSAGQLITFIDELHTI

SEQ ID NO: 679802 - protein, 21 aa, Mycobacterium
IKPEFDRRNVKIIGLSTDPLD

SEQ ID NO: 679803 - protein, 23 aa, Mycobacterium
IKPEVLERALAVGADYAFDARDE

SEQ ID NO: 679804 - protein, 20 aa, Mycobacterium
IKPLNLVVGLIEEIRHRHPD

SEQ ID NO: 679805 - protein, 23 aa, Mycobacterium
IKPRTIVEYGLSYGISTLHSAAA

SEQ ID NO: 679806 - protein, 22 aa, Mycobacterium
IKPSHLAGGYGQHAFAFNYMGP

SEQ ID NO: 679807 - protein, 25 aa, Mycobacterium
IKPTELRRSIGYAIQQAGLFPHMTI

SEQ ID NO: 679808 - protein, 20 aa, Mycobacterium
IKPTRAFDGLPALSADEAAD

SEQ ID NO: 679809 - protein, 18 aa, Mycobacterium
IKPVAALAYQFAQSPTVL

SEQ ID NO: 679810 - protein, 29 aa, Mycobacterium
IKPVFLRENWYCPVCLEVTNSALCGHDSQ

SEQ ID NO: 679811 - protein, 19 aa, Mycobacterium
IKPVGALVVCVDDPGAAAL

SEQ ID NO: 679812 - protein, 20 aa, Mycobacterium
IKPVSVWLSHEYVRAAPGGI

SEQ ID NO: 679813 - protein, 25 aa, Mycobacterium
IKQARIGCISRLFGTGIAIGANVRE

SEQ ID NO: 679814 - protein, 22 aa, Mycobacterium
IKQEILAGIGGVRAIRAFTDLE

SEQ ID NO: 679815 - protein, 21 aa, Mycobacterium
IKQEILAGIGGVRAIRAFTEI

SEQ ID NO: 679816 - protein, 22 aa, Mycobacterium
IKQEILAGIGGVRAIRAYVASS

SEQ ID NO: 679817 - protein, 26 aa, Mycobacterium
IKQFASGRFGVWAGYLADPMLQELEI

SEQ ID NO: 679818 - protein, 26 aa, Mycobacterium
IKQKGFPAYFLVVGDLVSHAKEVGIR

SEQ ID NO: 679819 - protein, 17 aa, Mycobacterium
IKQKYGNKISWADLIAY

SEQ ID NO: 679820 - protein, 17 aa, Mycobacterium
IKQKYGNKISWADLLVF

SEQ ID NO: 679821 - protein, 19 aa, Mycobacterium
IKQVPGIVDDGEFTVWIKD

SEQ ID NO: 679822 - protein, 19 aa, Mycobacterium
IKRDPRCGRNFEYFSEDPL

SEQ ID NO: 679823 - protein, 22 aa, Mycobacterium
IKRGQEGPFAKWLEHWHPDHDP

SEQ ID NO: 679824 - protein, 17 aa, Mycobacterium
IKRLIAMKCSGERAPEG

SEQ ID NO: 679825 - protein, 21 aa, Mycobacterium
IKRQMIEWWGPIVDEYYGSSE

SEQ ID NO: 679826 - protein, 18 aa, Mycobacterium
IKRRIMAMAEPNADGRRP

SEQ ID NO: 679827 - protein, 20 aa, Mycobacterium
IKRRIMAMAEPNPGGRRPDV

SEQ ID NO: 679828 - protein, 22 aa, Mycobacterium
IKRSVDELLEIVKLSDFAKRKP

SEQ ID NO: 679829 - protein, 20 aa, Mycobacterium
IKRYPGCAYVDTTVDALLEL

SEQ ID NO: 679830 - protein, 17 aa, Mycobacterium
IKSAVAFGALLSSGIGD

SEQ ID NO: 679831 - protein, 19 aa, Mycobacterium
IKSGFFEREITPVTLPDGT

SEQ ID NO: 679832 - protein, 24 aa, Mycobacterium
IKSLDLPGGIGQHFFFDAGNGDCI

SEQ ID NO: 679833 - protein, 22 aa, Mycobacterium
IKSREIYEAPGAMVLITAHEEL

SEQ ID NO: 679834 - protein, 17 aa, Mycobacterium
IKSRSALQEKVRRAEDL

SEQ ID NO: 679835 - protein, 19 aa, Mycobacterium
IKSVGRWVLGRKRIRSAIR

SEQ ID NO: 679836 - protein, 21 aa, Mycobacterium
IKTAKLRAAQRVQRFLDAAQA

SEQ ID NO: 679837 - protein, 17 aa, Mycobacterium
IKTISRDGGEVWSTNAK

SEQ ID NO: 679838 - protein, 20 aa, Mycobacterium
IKTLALSAGVDRTAFYGTRP

SEQ ID NO: 679839 - protein, 26 aa, Mycobacterium
IKTRASGGLYRWEARFLQESDQAISN

SEQ ID NO: 679840 - protein, 18 aa, Mycobacterium
IKTVRRWLANIDYNVRED

SEQ ID NO: 679841 - protein, 19 aa, Mycobacterium
IKTVVSMLLLRGFAKQVGA

SEQ ID NO: 679842 - protein, 20 aa, Mycobacterium
IKTVVVRTAAEPVDWYGGEP

SEQ ID NO: 679843 - protein, 19 aa, Mycobacterium
IKVDGRRAYQLAREGQTVE

SEQ ID NO: 679844 - protein, 19 aa, Mycobacterium
IKVEAPGGEAARHITAVLP

SEQ ID NO: 679845 - protein, 22 aa, Mycobacterium
IKVEPPGGGGFRGAAVSGGELQ

SEQ ID NO: 679846 - protein, 20 aa, Mycobacterium
IKVEPRKGDNAPMAVIELVR

SEQ ID NO: 679847 - protein, 20 aa, Mycobacterium
IKVHRPAVALLDYRMPQLDG

SEQ ID NO: 679848 - protein, 21 aa, Mycobacterium
IKVLILKANGKGFCSGHAIGN

SEQ ID NO: 679849 - protein, 28 aa, Mycobacterium
IKVLPLWLRLERFAVWLIFEVLAVTLVD

SEQ ID NO: 679850 - protein, 21 aa, Mycobacterium
IKVRVLRRWGPARIGYMLGVH

SEQ ID NO: 679851 - protein, 27 aa, Mycobacterium
IKVSARPSDSVAIALRVGVPIYVEEAV

SEQ ID NO: 679852 - protein, 25 aa, Mycobacterium
IKVVREIVSGLGLKEAKDLVDSAPK

SEQ ID NO: 679853 - protein, 18 aa, Mycobacterium
IKWHYQFTPHDLWDYDST

SEQ ID NO: 679854 - protein, 17 aa, Mycobacterium
IKYLGVIPQEMRFDRVG

SEQ ID NO: 679855 - protein, 18 aa, Mycobacterium
IKYRGMVDGVARVETHLE

SEQ ID NO: 679856 - protein, 18 aa, Mycobacterium
ILAANGRWLELAVTALDR

SEQ ID NO: 679857 - protein, 20 aa, Mycobacterium
ILAAPLRRKRVTCADLAAVQ

SEQ ID NO: 679858 - protein, 25 aa, Mycobacterium
ILACMDARLDVYRLLGINEGEAHVI

SEQ ID NO: 679859 - protein, 26 aa, Mycobacterium
ILADEILTPLGFRWTNYGVAPEDVPL

SEQ ID NO: 679860 - protein, 18 aa, Mycobacterium
ILADLGVEPDRLRMLRSF

SEQ ID NO: 679861 - protein, 17 aa, Mycobacterium
ILAEAGLRWIGMGRSCT

SEQ ID NO: 679862 - protein, 19 aa, Mycobacterium
ILAEILALLGRSWSDERGT

SEQ ID NO: 679863 - protein, 17 aa, Mycobacterium
ILAERLAGNIGEYSGVE

SEQ ID NO: 679864 - protein, 19 aa, Mycobacterium
ILAERLATHIAEFSGVEVG

SEQ ID NO: 679865 - protein, 24 aa, Mycobacterium
ILAGPDLRDVCGWTLERPPHHLET

SEQ ID NO: 679866 - protein, 24 aa, Mycobacterium
ILAGVPRLADWGGVAANLRCEHRR

SEQ ID NO: 679867 - protein, 25 aa, Mycobacterium
ILAGYPVHIAKMFGLIYGGDHTDTA

SEQ ID NO: 679868 - protein, 17 aa, Mycobacterium
ILAHGFPELAYSWRHQI

SEQ ID NO: 679869 - protein, 24 aa, Mycobacterium
ILAHISIPLLLRVSSQGWGHYLET

SEQ ID NO: 679870 - protein, 25 aa, Mycobacterium
ILAKKFRPGLPMLAMPERGVAEVEQ

SEQ ID NO: 679871 - protein, 17 aa, Mycobacterium
ILALGAVVAQEWESRAI

SEQ ID NO: 679872 - protein, 18 aa, Mycobacterium
ILALLGRSWSDERGTRPL

SEQ ID NO: 679873 - protein, 17 aa, Mycobacterium
ILALRRAGDLAAGGTVV

SEQ ID NO: 679874 - protein, 25 aa, Mycobacterium
ILALSRLTATFLDRLEAHLKGWGKT

SEQ ID NO: 679875 - protein, 24 aa, Mycobacterium
ILAPIRYRALEAFAATSATVDEWE

SEQ ID NO: 679876 - protein, 24 aa, Mycobacterium
ILARAWLYIIWHCWQDNTTYDPAH

SEQ ID NO: 679877 - protein, 18 aa, Mycobacterium
ILARFPPDHMDEMELVQW

SEQ ID NO: 679878 - protein, 17 aa, Mycobacterium
ILARTGAPLLFASGAFL

SEQ ID NO: 679879 - protein, 25 aa, Mycobacterium
ILARTGAPVLFGMGTFLGHDRVADL

SEQ ID NO: 679880 - protein, 18 aa, Mycobacterium
ILASGHRYGWPVAQGGSG

SEQ ID NO: 679881 - protein, 19 aa, Mycobacterium
ILASGHRYGWPVAQGGSGS

SEQ ID NO: 679882 - protein, 17 aa, Mycobacterium
ILASNRFRAGLAKIPGA

SEQ ID NO: 679883 - protein, 26 aa, Mycobacterium
ILATEILDPLGFRWTNFGVAEEDLPL

SEQ ID NO: 679884 - protein, 26 aa, Mycobacterium
ILATEILDPLGFRWTNYGVAPEDVPL

SEQ ID NO: 679885 - protein, 27 aa, Mycobacterium
ILAVRGDAPWPPARAGFLTLDHVCAVV

SEQ ID NO: 679886 - protein, 22 aa, Mycobacterium
ILAWNPEMAWLLTDFGELPPVQ

SEQ ID NO: 679887 - protein, 25 aa, Mycobacterium
ILCACCTTSCPVFWNEGSYFGPAAI

SEQ ID NO: 679888 - protein, 26 aa, Mycobacterium
ILCACCTTSCPVFWSDGSYFGPAAIV

SEQ ID NO: 679889 - protein, 20 aa, Mycobacterium
ILCACCTTSCPVYWSEGSYF

SEQ ID NO: 679890 - protein, 17 aa, Mycobacterium
ILCDLILIRGTGGTPAA

SEQ ID NO: 679891 - protein, 17 aa, Mycobacterium
ILCDLILIRSALSPRAA

SEQ ID NO: 679892 - protein, 22 aa, Mycobacterium
ILCDPWVNPAYFASWFPFPDNS

SEQ ID NO: 679893 - protein, 23 aa, Mycobacterium
ILCDPWVNPAYFASWFPFPDNST

SEQ ID NO: 679894 - protein, 23 aa, Mycobacterium
ILCDPWVNPAYFASWFPFPDNTG

SEQ ID NO: 679895 - protein, 17 aa, Mycobacterium
ILCECNCGIVVQLDDRR

SEQ ID NO: 679896 - protein, 18 aa, Mycobacterium
ILCESCGFGGDRRQFGRP

SEQ ID NO: 679897 - protein, 19 aa, Mycobacterium
ILCIGFGGGMAAGITLLAA

SEQ ID NO: 679898 - protein, 17 aa, Mycobacterium
ILCLELLVHAWDFAFAT

SEQ ID NO: 679899 - protein, 25 aa, Mycobacterium
ILDAGLRSGLKLNFSCTVGGCAACK

SEQ ID NO: 679900 - protein, 23 aa, Mycobacterium
ILDALGIKWSLLVGDRLGGELAW

SEQ ID NO: 679901 - protein, 18 aa, Mycobacterium
ILDALIRRLDEWRSLECI

SEQ ID NO: 679902 - protein, 25 aa, Mycobacterium
ILDAPEIPELYVIQGPYANAYTIGM

SEQ ID NO: 679903 - protein, 17 aa, Mycobacterium
ILDDGRGGEGIRIRKAP

SEQ ID NO: 679904 - protein, 17 aa, Mycobacterium
ILDEGRIAIAALSVGAA

SEQ ID NO: 679905 - protein, 18 aa, Mycobacterium
ILDEGRIAIAALSVGAAQ

SEQ ID NO: 679906 - protein, 19 aa, Mycobacterium
ILDELDWRGLIAQSTDREA

SEQ ID NO: 679907 - protein, 19 aa, Mycobacterium
ILDELTWRGLIAQTTDRDA

SEQ ID NO: 679908 - protein, 23 aa, Mycobacterium
ILDEVEVRWALLVGDRHGGEIAW

SEQ ID NO: 679909 - protein, 18 aa, Mycobacterium
ILDFARLSGELGPVNLGN

SEQ ID NO: 679910 - protein, 20 aa, Mycobacterium
ILDGCGLPADSNGAIATTTA

SEQ ID NO: 679911 - protein, 19 aa, Mycobacterium
ILDGLAVPGVHRALVDPKH

SEQ ID NO: 679912 - protein, 18 aa, Mycobacterium
ILDGLRLAAAMVGADRAY

SEQ ID NO: 679913 - protein, 18 aa, Mycobacterium
ILDGTHLVGFDAQQVPPT

SEQ ID NO: 679914 - protein, 27 aa, Mycobacterium
ILDGWHGDSAWTFAVGTVIPSDEALSE

SEQ ID NO: 679915 - protein, 17 aa, Mycobacterium
ILDLGPGDILTRLTAPV

SEQ ID NO: 679916 - protein, 23 aa, Mycobacterium
ILDNPAYRGIRVWGKQEKYEVLL

SEQ ID NO: 679917 - protein, 19 aa, Mycobacterium
ILDQLRTAYGQGFLDDIPK

SEQ ID NO: 679918 - protein, 19 aa, Mycobacterium
ILDQLRTAYGQGYLDGIAK

SEQ ID NO: 679919 - protein, 17 aa, Mycobacterium
ILDREIFDVVAARLRAD

SEQ ID NO: 679920 - protein, 17 aa, Mycobacterium
ILDRGDKLMGFGHRVYR

SEQ ID NO: 679921 - protein, 30 aa, Mycobacterium
ILDRHPELKIGWFEGGIAWVPTALQDAEHM

SEQ ID NO: 679922 - protein, 30 aa, Mycobacterium
ILDRHPGLRVGWFEGGIAWVPPALQDAEHV

SEQ ID NO: 679923 - protein, 30 aa, Mycobacterium
ILDRHPGLRVGWFEGGIAWVPTALQDAEHV

SEQ ID NO: 679924 - protein, 32 aa, Mycobacterium
ILDRHPRLRIGWFEGGIAWVPWALQDAEHLVA

SEQ ID NO: 679925 - protein, 19 aa, Mycobacterium
ILDRLRVAEHYVPVADGGR

SEQ ID NO: 679926 - protein, 24 aa, Mycobacterium
ILDRREKLMGFGHRVYRAEDPRAR

SEQ ID NO: 679927 - protein, 18 aa, Mycobacterium
ILDRSGVTLAELIGNERS

SEQ ID NO: 679928 - protein, 21 aa, Mycobacterium
ILDRTGLRTGSRVSVAMPMFH

SEQ ID NO: 679929 - protein, 18 aa, Mycobacterium
ILDRTPWRAEETVVVVAP

SEQ ID NO: 679930 - protein, 19 aa, Mycobacterium
ILDRTPWRAEQPVVIVAPM

SEQ ID NO: 679931 - protein, 17 aa, Mycobacterium
ILDVVRYARMFDHDRHG

SEQ ID NO: 679932 - protein, 22 aa, Mycobacterium
ILEAMLALPLYRAVVDAQGGRQ

SEQ ID NO: 679933 - protein, 25 aa, Mycobacterium
ILEDAELQWKLTRYLDGDPEPWPGA

SEQ ID NO: 679934 - protein, 24 aa, Mycobacterium
ILEEVARLGSQFLMQAALEAEVTE

SEQ ID NO: 679935 - protein, 28 aa, Mycobacterium
ILEFLAERVVRWWLPDDVVFVDELPHTA

SEQ ID NO: 679936 - protein, 17 aa, Mycobacterium
ILEGDWVPQRLAILEFP

SEQ ID NO: 679937 - protein, 18 aa, Mycobacterium
ILELEGATQAFGLPGAAI

SEQ ID NO: 679938 - protein, 18 aa, Mycobacterium
ILENPAWYTAYTPYQPEI

SEQ ID NO: 679939 - protein, 18 aa, Mycobacterium
ILEPFGLENMRYKWRKWL

SEQ ID NO: 679940 - protein, 33 aa, Mycobacterium
ILEPGHEGMGWLAQRGYVPLGYKGDAAKTAKTF

SEQ ID NO: 679941 - protein, 23 aa, Mycobacterium
ILEPRVLASLAYNEAREGAVWSI

SEQ ID NO: 679942 - protein, 17 aa, Mycobacterium
ILEQLMGVYRDLDGVPA

SEQ ID NO: 679943 - protein, 21 aa, Mycobacterium
ILEQRGVVFFRGLQISDEQQV

SEQ ID NO: 679944 - protein, 20 aa, Mycobacterium
ILERICEPERQIIFRVPWIR

SEQ ID NO: 679945 - protein, 23 aa, Mycobacterium
ILERSAGIGGTWYNNHYPDVAVD

SEQ ID NO: 679946 - protein, 26 aa, Mycobacterium
ILESRRKPRMAAYVKQLYGIYDRYIA

SEQ ID NO: 679947 - protein, 19 aa, Mycobacterium
ILESWFAGTPIRPEYLIVE

SEQ ID NO: 679948 - protein, 26 aa, Mycobacterium
ILETRGRFGTFVARADPADVAMATAA

SEQ ID NO: 679949 - protein, 26 aa, Mycobacterium
ILEVIMVGGVLHFRQFRQANHGASLL

SEQ ID NO: 679950 - protein, 18 aa, Mycobacterium
ILEVPRPDLDRMSTNGLH

SEQ ID NO: 679951 - protein, 23 aa, Mycobacterium
ILFDWPTHILEIFISQPELLAPA

SEQ ID NO: 679952 - protein, 18 aa, Mycobacterium
ILFLDGRLLTKATYTDRR

SEQ ID NO: 679953 - protein, 24 aa, Mycobacterium
ILFRPCAQKAPSFAIRGRRARVET

SEQ ID NO: 679954 - protein, 18 aa, Mycobacterium
ILGAAAWTGHEGRDAKFM

SEQ ID NO: 679955 - protein, 23 aa, Mycobacterium
ILGAANFKAGRFLAFASGNLCYQ

SEQ ID NO: 679956 - protein, 24 aa, Mycobacterium
ILGAFKAGAAYVPVDPAVPAARVR

SEQ ID NO: 679957 - protein, 28 aa, Mycobacterium
ILGAGMHPWGKWGRDFTEYGVVAARAAL

SEQ ID NO: 679958 - protein, 18 aa, Mycobacterium
ILGALRLGPVAPVGSERV

SEQ ID NO: 679959 - protein, 23 aa, Mycobacterium
ILGDPWPSAGVRLEMLEEAVEVI

SEQ ID NO: 679960 - protein, 25 aa, Mycobacterium
ILGDYRIAVLSIKGGVGKTTTTLGL

SEQ ID NO: 679961 - protein, 23 aa, Mycobacterium
ILGERWTLLILRELVGGPRRYGD

SEQ ID NO: 679962 - protein, 17 aa, Mycobacterium
ILGEVFRRVTGRTIGQY

SEQ ID NO: 679963 - protein, 19 aa, Mycobacterium
ILGFYGLSYWYAEQVTILG

SEQ ID NO: 679964 - protein, 18 aa, Mycobacterium
ILGIGGLVGSGRTELLAA

SEQ ID NO: 679965 - protein, 18 aa, Mycobacterium
ILGLAGLLGSGRTELARL

SEQ ID NO: 679966 - protein, 17 aa, Mycobacterium
ILGMISVIEHTRSNLPR

SEQ ID NO: 679967 - protein, 19 aa, Mycobacterium
ILGMSRVLAAEWGPHGVTV

SEQ ID NO: 679968 - protein, 26 aa, Mycobacterium
ILGPAHLPGGFAVRYQPATRPLQVGG

SEQ ID NO: 679969 - protein, 17 aa, Mycobacterium
ILGPQYKSPRLVKPEML

SEQ ID NO: 679970 - protein, 24 aa, Mycobacterium
ILGPRPRGAGLFLMGHSGGCELVL

SEQ ID NO: 679971 - protein, 17 aa, Mycobacterium
ILGQAGTAWQIFPNFQI

SEQ ID NO: 679972 - protein, 18 aa, Mycobacterium
ILGQAGTAWQIFPNFQIG

SEQ ID NO: 679973 - protein, 17 aa, Mycobacterium
ILGQGVAYQARFDPQAK

SEQ ID NO: 679974 - protein, 24 aa, Mycobacterium
ILGQPGAIMAPGFGDLAEGMVRPS

SEQ ID NO: 679975 - protein, 27 aa, Mycobacterium
ILGRPAETFASWANRFRTRFAPAEFAA

SEQ ID NO: 679976 - protein, 23 aa, Mycobacterium
ILGRSQWAPIIFGCQAPDTGNAE

SEQ ID NO: 679977 - protein, 19 aa, Mycobacterium
ILGSIRLAGSHFRSDIGLR

SEQ ID NO: 679978 - protein, 19 aa, Mycobacterium
ILGSPFLVMERIDGRIPAD

SEQ ID NO: 679979 - protein, 22 aa, Mycobacterium
ILGSYRFTAFRSAKTAPKDEGL

SEQ ID NO: 679980 - protein, 18 aa, Mycobacterium
ILGVRALDLQERFAATGP

SEQ ID NO: 679981 - protein, 19 aa, Mycobacterium
ILHPGIREMTGFRWESRHD

SEQ ID NO: 679982 - protein, 18 aa, Mycobacterium
ILHVAKLSPFASGKTLSE

SEQ ID NO: 679983 - protein, 19 aa, Mycobacterium
ILIELPRQSILDIAVASAA

SEQ ID NO: 679984 - protein, 18 aa, Mycobacterium
ILIFAWGATVPMIAHAAG

SEQ ID NO: 679985 - protein, 19 aa, Mycobacterium
ILIGHSFGGAAVLAAARDS

SEQ ID NO: 679986 - protein, 20 aa, Mycobacterium
ILIHWDDFFRPLSKPLRALP

SEQ ID NO: 679987 - protein, 17 aa, Mycobacterium
ILIQLPVDLLRDVADFD

SEQ ID NO: 679988 - protein, 28 aa, Mycobacterium
ILKGPPATWGRPMWEHNLENGLRLLRLG

SEQ ID NO: 679989 - protein, 23 aa, Mycobacterium
ILKNIKGADTFRRVGTDALTPTF

SEQ ID NO: 679990 - protein, 18 aa, Mycobacterium
ILKNPALEAVRVAARSAP

SEQ ID NO: 679991 - protein, 23 aa, Mycobacterium
ILKSLIQRCADAGFEPWVGAEVE

SEQ ID NO: 679992 - protein, 28 aa, Mycobacterium
ILKTLRRAEGKFGFAVKFHRIAADEGDT

SEQ ID NO: 679993 - protein, 25 aa, Mycobacterium
ILLAARRVPAALKWIEDRRENLMSA

SEQ ID NO: 679994 - protein, 17 aa, Mycobacterium
ILLAHGGGAFLALLPRI

SEQ ID NO: 679995 - protein, 17 aa, Mycobacterium
ILLCDPEKIRTRAADLI

SEQ ID NO: 679996 - protein, 17 aa, Mycobacterium
ILLCKKIHAKRQGEVSS

SEQ ID NO: 679997 - protein, 25 aa, Mycobacterium
ILLDAPSVLGWAGFRDVAQRYSLGM

SEQ ID NO: 679998 - protein, 20 aa, Mycobacterium
ILLDDCAKAALRYTDALIWT

SEQ ID NO: 679999 - protein, 19 aa, Mycobacterium
ILLDEPRKVFGSLANAVVH

SEQ ID NO: 680000 - protein, 19 aa, Mycobacterium
ILLECTMAGLATCPLTHIT

SEQ ID NO: 680001 - protein, 23 aa, Mycobacterium
ILLECTMAGLATCTVTHVTELPA

SEQ ID NO: 680002 - protein, 19 aa, Mycobacterium
ILLELEVGWDDIARAKDLN

SEQ ID NO: 680003 - protein, 29 aa, Mycobacterium
ILLENAAPMGRGMRGVSYVFVTKDRPGCL

SEQ ID NO: 680004 - protein, 19 aa, Mycobacterium
ILLEPVKPFVALQHIRFDS

SEQ ID NO: 680005 - protein, 29 aa, Mycobacterium
ILLESKWLRPTPYMMAKFGMTLCALGIAE

SEQ ID NO: 680006 - protein, 17 aa, Mycobacterium
ILLFAIHSIANYSAPVF

SEQ ID NO: 680007 - protein, 17 aa, Mycobacterium
ILLFAIRSIANYSAPVF

SEQ ID NO: 680008 - protein, 26 aa, Mycobacterium
ILLFPGQGGEAWSVLQRWLEVDEDFR

SEQ ID NO: 680009 - protein, 19 aa, Mycobacterium
ILLGEWPGTELVLGTVTKP

SEQ ID NO: 680010 - protein, 17 aa, Mycobacterium
ILLGHSYYDDWEDQEMF

SEQ ID NO: 680011 - protein, 17 aa, Mycobacterium
ILLGSSYYDDWADQEMF

SEQ ID NO: 680012 - protein, 20 aa, Mycobacterium
ILLIRACAVRRAGGLPLLYY

SEQ ID NO: 680013 - protein, 28 aa, Mycobacterium
ILLLDGLPNYQRIGSLRVGQTLREQFEA

SEQ ID NO: 680014 - protein, 18 aa, Mycobacterium
ILLLDGLPNYQRLFSLRI

SEQ ID NO: 680015 - protein, 18 aa, Mycobacterium
ILLLRLRALLARAHGDDT

SEQ ID NO: 680016 - protein, 17 aa, Mycobacterium
ILLLRTVLEAVGDRARI

SEQ ID NO: 680017 - protein, 25 aa, Mycobacterium
ILLNSKTRRPSVCNAAETLLIDRAI

SEQ ID NO: 680018 - protein, 25 aa, Mycobacterium
ILLNSKTRRPSVCNAAETLLVDATI

SEQ ID NO: 680019 - protein, 17 aa, Mycobacterium
ILLPDALLLHFNACTVG

SEQ ID NO: 680020 - protein, 28 aa, Mycobacterium
ILLPDPREIADIVAIRFALEPPAAGRAA

SEQ ID NO: 680021 - protein, 25 aa, Mycobacterium
ILLRARPGTRLVVAGVCMQPDTVHP

SEQ ID NO: 680022 - protein, 20 aa, Mycobacterium
ILLRHHFRRGVGITPTDYRK

SEQ ID NO: 680023 - protein, 17 aa, Mycobacterium
ILLRLAGAVLGTAVPDV

SEQ ID NO: 680024 - protein, 18 aa, Mycobacterium
ILLRRLGLDEVQRATKDL

SEQ ID NO: 680025 - protein, 18 aa, Mycobacterium
ILLRRRPTGLVDPEDTEL

SEQ ID NO: 680026 - protein, 18 aa, Mycobacterium
ILLSIGYAACHWCHVMAH

SEQ ID NO: 680027 - protein, 21 aa, Mycobacterium
ILLTEWRLRNTPHVPIPYVYP

SEQ ID NO: 680028 - protein, 23 aa, Mycobacterium
ILLTQGTGFNWPEPDHLRIVTLP

SEQ ID NO: 680029 - protein, 23 aa, Mycobacterium
ILLTQGTGFNWPTPDHLRIVTLP

SEQ ID NO: 680030 - protein, 20 aa, Mycobacterium
ILLVDARAGVLRQTRRHARI

SEQ ID NO: 680031 - protein, 20 aa, Mycobacterium
ILMAEWQLRETPNIPVPYVY

SEQ ID NO: 680032 - protein, 20 aa, Mycobacterium
ILMEKSLNWLTTRNAQRSIT

SEQ ID NO: 680033 - protein, 24 aa, Mycobacterium
ILMETRPSALVAIAALSRLGAVAV

SEQ ID NO: 680034 - protein, 19 aa, Mycobacterium
ILNAGVFGGSWRFPATDSL

SEQ ID NO: 680035 - protein, 23 aa, Mycobacterium
ILNDFPLFWDPRLLEHNVHLPRF

SEQ ID NO: 680036 - protein, 24 aa, Mycobacterium
ILNDFPMFWDAEFLKHNAHIPRLH

SEQ ID NO: 680037 - protein, 18 aa, Mycobacterium
ILNEFSYNMAIYGTPHET

SEQ ID NO: 680038 - protein, 21 aa, Mycobacterium
ILNGAKCWITNGGKSDWYTVM

SEQ ID NO: 680039 - protein, 20 aa, Mycobacterium
ILNGAKCWITNGGKSSWYTV

SEQ ID NO: 680040 - protein, 18 aa, Mycobacterium
ILNGGEAIVPRVARRFLR

SEQ ID NO: 680041 - protein, 25 aa, Mycobacterium
ILNGRKWFASNGMHRNCKVLIVMGK

SEQ ID NO: 680042 - protein, 20 aa, Mycobacterium
ILNGTKCWITNGGKSSWYTV

SEQ ID NO: 680043 - protein, 26 aa, Mycobacterium
ILNMTLSQRWGRLFVSVGYALRTPSA

SEQ ID NO: 680044 - protein, 25 aa, Mycobacterium
ILNVLKARELVNVVAVVSRHYGGVK

SEQ ID NO: 680045 - protein, 18 aa, Mycobacterium
ILPEAGEVIGAFRDALEK

SEQ ID NO: 680046 - protein, 24 aa, Mycobacterium
ILPEGRRAIKYLGDFVKDVTPAGD

SEQ ID NO: 680047 - protein, 23 aa, Mycobacterium
ILPEGRRALRYVGDFVKQTTGTR

SEQ ID NO: 680048 - protein, 29 aa, Mycobacterium
ILPEVSLPPWLATNLANWNTIMATLTGPF

SEQ ID NO: 680049 - protein, 26 aa, Mycobacterium
ILPFEEGWCRLAFSTGLDRLGVEPTL

SEQ ID NO: 680050 - protein, 18 aa, Mycobacterium
ILPIQFADYAVWQRNTFE

SEQ ID NO: 680051 - protein, 19 aa, Mycobacterium
ILPLLRELGIGFVAYSPLG

SEQ ID NO: 680052 - protein, 21 aa, Mycobacterium
ILPNDFRLLLVQQLNTEERRT

SEQ ID NO: 680053 - protein, 30 aa, Mycobacterium
ILPPGMPGYEEFTLYPGPDMDKAKQLIAEA

SEQ ID NO: 680054 - protein, 17 aa, Mycobacterium
ILPPQGWFDDPNPDIAF

SEQ ID NO: 680055 - protein, 17 aa, Mycobacterium
ILPRLVGQALRGEVPGP

SEQ ID NO: 680056 - protein, 18 aa, Mycobacterium
ILPRRGGTHDIRWFEAEP

SEQ ID NO: 680057 - protein, 26 aa, Mycobacterium
ILPRSFVPFKEIEGFGVRLTALEERN

SEQ ID NO: 680058 - protein, 26 aa, Mycobacterium
ILPSFPALLRKQLKGAPMPAPKAILA

SEQ ID NO: 680059 - protein, 26 aa, Mycobacterium
ILPSFPALLRKQLKGAPMPAPKAILS

SEQ ID NO: 680060 - protein, 26 aa, Mycobacterium
ILPSFPALLRKQLKGAPMPAPRAILA

SEQ ID NO: 680061 - protein, 26 aa, Mycobacterium
ILPSFPALLRKQLKGAPMPAPRAILD

SEQ ID NO: 680062 - protein, 21 aa, Mycobacterium
ILPVSYWKLTEREIFQHYRSI

SEQ ID NO: 680063 - protein, 26 aa, Mycobacterium
ILPVTDPRALAALTAFTQPWPGTPSD

SEQ ID NO: 680064 - protein, 25 aa, Mycobacterium
ILQARGRGATMVFTRTKRTAQKVSD

SEQ ID NO: 680065 - protein, 17 aa, Mycobacterium
ILQCARALSEYGVEPRH

SEQ ID NO: 680066 - protein, 18 aa, Mycobacterium
ILQDHGWDGQPPEPVRGP

SEQ ID NO: 680067 - protein, 18 aa, Mycobacterium
ILQGLCLTSSRAQWSEND

SEQ ID NO: 680068 - protein, 17 aa, Mycobacterium
ILQIEPFASMPAEDIAR

SEQ ID NO: 680069 - protein, 17 aa, Mycobacterium
ILQRRVVFRADRAAVQA

SEQ ID NO: 680070 - protein, 18 aa, Mycobacterium
ILQRRVVFRADRAAVQAI

SEQ ID NO: 680071 - protein, 18 aa, Mycobacterium
ILQRVMRSGNQLAYLDSG

SEQ ID NO: 680072 - protein, 27 aa, Mycobacterium
ILQRYKDLQDIIAILGIDELAEEDKQL

SEQ ID NO: 680073 - protein, 26 aa, Mycobacterium
ILQRYKDLQDIIAILGIDELSEEDKQ

SEQ ID NO: 680074 - protein, 18 aa, Mycobacterium
ILRAEALAEMGFDGLGTP

SEQ ID NO: 680075 - protein, 26 aa, Mycobacterium
ILRAEDLVGLGIDGHRWGLASFNPAR

SEQ ID NO: 680076 - protein, 24 aa, Mycobacterium
ILRALALNRFAKSPMLVGGQMLNL

SEQ ID NO: 680077 - protein, 20 aa, Mycobacterium
ILRAPLVKAFLLQVSAETLR

SEQ ID NO: 680078 - protein, 18 aa, Mycobacterium
ILRAVIYCHHVRVADRWR

SEQ ID NO: 680079 - protein, 21 aa, Mycobacterium
ILRDHIVALGMPLATVEDEWG

SEQ ID NO: 680080 - protein, 24 aa, Mycobacterium
ILRDPRFAIPPGINLAAQGVTSGP

SEQ ID NO: 680081 - protein, 23 aa, Mycobacterium
ILRDPRFVFPPGMHMTARGITSG

SEQ ID NO: 680082 - protein, 18 aa, Mycobacterium
ILREKIVALAAHHLEVAE

SEQ ID NO: 680083 - protein, 18 aa, Mycobacterium
ILREVVPSNAGVIIRTAS

SEQ ID NO: 680084 - protein, 21 aa, Mycobacterium
ILRGIYKFRAAPEARTHRANI

SEQ ID NO: 680085 - protein, 33 aa, Mycobacterium
ILRNAEIFYGRWGWWPMEGWLSSFADQGLIRRD

SEQ ID NO: 680086 - protein, 21 aa, Mycobacterium
ILRNEGLNWVTWVDGETTYSP

SEQ ID NO: 680087 - protein, 21 aa, Mycobacterium
ILRNFKMPGFTVPEFRRKAVI

SEQ ID NO: 680088 - protein, 18 aa, Mycobacterium
ILRNHELAKLINLDPETV

SEQ ID NO: 680089 - protein, 19 aa, Mycobacterium
ILRNRELAKLINLNPDDEV

SEQ ID NO: 680090 - protein, 18 aa, Mycobacterium
ILRNYELAKLINLDPDTE

SEQ ID NO: 680091 - protein, 23 aa, Mycobacterium
ILRQRPLDVCKTAQANADETIST

SEQ ID NO: 680092 - protein, 18 aa, Mycobacterium
ILRRAHRPVLLAGHGAAR

SEQ ID NO: 680093 - protein, 18 aa, Mycobacterium
ILRREHGVGEGWRIASVE

SEQ ID NO: 680094 - protein, 23 aa, Mycobacterium
ILRRELPELAVRVVNVVDLMRLQ

SEQ ID NO: 680095 - protein, 22 aa, Mycobacterium
ILRRELPGLGVRVVNVVDIMRL

SEQ ID NO: 680096 - protein, 17 aa, Mycobacterium
ILRRVELTTTTASGERQ

SEQ ID NO: 680097 - protein, 35 aa, Mycobacterium
ILRRVPGKPAGAVGFCFGGGLVWQLLAAGEPRLAA

SEQ ID NO: 680098 - protein, 24 aa, Mycobacterium
ILRRWPQPLSGYEIHHGRVSRCAE

SEQ ID NO: 680099 - protein, 21 aa, Mycobacterium
ILRTAYRAGCVYEWGHHAAMG

SEQ ID NO: 680100 - protein, 22 aa, Mycobacterium
ILRTGWSDVFFLHLSGNRSLVG

SEQ ID NO: 680101 - protein, 19 aa, Mycobacterium
ILRTNLAAVILQMAALGFG

SEQ ID NO: 680102 - protein, 20 aa, Mycobacterium
ILRTNLAAVLLQMAALQIGD

SEQ ID NO: 680103 - protein, 25 aa, Mycobacterium
ILRVERPNLSGARDGLMTEGGETLS

SEQ ID NO: 680104 - protein, 20 aa, Mycobacterium
ILRVRGRGIPKRAGGNGDLL

SEQ ID NO: 680105 - protein, 23 aa, Mycobacterium
ILRYIRPEFVHVFVGGRIAESGG

SEQ ID NO: 680106 - protein, 23 aa, Mycobacterium
ILRYIRPQFVHVFVGGRIVESGG

SEQ ID NO: 680107 - protein, 25 aa, Mycobacterium
ILSAATVFVCASIYEPLGIVNLEAM

SEQ ID NO: 680108 - protein, 23 aa, Mycobacterium
ILSALWALIGYQIPTPIPRISYA

SEQ ID NO: 680109 - protein, 26 aa, Mycobacterium
ILSATECWDLLKSVALGRIVTTVDNT

SEQ ID NO: 680110 - protein, 18 aa, Mycobacterium
ILSCGAVLDHLRVATSAA

SEQ ID NO: 680111 - protein, 18 aa, Mycobacterium
ILSGEVHFAIGYSEPEAG

SEQ ID NO: 680112 - protein, 18 aa, Mycobacterium
ILSHAGGFVPFIAERIAT

SEQ ID NO: 680113 - protein, 18 aa, Mycobacterium
ILSKGWHQFALVLSSAAR

SEQ ID NO: 680114 - protein, 22 aa, Mycobacterium
ILSLFYRWALDEGHALAEPFTY

SEQ ID NO: 680115 - protein, 18 aa, Mycobacterium
ILSPAGRPSWQASTVRRI

SEQ ID NO: 680116 - protein, 23 aa, Mycobacterium
ILSPELRSRIDFFSHNLATDSAF

SEQ ID NO: 680117 - protein, 18 aa, Mycobacterium
ILSPKAATLLEHAQRVAE

SEQ ID NO: 680118 - protein, 23 aa, Mycobacterium
ILSRARLLELVWGNSHFAADTRV

SEQ ID NO: 680119 - protein, 33 aa, Mycobacterium
ILSRELPESIIIAGCGAIGMEFGYVLRNYGVDV

SEQ ID NO: 680120 - protein, 34 aa, Mycobacterium
ILSRELPESIVIAGAGAIGMEFGYVLSNYGVDVT

SEQ ID NO: 680121 - protein, 26 aa, Mycobacterium
ILSRTRAPVLFAMGRFLGADRVAGLD

SEQ ID NO: 680122 - protein, 18 aa, Mycobacterium
ILSRVMRGGNQLAYLDSG

SEQ ID NO: 680123 - protein, 26 aa, Mycobacterium
ILSTPRWTELKSRVRDYLGTKIEFRL

SEQ ID NO: 680124 - protein, 18 aa, Mycobacterium
ILSVPRLRQVLHTRPLDL

SEQ ID NO: 680125 - protein, 23 aa, Mycobacterium
ILSVRSVFPAHRYPQAELSDAVA

SEQ ID NO: 680126 - protein, 22 aa, Mycobacterium
ILSYEMARGILRDNRFRLPPGV

SEQ ID NO: 680127 - protein, 24 aa, Mycobacterium
ILTAAWLRALERFQTRALAAGGET

SEQ ID NO: 680128 - protein, 34 aa, Mycobacterium
ILTALWALIGYRIPTPIPRISYADAMRRFGSDKP

SEQ ID NO: 680129 - protein, 30 aa, Mycobacterium
ILTALWALIGYRLPTPIPRITYADAMRRFG

SEQ ID NO: 680130 - protein, 29 aa, Mycobacterium
ILTAVRFPVWSGRCGFAVQEFARRHGDFA

SEQ ID NO: 680131 - protein, 22 aa, Mycobacterium
ILTDHPDRFRAMIVESSNPAHS

SEQ ID NO: 680132 - protein, 17 aa, Mycobacterium
ILTEAGVEISYDRPAHV

SEQ ID NO: 680133 - protein, 20 aa, Mycobacterium
ILTLWQTALIRLSRLKIQDE

SEQ ID NO: 680134 - protein, 22 aa, Mycobacterium
ILTPPVGRFARGIFAARAAMGL

SEQ ID NO: 680135 - protein, 23 aa, Mycobacterium
ILTRAARSGGHWLAVAEAQLRGP

SEQ ID NO: 680136 - protein, 18 aa, Mycobacterium
ILTYFGTLIAEYQQAREE

SEQ ID NO: 680137 - protein, 17 aa, Mycobacterium
ILVAGAGTGVWETVLDS

SEQ ID NO: 680138 - protein, 17 aa, Mycobacterium
ILVCGRPEMVAATRSAL

SEQ ID NO: 680139 - protein, 22 aa, Mycobacterium
ILVCPADQGPLLLVDDGQALYN

SEQ ID NO: 680140 - protein, 20 aa, Mycobacterium
ILVCPADRGPLLLVEDGERG

SEQ ID NO: 680141 - protein, 24 aa, Mycobacterium
ILVCPADRGPLVLVSQTGGGEVLY

SEQ ID NO: 680142 - protein, 19 aa, Mycobacterium
ILVGHSFGGAAVLAAARQI

SEQ ID NO: 680143 - protein, 23 aa, Mycobacterium
ILVGKRLFDLFAYDADAEQPRVN

SEQ ID NO: 680144 - protein, 20 aa, Mycobacterium
ILVHWDDFFRPLSKPLRAIP

SEQ ID NO: 680145 - protein, 20 aa, Mycobacterium
ILVNNAGLWGMPEATSAVSE

SEQ ID NO: 680146 - protein, 24 aa, Mycobacterium
ILVRRPEHFDGIHWVQKQIGHLAS

SEQ ID NO: 680147 - protein, 18 aa, Mycobacterium
ILVTEFLDGQAFPYMQTL

SEQ ID NO: 680148 - protein, 19 aa, Mycobacterium
ILVTLGYDIDKPWRKLPKR

SEQ ID NO: 680149 - protein, 26 aa, Mycobacterium
ILVVGCGESGILAGIRLKQANIPFTI

SEQ ID NO: 680150 - protein, 26 aa, Mycobacterium
ILWHIMKLYSHHGIRDFVVCCGYKGY

SEQ ID NO: 680151 - protein, 22 aa, Mycobacterium
ILYDEPRVVLLPSDHPLAQHDS

SEQ ID NO: 680152 - protein, 17 aa, Mycobacterium
ILYHAALAHASNHIVTV

SEQ ID NO: 680153 - protein, 18 aa, Mycobacterium
ILYTEARAVGASWVDPLA

SEQ ID NO: 680154 - protein, 18 aa, Mycobacterium
IMAARGAAEDGFKKEHGG

SEQ ID NO: 680155 - protein, 17 aa, Mycobacterium
IMADFTVREQGRFGFDV

SEQ ID NO: 680156 - protein, 23 aa, Mycobacterium
IMAGAVCPVEVMKRCVEEMHLTE

SEQ ID NO: 680157 - protein, 23 aa, Mycobacterium
IMAGSVCPIEVMKRVVADMHMAE

SEQ ID NO: 680158 - protein, 17 aa, Mycobacterium
IMALLIGRLRRPENGAA

SEQ ID NO: 680159 - protein, 24 aa, Mycobacterium
IMARLRSPLLPVVKDRRLLGVITA

SEQ ID NO: 680160 - protein, 22 aa, Mycobacterium
IMARNHRGFVLSLIAANRIGAD

SEQ ID NO: 680161 - protein, 26 aa, Mycobacterium
IMASKSDHCLLDLLWRNRRGELEMSV

SEQ ID NO: 680162 - protein, 18 aa, Mycobacterium
IMAVAAAVLAEFAPDATP

SEQ ID NO: 680163 - protein, 17 aa, Mycobacterium
IMAYEWPADRQSLSWTL

SEQ ID NO: 680164 - protein, 17 aa, Mycobacterium
IMDARLLIEPQLAELAC

SEQ ID NO: 680165 - protein, 24 aa, Mycobacterium
IMDDPELQPLVQRLMRIHVTEEAR

SEQ ID NO: 680166 - protein, 19 aa, Mycobacterium
IMDEIFPGGELPYVAQVSE

SEQ ID NO: 680167 - protein, 25 aa, Mycobacterium
IMDFLRGCFNFGEVEAGRECARSSF

SEQ ID NO: 680168 - protein, 22 aa, Mycobacterium
IMDLAVPFTYFLGSLAPAYDRL

SEQ ID NO: 680169 - protein, 18 aa, Mycobacterium
IMDSLRYWVTEMHVDGFR

SEQ ID NO: 680170 - protein, 18 aa, Mycobacterium
IMEDAWWGPTVPLEGAPW

SEQ ID NO: 680171 - protein, 18 aa, Mycobacterium
IMELGMGAVDLWTEELFG

SEQ ID NO: 680172 - protein, 20 aa, Mycobacterium
IMELLARIHLRRHVDDPWVR

SEQ ID NO: 680173 - protein, 26 aa, Mycobacterium
IMERFGIDAVEAFQLLTRVSQQSNIK

SEQ ID NO: 680174 - protein, 18 aa, Mycobacterium
IMESHRGPDCTVVQDAYS

SEQ ID NO: 680175 - protein, 25 aa, Mycobacterium
IMGLAELLASLGIPYDSVEGVRLAG

SEQ ID NO: 680176 - protein, 21 aa, Mycobacterium
IMGPAKPLGPIEQEDYDLGYT

SEQ ID NO: 680177 - protein, 17 aa, Mycobacterium
IMGPLLRIPRHPLALTR

SEQ ID NO: 680178 - protein, 18 aa, Mycobacterium
IMHALKVRKAIERIAATE

SEQ ID NO: 680179 - protein, 19 aa, Mycobacterium
IMHNVALIYAWWSSADAVH

SEQ ID NO: 680180 - protein, 33 aa, Mycobacterium
IMIRLTAGMWWVPVWLLRALEVIVYGPDRVSRM

SEQ ID NO: 680181 - protein, 18 aa, Mycobacterium
IMIRRRSYNYTDGLDANG

SEQ ID NO: 680182 - protein, 19 aa, Mycobacterium
IMIRRRSYNYTDGLDANGQ

SEQ ID NO: 680183 - protein, 30 aa, Mycobacterium
IMKADHGLALPRRLQIEFSQVIQQITDGEG

SEQ ID NO: 680184 - protein, 20 aa, Mycobacterium
IMKADHGLALPRRLQIEFSR

SEQ ID NO: 680185 - protein, 24 aa, Mycobacterium
IMKKGRPAHTLSVLAPSQRAADLR

SEQ ID NO: 680186 - protein, 21 aa, Mycobacterium
IMKRGAALLELGKVGRMLSAR

SEQ ID NO: 680187 - protein, 20 aa, Mycobacterium
IMLAARKVPGALKWIEDRRE

SEQ ID NO: 680188 - protein, 24 aa, Mycobacterium
IMLEEFRSGFDLERVVQRLTEPGQ

SEQ ID NO: 680189 - protein, 26 aa, Mycobacterium
IMLLEARLKTTLFDRTPRGMKLTPAG

SEQ ID NO: 680190 - protein, 22 aa, Mycobacterium
IMLLLCGVGFAVRHTPNRDDPA

SEQ ID NO: 680191 - protein, 18 aa, Mycobacterium
IMLTTRFSEFAVHVVEVC

SEQ ID NO: 680192 - protein, 24 aa, Mycobacterium
IMNLGNGVTAIFRPGPAADELAAQ

SEQ ID NO: 680193 - protein, 24 aa, Mycobacterium
IMPAGRPGPTWNHRIRAVLTTDDS

SEQ ID NO: 680194 - protein, 24 aa, Mycobacterium
IMPPDARAGCPIVSYQCAIDAISA

SEQ ID NO: 680195 - protein, 23 aa, Mycobacterium
IMQNCAYTQMGVWSENSLDRSVV

SEQ ID NO: 680196 - protein, 19 aa, Mycobacterium
IMQQAFLRSRLAGYVEQID

SEQ ID NO: 680197 - protein, 21 aa, Mycobacterium
IMRAALKYPLIAQIMRSPTAP

SEQ ID NO: 680198 - protein, 18 aa, Mycobacterium
IMRDAWRDGVVSFDGKHY

SEQ ID NO: 680199 - protein, 24 aa, Mycobacterium
IMRDCGFTRMGVWSENSLDRSVLV

SEQ ID NO: 680200 - protein, 18 aa, Mycobacterium
IMRHKSYSLPTCTVEEAA

SEQ ID NO: 680201 - protein, 18 aa, Mycobacterium
IMRLRERMGVTLQMRDFV

SEQ ID NO: 680202 - protein, 19 aa, Mycobacterium
IMRNGKLEKTFPVSLGKKG

SEQ ID NO: 680203 - protein, 19 aa, Mycobacterium
IMRQICTGLGYVHDRGIYH

SEQ ID NO: 680204 - protein, 20 aa, Mycobacterium
IMRRLLRDVAEGRELGDTST

SEQ ID NO: 680205 - protein, 26 aa, Mycobacterium
IMSGIGPKPLRAGDRLPIGPRSPSFP

SEQ ID NO: 680206 - protein, 23 aa, Mycobacterium
IMSGTLRPGTFIRLDETAAQLGV

SEQ ID NO: 680207 - protein, 18 aa, Mycobacterium
IMSLFGLHRRLRGAAIGH

SEQ ID NO: 680208 - protein, 24 aa, Mycobacterium
IMSNGSNQLVVWWLLDPPTGARSI

SEQ ID NO: 680209 - protein, 23 aa, Mycobacterium
IMSRAGYPTACFSSIDRHKALSN

SEQ ID NO: 680210 - protein, 24 aa, Mycobacterium
IMSRGGYPTACFSSFDRHKALSNY

SEQ ID NO: 680211 - protein, 23 aa, Mycobacterium
IMSSCANSQMGVWSLNSPDRTVV

SEQ ID NO: 680212 - protein, 24 aa, Mycobacterium
IMTPRTGHWMQWERAEFFNHVVRE

SEQ ID NO: 680213 - protein, 17 aa, Mycobacterium
IMTREAFENAIAVVMAF

SEQ ID NO: 680214 - protein, 27 aa, Mycobacterium
IMTTQGPGAWPRCSSCSRGDGPVGSLT

SEQ ID NO: 680215 - protein, 23 aa, Mycobacterium
IMVADLRAAWARRRTEADMRELV

SEQ ID NO: 680216 - protein, 23 aa, Mycobacterium
IMVEFPDRLRVVHWLEAERGLPT

SEQ ID NO: 680217 - protein, 19 aa, Mycobacterium
IMVSFPVECWKQPRVPDSG

SEQ ID NO: 680218 - protein, 23 aa, Mycobacterium
IMVSFPVECWKQPRVPDSGASTL

SEQ ID NO: 680219 - protein, 22 aa, Mycobacterium
IMVSLAELWRSVGVTPDAVIGH

SEQ ID NO: 680220 - protein, 17 aa, Mycobacterium
IMVVGALHYRESRGRGN

SEQ ID NO: 680221 - protein, 24 aa, Mycobacterium
IMWTASDNQLAWRWYLNGADPEQA

SEQ ID NO: 680222 - protein, 27 aa, Mycobacterium
IMYLKYNCPGFVFSTGLPGPLAAAALR

SEQ ID NO: 680223 - protein, 18 aa, Mycobacterium
IMYQVCRKAPGFAKWFLR

SEQ ID NO: 680224 - protein, 30 aa, Mycobacterium
IMYSTTWCGYCRRLETQLKAAGIDYTKVDI

SEQ ID NO: 680225 - protein, 18 aa, Mycobacterium
INAAKWAITEAISRDIPL

SEQ ID NO: 680226 - protein, 25 aa, Mycobacterium
INAALRRCGYGQLTASVERYACEHL

SEQ ID NO: 680227 - protein, 17 aa, Mycobacterium
INAAYQYREEQSKGSIT

SEQ ID NO: 680228 - protein, 18 aa, Mycobacterium
INADLRLQAAPGHTPGSS

SEQ ID NO: 680229 - protein, 25 aa, Mycobacterium
INAFARYHSDRGWPDLPSVPLETTC

SEQ ID NO: 680230 - protein, 18 aa, Mycobacterium
INAGKGKRALASELRNKG

SEQ ID NO: 680231 - protein, 17 aa, Mycobacterium
INAGNYRGSMNVTDALA

SEQ ID NO: 680232 - protein, 17 aa, Mycobacterium
INAHGPYAVGITGEDAQ

SEQ ID NO: 680233 - protein, 19 aa, Mycobacterium
INAHGPYAVGITGEDAQLF

SEQ ID NO: 680234 - protein, 18 aa, Mycobacterium
INAKFVFVGAGGGALPLL

SEQ ID NO: 680235 - protein, 17 aa, Mycobacterium
INALLAIGFEWGIALRH

SEQ ID NO: 680236 - protein, 23 aa, Mycobacterium
INALPEWLKRKAIQRLNGNQDAD

SEQ ID NO: 680237 - protein, 20 aa, Mycobacterium
INALRLLSEFLGRRPDGGLV

SEQ ID NO: 680238 - protein, 17 aa, Mycobacterium
INALRWRPHPWGEDLRS

SEQ ID NO: 680239 - protein, 17 aa, Mycobacterium
INAPALALLHRPLIGDG

SEQ ID NO: 680240 - protein, 24 aa, Mycobacterium
INAPDLDAALKWAAEGSAACEEAV

SEQ ID NO: 680241 - protein, 25 aa, Mycobacterium
INAPFDALTGRPLIGNGTPGAAGSG

SEQ ID NO: 680242 - protein, 18 aa, Mycobacterium
INAPSLALLGRPLIGNGA

SEQ ID NO: 680243 - protein, 28 aa, Mycobacterium
INAPTEALLGRPLIGDGANGSAPGQAGG

SEQ ID NO: 680244 - protein, 29 aa, Mycobacterium
INAPTQALFGRPLIGNGADGAAGTGQTGQ

SEQ ID NO: 680245 - protein, 18 aa, Mycobacterium
INAQRHFHRYGTTKETLG

SEQ ID NO: 680246 - protein, 20 aa, Mycobacterium
INAVMGIPFVHADYQHLTQA

SEQ ID NO: 680247 - protein, 20 aa, Mycobacterium
INCNPKVISIAARPRQESRC

SEQ ID NO: 680248 - protein, 28 aa, Mycobacterium
INCPGWVEAFRWLKPILSTRLGELPVLR

SEQ ID NO: 680249 - protein, 23 aa, Mycobacterium
INDAPLFLVWVADLGRARRIAER

SEQ ID NO: 680250 - protein, 23 aa, Mycobacterium
INDEYPFLLGHEAAGRVEAVGPD

SEQ ID NO: 680251 - protein, 23 aa, Mycobacterium
INDEYPFLLGHEAAGRVEAVGPG

SEQ ID NO: 680252 - protein, 22 aa, Mycobacterium
INDEYPFLLGHEAAGTVEAVGP

SEQ ID NO: 680253 - protein, 24 aa, Mycobacterium
INDLELLNCLLLLFMAGLDTVSNQ

SEQ ID NO: 680254 - protein, 17 aa, Mycobacterium
INDPRFELTAVWVSSEA

SEQ ID NO: 680255 - protein, 19 aa, Mycobacterium
INDRCRALRPHAATLVDGF

SEQ ID NO: 680256 - protein, 18 aa, Mycobacterium
INEAASLVQDAAHPEANI

SEQ ID NO: 680257 - protein, 18 aa, Mycobacterium
INEAASLVQEAAHPEANI

SEQ ID NO: 680258 - protein, 17 aa, Mycobacterium
INEAASLVQESAHPEAN

SEQ ID NO: 680259 - protein, 26 aa, Mycobacterium
INEAFAAMCVATIKLLDLDPEKVNVS

SEQ ID NO: 680260 - protein, 21 aa, Mycobacterium
INEAFASVVLSWARVHEPDMA

SEQ ID NO: 680261 - protein, 22 aa, Mycobacterium
INEAFASVVLSWARVHNPDMDK

SEQ ID NO: 680262 - protein, 17 aa, Mycobacterium
INEGAAMIRSKGEAGTG

SEQ ID NO: 680263 - protein, 17 aa, Mycobacterium
INEKPPWVIAKELADRA

SEQ ID NO: 680264 - protein, 23 aa, Mycobacterium
INESANRLAHWLIGQGIGTEDRV

SEQ ID NO: 680265 - protein, 17 aa, Mycobacterium
INFQRPIANRTLAEQAV

SEQ ID NO: 680266 - protein, 26 aa, Mycobacterium
INFTNVCYTGCRFCAFAQRKGDADAY

SEQ ID NO: 680267 - protein, 17 aa, Mycobacterium
INGAKAFITNSGTDITA

SEQ ID NO: 680268 - protein, 18 aa, Mycobacterium
INGAKTWSTSAFAADYGL

SEQ ID NO: 680269 - protein, 18 aa, Mycobacterium
INGEKLWTSWAHHATRCI

SEQ ID NO: 680270 - protein, 21 aa, Mycobacterium
INGFAGFPIGGRFLRTANPAL

SEQ ID NO: 680271 - protein, 18 aa, Mycobacterium
INGGNYFGADSPFGGFKQ

SEQ ID NO: 680272 - protein, 18 aa, Mycobacterium
INGGNYFSPDSPFGGYKQ

SEQ ID NO: 680273 - protein, 23 aa, Mycobacterium
INGICCGAGLDWVTTGDIVIASD

SEQ ID NO: 680274 - protein, 17 aa, Mycobacterium
INGPSPQRVMCFQDSLQ

SEQ ID NO: 680275 - protein, 23 aa, Mycobacterium
INGRPRLLCMTRMSTFGEDEVVT

SEQ ID NO: 680276 - protein, 21 aa, Mycobacterium
INGRPRLMCMTRMSTFAEDEV

SEQ ID NO: 680277 - protein, 21 aa, Mycobacterium
INGRPRLMCMTRMSTFDESET

SEQ ID NO: 680278 - protein, 23 aa, Mycobacterium
INGYPRLLCMTRMSTFAEDEVVT

SEQ ID NO: 680279 - protein, 26 aa, Mycobacterium
INHALMAWAQALGRMHVATVGREGDF

SEQ ID NO: 680280 - protein, 19 aa, Mycobacterium
INHGFDLSAPFGGYKRSGN

SEQ ID NO: 680281 - protein, 18 aa, Mycobacterium
INHIALWARSRAEVDRFH

SEQ ID NO: 680282 - protein, 18 aa, Mycobacterium
INHLGHFALTCLLGDRIR

SEQ ID NO: 680283 - protein, 17 aa, Mycobacterium
INHSVWFHRPLRFDDWV

SEQ ID NO: 680284 - protein, 26 aa, Mycobacterium
INHVLPAWDVCCGLYAALSVVTAVHR

SEQ ID NO: 680285 - protein, 17 aa, Mycobacterium
INIARVFHRDQKFRFHR

SEQ ID NO: 680286 - protein, 22 aa, Mycobacterium
INIGGPEKFSFADMAGAVLAAR

SEQ ID NO: 680287 - protein, 18 aa, Mycobacterium
INIGIGYVNSYRRWQDVN

SEQ ID NO: 680288 - protein, 30 aa, Mycobacterium
INIGQAVFDTVAWNMFAVIASSILNGNTVP

SEQ ID NO: 680289 - protein, 17 aa, Mycobacterium
INIGSVLGLLPAPYAAL

SEQ ID NO: 680290 - protein, 18 aa, Mycobacterium
INIPEDFDGIAAHRSSVT

SEQ ID NO: 680291 - protein, 18 aa, Mycobacterium
INIPEDFEGIAAHRSSVT

SEQ ID NO: 680292 - protein, 30 aa, Mycobacterium
INIPLDCRDGACGTCKALCESGRYDAGTYI

SEQ ID NO: 680293 - protein, 25 aa, Mycobacterium
INIPLDCRDGACGTCKALCETGSYD

SEQ ID NO: 680294 - protein, 17 aa, Mycobacterium
INIPVAATLGVIKVGTF

SEQ ID NO: 680295 - protein, 17 aa, Mycobacterium
INIRGTFLLTKAALPHL

SEQ ID NO: 680296 - protein, 17 aa, Mycobacterium
INIRNALSDELQKQPPD

SEQ ID NO: 680297 - protein, 23 aa, Mycobacterium
INIRTSLRISPAVYVRLICPPEL

SEQ ID NO: 680298 - protein, 25 aa, Mycobacterium
INKITWANACRFFGWDPFARTPREQ

SEQ ID NO: 680299 - protein, 24 aa, Mycobacterium
INKLLPILAPIVLAYLGRKLSGGQ

SEQ ID NO: 680300 - protein, 28 aa, Mycobacterium
INLAMTEFKMFYNLPVEGLDIPKSALGA

SEQ ID NO: 680301 - protein, 17 aa, Mycobacterium
INLARLATLGLRHGAAG

SEQ ID NO: 680302 - protein, 31 aa, Mycobacterium
INLELRYRGLRAPHKIKMGVSGCARECAEAR

SEQ ID NO: 680303 - protein, 19 aa, Mycobacterium
INLIGSFNLIRLAATAISQ

SEQ ID NO: 680304 - protein, 21 aa, Mycobacterium
INLRGAWLCTKHAAPKMVERG

SEQ ID NO: 680305 - protein, 19 aa, Mycobacterium
INLVAYAWGGKHLRPGDEI

SEQ ID NO: 680306 - protein, 20 aa, Mycobacterium
INMFEFARPVVEACGEKWPR

SEQ ID NO: 680307 - protein, 27 aa, Mycobacterium
INMFEFARPVVEACGVNWPRVRVNGPL

SEQ ID NO: 680308 - protein, 18 aa, Mycobacterium
INMPVTVRIPSFGGIGAA

SEQ ID NO: 680309 - protein, 18 aa, Mycobacterium
INNAFRVPSMKPFANTTF

SEQ ID NO: 680310 - protein, 22 aa, Mycobacterium
INNAFRVPSMKPLAGTSFQHIR

SEQ ID NO: 680311 - protein, 17 aa, Mycobacterium
INNSMMFHPMHLHGHTF

SEQ ID NO: 680312 - protein, 17 aa, Mycobacterium
INNVLAFPGVFRGALDA

SEQ ID NO: 680313 - protein, 17 aa, Mycobacterium
INPANGIEAVFASAAEL

SEQ ID NO: 680314 - protein, 23 aa, Mycobacterium
INPARISEAMFAKHLHRADIPDV

SEQ ID NO: 680315 - protein, 21 aa, Mycobacterium
INPDAGLLLREVGTDVLGSAR

SEQ ID NO: 680316 - protein, 20 aa, Mycobacterium
INPEAWRWYRDVVGAGHTPI

SEQ ID NO: 680317 - protein, 25 aa, Mycobacterium
INPEAWRWYREVIGAGRTPVVDTWW

SEQ ID NO: 680318 - protein, 24 aa, Mycobacterium
INPEAWRWYREVIGGNRTPIVDTW

SEQ ID NO: 680319 - protein, 23 aa, Mycobacterium
INPEAWRWYRKVIGADSLPIVDT

SEQ ID NO: 680320 - protein, 24 aa, Mycobacterium
INPEAWRWYRTVIGADRLPIVDTW

SEQ ID NO: 680321 - protein, 21 aa, Mycobacterium
INPGIDTCLERAATDQRPDWT

SEQ ID NO: 680322 - protein, 32 aa, Mycobacterium
INPLVWGALTPRIISLDVEYFGVMWPNNSAVG

SEQ ID NO: 680323 - protein, 28 aa, Mycobacterium
INPPSGCSFHTRCPWATEICKEETPALV

SEQ ID NO: 680324 - protein, 20 aa, Mycobacterium
INPQSDWRSTELVVSQADER

SEQ ID NO: 680325 - protein, 24 aa, Mycobacterium
INQLREVVDFTALPSGIFDFAARN

SEQ ID NO: 680326 - protein, 41 aa, Mycobacterium
INQQRPSRLVVCLDLDWRPQFRVDLVPSYKAHRVAEAEPAG

SEQ ID NO: 680327 - protein, 29 aa, Mycobacterium
INRAGDGTGCLRVRAGIPAGYYADHSGFC

SEQ ID NO: 680328 - protein, 19 aa, Mycobacterium
INRHIKRGGKVWINVFPDR

SEQ ID NO: 680329 - protein, 20 aa, Mycobacterium
INRHIKRGGKVWINVFPDRP

SEQ ID NO: 680330 - protein, 17 aa, Mycobacterium
INRLPVLLLPADTFATR

SEQ ID NO: 680331 - protein, 18 aa, Mycobacterium
INRLRAGDVSTYELAELL

SEQ ID NO: 680332 - protein, 17 aa, Mycobacterium
INRMAPDLAPQWASAPH

SEQ ID NO: 680333 - protein, 17 aa, Mycobacterium
INRNRPVAIDALIEAAW

SEQ ID NO: 680334 - protein, 24 aa, Mycobacterium
INRRLAAISSLFAFREMRDPDARS

SEQ ID NO: 680335 - protein, 22 aa, Mycobacterium
INRVKGLVARKVLELFRNPDGS

SEQ ID NO: 680336 - protein, 24 aa, Mycobacterium
INRVKTWLQFPQWFYMNNPPNVFE

SEQ ID NO: 680337 - protein, 18 aa, Mycobacterium
INSALMYFGPGSRSMLAA

SEQ ID NO: 680338 - protein, 17 aa, Mycobacterium
INSARIFAGAGSGPMLQ

SEQ ID NO: 680339 - protein, 17 aa, Mycobacterium
INSARIFAGAGSSPMLD

SEQ ID NO: 680340 - protein, 25 aa, Mycobacterium
INSASLRFIHRDDLEAEGYGRYLSL

SEQ ID NO: 680341 - protein, 17 aa, Mycobacterium
INSEWRQFVELVGEDPA

SEQ ID NO: 680342 - protein, 18 aa, Mycobacterium
INSGRMYIGPGSGPMLAA

SEQ ID NO: 680343 - protein, 20 aa, Mycobacterium
INSKAAYFFLQQAGKRLNDN

SEQ ID NO: 680344 - protein, 25 aa, Mycobacterium
INSPGWVGLMRWLKPVLSTPIGETP

SEQ ID NO: 680345 - protein, 18 aa, Mycobacterium
INSRRWYSLALAPRRRHR

SEQ ID NO: 680346 - protein, 18 aa, Mycobacterium
INSTRMFSGAGLGPMLAA

SEQ ID NO: 680347 - protein, 18 aa, Mycobacterium
INTDNMFGFWDWVGGRYS

SEQ ID NO: 680348 - protein, 20 aa, Mycobacterium
INTEIPIEWCRMSDERPEVT

SEQ ID NO: 680349 - protein, 24 aa, Mycobacterium
INTISGQYLIGNGINGTADNPNGG

SEQ ID NO: 680350 - protein, 17 aa, Mycobacterium
INTTIWVLRGHAFLGYW

SEQ ID NO: 680351 - protein, 18 aa, Mycobacterium
INVACSLGMLTAEQVEQL

SEQ ID NO: 680352 - protein, 17 aa, Mycobacterium
INVCRAREMVRRGDRDE

SEQ ID NO: 680353 - protein, 19 aa, Mycobacterium
INVKPKFAVDALVATIGQE

SEQ ID NO: 680354 - protein, 19 aa, Mycobacterium
INVKPKFAVDAMVATIGQQ

SEQ ID NO: 680355 - protein, 17 aa, Mycobacterium
INVRSARVLAHRQPVGE

SEQ ID NO: 680356 - protein, 20 aa, Mycobacterium
INVTSALAFVPKAVAPTYCA

SEQ ID NO: 680357 - protein, 25 aa, Mycobacterium
INYLGPIRLLLGLLPAMRESGRGHI

SEQ ID NO: 680358 - protein, 24 aa, Mycobacterium
INYLGPIWLLLGLLPAMREAGRGH

SEQ ID NO: 680359 - protein, 24 aa, Mycobacterium
INYLGPIWLLLGLLPAMRESGRGH

SEQ ID NO: 680360 - protein, 28 aa, Mycobacterium
INYNRKGWKVWPTRAVLTAVEPNKRLAW

SEQ ID NO: 680361 - protein, 23 aa, Mycobacterium
INYRLSADGIRALIRRLPEPLVI

SEQ ID NO: 680362 - protein, 21 aa, Mycobacterium
IPAAEAMLGLPVISAATATSW

SEQ ID NO: 680363 - protein, 17 aa, Mycobacterium
IPAALRVAPRMLGQGTA

SEQ ID NO: 680364 - protein, 23 aa, Mycobacterium
IPAARPLREVWVPGADLRDPSTL

SEQ ID NO: 680365 - protein, 23 aa, Mycobacterium
IPAASMLPFRFTVNGYRGCSHAC

SEQ ID NO: 680366 - protein, 28 aa, Mycobacterium
IPACGECPPCLKGFRSLCDRGAVLLGGK

SEQ ID NO: 680367 - protein, 20 aa, Mycobacterium
IPADAQIDMCMGSANRDEGR

SEQ ID NO: 680368 - protein, 32 aa, Mycobacterium
IPADERAKWATYPILAVQGWAQHHELQLRAVV

SEQ ID NO: 680369 - protein, 17 aa, Mycobacterium
IPADIAAAIAEHQNDDM

SEQ ID NO: 680370 - protein, 22 aa, Mycobacterium
IPADLQGSAAYRSRVCATMVAR

SEQ ID NO: 680371 - protein, 25 aa, Mycobacterium
IPADVLGCLPRRSLAFDMPAEYVYR

SEQ ID NO: 680372 - protein, 26 aa, Mycobacterium
IPAEARARLLYERSLGMLDSTVGNAL

SEQ ID NO: 680373 - protein, 20 aa, Mycobacterium
IPAEIDVASAAFWAADAGHR

SEQ ID NO: 680374 - protein, 17 aa, Mycobacterium
IPAGAVIDVCIGSANRD

SEQ ID NO: 680375 - protein, 31 aa, Mycobacterium
IPAGERARCATYPLLAVQAWATHHDTTLRAV

SEQ ID NO: 680376 - protein, 19 aa, Mycobacterium
IPAGFMAPSENGIGGTGGD

SEQ ID NO: 680377 - protein, 17 aa, Mycobacterium
IPAGGAIAVVASNAAMG

SEQ ID NO: 680378 - protein, 18 aa, Mycobacterium
IPAGGLFSGAEEKMSPEE

SEQ ID NO: 680379 - protein, 24 aa, Mycobacterium
IPAGHCAAVRFEIRGWVGGEPKIV

SEQ ID NO: 680380 - protein, 18 aa, Mycobacterium
IPAGPLVGEAWRYLKELR

SEQ ID NO: 680381 - protein, 19 aa, Mycobacterium
IPALAHRVLEIYWQQVRPF

SEQ ID NO: 680382 - protein, 18 aa, Mycobacterium
IPALCGLKNGLLDAEHSL

SEQ ID NO: 680383 - protein, 17 aa, Mycobacterium
IPALLPPSARVRGSVKL

SEQ ID NO: 680384 - protein, 36 aa, Mycobacterium
IPALNAAEVAALWSRLMTALGYPRYGAVGGDIGSSV

SEQ ID NO: 680385 - protein, 17 aa, Mycobacterium
IPALPDLDGIRVLRTFD

SEQ ID NO: 680386 - protein, 18 aa, Mycobacterium
IPANRPGRAVSLEKHHLM

SEQ ID NO: 680387 - protein, 25 aa, Mycobacterium
IPANTARCSGLANLKARAQQAGGSC

SEQ ID NO: 680388 - protein, 20 aa, Mycobacterium
IPAPARRTGGHPAKRTFQAL

SEQ ID NO: 680389 - protein, 20 aa, Mycobacterium
IPAPCAPPATPVEPTVETAV

SEQ ID NO: 680390 - protein, 18 aa, Mycobacterium
IPAPLFPGFDTLGTLEHI

SEQ ID NO: 680391 - protein, 21 aa, Mycobacterium
IPAPTSGVLTKIVAREDDTVE

SEQ ID NO: 680392 - protein, 22 aa, Mycobacterium
IPAQAIAQVCELTWQLRGQAGD

SEQ ID NO: 680393 - protein, 22 aa, Mycobacterium
IPAQAIAQVCELTWQLRGRATG

SEQ ID NO: 680394 - protein, 17 aa, Mycobacterium
IPAQELVTITGQPVSVP

SEQ ID NO: 680395 - protein, 18 aa, Mycobacterium
IPAQGVWPLAASLDHVGV

SEQ ID NO: 680396 - protein, 18 aa, Mycobacterium
IPARIELLEQMPLTSNGK

SEQ ID NO: 680397 - protein, 22 aa, Mycobacterium
IPARPPADYELVRFANRSARRG

SEQ ID NO: 680398 - protein, 19 aa, Mycobacterium
IPARPVIIGPITFLLLSKA

SEQ ID NO: 680399 - protein, 22 aa, Mycobacterium
IPASALRPMFVYRHQQLADDLA

SEQ ID NO: 680400 - protein, 21 aa, Mycobacterium
IPASCCGLVGLKPSQGRITLG

SEQ ID NO: 680401 - protein, 26 aa, Mycobacterium
IPASRVDEVLEMVGLASAADRNAGAL

SEQ ID NO: 680402 - protein, 17 aa, Mycobacterium
IPATRGLFRRVILHSAP

SEQ ID NO: 680403 - protein, 21 aa, Mycobacterium
IPATRSYRYIDYWGTAVTAFD

SEQ ID NO: 680404 - protein, 30 aa, Mycobacterium
IPAVCAAPPGLLCALDLPLITGAGLVRPVA

SEQ ID NO: 680405 - protein, 22 aa, Mycobacterium
IPAVIKNAIDWLSRPFGDGALK

SEQ ID NO: 680406 - protein, 27 aa, Mycobacterium
IPAVLHYYWRFVPEADEDGVVEFLLTA

SEQ ID NO: 680407 - protein, 18 aa, Mycobacterium
IPAVPGLAQARPWTNRDL

SEQ ID NO: 680408 - protein, 18 aa, Mycobacterium
IPCREVGGALMFSTQGLY

SEQ ID NO: 680409 - protein, 25 aa, Mycobacterium
IPCRTFAAWLNRRGWVKTFTAKAIP

SEQ ID NO: 680410 - protein, 19 aa, Mycobacterium
IPCSVEILTAICVATRVIL

SEQ ID NO: 680411 - protein, 17 aa, Mycobacterium
IPCTVSGTVTIGDTSYR

SEQ ID NO: 680412 - protein, 17 aa, Mycobacterium
IPCTVSGTVTVGDATYR

SEQ ID NO: 680413 - protein, 25 aa, Mycobacterium
IPDAAALCHALAAGGIRTVELTFTT

SEQ ID NO: 680414 - protein, 18 aa, Mycobacterium
IPDARWQPAFTPARPDDF

SEQ ID NO: 680415 - protein, 18 aa, Mycobacterium
IPDELSFVEAAPMGCAGV

SEQ ID NO: 680416 - protein, 24 aa, Mycobacterium
IPDELTVLCGMSIGYADPAFPANH

SEQ ID NO: 680417 - protein, 27 aa, Mycobacterium
IPDFVKLAEALGCVGLRCERAEDVVDV

SEQ ID NO: 680418 - protein, 26 aa, Mycobacterium
IPDFVKLAEALGCVGLRCEREEDVAK

SEQ ID NO: 680419 - protein, 27 aa, Mycobacterium
IPDFVKLAEALGCVGLRCEREEDVEDV

SEQ ID NO: 680420 - protein, 18 aa, Mycobacterium
IPDGLSFVEAAPMGCAGV

SEQ ID NO: 680421 - protein, 17 aa, Mycobacterium
IPDGQTWVFPILQFETG

SEQ ID NO: 680422 - protein, 20 aa, Mycobacterium
IPDGTLYYMGIFQFDDELVH

SEQ ID NO: 680423 - protein, 26 aa, Mycobacterium
IPDHRLGEVGRAFIVARPGFNLDEKS

SEQ ID NO: 680424 - protein, 20 aa, Mycobacterium
IPDIFAADGEREFRRIEEEA

SEQ ID NO: 680425 - protein, 28 aa, Mycobacterium
IPDILRAEGLRWIDWVAGETTYSPLPAT

SEQ ID NO: 680426 - protein, 17 aa, Mycobacterium
IPDKGRILTAMSVFFFD

SEQ ID NO: 680427 - protein, 19 aa, Mycobacterium
IPDKGRVLTAMSVFFFGLV

SEQ ID NO: 680428 - protein, 24 aa, Mycobacterium
IPDLETFAVLPWDTSFARVFCRLY

SEQ ID NO: 680429 - protein, 20 aa, Mycobacterium
IPDLLRWDVQLENTWATRTM

SEQ ID NO: 680430 - protein, 18 aa, Mycobacterium
IPDMAQWGIFLRNHDELT

SEQ ID NO: 680431 - protein, 25 aa, Mycobacterium
IPDNEFRVVLARRGQHWVSAVRVGN

SEQ ID NO: 680432 - protein, 20 aa, Mycobacterium
IPDPPAPGAVVVFSAHGVSP

SEQ ID NO: 680433 - protein, 17 aa, Mycobacterium
IPDPRYGQQVAAVVQAR

SEQ ID NO: 680434 - protein, 17 aa, Mycobacterium
IPDRGGALIALNHTSYV

SEQ ID NO: 680435 - protein, 21 aa, Mycobacterium
IPDSYSLVAMTYFPDPFVGQG

SEQ ID NO: 680436 - protein, 21 aa, Mycobacterium
IPDVMRTDLLVMIGANPVVSH

SEQ ID NO: 680437 - protein, 18 aa, Mycobacterium
IPDVPAWDSVVASRRPDR

SEQ ID NO: 680438 - protein, 20 aa, Mycobacterium
IPDVPGYAAKVFRAVADAEI

SEQ ID NO: 680439 - protein, 18 aa, Mycobacterium
IPDVVARSGLSGLANRAA

SEQ ID NO: 680440 - protein, 19 aa, Mycobacterium
IPDYEIKPGTQLTYTAALR

SEQ ID NO: 680441 - protein, 19 aa, Mycobacterium
IPDYEIKPGTQLVYTAALR

SEQ ID NO: 680442 - protein, 29 aa, Mycobacterium
IPEAASDDWTQWRWNRILIEGSNCRDIID

SEQ ID NO: 680443 - protein, 30 aa, Mycobacterium
IPEAASDEWTEWRWNRILIEGSNCRDIIDN

SEQ ID NO: 680444 - protein, 21 aa, Mycobacterium
IPEALDLVYSLGFTLTGLLPC

SEQ ID NO: 680445 - protein, 20 aa, Mycobacterium
IPEARIVNRPDWIRAAAQSM

SEQ ID NO: 680446 - protein, 21 aa, Mycobacterium
IPEARVGFVGMARDEDTWQPT

SEQ ID NO: 680447 - protein, 18 aa, Mycobacterium
IPEDIRARHAKGGELLKD

SEQ ID NO: 680448 - protein, 22 aa, Mycobacterium
IPEDVKALAIPAVAHRITLRPE

SEQ ID NO: 680449 - protein, 18 aa, Mycobacterium
IPEELLEGYLKYAESYGE

SEQ ID NO: 680450 - protein, 25 aa, Mycobacterium
IPEGKICHWGGWGGSWETMNPDKRA

SEQ ID NO: 680451 - protein, 25 aa, Mycobacterium
IPEGLLNYLALLGWSIADDHDIFSL

SEQ ID NO: 680452 - protein, 25 aa, Mycobacterium
IPEGLLNYLALLGWSIADDRDIFSV

SEQ ID NO: 680453 - protein, 19 aa, Mycobacterium
IPEGMPFLIDDDLLLEDGS

SEQ ID NO: 680454 - protein, 19 aa, Mycobacterium
IPEGYRIQLNPDINVDAIA

SEQ ID NO: 680455 - protein, 19 aa, Mycobacterium
IPEGYSIVVSISRCHADAT

SEQ ID NO: 680456 - protein, 22 aa, Mycobacterium
IPEHLVVIGGSYVGLEFAQIYR

SEQ ID NO: 680457 - protein, 30 aa, Mycobacterium
IPEIPAHIEGTIPLAVPVTMTSTNTVIHAV

SEQ ID NO: 680458 - protein, 25 aa, Mycobacterium
IPELGRPSWLTAYGLCEQPKLAAPL

SEQ ID NO: 680459 - protein, 17 aa, Mycobacterium
IPELLARASDDGILFQP

SEQ ID NO: 680460 - protein, 27 aa, Mycobacterium
IPELPEHLVIVGGGFVAAEFAHTFSSL

SEQ ID NO: 680461 - protein, 17 aa, Mycobacterium
IPELRRAITADRLARYG

SEQ ID NO: 680462 - protein, 17 aa, Mycobacterium
IPEMSVRLFDGDRDVTD

SEQ ID NO: 680463 - protein, 21 aa, Mycobacterium
IPEPARAVAEMVRVLRSGRRV

SEQ ID NO: 680464 - protein, 17 aa, Mycobacterium
IPEPTIPDGLRIRTYAG

SEQ ID NO: 680465 - protein, 24 aa, Mycobacterium
IPEPWRSKYFLTRNVGEQIYYDAP

SEQ ID NO: 680466 - protein, 23 aa, Mycobacterium
IPERARRAYPIRPIIETLADTGS

SEQ ID NO: 680467 - protein, 24 aa, Mycobacterium
IPERGDMGLRPAMTLKCPVALVRS

SEQ ID NO: 680468 - protein, 27 aa, Mycobacterium
IPERGDMGLRPAMTVKCPVALVRSVRA

SEQ ID NO: 680469 - protein, 18 aa, Mycobacterium
IPERPVGVVLFAHGSGSS

SEQ ID NO: 680470 - protein, 20 aa, Mycobacterium
IPESALRPSRTADVSHRSAN

SEQ ID NO: 680471 - protein, 19 aa, Mycobacterium
IPESPRPVVQVPLGNDLIH

SEQ ID NO: 680472 - protein, 17 aa, Mycobacterium
IPETDFRLSRFAEDNLL

SEQ ID NO: 680473 - protein, 19 aa, Mycobacterium
IPETLGLDERAGFYESTGA

SEQ ID NO: 680474 - protein, 19 aa, Mycobacterium
IPEVLAKVATARRLVDSGE

SEQ ID NO: 680475 - protein, 26 aa, Mycobacterium
IPEYSDDGWTTWDWNTIVIEGSNCRE

SEQ ID NO: 680476 - protein, 24 aa, Mycobacterium
IPFAAKLTGPWDIDALIAAVGDVL

SEQ ID NO: 680477 - protein, 20 aa, Mycobacterium
IPFATLRPAPYRQATEAVVA

SEQ ID NO: 680478 - protein, 19 aa, Mycobacterium
IPFENLDPLLGIPVADLSA

SEQ ID NO: 680479 - protein, 17 aa, Mycobacterium
IPFENLDPLMGVPVDDL

SEQ ID NO: 680480 - protein, 27 aa, Mycobacterium
IPFFATKTRFGLWFRIVAMRTMNFAPM

SEQ ID NO: 680481 - protein, 19 aa, Mycobacterium
IPFIYPDERIDAVVTGDSD

SEQ ID NO: 680482 - protein, 17 aa, Mycobacterium
IPFNLSIDEMRTYATDK

SEQ ID NO: 680483 - protein, 18 aa, Mycobacterium
IPFPGQRIKPPYVAAYVL

SEQ ID NO: 680484 - protein, 23 aa, Mycobacterium
IPFPHKGTMVIVSPIFHSTGWAT

SEQ ID NO: 680485 - protein, 24 aa, Mycobacterium
IPFPPEPLASVGIQATRWSLDRAD

SEQ ID NO: 680486 - protein, 17 aa, Mycobacterium
IPFPRPDDPLLTARQRA

SEQ ID NO: 680487 - protein, 18 aa, Mycobacterium
IPFQDWWTNPVIQDVDGT

SEQ ID NO: 680488 - protein, 17 aa, Mycobacterium
IPFQISCGHCFMCDMKL

SEQ ID NO: 680489 - protein, 28 aa, Mycobacterium
IPFQISCGHCFMCDQKLYTQCETTQVRE

SEQ ID NO: 680490 - protein, 30 aa, Mycobacterium
IPFQISCGSCYMCGQQLYTQCETTQVRDQG

SEQ ID NO: 680491 - protein, 24 aa, Mycobacterium
IPGAARLPSRYVIGMLAVGRDADP

SEQ ID NO: 680492 - protein, 18 aa, Mycobacterium
IPGALVIERNVLEWRCDP

SEQ ID NO: 680493 - protein, 19 aa, Mycobacterium
IPGAPVIGELVARGDHTIV

SEQ ID NO: 680494 - protein, 18 aa, Mycobacterium
IPGAPVIGELVARRAGHT

SEQ ID NO: 680495 - protein, 17 aa, Mycobacterium
IPGARLARAGVPVYERA

SEQ ID NO: 680496 - protein, 17 aa, Mycobacterium
IPGASLWDGILTDPLAW

SEQ ID NO: 680497 - protein, 17 aa, Mycobacterium
IPGAVILAAHSYGGAVI

SEQ ID NO: 680498 - protein, 30 aa, Mycobacterium
IPGDGGTWFLPRAVGWARAAEMTLTGDRVD

SEQ ID NO: 680499 - protein, 21 aa, Mycobacterium
IPGDPKVGFAQLYGAPGTAGA

SEQ ID NO: 680500 - protein, 24 aa, Mycobacterium
IPGDRIPYAPPFGVALAAWDDEEE

SEQ ID NO: 680501 - protein, 24 aa, Mycobacterium
IPGDRIPYAPPFGVAMAAWDTDEE

SEQ ID NO: 680502 - protein, 23 aa, Mycobacterium
IPGEPRVGFAQLYGAPGTAAATI

SEQ ID NO: 680503 - protein, 25 aa, Mycobacterium
IPGEPTVVAGLRLRRTVASIVGAEL

SEQ ID NO: 680504 - protein, 17 aa, Mycobacterium
IPGERKALIERKYSLRD

SEQ ID NO: 680505 - protein, 30 aa, Mycobacterium
IPGETVAAYIARRTGCIAATEAMESAAAAL

SEQ ID NO: 680506 - protein, 20 aa, Mycobacterium
IPGFLDPSVPFTAHTCSGTG

SEQ ID NO: 680507 - protein, 17 aa, Mycobacterium
IPGFRRNAVTIATGGVY

SEQ ID NO: 680508 - protein, 21 aa, Mycobacterium
IPGFYTRTAYGTNLAEGKDTR

SEQ ID NO: 680509 - protein, 19 aa, Mycobacterium
IPGGAFVYGAGQFQLYNGS

SEQ ID NO: 680510 - protein, 20 aa, Mycobacterium
IPGGAVLPVYDPLYDSTKVR

SEQ ID NO: 680511 - protein, 21 aa, Mycobacterium
IPGHATLQYAMRAVESDSLRQ

SEQ ID NO: 680512 - protein, 17 aa, Mycobacterium
IPGKEPWEHGAISTAQW

SEQ ID NO: 680513 - protein, 17 aa, Mycobacterium
IPGLPPITIPLLAPPPP

SEQ ID NO: 680514 - protein, 20 aa, Mycobacterium
IPGLRQALGLADDGTDERTS

SEQ ID NO: 680515 - protein, 18 aa, Mycobacterium
IPGLRRRIPVVIHEANAR

SEQ ID NO: 680516 - protein, 17 aa, Mycobacterium
IPGLVSFDVNWREQLWP

SEQ ID NO: 680517 - protein, 19 aa, Mycobacterium
IPGNRGWQTPNPHIPFDKL

SEQ ID NO: 680518 - protein, 19 aa, Mycobacterium
IPGPDWGSGASVVGTAGLR

SEQ ID NO: 680519 - protein, 21 aa, Mycobacterium
IPGPRSQALIDRKGTAVARGV

SEQ ID NO: 680520 - protein, 23 aa, Mycobacterium
IPGPRWIPKPLWKLVSAPLNAYT

SEQ ID NO: 680521 - protein, 22 aa, Mycobacterium
IPGQPGKYLAIFGDSFSGNKVG

SEQ ID NO: 680522 - protein, 20 aa, Mycobacterium
IPGQRYGFRVYGPFAPSAGH

SEQ ID NO: 680523 - protein, 17 aa, Mycobacterium
IPGRDGVSPGGGGNGGN

SEQ ID NO: 680524 - protein, 20 aa, Mycobacterium
IPGRPRPSTPGGGRLTTPPQ

SEQ ID NO: 680525 - protein, 23 aa, Mycobacterium
IPGSPQWSALLAKIAAGARDRDL

SEQ ID NO: 680526 - protein, 18 aa, Mycobacterium
IPGSRLALIDGMGHDLPE

SEQ ID NO: 680527 - protein, 19 aa, Mycobacterium
IPGTEKFGGLRNYDDPIPL

SEQ ID NO: 680528 - protein, 18 aa, Mycobacterium
IPGVDSFAGTTIHTARWD

SEQ ID NO: 680529 - protein, 17 aa, Mycobacterium
IPGWGRLLSKILAAFFT

SEQ ID NO: 680530 - protein, 22 aa, Mycobacterium
IPGWNICVDFPIKAGLNEFVSE

SEQ ID NO: 680531 - protein, 23 aa, Mycobacterium
IPGWNICVDFPIKAGLNEFVSEL

SEQ ID NO: 680532 - protein, 23 aa, Mycobacterium
IPGWNVCVDFPIKAGLHEFVTEL

SEQ ID NO: 680533 - protein, 22 aa, Mycobacterium
IPGWNVCVDFPITAGLNEFLNG

SEQ ID NO: 680534 - protein, 17 aa, Mycobacterium
IPHENLYGISWNPVNTM

SEQ ID NO: 680535 - protein, 21 aa, Mycobacterium
IPHEVGWIGGPGIGAVHLDKG

SEQ ID NO: 680536 - protein, 19 aa, Mycobacterium
IPHEVGWIGGPGLGAVHLD

SEQ ID NO: 680537 - protein, 27 aa, Mycobacterium
IPHGCPFAPRCPLAIDECTAAEPELVA

SEQ ID NO: 680538 - protein, 24 aa, Mycobacterium
IPHLGLDHRAAWVEAESDGTVTSV

SEQ ID NO: 680539 - protein, 18 aa, Mycobacterium
IPHLHPGDGGPYVNTIGF

SEQ ID NO: 680540 - protein, 24 aa, Mycobacterium
IPHQSAYCSAKFAVRGFTDALRQE

SEQ ID NO: 680541 - protein, 20 aa, Mycobacterium
IPHRDCGSFAAGGFGSGADY

SEQ ID NO: 680542 - protein, 19 aa, Mycobacterium
IPHRDCGSFAAGGMGSGAD

SEQ ID NO: 680543 - protein, 21 aa, Mycobacterium
IPHVGRRLVVFLGSTIGNLTP

SEQ ID NO: 680544 - protein, 24 aa, Mycobacterium
IPHVRARGGGSLIAITTTGVDMVE

SEQ ID NO: 680545 - protein, 22 aa, Mycobacterium
IPHVRARGGGSLIAVTTTGVTM

SEQ ID NO: 680546 - protein, 21 aa, Mycobacterium
IPHVSAPVILKYVTDLQLLGL

SEQ ID NO: 680547 - protein, 21 aa, Mycobacterium
IPHWEDADGPTECMFIHNQDF

SEQ ID NO: 680548 - protein, 20 aa, Mycobacterium
IPHWFSRRTLQGFKLSDRYV

SEQ ID NO: 680549 - protein, 25 aa, Mycobacterium
IPIAIRSGLGPISIVLLDIPAAPGF

SEQ ID NO: 680550 - protein, 19 aa, Mycobacterium
IPIAPRPAQLIVREAYNDW

SEQ ID NO: 680551 - protein, 26 aa, Mycobacterium
IPIDLRGDWPVALRAAGLDTTAPTAW

SEQ ID NO: 680552 - protein, 25 aa, Mycobacterium
IPIDLRQDWPAALLDSGFDASKPTA

SEQ ID NO: 680553 - protein, 17 aa, Mycobacterium
IPIEKPGVGSPFHGGGG

SEQ ID NO: 680554 - protein, 20 aa, Mycobacterium
IPIEPIWLCPLRLRDDNSWS

SEQ ID NO: 680555 - protein, 18 aa, Mycobacterium
IPIGKLSLYTLIGGIDPA

SEQ ID NO: 680556 - protein, 19 aa, Mycobacterium
IPIMTTWHGADRVPSEHPR

SEQ ID NO: 680557 - protein, 17 aa, Mycobacterium
IPINIARVFHRDQKFRF

SEQ ID NO: 680558 - protein, 17 aa, Mycobacterium
IPIPFPVPAGITKGRKF

SEQ ID NO: 680559 - protein, 24 aa, Mycobacterium
IPISRRAIKHAVIRREILPTRLGN

SEQ ID NO: 680560 - protein, 23 aa, Mycobacterium
IPITGTLGVFTVDGFTIPASTVE

SEQ ID NO: 680561 - protein, 20 aa, Mycobacterium
IPIVDVPAAPGFGNSTTSPS

SEQ ID NO: 680562 - protein, 23 aa, Mycobacterium
IPIYVGALGPRLTRMTAEVADGL

SEQ ID NO: 680563 - protein, 21 aa, Mycobacterium
IPKEVPQEFVSYVPQPLPRAV

SEQ ID NO: 680564 - protein, 17 aa, Mycobacterium
IPKGEYGAGKVIIWDSG

SEQ ID NO: 680565 - protein, 22 aa, Mycobacterium
IPKGLQGIAFFAARRRATEQLA

SEQ ID NO: 680566 - protein, 21 aa, Mycobacterium
IPKGRALSVEREVFPKLLSDG

SEQ ID NO: 680567 - protein, 21 aa, Mycobacterium
IPKKKWEVITAEDLENARPQI

SEQ ID NO: 680568 - protein, 28 aa, Mycobacterium
IPKLPGLHKAFYFGMGLVLQDERQGAES

SEQ ID NO: 680569 - protein, 21 aa, Mycobacterium
IPKLRIEEAAARTQARIDSGR

SEQ ID NO: 680570 - protein, 28 aa, Mycobacterium
IPKPGDWKRYEILDQSFIIVRGKDEQLR

SEQ ID NO: 680571 - protein, 24 aa, Mycobacterium
IPKSALGAGLGMRSAGAGLTSAVS

SEQ ID NO: 680572 - protein, 20 aa, Mycobacterium
IPKSPQWASSLCGLSADDLT

SEQ ID NO: 680573 - protein, 17 aa, Mycobacterium
IPLAAQLLVYPMIDDRT

SEQ ID NO: 680574 - protein, 20 aa, Mycobacterium
IPLAIARPDLEVVLLEPLLR

SEQ ID NO: 680575 - protein, 20 aa, Mycobacterium
IPLALARPDIHVTLIEPLLR

SEQ ID NO: 680576 - protein, 27 aa, Mycobacterium
IPLAPVYRWPDLAGIAVATTAPRFAFE

SEQ ID NO: 680577 - protein, 23 aa, Mycobacterium
IPLASRAAWAWFRHLHSLADRTL

SEQ ID NO: 680578 - protein, 19 aa, Mycobacterium
IPLDALRRILDVAPGVVIL

SEQ ID NO: 680579 - protein, 21 aa, Mycobacterium
IPLDDVLDAFQIVKKGEAIKV

SEQ ID NO: 680580 - protein, 17 aa, Mycobacterium
IPLDVAEGDTVIYSKYG

SEQ ID NO: 680581 - protein, 17 aa, Mycobacterium
IPLDVSEGDVVIYSKYG

SEQ ID NO: 680582 - protein, 21 aa, Mycobacterium
IPLEDGRRLYTLTDIMNTRPL

SEQ ID NO: 680583 - protein, 25 aa, Mycobacterium
IPLELPAVAVGVAWHPRNNDDAAHT

SEQ ID NO: 680584 - protein, 25 aa, Mycobacterium
IPLELPPLVIGMAWHPRFDADGAHR

SEQ ID NO: 680585 - protein, 18 aa, Mycobacterium
IPLFSFPGPGFANSTTSP

SEQ ID NO: 680586 - protein, 17 aa, Mycobacterium
IPLGAFAQWAEDFDGAP

SEQ ID NO: 680587 - protein, 19 aa, Mycobacterium
IPLGDRLVLVVGDVVGHGV

SEQ ID NO: 680588 - protein, 24 aa, Mycobacterium
IPLGVKDLYDTAGIRTTSSSAQRA

SEQ ID NO: 680589 - protein, 24 aa, Mycobacterium
IPLIDIKPAAGFFNATTGPSSGFF

SEQ ID NO: 680590 - protein, 20 aa, Mycobacterium
IPLIGFGGRVDMEFLEVCEP

SEQ ID NO: 680591 - protein, 35 aa, Mycobacterium
IPLLIVASLPNFARRLPMLRGWVADLLDRDARDRA

SEQ ID NO: 680592 - protein, 23 aa, Mycobacterium
IPLPGRRARRGVGTATPGRPLLR

SEQ ID NO: 680593 - protein, 17 aa, Mycobacterium
IPLPGRRRPSSRAVRSA

SEQ ID NO: 680594 - protein, 22 aa, Mycobacterium
IPLPRRYGRRSTTPTPVVSQRI

SEQ ID NO: 680595 - protein, 17 aa, Mycobacterium
IPLQHLVGTAAFGPLTL

SEQ ID NO: 680596 - protein, 17 aa, Mycobacterium
IPLQLPWLADPQLAPEE

SEQ ID NO: 680597 - protein, 19 aa, Mycobacterium
IPLQVFAAGVARARGYDVD

SEQ ID NO: 680598 - protein, 19 aa, Mycobacterium
IPLRGRIAVIVDDGVATGA

SEQ ID NO: 680599 - protein, 17 aa, Mycobacterium
IPLRHAYAALWRVGVLE

SEQ ID NO: 680600 - protein, 24 aa, Mycobacterium
IPLSFAQNRLWFIDQFQGPSPVYN

SEQ ID NO: 680601 - protein, 28 aa, Mycobacterium
IPLSRACLLGCGVTTGWGSAVNTADVSP

SEQ ID NO: 680602 - protein, 19 aa, Mycobacterium
IPLTAHFLGGAAIGDSPET

SEQ ID NO: 680603 - protein, 18 aa, Mycobacterium
IPLTAHFLGGAVIGDNPD

SEQ ID NO: 680604 - protein, 19 aa, Mycobacterium
IPLTAHFLGGAVIGDSPQS

SEQ ID NO: 680605 - protein, 19 aa, Mycobacterium
IPLTAHFLGGAVIGTSPEN

SEQ ID NO: 680606 - protein, 18 aa, Mycobacterium
IPLVGGRVEKVICDQIVV

SEQ ID NO: 680607 - protein, 17 aa, Mycobacterium
IPLVLGGTGPRMMELVR

SEQ ID NO: 680608 - protein, 21 aa, Mycobacterium
IPLVMLLEGAGFRPTGVHYGR

SEQ ID NO: 680609 - protein, 19 aa, Mycobacterium
IPLVVPKPIGIAVIENKII

SEQ ID NO: 680610 - protein, 33 aa, Mycobacterium
IPMAPRPNRFAGLRLGVLSNTKWNAAKLLRATV

SEQ ID NO: 680611 - protein, 20 aa, Mycobacterium
IPMDCHLMIDNPDRWAPPYA

SEQ ID NO: 680612 - protein, 17 aa, Mycobacterium
IPMGGKLGDPARDLGPM

SEQ ID NO: 680613 - protein, 19 aa, Mycobacterium
IPMSAPVVVVGGGLTGIEA

SEQ ID NO: 680614 - protein, 23 aa, Mycobacterium
IPMTARAAWAWFRHLHGLADRTL

SEQ ID NO: 680615 - protein, 17 aa, Mycobacterium
IPMVALAGMRREQELPH

SEQ ID NO: 680616 - protein, 17 aa, Mycobacterium
IPNCPVVTPATLFDEWF

SEQ ID NO: 680617 - protein, 28 aa, Mycobacterium
IPNEKFRYGFAIAPELVRTVLRDQEPDW

SEQ ID NO: 680618 - protein, 18 aa, Mycobacterium
IPNGATAFKCCPPIREAS

SEQ ID NO: 680619 - protein, 18 aa, Mycobacterium
IPNGGDVFGCQPRTAPDW

SEQ ID NO: 680620 - protein, 17 aa, Mycobacterium
IPNMYKIAGELTSAVIH

SEQ ID NO: 680621 - protein, 17 aa, Mycobacterium
IPNMYKIAGELTSAVMH

SEQ ID NO: 680622 - protein, 24 aa, Mycobacterium
IPNPCNRCGGDGRVRARREISVKI

SEQ ID NO: 680623 - protein, 18 aa, Mycobacterium
IPNPFVIGTDLVIGAVHG

SEQ ID NO: 680624 - protein, 21 aa, Mycobacterium
IPNPGISAWVALSHGAAVQPG

SEQ ID NO: 680625 - protein, 25 aa, Mycobacterium
IPNRGELAFLPGQYVNIAVPGTDQT

SEQ ID NO: 680626 - protein, 25 aa, Mycobacterium
IPPAHRASIEFTPPLPAEYEQLARH

SEQ ID NO: 680627 - protein, 26 aa, Mycobacterium
IPPDRRYPGDWRVIRGLTQPQLAAAT

SEQ ID NO: 680628 - protein, 25 aa, Mycobacterium
IPPELNILCGLAIGYSDPEFPANRL

SEQ ID NO: 680629 - protein, 22 aa, Mycobacterium
IPPELRPMVQLDGGRFATSDLN

SEQ ID NO: 680630 - protein, 27 aa, Mycobacterium
IPPEMIEPPEAMARAAVLLAQQDGTGV

SEQ ID NO: 680631 - protein, 17 aa, Mycobacterium
IPPERYQQVDGAPPPDQ

SEQ ID NO: 680632 - protein, 22 aa, Mycobacterium
IPPEVNSGLMYAGPGPGSMLTS

SEQ ID NO: 680633 - protein, 18 aa, Mycobacterium
IPPFPANLTTLVMGGTGI

SEQ ID NO: 680634 - protein, 20 aa, Mycobacterium
IPPFYVMDVWLAAAERQRTH

SEQ ID NO: 680635 - protein, 19 aa, Mycobacterium
IPPGAGFANLPVHRILLQD

SEQ ID NO: 680636 - protein, 19 aa, Mycobacterium
IPPGERRIAVVFSAYPTKH

SEQ ID NO: 680637 - protein, 25 aa, Mycobacterium
IPPGMSYEPKWDGFRSILFRDGAEV

SEQ ID NO: 680638 - protein, 18 aa, Mycobacterium
IPPGNRFTTTGRRLGNNA

SEQ ID NO: 680639 - protein, 17 aa, Mycobacterium
IPPGPQVGEAWKYLKEL

SEQ ID NO: 680640 - protein, 19 aa, Mycobacterium
IPPHLGRRMGLRPSLHLRR

SEQ ID NO: 680641 - protein, 18 aa, Mycobacterium
IPPIGGLGGKGGSGGLGP

SEQ ID NO: 680642 - protein, 21 aa, Mycobacterium
IPPLASQTFRSWFASRPASPA

SEQ ID NO: 680643 - protein, 17 aa, Mycobacterium
IPPLDWDPDEAFDRLQS

SEQ ID NO: 680644 - protein, 19 aa, Mycobacterium
IPPLFVMSWIDGSSLEPLF

SEQ ID NO: 680645 - protein, 19 aa, Mycobacterium
IPPLPGMSALELSAADVWA

SEQ ID NO: 680646 - protein, 18 aa, Mycobacterium
IPPMFDLRSPVLRRAEAI

SEQ ID NO: 680647 - protein, 17 aa, Mycobacterium
IPPRSVIPIQPETIREL

SEQ ID NO: 680648 - protein, 20 aa, Mycobacterium
IPPSSLPAATGTRGDSPPYG

SEQ ID NO: 680649 - protein, 17 aa, Mycobacterium
IPPTIVGAFTLPEITTP

SEQ ID NO: 680650 - protein, 24 aa, Mycobacterium
IPPTQRGEIHWCQLFSEPGAGSDL

SEQ ID NO: 680651 - protein, 17 aa, Mycobacterium
IPPTWPAHVRPGVVGTH

SEQ ID NO: 680652 - protein, 24 aa, Mycobacterium
IPQALLERAMKVFPNAEFVQGYGM

SEQ ID NO: 680653 - protein, 26 aa, Mycobacterium
IPQEVRDACSMLGLDPLYVANEGKLV

SEQ ID NO: 680654 - protein, 18 aa, Mycobacterium
IPQFLAIAREAAERASGL

SEQ ID NO: 680655 - protein, 24 aa, Mycobacterium
IPQFNYPAPALWYFPTQANGSVNA

SEQ ID NO: 680656 - protein, 18 aa, Mycobacterium
IPQLLSMYKARKLNIDDM

SEQ ID NO: 680657 - protein, 18 aa, Mycobacterium
IPQLSQREAWPVLRRNLS

SEQ ID NO: 680658 - protein, 20 aa, Mycobacterium
IPQLSWQTPVAVWGYSGGGT

SEQ ID NO: 680659 - protein, 20 aa, Mycobacterium
IPQMVSAGMIPFSLDQASEV

SEQ ID NO: 680660 - protein, 19 aa, Mycobacterium
IPQPVRSLVMLALITPERP

SEQ ID NO: 680661 - protein, 21 aa, Mycobacterium
IPQRTDPDWLRAGFTCDMANA

SEQ ID NO: 680662 - protein, 17 aa, Mycobacterium
IPRAELFVTTKVATADH

SEQ ID NO: 680663 - protein, 20 aa, Mycobacterium
IPRARSAEVQQRIADCVDDL

SEQ ID NO: 680664 - protein, 17 aa, Mycobacterium
IPRDEIYVTTKLATPDQ

SEQ ID NO: 680665 - protein, 22 aa, Mycobacterium
IPRELRLAVRESLLALLSEQSS

SEQ ID NO: 680666 - protein, 19 aa, Mycobacterium
IPRFDPRKALEVIERDAVT

SEQ ID NO: 680667 - protein, 23 aa, Mycobacterium
IPRFLQGLGFSLSRQWTVAQVVR

SEQ ID NO: 680668 - protein, 25 aa, Mycobacterium
IPRGLGRRRRVPVLIHEANASAGLA

SEQ ID NO: 680669 - protein, 27 aa, Mycobacterium
IPRGLPLPAHTAWLLFPGDRDALRVSG

SEQ ID NO: 680670 - protein, 26 aa, Mycobacterium
IPRGVNRWAVSLAYLTDVLFNRSVVS

SEQ ID NO: 680671 - protein, 24 aa, Mycobacterium
IPRHLRLHSLFPRDALAHTDVVTG

SEQ ID NO: 680672 - protein, 17 aa, Mycobacterium
IPRISYADAMRRFGSDK

SEQ ID NO: 680673 - protein, 20 aa, Mycobacterium
IPRKKGIGLLQADLLVVNKI

SEQ ID NO: 680674 - protein, 20 aa, Mycobacterium
IPRNVFGPGLSIAHIGSIVV

SEQ ID NO: 680675 - protein, 21 aa, Mycobacterium
IPRPELFALSSKQLLEMALAV

SEQ ID NO: 680676 - protein, 23 aa, Mycobacterium
IPRPETESLYAWAAGQLAPHATV

SEQ ID NO: 680677 - protein, 21 aa, Mycobacterium
IPRPEYAWKPTVQEGSEPWVQ

SEQ ID NO: 680678 - protein, 24 aa, Mycobacterium
IPRPPSIRDSLCFLDHMRNCQAAL

SEQ ID NO: 680679 - protein, 25 aa, Mycobacterium
IPRPPSIRDSLCFLDHMRNCQAALG

SEQ ID NO: 680680 - protein, 24 aa, Mycobacterium
IPRPPSIRDSLCFLDHMRNCQQAM

SEQ ID NO: 680681 - protein, 19 aa, Mycobacterium
IPRPRAALGAATIWAIDDF

SEQ ID NO: 680682 - protein, 25 aa, Mycobacterium
IPRPRAPLAAATIWAIDDFTADNGA

SEQ ID NO: 680683 - protein, 18 aa, Mycobacterium
IPRRGSTADIRWFEADPT

SEQ ID NO: 680684 - protein, 18 aa, Mycobacterium
IPRRIIATSCDAEQVLAA

SEQ ID NO: 680685 - protein, 17 aa, Mycobacterium
IPRRLVTSCEHFHRQAM

SEQ ID NO: 680686 - protein, 17 aa, Mycobacterium
IPRVHKWARGVDVTGFA

SEQ ID NO: 680687 - protein, 17 aa, Mycobacterium
IPRVHVTILRRAATGPM

SEQ ID NO: 680688 - protein, 20 aa, Mycobacterium
IPSAAIALADRVDRARAIVF

SEQ ID NO: 680689 - protein, 17 aa, Mycobacterium
IPSALLDRMELVAIDGY

SEQ ID NO: 680690 - protein, 19 aa, Mycobacterium
IPSAPGLGYEIRWDYIEEH

SEQ ID NO: 680691 - protein, 25 aa, Mycobacterium
IPSCGKCTPCQTGLRNLCDLGMGLL

SEQ ID NO: 680692 - protein, 26 aa, Mycobacterium
IPSCGKCTPCQVGLRNLCDLGMGLLS

SEQ ID NO: 680693 - protein, 22 aa, Mycobacterium
IPSCGRCPSCSTGHQSLCDLGA

SEQ ID NO: 680694 - protein, 25 aa, Mycobacterium
IPSCGRCPTCQAGLRNLCDLGAGLL

SEQ ID NO: 680695 - protein, 20 aa, Mycobacterium
IPSDEFLLYAFAGEPADLGR

SEQ ID NO: 680696 - protein, 21 aa, Mycobacterium
IPSDMRTFFDLWLDNDGYDCC

SEQ ID NO: 680697 - protein, 22 aa, Mycobacterium
IPSDRTGSVARCYSLSSSPHLD

SEQ ID NO: 680698 - protein, 18 aa, Mycobacterium
IPSFCERESKNFPGGYGI

SEQ ID NO: 680699 - protein, 25 aa, Mycobacterium
IPSGPGIPYPGFWLVPQWRTDEILL

SEQ ID NO: 680700 - protein, 17 aa, Mycobacterium
IPSGWRNLASGYQVKSY

SEQ ID NO: 680701 - protein, 24 aa, Mycobacterium
IPSGWRNLRSGYQVKTYGDDDGNE

SEQ ID NO: 680702 - protein, 19 aa, Mycobacterium
IPSHATVAVGGNRQGDKGF

SEQ ID NO: 680703 - protein, 24 aa, Mycobacterium
IPSHLTILCGLAIGYPDPDFAGNQ

SEQ ID NO: 680704 - protein, 17 aa, Mycobacterium
IPSIALRAARSSLQAAA

SEQ ID NO: 680705 - protein, 24 aa, Mycobacterium
IPSINRLGALSGLAGPGREVLVID

SEQ ID NO: 680706 - protein, 17 aa, Mycobacterium
IPSKMLSYTAQVADTVA

SEQ ID NO: 680707 - protein, 26 aa, Mycobacterium
IPSLDMHPSMRLRIEHYLQHRDNPYL

SEQ ID NO: 680708 - protein, 19 aa, Mycobacterium
IPSLLFSILHFRDTCNPIP

SEQ ID NO: 680709 - protein, 22 aa, Mycobacterium
IPSLLLDRWESVYPQPRAVHLD

SEQ ID NO: 680710 - protein, 25 aa, Mycobacterium
IPSLNGRQASEFVIRRAMSQLGVPY

SEQ ID NO: 680711 - protein, 18 aa, Mycobacterium
IPSLPSDYGALGGGDGDT

SEQ ID NO: 680712 - protein, 20 aa, Mycobacterium
IPSLYAVYPTNDWHERETYD

SEQ ID NO: 680713 - protein, 21 aa, Mycobacterium
IPSLYSVYPTNDWHERETYDF

SEQ ID NO: 680714 - protein, 18 aa, Mycobacterium
IPSMAKFLAGVKITGTAY

SEQ ID NO: 680715 - protein, 20 aa, Mycobacterium
IPSNNRFTADFPTRNYPGTD

SEQ ID NO: 680716 - protein, 19 aa, Mycobacterium
IPSPFAGRIVEIGGAEGDV

SEQ ID NO: 680717 - protein, 22 aa, Mycobacterium
IPSPTLPMLLPLEQIGVPAPIV

SEQ ID NO: 680718 - protein, 26 aa, Mycobacterium
IPSQHSWSQCHSYAFDYSVWEIFGAL

SEQ ID NO: 680719 - protein, 18 aa, Mycobacterium
IPSVARVVFASSLLLQRG

SEQ ID NO: 680720 - protein, 20 aa, Mycobacterium
IPSVNRLGALRDLADGDRDV

SEQ ID NO: 680721 - protein, 28 aa, Mycobacterium
IPSYKSCYLAMMRRFYDKGVTELNGHLL

SEQ ID NO: 680722 - protein, 25 aa, Mycobacterium
IPTAGGLHFAGRVGTGFTDRDLANL

SEQ ID NO: 680723 - protein, 25 aa, Mycobacterium
IPTDRPTLMIGEGLTMYLTEQDGTA

SEQ ID NO: 680724 - protein, 23 aa, Mycobacterium
IPTDWGRCVLTVGVFDGVHRGHA

SEQ ID NO: 680725 - protein, 26 aa, Mycobacterium
IPTEALASLGEVEWPPRGRAELIEAL

SEQ ID NO: 680726 - protein, 32 aa, Mycobacterium
IPTEHLPLLAPLRFIPYVGDPLAELLEPNLRV

SEQ ID NO: 680727 - protein, 21 aa, Mycobacterium
IPTFPDLAGVHVLRTADDSFA

SEQ ID NO: 680728 - protein, 17 aa, Mycobacterium
IPTGTAVELSARDVHRF

SEQ ID NO: 680729 - protein, 25 aa, Mycobacterium
IPTGTFPWFQVDSVIPFATLSSIFD

SEQ ID NO: 680730 - protein, 26 aa, Mycobacterium
IPTHQIGDLIVLFAYNPFSTSAPTKP

SEQ ID NO: 680731 - protein, 18 aa, Mycobacterium
IPTIPFSGLNDHLGGKVE

SEQ ID NO: 680732 - protein, 23 aa, Mycobacterium
IPTKEVILYFSPAGLVVVAPLPD

SEQ ID NO: 680733 - protein, 18 aa, Mycobacterium
IPTMILFKDGEPVKRIVG

SEQ ID NO: 680734 - protein, 19 aa, Mycobacterium
IPTPFGFGLWTSHTTPIYL

SEQ ID NO: 680735 - protein, 36 aa, Mycobacterium
IPTRSGNCAHFKIQIAFRGKLQLKRHSAARTDGLDL

SEQ ID NO: 680736 - protein, 19 aa, Mycobacterium
IPTTLNLPMDGILVPAGPY

SEQ ID NO: 680737 - protein, 20 aa, Mycobacterium
IPTTRYIPAFTLTRSSAAYW

SEQ ID NO: 680738 - protein, 21 aa, Mycobacterium
IPTTVRLEPIIGRIEEDGVLK

SEQ ID NO: 680739 - protein, 18 aa, Mycobacterium
IPVAETRQILGLAAAEVY

SEQ ID NO: 680740 - protein, 27 aa, Mycobacterium
IPVALTEWLGYAWVCLSDTPPPFEDVV

SEQ ID NO: 680741 - protein, 18 aa, Mycobacterium
IPVDAVFVGSCTNGRIED

SEQ ID NO: 680742 - protein, 20 aa, Mycobacterium
IPVDIIWHGGEPTLLPREYF

SEQ ID NO: 680743 - protein, 25 aa, Mycobacterium
IPVEDCYAALLWLAHQPWVDPDRVA

SEQ ID NO: 680744 - protein, 25 aa, Mycobacterium
IPVEDIRTAARWIGEAANWMSCWTM

SEQ ID NO: 680745 - protein, 17 aa, Mycobacterium
IPVEVALNPEKLAQQQL

SEQ ID NO: 680746 - protein, 25 aa, Mycobacterium
IPVFCPGCGTPELDTGAGEFMFRLT

SEQ ID NO: 680747 - protein, 20 aa, Mycobacterium
IPVFHLSPTPGFGNSGGAPS

SEQ ID NO: 680748 - protein, 19 aa, Mycobacterium
IPVGVGLGVRSREQAAQIA

SEQ ID NO: 680749 - protein, 19 aa, Mycobacterium
IPVGVGLGVRSREQAAQIG

SEQ ID NO: 680750 - protein, 19 aa, Mycobacterium
IPVHRDWRLNERHYGALQG

SEQ ID NO: 680751 - protein, 17 aa, Mycobacterium
IPVLGVCRGAQVLNTAL

SEQ ID NO: 680752 - protein, 17 aa, Mycobacterium
IPVPGFASALSYYDALR

SEQ ID NO: 680753 - protein, 17 aa, Mycobacterium
IPVPGFASSLSYYDGLR

SEQ ID NO: 680754 - protein, 24 aa, Mycobacterium
IPVPGPEPVLMLPMTLPGAGIAPT

SEQ ID NO: 680755 - protein, 17 aa, Mycobacterium
IPVQAEMGGKNAAVVLD

SEQ ID NO: 680756 - protein, 26 aa, Mycobacterium
IPVQSLRLYERYGLLMPARSQGGTRR

SEQ ID NO: 680757 - protein, 19 aa, Mycobacterium
IPVRRTWRLNERHYGALQG

SEQ ID NO: 680758 - protein, 17 aa, Mycobacterium
IPVSAAVWREGHEAVAA

SEQ ID NO: 680759 - protein, 21 aa, Mycobacterium
IPVSTRDGAPLSLRPVLPGDA

SEQ ID NO: 680760 - protein, 25 aa, Mycobacterium
IPVVAFRLAGDRGYTEFDVSHELRT

SEQ ID NO: 680761 - protein, 17 aa, Mycobacterium
IPVVSDFTRGIPFVHKK

SEQ ID NO: 680762 - protein, 26 aa, Mycobacterium
IPWADPRLRKAPTLHLGGTRAQMARA

SEQ ID NO: 680763 - protein, 17 aa, Mycobacterium
IPWGSDPAAVPLSDPDK

SEQ ID NO: 680764 - protein, 26 aa, Mycobacterium
IPYFDHLIRVGHAFTKVSQKTLKRDL

SEQ ID NO: 680765 - protein, 19 aa, Mycobacterium
IPYFLDRVDRTFEMHSTWT

SEQ ID NO: 680766 - protein, 17 aa, Mycobacterium
IPYLVAYQNNSAVRDVY

SEQ ID NO: 680767 - protein, 21 aa, Mycobacterium
IPYRASRSAFAFKDTLADGIQ

SEQ ID NO: 680768 - protein, 23 aa, Mycobacterium
IPYRASRSAFAFRDTLTSGIQAI

SEQ ID NO: 680769 - protein, 21 aa, Mycobacterium
IPYSMADKVLPELKRFNLVIC

SEQ ID NO: 680770 - protein, 19 aa, Mycobacterium
IPYTLSLRVAEIEHWNGHP

SEQ ID NO: 680771 - protein, 19 aa, Mycobacterium
IPYVRRRGDYLYDFWRDAN

SEQ ID NO: 680772 - protein, 25 aa, Mycobacterium
IPYVRRRGEYLYNFWRDAANPKGLW

SEQ ID NO: 680773 - protein, 27 aa, Mycobacterium
IPYVVILRREWDFLFNHLRSTTAVVDY

SEQ ID NO: 680774 - protein, 23 aa, Mycobacterium
IPYVVRRGEYLYNFWRDAANPRG

SEQ ID NO: 680775 - protein, 43 aa, Mycobacterium
IQAALSRIGSPYSWGGSGPNAFDCSGLVMWSFQQAGISLPHSS

SEQ ID NO: 680776 - protein, 21 aa, Mycobacterium
IQAATGRPLIGNGAPGATGSG

SEQ ID NO: 680777 - protein, 18 aa, Mycobacterium
IQACDAGNIDAVREFVVE

SEQ ID NO: 680778 - protein, 23 aa, Mycobacterium
IQAELPPLAGIVHAAGEIGTTPL

SEQ ID NO: 680779 - protein, 25 aa, Mycobacterium
IQAFHRRGDIAFGIPAHRSGTGRMP

SEQ ID NO: 680780 - protein, 18 aa, Mycobacterium
IQAGALDFIPAKRVGTAA

SEQ ID NO: 680781 - protein, 18 aa, Mycobacterium
IQAGEIEAGMLILPIDDE

SEQ ID NO: 680782 - protein, 18 aa, Mycobacterium
IQAGGGVMIYRASKAAVI

SEQ ID NO: 680783 - protein, 20 aa, Mycobacterium
IQAGLARTGRMFACDHWNVV

SEQ ID NO: 680784 - protein, 19 aa, Mycobacterium
IQAGYAQNIIVGFGRIEGR

SEQ ID NO: 680785 - protein, 19 aa, Mycobacterium
IQAIKGVEIGDGFETARRR

SEQ ID NO: 680786 - protein, 24 aa, Mycobacterium
IQAIKGVEIGDGFETARRRGSVAH

SEQ ID NO: 680787 - protein, 29 aa, Mycobacterium
IQALDFFFRKIVRDHGKALQFVTAQITQT

SEQ ID NO: 680788 - protein, 25 aa, Mycobacterium
IQALERLETLLALIEGWVQTVVTDA

SEQ ID NO: 680789 - protein, 18 aa, Mycobacterium
IQAPAIYYYFPSREDLIE

SEQ ID NO: 680790 - protein, 22 aa, Mycobacterium
IQAQDFFFRKIIRDKGQALAYV

SEQ ID NO: 680791 - protein, 27 aa, Mycobacterium
IQAQDFFFRKIIRDKGVALAHVSGEIQ

SEQ ID NO: 680792 - protein, 24 aa, Mycobacterium
IQAQDFFFRKIVKDQGKSLAFISG

SEQ ID NO: 680793 - protein, 28 aa, Mycobacterium
IQAQDFFFRKIVRDKGVALAHVAGQIEQ

SEQ ID NO: 680794 - protein, 27 aa, Mycobacterium
IQAQDFFFRKIVRDKGVALAHVSEQIQ

SEQ ID NO: 680795 - protein, 25 aa, Mycobacterium
IQARGLVDVVIPRGGAGLIDAVVRD

SEQ ID NO: 680796 - protein, 18 aa, Mycobacterium
IQARIRAGASVEQVAAAS

SEQ ID NO: 680797 - protein, 17 aa, Mycobacterium
IQASYVIAAEGGSSPTR

SEQ ID NO: 680798 - protein, 23 aa, Mycobacterium
IQAVFERFERVLVSMVSDADQRL

SEQ ID NO: 680799 - protein, 19 aa, Mycobacterium
IQCAVAMLRRHHETLTGSV

SEQ ID NO: 680800 - protein, 25 aa, Mycobacterium
IQDFARASFSYGLNAKWPVYLSTKN

SEQ ID NO: 680801 - protein, 26 aa, Mycobacterium
IQDFARASFSYGLNAKWPVYLSTKNT

SEQ ID NO: 680802 - protein, 23 aa, Mycobacterium
IQDFTADLQAMFGQPIPTPDIVP

SEQ ID NO: 680803 - protein, 19 aa, Mycobacterium
IQDGIRLSGASSRFFAHND

SEQ ID NO: 680804 - protein, 24 aa, Mycobacterium
IQDGPAWWAARDAIRHTADIQQRP

SEQ ID NO: 680805 - protein, 23 aa, Mycobacterium
IQDGRLHYVYNFLGERQQEVSSA

SEQ ID NO: 680806 - protein, 23 aa, Mycobacterium
IQDGRLHYVYNFLGERQQLLSSV

SEQ ID NO: 680807 - protein, 20 aa, Mycobacterium
IQDLHIWTAASIRADRLDFR

SEQ ID NO: 680808 - protein, 23 aa, Mycobacterium
IQDRVPGMLISFGASRNGVEVKE

SEQ ID NO: 680809 - protein, 28 aa, Mycobacterium
IQDVKWQRPGSETVWFEIHVNPLVDNEN

SEQ ID NO: 680810 - protein, 20 aa, Mycobacterium
IQDVVRRIYVDPAIVHYVTQ

SEQ ID NO: 680811 - protein, 22 aa, Mycobacterium
IQEAIELADLVVVPTGASPLDV

SEQ ID NO: 680812 - protein, 18 aa, Mycobacterium
IQEALKAAAIVSGVAQAI

SEQ ID NO: 680813 - protein, 18 aa, Mycobacterium
IQEALKAAAIVSGVAQAM

SEQ ID NO: 680814 - protein, 18 aa, Mycobacterium
IQEMSRLLEPGRTYQFNA

SEQ ID NO: 680815 - protein, 24 aa, Mycobacterium
IQESHAMLGYRLWSVAQELMAAAR

SEQ ID NO: 680816 - protein, 23 aa, Mycobacterium
IQESLDSLGPIFGELRDAGRELL

SEQ ID NO: 680817 - protein, 21 aa, Mycobacterium
IQESLNSLGPIFSELRDAGRD

SEQ ID NO: 680818 - protein, 22 aa, Mycobacterium
IQEVARELFLRQGVRGTSLQDI

SEQ ID NO: 680819 - protein, 18 aa, Mycobacterium
IQEYLLGVTAKYGLRRYI

SEQ ID NO: 680820 - protein, 19 aa, Mycobacterium
IQFARGVSDQVLFTDQGVI

SEQ ID NO: 680821 - protein, 18 aa, Mycobacterium
IQFFRFASVRSEQSVFSM

SEQ ID NO: 680822 - protein, 19 aa, Mycobacterium
IQFKDLTPLFADREAMAAV

SEQ ID NO: 680823 - protein, 30 aa, Mycobacterium
IQFPKMFFLPWNMRTAGSIIMFLNLARQFF

SEQ ID NO: 680824 - protein, 19 aa, Mycobacterium
IQFRKGALPGEETGSGEGD

SEQ ID NO: 680825 - protein, 22 aa, Mycobacterium
IQGAGLFPHFTVGDNIAIVPKL

SEQ ID NO: 680826 - protein, 24 aa, Mycobacterium
IQGARIAGALAIVAVDPVNFKREQ

SEQ ID NO: 680827 - protein, 18 aa, Mycobacterium
IQGFLAFNPGLYAQQFVA

SEQ ID NO: 680828 - protein, 25 aa, Mycobacterium
IQGGRRYSYKQVIERSRRLAAYLHS

SEQ ID NO: 680829 - protein, 20 aa, Mycobacterium
IQGGWLEFDAAIATPDQMAK

SEQ ID NO: 680830 - protein, 26 aa, Mycobacterium
IQGHASPGIYARAFLEGRLTTDQLDG

SEQ ID NO: 680831 - protein, 18 aa, Mycobacterium
IQGLGAGFVPPVLAMDLV

SEQ ID NO: 680832 - protein, 18 aa, Mycobacterium
IQGLLSEAARTWTDRLMA

SEQ ID NO: 680833 - protein, 30 aa, Mycobacterium
IQGPEDLPALFLDFLENLPVIGTVVEIVEA

SEQ ID NO: 680834 - protein, 19 aa, Mycobacterium
IQHADLLVVRRGEKVVVEV

SEQ ID NO: 680835 - protein, 19 aa, Mycobacterium
IQHPHWFRTGDLGRLDAEG

SEQ ID NO: 680836 - protein, 22 aa, Mycobacterium
IQIAPALAWLRDHFGIRSWCLV

SEQ ID NO: 680837 - protein, 20 aa, Mycobacterium
IQIGWTPRHAVVVHTGSAAP

SEQ ID NO: 680838 - protein, 17 aa, Mycobacterium
IQIHGGIGFTWEHPAHL

SEQ ID NO: 680839 - protein, 26 aa, Mycobacterium
IQIPTPPRLGSVVVEVEHLDKGFNGR

SEQ ID NO: 680840 - protein, 25 aa, Mycobacterium
IQIPVGPRLGNVVVEVDHLDKGYDG

SEQ ID NO: 680841 - protein, 25 aa, Mycobacterium
IQIPVGPRLGNVVVEVDHLDKGYGG

SEQ ID NO: 680842 - protein, 26 aa, Mycobacterium
IQIPVGPRLGNVVVEVEHLDKGFDGR

SEQ ID NO: 680843 - protein, 26 aa, Mycobacterium
IQIPVGPRLGNVVVEVEHLDKGYGGR

SEQ ID NO: 680844 - protein, 17 aa, Mycobacterium
IQKCIRTPDIDEVGITT

SEQ ID NO: 680845 - protein, 25 aa, Mycobacterium
IQKMATVLGRRVWENAGAPEVDTER

SEQ ID NO: 680846 - protein, 20 aa, Mycobacterium
IQLAEWEWPENPRFLMCTPL

SEQ ID NO: 680847 - protein, 21 aa, Mycobacterium
IQLARLTWRIQGLRITVTGVE

SEQ ID NO: 680848 - protein, 21 aa, Mycobacterium
IQLARLVWRAQGLKITVTGVE

SEQ ID NO: 680849 - protein, 22 aa, Mycobacterium
IQLARLVWRIQGLKFTVTGIEN

SEQ ID NO: 680850 - protein, 19 aa, Mycobacterium
IQLCLRRNGRVVLNRAIGH

SEQ ID NO: 680851 - protein, 19 aa, Mycobacterium
IQLGAIARLACETYGPAAL

SEQ ID NO: 680852 - protein, 22 aa, Mycobacterium
IQLHGGIGFTWEHDAHLYLRRA

SEQ ID NO: 680853 - protein, 19 aa, Mycobacterium
IQLHGGIGITAEYPVGHYA

SEQ ID NO: 680854 - protein, 18 aa, Mycobacterium
IQLITSFKFDDMSPIPYA

SEQ ID NO: 680855 - protein, 19 aa, Mycobacterium
IQLLEGMVDFAAKYGGNPN

SEQ ID NO: 680856 - protein, 18 aa, Mycobacterium
IQLLEGMVDFAEKYGGNP

SEQ ID NO: 680857 - protein, 17 aa, Mycobacterium
IQLLGVLLFDVNPRATK

SEQ ID NO: 680858 - protein, 18 aa, Mycobacterium
IQLMAFAYDGAWAEYTVA

SEQ ID NO: 680859 - protein, 25 aa, Mycobacterium
IQLPAMRVLVAPDCYGDSLSAVDAA

SEQ ID NO: 680860 - protein, 26 aa, Mycobacterium
IQLPVVCTVRGWAVGLGCNLALAADF

SEQ ID NO: 680861 - protein, 17 aa, Mycobacterium
IQLRRPRFGGTKRRLDA

SEQ ID NO: 680862 - protein, 20 aa, Mycobacterium
IQLRVSTWPPGPTYDPNTWT

SEQ ID NO: 680863 - protein, 18 aa, Mycobacterium
IQLSNGRCGWRMNLPAAV

SEQ ID NO: 680864 - protein, 26 aa, Mycobacterium
IQLSPWLAMDYFEIWRTQPSVRRTVS

SEQ ID NO: 680865 - protein, 17 aa, Mycobacterium
IQLWPVTDTGYGRAQDI

SEQ ID NO: 680866 - protein, 23 aa, Mycobacterium
IQPAMSGSVLQLLQPLQAVTSLF

SEQ ID NO: 680867 - protein, 22 aa, Mycobacterium
IQPDLKVIVNLGYGDPNYGYST

SEQ ID NO: 680868 - protein, 22 aa, Mycobacterium
IQPDLKVIVNLGYGNPDYGYST

SEQ ID NO: 680869 - protein, 23 aa, Mycobacterium
IQPDLKVLVNLGYGDPAYGYSTS

SEQ ID NO: 680870 - protein, 24 aa, Mycobacterium
IQPDLRVLVDLGYGNIGVGADYAN

SEQ ID NO: 680871 - protein, 25 aa, Mycobacterium
IQPDLRVLVDLGYGYGYADVPTPAS

SEQ ID NO: 680872 - protein, 24 aa, Mycobacterium
IQPDLRVLVDLGYTDWGSGQDYAN

SEQ ID NO: 680873 - protein, 18 aa, Mycobacterium
IQPDRTYVNIGFWSSVPV

SEQ ID NO: 680874 - protein, 21 aa, Mycobacterium
IQPEALVKMHVLDEEDRLAGV

SEQ ID NO: 680875 - protein, 21 aa, Mycobacterium
IQPLGRPDIEVTRKEYGQDLA

SEQ ID NO: 680876 - protein, 25 aa, Mycobacterium
IQPNLKVLVNWGYGNLEHGYSQGPA

SEQ ID NO: 680877 - protein, 17 aa, Mycobacterium
IQPPIGHVYGYRLEPTE

SEQ ID NO: 680878 - protein, 24 aa, Mycobacterium
IQPQLRVLVDLGYSDYGPGLSYAD

SEQ ID NO: 680879 - protein, 23 aa, Mycobacterium
IQPQQKLSWRIMPQNLEDAAVSW

SEQ ID NO: 680880 - protein, 20 aa, Mycobacterium
IQPRMLRRALDFMHENAQYD

SEQ ID NO: 680881 - protein, 24 aa, Mycobacterium
IQPSLRVIVDLGYSDYGPGQNYAD

SEQ ID NO: 680882 - protein, 18 aa, Mycobacterium
IQQACLQHGLIVETGGQY

SEQ ID NO: 680883 - protein, 17 aa, Mycobacterium
IQQADLQNMGWLEWAYT

SEQ ID NO: 680884 - protein, 20 aa, Mycobacterium
IQQAGLFPHMTIRQNVGLVP

SEQ ID NO: 680885 - protein, 24 aa, Mycobacterium
IQQDNCKLVPWPVTGVSAIGVRSA

SEQ ID NO: 680886 - protein, 24 aa, Mycobacterium
IQQEFPRTAILVLSAHIDAQHAKE

SEQ ID NO: 680887 - protein, 17 aa, Mycobacterium
IQQEVDAEFALPSRRLV

SEQ ID NO: 680888 - protein, 25 aa, Mycobacterium
IQQEVLSALGRYVTMNQNLTGTGFS

SEQ ID NO: 680889 - protein, 17 aa, Mycobacterium
IQQFACRVADLDALSRR

SEQ ID NO: 680890 - protein, 24 aa, Mycobacterium
IQQGRARVVLIAGAETWRTRTGLK

SEQ ID NO: 680891 - protein, 27 aa, Mycobacterium
IQRAHDQFRWFAGGWKVNADLPTPAGF

SEQ ID NO: 680892 - protein, 23 aa, Mycobacterium
IQRCGGCGQLRHPPRPMCPHCRS

SEQ ID NO: 680893 - protein, 25 aa, Mycobacterium
IQRDEMKSGVFGFCKGIDSFCPIGP

SEQ ID NO: 680894 - protein, 23 aa, Mycobacterium
IQREVVARTGLRDCRVHGRTWDL

SEQ ID NO: 680895 - protein, 17 aa, Mycobacterium
IQRGDIVFPKSVTPARV

SEQ ID NO: 680896 - protein, 17 aa, Mycobacterium
IQRGRRGPVSLPLLTRT

SEQ ID NO: 680897 - protein, 22 aa, Mycobacterium
IQRIDVGGGLPVNFRSDDVTPT

SEQ ID NO: 680898 - protein, 18 aa, Mycobacterium
IQRLAACAHALRSPLVSE

SEQ ID NO: 680899 - protein, 21 aa, Mycobacterium
IQRLFAAGMDLQGTLARARSP

SEQ ID NO: 680900 - protein, 26 aa, Mycobacterium
IQRLFKADSGGSVFFGVIVGANDYAE

SEQ ID NO: 680901 - protein, 18 aa, Mycobacterium
IQRLTQWHRLVPVQQSAA

SEQ ID NO: 680902 - protein, 19 aa, Mycobacterium
IQRQLCKQLLLTDQLPILG

SEQ ID NO: 680903 - protein, 25 aa, Mycobacterium
IQRRQPTIIGHDGWLAIDRAEIARG

SEQ ID NO: 680904 - protein, 22 aa, Mycobacterium
IQRRSEAGIGLTSPEMCTLMAH

SEQ ID NO: 680905 - protein, 23 aa, Mycobacterium
IQSARPGAFVGFVGVPHDVSITG

SEQ ID NO: 680906 - protein, 17 aa, Mycobacterium
IQSCRRIAIPELPLELF

SEQ ID NO: 680907 - protein, 24 aa, Mycobacterium
IQSEPRVAFSILDPTNPYRYLEVR

SEQ ID NO: 680908 - protein, 19 aa, Mycobacterium
IQSFVEWRARTRGELTEVG

SEQ ID NO: 680909 - protein, 29 aa, Mycobacterium
IQSGLARTGRTFACDHWGVVPDVYLLGKA

SEQ ID NO: 680910 - protein, 29 aa, Mycobacterium
IQSGLARTGRTFACEHWGVVPDVYLLGKA

SEQ ID NO: 680911 - protein, 24 aa, Mycobacterium
IQSIPIIAERAAHLYVFQRTPNYS

SEQ ID NO: 680912 - protein, 26 aa, Mycobacterium
IQSPKWLELVEPYGFTEAERPDPGLT

SEQ ID NO: 680913 - protein, 23 aa, Mycobacterium
IQSQAGEVIGFFRALAAEHPGLL

SEQ ID NO: 680914 - protein, 18 aa, Mycobacterium
IQSQVLAKIAAAVGNGVV

SEQ ID NO: 680915 - protein, 25 aa, Mycobacterium
IQSTFVGAVCRWQAANPAGLVDITR

SEQ ID NO: 680916 - protein, 18 aa, Mycobacterium
IQTAFIYDHFTPFVFVQL

SEQ ID NO: 680917 - protein, 22 aa, Mycobacterium
IQTEARISCLVRASTPEEGRQR

SEQ ID NO: 680918 - protein, 19 aa, Mycobacterium
IQTGVTWKDLGLVIVDEEQ

SEQ ID NO: 680919 - protein, 36 aa, Mycobacterium
IQTLKRGAGIPVFCLHPAGGVSWPYQVLGTYLDCPL

SEQ ID NO: 680920 - protein, 17 aa, Mycobacterium
IQVAKALGLRVAVTAGT

SEQ ID NO: 680921 - protein, 18 aa, Mycobacterium
IQVARLGLMNAVNRFDPA

SEQ ID NO: 680922 - protein, 24 aa, Mycobacterium
IQVCAALDEILRLCIQHVTSRNQF

SEQ ID NO: 680923 - protein, 20 aa, Mycobacterium
IQVCAALDRIVQLSIEHATT

SEQ ID NO: 680924 - protein, 18 aa, Mycobacterium
IQVFDSWAGALSLADYRA

SEQ ID NO: 680925 - protein, 17 aa, Mycobacterium
IQVFGLPNMRTVLHCLP

SEQ ID NO: 680926 - protein, 17 aa, Mycobacterium
IQVPLFINTGDRLKVDT

SEQ ID NO: 680927 - protein, 18 aa, Mycobacterium
IQVPLFINTGDRLKVDTR

SEQ ID NO: 680928 - protein, 25 aa, Mycobacterium
IQVQRSTVVLAMWQYLLHRYTQQDA

SEQ ID NO: 680929 - protein, 27 aa, Mycobacterium
IQVRFKGLCPYAGELIVVGEAKPYCVA

SEQ ID NO: 680930 - protein, 17 aa, Mycobacterium
IQVTVRYFAAARAAVGA

SEQ ID NO: 680931 - protein, 19 aa, Mycobacterium
IQVVLCAGAPDTPEIADEV

SEQ ID NO: 680932 - protein, 19 aa, Mycobacterium
IQYLLLRSGPLTMPPSTLG

SEQ ID NO: 680933 - protein, 19 aa, Mycobacterium
IQYLLLRSGPMTMPPSTLG

SEQ ID NO: 680934 - protein, 18 aa, Mycobacterium
IQYRFDRTRLVLPDDPSV

SEQ ID NO: 680935 - protein, 17 aa, Mycobacterium
IQYSTAVQLAGAPEMNK

SEQ ID NO: 680936 - protein, 19 aa, Mycobacterium
IRAAAAAVRGHAAAAPENE

SEQ ID NO: 680937 - protein, 23 aa, Mycobacterium
IRAAAAPARRLRPDMATGGMPMR

SEQ ID NO: 680938 - protein, 17 aa, Mycobacterium
IRAAIAVGHGVTVRDLL

SEQ ID NO: 680939 - protein, 17 aa, Mycobacterium
IRAAIHLVTDKEPNPEE

SEQ ID NO: 680940 - protein, 18 aa, Mycobacterium
IRAAMDRLLRGEIPPGGN

SEQ ID NO: 680941 - protein, 22 aa, Mycobacterium
IRAAMMRGAFDFQLTPLDLEDL

SEQ ID NO: 680942 - protein, 19 aa, Mycobacterium
IRAANYALTPGRYVDAPET

SEQ ID NO: 680943 - protein, 18 aa, Mycobacterium
IRAARAVVRIGGAGHSAA

SEQ ID NO: 680944 - protein, 20 aa, Mycobacterium
IRAAREAANNIVSWSNDLYS

SEQ ID NO: 680945 - protein, 18 aa, Mycobacterium
IRAARSVARAAAWSAGAA

SEQ ID NO: 680946 - protein, 17 aa, Mycobacterium
IRAAVPAMIEAGNGGSI

SEQ ID NO: 680947 - protein, 20 aa, Mycobacterium
IRAAVPAVWGYTRREPMLTL

SEQ ID NO: 680948 - protein, 20 aa, Mycobacterium
IRAAWPHFRENGFGRVVVAT

SEQ ID NO: 680949 - protein, 21 aa, Mycobacterium
IRAAWPHFREQSFGRVVVATS

SEQ ID NO: 680950 - protein, 23 aa, Mycobacterium
IRAAWPHFREQSFGRVVVATSTS

SEQ ID NO: 680951 - protein, 19 aa, Mycobacterium
IRADDDWSVIMRHVAANLD

SEQ ID NO: 680952 - protein, 19 aa, Mycobacterium
IRADFPILQRVMRSGNQLA

SEQ ID NO: 680953 - protein, 18 aa, Mycobacterium
IRADFPILSRVMRGGNQL

SEQ ID NO: 680954 - protein, 19 aa, Mycobacterium
IRADVALVKAWKGDTAGNL

SEQ ID NO: 680955 - protein, 18 aa, Mycobacterium
IRAEIDRVGAGQWPVDDN

SEQ ID NO: 680956 - protein, 17 aa, Mycobacterium
IRAEIDRVGSGEWPVDD

SEQ ID NO: 680957 - protein, 17 aa, Mycobacterium
IRAEIDRVGSGQWPVDD

SEQ ID NO: 680958 - protein, 17 aa, Mycobacterium
IRAELDVEVPMRVVFGT

SEQ ID NO: 680959 - protein, 17 aa, Mycobacterium
IRAELPAVRGLCTQVTS

SEQ ID NO: 680960 - protein, 23 aa, Mycobacterium
IRAELPPLAGIAHLAGVLDDALL

SEQ ID NO: 680961 - protein, 18 aa, Mycobacterium
IRAELPRAEIVELGSDDD

SEQ ID NO: 680962 - protein, 22 aa, Mycobacterium
IRAETDLYFGNIVGDGALGEFT

SEQ ID NO: 680963 - protein, 26 aa, Mycobacterium
IRAFCVACLDPLVGGDRFDFVEDLGA

SEQ ID NO: 680964 - protein, 18 aa, Mycobacterium
IRAFFDGKPLRAYRPPTR

SEQ ID NO: 680965 - protein, 18 aa, Mycobacterium
IRAFKAIDCQGLARVDFF

SEQ ID NO: 680966 - protein, 19 aa, Mycobacterium
IRAFSTLVIDWISAEPELY

SEQ ID NO: 680967 - protein, 20 aa, Mycobacterium
IRAFWPGALSLVVHQAPSLQ

SEQ ID NO: 680968 - protein, 20 aa, Mycobacterium
IRAFWPGALSLVVVQAPSLQ

SEQ ID NO: 680969 - protein, 17 aa, Mycobacterium
IRAGDNLHREAAPEMNS

SEQ ID NO: 680970 - protein, 21 aa, Mycobacterium
IRAGESVSYGHTWTARRDTTL

SEQ ID NO: 680971 - protein, 20 aa, Mycobacterium
IRAGIDCIEHGFLASDDTIQ

SEQ ID NO: 680972 - protein, 19 aa, Mycobacterium
IRAGIDCIEHGFLASDETI

SEQ ID NO: 680973 - protein, 20 aa, Mycobacterium
IRAGIDCIEHGFLATDETIQ

SEQ ID NO: 680974 - protein, 20 aa, Mycobacterium
IRAGIDCIEHGFLATDETLQ

SEQ ID NO: 680975 - protein, 18 aa, Mycobacterium
IRAGNGPALRAAAGDLLR

SEQ ID NO: 680976 - protein, 19 aa, Mycobacterium
IRAGQEFGADIALMDQAWW

SEQ ID NO: 680977 - protein, 24 aa, Mycobacterium
IRAGQLAALPVRPLATVMIGALDE

SEQ ID NO: 680978 - protein, 17 aa, Mycobacterium
IRAGRRPDLAGRVTMSE

SEQ ID NO: 680979 - protein, 22 aa, Mycobacterium
IRAGSFSINGGNYFGADSPFGG

SEQ ID NO: 680980 - protein, 25 aa, Mycobacterium
IRAGSFSINGGNYFGADSPFGGFKQ

SEQ ID NO: 680981 - protein, 20 aa, Mycobacterium
IRAGSVAINHGFDLSAPFGG

SEQ ID NO: 680982 - protein, 18 aa, Mycobacterium
IRAGSVAINHGFDMAAPF

SEQ ID NO: 680983 - protein, 18 aa, Mycobacterium
IRAIASPHLVAFNRAYGR

SEQ ID NO: 680984 - protein, 20 aa, Mycobacterium
IRAKIHFEDLQWERRYNRVE

SEQ ID NO: 680985 - protein, 25 aa, Mycobacterium
IRALERRLRLVLLERGPTGSRLTDA

SEQ ID NO: 680986 - protein, 19 aa, Mycobacterium
IRALGELALDMATHATDEA

SEQ ID NO: 680987 - protein, 17 aa, Mycobacterium
IRALKLTLNNTAGRDLR

SEQ ID NO: 680988 - protein, 28 aa, Mycobacterium
IRALLERDLPVYIISIGRTFRTDELDST

SEQ ID NO: 680989 - protein, 18 aa, Mycobacterium
IRALLQAFIGRMNDVPAS

SEQ ID NO: 680990 - protein, 19 aa, Mycobacterium
IRALVARDAPLVAILWGRD

SEQ ID NO: 680991 - protein, 23 aa, Mycobacterium
IRANELIKPLAAAVDGRGGGKAD

SEQ ID NO: 680992 - protein, 22 aa, Mycobacterium
IRARAPLRISFAGGGTDVPPFP

SEQ ID NO: 680993 - protein, 24 aa, Mycobacterium
IRARDAVLLGLTGRRWGFGRTSAA

SEQ ID NO: 680994 - protein, 25 aa, Mycobacterium
IRARFEPRFRMCIRTGCGTALRCEP

SEQ ID NO: 680995 - protein, 23 aa, Mycobacterium
IRARKGVILACGGFDHNEQMRVK

SEQ ID NO: 680996 - protein, 22 aa, Mycobacterium
IRARNAIGFAGAGAMVSMLQNL

SEQ ID NO: 680997 - protein, 24 aa, Mycobacterium
IRARQSLDAAAGWLAPLGGSHLRS

SEQ ID NO: 680998 - protein, 17 aa, Mycobacterium
IRARYGKCLGSAVNPVL

SEQ ID NO: 680999 - protein, 24 aa, Mycobacterium
IRASGLPYALFRLGGVISPDTHTT

SEQ ID NO: 681000 - protein, 20 aa, Mycobacterium
IRASIPAGRFDELREHVLGR

SEQ ID NO: 681001 - protein, 23 aa, Mycobacterium
IRAVVCAPLRVVLPARGTDAPPQ

SEQ ID NO: 681002 - protein, 19 aa, Mycobacterium
IRAVVRWAQPQASAVVVAG

SEQ ID NO: 681003 - protein, 25 aa, Mycobacterium
IRAYLPAMIGAGWGRIIQIASDSAI

SEQ ID NO: 681004 - protein, 25 aa, Mycobacterium
IRAYRSGSSLHVDWWYDTRRITAET

SEQ ID NO: 681005 - protein, 17 aa, Mycobacterium
IRDAALREFGDKGYDGA

SEQ ID NO: 681006 - protein, 20 aa, Mycobacterium
IRDAIKFPDVIHALKPDPVT

SEQ ID NO: 681007 - protein, 18 aa, Mycobacterium
IRDAVCGVVPPRGSVSAP

SEQ ID NO: 681008 - protein, 25 aa, Mycobacterium
IRDDAEVFEALALLRASPGMDQAKE

SEQ ID NO: 681009 - protein, 21 aa, Mycobacterium
IRDDHPILAAMEFQPWTISDD

SEQ ID NO: 681010 - protein, 21 aa, Mycobacterium
IRDDPRSWIAQPMMELSTVPT

SEQ ID NO: 681011 - protein, 23 aa, Mycobacterium
IRDDRFAALFLLELTTGIRRGQV

SEQ ID NO: 681012 - protein, 24 aa, Mycobacterium
IRDELGECWGHFDAEDSVKALRHT

SEQ ID NO: 681013 - protein, 26 aa, Mycobacterium
IRDERLETAFTWREYGTAALRAAAKL

SEQ ID NO: 681014 - protein, 18 aa, Mycobacterium
IRDFMFSGLEGFESLEEA

SEQ ID NO: 681015 - protein, 18 aa, Mycobacterium
IRDGAWVAEATPLVNLAT

SEQ ID NO: 681016 - protein, 18 aa, Mycobacterium
IRDGAWVAEATSLVNLCT

SEQ ID NO: 681017 - protein, 24 aa, Mycobacterium
IRDGEFRPGESIGTLESLRAETKF

SEQ ID NO: 681018 - protein, 19 aa, Mycobacterium
IRDGLLYVFLPPTAELDDF

SEQ ID NO: 681019 - protein, 19 aa, Mycobacterium
IRDGLLYVFLPPVDELEHF

SEQ ID NO: 681020 - protein, 18 aa, Mycobacterium
IRDGYWACFDTEDLKTEP

SEQ ID NO: 681021 - protein, 17 aa, Mycobacterium
IRDILGRRPTDAELAMY

SEQ ID NO: 681022 - protein, 17 aa, Mycobacterium
IRDILGRRPTDTELAMY

SEQ ID NO: 681023 - protein, 25 aa, Mycobacterium
IRDKPAWLDRAWTRIAEEVAAGRQA

SEQ ID NO: 681024 - protein, 18 aa, Mycobacterium
IRDLGCEYAICYFPEAAY

SEQ ID NO: 681025 - protein, 18 aa, Mycobacterium
IRDLKWAQRFAYLNRAEM

SEQ ID NO: 681026 - protein, 28 aa, Mycobacterium
IRDLNVSTCLRGDFSGAHLTGDQSQVLP

SEQ ID NO: 681027 - protein, 23 aa, Mycobacterium
IRDMAKVPSAIWVVDTNKEHIAV

SEQ ID NO: 681028 - protein, 23 aa, Mycobacterium
IRDMAKVPSAIWVVDTNKEHLAV

SEQ ID NO: 681029 - protein, 23 aa, Mycobacterium
IRDRERHGAKFSIVCVAEGARPV

SEQ ID NO: 681030 - protein, 23 aa, Mycobacterium
IRDREVVTDLFLRCAQSYGPKRA

SEQ ID NO: 681031 - protein, 26 aa, Mycobacterium
IRDRIGVPGIWYAGSHGFELCSPDGG

SEQ ID NO: 681032 - protein, 17 aa, Mycobacterium
IRDRVVAELSGYPEPGV

SEQ ID NO: 681033 - protein, 19 aa, Mycobacterium
IRDRWKRAVSLVESLMGDA

SEQ ID NO: 681034 - protein, 20 aa, Mycobacterium
IRDRWLPGLIDGSIRGSFAL

SEQ ID NO: 681035 - protein, 24 aa, Mycobacterium
IRDSGGTLLRWLARKHASAVVLRP

SEQ ID NO: 681036 - protein, 20 aa, Mycobacterium
IRDTMPKWAMELIQHKSPNI

SEQ ID NO: 681037 - protein, 24 aa, Mycobacterium
IRDVKRLSKMTGIDESRLGLILEV

SEQ ID NO: 681038 - protein, 20 aa, Mycobacterium
IRDVSLRDGLQIEDPIPLSA

SEQ ID NO: 681039 - protein, 17 aa, Mycobacterium
IREAAKFWVGLKAAKRQ

SEQ ID NO: 681040 - protein, 32 aa, Mycobacterium
IREAARYGVDAHIDRVRWDDIVSRIFGRIDPI

SEQ ID NO: 681041 - protein, 17 aa, Mycobacterium
IREALQFNLGDCPARAA

SEQ ID NO: 681042 - protein, 21 aa, Mycobacterium
IREALRIVGPPSYALPEEPLL

SEQ ID NO: 681043 - protein, 24 aa, Mycobacterium
IREARLCRKYGAAVVVMAFDEKGQ

SEQ ID NO: 681044 - protein, 19 aa, Mycobacterium
IREARRLETRARLFDAALA

SEQ ID NO: 681045 - protein, 17 aa, Mycobacterium
IREEVGFYDPYYLGDEG

SEQ ID NO: 681046 - protein, 21 aa, Mycobacterium
IREGARIALNPGPEWITELDR

SEQ ID NO: 681047 - protein, 27 aa, Mycobacterium
IREGGEWGLDEVHALGALSGSRQAQRW

SEQ ID NO: 681048 - protein, 18 aa, Mycobacterium
IREGGGRAVANYDSVATE

SEQ ID NO: 681049 - protein, 25 aa, Mycobacterium
IREGKAGLVPPHLRDGHYSGAAKLG

SEQ ID NO: 681050 - protein, 26 aa, Mycobacterium
IREHPRPGIVDALARLRIDGEPAPDA

SEQ ID NO: 681051 - protein, 28 aa, Mycobacterium
IREIRSITWCRRRTIQVARIAERVPQEW

SEQ ID NO: 681052 - protein, 19 aa, Mycobacterium
IRELCAAERAAVCDLADRP

SEQ ID NO: 681053 - protein, 17 aa, Mycobacterium
IREMTGFRWESRHDREF

SEQ ID NO: 681054 - protein, 25 aa, Mycobacterium
IRENPRPGLVNALLQLRIDGEPAPD

SEQ ID NO: 681055 - protein, 17 aa, Mycobacterium
IREPARFWAAMRNAKGK

SEQ ID NO: 681056 - protein, 23 aa, Mycobacterium
IREPRWGTVIVGLDCATIILDER

SEQ ID NO: 681057 - protein, 18 aa, Mycobacterium
IRERIFRVYNEHIAEVQE

SEQ ID NO: 681058 - protein, 24 aa, Mycobacterium
IRERLPNLRLWNFYGQTELAPLAC

SEQ ID NO: 681059 - protein, 30 aa, Mycobacterium
IRERLPRLRLWNFYGQTEMAPLASALGPDE

SEQ ID NO: 681060 - protein, 21 aa, Mycobacterium
IRERPRELARTVFIELLAWQF

SEQ ID NO: 681061 - protein, 19 aa, Mycobacterium
IRESARFGVDGRLDGVRWP

SEQ ID NO: 681062 - protein, 24 aa, Mycobacterium
IRESGELTTAIGLTNTHSAGVVRD

SEQ ID NO: 681063 - protein, 17 aa, Mycobacterium
IRESLAEVLGVYGPPLK

SEQ ID NO: 681064 - protein, 34 aa, Mycobacterium
IRETDPRCAIVFQEPRLFPWRSLAGNVAYGLPRG

SEQ ID NO: 681065 - protein, 24 aa, Mycobacterium
IREVCLRDGLQIEQPIPLSAKLEI

SEQ ID NO: 681066 - protein, 24 aa, Mycobacterium
IREVKRLTKATGIDERRLGLILEV

SEQ ID NO: 681067 - protein, 22 aa, Mycobacterium
IREVLLRDGLQLETPIALADKL

SEQ ID NO: 681068 - protein, 26 aa, Mycobacterium
IREVVSGLVSDIGWHAKVGTLSGGQR

SEQ ID NO: 681069 - protein, 17 aa, Mycobacterium
IRFAESAIQVMGKAGEH

SEQ ID NO: 681070 - protein, 20 aa, Mycobacterium
IRFASSLPALLAGGGVDTGI

SEQ ID NO: 681071 - protein, 18 aa, Mycobacterium
IRFGGARVLELAGLDIDD

SEQ ID NO: 681072 - protein, 24 aa, Mycobacterium
IRFLHNVMGLWLLSETLRQYERDG

SEQ ID NO: 681073 - protein, 29 aa, Mycobacterium
IRFMPKPVICLVNGWAAGGGHSLHVVCDL

SEQ ID NO: 681074 - protein, 21 aa, Mycobacterium
IRFRVREAFARRGVTPRLRSG

SEQ ID NO: 681075 - protein, 26 aa, Mycobacterium
IRGAITLPLRITEMPDRVVWVPMRST

SEQ ID NO: 681076 - protein, 18 aa, Mycobacterium
IRGDDLCWTLIKELEQLQ

SEQ ID NO: 681077 - protein, 29 aa, Mycobacterium
IRGDHRYRITGTRGTSCYLGIQILAGTGL

SEQ ID NO: 681078 - protein, 17 aa, Mycobacterium
IRGDLLALVTAYAETVQ

SEQ ID NO: 681079 - protein, 24 aa, Mycobacterium
IRGDRRYRITGSRGTSAYLGFQIL

SEQ ID NO: 681080 - protein, 18 aa, Mycobacterium
IRGELLRILAGVDQLISR

SEQ ID NO: 681081 - protein, 17 aa, Mycobacterium
IRGFSLWGGVGIIRKAR

SEQ ID NO: 681082 - protein, 28 aa, Mycobacterium
IRGGELRRLKICAAPDCEAVLTDLSKNR

SEQ ID NO: 681083 - protein, 20 aa, Mycobacterium
IRGGEPWVRYDGSGGSTMLL

SEQ ID NO: 681084 - protein, 18 aa, Mycobacterium
IRGGFILAADRAEILELA

SEQ ID NO: 681085 - protein, 18 aa, Mycobacterium
IRGGHPWRAARTANTCSM

SEQ ID NO: 681086 - protein, 18 aa, Mycobacterium
IRGGRRVSAATAFLKPVL

SEQ ID NO: 681087 - protein, 17 aa, Mycobacterium
IRGGSTVIHLERVLLAD

SEQ ID NO: 681088 - protein, 18 aa, Mycobacterium
IRGGSVVHTECDMRALPP

SEQ ID NO: 681089 - protein, 17 aa, Mycobacterium
IRGKRIFHPSGVLARGF

SEQ ID NO: 681090 - protein, 18 aa, Mycobacterium
IRGLLPYSVAKGGLEALT

SEQ ID NO: 681091 - protein, 25 aa, Mycobacterium
IRGLPPKRRYEVLKALDDDRLADVL

SEQ ID NO: 681092 - protein, 18 aa, Mycobacterium
IRGNLYATEVMDGRVSVR

SEQ ID NO: 681093 - protein, 18 aa, Mycobacterium
IRGPERIALTGRNGAGKT

SEQ ID NO: 681094 - protein, 26 aa, Mycobacterium
IRGPGRYPFDPVVSALILRALVTRVP

SEQ ID NO: 681095 - protein, 29 aa, Mycobacterium
IRGPHTLRGICGRGREDLFTADGFYPTGD

SEQ ID NO: 681096 - protein, 17 aa, Mycobacterium
IRGPRIVAQLAAGIAVG

SEQ ID NO: 681097 - protein, 18 aa, Mycobacterium
IRGRFQRIQCTPDLLPSD

SEQ ID NO: 681098 - protein, 23 aa, Mycobacterium
IRGRGAMIAVELIKPGTREPNKE

SEQ ID NO: 681099 - protein, 20 aa, Mycobacterium
IRGRGLFWAVELVRNKETRE

SEQ ID NO: 681100 - protein, 26 aa, Mycobacterium
IRGRGMVQGIAFADAERGPRVSRAAF

SEQ ID NO: 681101 - protein, 21 aa, Mycobacterium
IRGRIKELINRGGEKISPERV

SEQ ID NO: 681102 - protein, 21 aa, Mycobacterium
IRGRNGVRLSEFWGDSPSAYR

SEQ ID NO: 681103 - protein, 23 aa, Mycobacterium
IRGRTEWGVKGYAAPAPAPEAAE

SEQ ID NO: 681104 - protein, 17 aa, Mycobacterium
IRGSFALSEPHSGTDIR

SEQ ID NO: 681105 - protein, 18 aa, Mycobacterium
IRGTCVLVDDSIKTLPAS

SEQ ID NO: 681106 - protein, 20 aa, Mycobacterium
IRGTCVLVDGSIKVLSPSGM

SEQ ID NO: 681107 - protein, 19 aa, Mycobacterium
IRGTCVLVDGSPRSLSGSG

SEQ ID NO: 681108 - protein, 18 aa, Mycobacterium
IRGTFLLTKAALPHLRQA

SEQ ID NO: 681109 - protein, 21 aa, Mycobacterium
IRGVLHFMQRTAIQASPDMLT

SEQ ID NO: 681110 - protein, 26 aa, Mycobacterium
IRHIARFCDVMGIAAAHFVGNSMGAI

SEQ ID NO: 681111 - protein, 22 aa, Mycobacterium
IRHILCAPVDLLFNGGIGTYIK

SEQ ID NO: 681112 - protein, 25 aa, Mycobacterium
IRHLEMLATFLKWRSDTRGELTEVG

SEQ ID NO: 681113 - protein, 19 aa, Mycobacterium
IRHNMPFGEIGKGEFGTYY

SEQ ID NO: 681114 - protein, 19 aa, Mycobacterium
IRHTLSRTAMRGVARLMNS

SEQ ID NO: 681115 - protein, 20 aa, Mycobacterium
IRHVARFCELLGVDSAHFVG

SEQ ID NO: 681116 - protein, 32 aa, Mycobacterium
IRHVPVAVDLRDDWPAALRAGGFDVGRPAAWI

SEQ ID NO: 681117 - protein, 19 aa, Mycobacterium
IRHVRGLVENAGFVIGNAT

SEQ ID NO: 681118 - protein, 17 aa, Mycobacterium
IRIAPTFPATSDLRAAI

SEQ ID NO: 681119 - protein, 21 aa, Mycobacterium
IRIGAPASWTAAVDAQRQSNG

SEQ ID NO: 681120 - protein, 21 aa, Mycobacterium
IRIGAWFLENGHRALLALTGG

SEQ ID NO: 681121 - protein, 18 aa, Mycobacterium
IRIGGAVVNHLSPGQRDI

SEQ ID NO: 681122 - protein, 19 aa, Mycobacterium
IRIGHEVEEIIPAGPVTGP

SEQ ID NO: 681123 - protein, 19 aa, Mycobacterium
IRIGLALNCEIVPWCRFAR

SEQ ID NO: 681124 - protein, 24 aa, Mycobacterium
IRIGRRIMARLNWRKLGPGPTQPP

SEQ ID NO: 681125 - protein, 25 aa, Mycobacterium
IRIGRRIMARLNWRKNGPGPTTPPH

SEQ ID NO: 681126 - protein, 25 aa, Mycobacterium
IRIGRRIMARLNWRKSGPGPTTPPH

SEQ ID NO: 681127 - protein, 26 aa, Mycobacterium
IRIKLDRPAYVYPIFEQALRIANGES

SEQ ID NO: 681128 - protein, 17 aa, Mycobacterium
IRIKPSHLAGGYGQHAF

SEQ ID NO: 681129 - protein, 24 aa, Mycobacterium
IRIPAALCGTVGLKPTYGRASRVG

SEQ ID NO: 681130 - protein, 19 aa, Mycobacterium
IRIPEVISGASGNRVLTMT

SEQ ID NO: 681131 - protein, 17 aa, Mycobacterium
IRIPLKDRIRVEEPYVL

SEQ ID NO: 681132 - protein, 17 aa, Mycobacterium
IRIQGMLSEAARTWTDR

SEQ ID NO: 681133 - protein, 21 aa, Mycobacterium
IRITTDFTPVLGVLAQKSNNF

SEQ ID NO: 681134 - protein, 20 aa, Mycobacterium
IRIVPKGPDLSGWLSPHGRE

SEQ ID NO: 681135 - protein, 20 aa, Mycobacterium
IRKAKETVIGYAQEAQRELD

SEQ ID NO: 681136 - protein, 18 aa, Mycobacterium
IRKALSMGADKAVHLKDD

SEQ ID NO: 681137 - protein, 24 aa, Mycobacterium
IRKEIYPGGRLPMISVVDEYATGA

SEQ ID NO: 681138 - protein, 18 aa, Mycobacterium
IRKGIDRLIEFNKKEYAK

SEQ ID NO: 681139 - protein, 18 aa, Mycobacterium
IRKHIGWYLHGFPAGSEL

SEQ ID NO: 681140 - protein, 23 aa, Mycobacterium
IRKLEPIGAIGNYWASRHQPADQ

SEQ ID NO: 681141 - protein, 19 aa, Mycobacterium
IRKNVCLQYLPDAQVGQYV

SEQ ID NO: 681142 - protein, 20 aa, Mycobacterium
IRKTAEFGFLRQLRGQRDHW

SEQ ID NO: 681143 - protein, 18 aa, Mycobacterium
IRKTVGLFVNPFDDLDGY

SEQ ID NO: 681144 - protein, 19 aa, Mycobacterium
IRKVLSWLPGRGTNRRVDY

SEQ ID NO: 681145 - protein, 18 aa, Mycobacterium
IRLADVARRLGVTRQTVY

SEQ ID NO: 681146 - protein, 17 aa, Mycobacterium
IRLAEAISVDEYVDDRT

SEQ ID NO: 681147 - protein, 20 aa, Mycobacterium
IRLAEARGGEHLDEAALYTE

SEQ ID NO: 681148 - protein, 40 aa, Mycobacterium
IRLAEHEMPGLMALRREYAEVLPLKGARISGSLHMTIQTA

SEQ ID NO: 681149 - protein, 26 aa, Mycobacterium
IRLAEHEMPGLMALRREYHDVQPLKG

SEQ ID NO: 681150 - protein, 25 aa, Mycobacterium
IRLAGEGARVGVHYGTNADTAEQTA

SEQ ID NO: 681151 - protein, 20 aa, Mycobacterium
IRLAHAPMVNHWWQVTLYVT

SEQ ID NO: 681152 - protein, 20 aa, Mycobacterium
IRLANPPLLLATRRLIGDDG

SEQ ID NO: 681153 - protein, 20 aa, Mycobacterium
IRLAPQYLLDDLPRLAARLE

SEQ ID NO: 681154 - protein, 24 aa, Mycobacterium
IRLARVKRGLSWAKIAETIGKDPA

SEQ ID NO: 681155 - protein, 18 aa, Mycobacterium
IRLAVDAVEDMFRLPDLT

SEQ ID NO: 681156 - protein, 18 aa, Mycobacterium
IRLDELITAIKTIHPDVL

SEQ ID NO: 681157 - protein, 20 aa, Mycobacterium
IRLDHPGVLVIEGGPGTGKT

SEQ ID NO: 681158 - protein, 24 aa, Mycobacterium
IRLDRPAYVYPLFEQALRIANGES

SEQ ID NO: 681159 - protein, 18 aa, Mycobacterium
IRLDSVVDLDVFRHLHQA

SEQ ID NO: 681160 - protein, 18 aa, Mycobacterium
IRLDSVVDLELFKHLHKA

SEQ ID NO: 681161 - protein, 19 aa, Mycobacterium
IRLEPQRSWAVNEPEKLAI

SEQ ID NO: 681162 - protein, 17 aa, Mycobacterium
IRLEVFAASGAEQHQAP

SEQ ID NO: 681163 - protein, 24 aa, Mycobacterium
IRLGKYDIGIAIGMDKHPRGAFTD

SEQ ID NO: 681164 - protein, 20 aa, Mycobacterium
IRLGKYDIGVAVGLDKHPRG

SEQ ID NO: 681165 - protein, 17 aa, Mycobacterium
IRLGTNHAYAVVETGKA

SEQ ID NO: 681166 - protein, 20 aa, Mycobacterium
IRLGTRGSLLATTQAGTVRD

SEQ ID NO: 681167 - protein, 18 aa, Mycobacterium
IRLGTSVIQLSARTPTAC

SEQ ID NO: 681168 - protein, 25 aa, Mycobacterium
IRLIRRRLIPAGTWSGQATFRATVG

SEQ ID NO: 681169 - protein, 23 aa, Mycobacterium
IRLKLNAPMPYHCGQYVHVQVPQ

SEQ ID NO: 681170 - protein, 19 aa, Mycobacterium
IRLKPGERHWTLFRQLAAD

SEQ ID NO: 681171 - protein, 22 aa, Mycobacterium
IRLKVVGARVGLPHNVLDAIDR

SEQ ID NO: 681172 - protein, 22 aa, Mycobacterium
IRLLAERLGVRRVIGLGSIPMA

SEQ ID NO: 681173 - protein, 18 aa, Mycobacterium
IRLLEAIRLSRVECRFYQ

SEQ ID NO: 681174 - protein, 17 aa, Mycobacterium
IRLLGAILGDTVREQNG

SEQ ID NO: 681175 - protein, 17 aa, Mycobacterium
IRLLGRTEIRRLAKELD

SEQ ID NO: 681176 - protein, 21 aa, Mycobacterium
IRLLIVDGRLPVGARIPSERA

SEQ ID NO: 681177 - protein, 17 aa, Mycobacterium
IRLLKLPIAVQRRVAAG

SEQ ID NO: 681178 - protein, 18 aa, Mycobacterium
IRLLPGVTVAEFSAALSD

SEQ ID NO: 681179 - protein, 19 aa, Mycobacterium
IRLLRRLWREDDVTHRGEF

SEQ ID NO: 681180 - protein, 26 aa, Mycobacterium
IRLLSRVAGLGFRIVAIDAPGHGDTG

SEQ ID NO: 681181 - protein, 26 aa, Mycobacterium
IRLLVIDGRLPLGVRIPSERALASAL

SEQ ID NO: 681182 - protein, 17 aa, Mycobacterium
IRLLVIRSGLPAPQTEI

SEQ ID NO: 681183 - protein, 21 aa, Mycobacterium
IRLMSWRAHVFAPVSGIPGVQ

SEQ ID NO: 681184 - protein, 17 aa, Mycobacterium
IRLNCINPGPTDTAMLP

SEQ ID NO: 681185 - protein, 18 aa, Mycobacterium
IRLPAGVSRQSLADAWLG

SEQ ID NO: 681186 - protein, 25 aa, Mycobacterium
IRLPDGRLGIFTDRDLRIRVVAAGL

SEQ ID NO: 681187 - protein, 22 aa, Mycobacterium
IRLPESGAICFLIRTYMLPFAD

SEQ ID NO: 681188 - protein, 23 aa, Mycobacterium
IRLPESGSICFLIRSYMLPLADL

SEQ ID NO: 681189 - protein, 17 aa, Mycobacterium
IRLPKAWSGSPEITKLA

SEQ ID NO: 681190 - protein, 17 aa, Mycobacterium
IRLQCYEGLTASEALYD

SEQ ID NO: 681191 - protein, 27 aa, Mycobacterium
IRLQQELAELLPGCQGLDVVDSIYGHD

SEQ ID NO: 681192 - protein, 26 aa, Mycobacterium
IRLRARSAGLLTAWVATSFDVLASRV

SEQ ID NO: 681193 - protein, 21 aa, Mycobacterium
IRLRDGMAWSRARLADQSHLQ

SEQ ID NO: 681194 - protein, 18 aa, Mycobacterium
IRLRFGLDDGQPRTLDQI

SEQ ID NO: 681195 - protein, 22 aa, Mycobacterium
IRLRLFHGRGGTVGRGGGPSYE

SEQ ID NO: 681196 - protein, 22 aa, Mycobacterium
IRLRLFHGRGGTVGRGGGPSYQ

SEQ ID NO: 681197 - protein, 34 aa, Mycobacterium
IRLSGTRPPIWCPSAAFGLSWSYRGLLDHVDDRP

SEQ ID NO: 681198 - protein, 25 aa, Mycobacterium
IRLSMYVLNAAFYKPALLGREVEAL

SEQ ID NO: 681199 - protein, 19 aa, Mycobacterium
IRLSRAGQPVFHHLGVSGF

SEQ ID NO: 681200 - protein, 18 aa, Mycobacterium
IRLTCGRALSLTPLPPPA

SEQ ID NO: 681201 - protein, 19 aa, Mycobacterium
IRLVTPVQWAMRQTVRDTE

SEQ ID NO: 681202 - protein, 17 aa, Mycobacterium
IRMFSRIGLSANLNSTA

SEQ ID NO: 681203 - protein, 18 aa, Mycobacterium
IRMLIKAGAELAGHYRFP

SEQ ID NO: 681204 - protein, 20 aa, Mycobacterium
IRMLRLLVLETAWKIDNSST

SEQ ID NO: 681205 - protein, 17 aa, Mycobacterium
IRMMGADGLRAASLTAI

SEQ ID NO: 681206 - protein, 17 aa, Mycobacterium
IRMMGAEGLRAASLTAI

SEQ ID NO: 681207 - protein, 27 aa, Mycobacterium
IRMPAKRARAAATLAQRLTEIPQSEWD

SEQ ID NO: 681208 - protein, 19 aa, Mycobacterium
IRMPEFCAPSLGNKNNTVT

SEQ ID NO: 681209 - protein, 26 aa, Mycobacterium
IRMSQRLGIPLARIREALATLPSDRV

SEQ ID NO: 681210 - protein, 25 aa, Mycobacterium
IRMSQRLGIPLSRIREALSTLPNDR

SEQ ID NO: 681211 - protein, 27 aa, Mycobacterium
IRNEWGWAEAYLDMGWEDIKVAVEYDG

SEQ ID NO: 681212 - protein, 18 aa, Mycobacterium
IRNGRRVSAATAFLKPAL

SEQ ID NO: 681213 - protein, 17 aa, Mycobacterium
IRNLAEWRHHLISRLRR

SEQ ID NO: 681214 - protein, 20 aa, Mycobacterium
IRNLKALGYSVGGWDPTHRP

SEQ ID NO: 681215 - protein, 17 aa, Mycobacterium
IRNPRFVSTSVHLGPGD

SEQ ID NO: 681216 - protein, 19 aa, Mycobacterium
IRNQWLFGQAWGVDVAVST

SEQ ID NO: 681217 - protein, 18 aa, Mycobacterium
IRPACPKSLPFGGLPSAM

SEQ ID NO: 681218 - protein, 17 aa, Mycobacterium
IRPAMAINKEIDLRFVL

SEQ ID NO: 681219 - protein, 17 aa, Mycobacterium
IRPAYNVLDGFEGHLDA

SEQ ID NO: 681220 - protein, 17 aa, Mycobacterium
IRPDGQGLLALVGVTHD

SEQ ID NO: 681221 - protein, 18 aa, Mycobacterium
IRPEFRPKLKAFMADLCW

SEQ ID NO: 681222 - protein, 17 aa, Mycobacterium
IRPGAAHCRTCGADFTL

SEQ ID NO: 681223 - protein, 19 aa, Mycobacterium
IRPGDIVIVNTGWHHKYAD

SEQ ID NO: 681224 - protein, 18 aa, Mycobacterium
IRPGDIVVVNTGWHHKYA

SEQ ID NO: 681225 - protein, 18 aa, Mycobacterium
IRPGDLVFPHPGHVQLAI

SEQ ID NO: 681226 - protein, 18 aa, Mycobacterium
IRPGEFVISGSYTTAASV

SEQ ID NO: 681227 - protein, 17 aa, Mycobacterium
IRPGHRNSRAALALWSG

SEQ ID NO: 681228 - protein, 18 aa, Mycobacterium
IRPGSPFVDRPLGDTKAR

SEQ ID NO: 681229 - protein, 21 aa, Mycobacterium
IRPGTDGALAMGMIQQIIAQG

SEQ ID NO: 681230 - protein, 22 aa, Mycobacterium
IRPGTTGVWVLVQRPSIFSQDP

SEQ ID NO: 681231 - protein, 20 aa, Mycobacterium
IRPIEVFNLARAVPGVRETI

SEQ ID NO: 681232 - protein, 18 aa, Mycobacterium
IRPIVSMDGRHHFNEVLL

SEQ ID NO: 681233 - protein, 18 aa, Mycobacterium
IRPLWPYVDPLRAGEFHF

SEQ ID NO: 681234 - protein, 24 aa, Mycobacterium
IRPLYTRVLLKLGGEMFGGGQVGL

SEQ ID NO: 681235 - protein, 24 aa, Mycobacterium
IRPPQCARAAVLRAMGLPLAGLRV

SEQ ID NO: 681236 - protein, 17 aa, Mycobacterium
IRPPRAAGIAPHRYEEL

SEQ ID NO: 681237 - protein, 23 aa, Mycobacterium
IRPRRGRGRIVAPVRAGRHNEWV

SEQ ID NO: 681238 - protein, 20 aa, Mycobacterium
IRPSDVYRPIGEILAEIERT

SEQ ID NO: 681239 - protein, 20 aa, Mycobacterium
IRPSMLEFMDSVAINAVEDK

SEQ ID NO: 681240 - protein, 19 aa, Mycobacterium
IRPSPALGTVEVRIFDGIS

SEQ ID NO: 681241 - protein, 19 aa, Mycobacterium
IRPSPQLGTVEVRIFDGVS

SEQ ID NO: 681242 - protein, 19 aa, Mycobacterium
IRPSYEWPGHKPGQYVRLG

SEQ ID NO: 681243 - protein, 18 aa, Mycobacterium
IRPTLAIGSRVPHLPWPF

SEQ ID NO: 681244 - protein, 18 aa, Mycobacterium
IRPWRLPAPGGRRELDEA

SEQ ID NO: 681245 - protein, 20 aa, Mycobacterium
IRPWVPGTFVTLGTDGFGFS

SEQ ID NO: 681246 - protein, 18 aa, Mycobacterium
IRQDIDWITHAENPIGPR

SEQ ID NO: 681247 - protein, 18 aa, Mycobacterium
IRQDIDWLDYLENPTGPR

SEQ ID NO: 681248 - protein, 17 aa, Mycobacterium
IRQGSAFAVPRMLRSGR

SEQ ID NO: 681249 - protein, 19 aa, Mycobacterium
IRQLLKHQRFPVHQLDGEV

SEQ ID NO: 681250 - protein, 24 aa, Mycobacterium
IRQNPRPGIVNALLEMRIDGQPAP

SEQ ID NO: 681251 - protein, 25 aa, Mycobacterium
IRQNPRPGLVNALLQLRIDGEPAPD

SEQ ID NO: 681252 - protein, 18 aa, Mycobacterium
IRQQPTVWGRLLSDGRSA

SEQ ID NO: 681253 - protein, 22 aa, Mycobacterium
IRQRIEDIVSIALQEDVALVGL

SEQ ID NO: 681254 - protein, 23 aa, Mycobacterium
IRQRIEDIVSIALQEDVALVGLS

SEQ ID NO: 681255 - protein, 19 aa, Mycobacterium
IRQRIVGIAGIDTRAVVRH

SEQ ID NO: 681256 - protein, 18 aa, Mycobacterium
IRQRYPLGHARLENSAKV

SEQ ID NO: 681257 - protein, 17 aa, Mycobacterium
IRQVLGLAGVEIGSNVR

SEQ ID NO: 681258 - protein, 17 aa, Mycobacterium
IRRAAGLKDPGAGDTLL

SEQ ID NO: 681259 - protein, 19 aa, Mycobacterium
IRRAIAFQRCLEVAARLTL

SEQ ID NO: 681260 - protein, 22 aa, Mycobacterium
IRRAMSQLGVPYSWGGGNANGP

SEQ ID NO: 681261 - protein, 17 aa, Mycobacterium
IRRCRQFGFSVEQIRNL

SEQ ID NO: 681262 - protein, 20 aa, Mycobacterium
IRRDGWRHNAWGLVPPWCIR

SEQ ID NO: 681263 - protein, 17 aa, Mycobacterium
IRRDKRARLLAEGTEPY

SEQ ID NO: 681264 - protein, 17 aa, Mycobacterium
IRRDKRARLLAEGYDPY

SEQ ID NO: 681265 - protein, 21 aa, Mycobacterium
IRRDPRVAVTIASTDRSGPQT

SEQ ID NO: 681266 - protein, 27 aa, Mycobacterium
IRREAAKPGSYRWLKGGRRPAQAPAAV

SEQ ID NO: 681267 - protein, 25 aa, Mycobacterium
IRRFCVRCLDPLVGRDSFDIIAELA

SEQ ID NO: 681268 - protein, 28 aa, Mycobacterium
IRRFWPRRLRRSSFYWKLVAYDQRYDIA

SEQ ID NO: 681269 - protein, 22 aa, Mycobacterium
IRRGAKLLFAYGEATVPKITVI

SEQ ID NO: 681270 - protein, 19 aa, Mycobacterium
IRRGEILGLIGPNGAGKTT

SEQ ID NO: 681271 - protein, 19 aa, Mycobacterium
IRRGHDAIRAFYAGFQDAK

SEQ ID NO: 681272 - protein, 19 aa, Mycobacterium
IRRHGALLAAHFGEDKGMR

SEQ ID NO: 681273 - protein, 18 aa, Mycobacterium
IRRHGVALDKLIDVHEQV

SEQ ID NO: 681274 - protein, 20 aa, Mycobacterium
IRRHRVDAAILFSDIVVPLK

SEQ ID NO: 681275 - protein, 28 aa, Mycobacterium
IRRIGAVAKLFCEAGVIALTAFISPYVR

SEQ ID NO: 681276 - protein, 19 aa, Mycobacterium
IRRKAAKRLAKEVTAELSG

SEQ ID NO: 681277 - protein, 21 aa, Mycobacterium
IRRKAMEELARIKKDGDAGED

SEQ ID NO: 681278 - protein, 21 aa, Mycobacterium
IRRKAMEELHRIRKDGEAGED

SEQ ID NO: 681279 - protein, 19 aa, Mycobacterium
IRRKIPISFAPTAVNATQM

SEQ ID NO: 681280 - protein, 23 aa, Mycobacterium
IRRKTYESLDRWHDAERTMQLNY

SEQ ID NO: 681281 - protein, 25 aa, Mycobacterium
IRRLAKLRGATVLAHNYQLPAIQDV

SEQ ID NO: 681282 - protein, 25 aa, Mycobacterium
IRRLAKLRGATVLAHNYQLPEIQDV

SEQ ID NO: 681283 - protein, 25 aa, Mycobacterium
IRRLLDRVASIDGIINTVKGIFTGD

SEQ ID NO: 681284 - protein, 18 aa, Mycobacterium
IRRLLRLSATNTLDAQLD

SEQ ID NO: 681285 - protein, 18 aa, Mycobacterium
IRRLQKLLNVMSADPAAR

SEQ ID NO: 681286 - protein, 19 aa, Mycobacterium
IRRNARDSYQIGVFGLKGG

SEQ ID NO: 681287 - protein, 20 aa, Mycobacterium
IRRPDDFPDFVDVDVEVDCS

SEQ ID NO: 681288 - protein, 22 aa, Mycobacterium
IRRQGGGISETFTVRKESYGVG

SEQ ID NO: 681289 - protein, 17 aa, Mycobacterium
IRRQGGIALKPLIARAL

SEQ ID NO: 681290 - protein, 19 aa, Mycobacterium
IRRRGWQGAGVVEADGPDD

SEQ ID NO: 681291 - protein, 28 aa, Mycobacterium
IRRRKPRDPWPEFPHLRTARGAFHDPHH

SEQ ID NO: 681292 - protein, 17 aa, Mycobacterium
IRRRWDKDAVVLPHPHV

SEQ ID NO: 681293 - protein, 17 aa, Mycobacterium
IRRSDVFLTNYLPSTRK

SEQ ID NO: 681294 - protein, 22 aa, Mycobacterium
IRRSHAPEHIGWQVAVNHRLNA

SEQ ID NO: 681295 - protein, 19 aa, Mycobacterium
IRRSLRVLGQISAEGMQLR

SEQ ID NO: 681296 - protein, 18 aa, Mycobacterium
IRRTYRAAHNIGHFRFVE

SEQ ID NO: 681297 - protein, 21 aa, Mycobacterium
IRRVDAAGGTGVLDLLKRLDI

SEQ ID NO: 681298 - protein, 20 aa, Mycobacterium
IRRVRREVPGAGEVVATQCT

SEQ ID NO: 681299 - protein, 23 aa, Mycobacterium
IRRYCVRCLDPLVGSDRFDIIAE

SEQ ID NO: 681300 - protein, 19 aa, Mycobacterium
IRRYELGRAASLLNVPSPI

SEQ ID NO: 681301 - protein, 26 aa, Mycobacterium
IRRYLSYFPASAWSYPPAAEIDESVE

SEQ ID NO: 681302 - protein, 25 aa, Mycobacterium
IRSAIKQICRRHGYHATFMSRPAFP

SEQ ID NO: 681303 - protein, 18 aa, Mycobacterium
IRSAKLLNIDTAIVGDLM

SEQ ID NO: 681304 - protein, 20 aa, Mycobacterium
IRSATWIVVVGIVTGDTNGA

SEQ ID NO: 681305 - protein, 17 aa, Mycobacterium
IRSDVECQVRAGELTPA

SEQ ID NO: 681306 - protein, 17 aa, Mycobacterium
IRSECGAELGIRDVFEL

SEQ ID NO: 681307 - protein, 18 aa, Mycobacterium
IRSGNGWPTDQSLGESVR

SEQ ID NO: 681308 - protein, 17 aa, Mycobacterium
IRSGTAHVVVWPTGSAS

SEQ ID NO: 681309 - protein, 19 aa, Mycobacterium
IRSILSFELFIDGGSMAAL

SEQ ID NO: 681310 - protein, 26 aa, Mycobacterium
IRSIMSKELACLTLGDAGAALLFERA

SEQ ID NO: 681311 - protein, 24 aa, Mycobacterium
IRSIPARALIRFAAHAPTWRETGR

SEQ ID NO: 681312 - protein, 17 aa, Mycobacterium
IRSIVAIGTPLDYGQIP

SEQ ID NO: 681313 - protein, 23 aa, Mycobacterium
IRSKGVGVFFCTQLPTDLPKDVL

SEQ ID NO: 681314 - protein, 23 aa, Mycobacterium
IRSKGVGVFFCTQLPTDLPNTVL

SEQ ID NO: 681315 - protein, 23 aa, Mycobacterium
IRSKGVGVLFCTQLPTDIPKEVL

SEQ ID NO: 681316 - protein, 25 aa, Mycobacterium
IRSLLREAPDSFGLADGAWVLDELR

SEQ ID NO: 681317 - protein, 19 aa, Mycobacterium
IRSNVPVYTAAALDGTDDG

SEQ ID NO: 681318 - protein, 20 aa, Mycobacterium
IRSPAPFYAGERMCAEVAIW

SEQ ID NO: 681319 - protein, 18 aa, Mycobacterium
IRSPAWLSRFTDMARQAA

SEQ ID NO: 681320 - protein, 18 aa, Mycobacterium
IRSRAEWRRLYEEKQLAK

SEQ ID NO: 681321 - protein, 25 aa, Mycobacterium
IRSRISAALPDYMIPAAYVVLDEIP

SEQ ID NO: 681322 - protein, 17 aa, Mycobacterium
IRSRIVKRRGHLQAVCE

SEQ ID NO: 681323 - protein, 23 aa, Mycobacterium
IRSRLPRVVDWLARADVDVLAMQ

SEQ ID NO: 681324 - protein, 17 aa, Mycobacterium
IRSRSDLVAALPHRAAQ

SEQ ID NO: 681325 - protein, 22 aa, Mycobacterium
IRSRTELYATIVRPGQLTDDPG

SEQ ID NO: 681326 - protein, 25 aa, Mycobacterium
IRSSHLHLGGPEFLGGPAAGELLQY

SEQ ID NO: 681327 - protein, 20 aa, Mycobacterium
IRSSMPGVVRVVSVSTGAAV

SEQ ID NO: 681328 - protein, 18 aa, Mycobacterium
IRSTGIAFDRDEHTPGIS

SEQ ID NO: 681329 - protein, 19 aa, Mycobacterium
IRSTYPLSYGPQSDGSLSP

SEQ ID NO: 681330 - protein, 25 aa, Mycobacterium
IRSVKREIGTDWSVEIDGKNYTPQE

SEQ ID NO: 681331 - protein, 24 aa, Mycobacterium
IRSVKRHVGTDWNIEIDDKKYTPQ

SEQ ID NO: 681332 - protein, 26 aa, Mycobacterium
IRSVRELRMPAGRGKVLRWAAPLLYA

SEQ ID NO: 681333 - protein, 26 aa, Mycobacterium
IRSYPSIQWYGFILVWHERHGRPPYW

SEQ ID NO: 681334 - protein, 28 aa, Mycobacterium
IRTAEEFSWRASELFDAISSGVITIEVG

SEQ ID NO: 681335 - protein, 28 aa, Mycobacterium
IRTCDCFNIPIVLLVDVPGFLPGTDQEY

SEQ ID NO: 681336 - protein, 17 aa, Mycobacterium
IRTCPRCHNTTQWTRME

SEQ ID NO: 681337 - protein, 18 aa, Mycobacterium
IRTCREGEHMARVEICDT

SEQ ID NO: 681338 - protein, 19 aa, Mycobacterium
IRTDPFAHWQHIPRCVRPA

SEQ ID NO: 681339 - protein, 18 aa, Mycobacterium
IRTDSRFTEDGRRRELAK

SEQ ID NO: 681340 - protein, 18 aa, Mycobacterium
IRTDVSLVVRMHQGGDFV

SEQ ID NO: 681341 - protein, 19 aa, Mycobacterium
IRTGALLAAAHWGRPLDLE

SEQ ID NO: 681342 - protein, 17 aa, Mycobacterium
IRTGGWDVGTRPPLVLG

SEQ ID NO: 681343 - protein, 17 aa, Mycobacterium
IRTGMDAAKALAMGAEV

SEQ ID NO: 681344 - protein, 18 aa, Mycobacterium
IRTGNGLHGPRRAQHRAH

SEQ ID NO: 681345 - protein, 26 aa, Mycobacterium
IRTGRANPGMFSRIVIDYYGTHTPIT

SEQ ID NO: 681346 - protein, 26 aa, Mycobacterium
IRTGRANPGMFSRIVIDYYGTNTPIT

SEQ ID NO: 681347 - protein, 33 aa, Mycobacterium
IRTHHLPLLTPLRFIPVLGNPLADLVEPNLTTI

SEQ ID NO: 681348 - protein, 19 aa, Mycobacterium
IRTIAGVYRDEAGKAGNMA

SEQ ID NO: 681349 - protein, 18 aa, Mycobacterium
IRTIAGVYRDEAGKAPNI

SEQ ID NO: 681350 - protein, 20 aa, Mycobacterium
IRTLHHYDHIGLLTPEQRNA

SEQ ID NO: 681351 - protein, 19 aa, Mycobacterium
IRTLPQILSESGWYSALFG

SEQ ID NO: 681352 - protein, 17 aa, Mycobacterium
IRTLPTLSLHLLAAIAE

SEQ ID NO: 681353 - protein, 17 aa, Mycobacterium
IRTLSALALIDTDVLLP

SEQ ID NO: 681354 - protein, 26 aa, Mycobacterium
IRTPEEFAWRADDVLDLVSRGTLKIT

SEQ ID NO: 681355 - protein, 17 aa, Mycobacterium
IRTPWWRTPSLWAPDLF

SEQ ID NO: 681356 - protein, 17 aa, Mycobacterium
IRTRARMGPEYTELKNL

SEQ ID NO: 681357 - protein, 20 aa, Mycobacterium
IRTRGRLWLATQGEQAMWLE

SEQ ID NO: 681358 - protein, 22 aa, Mycobacterium
IRTRLDRVLDWIARADVDVLAM

SEQ ID NO: 681359 - protein, 20 aa, Mycobacterium
IRTRWVRALVDLRVARLLAY

SEQ ID NO: 681360 - protein, 20 aa, Mycobacterium
IRTSGMLMVAPYVARMTPQL

SEQ ID NO: 681361 - protein, 22 aa, Mycobacterium
IRTSQDWWPADYGNYAGLFVRM

SEQ ID NO: 681362 - protein, 18 aa, Mycobacterium
IRTTASWLGTALALKPLL

SEQ ID NO: 681363 - protein, 18 aa, Mycobacterium
IRTTSGIVFSDFEDICRG

SEQ ID NO: 681364 - protein, 22 aa, Mycobacterium
IRTTWPTMFHPMTYVGMARLAK

SEQ ID NO: 681365 - protein, 22 aa, Mycobacterium
IRTVERLPWLTVIPAYLVGVGV

SEQ ID NO: 681366 - protein, 21 aa, Mycobacterium
IRTVGALALMGVRIDQVIVNQ

SEQ ID NO: 681367 - protein, 18 aa, Mycobacterium
IRTWISAFAAMAVAGPYQ

SEQ ID NO: 681368 - protein, 17 aa, Mycobacterium
IRVAAELALPHRRRRDP

SEQ ID NO: 681369 - protein, 20 aa, Mycobacterium
IRVAAELALPHRRRRDPFDE

SEQ ID NO: 681370 - protein, 18 aa, Mycobacterium
IRVAAMLENLAVVRTVVA

SEQ ID NO: 681371 - protein, 22 aa, Mycobacterium
IRVADEWGELVAYLDMGWEELM

SEQ ID NO: 681372 - protein, 19 aa, Mycobacterium
IRVAQLFSGLLGHERVGVD

SEQ ID NO: 681373 - protein, 23 aa, Mycobacterium
IRVASWIDRLGTVWVEGQLAQIT

SEQ ID NO: 681374 - protein, 20 aa, Mycobacterium
IRVAVPAARFAVMEPKRGLF

SEQ ID NO: 681375 - protein, 17 aa, Mycobacterium
IRVDGNDVLACYAVMAE

SEQ ID NO: 681376 - protein, 17 aa, Mycobacterium
IRVDGNDVLACYAVMSE

SEQ ID NO: 681377 - protein, 17 aa, Mycobacterium
IRVDGNDVLACYAVTAE

SEQ ID NO: 681378 - protein, 17 aa, Mycobacterium
IRVDGPRSWDLDLTIDL

SEQ ID NO: 681379 - protein, 19 aa, Mycobacterium
IRVDVRPGALVSEMDVTAV

SEQ ID NO: 681380 - protein, 17 aa, Mycobacterium
IRVELKLAAGARLDKLD

SEQ ID NO: 681381 - protein, 17 aa, Mycobacterium
IRVFPGDHFYLNNNLPE

SEQ ID NO: 681382 - protein, 17 aa, Mycobacterium
IRVGDIIGTVRPTPQRY

SEQ ID NO: 681383 - protein, 18 aa, Mycobacterium
IRVGDVIGTVRPTHVPFK

SEQ ID NO: 681384 - protein, 26 aa, Mycobacterium
IRVGSLTWPGAHSWPDRGKRTGGGLL

SEQ ID NO: 681385 - protein, 18 aa, Mycobacterium
IRVGVLAYMAYHEQNPEA

SEQ ID NO: 681386 - protein, 18 aa, Mycobacterium
IRVLEAMGVIRTAAGSGP

SEQ ID NO: 681387 - protein, 18 aa, Mycobacterium
IRVLKPGGRFVFAGEPTT

SEQ ID NO: 681388 - protein, 23 aa, Mycobacterium
IRVLRPGGRFVFAGEPTSAGDVY

SEQ ID NO: 681389 - protein, 18 aa, Mycobacterium
IRVLRYGSGASLPGEPLA

SEQ ID NO: 681390 - protein, 17 aa, Mycobacterium
IRVNGPRSWDLDVAVDV

SEQ ID NO: 681391 - protein, 24 aa, Mycobacterium
IRVNSVAPGYIWGDTLKGYFQHQA

SEQ ID NO: 681392 - protein, 18 aa, Mycobacterium
IRVPVEITDAIKPGVVSM

SEQ ID NO: 681393 - protein, 29 aa, Mycobacterium
IRVRARGGVVLATGGFEWDTTLVEAFLRG

SEQ ID NO: 681394 - protein, 19 aa, Mycobacterium
IRVRDGIRQSVFRSYVHPY

SEQ ID NO: 681395 - protein, 19 aa, Mycobacterium
IRVRGRFLSMDEIAAEIGV

SEQ ID NO: 681396 - protein, 21 aa, Mycobacterium
IRVRVLPTWLRLDARFGSVYR

SEQ ID NO: 681397 - protein, 21 aa, Mycobacterium
IRVTAPQHWKVVSNAAAVEVS

SEQ ID NO: 681398 - protein, 20 aa, Mycobacterium
IRVTSWPPKGTDRGKGDAVA

SEQ ID NO: 681399 - protein, 17 aa, Mycobacterium
IRVVPLHILLDGADLRD

SEQ ID NO: 681400 - protein, 19 aa, Mycobacterium
IRVVRPFRGVSAEERRDLR

SEQ ID NO: 681401 - protein, 25 aa, Mycobacterium
IRVYRWKPTPLGGAFDQLVTEIARR

SEQ ID NO: 681402 - protein, 21 aa, Mycobacterium
IRWDPSDSRWVIATNRNDTIR

SEQ ID NO: 681403 - protein, 23 aa, Mycobacterium
IRWMGSGPLTGLAEIRLPDLQPG

SEQ ID NO: 681404 - protein, 23 aa, Mycobacterium
IRWMGSGPLTGLGEIQLPDLQPG

SEQ ID NO: 681405 - protein, 22 aa, Mycobacterium
IRWMGSGPLTGLGELQLPDLQP

SEQ ID NO: 681406 - protein, 31 aa, Mycobacterium
IRWYKTGDMARYWPDGTIEFLGRADHQVQIR

SEQ ID NO: 681407 - protein, 25 aa, Mycobacterium
IRYAFELAASAGFRVCSATKSNGII

SEQ ID NO: 681408 - protein, 30 aa, Mycobacterium
IRYARKRRVPILGLCLGLQCMVIEAARSAG

SEQ ID NO: 681409 - protein, 26 aa, Mycobacterium
IRYEGPRGGPGMQEMLYPTAFLKGRG

SEQ ID NO: 681410 - protein, 18 aa, Mycobacterium
IRYFESREAVLLELLDGA

SEQ ID NO: 681411 - protein, 24 aa, Mycobacterium
IRYGAECYFHQSCTAKMGRDSMSV

SEQ ID NO: 681412 - protein, 18 aa, Mycobacterium
IRYGEFVGAQLADTDPAT

SEQ ID NO: 681413 - protein, 20 aa, Mycobacterium
IRYGSFRRSFQLPEHVTSEA

SEQ ID NO: 681414 - protein, 26 aa, Mycobacterium
IRYHGREFIELIAVGATYDLAAAAAL

SEQ ID NO: 681415 - protein, 25 aa, Mycobacterium
IRYHGREFIELIVGGTTYDLAAEAA

SEQ ID NO: 681416 - protein, 23 aa, Mycobacterium
IRYIDRFLMFYIRTADRLQRTAP

SEQ ID NO: 681417 - protein, 22 aa, Mycobacterium
IRYLGEEGGRAFIRSMEGVEEV

SEQ ID NO: 681418 - protein, 22 aa, Mycobacterium
IRYLGEEGGRAFVRSMEGVEEV

SEQ ID NO: 681419 - protein, 26 aa, Mycobacterium
IRYLRATPLGDLRAEGWITRTDGIKT

SEQ ID NO: 681420 - protein, 19 aa, Mycobacterium
IRYLYAFGTPSGRAGSAYL

SEQ ID NO: 681421 - protein, 25 aa, Mycobacterium
IRYPLRKVHLALVLWFPDDATDGNE

SEQ ID NO: 681422 - protein, 18 aa, Mycobacterium
IRYQRVCEVDGEVVEYRD

SEQ ID NO: 681423 - protein, 18 aa, Mycobacterium
IRYRASRSAFAFKDTLMT

SEQ ID NO: 681424 - protein, 18 aa, Mycobacterium
IRYTELRPFVLHVNHTGA

SEQ ID NO: 681425 - protein, 19 aa, Mycobacterium
IRYTELRPFVVHVNHTGAK

SEQ ID NO: 681426 - protein, 17 aa, Mycobacterium
IRYTQLRPFVLHVNHTG

SEQ ID NO: 681427 - protein, 17 aa, Mycobacterium
IRYVLPGAEGWRTTETW

SEQ ID NO: 681428 - protein, 20 aa, Mycobacterium
ISAACARLGERALICSGPND

SEQ ID NO: 681429 - protein, 17 aa, Mycobacterium
ISAAGGRAVVMTYWNPV

SEQ ID NO: 681430 - protein, 20 aa, Mycobacterium
ISAAGLRPVRRFEDQPDAVV

SEQ ID NO: 681431 - protein, 18 aa, Mycobacterium
ISAAGVMRAEKILEAVRD

SEQ ID NO: 681432 - protein, 17 aa, Mycobacterium
ISAAIAYLVSDEAKYVT

SEQ ID NO: 681433 - protein, 24 aa, Mycobacterium
ISAATCFPNISFVHNWPKVEDGEH

SEQ ID NO: 681434 - protein, 24 aa, Mycobacterium
ISAATCFPNLSFVHNWPKVRDGRA

SEQ ID NO: 681435 - protein, 24 aa, Mycobacterium
ISAATCFPNLSFVHNWPKVRDRDD

SEQ ID NO: 681436 - protein, 20 aa, Mycobacterium
ISAAVAWARDCRVHTIRLRV

SEQ ID NO: 681437 - protein, 17 aa, Mycobacterium
ISAAVEWSSAQDVDQSV

SEQ ID NO: 681438 - protein, 18 aa, Mycobacterium
ISAAWDYAPTFVDAGLDV

SEQ ID NO: 681439 - protein, 17 aa, Mycobacterium
ISAAYPFEREVEDHHSY

SEQ ID NO: 681440 - protein, 17 aa, Mycobacterium
ISACALSKMAPGSVIDA

SEQ ID NO: 681441 - protein, 17 aa, Mycobacterium
ISACVAVGPIADDLVAK

SEQ ID NO: 681442 - protein, 17 aa, Mycobacterium
ISADTWRSEVAKVACAA

SEQ ID NO: 681443 - protein, 23 aa, Mycobacterium
ISAECDVLICVVAHAGDGNTHPV

SEQ ID NO: 681444 - protein, 20 aa, Mycobacterium
ISAEDAWTLGLVNEVVPDGT

SEQ ID NO: 681445 - protein, 25 aa, Mycobacterium
ISAEWRRHLSGWIGLDSYDERNTVG

SEQ ID NO: 681446 - protein, 24 aa, Mycobacterium
ISAEWVGTVISRLMPPGWSMHKLR

SEQ ID NO: 681447 - protein, 17 aa, Mycobacterium
ISAFAEIVGFYGLNYWY

SEQ ID NO: 681448 - protein, 17 aa, Mycobacterium
ISAFGQAGPASDRPGVD

SEQ ID NO: 681449 - protein, 17 aa, Mycobacterium
ISAFSTPASGTWAATIL

SEQ ID NO: 681450 - protein, 25 aa, Mycobacterium
ISAGAADCILAFDLLTAVDSQNIRY

SEQ ID NO: 681451 - protein, 25 aa, Mycobacterium
ISAGCAGFGYALGVAADMIRGGTAA

SEQ ID NO: 681452 - protein, 18 aa, Mycobacterium
ISAGCAGFGYAVGVAADM

SEQ ID NO: 681453 - protein, 18 aa, Mycobacterium
ISAGNFLPRTVSAAPSSR

SEQ ID NO: 681454 - protein, 17 aa, Mycobacterium
ISAHAAAIHDQLVTTLG

SEQ ID NO: 681455 - protein, 17 aa, Mycobacterium
ISAHCPVAIVRGGDGRR

SEQ ID NO: 681456 - protein, 19 aa, Mycobacterium
ISAHLRAAVGSRRHPPGTT

SEQ ID NO: 681457 - protein, 21 aa, Mycobacterium
ISALLDLLGSPQLSYPSIHIA

SEQ ID NO: 681458 - protein, 21 aa, Mycobacterium
ISALLDVAGWAQPWDTADERE

SEQ ID NO: 681459 - protein, 21 aa, Mycobacterium
ISALQAALFTAYGELYQSVNA

SEQ ID NO: 681460 - protein, 18 aa, Mycobacterium
ISALTHFDPEAGDACVLW

SEQ ID NO: 681461 - protein, 33 aa, Mycobacterium
ISAPGWAKHAWSCFFAPWIAEATIFVYNYGRFQ

SEQ ID NO: 681462 - protein, 26 aa, Mycobacterium
ISAQASAFHARFMSALNTGAGAYAAA

SEQ ID NO: 681463 - protein, 20 aa, Mycobacterium
ISARLAAAGVGWHIDTGVHC

SEQ ID NO: 681464 - protein, 21 aa, Mycobacterium
ISARSEWAPEVALQEFDSADD

SEQ ID NO: 681465 - protein, 17 aa, Mycobacterium
ISATTPWTLHHRASGAK

SEQ ID NO: 681466 - protein, 28 aa, Mycobacterium
ISAVIRRLRRPDPYKGKGVRYEGEQIRR

SEQ ID NO: 681467 - protein, 26 aa, Mycobacterium
ISAVLEKHARLSLAVNDMYLSTVGGM

SEQ ID NO: 681468 - protein, 21 aa, Mycobacterium
ISAVRARDGLFDYLAAHGDGL

SEQ ID NO: 681469 - protein, 24 aa, Mycobacterium
ISAWGLLSPEGRCATFDAAADGFV

SEQ ID NO: 681470 - protein, 25 aa, Mycobacterium
ISAYTRGRFASAFGPDAALEHVPPG

SEQ ID NO: 681471 - protein, 17 aa, Mycobacterium
ISCGTCRECRRGMTGSC

SEQ ID NO: 681472 - protein, 21 aa, Mycobacterium
ISCSFLLLCSGYYYYEQGYSP

SEQ ID NO: 681473 - protein, 21 aa, Mycobacterium
ISCVSAGSILRNLDPDRFEVT

SEQ ID NO: 681474 - protein, 22 aa, Mycobacterium
ISCVSAGSILRNLDPERFEVVA

SEQ ID NO: 681475 - protein, 17 aa, Mycobacterium
ISCVSAGSILRNLDPQR

SEQ ID NO: 681476 - protein, 24 aa, Mycobacterium
ISDALKQNEFVSLWSQYASPTQNS

SEQ ID NO: 681477 - protein, 17 aa, Mycobacterium
ISDAVAFAGAVSACSAF

SEQ ID NO: 681478 - protein, 24 aa, Mycobacterium
ISDELAEARWYLATLRDEGAVAKR

SEQ ID NO: 681479 - protein, 18 aa, Mycobacterium
ISDFPKPYVALMDGIVMG

SEQ ID NO: 681480 - protein, 35 aa, Mycobacterium
ISDFPTRHNYGLALWQNRIERILAEWVAELRVRIY

SEQ ID NO: 681481 - protein, 23 aa, Mycobacterium
ISDFPTRHPYGLALWQNEIERIL

SEQ ID NO: 681482 - protein, 26 aa, Mycobacterium
ISDFPTRHPYGLALWQNHIEHILADW

SEQ ID NO: 681483 - protein, 23 aa, Mycobacterium
ISDFPTRHPYGLALWQNQIERIL

SEQ ID NO: 681484 - protein, 23 aa, Mycobacterium
ISDFSADIQQMFSQPATLPSPPM

SEQ ID NO: 681485 - protein, 17 aa, Mycobacterium
ISDGELFIMGRIKDLLI

SEQ ID NO: 681486 - protein, 19 aa, Mycobacterium
ISDGWGELIDLSMLETQIL

SEQ ID NO: 681487 - protein, 24 aa, Mycobacterium
ISDIFYPRVFLRRGAMSPAGTISL

SEQ ID NO: 681488 - protein, 19 aa, Mycobacterium
ISDPGYFSRLFSRAHGTSP

SEQ ID NO: 681489 - protein, 20 aa, Mycobacterium
ISDTEGRLSIDLITFDKPDA

SEQ ID NO: 681490 - protein, 17 aa, Mycobacterium
ISDTRPAARRFFNTDAE

SEQ ID NO: 681491 - protein, 19 aa, Mycobacterium
ISDVIRLARHAHHYLAVFD

SEQ ID NO: 681492 - protein, 19 aa, Mycobacterium
ISDVLPLTPLQQGLLFQAG

SEQ ID NO: 681493 - protein, 21 aa, Mycobacterium
ISEADILWDLASRLEGRMTAI

SEQ ID NO: 681494 - protein, 22 aa, Mycobacterium
ISEADILWDLASRLEGRMTAIG

SEQ ID NO: 681495 - protein, 18 aa, Mycobacterium
ISEAVLFLASDAARYITG

SEQ ID NO: 681496 - protein, 17 aa, Mycobacterium
ISEDEWRAYWPGAESSA

SEQ ID NO: 681497 - protein, 22 aa, Mycobacterium
ISEEDLRRGLSIIDAALNVADG

SEQ ID NO: 681498 - protein, 17 aa, Mycobacterium
ISEGMGVPARRVTTAEE

SEQ ID NO: 681499 - protein, 20 aa, Mycobacterium
ISEGRSWFDAALAGASVLEV

SEQ ID NO: 681500 - protein, 23 aa, Mycobacterium
ISEIFTEVIIAPAYEPGAVEVLA

SEQ ID NO: 681501 - protein, 24 aa, Mycobacterium
ISEINAFLSGFGIPPFVVPTDGQP

SEQ ID NO: 681502 - protein, 21 aa, Mycobacterium
ISEIVTGYGMTECGGAMTLTR

SEQ ID NO: 681503 - protein, 32 aa, Mycobacterium
ISEKGCVVGARFRPGGFTARFGGDASVRTGCV

SEQ ID NO: 681504 - protein, 18 aa, Mycobacterium
ISELALRGTLGILDRTVR

SEQ ID NO: 681505 - protein, 21 aa, Mycobacterium
ISELLEKLFAGQSMKDLVAAG

SEQ ID NO: 681506 - protein, 22 aa, Mycobacterium
ISELLLRPGQTLAYNGQTLTLP

SEQ ID NO: 681507 - protein, 22 aa, Mycobacterium
ISELRSLVEPAGFTFAAATGSR

SEQ ID NO: 681508 - protein, 17 aa, Mycobacterium
ISEMLGWCQDAGVEMAT

SEQ ID NO: 681509 - protein, 32 aa, Mycobacterium
ISEPMPVAATFSWEFDDGFSLGALARLDTLVT

SEQ ID NO: 681510 - protein, 21 aa, Mycobacterium
ISEQLMPHWLLSLQADAARRG

SEQ ID NO: 681511 - protein, 26 aa, Mycobacterium
ISEREVEGLYKIVRRLRDHGVAMVYT

SEQ ID NO: 681512 - protein, 23 aa, Mycobacterium
ISESGVHYWGRFGSAGLLLRAPR

SEQ ID NO: 681513 - protein, 25 aa, Mycobacterium
ISEVLFPPASWMFGAAGREHMQQYG

SEQ ID NO: 681514 - protein, 26 aa, Mycobacterium
ISFASTCAHHLLPFSGTATIAYRPHP

SEQ ID NO: 681515 - protein, 23 aa, Mycobacterium
ISFDPKSSISMIGREVFESEDRI

SEQ ID NO: 681516 - protein, 23 aa, Mycobacterium
ISFELRQGRTLGIVGESGSGKST

SEQ ID NO: 681517 - protein, 28 aa, Mycobacterium
ISFMTPAAFVRRPGRWIRAMARKPDDTG

SEQ ID NO: 681518 - protein, 17 aa, Mycobacterium
ISFNDGWFVQGLKGTGS

SEQ ID NO: 681519 - protein, 18 aa, Mycobacterium
ISFPAIVGTIADVLHAAD

SEQ ID NO: 681520 - protein, 17 aa, Mycobacterium
ISFQRLGAEVIVVDTGK

SEQ ID NO: 681521 - protein, 22 aa, Mycobacterium
ISFRGLERTQIRALGLLKAACA

SEQ ID NO: 681522 - protein, 26 aa, Mycobacterium
ISFSSTCAHHLLPFTGTATIAYRPHP

SEQ ID NO: 681523 - protein, 19 aa, Mycobacterium
ISFSTPYNLACDFYGGPAP

SEQ ID NO: 681524 - protein, 26 aa, Mycobacterium
ISGAFLAKLGCSFVVVGHSERRTYHN

SEQ ID NO: 681525 - protein, 27 aa, Mycobacterium
ISGAFLAKLGCTFAVVGHSERRTYHGE

SEQ ID NO: 681526 - protein, 26 aa, Mycobacterium
ISGAFLAKLGCTFVIVGHSERRTYHG

SEQ ID NO: 681527 - protein, 27 aa, Mycobacterium
ISGAKHDLRRTLGTVFVATAVGGAATA

SEQ ID NO: 681528 - protein, 18 aa, Mycobacterium
ISGAPGALRIRLDDGSIV

SEQ ID NO: 681529 - protein, 18 aa, Mycobacterium
ISGARAATLCFMLGGELE

SEQ ID NO: 681530 - protein, 36 aa, Mycobacterium
ISGCRPRALSKFRRDHVGFIFQFFNLIPTLTAKENV

SEQ ID NO: 681531 - protein, 18 aa, Mycobacterium
ISGCSAVFASLWDTYTVR

SEQ ID NO: 681532 - protein, 24 aa, Mycobacterium
ISGDGRAGEAFADFQDTARQLSSQ

SEQ ID NO: 681533 - protein, 18 aa, Mycobacterium
ISGDNVKFGATEILAGLV

SEQ ID NO: 681534 - protein, 25 aa, Mycobacterium
ISGEATFDFGAAFDRSRKVAEGRVA

SEQ ID NO: 681535 - protein, 24 aa, Mycobacterium
ISGEATFDYGAAFDRSRKVADGRV

SEQ ID NO: 681536 - protein, 18 aa, Mycobacterium
ISGFALGGGFEMALMTDI

SEQ ID NO: 681537 - protein, 26 aa, Mycobacterium
ISGGKVKGNVPFRVVTGHGAFVVPFF

SEQ ID NO: 681538 - protein, 22 aa, Mycobacterium
ISGGWRPTPRRSTSTDLHVPAA

SEQ ID NO: 681539 - protein, 18 aa, Mycobacterium
ISGIPFNGPVGGVRVALI

SEQ ID NO: 681540 - protein, 27 aa, Mycobacterium
ISGLDLRPASSLAECLQLAADHAAAHP

SEQ ID NO: 681541 - protein, 19 aa, Mycobacterium
ISGLFHGPRLQEMDARHGG

SEQ ID NO: 681542 - protein, 23 aa, Mycobacterium
ISGLLPLTSGSVWFEGKDISRVK

SEQ ID NO: 681543 - protein, 21 aa, Mycobacterium
ISGLRARLGGARMRLGDHPYA

SEQ ID NO: 681544 - protein, 17 aa, Mycobacterium
ISGLVIVASASIDGARQ

SEQ ID NO: 681545 - protein, 20 aa, Mycobacterium
ISGMKAWRAVLPADIEMLPV

SEQ ID NO: 681546 - protein, 17 aa, Mycobacterium
ISGMVVDLSGQVFAVDR

SEQ ID NO: 681547 - protein, 34 aa, Mycobacterium
ISGNYSNGMFWRGDYQGLVGAHYEIFIPEFPVLN

SEQ ID NO: 681548 - protein, 29 aa, Mycobacterium
ISGPARAPMAVTVADTLIGRVVVSNSVGP

SEQ ID NO: 681549 - protein, 25 aa, Mycobacterium
ISGPHLQYAGAFLRSARTPRAVAQV

SEQ ID NO: 681550 - protein, 24 aa, Mycobacterium
ISGPHLQYAGAFLRSGRTPRSVAQ

SEQ ID NO: 681551 - protein, 17 aa, Mycobacterium
ISGRNSGFFNVGTAVSG

SEQ ID NO: 681552 - protein, 20 aa, Mycobacterium
ISGTCAPGFERVRTAFEQNF

SEQ ID NO: 681553 - protein, 19 aa, Mycobacterium
ISGTLQILGFAFTMVTGGN

SEQ ID NO: 681554 - protein, 19 aa, Mycobacterium
ISGVFFPKGGVRAVPDALA

SEQ ID NO: 681555 - protein, 23 aa, Mycobacterium
ISGVLDPRFDAYVGRTIADIAAD

SEQ ID NO: 681556 - protein, 20 aa, Mycobacterium
ISGYALGGGFEMALMTDISV

SEQ ID NO: 681557 - protein, 18 aa, Mycobacterium
ISGYGLPMALTLFRRDLD

SEQ ID NO: 681558 - protein, 20 aa, Mycobacterium
ISGYGLPMALTLIRPDLDQW

SEQ ID NO: 681559 - protein, 25 aa, Mycobacterium
ISGYRPAALTRYGLDSAALRERFPA

SEQ ID NO: 681560 - protein, 17 aa, Mycobacterium
ISHAFNLRGPSIAVQTA

SEQ ID NO: 681561 - protein, 18 aa, Mycobacterium
ISHCLGLTGPSMCIDSAC

SEQ ID NO: 681562 - protein, 17 aa, Mycobacterium
ISHISYYRLYEAMQNTK

SEQ ID NO: 681563 - protein, 18 aa, Mycobacterium
ISHVVFKPGTVEQIRSVI

SEQ ID NO: 681564 - protein, 21 aa, Mycobacterium
ISHVYPTGASLYFTVVAGQRG

SEQ ID NO: 681565 - protein, 19 aa, Mycobacterium
ISIAHGIRRFEFMIHADET

SEQ ID NO: 681566 - protein, 24 aa, Mycobacterium
ISIDLRDDWPAALRDGGFDVTQPT

SEQ ID NO: 681567 - protein, 26 aa, Mycobacterium
ISIERGGAFGDMWRSDLAAAFGREPD

SEQ ID NO: 681568 - protein, 26 aa, Mycobacterium
ISIIANRVSYFFDLRGPSVTIDTACS

SEQ ID NO: 681569 - protein, 32 aa, Mycobacterium
ISIKDVFLTRNWPTLRGSGLIDPDGPWDVDSP

SEQ ID NO: 681570 - protein, 24 aa, Mycobacterium
ISILEAKGYCYGWHFYQAADADLV

SEQ ID NO: 681571 - protein, 25 aa, Mycobacterium
ISILEAKGYCYGWHFYQAADADLVI

SEQ ID NO: 681572 - protein, 24 aa, Mycobacterium
ISIRKARTSILMNLPTSALMDVAQ

SEQ ID NO: 681573 - protein, 19 aa, Mycobacterium
ISKALTLLRELWARYEHVQ

SEQ ID NO: 681574 - protein, 17 aa, Mycobacterium
ISKAVGLGFSEGAAGSN

SEQ ID NO: 681575 - protein, 18 aa, Mycobacterium
ISKLLWANWHRELGEIAM

SEQ ID NO: 681576 - protein, 17 aa, Mycobacterium
ISKLVLNFFSFHDSDYA

SEQ ID NO: 681577 - protein, 17 aa, Mycobacterium
ISKPVGLGFTKGGGEND

SEQ ID NO: 681578 - protein, 17 aa, Mycobacterium
ISLAPGEAIFLPAGNLH

SEQ ID NO: 681579 - protein, 20 aa, Mycobacterium
ISLAPPRSGLRSYLAVRGGI

SEQ ID NO: 681580 - protein, 21 aa, Mycobacterium
ISLAPRLRVPDTFSLAHHLAV

SEQ ID NO: 681581 - protein, 19 aa, Mycobacterium
ISLARLGMFAPAMSYLEDP

SEQ ID NO: 681582 - protein, 26 aa, Mycobacterium
ISLDEARRIANFEGLQPYSYADRDDP

SEQ ID NO: 681583 - protein, 25 aa, Mycobacterium
ISLDELRSGLKFASTGLLAGAVSGG

SEQ ID NO: 681584 - protein, 23 aa, Mycobacterium
ISLDRNALPLGLAHGATLVRDIA

SEQ ID NO: 681585 - protein, 25 aa, Mycobacterium
ISLEANAFHQQFWRSLSGAAASYSG

SEQ ID NO: 681586 - protein, 22 aa, Mycobacterium
ISLEEYERYGGMHLTGQLPVGG

SEQ ID NO: 681587 - protein, 26 aa, Mycobacterium
ISLEHPCVFTIRVTPAYFFPAADQAR

SEQ ID NO: 681588 - protein, 19 aa, Mycobacterium
ISLGELDSFLTERLARYKH

SEQ ID NO: 681589 - protein, 19 aa, Mycobacterium
ISLGGATVAKGYRNPVEPD

SEQ ID NO: 681590 - protein, 18 aa, Mycobacterium
ISLGGATVATGYRNIPEH

SEQ ID NO: 681591 - protein, 20 aa, Mycobacterium
ISLGGLRPVIVGGPATCADE

SEQ ID NO: 681592 - protein, 19 aa, Mycobacterium
ISLGTALARLGMFAPALSY

SEQ ID NO: 681593 - protein, 17 aa, Mycobacterium
ISLLSWILNPERGLAAA

SEQ ID NO: 681594 - protein, 19 aa, Mycobacterium
ISLNAWLVRAAVAAAEKRT

SEQ ID NO: 681595 - protein, 18 aa, Mycobacterium
ISLPEIKAAAAAAPPPLD

SEQ ID NO: 681596 - protein, 17 aa, Mycobacterium
ISLSPADAEWYFNTVNV

SEQ ID NO: 681597 - protein, 25 aa, Mycobacterium
ISLTVRSGEHWALLGPNGAGKSTLL

SEQ ID NO: 681598 - protein, 17 aa, Mycobacterium
ISMAAVFSGDAAISAGW

SEQ ID NO: 681599 - protein, 24 aa, Mycobacterium
ISMCPRFGQRLRTRPFDLGAPEWV

SEQ ID NO: 681600 - protein, 22 aa, Mycobacterium
ISMLTCHVDLPLWVRLDELPSL

SEQ ID NO: 681601 - protein, 33 aa, Mycobacterium
ISMMHCMTVSLALDGVGLGTVWGSQLATKMLAD

SEQ ID NO: 681602 - protein, 17 aa, Mycobacterium
ISMPRALEKAGLDLDDV

SEQ ID NO: 681603 - protein, 24 aa, Mycobacterium
ISMYPRMWAASGVDYPTLLATMVE

SEQ ID NO: 681604 - protein, 32 aa, Mycobacterium
ISNAPAWQVSRMQAIADLRGWSPLVALQIEYS

SEQ ID NO: 681605 - protein, 19 aa, Mycobacterium
ISNAVLWLASDESRFVTGM

SEQ ID NO: 681606 - protein, 17 aa, Mycobacterium
ISNCARAICSTNGARRA

SEQ ID NO: 681607 - protein, 17 aa, Mycobacterium
ISNCDKITPGMLMAALR

SEQ ID NO: 681608 - protein, 21 aa, Mycobacterium
ISNGGAWLREGPLIRLARAKG

SEQ ID NO: 681609 - protein, 20 aa, Mycobacterium
ISNGRAELVLGRGSFTDSFP

SEQ ID NO: 681610 - protein, 28 aa, Mycobacterium
ISNGRFVFGVGAGWNLEEMRNHGTDPKT

SEQ ID NO: 681611 - protein, 21 aa, Mycobacterium
ISNLTGEEWIGPSSSAMATAV

SEQ ID NO: 681612 - protein, 24 aa, Mycobacterium
ISNPLPVDFLSKFVTQMRDGLGHE

SEQ ID NO: 681613 - protein, 22 aa, Mycobacterium
ISNRIPEDFPYPDAFDPDRYEK

SEQ ID NO: 681614 - protein, 22 aa, Mycobacterium
ISNSLGELWVMQTYLRPDLLEH

SEQ ID NO: 681615 - protein, 24 aa, Mycobacterium
ISPARFPDWTSLAEYRDFAAQVRD

SEQ ID NO: 681616 - protein, 17 aa, Mycobacterium
ISPDELRAWKAEHPGAV

SEQ ID NO: 681617 - protein, 19 aa, Mycobacterium
ISPDGRRLMVTNYGDNSVS

SEQ ID NO: 681618 - protein, 17 aa, Mycobacterium
ISPEALGLADAFLAKEV

SEQ ID NO: 681619 - protein, 27 aa, Mycobacterium
ISPFNFPAMVPMWFFPIAIAAGNTVVV

SEQ ID NO: 681620 - protein, 27 aa, Mycobacterium
ISPFNFPAMVPMWFFPVAIAAGNTVVL

SEQ ID NO: 681621 - protein, 19 aa, Mycobacterium
ISPGMLRIFDRLDDTPAEI

SEQ ID NO: 681622 - protein, 20 aa, Mycobacterium
ISPHTVEWHLRKVFVKLGIT

SEQ ID NO: 681623 - protein, 19 aa, Mycobacterium
ISPKAGNALVFPVSASSAD

SEQ ID NO: 681624 - protein, 24 aa, Mycobacterium
ISPLKEWTCAACDGTGDLLFMEDD

SEQ ID NO: 681625 - protein, 22 aa, Mycobacterium
ISPLRLPTCRFMPTCSQYAVDA

SEQ ID NO: 681626 - protein, 18 aa, Mycobacterium
ISPLTLRQALLGKVLTVG

SEQ ID NO: 681627 - protein, 24 aa, Mycobacterium
ISPQGEVHVGIYLTTAACPKKSEI

SEQ ID NO: 681628 - protein, 18 aa, Mycobacterium
ISPQVRAALGIDTDVTEM

SEQ ID NO: 681629 - protein, 17 aa, Mycobacterium
ISPRKVIKPVAGQFAAA

SEQ ID NO: 681630 - protein, 17 aa, Mycobacterium
ISPRRKGPVVWVKDASR

SEQ ID NO: 681631 - protein, 17 aa, Mycobacterium
ISPRWPALTKPVIGAIN

SEQ ID NO: 681632 - protein, 18 aa, Mycobacterium
ISPRWPAMAKPVIGAING

SEQ ID NO: 681633 - protein, 21 aa, Mycobacterium
ISPSGPRLAGALGTSLLSLSM

SEQ ID NO: 681634 - protein, 24 aa, Mycobacterium
ISPSGPRLAGKLGTSLLSLSMSVP

SEQ ID NO: 681635 - protein, 22 aa, Mycobacterium
ISPSGPRLAGSLGTSLLSLSMS

SEQ ID NO: 681636 - protein, 17 aa, Mycobacterium
ISPWLALQYEDLGWNGA

SEQ ID NO: 681637 - protein, 23 aa, Mycobacterium
ISPYPRSNVFLVFNSVENTPQKP

SEQ ID NO: 681638 - protein, 22 aa, Mycobacterium
ISQFRGSELIAERWDISREEME

SEQ ID NO: 681639 - protein, 18 aa, Mycobacterium
ISQGPLIGRSILAMDGAE

SEQ ID NO: 681640 - protein, 24 aa, Mycobacterium
ISQGRLEALLNFQTMITDLTGLEI

SEQ ID NO: 681641 - protein, 24 aa, Mycobacterium
ISQGRLEALLNFQTMVAELTGLDI

SEQ ID NO: 681642 - protein, 24 aa, Mycobacterium
ISQGRLEALLNFQTMVCDLTGLEV

SEQ ID NO: 681643 - protein, 24 aa, Mycobacterium
ISQGRLEALLNFQTMVTDLTGLEI

SEQ ID NO: 681644 - protein, 24 aa, Mycobacterium
ISQGRLEALLNFQTMVTDLTGLEV

SEQ ID NO: 681645 - protein, 24 aa, Mycobacterium
ISQGRLEALLTFQTMIEDLTGLPL

SEQ ID NO: 681646 - protein, 26 aa, Mycobacterium
ISQLKPGSVLIGFLAPRTQPELASRL

SEQ ID NO: 681647 - protein, 21 aa, Mycobacterium
ISQLRAEGMLARTGDGANADP

SEQ ID NO: 681648 - protein, 24 aa, Mycobacterium
ISQLRSRFGFLAIHGGSLEKMTDV

SEQ ID NO: 681649 - protein, 17 aa, Mycobacterium
ISQQAYRVWNNPLDAMA

SEQ ID NO: 681650 - protein, 20 aa, Mycobacterium
ISRAIGGAGLVFTEATSVNA

SEQ ID NO: 681651 - protein, 23 aa, Mycobacterium
ISRATACRMLMARLAAEHAPSED

SEQ ID NO: 681652 - protein, 25 aa, Mycobacterium
ISRDIPLRLIHAIPRGADVPAGDES

SEQ ID NO: 681653 - protein, 19 aa, Mycobacterium
ISRDWPYAKVRLAAQTVAR

SEQ ID NO: 681654 - protein, 23 aa, Mycobacterium
ISREDSDAFALRSHVRALAAQDA

SEQ ID NO: 681655 - protein, 22 aa, Mycobacterium
ISRGDGVVYWQVPKGGTLDSTI

SEQ ID NO: 681656 - protein, 22 aa, Mycobacterium
ISRGDGVVYWQVPKGSTLNSAI

SEQ ID NO: 681657 - protein, 19 aa, Mycobacterium
ISRGGWATITVRYDRASVR

SEQ ID NO: 681658 - protein, 24 aa, Mycobacterium
ISRGGWCTITARYDRASVRNDELF

SEQ ID NO: 681659 - protein, 27 aa, Mycobacterium
ISRIKARYGLPGTIAPYNGHWDVTQST

SEQ ID NO: 681660 - protein, 24 aa, Mycobacterium
ISRKRNLVEYGFRLPSACDNRPLT

SEQ ID NO: 681661 - protein, 22 aa, Mycobacterium
ISRLMPPGWSMHKLRHRFATLG

SEQ ID NO: 681662 - protein, 23 aa, Mycobacterium
ISRLRSGQFYLALEGNAFHKIQT

SEQ ID NO: 681663 - protein, 24 aa, Mycobacterium
ISRQLPLRLVYVIPSQQTGSVHAP

SEQ ID NO: 681664 - protein, 17 aa, Mycobacterium
ISRRSDVFSSLQKTALP

SEQ ID NO: 681665 - protein, 17 aa, Mycobacterium
ISRRTLFRYYASKNAIP

SEQ ID NO: 681666 - protein, 18 aa, Mycobacterium
ISRRTLFRYYASKSAIPW

SEQ ID NO: 681667 - protein, 20 aa, Mycobacterium
ISRRVEEALAMAHRDPSHPG

SEQ ID NO: 681668 - protein, 19 aa, Mycobacterium
ISRTLCATGGGLLIAADGT

SEQ ID NO: 681669 - protein, 20 aa, Mycobacterium
ISRTLTLRPGDLLATGTPSG

SEQ ID NO: 681670 - protein, 23 aa, Mycobacterium
ISRTPEFLRWFLDEIPIEPVWVC

SEQ ID NO: 681671 - protein, 29 aa, Mycobacterium
ISRVVEWRLDLPLTMFPRTPHDVWQELAS

SEQ ID NO: 681672 - protein, 20 aa, Mycobacterium
ISRVVIDLLGPVPVTDELWV

SEQ ID NO: 681673 - protein, 23 aa, Mycobacterium
ISRWPELREAFAKAFAAHDRAHW

SEQ ID NO: 681674 - protein, 19 aa, Mycobacterium
ISSAMEVGKQFGFSSPTAE

SEQ ID NO: 681675 - protein, 17 aa, Mycobacterium
ISSAMTVAEQFGFTSPT

SEQ ID NO: 681676 - protein, 17 aa, Mycobacterium
ISSEVPTEFEAATQEAI

SEQ ID NO: 681677 - protein, 17 aa, Mycobacterium
ISSGAAVWAARELAHRP

SEQ ID NO: 681678 - protein, 26 aa, Mycobacterium
ISSGEARPALMLSWIRDVPSLGAVAR

SEQ ID NO: 681679 - protein, 22 aa, Mycobacterium
ISSGFPINLLSYLAQNTSAQAL

SEQ ID NO: 681680 - protein, 25 aa, Mycobacterium
ISSGPYRFVYRKRFHKKCETQLTVL

SEQ ID NO: 681681 - protein, 25 aa, Mycobacterium
ISSIPGGPFLSFGQVYAYVQNAQGL

SEQ ID NO: 681682 - protein, 20 aa, Mycobacterium
ISSIPIKVQLQQTICFLGYC

SEQ ID NO: 681683 - protein, 25 aa, Mycobacterium
ISSIPPVPGKFYWMTPTQVRWRPFQ

SEQ ID NO: 681684 - protein, 17 aa, Mycobacterium
ISSIPYWADMATNFEYE

SEQ ID NO: 681685 - protein, 24 aa, Mycobacterium
ISSISARAPGLFTGNVTGRVRATD

SEQ ID NO: 681686 - protein, 17 aa, Mycobacterium
ISSLAAIVDQVRKLHGL

SEQ ID NO: 681687 - protein, 26 aa, Mycobacterium
ISSLCYRILAEPGLRDRLLADPSLRH

SEQ ID NO: 681688 - protein, 18 aa, Mycobacterium
ISSLDCRSGQLGTVSATG

SEQ ID NO: 681689 - protein, 25 aa, Mycobacterium
ISSLHKWAELCWLQGGENYLRNGCV

SEQ ID NO: 681690 - protein, 18 aa, Mycobacterium
ISSLPAEPVRLADSALVL

SEQ ID NO: 681691 - protein, 24 aa, Mycobacterium
ISSLPDLLPLLELVAKEGKPLLIV

SEQ ID NO: 681692 - protein, 17 aa, Mycobacterium
ISSLRDVYSAALDYQVD

SEQ ID NO: 681693 - protein, 26 aa, Mycobacterium
ISSLRLVACGGSAVPVSLMRAFEDKY

SEQ ID NO: 681694 - protein, 36 aa, Mycobacterium
ISSPGWAKHAWSCFFAPWIAEATIFVYNYRRFDAPA

SEQ ID NO: 681695 - protein, 22 aa, Mycobacterium
ISSPRRRSLVTAELAGLSVDDA

SEQ ID NO: 681696 - protein, 30 aa, Mycobacterium
ISSQAGCGMACPFCATGQGGLQRNLTTAEI

SEQ ID NO: 681697 - protein, 23 aa, Mycobacterium
ISSREYMSSGIFVGSLRGPEEAH

SEQ ID NO: 681698 - protein, 32 aa, Mycobacterium
ISSSLKNAIDWLSRPFGSSVFKGKPTVVIGTS

SEQ ID NO: 681699 - protein, 20 aa, Mycobacterium
ISSTESRLSIDLITFDRPDV

SEQ ID NO: 681700 - protein, 19 aa, Mycobacterium
ISSYVRWPETVRPLVRPLA

SEQ ID NO: 681701 - protein, 25 aa, Mycobacterium
ISTAFLYDHFTPFVFTQLEELGFCG

SEQ ID NO: 681702 - protein, 17 aa, Mycobacterium
ISTDFCFDAADFANELR

SEQ ID NO: 681703 - protein, 18 aa, Mycobacterium
ISTDGGGTEQVWTTASTV

SEQ ID NO: 681704 - protein, 23 aa, Mycobacterium
ISTDPRTGLPLVNVGKVVTSEDV

SEQ ID NO: 681705 - protein, 17 aa, Mycobacterium
ISTELLLRDEFRPATTL

SEQ ID NO: 681706 - protein, 25 aa, Mycobacterium
ISTGPYRFLYRKRFHKRAETQLTIL

SEQ ID NO: 681707 - protein, 21 aa, Mycobacterium
ISTGVAFAFAPGVTVEGMLFD

SEQ ID NO: 681708 - protein, 21 aa, Mycobacterium
ISTLLGAVGMRVTVLGRAESA

SEQ ID NO: 681709 - protein, 20 aa, Mycobacterium
ISTLPLGWAEQWSADAEAAA

SEQ ID NO: 681710 - protein, 18 aa, Mycobacterium
ISTLPMAVPVNLRAEADN

SEQ ID NO: 681711 - protein, 18 aa, Mycobacterium
ISTLPMAVPVNLRAEADT

SEQ ID NO: 681712 - protein, 20 aa, Mycobacterium
ISTLPMAVPVNLRAEGAAAG

SEQ ID NO: 681713 - protein, 24 aa, Mycobacterium
ISTPHPLQWDCFFFGIVQSDGHFT

SEQ ID NO: 681714 - protein, 25 aa, Mycobacterium
ISTPRWTELKSRVRDYLGTKIEFRL

SEQ ID NO: 681715 - protein, 26 aa, Mycobacterium
ISTQLSVFHEQFVQTLTNGVGAYSAA

SEQ ID NO: 681716 - protein, 17 aa, Mycobacterium
ISTTYGPGDWAPTPHGS

SEQ ID NO: 681717 - protein, 19 aa, Mycobacterium
ISTVRCFEDNALLKSVLSQ

SEQ ID NO: 681718 - protein, 19 aa, Mycobacterium
ISTVRCFQDNALLKSVLSE

SEQ ID NO: 681719 - protein, 19 aa, Mycobacterium
ISVAARILAEFGDHLTEEQ

SEQ ID NO: 681720 - protein, 20 aa, Mycobacterium
ISVAARILAEFSDRLTDEQK

SEQ ID NO: 681721 - protein, 19 aa, Mycobacterium
ISVAFADLVGFTRIGEAVT

SEQ ID NO: 681722 - protein, 17 aa, Mycobacterium
ISVALGVNLDARDDMAI

SEQ ID NO: 681723 - protein, 19 aa, Mycobacterium
ISVAMPMFHGLGLGMLMLT

SEQ ID NO: 681724 - protein, 20 aa, Mycobacterium
ISVARFVIEKMDVHPAAELS

SEQ ID NO: 681725 - protein, 17 aa, Mycobacterium
ISVCANGSVLYDAENDR

SEQ ID NO: 681726 - protein, 26 aa, Mycobacterium
ISVDLRPAPSWYGFAATLLVGKERDN

SEQ ID NO: 681727 - protein, 20 aa, Mycobacterium
ISVDSARYWLNNDRPIDKDS

SEQ ID NO: 681728 - protein, 19 aa, Mycobacterium
ISVFPSERALARYLADEHD

SEQ ID NO: 681729 - protein, 20 aa, Mycobacterium
ISVFPSERALARYLADEHDH

SEQ ID NO: 681730 - protein, 19 aa, Mycobacterium
ISVGLLANATHRGVALTKI

SEQ ID NO: 681731 - protein, 19 aa, Mycobacterium
ISVGLLANATHRGVTLTKI

SEQ ID NO: 681732 - protein, 33 aa, Mycobacterium
ISVGSGRIFGAWVDLRSGPTFGTVFTAEIDPSR

SEQ ID NO: 681733 - protein, 18 aa, Mycobacterium
ISVILARLLFLMFGDDTE

SEQ ID NO: 681734 - protein, 19 aa, Mycobacterium
ISVKIPAGVGDGMRVRLAA

SEQ ID NO: 681735 - protein, 25 aa, Mycobacterium
ISVLTSRYALAVAREKGHAIDNPVA

SEQ ID NO: 681736 - protein, 24 aa, Mycobacterium
ISVRGNWPLVPTMDVVVPHTRSMA

SEQ ID NO: 681737 - protein, 29 aa, Mycobacterium
ISVRIRFSFSSLPRVLDWREYGKYPRFEI

SEQ ID NO: 681738 - protein, 24 aa, Mycobacterium
ISVRRPLARLGMGLHRRPRQPQGD

SEQ ID NO: 681739 - protein, 21 aa, Mycobacterium
ISWGDVALLLSVPRQGLGNAA

SEQ ID NO: 681740 - protein, 26 aa, Mycobacterium
ISWIGWGVAGITEFYVQVYRLDLASG

SEQ ID NO: 681741 - protein, 25 aa, Mycobacterium
ISWRELPGRIGAVAAELRRLGVGRG

SEQ ID NO: 681742 - protein, 18 aa, Mycobacterium
ISYADAMRRFGSDKPDLR

SEQ ID NO: 681743 - protein, 18 aa, Mycobacterium
ISYADAMRRFGSDKPDMR

SEQ ID NO: 681744 - protein, 32 aa, Mycobacterium
ISYARKRGLPVLGLCLGLQCIVIEAARSVGIT

SEQ ID NO: 681745 - protein, 19 aa, Mycobacterium
ISYDRLRQTPLQWPCPPDS

SEQ ID NO: 681746 - protein, 17 aa, Mycobacterium
ISYLDGYTGLLTGGIDH

SEQ ID NO: 681747 - protein, 25 aa, Mycobacterium
ISYLLWRFYFERGVGGSVVIPGARR

SEQ ID NO: 681748 - protein, 18 aa, Mycobacterium
ITAAGLRESHPHDVAMTV

SEQ ID NO: 681749 - protein, 24 aa, Mycobacterium
ITAAILRGVMRVFDDFRYTREIID

SEQ ID NO: 681750 - protein, 27 aa, Mycobacterium
ITAAMHARCPLAWTDTYGGHWVAAGNR

SEQ ID NO: 681751 - protein, 25 aa, Mycobacterium
ITAAMRCVAEAGPAQASIREIAKAA

SEQ ID NO: 681752 - protein, 24 aa, Mycobacterium
ITAARAAWSLVHGFVSLWTTGALA

SEQ ID NO: 681753 - protein, 18 aa, Mycobacterium
ITAARARQSTRINAQAAD

SEQ ID NO: 681754 - protein, 23 aa, Mycobacterium
ITADELRARFGFYFDRFDVRAEA

SEQ ID NO: 681755 - protein, 19 aa, Mycobacterium
ITAELLPRMDAEAAALGRS

SEQ ID NO: 681756 - protein, 26 aa, Mycobacterium
ITAFSRPSFWWIRLGNPLAKQLQRIV

SEQ ID NO: 681757 - protein, 29 aa, Mycobacterium
ITAGHEFYRAHGCDVLIALGGGSVIDAAK

SEQ ID NO: 681758 - protein, 23 aa, Mycobacterium
ITAGRISYLLGLRGPAAAIDTAC

SEQ ID NO: 681759 - protein, 18 aa, Mycobacterium
ITAGWVLDLLGLPAECGV

SEQ ID NO: 681760 - protein, 21 aa, Mycobacterium
ITAHEALAWGIVNEVVDADEL

SEQ ID NO: 681761 - protein, 17 aa, Mycobacterium
ITAIGGGTVTSSATNGG

SEQ ID NO: 681762 - protein, 19 aa, Mycobacterium
ITAINVFRTAMVGFGQLTD

SEQ ID NO: 681763 - protein, 18 aa, Mycobacterium
ITAKGAWEAVKRHFREMG

SEQ ID NO: 681764 - protein, 25 aa, Mycobacterium
ITALGCAIARCAVEHRAALQMSFYE

SEQ ID NO: 681765 - protein, 19 aa, Mycobacterium
ITALLRLGYYGAGGLGQSP

SEQ ID NO: 681766 - protein, 25 aa, Mycobacterium
ITALWTDRLLDRIDIEPPGGPTAPA

SEQ ID NO: 681767 - protein, 19 aa, Mycobacterium
ITAMVSAWCGRELPEQLRG

SEQ ID NO: 681768 - protein, 45 aa, Mycobacterium
ITANLDGKIKYKIPGVGKVNVKLYWDLKISPITFSDITISGPTLT

SEQ ID NO: 681769 - protein, 25 aa, Mycobacterium
ITANLLFIRFEFRTGDASGHNMATL

SEQ ID NO: 681770 - protein, 29 aa, Mycobacterium
ITAPAGFRAAGIAAGIKASGARDLALVFN

SEQ ID NO: 681771 - protein, 18 aa, Mycobacterium
ITAPVLLEVYLERIERLD

SEQ ID NO: 681772 - protein, 24 aa, Mycobacterium
ITAQAERAMAFWPNKGEADPRPAL

SEQ ID NO: 681773 - protein, 23 aa, Mycobacterium
ITARELVRVGGHVILAVRNTDKG

SEQ ID NO: 681774 - protein, 19 aa, Mycobacterium
ITARHVIVGIGGLEVPNLP

SEQ ID NO: 681775 - protein, 18 aa, Mycobacterium
ITARILAAIAEQAELVGM

SEQ ID NO: 681776 - protein, 17 aa, Mycobacterium
ITASLGMSEPSAGSDLA

SEQ ID NO: 681777 - protein, 21 aa, Mycobacterium
ITASQGCHVWDGDGNKLLDFS

SEQ ID NO: 681778 - protein, 22 aa, Mycobacterium
ITASRGAPIWNQFNDLHRDRRT

SEQ ID NO: 681779 - protein, 17 aa, Mycobacterium
ITATMLVPSMIYALMDH

SEQ ID NO: 681780 - protein, 27 aa, Mycobacterium
ITATPLRPGSWRAYADHRMAMAGAIVG

SEQ ID NO: 681781 - protein, 20 aa, Mycobacterium
ITATVPLEILGVDIPINLTL

SEQ ID NO: 681782 - protein, 19 aa, Mycobacterium
ITATWNRRHRPAYVGEFHD

SEQ ID NO: 681783 - protein, 20 aa, Mycobacterium
ITAVGVLRAYASITPHYPFS

SEQ ID NO: 681784 - protein, 19 aa, Mycobacterium
ITAVIQWSDMLPALYDGPL

SEQ ID NO: 681785 - protein, 19 aa, Mycobacterium
ITAVPGIGVATARAVQEAL

SEQ ID NO: 681786 - protein, 18 aa, Mycobacterium
ITAYLKPVHDVGGEPDAP

SEQ ID NO: 681787 - protein, 17 aa, Mycobacterium
ITCKTLFTLTATTAEQT

SEQ ID NO: 681788 - protein, 26 aa, Mycobacterium
ITDADWRKDLDINFLAAVRLNAALLP

SEQ ID NO: 681789 - protein, 18 aa, Mycobacterium
ITDARAFCETRYEQDPND

SEQ ID NO: 681790 - protein, 23 aa, Mycobacterium
ITDDIRAAIAVRHGVTVRDVLLT

SEQ ID NO: 681791 - protein, 17 aa, Mycobacterium
ITDDLFISKHPSSQQRA

SEQ ID NO: 681792 - protein, 23 aa, Mycobacterium
ITDEIKGRIMAMAQPDAQGNRPD

SEQ ID NO: 681793 - protein, 24 aa, Mycobacterium
ITDEIKSRILAMAEPDAAGVRPDV

SEQ ID NO: 681794 - protein, 23 aa, Mycobacterium
ITDEIKSRILAMAEPNENGQRPD

SEQ ID NO: 681795 - protein, 23 aa, Mycobacterium
ITDEIKSRIMAMAEPDAQGNRPD

SEQ ID NO: 681796 - protein, 24 aa, Mycobacterium
ITDGEAMDAFLLLSRAEGIIPAIE

SEQ ID NO: 681797 - protein, 22 aa, Mycobacterium
ITDGRWSCVQWGTLKPPFYPDL

SEQ ID NO: 681798 - protein, 26 aa, Mycobacterium
ITDGVPRSGAPFGFAVTTEPHDWAWN

SEQ ID NO: 681799 - protein, 24 aa, Mycobacterium
ITDLFPLRGAIIGANRVAELTEND

SEQ ID NO: 681800 - protein, 24 aa, Mycobacterium
ITDLFPLRGAIVGANRVAELTEND

SEQ ID NO: 681801 - protein, 23 aa, Mycobacterium
ITDLPEGRWEEFTAEPRIAERVA

SEQ ID NO: 681802 - protein, 19 aa, Mycobacterium
ITDLRAWLTTVVSRLGLDR

SEQ ID NO: 681803 - protein, 18 aa, Mycobacterium
ITDPAWPGLVAAVTAADW

SEQ ID NO: 681804 - protein, 17 aa, Mycobacterium
ITDRGRLTQALADAAQY

SEQ ID NO: 681805 - protein, 17 aa, Mycobacterium
ITDRILLLDGLPNYQRI

SEQ ID NO: 681806 - protein, 23 aa, Mycobacterium
ITDRKQLLVVLGRDDLASVKSVR

SEQ ID NO: 681807 - protein, 18 aa, Mycobacterium
ITDRLDAVLRPLTARHDV

SEQ ID NO: 681808 - protein, 25 aa, Mycobacterium
ITDRLKDMYICGGFNVYPAEIEQVL

SEQ ID NO: 681809 - protein, 29 aa, Mycobacterium
ITDRVRPGNCFAPFHWNDAFGEYLSINAV

SEQ ID NO: 681810 - protein, 21 aa, Mycobacterium
ITDTGSWKPPQPASFPHRGRG

SEQ ID NO: 681811 - protein, 23 aa, Mycobacterium
ITDTRWRLVAKELILALLAPNHN

SEQ ID NO: 681812 - protein, 26 aa, Mycobacterium
ITDVPRYTHTFVYEHPEFTFTDVHVG

SEQ ID NO: 681813 - protein, 19 aa, Mycobacterium
ITDWVGPVIRRYFRAEVRG

SEQ ID NO: 681814 - protein, 27 aa, Mycobacterium
ITEAIDWYARRDLPALISAPDRLFRIP

SEQ ID NO: 681815 - protein, 18 aa, Mycobacterium
ITEALPGVPVVIYDNPAA

SEQ ID NO: 681816 - protein, 24 aa, Mycobacterium
ITEARQVFELGIIPLVCERATEAD

SEQ ID NO: 681817 - protein, 25 aa, Mycobacterium
ITEELRAYAAPSFVAGRPLIEVLRD

SEQ ID NO: 681818 - protein, 17 aa, Mycobacterium
ITEGLAIAERVLDHPEC

SEQ ID NO: 681819 - protein, 19 aa, Mycobacterium
ITEGLRLELDPSIRVTTIS

SEQ ID NO: 681820 - protein, 19 aa, Mycobacterium
ITEICAGATSLYHCALPPM

SEQ ID NO: 681821 - protein, 17 aa, Mycobacterium
ITELGRRLARLPVDPRL

SEQ ID NO: 681822 - protein, 26 aa, Mycobacterium
ITELRYRQMRNFWATLMVSQGTPMIA

SEQ ID NO: 681823 - protein, 18 aa, Mycobacterium
ITEPEAWGPTRNPWNLTH

SEQ ID NO: 681824 - protein, 19 aa, Mycobacterium
ITEPPPMGFGISARSVTVS

SEQ ID NO: 681825 - protein, 17 aa, Mycobacterium
ITEQIARVNTGLGAVEF

SEQ ID NO: 681826 - protein, 25 aa, Mycobacterium
ITERHLKKLWGLPGTQLGVVAWPPA

SEQ ID NO: 681827 - protein, 21 aa, Mycobacterium
ITEYNVRFTAVVPVPNDGKGA

SEQ ID NO: 681828 - protein, 25 aa, Mycobacterium
ITFAEPGAMIGFLGPRVYQALYDAP

SEQ ID NO: 681829 - protein, 22 aa, Mycobacterium
ITFDPDVSWRLHHQVAVRPEPF

SEQ ID NO: 681830 - protein, 17 aa, Mycobacterium
ITFSMIYAFSENFVLPI

SEQ ID NO: 681831 - protein, 25 aa, Mycobacterium
ITFSVRHLGVSKVRGSFTDFSGEIT

SEQ ID NO: 681832 - protein, 17 aa, Mycobacterium
ITFTGGPNFAYDLCADA

SEQ ID NO: 681833 - protein, 26 aa, Mycobacterium
ITGADALASIMSWQGWEQMFESARFV

SEQ ID NO: 681834 - protein, 24 aa, Mycobacterium
ITGDLRAGGHYSLQGNASGTVLSC

SEQ ID NO: 681835 - protein, 20 aa, Mycobacterium
ITGDVWPRKEIRDQRLVECV

SEQ ID NO: 681836 - protein, 23 aa, Mycobacterium
ITGEGLIAVLERLAASRGTYPDV

SEQ ID NO: 681837 - protein, 17 aa, Mycobacterium
ITGELGGTVTGGLAGIN

SEQ ID NO: 681838 - protein, 18 aa, Mycobacterium
ITGERRPGVTATDVVLTV

SEQ ID NO: 681839 - protein, 17 aa, Mycobacterium
ITGFLRMGQRLGAILDT

SEQ ID NO: 681840 - protein, 17 aa, Mycobacterium
ITGGHEWDADAVATVNA

SEQ ID NO: 681841 - protein, 19 aa, Mycobacterium
ITGGPALPIAGMAGAGLGG

SEQ ID NO: 681842 - protein, 17 aa, Mycobacterium
ITGHKIWTSSAHRADYG

SEQ ID NO: 681843 - protein, 18 aa, Mycobacterium
ITGHPAISVPAGLVDGLP

SEQ ID NO: 681844 - protein, 17 aa, Mycobacterium
ITGIITMPWMFYTGPDA

SEQ ID NO: 681845 - protein, 38 aa, Mycobacterium
ITGLEGYPFDKMVSRWCYRSEVKANWKLYMDAFQEFYH

SEQ ID NO: 681846 - protein, 18 aa, Mycobacterium
ITGLPAFKAPFEPLTPGG

SEQ ID NO: 681847 - protein, 20 aa, Mycobacterium
ITGLPGVLSRRIDPRHNTVM

SEQ ID NO: 681848 - protein, 20 aa, Mycobacterium
ITGLPGVLSRRIDPRNGTVL

SEQ ID NO: 681849 - protein, 22 aa, Mycobacterium
ITGLYPLGPIFPGSGLNITVMS

SEQ ID NO: 681850 - protein, 18 aa, Mycobacterium
ITGNCGQSTFPVRDQEEA

SEQ ID NO: 681851 - protein, 24 aa, Mycobacterium
ITGPDFPTSGLIVGTQGIHDAYTT

SEQ ID NO: 681852 - protein, 23 aa, Mycobacterium
ITGPHRYPGWPLRITPGPTGHHR

SEQ ID NO: 681853 - protein, 26 aa, Mycobacterium
ITGRHFKRLWGLPGTQLGVVSWPSER

SEQ ID NO: 681854 - protein, 18 aa, Mycobacterium
ITGRIKDLLVVDGSNHYP

SEQ ID NO: 681855 - protein, 18 aa, Mycobacterium
ITGRIRPSMLEFMDSTAI

SEQ ID NO: 681856 - protein, 25 aa, Mycobacterium
ITGRLKELIIRGGENIAPAEIEACL

SEQ ID NO: 681857 - protein, 19 aa, Mycobacterium
ITGRNGVDLHEMWGSRPYA

SEQ ID NO: 681858 - protein, 25 aa, Mycobacterium
ITGRPAISLPLHWTADGLPLGVQFV

SEQ ID NO: 681859 - protein, 17 aa, Mycobacterium
ITGRPAYQVLAGLVDSD

SEQ ID NO: 681860 - protein, 19 aa, Mycobacterium
ITGRPGRTFRQWAGERLDA

SEQ ID NO: 681861 - protein, 18 aa, Mycobacterium
ITGSPGYQPTEEWIRADA

SEQ ID NO: 681862 - protein, 25 aa, Mycobacterium
ITGSRPVNRAAFCIHSEVHKARPDV

SEQ ID NO: 681863 - protein, 23 aa, Mycobacterium
ITGTGRRGKYLWLTLGDGSAVVV

SEQ ID NO: 681864 - protein, 17 aa, Mycobacterium
ITGTLAPLVPEISPGGV

SEQ ID NO: 681865 - protein, 23 aa, Mycobacterium
ITGWAAYIAGVVWALRDRGHRVE

SEQ ID NO: 681866 - protein, 17 aa, Mycobacterium
ITGWVAALGATAGDRQV

SEQ ID NO: 681867 - protein, 18 aa, Mycobacterium
ITGYPGWSHYGASKAAQL

SEQ ID NO: 681868 - protein, 18 aa, Mycobacterium
ITHDGFWASFAREAGIEG

SEQ ID NO: 681869 - protein, 19 aa, Mycobacterium
ITHHYWKDNGQGVGSLFSW

SEQ ID NO: 681870 - protein, 23 aa, Mycobacterium
ITHPEWTRRTLTCGVALQCSPSK

SEQ ID NO: 681871 - protein, 19 aa, Mycobacterium
ITHPSSIIWAAQMGTVTLH

SEQ ID NO: 681872 - protein, 20 aa, Mycobacterium
ITHYSCLELLAQRPGLSNSE

SEQ ID NO: 681873 - protein, 19 aa, Mycobacterium
ITHYVGWPLGQRVNKHVEM

SEQ ID NO: 681874 - protein, 26 aa, Mycobacterium
ITIEGRPTVNMSVGFLPPQDMIENAK

SEQ ID NO: 681875 - protein, 25 aa, Mycobacterium
ITIGRLGTREWLTLRSMGVTTTEAL

SEQ ID NO: 681876 - protein, 23 aa, Mycobacterium
ITIIDIPAAPGFGNSTTSPSSGF

SEQ ID NO: 681877 - protein, 17 aa, Mycobacterium
ITILAERVADTFVAMGW

SEQ ID NO: 681878 - protein, 18 aa, Mycobacterium
ITIPAGVFRCFKNVGDEE

SEQ ID NO: 681879 - protein, 21 aa, Mycobacterium
ITIPQFRTLVILSNRGPVNLA

SEQ ID NO: 681880 - protein, 22 aa, Mycobacterium
ITIPQFRTLVILSNRGPVNLAT

SEQ ID NO: 681881 - protein, 23 aa, Mycobacterium
ITIRGTVFGSLYLTHVDPGRKFS

SEQ ID NO: 681882 - protein, 17 aa, Mycobacterium
ITITSAATTCFWKDNQI

SEQ ID NO: 681883 - protein, 22 aa, Mycobacterium
ITKDHIEAIAKWDPSADPSVEI

SEQ ID NO: 681884 - protein, 20 aa, Mycobacterium
ITKRAGVSVGALFRHFDTMG

SEQ ID NO: 681885 - protein, 17 aa, Mycobacterium
ITKRAGVSVGALFRHFE

SEQ ID NO: 681886 - protein, 26 aa, Mycobacterium
ITKTSEVSTVWTWPDKPGVAGCAAMD

SEQ ID NO: 681887 - protein, 20 aa, Mycobacterium
ITLARMMKRRQFGHTLYEHQ

SEQ ID NO: 681888 - protein, 19 aa, Mycobacterium
ITLARMMTRRQFGHTLFEH

SEQ ID NO: 681889 - protein, 25 aa, Mycobacterium
ITLAVDHFRYFAGAIRAQEGSLSQI

SEQ ID NO: 681890 - protein, 23 aa, Mycobacterium
ITLEAAVGLGAMPIYRFGTEEQK

SEQ ID NO: 681891 - protein, 22 aa, Mycobacterium
ITLEAAVSLGAMPVYRYGSEEQ

SEQ ID NO: 681892 - protein, 23 aa, Mycobacterium
ITLEAGVGLGAMPIYRFGNEEQK

SEQ ID NO: 681893 - protein, 23 aa, Mycobacterium
ITLEAGVSLGAMPIYRFGSEEQK

SEQ ID NO: 681894 - protein, 23 aa, Mycobacterium
ITLEAGVSLGAMPVYRFGNDAQK

SEQ ID NO: 681895 - protein, 23 aa, Mycobacterium
ITLEAGVSLGAMPVYRFGNESQK

SEQ ID NO: 681896 - protein, 25 aa, Mycobacterium
ITLEPHLFEFGSLIQALNSERVDVV

SEQ ID NO: 681897 - protein, 18 aa, Mycobacterium
ITLGEHRIDIGAEAFITR

SEQ ID NO: 681898 - protein, 23 aa, Mycobacterium
ITLGNLRARFNIALDIGSSGFSG

SEQ ID NO: 681899 - protein, 27 aa, Mycobacterium
ITLGNLRARFNLALGIGSAGFSGDRVC

SEQ ID NO: 681900 - protein, 19 aa, Mycobacterium
ITLGTALARLGMFAPALSY

SEQ ID NO: 681901 - protein, 17 aa, Mycobacterium
ITLGTGIHVCLGQVLAR

SEQ ID NO: 681902 - protein, 22 aa, Mycobacterium
ITLIRKEGWRDFVVAAPRRQPE

SEQ ID NO: 681903 - protein, 20 aa, Mycobacterium
ITLLDTCYLTGGVGQELQGP

SEQ ID NO: 681904 - protein, 21 aa, Mycobacterium
ITLLSWEWGISLAYIARSLTG

SEQ ID NO: 681905 - protein, 24 aa, Mycobacterium
ITLPEAVAIVIARATVLDRLTGPY

SEQ ID NO: 681906 - protein, 33 aa, Mycobacterium
ITLPNGRYSWRISLPAMVCYWSELARDAALPPP

SEQ ID NO: 681907 - protein, 17 aa, Mycobacterium
ITLPPGAFRELAQIRNI

SEQ ID NO: 681908 - protein, 33 aa, Mycobacterium
ITLRAELIAAPVLDADLLRRGKHNGLSDRQIAA

SEQ ID NO: 681909 - protein, 19 aa, Mycobacterium
ITLRFGSKVPGSAMEVRDV

SEQ ID NO: 681910 - protein, 17 aa, Mycobacterium
ITLRGQRLLQSCPVCLY

SEQ ID NO: 681911 - protein, 26 aa, Mycobacterium
ITLRGRWARDGLRSNLGIGVHGFPNF

SEQ ID NO: 681912 - protein, 17 aa, Mycobacterium
ITLRRLTTIVGDATAQW

SEQ ID NO: 681913 - protein, 17 aa, Mycobacterium
ITLRRTREGTGDADGDW

SEQ ID NO: 681914 - protein, 21 aa, Mycobacterium
ITLRSRCRHVALVTPSVAAIA

SEQ ID NO: 681915 - protein, 17 aa, Mycobacterium
ITLWRDYFDLFDFLVKA

SEQ ID NO: 681916 - protein, 17 aa, Mycobacterium
ITLWRDYFDMFDMFKAT

SEQ ID NO: 681917 - protein, 24 aa, Mycobacterium
ITMCKGRFLAADGRSKSFDAAADG

SEQ ID NO: 681918 - protein, 17 aa, Mycobacterium
ITMDWLRQNGYQDLLGR

SEQ ID NO: 681919 - protein, 34 aa, Mycobacterium
ITMGCGDTCPYFPGVTYRDWKLPDPAGQPLDTVR

SEQ ID NO: 681920 - protein, 24 aa, Mycobacterium
ITMPGIPLNIGVNVDLAIPVTGFI

SEQ ID NO: 681921 - protein, 17 aa, Mycobacterium
ITMPTYDATLFVDQLLQ

SEQ ID NO: 681922 - protein, 18 aa, Mycobacterium
ITMPWPRVSGNTITTDNG

SEQ ID NO: 681923 - protein, 19 aa, Mycobacterium
ITMSLELGDRVGLVGHNGA

SEQ ID NO: 681924 - protein, 20 aa, Mycobacterium
ITMSLELGDRVGLVGHNGAG

SEQ ID NO: 681925 - protein, 19 aa, Mycobacterium
ITMSLEMGDRVGLVGHNGA

SEQ ID NO: 681926 - protein, 18 aa, Mycobacterium
ITNAGGLVQQAGAVEEAT

SEQ ID NO: 681927 - protein, 25 aa, Mycobacterium
ITNCGSSWPMSRLTLALSPATLRKV

SEQ ID NO: 681928 - protein, 23 aa, Mycobacterium
ITNEAKSDIRAMYNGIYTPTAPA

SEQ ID NO: 681929 - protein, 23 aa, Mycobacterium
ITNELPELVAVLTPLLGGISAIN

SEQ ID NO: 681930 - protein, 18 aa, Mycobacterium
ITNFYAMRNPEKLTGVMV

SEQ ID NO: 681931 - protein, 24 aa, Mycobacterium
ITNFYVMRNPRKLAALATARDISR

SEQ ID NO: 681932 - protein, 25 aa, Mycobacterium
ITNGRIPRLYGRQASEFVIRRAMSQ

SEQ ID NO: 681933 - protein, 34 aa, Mycobacterium
ITNLKGSPVVWDFRKRLVAGFYAMRQKLAERSAA

SEQ ID NO: 681934 - protein, 25 aa, Mycobacterium
ITNPGLRRYWPWTAVGRRMAETDAL

SEQ ID NO: 681935 - protein, 30 aa, Mycobacterium
ITNPLVFPYDWRLSNRYTARQLKVFVERAL

SEQ ID NO: 681936 - protein, 23 aa, Mycobacterium
ITNPRLTLLGALPTLYDSRTTHS

SEQ ID NO: 681937 - protein, 30 aa, Mycobacterium
ITNTGTAPVTDWQLQFDLPSNESITNLWNG

SEQ ID NO: 681938 - protein, 21 aa, Mycobacterium
ITPEALRRAWIDIPEVVSAAT

SEQ ID NO: 681939 - protein, 17 aa, Mycobacterium
ITPEGSWVLTEGRPETL

SEQ ID NO: 681940 - protein, 17 aa, Mycobacterium
ITPELIRALGAVRRYHD

SEQ ID NO: 681941 - protein, 19 aa, Mycobacterium
ITPFLRFATLASHAGLALA

SEQ ID NO: 681942 - protein, 20 aa, Mycobacterium
ITPFNFPAMIPLWKAGPALA

SEQ ID NO: 681943 - protein, 34 aa, Mycobacterium
ITPFNFPIAIPAWKIAPALAYGNAVVWKPASTVP

SEQ ID NO: 681944 - protein, 32 aa, Mycobacterium
ITPFNFPIAIPAWKIAPALVYGNAVLWKPAST

SEQ ID NO: 681945 - protein, 17 aa, Mycobacterium
ITPILAMMESLRAAGEE

SEQ ID NO: 681946 - protein, 19 aa, Mycobacterium
ITPISEVERALILSVVGGV

SEQ ID NO: 681947 - protein, 17 aa, Mycobacterium
ITPLALWNARAAGHDAE

SEQ ID NO: 681948 - protein, 24 aa, Mycobacterium
ITPLPRSNVFLVFNSVDNALEEPF

SEQ ID NO: 681949 - protein, 19 aa, Mycobacterium
ITPLYAGFVDRYGDQIAPE

SEQ ID NO: 681950 - protein, 18 aa, Mycobacterium
ITPMPGYVEVQFTVDKNV

SEQ ID NO: 681951 - protein, 17 aa, Mycobacterium
ITPRAEEALAYCDKFSL

SEQ ID NO: 681952 - protein, 18 aa, Mycobacterium
ITPRIEFHGARRVVSFMA

SEQ ID NO: 681953 - protein, 17 aa, Mycobacterium
ITPRQLWLRAVAAGGQG

SEQ ID NO: 681954 - protein, 20 aa, Mycobacterium
ITPSRIRRYAAVGGDHNPIH

SEQ ID NO: 681955 - protein, 20 aa, Mycobacterium
ITPVGLVRRALARISHVEDK

SEQ ID NO: 681956 - protein, 17 aa, Mycobacterium
ITPVPLPRKLSADLLRL

SEQ ID NO: 681957 - protein, 17 aa, Mycobacterium
ITPWLLSEYDRFALLHG

SEQ ID NO: 681958 - protein, 17 aa, Mycobacterium
ITPWNFPFEIISNKVGQ

SEQ ID NO: 681959 - protein, 17 aa, Mycobacterium
ITPWNFPLQTAMTKILP

SEQ ID NO: 681960 - protein, 23 aa, Mycobacterium
ITPWNFPMLMIARKAGAALAAGC

SEQ ID NO: 681961 - protein, 18 aa, Mycobacterium
ITQILPCTLMSPDSVARF

SEQ ID NO: 681962 - protein, 41 aa, Mycobacterium
ITQQRPSRLVVCLDLDWRPQFRVDLVPSYKAHRVAEPEPPG

SEQ ID NO: 681963 - protein, 26 aa, Mycobacterium
ITQYAWGSIWTRPGLDFRSRSMITLT

SEQ ID NO: 681964 - protein, 19 aa, Mycobacterium
ITRAAIMLMSAAAEKIGLS

SEQ ID NO: 681965 - protein, 21 aa, Mycobacterium
ITRARLARFADRITLVHTRYD

SEQ ID NO: 681966 - protein, 20 aa, Mycobacterium
ITRARMVVEAAIIKGPHVLE

SEQ ID NO: 681967 - protein, 23 aa, Mycobacterium
ITRDGFLPGTLRVRRRARDWYQR

SEQ ID NO: 681968 - protein, 30 aa, Mycobacterium
ITRERLDMEILKWLLAEAYARLDDVQARIS

SEQ ID NO: 681969 - protein, 22 aa, Mycobacterium
ITRGGRIAVVFDLEDSRPLDDD

SEQ ID NO: 681970 - protein, 22 aa, Mycobacterium
ITRLAPNFKDIVIRHITFAPYH

SEQ ID NO: 681971 - protein, 23 aa, Mycobacterium
ITRLRGDLRPDWAQPAQEGGSYR

SEQ ID NO: 681972 - protein, 24 aa, Mycobacterium
ITRNPAVGLVFFVPGLREVIRVNG

SEQ ID NO: 681973 - protein, 25 aa, Mycobacterium
ITRNVWGGIWTRPGLDRRSRSLITL

SEQ ID NO: 681974 - protein, 17 aa, Mycobacterium
ITRPWAASLAEDAARLL

SEQ ID NO: 681975 - protein, 19 aa, Mycobacterium
ITRQRLLDMALNHHCDPAP

SEQ ID NO: 681976 - protein, 18 aa, Mycobacterium
ITRQRLQDELLRLQEELH

SEQ ID NO: 681977 - protein, 21 aa, Mycobacterium
ITRQRLQDELLRLQEELSKTI

SEQ ID NO: 681978 - protein, 17 aa, Mycobacterium
ITRSRLPADNEVVSLVA

SEQ ID NO: 681979 - protein, 22 aa, Mycobacterium
ITRVAPVERIRLVNSGTEATMS

SEQ ID NO: 681980 - protein, 18 aa, Mycobacterium
ITRVDGGREPVWRIGPDE

SEQ ID NO: 681981 - protein, 25 aa, Mycobacterium
ITRYFRPRFAAVPFKAGEEQARYDE

SEQ ID NO: 681982 - protein, 19 aa, Mycobacterium
ITSDARLSIATGNTTGVYY

SEQ ID NO: 681983 - protein, 19 aa, Mycobacterium
ITSFPPDWSNVGFDAETRA

SEQ ID NO: 681984 - protein, 18 aa, Mycobacterium
ITSGPAEVLTGWRRVLLL

SEQ ID NO: 681985 - protein, 20 aa, Mycobacterium
ITSHCLLPLLVTRPGGLLVE

SEQ ID NO: 681986 - protein, 23 aa, Mycobacterium
ITSIAARFTSPVFPGETLTTLIW

SEQ ID NO: 681987 - protein, 17 aa, Mycobacterium
ITSIPGMGFRLGAEFLA

SEQ ID NO: 681988 - protein, 23 aa, Mycobacterium
ITSKGWRAVHRLAVDATWSVTRE

SEQ ID NO: 681989 - protein, 24 aa, Mycobacterium
ITSLPNSVGLHWTSVGTGDFYTYQ

SEQ ID NO: 681990 - protein, 18 aa, Mycobacterium
ITSPGLLFQAWQARQGRR

SEQ ID NO: 681991 - protein, 18 aa, Mycobacterium
ITSPSGRCAVEIALYDER

SEQ ID NO: 681992 - protein, 22 aa, Mycobacterium
ITSRAVPELVVERGGTPLRSRV

SEQ ID NO: 681993 - protein, 18 aa, Mycobacterium
ITSRCFPSYALRRRAKGL

SEQ ID NO: 681994 - protein, 17 aa, Mycobacterium
ITSRFLPDKAIDLVDEA

SEQ ID NO: 681995 - protein, 23 aa, Mycobacterium
ITSSRWLVDASIEILQRYSPTLL

SEQ ID NO: 681996 - protein, 23 aa, Mycobacterium
ITSYKMFMAYPGVFYSDDAQIVR

SEQ ID NO: 681997 - protein, 18 aa, Mycobacterium
ITTAIRRLPCGTPASTSG

SEQ ID NO: 681998 - protein, 27 aa, Mycobacterium
ITTEIRRRFSIDSIKGRDGVSLYDHWA

SEQ ID NO: 681999 - protein, 23 aa, Mycobacterium
ITTERFLNTPWWISPLPSARTRA

SEQ ID NO: 682000 - protein, 24 aa, Mycobacterium
ITTGKIREAWNVPRDPNGAPAITG

SEQ ID NO: 682001 - protein, 18 aa, Mycobacterium
ITTGLGWAKAAETVVVSG

SEQ ID NO: 682002 - protein, 32 aa, Mycobacterium
ITTGRRLLDEWPRAGTVVVMLDGDCAFRQLDP

SEQ ID NO: 682003 - protein, 18 aa, Mycobacterium
ITTLCAAAGQIAELLAKW

SEQ ID NO: 682004 - protein, 18 aa, Mycobacterium
ITTLSDLWFEAARVAGFD

SEQ ID NO: 682005 - protein, 17 aa, Mycobacterium
ITTMGRHAAREWNQFLH

SEQ ID NO: 682006 - protein, 41 aa, Mycobacterium
ITTNPPVEGAFYWLNNREVRWRPEHFWKSGTAIDVAVNTYG

SEQ ID NO: 682007 - protein, 29 aa, Mycobacterium
ITTNPPVEGAFYWLNNREVRWRPESFWDS

SEQ ID NO: 682008 - protein, 18 aa, Mycobacterium
ITTPRWTELKSRVRDYLG

SEQ ID NO: 682009 - protein, 19 aa, Mycobacterium
ITTPVTVDPEWDRPGDSVT

SEQ ID NO: 682010 - protein, 20 aa, Mycobacterium
ITTVKVRSVLTCTSATGVCA

SEQ ID NO: 682011 - protein, 26 aa, Mycobacterium
ITTVLPEVIRRSGVDPADIDDIIFAE

SEQ ID NO: 682012 - protein, 19 aa, Mycobacterium
ITTVRCFEDNALLKSVLSE

SEQ ID NO: 682013 - protein, 19 aa, Mycobacterium
ITVAEAVMMGRWRRLGLLR

SEQ ID NO: 682014 - protein, 24 aa, Mycobacterium
ITVCSGRGLSHRAAWFLDNEPDER

SEQ ID NO: 682015 - protein, 27 aa, Mycobacterium
ITVDAAWRPDTVWRYRLGSPGSSERVY

SEQ ID NO: 682016 - protein, 21 aa, Mycobacterium
ITVDGPLRFELIDAATGVSRG

SEQ ID NO: 682017 - protein, 21 aa, Mycobacterium
ITVDMFCHWNYVMEGILGKVE

SEQ ID NO: 682018 - protein, 17 aa, Mycobacterium
ITVEPFAPLPEFWVSRA

SEQ ID NO: 682019 - protein, 23 aa, Mycobacterium
ITVEPWAPLPEFWVARARKKILH

SEQ ID NO: 682020 - protein, 17 aa, Mycobacterium
ITVGGFGLPEFTIPSLT

SEQ ID NO: 682021 - protein, 20 aa, Mycobacterium
ITVGRISYLLGLRGPAVAVD

SEQ ID NO: 682022 - protein, 25 aa, Mycobacterium
ITVHYRPRPVVGIIAPWNYPVANAL

SEQ ID NO: 682023 - protein, 19 aa, Mycobacterium
ITVIHEIAHHFGIDDDRLG

SEQ ID NO: 682024 - protein, 19 aa, Mycobacterium
ITVIHEIAHHFGIDDDRLH

SEQ ID NO: 682025 - protein, 19 aa, Mycobacterium
ITVINKWDRPGRHALELID

SEQ ID NO: 682026 - protein, 17 aa, Mycobacterium
ITVKRDPGGLVSNWIND

SEQ ID NO: 682027 - protein, 18 aa, Mycobacterium
ITVLKGAVLFVTDLARAI

SEQ ID NO: 682028 - protein, 18 aa, Mycobacterium
ITVLPLQHPIVLAKALAT

SEQ ID NO: 682029 - protein, 17 aa, Mycobacterium
ITVLRLRPVEVVSSAAL

SEQ ID NO: 682030 - protein, 23 aa, Mycobacterium
ITVNLEGLWLLQAMLGIPQLAPE

SEQ ID NO: 682031 - protein, 24 aa, Mycobacterium
ITVNYPLYVIMSLLGIPEADFPLM

SEQ ID NO: 682032 - protein, 19 aa, Mycobacterium
ITVPGAGPLYYPNFITTLP

SEQ ID NO: 682033 - protein, 20 aa, Mycobacterium
ITVPGAGPLYYPRFLTELPY

SEQ ID NO: 682034 - protein, 24 aa, Mycobacterium
ITVPKFPNLFIIYGPGTHLAHGGS

SEQ ID NO: 682035 - protein, 25 aa, Mycobacterium
ITVPMFPNLFLLYGPNTNVGSGSII

SEQ ID NO: 682036 - protein, 22 aa, Mycobacterium
ITVPQFPNFFIVYGPGTHLAHG

SEQ ID NO: 682037 - protein, 25 aa, Mycobacterium
ITVPRWLPERICWALSDEYHANEGG

SEQ ID NO: 682038 - protein, 19 aa, Mycobacterium
ITVPTIEWDGRPWTYRQRI

SEQ ID NO: 682039 - protein, 19 aa, Mycobacterium
ITVRAANFGNLYLADDRPG

SEQ ID NO: 682040 - protein, 22 aa, Mycobacterium
ITVRGADFGSLYLADDRPGRVF

SEQ ID NO: 682041 - protein, 27 aa, Mycobacterium
ITVRHMMCLRSGLFNEQTDLGMMMRYF

SEQ ID NO: 682042 - protein, 17 aa, Mycobacterium
ITVSDVLLAPTLREAWA

SEQ ID NO: 682043 - protein, 27 aa, Mycobacterium
ITVSTVWPIAKKVVGAVRKVISIATEP

SEQ ID NO: 682044 - protein, 17 aa, Mycobacterium
ITVTVFAECGYRATTTQ

SEQ ID NO: 682045 - protein, 18 aa, Mycobacterium
ITYADGWFAETHDDSASI

SEQ ID NO: 682046 - protein, 21 aa, Mycobacterium
ITYENACRWYSFDPFEHRTRD

SEQ ID NO: 682047 - protein, 19 aa, Mycobacterium
ITYHPGYAPAFPNYSGSAT

SEQ ID NO: 682048 - protein, 19 aa, Mycobacterium
ITYPHYLINGRIPASPMTF

SEQ ID NO: 682049 - protein, 20 aa, Mycobacterium
ITYRPEYTGVLARVSGAQTI

SEQ ID NO: 682050 - protein, 21 aa, Mycobacterium
ITYWPLTRHGPANGLHAYKIR

SEQ ID NO: 682051 - protein, 19 aa, Mycobacterium
IVAACGFSDLLPVYPTVAS

SEQ ID NO: 682052 - protein, 18 aa, Mycobacterium
IVAAEGAFHGRTMGSLAL

SEQ ID NO: 682053 - protein, 17 aa, Mycobacterium
IVAAFGIARDQVLAHQW

SEQ ID NO: 682054 - protein, 26 aa, Mycobacterium
IVAAWPRALCVPSWLRQWEDKTSYVG

SEQ ID NO: 682055 - protein, 17 aa, Mycobacterium
IVADDFTFLDGVMAWYA

SEQ ID NO: 682056 - protein, 19 aa, Mycobacterium
IVADPAWPGLVSAVNAADP

SEQ ID NO: 682057 - protein, 21 aa, Mycobacterium
IVADTKFEFGIDADGELTLAD

SEQ ID NO: 682058 - protein, 23 aa, Mycobacterium
IVADWQKYALIVDRTIAFDNVQD

SEQ ID NO: 682059 - protein, 17 aa, Mycobacterium
IVAEAAIAQTAQDINAA

SEQ ID NO: 682060 - protein, 17 aa, Mycobacterium
IVAEGLYDDFVAGVAEV

SEQ ID NO: 682061 - protein, 21 aa, Mycobacterium
IVAEIRRLLGAAWTDERGTVP

SEQ ID NO: 682062 - protein, 24 aa, Mycobacterium
IVAELFKPLPSMVVAHYLGVPDED

SEQ ID NO: 682063 - protein, 24 aa, Mycobacterium
IVAELFKPLPSMVVAHYLGVPEAD

SEQ ID NO: 682064 - protein, 24 aa, Mycobacterium
IVAFPRSPMLTAYAAWDLAKYSDG

SEQ ID NO: 682065 - protein, 21 aa, Mycobacterium
IVAGADWGRLADAYRMRAAVK

SEQ ID NO: 682066 - protein, 25 aa, Mycobacterium
IVAGNRVRLGLLRRSDDLRRRAHAV

SEQ ID NO: 682067 - protein, 17 aa, Mycobacterium
IVAKFVGGLPIVLATKL

SEQ ID NO: 682068 - protein, 22 aa, Mycobacterium
IVAKPPAGGWFGEPPQAARPRP

SEQ ID NO: 682069 - protein, 23 aa, Mycobacterium
IVALGGFAWQVALRMSGALAKPK

SEQ ID NO: 682070 - protein, 23 aa, Mycobacterium
IVALKYPGGVLIAGDRRSTQGNM

SEQ ID NO: 682071 - protein, 18 aa, Mycobacterium
IVALPWHAAYSASKYGLR

SEQ ID NO: 682072 - protein, 23 aa, Mycobacterium
IVALRSAQLITFTAMDIDDPRAL

SEQ ID NO: 682073 - protein, 22 aa, Mycobacterium
IVALTYRGGVLIAGDRRATQGN

SEQ ID NO: 682074 - protein, 25 aa, Mycobacterium
IVAMDRLGFHEAWVGEHHSAGFEII

SEQ ID NO: 682075 - protein, 26 aa, Mycobacterium
IVANADFMGGFALWVDEHQRLHHTYS

SEQ ID NO: 682076 - protein, 25 aa, Mycobacterium
IVANADFMGGFALWVDEQRRLHHTY

SEQ ID NO: 682077 - protein, 17 aa, Mycobacterium
IVANGVVTRSVRDTAAF

SEQ ID NO: 682078 - protein, 17 aa, Mycobacterium
IVAQLAAGIAVGSALWP

SEQ ID NO: 682079 - protein, 25 aa, Mycobacterium
IVARAGAPTRFWVHVTHGAPADVWL

SEQ ID NO: 682080 - protein, 17 aa, Mycobacterium
IVARAGVGLDNVDVDAA

SEQ ID NO: 682081 - protein, 23 aa, Mycobacterium
IVARASALFLRRSEHAVDTVWTS

SEQ ID NO: 682082 - protein, 17 aa, Mycobacterium
IVARFLGVLELYRSKAV

SEQ ID NO: 682083 - protein, 24 aa, Mycobacterium
IVARVVSMPCVEWFESQPEDYRDS

SEQ ID NO: 682084 - protein, 19 aa, Mycobacterium
IVASFGRRDPLGIGAPARL

SEQ ID NO: 682085 - protein, 20 aa, Mycobacterium
IVASMSWTLALLLQHPEHLD

SEQ ID NO: 682086 - protein, 17 aa, Mycobacterium
IVASWPGARLMTTRGLG

SEQ ID NO: 682087 - protein, 20 aa, Mycobacterium
IVATAWDCPFDGAVAPQQVL

SEQ ID NO: 682088 - protein, 24 aa, Mycobacterium
IVATAWDCPFDGPTPSQRVLDIAA

SEQ ID NO: 682089 - protein, 18 aa, Mycobacterium
IVATETFAPILYVLTYDD

SEQ ID NO: 682090 - protein, 23 aa, Mycobacterium
IVATETFAPVLYVLAYDELDDAI

SEQ ID NO: 682091 - protein, 20 aa, Mycobacterium
IVATLIRRGEPDRPPGPPGA

SEQ ID NO: 682092 - protein, 24 aa, Mycobacterium
IVAVEPRRRFAYRWHPFAIDPEVD

SEQ ID NO: 682093 - protein, 19 aa, Mycobacterium
IVAVLALYRPGPMGQNAHN

SEQ ID NO: 682094 - protein, 21 aa, Mycobacterium
IVAVPAPRAAAILEAVAPESA

SEQ ID NO: 682095 - protein, 25 aa, Mycobacterium
IVAVQRWAEHHGKNLRAVIATEDQL

SEQ ID NO: 682096 - protein, 21 aa, Mycobacterium
IVAVVRGWAIGLGFHIALASD

SEQ ID NO: 682097 - protein, 25 aa, Mycobacterium
IVAWDIPGTCDIAAMTATINAHVRR

SEQ ID NO: 682098 - protein, 26 aa, Mycobacterium
IVCALCSCYPRPILGNSPEWYRTPNY

SEQ ID NO: 682099 - protein, 23 aa, Mycobacterium
IVCANAGIAPTAFREVSIEEDLE

SEQ ID NO: 682100 - protein, 18 aa, Mycobacterium
IVCDDRRTLLWLANQRAV

SEQ ID NO: 682101 - protein, 20 aa, Mycobacterium
IVCPDCGTKGQWTEPRDFNM

SEQ ID NO: 682102 - protein, 22 aa, Mycobacterium
IVCPIGFVADHIEVVWDLDSEL

SEQ ID NO: 682103 - protein, 18 aa, Mycobacterium
IVCRGDVVMSGYWNNPEA

SEQ ID NO: 682104 - protein, 17 aa, Mycobacterium
IVCRPELADAVLAVTTR

SEQ ID NO: 682105 - protein, 23 aa, Mycobacterium
IVCVDPRLTPVARHATVHLAPVP

SEQ ID NO: 682106 - protein, 20 aa, Mycobacterium
IVCVDPRLTPVARQATVHLA

SEQ ID NO: 682107 - protein, 20 aa, Mycobacterium
IVCVQRFGPLIKEIPDTVRV

SEQ ID NO: 682108 - protein, 23 aa, Mycobacterium
IVCVSRLVPRKGQDMLIEALPAI

SEQ ID NO: 682109 - protein, 19 aa, Mycobacterium
IVDAACARHGIDPTLAFEG

SEQ ID NO: 682110 - protein, 25 aa, Mycobacterium
IVDAASLALACWAEPDITARPNVVW

SEQ ID NO: 682111 - protein, 19 aa, Mycobacterium
IVDACKRGGSTIFGSGAHP

SEQ ID NO: 682112 - protein, 20 aa, Mycobacterium
IVDAGCPWTLTEAAAVADEL

SEQ ID NO: 682113 - protein, 23 aa, Mycobacterium
IVDATGLLRAWVLMDGATPLAVE

SEQ ID NO: 682114 - protein, 19 aa, Mycobacterium
IVDAYSRMIVGWRVASHMR

SEQ ID NO: 682115 - protein, 25 aa, Mycobacterium
IVDDAARLTVVWIADWADDMVHLSA

SEQ ID NO: 682116 - protein, 18 aa, Mycobacterium
IVDDLYLVHFGRDRDDPP

SEQ ID NO: 682117 - protein, 23 aa, Mycobacterium
IVDEFTGRVLIGRRYNEGMHQAI

SEQ ID NO: 682118 - protein, 19 aa, Mycobacterium
IVDEMWASGLMSAFNPVAA

SEQ ID NO: 682119 - protein, 20 aa, Mycobacterium
IVDEPFIIGVVGPAFSGETK

SEQ ID NO: 682120 - protein, 24 aa, Mycobacterium
IVDGAPLCWQRRPTARDDAGLARG

SEQ ID NO: 682121 - protein, 23 aa, Mycobacterium
IVDGRGGPQFLPFGTSTVGSDTI

SEQ ID NO: 682122 - protein, 20 aa, Mycobacterium
IVDHEWQFIAGWPDANSDDP

SEQ ID NO: 682123 - protein, 20 aa, Mycobacterium
IVDHEWQFVAGWPDARSDNP

SEQ ID NO: 682124 - protein, 18 aa, Mycobacterium
IVDLCTGSGALAVALAHE

SEQ ID NO: 682125 - protein, 19 aa, Mycobacterium
IVDLCTGSGALAVALAHQR

SEQ ID NO: 682126 - protein, 21 aa, Mycobacterium
IVDLDGGFVAPAFVDSHVHIT

SEQ ID NO: 682127 - protein, 19 aa, Mycobacterium
IVDLTAFWAGPAATHLLAA

SEQ ID NO: 682128 - protein, 19 aa, Mycobacterium
IVDNCVQLHGGYGYMMEYR

SEQ ID NO: 682129 - protein, 24 aa, Mycobacterium
IVDPACGTGGFLLVAHEHVAEGAG

SEQ ID NO: 682130 - protein, 18 aa, Mycobacterium
IVDPRTGEGYEFQPDSTH

SEQ ID NO: 682131 - protein, 17 aa, Mycobacterium
IVDRALEELQWCLERGA

SEQ ID NO: 682132 - protein, 23 aa, Mycobacterium
IVDRLKDIINRGGENVSSVEVEA

SEQ ID NO: 682133 - protein, 23 aa, Mycobacterium
IVDRLKDIINRGGENVSSVEVES

SEQ ID NO: 682134 - protein, 24 aa, Mycobacterium
IVDRVKDMIVTGGFNVFPREVEDV

SEQ ID NO: 682135 - protein, 17 aa, Mycobacterium
IVDTALEHYGRVDILIH

SEQ ID NO: 682136 - protein, 24 aa, Mycobacterium
IVDYLTARGWRVAAHPARELYAQN

SEQ ID NO: 682137 - protein, 23 aa, Mycobacterium
IVEAEGLTVLGWREVPHDDSSLG

SEQ ID NO: 682138 - protein, 18 aa, Mycobacterium
IVEAFLAASRGGDIAGLL

SEQ ID NO: 682139 - protein, 18 aa, Mycobacterium
IVEAFTFELGKCYEQAIK

SEQ ID NO: 682140 - protein, 22 aa, Mycobacterium
IVEALASWDRPAAAKRAADAEK

SEQ ID NO: 682141 - protein, 18 aa, Mycobacterium
IVEAMPLRGAEIAAQIEK

SEQ ID NO: 682142 - protein, 25 aa, Mycobacterium
IVEEKYWGGVCLNVGCIPSKALLRN

SEQ ID NO: 682143 - protein, 24 aa, Mycobacterium
IVEEPPDHLIFVFATTEPEKVLPT

SEQ ID NO: 682144 - protein, 18 aa, Mycobacterium
IVEFARTRGRVEVASLAT

SEQ ID NO: 682145 - protein, 17 aa, Mycobacterium
IVEFMLANARRLLDAGA

SEQ ID NO: 682146 - protein, 17 aa, Mycobacterium
IVEGGYETTLWARRPAT

SEQ ID NO: 682147 - protein, 24 aa, Mycobacterium
IVEICRKVWRRERVQYAGKHYQLP

SEQ ID NO: 682148 - protein, 18 aa, Mycobacterium
IVEKAARGLAGANLTVLN

SEQ ID NO: 682149 - protein, 18 aa, Mycobacterium
IVEKGYVHEVARFFATGW

SEQ ID NO: 682150 - protein, 18 aa, Mycobacterium
IVEKVCVPMMQRVADACN

SEQ ID NO: 682151 - protein, 20 aa, Mycobacterium
IVELARYKPLLDSIVRNDDT

SEQ ID NO: 682152 - protein, 20 aa, Mycobacterium
IVELKKTYDFRLLVDDAHGF

SEQ ID NO: 682153 - protein, 25 aa, Mycobacterium
IVELLRSRVFFDWFDEAGVDDIPAV

SEQ ID NO: 682154 - protein, 25 aa, Mycobacterium
IVELTRLSATTVRFTVEIPDRADLA

SEQ ID NO: 682155 - protein, 24 aa, Mycobacterium
IVEPKYWGGVCLNVGCIPSKALLR

SEQ ID NO: 682156 - protein, 20 aa, Mycobacterium
IVEQLPRKVALELIYTGEPI

SEQ ID NO: 682157 - protein, 23 aa, Mycobacterium
IVEQLPRKVALELVLTGEPMTAS

SEQ ID NO: 682158 - protein, 23 aa, Mycobacterium
IVERGRMLGGVCVNTGTIPSKTL

SEQ ID NO: 682159 - protein, 19 aa, Mycobacterium
IVESLASVSGHIWLSENGG

SEQ ID NO: 682160 - protein, 17 aa, Mycobacterium
IVFECVGVPGIIDDIIA

SEQ ID NO: 682161 - protein, 34 aa, Mycobacterium
IVFRAELSPGAARRVQRVWAEIRTEVLGGQYLDI

SEQ ID NO: 682162 - protein, 26 aa, Mycobacterium
IVFTIRIPLEIDMVIDLRIDRPRFMV

SEQ ID NO: 682163 - protein, 26 aa, Mycobacterium
IVGCNLRPGNVWQTIEIPRLIGNLNV

SEQ ID NO: 682164 - protein, 24 aa, Mycobacterium
IVGDSAGLGLIWIADWADDTVHVS

SEQ ID NO: 682165 - protein, 33 aa, Mycobacterium
IVGFIDPRTRWLLRELIHALLVKKDHRAAGKIV

SEQ ID NO: 682166 - protein, 17 aa, Mycobacterium
IVGFRIPYIKGKDTEPL

SEQ ID NO: 682167 - protein, 28 aa, Mycobacterium
IVGHGITCIAAIHALELMDASLSPLTKP

SEQ ID NO: 682168 - protein, 26 aa, Mycobacterium
IVGIGSRPSVDWLKGSGIEVDNGVVC

SEQ ID NO: 682169 - protein, 19 aa, Mycobacterium
IVGIMRVYANFLAQYSIRV

SEQ ID NO: 682170 - protein, 21 aa, Mycobacterium
IVGITPRFGADSCEGNFESYL

SEQ ID NO: 682171 - protein, 22 aa, Mycobacterium
IVGKLSVPPAWTAAAPLHSPLG

SEQ ID NO: 682172 - protein, 17 aa, Mycobacterium
IVGKLSVPPSWTGAAPL

SEQ ID NO: 682173 - protein, 31 aa, Mycobacterium
IVGKSPLVARAWRAPLQFLFIDGGHSEDAAN

SEQ ID NO: 682174 - protein, 25 aa, Mycobacterium
IVGLLRPRLNPVAWMSGAWRATLTA

SEQ ID NO: 682175 - protein, 24 aa, Mycobacterium
IVGLRPEVAFAMVQLGLAFDDMHT

SEQ ID NO: 682176 - protein, 28 aa, Mycobacterium
IVGMSARLMERWSSRRAAIKARTAELAK

SEQ ID NO: 682177 - protein, 19 aa, Mycobacterium
IVGPPFIVARFMRYLELEA

SEQ ID NO: 682178 - protein, 25 aa, Mycobacterium
IVGQEWLDRYGLRDPLNRGLKYGVK

SEQ ID NO: 682179 - protein, 17 aa, Mycobacterium
IVGRFLALLELFRARAV

SEQ ID NO: 682180 - protein, 25 aa, Mycobacterium
IVGRIKDLLIVYGRNHAPEDIEATI

SEQ ID NO: 682181 - protein, 19 aa, Mycobacterium
IVGRIKDVVIIRGRNHYPD

SEQ ID NO: 682182 - protein, 17 aa, Mycobacterium
IVGRLLRSGTRFPEPDT

SEQ ID NO: 682183 - protein, 23 aa, Mycobacterium
IVGRMKDLLIIRGRNHYPEDIEA

SEQ ID NO: 682184 - protein, 25 aa, Mycobacterium
IVGRMKDLLIVYGRNHYPEDIESTV

SEQ ID NO: 682185 - protein, 23 aa, Mycobacterium
IVGRRLAEPGPWSMLEVLAPTMI

SEQ ID NO: 682186 - protein, 26 aa, Mycobacterium
IVGSDLRPGNIWQTVEIPRLMDNPNV

SEQ ID NO: 682187 - protein, 26 aa, Mycobacterium
IVGSGPELRSAAAWFEVLKLERRRQR

SEQ ID NO: 682188 - protein, 22 aa, Mycobacterium
IVGTGGTGFAGDGGDGGAGGQG

SEQ ID NO: 682189 - protein, 35 aa, Mycobacterium
IVGVERIGLRYVLEIRVPVGVDGRVNWGNWIDEQL

SEQ ID NO: 682190 - protein, 22 aa, Mycobacterium
IVGVPVVTTWAALTIPVGEPTG

SEQ ID NO: 682191 - protein, 24 aa, Mycobacterium
IVHAPRAPARWEARKDGPPLLVLD

SEQ ID NO: 682192 - protein, 17 aa, Mycobacterium
IVHGGVYCSVVESVASV

SEQ ID NO: 682193 - protein, 19 aa, Mycobacterium
IVHGLPVMPGAGFAEIALA

SEQ ID NO: 682194 - protein, 17 aa, Mycobacterium
IVHKLRRVLSGLDAHQA

SEQ ID NO: 682195 - protein, 26 aa, Mycobacterium
IVHLEEGFSFLGFNIRCYRHGRRPGK

SEQ ID NO: 682196 - protein, 19 aa, Mycobacterium
IVHRGVALSSFYQCGDLYR

SEQ ID NO: 682197 - protein, 18 aa, Mycobacterium
IVIDPGLGGGDRGRIVPG

SEQ ID NO: 682198 - protein, 25 aa, Mycobacterium
IVIGCGESGILAGIRLKQANIPFTI

SEQ ID NO: 682199 - protein, 18 aa, Mycobacterium
IVIGCGPVGIAVIAALHN

SEQ ID NO: 682200 - protein, 20 aa, Mycobacterium
IVIGEAKPYCVALVSLDREA

SEQ ID NO: 682201 - protein, 18 aa, Mycobacterium
IVIPWVFDGLGFDAPLGK

SEQ ID NO: 682202 - protein, 23 aa, Mycobacterium
IVISCPLLLTLPAVGTYPIEAVR

SEQ ID NO: 682203 - protein, 21 aa, Mycobacterium
IVISQPFWPAYLTKERIAKAP

SEQ ID NO: 682204 - protein, 25 aa, Mycobacterium
IVITPWRSVLVFDLDEGVADTALRV

SEQ ID NO: 682205 - protein, 28 aa, Mycobacterium
IVKAAARAVSWPTMWLSSADSPITMRHY

SEQ ID NO: 682206 - protein, 19 aa, Mycobacterium
IVKIEPFASLPADQVAQAI

SEQ ID NO: 682207 - protein, 23 aa, Mycobacterium
IVKRMGDGMMAVFGDPATAVRAV

SEQ ID NO: 682208 - protein, 17 aa, Mycobacterium
IVLAAADLVAWAQLIGF

SEQ ID NO: 682209 - protein, 20 aa, Mycobacterium
IVLADDGVGFSFHETTIDAG

SEQ ID NO: 682210 - protein, 18 aa, Mycobacterium
IVLADDGVGFSFHETTIH

SEQ ID NO: 682211 - protein, 24 aa, Mycobacterium
IVLANAGIAPLAFRELSIEEELAQ

SEQ ID NO: 682212 - protein, 19 aa, Mycobacterium
IVLAYTWRDDGVTWTQESG

SEQ ID NO: 682213 - protein, 23 aa, Mycobacterium
IVLDGWSKPVLLQEIFASYFGVR

SEQ ID NO: 682214 - protein, 21 aa, Mycobacterium
IVLDRIMRYVGIVPRELSDMT

SEQ ID NO: 682215 - protein, 31 aa, Mycobacterium
IVLDRSTFRWWLTVATLRWGVICRHQAERHL

SEQ ID NO: 682216 - protein, 20 aa, Mycobacterium
IVLDVPRGSAARFGYQAGQF

SEQ ID NO: 682217 - protein, 18 aa, Mycobacterium
IVLGAAVLRDLELEVAMG

SEQ ID NO: 682218 - protein, 20 aa, Mycobacterium
IVLGNTWFWPADTLTMKAFS

SEQ ID NO: 682219 - protein, 24 aa, Mycobacterium
IVLGPRWLVPPALLVTSPQGAHDV

SEQ ID NO: 682220 - protein, 24 aa, Mycobacterium
IVLGRSGATSTFWVHVTHGDAVEV

SEQ ID NO: 682221 - protein, 18 aa, Mycobacterium
IVLLMAVERIELFADALI

SEQ ID NO: 682222 - protein, 18 aa, Mycobacterium
IVLLMAVERIELFAEALL

SEQ ID NO: 682223 - protein, 18 aa, Mycobacterium
IVLLMAVERIELFVEALL

SEQ ID NO: 682224 - protein, 26 aa, Mycobacterium
IVLLMAVERIELFVKVLLKGGRPADT

SEQ ID NO: 682225 - protein, 25 aa, Mycobacterium
IVLNAKTRRPSVCNAAESLLIDAAV

SEQ ID NO: 682226 - protein, 24 aa, Mycobacterium
IVLPHVWRGVPEIAAVLAAATGPA

SEQ ID NO: 682227 - protein, 17 aa, Mycobacterium
IVLPSLYYAHQRNVVER

SEQ ID NO: 682228 - protein, 18 aa, Mycobacterium
IVLQCFRGKAAERAKIDE

SEQ ID NO: 682229 - protein, 20 aa, Mycobacterium
IVLQEIFAGYFRERMPAAAP

SEQ ID NO: 682230 - protein, 21 aa, Mycobacterium
IVLRTPKGWTGPKMVDGKKVE

SEQ ID NO: 682231 - protein, 20 aa, Mycobacterium
IVLTHELFHYAARVDTALDA

SEQ ID NO: 682232 - protein, 31 aa, Mycobacterium
IVLVDFWAPWCGPCRAFAPTFERSAQNHPDI

SEQ ID NO: 682233 - protein, 31 aa, Mycobacterium
IVLVDFWASWCGPCRAFGPVYERSSEAHPEV

SEQ ID NO: 682234 - protein, 30 aa, Mycobacterium
IVLVDFWASWCGPCRQFGPTFQASSEKHPD

SEQ ID NO: 682235 - protein, 19 aa, Mycobacterium
IVLVEHGPGLTVSRDLPKL

SEQ ID NO: 682236 - protein, 29 aa, Mycobacterium
IVLVSSVHAMFGLPGRPAYAAAKAGLTGL

SEQ ID NO: 682237 - protein, 17 aa, Mycobacterium
IVMEKLDLVGLGGDEDK

SEQ ID NO: 682238 - protein, 18 aa, Mycobacterium
IVMFDFPDLVFVTRHGCE

SEQ ID NO: 682239 - protein, 28 aa, Mycobacterium
IVMFLDELVLWLAFRVRDAEFFGREAQK

SEQ ID NO: 682240 - protein, 18 aa, Mycobacterium
IVMPWVFDGLGFDAPLDK

SEQ ID NO: 682241 - protein, 18 aa, Mycobacterium
IVNLPMGNMVLSHGGTGA

SEQ ID NO: 682242 - protein, 24 aa, Mycobacterium
IVNMPGQTTVDWSRDQALISPNMG

SEQ ID NO: 682243 - protein, 19 aa, Mycobacterium
IVNPARLVFELARACRDAG

SEQ ID NO: 682244 - protein, 19 aa, Mycobacterium
IVNRPDWIRAAAQSMRAMT

SEQ ID NO: 682245 - protein, 26 aa, Mycobacterium
IVNSLGGRGVFGVELLVQGEDVYFSD

SEQ ID NO: 682246 - protein, 25 aa, Mycobacterium
IVNTSSKLSVCFAHLDDVAVRVAEA

SEQ ID NO: 682247 - protein, 29 aa, Mycobacterium
IVPADGFLPALQRWCRDNDVVFIADEVQT

SEQ ID NO: 682248 - protein, 31 aa, Mycobacterium
IVPAEGFLPTLLDWCRANDVVFIADEVQTGF

SEQ ID NO: 682249 - protein, 33 aa, Mycobacterium
IVPAEGFLPTLLEWCRRNDVVFIADEVQTGFAR

SEQ ID NO: 682250 - protein, 25 aa, Mycobacterium
IVPCWECLFCKRGQYHMCQPHDLYG

SEQ ID NO: 682251 - protein, 21 aa, Mycobacterium
IVPDGSPYRDAFRTVDAAMAA

SEQ ID NO: 682252 - protein, 17 aa, Mycobacterium
IVPDRLYELIGDPDRAR

SEQ ID NO: 682253 - protein, 19 aa, Mycobacterium
IVPELPKTRSGKIMRRLLR

SEQ ID NO: 682254 - protein, 24 aa, Mycobacterium
IVPETCLYVAAVSRRSHLSAGAAA

SEQ ID NO: 682255 - protein, 20 aa, Mycobacterium
IVPFNHPVLFAGSKIAAPLM

SEQ ID NO: 682256 - protein, 18 aa, Mycobacterium
IVPGMLIGALSFGHLPAI

SEQ ID NO: 682257 - protein, 17 aa, Mycobacterium
IVPHTWLWTTPAGGEIR

SEQ ID NO: 682258 - protein, 24 aa, Mycobacterium
IVPIGVDAVRVFTPLPERVEVLTT

SEQ ID NO: 682259 - protein, 21 aa, Mycobacterium
IVPKGPELAGWLTPHGREALG

SEQ ID NO: 682260 - protein, 18 aa, Mycobacterium
IVPLLKIPGVTNVHRNLP

SEQ ID NO: 682261 - protein, 19 aa, Mycobacterium
IVPNAARLDKVSFEEMLEM

SEQ ID NO: 682262 - protein, 24 aa, Mycobacterium
IVPPDICGPGALRPRVIRSVCSIA

SEQ ID NO: 682263 - protein, 17 aa, Mycobacterium
IVPRGANRLLLGGLVEP

SEQ ID NO: 682264 - protein, 20 aa, Mycobacterium
IVPRLSGPVTTPRNETHYVA

SEQ ID NO: 682265 - protein, 18 aa, Mycobacterium
IVQAMFIGPVFNPLLKML

SEQ ID NO: 682266 - protein, 17 aa, Mycobacterium
IVQAWGMTETSPLATVA

SEQ ID NO: 682267 - protein, 23 aa, Mycobacterium
IVQEAWLRWDAAPGRDDVADLRA

SEQ ID NO: 682268 - protein, 21 aa, Mycobacterium
IVRAAAATMFFGKTANDLARG

SEQ ID NO: 682269 - protein, 20 aa, Mycobacterium
IVRAVACAVWDAQFDGRPFT

SEQ ID NO: 682270 - protein, 19 aa, Mycobacterium
IVRCLKRAERLGATRVEVS

SEQ ID NO: 682271 - protein, 24 aa, Mycobacterium
IVRDPRWIALAGRVPRIQVVHDDR

SEQ ID NO: 682272 - protein, 24 aa, Mycobacterium
IVREAVAMPIDWGTMTLAEGVNDI

SEQ ID NO: 682273 - protein, 20 aa, Mycobacterium
IVRFYADLLRGYEFSDDLGE

SEQ ID NO: 682274 - protein, 20 aa, Mycobacterium
IVRFYADLLRTYQFSEDLGE

SEQ ID NO: 682275 - protein, 20 aa, Mycobacterium
IVRFYADLLSRYEFSEDLGE

SEQ ID NO: 682276 - protein, 18 aa, Mycobacterium
IVRLAEALDAEWDAVDAA

SEQ ID NO: 682277 - protein, 18 aa, Mycobacterium
IVRLDRELPLPSRAHADD

SEQ ID NO: 682278 - protein, 20 aa, Mycobacterium
IVRLEPPAPMLPRVTTTEVT

SEQ ID NO: 682279 - protein, 17 aa, Mycobacterium
IVRLRYRPTAVSLSISD

SEQ ID NO: 682280 - protein, 22 aa, Mycobacterium
IVRMHGAFELFGKVRDHVLEVR

SEQ ID NO: 682281 - protein, 18 aa, Mycobacterium
IVRPLGLDMHIGLPDSVD

SEQ ID NO: 682282 - protein, 25 aa, Mycobacterium
IVRQLHSWAKPAFEIAQTFTETGGR

SEQ ID NO: 682283 - protein, 26 aa, Mycobacterium
IVRQMFAKRPRFEFDHLVTADDVPCL

SEQ ID NO: 682284 - protein, 17 aa, Mycobacterium
IVRRCADGVVCINPPAN

SEQ ID NO: 682285 - protein, 25 aa, Mycobacterium
IVRRREDILSVRYCRGATEDSSGYS

SEQ ID NO: 682286 - protein, 24 aa, Mycobacterium
IVRRSNALLDWAYGRQFRYTESMS

SEQ ID NO: 682287 - protein, 29 aa, Mycobacterium
IVRRSNALLDWAYGRRFRYSEHMSLGSSP

SEQ ID NO: 682288 - protein, 24 aa, Mycobacterium
IVRRSNALLDWAYGTRMRYREAMS

SEQ ID NO: 682289 - protein, 18 aa, Mycobacterium
IVRRVEKVVQAWSELQVA

SEQ ID NO: 682290 - protein, 18 aa, Mycobacterium
IVRTEKWGAIADGTSEGT

SEQ ID NO: 682291 - protein, 17 aa, Mycobacterium
IVRTRWEGGGGRPVVTA

SEQ ID NO: 682292 - protein, 29 aa, Mycobacterium
IVRTTFGFRLGFFGPFAIADQAGLDVYVK

SEQ ID NO: 682293 - protein, 17 aa, Mycobacterium
IVSALCRAWGATPTSSG

SEQ ID NO: 682294 - protein, 21 aa, Mycobacterium
IVSALNRPVAAGGDTRNQNTV

SEQ ID NO: 682295 - protein, 18 aa, Mycobacterium
IVSDVPWVKHVAKLSELL

SEQ ID NO: 682296 - protein, 17 aa, Mycobacterium
IVSEAGITVPKGRLATF

SEQ ID NO: 682297 - protein, 27 aa, Mycobacterium
IVSFDPKAGWSHRFVPVEAQVVADQIE

SEQ ID NO: 682298 - protein, 18 aa, Mycobacterium
IVSFEAFDAFRKERYGAF

SEQ ID NO: 682299 - protein, 17 aa, Mycobacterium
IVSGSSFRGVLRRIGEQ

SEQ ID NO: 682300 - protein, 17 aa, Mycobacterium
IVSIEAFEAFGKSRYKA

SEQ ID NO: 682301 - protein, 18 aa, Mycobacterium
IVSPEFQFQVFLDEVRLP

SEQ ID NO: 682302 - protein, 21 aa, Mycobacterium
IVSPKAGGLIDHAQRVAEGAM

SEQ ID NO: 682303 - protein, 29 aa, Mycobacterium
IVSPSGRDCLDWVAGELWVGGANVAARYR

SEQ ID NO: 682304 - protein, 24 aa, Mycobacterium
IVSRAGAQTRFWAHVTHGAPADVW

SEQ ID NO: 682305 - protein, 25 aa, Mycobacterium
IVSRERLQLAIAWANILLQRKVPAD

SEQ ID NO: 682306 - protein, 17 aa, Mycobacterium
IVSSVGFTALGVAAARA

SEQ ID NO: 682307 - protein, 18 aa, Mycobacterium
IVSSVGFTALMVSSFRAL

SEQ ID NO: 682308 - protein, 18 aa, Mycobacterium
IVSSVGYTALLVAGWRAL

SEQ ID NO: 682309 - protein, 19 aa, Mycobacterium
IVSSVGYTALLVAGWRALH

SEQ ID NO: 682310 - protein, 17 aa, Mycobacterium
IVSVVNWADCLVALQQR

SEQ ID NO: 682311 - protein, 20 aa, Mycobacterium
IVSYAKVLGGGMPIGVVAGR

SEQ ID NO: 682312 - protein, 19 aa, Mycobacterium
IVTDACWNLIAGNVGCVVL

SEQ ID NO: 682313 - protein, 17 aa, Mycobacterium
IVTEIFPGGRLPSIDMV

SEQ ID NO: 682314 - protein, 22 aa, Mycobacterium
IVTEIFPGGRLPSIDMVQQHAG

SEQ ID NO: 682315 - protein, 18 aa, Mycobacterium
IVTELAVIDVCHDGLHLI

SEQ ID NO: 682316 - protein, 24 aa, Mycobacterium
IVTELFKPLPSMVVAHYLGVPEAD

SEQ ID NO: 682317 - protein, 24 aa, Mycobacterium
IVTELFKPLPSMVVAHYLGVPEED

SEQ ID NO: 682318 - protein, 24 aa, Mycobacterium
IVTELFKPLPSMVVAHYLGVPEQD

SEQ ID NO: 682319 - protein, 22 aa, Mycobacterium
IVTGLRLMTRMVATGASLAALA

SEQ ID NO: 682320 - protein, 19 aa, Mycobacterium
IVTGLRLMTRMVQTGSSLA

SEQ ID NO: 682321 - protein, 18 aa, Mycobacterium
IVTHGASVTWVRGGAEAL

SEQ ID NO: 682322 - protein, 19 aa, Mycobacterium
IVTLMGMANTVEWTVQEFT

SEQ ID NO: 682323 - protein, 17 aa, Mycobacterium
IVTLPWARDLAVAIERL

SEQ ID NO: 682324 - protein, 25 aa, Mycobacterium
IVTPEIVRRICWDWDGHGDVDEQLA

SEQ ID NO: 682325 - protein, 18 aa, Mycobacterium
IVTRTMSKAFAFAGGRLG

SEQ ID NO: 682326 - protein, 19 aa, Mycobacterium
IVTTLRFVPHGVRAGQLTS

SEQ ID NO: 682327 - protein, 19 aa, Mycobacterium
IVTYPGGSLLDMLRPRASS

SEQ ID NO: 682328 - protein, 24 aa, Mycobacterium
IVVANAGIASWARLWEIEADQWRD

SEQ ID NO: 682329 - protein, 17 aa, Mycobacterium
IVVAPGANAHLSLASPV

SEQ ID NO: 682330 - protein, 18 aa, Mycobacterium
IVVARLAKGLTWQQLADA

SEQ ID NO: 682331 - protein, 23 aa, Mycobacterium
IVVARLGIREVRFTGGEPLLRRG

SEQ ID NO: 682332 - protein, 17 aa, Mycobacterium
IVVASWQIHRRIGMDGS

SEQ ID NO: 682333 - protein, 17 aa, Mycobacterium
IVVEKHKGNLTVQSQPG

SEQ ID NO: 682334 - protein, 20 aa, Mycobacterium
IVVGEAKPYCVALVSLDSEA

SEQ ID NO: 682335 - protein, 17 aa, Mycobacterium
IVVIAGLATQDARSAQY

SEQ ID NO: 682336 - protein, 22 aa, Mycobacterium
IVVKCSPGIDFAELGRLGFAGE

SEQ ID NO: 682337 - protein, 17 aa, Mycobacterium
IVVLCVFTDPQVREVCM

SEQ ID NO: 682338 - protein, 17 aa, Mycobacterium
IVVLPGLSTVVGSTEAE

SEQ ID NO: 682339 - protein, 25 aa, Mycobacterium
IVVNCAGTGNAIRVLGRDGVFPLAA

SEQ ID NO: 682340 - protein, 20 aa, Mycobacterium
IVVNCAGTGNAIRVLSRDGV

SEQ ID NO: 682341 - protein, 22 aa, Mycobacterium
IVVNYDLPWAIIRIIQRAGRVD

SEQ ID NO: 682342 - protein, 17 aa, Mycobacterium
IVVPCHRVIGANGSLTG

SEQ ID NO: 682343 - protein, 19 aa, Mycobacterium
IVVPERWGGAGAGVVELAV

SEQ ID NO: 682344 - protein, 19 aa, Mycobacterium
IVVPRTRMIYVRAADNHPI

SEQ ID NO: 682345 - protein, 26 aa, Mycobacterium
IVVRDACKRYGDFVALDNVNFVVPAG

SEQ ID NO: 682346 - protein, 20 aa, Mycobacterium
IVVREGFSANLARALRDDLR

SEQ ID NO: 682347 - protein, 19 aa, Mycobacterium
IVVREGLSADLARALHDDA

SEQ ID NO: 682348 - protein, 19 aa, Mycobacterium
IVVREGLSADLARALHDDI

SEQ ID NO: 682349 - protein, 28 aa, Mycobacterium
IVVRQIRSITWCRRRTVQVGRIAARVPQ

SEQ ID NO: 682350 - protein, 17 aa, Mycobacterium
IVVVHTGWWTRFLSAGD

SEQ ID NO: 682351 - protein, 19 aa, Mycobacterium
IVVVRILGGYRAWQGGIDT

SEQ ID NO: 682352 - protein, 18 aa, Mycobacterium
IVVYAHGGGFVFCDLDSH

SEQ ID NO: 682353 - protein, 18 aa, Mycobacterium
IVYDPEWAAGHLSIPRAN

SEQ ID NO: 682354 - protein, 23 aa, Mycobacterium
IVYFLRKVIWSVPDFTVQRYRDR

SEQ ID NO: 682355 - protein, 17 aa, Mycobacterium
IVYGAGLPPELAAEITA

SEQ ID NO: 682356 - protein, 17 aa, Mycobacterium
IVYQFSFAKNPNWSRTF

SEQ ID NO: 682357 - protein, 21 aa, Mycobacterium
IWAAECVFVPLNFKLHPREME

SEQ ID NO: 682358 - protein, 18 aa, Mycobacterium
IWAGLAMVLARIGLGPLR

SEQ ID NO: 682359 - protein, 19 aa, Mycobacterium
IWAPNSVEWIVAAFGLLTA

SEQ ID NO: 682360 - protein, 21 aa, Mycobacterium
IWAVGPPRADIHVMVRGDHRA

SEQ ID NO: 682361 - protein, 17 aa, Mycobacterium
IWDDIGPRIERVLSTGV

SEQ ID NO: 682362 - protein, 19 aa, Mycobacterium
IWDRIQPYMAIYASAMHDF

SEQ ID NO: 682363 - protein, 21 aa, Mycobacterium
IWEGELPDWLVSTSERKSPAH

SEQ ID NO: 682364 - protein, 25 aa, Mycobacterium
IWEPKTEKVRRLFAAADIHIPTQDD

SEQ ID NO: 682365 - protein, 25 aa, Mycobacterium
IWERLSVDVLDLWDNVRAHLDENLG

SEQ ID NO: 682366 - protein, 19 aa, Mycobacterium
IWFGGHAPAALARAVRFGD

SEQ ID NO: 682367 - protein, 17 aa, Mycobacterium
IWFGGRAPKALARAVRH

SEQ ID NO: 682368 - protein, 19 aa, Mycobacterium
IWGALSGGGRLVVVPEALT

SEQ ID NO: 682369 - protein, 45 aa, Mycobacterium
IWHAVCWGIIIPAGWWRTRDAALYRYLWRSVLEFDGATRFRARLA

SEQ ID NO: 682370 - protein, 17 aa, Mycobacterium
IWHEGWFANTIHAATPA

SEQ ID NO: 682371 - protein, 18 aa, Mycobacterium
IWHSINLPNLLENILPTR

SEQ ID NO: 682372 - protein, 26 aa, Mycobacterium
IWIHPAHRKHGFGTAALRASRSEMAA

SEQ ID NO: 682373 - protein, 19 aa, Mycobacterium
IWLEPSLDGVVLHYFLHAE

SEQ ID NO: 682374 - protein, 29 aa, Mycobacterium
IWLHRINHWLWLRGARLIARITAEITRIL

SEQ ID NO: 682375 - protein, 18 aa, Mycobacterium
IWLTARWGAHTRRGGRTW

SEQ ID NO: 682376 - protein, 20 aa, Mycobacterium
IWPGGAPDYATWRQAVLDAE

SEQ ID NO: 682377 - protein, 21 aa, Mycobacterium
IWPRRRRIPLRCHDGAARWVT

SEQ ID NO: 682378 - protein, 18 aa, Mycobacterium
IWRDVPGVRGAYPPVTYQ

SEQ ID NO: 682379 - protein, 17 aa, Mycobacterium
IWRRMAAAGDIYLDTYS

SEQ ID NO: 682380 - protein, 18 aa, Mycobacterium
IWRSNERFFRAGGSGEWQ

SEQ ID NO: 682381 - protein, 21 aa, Mycobacterium
IWRVESGRGVFRTEAANADGS

SEQ ID NO: 682382 - protein, 17 aa, Mycobacterium
IWTPEFTDLATASPSPH

SEQ ID NO: 682383 - protein, 18 aa, Mycobacterium
IWTRKKLNPSVLRALTWL

SEQ ID NO: 682384 - protein, 21 aa, Mycobacterium
IWTRRGVPLDDDWASPLPKEV

SEQ ID NO: 682385 - protein, 24 aa, Mycobacterium
IWTSVGHLANWIFALCRTDMDAPK

SEQ ID NO: 682386 - protein, 18 aa, Mycobacterium
IWVFKQLWDKGLAYEGNR

SEQ ID NO: 682387 - protein, 28 aa, Mycobacterium
IWVMPKLDFPFGRAAQRLFAKVPATQQF

SEQ ID NO: 682388 - protein, 18 aa, Mycobacterium
IWVMRRTTIAFIYTTFFE

SEQ ID NO: 682389 - protein, 19 aa, Mycobacterium
IWVSVLTRLRRDLPEEEAR

SEQ ID NO: 682390 - protein, 21 aa, Mycobacterium
IWWAAEHGVPVYAHNAELGNV

SEQ ID NO: 682391 - protein, 19 aa, Mycobacterium
IWWERAVGVWPDYAEYQKK

SEQ ID NO: 682392 - protein, 19 aa, Mycobacterium
IWWKNLSPNGGDKPTGDLA

SEQ ID NO: 682393 - protein, 19 aa, Mycobacterium
IWWKNLSPNGGDKPTGELA

SEQ ID NO: 682394 - protein, 20 aa, Mycobacterium
IWWQIYPLGFVGAHPADPPP

SEQ ID NO: 682395 - protein, 17 aa, Mycobacterium
IWYPMVYDMPARAKQAF

SEQ ID NO: 682396 - protein, 26 aa, Mycobacterium
IWYPRLPALDLWLRLYDGAARANGGE

SEQ ID NO: 682397 - protein, 19 aa, Mycobacterium
IYAAIRAGGGLAISDEVQV

SEQ ID NO: 682398 - protein, 17 aa, Mycobacterium
IYAESFRGPEHLAEVQD

SEQ ID NO: 682399 - protein, 17 aa, Mycobacterium
IYAESFRGPEHLAEVQK

SEQ ID NO: 682400 - protein, 17 aa, Mycobacterium
IYAEVLDAFAGNKVVIR

SEQ ID NO: 682401 - protein, 17 aa, Mycobacterium
IYAGGAMMRRAGYMYGS

SEQ ID NO: 682402 - protein, 19 aa, Mycobacterium
IYAGGGLHPLPARTVNGIP

SEQ ID NO: 682403 - protein, 22 aa, Mycobacterium
IYAKQVAVAPQFGDYQRKTTRV

SEQ ID NO: 682404 - protein, 17 aa, Mycobacterium
IYAKRIQQALDFEGDDV

SEQ ID NO: 682405 - protein, 31 aa, Mycobacterium
IYALPSYFMAAGTPLYAMSSILGMAQTAQGL

SEQ ID NO: 682406 - protein, 23 aa, Mycobacterium
IYAWPKPRLALNVVGSGRGGGSE

SEQ ID NO: 682407 - protein, 17 aa, Mycobacterium
IYCAPEVLDCLASGTDR

SEQ ID NO: 682408 - protein, 31 aa, Mycobacterium
IYCLPKPDFSIPSWAATVMRLVPGAQLMTRT

SEQ ID NO: 682409 - protein, 25 aa, Mycobacterium
IYCRPSCPVRPPLARNLRFYPTAAA

SEQ ID NO: 682410 - protein, 25 aa, Mycobacterium
IYCRPSCPVRPPYARNMRFYPTAAA

SEQ ID NO: 682411 - protein, 25 aa, Mycobacterium
IYDDTRLALFTLRRNLTFHAVDLAL

SEQ ID NO: 682412 - protein, 17 aa, Mycobacterium
IYDEALVGWSRLEVPAK

SEQ ID NO: 682413 - protein, 19 aa, Mycobacterium
IYDKLPIAPWLPDRLWGGL

SEQ ID NO: 682414 - protein, 23 aa, Mycobacterium
IYDLLPGYLVFRALVSARPPTLK

SEQ ID NO: 682415 - protein, 22 aa, Mycobacterium
IYDPPMRTMIALGARYPTTAIP

SEQ ID NO: 682416 - protein, 26 aa, Mycobacterium
IYDVNFKGVWLALAAEIAAIRATSKT

SEQ ID NO: 682417 - protein, 29 aa, Mycobacterium
IYDVVRWAAGPHPDWDGARLCVGGQSAGG

SEQ ID NO: 682418 - protein, 23 aa, Mycobacterium
IYEHCRRIGKHYGLYDSAIFGTQ

SEQ ID NO: 682419 - protein, 23 aa, Mycobacterium
IYEHCRRIGKHYGLYDSAIFSTQ

SEQ ID NO: 682420 - protein, 24 aa, Mycobacterium
IYEPPRFFEAFLRGRAHTEPPDLT

SEQ ID NO: 682421 - protein, 25 aa, Mycobacterium
IYERAWRPMFTRGFSYGGKSTLKAH

SEQ ID NO: 682422 - protein, 19 aa, Mycobacterium
IYERPTSRFAATFVGSRNA

SEQ ID NO: 682423 - protein, 19 aa, Mycobacterium
IYERWRQRVPGGLVRPPVF

SEQ ID NO: 682424 - protein, 18 aa, Mycobacterium
IYETSSADQVRWVLQDSA

SEQ ID NO: 682425 - protein, 20 aa, Mycobacterium
IYFCDPYKPWQRGTNENTNG

SEQ ID NO: 682426 - protein, 17 aa, Mycobacterium
IYGAFDIPGARLARAGV

SEQ ID NO: 682427 - protein, 18 aa, Mycobacterium
IYGAGTAFAHRIADVDPV

SEQ ID NO: 682428 - protein, 27 aa, Mycobacterium
IYGDPRIPHALYRPTFVKSLVMVPIRK

SEQ ID NO: 682429 - protein, 17 aa, Mycobacterium
IYGEVLDAFSGAKVVIR

SEQ ID NO: 682430 - protein, 29 aa, Mycobacterium
IYGGMKLDLLLSVPWDYYKKFMSVNQDGA

SEQ ID NO: 682431 - protein, 26 aa, Mycobacterium
IYGGMKLDLLLTVPLDYYKKFMSVNH

SEQ ID NO: 682432 - protein, 29 aa, Mycobacterium
IYGGMKLDLLLTVPWDYYRKFMSVNHDGA

SEQ ID NO: 682433 - protein, 17 aa, Mycobacterium
IYGGSVAEAVRYGARPV

SEQ ID NO: 682434 - protein, 23 aa, Mycobacterium
IYGKSRYDYLVTMCDEMGIVTPE

SEQ ID NO: 682435 - protein, 18 aa, Mycobacterium
IYGNLLGLLPAELDELRA

SEQ ID NO: 682436 - protein, 17 aa, Mycobacterium
IYHDGWFAGAVGPRLPW

SEQ ID NO: 682437 - protein, 18 aa, Mycobacterium
IYHREWWDRYVDVNRRFA

SEQ ID NO: 682438 - protein, 17 aa, Mycobacterium
IYKLGVVSIPTNRPMVR

SEQ ID NO: 682439 - protein, 29 aa, Mycobacterium
IYKVGLASVRFLLAVGDLLIGWRLLVQAG

SEQ ID NO: 682440 - protein, 36 aa, Mycobacterium
IYKVGLASVRYLLAVGDLIIGWRLLVQAGVAHAALA

SEQ ID NO: 682441 - protein, 23 aa, Mycobacterium
IYKVGLGSVRFLMAVGDLLSGWL

SEQ ID NO: 682442 - protein, 21 aa, Mycobacterium
IYKWWPSKGALALDGYFRKVE

SEQ ID NO: 682443 - protein, 27 aa, Mycobacterium
IYLEDLFVRPGFRRRGLARALLAALAN

SEQ ID NO: 682444 - protein, 29 aa, Mycobacterium
IYLEEVFLFPPLRDAGIVMPIFVMMREHG

SEQ ID NO: 682445 - protein, 23 aa, Mycobacterium
IYLQHGFGAIGWFYEPLAVQLAQ

SEQ ID NO: 682446 - protein, 17 aa, Mycobacterium
IYLQKAGQWLDFDHWPP

SEQ ID NO: 682447 - protein, 17 aa, Mycobacterium
IYLSLPGLGVILGARVL

SEQ ID NO: 682448 - protein, 17 aa, Mycobacterium
IYLSTLFFHGFIDRGLN

SEQ ID NO: 682449 - protein, 17 aa, Mycobacterium
IYLTDLLPRHGVRRIAV

SEQ ID NO: 682450 - protein, 29 aa, Mycobacterium
IYLYWPSKLELFGAVFTRDGVAMLTAAAD

SEQ ID NO: 682451 - protein, 20 aa, Mycobacterium
IYNKHMIFPKAGVDLSNPEN

SEQ ID NO: 682452 - protein, 24 aa, Mycobacterium
IYNKHMIFPKPGVDLSNPDNFASI

SEQ ID NO: 682453 - protein, 24 aa, Mycobacterium
IYNKHMIFPKPGVDLSNPDSFASI

SEQ ID NO: 682454 - protein, 29 aa, Mycobacterium
IYNPLRFLKAGLTWCRKAQALGTLDEDAA

SEQ ID NO: 682455 - protein, 26 aa, Mycobacterium
IYNPLRFVSAAVKWCRKAEELGTLPD

SEQ ID NO: 682456 - protein, 20 aa, Mycobacterium
IYPIPELIAHLSRYQTLQPG

SEQ ID NO: 682457 - protein, 17 aa, Mycobacterium
IYPPPSAYEAWFVSTAL

SEQ ID NO: 682458 - protein, 23 aa, Mycobacterium
IYPQEIENALALHPAVLDVAVIG

SEQ ID NO: 682459 - protein, 24 aa, Mycobacterium
IYPRESLWRPPVLTMSAVEGTGLP

SEQ ID NO: 682460 - protein, 24 aa, Mycobacterium
IYPRETLWRPPVLTMSALTGAGLS

SEQ ID NO: 682461 - protein, 25 aa, Mycobacterium
IYQGIPYYGRWLWAVARVLIEKHHI

SEQ ID NO: 682462 - protein, 20 aa, Mycobacterium
IYQPLPVEVFDAADIGRALE

SEQ ID NO: 682463 - protein, 24 aa, Mycobacterium
IYRALRPGGVLLMVDVKASSRLED

SEQ ID NO: 682464 - protein, 20 aa, Mycobacterium
IYRAVLALLMLTGSMGRNGG

SEQ ID NO: 682465 - protein, 19 aa, Mycobacterium
IYRIDHFLGKEAVQNILAL

SEQ ID NO: 682466 - protein, 22 aa, Mycobacterium
IYRLKPRKELPAFGDAPETEQQ

SEQ ID NO: 682467 - protein, 18 aa, Mycobacterium
IYRNPWMVLREDDIRRPD

SEQ ID NO: 682468 - protein, 18 aa, Mycobacterium
IYRQSFATIRAEADLARF

SEQ ID NO: 682469 - protein, 18 aa, Mycobacterium
IYRQSFATIRAEADLSRF

SEQ ID NO: 682470 - protein, 20 aa, Mycobacterium
IYRTRFGALLTAAADRRHAL

SEQ ID NO: 682471 - protein, 20 aa, Mycobacterium
IYRWTWNAPTATAFVGVPTN

SEQ ID NO: 682472 - protein, 25 aa, Mycobacterium
IYSDGRYSYQLTIYVFRYEEGTAMA

SEQ ID NO: 682473 - protein, 18 aa, Mycobacterium
IYSFSYDQKTTWSKFFTP

SEQ ID NO: 682474 - protein, 19 aa, Mycobacterium
IYSGVRLRRGEYISERDPQ

SEQ ID NO: 682475 - protein, 18 aa, Mycobacterium
IYSNYGFAVLAHAVEAGA

SEQ ID NO: 682476 - protein, 21 aa, Mycobacterium
IYTEGRLDVVLAVSIEDGKVE

SEQ ID NO: 682477 - protein, 33 aa, Mycobacterium
IYTKRMQRALGYEGVDVITIFKGMQLDIGAPPQ

SEQ ID NO: 682478 - protein, 18 aa, Mycobacterium
IYTMPPYICDEGEIRRIT

SEQ ID NO: 682479 - protein, 27 aa, Mycobacterium
IYTSLDIRALYLFKRTMWLPYSIAMKQ

SEQ ID NO: 682480 - protein, 27 aa, Mycobacterium
IYTSPDIRALYAFKRLAWWPYSVAMRQ

SEQ ID NO: 682481 - protein, 17 aa, Mycobacterium
IYTSTACLIGLKFRNQL

SEQ ID NO: 682482 - protein, 19 aa, Mycobacterium
IYTYHSKTLGWCDIAYNAL

SEQ ID NO: 682483 - protein, 23 aa, Mycobacterium
IYVAGRLWGFIAIGSVTGPLPAD

SEQ ID NO: 682484 - protein, 24 aa, Mycobacterium
IYVEPRYFLYGGFGQHKTSPRTVA

SEQ ID NO: 682485 - protein, 20 aa, Mycobacterium
IYVHVPFCVTRCGYCDFNTY

SEQ ID NO: 682486 - protein, 17 aa, Mycobacterium
IYVKDGIITWETQETDY

SEQ ID NO: 682487 - protein, 18 aa, Mycobacterium
IYVNRRAQVVAAKLSSQP

SEQ ID NO: 682488 - protein, 23 aa, Mycobacterium
IYVRSGRPEFVFHDGEQEVRIAT

SEQ ID NO: 682489 - protein, 17 aa, Mycobacterium
IYYEGGHSFQYLKDDAK

SEQ ID NO: 682490 - protein, 22 aa, Mycobacterium
IYYNEKYDFWALSRHSDVERGL

SEQ ID NO: 682491 - protein, 20 aa, Mycobacterium
IYYPDCADVGIGAAAEIRGR

SEQ ID NO: 682492 - protein, 17 aa, Mycobacterium
KAAAAALADWMETEEGQ

SEQ ID NO: 682493 - protein, 30 aa, Mycobacterium; identical to SEQ ID NO: 81347

SEQ ID NO: 682494 - protein, 30 aa, Mycobacterium
KAAAAGRPWWEWAATYERAFTAAYDALDVM

SEQ ID NO: 682495 - protein, 21 aa, Mycobacterium
KAAAAMPAKVLGYVAGGAGDE

SEQ ID NO: 682496 - protein, 21 aa, Mycobacterium
KAAADELMKTGGTIVTIGSQI

SEQ ID NO: 682497 - protein, 25 aa, Mycobacterium
KAAAEEFRFHIGLAQLAGNALLDLF

SEQ ID NO: 682498 - protein, 17 aa, Mycobacterium
KAAAHGRTLRFGIRLHV

SEQ ID NO: 682499 - protein, 18 aa, Mycobacterium
KAAALPIYVHAPYLINLA

SEQ ID NO: 682500 - protein, 18 aa, Mycobacterium
KAAAPKYAAAGIRAIDLT

SEQ ID NO: 682501 - protein, 19 aa, Mycobacterium
KAAAPKYAEAGIRAIDLTP

SEQ ID NO: 682502 - protein, 30 aa, Mycobacterium
KAADAGRPWWEWAATFERAFSAAYDALGVL

SEQ ID NO: 682503 - protein, 29 aa, Mycobacterium
KAADAGRPWWEWAATYERAFDEAYESLGV

SEQ ID NO: 682504 - protein, 30 aa, Mycobacterium
KAADAGRPWWEWAATYERAFTAAYDALGVL

SEQ ID NO: 682505 - protein, 20 aa, Mycobacterium
KAADALLDLGVELAIVKQGP

SEQ ID NO: 682506 - protein, 18 aa, Mycobacterium
KAADELFKVLGELKGGAM

SEQ ID NO: 682507 - protein, 26 aa, Mycobacterium
KAADFLTLCESFRLPVISLCDTPGFM

SEQ ID NO: 682508 - protein, 20 aa, Mycobacterium
KAADGVAVAAARTWDVDGSI

SEQ ID NO: 682509 - protein, 20 aa, Mycobacterium
KAADVFAEFGENIEMLKKLV

SEQ ID NO: 682510 - protein, 17 aa, Mycobacterium
KAADVGGTWYWNRYPGI

SEQ ID NO: 682511 - protein, 17 aa, Mycobacterium
KAADVRANFTIKGITAE

SEQ ID NO: 682512 - protein, 21 aa, Mycobacterium
KAAEALAGYRVHTGIGGTGVI

SEQ ID NO: 682513 - protein, 17 aa, Mycobacterium
KAAEFGQEVIRQFTQDI

SEQ ID NO: 682514 - protein, 20 aa, Mycobacterium
KAAEVARLLAAPPRAGLGGI

SEQ ID NO: 682515 - protein, 19 aa, Mycobacterium
KAAFDVTVVAPAHWEVISN

SEQ ID NO: 682516 - protein, 17 aa, Mycobacterium
KAAFEMLVTGEFVSADD

SEQ ID NO: 682517 - protein, 17 aa, Mycobacterium
KAAFLQRYSGPRRALAV

SEQ ID NO: 682518 - protein, 19 aa, Mycobacterium
KAAGIEFPGWDATTSYLLA

SEQ ID NO: 682519 - protein, 27 aa, Mycobacterium
KAAGLRCLLAYMWAHPGKQLLFMGQEF

SEQ ID NO: 682520 - protein, 25 aa, Mycobacterium
KAAGLRSLLAYQWAHPGKQLLFMGQ

SEQ ID NO: 682521 - protein, 20 aa, Mycobacterium
KAAGVQRIYGLPGDSLNGFT

SEQ ID NO: 682522 - protein, 19 aa, Mycobacterium
KAAHLRAVARAEFGRRGYE

SEQ ID NO: 682523 - protein, 21 aa, Mycobacterium
KAAHSIDAWLRGASEAPPPKH

SEQ ID NO: 682524 - protein, 17 aa, Mycobacterium
KAAIATFIKHGYDGASM

SEQ ID NO: 682525 - protein, 21 aa, Mycobacterium
KAAICGSDLHLYHGMMPDTRV

SEQ ID NO: 682526 - protein, 19 aa, Mycobacterium
KAAIGVMERVGLDPKLADR

SEQ ID NO: 682527 - protein, 20 aa, Mycobacterium
KAAIIHYTQGLAFKYAGQGV

SEQ ID NO: 682528 - protein, 19 aa, Mycobacterium
KAAIKAASDRVVFINTGFL

SEQ ID NO: 682529 - protein, 24 aa, Mycobacterium
KAAKAPPERRAPAPEAKAHQAAQA

SEQ ID NO: 682530 - protein, 18 aa, Mycobacterium
KAALAAVELCREIGNSVP

SEQ ID NO: 682531 - protein, 24 aa, Mycobacterium
KAALPQALAVFLAPPSWEALVDRL

SEQ ID NO: 682532 - protein, 21 aa, Mycobacterium
KAALVGGMSVPQGWTEAAPAI

SEQ ID NO: 682533 - protein, 21 aa, Mycobacterium
KAALWELIWAGRVCGDTFAPV

SEQ ID NO: 682534 - protein, 25 aa, Mycobacterium
KAAMFRFGCVCGGASLYAPQAHNNI

SEQ ID NO: 682535 - protein, 28 aa, Mycobacterium
KAAMGVFPRREFGRLATHVGVAGVSGAL

SEQ ID NO: 682536 - protein, 30 aa, Mycobacterium
KAAMLRAQRRIMLIGWDLDYRTTFEPAGAT

SEQ ID NO: 682537 - protein, 18 aa, Mycobacterium
KAAMQYFTQAFVLRDKNP

SEQ ID NO: 682538 - protein, 17 aa, Mycobacterium
KAAMQYFTQAFVLREKN

SEQ ID NO: 682539 - protein, 24 aa, Mycobacterium
KAANAPIRIEFEALQSEFVKQGMA

SEQ ID NO: 682540 - protein, 24 aa, Mycobacterium
KAAPDQWPALTAPPATAAPADSAA

SEQ ID NO: 682541 - protein, 18 aa, Mycobacterium
KAAPKPLDVMAALREPGI

SEQ ID NO: 682542 - protein, 17 aa, Mycobacterium
KAAPLPVGQRVAALSAA

SEQ ID NO: 682543 - protein, 18 aa, Mycobacterium
KAAPPLERLGEPADIAEI

SEQ ID NO: 682544 - protein, 25 aa, Mycobacterium
KAAQTRKSFAESVKGKAKELAGAVT

SEQ ID NO: 682545 - protein, 22 aa, Mycobacterium
KAARAAKNFTSFNWIGFSVFRD

SEQ ID NO: 682546 - protein, 17 aa, Mycobacterium
KAARAKLQIGRSGRHIA

SEQ ID NO: 682547 - protein, 19 aa, Mycobacterium
KAARAYAKLLTQITGSEPT

SEQ ID NO: 682548 - protein, 31 aa, Mycobacterium
KAARFVRFCDAFKIPLVFVVDTPGFLPGAEQ

SEQ ID NO: 682549 - protein, 17 aa, Mycobacterium
KAARFVRFCDSFNTPLV

SEQ ID NO: 682550 - protein, 18 aa, Mycobacterium
KAARFVRTCDCFNIPIIM

SEQ ID NO: 682551 - protein, 19 aa, Mycobacterium
KAARFVRTCDCFNIPIVMF

SEQ ID NO: 682552 - protein, 26 aa, Mycobacterium
KAARRRAVELLELVGIAQPERRARAF

SEQ ID NO: 682553 - protein, 17 aa, Mycobacterium
KAARVASDITLKAVEMA

SEQ ID NO: 682554 - protein, 23 aa, Mycobacterium
KAASVIMEFAEKYGISMPIAREV

SEQ ID NO: 682555 - protein, 17 aa, Mycobacterium
KAATLLEHAQRVAEGRL

SEQ ID NO: 682556 - protein, 18 aa, Mycobacterium
KAATTVGCQYCIDLGSQI

SEQ ID NO: 682557 - protein, 17 aa, Mycobacterium
KAAVIAYRNKAYSRMGE

SEQ ID NO: 682558 - protein, 17 aa, Mycobacterium
KAAVICRHCPVILECGA

SEQ ID NO: 682559 - protein, 20 aa, Mycobacterium
KAAVIHLTKAMAVEFAPHNI

SEQ ID NO: 682560 - protein, 21 aa, Mycobacterium
KAAVVPRPVAWTSTVSPDGIP

SEQ ID NO: 682561 - protein, 26 aa, Mycobacterium
KAAVYLADCRRLGITVLPPDVNESEH

SEQ ID NO: 682562 - protein, 27 aa, Mycobacterium
KAAVYLADCRRLGITVLPPDVNESVHN

SEQ ID NO: 682563 - protein, 18 aa, Mycobacterium
KAAYGTTLVTGFARIHGH

SEQ ID NO: 682564 - protein, 18 aa, Mycobacterium
KAAYQVLERVGLSPRVAT

SEQ ID NO: 682565 - protein, 19 aa, Mycobacterium
KACDKRGAQALAPTRAAQD

SEQ ID NO: 682566 - protein, 17 aa, Mycobacterium
KACPWLGDHKVFGQAIM

SEQ ID NO: 682567 - protein, 21 aa, Mycobacterium
KADAIGVNFIDTYFRSGLYPR

SEQ ID NO: 682568 - protein, 18 aa, Mycobacterium
KADALVCISNCDKITPGM

SEQ ID NO: 682569 - protein, 19 aa, Mycobacterium
KADCPNVQLIFARGTAEPP

SEQ ID NO: 682570 - protein, 21 aa, Mycobacterium
KADCRAAALAEVAVAGLAGLT

SEQ ID NO: 682571 - protein, 26 aa, Mycobacterium
KADFGTRKCRIYGHGEVDVAIIEVEL

SEQ ID NO: 682572 - protein, 31 aa, Mycobacterium; identical to SEQ ID NO: 81351

SEQ ID NO: 682573 - protein, 18 aa, Mycobacterium
KADGAWHLHELTRGLDLS

SEQ ID NO: 682574 - protein, 19 aa, Mycobacterium
KADGIGWLILDRPEAGNAF

SEQ ID NO: 682575 - protein, 20 aa, Mycobacterium
KADIGIRDGRVCAIGKAGNP

SEQ ID NO: 682576 - protein, 20 aa, Mycobacterium
KADILRNVWDAHYHGPDNVV

SEQ ID NO: 682577 - protein, 23 aa, Mycobacterium
KADIRPGFTGQLTAKVQRIDDAL

SEQ ID NO: 682578 - protein, 18 aa, Mycobacterium
KADLAAVQCFFRTPTTHS

SEQ ID NO: 682579 - protein, 22 aa, Mycobacterium
KADLTYGSWDWRRYAEVPVAEL

SEQ ID NO: 682580 - protein, 25 aa, Mycobacterium
KADNSELGWRMEVEHDGDWHFFDDS

SEQ ID NO: 682581 - protein, 28 aa, Mycobacterium
KADNSELGWRMEVEHDGEWSFFDDTEGT

SEQ ID NO: 682582 - protein, 22 aa, Mycobacterium
KADPAVRLRIGGQWRSGTAHLL

SEQ ID NO: 682583 - protein, 26 aa, Mycobacterium
KADPVNPMRVVWELSSRLPEYAMVAG

SEQ ID NO: 682584 - protein, 24 aa, Mycobacterium
KADRKAAAASAAWESEQRAVEALP

SEQ ID NO: 682585 - protein, 23 aa, Mycobacterium
KADSYKAYLMCFGSTGMFEQDDV

SEQ ID NO: 682586 - protein, 19 aa, Mycobacterium
KADTRRALSDAALRLAFER

SEQ ID NO: 682587 - protein, 20 aa, Mycobacterium
KADVLASALPWLKQLHGKIV

SEQ ID NO: 682588 - protein, 21 aa, Mycobacterium
KADVLLAHLVLRPFLDAYHIV

SEQ ID NO: 682589 - protein, 30 aa, Mycobacterium
KADYDEWARRAGPQWSYTEVLGYFRRIENV

SEQ ID NO: 682590 - protein, 17 aa, Mycobacterium
KAEAAGFDVVLVPDHLG

SEQ ID NO: 682591 - protein, 17 aa, Mycobacterium
KAEAVCLLDRVGLGNRA

SEQ ID NO: 682592 - protein, 23 aa, Mycobacterium
KAEGHKWAMLTAYDYSTARIFDE

SEQ ID NO: 682593 - protein, 23 aa, Mycobacterium
KAEGHKWAMLTAYDYSTARVFDD

SEQ ID NO: 682594 - protein, 26 aa, Mycobacterium
KAEGHKWAMLTVYDYSTARAFDDAGI

SEQ ID NO: 682595 - protein, 26 aa, Mycobacterium
KAEGHKWSMLTAYDYSTARVFNDAGI

SEQ ID NO: 682596 - protein, 20 aa, Mycobacterium
KAELFRAVFEDVENDLTLRS

SEQ ID NO: 682597 - protein, 30 aa, Mycobacterium
KAELFRSAVGWPFEPVEIGGRIVSGERDEI

SEQ ID NO: 682598 - protein, 21 aa, Mycobacterium
KAEQWRPDAVLQNARELADIC

SEQ ID NO: 682599 - protein, 19 aa, Mycobacterium
KAERRRLRITTGNAQELYF

SEQ ID NO: 682600 - protein, 17 aa, Mycobacterium
KAESFAHAETYNFVEYD

SEQ ID NO: 682601 - protein, 17 aa, Mycobacterium
KAESILINCHYPVTQDS

SEQ ID NO: 682602 - protein, 18 aa, Mycobacterium
KAESLALPMVYVNVPEMT

SEQ ID NO: 682603 - protein, 29 aa, Mycobacterium
KAEYFTGTGLKGWINRWFYSVSGQVPIDR

SEQ ID NO: 682604 - protein, 24 aa, Mycobacterium
KAFADRGIAAPWSHQFAAAELAYA

SEQ ID NO: 682605 - protein, 17 aa, Mycobacterium
KAFGAWAATSPRERSEI

SEQ ID NO: 682606 - protein, 18 aa, Mycobacterium
KAFGRIALDAVYLDIKAL

SEQ ID NO: 682607 - protein, 28 aa, Mycobacterium
KAFHHDIGYRIAHHADLNAPPAVEVHEY

SEQ ID NO: 682608 - protein, 18 aa, Mycobacterium
KAFQDWLAGRPKQWRDGV

SEQ ID NO: 682609 - protein, 18 aa, Mycobacterium
KAFQKMSRTNWGMLIRDS

SEQ ID NO: 682610 - protein, 19 aa, Mycobacterium
KAFQRFLVKGTENLVFNEA

SEQ ID NO: 682611 - protein, 18 aa, Mycobacterium
KAFRPGRPPFPVMHVDTG

SEQ ID NO: 682612 - protein, 17 aa, Mycobacterium
KAFRPSSLVNISGMSYG

SEQ ID NO: 682613 - protein, 24 aa, Mycobacterium
KAFSAVCTHTGCLVNKVADGTIDC

SEQ ID NO: 682614 - protein, 20 aa, Mycobacterium
KAFSRLFAESLWLELRDHGV

SEQ ID NO: 682615 - protein, 20 aa, Mycobacterium
KAFSRLFAESLWLELREHGV

SEQ ID NO: 682616 - protein, 23 aa, Mycobacterium
KAFSRLFAESLWLELRETGVDVL

SEQ ID NO: 682617 - protein, 19 aa, Mycobacterium
KAFTELRQLLAVHETAEEM

SEQ ID NO: 682618 - protein, 22 aa, Mycobacterium
KAFYSALFGWTLQEAGPEYGGY

SEQ ID NO: 682619 - protein, 29 aa, Mycobacterium
KAGADVLPWWPVLGVVLLLERETHRNDGL

SEQ ID NO: 682620 - protein, 18 aa, Mycobacterium
KAGAILVNVNYRYVEGEL

SEQ ID NO: 682621 - protein, 31 aa, Mycobacterium
KAGALRLAPGLKRSSLIGGIRYYDTVVDDAR

SEQ ID NO: 682622 - protein, 33 aa, Mycobacterium
KAGASGWCTAAPCLRPQPCIDLYEAVRANDLDT

SEQ ID NO: 682623 - protein, 21 aa, Mycobacterium
KAGASGWCTAAPNLRPQPCID

SEQ ID NO: 682624 - protein, 17 aa, Mycobacterium
KAGDWKPLAEFYTDDAT

SEQ ID NO: 682625 - protein, 18 aa, Mycobacterium
KAGDWKPLARFYTDDATY

SEQ ID NO: 682626 - protein, 24 aa, Mycobacterium
KAGEGDAFISAGVETVSRFAKGSA

SEQ ID NO: 682627 - protein, 21 aa, Mycobacterium
KAGELCERFDRLYLVRGAQVV

SEQ ID NO: 682628 - protein, 17 aa, Mycobacterium
KAGELLVSTSRKLDKAV

SEQ ID NO: 682629 - protein, 27 aa, Mycobacterium
KAGERLRLVKYLAYGWSSLRSRPALRD

SEQ ID NO: 682630 - protein, 20 aa, Mycobacterium
KAGEVLVRLAATGLCHSDEH

SEQ ID NO: 682631 - protein, 24 aa, Mycobacterium
KAGEYEVFSSIVLIRSRYDEPALE

SEQ ID NO: 682632 - protein, 26 aa, Mycobacterium
KAGFDGVELVKALLFSLFEGGLRHGL

SEQ ID NO: 682633 - protein, 28 aa, Mycobacterium
KAGFEPLPPRYKTGVLAKYTKLVQSAAV

SEQ ID NO: 682634 - protein, 24 aa, Mycobacterium
KAGGKCKVEVGGKCTAESLRIQPT

SEQ ID NO: 682635 - protein, 24 aa, Mycobacterium
KAGGKRFRPLFTVLSAQIGPNPDA

SEQ ID NO: 682636 - protein, 24 aa, Mycobacterium
KAGGKRFRPLFTVLSAQLGPNPDA

SEQ ID NO: 682637 - protein, 23 aa, Mycobacterium
KAGGLGVLGCVRFNDADDLEDVL

SEQ ID NO: 682638 - protein, 21 aa, Mycobacterium
KAGGLGVLGCVRFNDADDLEN

SEQ ID NO: 682639 - protein, 21 aa, Mycobacterium
KAGGRAVVMTYWNPVLRYGVD

SEQ ID NO: 682640 - protein, 21 aa, Mycobacterium
KAGIAGMCLTMARDLGSMGIR

SEQ ID NO: 682641 - protein, 23 aa, Mycobacterium
KAGIERKAIRVILGNPLIAITML

SEQ ID NO: 682642 - protein, 28 aa, Mycobacterium
KAGIICVTRNLAVKWAAKGIRVNAVAPG

SEQ ID NO: 682643 - protein, 18 aa, Mycobacterium
KAGIPLVVLGGKEYGSGS

SEQ ID NO: 682644 - protein, 19 aa, Mycobacterium
KAGKAGLVPAQLRDGHYSG

SEQ ID NO: 682645 - protein, 24 aa, Mycobacterium
KAGKAGLVPPHLRDGHYSGAAALG

SEQ ID NO: 682646 - protein, 24 aa, Mycobacterium
KAGKAGMVPPHLRDGHYSGAAALG

SEQ ID NO: 682647 - protein, 24 aa, Mycobacterium
KAGKHPGGIVGHEWHHKSSSDPQV

SEQ ID NO: 682648 - protein, 20 aa, Mycobacterium
KAGLERRFRGGPVPEEYTTR

SEQ ID NO: 682649 - protein, 21 aa, Mycobacterium
KAGLMGWGLTLSIWCSEWVPF

SEQ ID NO: 682650 - protein, 26 aa, Mycobacterium
KAGLPIAFMDCFRVTALRTAANTALI

SEQ ID NO: 682651 - protein, 18 aa, Mycobacterium
KAGLPPATYFAGGKIQWI

SEQ ID NO: 682652 - protein, 17 aa, Mycobacterium
KAGLPPATYFSGAKLQW

SEQ ID NO: 682653 - protein, 18 aa, Mycobacterium
KAGLPPQLIPSGITSIRV

SEQ ID NO: 682654 - protein, 18 aa, Mycobacterium
KAGLVTSFLRGATMLPVA

SEQ ID NO: 682655 - protein, 18 aa, Mycobacterium
KAGLWPYLEKLGFYLVGY

SEQ ID NO: 682656 - protein, 18 aa, Mycobacterium
KAGNQLMEFVGGRAIHPI

SEQ ID NO: 682657 - protein, 17 aa, Mycobacterium
KAGNRLMEFVGGRAIHP

SEQ ID NO: 682658 - protein, 26 aa, Mycobacterium
KAGPENTARYIARFNGANIIVSLLRD

SEQ ID NO: 682659 - protein, 22 aa, Mycobacterium
KAGQVPAHLRDGHYSGAQKLGN

SEQ ID NO: 682660 - protein, 23 aa, Mycobacterium
KAGRLRRRLPITAETADIITAWQ

SEQ ID NO: 682661 - protein, 24 aa, Mycobacterium
KAGRRRCVEEFSWAHVAEQTLEIY

SEQ ID NO: 682662 - protein, 17 aa, Mycobacterium
KAGRSVSDLAIIVPVMT

SEQ ID NO: 682663 - protein, 37 aa, Mycobacterium
KAGRWPRYRRGALKHTPIRSVLSFKLFRGSQTAGTLN

SEQ ID NO: 682664 - protein, 24 aa, Mycobacterium
KAGSVLNLLRWTSARTIKETFVPA

SEQ ID NO: 682665 - protein, 29 aa, Mycobacterium
KAGTGKSRRGRLAAGATLGALALTSGIAG

SEQ ID NO: 682666 - protein, 19 aa, Mycobacterium
KAGVDIVVACPGRLDDLLK

SEQ ID NO: 682667 - protein, 23 aa, Mycobacterium
KAHASGALHDWIQTGINAFGHLV

SEQ ID NO: 682668 - protein, 19 aa, Mycobacterium
KAHECDPLSAFGGVIAANT

SEQ ID NO: 682669 - protein, 18 aa, Mycobacterium
KAHGAGVIAMVHRAGAED

SEQ ID NO: 682670 - protein, 17 aa, Mycobacterium
KAHHTYVNIGFWSSVPV

SEQ ID NO: 682671 - protein, 21 aa, Mycobacterium
KAHLLQIARRLDIRGRSTMNK

SEQ ID NO: 682672 - protein, 25 aa, Mycobacterium
KAHLPADAWPPTSWYADWVSGLDVF

SEQ ID NO: 682673 - protein, 17 aa, Mycobacterium
KAHPSFNTVVALRNAQL

SEQ ID NO: 682674 - protein, 20 aa, Mycobacterium
KAHRVGGLLLLTGDQQQPGQ

SEQ ID NO: 682675 - protein, 19 aa, Mycobacterium
KAHVTTFYMAKQMGFMVID

SEQ ID NO: 682676 - protein, 19 aa, Mycobacterium
KAIAAGWIDGPRVIPAGHA

SEQ ID NO: 682677 - protein, 20 aa, Mycobacterium
KAIAALDGWATDALDYGGHD

SEQ ID NO: 682678 - protein, 20 aa, Mycobacterium
KAIAALDGWATDALEYGGHD

SEQ ID NO: 682679 - protein, 17 aa, Mycobacterium
KAIAAMHELDRTGALLT

SEQ ID NO: 682680 - protein, 20 aa, Mycobacterium
KAIADFSRWYAGDTDLSNPP

SEQ ID NO: 682681 - protein, 21 aa, Mycobacterium
KAIATEIGKPVMVKAQVKVGG

SEQ ID NO: 682682 - protein, 20 aa, Mycobacterium
KAIDAGWIEGPRIVPAGHAI

SEQ ID NO: 682683 - protein, 18 aa, Mycobacterium
KAIDDEYPGRVLLAEANQ

SEQ ID NO: 682684 - protein, 18 aa, Mycobacterium
KAIDDLVLIIGLIGVATV

SEQ ID NO: 682685 - protein, 20 aa, Mycobacterium
KAIEHWVPLLSKDVLTDLLA

SEQ ID NO: 682686 - protein, 25 aa, Mycobacterium
KAIEQRIAPMLGRLSTREQQRLAAL

SEQ ID NO: 682687 - protein, 27 aa, Mycobacterium
KAIEVSADWEKLATGFSKALDDFKRSF

SEQ ID NO: 682688 - protein, 25 aa, Mycobacterium
KAIHRSRGRFGFFGNVVLSNVPGPK

SEQ ID NO: 682689 - protein, 24 aa, Mycobacterium
KAIKSGARVHVHWADEPVGAITDI

SEQ ID NO: 682690 - protein, 22 aa, Mycobacterium
KAILHRMLRSFTWKVPENYHVR

SEQ ID NO: 682691 - protein, 29 aa, Mycobacterium
KAKALAPVRFFNPLSMRFAKKATIDDIRE

SEQ ID NO: 682692 - protein, 21 aa, Mycobacterium
KAKAMDLCLTGRSLTAEEAER

SEQ ID NO: 682693 - protein, 24 aa, Mycobacterium
KAKAQELGLSWLAEIGAHGVVAGP

SEQ ID NO: 682694 - protein, 17 aa, Mycobacterium
KAKDILRAARLEMLPKT

SEQ ID NO: 682695 - protein, 18 aa, Mycobacterium
KAKEGDGTIYGRIINTSS

SEQ ID NO: 682696 - protein, 18 aa, Mycobacterium
KAKEGLGKLTGDKGTENE

SEQ ID NO: 682697 - protein, 17 aa, Mycobacterium
KAKEILFTGRAMTADEV

SEQ ID NO: 682698 - protein, 19 aa, Mycobacterium
KAKELLAATLCTIHNERFI

SEQ ID NO: 682699 - protein, 19 aa, Mycobacterium
KAKGVRVGPILNHDNSEMQ

SEQ ID NO: 682700 - protein, 17 aa, Mycobacterium
KAKKLAIVYLTYKLADG

SEQ ID NO: 682701 - protein, 17 aa, Mycobacterium
KAKKLRVRLPLLKLTVA

SEQ ID NO: 682702 - protein, 23 aa, Mycobacterium
KAKKLRVRLPLPKLTVAVQDPDS

SEQ ID NO: 682703 - protein, 23 aa, Mycobacterium
KAKNRPVWVKGFGEHVPFKTPTY

SEQ ID NO: 682704 - protein, 30 aa, Mycobacterium
KAKPGQTLCSTWDLTDWRGKAIRIGFVART

SEQ ID NO: 682705 - protein, 23 aa, Mycobacterium
KAKQAWEEGRFDREISPIEAPAL

SEQ ID NO: 682706 - protein, 17 aa, Mycobacterium
KAKQWAFEGKWDGYRVI

SEQ ID NO: 682707 - protein, 19 aa, Mycobacterium
KAKQWRTVVKSGRTHLMDA

SEQ ID NO: 682708 - protein, 19 aa, Mycobacterium
KALAAALPMVTWLQTASTQ

SEQ ID NO: 682709 - protein, 20 aa, Mycobacterium
KALAAGRAWGERLQAPTTAH

SEQ ID NO: 682710 - protein, 20 aa, Mycobacterium
KALAALDGWSTDALEYGGHD

SEQ ID NO: 682711 - protein, 20 aa, Mycobacterium
KALADFLFDDEHAMVRIDMS

SEQ ID NO: 682712 - protein, 18 aa, Mycobacterium
KALADFVQRGWIEQRGRT

SEQ ID NO: 682713 - protein, 20 aa, Mycobacterium
KALAEFLFDDERAMVRIDMS

SEQ ID NO: 682714 - protein, 19 aa, Mycobacterium
KALAGGGGRGMRKVTGAGQ

SEQ ID NO: 682715 - protein, 20 aa, Mycobacterium
KALAGGGGRGMRPVRSADQI

SEQ ID NO: 682716 - protein, 19 aa, Mycobacterium
KALALGARAVMIGRAYLWG

SEQ ID NO: 682717 - protein, 31 aa, Mycobacterium
KALARGKRAVWVPWVIRPMAFTTRFVPQVLW

SEQ ID NO: 682718 - protein, 24 aa, Mycobacterium
KALASWLADPHVPKALHEAKLAIH

SEQ ID NO: 682719 - protein, 20 aa, Mycobacterium
KALAVREGPAALPWGDLGVD

SEQ ID NO: 682720 - protein, 22 aa, Mycobacterium
KALCAGCPIRVQCLTAALERQE

SEQ ID NO: 682721 - protein, 21 aa, Mycobacterium
KALDGRGAALIANHGLVAVGP

SEQ ID NO: 682722 - protein, 17 aa, Mycobacterium
KALDPAKYFIIVPNMLG

SEQ ID NO: 682723 - protein, 17 aa, Mycobacterium
KALDVYFNLANYRNNWK

SEQ ID NO: 682724 - protein, 22 aa, Mycobacterium
KALEEVLRFCRIDIPDEPLTYE

SEQ ID NO: 682725 - protein, 24 aa, Mycobacterium
KALEFRPKVIIAGWSAYPRILDFA

SEQ ID NO: 682726 - protein, 23 aa, Mycobacterium
KALEFRPKVIIAGWSAYPRVLDF

SEQ ID NO: 682727 - protein, 30 aa, Mycobacterium; identical to SEQ ID NO: 81363

SEQ ID NO: 682728 - protein, 33 aa, Mycobacterium
KALFTEWLGIWVPRCLDAALALQPIWSAPADKA

SEQ ID NO: 682729 - protein, 17 aa, Mycobacterium
KALGHAYGGGAQYFSMW

SEQ ID NO: 682730 - protein, 18 aa, Mycobacterium
KALGHAYGGGSQYFSMWV

SEQ ID NO: 682731 - protein, 17 aa, Mycobacterium
KALGVRHVVVVDIVASR

SEQ ID NO: 682732 - protein, 17 aa, Mycobacterium
KALGVYFNLANYRNNWK

SEQ ID NO: 682733 - protein, 17 aa, Mycobacterium
KALHARLDRPFDVDELT

SEQ ID NO: 682734 - protein, 20 aa, Mycobacterium
KALHEFFTPLLRNVGKSGRL

SEQ ID NO: 682735 - protein, 22 aa, Mycobacterium
KALKCPVLVQIADFDRFVPADS

SEQ ID NO: 682736 - protein, 19 aa, Mycobacterium
KALKSFRSGSVNVLVATDV

SEQ ID NO: 682737 - protein, 24 aa, Mycobacterium
KALLARIGDAFLAFPDGFTPHPRV

SEQ ID NO: 682738 - protein, 23 aa, Mycobacterium
KALLARIGDAFLALPEGFTAHPR

SEQ ID NO: 682739 - protein, 22 aa, Mycobacterium
KALLARTTRWGSYLTDIDAFDA

SEQ ID NO: 682740 - protein, 17 aa, Mycobacterium
KALLPDVERTAGTDVGH

SEQ ID NO: 682741 - protein, 23 aa, Mycobacterium
KALLRNAEIAHMFNKEAKTFGIS

SEQ ID NO: 682742 - protein, 17 aa, Mycobacterium
KALLSRIGDAFLALPEG

SEQ ID NO: 682743 - protein, 21 aa, Mycobacterium
KALMPDKPFFMYFAPGATHAP

SEQ ID NO: 682744 - protein, 19 aa, Mycobacterium
KALNAAMLFEIDDVIDPAE

SEQ ID NO: 682745 - protein, 18 aa, Mycobacterium
KALNYEGEDIFTLFKGLQ

SEQ ID NO: 682746 - protein, 17 aa, Mycobacterium
KALPEFREKLASSPLNL

SEQ ID NO: 682747 - protein, 19 aa, Mycobacterium
KALPSAGHIGVFDRSHYED

SEQ ID NO: 682748 - protein, 25 aa, Mycobacterium
KALQFLRGGGRWVLKSPQHLAQLPV

SEQ ID NO: 682749 - protein, 21 aa, Mycobacterium
KALQLHGGYGYLREYGLEKIV

SEQ ID NO: 682750 - protein, 23 aa, Mycobacterium
KALRDMRKHIAWYLHGFPAGGDI

SEQ ID NO: 682751 - protein, 31 aa, Mycobacterium
KALRGNGFRGMPMPWGLVTWQTADHPETLVV

SEQ ID NO: 682752 - protein, 21 aa, Mycobacterium
KALRGYSAWVTGLRRGETAAR

SEQ ID NO: 682753 - protein, 20 aa, Mycobacterium
KALRMACYTAGPMAATAADT

SEQ ID NO: 682754 - protein, 17 aa, Mycobacterium
KALRRIRQQYSDLMVRA

SEQ ID NO: 682755 - protein, 20 aa, Mycobacterium
KALRRKLGQELIRTVHGIGY

SEQ ID NO: 682756 - protein, 20 aa, Mycobacterium
KALRSGAVVLAFPGGDYDAF

SEQ ID NO: 682757 - protein, 20 aa, Mycobacterium
KALRVIDVVNPFALKCFYRA

SEQ ID NO: 682758 - protein, 23 aa, Mycobacterium
KALSDFAQRGWIRVQGKSILIDN

SEQ ID NO: 682759 - protein, 21 aa, Mycobacterium
KALSGEEWFGPASAMMLEAIT

SEQ ID NO: 682760 - protein, 25 aa, Mycobacterium
KALSLPSVRGLIVGRTLLYPPDDDV

SEQ ID NO: 682761 - protein, 24 aa, Mycobacterium
KALSQVGVPYEWGGTKPGVGLDCS

SEQ ID NO: 682762 - protein, 18 aa, Mycobacterium
KALSYKAYLMCFGSTGMF

SEQ ID NO: 682763 - protein, 18 aa, Mycobacterium
KALTDFPDQRAWLLEDFD

SEQ ID NO: 682764 - protein, 17 aa, Mycobacterium
KALTDICCTSSNAVDVV

SEQ ID NO: 682765 - protein, 19 aa, Mycobacterium
KALTGAPAVRTKLLYMYFP

SEQ ID NO: 682766 - protein, 18 aa, Mycobacterium
KALTGDWAKAMTERARRH

SEQ ID NO: 682767 - protein, 25 aa, Mycobacterium
KALTIGSLIREANRLAEFATTQLAP

SEQ ID NO: 682768 - protein, 18 aa, Mycobacterium
KALTLARTVGRVNPTAWV

SEQ ID NO: 682769 - protein, 24 aa, Mycobacterium
KALTRRGPHKVLRGDLAFAGVTGV

SEQ ID NO: 682770 - protein, 17 aa, Mycobacterium
KALVGKRPMTRVGRAVE

SEQ ID NO: 682771 - protein, 18 aa, Mycobacterium
KALVGKRPMTRVGRAVEK

SEQ ID NO: 682772 - protein, 24 aa, Mycobacterium
KALVPMTIDIVGRVAKVLAAAQEV

SEQ ID NO: 682773 - protein, 23 aa, Mycobacterium
KAMARPTLRHRVALRPEAELEGA

SEQ ID NO: 682774 - protein, 23 aa, Mycobacterium
KAMARPTLRHRVMLRPEAELEGA

SEQ ID NO: 682775 - protein, 25 aa, Mycobacterium
KAMDRKVYLPSGGTLVIDRTEAMTV

SEQ ID NO: 682776 - protein, 27 aa, Mycobacterium
KAMYAAKAVPCWMVFDHGYVRRYVTGT

SEQ ID NO: 682777 - protein, 28 aa, Mycobacterium
KAMYANKAVPCWMVFDEGYIGRYVSGAN

SEQ ID NO: 682778 - protein, 22 aa, Mycobacterium
KANDVLLQICLDYIDRTFGAGS

SEQ ID NO: 682779 - protein, 20 aa, Mycobacterium
KANEVVEPWNLKLSHPDLLY

SEQ ID NO: 682780 - protein, 25 aa, Mycobacterium
KANIKRAWELMGMRVHWQSSNDLVA

SEQ ID NO: 682781 - protein, 18 aa, Mycobacterium
KANLTWTPQPAMPGQLRA

SEQ ID NO: 682782 - protein, 26 aa, Mycobacterium
KANPAVRVRIGGQWRTGTAHLLPEDD

SEQ ID NO: 682783 - protein, 26 aa, Mycobacterium
KANPAVRVRVGGTWRNGTAHLLPDDD

SEQ ID NO: 682784 - protein, 18 aa, Mycobacterium
KANRIRQITAKKTRESLQ

SEQ ID NO: 682785 - protein, 19 aa, Mycobacterium
KANVVGFGNVPSAATVIGS

SEQ ID NO: 682786 - protein, 17 aa, Mycobacterium
KAPAGITPHLLVMTATP

SEQ ID NO: 682787 - protein, 26 aa, Mycobacterium
KAPDVLLRAAALLPDVHVVIAGGPSG

SEQ ID NO: 682788 - protein, 19 aa, Mycobacterium
KAPEAFPSDPVEMVKSRIH

SEQ ID NO: 682789 - protein, 18 aa, Mycobacterium
KAPFEPLVPGGFRVPNTN

SEQ ID NO: 682790 - protein, 21 aa, Mycobacterium
KAPFGQRIHLALRPTDAPTAP

SEQ ID NO: 682791 - protein, 27 aa, Mycobacterium
KAPGVPMLFPPWLERLQLKYVNPVMTP

SEQ ID NO: 682792 - protein, 22 aa, Mycobacterium
KAPKDRDIAMVFQSYALYPHMT

SEQ ID NO: 682793 - protein, 21 aa, Mycobacterium
KAPKLKLALTAGIGSDHVDLD

SEQ ID NO: 682794 - protein, 24 aa, Mycobacterium
KAPLPVRLIRRLPLLARIPARLIG

SEQ ID NO: 682795 - protein, 20 aa, Mycobacterium
KAPLRPLAPVSHLAFDEPAK

SEQ ID NO: 682796 - protein, 17 aa, Mycobacterium
KAPRLVNRLARLPLTKR

SEQ ID NO: 682797 - protein, 17 aa, Mycobacterium
KAPRPAVHLDVPAGAAK

SEQ ID NO: 682798 - protein, 19 aa, Mycobacterium
KAPTTVLFLHGWTQNREAW

SEQ ID NO: 682799 - protein, 24 aa, Mycobacterium
KAQIADWAICLARTNPDVPKHKGI

SEQ ID NO: 682800 - protein, 19 aa, Mycobacterium
KAQIGKGMWAMTDLMADMV

SEQ ID NO: 682801 - protein, 23 aa, Mycobacterium
KAQKQARHWSRDTVAAAMQVVAA

SEQ ID NO: 682802 - protein, 24 aa, Mycobacterium
KAQKQARRWSRDKVATAMKLVAEL

SEQ ID NO: 682803 - protein, 25 aa, Mycobacterium
KAQKQARRWSRDKVATAMQLVAQLN

SEQ ID NO: 682804 - protein, 22 aa, Mycobacterium
KAQKQARRWTRDAVAEAMRVVA

SEQ ID NO: 682805 - protein, 32 aa, Mycobacterium
KAQLPRHIAVLCDGNRRWARDAGYDDVSIGYR

SEQ ID NO: 682806 - protein, 18 aa, Mycobacterium
KAQLSAAEPYEEWLHAGL

SEQ ID NO: 682807 - protein, 22 aa, Mycobacterium
KAQNVRLPWTLKDGQDGADAGD

SEQ ID NO: 682808 - protein, 26 aa, Mycobacterium
KAQPLWRVLVALSIRHVGPTAARALA

SEQ ID NO: 682809 - protein, 18 aa, Mycobacterium
KAQPWRERIETYSFLEHI

SEQ ID NO: 682810 - protein, 17 aa, Mycobacterium
KAQTLVAERGFAITPAA

SEQ ID NO: 682811 - protein, 20 aa, Mycobacterium
KAQVALAQMEYMLPRLRGWG

SEQ ID NO: 682812 - protein, 25 aa, Mycobacterium
KAQWTPPSGVLMPGQAPAIISRAEW

SEQ ID NO: 682813 - protein, 20 aa, Mycobacterium
KARAFEVLDKLRVIDISNNL

SEQ ID NO: 682814 - protein, 22 aa, Mycobacterium
KARAGALFGSRILLLEHIGRKS

SEQ ID NO: 682815 - protein, 21 aa, Mycobacterium
KARAGALFGSRLLMLEHIGRK

SEQ ID NO: 682816 - protein, 20 aa, Mycobacterium
KARALGLRPRARIVSQALVG

SEQ ID NO: 682817 - protein, 21 aa, Mycobacterium
KARAVAGWAYAAHSVDNARLI

SEQ ID NO: 682818 - protein, 20 aa, Mycobacterium
KARAVIMKAARAIASGDERA

SEQ ID NO: 682819 - protein, 17 aa, Mycobacterium
KARAVPINVNYRYRQNE

SEQ ID NO: 682820 - protein, 18 aa, Mycobacterium
KARDGEWISTFAPGDPVA

SEQ ID NO: 682821 - protein, 21 aa, Mycobacterium
KARDQLGWRPKYSAAETLSAL

SEQ ID NO: 682822 - protein, 20 aa, Mycobacterium
KAREALFAGCRDGRVAVLIG

SEQ ID NO: 682823 - protein, 26 aa, Mycobacterium
KAREVARKIRAGWVTINHAFDMNAPF

SEQ ID NO: 682824 - protein, 23 aa, Mycobacterium
KAREVLARELVRAGTAFPTDIAE

SEQ ID NO: 682825 - protein, 21 aa, Mycobacterium
KARGARIYARLLGAGITSDGF

SEQ ID NO: 682826 - protein, 18 aa, Mycobacterium
KARGLSGVHLVISDAHAG

SEQ ID NO: 682827 - protein, 19 aa, Mycobacterium
KARGRRVVARQVDVRDGEA

SEQ ID NO: 682828 - protein, 21 aa, Mycobacterium
KARKGDFRKLWITRINAAARL

SEQ ID NO: 682829 - protein, 20 aa, Mycobacterium
KARLAAGDWIIGRIQRVLDK

SEQ ID NO: 682830 - protein, 21 aa, Mycobacterium
KARLERAERPLAMSAAQISEL

SEQ ID NO: 682831 - protein, 17 aa, Mycobacterium
KARLLPCIDEGNRPKVA

SEQ ID NO: 682832 - protein, 27 aa, Mycobacterium
KARPPARLVGWTARFLGMVRPGDDVDF

SEQ ID NO: 682833 - protein, 21 aa, Mycobacterium
KARPRYVRIAADLPSTATHKV

SEQ ID NO: 682834 - protein, 18 aa, Mycobacterium
KARQAWIGATRDIATELL

SEQ ID NO: 682835 - protein, 17 aa, Mycobacterium
KARQPAALVLSGGPSSV

SEQ ID NO: 682836 - protein, 18 aa, Mycobacterium
KARRHLLVAAGIGITPMM

SEQ ID NO: 682837 - protein, 17 aa, Mycobacterium
KARRKKRQAARDSRWVP

SEQ ID NO: 682838 - protein, 17 aa, Mycobacterium
KARRLRQVASRAALRVA

SEQ ID NO: 682839 - protein, 19 aa, Mycobacterium
KARTLFPDREVVLAGVRDE

SEQ ID NO: 682840 - protein, 19 aa, Mycobacterium
KARTRGGYLTDIKGFDSEF

SEQ ID NO: 682841 - protein, 25 aa, Mycobacterium
KARVAPRLRGGMQMIDVRDVADVHV

SEQ ID NO: 682842 - protein, 19 aa, Mycobacterium
KARVLPGVAAGEVLICLGY

SEQ ID NO: 682843 - protein, 24 aa, Mycobacterium
KARVRALGVAGAFHTKYMAPALDR

SEQ ID NO: 682844 - protein, 24 aa, Mycobacterium
KARVRALGVAGAFHTKYMASALDG

SEQ ID NO: 682845 - protein, 20 aa, Mycobacterium
KARVREILHTLPPAAQAAIL

SEQ ID NO: 682846 - protein, 22 aa, Mycobacterium
KARYELALLAGRDAELAAALGE

SEQ ID NO: 682847 - protein, 22 aa, Mycobacterium
KARYELALLAGRDPELAAALSE

SEQ ID NO: 682848 - protein, 17 aa, Mycobacterium
KASAAIRAEAERLAEDE

SEQ ID NO: 682849 - protein, 24 aa, Mycobacterium
KASAPRLPSFALWLQEHEIGGLAV

SEQ ID NO: 682850 - protein, 20 aa, Mycobacterium
KASARSGSVLIKRYVSEKHH

SEQ ID NO: 682851 - protein, 21 aa, Mycobacterium
KASDFTYAIQRLFKADSGGSV

SEQ ID NO: 682852 - protein, 22 aa, Mycobacterium
KASDLRRLAGAPNYDAVASIAW

SEQ ID NO: 682853 - protein, 18 aa, Mycobacterium
KASEALSAVSGDSIQLHG

SEQ ID NO: 682854 - protein, 20 aa, Mycobacterium
KASEAVARFLSWVYVTNGPG

SEQ ID NO: 682855 - protein, 17 aa, Mycobacterium
KASFVAIEYDEYGAGHG

SEQ ID NO: 682856 - protein, 18 aa, Mycobacterium
KASGIAIVAKQAGVQPES

SEQ ID NO: 682857 - protein, 19 aa, Mycobacterium
KASGLKWTLEYPGALNDGV

SEQ ID NO: 682858 - protein, 19 aa, Mycobacterium
KASGRLMFYGQGAGGAPTA

SEQ ID NO: 682859 - protein, 31 aa, Mycobacterium
KASKATLYRRWPSKSDLVLAAFVEGTRLAAV

SEQ ID NO: 682860 - protein, 21 aa, Mycobacterium
KASLDAVRLISRFSPGDDPAT

SEQ ID NO: 682861 - protein, 24 aa, Mycobacterium
KASLDAVRLSSRFTPGADPATVAP

SEQ ID NO: 682862 - protein, 19 aa, Mycobacterium
KASLFGDSHAHGMDGVHFF

SEQ ID NO: 682863 - protein, 19 aa, Mycobacterium
KASLGELPRQVLGTLHAGG

SEQ ID NO: 682864 - protein, 28 aa, Mycobacterium
KASLIGDLVRRCRLVMAGEPLPHPDPID

SEQ ID NO: 682865 - protein, 19 aa, Mycobacterium
KASLMTRLMPGASVIIVLT

SEQ ID NO: 682866 - protein, 20 aa, Mycobacterium
KASPQFSDRRQAVAAVFSQM

SEQ ID NO: 682867 - protein, 23 aa, Mycobacterium
KASRAVVIGAGFIGCEVAASLRK

SEQ ID NO: 682868 - protein, 17 aa, Mycobacterium
KASTMRLDGLTVVVDCA

SEQ ID NO: 682869 - protein, 17 aa, Mycobacterium
KASVHTAELAQIMVDAD

SEQ ID NO: 682870 - protein, 17 aa, Mycobacterium
KATAEAIVNGWFHTGDL

SEQ ID NO: 682871 - protein, 23 aa, Mycobacterium
KATAICRHCPVILECGAEALDNR

SEQ ID NO: 682872 - protein, 26 aa, Mycobacterium
KATALRDFAQRAGVPMAQTVAVGDGA

SEQ ID NO: 682873 - protein, 24 aa, Mycobacterium
KATAWIAEGLFGYLAPEAQDRLLD

SEQ ID NO: 682874 - protein, 25 aa, Mycobacterium
KATAWPGCPPRLLRVAGGHADQQDH

SEQ ID NO: 682875 - protein, 25 aa, Mycobacterium
KATDFSRPWVTVTLHGAAVRPVGLP

SEQ ID NO: 682876 - protein, 19 aa, Mycobacterium
KATFDVRVTAPRHWKVISN

SEQ ID NO: 682877 - protein, 20 aa, Mycobacterium
KATFEIRVTAPQHWKVVSNA

SEQ ID NO: 682878 - protein, 19 aa, Mycobacterium
KATGLVVVPVMFDRIMDLP

SEQ ID NO: 682879 - protein, 19 aa, Mycobacterium
KATGRWTARALIFVINLYR

SEQ ID NO: 682880 - protein, 35 aa, Mycobacterium
KATHGRIPMTGVWPRVPRRFWHVGPMARTVRDLAL

SEQ ID NO: 682881 - protein, 18 aa, Mycobacterium
KATIKHLLCLEYSTVAIQ

SEQ ID NO: 682882 - protein, 17 aa, Mycobacterium
KATLKAKLGEDMEDYLI

SEQ ID NO: 682883 - protein, 32 aa, Mycobacterium
KATLPCIDGGLYLEPWDGILIDTLKMVAQPLD

SEQ ID NO: 682884 - protein, 19 aa, Mycobacterium
KATLRRLYRHPGSGQLVAM

SEQ ID NO: 682885 - protein, 18 aa, Mycobacterium
KATNPIEGVAAWIDGRLD

SEQ ID NO: 682886 - protein, 18 aa, Mycobacterium
KATPEERPALLAAASELA

SEQ ID NO: 682887 - protein, 21 aa, Mycobacterium
KATPEMVAFMVRYTSGYLCVP

SEQ ID NO: 682888 - protein, 21 aa, Mycobacterium
KATRDCMPWTDGWLPGDAAFN

SEQ ID NO: 682889 - protein, 17 aa, Mycobacterium
KATRDEIFVDLKQRVSE

SEQ ID NO: 682890 - protein, 24 aa, Mycobacterium
KATRPEVRGGLGGFAGLFALKRDY

SEQ ID NO: 682891 - protein, 21 aa, Mycobacterium
KATRSRAVLREALQHYGKTES

SEQ ID NO: 682892 - protein, 17 aa, Mycobacterium
KATRWHTDVTFAANYPA

SEQ ID NO: 682893 - protein, 17 aa, Mycobacterium
KATVRFLAGYAALESQR

SEQ ID NO: 682894 - protein, 22 aa, Mycobacterium
KAVAEFSRWYAGEVDLSAPPPG

SEQ ID NO: 682895 - protein, 19 aa, Mycobacterium
KAVAGGGGRGMRRVTDPAA

SEQ ID NO: 682896 - protein, 27 aa, Mycobacterium
KAVAGIRFALSLGFRVRVAATVAAPAP

SEQ ID NO: 682897 - protein, 20 aa, Mycobacterium
KAVAKFEFRASAVIVASGGI

SEQ ID NO: 682898 - protein, 30 aa, Mycobacterium
KAVARGSFFPVIPVCSGTGVGTLELLEVAT

SEQ ID NO: 682899 - protein, 24 aa, Mycobacterium
KAVASAFETARVAMVHPLAVAANR

SEQ ID NO: 682900 - protein, 20 aa, Mycobacterium
KAVEILAFIHGMEMTWLLDP

SEQ ID NO: 682901 - protein, 21 aa, Mycobacterium
KAVELATGWIFGYVDAALMRA

SEQ ID NO: 682902 - protein, 18 aa, Mycobacterium
KAVETFAFPELTGTFNWA

SEQ ID NO: 682903 - protein, 17 aa, Mycobacterium
KAVEVLRIKGAKDVGKR

SEQ ID NO: 682904 - protein, 20 aa, Mycobacterium
KAVEVPHAMVLFAGSALVER

SEQ ID NO: 682905 - protein, 25 aa, Mycobacterium
KAVFSEWPLGVALEQAQILHAEAVV

SEQ ID NO: 682906 - protein, 26 aa, Mycobacterium
KAVGPDFIICYRLSMADYVPDGQTWD

SEQ ID NO: 682907 - protein, 20 aa, Mycobacterium
KAVGRLARRKVRYAQVQLPA

SEQ ID NO: 682908 - protein, 21 aa, Mycobacterium
KAVIGDSFSWLAAHLHGDASA

SEQ ID NO: 682909 - protein, 17 aa, Mycobacterium
KAVIISDPFMAAAPVLQ

SEQ ID NO: 682910 - protein, 20 aa, Mycobacterium
KAVIVSEPFLVAIPVLEEKG

SEQ ID NO: 682911 - protein, 20 aa, Mycobacterium
KAVIVSEPFLVATPVLEEKG

SEQ ID NO: 682912 - protein, 18 aa, Mycobacterium
KAVKAARAAKNFTSFNWI

SEQ ID NO: 682913 - protein, 24 aa, Mycobacterium
KAVKDARRGKEFAKLIKNIEVAAR

SEQ ID NO: 682914 - protein, 25 aa, Mycobacterium
KAVLLPNRTFFAIPDILRAEGLRWI

SEQ ID NO: 682915 - protein, 18 aa, Mycobacterium
KAVLRRADLTGSRVQDAR

SEQ ID NO: 682916 - protein, 24 aa, Mycobacterium
KAVQRSAGALAIGPVLQGLRKPVN

SEQ ID NO: 682917 - protein, 22 aa, Mycobacterium
KAVRAAREFGDTVSAVATSWAL

SEQ ID NO: 682918 - protein, 26 aa, Mycobacterium
KAVRDVWSAAGSVEWIHVTAAGVDTL

SEQ ID NO: 682919 - protein, 29 aa, Mycobacterium
KAVRGVPMIGEFCYQCMHSIKAGIKDALS

SEQ ID NO: 682920 - protein, 17 aa, Mycobacterium
KAVRPARGRAPAADSSD

SEQ ID NO: 682921 - protein, 17 aa, Mycobacterium
KAVRPARGRAPIAEPED

SEQ ID NO: 682922 - protein, 23 aa, Mycobacterium
KAVSFRFGDRTQINGVPRDSAVD

SEQ ID NO: 682923 - protein, 18 aa, Mycobacterium
KAVSVARDELGSIRTGRA

SEQ ID NO: 682924 - protein, 18 aa, Mycobacterium
KAVTHRWVVDPGETMLFG

SEQ ID NO: 682925 - protein, 24 aa, Mycobacterium
KAVTPWMRLGLRGMTEPTFDESFL

SEQ ID NO: 682926 - protein, 21 aa, Mycobacterium
KAVVAEATWNRGVDKFICAMG

SEQ ID NO: 682927 - protein, 25 aa, Mycobacterium
KAVVDARRGKMFARLIKNIEVAARV

SEQ ID NO: 682928 - protein, 20 aa, Mycobacterium
KAWKVKRIRNTPRVTLAICD

SEQ ID NO: 682929 - protein, 22 aa, Mycobacterium
KAWLDPEFKQLALTDALAASKA

SEQ ID NO: 682930 - protein, 24 aa, Mycobacterium
KAWREYADRTGINWCVVGHSHEAW

SEQ ID NO: 682931 - protein, 23 aa, Mycobacterium
KAYAAGLAAWWTVLEHTGTDWRE

SEQ ID NO: 682932 - protein, 23 aa, Mycobacterium
KAYAEGLRAIYLYTATFQDAEVA

SEQ ID NO: 682933 - protein, 17 aa, Mycobacterium
KAYAGAADGVGWSEGGA

SEQ ID NO: 682934 - protein, 23 aa, Mycobacterium
KAYCVPKAVLLTAAARAAGIPAR

SEQ ID NO: 682935 - protein, 25 aa, Mycobacterium
KAYDPWYNLGHPFWVADTSFDLDRH

SEQ ID NO: 682936 - protein, 24 aa, Mycobacterium
KAYFRRTPLDIALGMSVLVTQVLT

SEQ ID NO: 682937 - protein, 18 aa, Mycobacterium
KAYMRRVTNTVNYSTELP

SEQ ID NO: 682938 - protein, 17 aa, Mycobacterium
KAYPQRLEMSAGMSNDL

SEQ ID NO: 682939 - protein, 24 aa, Mycobacterium
KAYRVAGYRAGWLAITGPKDHAES

SEQ ID NO: 682940 - protein, 24 aa, Mycobacterium
KAYRVAGYRAGWLAITGPKDHAGS

SEQ ID NO: 682941 - protein, 24 aa, Mycobacterium
KAYRVAGYRAGWLAITGPKDHASS

SEQ ID NO: 682942 - protein, 24 aa, Mycobacterium
KAYRVAGYRAGWLAITGPKEHASS

SEQ ID NO: 682943 - protein, 23 aa, Mycobacterium
KAYRVAGYRSAWLAITGPKDHAA

SEQ ID NO: 682944 - protein, 25 aa, Mycobacterium
KAYRVAGYRSGWLVITGPKEHAASF

SEQ ID NO: 682945 - protein, 25 aa, Mycobacterium
KAYRVAGYRSGWLVITGPKEHATSF

SEQ ID NO: 682946 - protein, 17 aa, Mycobacterium
KAYTEALIGRGDISMKE

SEQ ID NO: 682947 - protein, 17 aa, Mycobacterium
KCADRWGYDMIAVPEHL

SEQ ID NO: 682948 - protein, 24 aa, Mycobacterium
KCAELELPLCINTGIPGPPIPGEV

SEQ ID NO: 682949 - protein, 21 aa, Mycobacterium
KCDVPFLYRFELMGTTDDVFA

SEQ ID NO: 682950 - protein, 19 aa, Mycobacterium
KCGGDGRVRARREITVKIP

SEQ ID NO: 682951 - protein, 21 aa, Mycobacterium
KCGHLGGKVLIPTQQHIRTLT

SEQ ID NO: 682952 - protein, 21 aa, Mycobacterium
KCGLLQTGRWRPGLSNGGAEN

SEQ ID NO: 682953 - protein, 20 aa, Mycobacterium
KCGLPASSIYWHFKDKDDLI

SEQ ID NO: 682954 - protein, 18 aa, Mycobacterium
KCIIFWGVATDKDFRGGT

SEQ ID NO: 682955 - protein, 27 aa, Mycobacterium
KCILCAACTTSCPIFWHEGSYYGPAAI

SEQ ID NO: 682956 - protein, 27 aa, Mycobacterium
KCILCAACTTSCPVFWNEGSYFGPAAI

SEQ ID NO: 682957 - protein, 18 aa, Mycobacterium
KCKETRALRATRSKVGMV

SEQ ID NO: 682958 - protein, 19 aa, Mycobacterium
KCLLDLVDLLGFDTRIDPR

SEQ ID NO: 682959 - protein, 17 aa, Mycobacterium
KCNIHVAGMPLTEGSAA

SEQ ID NO: 682960 - protein, 17 aa, Mycobacterium
KCPFTLGHSRAVARLAG

SEQ ID NO: 682961 - protein, 20 aa, Mycobacterium
KCPRSIAFEAQLPRTDTGKL

SEQ ID NO: 682962 - protein, 28 aa, Mycobacterium
KCQQVWCPVCALAALATGDQHPLLTAIA

SEQ ID NO: 682963 - protein, 21 aa, Mycobacterium
KCRLRVSRKRLVGTYGSMTHP

SEQ ID NO: 682964 - protein, 33 aa, Mycobacterium
KCVEEAAKYPGTRWRFEYSPESYTGTELEYAKQ

SEQ ID NO: 682965 - protein, 19 aa, Mycobacterium
KCVRQVLEVLDPVDDPLPA

SEQ ID NO: 682966 - protein, 18 aa, Mycobacterium
KCVRQVLEVLDPVDDPLS

SEQ ID NO: 682967 - protein, 22 aa, Mycobacterium
KCVRTTEFIYTNSFHAFEQPDA

SEQ ID NO: 682968 - protein, 18 aa, Mycobacterium
KCVTDMRDAGVALALVSN

SEQ ID NO: 682969 - protein, 23 aa, Mycobacterium
KDAEARAGAIGLASELDGLGVEV

SEQ ID NO: 682970 - protein, 18 aa, Mycobacterium
KDAFPQAAVFNGYGMTES

SEQ ID NO: 682971 - protein, 20 aa, Mycobacterium
KDAGPSWSFLTWAKPGSDWE

SEQ ID NO: 682972 - protein, 24 aa, Mycobacterium
KDAGVEWKDIQFGFGGSYEVSNPD

SEQ ID NO: 682973 - protein, 19 aa, Mycobacterium
KDAGVRRIVYLGGLHPDDA

SEQ ID NO: 682974 - protein, 17 aa, Mycobacterium
KDAIAAAAAEFFPPTGS

SEQ ID NO: 682975 - protein, 31 aa, Mycobacterium
KDAIAREVRRGGLPLQRLMNAETMGALAREL

SEQ ID NO: 682976 - protein, 20 aa, Mycobacterium
KDAIAYLRGRIRLVHEDIEA

SEQ ID NO: 682977 - protein, 18 aa, Mycobacterium
KDAIKVVGLLGKKELEGT

SEQ ID NO: 682978 - protein, 21 aa, Mycobacterium
KDAKNRLGYSKVVLAGWSGGG

SEQ ID NO: 682979 - protein, 21 aa, Mycobacterium
KDAKTKFLLVRTGEERQGVVG

SEQ ID NO: 682980 - protein, 17 aa, Mycobacterium
KDALGPGERVEFVKVAM

SEQ ID NO: 682981 - protein, 20 aa, Mycobacterium
KDALRSYWTTALAGMPDLHF

SEQ ID NO: 682982 - protein, 29 aa, Mycobacterium
KDAMAREVRRGGLPLQRLVNGETLSAVAR

SEQ ID NO: 682983 - protein, 37 aa, Mycobacterium
KDAPIRDWVKLAVTRARLSGMPVVFWLDTERPHEVEL

SEQ ID NO: 682984 - protein, 21 aa, Mycobacterium
KDAPIRDWVKLAVTRARNSGM

SEQ ID NO: 682985 - protein, 18 aa, Mycobacterium
KDAQGIPIPHMPSVNTSF

SEQ ID NO: 682986 - protein, 22 aa, Mycobacterium
KDARFDGWFVIAVLTTRIYCRP

SEQ ID NO: 682987 - protein, 17 aa, Mycobacterium
KDARLTILEVMAEAIDA

SEQ ID NO: 682988 - protein, 22 aa, Mycobacterium
KDARLTILEVMAEAIDAPDEMS

SEQ ID NO: 682989 - protein, 17 aa, Mycobacterium
KDARLTILEVMAEAIDT

SEQ ID NO: 682990 - protein, 21 aa, Mycobacterium
KDARVPQTWNPRLRLVEESSL

SEQ ID NO: 682991 - protein, 29 aa, Mycobacterium
KDARYLDALFPVWRYHPFFTDSDEPVDAA

SEQ ID NO: 682992 - protein, 19 aa, Mycobacterium
KDDCVRVAIRPGAKAGASH

SEQ ID NO: 682993 - protein, 25 aa, Mycobacterium
KDDEVARLLALESFDILDTPPEESF

SEQ ID NO: 682994 - protein, 26 aa, Mycobacterium
KDDFTALDALFAWYSTMGSVTGVSGM

SEQ ID NO: 682995 - protein, 21 aa, Mycobacterium
KDDLFAAAVTSIFDSVRERVE

SEQ ID NO: 682996 - protein, 19 aa, Mycobacterium
KDDMAFVVNQLHWLIIILD

SEQ ID NO: 682997 - protein, 18 aa, Mycobacterium
KDDPRLVPGYAASGDAQV

SEQ ID NO: 682998 - protein, 23 aa, Mycobacterium
KDDSASVAVLWGDHGTFCAGADL

SEQ ID NO: 682999 - protein, 19 aa, Mycobacterium
KDDVCGYLGYNDAFEAMLA

SEQ ID NO: 683000 - protein, 29 aa, Mycobacterium
KDEAKKWAAKCPLGTGVTLEVRRIADVEE

SEQ ID NO: 683001 - protein, 24 aa, Mycobacterium
KDEKGVLTRLWKRLGDIRYMDPAC

SEQ ID NO: 683002 - protein, 19 aa, Mycobacterium
KDELLLALIDRIMAESAQR

SEQ ID NO: 683003 - protein, 19 aa, Mycobacterium
KDELLLALVEKIMAEATER

SEQ ID NO: 683004 - protein, 28 aa, Mycobacterium
KDELLMSIMLEFGRKVGGAWSDIVRTDS

SEQ ID NO: 683005 - protein, 21 aa, Mycobacterium
KDENVEFVDVRFCDLPGIMQH

SEQ ID NO: 683006 - protein, 23 aa, Mycobacterium
KDEPALDILAGWLASRIDGPVTR

SEQ ID NO: 683007 - protein, 26 aa, Mycobacterium
KDESVEYVDIRFCDLPGVVQHFSIPA

SEQ ID NO: 683008 - protein, 22 aa, Mycobacterium
KDFEVGHALYLGFLFLDEDDDA

SEQ ID NO: 683009 - protein, 26 aa, Mycobacterium
KDFFLPRILTGEVFFCQGYSEPEAGS

SEQ ID NO: 683010 - protein, 21 aa, Mycobacterium
KDFGAIMPMRVISALLGIPEE

SEQ ID NO: 683011 - protein, 25 aa, Mycobacterium
KDFKGHAFHSSRWDYDYTGGDSGGN

SEQ ID NO: 683012 - protein, 25 aa, Mycobacterium
KDFKGHAFHSSRWDYDYTGGDTGGN

SEQ ID NO: 683013 - protein, 20 aa, Mycobacterium
KDFPRHMGIHSGGMVICDRP

SEQ ID NO: 683014 - protein, 18 aa, Mycobacterium
KDFRAVSDVETLRVGGTE

SEQ ID NO: 683015 - protein, 22 aa, Mycobacterium
KDFRHLYVPPGFLHGFQALTAI

SEQ ID NO: 683016 - protein, 17 aa, Mycobacterium
KDFYKVLGVASDADEKE

SEQ ID NO: 683017 - protein, 20 aa, Mycobacterium
KDGDAIAGAFGYIRESGNFI

SEQ ID NO: 683018 - protein, 26 aa, Mycobacterium
KDGDALFFGHGLNIHFGLIKPPANVT

SEQ ID NO: 683019 - protein, 24 aa, Mycobacterium
KDGDRLRGVMTILTVDERFGADIV

SEQ ID NO: 683020 - protein, 22 aa, Mycobacterium
KDGIIPLLLIAGLVSRSDEIAL

SEQ ID NO: 683021 - protein, 21 aa, Mycobacterium
KDGKRALVVAGIKRCETMRFA

SEQ ID NO: 683022 - protein, 24 aa, Mycobacterium
KDGKRSLVVAGIKGCETMRFAEFV

SEQ ID NO: 683023 - protein, 23 aa, Mycobacterium
KDGKRSLVVAGIKGCETMRFAQF

SEQ ID NO: 683024 - protein, 21 aa, Mycobacterium
KDGKRSLVVAGIKRCETMRFA

SEQ ID NO: 683025 - protein, 19 aa, Mycobacterium
KDGLAMRHGKELTWSQVLM

SEQ ID NO: 683026 - protein, 25 aa, Mycobacterium
KDGLFDKELIPIAGLSTDEFIRPGT

SEQ ID NO: 683027 - protein, 20 aa, Mycobacterium
KDGPKRTVTVRSRSRRVDRD

SEQ ID NO: 683028 - protein, 24 aa, Mycobacterium
KDGQLCYAHNYVAKEIFTIRSEQR

SEQ ID NO: 683029 - protein, 18 aa, Mycobacterium
KDGREFIAQFLVSGAGGL

SEQ ID NO: 683030 - protein, 23 aa, Mycobacterium
KDGRPKPTPIWAAADQGRLLVIT

SEQ ID NO: 683031 - protein, 23 aa, Mycobacterium
KDGRPKPTPVWAALDKDHGDRLL

SEQ ID NO: 683032 - protein, 20 aa, Mycobacterium
KDGRQLVIRDLFYDAQGSRQ

SEQ ID NO: 683033 - protein, 19 aa, Mycobacterium
KDGTIRLFGRDSLVVNTGG

SEQ ID NO: 683034 - protein, 18 aa, Mycobacterium
KDGYGRNFLLPRGLAIMA

SEQ ID NO: 683035 - protein, 24 aa, Mycobacterium
KDHLELGEALGLIDMQRGAKVSGS

SEQ ID NO: 683036 - protein, 24 aa, Mycobacterium
KDHLELGESLGLIDMERGAKVSGS

SEQ ID NO: 683037 - protein, 23 aa, Mycobacterium
KDHLELGESLGLIDMQRGAKVSG

SEQ ID NO: 683038 - protein, 24 aa, Mycobacterium
KDHLELGESLGLIDMQRGAKVSGS

SEQ ID NO: 683039 - protein, 26 aa, Mycobacterium
KDHPGRVAVCIEGLYSMDGDLPPLAE

SEQ ID NO: 683040 - protein, 18 aa, Mycobacterium
KDIALWRALEFPGTNAHV

SEQ ID NO: 683041 - protein, 18 aa, Mycobacterium
KDIALYLNFDMLGSPNPG

SEQ ID NO: 683042 - protein, 24 aa, Mycobacterium
KDIDFAFAVGQLFATVPYAQLILE

SEQ ID NO: 683043 - protein, 25 aa, Mycobacterium
KDIDFAFGVGQIFALVPYAQLILEE

SEQ ID NO: 683044 - protein, 23 aa, Mycobacterium
KDIDFHCWLQWLVDEQLSAAQDS

SEQ ID NO: 683045 - protein, 18 aa, Mycobacterium
KDIIRWIQTTGHYSALNV

SEQ ID NO: 683046 - protein, 17 aa, Mycobacterium
KDIKGMDLTHAIKEVAA

SEQ ID NO: 683047 - protein, 18 aa, Mycobacterium
KDIKGMELARAIKDVGAG

SEQ ID NO: 683048 - protein, 24 aa, Mycobacterium
KDIPLRVKAAAVGLAADEYHAQDV

SEQ ID NO: 683049 - protein, 25 aa, Mycobacterium
KDIPLRVKAAAVGLPADEYHAQDVV

SEQ ID NO: 683050 - protein, 25 aa, Mycobacterium
KDIPLRVKAGAVGLAADEYHAQDVV

SEQ ID NO: 683051 - protein, 25 aa, Mycobacterium
KDIPLRVKAGAVGLAADEYRAQDVV

SEQ ID NO: 683052 - protein, 26 aa, Mycobacterium
KDIPLRVKAGAVGLLADEYRAQDVVT

SEQ ID NO: 683053 - protein, 19 aa, Mycobacterium
KDIPSLVAAVAEANQRVAD

SEQ ID NO: 683054 - protein, 20 aa, Mycobacterium
KDIQRLAALGDTYADASPDL

SEQ ID NO: 683055 - protein, 28 aa, Mycobacterium
KDIRRLEMLEGMGWLIVRVVAEDHPHDI

SEQ ID NO: 683056 - protein, 30 aa, Mycobacterium
KDISVVHPILLFSLMKGMRSMEGGLGSITA

SEQ ID NO: 683057 - protein, 18 aa, Mycobacterium
KDIVTRPLLEVMFATDRE

SEQ ID NO: 683058 - protein, 18 aa, Mycobacterium
KDIWWCLQPFLDDEDAVA

SEQ ID NO: 683059 - protein, 17 aa, Mycobacterium
KDIYDLYGYSAVVHVLS

SEQ ID NO: 683060 - protein, 19 aa, Mycobacterium
KDKAAQGLATWDEYSDEIE

SEQ ID NO: 683061 - protein, 17 aa, Mycobacterium
KDKASGDFVWDEEESEA

SEQ ID NO: 683062 - protein, 21 aa, Mycobacterium
KDKEKAAEMMEAYEEKPTIVL

SEQ ID NO: 683063 - protein, 17 aa, Mycobacterium
KDKGGLAIVTFSALSKI

SEQ ID NO: 683064 - protein, 23 aa, Mycobacterium
KDKKLPVAEAIAYLLEILPALTY

SEQ ID NO: 683065 - protein, 20 aa, Mycobacterium
KDKLLNLSITMRSTGSDVTG

SEQ ID NO: 683066 - protein, 20 aa, Mycobacterium
KDLAAAICATAFERGVLMET

SEQ ID NO: 683067 - protein, 17 aa, Mycobacterium
KDLAEAVTAMFEKRRPE

SEQ ID NO: 683068 - protein, 18 aa, Mycobacterium
KDLAELVTIEAGKIVSEA

SEQ ID NO: 683069 - protein, 29 aa, Mycobacterium
KDLAQHGFIGINFPEEFGGGGAGMAELAI

SEQ ID NO: 683070 - protein, 17 aa, Mycobacterium
KDLARFATRLEELGYDT

SEQ ID NO: 683071 - protein, 22 aa, Mycobacterium
KDLEIATAAPLRAVVEAGMARG

SEQ ID NO: 683072 - protein, 25 aa, Mycobacterium
KDLESCSRWPDLATFKVQVRKLKNL

SEQ ID NO: 683073 - protein, 17 aa, Mycobacterium
KDLGVTALVEFPPAGTL

SEQ ID NO: 683074 - protein, 25 aa, Mycobacterium
KDLHLPWQWGAAWFLDQLTDGDLAS

SEQ ID NO: 683075 - protein, 25 aa, Mycobacterium
KDLHLPWQWGAAWFLDQLTDGDVAS

SEQ ID NO: 683076 - protein, 25 aa, Mycobacterium
KDLHLPWQWGARWFLDQLVDGDIAN

SEQ ID NO: 683077 - protein, 20 aa, Mycobacterium
KDLIIRGGHNIDPRPIEEAM

SEQ ID NO: 683078 - protein, 21 aa, Mycobacterium
KDLIIRGGYNVYPREIEEVLY

SEQ ID NO: 683079 - protein, 19 aa, Mycobacterium
KDLIKQFADHLPGDPKKVA

SEQ ID NO: 683080 - protein, 18 aa, Mycobacterium
KDLIKQFADHLPGDPRKV

SEQ ID NO: 683081 - protein, 21 aa, Mycobacterium
KDLIRLPGLVAAAYQHETSRS

SEQ ID NO: 683082 - protein, 21 aa, Mycobacterium
KDLLRNAIVSFLRYIDQNQAS

SEQ ID NO: 683083 - protein, 21 aa, Mycobacterium
KDLLRNAIVSFLRYIDTNRAS

SEQ ID NO: 683084 - protein, 19 aa, Mycobacterium
KDLMGREMLDQRFAGMKEA

SEQ ID NO: 683085 - protein, 19 aa, Mycobacterium
KDLMGREMLDQRFAGMKQA

SEQ ID NO: 683086 - protein, 17 aa, Mycobacterium
KDLPAAIVAAGDYAGAP

SEQ ID NO: 683087 - protein, 22 aa, Mycobacterium
KDLPAATGEDIVWADAVIFGSP

SEQ ID NO: 683088 - protein, 26 aa, Mycobacterium
KDLPFALKRFCGAEGIENVTTASAFR

SEQ ID NO: 683089 - protein, 27 aa, Mycobacterium
KDLPGQIARIASFLSIDPASLRMDAIV

SEQ ID NO: 683090 - protein, 17 aa, Mycobacterium
KDLPSFADIVARLGRNS

SEQ ID NO: 683091 - protein, 20 aa, Mycobacterium
KDLPYVCELMDLRPGQERWR

SEQ ID NO: 683092 - protein, 27 aa, Mycobacterium
KDLQLWVGACLYKGVVDVHRLFVGEMD

SEQ ID NO: 683093 - protein, 24 aa, Mycobacterium
KDLQQRVTGLVARGEMLDDSLARV

SEQ ID NO: 683094 - protein, 21 aa, Mycobacterium
KDLQRLIKVGARVDDDGRPVK

SEQ ID NO: 683095 - protein, 23 aa, Mycobacterium
KDLQRLPGLVAIAYQHETSRCGD

SEQ ID NO: 683096 - protein, 21 aa, Mycobacterium
KDLRNTEVLPLYARLPTAEQQ

SEQ ID NO: 683097 - protein, 20 aa, Mycobacterium
KDLRRARAAALNIVPTSTGA

SEQ ID NO: 683098 - protein, 18 aa, Mycobacterium
KDLSLALALGESVSVDLP

SEQ ID NO: 683099 - protein, 23 aa, Mycobacterium
KDLTECGVKIVWDQDHTHAKILW

SEQ ID NO: 683100 - protein, 30 aa, Mycobacterium
KDLTERTAIGIGFDLVWRTEFDRSSKIGGR

SEQ ID NO: 683101 - protein, 24 aa, Mycobacterium
KDLTLKFGGLQALDGVSFDIRRGE

SEQ ID NO: 683102 - protein, 24 aa, Mycobacterium
KDLTRLLGGPSHRLELVAIASAAQ

SEQ ID NO: 683103 - protein, 25 aa, Mycobacterium
KDMLSGALEALRFDGSVFSDPSQWG

SEQ ID NO: 683104 - protein, 17 aa, Mycobacterium
KDMNAGGILASICFPSF

SEQ ID NO: 683105 - protein, 17 aa, Mycobacterium
KDMNAGGILGSMCFPSF

SEQ ID NO: 683106 - protein, 36 aa, Mycobacterium
KDMNAGGILGSMCFPSFPGFAGRLFATEDPEFSLAL

SEQ ID NO: 683107 - protein, 20 aa, Mycobacterium
KDMNAGGVLATMNFPSFPGF

SEQ ID NO: 683108 - protein, 18 aa, Mycobacterium
KDMRHVLGSWIAESDSEG

SEQ ID NO: 683109 - protein, 26 aa, Mycobacterium
KDNGQGVGSLFSWTGDPAVVQGPEEG

SEQ ID NO: 683110 - protein, 18 aa, Mycobacterium
KDNLRTVGAATGRAAAAD

SEQ ID NO: 683111 - protein, 19 aa, Mycobacterium
KDNSGVIVLLTFGTGIGSA

SEQ ID NO: 683112 - protein, 22 aa, Mycobacterium
KDNWIGCEHMVLGILRGGDPVA

SEQ ID NO: 683113 - protein, 22 aa, Mycobacterium
KDPAGGYARTFLTQMEQVLGTC

SEQ ID NO: 683114 - protein, 23 aa, Mycobacterium
KDPEGMKAYAQAAGSAMAGATIL

SEQ ID NO: 683115 - protein, 23 aa, Mycobacterium
KDPEGMKAYAQAAGSAMSGATIL

SEQ ID NO: 683116 - protein, 48 aa, Mycobacterium
KDPELAWAAVRAWNDWHLEAWAGPYPERIIPCQLPWLLDPSAGAQLIH

SEQ ID NO: 683117 - protein, 23 aa, Mycobacterium
KDPEVTRFLLWRAHRNVAETRRV

SEQ ID NO: 683118 - protein, 27 aa, Mycobacterium
KDPIYGLGPRLAQLVAGAFWREPKQVV

SEQ ID NO: 683119 - protein, 21 aa, Mycobacterium
KDPIYGLGPRVAQLVAGAFFR

SEQ ID NO: 683120 - protein, 30 aa, Mycobacterium
KDPNYSLRMSWDFLSRSTAGLLDWDDRLDT

SEQ ID NO: 683121 - protein, 24 aa, Mycobacterium
KDPQSFRIGKRVYLIVDDDGARAR

SEQ ID NO: 683122 - protein, 19 aa, Mycobacterium
KDPRLTAQLDDLFESALDP

SEQ ID NO: 683123 - protein, 21 aa, Mycobacterium
KDPRLTAQLDDLFESALDPST

SEQ ID NO: 683124 - protein, 21 aa, Mycobacterium
KDPRLTAQLNEVFESAMDPAT

SEQ ID NO: 683125 - protein, 20 aa, Mycobacterium
KDPRLTTQLNDIFDSAADPR

SEQ ID NO: 683126 - protein, 30 aa, Mycobacterium
KDPSASLWLAELWKEAGLPDGVFNVLQGDK

SEQ ID NO: 683127 - protein, 24 aa, Mycobacterium
KDPSASLWLARLLAEAGVPAGVFN

SEQ ID NO: 683128 - protein, 22 aa, Mycobacterium
KDPSGGYARTFLTQMEQVLGTC

SEQ ID NO: 683129 - protein, 20 aa, Mycobacterium
KDPTLRRLLPDFYRNDDQDT

SEQ ID NO: 683130 - protein, 20 aa, Mycobacterium
KDPVKGFFRALDYTLPWDVD

SEQ ID NO: 683131 - protein, 20 aa, Mycobacterium
KDPVKGFFRALEFTLPRDVD

SEQ ID NO: 683132 - protein, 20 aa, Mycobacterium
KDPVKGFFRALEFTLPYDVD

SEQ ID NO: 683133 - protein, 18 aa, Mycobacterium
KDPVLYVVGRKALGYFSF

SEQ ID NO: 683134 - protein, 31 aa, Mycobacterium
KDPWLRRQLTPHFRPGCKRMLMTSDYYPALQ

SEQ ID NO: 683135 - protein, 22 aa, Mycobacterium
KDQAIKLYAEYQQKSEQVLSEY

SEQ ID NO: 683136 - protein, 18 aa, Mycobacterium
KDQLPNGSAICFISSVAG

SEQ ID NO: 683137 - protein, 26 aa, Mycobacterium
KDQPAGLYWYHPHFHTATAHQGWNGL

SEQ ID NO: 683138 - protein, 18 aa, Mycobacterium
KDQVVAHLLNLILTGKLR

SEQ ID NO: 683139 - protein, 17 aa, Mycobacterium
KDQVVSHILDLILTGKL

SEQ ID NO: 683140 - protein, 25 aa, Mycobacterium
KDRAARIFGSKPWMALGATRDNRVF

SEQ ID NO: 683141 - protein, 22 aa, Mycobacterium
KDRDGFVFGEAGALLVIETEEH

SEQ ID NO: 683142 - protein, 23 aa, Mycobacterium
KDRDGFVFGEAGALMVIETEEHA

SEQ ID NO: 683143 - protein, 18 aa, Mycobacterium
KDRDIAMVFQSYALYPHM

SEQ ID NO: 683144 - protein, 32 aa, Mycobacterium
KDRDLALASVRAWNDWHLEVWAGSYPDRIIPC

SEQ ID NO: 683145 - protein, 26 aa, Mycobacterium
KDRFGAEIRTHYPLELDAEVGVIAQE

SEQ ID NO: 683146 - protein, 25 aa, Mycobacterium
KDRFGAEIRTHYPLELDAEVRVIVQ

SEQ ID NO: 683147 - protein, 30 aa, Mycobacterium
KDRFGAEIRTHYPLELEAEMGVIAQEAHLS

SEQ ID NO: 683148 - protein, 26 aa, Mycobacterium
KDRFGAEIRTHYPLELEAEVGVIRQE

SEQ ID NO: 683149 - protein, 29 aa, Mycobacterium
KDRGCSHPGCDVPGYLCEVHHVTDWAHTH

SEQ ID NO: 683150 - protein, 25 aa, Mycobacterium
KDRGCTRPGCDVPGYQCEVHHVAAW

SEQ ID NO: 683151 - protein, 19 aa, Mycobacterium
KDRLFDLIERMKLPTVFFA

SEQ ID NO: 683152 - protein, 17 aa, Mycobacterium
KDRLFGTWHYWWQAHLL

SEQ ID NO: 683153 - protein, 19 aa, Mycobacterium
KDRLFPTAFGPATIDGRIY

SEQ ID NO: 683154 - protein, 25 aa, Mycobacterium
KDRMIGIDATHAWAAVWTPQEPGQF

SEQ ID NO: 683155 - protein, 25 aa, Mycobacterium
KDRMIGIDATHAWAAVWTPQQPGQF

SEQ ID NO: 683156 - protein, 24 aa, Mycobacterium
KDRMPSPYLPSGLKLDPMEGTGEV

SEQ ID NO: 683157 - protein, 23 aa, Mycobacterium
KDRMPTPYLPSGLKLDPMEGTGE

SEQ ID NO: 683158 - protein, 17 aa, Mycobacterium
KDRNGVLAWKVAAHASK

SEQ ID NO: 683159 - protein, 17 aa, Mycobacterium
KDRRHALALTEDIQSRW

SEQ ID NO: 683160 - protein, 25 aa, Mycobacterium
KDSDSRIAAQLAYWEDALAGMPERL

SEQ ID NO: 683161 - protein, 24 aa, Mycobacterium
KDSELKRRRTLAALEAMEASGASI

SEQ ID NO: 683162 - protein, 21 aa, Mycobacterium
KDSLERVWAPKAAGALRLHDA

SEQ ID NO: 683163 - protein, 20 aa, Mycobacterium
KDSLRAAAVAVNVRLTEANQ

SEQ ID NO: 683164 - protein, 18 aa, Mycobacterium
KDSLVREFRNIGPVLESL

SEQ ID NO: 683165 - protein, 17 aa, Mycobacterium
KDSMKFTADMTINDPGN

SEQ ID NO: 683166 - protein, 22 aa, Mycobacterium
KDSRGGSSFADFAANAKALSGN

SEQ ID NO: 683167 - protein, 18 aa, Mycobacterium
KDSSCLHCIVATNRRLGA

SEQ ID NO: 683168 - protein, 23 aa, Mycobacterium
KDSTRYLLHFSQSGIGLPDESYY

SEQ ID NO: 683169 - protein, 22 aa, Mycobacterium
KDSYRNLLVAPRGVRKGIIERI

SEQ ID NO: 683170 - protein, 21 aa, Mycobacterium
KDTAHKGMFLAFNTNINLPPP

SEQ ID NO: 683171 - protein, 19 aa, Mycobacterium
KDTDIARHFDLVGFDPRGV

SEQ ID NO: 683172 - protein, 19 aa, Mycobacterium
KDTHAHAWALRMSPDGNVW

SEQ ID NO: 683173 - protein, 21 aa, Mycobacterium
KDTMGPFALNAGRPVAIASAA

SEQ ID NO: 683174 - protein, 20 aa, Mycobacterium
KDTPSVCDWMIFGNEHCVVI

SEQ ID NO: 683175 - protein, 24 aa, Mycobacterium
KDTRGIIRVHQFDKVEAFVYCKPE

SEQ ID NO: 683176 - protein, 24 aa, Mycobacterium
KDTRGIIRVHQFDKVEGFIYCKPE

SEQ ID NO: 683177 - protein, 24 aa, Mycobacterium
KDTRGIIRVHQFDKVEGFIYCTPG

SEQ ID NO: 683178 - protein, 24 aa, Mycobacterium
KDTRGIIRVHQFDKVEGFVYCKPA

SEQ ID NO: 683179 - protein, 20 aa, Mycobacterium
KDTYWSRFAEQGWYFAGDGA

SEQ ID NO: 683180 - protein, 19 aa, Mycobacterium
KDVAARCPNTKIVMGGFSQ

SEQ ID NO: 683181 - protein, 17 aa, Mycobacterium
KDVAAWAQRVERLGFDV

SEQ ID NO: 683182 - protein, 17 aa, Mycobacterium
KDVAVLRTFLSERGKIR

SEQ ID NO: 683183 - protein, 24 aa, Mycobacterium
KDVDFAFAVGQLFATVPYAQLILE

SEQ ID NO: 683184 - protein, 22 aa, Mycobacterium
KDVFIPPDINSLLDAANTGLQA

SEQ ID NO: 683185 - protein, 19 aa, Mycobacterium
KDVFVPRHRFLSYKAMNDH

SEQ ID NO: 683186 - protein, 20 aa, Mycobacterium
KDVFVPRHRFLSYKAMNDHT

SEQ ID NO: 683187 - protein, 25 aa, Mycobacterium
KDVGELWSRFMQKWVDHITTVIEAE

SEQ ID NO: 683188 - protein, 21 aa, Mycobacterium
KDVGFPYRSSLVPRRNAELDE

SEQ ID NO: 683189 - protein, 31 aa, Mycobacterium
KDVGGPLGLLRMGLPSGISMSAYSGGLTYLF

SEQ ID NO: 683190 - protein, 17 aa, Mycobacterium
KDVHRAHRVAAKLRAGT

SEQ ID NO: 683191 - protein, 18 aa, Mycobacterium
KDVIIDMLCYRRRGHNEG

SEQ ID NO: 683192 - protein, 26 aa, Mycobacterium
KDVLQGQCTFAWPPQFELPGYKPNTK

SEQ ID NO: 683193 - protein, 26 aa, Mycobacterium
KDVLQGQCTFSWPPRIDLPGYKPTVK

SEQ ID NO: 683194 - protein, 28 aa, Mycobacterium
KDVPAARAAEFILGYTIGNDVSARDQQR

SEQ ID NO: 683195 - protein, 20 aa, Mycobacterium
KDVSTAWQLDAYRFEIPLLA

SEQ ID NO: 683196 - protein, 20 aa, Mycobacterium
KDVSTAWQLDAYRFEIPVIA

SEQ ID NO: 683197 - protein, 20 aa, Mycobacterium
KDVSTAWQLDAYRFEIPVLA

SEQ ID NO: 683198 - protein, 20 aa, Mycobacterium
KDVSTAWQLDAYRFEIPVVA

SEQ ID NO: 683199 - protein, 20 aa, Mycobacterium
KDVVIRGGENIYPREIEEFL

SEQ ID NO: 683200 - protein, 23 aa, Mycobacterium
KDVWLLRRGRLDDDVIFTAAPAA

SEQ ID NO: 683201 - protein, 17 aa, Mycobacterium
KDVWTPRQQRVIGEDGF

SEQ ID NO: 683202 - protein, 28 aa, Mycobacterium
KDWEPEPLRWIGVRGMYLAYKAADWHEA

SEQ ID NO: 683203 - protein, 30 aa, Mycobacterium
KDWGSGQPIVFSHGWPLSADDWDAQLMFFL

SEQ ID NO: 683204 - protein, 26 aa, Mycobacterium
KDWIPRLATMDAIASYCLTEPGAGSD

SEQ ID NO: 683205 - protein, 26 aa, Mycobacterium
KDWIPRLATMDVIASYCLTEPDAGSD

SEQ ID NO: 683206 - protein, 17 aa, Mycobacterium
KDWPLQLISSPRWSEQR

SEQ ID NO: 683207 - protein, 17 aa, Mycobacterium
KDWRARNALEVLTSSVD

SEQ ID NO: 683208 - protein, 20 aa, Mycobacterium
KDWTEPGFMGLGMIYTAMPV

SEQ ID NO: 683209 - protein, 23 aa, Mycobacterium
KDWYRAGPHLMMVFPASAGDLTK

SEQ ID NO: 683210 - protein, 23 aa, Mycobacterium
KDYHLPKPFLVMATQNPIENEGV

SEQ ID NO: 683211 - protein, 17 aa, Mycobacterium
KDYVAFPALTSVSPAAT

SEQ ID NO: 683212 - protein, 21 aa, Mycobacterium
KDYVFFPALGRRRWRRTLGAN

SEQ ID NO: 683213 - protein, 19 aa, Mycobacterium
KDYVGWGLNHLVFHAPGHD

SEQ ID NO: 683214 - protein, 20 aa, Mycobacterium
KDYVPYCFDPTALITSLNDA

SEQ ID NO: 683215 - protein, 19 aa, Mycobacterium
KDYWDFNSLVAFAPPQHFE

SEQ ID NO: 683216 - protein, 24 aa, Mycobacterium
KEADPRAVVWLMVRPLANSIAAGE

SEQ ID NO: 683217 - protein, 23 aa, Mycobacterium
KEAGLKSRMLLQVHDELLFEVAP

SEQ ID NO: 683218 - protein, 31 aa, Mycobacterium
KEAIAREVRRGGLPLQRLMNAETMAALAREL

SEQ ID NO: 683219 - protein, 17 aa, Mycobacterium
KEAILIELIRRYQDDLH

SEQ ID NO: 683220 - protein, 20 aa, Mycobacterium
KEAKRYPALLDLIAAEVPLV

SEQ ID NO: 683221 - protein, 27 aa, Mycobacterium
KEALFRESLRLILDPGVLIEALSGGEA

SEQ ID NO: 683222 - protein, 26 aa, Mycobacterium
KEALLRRIGLAASKYWVCKRSTPHAA

SEQ ID NO: 683223 - protein, 17 aa, Mycobacterium
KEALNFIDIQPVNARYR

SEQ ID NO: 683224 - protein, 21 aa, Mycobacterium
KEALSRFGAVHVVCNNAGTGG

SEQ ID NO: 683225 - protein, 17 aa, Mycobacterium
KEALTDWGPGEFEGPLR

SEQ ID NO: 683226 - protein, 19 aa, Mycobacterium
KEAMVRQWALRFRDEANQR

SEQ ID NO: 683227 - protein, 17 aa, Mycobacterium
KEAPFVFLYQADTIVIS

SEQ ID NO: 683228 - protein, 17 aa, Mycobacterium
KEAPVIDGLTGVQRVFF

SEQ ID NO: 683229 - protein, 19 aa, Mycobacterium
KEAQNNGGEICRIATHCTE

SEQ ID NO: 683230 - protein, 21 aa, Mycobacterium
KEARDALLKAIRAATPSASTT

SEQ ID NO: 683231 - protein, 19 aa, Mycobacterium
KEARQAKLKAAKEAKKAKA

SEQ ID NO: 683232 - protein, 25 aa, Mycobacterium
KEDAIKELFGMSATRYYQVLNALVD

SEQ ID NO: 683233 - protein, 24 aa, Mycobacterium
KEDEIAWDPAILVMPHGGFIELTV

SEQ ID NO: 683234 - protein, 17 aa, Mycobacterium
KEDEITRALTLLDELWK

SEQ ID NO: 683235 - protein, 20 aa, Mycobacterium
KEDHCLLDLLWRNRRGELEM

SEQ ID NO: 683236 - protein, 25 aa, Mycobacterium
KEDHYGITMVTGWQEAVDVYNDADT

SEQ ID NO: 683237 - protein, 21 aa, Mycobacterium
KEDLAGLPFVGPAGRLLDRAL

SEQ ID NO: 683238 - protein, 20 aa, Mycobacterium
KEELAHYGVQPDWFQLGDRD

SEQ ID NO: 683239 - protein, 24 aa, Mycobacterium
KEELARYGVQPDWFGLGDRDIATH

SEQ ID NO: 683240 - protein, 17 aa, Mycobacterium
KEELLLAPVRYGGAAIV

SEQ ID NO: 683241 - protein, 18 aa, Mycobacterium
KEELREELILEVGSPRAI

SEQ ID NO: 683242 - protein, 17 aa, Mycobacterium
KEEMARIGLTVDALQIQ

SEQ ID NO: 683243 - protein, 19 aa, Mycobacterium
KEEMARIGLTVDALQIQSI

SEQ ID NO: 683244 - protein, 21 aa, Mycobacterium
KEESVGFLFNINVEVQQPDGA

SEQ ID NO: 683245 - protein, 21 aa, Mycobacterium
KEESVGFLFNVQVEAAPQQPQ

SEQ ID NO: 683246 - protein, 21 aa, Mycobacterium
KEESVGFLFNVQVEPVAAPTV

SEQ ID NO: 683247 - protein, 21 aa, Mycobacterium
KEESVGFLFNVSVEAVPAPQV

SEQ ID NO: 683248 - protein, 28 aa, Mycobacterium
KEFAAAFKPPLSWGMRMTGKKFLREYPY

SEQ ID NO: 683249 - protein, 30 aa, Mycobacterium
KEFAAAFKPPMRWGVRMMGKKFLREYPYRD

SEQ ID NO: 683250 - protein, 20 aa, Mycobacterium
KEFADLLGWLKETLGEQVKE

SEQ ID NO: 683251 - protein, 17 aa, Mycobacterium
KEFAELFGRALDAADEV

SEQ ID NO: 683252 - protein, 27 aa, Mycobacterium
KEFAGAFKPPISWGMRTVGKGFLREYP

SEQ ID NO: 683253 - protein, 22 aa, Mycobacterium
KEFDASMANFWMATPQQLYREL

SEQ ID NO: 683254 - protein, 17 aa, Mycobacterium
KEFDPGAPFTRSDTQKL

SEQ ID NO: 683255 - protein, 26 aa, Mycobacterium
KEFFLPRILTGEVFFCQGYSEPESGS

SEQ ID NO: 683256 - protein, 21 aa, Mycobacterium
KEFHRRPAPLLGEHNHELLAK

SEQ ID NO: 683257 - protein, 20 aa, Mycobacterium
KEFLDQRIPELVKARSALGA

SEQ ID NO: 683258 - protein, 20 aa, Mycobacterium
KEFLLRRQLEAIRKELGELG

SEQ ID NO: 683259 - protein, 19 aa, Mycobacterium
KEFPPRHPPASFTIDQAVE

SEQ ID NO: 683260 - protein, 17 aa, Mycobacterium
KEFRVVLGADRPDTRVG

SEQ ID NO: 683261 - protein, 20 aa, Mycobacterium
KEFTKKLFVAEGLPVGDYAV

SEQ ID NO: 683262 - protein, 20 aa, Mycobacterium
KEGAAAAVQRYGCSAGASRL

SEQ ID NO: 683263 - protein, 24 aa, Mycobacterium
KEGDNVFVALSWSKHPAPQNFEEA

SEQ ID NO: 683264 - protein, 23 aa, Mycobacterium
KEGDPHAWAIPRLMGTAKAAFVA

SEQ ID NO: 683265 - protein, 25 aa, Mycobacterium
KEGDPHAWAIPRLMGVAKAAFVAVE

SEQ ID NO: 683266 - protein, 21 aa, Mycobacterium
KEGDPHAWLIPRISGQAKASF

SEQ ID NO: 683267 - protein, 27 aa, Mycobacterium
KEGEPFVLHPGEFVLGATLERCTLPDD

SEQ ID NO: 683268 - protein, 21 aa, Mycobacterium
KEGKDVFLRDIWPSQQDVADT

SEQ ID NO: 683269 - protein, 18 aa, Mycobacterium
KEGLRWSIIELTNNSNAR

SEQ ID NO: 683270 - protein, 19 aa, Mycobacterium
KEGVLLRTLGDFPRMLKTA

SEQ ID NO: 683271 - protein, 19 aa, Mycobacterium
KEHALKSRMLLQVHDELLF

SEQ ID NO: 683272 - protein, 20 aa, Mycobacterium
KEHGVPVAIKAAFGGGGRGM

SEQ ID NO: 683273 - protein, 22 aa, Mycobacterium
KEHKALVIKGGYMDGHALTVAE

SEQ ID NO: 683274 - protein, 17 aa, Mycobacterium
KEICNMMGLRQLGCSTG

SEQ ID NO: 683275 - protein, 25 aa, Mycobacterium
KEIDIPVYLGCDWDNVPLHLPSTFA

SEQ ID NO: 683276 - protein, 23 aa, Mycobacterium
KEIDRRPGDILGEVQALVDQGVL

SEQ ID NO: 683277 - protein, 17 aa, Mycobacterium
KEIFYDWDQVTVEEEEY

SEQ ID NO: 683278 - protein, 19 aa, Mycobacterium
KEIHHAVGHDQLFDTMFVY

SEQ ID NO: 683279 - protein, 18 aa, Mycobacterium
KEILDCACQLARAALPHM

SEQ ID NO: 683280 - protein, 28 aa, Mycobacterium
KEILEYHWGPDWMCWDADQTFQQHGQHI

SEQ ID NO: 683281 - protein, 26 aa, Mycobacterium
KEILEYHWGPDWVCYDAKGTSQQHGQ

SEQ ID NO: 683282 - protein, 25 aa, Mycobacterium
KEILEYHWGPDWVVYDARGTSQQHG

SEQ ID NO: 683283 - protein, 19 aa, Mycobacterium
KEINIQFVLAYGPDEFAES

SEQ ID NO: 683284 - protein, 17 aa, Mycobacterium
KEIPVEVALNPEKLAQQ

SEQ ID NO: 683285 - protein, 21 aa, Mycobacterium
KEIQARIRAGASVEQVATASG

SEQ ID NO: 683286 - protein, 17 aa, Mycobacterium
KEIRAVLEADGRFDIVE

SEQ ID NO: 683287 - protein, 30 aa, Mycobacterium
KEIREILGTEILDPLGFRWTNFGVAEKDVA

SEQ ID NO: 683288 - protein, 24 aa, Mycobacterium
KEISDIPVGVGLGVRSGEQAAQIG

SEQ ID NO: 683289 - protein, 23 aa, Mycobacterium
KEISLRLADRGVLVKDTHGSTLR

SEQ ID NO: 683290 - protein, 17 aa, Mycobacterium
KEIWRRMAAAGDIYLDT

SEQ ID NO: 683291 - protein, 20 aa, Mycobacterium
KEKAAELLVSTNRKLDKAAS

SEQ ID NO: 683292 - protein, 17 aa, Mycobacterium
KEKFEAIRDEFHAFAAR

SEQ ID NO: 683293 - protein, 32 aa, Mycobacterium
KEKPLDYLVERWEWWSRTAPDVGVQTRTVLSE

SEQ ID NO: 683294 - protein, 19 aa, Mycobacterium
KEKYPEYKEGRSATPDEFR

SEQ ID NO: 683295 - protein, 17 aa, Mycobacterium
KELAALVRRGMTPMQAI

SEQ ID NO: 683296 - protein, 18 aa, Mycobacterium
KELAFPNAVLALFHYPDK

SEQ ID NO: 683297 - protein, 22 aa, Mycobacterium
KELAGAIAFASPLSYPVVADQL

SEQ ID NO: 683298 - protein, 31 aa, Mycobacterium
KELCRKVVIELLAWQFASPVRWIETQDLLFI

SEQ ID NO: 683299 - protein, 20 aa, Mycobacterium
KELDDLVGRLMSYKLDRSKP

SEQ ID NO: 683300 - protein, 18 aa, Mycobacterium
KELDRLRLVNARAAAANA

SEQ ID NO: 683301 - protein, 17 aa, Mycobacterium
KELDRMRLANARAAAVN

SEQ ID NO: 683302 - protein, 20 aa, Mycobacterium
KELERLSARVAATVVLPFDR

SEQ ID NO: 683303 - protein, 21 aa, Mycobacterium
KELFDRAWKSPDVIEAQVARI

SEQ ID NO: 683304 - protein, 21 aa, Mycobacterium
KELKQRVLGIQSMLDSYVQRG

SEQ ID NO: 683305 - protein, 20 aa, Mycobacterium
KELNPATGVELLIPDFNGEP

SEQ ID NO: 683306 - protein, 21 aa, Mycobacterium
KELNVMGAIQLFAACQKTPSV

SEQ ID NO: 683307 - protein, 20 aa, Mycobacterium
KELNVMGAMQLFAACQKAPS

SEQ ID NO: 683308 - protein, 17 aa, Mycobacterium
KELPAQPAPVLLFVPGG

SEQ ID NO: 683309 - protein, 17 aa, Mycobacterium
KELPIRTLSDMVGIPEA

SEQ ID NO: 683310 - protein, 17 aa, Mycobacterium
KELPIRTLSDMVGIPEG

SEQ ID NO: 683311 - protein, 17 aa, Mycobacterium
KELPIRTLSDMVWIPES

SEQ ID NO: 683312 - protein, 24 aa, Mycobacterium
KELPLPRPKFEIFVYSPRVEGVHL

SEQ ID NO: 683313 - protein, 21 aa, Mycobacterium
KELRNGSTVALVYLSPDAKPA

SEQ ID NO: 683314 - protein, 22 aa, Mycobacterium
KELRNGSTVALVYLSPDAKPAA

SEQ ID NO: 683315 - protein, 24 aa, Mycobacterium
KELSEIGPGFALVPLPGHTEGHAC

SEQ ID NO: 683316 - protein, 21 aa, Mycobacterium
KELSVALAERGVLVKDTHGST

SEQ ID NO: 683317 - protein, 17 aa, Mycobacterium
KELTRSSSAIVFAPLPP

SEQ ID NO: 683318 - protein, 17 aa, Mycobacterium
KELVGIEQIQLGLIGMQ

SEQ ID NO: 683319 - protein, 18 aa, Mycobacterium
KELVWAPGAFRYVMMVLR

SEQ ID NO: 683320 - protein, 21 aa, Mycobacterium
KELVWKLQHASYMAGNYLTGW

SEQ ID NO: 683321 - protein, 20 aa, Mycobacterium
KEMAQKYGVVAWNRDMYDTE

SEQ ID NO: 683322 - protein, 17 aa, Mycobacterium
KEMHEIPGANHYYAGPD

SEQ ID NO: 683323 - protein, 19 aa, Mycobacterium
KEMIRLAVEGCRRNGIHSG

SEQ ID NO: 683324 - protein, 24 aa, Mycobacterium
KEMQRTEGFTALIDANRGCFAAFR

SEQ ID NO: 683325 - protein, 17 aa, Mycobacterium
KEMREIVQIASRRPGTG

SEQ ID NO: 683326 - protein, 17 aa, Mycobacterium
KEMVKVRGFQVAPAEVE

SEQ ID NO: 683327 - protein, 28 aa, Mycobacterium
KEMVSTGWLGLHIDERFGGQGYGLPELT

SEQ ID NO: 683328 - protein, 20 aa, Mycobacterium
KEMYEIPGATHYYAGPDQRD

SEQ ID NO: 683329 - protein, 20 aa, Mycobacterium
KEMYEIPGATHYYAGPNQRD

SEQ ID NO: 683330 - protein, 25 aa, Mycobacterium
KENDARARHALALKHQALNALSELG

SEQ ID NO: 683331 - protein, 28 aa, Mycobacterium
KENEDFMWRLADECLDDFIDDGSCEFLK

SEQ ID NO: 683332 - protein, 18 aa, Mycobacterium
KENGCMKFLPGSHRTLYY

SEQ ID NO: 683333 - protein, 26 aa, Mycobacterium
KENGPRFALAGSYALWAYGAPEPTHD

SEQ ID NO: 683334 - protein, 20 aa, Mycobacterium
KENIKRQWWKSVVTGRDDVV

SEQ ID NO: 683335 - protein, 19 aa, Mycobacterium
KENLLRDWDDTASLVASDH

SEQ ID NO: 683336 - protein, 22 aa, Mycobacterium
KENLTSLPWPARGWSEARDAPV

SEQ ID NO: 683337 - protein, 25 aa, Mycobacterium
KEPDLIPVFIEEALRTQSPTKVDFR

SEQ ID NO: 683338 - protein, 17 aa, Mycobacterium
KEPGEARDQAAWTRALA

SEQ ID NO: 683339 - protein, 19 aa, Mycobacterium
KEPIRLAAVVRDQANAATV

SEQ ID NO: 683340 - protein, 18 aa, Mycobacterium
KEPLEWPDATVAHGDAVD

SEQ ID NO: 683341 - protein, 19 aa, Mycobacterium
KEPLYGPPPLLLRMVEAGQ

SEQ ID NO: 683342 - protein, 18 aa, Mycobacterium
KEPLYRLYELRLRQGLAA

SEQ ID NO: 683343 - protein, 17 aa, Mycobacterium
KEPLYRVYELRLRQELA

SEQ ID NO: 683344 - protein, 18 aa, Mycobacterium
KEPPKRVVSAGFTEQDDL

SEQ ID NO: 683345 - protein, 17 aa, Mycobacterium
KEPRITALSDLWFEAAR

SEQ ID NO: 683346 - protein, 23 aa, Mycobacterium
KEPWFRNAYRQAWEWADATGWKP

SEQ ID NO: 683347 - protein, 19 aa, Mycobacterium
KEQGVELVGPNGLLNQITK

SEQ ID NO: 683348 - protein, 18 aa, Mycobacterium
KEQLGWIALNGRRNAALN

SEQ ID NO: 683349 - protein, 18 aa, Mycobacterium
KEQLGWIALNGRRNAASN

SEQ ID NO: 683350 - protein, 23 aa, Mycobacterium
KEQLSVVITRQFFRNATAEIEEA

SEQ ID NO: 683351 - protein, 25 aa, Mycobacterium
KEQPDVVHAYGWLGGLAAQLAARRR

SEQ ID NO: 683352 - protein, 23 aa, Mycobacterium
KERAFEVLDKLQIVDISNNLGDA

SEQ ID NO: 683353 - protein, 18 aa, Mycobacterium
KERARIMFMIGTLTPDRV

SEQ ID NO: 683354 - protein, 18 aa, Mycobacterium
KERFKHVAVEGHRQFNPG

SEQ ID NO: 683355 - protein, 24 aa, Mycobacterium
KERFRQLVDLVCLHAAIVTGHSNS

SEQ ID NO: 683356 - protein, 18 aa, Mycobacterium
KERGFAVGAVHGDLGQIA

SEQ ID NO: 683357 - protein, 17 aa, Mycobacterium
KERLFGRAWMFMAHESE

SEQ ID NO: 683358 - protein, 20 aa, Mycobacterium
KERLGYRKVVLAGWSGGGSP

SEQ ID NO: 683359 - protein, 20 aa, Mycobacterium
KERLKAAAIAAGEPKPEKRG

SEQ ID NO: 683360 - protein, 29 aa, Mycobacterium
KERPGTAADEIVRWATPVTSFQRTALEDY

SEQ ID NO: 683361 - protein, 19 aa, Mycobacterium
KERPRVIAVDAVPNEVAST

SEQ ID NO: 683362 - protein, 17 aa, Mycobacterium
KERPRVIAVDAVPTEVA

SEQ ID NO: 683363 - protein, 20 aa, Mycobacterium
KERRRLFGMIGSVTPDKIAS

SEQ ID NO: 683364 - protein, 23 aa, Mycobacterium
KERTVPLHYVWDGSNVVAVCENF

SEQ ID NO: 683365 - protein, 25 aa, Mycobacterium
KERYLRPLLEGELFSSYSMTEPHAG

SEQ ID NO: 683366 - protein, 26 aa, Mycobacterium
KESDPRYLPFQSLRGRDFTSMVSVPM

SEQ ID NO: 683367 - protein, 22 aa, Mycobacterium
KESETPGALVLKLRQEEPEAFT

SEQ ID NO: 683368 - protein, 19 aa, Mycobacterium
KESHPVLAMASNRTYGLDT

SEQ ID NO: 683369 - protein, 17 aa, Mycobacterium
KESRGMRHHRWVEKEAA

SEQ ID NO: 683370 - protein, 19 aa, Mycobacterium
KESTMALKIVIGGDNAGFN

SEQ ID NO: 683371 - protein, 19 aa, Mycobacterium
KETAKHLGVTFNDIVLAVA

SEQ ID NO: 683372 - protein, 23 aa, Mycobacterium
KETALGTGFFLTWVTTYVDQHSE

SEQ ID NO: 683373 - protein, 17 aa, Mycobacterium
KETIAYCRIGERSSHTW

SEQ ID NO: 683374 - protein, 19 aa, Mycobacterium
KETIKRAAQNVEFTHKKQT

SEQ ID NO: 683375 - protein, 22 aa, Mycobacterium
KETIKRLVEKVEFTHKKQTGGS

SEQ ID NO: 683376 - protein, 32 aa, Mycobacterium
KETLAFFAGIGIPIAEVWGMSELSCVATVSHP

SEQ ID NO: 683377 - protein, 31 aa, Mycobacterium
KETLAFFLGIGVPIAEVWGMSELSCVAAVSH

SEQ ID NO: 683378 - protein, 17 aa, Mycobacterium
KETLAVFDVGISPTARM

SEQ ID NO: 683379 - protein, 17 aa, Mycobacterium
KETLGWIALNQRANAEL

SEQ ID NO: 683380 - protein, 26 aa, Mycobacterium
KETLRLHPPLIILMRVAKGEFEVGGF

SEQ ID NO: 683381 - protein, 21 aa, Mycobacterium
KETPACFEPTLDYVVVKSPRF

SEQ ID NO: 683382 - protein, 21 aa, Mycobacterium
KETPLTCALFVETLREAGFPA

SEQ ID NO: 683383 - protein, 21 aa, Mycobacterium
KETPWLPGQVQVFIHGEAQAV

SEQ ID NO: 683384 - protein, 26 aa, Mycobacterium
KETWNGHFPFGWGVSAHPKVDSGTGE

SEQ ID NO: 683385 - protein, 26 aa, Mycobacterium
KETYWSRFAEKGWYFAGDGARIGSDG

SEQ ID NO: 683386 - protein, 21 aa, Mycobacterium
KETYWSRYAEQGWYFAGDGAR

SEQ ID NO: 683387 - protein, 25 aa, Mycobacterium
KEVAAEFANRFAGLLGVRKQDAADA

SEQ ID NO: 683388 - protein, 18 aa, Mycobacterium
KEVAPSKDLREWYQHRAE

SEQ ID NO: 683389 - protein, 25 aa, Mycobacterium
KEVDIPVYLGCDWQNVPLHLPSTFA

SEQ ID NO: 683390 - protein, 30 aa, Mycobacterium
KEVGHGISGAAARRLGGCRLAAIDVAGAGG

SEQ ID NO: 683391 - protein, 20 aa, Mycobacterium
KEVIETFVLTAALGAVTTTL

SEQ ID NO: 683392 - protein, 17 aa, Mycobacterium
KEVLDRFGKTAAVDGFR

SEQ ID NO: 683393 - protein, 18 aa, Mycobacterium
KEVPSMTRHWLVMETTGN

SEQ ID NO: 683394 - protein, 20 aa, Mycobacterium
KEVQSLPGFDGILGQARGSQ

SEQ ID NO: 683395 - protein, 17 aa, Mycobacterium
KEVRAVIDVARQAAVRG

SEQ ID NO: 683396 - protein, 21 aa, Mycobacterium
KEVRLSTRLTESPACLITDAF

SEQ ID NO: 683397 - protein, 26 aa, Mycobacterium
KEVVARLKPGIIMCREKGDATSANLF

SEQ ID NO: 683398 - protein, 17 aa, Mycobacterium
KEWKNPTRWLAERLNRG

SEQ ID NO: 683399 - protein, 24 aa, Mycobacterium
KEWMLPLLELRNALDVGDDRHLRD

SEQ ID NO: 683400 - protein, 17 aa, Mycobacterium
KEWTEFLTEHGVGLFDS

SEQ ID NO: 683401 - protein, 17 aa, Mycobacterium
KEYARKHPHSMGEWSMA

SEQ ID NO: 683402 - protein, 27 aa, Mycobacterium
KEYASRGTWIWPPEPSLRLIADTIEFC

SEQ ID NO: 683403 - protein, 24 aa, Mycobacterium
KEYASRGTWIWPPGPSLRLIADTI

SEQ ID NO: 683404 - protein, 21 aa, Mycobacterium
KEYESKFGVRVWHRDFFDAEI

SEQ ID NO: 683405 - protein, 19 aa, Mycobacterium
KEYGQDLAFTAEVDVRPQI

SEQ ID NO: 683406 - protein, 17 aa, Mycobacterium
KEYGSGSSRDWAAKGTS

SEQ ID NO: 683407 - protein, 20 aa, Mycobacterium
KEYGVPVAIKAAFGGGGRGM

SEQ ID NO: 683408 - protein, 22 aa, Mycobacterium
KEYPQYWPGYYAVFFDDPINGI

SEQ ID NO: 683409 - protein, 22 aa, Mycobacterium
KFAAIIDRLFRNAANDPIPTDR

SEQ ID NO: 683410 - protein, 19 aa, Mycobacterium
KFAAISLDLLAEVPDPRIL

SEQ ID NO: 683411 - protein, 18 aa, Mycobacterium
KFAALCSEKPAIHRFPGS

SEQ ID NO: 683412 - protein, 19 aa, Mycobacterium
KFAALCSEKPAIHRFPGSM

SEQ ID NO: 683413 - protein, 26 aa, Mycobacterium
KFAANMMNRILLKRWADAEEVAGAFV

SEQ ID NO: 683414 - protein, 18 aa, Mycobacterium
KFADEFHPELQFDKPYLL

SEQ ID NO: 683415 - protein, 25 aa, Mycobacterium
KFADEFHPELQFDKPYLLAMANAGP

SEQ ID NO: 683416 - protein, 18 aa, Mycobacterium
KFAEYSRVDWQVIAVDTR

SEQ ID NO: 683417 - protein, 25 aa, Mycobacterium
KFAFNGWKALSWVDENVWRHVVPKG

SEQ ID NO: 683418 - protein, 24 aa, Mycobacterium
KFAGQCPVHEPASVVPIVGAFTKH

SEQ ID NO: 683419 - protein, 17 aa, Mycobacterium
KFAKAVAHDAFDAVMLY

SEQ ID NO: 683420 - protein, 17 aa, Mycobacterium
KFARCSWHSGPDGMPIL

SEQ ID NO: 683421 - protein, 19 aa, Mycobacterium
KFAVTKNGRHSLTHYDTVE

SEQ ID NO: 683422 - protein, 22 aa, Mycobacterium
KFDGGTLPPMFVDLINAPTRRQ

SEQ ID NO: 683423 - protein, 22 aa, Mycobacterium
KFDGPYFVMQWLLRQPRHAILP

SEQ ID NO: 683424 - protein, 20 aa, Mycobacterium
KFDLVGWLPSYLHWYGLAMR

SEQ ID NO: 683425 - protein, 37 aa, Mycobacterium
KFDPEHALECIQRYGITHGQFVPAMFVRMLKLPEAVR

SEQ ID NO: 683426 - protein, 22 aa, Mycobacterium
KFDSGTLPPMFVDLINAPTRRQ

SEQ ID NO: 683427 - protein, 18 aa, Mycobacterium
KFDVLRLPPRNAPAAALT

SEQ ID NO: 683428 - protein, 20 aa, Mycobacterium
KFEDEFHPELQFDKPYLLAM

SEQ ID NO: 683429 - protein, 23 aa, Mycobacterium
KFERECLDLLVIEEAGQFSLANT

SEQ ID NO: 683430 - protein, 24 aa, Mycobacterium
KFERLYRAAPLMRFGGGTNEVLRD

SEQ ID NO: 683431 - protein, 19 aa, Mycobacterium
KFEVLQALWRRGGEDRELA

SEQ ID NO: 683432 - protein, 19 aa, Mycobacterium
KFFAGCFGIFGHGNVAGLG

SEQ ID NO: 683433 - protein, 17 aa, Mycobacterium
KFFGIEHPIVLAPMAGV

SEQ ID NO: 683434 - protein, 25 aa, Mycobacterium
KFFLPRIAAGNLHFSIGYSEPGAGT

SEQ ID NO: 683435 - protein, 25 aa, Mycobacterium
KFFRTTPYLPLSWQRKAVQMIAPML

SEQ ID NO: 683436 - protein, 17 aa, Mycobacterium
KFFSLRRRVPVLTTVID

SEQ ID NO: 683437 - protein, 25 aa, Mycobacterium
KFGAEGCGPFLPTSRIGVLASADYG

SEQ ID NO: 683438 - protein, 19 aa, Mycobacterium
KFGATHAYPDIFSAMAGVA

SEQ ID NO: 683439 - protein, 21 aa, Mycobacterium
KFGAYKMAKSTLLAMSHSLAA

SEQ ID NO: 683440 - protein, 22 aa, Mycobacterium
KFGGPMGVGALLLRREIACVPL

SEQ ID NO: 683441 - protein, 26 aa, Mycobacterium
KFGKSARPGGHFSLPALQLLISGLPK

SEQ ID NO: 683442 - protein, 18 aa, Mycobacterium
KFGKSTGGGNLWLDPEMT

SEQ ID NO: 683443 - protein, 24 aa, Mycobacterium
KFGKSTGGGNLWLDPEMTSPYAWY

SEQ ID NO: 683444 - protein, 24 aa, Mycobacterium
KFGKSTGGGSLWLDPALTTPYAWY

SEQ ID NO: 683445 - protein, 24 aa, Mycobacterium
KFGKSTGGGSLWLDPAMTTPYAWY

SEQ ID NO: 683446 - protein, 23 aa, Mycobacterium
KFGKSTGGGSLWLDPQLTSPYAW

SEQ ID NO: 683447 - protein, 18 aa, Mycobacterium
KFGLPEVERGALGAATHL

SEQ ID NO: 683448 - protein, 19 aa, Mycobacterium
KFGMTLCALGIAEEMRDEG

SEQ ID NO: 683449 - protein, 19 aa, Mycobacterium
KFGMTLCALGIAEEMREHG

SEQ ID NO: 683450 - protein, 21 aa, Mycobacterium
KFGQRLAAFVVLNPGAAATPE

SEQ ID NO: 683451 - protein, 25 aa, Mycobacterium
KFGRIDGSVGLLVWNTNFGFIGAML

SEQ ID NO: 683452 - protein, 20 aa, Mycobacterium
KFHLSEPCVLFAKLNPRVPR

SEQ ID NO: 683453 - protein, 25 aa, Mycobacterium
KFHRPIRVGDRLYFDSYLDSVLESH

SEQ ID NO: 683454 - protein, 31 aa, Mycobacterium
KFIDRLRAASCTKMLICDEAHTAGSKEMRAA

SEQ ID NO: 683455 - protein, 24 aa, Mycobacterium
KFILTEIFPGGRLPQIPQIDEYSS

SEQ ID NO: 683456 - protein, 25 aa, Mycobacterium
KFIMDEIYPGGRLPLAAQVTDAAKG

SEQ ID NO: 683457 - protein, 23 aa, Mycobacterium
KFIVTEIFPGGRLPSIPMVQERA

SEQ ID NO: 683458 - protein, 22 aa, Mycobacterium
KFKGSEARVTVTGFRIKTDGCV

SEQ ID NO: 683459 - protein, 25 aa, Mycobacterium
KFKQYERLWLSWAMANRDPSVFDKP

SEQ ID NO: 683460 - protein, 22 aa, Mycobacterium
KFKVTAIVVVPVMLNRLLNALD

SEQ ID NO: 683461 - protein, 21 aa, Mycobacterium
KFLANEGWIAWSGPAIAELLR

SEQ ID NO: 683462 - protein, 22 aa, Mycobacterium
KFLDRRQLIGFCLLVTQYDGLA

SEQ ID NO: 683463 - protein, 20 aa, Mycobacterium
KFLDRSGFHVWTLCGDSEMA

SEQ ID NO: 683464 - protein, 17 aa, Mycobacterium
KFLELLPNRIITDSIGS

SEQ ID NO: 683465 - protein, 20 aa, Mycobacterium
KFLLSPGGEVVRRFRPRTEP

SEQ ID NO: 683466 - protein, 18 aa, Mycobacterium
KFLPEALPRRFGNVYPLR

SEQ ID NO: 683467 - protein, 31 aa, Mycobacterium
KFLREYPYRDAYLLRDARLFRAELSMPLILL

SEQ ID NO: 683468 - protein, 30 aa, Mycobacterium
KFLREYPYRDAYLLRDARLFRSELSMPLIL

SEQ ID NO: 683469 - protein, 17 aa, Mycobacterium
KFLRYNANKALMNLGYE

SEQ ID NO: 683470 - protein, 24 aa, Mycobacterium
KFLSHAKSYWGAQYAKPELMLFNI

SEQ ID NO: 683471 - protein, 20 aa, Mycobacterium
KFLTRDSLRWVIANKAYTPW

SEQ ID NO: 683472 - protein, 26 aa, Mycobacterium
KFLWAPMFKCFGIQRIHLLSNCMILA

SEQ ID NO: 683473 - protein, 25 aa, Mycobacterium
KFMQRLNSVLPLWLQYGGSPTQAAA

SEQ ID NO: 683474 - protein, 18 aa, Mycobacterium
KFPLMLSAMSTGVTFVRA

SEQ ID NO: 683475 - protein, 20 aa, Mycobacterium
KFPPEWRLSKKGRKGKNAKK

SEQ ID NO: 683476 - protein, 21 aa, Mycobacterium
KFPRIASAALAVTVLPANIGA

SEQ ID NO: 683477 - protein, 20 aa, Mycobacterium
KFQRGLALVDEVKRAELKDY

SEQ ID NO: 683478 - protein, 18 aa, Mycobacterium
KFRDRDGVNFPLLSDPDK

SEQ ID NO: 683479 - protein, 19 aa, Mycobacterium
KFRELGLRADFVHSLIEGK

SEQ ID NO: 683480 - protein, 17 aa, Mycobacterium
KFRQLLPTEHTALATIA

SEQ ID NO: 683481 - protein, 17 aa, Mycobacterium
KFRQLLPVEHTAVATAD

SEQ ID NO: 683482 - protein, 20 aa, Mycobacterium
KFRRHAIDALEFMGISVEFS

SEQ ID NO: 683483 - protein, 23 aa, Mycobacterium
KFRRHAIEALEFMGISVEFSHHE

SEQ ID NO: 683484 - protein, 21 aa, Mycobacterium
KFRSELDALPLDEWPGQLRRM

SEQ ID NO: 683485 - protein, 23 aa, Mycobacterium
KFRTSWLKPGALFVSVNGTGVHS

SEQ ID NO: 683486 - protein, 26 aa, Mycobacterium
KFRVTFPRSNVLSALADELGGKDRVY

SEQ ID NO: 683487 - protein, 20 aa, Mycobacterium
KFSDVVAVRMGMPGVEYYAH

SEQ ID NO: 683488 - protein, 19 aa, Mycobacterium
KFSGAWPYLRVLSRLTGIA

SEQ ID NO: 683489 - protein, 24 aa, Mycobacterium
KFSPEVRDALRLGASYTGVEYLEA

SEQ ID NO: 683490 - protein, 27 aa, Mycobacterium
KFSQWTDEIFKAFNFHPDATFDEAAIM

SEQ ID NO: 683491 - protein, 28 aa, Mycobacterium
KFSSAGQFLAWAIARIMAGVVATQRGLF

SEQ ID NO: 683492 - protein, 28 aa, Mycobacterium
KFTPKIGYPARWRDYSAVVIKRDDLYGN

SEQ ID NO: 683493 - protein, 20 aa, Mycobacterium
KFVNMARLFGTDGVRGVANR

SEQ ID NO: 683494 - protein, 26 aa, Mycobacterium
KFVNSRPKPLSAYLFTKSREIRERVI

SEQ ID NO: 683495 - protein, 18 aa, Mycobacterium
KFVVLKSSSLRDVVTAAA

SEQ ID NO: 683496 - protein, 18 aa, Mycobacterium
KFWQRLVTLVGLDKRFHD

SEQ ID NO: 683497 - protein, 22 aa, Mycobacterium
KFYAELCDRLGVTVPQDDDAPA

SEQ ID NO: 683498 - protein, 25 aa, Mycobacterium
KFYATPPIDGAFCRYVTIDDDMAHA

SEQ ID NO: 683499 - protein, 24 aa, Mycobacterium
KFYSNGLDLEWLGAHSDQGAWYVG

SEQ ID NO: 683500 - protein, 24 aa, Mycobacterium
KFYSTGALFADWILVRASLSDGSV

SEQ ID NO: 683501 - protein, 19 aa, Mycobacterium
KGACAQVNKDLGLLAPEKA

SEQ ID NO: 683502 - protein, 20 aa, Mycobacterium
KGADGAGWVRFRQNPLEGEE

SEQ ID NO: 683503 - protein, 23 aa, Mycobacterium
KGADQGAQMAMQMASQLPQMLGQ

SEQ ID NO: 683504 - protein, 18 aa, Mycobacterium
KGAGPGVVLIPELPGIHP

SEQ ID NO: 683505 - protein, 21 aa, Mycobacterium
KGAIASNCIVLALLDHAGLQR

SEQ ID NO: 683506 - protein, 17 aa, Mycobacterium
KGAIEIALIHRPRYDDW

SEQ ID NO: 683507 - protein, 19 aa, Mycobacterium
KGAISSWKAFAPAWAGKAA

SEQ ID NO: 683508 - protein, 18 aa, Mycobacterium
KGAISTNSTLVWQALSAA

SEQ ID NO: 683509 - protein, 19 aa, Mycobacterium
KGALRGLRMTYLGDGANNM

SEQ ID NO: 683510 - protein, 19 aa, Mycobacterium
KGALTYEFLWRMLTGGNLD

SEQ ID NO: 683511 - protein, 18 aa, Mycobacterium
KGAMYTADMMTRIWQRPH

SEQ ID NO: 683512 - protein, 22 aa, Mycobacterium
KGAPTPVAWTRMRAPRSLMDTI

SEQ ID NO: 683513 - protein, 23 aa, Mycobacterium
KGAPTPVAWTRMRVPRSLMASIG

SEQ ID NO: 683514 - protein, 22 aa, Mycobacterium
KGAPTPVAWTRMRVPRSLMGAI

SEQ ID NO: 683515 - protein, 20 aa, Mycobacterium
KGASFPWRTIRGEECSAYWP

SEQ ID NO: 683516 - protein, 21 aa, Mycobacterium
KGASRRARRDGKIPAVLYGHG

SEQ ID NO: 683517 - protein, 21 aa, Mycobacterium
KGASRRARRDGQVPAVLYGHG

SEQ ID NO: 683518 - protein, 29 aa, Mycobacterium
KGASRRARREGKIPAVLYGHGADPQHLEL

SEQ ID NO: 683519 - protein, 28 aa, Mycobacterium
KGASRRARREGKVPAVMYGHGEEPRHLE

SEQ ID NO: 683520 - protein, 25 aa, Mycobacterium
KGCAESLAGQGARVSVTEIDPINAL

SEQ ID NO: 683521 - protein, 22 aa, Mycobacterium
KGCDICKPTIASILASTSSDHI

SEQ ID NO: 683522 - protein, 22 aa, Mycobacterium
KGCDICKPVVASILASTSSEHI

SEQ ID NO: 683523 - protein, 23 aa, Mycobacterium
KGCLRRRDDGWVFAAEHFTPKSR

SEQ ID NO: 683524 - protein, 17 aa, Mycobacterium
KGDDRWRSLPTPEGDTF

SEQ ID NO: 683525 - protein, 24 aa, Mycobacterium
KGDEIACPFHDWRWGGDGRCKKVP

SEQ ID NO: 683526 - protein, 18 aa, Mycobacterium
KGDERWRNLPTPSGNTFE

SEQ ID NO: 683527 - protein, 19 aa, Mycobacterium
KGDGAFEISKGAWSCGTKP

SEQ ID NO: 683528 - protein, 25 aa, Mycobacterium
KGDLRPEILVRLDLDGHVLDPGAPS

SEQ ID NO: 683529 - protein, 26 aa, Mycobacterium
KGDNSTRCGYALMAPSHSGSIVCPQC

SEQ ID NO: 683530 - protein, 24 aa, Mycobacterium
KGDPFVLHPGEFVLGSTLEIFSLP

SEQ ID NO: 683531 - protein, 18 aa, Mycobacterium
KGDRVGGLLINSPAFIET

SEQ ID NO: 683532 - protein, 24 aa, Mycobacterium
KGDSFRVHCREWFDGAIHNDDSAD

SEQ ID NO: 683533 - protein, 31 aa, Mycobacterium
KGDTADGVWSRMKFEGGVHRVQRVPVTESQG

SEQ ID NO: 683534 - protein, 35 aa, Mycobacterium
KGEAGPRISAALNRYADWAQEMARHADTVGKLAGS

SEQ ID NO: 683535 - protein, 19 aa, Mycobacterium
KGEASLWLEDFRGEVTATM

SEQ ID NO: 683536 - protein, 20 aa, Mycobacterium
KGEHIRVFPLSNWTELDIWQ

SEQ ID NO: 683537 - protein, 19 aa, Mycobacterium
KGEHIRVFPLSNWTEYDIW

SEQ ID NO: 683538 - protein, 20 aa, Mycobacterium
KGEKGPSMWEEVLQNPTVKS

SEQ ID NO: 683539 - protein, 17 aa, Mycobacterium
KGELVIAIVRPRTLFNG

SEQ ID NO: 683540 - protein, 20 aa, Mycobacterium
KGELYAMMLDMRRTFDELVI

SEQ ID NO: 683541 - protein, 22 aa, Mycobacterium
KGEPAPWLREFVHTSAHALLAR

SEQ ID NO: 683542 - protein, 22 aa, Mycobacterium
KGERLHYNRVWVKALGKLPDDP

SEQ ID NO: 683543 - protein, 19 aa, Mycobacterium
KGEVAVLSKRHRKSSKKVV

SEQ ID NO: 683544 - protein, 31 aa, Mycobacterium
KGEVAYGAEFFRWFSEEAVRIDGRYTHAPAG

SEQ ID NO: 683545 - protein, 33 aa, Mycobacterium
KGEVSADELIGWCRDRMAGFKVPRAVQFLDSLP

SEQ ID NO: 683546 - protein, 33 aa, Mycobacterium
KGEVTYGAEFFRWFAEEAVRIDGRYTAAPAGTG

SEQ ID NO: 683547 - protein, 23 aa, Mycobacterium
KGEWYLRQILGAANFKAGRFLAF

SEQ ID NO: 683548 - protein, 17 aa, Mycobacterium
KGEYGAGEVTIWDSGTY

SEQ ID NO: 683549 - protein, 18 aa, Mycobacterium
KGFASSWQQKIIKEIPQT

SEQ ID NO: 683550 - protein, 18 aa, Mycobacterium
KGFCEKLINQGLRVIRFD

SEQ ID NO: 683551 - protein, 23 aa, Mycobacterium
KGFEPLPPRYKTGVLAKYTKLVQ

SEQ ID NO: 683552 - protein, 24 aa, Mycobacterium
KGFFRALDYTLPWDVDGVSDDMPV

SEQ ID NO: 683553 - protein, 18 aa, Mycobacterium
KGFGGFPVSGAFLRTNST

SEQ ID NO: 683554 - protein, 18 aa, Mycobacterium
KGFKSFAAATTLRFEPGI

SEQ ID NO: 683555 - protein, 18 aa, Mycobacterium
KGFKSFAAPTTLRFEPGI

SEQ ID NO: 683556 - protein, 17 aa, Mycobacterium
KGFKSFASPTTLRLEPG

SEQ ID NO: 683557 - protein, 19 aa, Mycobacterium
KGFPCPKAVHPAVWRVVAL

SEQ ID NO: 683558 - protein, 22 aa, Mycobacterium
KGFSDKQIRLIQAFSQVEGNNP

SEQ ID NO: 683559 - protein, 18 aa, Mycobacterium
KGFWKYAEGMDVRRTYDF

SEQ ID NO: 683560 - protein, 20 aa, Mycobacterium
KGGDGGDAATLFGSGGTGGH

SEQ ID NO: 683561 - protein, 23 aa, Mycobacterium
KGGDGGEALIRATVIGSNASGTA

SEQ ID NO: 683562 - protein, 24 aa, Mycobacterium
KGGGHKRAYRLIDFRRHDKDGVNA

SEQ ID NO: 683563 - protein, 24 aa, Mycobacterium
KGGGHKRAYRLIDFRRNDKDGVNA

SEQ ID NO: 683564 - protein, 19 aa, Mycobacterium
KGGGNAWRVDDLTVLSKPK

SEQ ID NO: 683565 - protein, 18 aa, Mycobacterium
KGGGPGVVLIPEIPGIHP

SEQ ID NO: 683566 - protein, 17 aa, Mycobacterium
KGGKGALHLAVESARVL

SEQ ID NO: 683567 - protein, 24 aa, Mycobacterium
KGGLKKGLTLAAARDLVWLYNDPG

SEQ ID NO: 683568 - protein, 23 aa, Mycobacterium
KGGNGGDALVMAAGATGVATGNT

SEQ ID NO: 683569 - protein, 24 aa, Mycobacterium
KGGNLPGDLTFSWYAEDRTRQPYV

SEQ ID NO: 683570 - protein, 19 aa, Mycobacterium
KGGPDYGRFIDALRTLQDR

SEQ ID NO: 683571 - protein, 27 aa, Mycobacterium
KGGRMPRPVFEQMGSLGILGVAIPEEY

SEQ ID NO: 683572 - protein, 17 aa, Mycobacterium
KGGTCVLAGMTSQLTRS

SEQ ID NO: 683573 - protein, 18 aa, Mycobacterium
KGGVLEFGTTVVGEADGS

SEQ ID NO: 683574 - protein, 24 aa, Mycobacterium
KGGWLGMTIPEEYGGHGLGITEAT

SEQ ID NO: 683575 - protein, 27 aa, Mycobacterium
KGGYDMTAFWCRAGAAATITPPGIEGM

SEQ ID NO: 683576 - protein, 26 aa, Mycobacterium
KGGYDMTAFWCRAGTAATITPPGTPG

SEQ ID NO: 683577 - protein, 21 aa, Mycobacterium
KGHAAAARMAGPGRAEVRQLD

SEQ ID NO: 683578 - protein, 25 aa, Mycobacterium
KGHDTFCPLGPWIVTDLDPADLEIR

SEQ ID NO: 683579 - protein, 25 aa, Mycobacterium
KGHDTFCPLGPWIVTDLDPSDVELR

SEQ ID NO: 683580 - protein, 25 aa, Mycobacterium
KGHDTFCPVGPWIVTDIDPSDLEIR

SEQ ID NO: 683581 - protein, 25 aa, Mycobacterium
KGHDTFCPVGPWIVTDLKPLDPGDL

SEQ ID NO: 683582 - protein, 22 aa, Mycobacterium
KGHEYTTMFGWPEPFADGTDKK

SEQ ID NO: 683583 - protein, 21 aa, Mycobacterium
KGHFATMRHAAAYWRAKSKAG

SEQ ID NO: 683584 - protein, 21 aa, Mycobacterium
KGHFATMRHAASYWRGLSKAG

SEQ ID NO: 683585 - protein, 29 aa, Mycobacterium
KGHKREPVTALGWDAALTMYRPLLSYDEL

SEQ ID NO: 683586 - protein, 25 aa, Mycobacterium
KGHPEGLMSFRWFLSDDLPERPVAE

SEQ ID NO: 683587 - protein, 17 aa, Mycobacterium
KGHVRRALAGGGPVAAE

SEQ ID NO: 683588 - protein, 18 aa, Mycobacterium
KGIERWLSQRLSDRLGVC

SEQ ID NO: 683589 - protein, 19 aa, Mycobacterium
KGIGDTGADIFLREVQDVW

SEQ ID NO: 683590 - protein, 28 aa, Mycobacterium
KGIGFEVAKLLAAEGARVAILARTKTDV

SEQ ID NO: 683591 - protein, 26 aa, Mycobacterium
KGIGRGIATVFARAGANVAVAARSPR

SEQ ID NO: 683592 - protein, 27 aa, Mycobacterium
KGIGRGIATVFARAGANVAVAGRSTAD

SEQ ID NO: 683593 - protein, 21 aa, Mycobacterium
KGIHFCLGAPLARLETATVLR

SEQ ID NO: 683594 - protein, 17 aa, Mycobacterium
KGIIIADTKFEFGTDRD

SEQ ID NO: 683595 - protein, 24 aa, Mycobacterium
KGIKRELPHLPPAEVPGMMAMLVE

SEQ ID NO: 683596 - protein, 17 aa, Mycobacterium
KGIPRAKLTGTIQNDIL

SEQ ID NO: 683597 - protein, 21 aa, Mycobacterium
KGIRRELPHLPPSEAPSILMP

SEQ ID NO: 683598 - protein, 21 aa, Mycobacterium
KGIRVNSVAPGYIWGDTLQGY

SEQ ID NO: 683599 - protein, 29 aa, Mycobacterium
KGISIRRAPAPAWSHFTFNGARGAILADK

SEQ ID NO: 683600 - protein, 19 aa, Mycobacterium
KGITDWRAELSPHYEQAQR

SEQ ID NO: 683601 - protein, 19 aa, Mycobacterium
KGITKWGISDVRDLQQWNP

SEQ ID NO: 683602 - protein, 17 aa, Mycobacterium
KGIWCIPVYSNPTGSTY

SEQ ID NO: 683603 - protein, 22 aa, Mycobacterium
KGKAKEAIGTVAGRDDMVREGK

SEQ ID NO: 683604 - protein, 20 aa, Mycobacterium
KGKAKEAVGAVTGQDDLTRE

SEQ ID NO: 683605 - protein, 21 aa, Mycobacterium
KGKAKEVFGAVTGNESLTAEG

SEQ ID NO: 683606 - protein, 20 aa, Mycobacterium
KGKAKEVFGAVTGRDDMKRE

SEQ ID NO: 683607 - protein, 24 aa, Mycobacterium
KGKLPRLSKRLGVLTRTNSESIVG

SEQ ID NO: 683608 - protein, 18 aa, Mycobacterium
KGKMYTRHGSFLQHAGDF

SEQ ID NO: 683609 - protein, 19 aa, Mycobacterium
KGKTLRWVIDHLREADARP

SEQ ID NO: 683610 - protein, 20 aa, Mycobacterium
KGKTLRWVIEHLRSRTAPPA

SEQ ID NO: 683611 - protein, 19 aa, Mycobacterium
KGKTLRWVLDHLTGAESGP

SEQ ID NO: 683612 - protein, 21 aa, Mycobacterium
KGKWPEIWVAAHGPRMLRATG

SEQ ID NO: 683613 - protein, 20 aa, Mycobacterium
KGLAELLERVSVPVHVNAHE

SEQ ID NO: 683614 - protein, 19 aa, Mycobacterium
KGLARKPWVKTTMAPGSQV

SEQ ID NO: 683615 - protein, 32 aa, Mycobacterium
KGLAYEGYRVLPYCWRDETPLSNHELRMDDDV

SEQ ID NO: 683616 - protein, 27 aa, Mycobacterium
KGLELIETHLLFGIDYDRIDVVVHPQS

SEQ ID NO: 683617 - protein, 25 aa, Mycobacterium
KGLELIETHLLFGVDYDDIDVVVHP

SEQ ID NO: 683618 - protein, 33 aa, Mycobacterium
KGLELIETHLLFGVPYRQIGVVVHPQSIVHSMV

SEQ ID NO: 683619 - protein, 21 aa, Mycobacterium
KGLEVQLYFGGPDPEVNTARF

SEQ ID NO: 683620 - protein, 18 aa, Mycobacterium
KGLFAAVPDWRLVIENVV

SEQ ID NO: 683621 - protein, 18 aa, Mycobacterium
KGLGEWLRSRHIDIPEEL

SEQ ID NO: 683622 - protein, 20 aa, Mycobacterium
KGLIKAGHVAAVRFTINGVY

SEQ ID NO: 683623 - protein, 22 aa, Mycobacterium
KGLPGAEGRLKVAPPKPSKLEL

SEQ ID NO: 683624 - protein, 22 aa, Mycobacterium
KGLPGAEGRLKVKPPKPSKLEL

SEQ ID NO: 683625 - protein, 17 aa, Mycobacterium
KGLPLGVQFVAPLGGES

SEQ ID NO: 683626 - protein, 25 aa, Mycobacterium
KGLPPLLLRPVMDAIAFVTESLQLP

SEQ ID NO: 683627 - protein, 24 aa, Mycobacterium
KGLQFPVVYLPFAFNRNVQPRDVV

SEQ ID NO: 683628 - protein, 25 aa, Mycobacterium
KGLQFPVVYLPFAFNRYVPEPDLVL

SEQ ID NO: 683629 - protein, 24 aa, Mycobacterium
KGLQFPVVYLPFSFNRYVPEREYV

SEQ ID NO: 683630 - protein, 20 aa, Mycobacterium
KGLQWYWRGDFFRTIPDGAV

SEQ ID NO: 683631 - protein, 24 aa, Mycobacterium
KGLQYPVVYLPFAFNRNIQERELV

SEQ ID NO: 683632 - protein, 20 aa, Mycobacterium
KGLRHSVYFTQGIRNAVDNG

SEQ ID NO: 683633 - protein, 24 aa, Mycobacterium
KGLRSFRSEVEINFSELALVAIVG

SEQ ID NO: 683634 - protein, 18 aa, Mycobacterium
KGLSILIAPEGTRLDTTE

SEQ ID NO: 683635 - protein, 20 aa, Mycobacterium
KGLSPEFVRRSIVKSLPALM

SEQ ID NO: 683636 - protein, 18 aa, Mycobacterium
KGLTMPIYEAELLAENYR

SEQ ID NO: 683637 - protein, 21 aa, Mycobacterium
KGLVFACWDPSAPEFDEYVGD

SEQ ID NO: 683638 - protein, 25 aa, Mycobacterium
KGLYAKARAGEITHFTGIDSPYQRP

SEQ ID NO: 683639 - protein, 17 aa, Mycobacterium
KGMEFSRVILAGADEKH

SEQ ID NO: 683640 - protein, 22 aa, Mycobacterium
KGMHNRIKWTIVRYQPPEGMTL

SEQ ID NO: 683641 - protein, 19 aa, Mycobacterium
KGMMLDGIPNFAFTVGYQA

SEQ ID NO: 683642 - protein, 22 aa, Mycobacterium
KGMPNRIKWTVVRYKPPEGMTL

SEQ ID NO: 683643 - protein, 24 aa, Mycobacterium
KGMPNRMRWTVVHYRPPESMTLNG

SEQ ID NO: 683644 - protein, 25 aa, Mycobacterium
KGMSPVEWVRFAANFAGERVLKRTA

SEQ ID NO: 683645 - protein, 24 aa, Mycobacterium
KGNEIACPFHDWRWGGDGRCKQIP

SEQ ID NO: 683646 - protein, 21 aa, Mycobacterium
KGNEYFLRHLLGTDSNLQASP

SEQ ID NO: 683647 - protein, 20 aa, Mycobacterium
KGNEYFLRHLLGTTSNLQAA

SEQ ID NO: 683648 - protein, 19 aa, Mycobacterium
KGNGGVMARFPGWHIPILG

SEQ ID NO: 683649 - protein, 23 aa, Mycobacterium
KGNLCRCTGYRAILDALEGKVNV

SEQ ID NO: 683650 - protein, 23 aa, Mycobacterium
KGNLCRCTGYRSITDALDGVSNV

SEQ ID NO: 683651 - protein, 27 aa, Mycobacterium
KGNRHFSFGIGVHRCVGSNVARTVFKS

SEQ ID NO: 683652 - protein, 17 aa, Mycobacterium
KGNVLAIALGHGKTNWV

SEQ ID NO: 683653 - protein, 24 aa, Mycobacterium
KGPDDLKLLIVFNASTAEGKDDIG

SEQ ID NO: 683654 - protein, 17 aa, Mycobacterium
KGPDFPTHGLIVGSQGI

SEQ ID NO: 683655 - protein, 21 aa, Mycobacterium
KGPDFPTYGLIVGSQGIDDTY

SEQ ID NO: 683656 - protein, 19 aa, Mycobacterium
KGPDLSGWGTVHGREKLGG

SEQ ID NO: 683657 - protein, 17 aa, Mycobacterium
KGPDLSGWLSPHGRESL

SEQ ID NO: 683658 - protein, 38 aa, Mycobacterium
KGPEQGQGWMGFGLGVVQWGSWLGWIGNLGGYKCTLFA

SEQ ID NO: 683659 - protein, 18 aa, Mycobacterium
KGPFDEWLERWPADDDTF

SEQ ID NO: 683660 - protein, 29 aa, Mycobacterium
KGPFGTTIAHGFMTLSLLPRLQHDMYTVK

SEQ ID NO: 683661 - protein, 29 aa, Mycobacterium
KGPFGTTIAHGFMTLSLLPRLQHEMYTVK

SEQ ID NO: 683662 - protein, 17 aa, Mycobacterium
KGPFRRFGPVFDIEPDG

SEQ ID NO: 683663 - protein, 26 aa, Mycobacterium
KGPGSWGGTLTPGFRERFGPAYDTEI

SEQ ID NO: 683664 - protein, 21 aa, Mycobacterium
KGPKAYRMTAIPGFPNFFTVL

SEQ ID NO: 683665 - protein, 21 aa, Mycobacterium
KGPPMARGFQYGYLVADEYAA

SEQ ID NO: 683666 - protein, 26 aa, Mycobacterium
KGPQGRRLGKTTGWVHRASLKAKGVQ

SEQ ID NO: 683667 - protein, 17 aa, Mycobacterium
KGPRLGVLGVVLEVDAR

SEQ ID NO: 683668 - protein, 24 aa, Mycobacterium
KGPTQRRWYLISMEFTLYAIREPS

SEQ ID NO: 683669 - protein, 18 aa, Mycobacterium
KGPVAGTGAEMWLKLNPQ

SEQ ID NO: 683670 - protein, 24 aa, Mycobacterium
KGPVELEWKVPKYGSNTIERDRAR

SEQ ID NO: 683671 - protein, 17 aa, Mycobacterium
KGQEMALRSLAFDRAAT

SEQ ID NO: 683672 - protein, 17 aa, Mycobacterium
KGQHWRLLSTVKELDPA

SEQ ID NO: 683673 - protein, 20 aa, Mycobacterium
KGQLDRWTIDLAKGTVHMER

SEQ ID NO: 683674 - protein, 25 aa, Mycobacterium
KGQLEASRASHEWAKGKREDLIGRA

SEQ ID NO: 683675 - protein, 17 aa, Mycobacterium
KGQLLSLHLGRLKDGAG

SEQ ID NO: 683676 - protein, 17 aa, Mycobacterium
KGQLLSLHLGRLKDSVG

SEQ ID NO: 683677 - protein, 22 aa, Mycobacterium
KGQPGPVSVVFLAIDRFKVINS

SEQ ID NO: 683678 - protein, 20 aa, Mycobacterium
KGQQVAWLREVDGVPVVTSA

SEQ ID NO: 683679 - protein, 30 aa, Mycobacterium
KGRAARDMRRRIGLVFQDPFASLNPRARVD

SEQ ID NO: 683680 - protein, 20 aa, Mycobacterium
KGRAETYCGMIFVTFDENAP

SEQ ID NO: 683681 - protein, 18 aa, Mycobacterium
KGRALAVSVMRKHRLAEC

SEQ ID NO: 683682 - protein, 22 aa, Mycobacterium
KGRAQIPAVLGVLAAGGTYVPI

SEQ ID NO: 683683 - protein, 19 aa, Mycobacterium
KGRARRALDSLPRDGLALQ

SEQ ID NO: 683684 - protein, 22 aa, Mycobacterium
KGRDGVSLYDHWADGYKTLHGM

SEQ ID NO: 683685 - protein, 17 aa, Mycobacterium
KGRDVVRAVPLVGEVCY

SEQ ID NO: 683686 - protein, 18 aa, Mycobacterium
KGRDVVRAVPLVGEVCYH

SEQ ID NO: 683687 - protein, 27 aa, Mycobacterium
KGRGRRGMRRYWRGWGRRRRWGRHHGH

SEQ ID NO: 683688 - protein, 20 aa, Mycobacterium
KGRHWFAIYRWVFELDELDG

SEQ ID NO: 683689 - protein, 27 aa, Mycobacterium
KGRMAEIIGALGLRSSDNVSLVTLRVL

SEQ ID NO: 683690 - protein, 21 aa, Mycobacterium
KGRMLPYVIELDGRFCGQLTV

SEQ ID NO: 683691 - protein, 25 aa, Mycobacterium
KGRNVEIPDHFRIFVNDKLTRLERY

SEQ ID NO: 683692 - protein, 24 aa, Mycobacterium
KGRNVEVPDHFRLYVAEKLARLER

SEQ ID NO: 683693 - protein, 18 aa, Mycobacterium
KGRTPKRLHADLEGLKDD

SEQ ID NO: 683694 - protein, 25 aa, Mycobacterium
KGRVGRPRLTYEIAPRLDYADIVAL

SEQ ID NO: 683695 - protein, 21 aa, Mycobacterium
KGSALAWLLTIAHRRAVDRVR

SEQ ID NO: 683696 - protein, 20 aa, Mycobacterium
KGSDLPAEFKLIDRANLLGL

SEQ ID NO: 683697 - protein, 19 aa, Mycobacterium
KGSELMDKWVGSSEKAVRE

SEQ ID NO: 683698 - protein, 20 aa, Mycobacterium
KGSELMDKWVGSSEKAVREL

SEQ ID NO: 683699 - protein, 19 aa, Mycobacterium
KGSGPGVVLIPEIPGIHPG

SEQ ID NO: 683700 - protein, 27 aa, Mycobacterium
KGSGPRPGRLLPAFVELLIATGCRPNE

SEQ ID NO: 683701 - protein, 26 aa, Mycobacterium
KGSGPRPRWVPMLDGLDLVLRWYLDD

SEQ ID NO: 683702 - protein, 18 aa, Mycobacterium
KGSGRVAAKPGLELVSRD

SEQ ID NO: 683703 - protein, 25 aa, Mycobacterium
KGSGRVPGRPSLRVVERDGEQTHVS

SEQ ID NO: 683704 - protein, 24 aa, Mycobacterium
KGSHIRTALTIAHEIAEHDPLVVS

SEQ ID NO: 683705 - protein, 22 aa, Mycobacterium
KGSPQRRGVCTRVYTTTPRKPN

SEQ ID NO: 683706 - protein, 21 aa, Mycobacterium
KGSVAALRFEIRGMVAGEPVI

SEQ ID NO: 683707 - protein, 18 aa, Mycobacterium
KGSWLCLWLHALGAEVTG

SEQ ID NO: 683708 - protein, 20 aa, Mycobacterium
KGTALITMCAGGALSTGTII

SEQ ID NO: 683709 - protein, 24 aa, Mycobacterium
KGTEPRLPTDPSLKPAAAGGGSSG

SEQ ID NO: 683710 - protein, 21 aa, Mycobacterium
KGTFGHQFWAHFRRHGFGFPG

SEQ ID NO: 683711 - protein, 22 aa, Mycobacterium
KGTFLCCQAVSPVMRKNQYGRI

SEQ ID NO: 683712 - protein, 18 aa, Mycobacterium
KGTFVVLRAALAQMTTQD

SEQ ID NO: 683713 - protein, 24 aa, Mycobacterium
KGTGCDICKPTVASILASTSSDHI

SEQ ID NO: 683714 - protein, 19 aa, Mycobacterium
KGTGFAAVLYKGGPTGYRL

SEQ ID NO: 683715 - protein, 24 aa, Mycobacterium
KGTLFRRFGSRAGLMIVLLDEDEK

SEQ ID NO: 683716 - protein, 24 aa, Mycobacterium
KGTLFRRFGSRAGLMMVLLDEDER

SEQ ID NO: 683717 - protein, 25 aa, Mycobacterium
KGTLFRRFGSRAGLMMVLLDEDERT

SEQ ID NO: 683718 - protein, 19 aa, Mycobacterium
KGTLLRRDVPLLVEAARQV

SEQ ID NO: 683719 - protein, 22 aa, Mycobacterium
KGTQPQAAKLVEWLKLALDEPH

SEQ ID NO: 683720 - protein, 22 aa, Mycobacterium
KGTSGMRKNELIAAIKEVRGQA

SEQ ID NO: 683721 - protein, 20 aa, Mycobacterium
KGTSGMRKNELIAAIQEITG

SEQ ID NO: 683722 - protein, 20 aa, Mycobacterium
KGVAVTGLYVGFMDTDMAAG

SEQ ID NO: 683723 - protein, 19 aa, Mycobacterium
KGVDAVVVPGGFSYGDYLR

SEQ ID NO: 683724 - protein, 17 aa, Mycobacterium
KGVDVLGLILGKTDTPA

SEQ ID NO: 683725 - protein, 19 aa, Mycobacterium
KGVEAVVVPGGFSYGDYLR

SEQ ID NO: 683726 - protein, 20 aa, Mycobacterium
KGVEIGDGFETARRRGSVAH

SEQ ID NO: 683727 - protein, 20 aa, Mycobacterium
KGVFERADAVLMVASAVPDG

SEQ ID NO: 683728 - protein, 18 aa, Mycobacterium
KGVGTEFQGGVGEGAAKS

SEQ ID NO: 683729 - protein, 29 aa, Mycobacterium
KGVKGESEGWCPACGSAYSFLPQLNPGEI

SEQ ID NO: 683730 - protein, 17 aa, Mycobacterium
KGVPCLIAVDQDPKGEG

SEQ ID NO: 683731 - protein, 17 aa, Mycobacterium
KGVPCLIAVDQDPSGKG

SEQ ID NO: 683732 - protein, 17 aa, Mycobacterium
KGVPCLIAVDQDPTGNG

SEQ ID NO: 683733 - protein, 19 aa, Mycobacterium
KGVRAHVLFPGGFLNTGIW

SEQ ID NO: 683734 - protein, 17 aa, Mycobacterium
KGVRDFSSGVGRYYYFY

SEQ ID NO: 683735 - protein, 20 aa, Mycobacterium
KGVSDFLWVRINDVPEVLGA

SEQ ID NO: 683736 - protein, 17 aa, Mycobacterium
KGVSLIGEFNHWGGNDA

SEQ ID NO: 683737 - protein, 25 aa, Mycobacterium
KGVTDVIVGFRWPYVKGPDTEPLEQ

SEQ ID NO: 683738 - protein, 20 aa, Mycobacterium
KGVTVPADLLGAADDLSRLL

SEQ ID NO: 683739 - protein, 21 aa, Mycobacterium
KGWEETAFQYAWLLATADGDR

SEQ ID NO: 683740 - protein, 17 aa, Mycobacterium
KGWGWDEILPIFKGFED

SEQ ID NO: 683741 - protein, 21 aa, Mycobacterium
KGWPELFDRLAMALPRLREWV

SEQ ID NO: 683742 - protein, 22 aa, Mycobacterium
KGWTLQEAERWLGPNLGYNPED

SEQ ID NO: 683743 - protein, 21 aa, Mycobacterium
KGYAGSVFEGAGWRGHKSERW

SEQ ID NO: 683744 - protein, 17 aa, Mycobacterium
KGYCFQIEMTWRSVNSG

SEQ ID NO: 683745 - protein, 18 aa, Mycobacterium
KGYHHWGDRFVDHLKGMF

SEQ ID NO: 683746 - protein, 21 aa, Mycobacterium
KGYHVEYGYSCMGYEIAGGIG

SEQ ID NO: 683747 - protein, 18 aa, Mycobacterium
KGYNDAVAEVAVARTNTK

SEQ ID NO: 683748 - protein, 21 aa, Mycobacterium
KHAAMAELFIRATSTPSADER

SEQ ID NO: 683749 - protein, 18 aa, Mycobacterium
KHAAWAITEGLRLELDPS

SEQ ID NO: 683750 - protein, 27 aa, Mycobacterium
KHAESVPQCALAFAELMRDAGVPEGVY

SEQ ID NO: 683751 - protein, 24 aa, Mycobacterium
KHAEVKAGILVVERQFGYLEFHGE

SEQ ID NO: 683752 - protein, 22 aa, Mycobacterium
KHAEVQAGVLVVERQFGYLEFH

SEQ ID NO: 683753 - protein, 23 aa, Mycobacterium
KHAKAMAQRVIKAMPRGPGGTKA

SEQ ID NO: 683754 - protein, 17 aa, Mycobacterium
KHAPWIAAGLITAFHAF

SEQ ID NO: 683755 - protein, 20 aa, Mycobacterium
KHARQLPGRLVGVSMDADGS

SEQ ID NO: 683756 - protein, 17 aa, Mycobacterium
KHASFFIVMAVTNPESR

SEQ ID NO: 683757 - protein, 18 aa, Mycobacterium
KHASLGIVAEQYPIVYEH

SEQ ID NO: 683758 - protein, 17 aa, Mycobacterium
KHDVARENKFGWTSAPN

SEQ ID NO: 683759 - protein, 19 aa, Mycobacterium
KHDVEFFNEFYVLDLALTH

SEQ ID NO: 683760 - protein, 17 aa, Mycobacterium
KHETGQTPMQWVNNVRI

SEQ ID NO: 683761 - protein, 28 aa, Mycobacterium
KHFGPLHVLKDIDLEVGRGQVVVVLGPS

SEQ ID NO: 683762 - protein, 23 aa, Mycobacterium
KHFPDRRFDPVLIDRFNRKIDTL

SEQ ID NO: 683763 - protein, 32 aa, Mycobacterium
KHGAKMVTAVACARVPKLTIVIGGSYGAGNYS

SEQ ID NO: 683764 - protein, 28 aa, Mycobacterium
KHGASSKEARSWWGNFLVQKANEAGIGL

SEQ ID NO: 683765 - protein, 19 aa, Mycobacterium
KHGERFLLGIGVSHAPLID

SEQ ID NO: 683766 - protein, 21 aa, Mycobacterium
KHGGAHGGHVLFIADGHLHYV

SEQ ID NO: 683767 - protein, 18 aa, Mycobacterium
KHGLELLDADSLAALKQD

SEQ ID NO: 683768 - protein, 21 aa, Mycobacterium
KHGLVGLMRLYANLLAPHNIR

SEQ ID NO: 683769 - protein, 18 aa, Mycobacterium
KHGNLEWLPGKTLGMSAA

SEQ ID NO: 683770 - protein, 19 aa, Mycobacterium
KHGSCLAAADFAEFTPEFT

SEQ ID NO: 683771 - protein, 18 aa, Mycobacterium
KHHSWRYHLAVRRWAIDL

SEQ ID NO: 683772 - protein, 24 aa, Mycobacterium
KHIVRRLLAEVGFPVQNLVRTDIG

SEQ ID NO: 683773 - protein, 23 aa, Mycobacterium
KHKFADMKLWLEACRATTAAAVA

SEQ ID NO: 683774 - protein, 25 aa, Mycobacterium
KHKFADMKLWLEACRATTWAAVDDV

SEQ ID NO: 683775 - protein, 19 aa, Mycobacterium
KHKGISCLIVDMTLPGIEV

SEQ ID NO: 683776 - protein, 19 aa, Mycobacterium
KHLATLRRPPGHFDPDGRR

SEQ ID NO: 683777 - protein, 25 aa, Mycobacterium
KHLDAPLVWCVAALLGQHPLSAEQA

SEQ ID NO: 683778 - protein, 24 aa, Mycobacterium
KHLDECPPCLVYLQQMLDLKILLS

SEQ ID NO: 683779 - protein, 20 aa, Mycobacterium
KHLGIRRVAVAASYPEDVAQ

SEQ ID NO: 683780 - protein, 20 aa, Mycobacterium
KHLKRWMRRKRVRGLPMAQQ

SEQ ID NO: 683781 - protein, 18 aa, Mycobacterium
KHLLAMLQARGGGQWATF

SEQ ID NO: 683782 - protein, 20 aa, Mycobacterium
KHLLTHPGLLGRLPILREAN

SEQ ID NO: 683783 - protein, 25 aa, Mycobacterium
KHLPIAMLLVKRGLMTRNQIAEKLQ

SEQ ID NO: 683784 - protein, 21 aa, Mycobacterium
KHLPTVHGFDEFFGNLYHLNA

SEQ ID NO: 683785 - protein, 17 aa, Mycobacterium
KHMGADVNVAWPTAQIA

SEQ ID NO: 683786 - protein, 27 aa, Mycobacterium
KHPEHLRLATWAQLERPAAGPAETSAY

SEQ ID NO: 683787 - protein, 29 aa, Mycobacterium
KHPFDAELVSYVRGVLYFRTKRWPDVLAQ

SEQ ID NO: 683788 - protein, 21 aa, Mycobacterium
KHPHHRGLREPFAAEVHHVNP

SEQ ID NO: 683789 - protein, 21 aa, Mycobacterium
KHPQHRGLREPFATQVSHVNP

SEQ ID NO: 683790 - protein, 21 aa, Mycobacterium
KHPRARAGWDRVSGRIPADTP

SEQ ID NO: 683791 - protein, 17 aa, Mycobacterium
KHPRMLQAYVRAQAGPG

SEQ ID NO: 683792 - protein, 37 aa, Mycobacterium
KHPSLEWIPDWLWKLNLKILGPFAVWVTVGLYDPPVR

SEQ ID NO: 683793 - protein, 21 aa, Mycobacterium
KHPVVRSMSAIYWQGGDTTIE

SEQ ID NO: 683794 - protein, 26 aa, Mycobacterium
KHPWERDWSYGWSLMRIGALLRRTDM

SEQ ID NO: 683795 - protein, 20 aa, Mycobacterium
KHPWKRARTTFQYLAVAIFG

SEQ ID NO: 683796 - protein, 29 aa, Mycobacterium
KHQGPAYLDHISWKFIEDGSVRAAAVQGR

SEQ ID NO: 683797 - protein, 18 aa, Mycobacterium
KHRFIAAQFVALFGDGLW

SEQ ID NO: 683798 - protein, 18 aa, Mycobacterium
KHRGARRIVTGGTPLDDP

SEQ ID NO: 683799 - protein, 20 aa, Mycobacterium
KHRLADLWFEVGAATAAARY

SEQ ID NO: 683800 - protein, 19 aa, Mycobacterium
KHRLADLWFEVGSATAAAR

SEQ ID NO: 683801 - protein, 19 aa, Mycobacterium
KHRLADLWLEVGSARAAAR

SEQ ID NO: 683802 - protein, 18 aa, Mycobacterium
KHRLAELGDRLRAAHAEM

SEQ ID NO: 683803 - protein, 19 aa, Mycobacterium
KHRMADLYVKVASARAVVH

SEQ ID NO: 683804 - protein, 19 aa, Mycobacterium
KHRMADLYVMVAAARSVVA

SEQ ID NO: 683805 - protein, 19 aa, Mycobacterium
KHRMADLYVTIAAAKAVVA

SEQ ID NO: 683806 - protein, 22 aa, Mycobacterium
KHRRRARELTWHSTADLQRMLA

SEQ ID NO: 683807 - protein, 22 aa, Mycobacterium
KHRYGGTVPWTMSPWAVANLGV

SEQ ID NO: 683808 - protein, 20 aa, Mycobacterium
KHSDAVIVLEVEFGLDAAGR

SEQ ID NO: 683809 - protein, 19 aa, Mycobacterium
KHSSQWVVLEVEFGLDAAG

SEQ ID NO: 683810 - protein, 20 aa, Mycobacterium
KHTDFRTGEVEVRRSRRLVI

SEQ ID NO: 683811 - protein, 25 aa, Mycobacterium
KHTPLKMCWVPGYSDYYPEAPGGLP

SEQ ID NO: 683812 - protein, 20 aa, Mycobacterium
KHTQVFRMWLDAVGITEDLQ

SEQ ID NO: 683813 - protein, 19 aa, Mycobacterium
KHTQVFRMWLDAVGVTDDL

SEQ ID NO: 683814 - protein, 19 aa, Mycobacterium
KHTQVFRMWLDSVGVTGDL

SEQ ID NO: 683815 - protein, 20 aa, Mycobacterium
KHTVRAAGAVLWRDASEHGG

SEQ ID NO: 683816 - protein, 25 aa, Mycobacterium
KHVAERAGVTWGVIQYHFGDRNGLL

SEQ ID NO: 683817 - protein, 26 aa, Mycobacterium
KHVAERAGVTWGVIQYHFGDRNGLLM

SEQ ID NO: 683818 - protein, 17 aa, Mycobacterium
KHVDSWGGLMKSKEVGL

SEQ ID NO: 683819 - protein, 22 aa, Mycobacterium
KHVDVPELLRVLDFSPASEAHL

SEQ ID NO: 683820 - protein, 35 aa, Mycobacterium
KHVKAAMLRARRRIMLIGWDFDSRVTFERGRKTLP

SEQ ID NO: 683821 - protein, 24 aa, Mycobacterium
KHWRPGESVPVLPAMQKLSIAQVG

SEQ ID NO: 683822 - protein, 17 aa, Mycobacterium
KHYSVVLVDCVKALESS

SEQ ID NO: 683823 - protein, 24 aa, Mycobacterium
KIAAAPRGRLEWLLLADGMPIAWR

SEQ ID NO: 683824 - protein, 31 aa, Mycobacterium
KIAEANLLARFRGWSAFIGLQVEYSLLERTI

SEQ ID NO: 683825 - protein, 18 aa, Mycobacterium
KIAEGFGCHGEFVEKESE

SEQ ID NO: 683826 - protein, 18 aa, Mycobacterium
KIAEGFGCHGEYVEKEDE

SEQ ID NO: 683827 - protein, 28 aa, Mycobacterium
KIAERLPLRAALLWSRIGDQLSGQPRIE

SEQ ID NO: 683828 - protein, 23 aa, Mycobacterium
KIAHAFGGVVRRLRRDRQELQSS

SEQ ID NO: 683829 - protein, 24 aa, Mycobacterium
KIALGTALARLGMFAPALSYLEEP

SEQ ID NO: 683830 - protein, 22 aa, Mycobacterium
KIALILERLLADRGDSVVGLIR

SEQ ID NO: 683831 - protein, 26 aa, Mycobacterium
KIALPNGYCGLPLQKSCPHANACLTC

SEQ ID NO: 683832 - protein, 23 aa, Mycobacterium
KIANEKCDWMPAVTANGGGRDGL

SEQ ID NO: 683833 - protein, 17 aa, Mycobacterium
KIAPSMGRMSGWQMPFG

SEQ ID NO: 683834 - protein, 19 aa, Mycobacterium
KIARAYTRRQAVVVFDHAY

SEQ ID NO: 683835 - protein, 21 aa, Mycobacterium
KIARMEARAHTARAAYYDAAA

SEQ ID NO: 683836 - protein, 23 aa, Mycobacterium
KIARTDTWDGFPCFTAEICSPML

SEQ ID NO: 683837 - protein, 26 aa, Mycobacterium
KIASWTEPKGGYFISLDVLPGTAKRT

SEQ ID NO: 683838 - protein, 19 aa, Mycobacterium
KIAVASFFAKNFLPLLTST

SEQ ID NO: 683839 - protein, 20 aa, Mycobacterium
KIAVGYAAQADWLVVTTDSG

SEQ ID NO: 683840 - protein, 20 aa, Mycobacterium
KIAVHWPLIDFECGPTGGAD

SEQ ID NO: 683841 - protein, 26 aa, Mycobacterium
KICNDLRLLSSGPRAGFGEINLPPVQ

SEQ ID NO: 683842 - protein, 21 aa, Mycobacterium
KICTPGTPYRPIAMADAPPPT

SEQ ID NO: 683843 - protein, 23 aa, Mycobacterium
KIDGVAARRFFRDEYVLNAQIAR

SEQ ID NO: 683844 - protein, 18 aa, Mycobacterium
KIDLALGKLGLRPGMTLL

SEQ ID NO: 683845 - protein, 34 aa, Mycobacterium
KIDPDVVELPGWYRPNPGLARDLAFIGFSTVSGE

SEQ ID NO: 683846 - protein, 22 aa, Mycobacterium
KIDPRWAKLAGMLQDDSKDRDR

SEQ ID NO: 683847 - protein, 18 aa, Mycobacterium
KIDTRIGIEVFLSDDAKE

SEQ ID NO: 683848 - protein, 20 aa, Mycobacterium
KIDVLRRHCDTVGRDFGEIR

SEQ ID NO: 683849 - protein, 21 aa, Mycobacterium
KIEAALEFKNQVLVKIYNRKA

SEQ ID NO: 683850 - protein, 17 aa, Mycobacterium
KIEACLRAVNGGVPSAH

SEQ ID NO: 683851 - protein, 24 aa, Mycobacterium
KIEDIPEVWRRLDTVGLTSIEACG

SEQ ID NO: 683852 - protein, 24 aa, Mycobacterium
KIEEIGGLITRLSIGGNGERAYLV

SEQ ID NO: 683853 - protein, 17 aa, Mycobacterium
KIEPSLLAWLVRTLPAA

SEQ ID NO: 683854 - protein, 21 aa, Mycobacterium
KIERQGWNALVTMTLNGDVNL

SEQ ID NO: 683855 - protein, 18 aa, Mycobacterium
KIERRYANALGQAELAQN

SEQ ID NO: 683856 - protein, 20 aa, Mycobacterium
KIETRRAFENLPRLLFAAMR

SEQ ID NO: 683857 - protein, 21 aa, Mycobacterium
KIEVDRFFLIGPMHSVSRMVD

SEQ ID NO: 683858 - protein, 25 aa, Mycobacterium
KIEVHYRPRAVVGIIAPWNYPVANA

SEQ ID NO: 683859 - protein, 28 aa, Mycobacterium
KIEVVRELLRLGVPALEIGSMARADLVP

SEQ ID NO: 683860 - protein, 17 aa, Mycobacterium
KIFADNLETAFFMSQAV

SEQ ID NO: 683861 - protein, 22 aa, Mycobacterium
KIFDSRWVPAQATAGAAQAGSW

SEQ ID NO: 683862 - protein, 23 aa, Mycobacterium
KIFFQIYWLGSRDAIAARMERAR

SEQ ID NO: 683863 - protein, 19 aa, Mycobacterium
KIFPAGRFGPRYLSDLHGP

SEQ ID NO: 683864 - protein, 17 aa, Mycobacterium
KIFYRSGTGVTLQATAY

SEQ ID NO: 683865 - protein, 21 aa, Mycobacterium
KIGELLGKWNIRRSVKDPVLR

SEQ ID NO: 683866 - protein, 27 aa, Mycobacterium
KIGGARRCAAQSWSLDRIKSVKKAAGV

SEQ ID NO: 683867 - protein, 27 aa, Mycobacterium
KIGGARRCAAQSWSLDRIKSVKRAAGV

SEQ ID NO: 683868 - protein, 27 aa, Mycobacterium
KIGGARRCAAQSWSLERVKAVKQAAGV

SEQ ID NO: 683869 - protein, 18 aa, Mycobacterium
KIGGEIRRLTSLAEDELY

SEQ ID NO: 683870 - protein, 18 aa, Mycobacterium
KIGGEIRRLTSLSEDELY

SEQ ID NO: 683871 - protein, 18 aa, Mycobacterium
KIGKPLAGVYAMFHTLRR

SEQ ID NO: 683872 - protein, 25 aa, Mycobacterium
KIGLDRPAYVYPMFETAVRIAAGET

SEQ ID NO: 683873 - protein, 20 aa, Mycobacterium
KIGQAFGRDHTTVMYAQRKI

SEQ ID NO: 683874 - protein, 17 aa, Mycobacterium
KIGSLAITEPGGGSDVG

SEQ ID NO: 683875 - protein, 22 aa, Mycobacterium
KIGVGYAGHAEWLIVTADSAVV

SEQ ID NO: 683876 - protein, 23 aa, Mycobacterium
KIGVPYAGSAQWLVVTADTAVVV

SEQ ID NO: 683877 - protein, 23 aa, Mycobacterium
KIGWACGPAELIAGVRAAKQYLS

SEQ ID NO: 683878 - protein, 23 aa, Mycobacterium
KIGWACGPSDLIAGVRAAKQYLS

SEQ ID NO: 683879 - protein, 25 aa, Mycobacterium
KIHGMQCTTMSWPRHADHSSTVGQL

SEQ ID NO: 683880 - protein, 24 aa, Mycobacterium
KIHHCLADGIAIVRMITRLADPGT

SEQ ID NO: 683881 - protein, 18 aa, Mycobacterium
KIHHCMADGIAATHMLAG

SEQ ID NO: 683882 - protein, 18 aa, Mycobacterium
KIHTVDWTPAIIGHPTTV

SEQ ID NO: 683883 - protein, 18 aa, Mycobacterium
KIHTVEWTPAILAHPTLH

SEQ ID NO: 683884 - protein, 18 aa, Mycobacterium
KIHYEAVGVVGAITPWNV

SEQ ID NO: 683885 - protein, 20 aa, Mycobacterium
KIIEEGLRRGLSPEAIQIAL

SEQ ID NO: 683886 - protein, 26 aa, Mycobacterium
KIIGCFRAGGGLPYSEFPRFHQLMAE

SEQ ID NO: 683887 - protein, 19 aa, Mycobacterium
KIIRELFTGELIDFRGEYF

SEQ ID NO: 683888 - protein, 23 aa, Mycobacterium
KIISLELRGCFAMTETGHGSDVQ

SEQ ID NO: 683889 - protein, 25 aa, Mycobacterium
KIKDAFAAMIPRLIATAAELARATK

SEQ ID NO: 683890 - protein, 18 aa, Mycobacterium
KIKEKLGIGAVVTDDGVL

SEQ ID NO: 683891 - protein, 21 aa, Mycobacterium
KIKSFDWEPSYFHRDALYPTK

SEQ ID NO: 683892 - protein, 17 aa, Mycobacterium
KILAHGWAVQYVGSERT

SEQ ID NO: 683893 - protein, 24 aa, Mycobacterium
KILDVACGPGLYTRELAAQLGTAG

SEQ ID NO: 683894 - protein, 20 aa, Mycobacterium
KILGAEFLSRFPGRVVNTHP

SEQ ID NO: 683895 - protein, 20 aa, Mycobacterium
KILGCDAVVLAARIAELLKG

SEQ ID NO: 683896 - protein, 20 aa, Mycobacterium
KILGCFRRGGGLQYQDYPRF

SEQ ID NO: 683897 - protein, 22 aa, Mycobacterium
KILKRVLISEGLDIADETLWYR

SEQ ID NO: 683898 - protein, 26 aa, Mycobacterium
KILLNAKTRRPSVCNAAETLLVDRAL

SEQ ID NO: 683899 - protein, 27 aa, Mycobacterium
KILPIPAEAATPFGIMSDALKDSIVGK

SEQ ID NO: 683900 - protein, 21 aa, Mycobacterium
KILPPKVAYPIARWINIGQLI

SEQ ID NO: 683901 - protein, 27 aa, Mycobacterium
KILSPARIRRALTVSRLLAPILTPIIY

SEQ ID NO: 683902 - protein, 20 aa, Mycobacterium
KILTGRAGDFDTLRQKDGLS

SEQ ID NO: 683903 - protein, 18 aa, Mycobacterium
KINACLAAPLADGAPLGV

SEQ ID NO: 683904 - protein, 25 aa, Mycobacterium
KINEPRFPSFKGIMAAKKKEVAVLT

SEQ ID NO: 683905 - protein, 25 aa, Mycobacterium
KINEPRFPSFKGIMAAKKKEVTTLT

SEQ ID NO: 683906 - protein, 25 aa, Mycobacterium
KINEPRFPSFKGIMAAKKKEVTVLS

SEQ ID NO: 683907 - protein, 26 aa, Mycobacterium
KINEPRFPSFKGIMAAKKKEVTVLTL

SEQ ID NO: 683908 - protein, 21 aa, Mycobacterium
KIPAGGGWRMLGRTVGNRNSK

SEQ ID NO: 683909 - protein, 18 aa, Mycobacterium
KIPGAPVPTGRRVPAAWL

SEQ ID NO: 683910 - protein, 24 aa, Mycobacterium
KIPIIDIAAAPGFGNSTTTASSGF

SEQ ID NO: 683911 - protein, 24 aa, Mycobacterium
KIPLPYYRTKLRVEQLLADSGVPH

SEQ ID NO: 683912 - protein, 21 aa, Mycobacterium
KIPLVMLLEGAGFRPTGGHYG

SEQ ID NO: 683913 - protein, 20 aa, Mycobacterium
KIPPRTLAAVKVRHSNADGR

SEQ ID NO: 683914 - protein, 17 aa, Mycobacterium
KIPRYVHVVDEFPMTVT

SEQ ID NO: 683915 - protein, 20 aa, Mycobacterium
KIPSVLLPLWDSELSTGLVS

SEQ ID NO: 683916 - protein, 29 aa, Mycobacterium
KIPSYKSCFLALVRRFYELGVKDLNGHLL

SEQ ID NO: 683917 - protein, 29 aa, Mycobacterium
KIPSYKSCFLAMMRRFYDQGLTEINGHLL

SEQ ID NO: 683918 - protein, 27 aa, Mycobacterium
KIPTPAARWAFCNGMTPAQRRLTMSKL

SEQ ID NO: 683919 - protein, 19 aa, Mycobacterium
KIPYGRAMAQQEINRVLIE

SEQ ID NO: 683920 - protein, 20 aa, Mycobacterium
KIQGGFLDFDAAIATPDQMA

SEQ ID NO: 683921 - protein, 20 aa, Mycobacterium
KIQSFATFRIRTENGNDTQT

SEQ ID NO: 683922 - protein, 19 aa, Mycobacterium
KIQTPWCLSHHPPSPPTTD

SEQ ID NO: 683923 - protein, 24 aa, Mycobacterium
KIRAFPMGPGFLIDGKPVILTAPK

SEQ ID NO: 683924 - protein, 19 aa, Mycobacterium
KIRAVDFTINYEVRSVNAA

SEQ ID NO: 683925 - protein, 17 aa, Mycobacterium
KIRKANQHMAMFSVDAD

SEQ ID NO: 683926 - protein, 20 aa, Mycobacterium
KIRLGRFADGPTVWRNGETI

SEQ ID NO: 683927 - protein, 21 aa, Mycobacterium
KIRLGRFATGSAHWATGEQVR

SEQ ID NO: 683928 - protein, 19 aa, Mycobacterium
KIRLGRFATGSTYWADGET

SEQ ID NO: 683929 - protein, 20 aa, Mycobacterium
KIRPSDVYRPIGEVWDEISR

SEQ ID NO: 683930 - protein, 20 aa, Mycobacterium
KIRRAACVEHYRRQQFTRLD

SEQ ID NO: 683931 - protein, 17 aa, Mycobacterium
KIRSRRVTGLTVQQQRQ

SEQ ID NO: 683932 - protein, 17 aa, Mycobacterium
KIRTEFLDPVYVDTDPA

SEQ ID NO: 683933 - protein, 22 aa, Mycobacterium
KIRTVAHPWAAPVISTADPAID

SEQ ID NO: 683934 - protein, 33 aa, Mycobacterium
KIRYGGFSNFPAWRIAGAAARADLLGMPRPICI

SEQ ID NO: 683935 - protein, 26 aa, Mycobacterium
KISFQGLPARICWLGYGERDKAGVLF

SEQ ID NO: 683936 - protein, 18 aa, Mycobacterium
KISLEAVADLLLFDADNP

SEQ ID NO: 683937 - protein, 18 aa, Mycobacterium
KISLPQIHARVKALAAEQ

SEQ ID NO: 683938 - protein, 20 aa, Mycobacterium
KISRDLWPAPELVMDTGNSI

SEQ ID NO: 683939 - protein, 17 aa, Mycobacterium
KISSLPDLLPLLEKVAE

SEQ ID NO: 683940 - protein, 24 aa, Mycobacterium
KISSRPASPLAEWIARGTVDDISF

SEQ ID NO: 683941 - protein, 17 aa, Mycobacterium
KITELEPGTSWTWEQRA

SEQ ID NO: 683942 - protein, 18 aa, Mycobacterium
KITGWVAAMSREIGDSTV

SEQ ID NO: 683943 - protein, 26 aa, Mycobacterium
KITLDEWNRYLAVNLTGTFLCIRAAL

SEQ ID NO: 683944 - protein, 25 aa, Mycobacterium
KITLDEWNRYLAVNLTGTFLSIRAA

SEQ ID NO: 683945 - protein, 25 aa, Mycobacterium
KITRFAPNFKDIVIRYITFAPYHMQ

SEQ ID NO: 683946 - protein, 18 aa, Mycobacterium
KITRRLWAGESVSYTGQL

SEQ ID NO: 683947 - protein, 19 aa, Mycobacterium
KITVFPAREIITMCEAMPT

SEQ ID NO: 683948 - protein, 24 aa, Mycobacterium
KITWQNSCRFFGWDPFKLTPRDQA

SEQ ID NO: 683949 - protein, 19 aa, Mycobacterium
KIVAGQLFSSIGMSEHGAG

SEQ ID NO: 683950 - protein, 20 aa, Mycobacterium
KIVDRPNLLIKIPATEAGVP

SEQ ID NO: 683951 - protein, 23 aa, Mycobacterium
KIVEIPRPAGVVLALTPTTNPVA

SEQ ID NO: 683952 - protein, 23 aa, Mycobacterium
KIVELPRPAGVVLALTPTTNPVA

SEQ ID NO: 683953 - protein, 25 aa, Mycobacterium
KIVGDFGSLPVWFPFVTASELDPPG

SEQ ID NO: 683954 - protein, 23 aa, Mycobacterium
KIVPVCPYVKKFVGKHHEFDDIV

SEQ ID NO: 683955 - protein, 18 aa, Mycobacterium
KIVRDRILDIGYDSSTKG

SEQ ID NO: 683956 - protein, 18 aa, Mycobacterium
KIVTGIRSATWIVVVGIV

SEQ ID NO: 683957 - protein, 22 aa, Mycobacterium
KIYLDLRVKVAKNWQRDPKQLG

SEQ ID NO: 683958 - protein, 18 aa, Mycobacterium
KIYPALHDYLRASGVPLL

SEQ ID NO: 683959 - protein, 28 aa, Mycobacterium
KKADPSLRIAILEARFAGFGASGRNGGW

SEQ ID NO: 683960 - protein, 22 aa, Mycobacterium
KKAGYRDCWHVLIYGRENQKRF

SEQ ID NO: 683961 - protein, 24 aa, Mycobacterium
KKAKDRLLELSIDMHSTGPDVMGR

SEQ ID NO: 683962 - protein, 19 aa, Mycobacterium
KKALLLGGTLYRGGVQATP

SEQ ID NO: 683963 - protein, 19 aa, Mycobacterium
KKALYILNVLFEMEARKAA

SEQ ID NO: 683964 - protein, 21 aa, Mycobacterium
KKANGISAFMVHKDDEGFTVG

SEQ ID NO: 683965 - protein, 18 aa, Mycobacterium
KKAPARKAATKAPAKKAA

SEQ ID NO: 683966 - protein, 21 aa, Mycobacterium
KKAPDAPGWHSAARYVARQPL

SEQ ID NO: 683967 - protein, 19 aa, Mycobacterium
KKARAKSSGVRRLDDDDRV

SEQ ID NO: 683968 - protein, 24 aa, Mycobacterium
KKARSARVGQLIAERAKAAGVDTV

SEQ ID NO: 683969 - protein, 21 aa, Mycobacterium
KKAVIDARRGKNFAKLIKNIE

SEQ ID NO: 683970 - protein, 21 aa, Mycobacterium
KKCLLDLAELIGFDTRIDERA

SEQ ID NO: 683971 - protein, 22 aa, Mycobacterium
KKCLLDLAELVGFDTAIDERAV

SEQ ID NO: 683972 - protein, 17 aa, Mycobacterium
KKDGWDFIKSRKQSGVY

SEQ ID NO: 683973 - protein, 22 aa, Mycobacterium
KKDILAALVRLALERPLAVADE

SEQ ID NO: 683974 - protein, 19 aa, Mycobacterium
KKDKCIRVAMRPGVSTVTG

SEQ ID NO: 683975 - protein, 20 aa, Mycobacterium
KKDLLGRVAAVVGVNTPICT

SEQ ID NO: 683976 - protein, 30 aa, Mycobacterium
KKDRLFDLIERMRLPTVFFAEGGGGRPGDT

SEQ ID NO: 683977 - protein, 26 aa, Mycobacterium
KKDRLFELIERMALPTVFFAEGGGGR

SEQ ID NO: 683978 - protein, 21 aa, Mycobacterium
KKDYPLIEVGKWTLNRNPRNY

SEQ ID NO: 683979 - protein, 19 aa, Mycobacterium
KKEVLARVCASARPDTIIG

SEQ ID NO: 683980 - protein, 28 aa, Mycobacterium
KKFFLPRIAKGDLHFSIGYSEPGAGTDL

SEQ ID NO: 683981 - protein, 17 aa, Mycobacterium
KKFGRLIYIGSVSGSWG

SEQ ID NO: 683982 - protein, 20 aa, Mycobacterium
KKFKELIAVAIGVVAGCDGC

SEQ ID NO: 683983 - protein, 18 aa, Mycobacterium
KKGAARTEEVHVAKVPDH

SEQ ID NO: 683984 - protein, 24 aa, Mycobacterium
KKGAKTDVFCRFSTVLGSRGSADT

SEQ ID NO: 683985 - protein, 17 aa, Mycobacterium
KKGHLVLGLVKTLTALA

SEQ ID NO: 683986 - protein, 17 aa, Mycobacterium
KKGKLVFKQAGIANPAV

SEQ ID NO: 683987 - protein, 19 aa, Mycobacterium
KKGPFPLDAFEKVIKINLI

SEQ ID NO: 683988 - protein, 23 aa, Mycobacterium
KKGRRTFYRMSFDSGYLPRPGEP

SEQ ID NO: 683989 - protein, 21 aa, Mycobacterium
KKGRSESGLTHVSITSVTVNG

SEQ ID NO: 683990 - protein, 23 aa, Mycobacterium
KKHAGSFYDWKYRQQFRSTRHVL

SEQ ID NO: 683991 - protein, 18 aa, Mycobacterium
KKHLEKFSDGATRFMPQS

SEQ ID NO: 683992 - protein, 24 aa, Mycobacterium
KKHLLEVARRLDVRGRSTMTKDEL

SEQ ID NO: 683993 - protein, 27 aa, Mycobacterium
KKHPWERDWSYGWSLMRIGALLRRSDM

SEQ ID NO: 683994 - protein, 23 aa, Mycobacterium
KKHRYGGTIPWTMSPWAVTNLGL

SEQ ID NO: 683995 - protein, 20 aa, Mycobacterium
KKHVPRFAGHMAAAAQSVAV

SEQ ID NO: 683996 - protein, 20 aa, Mycobacterium
KKIDYCIAEDCSYIDSTTFQ

SEQ ID NO: 683997 - protein, 24 aa, Mycobacterium
KKIISLELRGCFAMTETGHGSDVQ

SEQ ID NO: 683998 - protein, 19 aa, Mycobacterium
KKIKEKLGIGAVLTDDEVV

SEQ ID NO: 683999 - protein, 20 aa, Mycobacterium
KKIKEKLGIGAVVTAEADDV

SEQ ID NO: 684000 - protein, 20 aa, Mycobacterium
KKIKEKLGIGAVVTDDLSDD

SEQ ID NO: 684001 - protein, 19 aa, Mycobacterium
KKIKEKLGIGAVVTDDPSN

SEQ ID NO: 684002 - protein, 19 aa, Mycobacterium
KKIKEKLGIGAVVTDGLSD

SEQ ID NO: 684003 - protein, 20 aa, Mycobacterium
KKILAGVLVMTGIGGAGLLS

SEQ ID NO: 684004 - protein, 24 aa, Mycobacterium
KKKFLPRCAAGAISAFLLTEPDVG

SEQ ID NO: 684005 - protein, 25 aa, Mycobacterium
KKKFLPRCAAGAISAFLLTEPDVGS

SEQ ID NO: 684006 - protein, 21 aa, Mycobacterium
KKKLFRPKVPIVVVVGEPIEP

SEQ ID NO: 684007 - protein, 24 aa, Mycobacterium
KKKPRPLVDAMLFGSSSNQYGSPQ

SEQ ID NO: 684008 - protein, 23 aa, Mycobacterium
KKKSRGRLLRAIDQVSITAGVPG

SEQ ID NO: 684009 - protein, 25 aa, Mycobacterium
KKLAKRYRQAWNLYYQTVIRRVSKR

SEQ ID NO: 684010 - protein, 21 aa, Mycobacterium
KKLALIDVREQVEWDIVHIDG

SEQ ID NO: 684011 - protein, 17 aa, Mycobacterium
KKLDRYYGEFVRVGHAL

SEQ ID NO: 684012 - protein, 17 aa, Mycobacterium
KKLEGLGLVTSRVERDE

SEQ ID NO: 684013 - protein, 18 aa, Mycobacterium
KKLEGLGLVTSRVERDEG

SEQ ID NO: 684014 - protein, 33 aa, Mycobacterium
KKLEIRSGDALIIRTGFMAARRGNWRDYAGGAA

SEQ ID NO: 684015 - protein, 25 aa, Mycobacterium
KKLERTRISGVLINLQPDRSASKPR

SEQ ID NO: 684016 - protein, 20 aa, Mycobacterium
KKLFEMMGTLTPEVIASDAE

SEQ ID NO: 684017 - protein, 19 aa, Mycobacterium
KKLFGENFFGTNPSLGTDP

SEQ ID NO: 684018 - protein, 19 aa, Mycobacterium
KKLFGRAIGNTRLRTEGRA

SEQ ID NO: 684019 - protein, 18 aa, Mycobacterium
KKLGAEVHPCARIAKASE

SEQ ID NO: 684020 - protein, 17 aa, Mycobacterium
KKLGIPPLATNDCHYVT

SEQ ID NO: 684021 - protein, 17 aa, Mycobacterium
KKLGISHTRLWAPAYLP

SEQ ID NO: 684022 - protein, 27 aa, Mycobacterium
KKLPSVAETIDWARTVLALGMDTIDDE

SEQ ID NO: 684023 - protein, 27 aa, Mycobacterium
KKLPSVAETIDWGRTVLALGMDTIDDE

SEQ ID NO: 684024 - protein, 39 aa, Mycobacterium
KKLPSVQVGDPFMEKVLIECCLELYAGHLVVGIQDLGGA

SEQ ID NO: 684025 - protein, 38 aa, Mycobacterium
KKLPSVQVGDPFMEKVLIECCLELYSGGLVIGIQDLGG

SEQ ID NO: 684026 - protein, 18 aa, Mycobacterium
KKLRAVIEKGHQGAAEIL

SEQ ID NO: 684027 - protein, 26 aa, Mycobacterium
KKLRDILSVLRDAYCRHVGVEYTHIL

SEQ ID NO: 684028 - protein, 19 aa, Mycobacterium
KKLRIRRYSVITAASALVV

SEQ ID NO: 684029 - protein, 18 aa, Mycobacterium
KKLSAPVGIRADCLGVQD

SEQ ID NO: 684030 - protein, 31 aa, Mycobacterium; identical to SEQ ID NO: 81462

SEQ ID NO: 684031 - protein, 22 aa, Mycobacterium
KKLSPKGTGAVLSFELAGGVEA

SEQ ID NO: 684032 - protein, 24 aa, Mycobacterium
KKLVEMPKDLAIRLILDNYATHEH

SEQ ID NO: 684033 - protein, 25 aa, Mycobacterium
KKLWHRLCAELELPALHAPPEYGGA

SEQ ID NO: 684034 - protein, 19 aa, Mycobacterium
KKLYPSYIERLKNDGRDDL

SEQ ID NO: 684035 - protein, 21 aa, Mycobacterium
KKLYRTRLWLRSEANISVIEH

SEQ ID NO: 684036 - protein, 25 aa, Mycobacterium
KKMLRFGRVTVRFGKPMDFTRFEGL

SEQ ID NO: 684037 - protein, 26 aa, Mycobacterium
KKNVAKQRLVWRFCQQYPQAARRLIR

SEQ ID NO: 684038 - protein, 19 aa, Mycobacterium
KKPGVHAVHLSKGKKPKIV

SEQ ID NO: 684039 - protein, 33 aa, Mycobacterium
KKPNKPVPQRGWRRWVYAVTRINFGLSPDEKYE

SEQ ID NO: 684040 - protein, 24 aa, Mycobacterium
KKPRPARPELVVLCDVSGSVAGFS

SEQ ID NO: 684041 - protein, 18 aa, Mycobacterium
KKPTAINGILGRGKNVVT

SEQ ID NO: 684042 - protein, 17 aa, Mycobacterium
KKPVVLIGGLNGAGKTT

SEQ ID NO: 684043 - protein, 26 aa, Mycobacterium
KKQAELLAALGDEYRGTAGGDHPKKK

SEQ ID NO: 684044 - protein, 19 aa, Mycobacterium
KKQGELIGPVFSSKDAIEG

SEQ ID NO: 684045 - protein, 21 aa, Mycobacterium
KKQMIAWWGPIIDEYYAASEA

SEQ ID NO: 684046 - protein, 20 aa, Mycobacterium
KKQVRCVYVAIGQKGTTIAS

SEQ ID NO: 684047 - protein, 21 aa, Mycobacterium
KKQVRCVYVAIGQKGTTIASV

SEQ ID NO: 684048 - protein, 18 aa, Mycobacterium
KKRKAVREPSVAKGAGLV

SEQ ID NO: 684049 - protein, 35 aa, Mycobacterium
KKRKMSFPAAIRSNFRSLPVVDVIQVRRLGAAMSF

SEQ ID NO: 684050 - protein, 19 aa, Mycobacterium
KKRLESVGLGELSLDLHDK

SEQ ID NO: 684051 - protein, 18 aa, Mycobacterium
KKRLPSMYHQFKELAEVD

SEQ ID NO: 684052 - protein, 22 aa, Mycobacterium
KKRNALTAAMWTAIAELVPELA

SEQ ID NO: 684053 - protein, 25 aa, Mycobacterium
KKRPEFGKLTPLYPNQRLRLETTTE

SEQ ID NO: 684054 - protein, 26 aa, Mycobacterium
KKRPEFTKLTPLYPNQRLRLETSSDK

SEQ ID NO: 684055 - protein, 22 aa, Mycobacterium
KKRPFYFGALTWYMDRLLELVH

SEQ ID NO: 684056 - protein, 18 aa, Mycobacterium
KKRQAARDSRWVPHEVIE

SEQ ID NO: 684057 - protein, 18 aa, Mycobacterium
KKRSVWLADSFEGVPPPD

SEQ ID NO: 684058 - protein, 20 aa, Mycobacterium
KKRWIPKMVSGEMVIAVAMT

SEQ ID NO: 684059 - protein, 33 aa, Mycobacterium
KKSEPEWMLQARLKALRIFERKPMPTWGSNLEG

SEQ ID NO: 684060 - protein, 20 aa, Mycobacterium
KKSFRAWYDGEWFRVGMAEE

SEQ ID NO: 684061 - protein, 18 aa, Mycobacterium
KKSLAERIVYGALEQARE

SEQ ID NO: 684062 - protein, 27 aa, Mycobacterium
KKSMPVPMLTFRLWRPLSHDTMEVWSW

SEQ ID NO: 684063 - protein, 19 aa, Mycobacterium
KKSTFEHGTITWKPGDAQA

SEQ ID NO: 684064 - protein, 19 aa, Mycobacterium
KKTLRLVAQYADIWNSMSN

SEQ ID NO: 684065 - protein, 20 aa, Mycobacterium
KKTLRLVAQYADIWNSTVTE

SEQ ID NO: 684066 - protein, 18 aa, Mycobacterium
KKTLWRVVDPAPKQMPEI

SEQ ID NO: 684067 - protein, 27 aa, Mycobacterium
KKTPRRQCLRITLGTGRNKVTATFFNA

SEQ ID NO: 684068 - protein, 26 aa, Mycobacterium
KKVALWRVLVALSIRHVGPTAARALA

SEQ ID NO: 684069 - protein, 17 aa, Mycobacterium
KKVASWGADAVIVQGGE

SEQ ID NO: 684070 - protein, 17 aa, Mycobacterium
KKVCNTCPVRAQCLNHA

SEQ ID NO: 684071 - protein, 24 aa, Mycobacterium
KKVDFYLRLRAIGIFPDDAPHTIR

SEQ ID NO: 684072 - protein, 27 aa, Mycobacterium
KKVLAINLVGTFDCIRIAATAMSRNEP

SEQ ID NO: 684073 - protein, 20 aa, Mycobacterium
KKVLEAWGAFGEKTMYGKTV

SEQ ID NO: 684074 - protein, 19 aa, Mycobacterium
KKVLESGLSIPQLVKTAWS

SEQ ID NO: 684075 - protein, 18 aa, Mycobacterium
KKVLGFDPDKTFEVREDV

SEQ ID NO: 684076 - protein, 28 aa, Mycobacterium
KKVPSVAETIDWGRTILALGLDTLDDAV

SEQ ID NO: 684077 - protein, 18 aa, Mycobacterium
KKVSVPLVPGETLLESAR

SEQ ID NO: 684078 - protein, 19 aa, Mycobacterium
KKVVFCGTLTAGGLTIDLA

SEQ ID NO: 684079 - protein, 20 aa, Mycobacterium
KKWSKESGEPVIDRLATIVS

SEQ ID NO: 684080 - protein, 18 aa, Mycobacterium
KKYEIIRINGAYQHVSDN

SEQ ID NO: 684081 - protein, 18 aa, Mycobacterium
KKYGLPFMYWNLMLKGLA

SEQ ID NO: 684082 - protein, 19 aa, Mycobacterium
KKYLVLCELSHDMVIGMYS

SEQ ID NO: 684083 - protein, 17 aa, Mycobacterium
KLAAAGVGRIILNGRSA

SEQ ID NO: 684084 - protein, 18 aa, Mycobacterium
KLAAKLRAGGARVDLAYG

SEQ ID NO: 684085 - protein, 19 aa, Mycobacterium
KLAALKPAFTEDGVIHAGN

SEQ ID NO: 684086 - protein, 19 aa, Mycobacterium
KLAALKPAFVEDGVIHAGN

SEQ ID NO: 684087 - protein, 23 aa, Mycobacterium
KLAALRPVFRAGGIVTAGSSSPL

SEQ ID NO: 684088 - protein, 18 aa, Mycobacterium
KLAANRPGTFLLESAEHG

SEQ ID NO: 684089 - protein, 18 aa, Mycobacterium
KLAANRPGTFLLESAENG

SEQ ID NO: 684090 - protein, 25 aa, Mycobacterium
KLAAVKPRLDLIVVEASGLAEPAAL

SEQ ID NO: 684091 - protein, 18 aa, Mycobacterium
KLADACERGGSTLFGSGV

SEQ ID NO: 684092 - protein, 24 aa, Mycobacterium
KLADELRAAPGLVYGYTAALDTAA

SEQ ID NO: 684093 - protein, 18 aa, Mycobacterium
KLADGICVDGMESLLPVL

SEQ ID NO: 684094 - protein, 24 aa, Mycobacterium
KLADGRPGTFLLESAENGRSWSRW

SEQ ID NO: 684095 - protein, 22 aa, Mycobacterium
KLADLVLWEPAFFGVRPHAVVK

SEQ ID NO: 684096 - protein, 26 aa, Mycobacterium
KLAEAHGFSHLWTFDSHLLWQEPYVL

SEQ ID NO: 684097 - protein, 17 aa, Mycobacterium
KLAELGYDVVLAARRAA

SEQ ID NO: 684098 - protein, 23 aa, Mycobacterium
KLAELVFPAPPAPIAATGGDPVS

SEQ ID NO: 684099 - protein, 19 aa, Mycobacterium
KLAEMIVDVEAALALIFDG

SEQ ID NO: 684100 - protein, 25 aa, Mycobacterium
KLAETLADFAYAYLVTVGDDYRAHT

SEQ ID NO: 684101 - protein, 22 aa, Mycobacterium
KLAEVCNRLGVTTGSFYHYFPN

SEQ ID NO: 684102 - protein, 21 aa, Mycobacterium
KLAEVPWRQGAEVARGDLGDV

SEQ ID NO: 684103 - protein, 26 aa, Mycobacterium
KLAEYARLDFLAGLRVVPAELGGEAG

SEQ ID NO: 684104 - protein, 18 aa, Mycobacterium
KLAFAEAQAGWIPYYLQR

SEQ ID NO: 684105 - protein, 24 aa, Mycobacterium
KLAGEYKKLLLAMLQRRDAWQIVD

SEQ ID NO: 684106 - protein, 20 aa, Mycobacterium
KLAGIHERGGVPIEVKTNPL

SEQ ID NO: 684107 - protein, 22 aa, Mycobacterium
KLAGLRPAAVICEIVSQKDEGA

SEQ ID NO: 684108 - protein, 18 aa, Mycobacterium
KLAKFGFEALHYDIKGDH

SEQ ID NO: 684109 - protein, 21 aa, Mycobacterium
KLAKLEGDAAFFWAPDGDAKV

SEQ ID NO: 684110 - protein, 20 aa, Mycobacterium
KLALERLAAGLGVPHPDLAE

SEQ ID NO: 684111 - protein, 19 aa, Mycobacterium
KLALVARFTARRAADSEDE

SEQ ID NO: 684112 - protein, 25 aa, Mycobacterium
KLANALRSWSVLRFEVTEDPSPGVD

SEQ ID NO: 684113 - protein, 30 aa, Mycobacterium
KLANMALEYGKGVLLALHLGRRKDADTLAT

SEQ ID NO: 684114 - protein, 19 aa, Mycobacterium
KLANRAIGYAGQLAGIGVS

SEQ ID NO: 684115 - protein, 19 aa, Mycobacterium
KLAPKGTGAVLSFELAGGV

SEQ ID NO: 684116 - protein, 17 aa, Mycobacterium
KLARAMVNLHRRYRLAT

SEQ ID NO: 684117 - protein, 17 aa, Mycobacterium
KLARASGVTAVIDSKAV

SEQ ID NO: 684118 - protein, 18 aa, Mycobacterium
KLARASGVTAVIDSTAVP

SEQ ID NO: 684119 - protein, 17 aa, Mycobacterium
KLARMGLANYFAAATVL

SEQ ID NO: 684120 - protein, 25 aa, Mycobacterium
KLARRGELRAAPRLSHVIANSHAVA

SEQ ID NO: 684121 - protein, 18 aa, Mycobacterium
KLARSAGVSIQLLGKEGT

SEQ ID NO: 684122 - protein, 33 aa, Mycobacterium
KLARTRIAVQLARAHLSYGEWLRRCNRRIDARS

SEQ ID NO: 684123 - protein, 19 aa, Mycobacterium
KLASGLLCGNIASALVGTS

SEQ ID NO: 684124 - protein, 19 aa, Mycobacterium
KLAVRYHLLDFLDDKSHSK

SEQ ID NO: 684125 - protein, 22 aa, Mycobacterium
KLCDPEGLIPLQDIASVRGVKP

SEQ ID NO: 684126 - protein, 18 aa, Mycobacterium
KLCHIPIVVLTTSSAEED

SEQ ID NO: 684127 - protein, 24 aa, Mycobacterium
KLDACRDLGADLAINYRDTDFVQA

SEQ ID NO: 684128 - protein, 24 aa, Mycobacterium
KLDALLRMLDPYGIREIVQSGVVA

SEQ ID NO: 684129 - protein, 17 aa, Mycobacterium
KLDARARIGHLLDPGTF

SEQ ID NO: 684130 - protein, 25 aa, Mycobacterium
KLDAVIGGAVLKHSRDFNLMRECVL

SEQ ID NO: 684131 - protein, 32 aa, Mycobacterium
KLDDLAERVGWRWRLIWYKAVAELLTGDYDSA

SEQ ID NO: 684132 - protein, 31 aa, Mycobacterium
KLDDLAERVGWRWRLVWFRAVSELLTADYDS

SEQ ID NO: 684133 - protein, 25 aa, Mycobacterium
KLDELKALWFSEAQKYNGLPLGDLD

SEQ ID NO: 684134 - protein, 31 aa, Mycobacterium
KLDIAADGTFEWRFTPAVPSQLVIREVYNDW

SEQ ID NO: 684135 - protein, 23 aa, Mycobacterium
KLDLLNQRVEAIYKALKADVEIG

SEQ ID NO: 684136 - protein, 19 aa, Mycobacterium
KLDLLSAWAEAAGVFDDAE

SEQ ID NO: 684137 - protein, 25 aa, Mycobacterium
KLDLPAADGIMLLAAHISRHGTLTE

SEQ ID NO: 684138 - protein, 20 aa, Mycobacterium
KLDLVILEYRPGMPTDAQES

SEQ ID NO: 684139 - protein, 21 aa, Mycobacterium
KLDRSRPLWELWVIEGVEGGR

SEQ ID NO: 684140 - protein, 18 aa, Mycobacterium
KLDTWRRAIATAPYLLSK

SEQ ID NO: 684141 - protein, 32 aa, Mycobacterium
KLEDLAARVGWRWRLVWFKAVSEMLSADYDSA

SEQ ID NO: 684142 - protein, 23 aa, Mycobacterium
KLEELKALWFSEAAKYNGLPLSD

SEQ ID NO: 684143 - protein, 19 aa, Mycobacterium
KLEERCRQLGESIDQARTT

SEQ ID NO: 684144 - protein, 27 aa, Mycobacterium
KLEETFMFYLPRICEHCLNPSCVASCP

SEQ ID NO: 684145 - protein, 18 aa, Mycobacterium
KLEEVGWMRLAVGAPDKR

SEQ ID NO: 684146 - protein, 17 aa, Mycobacterium
KLEEVGWMRLAVGTPDV

SEQ ID NO: 684147 - protein, 22 aa, Mycobacterium
KLEEVLQWPAGTIARIRQGESV

SEQ ID NO: 684148 - protein, 20 aa, Mycobacterium
KLEHELGVPLVLRGSNFEGL

SEQ ID NO: 684149 - protein, 19 aa, Mycobacterium
KLEKVVIRFAGDSGDGMQL

SEQ ID NO: 684150 - protein, 24 aa, Mycobacterium
KLELSSLPFVLGFKQPAQGFRNLG

SEQ ID NO: 684151 - protein, 20 aa, Mycobacterium
KLEPGRRALVRTGVAVAIPF

SEQ ID NO: 684152 - protein, 23 aa, Mycobacterium
KLEPMKPILASVGRFVTNGLDQA

SEQ ID NO: 684153 - protein, 21 aa, Mycobacterium
KLEQQAIFRKTWLQMGRIELI

SEQ ID NO: 684154 - protein, 24 aa, Mycobacterium
KLEQQAIFRRTWLHVGRVERLPKT

SEQ ID NO: 684155 - protein, 21 aa, Mycobacterium
KLESEGGFNPVRRRIFHLEIG

SEQ ID NO: 684156 - protein, 18 aa, Mycobacterium
KLEVVADVRPELVSFTFG

SEQ ID NO: 684157 - protein, 19 aa, Mycobacterium
KLFAERGATVFGIARDADR

SEQ ID NO: 684158 - protein, 23 aa, Mycobacterium
KLFASEVAMEIALNAVRIHGGYG

SEQ ID NO: 684159 - protein, 24 aa, Mycobacterium
KLFASEVAMEIALNAVRIHGGYGY

SEQ ID NO: 684160 - protein, 19 aa, Mycobacterium
KLFESLWRLDFLAMALHPS

SEQ ID NO: 684161 - protein, 18 aa, Mycobacterium
KLFESVIKGHVKVLVGPK

SEQ ID NO: 684162 - protein, 25 aa, Mycobacterium
KLFGETCPRQALVLPLAETSNAGAV

SEQ ID NO: 684163 - protein, 21 aa, Mycobacterium
KLFGRTGLNFDDLDLIELNEA

SEQ ID NO: 684164 - protein, 19 aa, Mycobacterium
KLFRGLFRGTGKYYSGVKW

SEQ ID NO: 684165 - protein, 17 aa, Mycobacterium
KLFSWTWWRSGRGRRLG

SEQ ID NO: 684166 - protein, 21 aa, Mycobacterium
KLFTRDGWMRMGDICEIDADG

SEQ ID NO: 684167 - protein, 20 aa, Mycobacterium
KLFVRQGFDSWDEIPARIAI

SEQ ID NO: 684168 - protein, 19 aa, Mycobacterium
KLGAVPQPLSARLPDAELQ

SEQ ID NO: 684169 - protein, 21 aa, Mycobacterium
KLGAVPQPLSPRMPDAEFEAI

SEQ ID NO: 684170 - protein, 25 aa, Mycobacterium
KLGAVPVPLNTRWAAPEKLFVLEHS

SEQ ID NO: 684171 - protein, 17 aa, Mycobacterium
KLGCYGIQRIHPLKNVM

SEQ ID NO: 684172 - protein, 19 aa, Mycobacterium
KLGECPEVVAIRDRHREHY

SEQ ID NO: 684173 - protein, 17 aa, Mycobacterium
KLGEDMESYLILGACNP

SEQ ID NO: 684174 - protein, 19 aa, Mycobacterium
KLGEFEFRAQAVIVTSGGI

SEQ ID NO: 684175 - protein, 30 aa, Mycobacterium
KLGELRPLYRPGLIHMYHALTWGPLVREIV

SEQ ID NO: 684176 - protein, 29 aa, Mycobacterium
KLGELRPLYRPGLVHMYHALTWGPLMREI

SEQ ID NO: 684177 - protein, 18 aa, Mycobacterium
KLGGEMFGGGAVGLDPDV

SEQ ID NO: 684178 - protein, 21 aa, Mycobacterium
KLGGLGAEIPVSDWLFTDEAL

SEQ ID NO: 684179 - protein, 20 aa, Mycobacterium
KLGGMWRFLGRDMAAVSGTS

SEQ ID NO: 684180 - protein, 21 aa, Mycobacterium
KLGICRDLGADITINYREEDF

SEQ ID NO: 684181 - protein, 18 aa, Mycobacterium
KLGKGDIIDSMFMSKKAL

SEQ ID NO: 684182 - protein, 25 aa, Mycobacterium
KLGKIPAGGGWRMLGRTAGRKNSLA

SEQ ID NO: 684183 - protein, 24 aa, Mycobacterium
KLGLDVCWVAEAWGADAPSALGYL

SEQ ID NO: 684184 - protein, 24 aa, Mycobacterium
KLGLDVCWVAEAWGSDAPSALGYL

SEQ ID NO: 684185 - protein, 21 aa, Mycobacterium
KLGLDVCWVAEAWGTDGPSAL

SEQ ID NO: 684186 - protein, 18 aa, Mycobacterium
KLGLDWPADALTMIGMQR

SEQ ID NO: 684187 - protein, 21 aa, Mycobacterium
KLGLGDLRMDPAVLEHQAAVA

SEQ ID NO: 684188 - protein, 18 aa, Mycobacterium
KLGLPQGFGARPMVRHGP

SEQ ID NO: 684189 - protein, 22 aa, Mycobacterium
KLGLQPGMTLLDIGCGWGSTIQ

SEQ ID NO: 684190 - protein, 24 aa, Mycobacterium
KLGMKRIRLSTERLISLSMTGKQR

SEQ ID NO: 684191 - protein, 20 aa, Mycobacterium
KLGQAVDIVTDWLLRHDFAS

SEQ ID NO: 684192 - protein, 18 aa, Mycobacterium
KLGQLGVTASQWQDLRAQ

SEQ ID NO: 684193 - protein, 23 aa, Mycobacterium
KLGRAKIPVTVQVGAPLQVREDI

SEQ ID NO: 684194 - protein, 19 aa, Mycobacterium
KLGRFGVFGRGVTPQQAKD

SEQ ID NO: 684195 - protein, 24 aa, Mycobacterium
KLGRGGLTDIEWTVQLLQLRHAHE

SEQ ID NO: 684196 - protein, 18 aa, Mycobacterium
KLGRGHRYRFDYDRCTGC

SEQ ID NO: 684197 - protein, 18 aa, Mycobacterium
KLGRSYHAVREALSASGQ

SEQ ID NO: 684198 - protein, 20 aa, Mycobacterium
KLGTEMYLKSADMVENSTGG

SEQ ID NO: 684199 - protein, 19 aa, Mycobacterium
KLGTFPLFQYWGPTANITS

SEQ ID NO: 684200 - protein, 20 aa, Mycobacterium
KLGVAAFELLVVNLYPFSQT

SEQ ID NO: 684201 - protein, 19 aa, Mycobacterium
KLGWLDKIVSPECVLTHDV

SEQ ID NO: 684202 - protein, 20 aa, Mycobacterium
KLHDLYLATCGLRRADMATA

SEQ ID NO: 684203 - protein, 17 aa, Mycobacterium
KLHEDWGSTPAAIDACL

SEQ ID NO: 684204 - protein, 21 aa, Mycobacterium
KLHELHAATGLVVHLAVLDGP

SEQ ID NO: 684205 - protein, 18 aa, Mycobacterium
KLHHPMWREHCDVDLEYH

SEQ ID NO: 684206 - protein, 18 aa, Mycobacterium
KLHLWRYGIDPEDVAGVL

SEQ ID NO: 684207 - protein, 17 aa, Mycobacterium
KLHPEILAATRAVADQL

SEQ ID NO: 684208 - protein, 18 aa, Mycobacterium
KLHPPMLRAMGLDHKLTL

SEQ ID NO: 684209 - protein, 23 aa, Mycobacterium
KLHSGQTLIGFLAPRNAENSIGA

SEQ ID NO: 684210 - protein, 17 aa, Mycobacterium
KLHTRRTLLDGTLELLK

SEQ ID NO: 684211 - protein, 17 aa, Mycobacterium
KLIADKMFEEFKEPLYG

SEQ ID NO: 684212 - protein, 20 aa, Mycobacterium
KLIDCANAYCTVGEMVSALK

SEQ ID NO: 684213 - protein, 19 aa, Mycobacterium
KLIDCANVYCTVGEMVSTL

SEQ ID NO: 684214 - protein, 17 aa, Mycobacterium
KLIDKYRATMTAAPNFA

SEQ ID NO: 684215 - protein, 18 aa, Mycobacterium
KLIEEAQDLFGTGEQPQI

SEQ ID NO: 684216 - protein, 17 aa, Mycobacterium
KLIELAFSLGRLGSAGI

SEQ ID NO: 684217 - protein, 22 aa, Mycobacterium
KLIKNIEVAARVGGGDPGGNPT

SEQ ID NO: 684218 - protein, 18 aa, Mycobacterium
KLILECPKPVLAVKPVAD

SEQ ID NO: 684219 - protein, 21 aa, Mycobacterium
KLINSGFSRRQVQLLEPKVRQ

SEQ ID NO: 684220 - protein, 23 aa, Mycobacterium
KLINSGFTRRQVAILEPKLRAFA

SEQ ID NO: 684221 - protein, 27 aa, Mycobacterium
KLINSGFTRRRVALLEPKIREIVRGIL

SEQ ID NO: 684222 - protein, 20 aa, Mycobacterium
KLIQSWPVYRQLTGSDPLGR

SEQ ID NO: 684223 - protein, 26 aa, Mycobacterium
KLIRAAERPVLFVGLRVGDPAPCAAL

SEQ ID NO: 684224 - protein, 17 aa, Mycobacterium
KLIRRDISMKAFDAGEP

SEQ ID NO: 684225 - protein, 20 aa, Mycobacterium
KLIRRRRYRSRPKTSATRTT

SEQ ID NO: 684226 - protein, 25 aa, Mycobacterium
KLIRSKGVGVFFCTQLPTDLPNDVL

SEQ ID NO: 684227 - protein, 25 aa, Mycobacterium
KLIRSKGVGVFFCTQLPTDVPNDVL

SEQ ID NO: 684228 - protein, 18 aa, Mycobacterium
KLKALSLLNYFHHVGFRK

SEQ ID NO: 684229 - protein, 21 aa, Mycobacterium
KLKARADAVTAIRAGIDGLAA

SEQ ID NO: 684230 - protein, 20 aa, Mycobacterium
KLKDLPSLGISVLGEAHDTA

SEQ ID NO: 684231 - protein, 21 aa, Mycobacterium
KLKHRNARKCSMFTRSAFSRF

SEQ ID NO: 684232 - protein, 21 aa, Mycobacterium
KLKTIPGMVAGVVPLALPTSP

SEQ ID NO: 684233 - protein, 22 aa, Mycobacterium
KLKTPYSALLPVLSQAFFGIQS

SEQ ID NO: 684234 - protein, 17 aa, Mycobacterium
KLKVCRLGISAASDAIE

SEQ ID NO: 684235 - protein, 18 aa, Mycobacterium
KLKVGIVEAGSKWMFPLL

SEQ ID NO: 684236 - protein, 18 aa, Mycobacterium
KLKVHGMENLRVADSSIM

SEQ ID NO: 684237 - protein, 24 aa, Mycobacterium
KLKWQRTEPEFAYSDRERDGLLEA

SEQ ID NO: 684238 - protein, 25 aa, Mycobacterium
KLLAQRTATIPGFRQRLLTRPFGLG

SEQ ID NO: 684239 - protein, 21 aa, Mycobacterium
KLLCRHHHLLKTFYTGPDGWR

SEQ ID NO: 684240 - protein, 21 aa, Mycobacterium
KLLDFMPAFEVDWAGCKRVHM

SEQ ID NO: 684241 - protein, 26 aa, Mycobacterium
KLLDGYGLACVGGFVPVVLFSDDHDP

SEQ ID NO: 684242 - protein, 19 aa, Mycobacterium
KLLDVSVLRNAGWLPKISL

SEQ ID NO: 684243 - protein, 22 aa, Mycobacterium
KLLEARFGREAMLDQIVNDAVP

SEQ ID NO: 684244 - protein, 17 aa, Mycobacterium
KLLEAVAATGVREVEAT

SEQ ID NO: 684245 - protein, 25 aa, Mycobacterium
KLLEEREFPASSVRFFASARSEGKK

SEQ ID NO: 684246 - protein, 23 aa, Mycobacterium
KLLEERKGLFTKLLADETGQPPT

SEQ ID NO: 684247 - protein, 22 aa, Mycobacterium
KLLEIKDQWGIKQITEPRHMHG

SEQ ID NO: 684248 - protein, 17 aa, Mycobacterium
KLLEKAANLTITEDEAA

SEQ ID NO: 684249 - protein, 18 aa, Mycobacterium
KLLEKVKFPLVSKDQLSD

SEQ ID NO: 684250 - protein, 20 aa, Mycobacterium
KLLELRRILEPFAVRVAASR

SEQ ID NO: 684251 - protein, 39 aa, Mycobacterium
KLLEMHKGPFVLAGWSLGGALAYACAIGLKQSGADVRFV

SEQ ID NO: 684252 - protein, 17 aa, Mycobacterium
KLLGARTGEKGKVYFPP

SEQ ID NO: 684253 - protein, 25 aa, Mycobacterium
KLLGFSIKRAVTWSEEAGNTRPRYA

SEQ ID NO: 684254 - protein, 18 aa, Mycobacterium
KLLGGRTGAGGRVYFPAR

SEQ ID NO: 684255 - protein, 19 aa, Mycobacterium
KLLGSEALQRACEDALDSA

SEQ ID NO: 684256 - protein, 18 aa, Mycobacterium
KLLGSVTLQRVWDLAAVA

SEQ ID NO: 684257 - protein, 20 aa, Mycobacterium
KLLIRKAGAASADMAAELAK

SEQ ID NO: 684258 - protein, 17 aa, Mycobacterium
KLLKGTRLRIDVAQLRF

SEQ ID NO: 684259 - protein, 17 aa, Mycobacterium
KLLPRGWAAEIAGQIAG

SEQ ID NO: 684260 - protein, 17 aa, Mycobacterium
KLLPSGWAAQIAAQISG

SEQ ID NO: 684261 - protein, 19 aa, Mycobacterium
KLLQPMGLVHGGVYCSIIE

SEQ ID NO: 684262 - protein, 18 aa, Mycobacterium
KLLRACGRIDGLERVRFT

SEQ ID NO: 684263 - protein, 26 aa, Mycobacterium
KLLRERAEPAVAPWIHRGLTSQDVLD

SEQ ID NO: 684264 - protein, 20 aa, Mycobacterium
KLLRGMPVVGPLAYALMHSL

SEQ ID NO: 684265 - protein, 17 aa, Mycobacterium
KLLRLEVRNAETPIERK

SEQ ID NO: 684266 - protein, 30 aa, Mycobacterium
KLLRRIGLAAGKYWVCKRATPHAAEAMECL

SEQ ID NO: 684267 - protein, 18 aa, Mycobacterium
KLLSSAALGRLVTSIAGE

SEQ ID NO: 684268 - protein, 21 aa, Mycobacterium
KLLSVMPMVLAPPFVSEAFHH

SEQ ID NO: 684269 - protein, 17 aa, Mycobacterium
KLLVEIGPRPVLTAAAL

SEQ ID NO: 684270 - protein, 18 aa, Mycobacterium
KLMPVLGVVRARGVQHAI

SEQ ID NO: 684271 - protein, 22 aa, Mycobacterium
KLMRDIPFRVGAVVGSPASYAG

SEQ ID NO: 684272 - protein, 18 aa, Mycobacterium
KLNAISVDLNEELSQTIV

SEQ ID NO: 684273 - protein, 17 aa, Mycobacterium
KLNAVVAKSVWDHASDA

SEQ ID NO: 684274 - protein, 31 aa, Mycobacterium
KLNPELIDELPLPRPKFEIFVYSPRVEGVHL

SEQ ID NO: 684275 - protein, 21 aa, Mycobacterium
KLPAGFGFSDTAFRIFVLMAT

SEQ ID NO: 684276 - protein, 17 aa, Mycobacterium
KLPIFGGPFRWDDLEWL

SEQ ID NO: 684277 - protein, 27 aa, Mycobacterium
KLPIFGGPFRWDDLEWLRSETDLPLMV

SEQ ID NO: 684278 - protein, 24 aa, Mycobacterium
KLPKLKADLARALDDLGKIPDYNS

SEQ ID NO: 684279 - protein, 21 aa, Mycobacterium
KLPLDCDEDGKILSPKAATLL

SEQ ID NO: 684280 - protein, 20 aa, Mycobacterium
KLPLTMSKVRFIKFIMDEIY

SEQ ID NO: 684281 - protein, 22 aa, Mycobacterium
KLPNDQFLLYGFDGDTGDLGAA

SEQ ID NO: 684282 - protein, 19 aa, Mycobacterium
KLPPEKLAEVQGVQLRCNA

SEQ ID NO: 684283 - protein, 25 aa, Mycobacterium
KLPPWNEVLQNLGFSNTTTAVTRPA

SEQ ID NO: 684284 - protein, 20 aa, Mycobacterium
KLPSFTPMMLPRAGRSNIVP

SEQ ID NO: 684285 - protein, 20 aa, Mycobacterium
KLPSGAGQVWSQWHSLVFDV

SEQ ID NO: 684286 - protein, 27 aa, Mycobacterium
KLPSIAETIDWGRTVLALGLDTIDDAV

SEQ ID NO: 684287 - protein, 22 aa, Mycobacterium
KLPSSGRPAAVLVLVSADGAVT

SEQ ID NO: 684288 - protein, 23 aa, Mycobacterium
KLPSYPWQTKRFWNDTHEAEEAL

SEQ ID NO: 684289 - protein, 20 aa, Mycobacterium
KLPTMAALLIKESVNQTVDA

SEQ ID NO: 684290 - protein, 18 aa, Mycobacterium
KLPTSMWIEIVTTAHEVG

SEQ ID NO: 684291 - protein, 19 aa, Mycobacterium
KLPVGNWPVLGGMGNASWV

SEQ ID NO: 684292 - protein, 19 aa, Mycobacterium
KLPVLFLCENNLYAMGTAL

SEQ ID NO: 684293 - protein, 24 aa, Mycobacterium
KLPYERLFEPAISYGRNGFLVSPT

SEQ ID NO: 684294 - protein, 24 aa, Mycobacterium
KLQLWVAACLYRYFVEQHEFLHGP

SEQ ID NO: 684295 - protein, 26 aa, Mycobacterium
KLQRLRLPWWHVWRAADAVGAATPKH

SEQ ID NO: 684296 - protein, 20 aa, Mycobacterium
KLQSPWRGGIGHTWEARVKL

SEQ ID NO: 684297 - protein, 21 aa, Mycobacterium
KLQVGRLWVERALSTTTSAQP

SEQ ID NO: 684298 - protein, 19 aa, Mycobacterium
KLRAAPSGRRAREVNAAEA

SEQ ID NO: 684299 - protein, 25 aa, Mycobacterium
KLRALKRLKVVAAFQNSTNSPGGMV

SEQ ID NO: 684300 - protein, 25 aa, Mycobacterium
KLRALKRLKVVAAFQTNRNSPMGMV

SEQ ID NO: 684301 - protein, 18 aa, Mycobacterium
KLRARADALAAIRAGIDG

SEQ ID NO: 684302 - protein, 17 aa, Mycobacterium
KLRAVVEPFSAELGAEL

SEQ ID NO: 684303 - protein, 24 aa, Mycobacterium
KLRDACPPERLHELSEEFQRAKSL

SEQ ID NO: 684304 - protein, 27 aa, Mycobacterium
KLRDGQAHRIRRCISCENCIDAMEQRF

SEQ ID NO: 684305 - protein, 28 aa, Mycobacterium
KLRDPELEEWLGISRTPIREALARLETA

SEQ ID NO: 684306 - protein, 32 aa, Mycobacterium
KLRDWLFARQRYWGEPFPIVYDEDGRPRALGE

SEQ ID NO: 684307 - protein, 17 aa, Mycobacterium
KLREAGALWERLTQAAG

SEQ ID NO: 684308 - protein, 26 aa, Mycobacterium
KLRERLGFGDLRWAVSGAAPIPKETL

SEQ ID NO: 684309 - protein, 21 aa, Mycobacterium
KLRFPAPVPVDSRIRAGAELL

SEQ ID NO: 684310 - protein, 18 aa, Mycobacterium
KLRGAGIMTAERTVDPAV

SEQ ID NO: 684311 - protein, 19 aa, Mycobacterium
KLRGETVALLIADYRMPQM

SEQ ID NO: 684312 - protein, 22 aa, Mycobacterium
KLRHALPGAVFVSARTGDGIDA

SEQ ID NO: 684313 - protein, 22 aa, Mycobacterium
KLRHALPGAVFVSARTGDGVDA

SEQ ID NO: 684314 - protein, 21 aa, Mycobacterium
KLRHEIGIDIIAWECDYPHSD

SEQ ID NO: 684315 - protein, 17 aa, Mycobacterium
KLRIASVENGSAWIKPL

SEQ ID NO: 684316 - protein, 17 aa, Mycobacterium
KLRKALGQMVHVNLIPL

SEQ ID NO: 684317 - protein, 20 aa, Mycobacterium
KLRNCARDGGAELLAAYSHA

SEQ ID NO: 684318 - protein, 19 aa, Mycobacterium
KLRNKMAYSHSGYPGGLRK

SEQ ID NO: 684319 - protein, 23 aa, Mycobacterium
KLRNRPRLGVSVLAEGHDEACIS

SEQ ID NO: 684320 - protein, 19 aa, Mycobacterium
KLRPDIPVVGSRFTLALVA

SEQ ID NO: 684321 - protein, 24 aa, Mycobacterium
KLRPLRAKFGFVFQDPATALNPKM

SEQ ID NO: 684322 - protein, 20 aa, Mycobacterium
KLRPPVYGILRYISDAVDEI

SEQ ID NO: 684323 - protein, 18 aa, Mycobacterium
KLRPSRGTHLVFDAAMFG

SEQ ID NO: 684324 - protein, 18 aa, Mycobacterium
KLRPSRGTHLVFRAASFG

SEQ ID NO: 684325 - protein, 19 aa, Mycobacterium
KLRPVTRVGKFTNLPALLA

SEQ ID NO: 684326 - protein, 17 aa, Mycobacterium
KLRQFSAEFGIDRRIAH

SEQ ID NO: 684327 - protein, 20 aa, Mycobacterium
KLRREPGMNLGRMADIGGCR

SEQ ID NO: 684328 - protein, 26 aa, Mycobacterium
KLRSLLRDYQEAFGLPDDGWVLDELR

SEQ ID NO: 684329 - protein, 18 aa, Mycobacterium
KLRVAVIDHGTWKHHREG

SEQ ID NO: 684330 - protein, 20 aa, Mycobacterium
KLRVQMRGEIARLQKRLGTT

SEQ ID NO: 684331 - protein, 29 aa, Mycobacterium
KLSAEAGAILGRWCAALTRAFTHDGFDEP

SEQ ID NO: 684332 - protein, 20 aa, Mycobacterium
KLSDAAFVRELISNYLNISS

SEQ ID NO: 684333 - protein, 18 aa, Mycobacterium
KLSEFGAITVIRGDVRDP

SEQ ID NO: 684334 - protein, 18 aa, Mycobacterium
KLSEGDWTLDREAADAVL

SEQ ID NO: 684335 - protein, 18 aa, Mycobacterium
KLSELGEFAVIDRLVADR

SEQ ID NO: 684336 - protein, 23 aa, Mycobacterium
KLSELPTEFGMILMLPQSGTRRP

SEQ ID NO: 684337 - protein, 25 aa, Mycobacterium
KLSELWFDALAGICAHVRDGGGGLT

SEQ ID NO: 684338 - protein, 19 aa, Mycobacterium
KLSEVARVAMVTNLLTEDN

SEQ ID NO: 684339 - protein, 31 aa, Mycobacterium
KLSFETARFIKFIITEIFPGGRLPSTGMMVE

SEQ ID NO: 684340 - protein, 18 aa, Mycobacterium
KLSGKRIIIDPGRGGADH

SEQ ID NO: 684341 - protein, 18 aa, Mycobacterium
KLSGKRIIIDPGRGGSDR

SEQ ID NO: 684342 - protein, 19 aa, Mycobacterium
KLSGLKPAFTDDGVIHAGN

SEQ ID NO: 684343 - protein, 21 aa, Mycobacterium
KLSLRFVGWAEVAKAGSDLVE

SEQ ID NO: 684344 - protein, 25 aa, Mycobacterium
KLSPEQLDELALYLNFDMLGSTNTG

SEQ ID NO: 684345 - protein, 25 aa, Mycobacterium
KLSPWIPTLKLHYVRVIPTGITGRH

SEQ ID NO: 684346 - protein, 18 aa, Mycobacterium
KLSRRYRVPVLSVHAPCL

SEQ ID NO: 684347 - protein, 23 aa, Mycobacterium
KLSRYVAVGAPLWSRAEGYHQLE

SEQ ID NO: 684348 - protein, 23 aa, Mycobacterium
KLSSEELLVFLGVIANAGTETVG

SEQ ID NO: 684349 - protein, 23 aa, Mycobacterium
KLSSLAVPLNFAMYALNFLDKGI

SEQ ID NO: 684350 - protein, 26 aa, Mycobacterium
KLSTEAGAILGRWCTALTRAFVNDGF

SEQ ID NO: 684351 - protein, 18 aa, Mycobacterium
KLSTSIDEWLEDRRQLLA

SEQ ID NO: 684352 - protein, 19 aa, Mycobacterium
KLSVEGGKVTGERETDEGL

SEQ ID NO: 684353 - protein, 17 aa, Mycobacterium
KLSVGLGRLAAEDPTLR

SEQ ID NO: 684354 - protein, 19 aa, Mycobacterium
KLSVPAGWSAAVPADDAAA

SEQ ID NO: 684355 - protein, 19 aa, Mycobacterium
KLSVPPGWSATGPVPVPSV

SEQ ID NO: 684356 - protein, 31 aa, Mycobacterium
KLTFETARFIKFIITEIFPGGRLPSTQMMVD

SEQ ID NO: 684357 - protein, 19 aa, Mycobacterium
KLTGFAWSEEVLARVNKLV

SEQ ID NO: 684358 - protein, 20 aa, Mycobacterium
KLTKKFAYRHSGYPGGLRKR

SEQ ID NO: 684359 - protein, 18 aa, Mycobacterium
KLTLDWDQHQPLKIEAQF

SEQ ID NO: 684360 - protein, 18 aa, Mycobacterium
KLTLKSGAAGVGREINLA

SEQ ID NO: 684361 - protein, 19 aa, Mycobacterium
KLTMARIVTSAGPEAVGIS

SEQ ID NO: 684362 - protein, 19 aa, Mycobacterium
KLTMPVRVLFGLDDVAVHP

SEQ ID NO: 684363 - protein, 18 aa, Mycobacterium
KLTPLETVVEGFEQLPTA

SEQ ID NO: 684364 - protein, 25 aa, Mycobacterium
KLTRAADHSKLWFVIAAGLGAVGGN

SEQ ID NO: 684365 - protein, 18 aa, Mycobacterium
KLTRAEVRAGLYRSPESI

SEQ ID NO: 684366 - protein, 17 aa, Mycobacterium
KLVAAHEAFHGRTMGSL

SEQ ID NO: 684367 - protein, 21 aa, Mycobacterium
KLVGSAVVEFARHPDQWQLLL

SEQ ID NO: 684368 - protein, 19 aa, Mycobacterium
KLVHPLIVFVETLSRTETP

SEQ ID NO: 684369 - protein, 24 aa, Mycobacterium
KLVIPMRVIMSVAAILCQLDAHVP

SEQ ID NO: 684370 - protein, 20 aa, Mycobacterium
KLVIRDLLGRLGVGSDTVRT

SEQ ID NO: 684371 - protein, 24 aa, Mycobacterium
KLVKACAPPTLSDDGSKVYSVTGQ

SEQ ID NO: 684372 - protein, 19 aa, Mycobacterium
KLVKSIAELVVKKFEESYT

SEQ ID NO: 684373 - protein, 19 aa, Mycobacterium
KLVLVRPAPVPGLVKPRSL

SEQ ID NO: 684374 - protein, 21 aa, Mycobacterium
KLVMRRRLEALDVPVPRYAEI

SEQ ID NO: 684375 - protein, 19 aa, Mycobacterium
KLVQDRGFGEIGVAVGTSS

SEQ ID NO: 684376 - protein, 30 aa, Mycobacterium
KLVRLGGAGRGFCSGAGIGADDVSGTGVPP

SEQ ID NO: 684377 - protein, 23 aa, Mycobacterium
KLVRTNRSNQHWIVEQSQGGEVK

SEQ ID NO: 684378 - protein, 17 aa, Mycobacterium
KLVSLLEKLRHEVPPPT

SEQ ID NO: 684379 - protein, 32 aa, Mycobacterium
KLVVECLRLSADCLICLTVRGKHRCDGRRHLI

SEQ ID NO: 684380 - protein, 27 aa, Mycobacterium
KLVVFPEATMCRFGVPLGPVAQPLDGP

SEQ ID NO: 684381 - protein, 22 aa, Mycobacterium
KLWAQACHWEPVTPKTLRLLQV

SEQ ID NO: 684382 - protein, 20 aa, Mycobacterium
KLWDAAEWSVQAQLDYLRRN

SEQ ID NO: 684383 - protein, 18 aa, Mycobacterium
KLWDEWGEDTIVEDRPAG

SEQ ID NO: 684384 - protein, 19 aa, Mycobacterium
KLWEGSWEPDAVVRDRERG

SEQ ID NO: 684385 - protein, 21 aa, Mycobacterium
KLWTQACDWEPVTPKSLRLLQ

SEQ ID NO: 684386 - protein, 20 aa, Mycobacterium
KLYADCLEKMTGRRPVIFYT

SEQ ID NO: 684387 - protein, 18 aa, Mycobacterium
KLYCRTHHLIKTFYTGPN

SEQ ID NO: 684388 - protein, 18 aa, Mycobacterium
KLYDGTDMQEEQKLDDEM

SEQ ID NO: 684389 - protein, 20 aa, Mycobacterium
KLYGPGGVGIAEFCDDHVTA

SEQ ID NO: 684390 - protein, 25 aa, Mycobacterium
KLYGYKWPTLDGMFTPHASDVTFDI

SEQ ID NO: 684391 - protein, 24 aa, Mycobacterium
KLYGYKWPTLEGMFTPHASDVTFD

SEQ ID NO: 684392 - protein, 19 aa, Mycobacterium
KMAALKPAFKEDGVIHAGN

SEQ ID NO: 684393 - protein, 28 aa, Mycobacterium
KMAAVAAKRGWPILKFSSRSGASPASQV

SEQ ID NO: 684394 - protein, 17 aa, Mycobacterium
KMAKRGGGAIVNQSSTA

SEQ ID NO: 684395 - protein, 24 aa, Mycobacterium
KMALASLLDMMWADEYVDERDARF

SEQ ID NO: 684396 - protein, 24 aa, Mycobacterium
KMANEKCDWMPAVASGDGRDQIIH

SEQ ID NO: 684397 - protein, 23 aa, Mycobacterium
KMAVICLIGAMLIEDGHSDDQKL

SEQ ID NO: 684398 - protein, 22 aa, Mycobacterium
KMAVICLIGAMLVEDGHSDDQK

SEQ ID NO: 684399 - protein, 19 aa, Mycobacterium
KMAYLEAIQFDFDDSSPGV

SEQ ID NO: 684400 - protein, 22 aa, Mycobacterium
KMDRWSKGRVALVGDAAYCCSP

SEQ ID NO: 684401 - protein, 20 aa, Mycobacterium
KMEDGLRLGAKHYYATADPD

SEQ ID NO: 684402 - protein, 20 aa, Mycobacterium
KMEDGLRLGAKHYYATADRE

SEQ ID NO: 684403 - protein, 39 aa, Mycobacterium
KMFCGCANRFGAEPNTLVCPVCLGLPGALPVLNEAAVES

SEQ ID NO: 684404 - protein, 20 aa, Mycobacterium
KMFNCTGWKIGWACGPAELI

SEQ ID NO: 684405 - protein, 21 aa, Mycobacterium
KMGLFPFRRNLSFYGVDLGML

SEQ ID NO: 684406 - protein, 21 aa, Mycobacterium
KMGLFPFRRNLSFYGVDLGMM

SEQ ID NO: 684407 - protein, 17 aa, Mycobacterium
KMGLRMFFSHNGNTDIT

SEQ ID NO: 684408 - protein, 19 aa, Mycobacterium
KMHVTLRKAFGFGSMVMSL

SEQ ID NO: 684409 - protein, 28 aa, Mycobacterium
KMIDPTCGSGHFLLGGFQRLLDRWHKQF

SEQ ID NO: 684410 - protein, 19 aa, Mycobacterium
KMLAELKIRAATDTLASEL

SEQ ID NO: 684411 - protein, 33 aa, Mycobacterium
KMLEFLERLSGWCEFVWKPGYADYYPELPGGSE

SEQ ID NO: 684412 - protein, 20 aa, Mycobacterium
KMLLGSSRGLGRIVTGAVGL

SEQ ID NO: 684413 - protein, 28 aa, Mycobacterium
KMLRELRPDLTIGFFLHIPFPPVELFMQ

SEQ ID NO: 684414 - protein, 21 aa, Mycobacterium
KMMARICPEGGQVQGPYLKEM

SEQ ID NO: 684415 - protein, 18 aa, Mycobacterium
KMMDGEFDLSVLQNVSSA

SEQ ID NO: 684416 - protein, 22 aa, Mycobacterium
KMNIELHRIWRETGTTVVLVTH

SEQ ID NO: 684417 - protein, 17 aa, Mycobacterium
KMPGAWSHGGARQTLQV

SEQ ID NO: 684418 - protein, 25 aa, Mycobacterium
KMQEIFPPGVCNLVCGDRDTGAALV

SEQ ID NO: 684419 - protein, 18 aa, Mycobacterium
KMRIEAFAPAPASPPTDD

SEQ ID NO: 684420 - protein, 20 aa, Mycobacterium
KMRVAGRIAAGALAEAGKAV

SEQ ID NO: 684421 - protein, 19 aa, Mycobacterium
KMSGNAPIYAILREAKERA

SEQ ID NO: 684422 - protein, 19 aa, Mycobacterium
KMSKSRGNLVLVSQLRAQG

SEQ ID NO: 684423 - protein, 25 aa, Mycobacterium
KMSQWSPQCRVMKPLGTLRPGTRTI

SEQ ID NO: 684424 - protein, 20 aa, Mycobacterium
KMSVRMVADYMGFRAEPRIK

SEQ ID NO: 684425 - protein, 30 aa, Mycobacterium
KMTGLLRSKGFCWIASRPSVAAIWSQAGPN

SEQ ID NO: 684426 - protein, 17 aa, Mycobacterium
KMTVLAWHLVTKDEDYA

SEQ ID NO: 684427 - protein, 19 aa, Mycobacterium
KMTVYRLVHNGELPAVRVG

SEQ ID NO: 684428 - protein, 27 aa, Mycobacterium
KMTYENAMRWYSFDPFSHITREQATVG

SEQ ID NO: 684429 - protein, 25 aa, Mycobacterium
KMVIPEIVKHPSFELVGVGVSNPNK

SEQ ID NO: 684430 - protein, 17 aa, Mycobacterium
KMVPSSLGIEYPDIAPD

SEQ ID NO: 684431 - protein, 17 aa, Mycobacterium
KMVPSSLGIEYPSIAPD

SEQ ID NO: 684432 - protein, 24 aa, Mycobacterium
KMWMARLYPTYQRNTCLISNGLST

SEQ ID NO: 684433 - protein, 19 aa, Mycobacterium
KMYAPTFVRDFPVETSPLT

SEQ ID NO: 684434 - protein, 30 aa, Mycobacterium
KNACARTRKSFMCGFHGWTYDLTGACTHIR

SEQ ID NO: 684435 - protein, 30 aa, Mycobacterium
KNACARTRKSFVCGFHGWTYGLDGACTHIR

SEQ ID NO: 684436 - protein, 17 aa, Mycobacterium
KNAKVLVIGAGGLGSPT

SEQ ID NO: 684437 - protein, 18 aa, Mycobacterium
KNALARALLSTGAGSAPE

SEQ ID NO: 684438 - protein, 17 aa, Mycobacterium
KNALARALLSTGSGTAP

SEQ ID NO: 684439 - protein, 19 aa, Mycobacterium
KNAMTVILNRGGAIEQAVV

SEQ ID NO: 684440 - protein, 24 aa, Mycobacterium
KNANRDGFLPLAFTVSNVKSTGPG

SEQ ID NO: 684441 - protein, 17 aa, Mycobacterium
KNARCAQRHYPIRHAML

SEQ ID NO: 684442 - protein, 21 aa, Mycobacterium
KNARGDTEWIPPAHLDRGQPR

SEQ ID NO: 684443 - protein, 21 aa, Mycobacterium
KNARQHLAFGRGIHSCPGAPL

SEQ ID NO: 684444 - protein, 20 aa, Mycobacterium
KNASFSKAWADGKLTKDHFA

SEQ ID NO: 684445 - protein, 17 aa, Mycobacterium
KNATGLTLPPTVILDHP

SEQ ID NO: 684446 - protein, 18 aa, Mycobacterium
KNAVARSLLSTGAGSAPD

SEQ ID NO: 684447 - protein, 21 aa, Mycobacterium
KNCHGIRELDAPFTFGEGRNA

SEQ ID NO: 684448 - protein, 20 aa, Mycobacterium
KNCQQVLGGIGFTEEHGLQH

SEQ ID NO: 684449 - protein, 25 aa, Mycobacterium
KNERVRISVKRCHRIGATVYEGSVL

SEQ ID NO: 684450 - protein, 24 aa, Mycobacterium
KNFHTRWRGVLGLDVNPTAPKEHW

SEQ ID NO: 684451 - protein, 26 aa, Mycobacterium
KNFIDDFVLYWSFLAFALVRGGRRTF

SEQ ID NO: 684452 - protein, 19 aa, Mycobacterium
KNFPIPARVTAAHTVLDAL

SEQ ID NO: 684453 - protein, 21 aa, Mycobacterium
KNFQYTAAAQKVWAQAGFRPV

SEQ ID NO: 684454 - protein, 21 aa, Mycobacterium
KNGARLLALDAEFAGEWYRFE

SEQ ID NO: 684455 - protein, 25 aa, Mycobacterium
KNGLLPRFANAYVRDTVARLCAESS

SEQ ID NO: 684456 - protein, 17 aa, Mycobacterium
KNGLPWASAQIEDLSGG

SEQ ID NO: 684457 - protein, 20 aa, Mycobacterium
KNGRAADFFRSSDFAVTGAD

SEQ ID NO: 684458 - protein, 17 aa, Mycobacterium
KNGYRRVREYGSPFSDV

SEQ ID NO: 684459 - protein, 21 aa, Mycobacterium
KNHPACLEVLIAGASIGVVTT

SEQ ID NO: 684460 - protein, 20 aa, Mycobacterium
KNIDTGMGVERIACLLQGVD

SEQ ID NO: 684461 - protein, 20 aa, Mycobacterium
KNIDTGMGVERVALILQGVP

SEQ ID NO: 684462 - protein, 20 aa, Mycobacterium
KNIDTGMGVERVALVLQDVH

SEQ ID NO: 684463 - protein, 24 aa, Mycobacterium
KNIGPRIVPIIPDEARTFGMDSWF

SEQ ID NO: 684464 - protein, 19 aa, Mycobacterium
KNIIGGNVILFGATSGEAF

SEQ ID NO: 684465 - protein, 27 aa, Mycobacterium
KNKGVRAWRLPMGFTAWPPWRPGVLFA

SEQ ID NO: 684466 - protein, 19 aa, Mycobacterium
KNKVYDFFEKLAVDDTQPS

SEQ ID NO: 684467 - protein, 18 aa, Mycobacterium
KNLARWRYVIDRATPAPL

SEQ ID NO: 684468 - protein, 19 aa, Mycobacterium
KNLERACFDFIMMEDKLAV

SEQ ID NO: 684469 - protein, 18 aa, Mycobacterium
KNLGLGYWGKEAETQETF

SEQ ID NO: 684470 - protein, 18 aa, Mycobacterium
KNLMAVVICRDVRDLYAY

SEQ ID NO: 684471 - protein, 20 aa, Mycobacterium
KNLPSRPAVPVLSGVLLSGT

SEQ ID NO: 684472 - protein, 17 aa, Mycobacterium
KNLTWQHIAEAIDSPLI

SEQ ID NO: 684473 - protein, 31 aa, Mycobacterium
KNNVLTFAGSLWWRTVQEIGEEYPDVELAYQ

SEQ ID NO: 684474 - protein, 17 aa, Mycobacterium
KNPDAWFYQRPITLEDH

SEQ ID NO: 684475 - protein, 26 aa, Mycobacterium
KNPDELRRHIGYVIQGAGLFPHFTVG

SEQ ID NO: 684476 - protein, 21 aa, Mycobacterium
KNPDNGLGVHRFTATDAFQLA

SEQ ID NO: 684477 - protein, 24 aa, Mycobacterium
KNPGRVLGLHFFNPVPVLPLVELI

SEQ ID NO: 684478 - protein, 21 aa, Mycobacterium
KNPNGYCGLGGTSVSCPIGLD

SEQ ID NO: 684479 - protein, 24 aa, Mycobacterium
KNPNLCERCCDALPRGGAEVDIAV

SEQ ID NO: 684480 - protein, 25 aa, Mycobacterium
KNPQRVLGLHFFNPVPVLPLVELVC

SEQ ID NO: 684481 - protein, 25 aa, Mycobacterium
KNPQRVLGLHFFNPVPVLPLVELVS

SEQ ID NO: 684482 - protein, 25 aa, Mycobacterium
KNPQRVLGLHFFNPVPVLPLVELVT

SEQ ID NO: 684483 - protein, 27 aa, Mycobacterium
KNPRFSLDGLRVFPFERAAERTVDHLL

SEQ ID NO: 684484 - protein, 20 aa, Mycobacterium
KNPRSALLHRRIDVDFNGWW

SEQ ID NO: 684485 - protein, 24 aa, Mycobacterium
KNPVLEWITGTALVPVRERLDDVS

SEQ ID NO: 684486 - protein, 19 aa, Mycobacterium
KNRACSRGIVEFYRDQDYV

SEQ ID NO: 684487 - protein, 25 aa, Mycobacterium
KNRKQLAALGRWMSSSQMEAVEESF

SEQ ID NO: 684488 - protein, 20 aa, Mycobacterium
KNRLARIGFDRVIGHLDRPF

SEQ ID NO: 684489 - protein, 23 aa, Mycobacterium
KNRLARIGFDRVVGYLDRPFEVM

SEQ ID NO: 684490 - protein, 18 aa, Mycobacterium
KNRLNVWVQGIGSTEARC

SEQ ID NO: 684491 - protein, 19 aa, Mycobacterium
KNRMVSWPYTKLMNSNNMV

SEQ ID NO: 684492 - protein, 23 aa, Mycobacterium
KNRQLAADYGRMVEIYNAAADYF

SEQ ID NO: 684493 - protein, 23 aa, Mycobacterium
KNRQLAADYGRMVEIYNAAATYF

SEQ ID NO: 684494 - protein, 23 aa, Mycobacterium
KNRTLWSGFTFEYWSQTRKVDPS

SEQ ID NO: 684495 - protein, 29 aa, Mycobacterium
KNRVRHVPVLDGKKLIGIVSIGDVVKTRM

SEQ ID NO: 684496 - protein, 20 aa, Mycobacterium
KNSYKAYLMCFGSSGMFEQD

SEQ ID NO: 684497 - protein, 20 aa, Mycobacterium
KNTLRAVGIQPRILRSTRLV

SEQ ID NO: 684498 - protein, 18 aa, Mycobacterium
KNTQGVEASRLFLTQMIQ

SEQ ID NO: 684499 - protein, 17 aa, Mycobacterium
KNTRIAAGRVQELIAEG

SEQ ID NO: 684500 - protein, 30 aa, Mycobacterium
KNTRYPMIHPFCGPTRKLGGDNADFVYLQA

SEQ ID NO: 684501 - protein, 24 aa, Mycobacterium
KNVAKQRLVWHFCQRYPGAARRVI

SEQ ID NO: 684502 - protein, 18 aa, Mycobacterium
KNVARIGGTLTIEAETLA

SEQ ID NO: 684503 - protein, 24 aa, Mycobacterium
KNVCLRLLTVRARTRAELETQLTK

SEQ ID NO: 684504 - protein, 21 aa, Mycobacterium
KNVVTPLGWFYPTEKEAAPLE

SEQ ID NO: 684505 - protein, 24 aa, Mycobacterium
KNWKGNVKKAGFLPQERQWLTEVL

SEQ ID NO: 684506 - protein, 24 aa, Mycobacterium
KNWKGNVKKSGFLPEERAWVSGLL

SEQ ID NO: 684507 - protein, 24 aa, Mycobacterium
KNYVSRLLAKLGMERRTQAAVFAT

SEQ ID NO: 684508 - protein, 18 aa, Mycobacterium
KPAAEKRAMELLGQVGLA

SEQ ID NO: 684509 - protein, 17 aa, Mycobacterium
KPAAIVWAAQMGTVTLH

SEQ ID NO: 684510 - protein, 20 aa, Mycobacterium
KPAAMPLPEIQVIGGGAHAA

SEQ ID NO: 684511 - protein, 20 aa, Mycobacterium
KPACGVCLIAKDCPSFGLGP

SEQ ID NO: 684512 - protein, 20 aa, Mycobacterium
KPACGVCVLAKDCPSYGLGP

SEQ ID NO: 684513 - protein, 19 aa, Mycobacterium
KPACGVCVVAKDCPSFGLG

SEQ ID NO: 684514 - protein, 25 aa, Mycobacterium
KPADGFGSGVARQFGQGVNSRVDGI

SEQ ID NO: 684515 - protein, 24 aa, Mycobacterium
KPADIQTAVLYDHFTPFTLIQLEE

SEQ ID NO: 684516 - protein, 26 aa, Mycobacterium
KPADTAPGWTGARGKPTRMLLLRHGQ

SEQ ID NO: 684517 - protein, 22 aa, Mycobacterium
KPAEGFRAFETLLRYDRPYSGY

SEQ ID NO: 684518 - protein, 19 aa, Mycobacterium
KPAELEWTLARTDHPDADT

SEQ ID NO: 684519 - protein, 19 aa, Mycobacterium
KPAFEAMGAARADGEQRTF

SEQ ID NO: 684520 - protein, 23 aa, Mycobacterium
KPAGDLPRGWAETVSGRLSGVTE

SEQ ID NO: 684521 - protein, 20 aa, Mycobacterium
KPAGMPADLAIYRLKTFREL

SEQ ID NO: 684522 - protein, 17 aa, Mycobacterium
KPAHIALRSARDHGFSL

SEQ ID NO: 684523 - protein, 17 aa, Mycobacterium
KPAHPLIINGWVRTGHS

SEQ ID NO: 684524 - protein, 20 aa, Mycobacterium
KPAIYARTAVALVKRHGILV

SEQ ID NO: 684525 - protein, 20 aa, Mycobacterium
KPALEAVGLPATRPATKDAP

SEQ ID NO: 684526 - protein, 29 aa, Mycobacterium
KPAMETPWSALRWGRIIAEKTDIPAGVVN

SEQ ID NO: 684527 - protein, 24 aa, Mycobacterium
KPANLKAATLLAWEQALAAVRSRR

SEQ ID NO: 684528 - protein, 20 aa, Mycobacterium
KPAPAGFQLAAERMGCEPDQ

SEQ ID NO: 684529 - protein, 23 aa, Mycobacterium
KPAPETPFTGGLMLAEVLAEAGL

SEQ ID NO: 684530 - protein, 20 aa, Mycobacterium
KPAPLRAAVPGGFTIDNFTV

SEQ ID NO: 684531 - protein, 20 aa, Mycobacterium
KPAPNLPPGFDFTDPDIYAE

SEQ ID NO: 684532 - protein, 18 aa, Mycobacterium
KPAPRHAVHPPAPQVAEA

SEQ ID NO: 684533 - protein, 17 aa, Mycobacterium
KPAPVRAASDTSAFFAA

SEQ ID NO: 684534 - protein, 20 aa, Mycobacterium
KPAQRVCVIDGGIRVVTTVQ

SEQ ID NO: 684535 - protein, 17 aa, Mycobacterium
KPARGGSSIGVSRVASW

SEQ ID NO: 684536 - protein, 17 aa, Mycobacterium
KPARGGSSIGVSRVSSF

SEQ ID NO: 684537 - protein, 17 aa, Mycobacterium
KPARGGSSIGVSRVSSW

SEQ ID NO: 684538 - protein, 22 aa, Mycobacterium
KPASDLRLPGSVAEIMASAPGP

SEQ ID NO: 684539 - protein, 19 aa, Mycobacterium
KPASLSFNEAAGFLLTGQT

SEQ ID NO: 684540 - protein, 33 aa, Mycobacterium
KPASSGWESGAWMLDFIGSWEWTIPGGASEIQR

SEQ ID NO: 684541 - protein, 20 aa, Mycobacterium
KPAVIAETGDWVAMASEYRA

SEQ ID NO: 684542 - protein, 18 aa, Mycobacterium
KPAVVAFDHAYHGRTNMT

SEQ ID NO: 684543 - protein, 18 aa, Mycobacterium
KPAVWRRKAAALTIGGIR

SEQ ID NO: 684544 - protein, 19 aa, Mycobacterium
KPAYGAIPAQGVWPLAASL

SEQ ID NO: 684545 - protein, 17 aa, Mycobacterium
KPCPARPWVCLLCPLAV

SEQ ID NO: 684546 - protein, 21 aa, Mycobacterium
KPDAICVSGLTAGASTDRQAL

SEQ ID NO: 684547 - protein, 19 aa, Mycobacterium
KPDDVLVVFFGSRNDMQVD

SEQ ID NO: 684548 - protein, 25 aa, Mycobacterium
KPDESRWRMAVEKVLRGAGLRLLVP

SEQ ID NO: 684549 - protein, 23 aa, Mycobacterium
KPDFPPTLMGRLLLDALTGSGVT

SEQ ID NO: 684550 - protein, 17 aa, Mycobacterium
KPDGVTFTTTQSPDGEI

SEQ ID NO: 684551 - protein, 25 aa, Mycobacterium
KPDLAPATIWRDYIRTVGRTPNGIW

SEQ ID NO: 684552 - protein, 23 aa, Mycobacterium
KPDLLRHRWWRRLRRRIVEADQL

SEQ ID NO: 684553 - protein, 18 aa, Mycobacterium
KPDLLSVLGDVDYLSSLP

SEQ ID NO: 684554 - protein, 33 aa, Mycobacterium
KPDMRFGLELVDCTEFFKDTTFRVFQAPYVGAV

SEQ ID NO: 684555 - protein, 23 aa, Mycobacterium
KPDMRFGLELVECTEFFKDTTFR

SEQ ID NO: 684556 - protein, 19 aa, Mycobacterium
KPDVSVLIAPNFAIGAVLS

SEQ ID NO: 684557 - protein, 18 aa, Mycobacterium
KPEAYARLEAARTALAAL

SEQ ID NO: 684558 - protein, 21 aa, Mycobacterium
KPEFIENFFMFIAEEVREYMA

SEQ ID NO: 684559 - protein, 17 aa, Mycobacterium
KPEFRVGDAPVYHTAGT

SEQ ID NO: 684560 - protein, 21 aa, Mycobacterium
KPELAHGIPLQSSPPNHSSTG

SEQ ID NO: 684561 - protein, 25 aa, Mycobacterium
KPENKAALSNWAWGRQSIDLLAQHP

SEQ ID NO: 684562 - protein, 19 aa, Mycobacterium
KPEPFWRTVIDHTEDDHWD

SEQ ID NO: 684563 - protein, 25 aa, Mycobacterium
KPEPMPVAVVYGWHDVLPFCAGSPF

SEQ ID NO: 684564 - protein, 28 aa, Mycobacterium
KPEQLSFAELRAAWRADERGVRLDDAAR

SEQ ID NO: 684565 - protein, 25 aa, Mycobacterium
KPERPRLLLKWIEECFGASSAVELA

SEQ ID NO: 684566 - protein, 30 aa, Mycobacterium
KPESEGGFTRVRRRIWELEKRRAHVPWVTW

SEQ ID NO: 684567 - protein, 23 aa, Mycobacterium
KPETSVLIAPNFAIGAVLCMHFA

SEQ ID NO: 684568 - protein, 18 aa, Mycobacterium
KPEYRLMTIRNWATTSQM

SEQ ID NO: 684569 - protein, 17 aa, Mycobacterium
KPFADRVVRKFQLPVKG

SEQ ID NO: 684570 - protein, 20 aa, Mycobacterium
KPFARPQYVAKFTGLAGGVI

SEQ ID NO: 684571 - protein, 17 aa, Mycobacterium
KPFGGLLAFTSLKIPFF

SEQ ID NO: 684572 - protein, 20 aa, Mycobacterium
KPFMEQSAHWFLDQHITTGQ

SEQ ID NO: 684573 - protein, 22 aa, Mycobacterium
KPFQLFMDRLYRVLLSDAGLDG

SEQ ID NO: 684574 - protein, 21 aa, Mycobacterium
KPFWRAEGLSGEALTDTAPVF

SEQ ID NO: 684575 - protein, 17 aa, Mycobacterium
KPGAGPSLAEPRMGGAG

SEQ ID NO: 684576 - protein, 18 aa, Mycobacterium
KPGASVWFKSRPRPAEAA

SEQ ID NO: 684577 - protein, 19 aa, Mycobacterium
KPGDHVLVLGGTGVTGSTA

SEQ ID NO: 684578 - protein, 32 aa, Mycobacterium
KPGDRLLDVGCGWGGMVRYAARHGVKALGVTL

SEQ ID NO: 684579 - protein, 20 aa, Mycobacterium
KPGDWYVIHSYAGYENKVKA

SEQ ID NO: 684580 - protein, 19 aa, Mycobacterium
KPGGMPLSEVLDWIERINA

SEQ ID NO: 684581 - protein, 17 aa, Mycobacterium
KPGGRQGRRPSRFLTGI

SEQ ID NO: 684582 - protein, 20 aa, Mycobacterium
KPGGSLAITVPRWLPEKICW

SEQ ID NO: 684583 - protein, 25 aa, Mycobacterium
KPGIASRVIGKWARTRLSGQKTLIA

SEQ ID NO: 684584 - protein, 22 aa, Mycobacterium
KPGIYYPPLRRLMEGQLRRLER

SEQ ID NO: 684585 - protein, 18 aa, Mycobacterium
KPGLRRLAPLAFVRFRID

SEQ ID NO: 684586 - protein, 19 aa, Mycobacterium
KPGMAWLLEQVRPGHADER

SEQ ID NO: 684587 - protein, 18 aa, Mycobacterium
KPGPPWATFDLVADEWLG

SEQ ID NO: 684588 - protein, 23 aa, Mycobacterium
KPGPVNGLRGWRSPALPEFDPFW

SEQ ID NO: 684589 - protein, 26 aa, Mycobacterium
KPGRAFLRKFLPGHWAYLQTLMSDLT

SEQ ID NO: 684590 - protein, 26 aa, Mycobacterium
KPGRDPRPAFSTATFAAGVEKVADLK

SEQ ID NO: 684591 - protein, 25 aa, Mycobacterium
KPGRDPRPAFTTATFAAGVEKVSDL

SEQ ID NO: 684592 - protein, 26 aa, Mycobacterium
KPGRHRRIRLDAVLAYQQETRARRKA

SEQ ID NO: 684593 - protein, 18 aa, Mycobacterium
KPGSLPRQPGRVIAIASA

SEQ ID NO: 684594 - protein, 25 aa, Mycobacterium
KPGSMGRPLPGWSVTVLGDDDRPAP

SEQ ID NO: 684595 - protein, 19 aa, Mycobacterium
KPGTRRIYSNYGFAVLAHA

SEQ ID NO: 684596 - protein, 25 aa, Mycobacterium
KPGTSFRVHCREWFDGAIHNDDSAD

SEQ ID NO: 684597 - protein, 19 aa, Mycobacterium
KPGTSVLIAPNFAIGAVLS

SEQ ID NO: 684598 - protein, 21 aa, Mycobacterium
KPGVGLDCSGLTQWAYGQSGV

SEQ ID NO: 684599 - protein, 27 aa, Mycobacterium
KPGVLARVASLFSRRGYNIQSLAVGAT

SEQ ID NO: 684600 - protein, 28 aa, Mycobacterium
KPGVLARVSSLFSRRGFNIQSLAVGATE

SEQ ID NO: 684601 - protein, 18 aa, Mycobacterium
KPGYALNLDDLRAHFAAS

SEQ ID NO: 684602 - protein, 25 aa, Mycobacterium
KPHARAMIGLALTVGWSMTAGGRFG

SEQ ID NO: 684603 - protein, 27 aa, Mycobacterium
KPHFGFGGGVHHCLGHFVARSDMSEAL

SEQ ID NO: 684604 - protein, 29 aa, Mycobacterium
KPHIEKRFSMPWGRPVARMREFVQALHEI

SEQ ID NO: 684605 - protein, 21 aa, Mycobacterium
KPHLATSFWFAFGPQADARAQ

SEQ ID NO: 684606 - protein, 19 aa, Mycobacterium
KPHLITSFWFAFGSPEESR

SEQ ID NO: 684607 - protein, 25 aa, Mycobacterium
KPHMAAWLNQWGRSFAATTPDCLHT

SEQ ID NO: 684608 - protein, 20 aa, Mycobacterium
KPHRQDRRWATAWSPEQISH

SEQ ID NO: 684609 - protein, 24 aa, Mycobacterium
KPHRVPVWMMRQAGRSLPEYRELR

SEQ ID NO: 684610 - protein, 20 aa, Mycobacterium
KPIAPVKGWATTTVSKVSAG

SEQ ID NO: 684611 - protein, 25 aa, Mycobacterium
KPIEIREFLEGYVIGQDTAKRTLAV

SEQ ID NO: 684612 - protein, 17 aa, Mycobacterium
KPIKGTGWTVRDLAFSD

SEQ ID NO: 684613 - protein, 19 aa, Mycobacterium
KPIPLRTPVPGGFTSDDFS

SEQ ID NO: 684614 - protein, 17 aa, Mycobacterium
KPISTGVAFAFAPGVTV

SEQ ID NO: 684615 - protein, 17 aa, Mycobacterium
KPISTPHPTVWMGGDAD

SEQ ID NO: 684616 - protein, 20 aa, Mycobacterium
KPKELVARIRARLRRNDDEP

SEQ ID NO: 684617 - protein, 20 aa, Mycobacterium
KPKHTRIFRLFNFSPALFSL

SEQ ID NO: 684618 - protein, 25 aa, Mycobacterium
KPKRNPLCCMAHPFSAASETPSGRQ

SEQ ID NO: 684619 - protein, 22 aa, Mycobacterium
KPKRVAIMASREDHCLLDLLWR

SEQ ID NO: 684620 - protein, 26 aa, Mycobacterium
KPKVLSRYLAKWYWQVKGYVGGLTPQ

SEQ ID NO: 684621 - protein, 18 aa, Mycobacterium
KPKVVVAASCGIEPTRIV

SEQ ID NO: 684622 - protein, 25 aa, Mycobacterium
KPLDGPPELGRFVAAMRRLQDLTVS

SEQ ID NO: 684623 - protein, 18 aa, Mycobacterium
KPLFRAKGLNAFITATRR

SEQ ID NO: 684624 - protein, 25 aa, Mycobacterium
KPLGLDVAHCLYAGLTTDTGSFRWA

SEQ ID NO: 684625 - protein, 18 aa, Mycobacterium
KPLGLKTFLMPLNPGKDD

SEQ ID NO: 684626 - protein, 29 aa, Mycobacterium
KPLKYPVMFRCVDVVLLNKIDLVPYLDAD

SEQ ID NO: 684627 - protein, 20 aa, Mycobacterium
KPLLANVDTFRCWLDDEREE

SEQ ID NO: 684628 - protein, 20 aa, Mycobacterium
KPLLANVETLRCWLDDEREE

SEQ ID NO: 684629 - protein, 20 aa, Mycobacterium
KPLMRRKLAELIVDVEAAQT

SEQ ID NO: 684630 - protein, 17 aa, Mycobacterium
KPLMVLEAGDRVSHDKY

SEQ ID NO: 684631 - protein, 19 aa, Mycobacterium
KPLNTLNAWIATGADGELL

SEQ ID NO: 684632 - protein, 22 aa, Mycobacterium
KPLPLRVPVPGGFTSDDFIIDF

SEQ ID NO: 684633 - protein, 24 aa, Mycobacterium
KPLQAGGIPLWIAGGGEKVTLRIA

SEQ ID NO: 684634 - protein, 22 aa, Mycobacterium
KPLRALISICAAGGQGVAAILE

SEQ ID NO: 684635 - protein, 21 aa, Mycobacterium
KPLRASFSLLTGWGRDRPIPP

SEQ ID NO: 684636 - protein, 24 aa, Mycobacterium
KPLRPKVRGPISFDAPKLPTIRKA

SEQ ID NO: 684637 - protein, 17 aa, Mycobacterium
KPLSIALREIHGDLLEH

SEQ ID NO: 684638 - protein, 18 aa, Mycobacterium
KPLSTLLFPNWNTTTPQP

SEQ ID NO: 684639 - protein, 22 aa, Mycobacterium
KPLTMAEGFALLSVPSSFVQNE

SEQ ID NO: 684640 - protein, 17 aa, Mycobacterium
KPLTTPHPPIWVGGNTS

SEQ ID NO: 684641 - protein, 20 aa, Mycobacterium
KPLVAMCPVSIRAEGDQNAG

SEQ ID NO: 684642 - protein, 26 aa, Mycobacterium
KPLWALWRLGSDPAFARISMEFMALA

SEQ ID NO: 684643 - protein, 24 aa, Mycobacterium
KPLYHREWWDRYVVVNRRFAEATS

SEQ ID NO: 684644 - protein, 17 aa, Mycobacterium
KPMAFVRAILRSDVTDL

SEQ ID NO: 684645 - protein, 17 aa, Mycobacterium
KPMAFVRALLRTDVTDL

SEQ ID NO: 684646 - protein, 22 aa, Mycobacterium
KPMNCPMHHLIFRSRGRSYREL

SEQ ID NO: 684647 - protein, 17 aa, Mycobacterium
KPMPNWGSNLAGIDFDN

SEQ ID NO: 684648 - protein, 19 aa, Mycobacterium
KPMPRWGSNLEGIDFDNIK

SEQ ID NO: 684649 - protein, 33 aa, Mycobacterium
KPMSSGWESGSWVLDFVGSWEWTIPGGASEIQR

SEQ ID NO: 684650 - protein, 20 aa, Mycobacterium
KPMYLFRGDVPVREFAQVMP

SEQ ID NO: 684651 - protein, 24 aa, Mycobacterium
KPNAEELAGVLGLDADVLENAVAQ

SEQ ID NO: 684652 - protein, 18 aa, Mycobacterium
KPNFSRIVDAMPVLYESQ

SEQ ID NO: 684653 - protein, 18 aa, Mycobacterium
KPNLDFPTGPAYYLMGFD

SEQ ID NO: 684654 - protein, 18 aa, Mycobacterium
KPNYRWAREQAGQQVPAI

SEQ ID NO: 684655 - protein, 19 aa, Mycobacterium
KPPAAYRASLPPAALHARV

SEQ ID NO: 684656 - protein, 25 aa, Mycobacterium
KPPEDLRFLIRLARQQGERLGRAYL

SEQ ID NO: 684657 - protein, 23 aa, Mycobacterium
KPPEFGEDIWIPGREPSDRQLLL

SEQ ID NO: 684658 - protein, 22 aa, Mycobacterium
KPPEFGEDIWIPSREPTDRQLV

SEQ ID NO: 684659 - protein, 19 aa, Mycobacterium
KPPEISWETAAVFPIPALT

SEQ ID NO: 684660 - protein, 19 aa, Mycobacterium
KPPELAAVVSAVLYESRGS

SEQ ID NO: 684661 - protein, 18 aa, Mycobacterium
KPPEPGRPAPAPSGKPAP

SEQ ID NO: 684662 - protein, 19 aa, Mycobacterium
KPPEVILIDLLRPPGTTAR

SEQ ID NO: 684663 - protein, 19 aa, Mycobacterium
KPPGAPQYVGEAWIHVQLL

SEQ ID NO: 684664 - protein, 17 aa, Mycobacterium
KPPGIRLIVAGYGRLPT

SEQ ID NO: 684665 - protein, 19 aa, Mycobacterium
KPPHNALKDLLHQVTPPAP

SEQ ID NO: 684666 - protein, 18 aa, Mycobacterium
KPPHNALQDLLHQVTPPT

SEQ ID NO: 684667 - protein, 21 aa, Mycobacterium
KPPHQRRVFTIANQKGGVGKT

SEQ ID NO: 684668 - protein, 19 aa, Mycobacterium
KPPLPYTFNLCVSNVPGPQ

SEQ ID NO: 684669 - protein, 24 aa, Mycobacterium
KPPPDQCPLCPGPTGLTSEVPAED

SEQ ID NO: 684670 - protein, 24 aa, Mycobacterium
KPPPDQCPLCPGPTGLTSEVPARD

SEQ ID NO: 684671 - protein, 17 aa, Mycobacterium
KPPRAGNAIILGDFNIF

SEQ ID NO: 684672 - protein, 17 aa, Mycobacterium
KPPRGYDGWTLAGDTAG

SEQ ID NO: 684673 - protein, 17 aa, Mycobacterium
KPPRMLVLLHLDGSTDR

SEQ ID NO: 684674 - protein, 18 aa, Mycobacterium
KPPRMLVLLHLDGSVDRP

SEQ ID NO: 684675 - protein, 28 aa, Mycobacterium
KPQRGRISTWPFAEAFNGITVHGPLART

SEQ ID NO: 684676 - protein, 30 aa, Mycobacterium
KPQRGRISTWPWPETFNGITVNGVLARTVA

SEQ ID NO: 684677 - protein, 28 aa, Mycobacterium
KPQSCAALPRILRDNGYVTAAFGKWHLT

SEQ ID NO: 684678 - protein, 24 aa, Mycobacterium
KPRAPRPPVEWREVDGVVIPPPFD

SEQ ID NO: 684679 - protein, 18 aa, Mycobacterium
KPRARIHHISARGADPVM

SEQ ID NO: 684680 - protein, 19 aa, Mycobacterium
KPRCTKCPVVVHKMQKAEH

SEQ ID NO: 684681 - protein, 17 aa, Mycobacterium
KPRELRSAVGSVLHALI

SEQ ID NO: 684682 - protein, 18 aa, Mycobacterium
KPRGPAPRCRVCNAQLTS

SEQ ID NO: 684683 - protein, 24 aa, Mycobacterium
KPRIKELALLGAIRGDVLDIGCGL

SEQ ID NO: 684684 - protein, 26 aa, Mycobacterium
KPRPLAKARWAAAVDCVGGATLADVL

SEQ ID NO: 684685 - protein, 26 aa, Mycobacterium
KPRPLAKARWAGAVDCVGGATLADVL

SEQ ID NO: 684686 - protein, 23 aa, Mycobacterium
KPRQSRPFTTYRIAVGKRHKVGP

SEQ ID NO: 684687 - protein, 17 aa, Mycobacterium
KPRRAGVSSYSMGGTNA

SEQ ID NO: 684688 - protein, 27 aa, Mycobacterium
KPRRAHASWLLARLAPGLMQRLSVRFV

SEQ ID NO: 684689 - protein, 28 aa, Mycobacterium
KPRSEWPSDIIRRAAGVAARSLGSAQAV

SEQ ID NO: 684690 - protein, 22 aa, Mycobacterium
KPRTDPSALAWLFYTSGTTGRS

SEQ ID NO: 684691 - protein, 19 aa, Mycobacterium
KPRTPRVVDRLGVDEQGSR

SEQ ID NO: 684692 - protein, 27 aa, Mycobacterium
KPRVFMPFIGGFGVYGAICADVAASGY

SEQ ID NO: 684693 - protein, 19 aa, Mycobacterium
KPRVPSMVEPDAFVVGETV

SEQ ID NO: 684694 - protein, 21 aa, Mycobacterium
KPRVSREIGETIVFTIRIPLE

SEQ ID NO: 684695 - protein, 19 aa, Mycobacterium
KPRYEELVADFQLAHDHEP

SEQ ID NO: 684696 - protein, 20 aa, Mycobacterium
KPSAIRRLGLTYEQLRRHNE

SEQ ID NO: 684697 - protein, 22 aa, Mycobacterium
KPSAIRRLGLTYERLRAHNDRI

SEQ ID NO: 684698 - protein, 27 aa, Mycobacterium
KPSDIQTAILYDHFTPFTLIQLEELGF

SEQ ID NO: 684699 - protein, 25 aa, Mycobacterium
KPSDIQTAVLYDHFTPFTLIQLEEL

SEQ ID NO: 684700 - protein, 25 aa, Mycobacterium
KPSELTPLTAIACQALIERAAADVG

SEQ ID NO: 684701 - protein, 24 aa, Mycobacterium
KPSGLAFLASAGWNRPADRPTIAP

SEQ ID NO: 684702 - protein, 25 aa, Mycobacterium
KPSPPDLSVRWLIGVARHKLADHYR

SEQ ID NO: 684703 - protein, 22 aa, Mycobacterium
KPSPPYAAAVREWEKLEQFVEG

SEQ ID NO: 684704 - protein, 17 aa, Mycobacterium
KPSPRFMRVLNDPPVVV

SEQ ID NO: 684705 - protein, 20 aa, Mycobacterium
KPSQRVCVIDGGIRVVTTVQ

SEQ ID NO: 684706 - protein, 17 aa, Mycobacterium
KPSRGGSSIGVSRVTAW

SEQ ID NO: 684707 - protein, 32 aa, Mycobacterium
KPSRGRLPLDPQLRRLPIRIVANGVLTRSVRD

SEQ ID NO: 684708 - protein, 24 aa, Mycobacterium
KPSRGRLPLDPTLRRMPVGIVANG

SEQ ID NO: 684709 - protein, 21 aa, Mycobacterium
KPSRGRLPLDRDMRQMPLRIV

SEQ ID NO: 684710 - protein, 25 aa, Mycobacterium
KPSRPFGIGLVHWVMTERPDLFDIA

SEQ ID NO: 684711 - protein, 19 aa, Mycobacterium
KPSTAVLIAPNFAIGAVLS

SEQ ID NO: 684712 - protein, 19 aa, Mycobacterium
KPSVMAAGAKLLWDGALAT

SEQ ID NO: 684713 - protein, 20 aa, Mycobacterium
KPSVTQAFAAHFTLELLEAA

SEQ ID NO: 684714 - protein, 23 aa, Mycobacterium
KPSWDIQAGYVLRSLHALPKSGT

SEQ ID NO: 684715 - protein, 18 aa, Mycobacterium
KPSYGLAEATLFVSTPPI

SEQ ID NO: 684716 - protein, 18 aa, Mycobacterium
KPSYGMAEATLFVSSIAP

SEQ ID NO: 684717 - protein, 19 aa, Mycobacterium
KPSYGMAEATLFVSTIPSD

SEQ ID NO: 684718 - protein, 25 aa, Mycobacterium
KPTAWLAEGVLIGFLPPDAEVRLLD

SEQ ID NO: 684719 - protein, 25 aa, Mycobacterium
KPTDEIGPWLDMPVVPEYTAAIDRR

SEQ ID NO: 684720 - protein, 22 aa, Mycobacterium
KPTEHKPRRGITGIHNVSLSVP

SEQ ID NO: 684721 - protein, 18 aa, Mycobacterium
KPTGWFQVAWCDEIAVGE

SEQ ID NO: 684722 - protein, 19 aa, Mycobacterium
KPTGWFQVAWSDEIAVGDV

SEQ ID NO: 684723 - protein, 18 aa, Mycobacterium
KPTGWFQVAWSDEIGVGD

SEQ ID NO: 684724 - protein, 20 aa, Mycobacterium
KPTGWFQVAWSDEIGVGDVH

SEQ ID NO: 684725 - protein, 18 aa, Mycobacterium
KPTGWFQVAWSDEVGVGD

SEQ ID NO: 684726 - protein, 18 aa, Mycobacterium
KPTPGIRTHLSISPQDNR

SEQ ID NO: 684727 - protein, 20 aa, Mycobacterium
KPTPLGGEFDQLVAGIARRQ

SEQ ID NO: 684728 - protein, 17 aa, Mycobacterium
KPTRLVAIASASSTLGT

SEQ ID NO: 684729 - protein, 28 aa, Mycobacterium
KPTSVPAFRPGAQFKAVVAGAQKLPAEG

SEQ ID NO: 684730 - protein, 28 aa, Mycobacterium
KPTSVPAFRPGAQFKAVVSGAQKLPAEG

SEQ ID NO: 684731 - protein, 34 aa, Mycobacterium
KPTSVPAFRPGAQFKAVVSGAQRLPAEGPAVKRG

SEQ ID NO: 684732 - protein, 32 aa, Mycobacterium
KPTSVPAFRPGAQFKAVVSGAQRLPSDGPAVK

SEQ ID NO: 684733 - protein, 32 aa, Mycobacterium
KPTSVPAFRPGAQFKAVVSGAQRLPSEGPAVK

SEQ ID NO: 684734 - protein, 18 aa, Mycobacterium
KPTTTGWGIGRIAQAWDT

SEQ ID NO: 684735 - protein, 23 aa, Mycobacterium
KPVAAICHGPWALVEAEVASGRT

SEQ ID NO: 684736 - protein, 25 aa, Mycobacterium
KPVAAICHGPWTLVEAGVAEGRTLT

SEQ ID NO: 684737 - protein, 27 aa, Mycobacterium
KPVAAICHGPWTLVEARVLAGRTVTSF

SEQ ID NO: 684738 - protein, 18 aa, Mycobacterium
KPVAGAFNVGFNSEHMQA

SEQ ID NO: 684739 - protein, 19 aa, Mycobacterium
KPVAVTCVHPGGIKTAIAR

SEQ ID NO: 684740 - protein, 19 aa, Mycobacterium
KPVAVTCVHPGGIKTNVAR

SEQ ID NO: 684741 - protein, 22 aa, Mycobacterium
KPVDARDSPSLSVVPPPPAWYL

SEQ ID NO: 684742 - protein, 24 aa, Mycobacterium
KPVDGGYVFNGRWQFSSGTDHCDW

SEQ ID NO: 684743 - protein, 24 aa, Mycobacterium
KPVFKKWASLVVRAGEPGAGTRMK

SEQ ID NO: 684744 - protein, 17 aa, Mycobacterium
KPVGFGEVVPGLRIPGK

SEQ ID NO: 684745 - protein, 17 aa, Mycobacterium
KPVGLGFSQTGGENDYE

SEQ ID NO: 684746 - protein, 17 aa, Mycobacterium
KPVGLGFTKGGGENDYE

SEQ ID NO: 684747 - protein, 17 aa, Mycobacterium
KPVGLGFTQGGGENNYE

SEQ ID NO: 684748 - protein, 25 aa, Mycobacterium
KPVGPYAKAVREWERVERFVESRLR

SEQ ID NO: 684749 - protein, 23 aa, Mycobacterium
KPVIEISDVWKLHKLGDEVVKAL

SEQ ID NO: 684750 - protein, 18 aa, Mycobacterium
KPVIPAWEDVLLGVRSGG

SEQ ID NO: 684751 - protein, 18 aa, Mycobacterium
KPVIPVFINSVATPLGPI

SEQ ID NO: 684752 - protein, 18 aa, Mycobacterium
KPVLCADDFFAWLAAHGP

SEQ ID NO: 684753 - protein, 23 aa, Mycobacterium
KPVLEWIGGTALRPVRAALPDHD

SEQ ID NO: 684754 - protein, 24 aa, Mycobacterium
KPVLGICGGFQMLCRRIDDTVESG

SEQ ID NO: 684755 - protein, 32 aa, Mycobacterium
KPVLVDFWATWCGPCKMVAPVLEEIAAEKGDQ

SEQ ID NO: 684756 - protein, 31 aa, Mycobacterium
KPVLVDFWATWCGPCKMVAPVLEEIAAERSG

SEQ ID NO: 684757 - protein, 31 aa, Mycobacterium
KPVLVDFWATWCGPCKMVAPVLEEIAKDHGE

SEQ ID NO: 684758 - protein, 31 aa, Mycobacterium
KPVLVDFWATWCGPCKMVAPVLEEIASERAG

SEQ ID NO: 684759 - protein, 25 aa, Mycobacterium
KPVMIKAQVKVGGRGKAGGVKYAAT

SEQ ID NO: 684760 - protein, 25 aa, Mycobacterium
KPVMVKAQVKVGGRGKAGGVKYAAT

SEQ ID NO: 684761 - protein, 27 aa, Mycobacterium
KPVQRPRLPICLGAFTPAGLRRIGRRG

SEQ ID NO: 684762 - protein, 24 aa, Mycobacterium
KPVRCEVWEGFVFVNLDPDAAPLA

SEQ ID NO: 684763 - protein, 23 aa, Mycobacterium
KPVRGVLHAAALVHDATLANITD

SEQ ID NO: 684764 - protein, 23 aa, Mycobacterium
KPVSANAYLGGWGIAEALGAGAD

SEQ ID NO: 684765 - protein, 17 aa, Mycobacterium
KPVTAMYLLAAFATLAG

SEQ ID NO: 684766 - protein, 18 aa, Mycobacterium
KPVTCDDLVLSWAAQSGR

SEQ ID NO: 684767 - protein, 19 aa, Mycobacterium
KPVTLVWGMGDRCFKPTLA

SEQ ID NO: 684768 - protein, 21 aa, Mycobacterium
KPVVDTGFWSFPRSCNPTGAL

SEQ ID NO: 684769 - protein, 33 aa, Mycobacterium; identical to SEQ ID NO: 89255

SEQ ID NO: 684770 - protein, 19 aa, Mycobacterium
KPWFAIGGIDAQRLPEVLD

SEQ ID NO: 684771 - protein, 21 aa, Mycobacterium
KPWGSRFPLISVRDQVEADMA

SEQ ID NO: 684772 - protein, 19 aa, Mycobacterium
KPWIHRKAIADGHIIMDYL

SEQ ID NO: 684773 - protein, 21 aa, Mycobacterium
KPWWSTAVFYQVYPRSFADSS

SEQ ID NO: 684774 - protein, 23 aa, Mycobacterium
KPYAQRQLKRWAGQWELSKTREL

SEQ ID NO: 684775 - protein, 21 aa, Mycobacterium
KPYMRRGRRVGGSAKERATPR

SEQ ID NO: 684776 - protein, 27 aa, Mycobacterium
KPYPARTTLFGGLPPGLLVEIDALAKI

SEQ ID NO: 684777 - protein, 18 aa, Mycobacterium
KPYPGKAITAAILRGVLR

SEQ ID NO: 684778 - protein, 38 aa, Mycobacterium
KQADAYRAISLLLRRPPGREAFPGDVFYLHSRLLERCA

SEQ ID NO: 684779 - protein, 28 aa, Mycobacterium
KQAEAYRAISLLLRRPPGREAYPGDVFY

SEQ ID NO: 684780 - protein, 19 aa, Mycobacterium
KQAGISFLLIDMNTPGITL

SEQ ID NO: 684781 - protein, 19 aa, Mycobacterium
KQAHLPYLVYLRHPTTGGV

SEQ ID NO: 684782 - protein, 24 aa, Mycobacterium
KQAKDRLLELSIAMHSTGPDVMGR

SEQ ID NO: 684783 - protein, 19 aa, Mycobacterium
KQALIWAMSVAAKRAEAML

SEQ ID NO: 684784 - protein, 25 aa, Mycobacterium
KQAMPDWLGAAGIAYRHEPDLGGRR

SEQ ID NO: 684785 - protein, 24 aa, Mycobacterium
KQARDCNFGGITLVEKVDPKAVQR

SEQ ID NO: 684786 - protein, 27 aa, Mycobacterium
KQARLWRNLLKCRARIDDNGSVQVRLP

SEQ ID NO: 684787 - protein, 22 aa, Mycobacterium
KQARRRLAFDEALGLQLALAMR

SEQ ID NO: 684788 - protein, 23 aa, Mycobacterium
KQASGLEQAHHWAIGQHPTLADI

SEQ ID NO: 684789 - protein, 23 aa, Mycobacterium
KQASGLEQAHHWAIGQHPTLTSI

SEQ ID NO: 684790 - protein, 17 aa, Mycobacterium
KQAVEFAAFGVGLTLPV

SEQ ID NO: 684791 - protein, 20 aa, Mycobacterium
KQAYLDWAVGAFRLSTSGVS

SEQ ID NO: 684792 - protein, 25 aa, Mycobacterium
KQDPDGWGKSPGFGTTVAFPTVPGA

SEQ ID NO: 684793 - protein, 27 aa, Mycobacterium
KQEARRRAVELLELVGISQAERRARAF

SEQ ID NO: 684794 - protein, 21 aa, Mycobacterium
KQERHEVFTADGWYDTGDRGW

SEQ ID NO: 684795 - protein, 27 aa, Mycobacterium
KQFKSYRGMGSLGAMAGRGSGTGKSYS

SEQ ID NO: 684796 - protein, 26 aa, Mycobacterium
KQFKSYRGMGSLGAMQGRGAAKSYSK

SEQ ID NO: 684797 - protein, 25 aa, Mycobacterium
KQFKSYRGMGSLGAMQGRGATGNLR

SEQ ID NO: 684798 - protein, 26 aa, Mycobacterium
KQFPDPHLSTLLALMLTYRLGSLEAL

SEQ ID NO: 684799 - protein, 25 aa, Mycobacterium
KQFPEELGKMGFVFNFITYGGHQID

SEQ ID NO: 684800 - protein, 26 aa, Mycobacterium
KQFRAELKLPLILLGGITNRDTMDQA

SEQ ID NO: 684801 - protein, 19 aa, Mycobacterium
KQFRLLVQALEMPRLARDD

SEQ ID NO: 684802 - protein, 27 aa, Mycobacterium
KQFRVSFDAAPARRLAPVSAHQIAAVI

SEQ ID NO: 684803 - protein, 24 aa, Mycobacterium
KQGEASAGFMLMKPLVETATAAGA

SEQ ID NO: 684804 - protein, 18 aa, Mycobacterium
KQGLLHTLVDEWTQAPEV

SEQ ID NO: 684805 - protein, 25 aa, Mycobacterium
KQGLRLAQTLTPWPATDGQRIAAAS

SEQ ID NO: 684806 - protein, 24 aa, Mycobacterium
KQGRGREPLRFIVLDELNKYAPRQ

SEQ ID NO: 684807 - protein, 25 aa, Mycobacterium
KQGTELLSDIALDFKPVVQTRYEPK

SEQ ID NO: 684808 - protein, 19 aa, Mycobacterium
KQGTLVIAAHLSFTDTDMT

SEQ ID NO: 684809 - protein, 19 aa, Mycobacterium
KQHFRIFARVMLESRAPTD

SEQ ID NO: 684810 - protein, 18 aa, Mycobacterium
KQILGFDPDKNFEVRDEV

SEQ ID NO: 684811 - protein, 23 aa, Mycobacterium
KQIPECKAVVVFIDDLDRCLPET

SEQ ID NO: 684812 - protein, 20 aa, Mycobacterium
KQISVSFVFGYDPAEFASSL

SEQ ID NO: 684813 - protein, 17 aa, Mycobacterium
KQIWEWEKRAKRLNQQH

SEQ ID NO: 684814 - protein, 17 aa, Mycobacterium
KQKEALGDVAILWTSQT

SEQ ID NO: 684815 - protein, 19 aa, Mycobacterium
KQLRDIPDVDALYFTMLNS

SEQ ID NO: 684816 - protein, 19 aa, Mycobacterium
KQLRNCYSTVRLPGIDVDT

SEQ ID NO: 684817 - protein, 21 aa, Mycobacterium
KQLRNSWYIMFFQLPELPERL

SEQ ID NO: 684818 - protein, 19 aa, Mycobacterium
KQLSAAWSLGRLYWSDREG

SEQ ID NO: 684819 - protein, 29 aa, Mycobacterium
KQLSADLNFAWPTARIAVIGAEGAAQLLV

SEQ ID NO: 684820 - protein, 19 aa, Mycobacterium
KQLTMRVFTGLTLLDTIQG

SEQ ID NO: 684821 - protein, 19 aa, Mycobacterium
KQMLVHAAMALWRTNGYAN

SEQ ID NO: 684822 - protein, 28 aa, Mycobacterium
KQMSDGFGRYGVDFTNPDFVGFAHSYGA

SEQ ID NO: 684823 - protein, 22 aa, Mycobacterium
KQMSLRLAGRGVLVKDTHGSTL

SEQ ID NO: 684824 - protein, 25 aa, Mycobacterium
KQNEEFMWRLADRQLDEFLGNGRCE

SEQ ID NO: 684825 - protein, 26 aa, Mycobacterium
KQNEEFMWRLADRQLDEFLVNGECEF

SEQ ID NO: 684826 - protein, 21 aa, Mycobacterium
KQPPLQRIIRALIGMDAKMRQ

SEQ ID NO: 684827 - protein, 25 aa, Mycobacterium
KQQFLEEFERTILLPRGMDYKVQFP

SEQ ID NO: 684828 - protein, 24 aa, Mycobacterium
KQQLCEVLDLFKAAARRAVAAGYD

SEQ ID NO: 684829 - protein, 20 aa, Mycobacterium
KQQPVELVDIVIPDPGPGEV

SEQ ID NO: 684830 - protein, 25 aa, Mycobacterium
KQQTDWRAAIAYARSLDNVDTTRLV

SEQ ID NO: 684831 - protein, 18 aa, Mycobacterium
KQREILILRVVVGLSAEE

SEQ ID NO: 684832 - protein, 19 aa, Mycobacterium
KQREILILRVVVGMSAEET

SEQ ID NO: 684833 - protein, 22 aa, Mycobacterium
KQRGHKGLAYVLVGKDGELTGP

SEQ ID NO: 684834 - protein, 28 aa, Mycobacterium
KQRIPATVGDIAKRVFLGKPLITENLTS

SEQ ID NO: 684835 - protein, 20 aa, Mycobacterium
KQRLAELGPEGFARWLRDSA

SEQ ID NO: 684836 - protein, 29 aa, Mycobacterium
KQRYPIIACKDGHVRICILSKRQWHGMFA

SEQ ID NO: 684837 - protein, 17 aa, Mycobacterium
KQSESNAMWALSIPIPF

SEQ ID NO: 684838 - protein, 17 aa, Mycobacterium
KQSESNAMWALSIPVPF

SEQ ID NO: 684839 - protein, 18 aa, Mycobacterium
KQTIPRDQVLYFRGYGGI

SEQ ID NO: 684840 - protein, 26 aa, Mycobacterium
KQTIYRWWPTRPALVADVMLEDADTL

SEQ ID NO: 684841 - protein, 28 aa, Mycobacterium
KQTRLGRFVSTYGWRAYALPALVALTAV

SEQ ID NO: 684842 - protein, 27 aa, Mycobacterium
KQTWLGRFVSTYGWRAYALPVLAVLTA

SEQ ID NO: 684843 - protein, 22 aa, Mycobacterium
KQVALHHPGNWTVGGMAKGAGM

SEQ ID NO: 684844 - protein, 25 aa, Mycobacterium
KQVLVVSARLVWEARDLEGRPYADG

SEQ ID NO: 684845 - protein, 24 aa, Mycobacterium
KQVPADEVFRGFATELGLDVAAWE

SEQ ID NO: 684846 - protein, 19 aa, Mycobacterium
KQVRCVYVAIGQKGTTIAS

SEQ ID NO: 684847 - protein, 17 aa, Mycobacterium
KQVYRLVKGRRLNQLSF

SEQ ID NO: 684848 - protein, 24 aa, Mycobacterium
KQWADPRLVVAVLHNNDLNQVTWE

SEQ ID NO: 684849 - protein, 19 aa, Mycobacterium
KQWPDVQIRVIPAMTAAQA

SEQ ID NO: 684850 - protein, 20 aa, Mycobacterium
KQYGCGFAPSGWDTLTKHLM

SEQ ID NO: 684851 - protein, 21 aa, Mycobacterium
KQYKVAVGDVVKVEKLDSDPG

SEQ ID NO: 684852 - protein, 21 aa, Mycobacterium
KQYLEDYARAFDLKRNIEFQN

SEQ ID NO: 684853 - protein, 26 aa, Mycobacterium
KQYPFLGAPFWVGRGFGLNLSVVTDP

SEQ ID NO: 684854 - protein, 19 aa, Mycobacterium
KQYQAFSVQAATFHEQLVR

SEQ ID NO: 684855 - protein, 17 aa, Mycobacterium
KQYRYQGTVPWTLSPWA

SEQ ID NO: 684856 - protein, 22 aa, Mycobacterium
KQYSDFIAWPVRMDVERRTPAS

SEQ ID NO: 684857 - protein, 26 aa, Mycobacterium
KRAADLPPAVGVLVEYTGDDKSAAHA

SEQ ID NO: 684858 - protein, 25 aa, Mycobacterium
KRAAELLKPCTLELGGKSAAIMLED

SEQ ID NO: 684859 - protein, 18 aa, Mycobacterium
KRAALKLILTAVLARGHI

SEQ ID NO: 684860 - protein, 19 aa, Mycobacterium
KRAALPWDAIFAAEMAGVF

SEQ ID NO: 684861 - protein, 24 aa, Mycobacterium
KRADFRCATTLQEFRDLRRAVTRE

SEQ ID NO: 684862 - protein, 19 aa, Mycobacterium
KRAEPVWDPERDTGAWRAI

SEQ ID NO: 684863 - protein, 22 aa, Mycobacterium
KRAESGALFALLSGQHAGSALR

SEQ ID NO: 684864 - protein, 17 aa, Mycobacterium
KRAESSAMFALLSGQHV

SEQ ID NO: 684865 - protein, 21 aa, Mycobacterium
KRAETQLTILSPVREQLSGDE

SEQ ID NO: 684866 - protein, 21 aa, Mycobacterium
KRAGAGIPLVHATPMPYDNYF

SEQ ID NO: 684867 - protein, 21 aa, Mycobacterium
KRAGAGVPLVHSTPMPYDNYF

SEQ ID NO: 684868 - protein, 20 aa, Mycobacterium
KRAGAYTITDTVGFVRHLPT

SEQ ID NO: 684869 - protein, 24 aa, Mycobacterium
KRAGLPWDAIFAAEMVGAFKPDPA

SEQ ID NO: 684870 - protein, 17 aa, Mycobacterium
KRAGTVITLDDLVEAIG

SEQ ID NO: 684871 - protein, 17 aa, Mycobacterium
KRAGTVITLDDLVEALG

SEQ ID NO: 684872 - protein, 19 aa, Mycobacterium
KRAGTVLTLDDLVEAIGVD

SEQ ID NO: 684873 - protein, 20 aa, Mycobacterium
KRAIIGEAFRVLRPGGRYAI

SEQ ID NO: 684874 - protein, 20 aa, Mycobacterium
KRAKERREVPGLAKPFNAPP

SEQ ID NO: 684875 - protein, 28 aa, Mycobacterium
KRALDLFLKIAMLRRAHPDRPHACLMTG

SEQ ID NO: 684876 - protein, 31 aa, Mycobacterium
KRALGEIHAMWRINELLNWQVAAAGEDINVA

SEQ ID NO: 684877 - protein, 23 aa, Mycobacterium
KRALMECLPHITIIEGYGSSESG

SEQ ID NO: 684878 - protein, 18 aa, Mycobacterium
KRALPAPEFTAGEYRAPA

SEQ ID NO: 684879 - protein, 21 aa, Mycobacterium
KRAMLRILIGVIRDGIDTGHF

SEQ ID NO: 684880 - protein, 24 aa, Mycobacterium
KRAMPEVVTVFLAPPSWQDLEARL

SEQ ID NO: 684881 - protein, 22 aa, Mycobacterium
KRANHIRVRFAARQWGTRGARI

SEQ ID NO: 684882 - protein, 20 aa, Mycobacterium
KRAPMWTASVPADWQDLPDR

SEQ ID NO: 684883 - protein, 20 aa, Mycobacterium
KRAQDGAIITGWDYPSCEAI

SEQ ID NO: 684884 - protein, 20 aa, Mycobacterium
KRARINAMRYVLGKFDYDNK

SEQ ID NO: 684885 - protein, 18 aa, Mycobacterium
KRARRESRQVLRRLIDGM

SEQ ID NO: 684886 - protein, 26 aa, Mycobacterium
KRARTCVKHVLYAYSMSTMVQIRNVP

SEQ ID NO: 684887 - protein, 29 aa, Mycobacterium
KRASAGASSDIWKNIFWLQQRPGISTAEE

SEQ ID NO: 684888 - protein, 19 aa, Mycobacterium
KRATSGWAALTRAELNVVR

SEQ ID NO: 684889 - protein, 18 aa, Mycobacterium
KRAVIERSGLPFSRIRVL

SEQ ID NO: 684890 - protein, 17 aa, Mycobacterium
KRCGHLPDKELVSADDF

SEQ ID NO: 684891 - protein, 19 aa, Mycobacterium
KRCHNHRCGSTFYDRSKNN

SEQ ID NO: 684892 - protein, 25 aa, Mycobacterium
KRCLIPMDGYYEWRVNSDAAAGKKS

SEQ ID NO: 684893 - protein, 25 aa, Mycobacterium
KRCLVPMDGWYEWKGTKGAKTPYYM

SEQ ID NO: 684894 - protein, 25 aa, Mycobacterium
KRCLVPMDGWYEWRKQEGAKTAFYM

SEQ ID NO: 684895 - protein, 18 aa, Mycobacterium
KRDAEALALLTAGNDVAL

SEQ ID NO: 684896 - protein, 19 aa, Mycobacterium
KRDAEGALRVSVEDAQTLG

SEQ ID NO: 684897 - protein, 21 aa, Mycobacterium
KRDDLANAFGKINDWITENPG

SEQ ID NO: 684898 - protein, 17 aa, Mycobacterium
KRDEVLADMAAQQKALE

SEQ ID NO: 684899 - protein, 23 aa, Mycobacterium
KRDFSHLMIRTEVRSAHGDSHLG

SEQ ID NO: 684900 - protein, 17 aa, Mycobacterium
KRDGELLGRPHALPAAD

SEQ ID NO: 684901 - protein, 23 aa, Mycobacterium
KRDGTWKFVARAIVTDTAHVLDP

SEQ ID NO: 684902 - protein, 18 aa, Mycobacterium
KRDGWPAVVVPVDNLAEA

SEQ ID NO: 684903 - protein, 18 aa, Mycobacterium
KRDHKPWIDDGVYGEIYW

SEQ ID NO: 684904 - protein, 18 aa, Mycobacterium
KRDLGWRPTHSSAETLAA

SEQ ID NO: 684905 - protein, 26 aa, Mycobacterium
KRDLITCLRRGRALRVPRARSRQKAW

SEQ ID NO: 684906 - protein, 20 aa, Mycobacterium
KRDMALKFGATHAFATAEEA

SEQ ID NO: 684907 - protein, 17 aa, Mycobacterium
KRDMDWFMDHFLDGADV

SEQ ID NO: 684908 - protein, 21 aa, Mycobacterium
KRDMLSKLGVEYVGDSRSVDF

SEQ ID NO: 684909 - protein, 19 aa, Mycobacterium
KRDPDFLARMADRVSLVII

SEQ ID NO: 684910 - protein, 20 aa, Mycobacterium
KRDQALKFGATHAYPDIFSA

SEQ ID NO: 684911 - protein, 19 aa, Mycobacterium
KRDQALKFGATHVYPDINA

SEQ ID NO: 684912 - protein, 19 aa, Mycobacterium
KRDRGGAVSNWLNDTAAPG

SEQ ID NO: 684913 - protein, 20 aa, Mycobacterium
KRDRIGAAIRGEEILVQLLS

SEQ ID NO: 684914 - protein, 17 aa, Mycobacterium
KRDRKRLRRRIGRDRLP

SEQ ID NO: 684915 - protein, 23 aa, Mycobacterium
KRDRMGGTWDLFRYPGIRADTDM

SEQ ID NO: 684916 - protein, 17 aa, Mycobacterium
KRDRQRLLGALQVAARG

SEQ ID NO: 684917 - protein, 26 aa, Mycobacterium
KRDSEWMGRVHRFLGLDVGVILAQMT

SEQ ID NO: 684918 - protein, 30 aa, Mycobacterium; identical to SEQ ID NO: 81539

SEQ ID NO: 684919 - protein, 29 aa, Mycobacterium
KRDSEWMGRVHRFLGLDVGVILSQMTPLE

SEQ ID NO: 684920 - protein, 20 aa, Mycobacterium
KRDVALNLIGAIGLITLPRS

SEQ ID NO: 684921 - protein, 17 aa, Mycobacterium
KRDVLWSHCADIGRDPK

SEQ ID NO: 684922 - protein, 18 aa, Mycobacterium
KREALFAGPVLRASATLV

SEQ ID NO: 684923 - protein, 25 aa, Mycobacterium
KREDFPPNNWHVRKAMWAPALGCYG

SEQ ID NO: 684924 - protein, 23 aa, Mycobacterium
KREDKPFWWGHFDRVNNPVEEWA

SEQ ID NO: 684925 - protein, 19 aa, Mycobacterium
KREDLQIVRSYKLRGAYNL

SEQ ID NO: 684926 - protein, 18 aa, Mycobacterium
KREFAALGVDHAERAELF

SEQ ID NO: 684927 - protein, 24 aa, Mycobacterium
KREGRPSDPLALWTELWGDALIRH

SEQ ID NO: 684928 - protein, 18 aa, Mycobacterium
KRELPRLRIPVLAEQLAP

SEQ ID NO: 684929 - protein, 19 aa, Mycobacterium
KRELVFAGPVARSTTTLVR

SEQ ID NO: 684930 - protein, 21 aa, Mycobacterium
KREMLSSLGVDYVGDSRTVDF

SEQ ID NO: 684931 - protein, 19 aa, Mycobacterium
KREQALKFGATAAFADVGS

SEQ ID NO: 684932 - protein, 19 aa, Mycobacterium
KRERPNWSFVPLARQTRRH

SEQ ID NO: 684933 - protein, 19 aa, Mycobacterium
KRESLGFRAALRDLIDDAP

SEQ ID NO: 684934 - protein, 20 aa, Mycobacterium
KREVLFAGPVLRPSTTLVRR

SEQ ID NO: 684935 - protein, 20 aa, Mycobacterium
KRFADYVAVADADFSIAQGE

SEQ ID NO: 684936 - protein, 21 aa, Mycobacterium
KRFAQMVPRAVYGWLAEANAV

SEQ ID NO: 684937 - protein, 19 aa, Mycobacterium
KRFASLAQRLMLLAKNGGC

SEQ ID NO: 684938 - protein, 17 aa, Mycobacterium
KRFGDFAALDDVDFTVP

SEQ ID NO: 684939 - protein, 20 aa, Mycobacterium
KRFGDKTVLDGMNFSVAPGE

SEQ ID NO: 684940 - protein, 19 aa, Mycobacterium
KRFGDRTVLDEVSLSVAAG

SEQ ID NO: 684941 - protein, 21 aa, Mycobacterium
KRFGVPVPNLTPWRASLTGDM

SEQ ID NO: 684942 - protein, 21 aa, Mycobacterium
KRFGVPVPNLTPWRASVTGDM

SEQ ID NO: 684943 - protein, 25 aa, Mycobacterium
KRFISNADWGDWFAVLARSGEENEF

SEQ ID NO: 684944 - protein, 21 aa, Mycobacterium
KRFLEKYGKATPEALVESALW

SEQ ID NO: 684945 - protein, 19 aa, Mycobacterium
KRFMFDYIPDVFKGQYAES

SEQ ID NO: 684946 - protein, 23 aa, Mycobacterium
KRFRFRLLAVAGRIIRTGRRRRL

SEQ ID NO: 684947 - protein, 23 aa, Mycobacterium
KRFRVALDAAPARRLAAASPDDV

SEQ ID NO: 684948 - protein, 20 aa, Mycobacterium
KRFSLEGAESVIPMMDAAID

SEQ ID NO: 684949 - protein, 20 aa, Mycobacterium
KRFSVPVPNLTPWRDSTVGD

SEQ ID NO: 684950 - protein, 19 aa, Mycobacterium
KRFVKGIDEEAVFQKRAPK

SEQ ID NO: 684951 - protein, 24 aa, Mycobacterium
KRFVKGIDVEAVFQKRAPTNRPDW

SEQ ID NO: 684952 - protein, 25 aa, Mycobacterium
KRGDTFRAHCREWFDGAIHNDDSAE

SEQ ID NO: 684953 - protein, 22 aa, Mycobacterium
KRGEAMSAPFSAPRTSFNSTIT

SEQ ID NO: 684954 - protein, 18 aa, Mycobacterium
KRGFPISWLADEFGVHRN

SEQ ID NO: 684955 - protein, 24 aa, Mycobacterium
KRGGVPSRGPHEWRHETEPTHRPK

SEQ ID NO: 684956 - protein, 17 aa, Mycobacterium
KRGHVVVAVDILDSSPF

SEQ ID NO: 684957 - protein, 28 aa, Mycobacterium
KRGLSIDLGGSWLLPKIVGLQQAKRLAL

SEQ ID NO: 684958 - protein, 19 aa, Mycobacterium
KRGLVGLMQVWANELAQYW

SEQ ID NO: 684959 - protein, 20 aa, Mycobacterium
KRGLYLAALDRYLTGGGDPA

SEQ ID NO: 684960 - protein, 18 aa, Mycobacterium
KRGPGVLRCDLLVINKVD

SEQ ID NO: 684961 - protein, 22 aa, Mycobacterium
KRGPNAGSRFLLDQPITSAGRH

SEQ ID NO: 684962 - protein, 20 aa, Mycobacterium
KRGQACSFGPAWNDPNDHSG

SEQ ID NO: 684963 - protein, 22 aa, Mycobacterium
KRGQEGPFGKWLEHWHPDHDPF

SEQ ID NO: 684964 - protein, 21 aa, Mycobacterium
KRGRAAVNMHWVLTPDEALVI

SEQ ID NO: 684965 - protein, 26 aa, Mycobacterium
KRGRAPDRLLLGLAVLTLVGEASRAS

SEQ ID NO: 684966 - protein, 17 aa, Mycobacterium
KRGRRISVVDVELMQGE

SEQ ID NO: 684967 - protein, 24 aa, Mycobacterium
KRGWERPYIAAGIFLYDRLGGAKS

SEQ ID NO: 684968 - protein, 25 aa, Mycobacterium
KRGWPLEWAGALAGNFVGAIWPTAR

SEQ ID NO: 684969 - protein, 17 aa, Mycobacterium
KRHADGLADVLVPDDAD

SEQ ID NO: 684970 - protein, 20 aa, Mycobacterium
KRHALPHARILMHQPLGGVT

SEQ ID NO: 684971 - protein, 18 aa, Mycobacterium
KRHHGLAWGVFHRRFLPN

SEQ ID NO: 684972 - protein, 19 aa, Mycobacterium
KRHKDRPVLFLGDTTLTGG

SEQ ID NO: 684973 - protein, 25 aa, Mycobacterium
KRHNFLGAPFWVGRGFGLNLSVVTD

SEQ ID NO: 684974 - protein, 19 aa, Mycobacterium
KRHNLTFVDLLVAHASKSG

SEQ ID NO: 684975 - protein, 25 aa, Mycobacterium
KRHWPCSRGFERFYGFMGGETDQWY

SEQ ID NO: 684976 - protein, 28 aa, Mycobacterium
KRIAPRTMLCGYAWRVHVNISDAHFAEL

SEQ ID NO: 684977 - protein, 21 aa, Mycobacterium
KRIATSFPNLVRKDLAAHGID

SEQ ID NO: 684978 - protein, 19 aa, Mycobacterium
KRIDECIEIVKGLTTGDYF

SEQ ID NO: 684979 - protein, 19 aa, Mycobacterium
KRIDECIEIVKGLTTGEYF

SEQ ID NO: 684980 - protein, 19 aa, Mycobacterium
KRIFAHGWLLNRGEKMSKS

SEQ ID NO: 684981 - protein, 22 aa, Mycobacterium
KRIFDITIAYLKTRFQFGRAIG

SEQ ID NO: 684982 - protein, 18 aa, Mycobacterium
KRINTIVASAIEFEIKDP

SEQ ID NO: 684983 - protein, 17 aa, Mycobacterium
KRIPLQHLVGTAAFGPL

SEQ ID NO: 684984 - protein, 24 aa, Mycobacterium
KRIPRLGHQWVLFHGHGQQRIRLL

SEQ ID NO: 684985 - protein, 20 aa, Mycobacterium
KRIQQEWGVSDEVMRDLVNA

SEQ ID NO: 684986 - protein, 23 aa, Mycobacterium
KRIRDQFTHCIDITPTVLEAVGL

SEQ ID NO: 684987 - protein, 18 aa, Mycobacterium
KRIRGYEVDEANAVRVHS

SEQ ID NO: 684988 - protein, 25 aa, Mycobacterium
KRIRNTPRVTLAICDMRGRPKSEAV

SEQ ID NO: 684989 - protein, 25 aa, Mycobacterium
KRIRNTPRVTLAICDVRGRPKSEAV

SEQ ID NO: 684990 - protein, 22 aa, Mycobacterium
KRIRRLKELTGLDMTVPKDSAR

SEQ ID NO: 684991 - protein, 17 aa, Mycobacterium
KRISEAGDVVFLELEER

SEQ ID NO: 684992 - protein, 19 aa, Mycobacterium
KRITGRYALIRTNGKQWLV

SEQ ID NO: 684993 - protein, 19 aa, Mycobacterium
KRITMGHTVVMGRRTWDSL

SEQ ID NO: 684994 - protein, 23 aa, Mycobacterium
KRIVERNQIWPVMAAKYGVENPV

SEQ ID NO: 684995 - protein, 22 aa, Mycobacterium
KRIYTGGGVWLARCRYRDTDGV

SEQ ID NO: 684996 - protein, 24 aa, Mycobacterium
KRKEACAVIGKSLRAVGEQVRDRS

SEQ ID NO: 684997 - protein, 17 aa, Mycobacterium
KRKIIGREFIRSFEGAV

SEQ ID NO: 684998 - protein, 17 aa, Mycobacterium
KRKIIGRQFIRAFESAV

SEQ ID NO: 684999 - protein, 24 aa, Mycobacterium
KRKITVPTLYVWSDRDIAITEKPA

SEQ ID NO: 685000 - protein, 20 aa, Mycobacterium
KRKRGELMGIGMSFFTEAVG

SEQ ID NO: 685001 - protein, 19 aa, Mycobacterium
KRKTYCLYEAPSPEAIRTA

SEQ ID NO: 685002 - protein, 20 aa, Mycobacterium
KRKTYCLYEAPSPEAIRTAA

SEQ ID NO: 685003 - protein, 30 aa, Mycobacterium
KRKVSVGTCGRAFGTPCFHEHACVRCSLLR

SEQ ID NO: 685004 - protein, 19 aa, Mycobacterium
KRLADKGCHAVTFSENPEA

SEQ ID NO: 685005 - protein, 22 aa, Mycobacterium
KRLARRVTEVALVFKRAPHLPF

SEQ ID NO: 685006 - protein, 19 aa, Mycobacterium
KRLASPAQRIMLYAKDRGC

SEQ ID NO: 685007 - protein, 17 aa, Mycobacterium
KRLDEFRRFGADQPVGH

SEQ ID NO: 685008 - protein, 17 aa, Mycobacterium
KRLEAKFADQPNAVLRR

SEQ ID NO: 685009 - protein, 18 aa, Mycobacterium
KRLEEVWVPSEPDPVILP

SEQ ID NO: 685010 - protein, 23 aa, Mycobacterium
KRLEHTRSLLLDAAEQVFAEKGF

SEQ ID NO: 685011 - protein, 20 aa, Mycobacterium
KRLGAALEPAEFALLDDADF

SEQ ID NO: 685012 - protein, 19 aa, Mycobacterium
KRLGDGIMAVFRNPTVAVR

SEQ ID NO: 685013 - protein, 19 aa, Mycobacterium
KRLGLCPPDVEAHPVVADG

SEQ ID NO: 685014 - protein, 18 aa, Mycobacterium
KRLGLKRIRIEILPITIG

SEQ ID NO: 685015 - protein, 17 aa, Mycobacterium
KRLGMTVTLAERERVFS

SEQ ID NO: 685016 - protein, 22 aa, Mycobacterium
KRLGRRVTEIALVFKRAPHLPF

SEQ ID NO: 685017 - protein, 18 aa, Mycobacterium
KRLGRYVVGIGVAGSSSR

SEQ ID NO: 685018 - protein, 20 aa, Mycobacterium
KRLISEYVHALATELAVRGI

SEQ ID NO: 685019 - protein, 18 aa, Mycobacterium
KRLITRGRSVIIDGNTLD

SEQ ID NO: 685020 - protein, 20 aa, Mycobacterium
KRLKARYCRLLDTKDIEAWR

SEQ ID NO: 685021 - protein, 19 aa, Mycobacterium
KRLLEVAGTSYAAEAGIRI

SEQ ID NO: 685022 - protein, 21 aa, Mycobacterium
KRLLPDFYRPATEHPAGSSAA

SEQ ID NO: 685023 - protein, 20 aa, Mycobacterium
KRLLRAAALNILGCELDTGL

SEQ ID NO: 685024 - protein, 30 aa, Mycobacterium
KRLLRSAILPLSFGFPFGFSAVIPPNLPLP

SEQ ID NO: 685025 - protein, 29 aa, Mycobacterium
KRLLRSAILPVSFGFPFGLSAVIPPNLPL

SEQ ID NO: 685026 - protein, 29 aa, Mycobacterium
KRLLRSDILPLSFGFPFGFSAAIPPNLPL

SEQ ID NO: 685027 - protein, 20 aa, Mycobacterium
KRLNSALDEYSAWVNSSVSA

SEQ ID NO: 685028 - protein, 19 aa, Mycobacterium
KRLPRTGSVIDVDIDAVLH

SEQ ID NO: 685029 - protein, 20 aa, Mycobacterium
KRLQHRTDLELVGLHCYTPE

SEQ ID NO: 685030 - protein, 22 aa, Mycobacterium
KRLQSGWLNGIKHWQVDFTGAS

SEQ ID NO: 685031 - protein, 20 aa, Mycobacterium
KRLRAAGADIFDEFPKYATS

SEQ ID NO: 685032 - protein, 26 aa, Mycobacterium
KRLRELTGAGMLDCKNALAESDGDFD

SEQ ID NO: 685033 - protein, 19 aa, Mycobacterium
KRLRELTGAGMLDSKNALV

SEQ ID NO: 685034 - protein, 18 aa, Mycobacterium
KRLRLLQVPPEMLPDLRI

SEQ ID NO: 685035 - protein, 19 aa, Mycobacterium
KRLRRVLVTYPDITFGRYT

SEQ ID NO: 685036 - protein, 18 aa, Mycobacterium
KRLRSVGAASEIGATTVP

SEQ ID NO: 685037 - protein, 31 aa, Mycobacterium
KRLRTVLDGSALRWDRILCSAGKRHYDVAVA

SEQ ID NO: 685038 - protein, 20 aa, Mycobacterium
KRLSDGLIEGVRRQWRSGIR

SEQ ID NO: 685039 - protein, 20 aa, Mycobacterium
KRLSHRGFEAAVPMTTWQTH

SEQ ID NO: 685040 - protein, 26 aa, Mycobacterium
KRLSSCGRPSAFLRTALLDENDRPVK

SEQ ID NO: 685041 - protein, 20 aa, Mycobacterium
KRLTLFLIPMDRPGITVRPI

SEQ ID NO: 685042 - protein, 25 aa, Mycobacterium
KRLTSCGRPTLFARTALLDADGNPV

SEQ ID NO: 685043 - protein, 26 aa, Mycobacterium
KRLTSCGRPTLFARVALLGEDGKPVP

SEQ ID NO: 685044 - protein, 25 aa, Mycobacterium
KRLTSCGRPTMFARTALLDPEGNPV

SEQ ID NO: 685045 - protein, 21 aa, Mycobacterium
KRLTTAPILADFDARAVELTE

SEQ ID NO: 685046 - protein, 18 aa, Mycobacterium
KRLVLRYRPMGLIGVIGP

SEQ ID NO: 685047 - protein, 21 aa, Mycobacterium
KRMALPNARVLIHQPALGGVI

SEQ ID NO: 685048 - protein, 20 aa, Mycobacterium
KRMALPNARVLIHQPSLSGV

SEQ ID NO: 685049 - protein, 21 aa, Mycobacterium
KRMALPNARVLIHQPSLSGVI

SEQ ID NO: 685050 - protein, 19 aa, Mycobacterium
KRMDECIEIIQGLTSGDYF

SEQ ID NO: 685051 - protein, 19 aa, Mycobacterium
KRMDECIEIIQGLTSGEYF

SEQ ID NO: 685052 - protein, 18 aa, Mycobacterium
KRMFKPGIDDLVFIGFAQ

SEQ ID NO: 685053 - protein, 19 aa, Mycobacterium
KRMGDGIMAVFRNPAVAVR

SEQ ID NO: 685054 - protein, 20 aa, Mycobacterium
KRMGIEAIYLGGWATSAKGS

SEQ ID NO: 685055 - protein, 21 aa, Mycobacterium
KRMGIEAIYLGGWATSAKGST

SEQ ID NO: 685056 - protein, 21 aa, Mycobacterium
KRMKQEIADVIKLQENLGIDV

SEQ ID NO: 685057 - protein, 25 aa, Mycobacterium
KRMPNGRMPLALWVVGERSLAEVTS

SEQ ID NO: 685058 - protein, 24 aa, Mycobacterium
KRMRTRWVNFAARSTPAGPDGEPD

SEQ ID NO: 685059 - protein, 25 aa, Mycobacterium
KRNAAGDGFNIWTINGEAYAMDTKQ

SEQ ID NO: 685060 - protein, 21 aa, Mycobacterium
KRNAEGLFTAVVQERGSGDVL

SEQ ID NO: 685061 - protein, 20 aa, Mycobacterium
KRNALDLTMIRSISRAIDGR

SEQ ID NO: 685062 - protein, 21 aa, Mycobacterium
KRNFHNWSPFVGVVFGEPDLV

SEQ ID NO: 685063 - protein, 21 aa, Mycobacterium
KRNGKALKRYEVVWRESVRDE

SEQ ID NO: 685064 - protein, 17 aa, Mycobacterium
KRNLAWQAAELMAEHVG

SEQ ID NO: 685065 - protein, 20 aa, Mycobacterium
KRNPVLSVLIRRAALAAPAL

SEQ ID NO: 685066 - protein, 21 aa, Mycobacterium
KRNQPAAAITAGMAMVPEDRK

SEQ ID NO: 685067 - protein, 21 aa, Mycobacterium
KRNRVTACYFGDGAVAEGAFH

SEQ ID NO: 685068 - protein, 19 aa, Mycobacterium
KRNSPQQVRFMLADYRSGL

SEQ ID NO: 685069 - protein, 22 aa, Mycobacterium
KRPACKCKHVYFAHPNEGPCNQ

SEQ ID NO: 685070 - protein, 20 aa, Mycobacterium
KRPAFFGGVTNVAWSFDKEV

SEQ ID NO: 685071 - protein, 18 aa, Mycobacterium
KRPATPIFDAGRITLQSV

SEQ ID NO: 685072 - protein, 22 aa, Mycobacterium
KRPDHDYYVLSRHADVWAAARD

SEQ ID NO: 685073 - protein, 21 aa, Mycobacterium
KRPDIADVLFGIHRWLHGHID

SEQ ID NO: 685074 - protein, 34 aa, Mycobacterium
KRPDSPWLDITWRDRFEQMLKRAEARLHPQDFGP

SEQ ID NO: 685075 - protein, 17 aa, Mycobacterium
KRPDVIHVQLLGRGDGS

SEQ ID NO: 685076 - protein, 19 aa, Mycobacterium
KRPDVIHVQLLGRGDGSTG

SEQ ID NO: 685077 - protein, 24 aa, Mycobacterium
KRPDWIASAELHYARGTSAREAVV

SEQ ID NO: 685078 - protein, 32 aa, Mycobacterium
KRPEFGKLTPLYPNERLRLETSPERLSTRVID

SEQ ID NO: 685079 - protein, 17 aa, Mycobacterium
KRPELTRVYLPPDGNTL

SEQ ID NO: 685080 - protein, 20 aa, Mycobacterium
KRPGPELTVERVGVPVALTP

SEQ ID NO: 685081 - protein, 19 aa, Mycobacterium
KRPGTGDVITVIDPATEET

SEQ ID NO: 685082 - protein, 22 aa, Mycobacterium
KRPKRYEFIDALPKNSYGKVLK

SEQ ID NO: 685083 - protein, 19 aa, Mycobacterium
KRPNFLVIVADDLGFSDIG

SEQ ID NO: 685084 - protein, 29 aa, Mycobacterium
KRPPRRKPLDPARRVAFDVLRAVSERDAY

SEQ ID NO: 685085 - protein, 17 aa, Mycobacterium
KRPPRWVVVAELVETSR

SEQ ID NO: 685086 - protein, 20 aa, Mycobacterium
KRPQCRVNIGGRESSRTAIL

SEQ ID NO: 685087 - protein, 21 aa, Mycobacterium
KRPQPKPIFRYLGMLPAVGSV

SEQ ID NO: 685088 - protein, 24 aa, Mycobacterium
KRPRGEGQWALGYREPLNANEQAK

SEQ ID NO: 685089 - protein, 23 aa, Mycobacterium
KRPRGEGQWALGYREPLNPNEQS

SEQ ID NO: 685090 - protein, 18 aa, Mycobacterium
KRPSMSNEYLKTFNRDDV

SEQ ID NO: 685091 - protein, 32 aa, Mycobacterium; identical to SEQ ID NO: 81548

SEQ ID NO: 685092 - protein, 32 aa, Mycobacterium
KRPSYSLSEIRHWLMVFAQRFYSFSQFKRSAL

SEQ ID NO: 685093 - protein, 30 aa, Mycobacterium
KRPSYSLSEIRHWLQVFVERFYSFSQFKRS

SEQ ID NO: 685094 - protein, 25 aa, Mycobacterium
KRPTAELRALIGLRDAAVALIEAEA

SEQ ID NO: 685095 - protein, 33 aa, Mycobacterium
KRPTYSLKEIRHWLGVFVQRFYSFSQFKRSALP

SEQ ID NO: 685096 - protein, 19 aa, Mycobacterium
KRQCNVASLTSLVFEGEQL

SEQ ID NO: 685097 - protein, 26 aa, Mycobacterium
KRQDFLGAPFWIGRGFGLNLSVVTDP

SEQ ID NO: 685098 - protein, 25 aa, Mycobacterium
KRQGEVSSSWGFRDIINSALDHGVD

SEQ ID NO: 685099 - protein, 17 aa, Mycobacterium
KRRAAAVSHAVNVSVPV

SEQ ID NO: 685100 - protein, 17 aa, Mycobacterium
KRRAEARLQGWEEFDEQ

SEQ ID NO: 685101 - protein, 19 aa, Mycobacterium
KRRCDAQTAVLFVTHEINP

SEQ ID NO: 685102 - protein, 34 aa, Mycobacterium
KRREMAYEGKVDWAFGELLAFGTLVAEGKVVRLS

SEQ ID NO: 685103 - protein, 21 aa, Mycobacterium
KRRGDLPKFLDGVVADPSAGN

SEQ ID NO: 685104 - protein, 19 aa, Mycobacterium
KRRGDYGIITVLGLSMSLS

SEQ ID NO: 685105 - protein, 19 aa, Mycobacterium
KRRIDELAKSYVDRMTAVG

SEQ ID NO: 685106 - protein, 17 aa, Mycobacterium
KRRINDYAENAALSLIC

SEQ ID NO: 685107 - protein, 17 aa, Mycobacterium
KRRIVDLGGDPLESAAA

SEQ ID NO: 685108 - protein, 18 aa, Mycobacterium
KRRLFGQIVAAAVRGVEG

SEQ ID NO: 685109 - protein, 17 aa, Mycobacterium
KRRLPSMYHQFIELAEV

SEQ ID NO: 685110 - protein, 17 aa, Mycobacterium
KRRLPSMYHQFKELAGV

SEQ ID NO: 685111 - protein, 19 aa, Mycobacterium
KRRMFDLQIRMGFKEIEVG

SEQ ID NO: 685112 - protein, 17 aa, Mycobacterium
KRRQVLRDMGIEHVYDS

SEQ ID NO: 685113 - protein, 24 aa, Mycobacterium
KRRRQQVDWMWAMVRDAVLDRVLN

SEQ ID NO: 685114 - protein, 19 aa, Mycobacterium
KRRTVPTLMPWAAEALLDY

SEQ ID NO: 685115 - protein, 28 aa, Mycobacterium
KRRVDRMLADGVIRGFTTVVDRNVLGWN

SEQ ID NO: 685116 - protein, 18 aa, Mycobacterium
KRRVEAIATTDIVAVPLD

SEQ ID NO: 685117 - protein, 29 aa, Mycobacterium
KRRYRLLEMSQLPGRGWVEYEPYGTVLVI

SEQ ID NO: 685118 - protein, 24 aa, Mycobacterium
KRSAEEVRFLMGFNRDVVRRRRDV

SEQ ID NO: 685119 - protein, 24 aa, Mycobacterium
KRSAEEVRFLMGFNRDVVRRRREN

SEQ ID NO: 685120 - protein, 20 aa, Mycobacterium
KRSALELLWRAEGRPDPLDG

SEQ ID NO: 685121 - protein, 18 aa, Mycobacterium
KRSDLLCHARTTRRRKEL

SEQ ID NO: 685122 - protein, 18 aa, Mycobacterium
KRSEPVRATALFDQAAEL

SEQ ID NO: 685123 - protein, 19 aa, Mycobacterium
KRSFYRMFFDSGYTPLPGE

SEQ ID NO: 685124 - protein, 20 aa, Mycobacterium
KRSGFGRELGRFGMEEFVNK

SEQ ID NO: 685125 - protein, 22 aa, Mycobacterium
KRSGLTGKFVRTIFESPRSGGA

SEQ ID NO: 685126 - protein, 25 aa, Mycobacterium
KRSLFPELRFDEHLIMGEDLLLIKQ

SEQ ID NO: 685127 - protein, 18 aa, Mycobacterium
KRSLPAPVYHDAARYREP

SEQ ID NO: 685128 - protein, 29 aa, Mycobacterium
KRSLSDWGGLTAEAWKAQHGKLRTDIAEQ

SEQ ID NO: 685129 - protein, 25 aa, Mycobacterium
KRSPAGKPDYRWAKDTTEERPADEV

SEQ ID NO: 685130 - protein, 27 aa, Mycobacterium
KRSPAGKPDYRWAKDVTEERPADEVHA

SEQ ID NO: 685131 - protein, 25 aa, Mycobacterium
KRSPAGKPDYRWAKEQTEARPADDV

SEQ ID NO: 685132 - protein, 25 aa, Mycobacterium
KRSPAGKPDYRWAKEQTEARPADEV

SEQ ID NO: 685133 - protein, 20 aa, Mycobacterium
KRSPHAFAATAIGLAVFLDH

SEQ ID NO: 685134 - protein, 23 aa, Mycobacterium
KRSPHPFAATAIGLAVFLDKESD

SEQ ID NO: 685135 - protein, 23 aa, Mycobacterium
KRSPHPFAATAIGLAVFLDKESG

SEQ ID NO: 685136 - protein, 20 aa, Mycobacterium
KRSPHPFAATAIGLAVFLDT

SEQ ID NO: 685137 - protein, 35 aa, Mycobacterium
KRSPSMLRNVWRFWYQIPISLPVIGPRVISASNPR

SEQ ID NO: 685138 - protein, 25 aa, Mycobacterium
KRSRKARATVPAWEDVLLGVRSSGT

SEQ ID NO: 685139 - protein, 23 aa, Mycobacterium
KRSRKEKIMGFGHRVYKNGDSRV

SEQ ID NO: 685140 - protein, 29 aa, Mycobacterium
KRSRRTVPLPPWLAKRMADYLAEVHPRGD

SEQ ID NO: 685141 - protein, 23 aa, Mycobacterium
KRSTEEWTTLLAAAQMWFAPVNG

SEQ ID NO: 685142 - protein, 18 aa, Mycobacterium
KRSVVLDLSTDTGRELAY

SEQ ID NO: 685143 - protein, 30 aa, Mycobacterium
KRSYLTDLGIRFMPTVGWAERGDLRAEGHG

SEQ ID NO: 685144 - protein, 22 aa, Mycobacterium
KRTADGYASNWLCDNAHAGMKM

SEQ ID NO: 685145 - protein, 20 aa, Mycobacterium
KRTADIVGIPFDKVTQGGLF

SEQ ID NO: 685146 - protein, 32 aa, Mycobacterium
KRTFDYLDHFTWWRVVTWMRKRHHGLAWGVFH

SEQ ID NO: 685147 - protein, 18 aa, Mycobacterium
KRTGRPYYNAIVWQDTRT

SEQ ID NO: 685148 - protein, 25 aa, Mycobacterium
KRTGWAACWLLLGLNGHRLSSQLDV

SEQ ID NO: 685149 - protein, 20 aa, Mycobacterium
KRTIPLVARHAHIWHAFGDI

SEQ ID NO: 685150 - protein, 19 aa, Mycobacterium
KRTKQGLIKARQAGKQLGK

SEQ ID NO: 685151 - protein, 26 aa, Mycobacterium
KRTLRITAKYADHWNFVLGTPEEFAH

SEQ ID NO: 685152 - protein, 20 aa, Mycobacterium
KRTLTANGLRQLISFISRMT

SEQ ID NO: 685153 - protein, 20 aa, Mycobacterium
KRTLTASGLRQLIAFISRMT

SEQ ID NO: 685154 - protein, 20 aa, Mycobacterium
KRTLTATGLRQLIAFISRMT

SEQ ID NO: 685155 - protein, 19 aa, Mycobacterium
KRTLTATGLRQLINFISRM

SEQ ID NO: 685156 - protein, 21 aa, Mycobacterium
KRTQVLFRFRELLNDRKGELA

SEQ ID NO: 685157 - protein, 27 aa, Mycobacterium
KRTQWWGRQMLIWGVHVHVGISSAHKV

SEQ ID NO: 685158 - protein, 26 aa, Mycobacterium
KRTQWWGRQMLIWGVHVHVGISSPNK

SEQ ID NO: 685159 - protein, 26 aa, Mycobacterium
KRTQWWGRQMLIWGVHVHVGVSSAHK

SEQ ID NO: 685160 - protein, 25 aa, Mycobacterium
KRTSDLIPLCHQLALTGVDVDFTVG

SEQ ID NO: 685161 - protein, 27 aa, Mycobacterium
KRTVFGWSMRVGLRVSAARQAGRKPSR

SEQ ID NO: 685162 - protein, 21 aa, Mycobacterium
KRTVIATGILNLWMHGPGDVA

SEQ ID NO: 685163 - protein, 20 aa, Mycobacterium
KRTWAGEGLGLAQVGEELQP

SEQ ID NO: 685164 - protein, 22 aa, Mycobacterium
KRVARQYLVGFIGARRPDRSAL

SEQ ID NO: 685165 - protein, 23 aa, Mycobacterium
KRVDNMTMAWGLEGRVPFLDHEL

SEQ ID NO: 685166 - protein, 23 aa, Mycobacterium
KRVFSEPIALNWAADGTDVDFGA

SEQ ID NO: 685167 - protein, 23 aa, Mycobacterium
KRVGWSHNVGPWIVFMQNVDAIV

SEQ ID NO: 685168 - protein, 19 aa, Mycobacterium
KRVKYWAAEALDGKFEAND

SEQ ID NO: 685169 - protein, 19 aa, Mycobacterium
KRVLHKVGRFVTDRYTHRN

SEQ ID NO: 685170 - protein, 17 aa, Mycobacterium
KRVPGERTIASTFLGLV

SEQ ID NO: 685171 - protein, 17 aa, Mycobacterium
KRVPSMHVHAFSPMEIA

SEQ ID NO: 685172 - protein, 21 aa, Mycobacterium
KRVPTGHGYYDAFNLDHVRLV

SEQ ID NO: 685173 - protein, 24 aa, Mycobacterium
KRVQQLRLHYARTLDTWAGALESR

SEQ ID NO: 685174 - protein, 19 aa, Mycobacterium
KRVRMLPLGGQLSVGEYER

SEQ ID NO: 685175 - protein, 21 aa, Mycobacterium
KRVSELLERVGLTDRASYLPA

SEQ ID NO: 685176 - protein, 18 aa, Mycobacterium
KRVSRGTAQLADINVSPF

SEQ ID NO: 685177 - protein, 19 aa, Mycobacterium
KRVTACYFGDGAVAEGAFH

SEQ ID NO: 685178 - protein, 23 aa, Mycobacterium
KRVTEVFEPAQVVEFFATTDGQA

SEQ ID NO: 685179 - protein, 33 aa, Mycobacterium
KRVTFAAFPWRWKKGDGCIVRLVAITDPTGEYR

SEQ ID NO: 685180 - protein, 20 aa, Mycobacterium
KRVVRDAALRLIGVGSDDDY

SEQ ID NO: 685181 - protein, 19 aa, Mycobacterium
KRWDEALANLLAKGLIERR

SEQ ID NO: 685182 - protein, 22 aa, Mycobacterium
KRWFRSEVRGLESFPPTGGVLV

SEQ ID NO: 685183 - protein, 24 aa, Mycobacterium
KRWNAIAEIIARGWDDVLKAIDDI

SEQ ID NO: 685184 - protein, 21 aa, Mycobacterium
KRWNAIAEIIARSWDDVLKAI

SEQ ID NO: 685185 - protein, 20 aa, Mycobacterium
KRWPGPRQIYRASGLSPMQY

SEQ ID NO: 685186 - protein, 20 aa, Mycobacterium
KRWPNGVAEEAFFEKQLASS

SEQ ID NO: 685187 - protein, 19 aa, Mycobacterium
KRWRDLRKITIAQVQGNAI

SEQ ID NO: 685188 - protein, 27 aa, Mycobacterium
KRWSVPESWVGLKPVQRPRLPICLGAF

SEQ ID NO: 685189 - protein, 19 aa, Mycobacterium
KRWTPQWTDEQRAAGYAGW

SEQ ID NO: 685190 - protein, 24 aa, Mycobacterium
KRWWERPYIAAGIFLYDRLGGAKS

SEQ ID NO: 685191 - protein, 21 aa, Mycobacterium
KRYAEALTFAYRRLGRVDTGV

SEQ ID NO: 685192 - protein, 21 aa, Mycobacterium
KRYDHGAPRWQEIDGNHYAAF

SEQ ID NO: 685193 - protein, 18 aa, Mycobacterium
KRYENWELADPAGQSVEA

SEQ ID NO: 685194 - protein, 31 aa, Mycobacterium
KRYGAECATLCWPRQADPAANLERLGKQLDC

SEQ ID NO: 685195 - protein, 19 aa, Mycobacterium
KRYGEVLLVEIGESGPQAT

SEQ ID NO: 685196 - protein, 21 aa, Mycobacterium
KRYGSLHRLECNFDEYDGDIA

SEQ ID NO: 685197 - protein, 31 aa, Mycobacterium
KRYLDALMPMVWTACERADFVVEVQAMRRRV

SEQ ID NO: 685198 - protein, 20 aa, Mycobacterium
KRYLDVDGAWRDHLLVAMTV

SEQ ID NO: 685199 - protein, 20 aa, Mycobacterium
KRYLGDLARLGVPVVPTAFF

SEQ ID NO: 685200 - protein, 21 aa, Mycobacterium
KRYPEVFDIDIAAPMIIAGLP

SEQ ID NO: 685201 - protein, 18 aa, Mycobacterium
KRYPGARGVRRLQAVLPL

SEQ ID NO: 685202 - protein, 21 aa, Mycobacterium
KRYPRFGPWGRLDKWRRQYDI

SEQ ID NO: 685203 - protein, 25 aa, Mycobacterium
KRYPTRDALILAALERWMDENRYAG

SEQ ID NO: 685204 - protein, 22 aa, Mycobacterium
KRYQDAITMHECRSAKQLAAVI

SEQ ID NO: 685205 - protein, 21 aa, Mycobacterium
KRYQTGWKRSLTAMRSQRYFR

SEQ ID NO: 685206 - protein, 17 aa, Mycobacterium
KRYRADHLIEAYEAKHG

SEQ ID NO: 685207 - protein, 27 aa, Mycobacterium
KRYRRGVLGLRAEPHWAGDSFDHKGIP

SEQ ID NO: 685208 - protein, 24 aa, Mycobacterium
KRYTGRGMAFLDLIQEGNLGLIRA

SEQ ID NO: 685209 - protein, 25 aa, Mycobacterium
KRYYRSEVHGLELLPPGGVLVVSNH

SEQ ID NO: 685210 - protein, 22 aa, Mycobacterium
KSAAEMRALWDGQVPGACDSTL

SEQ ID NO: 685211 - protein, 18 aa, Mycobacterium
KSAEEMRALWDSQVPGAC

SEQ ID NO: 685212 - protein, 26 aa, Mycobacterium
KSAFPQARLLAVAECGTHAIFAATIG

SEQ ID NO: 685213 - protein, 26 aa, Mycobacterium
KSAGDGLRANNDWLVPLIRSIMDLAV

SEQ ID NO: 685214 - protein, 18 aa, Mycobacterium
KSAGLWREVASELADSLR

SEQ ID NO: 685215 - protein, 28 aa, Mycobacterium
KSAGSVCTVRALALCRRLGDDLFMGLIS

SEQ ID NO: 685216 - protein, 18 aa, Mycobacterium
KSAHPLVVIPGGPGAASI

SEQ ID NO: 685217 - protein, 18 aa, Mycobacterium
KSAILYLARHLPAPGRDG

SEQ ID NO: 685218 - protein, 19 aa, Mycobacterium
KSAKLARRDFEVQAGLADV

SEQ ID NO: 685219 - protein, 17 aa, Mycobacterium
KSAKWKVGEEAALHQLG

SEQ ID NO: 685220 - protein, 19 aa, Mycobacterium
KSAKWKVGEEAVFRELGRL

SEQ ID NO: 685221 - protein, 17 aa, Mycobacterium
KSAKWKVGEETAFQHLG

SEQ ID NO: 685222 - protein, 19 aa, Mycobacterium
KSALALEFAERVGGEIVNA

SEQ ID NO: 685223 - protein, 24 aa, Mycobacterium
KSALLRLAGRYGIGEQQIDDLLRD

SEQ ID NO: 685224 - protein, 23 aa, Mycobacterium
KSALLRLAGRYGVGEHEVDELLR

SEQ ID NO: 685225 - protein, 24 aa, Mycobacterium
KSALRYVDALVWTPSAIDDAVVDG

SEQ ID NO: 685226 - protein, 17 aa, Mycobacterium
KSALSAAIGETAAAGAV

SEQ ID NO: 685227 - protein, 18 aa, Mycobacterium
KSALVRAIQVCAALDQIL

SEQ ID NO: 685228 - protein, 21 aa, Mycobacterium
KSAPFAFSAWAVRLLSRLPQR

SEQ ID NO: 685229 - protein, 26 aa, Mycobacterium
KSAPHVWIAGAWLTAGLVRPTAIPHI

SEQ ID NO: 685230 - protein, 20 aa, Mycobacterium
KSAPMIARIPLGRFAVPHEV

SEQ ID NO: 685231 - protein, 20 aa, Mycobacterium
KSAPSDAGFHVNVAVGYGGR

SEQ ID NO: 685232 - protein, 28 aa, Mycobacterium
KSARYLRFGWAAARLDDLMNVLPARITA

SEQ ID NO: 685233 - protein, 22 aa, Mycobacterium
KSASRLGACTARGAAAKSHTRA

SEQ ID NO: 685234 - protein, 17 aa, Mycobacterium
KSCPMVWTHRSGRKSLL

SEQ ID NO: 685235 - protein, 18 aa, Mycobacterium
KSCVGTDWCRYGQQDSVQ

SEQ ID NO: 685236 - protein, 21 aa, Mycobacterium
KSDEAFRGALEVISRRELLDR

SEQ ID NO: 685237 - protein, 20 aa, Mycobacterium
KSDEFHFTRKWMQRVAAKSS

SEQ ID NO: 685238 - protein, 20 aa, Mycobacterium
KSDFAQFVIRRAILAMERVE

SEQ ID NO: 685239 - protein, 25 aa, Mycobacterium
KSDGYRAVHVIVRYHGRLIEVQLRT

SEQ ID NO: 685240 - protein, 21 aa, Mycobacterium
KSDLLPYVDFDIDACASAARS

SEQ ID NO: 685241 - protein, 25 aa, Mycobacterium
KSDLRGLFRWWGLYTQREQGYDGSW

SEQ ID NO: 685242 - protein, 19 aa, Mycobacterium
KSDPRKGRDPVNQPMIHHW

SEQ ID NO: 685243 - protein, 18 aa, Mycobacterium
KSDTVAMDYVRPLKEEVK

SEQ ID NO: 685244 - protein, 18 aa, Mycobacterium
KSDVRRKVRDSGEREMRQ

SEQ ID NO: 685245 - protein, 21 aa, Mycobacterium
KSEALIAGLRRLLDGSPGVMF

SEQ ID NO: 685246 - protein, 18 aa, Mycobacterium
KSEEVLTGYATRTITEPV

SEQ ID NO: 685247 - protein, 22 aa, Mycobacterium
KSEGHKWAMLTAYDYSTAAVFD

SEQ ID NO: 685248 - protein, 18 aa, Mycobacterium
KSEGQPFLYPDNSLSLVE

SEQ ID NO: 685249 - protein, 17 aa, Mycobacterium
KSEIKEMQAESKGDEPK

SEQ ID NO: 685250 - protein, 19 aa, Mycobacterium
KSEIVMRLLSAEARIKLAD

SEQ ID NO: 685251 - protein, 19 aa, Mycobacterium
KSEIVMRLLSAEARVKLAD

SEQ ID NO: 685252 - protein, 32 aa, Mycobacterium
KSELPRHIAVLCDGNRRWARDAGYDDVSYGYR

SEQ ID NO: 685253 - protein, 17 aa, Mycobacterium
KSERELLAKALADVQAM

SEQ ID NO: 685254 - protein, 28 aa, Mycobacterium
KSEYFTEPGFKGWLKKVFFGGSGQVPID

SEQ ID NO: 685255 - protein, 17 aa, Mycobacterium
KSFARIHWQNLANFGVL

SEQ ID NO: 685256 - protein, 18 aa, Mycobacterium
KSFAVTMWPVVRKAIDFV

SEQ ID NO: 685257 - protein, 18 aa, Mycobacterium
KSFGLHPLLAFLDRPEIA

SEQ ID NO: 685258 - protein, 27 aa, Mycobacterium
KSFGVFRTRYDAVWCSGMRAKLGLPAV

SEQ ID NO: 685259 - protein, 26 aa, Mycobacterium
KSFHLPKILGGEVIWCQGFSEPDAGS

SEQ ID NO: 685260 - protein, 19 aa, Mycobacterium
KSFRDFRLTEMASDYVAVA

SEQ ID NO: 685261 - protein, 20 aa, Mycobacterium
KSGAALLVYPGGDYEVFRPS

SEQ ID NO: 685262 - protein, 17 aa, Mycobacterium
KSGAAYLPIDPALPAAR

SEQ ID NO: 685263 - protein, 20 aa, Mycobacterium
KSGAVPAALGAAMGDIREGK

SEQ ID NO: 685264 - protein, 21 aa, Mycobacterium
KSGEAVVEMLRRGITARDILT

SEQ ID NO: 685265 - protein, 17 aa, Mycobacterium
KSGEFFDKYTDQVWEPK

SEQ ID NO: 685266 - protein, 17 aa, Mycobacterium
KSGEGIGSILLGLYRDD

SEQ ID NO: 685267 - protein, 23 aa, Mycobacterium
KSGEPRDTPLLFLQEGRRIVLVA

SEQ ID NO: 685268 - protein, 23 aa, Mycobacterium
KSGEPRYVVLEVVGHSSPDTYVV

SEQ ID NO: 685269 - protein, 19 aa, Mycobacterium
KSGFGRTPLREALQRLSRD

SEQ ID NO: 685270 - protein, 17 aa, Mycobacterium
KSGFSFLQIPIGPSSFL

SEQ ID NO: 685271 - protein, 24 aa, Mycobacterium
KSGGSRLSLQLTVQVRIPLIGGKL

SEQ ID NO: 685272 - protein, 25 aa, Mycobacterium
KSGIRLRLFHGRGGTVGRGGGPSYQ

SEQ ID NO: 685273 - protein, 22 aa, Mycobacterium
KSGKLRKIALMRVEHNGEYALV

SEQ ID NO: 685274 - protein, 20 aa, Mycobacterium
KSGKPHGWIHNELRRRCGGP

SEQ ID NO: 685275 - protein, 19 aa, Mycobacterium
KSGLVVADVLPWMITAGDF

SEQ ID NO: 685276 - protein, 24 aa, Mycobacterium
KSGPLELLDMIGLDVQLHATEAAY

SEQ ID NO: 685277 - protein, 25 aa, Mycobacterium
KSGRPRLAPLVYLRIDGKMFIVGSF

SEQ ID NO: 685278 - protein, 18 aa, Mycobacterium
KSGRRKARVRGWRPFGMI

SEQ ID NO: 685279 - protein, 23 aa, Mycobacterium
KSGRVFRTPLWVFRRDNGFVIAL

SEQ ID NO: 685280 - protein, 24 aa, Mycobacterium
KSGRYRRVLTMAWEKQSESNAMWA

SEQ ID NO: 685281 - protein, 19 aa, Mycobacterium
KSGVDIVVACPGRLEDLMK

SEQ ID NO: 685282 - protein, 23 aa, Mycobacterium
KSGWNIEGSPDWAANLPEDLLHA

SEQ ID NO: 685283 - protein, 25 aa, Mycobacterium
KSGWNIEGSPDWAVNLPEELRHAQP

SEQ ID NO: 685284 - protein, 19 aa, Mycobacterium
KSHFPNVVTTHSWEERWDT

SEQ ID NO: 685285 - protein, 17 aa, Mycobacterium
KSHIGRIFVKLDLRDRA

SEQ ID NO: 685286 - protein, 32 aa, Mycobacterium
KSHLPRHIAVLCDGNRRWARDAGYTDVSYGYR

SEQ ID NO: 685287 - protein, 27 aa, Mycobacterium
KSIAWHWELMFTRPLTGYDIAAQQRLL

SEQ ID NO: 685288 - protein, 23 aa, Mycobacterium
KSIKTELLLDVIADKFDINVDQQ

SEQ ID NO: 685289 - protein, 19 aa, Mycobacterium
KSILDRGWLHPGSIVVADN

SEQ ID NO: 685290 - protein, 22 aa, Mycobacterium
KSIPFYRDYYRDEADPPAAFGL

SEQ ID NO: 685291 - protein, 32 aa, Mycobacterium
KSIPGMLMAAARLDLASVFLYNGSIMPGKAKL

SEQ ID NO: 685292 - protein, 19 aa, Mycobacterium
KSKGWSAAMNQLREIAAES

SEQ ID NO: 685293 - protein, 18 aa, Mycobacterium
KSKIPVIADIHFQPKYIF

SEQ ID NO: 685294 - protein, 25 aa, Mycobacterium
KSKKTGDVLLRYNFPAAGLTDDALR

SEQ ID NO: 685295 - protein, 17 aa, Mycobacterium
KSLAFGHGIHFCLGAHL

SEQ ID NO: 685296 - protein, 24 aa, Mycobacterium
KSLAMFRAALRADPSLNPSDVAVT

SEQ ID NO: 685297 - protein, 23 aa, Mycobacterium
KSLAPALRLGWMVLPPEQMDAAV

SEQ ID NO: 685298 - protein, 21 aa, Mycobacterium
KSLDADVRWVACTESSRSIPL

SEQ ID NO: 685299 - protein, 21 aa, Mycobacterium
KSLDCLAPLGTLVAFGAASGP

SEQ ID NO: 685300 - protein, 17 aa, Mycobacterium
KSLDCVDELAAVADIPR

SEQ ID NO: 685301 - protein, 23 aa, Mycobacterium
KSLDDLRLFAGLVAAARAYADGS

SEQ ID NO: 685302 - protein, 17 aa, Mycobacterium
KSLGFKSFSDFLRSRSD

SEQ ID NO: 685303 - protein, 28 aa, Mycobacterium
KSLLDLACGDGFYTRQFRTLVKAGPVSG

SEQ ID NO: 685304 - protein, 18 aa, Mycobacterium
KSLLPGPLLPTVAAGAVA

SEQ ID NO: 685305 - protein, 23 aa, Mycobacterium
KSLLSTAVARWARDEGLGVDVCS

SEQ ID NO: 685306 - protein, 18 aa, Mycobacterium
KSLMKWTDDEWHHVLDLN

SEQ ID NO: 685307 - protein, 18 aa, Mycobacterium
KSLMKWTDDEWHRVLDLN

SEQ ID NO: 685308 - protein, 20 aa, Mycobacterium
KSLPADVVIFDLEDAVGPDA

SEQ ID NO: 685309 - protein, 23 aa, Mycobacterium
KSLPPDRWWRREYLLTSELYIAS

SEQ ID NO: 685310 - protein, 17 aa, Mycobacterium
KSLPPKWFYDAVGSDLF

SEQ ID NO: 685311 - protein, 17 aa, Mycobacterium
KSLPPKWFYDAVGSELF

SEQ ID NO: 685312 - protein, 17 aa, Mycobacterium
KSLPPKWFYDEAGSDLF

SEQ ID NO: 685313 - protein, 21 aa, Mycobacterium
KSLPVPLVVALIGAHASDTAP

SEQ ID NO: 685314 - protein, 18 aa, Mycobacterium
KSLQPGWQKQRQRNFHSW

SEQ ID NO: 685315 - protein, 17 aa, Mycobacterium
KSLRVCTLLRKPEAVRA

SEQ ID NO: 685316 - protein, 20 aa, Mycobacterium
KSLTGGWDVSHDAVARAGAH

SEQ ID NO: 685317 - protein, 19 aa, Mycobacterium
KSLVVPVRYAGVHVYGDIT

SEQ ID NO: 685318 - protein, 18 aa, Mycobacterium
KSLYEKSGSVLIEEHKHS

SEQ ID NO: 685319 - protein, 20 aa, Mycobacterium
KSLYLRNEVFAEWINKVDAL

SEQ ID NO: 685320 - protein, 17 aa, Mycobacterium
KSLYTGLTRGREMNRVF

SEQ ID NO: 685321 - protein, 24 aa, Mycobacterium
KSMAGPLLQMMSQMGGMAFGSQLG

SEQ ID NO: 685322 - protein, 20 aa, Mycobacterium
KSMAGPLLSMMSQMGGMAFG

SEQ ID NO: 685323 - protein, 24 aa, Mycobacterium
KSMLVGGLCRLLVRKGLSVAPFKA

SEQ ID NO: 685324 - protein, 23 aa, Mycobacterium
KSMPYKSQFGPFAPEVYRMPASY

SEQ ID NO: 685325 - protein, 21 aa, Mycobacterium
KSMRIFKSEIKEMQAESKGDE

SEQ ID NO: 685326 - protein, 25 aa, Mycobacterium
KSMRIFKSEIKEMQSDSNAAKSDQP

SEQ ID NO: 685327 - protein, 21 aa, Mycobacterium
KSMSPVEWVRFAANTVGERVI

SEQ ID NO: 685328 - protein, 19 aa, Mycobacterium
KSNAPLTNRDWWPDQVDPS

SEQ ID NO: 685329 - protein, 32 aa, Mycobacterium
KSNKARALAPVRFFNPIGMRFAKKATRDDIND

SEQ ID NO: 685330 - protein, 20 aa, Mycobacterium
KSNLTVSVPVGFERDADTVN

SEQ ID NO: 685331 - protein, 18 aa, Mycobacterium
KSNVHRLRLVGGLPANLG

SEQ ID NO: 685332 - protein, 20 aa, Mycobacterium
KSNYAERRAMSWRSGGGSPH

SEQ ID NO: 685333 - protein, 20 aa, Mycobacterium
KSPAEAAAGLALHDADPAGI

SEQ ID NO: 685334 - protein, 19 aa, Mycobacterium
KSPAPRMAPTPAPTRPSPT

SEQ ID NO: 685335 - protein, 28 aa, Mycobacterium
KSPFGERPVRFWFRRQAQEVAVHRWDIG

SEQ ID NO: 685336 - protein, 27 aa, Mycobacterium
KSPHLEAFKAKGYEVLLLTDPVDEVWV

SEQ ID NO: 685337 - protein, 18 aa, Mycobacterium
KSPLPGWDVKAVVAHLIG

SEQ ID NO: 685338 - protein, 17 aa, Mycobacterium
KSPQMSEVLPLLYLHGL

SEQ ID NO: 685339 - protein, 17 aa, Mycobacterium
KSPRLVKPEILASNRFR

SEQ ID NO: 685340 - protein, 25 aa, Mycobacterium
KSPRPWAQERYRQMVRWNSPDRGGH

SEQ ID NO: 685341 - protein, 29 aa, Mycobacterium
KSPVVASGWRAPLRFLFIDGGHSEAAANE

SEQ ID NO: 685342 - protein, 24 aa, Mycobacterium
KSQGFPLDVIRRVIDSGSGSEDSV

SEQ ID NO: 685343 - protein, 18 aa, Mycobacterium
KSQILAEHCRTVGTDFDA

SEQ ID NO: 685344 - protein, 21 aa, Mycobacterium
KSQMAAALMRQIAGDSVEVHS

SEQ ID NO: 685345 - protein, 18 aa, Mycobacterium
KSQPSSVQHKGDRDLVTD

SEQ ID NO: 685346 - protein, 17 aa, Mycobacterium
KSRAAMCRTFAELDYTP

SEQ ID NO: 685347 - protein, 18 aa, Mycobacterium
KSRCQAMIDDLRLFGRDW

SEQ ID NO: 685348 - protein, 25 aa, Mycobacterium
KSRDGLRLPWIPGVRGDTRTIAALG

SEQ ID NO: 685349 - protein, 22 aa, Mycobacterium
KSRECIYLDLMAGQPKNVERYT

SEQ ID NO: 685350 - protein, 20 aa, Mycobacterium
KSREIYEAPGAMVLITAHAE

SEQ ID NO: 685351 - protein, 20 aa, Mycobacterium
KSREVLLCVSADSRAGVDEL

SEQ ID NO: 685352 - protein, 18 aa, Mycobacterium
KSRGNGIDPLDWVEKFGA

SEQ ID NO: 685353 - protein, 18 aa, Mycobacterium
KSRGNGIDPLDWVETFGA

SEQ ID NO: 685354 - protein, 19 aa, Mycobacterium
KSRIQFGRIIGSFQAVKHR

SEQ ID NO: 685355 - protein, 17 aa, Mycobacterium
KSRLAAVDRERRRQGLA

SEQ ID NO: 685356 - protein, 18 aa, Mycobacterium
KSRMLLQVHDELLFEVAA

SEQ ID NO: 685357 - protein, 25 aa, Mycobacterium
KSRNRKGSTWVLSLAEGRLVAADHL

SEQ ID NO: 685358 - protein, 21 aa, Mycobacterium
KSRPGEGIVTFAHTGRNQRGD

SEQ ID NO: 685359 - protein, 23 aa, Mycobacterium
KSRPGEGIVTFSHVGRNQHGDIV

SEQ ID NO: 685360 - protein, 26 aa, Mycobacterium
KSRRTVPLPPWLAERMADYLATDHPR

SEQ ID NO: 685361 - protein, 24 aa, Mycobacterium
KSRSARITIAVLMLGYVPVRTLRF

SEQ ID NO: 685362 - protein, 27 aa, Mycobacterium
KSRSGHAARDWKAFEPLIGHARSGASR

SEQ ID NO: 685363 - protein, 23 aa, Mycobacterium
KSRTRRQWTDFFIATDIAGAPAF

SEQ ID NO: 685364 - protein, 22 aa, Mycobacterium
KSSAADMHTWLLAHLGAVRGPE

SEQ ID NO: 685365 - protein, 23 aa, Mycobacterium
KSSAVFYRYFTDKEDLLAALAQS

SEQ ID NO: 685366 - protein, 26 aa, Mycobacterium
KSSGVGRFGGRWAIDEFTTEQWISVQ

SEQ ID NO: 685367 - protein, 29 aa, Mycobacterium
KSSHGVPRISIPIPNNWANVPDPNVPNAY

SEQ ID NO: 685368 - protein, 19 aa, Mycobacterium
KSSLQELTASLALGAPSYH

SEQ ID NO: 685369 - protein, 20 aa, Mycobacterium
KSSLRTAVRAFREAAHAGDK

SEQ ID NO: 685370 - protein, 32 aa, Mycobacterium
KSSRTAVGKPGWPGFVSVPLAAYRRHFETSVF

SEQ ID NO: 685371 - protein, 17 aa, Mycobacterium
KSSSPGLENIVHGSFTI

SEQ ID NO: 685372 - protein, 18 aa, Mycobacterium
KSTALRMLAGLDKPTAGE

SEQ ID NO: 685373 - protein, 21 aa, Mycobacterium
KSTFMRLLLAEELPTKGDVQV

SEQ ID NO: 685374 - protein, 21 aa, Mycobacterium
KSTGGGNLWLDPEMTSPYAWY

SEQ ID NO: 685375 - protein, 22 aa, Mycobacterium
KSTGTLIKWMSRFQTFLFKTTN

SEQ ID NO: 685376 - protein, 19 aa, Mycobacterium
KSTHFDWVLAPYDVVASKA

SEQ ID NO: 685377 - protein, 18 aa, Mycobacterium
KSTIGRRLAKVLDVSMLD

SEQ ID NO: 685378 - protein, 17 aa, Mycobacterium
KSTILRALAGLLKPMGG

SEQ ID NO: 685379 - protein, 27 aa, Mycobacterium
KSTLLGFCAAVTFPTTGSVWVLGAQMG

SEQ ID NO: 685380 - protein, 23 aa, Mycobacterium
KSTLLLEVAHRWAESGRRALYIS

SEQ ID NO: 685381 - protein, 24 aa, Mycobacterium
KSTLLLEVAHRWAQSGQRALYISG

SEQ ID NO: 685382 - protein, 23 aa, Mycobacterium
KSTLLLEVAHRWAQSGQRVLYIS

SEQ ID NO: 685383 - protein, 23 aa, Mycobacterium
KSTLLRLCNRLEVPTSGTVLFHG

SEQ ID NO: 685384 - protein, 23 aa, Mycobacterium
KSTMLRLCNRLEVPTSGRVFFWG

SEQ ID NO: 685385 - protein, 19 aa, Mycobacterium
KSTPAMTGKFEWLDNKVVQ

SEQ ID NO: 685386 - protein, 22 aa, Mycobacterium
KSTRRRCTPRSSSCPTPASSTG

SEQ ID NO: 685387 - protein, 17 aa, Mycobacterium
KSTRRWHALMWDHADLC

SEQ ID NO: 685388 - protein, 27 aa, Mycobacterium
KSTRYPGGVALRFARVLRYRDDKSPAE

SEQ ID NO: 685389 - protein, 20 aa, Mycobacterium
KSTTIRILLGLAKADGGSAR

SEQ ID NO: 685390 - protein, 19 aa, Mycobacterium
KSTTIRILLGLVKADSGSV

SEQ ID NO: 685391 - protein, 24 aa, Mycobacterium
KSTTLRCLYRALTPASGDVAVNGV

SEQ ID NO: 685392 - protein, 26 aa, Mycobacterium
KSTTLRMIVGLARPTSGTATIGGKQY

SEQ ID NO: 685393 - protein, 21 aa, Mycobacterium
KSTVADLNWLRDRGLAEEITA

SEQ ID NO: 685394 - protein, 26 aa, Mycobacterium
KSTVGRIWKALGLKPHLVDTFKLSDD

SEQ ID NO: 685395 - protein, 23 aa, Mycobacterium
KSTVKAREAGVVVWNADDRLKTG

SEQ ID NO: 685396 - protein, 29 aa, Mycobacterium
KSVAKTHRPEVLGGIGGFAGLFALKGGYR

SEQ ID NO: 685397 - protein, 25 aa, Mycobacterium
KSVAYRLGRCVARLETALATPSIFG

SEQ ID NO: 685398 - protein, 17 aa, Mycobacterium
KSVCFQLPALLAPEARA

SEQ ID NO: 685399 - protein, 19 aa, Mycobacterium
KSVDAVIVPGGFSYGDYLR

SEQ ID NO: 685400 - protein, 19 aa, Mycobacterium
KSVDAVVVPGGFSYGDYLR

SEQ ID NO: 685401 - protein, 24 aa, Mycobacterium
KSVEEALDILRWAPQAASEPVAKV

SEQ ID NO: 685402 - protein, 17 aa, Mycobacterium
KSVHQLRDRLGRIWAAA

SEQ ID NO: 685403 - protein, 17 aa, Mycobacterium
KSVKALLDDAGVTVTQF

SEQ ID NO: 685404 - protein, 18 aa, Mycobacterium
KSVLDRADALVVVSSASI

SEQ ID NO: 685405 - protein, 25 aa, Mycobacterium
KSVPRLGSSTLRLARSALLEQQMTL

SEQ ID NO: 685406 - protein, 25 aa, Mycobacterium
KSVRCEVWEGFIFINLDPAAAPLSE

SEQ ID NO: 685407 - protein, 23 aa, Mycobacterium
KSVRGDEFFFSLPVVGETCDGIL

SEQ ID NO: 685408 - protein, 27 aa, Mycobacterium
KSVVQRGLWFEEFEIGTTYLHRPGRTV

SEQ ID NO: 685409 - protein, 18 aa, Mycobacterium
KSVYLCCRAALRHMVPAR

SEQ ID NO: 685410 - protein, 21 aa, Mycobacterium
KSWEEFQEYWARVCRDELEIN

SEQ ID NO: 685411 - protein, 19 aa, Mycobacterium
KSWGQARHSYFLRPSDIAR

SEQ ID NO: 685412 - protein, 20 aa, Mycobacterium
KSWMDIKRKPSEYVKDHIKF

SEQ ID NO: 685413 - protein, 25 aa, Mycobacterium
KSYELFARKVIPHFTGQLTAAQASH

SEQ ID NO: 685414 - protein, 28 aa, Mycobacterium
KSYKEFWQQWIWEDWAGSYIERLEPFGL

SEQ ID NO: 685415 - protein, 22 aa, Mycobacterium
KSYPAALLVRSRFTELTRWLDR

SEQ ID NO: 685416 - protein, 19 aa, Mycobacterium
KSYQIYRLDAVPNTEKLPY

SEQ ID NO: 685417 - protein, 26 aa, Mycobacterium
KTAADCPKMKFVVGGYAQGAAVVDVL

SEQ ID NO: 685418 - protein, 23 aa, Mycobacterium
KTAADPRFRFFGNVRVGEHVQPG

SEQ ID NO: 685419 - protein, 18 aa, Mycobacterium
KTAAFAIPILSKIDLTSK

SEQ ID NO: 685420 - protein, 19 aa, Mycobacterium
KTAAFAIPILSKIDVASKA

SEQ ID NO: 685421 - protein, 18 aa, Mycobacterium
KTAAFAIPILSKIDVTST

SEQ ID NO: 685422 - protein, 19 aa, Mycobacterium
KTAAFAIPILSKIDVTSTA

SEQ ID NO: 685423 - protein, 23 aa, Mycobacterium
KTAASRDKHGWATVGDIGYLDEE

SEQ ID NO: 685424 - protein, 23 aa, Mycobacterium
KTAASRDKHGWVTVGDIGYLDDE

SEQ ID NO: 685425 - protein, 23 aa, Mycobacterium
KTAASRDKHGWVTVGDVGYLDDQ

SEQ ID NO: 685426 - protein, 22 aa, Mycobacterium
KTAATLCWRSRTIVGGHHAGRI

SEQ ID NO: 685427 - protein, 23 aa, Mycobacterium
KTACLISASGRFGATFSGSDEAQ

SEQ ID NO: 685428 - protein, 23 aa, Mycobacterium
KTADGSFHYCYNAQAVVDEEHQV

SEQ ID NO: 685429 - protein, 29 aa, Mycobacterium
KTAEQALGLPYVWGGGGAAGPSGGGFDCS

SEQ ID NO: 685430 - protein, 24 aa, Mycobacterium
KTAEQRLGVERAIIGDSWQLMSNP

SEQ ID NO: 685431 - protein, 20 aa, Mycobacterium
KTAETFKTFNGVRYAIPGDW

SEQ ID NO: 685432 - protein, 17 aa, Mycobacterium
KTAFALRIAAEALGQRA

SEQ ID NO: 685433 - protein, 19 aa, Mycobacterium
KTAFDGIGEMGGFDDVALQ

SEQ ID NO: 685434 - protein, 19 aa, Mycobacterium
KTAFDGIGEMGGFDDVALT

SEQ ID NO: 685435 - protein, 26 aa, Mycobacterium
KTAHFCSMCGPKFCSMRITADIREFA

SEQ ID NO: 685436 - protein, 27 aa, Mycobacterium
KTAHFCSMCGPKFCSMRITADLKDSIR

SEQ ID NO: 685437 - protein, 26 aa, Mycobacterium
KTAHFCSMCGPKFCSMRITQDVRDFA

SEQ ID NO: 685438 - protein, 26 aa, Mycobacterium
KTAHFCSMCGPKFCSMRITQDVRDYA

SEQ ID NO: 685439 - protein, 20 aa, Mycobacterium
KTAKLHWVELYTGPITWQLR

SEQ ID NO: 685440 - protein, 23 aa, Mycobacterium
KTAKRLALALGRSADDDLAVDKW

SEQ ID NO: 685441 - protein, 22 aa, Mycobacterium
KTALLRLAGRYGVGEDAIDDLL

SEQ ID NO: 685442 - protein, 23 aa, Mycobacterium
KTALLRLAGRYGVGEDDIDELLR

SEQ ID NO: 685443 - protein, 23 aa, Mycobacterium
KTALLRLAGRYGVGEDEVDELLR

SEQ ID NO: 685444 - protein, 23 aa, Mycobacterium
KTALLRLAGRYGVGEDQVDELLR

SEQ ID NO: 685445 - protein, 25 aa, Mycobacterium
KTAMKARRLAGVLKNAAVNMGLDAR

SEQ ID NO: 685446 - protein, 18 aa, Mycobacterium
KTAPRLPDGTPFPTLYYL

SEQ ID NO: 685447 - protein, 19 aa, Mycobacterium
KTARDVWWVDVLLTQLEAK

SEQ ID NO: 685448 - protein, 25 aa, Mycobacterium
KTARKEMMHRLLIVIDEAANVAPMP

SEQ ID NO: 685449 - protein, 24 aa, Mycobacterium
KTARRRGVVINPVLETSEIPETMP

SEQ ID NO: 685450 - protein, 17 aa, Mycobacterium
KTASSRDARGWKTVGDI

SEQ ID NO: 685451 - protein, 24 aa, Mycobacterium
KTASSRHPQGWKTVGDIGYVDEEG

SEQ ID NO: 685452 - protein, 20 aa, Mycobacterium
KTATKWIVEYGSLQALVDNV

SEQ ID NO: 685453 - protein, 19 aa, Mycobacterium
KTCEFGWAPLPSHDDGVLA

SEQ ID NO: 685454 - protein, 21 aa, Mycobacterium
KTCTPRNPLGATMVSSEGACA

SEQ ID NO: 685455 - protein, 19 aa, Mycobacterium
KTDGGWLLNGQKIWSSRAP

SEQ ID NO: 685456 - protein, 26 aa, Mycobacterium
KTDHRPEILLSFGFVPKVESRVGLIN

SEQ ID NO: 685457 - protein, 20 aa, Mycobacterium
KTDLAALVKAAAAQVLPDAK

SEQ ID NO: 685458 - protein, 26 aa, Mycobacterium
KTDLLDEAWWLPSVFIANGGAVAASL

SEQ ID NO: 685459 - protein, 26 aa, Mycobacterium
KTDLLDEAWWLPSVFIPNGGAAAASL

SEQ ID NO: 685460 - protein, 22 aa, Mycobacterium
KTEARVSAKPAPARSDAPDGVG

SEQ ID NO: 685461 - protein, 18 aa, Mycobacterium
KTEFSAPPDVEWSTDADG

SEQ ID NO: 685462 - protein, 19 aa, Mycobacterium
KTELFLAIFEQMASAVEGK

SEQ ID NO: 685463 - protein, 18 aa, Mycobacterium
KTELLFVALFLKLLKPGG

SEQ ID NO: 685464 - protein, 23 aa, Mycobacterium
KTELRIRYGTAIIDESRSHPQGF

SEQ ID NO: 685465 - protein, 23 aa, Mycobacterium
KTELRLRYGARKSFGNRSAPTYS

SEQ ID NO: 685466 - protein, 22 aa, Mycobacterium
KTEPALDILAGWLASRIDGPVR

SEQ ID NO: 685467 - protein, 24 aa, Mycobacterium
KTEPALDILAGWLASRIEGPVRRA

SEQ ID NO: 685468 - protein, 19 aa, Mycobacterium
KTERPRPLSKVSAGVQKAA

SEQ ID NO: 685469 - protein, 17 aa, Mycobacterium
KTFCIPHGGGGPGVGPV

SEQ ID NO: 685470 - protein, 19 aa, Mycobacterium
KTFFARWLGDRAMKKGFAV

SEQ ID NO: 685471 - protein, 19 aa, Mycobacterium
KTFGENFFYILYFQQPGVA

SEQ ID NO: 685472 - protein, 19 aa, Mycobacterium
KTFGFAFGREDVWEPEEIL

SEQ ID NO: 685473 - protein, 19 aa, Mycobacterium
KTFPDRFIPSGAIADPNDV

SEQ ID NO: 685474 - protein, 18 aa, Mycobacterium
KTFPMPNPFLVMATQNPI

SEQ ID NO: 685475 - protein, 20 aa, Mycobacterium
KTFRARIRMAAKRRELGLKT

SEQ ID NO: 685476 - protein, 17 aa, Mycobacterium
KTFSWLPDDGVQMLHTI

SEQ ID NO: 685477 - protein, 23 aa, Mycobacterium
KTFTDPRLCAAIVDRLTFAGQII

SEQ ID NO: 685478 - protein, 18 aa, Mycobacterium
KTGAALVWVPRRAGERGA

SEQ ID NO: 685479 - protein, 24 aa, Mycobacterium
KTGEPRVSPLLYLREGDRVVLVAS

SEQ ID NO: 685480 - protein, 24 aa, Mycobacterium
KTGEPRVSPLLYLREGNRVVLVAS

SEQ ID NO: 685481 - protein, 21 aa, Mycobacterium
KTGIDTCLWLLGQGIAPERLT

SEQ ID NO: 685482 - protein, 21 aa, Mycobacterium
KTGIDTCLWLLGQGVDPDRLT

SEQ ID NO: 685483 - protein, 25 aa, Mycobacterium
KTGKAEKCTLCYPRIEVGLPTVCSE

SEQ ID NO: 685484 - protein, 20 aa, Mycobacterium
KTGLARLALHTGVPVIPVAM

SEQ ID NO: 685485 - protein, 23 aa, Mycobacterium
KTGLKVGVAGRVIFARNSGKLCF

SEQ ID NO: 685486 - protein, 23 aa, Mycobacterium
KTGLPRDRINALLNQYFELTELH

SEQ ID NO: 685487 - protein, 20 aa, Mycobacterium
KTGMDVCLWLLRNGVTPEKL

SEQ ID NO: 685488 - protein, 19 aa, Mycobacterium
KTGNLKPALFVIPTDTPGL

SEQ ID NO: 685489 - protein, 17 aa, Mycobacterium
KTGNLKPALFVVPTDTP

SEQ ID NO: 685490 - protein, 20 aa, Mycobacterium
KTGQGYAEFAVSSFGTDAVV

SEQ ID NO: 685491 - protein, 17 aa, Mycobacterium
KTGQWYLHHFYKHQPDL

SEQ ID NO: 685492 - protein, 22 aa, Mycobacterium
KTGRPYYNAIVWQDTRTDRIAS

SEQ ID NO: 685493 - protein, 17 aa, Mycobacterium
KTGTPLLGVCLGHQAIG

SEQ ID NO: 685494 - protein, 24 aa, Mycobacterium
KTGWNIEGEPEWAANLPADLTSAP

SEQ ID NO: 685495 - protein, 21 aa, Mycobacterium
KTHFQIYWLGGRDDVAQRIQR

SEQ ID NO: 685496 - protein, 25 aa, Mycobacterium
KTHRAVVVDEAWRTGSLAAEVTTRV

SEQ ID NO: 685497 - protein, 22 aa, Mycobacterium
KTHRLCRSRQLAGTLCPNPLLP

SEQ ID NO: 685498 - protein, 18 aa, Mycobacterium
KTIAEVVHGFGWTGPLGV

SEQ ID NO: 685499 - protein, 25 aa, Mycobacterium
KTIAEVVNAFGWTGPLGVTYPGVVT

SEQ ID NO: 685500 - protein, 19 aa, Mycobacterium
KTIAEWHAKVADKCGDIAT

SEQ ID NO: 685501 - protein, 17 aa, Mycobacterium
KTIEVSRGFVYAASTMG

SEQ ID NO: 685502 - protein, 19 aa, Mycobacterium
KTIKGCLFGSSNPQYDIVR

SEQ ID NO: 685503 - protein, 23 aa, Mycobacterium
KTILELAKAQGFATGDVTTSEIQ

SEQ ID NO: 685504 - protein, 17 aa, Mycobacterium
KTIPMADNPPGWDQNMA

SEQ ID NO: 685505 - protein, 19 aa, Mycobacterium
KTIPMSMGMTSGNHQTPNG

SEQ ID NO: 685506 - protein, 20 aa, Mycobacterium
KTIPTLRLLRQMLANRPKFD

SEQ ID NO: 685507 - protein, 19 aa, Mycobacterium
KTITGTAVGDWLDEHGHPR

SEQ ID NO: 685508 - protein, 19 aa, Mycobacterium
KTKRPAFNPTMRLAEDPVF

SEQ ID NO: 685509 - protein, 19 aa, Mycobacterium
KTLAAFLWAIDTLVQEKEA

SEQ ID NO: 685510 - protein, 26 aa, Mycobacterium
KTLARLLWGLAYQRLPGTLVLIDGRH

SEQ ID NO: 685511 - protein, 25 aa, Mycobacterium
KTLARPQLSIPRGAYVTVGFDGARF

SEQ ID NO: 685512 - protein, 26 aa, Mycobacterium
KTLATNWRSDAALVERLQVVLLGAQL

SEQ ID NO: 685513 - protein, 18 aa, Mycobacterium
KTLAVAVYNHYKRIQAGD

SEQ ID NO: 685514 - protein, 26 aa, Mycobacterium
KTLEIDRDCFSRIAPGLPSGVIRIAE

SEQ ID NO: 685515 - protein, 23 aa, Mycobacterium
KTLELLERVGMLPSHYDRYIHEF

SEQ ID NO: 685516 - protein, 19 aa, Mycobacterium
KTLGFSIPVVARIADGTRV

SEQ ID NO: 685517 - protein, 20 aa, Mycobacterium
KTLIPGLIDAHWHAMFATIP

SEQ ID NO: 685518 - protein, 22 aa, Mycobacterium
KTLIQHLMRWVISSGQFDEHVD

SEQ ID NO: 685519 - protein, 19 aa, Mycobacterium
KTLLPGLIDAHWHAMFTTI

SEQ ID NO: 685520 - protein, 24 aa, Mycobacterium
KTLLRLALDAGPAMLYRLHLDLAS

SEQ ID NO: 685521 - protein, 25 aa, Mycobacterium
KTLPGLRLLQKYAVRAGGGVNHRLG

SEQ ID NO: 685522 - protein, 26 aa, Mycobacterium
KTLPGLRLLQKYAVRVGGGVNHRMGL

SEQ ID NO: 685523 - protein, 22 aa, Mycobacterium
KTLPGLRVLQKYAVRVGGGVNH

SEQ ID NO: 685524 - protein, 25 aa, Mycobacterium
KTLRADEALPLLAISVGASLVRTDE

SEQ ID NO: 685525 - protein, 17 aa, Mycobacterium
KTLRLVAEHAHIWHSFT

SEQ ID NO: 685526 - protein, 17 aa, Mycobacterium
KTLRWTVVTDAGETVTA

SEQ ID NO: 685527 - protein, 17 aa, Mycobacterium
KTLSIALDGEMGEGPVQ

SEQ ID NO: 685528 - protein, 26 aa, Mycobacterium
KTLSLCRYLRRWYPKAEVIRSNVPYR

SEQ ID NO: 685529 - protein, 21 aa, Mycobacterium
KTLTCVLPAYLNALAGKGTHV

SEQ ID NO: 685530 - protein, 20 aa, Mycobacterium
KTLTEDASWAQGLTILDNAI

SEQ ID NO: 685531 - protein, 18 aa, Mycobacterium
KTLWLHRVNVESGEFVEG

SEQ ID NO: 685532 - protein, 23 aa, Mycobacterium
KTMGIPILYPWANRLGANTYTAE

SEQ ID NO: 685533 - protein, 23 aa, Mycobacterium
KTMGIPILYPWANRLGANTYTAQ

SEQ ID NO: 685534 - protein, 23 aa, Mycobacterium
KTMGIPILYPWANRLGENTYHAE

SEQ ID NO: 685535 - protein, 22 aa, Mycobacterium
KTMGLPILYPWANRLGANSYTA

SEQ ID NO: 685536 - protein, 25 aa, Mycobacterium
KTMLEGFRIAREIGAAAAMAPWCGG

SEQ ID NO: 685537 - protein, 25 aa, Mycobacterium
KTMPPAMAQRTLWAPYWQLLMNALD

SEQ ID NO: 685538 - protein, 25 aa, Mycobacterium
KTMTLKSHRWISGTFGPDLSFGSII

SEQ ID NO: 685539 - protein, 20 aa, Mycobacterium
KTNLLEALWYSSTLGSHRVG

SEQ ID NO: 685540 - protein, 34 aa, Mycobacterium
KTNVKMPSQRGWRHWLYVMTRINLGLSPDEIYEL

SEQ ID NO: 685541 - protein, 17 aa, Mycobacterium
KTPAIRFLLIELPDNRW

SEQ ID NO: 685542 - protein, 21 aa, Mycobacterium
KTPECLAEGQVLLRFQAAGVC

SEQ ID NO: 685543 - protein, 22 aa, Mycobacterium
KTPGHPEFRHTAGVEITTGPLG

SEQ ID NO: 685544 - protein, 22 aa, Mycobacterium
KTPHRCSNHFLIGGYTLSRGSS

SEQ ID NO: 685545 - protein, 22 aa, Mycobacterium
KTPKARTGFYGYGFNASVDSSG

SEQ ID NO: 685546 - protein, 22 aa, Mycobacterium
KTPKDHFDFFPLTVDVEERMYA

SEQ ID NO: 685547 - protein, 22 aa, Mycobacterium
KTPKKDCHRITLGSGRNKVTAT

SEQ ID NO: 685548 - protein, 18 aa, Mycobacterium
KTPLLAQVSRIGHRIGAP

SEQ ID NO: 685549 - protein, 18 aa, Mycobacterium
KTPPKGAGLFVADCLARD

SEQ ID NO: 685550 - protein, 18 aa, Mycobacterium
KTPQLAVVDIRMPPTNTT

SEQ ID NO: 685551 - protein, 18 aa, Mycobacterium
KTPQRGGPRVQLPATPWH

SEQ ID NO: 685552 - protein, 25 aa, Mycobacterium
KTQDGRIGGWARFARFHLGRNGAVH

SEQ ID NO: 685553 - protein, 18 aa, Mycobacterium
KTQGKYSSTVDKVQEAAR

SEQ ID NO: 685554 - protein, 18 aa, Mycobacterium
KTQHGLACELWATGDTSA

SEQ ID NO: 685555 - protein, 18 aa, Mycobacterium
KTQIPFVATMMGKGVADE

SEQ ID NO: 685556 - protein, 19 aa, Mycobacterium
KTQRPEVLSLLAQTYQAAA

SEQ ID NO: 685557 - protein, 21 aa, Mycobacterium
KTQTFFPWDSWEHPYTAMPAE

SEQ ID NO: 685558 - protein, 28 aa, Mycobacterium
KTQVFIADCRLFDAFDQVWKRFFPVPPP

SEQ ID NO: 685559 - protein, 20 aa, Mycobacterium
KTQWAQAGARLGLSLDPKFS

SEQ ID NO: 685560 - protein, 18 aa, Mycobacterium
KTRAELIALPVFGGPRQK

SEQ ID NO: 685561 - protein, 17 aa, Mycobacterium
KTRAVAVAGGRVIGDAL

SEQ ID NO: 685562 - protein, 24 aa, Mycobacterium
KTRDAVAAVAGWLRDETATPPARP

SEQ ID NO: 685563 - protein, 17 aa, Mycobacterium
KTRDCDGLNAMLASRDG

SEQ ID NO: 685564 - protein, 20 aa, Mycobacterium
KTRDELSCLRRAARITEQAI

SEQ ID NO: 685565 - protein, 26 aa, Mycobacterium
KTRDEWERILAAPGCCATPVLSLTEA

SEQ ID NO: 685566 - protein, 18 aa, Mycobacterium
KTRFDLFEAGLERITARF

SEQ ID NO: 685567 - protein, 23 aa, Mycobacterium
KTRGFPLGPGYLIDGRPVILTAP

SEQ ID NO: 685568 - protein, 21 aa, Mycobacterium
KTRGLDLDPIFAVPTDAHGAK

SEQ ID NO: 685569 - protein, 20 aa, Mycobacterium
KTRHTIALAVSEANGCDYCL

SEQ ID NO: 685570 - protein, 20 aa, Mycobacterium
KTRIAHAVAQAICKRNSPQQ

SEQ ID NO: 685571 - protein, 19 aa, Mycobacterium
KTRLDEVSRQLSLAEIEDF

SEQ ID NO: 685572 - protein, 18 aa, Mycobacterium
KTRLKRLLAEAELETDAL

SEQ ID NO: 685573 - protein, 19 aa, Mycobacterium
KTRNEGLVLLDFDDLLLHT

SEQ ID NO: 685574 - protein, 19 aa, Mycobacterium
KTRPAQLITIDSAPISSGY

SEQ ID NO: 685575 - protein, 28 aa, Mycobacterium
KTRPETAADEIVRWATPVTSFQRTALED

SEQ ID NO: 685576 - protein, 18 aa, Mycobacterium
KTRPPLHVELERALRVTL

SEQ ID NO: 685577 - protein, 25 aa, Mycobacterium
KTRRLRVSGPLSTMVEAKWVFDAGT

SEQ ID NO: 685578 - protein, 19 aa, Mycobacterium
KTRVAHGYCARHESAGACP

SEQ ID NO: 685579 - protein, 25 aa, Mycobacterium
KTSADPRFRFFGNVVIGEHVHPDEL

SEQ ID NO: 685580 - protein, 21 aa, Mycobacterium
KTSELCDRFAEQYAELRQHKG

SEQ ID NO: 685581 - protein, 32 aa, Mycobacterium
KTSGGRGVHVFFRIATDWDFIQVRRAGIALAR

SEQ ID NO: 685582 - protein, 26 aa, Mycobacterium
KTSGGRGVHVFLRIKPQWDFIEVRRA

SEQ ID NO: 685583 - protein, 27 aa, Mycobacterium
KTSGGRGVHVFLRIKTDWDFIAVRRAG

SEQ ID NO: 685584 - protein, 37 aa, Mycobacterium
KTSGSRGFHIYARIHPRWPFKQVRLAAEAVAREVERR

SEQ ID NO: 685585 - protein, 20 aa, Mycobacterium
KTSGSRGFHVYARIAPQWSF

SEQ ID NO: 685586 - protein, 20 aa, Mycobacterium
KTSGSRGFHVYARVARRWEF

SEQ ID NO: 685587 - protein, 29 aa, Mycobacterium
KTSIARLICEMYFGLGILESPEFIEVSRK

SEQ ID NO: 685588 - protein, 18 aa, Mycobacterium
KTSLKLRHEIGIDIIAWE

SEQ ID NO: 685589 - protein, 18 aa, Mycobacterium
KTSLLRLLLGQVPLTRGS

SEQ ID NO: 685590 - protein, 24 aa, Mycobacterium
KTSRLRVGHLVLCDAFRHPAVLAK

SEQ ID NO: 685591 - protein, 18 aa, Mycobacterium
KTSSAWEFSRESVVMGSV

SEQ ID NO: 685592 - protein, 18 aa, Mycobacterium
KTTALRMINRMVEPSSGT

SEQ ID NO: 685593 - protein, 18 aa, Mycobacterium
KTTALRMINRMVEPTSGT

SEQ ID NO: 685594 - protein, 17 aa, Mycobacterium
KTTATAVFGLRRDTWSD

SEQ ID NO: 685595 - protein, 17 aa, Mycobacterium
KTTAVRTPSGYRLDGVK

SEQ ID NO: 685596 - protein, 18 aa, Mycobacterium
KTTFALRVAAELLGQRAV

SEQ ID NO: 685597 - protein, 18 aa, Mycobacterium
KTTFPHGYTFGGHPVSAA

SEQ ID NO: 685598 - protein, 20 aa, Mycobacterium
KTTKGKPEFYLSGDPESAWV

SEQ ID NO: 685599 - protein, 19 aa, Mycobacterium
KTTLADWNRTLAVNLTGTF

SEQ ID NO: 685600 - protein, 18 aa, Mycobacterium
KTTLARLLLKGRKPAPDM

SEQ ID NO: 685601 - protein, 19 aa, Mycobacterium
KTTLLRTIYRAQRPTAGNV

SEQ ID NO: 685602 - protein, 24 aa, Mycobacterium
KTTLTRLLPRGVLEPKKQNAADHI

SEQ ID NO: 685603 - protein, 18 aa, Mycobacterium
KTTRDEIFVDLKERVAAL

SEQ ID NO: 685604 - protein, 19 aa, Mycobacterium
KTTSLRMVAGLEKLDSGRI

SEQ ID NO: 685605 - protein, 20 aa, Mycobacterium
KTTTMRLILGLDHPTSGTAT

SEQ ID NO: 685606 - protein, 22 aa, Mycobacterium
KTTTVARLLALFAEQAQLAGKA

SEQ ID NO: 685607 - protein, 26 aa, Mycobacterium
KTVALWRVLVALSIRHVGPTAARALA

SEQ ID NO: 685608 - protein, 17 aa, Mycobacterium
KTVCALLSDWLPATTGT

SEQ ID NO: 685609 - protein, 17 aa, Mycobacterium
KTVDPYYGTSFYTIDFS

SEQ ID NO: 685610 - protein, 25 aa, Mycobacterium
KTVDRMVRQLTRFDGDTRVLDLGAG

SEQ ID NO: 685611 - protein, 27 aa, Mycobacterium
KTVELWLPHYERTEVVGLRTDAPVTPA

SEQ ID NO: 685612 - protein, 25 aa, Mycobacterium
KTVGEAFAGLAQMRVKDVLREVFTV

SEQ ID NO: 685613 - protein, 17 aa, Mycobacterium
KTVHHYLMRFLGGELSD

SEQ ID NO: 685614 - protein, 17 aa, Mycobacterium
KTVHHYLMRFSGGELSD

SEQ ID NO: 685615 - protein, 29 aa, Mycobacterium
KTVHIWGCGGLGSWIAEFIARAGASEITV

SEQ ID NO: 685616 - protein, 18 aa, Mycobacterium
KTVISLDLGSMVAGAKYR

SEQ ID NO: 685617 - protein, 17 aa, Mycobacterium
KTVLGRSVLLTRTSDGS

SEQ ID NO: 685618 - protein, 30 aa, Mycobacterium
KTVLVRPAPVPGFRGTRSFGTEEFDPFWQA

SEQ ID NO: 685619 - protein, 20 aa, Mycobacterium
KTVRSARFMQGYGMTELSPL

SEQ ID NO: 685620 - protein, 17 aa, Mycobacterium
KTVSSLATRLAHFGRYL

SEQ ID NO: 685621 - protein, 18 aa, Mycobacterium
KTVTLARQGEEMAATLAA

SEQ ID NO: 685622 - protein, 24 aa, Mycobacterium
KTVVIPAQGAVYVLLLKADGLQSD

SEQ ID NO: 685623 - protein, 23 aa, Mycobacterium
KTWALAGLRVGYALGSPEVLARL

SEQ ID NO: 685624 - protein, 21 aa, Mycobacterium
KTWELGDGWGKHVTVEVALGT

SEQ ID NO: 685625 - protein, 23 aa, Mycobacterium
KTWELGPGWVKHVTVELALGTRE

SEQ ID NO: 685626 - protein, 19 aa, Mycobacterium
KTWLYRIATTACLRALENR

SEQ ID NO: 685627 - protein, 17 aa, Mycobacterium
KTWPAPQGWSSPQQWAG

SEQ ID NO: 685628 - protein, 25 aa, Mycobacterium
KTWWEVNDGIELWRYIEINHLLRSD

SEQ ID NO: 685629 - protein, 19 aa, Mycobacterium
KTYATGRTRDVEWRRRQLL

SEQ ID NO: 685630 - protein, 18 aa, Mycobacterium
KTYLDLPLFAGRPAPNLA

SEQ ID NO: 685631 - protein, 26 aa, Mycobacterium
KTYRIDIPLLAIVPCAVPSSGTVYRQ

SEQ ID NO: 685632 - protein, 19 aa, Mycobacterium
KTYTRFGGFLDEIDGFDPE

SEQ ID NO: 685633 - protein, 20 aa, Mycobacterium
KTYTRWGAFLDDAAGFDAGF

SEQ ID NO: 685634 - protein, 17 aa, Mycobacterium
KTYVAPIAFNVVPLAGS

SEQ ID NO: 685635 - protein, 36 aa, Mycobacterium
KVAAEAVCTWIARHFRIPLTIIRICSTYGPQGGAPA

SEQ ID NO: 685636 - protein, 26 aa, Mycobacterium
KVAAEAVCTWVSRHFDIPLTIIRICS

SEQ ID NO: 685637 - protein, 21 aa, Mycobacterium
KVAAEQVCTWVAGHHRIPLTI

SEQ ID NO: 685638 - protein, 22 aa, Mycobacterium
KVADALKAMGIKTVDLAKASTK

SEQ ID NO: 685639 - protein, 17 aa, Mycobacterium
KVADFCRERGILVVADE

SEQ ID NO: 685640 - protein, 22 aa, Mycobacterium
KVADGRVAGVHFLMKKNKITEI

SEQ ID NO: 685641 - protein, 23 aa, Mycobacterium
KVADGRVAGVHFLMKKNKITEIH

SEQ ID NO: 685642 - protein, 22 aa, Mycobacterium
KVADGRVAGVHFLMKKNKITEV

SEQ ID NO: 685643 - protein, 19 aa, Mycobacterium
KVAEAFGGAADPALVNETI

SEQ ID NO: 685644 - protein, 22 aa, Mycobacterium
KVAEGRVAGVHFLMKKNKITEI

SEQ ID NO: 685645 - protein, 22 aa, Mycobacterium
KVAEGRVAGVHFLMKKNKITEY

SEQ ID NO: 685646 - protein, 17 aa, Mycobacterium
KVAELDAGHGFNAATLE

SEQ ID NO: 685647 - protein, 24 aa, Mycobacterium
KVAGMTCSHCASSVHDELGSIPGV

SEQ ID NO: 685648 - protein, 24 aa, Mycobacterium
KVAGPRLILRGCEIHEPGEQPAKA

SEQ ID NO: 685649 - protein, 19 aa, Mycobacterium
KVAHCLYAGLTTDTGSFRW

SEQ ID NO: 685650 - protein, 20 aa, Mycobacterium
KVALDLPVDLPRTGVDPQEL

SEQ ID NO: 685651 - protein, 24 aa, Mycobacterium
KVANERCDWMPAVASRDGKDEIIH

SEQ ID NO: 685652 - protein, 20 aa, Mycobacterium
KVAPELGKAAIIVVNLSGRG

SEQ ID NO: 685653 - protein, 20 aa, Mycobacterium
KVAPLGGVWALLDIAAQIDI

SEQ ID NO: 685654 - protein, 19 aa, Mycobacterium
KVAPRRSGPVVWVKDASRS

SEQ ID NO: 685655 - protein, 17 aa, Mycobacterium
KVARGESVPEFVDAGTG

SEQ ID NO: 685656 - protein, 17 aa, Mycobacterium
KVARGIVMAVRRAVEKE

SEQ ID NO: 685657 - protein, 18 aa, Mycobacterium
KVARGMVMAVRRAVEKEG

SEQ ID NO: 685658 - protein, 17 aa, Mycobacterium
KVARIVMDATVLKDTMV

SEQ ID NO: 685659 - protein, 21 aa, Mycobacterium
KVARMGIRVADVLDTDQLAHK

SEQ ID NO: 685660 - protein, 21 aa, Mycobacterium
KVARMGIRVADVLNPEQLAHK

SEQ ID NO: 685661 - protein, 20 aa, Mycobacterium
KVASISVVWTNYGSAAATEH

SEQ ID NO: 685662 - protein, 19 aa, Mycobacterium
KVATISVVWTNYGSAAATE

SEQ ID NO: 685663 - protein, 17 aa, Mycobacterium
KVATSMRAIYTAATVDA

SEQ ID NO: 685664 - protein, 19 aa, Mycobacterium
KVAVASFFAKNFLPLLAST

SEQ ID NO: 685665 - protein, 19 aa, Mycobacterium
KVAVASFFAKNFLPMLTST

SEQ ID NO: 685666 - protein, 21 aa, Mycobacterium
KVAVEEFGFHVGLAQLAGNAL

SEQ ID NO: 685667 - protein, 23 aa, Mycobacterium
KVAVPYAASADWIIVTADSAVVV

SEQ ID NO: 685668 - protein, 23 aa, Mycobacterium
KVAWDHIHATGFLGGQITLQTIW

SEQ ID NO: 685669 - protein, 17 aa, Mycobacterium
KVCWDRDADAALKTAHR

SEQ ID NO: 685670 - protein, 18 aa, Mycobacterium
KVDAAAVLHKLSLRTPVR

SEQ ID NO: 685671 - protein, 17 aa, Mycobacterium
KVDAIKLLSEGACACAT

SEQ ID NO: 685672 - protein, 17 aa, Mycobacterium
KVDCVRLSQGRHAAAED

SEQ ID NO: 685673 - protein, 19 aa, Mycobacterium
KVDEPWSSAGMGEWQATLE

SEQ ID NO: 685674 - protein, 27 aa, Mycobacterium
KVDFAKAFWNVVNWADVQARYEAATSK

SEQ ID NO: 685675 - protein, 25 aa, Mycobacterium
KVDFAKAFWNVVNWADVQERYTAAT

SEQ ID NO: 685676 - protein, 26 aa, Mycobacterium
KVDFAKAFWNVVNWADVQSRYDAATS

SEQ ID NO: 685677 - protein, 18 aa, Mycobacterium
KVDFAVEGDIPWTNPDCG

SEQ ID NO: 685678 - protein, 18 aa, Mycobacterium
KVDFTGLAAELVIPKDQG

SEQ ID NO: 685679 - protein, 20 aa, Mycobacterium
KVDGGWLVNGHKIWTSHADR

SEQ ID NO: 685680 - protein, 24 aa, Mycobacterium
KVDKRNRPVLVFVLDAGMPGLTQG

SEQ ID NO: 685681 - protein, 25 aa, Mycobacterium
KVDNIGRLPMAWVDPATADTRTVLA

SEQ ID NO: 685682 - protein, 23 aa, Mycobacterium
KVDPRFHGQLSLHFKTDIGEDVL

SEQ ID NO: 685683 - protein, 18 aa, Mycobacterium
KVDPRLVDLVHRLGYTAH

SEQ ID NO: 685684 - protein, 24 aa, Mycobacterium
KVDRSAAYAMRWVAKNVVAAGLAD

SEQ ID NO: 685685 - protein, 20 aa, Mycobacterium
KVDSGWEWNAGLLYLRGHLE

SEQ ID NO: 685686 - protein, 19 aa, Mycobacterium
KVDYAIEGHIPWTNPDCGH

SEQ ID NO: 685687 - protein, 18 aa, Mycobacterium
KVDYHPLSVPVPYYHSNV

SEQ ID NO: 685688 - protein, 22 aa, Mycobacterium
KVEAALELKNQILVKIYNRKAL

SEQ ID NO: 685689 - protein, 31 aa, Mycobacterium
KVEALWVGPVWRSATAIAERGGPVARLRDGD

SEQ ID NO: 685690 - protein, 19 aa, Mycobacterium
KVEAYYAASHEGARHLEDV

SEQ ID NO: 685691 - protein, 25 aa, Mycobacterium
KVEGRRNDYVVGWIKRGPTGVIGSN

SEQ ID NO: 685692 - protein, 24 aa, Mycobacterium
KVEMPEIRSAVVAQLARVDGELAA

SEQ ID NO: 685693 - protein, 22 aa, Mycobacterium
KVFARLASRLSYLSGDVTDSAL

SEQ ID NO: 685694 - protein, 17 aa, Mycobacterium
KVFAWPDAEVAVMGAKA

SEQ ID NO: 685695 - protein, 18 aa, Mycobacterium
KVFDAFPLTHHTECVALL

SEQ ID NO: 685696 - protein, 28 aa, Mycobacterium
KVFDKSRLRLGLFGAKFPKEPLLRALDT

SEQ ID NO: 685697 - protein, 17 aa, Mycobacterium
KVFESVLAGHVKVLVGR

SEQ ID NO: 685698 - protein, 19 aa, Mycobacterium
KVFGGGGVFSSIPFLNQYW

SEQ ID NO: 685699 - protein, 19 aa, Mycobacterium
KVFSGEIVNAIAVAGILAA

SEQ ID NO: 685700 - protein, 24 aa, Mycobacterium
KVFSGEVRLCLGYTEPEGGSDVAT

SEQ ID NO: 685701 - protein, 24 aa, Mycobacterium
KVFTPRAIEAMRPLVTGLVDRYLD

SEQ ID NO: 685702 - protein, 18 aa, Mycobacterium
KVFTRGIITWGIRDARRL

SEQ ID NO: 685703 - protein, 17 aa, Mycobacterium
KVGAESLDAWKADVDLG

SEQ ID NO: 685704 - protein, 36 aa, Mycobacterium
KVGAIRYARKRGLPLLGLCLGLQCIVIEAARSVGLT

SEQ ID NO: 685705 - protein, 20 aa, Mycobacterium
KVGDCLKLGGTPDRPQATKA

SEQ ID NO: 685706 - protein, 21 aa, Mycobacterium
KVGELPGIYQASGVYDPATNQ

SEQ ID NO: 685707 - protein, 32 aa, Mycobacterium
KVGGARRCAAQSWSLDRFRAVAKCAGVTINDV

SEQ ID NO: 685708 - protein, 24 aa, Mycobacterium
KVGGESARSRVCFTMDEVRETVDE

SEQ ID NO: 685709 - protein, 24 aa, Mycobacterium
KVGGESARSRVCFTMDEVRETVEE

SEQ ID NO: 685710 - protein, 26 aa, Mycobacterium
KVGGESARSRVCFTMEEVRETVEELG

SEQ ID NO: 685711 - protein, 19 aa, Mycobacterium
KVGGKRAYRLAREGHAVEL

SEQ ID NO: 685712 - protein, 21 aa, Mycobacterium
KVGGTLAISVPRWLPERVCWL

SEQ ID NO: 685713 - protein, 33 aa, Mycobacterium
KVGGTLAVSVPRWLPERLCWLLSDEYHANEGGH

SEQ ID NO: 685714 - protein, 33 aa, Mycobacterium; identical to SEQ ID NO: 81594

SEQ ID NO: 685715 - protein, 20 aa, Mycobacterium
KVGLRRGKIIVVRPEHDHGA

SEQ ID NO: 685716 - protein, 20 aa, Mycobacterium
KVGQCPLASPADVDAAVSAA

SEQ ID NO: 685717 - protein, 17 aa, Mycobacterium
KVGRGMGVAEMMKEHHP

SEQ ID NO: 685718 - protein, 24 aa, Mycobacterium
KVGRIARILGPRGLMPNPKTGTVT

SEQ ID NO: 685719 - protein, 25 aa, Mycobacterium
KVGRIARVLGPRGLMPNPKTGTVTP

SEQ ID NO: 685720 - protein, 18 aa, Mycobacterium
KVGRRFAQISPIVATYRK

SEQ ID NO: 685721 - protein, 25 aa, Mycobacterium
KVGVAPRDLAGWLVEALVSHAAIAG

SEQ ID NO: 685722 - protein, 19 aa, Mycobacterium
KVGVWSAAERLDWFADDAE

SEQ ID NO: 685723 - protein, 17 aa, Mycobacterium
KVGYRGNLVVSGYTGCR

SEQ ID NO: 685724 - protein, 20 aa, Mycobacterium
KVHDFPIIWVKSRGNDGKMH

SEQ ID NO: 685725 - protein, 18 aa, Mycobacterium
KVHDGLKPAVGAKPDKPA

SEQ ID NO: 685726 - protein, 18 aa, Mycobacterium
KVHGKAWRVGELDDLAPL

SEQ ID NO: 685727 - protein, 18 aa, Mycobacterium
KVHHCIADGIATTQLLAK

SEQ ID NO: 685728 - protein, 18 aa, Mycobacterium
KVHHCMADGIAASHILAG

SEQ ID NO: 685729 - protein, 19 aa, Mycobacterium
KVHKLRHYLPIYQHALART

SEQ ID NO: 685730 - protein, 18 aa, Mycobacterium
KVHLDRPGLGEVYVVGVD

SEQ ID NO: 685731 - protein, 24 aa, Mycobacterium
KVHRHWGFGGGPHRCLGSHLARLE

SEQ ID NO: 685732 - protein, 19 aa, Mycobacterium
KVHSGCMMTVCAAAAHRTI

SEQ ID NO: 685733 - protein, 19 aa, Mycobacterium
KVIAGDVLAAFAQAHATPP

SEQ ID NO: 685734 - protein, 18 aa, Mycobacterium
KVIARLSGEGTLRYVENT

SEQ ID NO: 685735 - protein, 17 aa, Mycobacterium
KVIASSVDFLADAVALV

SEQ ID NO: 685736 - protein, 17 aa, Mycobacterium
KVIASTGSRIWDRLNDI

SEQ ID NO: 685737 - protein, 21 aa, Mycobacterium
KVIEDFPYWEPCHNAILSNGI

SEQ ID NO: 685738 - protein, 18 aa, Mycobacterium
KVIGECRNSGYLVERLTP

SEQ ID NO: 685739 - protein, 17 aa, Mycobacterium
KVIGWAVEQERVPLSGT

SEQ ID NO: 685740 - protein, 24 aa, Mycobacterium
KVIPQPVMQRLVQWSTRRAAGSGG

SEQ ID NO: 685741 - protein, 17 aa, Mycobacterium
KVIPVHFDDYGVFASPL

SEQ ID NO: 685742 - protein, 19 aa, Mycobacterium
KVIPWIPGPVKRLLTRGRS

SEQ ID NO: 685743 - protein, 21 aa, Mycobacterium
KVIQDFGRPVGLTLYVVTSVA

SEQ ID NO: 685744 - protein, 18 aa, Mycobacterium
KVISEMFHRALAAIDEYD

SEQ ID NO: 685745 - protein, 24 aa, Mycobacterium
KVKACGKSRLDVVEEFAYPIPVTV

SEQ ID NO: 685746 - protein, 19 aa, Mycobacterium
KVKGVSFLADEVGRFIRAA

SEQ ID NO: 685747 - protein, 22 aa, Mycobacterium
KVKPGDHVVCSFIPNCGTCRYC

SEQ ID NO: 685748 - protein, 18 aa, Mycobacterium
KVKRRFGVTINDVVTALC

SEQ ID NO: 685749 - protein, 22 aa, Mycobacterium
KVKSPFGMPGMPGMPGMPGMPA

SEQ ID NO: 685750 - protein, 18 aa, Mycobacterium
KVLASRMVRDYVEHYYAP

SEQ ID NO: 685751 - protein, 18 aa, Mycobacterium
KVLASRMVRDYVQQYYIH

SEQ ID NO: 685752 - protein, 22 aa, Mycobacterium
KVLAYRNWLGLNRGDLAEEVSK

SEQ ID NO: 685753 - protein, 25 aa, Mycobacterium
KVLDDWGAVAARIGMGWPECKVGVE

SEQ ID NO: 685754 - protein, 19 aa, Mycobacterium
KVLEDLGWYVADNLPPQLI

SEQ ID NO: 685755 - protein, 19 aa, Mycobacterium
KVLEVDGGLIAPNLDIPLP

SEQ ID NO: 685756 - protein, 24 aa, Mycobacterium
KVLGGLAKRPALFVASYFGELTDA

SEQ ID NO: 685757 - protein, 21 aa, Mycobacterium
KVLGYRNWLGLNKGDLAEEVT

SEQ ID NO: 685758 - protein, 21 aa, Mycobacterium
KVLGYRNWLGLNKGDLSEEVD

SEQ ID NO: 685759 - protein, 22 aa, Mycobacterium
KVLGYRNWLGLNRGDLSEDVTK

SEQ ID NO: 685760 - protein, 22 aa, Mycobacterium
KVLGYRNWLGLNRGDLTEEVTK

SEQ ID NO: 685761 - protein, 18 aa, Mycobacterium
KVLICGYGDVGKGSAESV

SEQ ID NO: 685762 - protein, 18 aa, Mycobacterium
KVLINFNRCGAVAYNNLK

SEQ ID NO: 685763 - protein, 17 aa, Mycobacterium
KVLKVYPERNRVLVEGV

SEQ ID NO: 685764 - protein, 21 aa, Mycobacterium
KVLPVPEFHPHIAKLKLADGV

SEQ ID NO: 685765 - protein, 30 aa, Mycobacterium
KVLRARPRLARRYLMLEGHRALTELAGRLA

SEQ ID NO: 685766 - protein, 20 aa, Mycobacterium
KVLRCSAEAGLAGRIRHVMI

SEQ ID NO: 685767 - protein, 21 aa, Mycobacterium
KVLRDNGFAIVRSEGTRRMYR

SEQ ID NO: 685768 - protein, 24 aa, Mycobacterium
KVLRGVGLRLMVPDQHWTEVLRFV

SEQ ID NO: 685769 - protein, 23 aa, Mycobacterium
KVLRLPRGQGLGVTASGYEIHHG

SEQ ID NO: 685770 - protein, 17 aa, Mycobacterium
KVLRVVALSGGYNREDA

SEQ ID NO: 685771 - protein, 17 aa, Mycobacterium
KVLVANRGEIARRVFRT

SEQ ID NO: 685772 - protein, 24 aa, Mycobacterium
KVLVCGYGDVGKGCAESVKGQGAR

SEQ ID NO: 685773 - protein, 17 aa, Mycobacterium
KVLYRLRALMQTGEVPT

SEQ ID NO: 685774 - protein, 18 aa, Mycobacterium
KVMGHLTAIFGADGGQGQ

SEQ ID NO: 685775 - protein, 22 aa, Mycobacterium
KVMRDIPFRVGAVVQPPIQYAN

SEQ ID NO: 685776 - protein, 26 aa, Mycobacterium
KVMRLWAQERVRGWTNDRVRAALSAG

SEQ ID NO: 685777 - protein, 20 aa, Mycobacterium
KVMRVVALSGGYSRDEANKL

SEQ ID NO: 685778 - protein, 25 aa, Mycobacterium
KVNGKDVTARFVVVAAGPFPEPKPA

SEQ ID NO: 685779 - protein, 19 aa, Mycobacterium
KVNLDITWLRDESLDDADH

SEQ ID NO: 685780 - protein, 18 aa, Mycobacterium
KVNLLLRRLPRLRDENVT

SEQ ID NO: 685781 - protein, 19 aa, Mycobacterium
KVNQLRGFEGYNDPRTPER

SEQ ID NO: 685782 - protein, 20 aa, Mycobacterium
KVNTAWRLDDRGVFSDSHGE

SEQ ID NO: 685783 - protein, 24 aa, Mycobacterium
KVNYALREPVPWRAQRLRGVGTVH

SEQ ID NO: 685784 - protein, 20 aa, Mycobacterium
KVPAADAFVADPVLDVVTQF

SEQ ID NO: 685785 - protein, 18 aa, Mycobacterium
KVPAALAVDAVRYSISDA

SEQ ID NO: 685786 - protein, 18 aa, Mycobacterium
KVPAALAVDSVRYTIDDA

SEQ ID NO: 685787 - protein, 19 aa, Mycobacterium
KVPAALKWIEDRRENLMSA

SEQ ID NO: 685788 - protein, 25 aa, Mycobacterium
KVPGAEAWRAWRYLINNVGIDLGGA

SEQ ID NO: 685789 - protein, 19 aa, Mycobacterium
KVPGALKWIEDRRENLMSA

SEQ ID NO: 685790 - protein, 25 aa, Mycobacterium
KVPGARAALAWSVETAQLAREHNNA

SEQ ID NO: 685791 - protein, 34 aa, Mycobacterium
KVPIYPGYVCAIVGSLLLGKPVKWMEDRSENLTS

SEQ ID NO: 685792 - protein, 23 aa, Mycobacterium
KVPRERWAQRRDQLLARVGLEGT

SEQ ID NO: 685793 - protein, 26 aa, Mycobacterium
KVPRSFEFVDELPLSGAGKILKRVLR

SEQ ID NO: 685794 - protein, 25 aa, Mycobacterium
KVPRSVEFLDVLPLNATGKVVKDLL

SEQ ID NO: 685795 - protein, 27 aa, Mycobacterium
KVPSIAETIDWGRTVLALGLDTIDDAV

SEQ ID NO: 685796 - protein, 18 aa, Mycobacterium
KVPSQICCTSHCLPFFDR

SEQ ID NO: 685797 - protein, 17 aa, Mycobacterium
KVPVFALTTGPRWPDVS

SEQ ID NO: 685798 - protein, 18 aa, Mycobacterium
KVPVRMTGSQALRDFLLI

SEQ ID NO: 685799 - protein, 37 aa, Mycobacterium
KVPYYRVLELAPWLGWPRPNFPVSNFFHGGAAPLNAI

SEQ ID NO: 685800 - protein, 21 aa, Mycobacterium
KVQAALEFKNQVLVKIYNRKA

SEQ ID NO: 685801 - protein, 19 aa, Mycobacterium
KVQAIVDMSTWQGDAGEAA

SEQ ID NO: 685802 - protein, 19 aa, Mycobacterium
KVQGLLGWQEYAVLSDTAM

SEQ ID NO: 685803 - protein, 25 aa, Mycobacterium
KVQLALAWISCQNYTAAADFLQQHP

SEQ ID NO: 685804 - protein, 27 aa, Mycobacterium
KVQLARAHLLYGEWLRRMNRRNDARHH

SEQ ID NO: 685805 - protein, 18 aa, Mycobacterium
KVRAAGLNPIDWKIVAGF

SEQ ID NO: 685806 - protein, 20 aa, Mycobacterium
KVRAALGLDKLRWGVTGAAA

SEQ ID NO: 685807 - protein, 24 aa, Mycobacterium
KVRAKRGGSVLCAIEVDREDISAY

SEQ ID NO: 685808 - protein, 24 aa, Mycobacterium
KVRAKRGGSVLCAIEVPGDKISAY

SEQ ID NO: 685809 - protein, 24 aa, Mycobacterium
KVRAKRGGSVLCAIEVPPHEISSY

SEQ ID NO: 685810 - protein, 19 aa, Mycobacterium
KVRAMELIEEVELTRRGLY

SEQ ID NO: 685811 - protein, 23 aa, Mycobacterium
KVRCVDLALLPGVEADMGPGDEW

SEQ ID NO: 685812 - protein, 27 aa, Mycobacterium
KVRDRLLPAMRDWLAHSPLGFVATTDA

SEQ ID NO: 685813 - protein, 20 aa, Mycobacterium
KVREALGLDQLRWGVTGAAA

SEQ ID NO: 685814 - protein, 25 aa, Mycobacterium
KVREVKIGMARPVWMDDPEFDITYH

SEQ ID NO: 685815 - protein, 23 aa, Mycobacterium
KVREVTLGLARPVWIDDREFDIT

SEQ ID NO: 685816 - protein, 23 aa, Mycobacterium
KVREVTLGLARPVWVDDRDFDIT

SEQ ID NO: 685817 - protein, 23 aa, Mycobacterium
KVRFPAPLHVGARVRGHVTLLSA

SEQ ID NO: 685818 - protein, 19 aa, Mycobacterium
KVRGLALMAEVWPLRPDCR

SEQ ID NO: 685819 - protein, 21 aa, Mycobacterium
KVRKVIYFNALVPVRGRSLVD

SEQ ID NO: 685820 - protein, 18 aa, Mycobacterium
KVRPAVYRQLGLNDVASG

SEQ ID NO: 685821 - protein, 21 aa, Mycobacterium
KVRPGVPVIFLDTGYHFAETI

SEQ ID NO: 685822 - protein, 22 aa, Mycobacterium
KVRPGVPVIFLDTGYHFAETIG

SEQ ID NO: 685823 - protein, 22 aa, Mycobacterium
KVRPGVPVIFLDTGYHFAETLG

SEQ ID NO: 685824 - protein, 22 aa, Mycobacterium
KVRPGVPVLFLDTGYHFAETIG

SEQ ID NO: 685825 - protein, 21 aa, Mycobacterium
KVRPGVPVVFLDTGYHFVETI

SEQ ID NO: 685826 - protein, 17 aa, Mycobacterium
KVRRAGLDYHDMASVTV

SEQ ID NO: 685827 - protein, 24 aa, Mycobacterium
KVRRCFERARVASRNSLKGPTRTR

SEQ ID NO: 685828 - protein, 24 aa, Mycobacterium
KVRRLRRLAALWLAGQDTRWAALR

SEQ ID NO: 685829 - protein, 23 aa, Mycobacterium
KVRRPQLGIATWLVPSIVAYGTE

SEQ ID NO: 685830 - protein, 18 aa, Mycobacterium
KVRRSTCVERYLNQEFTR

SEQ ID NO: 685831 - protein, 20 aa, Mycobacterium
KVRSELGLAQAPRVDSYGGF

SEQ ID NO: 685832 - protein, 20 aa, Mycobacterium
KVRVRKALIHSFADELKKLG

SEQ ID NO: 685833 - protein, 24 aa, Mycobacterium
KVRYGFAIAPELVRTVLRDREPDW

SEQ ID NO: 685834 - protein, 20 aa, Mycobacterium
KVRYRGVTKNDHWLHHRVAA

SEQ ID NO: 685835 - protein, 26 aa, Mycobacterium
KVSARPSDSVAIALRVGVPIYVEEAV

SEQ ID NO: 685836 - protein, 26 aa, Mycobacterium
KVSARPSDSVAIALRVGVPIYVEEPV

SEQ ID NO: 685837 - protein, 23 aa, Mycobacterium
KVSELPKGQGFNAATLEFGDLVS

SEQ ID NO: 685838 - protein, 25 aa, Mycobacterium
KVSGARFYFLTGYGALLQLGLLQLA

SEQ ID NO: 685839 - protein, 25 aa, Mycobacterium
KVSGFKGQEYMKLRDVLSVLRDAYC

SEQ ID NO: 685840 - protein, 24 aa, Mycobacterium
KVSGWKLTGQKVWTSAAQKAHWGV

SEQ ID NO: 685841 - protein, 28 aa, Mycobacterium
KVSHPIVFGHAVKIFYKEAFAKHQELFD

SEQ ID NO: 685842 - protein, 21 aa, Mycobacterium
KVSHPIVFGHAVKTFYRDAFA

SEQ ID NO: 685843 - protein, 26 aa, Mycobacterium
KVSHPIVFGHAVKVFYKDAFAKHEKL

SEQ ID NO: 685844 - protein, 26 aa, Mycobacterium
KVSHPIVFGHAVKVFYKDAFAKHQEL

SEQ ID NO: 685845 - protein, 25 aa, Mycobacterium
KVSHPIVFGHAVKVFYKDAFEKHGK

SEQ ID NO: 685846 - protein, 17 aa, Mycobacterium
KVSPLAVQMCMPNGAAA

SEQ ID NO: 685847 - protein, 20 aa, Mycobacterium
KVSQFPRAWATVRTADGRTG

SEQ ID NO: 685848 - protein, 19 aa, Mycobacterium
KVSRATFYFYFASKFSVVS

SEQ ID NO: 685849 - protein, 20 aa, Mycobacterium
KVSVRFRPALTVGRDEIDLA

SEQ ID NO: 685850 - protein, 17 aa, Mycobacterium
KVTAAAVEHLRRGSGKS

SEQ ID NO: 685851 - protein, 18 aa, Mycobacterium
KVTDQLRCLGARVTGLDL

SEQ ID NO: 685852 - protein, 25 aa, Mycobacterium
KVTDTRPGQWVAISGIGGLGHVAVQ

SEQ ID NO: 685853 - protein, 26 aa, Mycobacterium
KVTDTRPGQWVAISGIGGLGHVAVQY

SEQ ID NO: 685854 - protein, 23 aa, Mycobacterium
KVTEAWTGFSERPEYASAQKIAD

SEQ ID NO: 685855 - protein, 19 aa, Mycobacterium
KVTGAPLGLDRPWFVEDED

SEQ ID NO: 685856 - protein, 17 aa, Mycobacterium
KVTGVFDWEMATLGRPE

SEQ ID NO: 685857 - protein, 21 aa, Mycobacterium
KVTHPSAIVWAAQMGTITLHP

SEQ ID NO: 685858 - protein, 26 aa, Mycobacterium
KVTIPEFPYHGDVHGLVELPIQGTIN

SEQ ID NO: 685859 - protein, 20 aa, Mycobacterium
KVTLRIAAQYAQYTNFTPQP

SEQ ID NO: 685860 - protein, 21 aa, Mycobacterium
KVTLRIAARYAQYTNFGQTAE

SEQ ID NO: 685861 - protein, 21 aa, Mycobacterium
KVTLRIAARYAQYTNFTPEPA

SEQ ID NO: 685862 - protein, 21 aa, Mycobacterium
KVTLRIAARYAQYTNFTPEPE

SEQ ID NO: 685863 - protein, 24 aa, Mycobacterium
KVTLVGARRSELEIAAKELDVDAI

SEQ ID NO: 685864 - protein, 18 aa, Mycobacterium
KVTPDFAPYGKRIIRDPG

SEQ ID NO: 685865 - protein, 19 aa, Mycobacterium
KVTRFPIILLGTEYWSGLL

SEQ ID NO: 685866 - protein, 19 aa, Mycobacterium
KVTRLVLVDVVPRFEKGGS

SEQ ID NO: 685867 - protein, 22 aa, Mycobacterium
KVTRRARQEWLAKRLATLDSEQ

SEQ ID NO: 685868 - protein, 23 aa, Mycobacterium
KVTRRLVGMLARRGYSQNLACEV

SEQ ID NO: 685869 - protein, 18 aa, Mycobacterium
KVVALDCDNTLWGGIVGE

SEQ ID NO: 685870 - protein, 20 aa, Mycobacterium
KVVCFPDRWLDLRYIGPASA

SEQ ID NO: 685871 - protein, 20 aa, Mycobacterium
KVVDDEFPGRVLLAEANQWP

SEQ ID NO: 685872 - protein, 21 aa, Mycobacterium
KVVDLDYRLDVNTLHRDKSAT

SEQ ID NO: 685873 - protein, 17 aa, Mycobacterium
KVVEKLDLLGIGVDEVL

SEQ ID NO: 685874 - protein, 30 aa, Mycobacterium
KVVELRPDIDWDKGAALAWIRSLIFEDSRV

SEQ ID NO: 685875 - protein, 24 aa, Mycobacterium
KVVEWARERGALVVSDECYLGLGW

SEQ ID NO: 685876 - protein, 21 aa, Mycobacterium
KVVEWARGRGVIVASDECYLG

SEQ ID NO: 685877 - protein, 25 aa, Mycobacterium
KVVFTRLRPDFVVPLTDAVSVAALD

SEQ ID NO: 685878 - protein, 28 aa, Mycobacterium
KVVGDCVECPFHGWRWGPDGCNKYIPYQ

SEQ ID NO: 685879 - protein, 29 aa, Mycobacterium
KVVGESMVDAAICDGDWVVVRQQSVADNG

SEQ ID NO: 685880 - protein, 17 aa, Mycobacterium
KVVGWALEQHRIPLGGT

SEQ ID NO: 685881 - protein, 25 aa, Mycobacterium
KVVILKANGKGFCGGHVARWDPDEN

SEQ ID NO: 685882 - protein, 25 aa, Mycobacterium
KVVKGGRRFSFTALVIVGDGHGLVG

SEQ ID NO: 685883 - protein, 20 aa, Mycobacterium
KVVLERQLWIAVLRAQRDLG

SEQ ID NO: 685884 - protein, 17 aa, Mycobacterium
KVVPTWNYEVLNVHGHL

SEQ ID NO: 685885 - protein, 23 aa, Mycobacterium
KVVREIVSGLGLKEAKDLVDGAP

SEQ ID NO: 685886 - protein, 35 aa, Mycobacterium
KVVWSGSIPNWIVALERIRAFGAKIVVPGHGPLLV

SEQ ID NO: 685887 - protein, 19 aa, Mycobacterium
KVWRGETALGEKYEVEDIP

SEQ ID NO: 685888 - protein, 19 aa, Mycobacterium
KVWRGETALGEKYEVEEIP

SEQ ID NO: 685889 - protein, 19 aa, Mycobacterium
KVWRGETKLGETYDTIDIP

SEQ ID NO: 685890 - protein, 19 aa, Mycobacterium
KVWRGETKLGETYDTIEIP

SEQ ID NO: 685891 - protein, 29 aa, Mycobacterium
KVWTSYALMASWCVLAACTDPDAPKHKRL

SEQ ID NO: 685892 - protein, 24 aa, Mycobacterium
KVWVSGPGGERWEIYTVKADSETF

SEQ ID NO: 685893 - protein, 22 aa, Mycobacterium
KVYLDLRVKIAKNWQRDPKQLG

SEQ ID NO: 685894 - protein, 25 aa, Mycobacterium
KVYRGPRRKGVRYFGPYSHAWAIRE

SEQ ID NO: 685895 - protein, 20 aa, Mycobacterium
KWAADCGQLCVKFSRTDLEY

SEQ ID NO: 685896 - protein, 36 aa, Mycobacterium
KWAGEVLLREAHDWCGLPVSVFRCDMILADTTYSGQ

SEQ ID NO: 685897 - protein, 18 aa, Mycobacterium
KWAPSMVIGLGRLAGRTV

SEQ ID NO: 685898 - protein, 17 aa, Mycobacterium
KWAQGRGYGLFLDLDGR

SEQ ID NO: 685899 - protein, 17 aa, Mycobacterium
KWASMVVRAGEPGAGTR

SEQ ID NO: 685900 - protein, 19 aa, Mycobacterium
KWDGFRALVFRDGDDVVLL

SEQ ID NO: 685901 - protein, 24 aa, Mycobacterium
KWDGYRLLVEIDHGALRVRSRRGR

SEQ ID NO: 685902 - protein, 20 aa, Mycobacterium
KWDKLFRFLALDRLQSRLHR

SEQ ID NO: 685903 - protein, 19 aa, Mycobacterium
KWDRTDPSYARPLTIEDVP

SEQ ID NO: 685904 - protein, 18 aa, Mycobacterium
KWEVPCAPVMSMKELAND

SEQ ID NO: 685905 - protein, 21 aa, Mycobacterium
KWGEVPVAFITRRDGSDVTFD

SEQ ID NO: 685906 - protein, 23 aa, Mycobacterium
KWGSTLESFFMGVPGLAGMSGGL

SEQ ID NO: 685907 - protein, 17 aa, Mycobacterium
KWHRQRVIEPFDVDAYR

SEQ ID NO: 685908 - protein, 24 aa, Mycobacterium
KWIDEPYPDLAWRYNPDRPETIHP

SEQ ID NO: 685909 - protein, 19 aa, Mycobacterium
KWIEQMKQIGIYGLAIPEE

SEQ ID NO: 685910 - protein, 18 aa, Mycobacterium
KWISGLIGSAPVEVLHGL

SEQ ID NO: 685911 - protein, 28 aa, Mycobacterium
KWKTVLDCADALKFVCCNADEGDSGTFA

SEQ ID NO: 685912 - protein, 20 aa, Mycobacterium
KWLARAGSPGTTLVYAYEEA

SEQ ID NO: 685913 - protein, 18 aa, Mycobacterium
KWLDCYADDVVYWMPAWT

SEQ ID NO: 685914 - protein, 28 aa, Mycobacterium
KWLDDPVPFFNWRAGGLRSDVVHPQDMP

SEQ ID NO: 685915 - protein, 18 aa, Mycobacterium
KWLLRPPPLLGEHNEDVL

SEQ ID NO: 685916 - protein, 19 aa, Mycobacterium
KWLNVPYDCAMAIVRDADA

SEQ ID NO: 685917 - protein, 21 aa, Mycobacterium
KWLRPAPEGVVGELYVAGRGV

SEQ ID NO: 685918 - protein, 36 aa, Mycobacterium
KWMRRRRESLPMAQLPGRAWVQYDPLGAVLIIGPWN

SEQ ID NO: 685919 - protein, 18 aa, Mycobacterium
KWMSRFQTFLFKTTNGKL

SEQ ID NO: 685920 - protein, 19 aa, Mycobacterium
KWNPDKLLAVIGTAESAHK

SEQ ID NO: 685921 - protein, 23 aa, Mycobacterium
KWPETLSARGWQWCRVYHLSAHT

SEQ ID NO: 685922 - protein, 20 aa, Mycobacterium
KWQKMWKPVVCAVHGMCTAG

SEQ ID NO: 685923 - protein, 19 aa, Mycobacterium
KWQKMWKPVVCAVQGMCTA

SEQ ID NO: 685924 - protein, 20 aa, Mycobacterium
KWQKMWKPVVCAVQGMCTAG

SEQ ID NO: 685925 - protein, 23 aa, Mycobacterium
KWQKMWKPVVCAVQGMCTAGAFY

SEQ ID NO: 685926 - protein, 26 aa, Mycobacterium
KWQRFFRYLSLDGMQTRLHRWRFNLV

SEQ ID NO: 685927 - protein, 26 aa, Mycobacterium
KWRAHPADVLPLWVAEMDVHLPPTVA

SEQ ID NO: 685928 - protein, 25 aa, Mycobacterium
KWRAHPADVLPLWVAEMDVNLAPTV

SEQ ID NO: 685929 - protein, 19 aa, Mycobacterium
KWRAHPRVVQIGVPLQSRE

SEQ ID NO: 685930 - protein, 25 aa, Mycobacterium
KWRAYPADVLPLWVAEMDVKLAPTV

SEQ ID NO: 685931 - protein, 17 aa, Mycobacterium
KWRFSYRDLTLIDMVGD

SEQ ID NO: 685932 - protein, 19 aa, Mycobacterium
KWRRHGFEPDFTVIEFEGE

SEQ ID NO: 685933 - protein, 28 aa, Mycobacterium
KWSAQAGALGLPFPPAMVFEHMTIAELA

SEQ ID NO: 685934 - protein, 21 aa, Mycobacterium
KWSPFPAYARSKLAVMLWGLE

SEQ ID NO: 685935 - protein, 23 aa, Mycobacterium
KWTAALIGPWWPASATILRAAAQ

SEQ ID NO: 685936 - protein, 20 aa, Mycobacterium
KWTDDEWHHVLDLNLSSAWY

SEQ ID NO: 685937 - protein, 21 aa, Mycobacterium
KWTTIGAFGDYVRGRGITPVI

SEQ ID NO: 685938 - protein, 21 aa, Mycobacterium
KWVLCRYRLQQAALEIESTGS

SEQ ID NO: 685939 - protein, 22 aa, Mycobacterium
KWVRIPEVHFAPDSCSYLGKPA

SEQ ID NO: 685940 - protein, 24 aa, Mycobacterium
KWWDDLWLNESFATFASVLCQSEA

SEQ ID NO: 685941 - protein, 23 aa, Mycobacterium
KYAADIDGVLAWAQDSRARLAAL

SEQ ID NO: 685942 - protein, 25 aa, Mycobacterium
KYAADIDGVLAWAVEARERLSALDV

SEQ ID NO: 685943 - protein, 23 aa, Mycobacterium
KYAARLKGLIDVGTYNASNADLT

SEQ ID NO: 685944 - protein, 19 aa, Mycobacterium
KYAEAGIRAIDLTPAAVGP

SEQ ID NO: 685945 - protein, 33 aa, Mycobacterium
KYAEVPGSALWFMHQLANGWSGVKDFLGATPFG

SEQ ID NO: 685946 - protein, 25 aa, Mycobacterium
KYDDLRAGLRMNIIANPGVEKANFE

SEQ ID NO: 685947 - protein, 24 aa, Mycobacterium
KYDDLRAGLRMNIIGNPGVAKEDF

SEQ ID NO: 685948 - protein, 24 aa, Mycobacterium
KYDDLRAGLRMNLIANPGVAKAHF

SEQ ID NO: 685949 - protein, 28 aa, Mycobacterium
KYDLRAAARLGLRTAFVARPLEFGIGGA

SEQ ID NO: 685950 - protein, 17 aa, Mycobacterium
KYDMSFAAVQKHVAVLD

SEQ ID NO: 685951 - protein, 18 aa, Mycobacterium
KYDVPIVQAWGMTETSPL

SEQ ID NO: 685952 - protein, 22 aa, Mycobacterium
KYDVSCLRSVFSGAAPLDEQLG

SEQ ID NO: 685953 - protein, 20 aa, Mycobacterium
KYDWGRGQTRTMGFLTEARE

SEQ ID NO: 685954 - protein, 19 aa, Mycobacterium
KYFRDAMRIPIDDAQLEED

SEQ ID NO: 685955 - protein, 22 aa, Mycobacterium
KYGNWMSVQALRMTGTRPVYLI

SEQ ID NO: 685956 - protein, 18 aa, Mycobacterium
KYGPWEWDGVLRAGVSSF

SEQ ID NO: 685957 - protein, 18 aa, Mycobacterium
KYGTAPGALVIGWNGGHT

SEQ ID NO: 685958 - protein, 20 aa, Mycobacterium
KYGTQPGALVIGWNSGHTAV

SEQ ID NO: 685959 - protein, 24 aa, Mycobacterium
KYGVDFRWGHALTGFDQGDDGVTI

SEQ ID NO: 685960 - protein, 20 aa, Mycobacterium
KYGWEHGCELFKLQDAAEDL

SEQ ID NO: 685961 - protein, 18 aa, Mycobacterium
KYHAWRYNLDGDLTFIQQ

SEQ ID NO: 685962 - protein, 19 aa, Mycobacterium
KYHGWRYDLEGALTFVQQQ

SEQ ID NO: 685963 - protein, 18 aa, Mycobacterium
KYIHRHAIDAAGLAAPVP

SEQ ID NO: 685964 - protein, 18 aa, Mycobacterium
KYILCEGVDSSEKYKLPA

SEQ ID NO: 685965 - protein, 20 aa, Mycobacterium
KYIWALELAPIVAGTELTPF

SEQ ID NO: 685966 - protein, 20 aa, Mycobacterium
KYKLCANLYAAECNWLVRVG

SEQ ID NO: 685967 - protein, 26 aa, Mycobacterium
KYKPEIDVMVSWLPLFHDMGMVGFLT

SEQ ID NO: 685968 - protein, 18 aa, Mycobacterium
KYLELLLNAVIRGLLTAA

SEQ ID NO: 685969 - protein, 20 aa, Mycobacterium
KYLHNMAAWSALPVDEQEKV

SEQ ID NO: 685970 - protein, 25 aa, Mycobacterium
KYLNRLSDLLFILARAANPDGDVLW

SEQ ID NO: 685971 - protein, 24 aa, Mycobacterium
KYLNRLSDLLFILSRVANPRGDLM

SEQ ID NO: 685972 - protein, 17 aa, Mycobacterium
KYLPRMASGEMRATMAL

SEQ ID NO: 685973 - protein, 26 aa, Mycobacterium
KYLRGTPLGPLRCEAWVDGKEGRKVF

SEQ ID NO: 685974 - protein, 27 aa, Mycobacterium
KYLRGTPLGPLRCEAWVDGKEGRKVFA

SEQ ID NO: 685975 - protein, 25 aa, Mycobacterium
KYLRGTPLGPLRCEAWVDRTEGVKA

SEQ ID NO: 685976 - protein, 17 aa, Mycobacterium
KYLRRCVDLAREALDDG

SEQ ID NO: 685977 - protein, 20 aa, Mycobacterium
KYLTGCADLFRDGYTDVVQF

SEQ ID NO: 685978 - protein, 23 aa, Mycobacterium
KYLTGCARAFRIGYIDCNQFTLA

SEQ ID NO: 685979 - protein, 23 aa, Mycobacterium
KYLVRVVVSLMYWPGEDDDAERR

SEQ ID NO: 685980 - protein, 24 aa, Mycobacterium
KYNAEAYIARFAREANISHKDVDK

SEQ ID NO: 685981 - protein, 18 aa, Mycobacterium
KYNIFNLVWNTLLALLFE

SEQ ID NO: 685982 - protein, 23 aa, Mycobacterium
KYNIKANAIAPIAATRMTQDILP

SEQ ID NO: 685983 - protein, 23 aa, Mycobacterium
KYNIKVNAIAPMARTRMTEELLG

SEQ ID NO: 685984 - protein, 24 aa, Mycobacterium
KYNPWDERLCVVPNGDLYKAIRKG

SEQ ID NO: 685985 - protein, 23 aa, Mycobacterium
KYNPWDQRLCVVPDSDLFRALRK

SEQ ID NO: 685986 - protein, 18 aa, Mycobacterium
KYNVPIVQAWGMTETSPL

SEQ ID NO: 685987 - protein, 19 aa, Mycobacterium
KYPAGCVLTLEAVSAEHGV

SEQ ID NO: 685988 - protein, 17 aa, Mycobacterium
KYPAINITSIKGPDGKE

SEQ ID NO: 685989 - protein, 27 aa, Mycobacterium
KYPARVKCALLGWMACKDALAQASHAL

SEQ ID NO: 685990 - protein, 27 aa, Mycobacterium
KYPARVKCALLGWMACKDALAQAYSRQ

SEQ ID NO: 685991 - protein, 29 aa, Mycobacterium
KYPARVKCALLGWMAFKAAVAEARPLDET

SEQ ID NO: 685992 - protein, 28 aa, Mycobacterium
KYPARVKCALLGWMAFKDALAQACSDRG

SEQ ID NO: 685993 - protein, 26 aa, Mycobacterium
KYPARVKCALLGWTAFKAALAEAHGP

SEQ ID NO: 685994 - protein, 24 aa, Mycobacterium
KYPCELYDLPTLWEVASMNPWLSV

SEQ ID NO: 685995 - protein, 28 aa, Mycobacterium
KYPDAGLRWPRSTIFKVLDDLTTPATTL

SEQ ID NO: 685996 - protein, 20 aa, Mycobacterium
KYPDRLTVVHWLESLQGLPS

SEQ ID NO: 685997 - protein, 20 aa, Mycobacterium
KYPDRLTVVHWLESVQGMPS

SEQ ID NO: 685998 - protein, 23 aa, Mycobacterium
KYPEAMVTLPIIVTAIYHERNPE

SEQ ID NO: 685999 - protein, 24 aa, Mycobacterium
KYPGWYSKFGKWWENYNRLAYPGR

SEQ ID NO: 686000 - protein, 21 aa, Mycobacterium
KYPRFEILHSHIVVRKLVMSA

SEQ ID NO: 686001 - protein, 19 aa, Mycobacterium
KYPVALAVGELDWAQVMAG

SEQ ID NO: 686002 - protein, 20 aa, Mycobacterium
KYPVALNVGGLSWADVVAGA

SEQ ID NO: 686003 - protein, 24 aa, Mycobacterium
KYPVALQVGGLSWGHVVTGEAELG

SEQ ID NO: 686004 - protein, 22 aa, Mycobacterium
KYPVSLSVGGLSWKEIADGSPD

SEQ ID NO: 686005 - protein, 26 aa, Mycobacterium
KYPWPRGRARRKFGFYDQDLQPALWV

SEQ ID NO: 686006 - protein, 26 aa, Mycobacterium
KYQASELKSLASQVLKGEQLKSFMAV

SEQ ID NO: 686007 - protein, 17 aa, Mycobacterium
KYRGCLRETLAQITSDG

SEQ ID NO: 686008 - protein, 17 aa, Mycobacterium
KYRGHWYPVVRVNSKTV

SEQ ID NO: 686009 - protein, 20 aa, Mycobacterium
KYRIGGPLSTIIDRPSTVPS

SEQ ID NO: 686010 - protein, 17 aa, Mycobacterium
KYRLVFDKLALKAGDRL

SEQ ID NO: 686011 - protein, 17 aa, Mycobacterium
KYRLVFEKLGLQPGDRL

SEQ ID NO: 686012 - protein, 23 aa, Mycobacterium
KYRRDKVGIVFQAFNLVPSLTAL

SEQ ID NO: 686013 - protein, 18 aa, Mycobacterium
KYSFTVFGPHEIEPEDVP

SEQ ID NO: 686014 - protein, 17 aa, Mycobacterium
KYSNAFWNGSQMAYGDG

SEQ ID NO: 686015 - protein, 27 aa, Mycobacterium
KYTAPEISARVLMKLKRDAEAYLGEDI

SEQ ID NO: 686016 - protein, 17 aa, Mycobacterium
KYTRVFADSVLLMADCF

SEQ ID NO: 686017 - protein, 18 aa, Mycobacterium
KYTRVFADSVLMMADCFD

SEQ ID NO: 686018 - protein, 25 aa, Mycobacterium
KYVDFDPIYCWPKPVTKPYPPLYIG

SEQ ID NO: 686019 - protein, 24 aa, Mycobacterium
KYVEAPYRFEVFEGVSHWIAEERP

SEQ ID NO: 686020 - protein, 17 aa, Mycobacterium
KYVEYNLIPSLFTEHAF

SEQ ID NO: 686021 - protein, 17 aa, Mycobacterium
KYVGAYLAVLGHTDVIS

SEQ ID NO: 686022 - protein, 24 aa, Mycobacterium
KYWEIDEIRPAFIHANVPVIPPLP

SEQ ID NO: 686023 - protein, 27 aa, Mycobacterium
KYWEVDEIRPAFILSNVVDIPNAPFEF

SEQ ID NO: 686024 - protein, 18 aa, Mycobacterium
KYWVCKRSTPHAAEALEC

SEQ ID NO: 686025 - protein, 18 aa, Mycobacterium
KYWYASVIEHMGRRTGKR

SEQ ID NO: 686026 - protein, 18 aa, Mycobacterium
LAAAAAWDALAAELQSTA

SEQ ID NO: 686027 - protein, 19 aa, Mycobacterium
LAAAAAWDGLAAELGDAAS

SEQ ID NO: 686028 - protein, 19 aa, Mycobacterium
LAAAAAWDSLAAGLHSTAA

SEQ ID NO: 686029 - protein, 17 aa, Mycobacterium
LAAAAPMVIWLRGAAQV

SEQ ID NO: 686030 - protein, 17 aa, Mycobacterium
LAAAATFYEDFGLIPHD

SEQ ID NO: 686031 - protein, 23 aa, Mycobacterium
LAAACAEAGITFVGPPADVLELT

SEQ ID NO: 686032 - protein, 18 aa, Mycobacterium
LAAACASAGITFVGPSAH

SEQ ID NO: 686033 - protein, 17 aa, Mycobacterium
LAAACAWDSLAAELHVT

SEQ ID NO: 686034 - protein, 23 aa, Mycobacterium
LAAACGLRVTTIFGGVSQTRQVA

SEQ ID NO: 686035 - protein, 22 aa, Mycobacterium
LAAACHQAGIVFVGPRAHVLEL

SEQ ID NO: 686036 - protein, 18 aa, Mycobacterium
LAAACTENGWDQRETAGK

SEQ ID NO: 686037 - protein, 21 aa, Mycobacterium
LAAADLVAWAQLIGFTDTPEL

SEQ ID NO: 686038 - protein, 17 aa, Mycobacterium
LAAADMGKWRLATVNVD

SEQ ID NO: 686039 - protein, 18 aa, Mycobacterium
LAAAFALKGGNPGIAATI

SEQ ID NO: 686040 - protein, 19 aa, Mycobacterium
LAAAGCGRIVLTARSQPNP

SEQ ID NO: 686041 - protein, 17 aa, Mycobacterium
LAAAGGFRNWDSMVKRH

SEQ ID NO: 686042 - protein, 20 aa, Mycobacterium
LAAAGGRGLITPDLIPDEAQ

SEQ ID NO: 686043 - protein, 20 aa, Mycobacterium
LAAAGYRVVASTGKADAAER

SEQ ID NO: 686044 - protein, 20 aa, Mycobacterium
LAAAGYRVVASTGKPQAAEL

SEQ ID NO: 686045 - protein, 26 aa, Mycobacterium
LAAAHAIALQLGWRLMGPSLRAGFGL

SEQ ID NO: 686046 - protein, 17 aa, Mycobacterium
LAAAHGIPVLKPPRPNS

SEQ ID NO: 686047 - protein, 18 aa, Mycobacterium
LAAAHLKGSLDTELVASF

SEQ ID NO: 686048 - protein, 18 aa, Mycobacterium
LAAAKALVRKLRRDSDIV

SEQ ID NO: 686049 - protein, 24 aa, Mycobacterium
LAAAKGLPYVFAHHFAGQGTAEAL

SEQ ID NO: 686050 - protein, 25 aa, Mycobacterium
LAAAKGLPYVFAHHFSGKGTEEALE

SEQ ID NO: 686051 - protein, 20 aa, Mycobacterium
LAAALADYPFAYLITVDDDY

SEQ ID NO: 686052 - protein, 19 aa, Mycobacterium
LAAALAVHRRGRKVVVLSK

SEQ ID NO: 686053 - protein, 19 aa, Mycobacterium
LAAAMALQGLNVLVIDLDP

SEQ ID NO: 686054 - protein, 18 aa, Mycobacterium
LAAAPGRTIVFARTKHGA

SEQ ID NO: 686055 - protein, 18 aa, Mycobacterium
LAAAPGWVRREAAIDGIE

SEQ ID NO: 686056 - protein, 20 aa, Mycobacterium
LAAAPPGYRLSIPDSTCDLG

SEQ ID NO: 686057 - protein, 18 aa, Mycobacterium
LAAAPPGYRLSIPENSCD

SEQ ID NO: 686058 - protein, 17 aa, Mycobacterium
LAAARGRVAQRLETLVP

SEQ ID NO: 686059 - protein, 25 aa, Mycobacterium
LAAARLAAHAAVFWIARGRTATRET

SEQ ID NO: 686060 - protein, 17 aa, Mycobacterium
LAAARRGIDVHFHTPSE

SEQ ID NO: 686061 - protein, 24 aa, Mycobacterium
LAAARRPVVIAGQGVDRADARGGL

SEQ ID NO: 686062 - protein, 32 aa, Mycobacterium
LAAARWWRKPLVQRWYGFLAMQQQVARQIPDL

SEQ ID NO: 686063 - protein, 29 aa, Mycobacterium
LAAARWWRKPLVRRWYGFLDMQQEVARHI

SEQ ID NO: 686064 - protein, 18 aa, Mycobacterium
LAAARWYGKVFKSINDVE

SEQ ID NO: 686065 - protein, 18 aa, Mycobacterium
LAAATARTVTAWRRERGQ

SEQ ID NO: 686066 - protein, 20 aa, Mycobacterium
LAAATAWTGLAAELRSAAAA

SEQ ID NO: 686067 - protein, 23 aa, Mycobacterium
LAAATKLAHSWIDRQVADPLPDD

SEQ ID NO: 686068 - protein, 19 aa, Mycobacterium
LAAAVADGFPGARNRSDPA

SEQ ID NO: 686069 - protein, 17 aa, Mycobacterium
LAAAVALHYRDAGEPVI

SEQ ID NO: 686070 - protein, 18 aa, Mycobacterium
LAAAVGLGGEVGRRFAEF

SEQ ID NO: 686071 - protein, 26 aa, Mycobacterium
LAAAVICARAGLKVNVIEAQPTFGGG

SEQ ID NO: 686072 - protein, 25 aa, Mycobacterium
LAAAVSELLVGKGFTAGKVGNNESD

SEQ ID NO: 686073 - protein, 18 aa, Mycobacterium
LAAAVVPLAMWGARHQMA

SEQ ID NO: 686074 - protein, 17 aa, Mycobacterium
LAACDRAGVGAQWADEA

SEQ ID NO: 686075 - protein, 19 aa, Mycobacterium
LAACPEALTSESTRRALIE

SEQ ID NO: 686076 - protein, 19 aa, Mycobacterium
LAACPMVGVLIAIGDGRPY

SEQ ID NO: 686077 - protein, 29 aa, Mycobacterium
LAACRRRYGDVFTLRIARMGTQVYLADPR

SEQ ID NO: 686078 - protein, 22 aa, Mycobacterium
LAACTAFGIPVLYAPGRNADAV

SEQ ID NO: 686079 - protein, 18 aa, Mycobacterium
LAADCAKAVLGADVDVAV

SEQ ID NO: 686080 - protein, 21 aa, Mycobacterium
LAADFLPPVWLPDDRTRSLRR

SEQ ID NO: 686081 - protein, 17 aa, Mycobacterium
LAADGHRVAVLDLDADA

SEQ ID NO: 686082 - protein, 22 aa, Mycobacterium
LAADHFRYFAAAIRAQEGTLSQ

SEQ ID NO: 686083 - protein, 23 aa, Mycobacterium
LAADHFRYFAAALRAQEGSLSQI

SEQ ID NO: 686084 - protein, 32 aa, Mycobacterium
LAADIYRIAHNVAWERWTDIAFGLTSNPQELR

SEQ ID NO: 686085 - protein, 17 aa, Mycobacterium
LAADMAVDFRGTSVCTV

SEQ ID NO: 686086 - protein, 27 aa, Mycobacterium
LAADPRFVCAYGWEVVEVAPRLNHPFT

SEQ ID NO: 686087 - protein, 27 aa, Mycobacterium
LAADRAARSRLAAILADNGLAVVTMNA

SEQ ID NO: 686088 - protein, 25 aa, Mycobacterium
LAADREPWLAISPRPCNGDPPYELA

SEQ ID NO: 686089 - protein, 17 aa, Mycobacterium
LAADRGRVGERYIISDR

SEQ ID NO: 686090 - protein, 17 aa, Mycobacterium
LAADRLQVIAGDKAEPS

SEQ ID NO: 686091 - protein, 22 aa, Mycobacterium
LAADRPACRTALGISASQDAEI

SEQ ID NO: 686092 - protein, 27 aa, Mycobacterium
LAADRRFVCAYGWEVVEVAPRLDHRFS

SEQ ID NO: 686093 - protein, 17 aa, Mycobacterium
LAADRWAVPLVHTAHTL

SEQ ID NO: 686094 - protein, 17 aa, Mycobacterium
LAADWGERVKPLVAGLP

SEQ ID NO: 686095 - protein, 18 aa, Mycobacterium
LAAEAELAEAELPIDSVM

SEQ ID NO: 686096 - protein, 17 aa, Mycobacterium
LAAEAKRLAYRLDAQAV

SEQ ID NO: 686097 - protein, 17 aa, Mycobacterium
LAAECRRIGHGLQAREH

SEQ ID NO: 686098 - protein, 28 aa, Mycobacterium
LAAEEARDLAGLLTKYADKLDEATYSDK

SEQ ID NO: 686099 - protein, 17 aa, Mycobacterium
LAAEEGLLVGISSGAAL

SEQ ID NO: 686100 - protein, 23 aa, Mycobacterium
LAAEEWRSLRLAIKQETVAANIA

SEQ ID NO: 686101 - protein, 19 aa, Mycobacterium
LAAEFDFRTLVGVVSVLAD

SEQ ID NO: 686102 - protein, 19 aa, Mycobacterium
LAAEHGVKYVTLELGGKNP

SEQ ID NO: 686103 - protein, 36 aa, Mycobacterium
LAAEICDGWLPIFYSPRIAGMYNEWLDEGFARPGAR

SEQ ID NO: 686104 - protein, 30 aa, Mycobacterium
LAAEICDGWLPIFYSPRMAGMYNEWLDEGF

SEQ ID NO: 686105 - protein, 30 aa, Mycobacterium
LAAEICDGWLPIFYTPRMADMYNEWLDEGF

SEQ ID NO: 686106 - protein, 25 aa, Mycobacterium
LAAEICDGWLPIFYTPRMADTYNEW

SEQ ID NO: 686107 - protein, 21 aa, Mycobacterium
LAAEIGVDWTATVPVGPVRRA

SEQ ID NO: 686108 - protein, 18 aa, Mycobacterium
LAAEINGWAPTGLLDTYE

SEQ ID NO: 686109 - protein, 23 aa, Mycobacterium
LAAEIPDDLLLVIERDGRLYFDA

SEQ ID NO: 686110 - protein, 21 aa, Mycobacterium
LAAEKARWAPSAGEPMLEALR

SEQ ID NO: 686111 - protein, 21 aa, Mycobacterium
LAAELCLPLVLVIDTAGPALS

SEQ ID NO: 686112 - protein, 24 aa, Mycobacterium
LAAELEAVCGWSTRQPTPWWNAET

SEQ ID NO: 686113 - protein, 19 aa, Mycobacterium
LAAELGAAVPSVYYHVPGK

SEQ ID NO: 686114 - protein, 17 aa, Mycobacterium
LAAELGVADRVRLLGAV

SEQ ID NO: 686115 - protein, 18 aa, Mycobacterium
LAAELVAAVAEFLETDVR

SEQ ID NO: 686116 - protein, 17 aa, Mycobacterium
LAAELVATIGSLTRTPE

SEQ ID NO: 686117 - protein, 25 aa, Mycobacterium
LAAEPEIPIASRFTLPTMAQMGSLP

SEQ ID NO: 686118 - protein, 23 aa, Mycobacterium
LAAERFAGMLLRRLGSGRGTRSR

SEQ ID NO: 686119 - protein, 23 aa, Mycobacterium
LAAESRAKIVYEYLKQFTDDPGV

SEQ ID NO: 686120 - protein, 17 aa, Mycobacterium
LAAESVGLVLTTRVVNP

SEQ ID NO: 686121 - protein, 23 aa, Mycobacterium
LAAEVARRLTARGLRIVGITGSS

SEQ ID NO: 686122 - protein, 17 aa, Mycobacterium
LAAEVLISAFNQSMDSF

SEQ ID NO: 686123 - protein, 22 aa, Mycobacterium
LAAEYKKLLVAMLQRREAWQII

SEQ ID NO: 686124 - protein, 23 aa, Mycobacterium
LAAEYKKLVLAMLQRREAWQIVD

SEQ ID NO: 686125 - protein, 23 aa, Mycobacterium
LAAFCDICVAAFAGFAVVKPQVA

SEQ ID NO: 686126 - protein, 18 aa, Mycobacterium
LAAFEIPATFELASELPH

SEQ ID NO: 686127 - protein, 24 aa, Mycobacterium
LAAFHEFLDALGIAGEDQLVRPIA

SEQ ID NO: 686128 - protein, 26 aa, Mycobacterium
LAAFPRYHPRWAWWLTGVPVLREFLV

SEQ ID NO: 686129 - protein, 17 aa, Mycobacterium
LAAFVSRVRAALPATSW

SEQ ID NO: 686130 - protein, 18 aa, Mycobacterium
LAAGAARAAGTTSPAGAA

SEQ ID NO: 686131 - protein, 23 aa, Mycobacterium
LAAGALRAGECDLAIVAGVNLML

SEQ ID NO: 686132 - protein, 18 aa, Mycobacterium
LAAGCPVAVLSGRDLADV

SEQ ID NO: 686133 - protein, 17 aa, Mycobacterium
LAAGCTVVLKSAPDTPL

SEQ ID NO: 686134 - protein, 24 aa, Mycobacterium
LAAGDFWGGAASVACQEFITQLGR

SEQ ID NO: 686135 - protein, 18 aa, Mycobacterium
LAAGEADVFFARRQVHIV

SEQ ID NO: 686136 - protein, 17 aa, Mycobacterium
LAAGEGRGRIYIVEPEG

SEQ ID NO: 686137 - protein, 18 aa, Mycobacterium
LAAGEGRGRIYIVEPQGP

SEQ ID NO: 686138 - protein, 18 aa, Mycobacterium
LAAGGLKLNRFHTTALCS

SEQ ID NO: 686139 - protein, 23 aa, Mycobacterium
LAAGGLYRQWALGRRAAGNPWAV

SEQ ID NO: 686140 - protein, 18 aa, Mycobacterium
LAAGGRRVAVVSSGDPGV

SEQ ID NO: 686141 - protein, 24 aa, Mycobacterium
LAAGKLVRYAAEFEALRDRSDAFV

SEQ ID NO: 686142 - protein, 31 aa, Mycobacterium
LAAGLDARCWRLPWPAGTTVYELDQPKVLEF

SEQ ID NO: 686143 - protein, 28 aa, Mycobacterium
LAAGLDSRAWRLPWPDGTTVYELDQPAV

SEQ ID NO: 686144 - protein, 25 aa, Mycobacterium
LAAGLPPTVPHKFPITPTPRYRRIG

SEQ ID NO: 686145 - protein, 30 aa, Mycobacterium
LAAGPLRYAGWSSCFRREAGSYGKDTRGII

SEQ ID NO: 686146 - protein, 17 aa, Mycobacterium
LAAGRLSKIVISALSSG

SEQ ID NO: 686147 - protein, 17 aa, Mycobacterium
LAAGSRRSAWWAGAVTL

SEQ ID NO: 686148 - protein, 19 aa, Mycobacterium
LAAGTAWPVRPLRRPVLAL

SEQ ID NO: 686149 - protein, 18 aa, Mycobacterium
LAAGTLLWHRDRLDEAQR

SEQ ID NO: 686150 - protein, 19 aa, Mycobacterium
LAAGTRCDCRVLPLKHVPR

SEQ ID NO: 686151 - protein, 22 aa, Mycobacterium
LAAGYRLALVAAHDDGETLRIV

SEQ ID NO: 686152 - protein, 17 aa, Mycobacterium
LAAGYWPDRAVLRSNWR

SEQ ID NO: 686153 - protein, 18 aa, Mycobacterium
LAAGYWQWVELLQAAIRR

SEQ ID NO: 686154 - protein, 24 aa, Mycobacterium
LAAHADHFWTWSIDMLGHGYTDKP

SEQ ID NO: 686155 - protein, 24 aa, Mycobacterium
LAAHAEHFWTWSIDMLGHGYTGKP

SEQ ID NO: 686156 - protein, 23 aa, Mycobacterium
LAAHARAGTIIAIHSTISDTTAE

SEQ ID NO: 686157 - protein, 19 aa, Mycobacterium
LAAHGHWLGGDVDFHEADS

SEQ ID NO: 686158 - protein, 24 aa, Mycobacterium
LAAHGIGGLLGFDGVPPAQLYAQG

SEQ ID NO: 686159 - protein, 26 aa, Mycobacterium
LAAHRRAHGLPGISLAWGLWDQASAM

SEQ ID NO: 686160 - protein, 18 aa, Mycobacterium
LAAHVTETFVIPAESASG

SEQ ID NO: 686161 - protein, 17 aa, Mycobacterium
LAAHWLSHGQWTDGWDP

SEQ ID NO: 686162 - protein, 18 aa, Mycobacterium
LAAIGAFAAGLVAGALRL

SEQ ID NO: 686163 - protein, 18 aa, Mycobacterium
LAAIGGFRKWDRMVKRHL

SEQ ID NO: 686164 - protein, 24 aa, Mycobacterium
LAAIGPKLPELWGGSADLAGSNNT

SEQ ID NO: 686165 - protein, 26 aa, Mycobacterium
LAAIKRVLPGLGYRLTSRGVRVATSP

SEQ ID NO: 686166 - protein, 25 aa, Mycobacterium
LAAIPGGPFLSFGQVYAYAQNAQGL

SEQ ID NO: 686167 - protein, 25 aa, Mycobacterium
LAAIRTGAAYACFTPSPSLGIPALR

SEQ ID NO: 686168 - protein, 24 aa, Mycobacterium
LAAITPKAVREWYAVTLTNRPTMR

SEQ ID NO: 686169 - protein, 18 aa, Mycobacterium
LAAIVELWTSDSPKFEGR

SEQ ID NO: 686170 - protein, 19 aa, Mycobacterium
LAAIWLAAQDAHWAVLRID

SEQ ID NO: 686171 - protein, 23 aa, Mycobacterium
LAAKCAEAGITFVGPSAEVLQLT

SEQ ID NO: 686172 - protein, 18 aa, Mycobacterium
LAAKFAATKPGSWVIRKL

SEQ ID NO: 686173 - protein, 23 aa, Mycobacterium
LAAKGIAAKGGWGPGVHGEYLVR

SEQ ID NO: 686174 - protein, 19 aa, Mycobacterium
LAAKHLPPGVLNVVTGDRV

SEQ ID NO: 686175 - protein, 18 aa, Mycobacterium
LAAKIKEFAGEDVPHGAL

SEQ ID NO: 686176 - protein, 24 aa, Mycobacterium
LAAKLELLAAIAATGVREVEATAF

SEQ ID NO: 686177 - protein, 24 aa, Mycobacterium
LAAKLEQAHDLLVQALETVDKGQV

SEQ ID NO: 686178 - protein, 17 aa, Mycobacterium
LAAKLRTASSAYQGVDE

SEQ ID NO: 686179 - protein, 17 aa, Mycobacterium
LAAKPWVKTTMAPGSQV

SEQ ID NO: 686180 - protein, 17 aa, Mycobacterium
LAAKRWTALNFPTNTVI

SEQ ID NO: 686181 - protein, 21 aa, Mycobacterium
LAAKVPGCIPLDRANDPDPLG

SEQ ID NO: 686182 - protein, 21 aa, Mycobacterium
LAAKVPGCIPLNRETDPELLG

SEQ ID NO: 686183 - protein, 30 aa, Mycobacterium
LAALAAFELIDWPVAVVIAAGHLLASNHHN

SEQ ID NO: 686184 - protein, 28 aa, Mycobacterium
LAALAALELIEWPVAVVIAAGHVMASNH

SEQ ID NO: 686185 - protein, 17 aa, Mycobacterium
LAALAKPGATLVLHLAA

SEQ ID NO: 686186 - protein, 26 aa, Mycobacterium
LAALAPDCCAVVAYGALLREELLAVP

SEQ ID NO: 686187 - protein, 19 aa, Mycobacterium
LAALAPRFGVGVVATTGAH

SEQ ID NO: 686188 - protein, 21 aa, Mycobacterium
LAALARLAAAVANELAADGLK

SEQ ID NO: 686189 - protein, 17 aa, Mycobacterium
LAALCDTVAEEATAGLA

SEQ ID NO: 686190 - protein, 18 aa, Mycobacterium
LAALDRLAPAAAKAVAVS

SEQ ID NO: 686191 - protein, 18 aa, Mycobacterium
LAALGFHVVVAARREDRV

SEQ ID NO: 686192 - protein, 27 aa, Mycobacterium
LAALGIPVLFPRNAREIVTLFLHGVAL

SEQ ID NO: 686193 - protein, 24 aa, Mycobacterium
LAALGRSAFQLGVLERGLQLTAEY

SEQ ID NO: 686194 - protein, 25 aa, Mycobacterium
LAALHRQAADLARRFEHITYSWIPR

SEQ ID NO: 686195 - protein, 20 aa, Mycobacterium
LAALIAQLGRFWRIDRGDTF

SEQ ID NO: 686196 - protein, 27 aa, Mycobacterium
LAALIRARFPALTARQVMQRIESTAHH

SEQ ID NO: 686197 - protein, 23 aa, Mycobacterium
LAALKQTRLGALCGQRSADKHVP

SEQ ID NO: 686198 - protein, 18 aa, Mycobacterium
LAALLAEALTEAGVPHQI

SEQ ID NO: 686199 - protein, 18 aa, Mycobacterium
LAALLAVQGIEATQATLS

SEQ ID NO: 686200 - protein, 17 aa, Mycobacterium
LAALLPMLRNLVNLGRT

SEQ ID NO: 686201 - protein, 17 aa, Mycobacterium
LAALLSRSLREHAVLCD

SEQ ID NO: 686202 - protein, 20 aa, Mycobacterium
LAALMPRSTLTVAHLPADVE

SEQ ID NO: 686203 - protein, 17 aa, Mycobacterium
LAALPALAMTAFEDLSN

SEQ ID NO: 686204 - protein, 18 aa, Mycobacterium
LAALPERDRLVLKLRFFE

SEQ ID NO: 686205 - protein, 17 aa, Mycobacterium
LAALPETYATAWTCLFR

SEQ ID NO: 686206 - protein, 18 aa, Mycobacterium
LAALPMGIPPNFAAPAAN

SEQ ID NO: 686207 - protein, 17 aa, Mycobacterium
LAALPRFTPMALPDTGR

SEQ ID NO: 686208 - protein, 17 aa, Mycobacterium
LAALRAGAQLARELAST

SEQ ID NO: 686209 - protein, 17 aa, Mycobacterium
LAALRDALLPGLVTGEV

SEQ ID NO: 686210 - protein, 18 aa, Mycobacterium
LAALRMLAGDVVEMATGE

SEQ ID NO: 686211 - protein, 17 aa, Mycobacterium
LAALRPAAVLAKTLATM

SEQ ID NO: 686212 - protein, 19 aa, Mycobacterium
LAALRRPAVLAKQLATLDV

SEQ ID NO: 686213 - protein, 17 aa, Mycobacterium
LAALRVIMRVRERMGVV

SEQ ID NO: 686214 - protein, 20 aa, Mycobacterium
LAALRWVQDNVEAFGGDPTR

SEQ ID NO: 686215 - protein, 33 aa, Mycobacterium
LAALSMPILFPRNAEEVIRFGMYGIALSRASGC

SEQ ID NO: 686216 - protein, 17 aa, Mycobacterium
LAALSRDGYVIWENLLS

SEQ ID NO: 686217 - protein, 20 aa, Mycobacterium
LAALSRFGAAPTLCDDDPAT

SEQ ID NO: 686218 - protein, 21 aa, Mycobacterium
LAALSRFGAVPTLCDDDPATL

SEQ ID NO: 686219 - protein, 17 aa, Mycobacterium
LAALTGHQPVERYGASE

SEQ ID NO: 686220 - protein, 20 aa, Mycobacterium
LAALTRFGAIPTMCDDDPAM

SEQ ID NO: 686221 - protein, 21 aa, Mycobacterium
LAALTSLPGVGVWTAAETVQR

SEQ ID NO: 686222 - protein, 25 aa, Mycobacterium
LAALTTASALTWMVERACQQNLPAQ

SEQ ID NO: 686223 - protein, 17 aa, Mycobacterium
LAALTWGGALVAHHYTR

SEQ ID NO: 686224 - protein, 20 aa, Mycobacterium
LAAMAGFCAQAAVRRTPLLL

SEQ ID NO: 686225 - protein, 19 aa, Mycobacterium
LAAMCPAITTSNFRELFYP

SEQ ID NO: 686226 - protein, 18 aa, Mycobacterium
LAAMEAHTGVTLAVRTTR

SEQ ID NO: 686227 - protein, 18 aa, Mycobacterium
LAAMIPWEGAGDFYRDWA

SEQ ID NO: 686228 - protein, 25 aa, Mycobacterium
LAAMMPMRVIGMLLGIPESEQVSVR

SEQ ID NO: 686229 - protein, 23 aa, Mycobacterium
LAAMPPFLTGGSMIETVTMEEST

SEQ ID NO: 686230 - protein, 25 aa, Mycobacterium
LAANARIALHVRVLYGRDPHHITEA

SEQ ID NO: 686231 - protein, 27 aa, Mycobacterium
LAANGLRLPGAHSFFVGNPQIGKTFFD

SEQ ID NO: 686232 - protein, 19 aa, Mycobacterium
LAANGYRVVASTGKESAAG

SEQ ID NO: 686233 - protein, 25 aa, Mycobacterium
LAANKTIRDWAWSLLCTPWARIGSR

SEQ ID NO: 686234 - protein, 24 aa, Mycobacterium
LAANLAAMGLRVLVIDMDQQAHST

SEQ ID NO: 686235 - protein, 23 aa, Mycobacterium
LAANLAAMGLRVLVVDMDQQAHS

SEQ ID NO: 686236 - protein, 17 aa, Mycobacterium
LAANLFEIEPRCRRILF

SEQ ID NO: 686237 - protein, 34 aa, Mycobacterium
LAANLREIWIPRGMFSEGYRWLDLALTALPPLPS

SEQ ID NO: 686238 - protein, 21 aa, Mycobacterium
LAAPAEAWARHGVEHPLGSDF

SEQ ID NO: 686239 - protein, 26 aa, Mycobacterium
LAAPCTERQVFICGPGPFMDAAREAL

SEQ ID NO: 686240 - protein, 22 aa, Mycobacterium
LAAPDLQAGGFVPNATVAIANL

SEQ ID NO: 686241 - protein, 18 aa, Mycobacterium
LAAPDLVSDIVVWLAGDA

SEQ ID NO: 686242 - protein, 20 aa, Mycobacterium
LAAPEAFAAQFADLDLTIVT

SEQ ID NO: 686243 - protein, 21 aa, Mycobacterium
LAAPFADVIVFARDWGFRLEE

SEQ ID NO: 686244 - protein, 17 aa, Mycobacterium
LAAPGCVYADHRRETAF

SEQ ID NO: 686245 - protein, 17 aa, Mycobacterium
LAAPGWPREVGGLDLSL

SEQ ID NO: 686246 - protein, 18 aa, Mycobacterium
LAAPLPMAVIGDMLGVLP

SEQ ID NO: 686247 - protein, 18 aa, Mycobacterium
LAAPLPMAVIGDMLGVRP

SEQ ID NO: 686248 - protein, 17 aa, Mycobacterium
LAAPPMRGGLPTAVPTD

SEQ ID NO: 686249 - protein, 25 aa, Mycobacterium
LAAPPRAGLGGIHWHMVGRIQRNKV

SEQ ID NO: 686250 - protein, 17 aa, Mycobacterium
LAAPPVRGGLPTAVPTD

SEQ ID NO: 686251 - protein, 26 aa, Mycobacterium
LAAPSEFRYYLPVLVRAVVGYFADPA

SEQ ID NO: 686252 - protein, 25 aa, Mycobacterium
LAAPYPTFLVRRAKQMVLDIALQNL

SEQ ID NO: 686253 - protein, 19 aa, Mycobacterium
LAAQCLVPGGRLVFNAFLT

SEQ ID NO: 686254 - protein, 19 aa, Mycobacterium
LAAQCPVAILSGRDLADVS

SEQ ID NO: 686255 - protein, 19 aa, Mycobacterium
LAAQDAHWAVLRIDVIGVR

SEQ ID NO: 686256 - protein, 20 aa, Mycobacterium
LAAQEIWHSINLPNLLENIL

SEQ ID NO: 686257 - protein, 19 aa, Mycobacterium
LAAQLPLPINAIALPDQDD

SEQ ID NO: 686258 - protein, 25 aa, Mycobacterium
LAAQRPELVSALVLEDMAPDFRGRT

SEQ ID NO: 686259 - protein, 17 aa, Mycobacterium
LAAQRSALAHPYLTPPS

SEQ ID NO: 686260 - protein, 21 aa, Mycobacterium
LAAQSERIFPTVAFVAEVGRS

SEQ ID NO: 686261 - protein, 18 aa, Mycobacterium
LAARADALAGQMAATAAG

SEQ ID NO: 686262 - protein, 27 aa, Mycobacterium
LAARADEFTAWLGGTRVNPRFPSPLSK

SEQ ID NO: 686263 - protein, 25 aa, Mycobacterium
LAARARIPVPTAHRLIGELVVGGAL

SEQ ID NO: 686264 - protein, 22 aa, Mycobacterium
LAARDWWTLVDIDSAPGFCDES

SEQ ID NO: 686265 - protein, 17 aa, Mycobacterium
LAARFARPLTFGTAGLR

SEQ ID NO: 686266 - protein, 18 aa, Mycobacterium
LAARFGVARETVRQALHE

SEQ ID NO: 686267 - protein, 20 aa, Mycobacterium
LAARFRIVRYDTRGAGRSAA

SEQ ID NO: 686268 - protein, 19 aa, Mycobacterium
LAARGFRVICLDLLGTTAD

SEQ ID NO: 686269 - protein, 17 aa, Mycobacterium
LAARHPDRFIPFAGADV

SEQ ID NO: 686270 - protein, 27 aa, Mycobacterium
LAARHRGRLRFGVGVTDASRRHPAVTA

SEQ ID NO: 686271 - protein, 28 aa, Mycobacterium
LAARIARPPHNWTPDIIWNAYAAIDAPK

SEQ ID NO: 686272 - protein, 17 aa, Mycobacterium
LAARIEAMPWQWAGQEL

SEQ ID NO: 686273 - protein, 17 aa, Mycobacterium
LAARISKWQGWSRQRIV

SEQ ID NO: 686274 - protein, 20 aa, Mycobacterium
LAARKGRAGERYLISEKMIS

SEQ ID NO: 686275 - protein, 24 aa, Mycobacterium
LAARLADVAIVFAVRAEGEGYDLA

SEQ ID NO: 686276 - protein, 19 aa, Mycobacterium
LAARLFPWRYDRQLLAGIP

SEQ ID NO: 686277 - protein, 18 aa, Mycobacterium
LAARLGLHTTTVRFHLDA

SEQ ID NO: 686278 - protein, 17 aa, Mycobacterium
LAARLGTGVLSIRKSGK

SEQ ID NO: 686279 - protein, 22 aa, Mycobacterium
LAARLRLALRERGIPLWLDSPM

SEQ ID NO: 686280 - protein, 21 aa, Mycobacterium
LAARNRLLLDGGYAPMFGEHT

SEQ ID NO: 686281 - protein, 36 aa, Mycobacterium
LAARPGDTWLGDRSWNRPSWTVAELEAAKAGRTISV

SEQ ID NO: 686282 - protein, 19 aa, Mycobacterium
LAARPGREGDLHRRLQSFA

SEQ ID NO: 686283 - protein, 18 aa, Mycobacterium
LAARPLRTFRTGQAEDTY

SEQ ID NO: 686284 - protein, 17 aa, Mycobacterium
LAARPVRISRFDVLAVR

SEQ ID NO: 686285 - protein, 17 aa, Mycobacterium
LAARPYASATFPWYLLG

SEQ ID NO: 686286 - protein, 18 aa, Mycobacterium
LAARRGDPVIPQAAHFGD

SEQ ID NO: 686287 - protein, 18 aa, Mycobacterium
LAARRPAVFFDFDGTLSD

SEQ ID NO: 686288 - protein, 18 aa, Mycobacterium
LAARSGGRLEALFLDEGF

SEQ ID NO: 686289 - protein, 24 aa, Mycobacterium
LAARSISDLVAWSGGLYDPPARFR

SEQ ID NO: 686290 - protein, 23 aa, Mycobacterium
LAARSIVYYVLGYVADEQSRLQW

SEQ ID NO: 686291 - protein, 17 aa, Mycobacterium
LAARSRKRISLDDLDAA

SEQ ID NO: 686292 - protein, 22 aa, Mycobacterium
LAARTARIRLATSVLVLGYHHP

SEQ ID NO: 686293 - protein, 19 aa, Mycobacterium
LAARTGLPTDAFKATVDRF

SEQ ID NO: 686294 - protein, 17 aa, Mycobacterium
LAARWLRAQGKGFYTIG

SEQ ID NO: 686295 - protein, 23 aa, Mycobacterium
LAARYRTAAAFVYPSQYEGFGIP

SEQ ID NO: 686296 - protein, 19 aa, Mycobacterium
LAARYTWANRLIAVVSDGS

SEQ ID NO: 686297 - protein, 21 aa, Mycobacterium
LAASATCYDLAPGQSLVAHLL

SEQ ID NO: 686298 - protein, 18 aa, Mycobacterium
LAASELVPFTAPPNTTAP

SEQ ID NO: 686299 - protein, 17 aa, Mycobacterium
LAASGRPPAAFICESVY

SEQ ID NO: 686300 - protein, 23 aa, Mycobacterium
LAASRLRYARALRERLPKTGAVF

SEQ ID NO: 686301 - protein, 17 aa, Mycobacterium
LAASRPLVRCPQCKSLE

SEQ ID NO: 686302 - protein, 17 aa, Mycobacterium
LAASRVRYARALRERLP

SEQ ID NO: 686303 - protein, 17 aa, Mycobacterium
LAASSRRSAWWAGALTL

SEQ ID NO: 686304 - protein, 25 aa, Mycobacterium
LAATCGGVRVWSLYVPNGRTVDSPH

SEQ ID NO: 686305 - protein, 20 aa, Mycobacterium
LAATCPPELKTAHGGKGVLK

SEQ ID NO: 686306 - protein, 18 aa, Mycobacterium
LAATEAFSKTAAEAVQMH

SEQ ID NO: 686307 - protein, 20 aa, Mycobacterium
LAATEFLDWKHDAVQQFTES

SEQ ID NO: 686308 - protein, 22 aa, Mycobacterium
LAATELRTAPGVLELDHTRPYA

SEQ ID NO: 686309 - protein, 24 aa, Mycobacterium
LAATEVYEAFGYRKSAYYKAAREG

SEQ ID NO: 686310 - protein, 22 aa, Mycobacterium
LAATGGRLGQRFGSNHTVELHV

SEQ ID NO: 686311 - protein, 19 aa, Mycobacterium
LAATGRPLIGNGANAAAGS

SEQ ID NO: 686312 - protein, 21 aa, Mycobacterium
LAATGRPLIGNGANGAPGTGA

SEQ ID NO: 686313 - protein, 17 aa, Mycobacterium
LAATIGGEAPEHLLDTY

SEQ ID NO: 686314 - protein, 17 aa, Mycobacterium
LAATLFYDSLPWNGEST

SEQ ID NO: 686315 - protein, 21 aa, Mycobacterium
LAATNWLGFNTPAIMDIEAAY

SEQ ID NO: 686316 - protein, 25 aa, Mycobacterium
LAATRAAGWASAREELEIGLNAVAA

SEQ ID NO: 686317 - protein, 20 aa, Mycobacterium
LAATVPKVGVFRPITRLGED

SEQ ID NO: 686318 - protein, 35 aa, Mycobacterium
LAAVADLFAAFGMFAVGFYDLRSARSPIPVVSTAF

SEQ ID NO: 686319 - protein, 26 aa, Mycobacterium
LAAVADLFEAFGMYPVDFYDLRDAAS

SEQ ID NO: 686320 - protein, 26 aa, Mycobacterium
LAAVCALEPFWEALRKVYAPFESGLP

SEQ ID NO: 686321 - protein, 20 aa, Mycobacterium
LAAVDARLRAPLSVTVQGRA

SEQ ID NO: 686322 - protein, 18 aa, Mycobacterium
LAAVEAFFGAGADRQLDI

SEQ ID NO: 686323 - protein, 18 aa, Mycobacterium
LAAVEAFFGAGTDRQLDV

SEQ ID NO: 686324 - protein, 20 aa, Mycobacterium
LAAVGARIALGVPTAHGLPA

SEQ ID NO: 686325 - protein, 18 aa, Mycobacterium
LAAVGLTWDEPVEWQTTH

SEQ ID NO: 686326 - protein, 17 aa, Mycobacterium
LAAVIYGAPEKLLDTYE

SEQ ID NO: 686327 - protein, 25 aa, Mycobacterium
LAAVLDRLAAYRARIVDIDGCQYRE

SEQ ID NO: 686328 - protein, 29 aa, Mycobacterium
LAAVLIRPKFRRWISVADAIAFVESLGGH

SEQ ID NO: 686329 - protein, 20 aa, Mycobacterium
LAAVMACASARVSAQPWSPC

SEQ ID NO: 686330 - protein, 25 aa, Mycobacterium
LAAVRGLRVVTVFGGVSQHKQVAAL

SEQ ID NO: 686331 - protein, 19 aa, Mycobacterium
LAAVRVRGLIALYGAASGQ

SEQ ID NO: 686332 - protein, 31 aa, Mycobacterium
LAAVTAAHPRPDFKNRILAAFNDGMKHRPHT

SEQ ID NO: 686333 - protein, 25 aa, Mycobacterium
LAAVTRPLLRSSFLAILAACAKTLE

SEQ ID NO: 686334 - protein, 18 aa, Mycobacterium
LAAVVAEGFGPDQRRSSP

SEQ ID NO: 686335 - protein, 19 aa, Mycobacterium
LAAVYRLVAHYRMTDLVFT

SEQ ID NO: 686336 - protein, 26 aa, Mycobacterium
LAAWQRAWDLKVWGYLELSQLALKAM

SEQ ID NO: 686337 - protein, 18 aa, Mycobacterium
LAAWSLVHGFAMLWLNEA

SEQ ID NO: 686338 - protein, 19 aa, Mycobacterium
LAAYEQWLSVKLMGDPAIA

SEQ ID NO: 686339 - protein, 18 aa, Mycobacterium
LAAYLSVAWELSPQSYLY

SEQ ID NO: 686340 - protein, 17 aa, Mycobacterium
LAAYPGHIAAMFGLVLG

SEQ ID NO: 686341 - protein, 24 aa, Mycobacterium
LAAYPGHIARMFSLVFGGDSTDHA

SEQ ID NO: 686342 - protein, 23 aa, Mycobacterium
LAAYPGHIARMFSLVYGDTPEDR

SEQ ID NO: 686343 - protein, 26 aa, Mycobacterium
LAAYPTFTFREGCVVRGAPTAGGSVL

SEQ ID NO: 686344 - protein, 18 aa, Mycobacterium
LAAYRALGLTGWTYDRIE

SEQ ID NO: 686345 - protein, 26 aa, Mycobacterium
LAAYRRAGGLPGMSLGWGLWEQSSTM

SEQ ID NO: 686346 - protein, 18 aa, Mycobacterium
LACAKLGAIAVMADGNLP

SEQ ID NO: 686347 - protein, 19 aa, Mycobacterium
LACALVCHPTLLVLDEPTV

SEQ ID NO: 686348 - protein, 26 aa, Mycobacterium
LACARLGAVHSVVFGGFAPHELAVRI

SEQ ID NO: 686349 - protein, 17 aa, Mycobacterium
LACAVLRRSDHRETYDA

SEQ ID NO: 686350 - protein, 17 aa, Mycobacterium
LACDIVIAGESGQFGLP

SEQ ID NO: 686351 - protein, 18 aa, Mycobacterium
LACDLIYAADTAFFLLAF

SEQ ID NO: 686352 - protein, 18 aa, Mycobacterium
LACDLVLASESAYFLLAF

SEQ ID NO: 686353 - protein, 17 aa, Mycobacterium
LACDVRIAAHNAYFRAA

SEQ ID NO: 686354 - protein, 18 aa, Mycobacterium
LACGCANADCPAAADGDA

SEQ ID NO: 686355 - protein, 18 aa, Mycobacterium
LACGELIATVALPPHAPR

SEQ ID NO: 686356 - protein, 19 aa, Mycobacterium
LACGTGLAAVWLALRGLEV

SEQ ID NO: 686357 - protein, 20 aa, Mycobacterium
LACIPRATTDLVYVRMHGPD

SEQ ID NO: 686358 - protein, 24 aa, Mycobacterium
LACKGCRSDCPVNVDMATYKAEFL

SEQ ID NO: 686359 - protein, 18 aa, Mycobacterium
LACLCRKHHLLKTFWGWR

SEQ ID NO: 686360 - protein, 18 aa, Mycobacterium
LACPGLLGSMTVGAPTVF

SEQ ID NO: 686361 - protein, 24 aa, Mycobacterium
LACQHPCLVPAPLNTQVLAGYARQ

SEQ ID NO: 686362 - protein, 20 aa, Mycobacterium
LACSGLRFAYDGLIPLPDGA

SEQ ID NO: 686363 - protein, 27 aa, Mycobacterium
LACSPWLDTEWRLVADDVRVIVALGGF

SEQ ID NO: 686364 - protein, 24 aa, Mycobacterium
LACTFPVLSTKASMGLPESGLGLI

SEQ ID NO: 686365 - protein, 20 aa, Mycobacterium
LACTYDFEVAAAKYLHALRD

SEQ ID NO: 686366 - protein, 17 aa, Mycobacterium
LACVLQCNGARFDVVSI

SEQ ID NO: 686367 - protein, 25 aa, Mycobacterium
LACVPHNYMIGAFVYGDLAGEHAAS

SEQ ID NO: 686368 - protein, 24 aa, Mycobacterium
LACWGADGQLHYKGRVDDQVKIRG

SEQ ID NO: 686369 - protein, 18 aa, Mycobacterium
LACYVLDPRLTGSSGDRR

SEQ ID NO: 686370 - protein, 38 aa, Mycobacterium
LADAADWVVWAGSLPAGFAPARLAAAVDEARAAGRRVA

SEQ ID NO: 686371 - protein, 20 aa, Mycobacterium
LADAAIWPRVLVAAAELAMT

SEQ ID NO: 686372 - protein, 25 aa, Mycobacterium
LADACRDAGVWGCFSIMERNRGGAP

SEQ ID NO: 686373 - protein, 22 aa, Mycobacterium
LADAEVDCIVWNGTAGSWLGLE

SEQ ID NO: 686374 - protein, 25 aa, Mycobacterium
LADAFKLAALNAWEDGPISTFFATD

SEQ ID NO: 686375 - protein, 23 aa, Mycobacterium
LADAGGEVQLWARRADVANQIND

SEQ ID NO: 686376 - protein, 17 aa, Mycobacterium
LADAGGFVVAYPDGLDR

SEQ ID NO: 686377 - protein, 30 aa, Mycobacterium
LADAGLIAPHWPRPWGVEATQLQLLIIDEE

SEQ ID NO: 686378 - protein, 19 aa, Mycobacterium
LADAGQRLQDGLSAVDLSV

SEQ ID NO: 686379 - protein, 17 aa, Mycobacterium
LADAGWQGPSSAAMAAA

SEQ ID NO: 686380 - protein, 26 aa, Mycobacterium
LADAGYLVSRRGRYGGTFLADALPAP

SEQ ID NO: 686381 - protein, 25 aa, Mycobacterium
LADAGYLVSRRGRYGGTFLADELPS

SEQ ID NO: 686382 - protein, 21 aa, Mycobacterium
LADAHAVFRRWLGDDYDTDAV

SEQ ID NO: 686383 - protein, 21 aa, Mycobacterium
LADAIDRPVVWTTSALLGQHP

SEQ ID NO: 686384 - protein, 18 aa, Mycobacterium
LADAIRRSGLPKIPTSVL

SEQ ID NO: 686385 - protein, 20 aa, Mycobacterium
LADAIRRSGLPKVPTSVLSR

SEQ ID NO: 686386 - protein, 17 aa, Mycobacterium
LADAIRSGHVRGAGLDV

SEQ ID NO: 686387 - protein, 18 aa, Mycobacterium
LADALALIAEHGYTAVAL

SEQ ID NO: 686388 - protein, 17 aa, Mycobacterium
LADALGVLPVLATDVLR

SEQ ID NO: 686389 - protein, 17 aa, Mycobacterium
LADALRYPVKLIDEYPW

SEQ ID NO: 686390 - protein, 24 aa, Mycobacterium
LADALSRRGVGFGDRVLILMLNRP

SEQ ID NO: 686391 - protein, 29 aa, Mycobacterium
LADALSRRGVGFGDRVMILMLNRTEFVES

SEQ ID NO: 686392 - protein, 19 aa, Mycobacterium
LADAMLRPYFEAYTIVADV

SEQ ID NO: 686393 - protein, 20 aa, Mycobacterium
LADAMPYAPGVYLFRGPSGE

SEQ ID NO: 686394 - protein, 27 aa, Mycobacterium
LADAMQIRWAPPFEMRSGFVRPDGSAD

SEQ ID NO: 686395 - protein, 24 aa, Mycobacterium
LADARATHPLLWKCGSPQRSADYA

SEQ ID NO: 686396 - protein, 24 aa, Mycobacterium
LADARLTAAGLRWYEVSNWARPGG

SEQ ID NO: 686397 - protein, 24 aa, Mycobacterium
LADATRVRVLWALTAGELSVNELA

SEQ ID NO: 686398 - protein, 17 aa, Mycobacterium
LADAVAVVAARATVVGR

SEQ ID NO: 686399 - protein, 29 aa, Mycobacterium
LADAWLRMAARPTGIWAPECAYAPGLEHD

SEQ ID NO: 686400 - protein, 18 aa, Mycobacterium
LADAYRRAGLSPGVVQYV

SEQ ID NO: 686401 - protein, 23 aa, Mycobacterium
LADCGAEVIMVEPLDGSPLRELA

SEQ ID NO: 686402 - protein, 23 aa, Mycobacterium
LADDEWPHLFLPFREGAAQESDL

SEQ ID NO: 686403 - protein, 24 aa, Mycobacterium
LADDLKWAAGISPILGTSLRGNPR

SEQ ID NO: 686404 - protein, 21 aa, Mycobacterium
LADDPGRHLLLLTGTPHSGDD

SEQ ID NO: 686405 - protein, 17 aa, Mycobacterium
LADEAWVAVRALAPRKG

SEQ ID NO: 686406 - protein, 18 aa, Mycobacterium
LADEGIKGLTHLKVDRTA

SEQ ID NO: 686407 - protein, 25 aa, Mycobacterium
LADEIKRVAERFVRAPELVGTFTVL

SEQ ID NO: 686408 - protein, 19 aa, Mycobacterium
LADEIREFLIHKVAATGGH

SEQ ID NO: 686409 - protein, 17 aa, Mycobacterium
LADEIRRKIPISFAPTA

SEQ ID NO: 686410 - protein, 20 aa, Mycobacterium
LADEIRVIADLAGEQARSAQ

SEQ ID NO: 686411 - protein, 17 aa, Mycobacterium
LADELGAAADSFASVTS

SEQ ID NO: 686412 - protein, 17 aa, Mycobacterium
LADELGIAARVTFLPPQ

SEQ ID NO: 686413 - protein, 17 aa, Mycobacterium
LADEMGLQWDVRDAEVA

SEQ ID NO: 686414 - protein, 23 aa, Mycobacterium
LADERGIPWDLIRGADSAEATPR

SEQ ID NO: 686415 - protein, 19 aa, Mycobacterium
LADERIELLAGEGTAVIKR

SEQ ID NO: 686416 - protein, 18 aa, Mycobacterium
LADETWISVPEGFPVDDV

SEQ ID NO: 686417 - protein, 19 aa, Mycobacterium
LADEWLKWNGQRPFVGTLT

SEQ ID NO: 686418 - protein, 18 aa, Mycobacterium
LADFPKPFLCAVNGVGVG

SEQ ID NO: 686419 - protein, 18 aa, Mycobacterium
LADFVERSPFAQAFRDAG

SEQ ID NO: 686420 - protein, 18 aa, Mycobacterium
LADFYARDATYGWNIGPK

SEQ ID NO: 686421 - protein, 21 aa, Mycobacterium
LADGARRWWTVAGRHDPDDVR

SEQ ID NO: 686422 - protein, 18 aa, Mycobacterium
LADGCAALGIPVTGGNVS

SEQ ID NO: 686423 - protein, 18 aa, Mycobacterium
LADGCVALGIPVTGGNVS

SEQ ID NO: 686424 - protein, 24 aa, Mycobacterium
LADGLPHRPGIYVFRGPSGEVLYV

SEQ ID NO: 686425 - protein, 23 aa, Mycobacterium
LADGRFAIYSKFHHALLDGASAL

SEQ ID NO: 686426 - protein, 17 aa, Mycobacterium
LADGRFALIGKVHHALA

SEQ ID NO: 686427 - protein, 23 aa, Mycobacterium
LADGRHWDLLSGRPVTGDDRGDL

SEQ ID NO: 686428 - protein, 23 aa, Mycobacterium
LADGRHWDLLSGRPVTGGDRAEL

SEQ ID NO: 686429 - protein, 24 aa, Mycobacterium
LADGRLVVLIKFSHAITDGVGAVT

SEQ ID NO: 686430 - protein, 18 aa, Mycobacterium
LADGRRVYTMSIGSHGLM

SEQ ID NO: 686431 - protein, 24 aa, Mycobacterium
LADGSRGGVVWIHHMPGYDRETKE

SEQ ID NO: 686432 - protein, 19 aa, Mycobacterium
LADGVALRIGDERAAHQRE

SEQ ID NO: 686433 - protein, 19 aa, Mycobacterium
LADGYIDVKGLRLTLTQAA

SEQ ID NO: 686434 - protein, 23 aa, Mycobacterium
LADHAVGGVVLFPGAGFVELAIR

SEQ ID NO: 686435 - protein, 20 aa, Mycobacterium
LADHAVSGVVVFPGTGFVEL

SEQ ID NO: 686436 - protein, 18 aa, Mycobacterium
LADHIACRFAGRGEPSDD

SEQ ID NO: 686437 - protein, 17 aa, Mycobacterium
LADHIVHGLPVMPGAGF

SEQ ID NO: 686438 - protein, 19 aa, Mycobacterium
LADHVRPFGVPFIHIPVTR

SEQ ID NO: 686439 - protein, 18 aa, Mycobacterium
LADIDRLSALVCAENGKS

SEQ ID NO: 686440 - protein, 20 aa, Mycobacterium
LADKALRLAVAKGIDRRTIA

SEQ ID NO: 686441 - protein, 20 aa, Mycobacterium
LADKQGIQWMLVDSEVDLRA

SEQ ID NO: 686442 - protein, 18 aa, Mycobacterium
LADLAALVNSLSASRGLR

SEQ ID NO: 686443 - protein, 17 aa, Mycobacterium
LADLAKPSRPFGIGLVH

SEQ ID NO: 686444 - protein, 23 aa, Mycobacterium
LADLALSCALWVGMGRVLRTLDI

SEQ ID NO: 686445 - protein, 17 aa, Mycobacterium
LADLAQLVVTINLGVAM

SEQ ID NO: 686446 - protein, 26 aa, Mycobacterium
LADLELGFAAARKFGADANDSGADPQ

SEQ ID NO: 686447 - protein, 25 aa, Mycobacterium
LADLELGFAAARRFSEFSGESQAVA

SEQ ID NO: 686448 - protein, 24 aa, Mycobacterium
LADLERRVAEFLGFTEVFTSVGQV

SEQ ID NO: 686449 - protein, 25 aa, Mycobacterium
LADLERRVAGFLGFTDMFTSVGQVY

SEQ ID NO: 686450 - protein, 25 aa, Mycobacterium
LADLERRVAQFLGFATVLTSVGQVY

SEQ ID NO: 686451 - protein, 21 aa, Mycobacterium
LADLFCRPNGVPKLPATAELA

SEQ ID NO: 686452 - protein, 19 aa, Mycobacterium
LADLFGGLIGSAAEGLPEA

SEQ ID NO: 686453 - protein, 24 aa, Mycobacterium
LADLFLPRPLRWLVSATRPAGIRR

SEQ ID NO: 686454 - protein, 18 aa, Mycobacterium
LADLGFLPTVTRILAATP

SEQ ID NO: 686455 - protein, 26 aa, Mycobacterium
LADLGITCLWLMPFYPTARKDDGYDI

SEQ ID NO: 686456 - protein, 17 aa, Mycobacterium
LADLIVLAGSAAVEKAA

SEQ ID NO: 686457 - protein, 25 aa, Mycobacterium
LADLLPGCTGLRVVESVHGHDAFLI

SEQ ID NO: 686458 - protein, 22 aa, Mycobacterium
LADLRKGDIITITHGRRGGLAV

SEQ ID NO: 686459 - protein, 22 aa, Mycobacterium
LADLRPAAPEVAYYSATLWDPR

SEQ ID NO: 686460 - protein, 17 aa, Mycobacterium
LADMAPRPDGVTLNVTS

SEQ ID NO: 686461 - protein, 33 aa, Mycobacterium
LADMKCRIDAARLLVWRAGWMARNNQSFDSAEG

SEQ ID NO: 686462 - protein, 18 aa, Mycobacterium
LADMSLRPLASAIGSSPR

SEQ ID NO: 686463 - protein, 26 aa, Mycobacterium
LADNSRTAADFGIRTRFDGVDMTAVH

SEQ ID NO: 686464 - protein, 19 aa, Mycobacterium
LADPAHCRAVIDRAVEEFG

SEQ ID NO: 686465 - protein, 19 aa, Mycobacterium
LADPAIVQWTVGRVRKAAE

SEQ ID NO: 686466 - protein, 17 aa, Mycobacterium
LADPALLIRALVARGVI

SEQ ID NO: 686467 - protein, 17 aa, Mycobacterium
LADPATFVIQGLATVHD

SEQ ID NO: 686468 - protein, 24 aa, Mycobacterium
LADPKGRDALRCIRCSACLNVCPV

SEQ ID NO: 686469 - protein, 23 aa, Mycobacterium
LADPKLRLDAIIVEASGLADPVA

SEQ ID NO: 686470 - protein, 18 aa, Mycobacterium
LADPKWQGFPMLPTPELR

SEQ ID NO: 686471 - protein, 25 aa, Mycobacterium
LADPLRWLTIADRYGVTNTWAPNFA

SEQ ID NO: 686472 - protein, 18 aa, Mycobacterium
LADPRATMDAVWDDVVDR

SEQ ID NO: 686473 - protein, 18 aa, Mycobacterium
LADPRLAGIHFTGSTRTF

SEQ ID NO: 686474 - protein, 23 aa, Mycobacterium
LADPRYGDARARAVNAVPLIAAL

SEQ ID NO: 686475 - protein, 19 aa, Mycobacterium
LADQFGVSRIPVRDAMQTL

SEQ ID NO: 686476 - protein, 19 aa, Mycobacterium
LADRAEVQVAYAIGKAAPV

SEQ ID NO: 686477 - protein, 18 aa, Mycobacterium
LADRAKLNLWAAANHMRA

SEQ ID NO: 686478 - protein, 23 aa, Mycobacterium
LADRAVAAPVFLQRSPHFRPPED

SEQ ID NO: 686479 - protein, 20 aa, Mycobacterium
LADRAVEVAALIASHSPLGA

SEQ ID NO: 686480 - protein, 19 aa, Mycobacterium
LADRGFCYGYHADLDLVGH

SEQ ID NO: 686481 - protein, 17 aa, Mycobacterium
LADRGRIAVGYKADLNV

SEQ ID NO: 686482 - protein, 20 aa, Mycobacterium
LADRLGFIEGASWAESSVGT

SEQ ID NO: 686483 - protein, 19 aa, Mycobacterium
LADRLGLCADERDCAYYTT

SEQ ID NO: 686484 - protein, 22 aa, Mycobacterium
LADRLIPHRAWILIYQLYLWDM

SEQ ID NO: 686485 - protein, 20 aa, Mycobacterium
LADRLNLAISALREEAEAEN

SEQ ID NO: 686486 - protein, 27 aa, Mycobacterium
LADRLNRWRRLGCWVSGHGEGWALYAE

SEQ ID NO: 686487 - protein, 22 aa, Mycobacterium
LADRLPGYMVPAAVVAVDAIPL

SEQ ID NO: 686488 - protein, 19 aa, Mycobacterium
LADRRFGRRRGFGYDLMTA

SEQ ID NO: 686489 - protein, 17 aa, Mycobacterium
LADRVDRARAIVFTAER

SEQ ID NO: 686490 - protein, 18 aa, Mycobacterium
LADSAAELPTPWPREVLD

SEQ ID NO: 686491 - protein, 30 aa, Mycobacterium
LADSACRYLRRWHRRRALWAGVAIGGTVDG

SEQ ID NO: 686492 - protein, 26 aa, Mycobacterium
LADSALYCGPLMRHFGWIFERNPDLI

SEQ ID NO: 686493 - protein, 20 aa, Mycobacterium
LADSPALWLGDRGKNLAYFG

SEQ ID NO: 686494 - protein, 20 aa, Mycobacterium
LADSVPIFGVNVLLSTATEM

SEQ ID NO: 686495 - protein, 21 aa, Mycobacterium
LADSVPWVVGYSGGKDSTAVL

SEQ ID NO: 686496 - protein, 28 aa, Mycobacterium
LADSWRMAAKALRPLPVAHKEMSEESRV

SEQ ID NO: 686497 - protein, 17 aa, Mycobacterium
LADSWRMAAKSLRPLPV

SEQ ID NO: 686498 - protein, 19 aa, Mycobacterium
LADTWRDRFEQMLQRAEAR

SEQ ID NO: 686499 - protein, 18 aa, Mycobacterium
LADVAWAPTFAYVDQQAA

SEQ ID NO: 686500 - protein, 17 aa, Mycobacterium
LADVAWQQPGIVFFRYV

SEQ ID NO: 686501 - protein, 33 aa, Mycobacterium
LADVLRPDVLLTRLVRRDGLLHFSTEVSWQRAV

SEQ ID NO: 686502 - protein, 25 aa, Mycobacterium
LADVQRLAAMLIERDGRIWLERGCP

SEQ ID NO: 686503 - protein, 23 aa, Mycobacterium
LAEAAELLALVAGQDVEAGEDGV

SEQ ID NO: 686504 - protein, 20 aa, Mycobacterium
LAEAALKMMAKNMSAELTTA

SEQ ID NO: 686505 - protein, 23 aa, Mycobacterium
LAEAARQGFNIALVPPGCEAVPA

SEQ ID NO: 686506 - protein, 18 aa, Mycobacterium
LAEAEGWQAVTTRRLSAE

SEQ ID NO: 686507 - protein, 18 aa, Mycobacterium
LAEAFVHRTGHGIGLSVH

SEQ ID NO: 686508 - protein, 17 aa, Mycobacterium
LAEAGGWEAEYPRDVWR

SEQ ID NO: 686509 - protein, 22 aa, Mycobacterium
LAEAGHLVRFWALPAGPDGPRM

SEQ ID NO: 686510 - protein, 23 aa, Mycobacterium
LAEAGLRQTHWWTDPAGDFGLSL

SEQ ID NO: 686511 - protein, 21 aa, Mycobacterium
LAEAGVDMLVIDTAHGHQLKA

SEQ ID NO: 686512 - protein, 17 aa, Mycobacterium
LAEAHARTLRVAAERER

SEQ ID NO: 686513 - protein, 25 aa, Mycobacterium
LAEAIDRFGPIFAQYYGQSEAPMVI

SEQ ID NO: 686514 - protein, 25 aa, Mycobacterium
LAEAIERFGPIFAQYFGQSEAPMVI

SEQ ID NO: 686515 - protein, 21 aa, Mycobacterium
LAEAIRLGERLGVPESTLLSA

SEQ ID NO: 686516 - protein, 17 aa, Mycobacterium
LAEALAVVSDVSRELTA

SEQ ID NO: 686517 - protein, 18 aa, Mycobacterium
LAEALGIERAELTAHRSP

SEQ ID NO: 686518 - protein, 17 aa, Mycobacterium
LAEALGLPVSMASHVDA

SEQ ID NO: 686519 - protein, 18 aa, Mycobacterium
LAEALNLVAVRPQLRAVT

SEQ ID NO: 686520 - protein, 22 aa, Mycobacterium
LAEALRRSRIDTVFVTTALFNT

SEQ ID NO: 686521 - protein, 17 aa, Mycobacterium
LAEALVCAAARETFEES

SEQ ID NO: 686522 - protein, 18 aa, Mycobacterium
LAEALVCAAARETFEESG

SEQ ID NO: 686523 - protein, 20 aa, Mycobacterium
LAEANCLVIVPADVEEVRTG

SEQ ID NO: 686524 - protein, 22 aa, Mycobacterium
LAEANCLVIVPAEVEQVRTGEI

SEQ ID NO: 686525 - protein, 31 aa, Mycobacterium
LAEAPSTIAGRWLVGAIHYKAQRWPEVISSL

SEQ ID NO: 686526 - protein, 25 aa, Mycobacterium
LAEARKGGGAAPVYEAPKPEKKPEP

SEQ ID NO: 686527 - protein, 22 aa, Mycobacterium
LAEATGAFHLRVVQLSGNATLS

SEQ ID NO: 686528 - protein, 19 aa, Mycobacterium
LAEATGLPKSSVHRIVQEL

SEQ ID NO: 686529 - protein, 19 aa, Mycobacterium
LAEAVAFYSKLFDTEPAKL

SEQ ID NO: 686530 - protein, 18 aa, Mycobacterium
LAEAVGGTVGRYSPYAVY

SEQ ID NO: 686531 - protein, 17 aa, Mycobacterium
LAEAVLAVTGVADRRFN

SEQ ID NO: 686532 - protein, 23 aa, Mycobacterium
LAEAVSEFAARRWDWDDLEVGRT

SEQ ID NO: 686533 - protein, 17 aa, Mycobacterium
LAEAVYWALDNHEADEE

SEQ ID NO: 686534 - protein, 20 aa, Mycobacterium
LAECARRLLETSAVLGFAVD

SEQ ID NO: 686535 - protein, 25 aa, Mycobacterium
LAECKAEVLAGKALIDYCTGRYLDG

SEQ ID NO: 686536 - protein, 22 aa, Mycobacterium
LAECSTAIDVQRVVAISWPNGE

SEQ ID NO: 686537 - protein, 25 aa, Mycobacterium
LAEDLRFATAEARRANRAELSAVLA

SEQ ID NO: 686538 - protein, 18 aa, Mycobacterium
LAEDRGWPVGAEYVDNDV

SEQ ID NO: 686539 - protein, 26 aa, Mycobacterium
LAEEARREAIPNIARLLGAARAAGVA

SEQ ID NO: 686540 - protein, 25 aa, Mycobacterium
LAEEGRYAIPQVRFGVAPDALAHWT

SEQ ID NO: 686541 - protein, 19 aa, Mycobacterium
LAEELGIPRRLLPRLRPAG

SEQ ID NO: 686542 - protein, 25 aa, Mycobacterium
LAEELGVPCARDVFRFYRSDAAAAI

SEQ ID NO: 686543 - protein, 23 aa, Mycobacterium
LAEELKPDLVIMDVKMPRRDGID

SEQ ID NO: 686544 - protein, 25 aa, Mycobacterium
LAEELWKRLGHEGSLAHGPFPLADE

SEQ ID NO: 686545 - protein, 20 aa, Mycobacterium
LAEERRLLIAAMGRARSRVL

SEQ ID NO: 686546 - protein, 21 aa, Mycobacterium
LAEERRLLVAAMGRARRRLLV

SEQ ID NO: 686547 - protein, 19 aa, Mycobacterium
LAEESARLFVSEEAREGML

SEQ ID NO: 686548 - protein, 20 aa, Mycobacterium
LAEESARLFVSEEAREGMLA

SEQ ID NO: 686549 - protein, 25 aa, Mycobacterium
LAEFDRGGADIVLLDLMLPGMSGTD

SEQ ID NO: 686550 - protein, 25 aa, Mycobacterium
LAEFDRSGADIVLLDLMLPGMSGTD

SEQ ID NO: 686551 - protein, 18 aa, Mycobacterium
LAEFGVELIVNCSGLGAR

SEQ ID NO: 686552 - protein, 23 aa, Mycobacterium
LAEFSNDSVTAWSTRGPDDSSDE

SEQ ID NO: 686553 - protein, 17 aa, Mycobacterium
LAEGAIAPWSMGNTADY

SEQ ID NO: 686554 - protein, 17 aa, Mycobacterium
LAEGGALGSVIFTGLVG

SEQ ID NO: 686555 - protein, 17 aa, Mycobacterium
LAEGISPALQRADNDAF

SEQ ID NO: 686556 - protein, 18 aa, Mycobacterium
LAEGISWMATPEDLERAR

SEQ ID NO: 686557 - protein, 21 aa, Mycobacterium
LAEGLFQERLRACGADLVTPP

SEQ ID NO: 686558 - protein, 21 aa, Mycobacterium
LAEGLFQERLRACGADVVTPP

SEQ ID NO: 686559 - protein, 17 aa, Mycobacterium
LAEGLRLREHRERIYDL

SEQ ID NO: 686560 - protein, 19 aa, Mycobacterium
LAEGLRVVARVSSLCAQMS

SEQ ID NO: 686561 - protein, 23 aa, Mycobacterium
LAEGLTKAAALMEGHEADSSHAF

SEQ ID NO: 686562 - protein, 23 aa, Mycobacterium
LAEGSRGGIVWIHHMPGYDRETK

SEQ ID NO: 686563 - protein, 24 aa, Mycobacterium
LAEGTPLRSYRVADFAALADAMQA

SEQ ID NO: 686564 - protein, 18 aa, Mycobacterium
LAEHACAVMVPKAHSADH

SEQ ID NO: 686565 - protein, 26 aa, Mycobacterium
LAEHAGRRLIGFSAELGGKNAMIVTR

SEQ ID NO: 686566 - protein, 26 aa, Mycobacterium
LAEHCGRRLIGFSAELGGKNAMIVTR

SEQ ID NO: 686567 - protein, 19 aa, Mycobacterium
LAEHEMPGLMELRREYHDV

SEQ ID NO: 686568 - protein, 17 aa, Mycobacterium
LAEHHFVAVASTVPALV

SEQ ID NO: 686569 - protein, 25 aa, Mycobacterium
LAEHIKRIGVDLVDVSSGGSAPDAA

SEQ ID NO: 686570 - protein, 19 aa, Mycobacterium
LAEHLPAYMVPATVLAVDA

SEQ ID NO: 686571 - protein, 17 aa, Mycobacterium
LAEIGWTVVRVTIEDTP

SEQ ID NO: 686572 - protein, 18 aa, Mycobacterium
LAEIIAHCETLVAFLQSI

SEQ ID NO: 686573 - protein, 17 aa, Mycobacterium
LAEIIRLGIALGAKGAT

SEQ ID NO: 686574 - protein, 22 aa, Mycobacterium
LAEIKVELELAKLMMQKAATLY

SEQ ID NO: 686575 - protein, 26 aa, Mycobacterium
LAEILKIALIKSGALFDVLETSGRDV

SEQ ID NO: 686576 - protein, 21 aa, Mycobacterium
LAEIYARILGLARVGVDESFF

SEQ ID NO: 686577 - protein, 17 aa, Mycobacterium
LAEKAHCPVAVIRSNSD

SEQ ID NO: 686578 - protein, 23 aa, Mycobacterium
LAEKDLKLALALGDETGVDLPLA

SEQ ID NO: 686579 - protein, 27 aa, Mycobacterium
LAEKMPRRFYCRARWHRSALDSETQVF

SEQ ID NO: 686580 - protein, 18 aa, Mycobacterium
LAEKNRWRRPASENRGYS

SEQ ID NO: 686581 - protein, 17 aa, Mycobacterium
LAELAVEYSTRYGGTLA

SEQ ID NO: 686582 - protein, 17 aa, Mycobacterium
LAELERLAVDHGAHTIR

SEQ ID NO: 686583 - protein, 25 aa, Mycobacterium
LAELERRIAQFLGFATVLTSVGQVY

SEQ ID NO: 686584 - protein, 27 aa, Mycobacterium
LAELGALPRDEWPSAIRRLVSGQISLL

SEQ ID NO: 686585 - protein, 26 aa, Mycobacterium
LAELGVRVALDWDRGVELISPIPDST

SEQ ID NO: 686586 - protein, 29 aa, Mycobacterium
LAELKEWRLRVSKEMKVPAYVVFTDTTLM

SEQ ID NO: 686587 - protein, 18 aa, Mycobacterium
LAELKLLPQEEWAGRLRR

SEQ ID NO: 686588 - protein, 19 aa, Mycobacterium
LAELLPSLRRGGVAAVSPI

SEQ ID NO: 686589 - protein, 27 aa, Mycobacterium
LAELLSIRAGDPFRALNPLSWASAAKA

SEQ ID NO: 686590 - protein, 22 aa, Mycobacterium
LAELLVALLYSGRIDLKNDAPA

SEQ ID NO: 686591 - protein, 24 aa, Mycobacterium
LAELMPRMRSGGVAAVSELGILGD

SEQ ID NO: 686592 - protein, 29 aa, Mycobacterium
LAELPGYRGWQWAVVVAACPGAGRATISE

SEQ ID NO: 686593 - protein, 24 aa, Mycobacterium
LAELRAGIDSGIERFGDVDIVVAN

SEQ ID NO: 686594 - protein, 21 aa, Mycobacterium
LAELREKLELAKEPGGEKAAA

SEQ ID NO: 686595 - protein, 21 aa, Mycobacterium
LAELREKLELAKEPGGEKAVA

SEQ ID NO: 686596 - protein, 22 aa, Mycobacterium
LAELRERLELAKEPGGEKAAAK

SEQ ID NO: 686597 - protein, 24 aa, Mycobacterium
LAELRHALPGALFVSAHTGDGIDV

SEQ ID NO: 686598 - protein, 25 aa, Mycobacterium
LAELRKSEPIHWVDVPGGTGGFGDK

SEQ ID NO: 686599 - protein, 20 aa, Mycobacterium
LAELRRRIEVPIAADEAIRK

SEQ ID NO: 686600 - protein, 21 aa, Mycobacterium
LAELRTTIFGEIKSRTKETDL

SEQ ID NO: 686601 - protein, 18 aa, Mycobacterium
LAELSALVIPRPKRKTRT

SEQ ID NO: 686602 - protein, 24 aa, Mycobacterium
LAELSEAGVAVWLDDLSRDRLNSG

SEQ ID NO: 686603 - protein, 18 aa, Mycobacterium
LAELSRRITATGVTGVTD

SEQ ID NO: 686604 - protein, 18 aa, Mycobacterium
LAELTMLILWKSRKKNPE

SEQ ID NO: 686605 - protein, 26 aa, Mycobacterium
LAELTPRSAFRDGPVRFVGSTRGAEL

SEQ ID NO: 686606 - protein, 26 aa, Mycobacterium
LAELVRRLAVVHGRVTLSSGKEADYY

SEQ ID NO: 686607 - protein, 18 aa, Mycobacterium
LAELWDRKSVSEIHVTMA

SEQ ID NO: 686608 - protein, 24 aa, Mycobacterium
LAELWFDALAGICAHVRGGGGGLT

SEQ ID NO: 686609 - protein, 17 aa, Mycobacterium
LAEMLRRYCEYMHANEP

SEQ ID NO: 686610 - protein, 18 aa, Mycobacterium
LAEMTMEGVYTRSGDWAY

SEQ ID NO: 686611 - protein, 24 aa, Mycobacterium
LAENPGGVMAWFCGPNHEVFAQSL

SEQ ID NO: 686612 - protein, 25 aa, Mycobacterium
LAEPDRFAVLHGDYRLDNMLFDPDR

SEQ ID NO: 686613 - protein, 18 aa, Mycobacterium
LAEPDRWDLGSVLAVANG

SEQ ID NO: 686614 - protein, 19 aa, Mycobacterium
LAEPFGATTMGLIYVNPEG

SEQ ID NO: 686615 - protein, 18 aa, Mycobacterium
LAEPGRWDLSSLLAVSNG

SEQ ID NO: 686616 - protein, 17 aa, Mycobacterium
LAEPLGAATGHLDEISA

SEQ ID NO: 686617 - protein, 19 aa, Mycobacterium
LAEPLGFDGIWFPEHHGTP

SEQ ID NO: 686618 - protein, 23 aa, Mycobacterium
LAEPPLLVPVLRAGLGMVDQALA

SEQ ID NO: 686619 - protein, 24 aa, Mycobacterium
LAEPRAVVAVDALTYPGIRMLATA

SEQ ID NO: 686620 - protein, 20 aa, Mycobacterium
LAEPRCFRMSDGSVGSDTLR

SEQ ID NO: 686621 - protein, 23 aa, Mycobacterium
LAEPRGYCAGVDRAVETVERALE

SEQ ID NO: 686622 - protein, 20 aa, Mycobacterium
LAEPRWEPGSAQGYHMTTFG

SEQ ID NO: 686623 - protein, 17 aa, Mycobacterium
LAEQAWQGPAAAAMTAA

SEQ ID NO: 686624 - protein, 26 aa, Mycobacterium
LAEQCGRRLIGFSAELGGKNPMIVTR

SEQ ID NO: 686625 - protein, 20 aa, Mycobacterium
LAEQLDWHWAHQLRPRLAGL

SEQ ID NO: 686626 - protein, 26 aa, Mycobacterium
LAEQLPRGLPELLLIAAEKQDEGLPG

SEQ ID NO: 686627 - protein, 22 aa, Mycobacterium
LAEQRLPVIASDRVYFVGQPVA

SEQ ID NO: 686628 - protein, 22 aa, Mycobacterium
LAEQRRLLGAALDRHSHFRQRL

SEQ ID NO: 686629 - protein, 21 aa, Mycobacterium
LAEQRRWLAPWFSRVPADTGR

SEQ ID NO: 686630 - protein, 17 aa, Mycobacterium
LAERALEVHGQYVAAAW

SEQ ID NO: 686631 - protein, 25 aa, Mycobacterium
LAERCAAAARGARGIAASSGDDIGA

SEQ ID NO: 686632 - protein, 26 aa, Mycobacterium
LAERFPKCVVSYACARDDAHSLRALR

SEQ ID NO: 686633 - protein, 20 aa, Mycobacterium
LAERGLRRILTEGGPILLGS

SEQ ID NO: 686634 - protein, 17 aa, Mycobacterium
LAERGVLVGERTSYCCH

SEQ ID NO: 686635 - protein, 17 aa, Mycobacterium
LAERIVRGDVKADALVG

SEQ ID NO: 686636 - protein, 21 aa, Mycobacterium
LAERLAGWQGRYRDVDIHRRI

SEQ ID NO: 686637 - protein, 18 aa, Mycobacterium
LAERPSYAWYSESTHAVG

SEQ ID NO: 686638 - protein, 25 aa, Mycobacterium
LAERQGIEILGPVGVAARTSKSVAE

SEQ ID NO: 686639 - protein, 27 aa, Mycobacterium
LAERQRLYGVSYWTVIDAWAGRESAMP

SEQ ID NO: 686640 - protein, 21 aa, Mycobacterium
LAERTGLPVDEEWLAVRGYRQ

SEQ ID NO: 686641 - protein, 22 aa, Mycobacterium
LAESCRAQLGATLRKLDKAVRK

SEQ ID NO: 686642 - protein, 25 aa, Mycobacterium
LAESGLLAPHWPKPYGRNASPAEQL

SEQ ID NO: 686643 - protein, 23 aa, Mycobacterium
LAESIRLGARLGVPEPTLLSALA

SEQ ID NO: 686644 - protein, 21 aa, Mycobacterium
LAESLGYRRAWLYDSPAVITD

SEQ ID NO: 686645 - protein, 24 aa, Mycobacterium
LAESLRLHYYVPIHLVQRYLPGMR

SEQ ID NO: 686646 - protein, 26 aa, Mycobacterium
LAESRGLGCSICFAAQAGSQLDAIYG

SEQ ID NO: 686647 - protein, 25 aa, Mycobacterium
LAESRPLSRVRIWDGSTPWLITGYE

SEQ ID NO: 686648 - protein, 26 aa, Mycobacterium
LAESVAAWLLDRGRPAAVGLVGEPTV

SEQ ID NO: 686649 - protein, 17 aa, Mycobacterium
LAESYGFDSVWLCDHFL

SEQ ID NO: 686650 - protein, 20 aa, Mycobacterium
LAETAPIWWPGSPESAAPIT

SEQ ID NO: 686651 - protein, 25 aa, Mycobacterium
LAETERLKFLVAFRPGLMPPTLAAQ

SEQ ID NO: 686652 - protein, 18 aa, Mycobacterium
LAETERPAAVFLAVPENI

SEQ ID NO: 686653 - protein, 18 aa, Mycobacterium
LAETFTGAIPVPFGAGSD

SEQ ID NO: 686654 - protein, 25 aa, Mycobacterium
LAETPIRSIMAFQLFIADESLGALN

SEQ ID NO: 686655 - protein, 17 aa, Mycobacterium
LAETRMLERLAFPAMLR

SEQ ID NO: 686656 - protein, 24 aa, Mycobacterium
LAEVARPVVVIGLGLNVFEAPDGI

SEQ ID NO: 686657 - protein, 20 aa, Mycobacterium
LAEVCLTAGTGRSHFEHRAA

SEQ ID NO: 686658 - protein, 18 aa, Mycobacterium
LAEVDGWDNGWIAEQAGN

SEQ ID NO: 686659 - protein, 27 aa, Mycobacterium
LAEVGRKLLREWAIALGSDGAVFSEAF

SEQ ID NO: 686660 - protein, 22 aa, Mycobacterium
LAEVGRPDIMVVVGGVIPPGDF

SEQ ID NO: 686661 - protein, 21 aa, Mycobacterium
LAEVHPHWIVLRTVIDVIEPI

SEQ ID NO: 686662 - protein, 22 aa, Mycobacterium
LAEVPTCPGARVDALGAVEMLS

SEQ ID NO: 686663 - protein, 19 aa, Mycobacterium
LAEVQWAAAGYIVALEYDL

SEQ ID NO: 686664 - protein, 18 aa, Mycobacterium
LAEVVADLPPGRALDLGC

SEQ ID NO: 686665 - protein, 17 aa, Mycobacterium
LAEWDFEKNTTYPLLLH

SEQ ID NO: 686666 - protein, 18 aa, Mycobacterium
LAEWEWPERPKFLMCTPL

SEQ ID NO: 686667 - protein, 18 aa, Mycobacterium
LAEWLRRVPDYAIQTHAA

SEQ ID NO: 686668 - protein, 17 aa, Mycobacterium
LAEYALFGLLAGAKTLP

SEQ ID NO: 686669 - protein, 20 aa, Mycobacterium
LAEYRAAGGYVAHDDPATLL

SEQ ID NO: 686670 - protein, 17 aa, Mycobacterium
LAEYRIGAQEVRHPPEG

SEQ ID NO: 686671 - protein, 32 aa, Mycobacterium
LAEYSIDLFTLLPLGELWVAAARMRQVARLRH

SEQ ID NO: 686672 - protein, 18 aa, Mycobacterium
LAFAEFLGAGAAVPIGID

SEQ ID NO: 686673 - protein, 21 aa, Mycobacterium
LAFAESRIRPSTIAAEDLLHD

SEQ ID NO: 686674 - protein, 23 aa, Mycobacterium
LAFAGRLGTPVGHPAAELLAAKN

SEQ ID NO: 686675 - protein, 25 aa, Mycobacterium
LAFDRATTGFGWSRPGRSALAGNTI

SEQ ID NO: 686676 - protein, 19 aa, Mycobacterium
LAFEEMQYIIGHAGARILI

SEQ ID NO: 686677 - protein, 17 aa, Mycobacterium
LAFEYDLFFPPALCAEA

SEQ ID NO: 686678 - protein, 25 aa, Mycobacterium
LAFGNVRAGGAWRLPGVRNGPANQL

SEQ ID NO: 686679 - protein, 25 aa, Mycobacterium
LAFGTSRFSSKLVHGGLRYLASGQV

SEQ ID NO: 686680 - protein, 17 aa, Mycobacterium
LAFIGALGPWGPLATPE

SEQ ID NO: 686681 - protein, 27 aa, Mycobacterium
LAFLHPLPVRRLWGVGAKTAAKLQSHG

SEQ ID NO: 686682 - protein, 27 aa, Mycobacterium
LAFLHPLPVRRLWGVGAKTADKLHAHG

SEQ ID NO: 686683 - protein, 27 aa, Mycobacterium
LAFLHPLPVRRLWGVGAKTADKLRAHG

SEQ ID NO: 686684 - protein, 27 aa, Mycobacterium
LAFLHPLPVRRLWGVGAKTAEKLRAHG

SEQ ID NO: 686685 - protein, 25 aa, Mycobacterium
LAFLLEERRTWLLGGHATPIERLTM

SEQ ID NO: 686686 - protein, 17 aa, Mycobacterium
LAFNKWDLVDEDRRDLL

SEQ ID NO: 686687 - protein, 19 aa, Mycobacterium
LAFPAGSAVMPWRAAEECE

SEQ ID NO: 686688 - protein, 23 aa, Mycobacterium
LAFPLRRGLVWRRRASELRTETG

SEQ ID NO: 686689 - protein, 20 aa, Mycobacterium
LAFQCLEPFDTWTMSYDGPA

SEQ ID NO: 686690 - protein, 27 aa, Mycobacterium
LAFQEPRLFPWRDVRTNVGYGLTRSRL

SEQ ID NO: 686691 - protein, 27 aa, Mycobacterium
LAFQEPRLFPWRDVRTNVSYGLTRTRL

SEQ ID NO: 686692 - protein, 17 aa, Mycobacterium
LAFRAGWNYGETTEAFG

SEQ ID NO: 686693 - protein, 24 aa, Mycobacterium
LAFRIPDGTTFTWRATSQGIEAVA

SEQ ID NO: 686694 - protein, 21 aa, Mycobacterium
LAFSAGLNWNIERVRGASVVT

SEQ ID NO: 686695 - protein, 22 aa, Mycobacterium
LAFSDRRLFAVIVLTIRGARVT

SEQ ID NO: 686696 - protein, 17 aa, Mycobacterium
LAFWEIRSGQWGVEPGD

SEQ ID NO: 686697 - protein, 18 aa, Mycobacterium
LAFWGIVMAGGIAVAVNT

SEQ ID NO: 686698 - protein, 20 aa, Mycobacterium
LAGACAVSAFTAAVHAGQGC

SEQ ID NO: 686699 - protein, 21 aa, Mycobacterium
LAGADAVIWSRGPGIAQDAFT

SEQ ID NO: 686700 - protein, 27 aa, Mycobacterium
LAGAFLRAGAIDRILAYVAPILLGGPV

SEQ ID NO: 686701 - protein, 26 aa, Mycobacterium
LAGAFLRAGAVDRILAYVAPTLLGGP

SEQ ID NO: 686702 - protein, 27 aa, Mycobacterium
LAGAFLRAGVVNRILAYVAPILLGGPI

SEQ ID NO: 686703 - protein, 27 aa, Mycobacterium
LAGAFLRAGVVNRILVYVAPMLLGGPV

SEQ ID NO: 686704 - protein, 20 aa, Mycobacterium
LAGAGADVFMPVRNLRKGQA

SEQ ID NO: 686705 - protein, 40 aa, Mycobacterium
LAGAGFGRLRLPREFGGFGVDLPTLFALLAEAGQADSNLP

SEQ ID NO: 686706 - protein, 30 aa, Mycobacterium
LAGAGLAMRSIWHVAPYVREGRLVHVLPDV

SEQ ID NO: 686707 - protein, 19 aa, Mycobacterium
LAGAISSFLERVNVHPSGA

SEQ ID NO: 686708 - protein, 17 aa, Mycobacterium
LAGAIVHDATCSVGTEL

SEQ ID NO: 686709 - protein, 17 aa, Mycobacterium
LAGALLFETADEDSAGG

SEQ ID NO: 686710 - protein, 26 aa, Mycobacterium
LAGALRPGGWMVIEDYDWTAFGFEGS

SEQ ID NO: 686711 - protein, 28 aa, Mycobacterium
LAGALSRRGIGFGDRVMVLMLNRTEFVE

SEQ ID NO: 686712 - protein, 19 aa, Mycobacterium
LAGALSVPPSWAVASPAVK

SEQ ID NO: 686713 - protein, 29 aa, Mycobacterium
LAGALWRFLPDRVRVLDFPTGFHYDFRTP

SEQ ID NO: 686714 - protein, 20 aa, Mycobacterium
LAGAPLPAWLRDLAPTPSRP

SEQ ID NO: 686715 - protein, 25 aa, Mycobacterium
LAGARLTVPLGMIILRKGYGLGAMA

SEQ ID NO: 686716 - protein, 17 aa, Mycobacterium
LAGAVLIGRDRQMVADA

SEQ ID NO: 686717 - protein, 19 aa, Mycobacterium
LAGAWAAVRTFGWETRRLG

SEQ ID NO: 686718 - protein, 19 aa, Mycobacterium
LAGAWASVRTFGWETRRLG

SEQ ID NO: 686719 - protein, 19 aa, Mycobacterium
LAGCGYSMCESVDDLSLRA

SEQ ID NO: 686720 - protein, 18 aa, Mycobacterium
LAGCMALGITGPILRSTG

SEQ ID NO: 686721 - protein, 17 aa, Mycobacterium
LAGCNPVDLALASGEMG

SEQ ID NO: 686722 - protein, 26 aa, Mycobacterium
LAGCRGEVPLGMLIDLLAAHHGVDAN

SEQ ID NO: 686723 - protein, 17 aa, Mycobacterium
LAGDAWQGAASAAMTAA

SEQ ID NO: 686724 - protein, 22 aa, Mycobacterium
LAGDCARAILDAGVDIAVSASM

SEQ ID NO: 686725 - protein, 23 aa, Mycobacterium
LAGDDVARLFALVQVVADEHLAD

SEQ ID NO: 686726 - protein, 53 aa, Mycobacterium
LAGDEVSAAVTRMFGAYAQEFQTLSARMEQFHTDFVRALLTGAGAYSGAEAAN

SEQ ID NO: 686727 - protein, 24 aa, Mycobacterium
LAGDEWPHLFLPFRAGASQESELP

SEQ ID NO: 686728 - protein, 19 aa, Mycobacterium
LAGDLAFGSAAWRVAEAHG

SEQ ID NO: 686729 - protein, 22 aa, Mycobacterium
LAGDLRPVSGMDRRLAEAERLG

SEQ ID NO: 686730 - protein, 18 aa, Mycobacterium
LAGDLRRVSGMERRLGEA

SEQ ID NO: 686731 - protein, 18 aa, Mycobacterium
LAGDLRRVSGMERRLSEA

SEQ ID NO: 686732 - protein, 19 aa, Mycobacterium
LAGDLRRVTGMDKRLAEAA

SEQ ID NO: 686733 - protein, 23 aa, Mycobacterium
LAGDPRASIAIVAPAMVSNPSAT

SEQ ID NO: 686734 - protein, 18 aa, Mycobacterium
LAGDWLRAHVPPVDGVLC

SEQ ID NO: 686735 - protein, 18 aa, Mycobacterium
LAGEAAPYARTWSFITRA

SEQ ID NO: 686736 - protein, 18 aa, Mycobacterium
LAGEFAIGIIEGDIATDL

SEQ ID NO: 686737 - protein, 21 aa, Mycobacterium
LAGEIRSAFSMTEPAVASSDA

SEQ ID NO: 686738 - protein, 19 aa, Mycobacterium
LAGELAIGVIEGDIATDLD

SEQ ID NO: 686739 - protein, 17 aa, Mycobacterium
LAGELGYTPAQIALAAT

SEQ ID NO: 686740 - protein, 24 aa, Mycobacterium
LAGELPAVVLAKLLGFSIKRAVTW

SEQ ID NO: 686741 - protein, 17 aa, Mycobacterium
LAGELSPGIASAVVLVD

SEQ ID NO: 686742 - protein, 21 aa, Mycobacterium
LAGEPLPDWATRYQEVARSKN

SEQ ID NO: 686743 - protein, 17 aa, Mycobacterium
LAGEREVIFWDQLGCGN

SEQ ID NO: 686744 - protein, 21 aa, Mycobacterium
LAGETGCRVIIPEGADPFVFL

SEQ ID NO: 686745 - protein, 20 aa, Mycobacterium
LAGETGCRVVLPEGADPFVA

SEQ ID NO: 686746 - protein, 17 aa, Mycobacterium
LAGEWLRANVATVDAVL

SEQ ID NO: 686747 - protein, 18 aa, Mycobacterium
LAGFAARGSGSAPAPTTG

SEQ ID NO: 686748 - protein, 26 aa, Mycobacterium
LAGFADRVATEWAGPRSRVMRRSMRL

SEQ ID NO: 686749 - protein, 19 aa, Mycobacterium
LAGFDAWLARWQALRPDAD

SEQ ID NO: 686750 - protein, 19 aa, Mycobacterium
LAGFDAWLSRWRALRPDAD

SEQ ID NO: 686751 - protein, 31 aa, Mycobacterium
LAGFFRDATGHARFNLGLGNIGSGNVGSGNI

SEQ ID NO: 686752 - protein, 21 aa, Mycobacterium
LAGFGARLGERMNRANARSGT

SEQ ID NO: 686753 - protein, 20 aa, Mycobacterium
LAGFKCPRTVDFVDSLPRNA

SEQ ID NO: 686754 - protein, 25 aa, Mycobacterium
LAGFKCPRTVDFVSELPRNASGKIL

SEQ ID NO: 686755 - protein, 18 aa, Mycobacterium
LAGFPKPLICAVNGVGVG

SEQ ID NO: 686756 - protein, 24 aa, Mycobacterium
LAGFWRPYLEAARDTGEIHALTDI

SEQ ID NO: 686757 - protein, 17 aa, Mycobacterium
LAGGAAFGRDGRFARQL

SEQ ID NO: 686758 - protein, 17 aa, Mycobacterium
LAGGCFWGMQDLIRKQP

SEQ ID NO: 686759 - protein, 27 aa, Mycobacterium
LAGGFARYSVDAAWVVPHFEKMLYDNA

SEQ ID NO: 686760 - protein, 27 aa, Mycobacterium
LAGGFARYSVDKAWVVPHFEKMLYDNA

SEQ ID NO: 686761 - protein, 28 aa, Mycobacterium
LAGGFARYSVDNAWVVPHFEKMLYDNAL

SEQ ID NO: 686762 - protein, 26 aa, Mycobacterium
LAGGFARYSVDSSWVVPHFEKMLYDN

SEQ ID NO: 686763 - protein, 22 aa, Mycobacterium
LAGGFDGTAFWTRSGVGHALTP

SEQ ID NO: 686764 - protein, 19 aa, Mycobacterium
LAGGFYLQPTIFAGNNAMR

SEQ ID NO: 686765 - protein, 18 aa, Mycobacterium
LAGGGGRGMRKVECGDQI

SEQ ID NO: 686766 - protein, 20 aa, Mycobacterium
LAGGRTRLADAITVSAESDT

SEQ ID NO: 686767 - protein, 29 aa, Mycobacterium
LAGGTPQRAGWFRFYFTDQRWEWSDQVHR

SEQ ID NO: 686768 - protein, 18 aa, Mycobacterium
LAGGWIPPHVRLPAHVSL

SEQ ID NO: 686769 - protein, 18 aa, Mycobacterium
LAGGWIPPHVRLPSHVTL

SEQ ID NO: 686770 - protein, 17 aa, Mycobacterium
LAGGWIPPHVRLTANVT

SEQ ID NO: 686771 - protein, 17 aa, Mycobacterium
LAGGYFYRPTIFDRCDR

SEQ ID NO: 686772 - protein, 17 aa, Mycobacterium
LAGGYGLANATRTETQI

SEQ ID NO: 686773 - protein, 18 aa, Mycobacterium
LAGHDLPLGELLSDHLEI

SEQ ID NO: 686774 - protein, 19 aa, Mycobacterium
LAGHLARQLFRSWYIMYFQ

SEQ ID NO: 686775 - protein, 23 aa, Mycobacterium
LAGHLRPSYDYLIHRKLAVFWRH

SEQ ID NO: 686776 - protein, 25 aa, Mycobacterium
LAGHSMGGITIAAWSARYRHMVRRR

SEQ ID NO: 686777 - protein, 21 aa, Mycobacterium
LAGIARTAARMGLPEPAITIG

SEQ ID NO: 686778 - protein, 17 aa, Mycobacterium
LAGILDLGRYPSGADAV

SEQ ID NO: 686779 - protein, 18 aa, Mycobacterium
LAGIPAGGLFSGAEEKMS

SEQ ID NO: 686780 - protein, 35 aa, Mycobacterium
LAGKMPPRLRASVILAAWCGLRWGETSELRRKDVS

SEQ ID NO: 686781 - protein, 25 aa, Mycobacterium
LAGKREFMELGGLRTDRERVFLLST

SEQ ID NO: 686782 - protein, 24 aa, Mycobacterium
LAGKTEFPGLVAIGQLIHEPELRA

SEQ ID NO: 686783 - protein, 17 aa, Mycobacterium
LAGKTIRAPGWMQKLGL

SEQ ID NO: 686784 - protein, 22 aa, Mycobacterium
LAGKVRGAGVPAEVMRLDRLAE

SEQ ID NO: 686785 - protein, 17 aa, Mycobacterium
LAGLAARYGELGLAPVL

SEQ ID NO: 686786 - protein, 18 aa, Mycobacterium
LAGLAMANAVFSIDVNPL

SEQ ID NO: 686787 - protein, 19 aa, Mycobacterium
LAGLAMSGAQFAITVAPLA

SEQ ID NO: 686788 - protein, 20 aa, Mycobacterium
LAGLAPRFGVGVVATTGAHF

SEQ ID NO: 686789 - protein, 17 aa, Mycobacterium
LAGLAPRRQPPKTVPPL

SEQ ID NO: 686790 - protein, 22 aa, Mycobacterium
LAGLARAIADIAARARSGNLKP

SEQ ID NO: 686791 - protein, 24 aa, Mycobacterium
LAGLARAIADIAARARSGNLKPDE

SEQ ID NO: 686792 - protein, 22 aa, Mycobacterium
LAGLARAIADIAGRARSGNLKP

SEQ ID NO: 686793 - protein, 18 aa, Mycobacterium
LAGLARWRQRVLIRVTPD

SEQ ID NO: 686794 - protein, 36 aa, Mycobacterium
LAGLAYLLGPVAWLLGLRIVPMLAPGSADANGFEFH

SEQ ID NO: 686795 - protein, 19 aa, Mycobacterium
LAGLCDRVNLLPGAQARAF

SEQ ID NO: 686796 - protein, 17 aa, Mycobacterium
LAGLCGAGPRSATELYR

SEQ ID NO: 686797 - protein, 29 aa, Mycobacterium
LAGLCGALRRYHEALGMPISTLPMAVPVN

SEQ ID NO: 686798 - protein, 19 aa, Mycobacterium
LAGLDARLLYVTNNASRAP

SEQ ID NO: 686799 - protein, 21 aa, Mycobacterium
LAGLDLRWAAVTLDGTRSTVT

SEQ ID NO: 686800 - protein, 19 aa, Mycobacterium
LAGLFRDGTSTVFNVGLAN

SEQ ID NO: 686801 - protein, 19 aa, Mycobacterium
LAGLGDRFGQSVVNANAVL

SEQ ID NO: 686802 - protein, 22 aa, Mycobacterium
LAGLIPGLAPAALVFALANAPL

SEQ ID NO: 686803 - protein, 18 aa, Mycobacterium
LAGLKPAFRNELWQQRFP

SEQ ID NO: 686804 - protein, 18 aa, Mycobacterium
LAGLKRGAQVVVGTPGRV

SEQ ID NO: 686805 - protein, 24 aa, Mycobacterium
LAGLLRKRHPALAISGMWAPDADD

SEQ ID NO: 686806 - protein, 22 aa, Mycobacterium
LAGLPGDFAVPVVVAQHRRPTL

SEQ ID NO: 686807 - protein, 18 aa, Mycobacterium
LAGLRLAQDVQRNVQYKA

SEQ ID NO: 686808 - protein, 22 aa, Mycobacterium
LAGLRLARERGMTAPTPPQTNG

SEQ ID NO: 686809 - protein, 17 aa, Mycobacterium
LAGLRLQPGYERVLEEG

SEQ ID NO: 686810 - protein, 24 aa, Mycobacterium
LAGLRLRRDLMVATGIDLPPTLIY

SEQ ID NO: 686811 - protein, 18 aa, Mycobacterium
LAGLRPAFFDDAIGARFP

SEQ ID NO: 686812 - protein, 24 aa, Mycobacterium
LAGLRTVGDVVAYIQKLEEENPEA

SEQ ID NO: 686813 - protein, 18 aa, Mycobacterium
LAGLSALGGCLRRDGALG

SEQ ID NO: 686814 - protein, 22 aa, Mycobacterium
LAGLTEPVANLFAPVLSGPESV

SEQ ID NO: 686815 - protein, 25 aa, Mycobacterium
LAGLTRRLPTLTVRVIEDQTERLLT

SEQ ID NO: 686816 - protein, 17 aa, Mycobacterium
LAGLVHLGEGCDVRPLL

SEQ ID NO: 686817 - protein, 17 aa, Mycobacterium
LAGLYAMLHTLRHDEPV

SEQ ID NO: 686818 - protein, 17 aa, Mycobacterium
LAGMARFVGAPAHREHW

SEQ ID NO: 686819 - protein, 23 aa, Mycobacterium
LAGMPDLHFEVVDVYRGVNTLVI

SEQ ID NO: 686820 - protein, 17 aa, Mycobacterium
LAGMSWLTGVPVEVETC

SEQ ID NO: 686821 - protein, 24 aa, Mycobacterium
LAGNLGGPEFLDWAHRGRGDRRGP

SEQ ID NO: 686822 - protein, 25 aa, Mycobacterium
LAGPAEQAARVWHRRFFAPTAEAGK

SEQ ID NO: 686823 - protein, 18 aa, Mycobacterium
LAGPDFVYPAIKSDGQNW

SEQ ID NO: 686824 - protein, 24 aa, Mycobacterium
LAGPDGWCALTLSRPDDVDAVPAL

SEQ ID NO: 686825 - protein, 19 aa, Mycobacterium
LAGPEKFAGYTGELGSPDW

SEQ ID NO: 686826 - protein, 17 aa, Mycobacterium
LAGPLVRSSYRAGRLYE

SEQ ID NO: 686827 - protein, 17 aa, Mycobacterium
LAGPRAVFHREVKRMQG

SEQ ID NO: 686828 - protein, 17 aa, Mycobacterium
LAGPRGVGVLAMRPEVL

SEQ ID NO: 686829 - protein, 17 aa, Mycobacterium
LAGPRGVGVLAVNPVLE

SEQ ID NO: 686830 - protein, 17 aa, Mycobacterium
LAGPRGVGVLAVRSELM

SEQ ID NO: 686831 - protein, 24 aa, Mycobacterium
LAGQAQRLAAWVAELPSIDVADVG

SEQ ID NO: 686832 - protein, 20 aa, Mycobacterium
LAGQHGRTIVRHAPWTLRNG

SEQ ID NO: 686833 - protein, 23 aa, Mycobacterium
LAGQRPRTRFTVGIDDDVSGTSI

SEQ ID NO: 686834 - protein, 20 aa, Mycobacterium
LAGQVSRLGGAVAGVASPAS

SEQ ID NO: 686835 - protein, 24 aa, Mycobacterium
LAGRAEGYVPFYPEYPEELAGGQR

SEQ ID NO: 686836 - protein, 20 aa, Mycobacterium
LAGRAMRRIGAIEFATTIAP

SEQ ID NO: 686837 - protein, 20 aa, Mycobacterium
LAGRAMRRIGAVEFATTIAP

SEQ ID NO: 686838 - protein, 23 aa, Mycobacterium
LAGRAVELATLIAGHAPLGAQLT

SEQ ID NO: 686839 - protein, 31 aa, Mycobacterium
LAGREVKKLPTLRGRTIITMFYENSTRTRVS

SEQ ID NO: 686840 - protein, 20 aa, Mycobacterium
LAGRGAKPGERVAMLLPRTG

SEQ ID NO: 686841 - protein, 18 aa, Mycobacterium
LAGRGGGGASVFATAVAQ

SEQ ID NO: 686842 - protein, 20 aa, Mycobacterium
LAGRGVGVGYVRRAGLTASR

SEQ ID NO: 686843 - protein, 24 aa, Mycobacterium
LAGRIVRGRIDAIFADGDGSFTVV

SEQ ID NO: 686844 - protein, 20 aa, Mycobacterium
LAGRLHAFVRAVDAADRPVV

SEQ ID NO: 686845 - protein, 24 aa, Mycobacterium
LAGRLRFACLPTPATLDDFDVDAA

SEQ ID NO: 686846 - protein, 37 aa, Mycobacterium
LAGRLSRRAQPWLADHVIGGLVLLPGTGFVELVIRAG

SEQ ID NO: 686847 - protein, 18 aa, Mycobacterium
LAGRPRLLIADEPTSALD

SEQ ID NO: 686848 - protein, 18 aa, Mycobacterium
LAGRPVVAPAQWTGELSD

SEQ ID NO: 686849 - protein, 25 aa, Mycobacterium
LAGRRNACVNLKMAMLGRADEPPHF

SEQ ID NO: 686850 - protein, 23 aa, Mycobacterium
LAGRSMLSHSLHAMAKLAPQHLV

SEQ ID NO: 686851 - protein, 27 aa, Mycobacterium
LAGRTGWFDIAAGDWWDDALAWSGATR

SEQ ID NO: 686852 - protein, 17 aa, Mycobacterium
LAGRVLVVAYSKESEGN

SEQ ID NO: 686853 - protein, 23 aa, Mycobacterium
LAGRYSGYCGIWIDNADQTCSLV

SEQ ID NO: 686854 - protein, 20 aa, Mycobacterium
LAGSCDAVLVGEHQNKPDFP

SEQ ID NO: 686855 - protein, 18 aa, Mycobacterium
LAGSDARNAGGASQPGPA

SEQ ID NO: 686856 - protein, 17 aa, Mycobacterium
LAGSGVVLRIHYTDPDA

SEQ ID NO: 686857 - protein, 28 aa, Mycobacterium
LAGSLSRRGVGFGDRVMILMLNRTEFVE

SEQ ID NO: 686858 - protein, 26 aa, Mycobacterium
LAGSWPLRPDCRILACSSVFGVWGGH

SEQ ID NO: 686859 - protein, 18 aa, Mycobacterium
LAGSWPRDPGSPAQRLHA

SEQ ID NO: 686860 - protein, 18 aa, Mycobacterium
LAGTGARIVAPVDAAGAA

SEQ ID NO: 686861 - protein, 25 aa, Mycobacterium
LAGTGGAGGFGVFPGGQTGQNGTDG

SEQ ID NO: 686862 - protein, 24 aa, Mycobacterium
LAGTRTAVMMGVYFNEYQSMLASS

SEQ ID NO: 686863 - protein, 24 aa, Mycobacterium
LAGTRTGVMMGVYFNEYQSMLAAS

SEQ ID NO: 686864 - protein, 20 aa, Mycobacterium
LAGTVSGWVRRTGDASQVSA

SEQ ID NO: 686865 - protein, 18 aa, Mycobacterium
LAGVAGYEGALAHDASEP

SEQ ID NO: 686866 - protein, 19 aa, Mycobacterium
LAGVCIPAGTLVLANTAAA

SEQ ID NO: 686867 - protein, 26 aa, Mycobacterium
LAGVFDFAFPPAPWMFGAAGREHMQK

SEQ ID NO: 686868 - protein, 25 aa, Mycobacterium
LAGVFRGASRIHNLGFANLGIANLG

SEQ ID NO: 686869 - protein, 26 aa, Mycobacterium
LAGVGRPDIMIVVGGVIPPGDFDELY

SEQ ID NO: 686870 - protein, 20 aa, Mycobacterium
LAGVLEYAGHFPFTQSFIDR

SEQ ID NO: 686871 - protein, 19 aa, Mycobacterium
LAGVRIVDLTAFWAGPAAT

SEQ ID NO: 686872 - protein, 23 aa, Mycobacterium
LAGVTAYEVLKKVAAKAPLHQTA

SEQ ID NO: 686873 - protein, 17 aa, Mycobacterium
LAGVTIRIEDSRISLGG

SEQ ID NO: 686874 - protein, 22 aa, Mycobacterium
LAGWPEPTGVLATNDVDALLAL

SEQ ID NO: 686875 - protein, 22 aa, Mycobacterium
LAGWRKRAEFMAAQPGFVSFRI

SEQ ID NO: 686876 - protein, 20 aa, Mycobacterium
LAGYAKDMAHMFVKSGYQRG

SEQ ID NO: 686877 - protein, 18 aa, Mycobacterium
LAGYARQNALPAILSAVT

SEQ ID NO: 686878 - protein, 28 aa, Mycobacterium
LAGYLEQLAGYGYRGYVGLEYKASREDP

SEQ ID NO: 686879 - protein, 22 aa, Mycobacterium
LAGYLRSLWDLMPDTRADIEAV

SEQ ID NO: 686880 - protein, 17 aa, Mycobacterium
LAGYRAGFVAGDPAVVA

SEQ ID NO: 686881 - protein, 21 aa, Mycobacterium
LAHAGVERWIVDTGFGTELIT

SEQ ID NO: 686882 - protein, 20 aa, Mycobacterium
LAHAKIQLELARLMTQRAAS

SEQ ID NO: 686883 - protein, 19 aa, Mycobacterium
LAHAVDVVTDWLIRHDFAS

SEQ ID NO: 686884 - protein, 22 aa, Mycobacterium
LAHAVGAKFGISHGRANGIFLP

SEQ ID NO: 686885 - protein, 23 aa, Mycobacterium
LAHAVGAKFSVPHGRANGIFLPH

SEQ ID NO: 686886 - protein, 24 aa, Mycobacterium
LAHAYAGMFHANMLAVVGRLDDAT

SEQ ID NO: 686887 - protein, 23 aa, Mycobacterium
LAHCPAYHKLLLKSLTTAGLMEL

SEQ ID NO: 686888 - protein, 18 aa, Mycobacterium
LAHDGRRALDLAREVDPD

SEQ ID NO: 686889 - protein, 26 aa, Mycobacterium
LAHDPRLSFGVGVAEELNYADRAFDL

SEQ ID NO: 686890 - protein, 23 aa, Mycobacterium
LAHEVRMRWCGPEVEVEGIISLK

SEQ ID NO: 686891 - protein, 32 aa, Mycobacterium
LAHFIRTGQEFSWRAEELFDAIAGGAINIEVG

SEQ ID NO: 686892 - protein, 25 aa, Mycobacterium
LAHFKAPKAFIFVSHIQRLGNGKPN

SEQ ID NO: 686893 - protein, 33 aa, Mycobacterium
LAHFVRTGQEFSWRAEELFSAIARGDITVEVGG

SEQ ID NO: 686894 - protein, 24 aa, Mycobacterium
LAHGAAVACHRARGFRSVMGKGAM

SEQ ID NO: 686895 - protein, 17 aa, Mycobacterium
LAHGCDIRPALHTLGAR

SEQ ID NO: 686896 - protein, 17 aa, Mycobacterium
LAHGCDIRPSLTTFDPR

SEQ ID NO: 686897 - protein, 29 aa, Mycobacterium
LAHGGREALEWVFHPFLSTMILARPKDIS

SEQ ID NO: 686898 - protein, 17 aa, Mycobacterium
LAHGLPVTEAVAFGKQW

SEQ ID NO: 686899 - protein, 17 aa, Mycobacterium
LAHGVAFAQERAQREAR

SEQ ID NO: 686900 - protein, 26 aa, Mycobacterium
LAHHPFGGWAEAYGRELDLIGPRFVD

SEQ ID NO: 686901 - protein, 18 aa, Mycobacterium
LAHILKMAGHVVGQTSTD

SEQ ID NO: 686902 - protein, 17 aa, Mycobacterium
LAHKVEAALEFKNQVLV

SEQ ID NO: 686903 - protein, 18 aa, Mycobacterium
LAHLGGHPVAVVANQPQV

SEQ ID NO: 686904 - protein, 20 aa, Mycobacterium
LAHLLKFDSILGRLPFDVSL

SEQ ID NO: 686905 - protein, 19 aa, Mycobacterium
LAHLLKFDSILGRLPHDVS

SEQ ID NO: 686906 - protein, 28 aa, Mycobacterium
LAHLLKFDSILGRLPHDVSLEGDDTIVV

SEQ ID NO: 686907 - protein, 19 aa, Mycobacterium
LAHLLKFDSILGRLPQDVS

SEQ ID NO: 686908 - protein, 20 aa, Mycobacterium
LAHLLKFDSILGRLPQDVSL

SEQ ID NO: 686909 - protein, 19 aa, Mycobacterium
LAHLLKFDSILGRLPYDVS

SEQ ID NO: 686910 - protein, 30 aa, Mycobacterium
LAHLLKFDSILGRLPYDVSLEGDDTIVVGD

SEQ ID NO: 686911 - protein, 22 aa, Mycobacterium
LAHPARIRILEILSASSEPTPV

SEQ ID NO: 686912 - protein, 27 aa, Mycobacterium
LAHPDRCVAVLAALPAWTGEPGPAPAA

SEQ ID NO: 686913 - protein, 17 aa, Mycobacterium
LAHPLLPPWMVTESGPD

SEQ ID NO: 686914 - protein, 25 aa, Mycobacterium
LAHPRSARGGKVFGVEGDYSPEWAA

SEQ ID NO: 686915 - protein, 24 aa, Mycobacterium
LAHRCTREGADLVLAARTPERLDD

SEQ ID NO: 686916 - protein, 19 aa, Mycobacterium
LAHRIFRRKHGPPNLLNAD

SEQ ID NO: 686917 - protein, 18 aa, Mycobacterium
LAHRLGIDPIELRLRNEP

SEQ ID NO: 686918 - protein, 19 aa, Mycobacterium
LAHRLSLRGYDAVHAASAE

SEQ ID NO: 686919 - protein, 18 aa, Mycobacterium
LAHRVVLEYLDTVIDRQR

SEQ ID NO: 686920 - protein, 17 aa, Mycobacterium
LAHSFSLARYAGVLLGM

SEQ ID NO: 686921 - protein, 17 aa, Mycobacterium
LAHSFSLARYAGVLMGM

SEQ ID NO: 686922 - protein, 20 aa, Mycobacterium
LAHSFSLARYAGVLMGMSGM

SEQ ID NO: 686923 - protein, 24 aa, Mycobacterium
LAHTAVEEIVRWASPVVYMRRTLS

SEQ ID NO: 686924 - protein, 25 aa, Mycobacterium
LAHTCPHCQRPPRRLTPYAAAIPQP

SEQ ID NO: 686925 - protein, 20 aa, Mycobacterium
LAHTGAREFVFVGAPLPVVG

SEQ ID NO: 686926 - protein, 22 aa, Mycobacterium
LAHTGDGWVLIAGDAAWHRLQI

SEQ ID NO: 686927 - protein, 21 aa, Mycobacterium
LAHVTWELRAMGGAPKFEGSQ

SEQ ID NO: 686928 - protein, 17 aa, Mycobacterium
LAHVWDYRSKAIIAGAD

SEQ ID NO: 686929 - protein, 19 aa, Mycobacterium
LAHWRDLGVTEVVFGLPDK

SEQ ID NO: 686930 - protein, 21 aa, Mycobacterium
LAHWRELGVTEVLFGLPDKSE

SEQ ID NO: 686931 - protein, 28 aa, Mycobacterium
LAHYIIECLQLMALRGATTMEVTREAYE

SEQ ID NO: 686932 - protein, 21 aa, Mycobacterium
LAIACLRANGLAACYVSGYLA

SEQ ID NO: 686933 - protein, 21 aa, Mycobacterium
LAIACLRANGLAASYVSGYLA

SEQ ID NO: 686934 - protein, 22 aa, Mycobacterium
LAIACLRANGLAASYVSGYLAT

SEQ ID NO: 686935 - protein, 22 aa, Mycobacterium
LAIAKARTSVMFQAPTEGLAAP

SEQ ID NO: 686936 - protein, 19 aa, Mycobacterium
LAIAKRFISEGARVVLGDL

SEQ ID NO: 686937 - protein, 21 aa, Mycobacterium
LAIAMRPRLWVFNSVGRLGHD

SEQ ID NO: 686938 - protein, 19 aa, Mycobacterium
LAIDGGWWVLGVHSPAAAE

SEQ ID NO: 686939 - protein, 22 aa, Mycobacterium
LAIDHFRYFASAIRAQEGSLSQ

SEQ ID NO: 686940 - protein, 20 aa, Mycobacterium
LAIDRFKVINSRLGQDAGDR

SEQ ID NO: 686941 - protein, 18 aa, Mycobacterium
LAIDWPLVDGAPPSLSER

SEQ ID NO: 686942 - protein, 25 aa, Mycobacterium
LAIELARSGAKLAISDVDTEGLAQT

SEQ ID NO: 686943 - protein, 17 aa, Mycobacterium
LAIEPMLTLGTRKTVVL

SEQ ID NO: 686944 - protein, 17 aa, Mycobacterium
LAIEYEVMDRLKPGIIM

SEQ ID NO: 686945 - protein, 26 aa, Mycobacterium
LAIGHYFKRLTVIESEFGNRDFHTAR

SEQ ID NO: 686946 - protein, 18 aa, Mycobacterium
LAIGRSFSVSRFWDEVIA

SEQ ID NO: 686947 - protein, 17 aa, Mycobacterium
LAIINLFGAYAYTYDHN

SEQ ID NO: 686948 - protein, 18 aa, Mycobacterium
LAIINLLGAYAYLYDQDH

SEQ ID NO: 686949 - protein, 26 aa, Mycobacterium
LAIIRRPRGGFTYEELLALVESRLPQ

SEQ ID NO: 686950 - protein, 17 aa, Mycobacterium
LAILDIRPFTRGHTLVI

SEQ ID NO: 686951 - protein, 18 aa, Mycobacterium
LAILKGLDVPLHEAEIMA

SEQ ID NO: 686952 - protein, 17 aa, Mycobacterium
LAILKGLNVPLHEAEIL

SEQ ID NO: 686953 - protein, 20 aa, Mycobacterium
LAILRKVLDCDDVISETTSS

SEQ ID NO: 686954 - protein, 18 aa, Mycobacterium
LAIMNLFGAYAYTYDQDR

SEQ ID NO: 686955 - protein, 17 aa, Mycobacterium
LAIPGPRDDWVVDPDAL

SEQ ID NO: 686956 - protein, 33 aa, Mycobacterium
LAIPPYGWVNLHFSLLPAWRGAAPVQAAIAAGD

SEQ ID NO: 686957 - protein, 22 aa, Mycobacterium
LAIRIDGPRSWDLDLTIDVTFE

SEQ ID NO: 686958 - protein, 24 aa, Mycobacterium
LAISVNGPKAWDLSLALDVSFDDL

SEQ ID NO: 686959 - protein, 22 aa, Mycobacterium
LAITVKASRGFVYAASTMGVTG

SEQ ID NO: 686960 - protein, 19 aa, Mycobacterium
LAIYHRILPPQGWFDDPNP

SEQ ID NO: 686961 - protein, 24 aa, Mycobacterium
LAIYLCGPPPMVEAVRTHLNTAGV

SEQ ID NO: 686962 - protein, 24 aa, Mycobacterium
LAKAAELRYGRIPEVEKKLDAALP

SEQ ID NO: 686963 - protein, 18 aa, Mycobacterium
LAKAARLGIKTITTGEVT

SEQ ID NO: 686964 - protein, 18 aa, Mycobacterium
LAKAFGISRATAYRYLSR

SEQ ID NO: 686965 - protein, 17 aa, Mycobacterium
LAKAGWRVVAPFMRGYA

SEQ ID NO: 686966 - protein, 17 aa, Mycobacterium
LAKALAAAGGRRLIRLQ

SEQ ID NO: 686967 - protein, 28 aa, Mycobacterium
LAKALDRKVWLPSGGTLVIDRTEAMTVV

SEQ ID NO: 686968 - protein, 17 aa, Mycobacterium
LAKAMLSVDRFVREDSA

SEQ ID NO: 686969 - protein, 17 aa, Mycobacterium
LAKAMLSVDRFVREDSP

SEQ ID NO: 686970 - protein, 26 aa, Mycobacterium
LAKAPGTPVFDCKHTMSLPGVAVASP

SEQ ID NO: 686971 - protein, 21 aa, Mycobacterium
LAKARARCAQVQWRKAPAEQL

SEQ ID NO: 686972 - protein, 18 aa, Mycobacterium
LAKAVKWGPAEVADTYGV

SEQ ID NO: 686973 - protein, 18 aa, Mycobacterium
LAKCPAQVPGTVVDVTTP

SEQ ID NO: 686974 - protein, 23 aa, Mycobacterium
LAKDLGNLLSVFQNGFNLAYQQG

SEQ ID NO: 686975 - protein, 17 aa, Mycobacterium
LAKDRVVADEVAGVVAG

SEQ ID NO: 686976 - protein, 18 aa, Mycobacterium
LAKEAGVAPNTIYWYFPD

SEQ ID NO: 686977 - protein, 19 aa, Mycobacterium
LAKEFELLGVPFAERGRIA

SEQ ID NO: 686978 - protein, 21 aa, Mycobacterium
LAKEFGNLGVLGMHLQGYGCA

SEQ ID NO: 686979 - protein, 24 aa, Mycobacterium
LAKELEFRPRKSLGQNFVHDANTV

SEQ ID NO: 686980 - protein, 19 aa, Mycobacterium
LAKELGVRLPPRRPFGRTA

SEQ ID NO: 686981 - protein, 23 aa, Mycobacterium
LAKELRDGSCMNLALVLQKDRGC

SEQ ID NO: 686982 - protein, 24 aa, Mycobacterium
LAKELRPWVPVVSLVKGLEQGTNM

SEQ ID NO: 686983 - protein, 24 aa, Mycobacterium
LAKELRPWVPVVSLVKGLEQGTNY

SEQ ID NO: 686984 - protein, 25 aa, Mycobacterium
LAKELRRGSTVALVYLAPDAKPAAT

SEQ ID NO: 686985 - protein, 25 aa, Mycobacterium
LAKESGSPIFLYLGGDFPQGLDKAA

SEQ ID NO: 686986 - protein, 24 aa, Mycobacterium
LAKFPEPLAPLAAAHRAGADLPSR

SEQ ID NO: 686987 - protein, 22 aa, Mycobacterium
LAKIEHRHTLVLAVLLGEDGET

SEQ ID NO: 686988 - protein, 20 aa, Mycobacterium
LAKKWLGLRYTMNVIALNGA

SEQ ID NO: 686989 - protein, 17 aa, Mycobacterium
LAKLEGDAAFFWAPGGN

SEQ ID NO: 686990 - protein, 19 aa, Mycobacterium
LAKLGGPVDRDEWFMTPQT

SEQ ID NO: 686991 - protein, 25 aa, Mycobacterium
LAKLLPHVDVCLGQHVMPFPAGTIG

SEQ ID NO: 686992 - protein, 21 aa, Mycobacterium
LAKLPTIAAYAYKKSIGQPFL

SEQ ID NO: 686993 - protein, 24 aa, Mycobacterium
LAKLRHALPGAVFVSARTGEGIDA

SEQ ID NO: 686994 - protein, 18 aa, Mycobacterium
LAKLRNGPAVALRKTKQA

SEQ ID NO: 686995 - protein, 20 aa, Mycobacterium
LAKMRAARRLWARVAEVAGD

SEQ ID NO: 686996 - protein, 18 aa, Mycobacterium
LAKPERVAGLIIQNGDIY

SEQ ID NO: 686997 - protein, 30 aa, Mycobacterium
LAKPEYWLSQQGRLSHPMVLRPGDDHYRPI

SEQ ID NO: 686998 - protein, 19 aa, Mycobacterium
LAKQFAEGVKAEFPDQMLA

SEQ ID NO: 686999 - protein, 20 aa, Mycobacterium
LAKRGTRVSFDIEDGPRGKF

SEQ ID NO: 687000 - protein, 19 aa, Mycobacterium
LAKRLAAAGADVVMAVRDR

SEQ ID NO: 687001 - protein, 17 aa, Mycobacterium
LAKRLGLERQWLHARSL

SEQ ID NO: 687002 - protein, 19 aa, Mycobacterium
LAKRLMQTAGVDRLSALYS

SEQ ID NO: 687003 - protein, 22 aa, Mycobacterium
LAKRQWQGMFTWMGEPEEFADP

SEQ ID NO: 687004 - protein, 18 aa, Mycobacterium
LAKRSDIVLQCFRGKAAE

SEQ ID NO: 687005 - protein, 20 aa, Mycobacterium
LAKRTDAMFDQGLVGEVTAL

SEQ ID NO: 687006 - protein, 24 aa, Mycobacterium
LAKSEKYPIPALLEVRGEVFFRLE

SEQ ID NO: 687007 - protein, 17 aa, Mycobacterium
LAKSTAAGSGWVGQIVG

SEQ ID NO: 687008 - protein, 18 aa, Mycobacterium
LAKTAKPVDEFRMPSQTY

SEQ ID NO: 687009 - protein, 19 aa, Mycobacterium
LAKVIAWAPTRAEALGALS

SEQ ID NO: 687010 - protein, 23 aa, Mycobacterium
LAKVSRGLGEPMVGINVEQIAQP

SEQ ID NO: 687011 - protein, 17 aa, Mycobacterium
LAKWLRVNMIALALTEG

SEQ ID NO: 687012 - protein, 19 aa, Mycobacterium
LALAADWRVSGDNVKFGAT

SEQ ID NO: 687013 - protein, 28 aa, Mycobacterium
LALAAGYPDRDWLAVCIGRPARGTTPRV

SEQ ID NO: 687014 - protein, 18 aa, Mycobacterium
LALAARETFGPDRVSTAE

SEQ ID NO: 687015 - protein, 20 aa, Mycobacterium
LALAEHGADIALHYGNSKPA

SEQ ID NO: 687016 - protein, 25 aa, Mycobacterium
LALAHEVRMRWCGPEVEVEGIISLK

SEQ ID NO: 687017 - protein, 17 aa, Mycobacterium
LALALAAHGRRVLLVEV

SEQ ID NO: 687018 - protein, 32 aa, Mycobacterium
LALAPLQFAPGSAWRYSLALDVLGAVVENATG

SEQ ID NO: 687019 - protein, 22 aa, Mycobacterium
LALARELAELVGGPTGTGGAFV

SEQ ID NO: 687020 - protein, 17 aa, Mycobacterium
LALARFGGQPAVVLGQR

SEQ ID NO: 687021 - protein, 18 aa, Mycobacterium
LALARFGNQPAVVLGQQR

SEQ ID NO: 687022 - protein, 22 aa, Mycobacterium
LALASPFFMEFDLPARGVQLAV

SEQ ID NO: 687023 - protein, 23 aa, Mycobacterium
LALASPFFVEFDLAARGVRLAVP

SEQ ID NO: 687024 - protein, 18 aa, Mycobacterium
LALAWADDIVFGIDLTPQ

SEQ ID NO: 687025 - protein, 18 aa, Mycobacterium
LALCGCVGASALSDDPDL

SEQ ID NO: 687026 - protein, 18 aa, Mycobacterium
LALCRDVFDGLQMTPKSL

SEQ ID NO: 687027 - protein, 19 aa, Mycobacterium
LALDFAERLGAEILNADAM

SEQ ID NO: 687028 - protein, 25 aa, Mycobacterium
LALDGDGLGTVWGRELATSMLADAG

SEQ ID NO: 687029 - protein, 23 aa, Mycobacterium
LALDMTRPLAAVTFSGAPSSKVG

SEQ ID NO: 687030 - protein, 17 aa, Mycobacterium
LALDVLTLFSYPLHPPG

SEQ ID NO: 687031 - protein, 19 aa, Mycobacterium
LALECLRPGETLPPGARVV

SEQ ID NO: 687032 - protein, 29 aa, Mycobacterium
LALEIARRPRLRLVALMSYEGHIAGFGDQ

SEQ ID NO: 687033 - protein, 24 aa, Mycobacterium
LALELGRSGASLAISDVDSDGLAQ

SEQ ID NO: 687034 - protein, 25 aa, Mycobacterium
LALENTRFWAPLSLTAEQKHSIDDP

SEQ ID NO: 687035 - protein, 17 aa, Mycobacterium
LALEQAPPGSVLHAVGD

SEQ ID NO: 687036 - protein, 17 aa, Mycobacterium
LALEVDRDGIAVHIVTP

SEQ ID NO: 687037 - protein, 18 aa, Mycobacterium
LALFPRRIGGRYAAMSRS

SEQ ID NO: 687038 - protein, 27 aa, Mycobacterium
LALFRPECIQDPYPLYRRMLDTAPVHP

SEQ ID NO: 687039 - protein, 23 aa, Mycobacterium
LALFRTATAFERAHVSELLPHDL

SEQ ID NO: 687040 - protein, 23 aa, Mycobacterium
LALGAQGAWTGSQWVMVEESENT

SEQ ID NO: 687041 - protein, 21 aa, Mycobacterium
LALGHRRVGVIAGLAHASTGI

SEQ ID NO: 687042 - protein, 22 aa, Mycobacterium
LALGHWLRRWWPASQRDGIAGL

SEQ ID NO: 687043 - protein, 26 aa, Mycobacterium
LALGKLGLRPGMTLLDIGCGWGSTMR

SEQ ID NO: 687044 - protein, 20 aa, Mycobacterium
LALGPLMSGMFGDFAAADAF

SEQ ID NO: 687045 - protein, 17 aa, Mycobacterium
LALGSGGARGYAHIGVI

SEQ ID NO: 687046 - protein, 18 aa, Mycobacterium
LALGVHRLLSWGILDTPL

SEQ ID NO: 687047 - protein, 23 aa, Mycobacterium
LALHCPLGPIALAACLQIDAGCY

SEQ ID NO: 687048 - protein, 17 aa, Mycobacterium
LALIDRIMAESAQRWRA

SEQ ID NO: 687049 - protein, 17 aa, Mycobacterium
LALIGACGVRQVVVGGE

SEQ ID NO: 687050 - protein, 24 aa, Mycobacterium
LALIKSWAAQGWLHRIVDPRSDQN

SEQ ID NO: 687051 - protein, 24 aa, Mycobacterium
LALIKSWASDGWLHRASDGTGPDA

SEQ ID NO: 687052 - protein, 21 aa, Mycobacterium
LALILKFMPAYLHDAQDLPVP

SEQ ID NO: 687053 - protein, 17 aa, Mycobacterium
LALKLINNLLFAANAQL

SEQ ID NO: 687054 - protein, 17 aa, Mycobacterium
LALLEADVSLPVVRAFI

SEQ ID NO: 687055 - protein, 33 aa, Mycobacterium
LALLEIRDLLFARLLQYRAFKHVAEMFAELEAA

SEQ ID NO: 687056 - protein, 33 aa, Mycobacterium
LALLEVRDLLFARLLQYRAFKHVAQMFAELEAA

SEQ ID NO: 687057 - protein, 20 aa, Mycobacterium
LALLEVRWREAVATLDRRFP

SEQ ID NO: 687058 - protein, 17 aa, Mycobacterium
LALLGFRGRPPVHRNAG

SEQ ID NO: 687059 - protein, 17 aa, Mycobacterium
LALLLRRERAGEGGSAS

SEQ ID NO: 687060 - protein, 19 aa, Mycobacterium
LALLRGELDLARSLAEQSL

SEQ ID NO: 687061 - protein, 19 aa, Mycobacterium
LALLSDRPILVVGDLEQVR

SEQ ID NO: 687062 - protein, 20 aa, Mycobacterium
LALMRHELFFTRKPFGESKL

SEQ ID NO: 687063 - protein, 21 aa, Mycobacterium
LALNCTYDFEVAASKYLHALR

SEQ ID NO: 687064 - protein, 19 aa, Mycobacterium
LALNKPFGMLSTMSDDRGR

SEQ ID NO: 687065 - protein, 20 aa, Mycobacterium
LALNRPEVLLVIGAGQLLGT

SEQ ID NO: 687066 - protein, 22 aa, Mycobacterium
LALPADPRWGGQLVSLPPGAGE

SEQ ID NO: 687067 - protein, 23 aa, Mycobacterium
LALPDCGVRHLWPQPAQAKCPLT

SEQ ID NO: 687068 - protein, 17 aa, Mycobacterium
LALPDRFLSATADDAPE

SEQ ID NO: 687069 - protein, 17 aa, Mycobacterium
LALPFSPVCGPDCQGLC

SEQ ID NO: 687070 - protein, 26 aa, Mycobacterium
LALPGHAPSGLGFRPDGTLLIVSTEL

SEQ ID NO: 687071 - protein, 18 aa, Mycobacterium
LALPPEPRDAVLGALSGD

SEQ ID NO: 687072 - protein, 17 aa, Mycobacterium
LALPQWYAQNGQFVTTK

SEQ ID NO: 687073 - protein, 21 aa, Mycobacterium
LALPRAMLRFAGGREITLGDL

SEQ ID NO: 687074 - protein, 17 aa, Mycobacterium
LALPSEAEWEVAARGGL

SEQ ID NO: 687075 - protein, 25 aa, Mycobacterium
LALPTRLGARRAWGMAVQLYSVRSR

SEQ ID NO: 687076 - protein, 17 aa, Mycobacterium
LALPWPDDPLAALWHAT

SEQ ID NO: 687077 - protein, 20 aa, Mycobacterium
LALQARRGFARPLSTKTKDQ

SEQ ID NO: 687078 - protein, 20 aa, Mycobacterium
LALRAGVSVADIEFIQFHPT

SEQ ID NO: 687079 - protein, 25 aa, Mycobacterium
LALRAKQMRNIMATLMLSQGTPMIA

SEQ ID NO: 687080 - protein, 23 aa, Mycobacterium
LALRAPARPALRTGSAGSAIAVG

SEQ ID NO: 687081 - protein, 18 aa, Mycobacterium
LALRARLVAEPSGAVSLA

SEQ ID NO: 687082 - protein, 19 aa, Mycobacterium
LALRDKIPLVMLLEGAGFR

SEQ ID NO: 687083 - protein, 17 aa, Mycobacterium
LALRGWFRTQLLQQSDI

SEQ ID NO: 687084 - protein, 17 aa, Mycobacterium
LALRGWMWTQLPHDPEL

SEQ ID NO: 687085 - protein, 25 aa, Mycobacterium
LALRHPLAALGFMYSLRSTAYTEER

SEQ ID NO: 687086 - protein, 19 aa, Mycobacterium
LALRLAIAAAGRPDVVAMR

SEQ ID NO: 687087 - protein, 23 aa, Mycobacterium
LALRLLDRGYFRAGGEQYAEEHE

SEQ ID NO: 687088 - protein, 29 aa, Mycobacterium
LALRLQHLVPEWLWLLGRRVVNADRTVGP

SEQ ID NO: 687089 - protein, 17 aa, Mycobacterium
LALRPGDDGSLPDTGSL

SEQ ID NO: 687090 - protein, 20 aa, Mycobacterium
LALRRARNAQALIVLAVPVP

SEQ ID NO: 687091 - protein, 18 aa, Mycobacterium
LALRSGGVVIVFPGGDYD

SEQ ID NO: 687092 - protein, 25 aa, Mycobacterium
LALSAPRGADGLTLVPYLEGERSPN

SEQ ID NO: 687093 - protein, 18 aa, Mycobacterium
LALSCAFWVGSGRALRVL

SEQ ID NO: 687094 - protein, 18 aa, Mycobacterium
LALSDFPPNFNILHIDGN

SEQ ID NO: 687095 - protein, 21 aa, Mycobacterium
LALSIGSYVCQARAAKQNDQA

SEQ ID NO: 687096 - protein, 19 aa, Mycobacterium
LALSLGDSLAGMFAAQGAL

SEQ ID NO: 687097 - protein, 18 aa, Mycobacterium
LALSLGDSLAGMFGAQGA

SEQ ID NO: 687098 - protein, 17 aa, Mycobacterium
LALSNGVLVHRKVAADE

SEQ ID NO: 687099 - protein, 17 aa, Mycobacterium
LALSRLTATLLERLQAH

SEQ ID NO: 687100 - protein, 18 aa, Mycobacterium
LALTALWRSYGVQPDLVI

SEQ ID NO: 687101 - protein, 21 aa, Mycobacterium
LALTECLRLEVQLAGHDDHVH

SEQ ID NO: 687102 - protein, 18 aa, Mycobacterium
LALTERIKPVTYLSTVSV

SEQ ID NO: 687103 - protein, 21 aa, Mycobacterium
LALTGRPLIGNGANGTPGTGA

SEQ ID NO: 687104 - protein, 18 aa, Mycobacterium
LALTKGWCLRELGEFDAA

SEQ ID NO: 687105 - protein, 18 aa, Mycobacterium
LALTPGFHAIQMPGGPGQ

SEQ ID NO: 687106 - protein, 18 aa, Mycobacterium
LALTQLWRSYGVHPDAVI

SEQ ID NO: 687107 - protein, 18 aa, Mycobacterium
LALTREMLDAMKPITDRA

SEQ ID NO: 687108 - protein, 17 aa, Mycobacterium
LALTSGIAGIVDTSAAT

SEQ ID NO: 687109 - protein, 17 aa, Mycobacterium
LALTWADDMVVGAQLSP

SEQ ID NO: 687110 - protein, 17 aa, Mycobacterium
LALVDDHAILRQGLRSL

SEQ ID NO: 687111 - protein, 21 aa, Mycobacterium
LALVLRGKYLVDIQSVTKVQG

SEQ ID NO: 687112 - protein, 24 aa, Mycobacterium
LALVSQAWLGPRYQVTSQVNVVNP

SEQ ID NO: 687113 - protein, 22 aa, Mycobacterium
LALWGTFAAVGFRGHLVTSSIE

SEQ ID NO: 687114 - protein, 25 aa, Mycobacterium
LAMALLRKGGICVLTGITPFTEPPV

SEQ ID NO: 687115 - protein, 23 aa, Mycobacterium
LAMASAAAPYVAWMQQTAAAAAQ

SEQ ID NO: 687116 - protein, 22 aa, Mycobacterium
LAMGPRCLMTSMELMMPTDASF

SEQ ID NO: 687117 - protein, 18 aa, Mycobacterium
LAMHPDAYVRPSPTSGTL

SEQ ID NO: 687118 - protein, 26 aa, Mycobacterium
LAMLRRLMMDDSFFRGELIYVFDGDE

SEQ ID NO: 687119 - protein, 25 aa, Mycobacterium
LAMMARLCRELGLPLVVDAAQALGQ

SEQ ID NO: 687120 - protein, 20 aa, Mycobacterium
LAMRSQRYFRLLDALEGLVA

SEQ ID NO: 687121 - protein, 27 aa, Mycobacterium
LAMSRELGVQFARQGIRVNALCPGPVN

SEQ ID NO: 687122 - protein, 17 aa, Mycobacterium
LAMTLFLERGYERVSLN

SEQ ID NO: 687123 - protein, 23 aa, Mycobacterium
LANADVFLTNWLPGALERARLTV

SEQ ID NO: 687124 - protein, 17 aa, Mycobacterium
LANAEKVFTRWMVAGDA

SEQ ID NO: 687125 - protein, 17 aa, Mycobacterium
LANAGGYGLITPDLIPE

SEQ ID NO: 687126 - protein, 22 aa, Mycobacterium
LANAIARACGARVTRLPMTAAR

SEQ ID NO: 687127 - protein, 27 aa, Mycobacterium
LANAKRWGVLHVIWRQKLYPGIGAPSW

SEQ ID NO: 687128 - protein, 23 aa, Mycobacterium
LANALRSWSVLRFEVTEDPSAGV

SEQ ID NO: 687129 - protein, 23 aa, Mycobacterium
LANALRSWSVLRFEVTEDPSSGV

SEQ ID NO: 687130 - protein, 18 aa, Mycobacterium
LANCGYAGAKVRHLLDMR

SEQ ID NO: 687131 - protein, 19 aa, Mycobacterium
LANCGYAGATVRHLLDMRS

SEQ ID NO: 687132 - protein, 19 aa, Mycobacterium
LANDSEYGLSAAIFTKDLT

SEQ ID NO: 687133 - protein, 17 aa, Mycobacterium
LANDVGFGIAHAHTQRI

SEQ ID NO: 687134 - protein, 17 aa, Mycobacterium
LANEAFAGMKLLEIYTT

SEQ ID NO: 687135 - protein, 21 aa, Mycobacterium
LANEIARCRDLTDKPFGVNLT

SEQ ID NO: 687136 - protein, 19 aa, Mycobacterium
LANFFRIKPAYFTDDEYYE

SEQ ID NO: 687137 - protein, 21 aa, Mycobacterium
LANFFRIRAAYFTDDDYYAKI

SEQ ID NO: 687138 - protein, 18 aa, Mycobacterium
LANGFALPIDEGATDGPL

SEQ ID NO: 687139 - protein, 18 aa, Mycobacterium
LANHYLVAHVLGYHEQAL

SEQ ID NO: 687140 - protein, 17 aa, Mycobacterium
LANIAITVQGGRNLARR

SEQ ID NO: 687141 - protein, 30 aa, Mycobacterium
LANIFSVRLPWQWLGRPAGRRRFRGDRPVL

SEQ ID NO: 687142 - protein, 23 aa, Mycobacterium
LANLKARVAAVERSQADYRSMVE

SEQ ID NO: 687143 - protein, 20 aa, Mycobacterium
LANLKPAFKDDGVIHAGNSS

SEQ ID NO: 687144 - protein, 20 aa, Mycobacterium
LANLPCHGFDANAAWLEIVL

SEQ ID NO: 687145 - protein, 18 aa, Mycobacterium
LANLPSLLIRSTVGRKTL

SEQ ID NO: 687146 - protein, 34 aa, Mycobacterium
LANLRARPQLAITFRNGWQWATVEGRAELVGPDD

SEQ ID NO: 687147 - protein, 36 aa, Mycobacterium
LANLRARPQLAVTFRNGWQWATVEGRAELAGPDDTQ

SEQ ID NO: 687148 - protein, 24 aa, Mycobacterium
LANLSHLRRPHIITIDDVPDSAGE

SEQ ID NO: 687149 - protein, 17 aa, Mycobacterium
LANLVLVCPYHHRLHHR

SEQ ID NO: 687150 - protein, 17 aa, Mycobacterium
LANMAITVQGGRNLARR

SEQ ID NO: 687151 - protein, 25 aa, Mycobacterium
LANMLARCREHGGTFAVQRSRIGGV

SEQ ID NO: 687152 - protein, 25 aa, Mycobacterium
LANNTEVRWKLSLRVTPDAEPPFEA

SEQ ID NO: 687153 - protein, 26 aa, Mycobacterium
LANPHVIRFAGFLTRVGDAMRNMGID

SEQ ID NO: 687154 - protein, 25 aa, Mycobacterium
LANPKLLSRRPWRGLRKRIADVDNL

SEQ ID NO: 687155 - protein, 26 aa, Mycobacterium
LANPRFREHIPLMIGGSGEKKTIPLA

SEQ ID NO: 687156 - protein, 20 aa, Mycobacterium
LANRCLPAGKVLGAALRMAH

SEQ ID NO: 687157 - protein, 24 aa, Mycobacterium
LANRRELVELVAAWTRKRTPVRAA

SEQ ID NO: 687158 - protein, 19 aa, Mycobacterium
LANSAFYYGALRSLAEAEQ

SEQ ID NO: 687159 - protein, 19 aa, Mycobacterium
LANSAFYYGALRTLAEADP

SEQ ID NO: 687160 - protein, 18 aa, Mycobacterium
LANSLRGVHAVRGRVDGV

SEQ ID NO: 687161 - protein, 19 aa, Mycobacterium
LANTLRWNGLRPTQAAAVE

SEQ ID NO: 687162 - protein, 17 aa, Mycobacterium
LANTVARKGRPNRGPVY

SEQ ID NO: 687163 - protein, 25 aa, Mycobacterium
LAPAEIWRDYIRTVGRTPNGVWGGK

SEQ ID NO: 687164 - protein, 19 aa, Mycobacterium
LAPAELLADLGPHVEVIDA

SEQ ID NO: 687165 - protein, 23 aa, Mycobacterium
LAPAGKAIIEWSPPSYFAERPTG

SEQ ID NO: 687166 - protein, 18 aa, Mycobacterium
LAPALNRFFWGLSDKISR

SEQ ID NO: 687167 - protein, 25 aa, Mycobacterium
LAPALPVIRRLLVEDAIGSGVVVAV

SEQ ID NO: 687168 - protein, 23 aa, Mycobacterium
LAPAPSYRGFVSWLAQQDREAAR

SEQ ID NO: 687169 - protein, 18 aa, Mycobacterium
LAPARLGPITLRNRTIKA

SEQ ID NO: 687170 - protein, 19 aa, Mycobacterium
LAPARRRGLIQIFPNDVEL

SEQ ID NO: 687171 - protein, 18 aa, Mycobacterium
LAPARRRGLIQVFPNDVD

SEQ ID NO: 687172 - protein, 24 aa, Mycobacterium
LAPARTRITLTYDWSAVPDAIRQH

SEQ ID NO: 687173 - protein, 21 aa, Mycobacterium
LAPATIWRDYIQTVGRTPNGV

SEQ ID NO: 687174 - protein, 17 aa, Mycobacterium
LAPAVAAETARHAVQVA

SEQ ID NO: 687175 - protein, 20 aa, Mycobacterium
LAPAVARLRHLLDLDADPSA

SEQ ID NO: 687176 - protein, 19 aa, Mycobacterium
LAPAVRVPVHFSIAEHEKV

SEQ ID NO: 687177 - protein, 17 aa, Mycobacterium
LAPCDIATYAMGMAASM

SEQ ID NO: 687178 - protein, 23 aa, Mycobacterium
LAPDCCAVVAYGALLSQRLLAVP

SEQ ID NO: 687179 - protein, 17 aa, Mycobacterium
LAPDFGWAPWQGEASEW

SEQ ID NO: 687180 - protein, 22 aa, Mycobacterium
LAPDFPRIDWVSATTARQGVPF

SEQ ID NO: 687181 - protein, 19 aa, Mycobacterium
LAPDGRCKVYAGAADGTSW

SEQ ID NO: 687182 - protein, 25 aa, Mycobacterium
LAPDIDVRFGLGWGAVTVLDADARI

SEQ ID NO: 687183 - protein, 26 aa, Mycobacterium
LAPDLSCPLLGLFGLDDRFPAPAAVA

SEQ ID NO: 687184 - protein, 17 aa, Mycobacterium
LAPDPGIRRAILVAASM

SEQ ID NO: 687185 - protein, 20 aa, Mycobacterium
LAPDPPRKWWQPGTGELCIG

SEQ ID NO: 687186 - protein, 19 aa, Mycobacterium
LAPDRAVIVGPDVETWLRS

SEQ ID NO: 687187 - protein, 23 aa, Mycobacterium
LAPDVVDGLALFLPQATPAAKPG

SEQ ID NO: 687188 - protein, 17 aa, Mycobacterium
LAPEGRLLVIGFAAGAG

SEQ ID NO: 687189 - protein, 18 aa, Mycobacterium
LAPEHPCPAALDDVEASL

SEQ ID NO: 687190 - protein, 17 aa, Mycobacterium
LAPEHPFPAAADDVRAA

SEQ ID NO: 687191 - protein, 22 aa, Mycobacterium
LAPELFAGILAQVPFVDPLTTI

SEQ ID NO: 687192 - protein, 17 aa, Mycobacterium
LAPENGCRMGICHTCTR

SEQ ID NO: 687193 - protein, 17 aa, Mycobacterium
LAPESPYPMPLDDCEAG

SEQ ID NO: 687194 - protein, 25 aa, Mycobacterium
LAPESRPAALPFLSIKKITVHYRPR

SEQ ID NO: 687195 - protein, 23 aa, Mycobacterium
LAPESRPASSIAMNTKKITVHQR

SEQ ID NO: 687196 - protein, 17 aa, Mycobacterium
LAPEVEKAYQLLAPESR

SEQ ID NO: 687197 - protein, 24 aa, Mycobacterium
LAPEVPYYSATLFDPREEPYCDAN

SEQ ID NO: 687198 - protein, 25 aa, Mycobacterium
LAPFGFKRGGQWVYWDGTVAAESRH

SEQ ID NO: 687199 - protein, 20 aa, Mycobacterium
LAPFPPVRPLLRLLAELGTS

SEQ ID NO: 687200 - protein, 17 aa, Mycobacterium
LAPFRFTMMGDQGTDET

SEQ ID NO: 687201 - protein, 21 aa, Mycobacterium
LAPGARLWWQAGHRSTEPGHA

SEQ ID NO: 687202 - protein, 25 aa, Mycobacterium
LAPGGTGGVGGWLYGNGGAGGAGGV

SEQ ID NO: 687203 - protein, 24 aa, Mycobacterium
LAPGHGEWIKGFAGPFTLLVIADL

SEQ ID NO: 687204 - protein, 25 aa, Mycobacterium
LAPGLMQRLSVRFVAAQRASQARTA

SEQ ID NO: 687205 - protein, 18 aa, Mycobacterium
LAPGPFLACTLGARVAAR

SEQ ID NO: 687206 - protein, 28 aa, Mycobacterium
LAPGPGESWLRPTVDLVKGEAMTPLQRL

SEQ ID NO: 687207 - protein, 17 aa, Mycobacterium
LAPGQALVLDFEPPETR

SEQ ID NO: 687208 - protein, 17 aa, Mycobacterium
LAPGQRALVPTGVAVAI

SEQ ID NO: 687209 - protein, 19 aa, Mycobacterium
LAPGQRALVSTGIAVAIPH

SEQ ID NO: 687210 - protein, 17 aa, Mycobacterium
LAPGRAMIVIPREGYLQ

SEQ ID NO: 687211 - protein, 19 aa, Mycobacterium
LAPGRPCPVLSYQCAIDAV

SEQ ID NO: 687212 - protein, 20 aa, Mycobacterium
LAPGRRLSGVRVLDLTRVIA

SEQ ID NO: 687213 - protein, 17 aa, Mycobacterium
LAPGTGLRDGLERILRG

SEQ ID NO: 687214 - protein, 20 aa, Mycobacterium
LAPGTPLARVFAPRAEVVIT

SEQ ID NO: 687215 - protein, 18 aa, Mycobacterium
LAPGTPLARVFWPRTRIV

SEQ ID NO: 687216 - protein, 17 aa, Mycobacterium
LAPGVRVPVRFTLGEHD

SEQ ID NO: 687217 - protein, 17 aa, Mycobacterium
LAPHGRIVLLSGDGTPE

SEQ ID NO: 687218 - protein, 24 aa, Mycobacterium
LAPHIDLSRTVGWFTTKYPVALNF

SEQ ID NO: 687219 - protein, 24 aa, Mycobacterium
LAPHLVKPLPFLFPLTKRWWERPY

SEQ ID NO: 687220 - protein, 17 aa, Mycobacterium
LAPILAMLRTMRAAGST

SEQ ID NO: 687221 - protein, 18 aa, Mycobacterium
LAPIPSLLAVAGVHHHLV

SEQ ID NO: 687222 - protein, 20 aa, Mycobacterium
LAPKGTGAVLAFELSGGIDA

SEQ ID NO: 687223 - protein, 18 aa, Mycobacterium
LAPKGTGAVLSFELAGGI

SEQ ID NO: 687224 - protein, 19 aa, Mycobacterium
LAPKLPVIPLLSTVTDTGT

SEQ ID NO: 687225 - protein, 26 aa, Mycobacterium
LAPKRVLPVFGLRSAMPAEREAFVVP

SEQ ID NO: 687226 - protein, 18 aa, Mycobacterium
LAPKTMRTLIEKIVASEQ

SEQ ID NO: 687227 - protein, 21 aa, Mycobacterium
LAPLEPARISGVGNIGSDLAG

SEQ ID NO: 687228 - protein, 18 aa, Mycobacterium
LAPLHGWGPDPYLTPGLT

SEQ ID NO: 687229 - protein, 19 aa, Mycobacterium
LAPLPKRRLAETLDQYPNA

SEQ ID NO: 687230 - protein, 23 aa, Mycobacterium
LAPLPKRRLGETLDRYPSVQEYF

SEQ ID NO: 687231 - protein, 22 aa, Mycobacterium
LAPLPRRRLAETLDRYPNVKEK

SEQ ID NO: 687232 - protein, 23 aa, Mycobacterium
LAPLPRRRLRETLDRYPNAKEFF

SEQ ID NO: 687233 - protein, 17 aa, Mycobacterium
LAPLPSLRLQIGAPSVL

SEQ ID NO: 687234 - protein, 17 aa, Mycobacterium
LAPLRRVLGDRLELRKP

SEQ ID NO: 687235 - protein, 17 aa, Mycobacterium
LAPLVAGICGTDWQILR

SEQ ID NO: 687236 - protein, 22 aa, Mycobacterium
LAPMLWNRWDELTGYVREGVRR

SEQ ID NO: 687237 - protein, 24 aa, Mycobacterium
LAPNEYIITLGMHDFGKVSTDPDL

SEQ ID NO: 687238 - protein, 31 aa, Mycobacterium
LAPNFGKGTLFGAIRPDDVAAHFGRGTLVGK

SEQ ID NO: 687239 - protein, 19 aa, Mycobacterium
LAPNFRDIVIRHITFAPYH

SEQ ID NO: 687240 - protein, 26 aa, Mycobacterium
LAPNVPRIDGCLARLGVDRLAAVLPV

SEQ ID NO: 687241 - protein, 24 aa, Mycobacterium
LAPPDLWAAVVLVDITPRIEFHGA

SEQ ID NO: 687242 - protein, 22 aa, Mycobacterium
LAPPDREVWGGMSVFGRLRPLL

SEQ ID NO: 687243 - protein, 25 aa, Mycobacterium
LAPPEIWRAYIRTVGRTPNGVWGGK

SEQ ID NO: 687244 - protein, 24 aa, Mycobacterium
LAPPEPFAAHFVDLDLTVVAAGRD

SEQ ID NO: 687245 - protein, 18 aa, Mycobacterium
LAPPLNMNPHWLGAHPSY

SEQ ID NO: 687246 - protein, 17 aa, Mycobacterium
LAPPSWEALVDRLTGRG

SEQ ID NO: 687247 - protein, 23 aa, Mycobacterium
LAPPTARGWEAVAGDEIWNWTDE

SEQ ID NO: 687248 - protein, 21 aa, Mycobacterium
LAPQCCAVVAYGALLGDALLG

SEQ ID NO: 687249 - protein, 18 aa, Mycobacterium
LAPQPAREWREIDGVVIP

SEQ ID NO: 687250 - protein, 20 aa, Mycobacterium
LAPRAFKLAGEEALVYHPNP

SEQ ID NO: 687251 - protein, 18 aa, Mycobacterium
LAPREPLVAAARENIAFF

SEQ ID NO: 687252 - protein, 19 aa, Mycobacterium
LAPRHSCRIHWVACDLERD

SEQ ID NO: 687253 - protein, 27 aa, Mycobacterium
LAPRKQWPTGLAKLGIDLSGKITDGPA

SEQ ID NO: 687254 - protein, 17 aa, Mycobacterium
LAPRLGKGPAKAVVTNV

SEQ ID NO: 687255 - protein, 20 aa, Mycobacterium
LAPRLRLVPIRRGRGPGPAS

SEQ ID NO: 687256 - protein, 20 aa, Mycobacterium
LAPRQKRAFDRFNVKHYLKM

SEQ ID NO: 687257 - protein, 20 aa, Mycobacterium
LAPRYVDLRPFAVNDGDDVW

SEQ ID NO: 687258 - protein, 26 aa, Mycobacterium
LAPSLRWPQPNFPVSNFFHGGAAPLN

SEQ ID NO: 687259 - protein, 24 aa, Mycobacterium
LAPTAVEEIVRWASPVSYMRRTVT

SEQ ID NO: 687260 - protein, 22 aa, Mycobacterium
LAPTGGTVICLARGADPTAGRQ

SEQ ID NO: 687261 - protein, 24 aa, Mycobacterium
LAPTLPLIRRLLVEDAVDSGVVVA

SEQ ID NO: 687262 - protein, 17 aa, Mycobacterium
LAPVGGTLITIVRGRDD

SEQ ID NO: 687263 - protein, 19 aa, Mycobacterium
LAPVKAAVLPLSRHADLSP

SEQ ID NO: 687264 - protein, 19 aa, Mycobacterium
LAPVKARGGMFAQLCTDLP

SEQ ID NO: 687265 - protein, 25 aa, Mycobacterium
LAPVRFFNPIAMRFAKKATRDDIAD

SEQ ID NO: 687266 - protein, 24 aa, Mycobacterium
LAPVRFFNPIAMRFAKRATRDDID

SEQ ID NO: 687267 - protein, 19 aa, Mycobacterium
LAPWLKKPPPRGGFPMVSF

SEQ ID NO: 687268 - protein, 18 aa, Mycobacterium
LAPYEIPRDFIVETTPFT

SEQ ID NO: 687269 - protein, 25 aa, Mycobacterium
LAPYLNRPGLHWEFHVDETSQELWM

SEQ ID NO: 687270 - protein, 17 aa, Mycobacterium
LAPYPGQPVPIGRARTY

SEQ ID NO: 687271 - protein, 17 aa, Mycobacterium
LAQAAGVPVAFLTAWYG

SEQ ID NO: 687272 - protein, 20 aa, Mycobacterium
LAQADGRVPAGLIVASPANP

SEQ ID NO: 687273 - protein, 18 aa, Mycobacterium
LAQALEFTDPISGELRRF

SEQ ID NO: 687274 - protein, 18 aa, Mycobacterium
LAQALVKGGLRLVAAGAN

SEQ ID NO: 687275 - protein, 27 aa, Mycobacterium
LAQAPKGLSCFMLPRILPDGTRNRMLL

SEQ ID NO: 687276 - protein, 18 aa, Mycobacterium
LAQCLRGGAPGEVAKLVL

SEQ ID NO: 687277 - protein, 17 aa, Mycobacterium
LAQCLRGGTRGEVAQLI

SEQ ID NO: 687278 - protein, 18 aa, Mycobacterium
LAQEATTFVDAHDKLVAN

SEQ ID NO: 687279 - protein, 25 aa, Mycobacterium
LAQELCMLCQAGPPPDLGPAPAQFG

SEQ ID NO: 687280 - protein, 18 aa, Mycobacterium
LAQEQGVGVKVDQGSVMP

SEQ ID NO: 687281 - protein, 26 aa, Mycobacterium
LAQGDLRAAIELPLAATFGLGALGGM

SEQ ID NO: 687282 - protein, 17 aa, Mycobacterium
LAQGIGMYAALKHHADT

SEQ ID NO: 687283 - protein, 17 aa, Mycobacterium
LAQGIGMYAALRRHGEM

SEQ ID NO: 687284 - protein, 17 aa, Mycobacterium
LAQHGWQVTGMDFAHTA

SEQ ID NO: 687285 - protein, 25 aa, Mycobacterium
LAQHPRLPRREALKILGGEVSADDD

SEQ ID NO: 687286 - protein, 18 aa, Mycobacterium
LAQHRMWSVVQLQGPSAV

SEQ ID NO: 687287 - protein, 20 aa, Mycobacterium
LAQIERLPKGLARFPISRVV

SEQ ID NO: 687288 - protein, 24 aa, Mycobacterium
LAQIKRLKIGSGRRLAATTKETLV

SEQ ID NO: 687289 - protein, 24 aa, Mycobacterium
LAQIKRLKIGSGRRLASTTKETLV

SEQ ID NO: 687290 - protein, 24 aa, Mycobacterium
LAQIQRRLGITSVYVTHDQEEAMT

SEQ ID NO: 687291 - protein, 20 aa, Mycobacterium
LAQKERWLPELMTLEKIAAW

SEQ ID NO: 687292 - protein, 25 aa, Mycobacterium
LAQKERWLPELVTLEKIACWAITEP

SEQ ID NO: 687293 - protein, 24 aa, Mycobacterium
LAQKPRGAGLFLMGHSGGCELVMR

SEQ ID NO: 687294 - protein, 25 aa, Mycobacterium
LAQLPIDTCYRVGRKVLVRADAGGA

SEQ ID NO: 687295 - protein, 18 aa, Mycobacterium
LAQLPMDRINFRNMRAVS

SEQ ID NO: 687296 - protein, 20 aa, Mycobacterium
LAQLPRRSRVLLICRDEPTN

SEQ ID NO: 687297 - protein, 22 aa, Mycobacterium
LAQLRARLASLSVEDLEALLAY

SEQ ID NO: 687298 - protein, 22 aa, Mycobacterium
LAQLRARLTSLSIGDLEALLAY

SEQ ID NO: 687299 - protein, 22 aa, Mycobacterium
LAQLRRAGAEGDKVRCVDLALL

SEQ ID NO: 687300 - protein, 18 aa, Mycobacterium
LAQLRSDVGMVFQSFNLF

SEQ ID NO: 687301 - protein, 19 aa, Mycobacterium
LAQLTWRHDAEELARRLRA

SEQ ID NO: 687302 - protein, 19 aa, Mycobacterium
LAQLVKWSQLIGSDPDSLW

SEQ ID NO: 687303 - protein, 24 aa, Mycobacterium
LAQMFPGRIWAALGSGEASNERIT

SEQ ID NO: 687304 - protein, 18 aa, Mycobacterium
LAQMSALERFYLKTTALE

SEQ ID NO: 687305 - protein, 23 aa, Mycobacterium
LAQNICFLYHLLGGGTGDWDVPI

SEQ ID NO: 687306 - protein, 25 aa, Mycobacterium
LAQNRSRLVSLVAADVLGLNAPAIA

SEQ ID NO: 687307 - protein, 20 aa, Mycobacterium
LAQPDALDWLMGDDEQARRY

SEQ ID NO: 687308 - protein, 22 aa, Mycobacterium
LAQPEDIGWATAFLASDAASYI

SEQ ID NO: 687309 - protein, 23 aa, Mycobacterium
LAQQATGMLPDFIGKRLMQTAGV

SEQ ID NO: 687310 - protein, 20 aa, Mycobacterium
LAQQGWVCLSVDYRVSPHHR

SEQ ID NO: 687311 - protein, 17 aa, Mycobacterium
LAQQPGTLGTIFRKAQN

SEQ ID NO: 687312 - protein, 18 aa, Mycobacterium
LAQRAAMSPRHFTRVFTE

SEQ ID NO: 687313 - protein, 17 aa, Mycobacterium
LAQRARALDAFLRDVYS

SEQ ID NO: 687314 - protein, 20 aa, Mycobacterium
LAQRAVHRVVTLLGSGRSVL

SEQ ID NO: 687315 - protein, 23 aa, Mycobacterium
LAQRCKRLGRYVVGIGVAGASSQ

SEQ ID NO: 687316 - protein, 25 aa, Mycobacterium
LAQRFNARFPDTFVVPEPMIPKATA

SEQ ID NO: 687317 - protein, 18 aa, Mycobacterium
LAQRGHLQAAAAQGRLQV

SEQ ID NO: 687318 - protein, 18 aa, Mycobacterium
LAQRHQIRRYGFHGTSHR

SEQ ID NO: 687319 - protein, 17 aa, Mycobacterium
LAQRLAGQHGRTIVRHA

SEQ ID NO: 687320 - protein, 38 aa, Mycobacterium
LAQRLKHLYGRGVVVLGLPRGGVPVAFEVAKALQAPLD

SEQ ID NO: 687321 - protein, 17 aa, Mycobacterium
LAQRMGKKRVIAETGAG

SEQ ID NO: 687322 - protein, 25 aa, Mycobacterium
LAQRQGIEILGPVGVAARTAATVAD

SEQ ID NO: 687323 - protein, 22 aa, Mycobacterium
LAQRVASVAAFLRQRLTGDYSV

SEQ ID NO: 687324 - protein, 26 aa, Mycobacterium
LAQSVSRTMFGWLLGGLSRTSLGNTA

SEQ ID NO: 687325 - protein, 25 aa, Mycobacterium
LAQVADLFSAFGMYPVGYYDLREAA

SEQ ID NO: 687326 - protein, 17 aa, Mycobacterium
LAQVVKCVAQFGVADHL

SEQ ID NO: 687327 - protein, 20 aa, Mycobacterium
LARAAGLAIAERGGVLTDLS

SEQ ID NO: 687328 - protein, 23 aa, Mycobacterium
LARAEAARRGLTNATFEVADISS

SEQ ID NO: 687329 - protein, 21 aa, Mycobacterium
LARAEAFARAFGFHASRHSAD

SEQ ID NO: 687330 - protein, 27 aa, Mycobacterium
LARAFLMFVTQRWPDVLLTAAEDLPPQ

SEQ ID NO: 687331 - protein, 23 aa, Mycobacterium
LARAIPLPTQFEFMAVSSYGSST

SEQ ID NO: 687332 - protein, 24 aa, Mycobacterium
LARAIPLPTQFEFMAVSSYGSSTS

SEQ ID NO: 687333 - protein, 17 aa, Mycobacterium
LARALHPVLDRYDYVLI

SEQ ID NO: 687334 - protein, 26 aa, Mycobacterium
LARALPRSVALRMALMGKHERMTAER

SEQ ID NO: 687335 - protein, 27 aa, Mycobacterium
LARALPRSVALRMALMGKHERMTVERA

SEQ ID NO: 687336 - protein, 17 aa, Mycobacterium
LARARALILSLAHTRLR

SEQ ID NO: 687337 - protein, 22 aa, Mycobacterium
LARARRPLIVLGKGAAYAQADN

SEQ ID NO: 687338 - protein, 17 aa, Mycobacterium
LARAWTREAPLTGASRA

SEQ ID NO: 687339 - protein, 18 aa, Mycobacterium
LARAYGIEVSEFEDERVH

SEQ ID NO: 687340 - protein, 17 aa, Mycobacterium
LARCDRVVYTVGFERRR

SEQ ID NO: 687341 - protein, 25 aa, Mycobacterium
LARDAGLEVAERGGVLTDLGCVTSD

SEQ ID NO: 687342 - protein, 26 aa, Mycobacterium
LARDDCARLAAALVRVSLDTALRDKV

SEQ ID NO: 687343 - protein, 25 aa, Mycobacterium
LARDGEGRWGLGPAVTELAAHVNDP

SEQ ID NO: 687344 - protein, 17 aa, Mycobacterium
LARDLAVGLVELIHPRG

SEQ ID NO: 687345 - protein, 22 aa, Mycobacterium
LAREFTFAFPVQVIARIMGLPR

SEQ ID NO: 687346 - protein, 18 aa, Mycobacterium
LAREGGLSSTIWAGPAVI

SEQ ID NO: 687347 - protein, 24 aa, Mycobacterium
LAREGGLSSTMWAGPAVIGKSVRQ

SEQ ID NO: 687348 - protein, 22 aa, Mycobacterium
LAREHRMVLVLPVYEQEQPGVL

SEQ ID NO: 687349 - protein, 25 aa, Mycobacterium
LARELAESILVRKVDWVDEITRVHE

SEQ ID NO: 687350 - protein, 17 aa, Mycobacterium
LARELGSEFDIYVLDFP

SEQ ID NO: 687351 - protein, 19 aa, Mycobacterium
LARELPHQLLRSWYIAYFQ

SEQ ID NO: 687352 - protein, 19 aa, Mycobacterium
LARELPHQLLRSWYILYFQ

SEQ ID NO: 687353 - protein, 24 aa, Mycobacterium
LARELRPWVPVVSLVKGLEQGTNL

SEQ ID NO: 687354 - protein, 24 aa, Mycobacterium
LARELRPWVPVVSLVKGLEQGTNM

SEQ ID NO: 687355 - protein, 24 aa, Mycobacterium
LARENDILDGVEWPAEAKRPGTGQ

SEQ ID NO: 687356 - protein, 18 aa, Mycobacterium
LARERPVEADLVIGVPES

SEQ ID NO: 687357 - protein, 23 aa, Mycobacterium
LARETHARGGVLVVDNTTATPMG

SEQ ID NO: 687358 - protein, 19 aa, Mycobacterium
LAREVCLRLVHAVASPAPD

SEQ ID NO: 687359 - protein, 20 aa, Mycobacterium
LARFAYRRFGSGAGVPLVLA

SEQ ID NO: 687360 - protein, 18 aa, Mycobacterium
LARFKRFADAGVTDLSVR

SEQ ID NO: 687361 - protein, 17 aa, Mycobacterium
LARFSDICVEAFADVAI

SEQ ID NO: 687362 - protein, 22 aa, Mycobacterium
LARFWCEVLDFVVLSREEDGSL

SEQ ID NO: 687363 - protein, 25 aa, Mycobacterium
LARGDLALRMGLPVLAVVAYAQSYA

SEQ ID NO: 687364 - protein, 34 aa, Mycobacterium
LARGDYQGLVGVPLFDIAAAPGFGNTTTSYSSGF

SEQ ID NO: 687365 - protein, 20 aa, Mycobacterium
LARGRLRFSEDFGALADRDV

SEQ ID NO: 687366 - protein, 17 aa, Mycobacterium
LARGRVHIAAIAVGAAQ

SEQ ID NO: 687367 - protein, 27 aa, Mycobacterium
LARGSGLLPRMEPFVGELVGRGLAEMG

SEQ ID NO: 687368 - protein, 18 aa, Mycobacterium
LARGTAWLDTGTFDSLLD

SEQ ID NO: 687369 - protein, 25 aa, Mycobacterium
LARHAGRIPRRFWAQASSPAPDRPL

SEQ ID NO: 687370 - protein, 21 aa, Mycobacterium
LARHDYDLVRWLASHGMALTW

SEQ ID NO: 687371 - protein, 34 aa, Mycobacterium
LARHGEWLAPGGFDFGAWHFKRGCEALAERHELD

SEQ ID NO: 687372 - protein, 21 aa, Mycobacterium
LARHLGAPAVRLEQLHADYLA

SEQ ID NO: 687373 - protein, 17 aa, Mycobacterium
LARHLRLPAGWDDAERQ

SEQ ID NO: 687374 - protein, 27 aa, Mycobacterium
LARHPRLTKAFLRFSNHLLFRSTLDPR

SEQ ID NO: 687375 - protein, 22 aa, Mycobacterium
LARKYFKSHLDSSVRTVAPRKG

SEQ ID NO: 687376 - protein, 17 aa, Mycobacterium
LARLAERGLRRILTEGG

SEQ ID NO: 687377 - protein, 18 aa, Mycobacterium
LARLCGKQLVLPMNSGAE

SEQ ID NO: 687378 - protein, 23 aa, Mycobacterium
LARLCNTAMWIDHGTIKMSGGIE

SEQ ID NO: 687379 - protein, 17 aa, Mycobacterium
LARLDEWDDVIAARNEQ

SEQ ID NO: 687380 - protein, 25 aa, Mycobacterium
LARLELKLMLGKILQRLPDMRLADE

SEQ ID NO: 687381 - protein, 26 aa, Mycobacterium
LARLPAPPLPTARLRPRPIPRRKEST

SEQ ID NO: 687382 - protein, 17 aa, Mycobacterium
LARLPLLHPDGLREHTG

SEQ ID NO: 687383 - protein, 19 aa, Mycobacterium
LARLQEVWVGRQIAEVKSK

SEQ ID NO: 687384 - protein, 21 aa, Mycobacterium
LARLRANGELVEMRSDDLRFG

SEQ ID NO: 687385 - protein, 20 aa, Mycobacterium
LARLREWEAAGGPVIEDSVV

SEQ ID NO: 687386 - protein, 30 aa, Mycobacterium
LARLRQTLLSWRGCRCNWLQYRTGARRLVS

SEQ ID NO: 687387 - protein, 18 aa, Mycobacterium
LARLRYVPLAGGDVSVKR

SEQ ID NO: 687388 - protein, 25 aa, Mycobacterium
LARLTKGILPDGVFNVVLGTAATGS

SEQ ID NO: 687389 - protein, 17 aa, Mycobacterium
LARLWSTALAGLVDIGY

SEQ ID NO: 687390 - protein, 17 aa, Mycobacterium
LARMAGMSTSVFHRHFR

SEQ ID NO: 687391 - protein, 19 aa, Mycobacterium
LARMLPMVRDVRRIGSAAL

SEQ ID NO: 687392 - protein, 25 aa, Mycobacterium
LARMMRLLGLDVWWSSVADDPALVD

SEQ ID NO: 687393 - protein, 23 aa, Mycobacterium
LARMPWQDACIVSSRALFDALRR

SEQ ID NO: 687394 - protein, 19 aa, Mycobacterium
LARNLGIDPFEFRRRNVIV

SEQ ID NO: 687395 - protein, 21 aa, Mycobacterium
LARPEFKAMFLDDLLNGSRKQ

SEQ ID NO: 687396 - protein, 22 aa, Mycobacterium
LARPEFKAMFLDDLLNGSRKQL

SEQ ID NO: 687397 - protein, 25 aa, Mycobacterium
LARPKRYAAGFSRELEDEWQLPDAV

SEQ ID NO: 687398 - protein, 25 aa, Mycobacterium
LARPKRYAAGFSRELEDEWQLPEAV

SEQ ID NO: 687399 - protein, 20 aa, Mycobacterium
LARPTLKLLNIVPGPLAGAL

SEQ ID NO: 687400 - protein, 21 aa, Mycobacterium
LARQKDHSWSRVVIEKPFGHD

SEQ ID NO: 687401 - protein, 18 aa, Mycobacterium
LARRCVELLAPALTRRHP

SEQ ID NO: 687402 - protein, 22 aa, Mycobacterium
LARRDVAVCKPVQTGTIDGDDD

SEQ ID NO: 687403 - protein, 21 aa, Mycobacterium
LARRFGAAKVLAHEPRSDLIE

SEQ ID NO: 687404 - protein, 19 aa, Mycobacterium
LARRGCVFVSVNYRVGAYG

SEQ ID NO: 687405 - protein, 18 aa, Mycobacterium
LARRGRGTAAIFLNARGG

SEQ ID NO: 687406 - protein, 17 aa, Mycobacterium
LARRGRGTPAIFLNARG

SEQ ID NO: 687407 - protein, 18 aa, Mycobacterium
LARRGRGTPAIFLNARGG

SEQ ID NO: 687408 - protein, 20 aa, Mycobacterium
LARRLGISAGDKVALINAPS

SEQ ID NO: 687409 - protein, 17 aa, Mycobacterium
LARRNSDVFQRLQEKLN

SEQ ID NO: 687410 - protein, 19 aa, Mycobacterium
LARRPRPLTRGAVELVNAA

SEQ ID NO: 687411 - protein, 26 aa, Mycobacterium
LARRQGIEILGPVGLAARTAATVADA

SEQ ID NO: 687412 - protein, 21 aa, Mycobacterium
LARRQSIEILGPVGVAARTAA

SEQ ID NO: 687413 - protein, 21 aa, Mycobacterium
LARRRKLRVELDGLAIALFEA

SEQ ID NO: 687414 - protein, 22 aa, Mycobacterium
LARRSAELGIRVLRYGSAEPEG

SEQ ID NO: 687415 - protein, 25 aa, Mycobacterium
LARRSDVFLTSFLPGARRKFGIDLE

SEQ ID NO: 687416 - protein, 25 aa, Mycobacterium
LARRSGATLRWYGVTDDGRIDLDSL

SEQ ID NO: 687417 - protein, 20 aa, Mycobacterium
LARRTGCAVRTAVLLFDEVV

SEQ ID NO: 687418 - protein, 17 aa, Mycobacterium
LARRTICVDESVLRMQN

SEQ ID NO: 687419 - protein, 26 aa, Mycobacterium
LARRWADRRIRVYSMHPGWADTPGVA

SEQ ID NO: 687420 - protein, 22 aa, Mycobacterium
LARRYGNVFTLNIPIYGRVVVV

SEQ ID NO: 687421 - protein, 23 aa, Mycobacterium
LARSCRVTVNIVLQAAFAQLLSW

SEQ ID NO: 687422 - protein, 25 aa, Mycobacterium
LARSGLPFGTCLNATYLHPCGSEEF

SEQ ID NO: 687423 - protein, 20 aa, Mycobacterium
LARSMLIDGFDFVLDLDRSR

SEQ ID NO: 687424 - protein, 21 aa, Mycobacterium
LARSMNFYAAMSIADGNLDPL

SEQ ID NO: 687425 - protein, 23 aa, Mycobacterium
LARTHLTYGEWLRRERRRSEARS

SEQ ID NO: 687426 - protein, 21 aa, Mycobacterium
LARTIGGTDFVWLPRGLTRDS

SEQ ID NO: 687427 - protein, 27 aa, Mycobacterium
LARTKIVPVSFGFPFGLSAVLPLNVPL

SEQ ID NO: 687428 - protein, 18 aa, Mycobacterium
LARTRAWHTTEVNGQLLV

SEQ ID NO: 687429 - protein, 24 aa, Mycobacterium
LARVFAGQSTRHWEEVAETVDIPI

SEQ ID NO: 687430 - protein, 26 aa, Mycobacterium
LARVHRARREGAPAMVHVDLYRLLDQ

SEQ ID NO: 687431 - protein, 18 aa, Mycobacterium
LARWCASGPVGLPAPEAL

SEQ ID NO: 687432 - protein, 17 aa, Mycobacterium
LARYCLNSSALSPIAGE

SEQ ID NO: 687433 - protein, 24 aa, Mycobacterium
LARYKAPKEFLFVDRVRRLGNGKA

SEQ ID NO: 687434 - protein, 24 aa, Mycobacterium
LARYKLPKRLSVVDQLPRNVTGKV

SEQ ID NO: 687435 - protein, 20 aa, Mycobacterium
LARYWLGKNAQIIDRAIAVR

SEQ ID NO: 687436 - protein, 17 aa, Mycobacterium
LASAGGYGLITPDLIPD

SEQ ID NO: 687437 - protein, 28 aa, Mycobacterium
LASAGVVRPDLVIGWWAVPTILEHGSPE

SEQ ID NO: 687438 - protein, 27 aa, Mycobacterium
LASARGHVLPALMVDRLTRHTAGHPGH

SEQ ID NO: 687439 - protein, 19 aa, Mycobacterium
LASCCLVRRVPHSNLSVGI

SEQ ID NO: 687440 - protein, 19 aa, Mycobacterium
LASDARLTGKTGLTGKTGL

SEQ ID NO: 687441 - protein, 26 aa, Mycobacterium
LASDLKRFGEWLTIFAGWKSEVPAEI

SEQ ID NO: 687442 - protein, 24 aa, Mycobacterium
LASEAGISRASFYIYFEDKGHLLR

SEQ ID NO: 687443 - protein, 26 aa, Mycobacterium
LASEFTGPMYACWPIEDRLDAFLLHN

SEQ ID NO: 687444 - protein, 19 aa, Mycobacterium
LASEIPLRAKLFALDEREH

SEQ ID NO: 687445 - protein, 19 aa, Mycobacterium
LASEMPLDGLTVAASQFGI

SEQ ID NO: 687446 - protein, 29 aa, Mycobacterium
LASEQLGVARWCFDTTLAYTKERKQFGRA

SEQ ID NO: 687447 - protein, 17 aa, Mycobacterium
LASERRASWVYYQVVPE

SEQ ID NO: 687448 - protein, 19 aa, Mycobacterium
LASFGELQWHDGYAVTIVV

SEQ ID NO: 687449 - protein, 17 aa, Mycobacterium
LASFRTNVIAPFLLTGA

SEQ ID NO: 687450 - protein, 17 aa, Mycobacterium
LASGAPVDEVWPGILGF

SEQ ID NO: 687451 - protein, 24 aa, Mycobacterium
LASGCRLGVIGAGFVGLEIAATAV

SEQ ID NO: 687452 - protein, 20 aa, Mycobacterium
LASGELIATVAAPPIAPRAL

SEQ ID NO: 687453 - protein, 18 aa, Mycobacterium
LASGELIATVAMPPQAPR

SEQ ID NO: 687454 - protein, 25 aa, Mycobacterium
LASGEQWLSVCGFRRAENAEPAEPA

SEQ ID NO: 687455 - protein, 24 aa, Mycobacterium
LASGGRFTLGLGMTHQAVTEGMWG

SEQ ID NO: 687456 - protein, 17 aa, Mycobacterium
LASGHRYGWPVAQGGSG

SEQ ID NO: 687457 - protein, 18 aa, Mycobacterium
LASGLPMGGDLEFADELT

SEQ ID NO: 687458 - protein, 20 aa, Mycobacterium
LASGWPGEWVQHESTLPPRQ

SEQ ID NO: 687459 - protein, 17 aa, Mycobacterium
LASIGGFAREAADLVAA

SEQ ID NO: 687460 - protein, 18 aa, Mycobacterium
LASIIAFGSPVDTLAALP

SEQ ID NO: 687461 - protein, 18 aa, Mycobacterium
LASKATRDADGWVLDATK

SEQ ID NO: 687462 - protein, 17 aa, Mycobacterium
LASKIAIASMAASQMRH

SEQ ID NO: 687463 - protein, 17 aa, Mycobacterium
LASKPWVKTSMAPGSQV

SEQ ID NO: 687464 - protein, 17 aa, Mycobacterium
LASLAAMLTIRPTLAIG

SEQ ID NO: 687465 - protein, 18 aa, Mycobacterium
LASLAVRGTLALFGASSG

SEQ ID NO: 687466 - protein, 18 aa, Mycobacterium
LASLGRPATVAVQPVPWP

SEQ ID NO: 687467 - protein, 18 aa, Mycobacterium
LASLMAEPMRARFPAAPD

SEQ ID NO: 687468 - protein, 28 aa, Mycobacterium
LASLPERERTVLVLRFFESMTQTQIAER

SEQ ID NO: 687469 - protein, 18 aa, Mycobacterium
LASLPGCALLVDADEMRR

SEQ ID NO: 687470 - protein, 25 aa, Mycobacterium
LASLPHRPGAVITREDVLSAAGGTG

SEQ ID NO: 687471 - protein, 17 aa, Mycobacterium
LASLRRWTGDSIPDADI

SEQ ID NO: 687472 - protein, 18 aa, Mycobacterium
LASLRSARLINIDTRVRF

SEQ ID NO: 687473 - protein, 17 aa, Mycobacterium
LASLVAKHGPVMFHQSG

SEQ ID NO: 687474 - protein, 19 aa, Mycobacterium
LASLVGCGVATGFGAAVNR

SEQ ID NO: 687475 - protein, 19 aa, Mycobacterium
LASMAGLVARMAPRAAKDV

SEQ ID NO: 687476 - protein, 19 aa, Mycobacterium
LASMDAIASYCLTEPGAGS

SEQ ID NO: 687477 - protein, 18 aa, Mycobacterium
LASMETIASYCLTEPGAG

SEQ ID NO: 687478 - protein, 19 aa, Mycobacterium
LASMGWRAKVNRLPDPDNP

SEQ ID NO: 687479 - protein, 25 aa, Mycobacterium
LASMMPMRVIGMLLGIPEGDQISVR

SEQ ID NO: 687480 - protein, 25 aa, Mycobacterium
LASMMPMRVIGMLLGIPESDQIGVR

SEQ ID NO: 687481 - protein, 17 aa, Mycobacterium
LASPAIKDWIAFARETD

SEQ ID NO: 687482 - protein, 19 aa, Mycobacterium
LASPALNYPLTQYMFCAPD

SEQ ID NO: 687483 - protein, 17 aa, Mycobacterium
LASPEPWIERFERCWQL

SEQ ID NO: 687484 - protein, 20 aa, Mycobacterium
LASPFAFSGLSFFHTIEYQM

SEQ ID NO: 687485 - protein, 24 aa, Mycobacterium
LASPGRPGRRVAVVGRDPRASGEM

SEQ ID NO: 687486 - protein, 17 aa, Mycobacterium
LASPKRPQAPVVPVISS

SEQ ID NO: 687487 - protein, 17 aa, Mycobacterium
LASPLVVVDAEYRDIVA

SEQ ID NO: 687488 - protein, 27 aa, Mycobacterium
LASQGKGAWPTCGKVLSAATPRNVVDE

SEQ ID NO: 687489 - protein, 23 aa, Mycobacterium
LASQLVPWQSILKGLPGMGSAGA

SEQ ID NO: 687490 - protein, 23 aa, Mycobacterium
LASRADCILGRFITGEVTADGCR

SEQ ID NO: 687491 - protein, 23 aa, Mycobacterium
LASRIRFGVTVVRAEFDEESTLW

SEQ ID NO: 687492 - protein, 25 aa, Mycobacterium
LASRMPCPYLNPGRYVCDRPLVQGM

SEQ ID NO: 687493 - protein, 22 aa, Mycobacterium
LASRPRVVVVGGGIAGLTAATG

SEQ ID NO: 687494 - protein, 17 aa, Mycobacterium
LASRPTFQKGLAHHVAA

SEQ ID NO: 687495 - protein, 22 aa, Mycobacterium
LASRQPCHWLNPGPYTAGQPLV

SEQ ID NO: 687496 - protein, 23 aa, Mycobacterium
LASRSRTALVLGTACLGLAKILE

SEQ ID NO: 687497 - protein, 17 aa, Mycobacterium
LASRVGGTALALDVTSE

SEQ ID NO: 687498 - protein, 19 aa, Mycobacterium
LASRWRRFDGGPGELLDLS

SEQ ID NO: 687499 - protein, 19 aa, Mycobacterium
LASSLRVGRMTVRAALARL

SEQ ID NO: 687500 - protein, 21 aa, Mycobacterium
LASSRPGVDWTSGEYYSRHKI

SEQ ID NO: 687501 - protein, 17 aa, Mycobacterium
LASSVGITWTSELLTVT

SEQ ID NO: 687502 - protein, 17 aa, Mycobacterium
LASSWAAFTVHAALFLR

SEQ ID NO: 687503 - protein, 18 aa, Mycobacterium
LASTMAEMQEFYDVAFPL

SEQ ID NO: 687504 - protein, 25 aa, Mycobacterium
LASTMPMRVIGMLLGIPESEQIGVR

SEQ ID NO: 687505 - protein, 25 aa, Mycobacterium
LASTYVLCASFLKSLGVQPDDGPVD

SEQ ID NO: 687506 - protein, 17 aa, Mycobacterium
LASVAATCGIPMQAEMG

SEQ ID NO: 687507 - protein, 23 aa, Mycobacterium
LASVDCRFCHVSVKVKKLGPAHT

SEQ ID NO: 687508 - protein, 20 aa, Mycobacterium
LASVDRYRAATARAIGRFLS

SEQ ID NO: 687509 - protein, 18 aa, Mycobacterium
LASVSGHIWLSENGGGTV

SEQ ID NO: 687510 - protein, 17 aa, Mycobacterium
LASWPSGEARVLGQCHP

SEQ ID NO: 687511 - protein, 17 aa, Mycobacterium
LASYDGRNRVNPPLRES

SEQ ID NO: 687512 - protein, 29 aa, Mycobacterium
LATAATWPDPWPMYRALRDQDPVHHVIPA

SEQ ID NO: 687513 - protein, 18 aa, Mycobacterium
LATAATWSNPWPMYRALR

SEQ ID NO: 687514 - protein, 27 aa, Mycobacterium
LATADTWRNPWPMYRALRDRDPVHHVV

SEQ ID NO: 687515 - protein, 17 aa, Mycobacterium
LATAFAFDEAARRRVGL

SEQ ID NO: 687516 - protein, 39 aa, Mycobacterium
LATAFGGGHNVCYAAKAFLCSEIARWVDEEGLSLDVSTG

SEQ ID NO: 687517 - protein, 24 aa, Mycobacterium
LATAGAAVHVWGPPSYPGCRPAPI

SEQ ID NO: 687518 - protein, 18 aa, Mycobacterium
LATAGAFACFGMSRREGL

SEQ ID NO: 687519 - protein, 18 aa, Mycobacterium
LATAGALGCFGITRREGL

SEQ ID NO: 687520 - protein, 20 aa, Mycobacterium
LATAGGWGVARVWLGVNQAN

SEQ ID NO: 687521 - protein, 18 aa, Mycobacterium
LATALAGLTPRKAAVPVY

SEQ ID NO: 687522 - protein, 17 aa, Mycobacterium
LATALLRHWKNGKPLPT

SEQ ID NO: 687523 - protein, 25 aa, Mycobacterium
LATALPFGAASTFALLLALLDDPYL

SEQ ID NO: 687524 - protein, 17 aa, Mycobacterium
LATALSVTTDDLLRAPE

SEQ ID NO: 687525 - protein, 18 aa, Mycobacterium
LATAPGDFYTGEFAERAV

SEQ ID NO: 687526 - protein, 18 aa, Mycobacterium
LATAPVITEWCQLPEGTT

SEQ ID NO: 687527 - protein, 18 aa, Mycobacterium
LATARGWITALRAYNNSG

SEQ ID NO: 687528 - protein, 18 aa, Mycobacterium
LATARRFAEILPHAQLVN

SEQ ID NO: 687529 - protein, 18 aa, Mycobacterium
LATARRLLAEGGTVVGAD

SEQ ID NO: 687530 - protein, 18 aa, Mycobacterium
LATARSFFTPLGMHTRAA

SEQ ID NO: 687531 - protein, 18 aa, Mycobacterium
LATCSGYGLNWRFGAENL

SEQ ID NO: 687532 - protein, 17 aa, Mycobacterium
LATDAGLLVAGMNEQRL

SEQ ID NO: 687533 - protein, 18 aa, Mycobacterium
LATDAGRLLLTVRDEFAG

SEQ ID NO: 687534 - protein, 18 aa, Mycobacterium
LATDCARAVLDHDVDVAL

SEQ ID NO: 687535 - protein, 17 aa, Mycobacterium
LATDLAAFVARIRPAFL

SEQ ID NO: 687536 - protein, 18 aa, Mycobacterium
LATDSWLSAASFQETTRV

SEQ ID NO: 687537 - protein, 18 aa, Mycobacterium
LATDVLRQLRMVKEAAEV

SEQ ID NO: 687538 - protein, 17 aa, Mycobacterium
LATDVLRRLRMIKDDAE

SEQ ID NO: 687539 - protein, 17 aa, Mycobacterium
LATEADYVRMWVQAATT

SEQ ID NO: 687540 - protein, 18 aa, Mycobacterium
LATEAGISRASFYIYFDD

SEQ ID NO: 687541 - protein, 22 aa, Mycobacterium
LATEEMIRWVTPVKEFMRTAVA

SEQ ID NO: 687542 - protein, 21 aa, Mycobacterium
LATEEMIRWVTPVKQFMRTAS

SEQ ID NO: 687543 - protein, 21 aa, Mycobacterium
LATEFGKLGLLGMHLEGYGCG

SEQ ID NO: 687544 - protein, 19 aa, Mycobacterium
LATEIRKLAPRHWVQTPYR

SEQ ID NO: 687545 - protein, 23 aa, Mycobacterium
LATELGRPLSLVAESDMNDPRLI

SEQ ID NO: 687546 - protein, 17 aa, Mycobacterium
LATEQVMRIASDPPMTG

SEQ ID NO: 687547 - protein, 17 aa, Mycobacterium
LATERLKVIAAVHPGLW

SEQ ID NO: 687548 - protein, 17 aa, Mycobacterium
LATEYAKVREQYGSAIG

SEQ ID NO: 687549 - protein, 25 aa, Mycobacterium
LATFPHPRYELIPQMLVHDGDAAVR

SEQ ID NO: 687550 - protein, 20 aa, Mycobacterium
LATFPVQIRDGAVYVDVSAI

SEQ ID NO: 687551 - protein, 18 aa, Mycobacterium
LATGCARVNLGTAALENP

SEQ ID NO: 687552 - protein, 28 aa, Mycobacterium
LATGGFEWDPVLVRAFLRGPMHGAVSPP

SEQ ID NO: 687553 - protein, 17 aa, Mycobacterium
LATGVMRALRMVKEECE

SEQ ID NO: 687554 - protein, 18 aa, Mycobacterium
LATHGASCRFVTADLTTD

SEQ ID NO: 687555 - protein, 24 aa, Mycobacterium
LATHLKRTAPLIGMSKTTVRQPHQ

SEQ ID NO: 687556 - protein, 19 aa, Mycobacterium
LATHLPLDLVIIMLGTNDT

SEQ ID NO: 687557 - protein, 17 aa, Mycobacterium
LATKHLIRHPGLQRAAE

SEQ ID NO: 687558 - protein, 26 aa, Mycobacterium
LATKLVAAVRARCAVDVGVQDVFEHA

SEQ ID NO: 687559 - protein, 18 aa, Mycobacterium
LATLAHRVGWPIPIGGSQ

SEQ ID NO: 687560 - protein, 27 aa, Mycobacterium
LATLARLDEALGWAHGSSRAILDGGVP

SEQ ID NO: 687561 - protein, 28 aa, Mycobacterium
LATLPEQFRLAIYYRDVVGLRYREIAEI

SEQ ID NO: 687562 - protein, 24 aa, Mycobacterium
LATLREFTLFYAPNINSYKRFAEG

SEQ ID NO: 687563 - protein, 18 aa, Mycobacterium
LATLRFHPMQAVTASQRH

SEQ ID NO: 687564 - protein, 22 aa, Mycobacterium
LATLRRRAIKAADEAKSAKTAA

SEQ ID NO: 687565 - protein, 22 aa, Mycobacterium
LATLSFRPLQFVTEGHRKRADA

SEQ ID NO: 687566 - protein, 17 aa, Mycobacterium
LATMAWPPPGTPPDRHW

SEQ ID NO: 687567 - protein, 17 aa, Mycobacterium
LATMEAQIGVTLAVRTT

SEQ ID NO: 687568 - protein, 18 aa, Mycobacterium
LATNIAEFSGVQVAHGAL

SEQ ID NO: 687569 - protein, 24 aa, Mycobacterium
LATPDFAAAEAWCQAHEAEGINHY

SEQ ID NO: 687570 - protein, 23 aa, Mycobacterium
LATPEIMGSLNLADRSYARLAQH

SEQ ID NO: 687571 - protein, 28 aa, Mycobacterium
LATPGPLEWDCFRFAIIQRDDHFTFCVS

SEQ ID NO: 687572 - protein, 22 aa, Mycobacterium
LATPSVRLLSVFDYHAEVDSQR

SEQ ID NO: 687573 - protein, 22 aa, Mycobacterium
LATQAACRVLRDGGTAADAVVA

SEQ ID NO: 687574 - protein, 29 aa, Mycobacterium
LATQGRGAWPVCGHGLSAATPRDVPAPAA

SEQ ID NO: 687575 - protein, 17 aa, Mycobacterium
LATQIAYLDIVSNGRYT

SEQ ID NO: 687576 - protein, 19 aa, Mycobacterium
LATQREVIFWDQLGCGKSK

SEQ ID NO: 687577 - protein, 18 aa, Mycobacterium
LATRAVRDGDEWVINGQK

SEQ ID NO: 687578 - protein, 18 aa, Mycobacterium
LATRHLIKHPGLQRAAER

SEQ ID NO: 687579 - protein, 18 aa, Mycobacterium
LATRHLLQHPGLQRAAGR

SEQ ID NO: 687580 - protein, 19 aa, Mycobacterium
LATRLRLLLDDGPASALLD

SEQ ID NO: 687581 - protein, 20 aa, Mycobacterium
LATRLSGLFRTRRFRVYTTD

SEQ ID NO: 687582 - protein, 17 aa, Mycobacterium
LATRPGVVGYVLRDRTT

SEQ ID NO: 687583 - protein, 24 aa, Mycobacterium
LATRRWPFDRITRESTGFAGLAPL

SEQ ID NO: 687584 - protein, 17 aa, Mycobacterium
LATRSDPLLPLARLRAN

SEQ ID NO: 687585 - protein, 18 aa, Mycobacterium
LATRVGLRQDVKRIPLFG

SEQ ID NO: 687586 - protein, 24 aa, Mycobacterium
LATRVMGALESWGHTNVIAVSEVE

SEQ ID NO: 687587 - protein, 24 aa, Mycobacterium
LATSLELPWRRPIASLNYLLSSHV

SEQ ID NO: 687588 - protein, 18 aa, Mycobacterium
LATTAVRTPSGYRLDGVK

SEQ ID NO: 687589 - protein, 24 aa, Mycobacterium
LATTRRPRIAAVRADYDKVVRQRT

SEQ ID NO: 687590 - protein, 17 aa, Mycobacterium
LATVCRFNESAAAGDDG

SEQ ID NO: 687591 - protein, 18 aa, Mycobacterium
LATVKFVFDRWLSTDPPS

SEQ ID NO: 687592 - protein, 25 aa, Mycobacterium
LATVLARNTFHWVLAFAHRGLSTPK

SEQ ID NO: 687593 - protein, 25 aa, Mycobacterium
LATVLARNVFHWVFAFADGGLATPQ

SEQ ID NO: 687594 - protein, 20 aa, Mycobacterium
LATVLDRCSYLRDGIAVRDD

SEQ ID NO: 687595 - protein, 24 aa, Mycobacterium
LATVRGGGLATVLSTARPGTVVLP

SEQ ID NO: 687596 - protein, 17 aa, Mycobacterium
LATWKRLCDPMAQQIST

SEQ ID NO: 687597 - protein, 17 aa, Mycobacterium
LATWRLGAVYVPLFTAF

SEQ ID NO: 687598 - protein, 18 aa, Mycobacterium
LATYDAAAAWVRMAHAYR

SEQ ID NO: 687599 - protein, 24 aa, Mycobacterium
LATYRAGDELIMLVQRPDGVYGRI

SEQ ID NO: 687600 - protein, 27 aa, Mycobacterium
LAVAAARLRPERLVFWDCYRPHEVQVR

SEQ ID NO: 687601 - protein, 31 aa, Mycobacterium
LAVACGLARHVLCFRTLWEATHGELMKQGKI

SEQ ID NO: 687602 - protein, 21 aa, Mycobacterium
LAVACGLDPIELRVRNDPEVD

SEQ ID NO: 687603 - protein, 21 aa, Mycobacterium
LAVADGRIVAVGSRSDVEAYV

SEQ ID NO: 687604 - protein, 21 aa, Mycobacterium
LAVADGRIVAVGTRAEVADAI

SEQ ID NO: 687605 - protein, 23 aa, Mycobacterium
LAVAEMGFRINAVLPGPVETPIL

SEQ ID NO: 687606 - protein, 19 aa, Mycobacterium
LAVAERAPVCIAMTSGTAV

SEQ ID NO: 687607 - protein, 17 aa, Mycobacterium
LAVAGRRVQQEIFNQFD

SEQ ID NO: 687608 - protein, 17 aa, Mycobacterium
LAVALAIASAYFDIAMP

SEQ ID NO: 687609 - protein, 27 aa, Mycobacterium
LAVALGIAGLAAWLPLTRHADVSAGQS

SEQ ID NO: 687610 - protein, 17 aa, Mycobacterium
LAVALHADFPPERITLH

SEQ ID NO: 687611 - protein, 17 aa, Mycobacterium
LAVALHANFPPERITLH

SEQ ID NO: 687612 - protein, 20 aa, Mycobacterium
LAVAQRVGNRPGLVMRPLPE

SEQ ID NO: 687613 - protein, 18 aa, Mycobacterium
LAVAREIVGPDVLIGRST

SEQ ID NO: 687614 - protein, 26 aa, Mycobacterium
LAVARVRRGPLCLGIDPHPELLRSWN

SEQ ID NO: 687615 - protein, 17 aa, Mycobacterium
LAVATAIAWSKALDTGG

SEQ ID NO: 687616 - protein, 19 aa, Mycobacterium
LAVAYARELARWGIETTII

SEQ ID NO: 687617 - protein, 23 aa, Mycobacterium
LAVDRAGVRLGRGRGFYDRSLGG

SEQ ID NO: 687618 - protein, 20 aa, Mycobacterium
LAVDSGLAWVSLRPSVFASN

SEQ ID NO: 687619 - protein, 24 aa, Mycobacterium
LAVELARSGAKIAISDIDNEGLAE

SEQ ID NO: 687620 - protein, 25 aa, Mycobacterium
LAVELARSGAKIAISDIDNEGLAET

SEQ ID NO: 687621 - protein, 24 aa, Mycobacterium
LAVELARSGAKVAISDVDLEGLAE

SEQ ID NO: 687622 - protein, 25 aa, Mycobacterium
LAVELGRAGAKVAISDVDTAGLAQT

SEQ ID NO: 687623 - protein, 24 aa, Mycobacterium
LAVFEGRQRFPLSARVGDRYPASV

SEQ ID NO: 687624 - protein, 17 aa, Mycobacterium
LAVFHPKGGIVRRELED

SEQ ID NO: 687625 - protein, 20 aa, Mycobacterium
LAVGHWLRRWWPASQRDDIA

SEQ ID NO: 687626 - protein, 24 aa, Mycobacterium
LAVGKRLYERFGIDEKPTASDDGI

SEQ ID NO: 687627 - protein, 25 aa, Mycobacterium
LAVGLPPTLPHEFPITDTPRYRDIG

SEQ ID NO: 687628 - protein, 25 aa, Mycobacterium
LAVGQRVVLVFLPRCGHCPSCATEG

SEQ ID NO: 687629 - protein, 19 aa, Mycobacterium
LAVGRRLRDRYGLDEKPTA

SEQ ID NO: 687630 - protein, 17 aa, Mycobacterium
LAVHAAAPCPPDVKDAM

SEQ ID NO: 687631 - protein, 29 aa, Mycobacterium
LAVIGGAFGRYGGVWAHDDTRKSFGIAGA

SEQ ID NO: 687632 - protein, 20 aa, Mycobacterium
LAVKAFRPGRLPFPVMHVDT

SEQ ID NO: 687633 - protein, 20 aa, Mycobacterium
LAVLAARLRAAGARVDMAYG

SEQ ID NO: 687634 - protein, 18 aa, Mycobacterium
LAVLAGQLRSAGVRVDLA

SEQ ID NO: 687635 - protein, 18 aa, Mycobacterium
LAVLERLERLAGHSIQRI

SEQ ID NO: 687636 - protein, 20 aa, Mycobacterium
LAVLGARAAGKVILDGVFND

SEQ ID NO: 687637 - protein, 19 aa, Mycobacterium
LAVLGERWTILILREALLG

SEQ ID NO: 687638 - protein, 18 aa, Mycobacterium
LAVLHAAWLIDTAGEHAA

SEQ ID NO: 687639 - protein, 17 aa, Mycobacterium
LAVLIERAAKLQLAAMA

SEQ ID NO: 687640 - protein, 24 aa, Mycobacterium
LAVLPRLAPRARITVGLDRVELAL

SEQ ID NO: 687641 - protein, 25 aa, Mycobacterium
LAVLRFERRLPYPVEAVWAAITDPQ

SEQ ID NO: 687642 - protein, 20 aa, Mycobacterium
LAVLRRCGVAGVLSGAGPSV

SEQ ID NO: 687643 - protein, 25 aa, Mycobacterium
LAVLTARHLDCWTLGTIEKGAKDGS

SEQ ID NO: 687644 - protein, 18 aa, Mycobacterium
LAVLTVSAGLSWQDTALL

SEQ ID NO: 687645 - protein, 21 aa, Mycobacterium
LAVMCDLRIAAESAFFAESFV

SEQ ID NO: 687646 - protein, 19 aa, Mycobacterium
LAVMLWGLELDRRLRAAGS

SEQ ID NO: 687647 - protein, 17 aa, Mycobacterium
LAVMTALQELPARQRAV

SEQ ID NO: 687648 - protein, 27 aa, Mycobacterium
LAVNRLRPSEIQWALNHDAVHGIAYAF

SEQ ID NO: 687649 - protein, 18 aa, Mycobacterium
LAVPASWTSVIPAAHSAV

SEQ ID NO: 687650 - protein, 24 aa, Mycobacterium
LAVPELPALLPRGTVAMLSGARSL

SEQ ID NO: 687651 - protein, 17 aa, Mycobacterium
LAVPGIRAALRATPAPI

SEQ ID NO: 687652 - protein, 29 aa, Mycobacterium
LAVPKVGDLVAWDGGSRLFEFADVDVVDP

SEQ ID NO: 687653 - protein, 36 aa, Mycobacterium
LAVPRHGWINLHFSLLPAWRGAAPVQAAIAAGDTVT

SEQ ID NO: 687654 - protein, 25 aa, Mycobacterium
LAVPRPVVDHALGAPVTRRLLVTDA

SEQ ID NO: 687655 - protein, 24 aa, Mycobacterium
LAVQRAAAVLLILNPAHPISRVAG

SEQ ID NO: 687656 - protein, 24 aa, Mycobacterium
LAVQSVPCAGLVVGSFPAEPDLAQ

SEQ ID NO: 687657 - protein, 18 aa, Mycobacterium
LAVRARHGILMGPGTAVP

SEQ ID NO: 687658 - protein, 24 aa, Mycobacterium
LAVRCLTFPVPVIMAATGPAIAMG

SEQ ID NO: 687659 - protein, 17 aa, Mycobacterium
LAVRELNWTSGSGETSA

SEQ ID NO: 687660 - protein, 25 aa, Mycobacterium
LAVRKECLRRRGLIAESGVRPPGRS

SEQ ID NO: 687661 - protein, 20 aa, Mycobacterium
LAVRVIVGGTWGFASHAELV

SEQ ID NO: 687662 - protein, 18 aa, Mycobacterium
LAVRYHLLNFLDDRSHSR

SEQ ID NO: 687663 - protein, 17 aa, Mycobacterium
LAVSFSGVQLLQRGSAN

SEQ ID NO: 687664 - protein, 20 aa, Mycobacterium
LAVSGGWDRIVVDCASTADA

SEQ ID NO: 687665 - protein, 17 aa, Mycobacterium
LAVSLPAAVLADAEEAS

SEQ ID NO: 687666 - protein, 20 aa, Mycobacterium
LAVSSSIAWADRYRALSDMV

SEQ ID NO: 687667 - protein, 20 aa, Mycobacterium
LAVTGCLLAGVQVVPVPADV

SEQ ID NO: 687668 - protein, 32 aa, Mycobacterium
LAVTSGLTGNSWRGPAAAVMSDVAASYVGWLS

SEQ ID NO: 687669 - protein, 18 aa, Mycobacterium
LAVTVARLVESARAGTLS

SEQ ID NO: 687670 - protein, 25 aa, Mycobacterium
LAVTVPWKNAIGLAISQAGGPFKRW

SEQ ID NO: 687671 - protein, 26 aa, Mycobacterium
LAVVDARLLVRVPSGWSLAEAAGVPV

SEQ ID NO: 687672 - protein, 20 aa, Mycobacterium
LAVVDCLFVGVAQRSFGETT

SEQ ID NO: 687673 - protein, 19 aa, Mycobacterium
LAVVGRLADRVAVMRNGVL

SEQ ID NO: 687674 - protein, 18 aa, Mycobacterium
LAVVPGPRDDWFVDPDLL

SEQ ID NO: 687675 - protein, 17 aa, Mycobacterium
LAVVPLLAAEPVGIRAL

SEQ ID NO: 687676 - protein, 27 aa, Mycobacterium
LAVVPLMPVWRNFFLGQELRKKRFPFS

SEQ ID NO: 687677 - protein, 17 aa, Mycobacterium
LAVYPRAEFEQLARKAA

SEQ ID NO: 687678 - protein, 17 aa, Mycobacterium
LAVYPRAEFEQLARRAS

SEQ ID NO: 687679 - protein, 18 aa, Mycobacterium
LAVYPRAEFEQLARRASK

SEQ ID NO: 687680 - protein, 23 aa, Mycobacterium
LAVYPRLRRQSSMAVPLLELHPV

SEQ ID NO: 687681 - protein, 25 aa, Mycobacterium
LAVYRLAWARLHGCPTSAVRAAFHY

SEQ ID NO: 687682 - protein, 20 aa, Mycobacterium
LAVYWVARQIGCSWCVDFGA

SEQ ID NO: 687683 - protein, 19 aa, Mycobacterium
LAWDYPTVDAMSGHLDSLL

SEQ ID NO: 687684 - protein, 17 aa, Mycobacterium
LAWHYRLLAKVMRPLSP

SEQ ID NO: 687685 - protein, 25 aa, Mycobacterium
LAWIVEKFWDWADCDGHPENAVSRD

SEQ ID NO: 687686 - protein, 24 aa, Mycobacterium
LAWLRKAEPIHWVDIPNGSGGFED

SEQ ID NO: 687687 - protein, 19 aa, Mycobacterium
LAWMQRVSTEYSYTTEFTE

SEQ ID NO: 687688 - protein, 17 aa, Mycobacterium
LAWPADLKVGPDGMGNS

SEQ ID NO: 687689 - protein, 25 aa, Mycobacterium
LAWSETYPSTLAYYLASAFGEVWMQ

SEQ ID NO: 687690 - protein, 25 aa, Mycobacterium
LAWTPPRFGHVLVFRTPDPPSADAH

SEQ ID NO: 687691 - protein, 35 aa, Mycobacterium
LAYAIEGLPAWMGRLTNRWTLRPAGVGTEVTVTST

SEQ ID NO: 687692 - protein, 26 aa, Mycobacterium
LAYDLLEEWDTLVLVDAVPSRGHPGT

SEQ ID NO: 687693 - protein, 18 aa, Mycobacterium
LAYEADPVAFARRYADAD

SEQ ID NO: 687694 - protein, 17 aa, Mycobacterium
LAYEAMHQPCNSAEWTA

SEQ ID NO: 687695 - protein, 20 aa, Mycobacterium
LAYFLGCALPTPDRREHYDA

SEQ ID NO: 687696 - protein, 36 aa, Mycobacterium
LAYGGSRVGLPLVRRALELLPDVGFVNAYGLTETSS

SEQ ID NO: 687697 - protein, 17 aa, Mycobacterium
LAYGPAAVCARLAELGG

SEQ ID NO: 687698 - protein, 18 aa, Mycobacterium
LAYLIVRIVESFLYSDII

SEQ ID NO: 687699 - protein, 17 aa, Mycobacterium
LAYLLSRLDTKRLIITG

SEQ ID NO: 687700 - protein, 24 aa, Mycobacterium
LAYMDLRPGTPMREIPVDAVFVGS

SEQ ID NO: 687701 - protein, 19 aa, Mycobacterium
LAYRTARTTFPVWMMNAVA

SEQ ID NO: 687702 - protein, 26 aa, Mycobacterium
LAYYLASAFGEVWMQPSGTVGLIGFA

SEQ ID NO: 687703 - protein, 18 aa, Mycobacterium
LCAAGAPFSGDEWAAGAV

SEQ ID NO: 687704 - protein, 18 aa, Mycobacterium
LCAALLQIADGGVRGPLL

SEQ ID NO: 687705 - protein, 18 aa, Mycobacterium
LCADAGFAAADRALQTHG

SEQ ID NO: 687706 - protein, 19 aa, Mycobacterium
LCADAGFAAADRALQTHGG

SEQ ID NO: 687707 - protein, 18 aa, Mycobacterium
LCADAGFGAADRALQLHG

SEQ ID NO: 687708 - protein, 18 aa, Mycobacterium
LCADAGFTAADRALQTHG

SEQ ID NO: 687709 - protein, 17 aa, Mycobacterium
LCADAGLNKRYFYESFA

SEQ ID NO: 687710 - protein, 21 aa, Mycobacterium
LCADPRPLGYDDSAAFCAALP

SEQ ID NO: 687711 - protein, 18 aa, Mycobacterium
LCAEGSMTVAMPSTPANY

SEQ ID NO: 687712 - protein, 23 aa, Mycobacterium
LCAGVLRRWLSDRGELPAKPLVA

SEQ ID NO: 687713 - protein, 19 aa, Mycobacterium
LCALWPVPPTSAPHAAPAM

SEQ ID NO: 687714 - protein, 21 aa, Mycobacterium
LCAMAKRFVTDTCFDVADKAL

SEQ ID NO: 687715 - protein, 20 aa, Mycobacterium
LCAMAKRYVTDACFEVADQA

SEQ ID NO: 687716 - protein, 20 aa, Mycobacterium
LCAMAKRYVTDTCFEVADKA

SEQ ID NO: 687717 - protein, 21 aa, Mycobacterium
LCAMAKRYVTDTCFEVADKAL

SEQ ID NO: 687718 - protein, 20 aa, Mycobacterium
LCAMGKRYVTDTCFDVADKA

SEQ ID NO: 687719 - protein, 19 aa, Mycobacterium
LCAPAKGLRPRVSRRFRRR

SEQ ID NO: 687720 - protein, 19 aa, Mycobacterium
LCAPALYALFDSVRELATP

SEQ ID NO: 687721 - protein, 17 aa, Mycobacterium
LCAPVIATLYPVRRMVF

SEQ ID NO: 687722 - protein, 19 aa, Mycobacterium
LCAQREVVDAFFAAGRSGN

SEQ ID NO: 687723 - protein, 18 aa, Mycobacterium
LCARHFRTTRAVTAEGLE

SEQ ID NO: 687724 - protein, 23 aa, Mycobacterium
LCARVLPTGSIMQFFGGIERVSL

SEQ ID NO: 687725 - protein, 23 aa, Mycobacterium
LCASQLVGLGIMRYGVRSEPLHS

SEQ ID NO: 687726 - protein, 22 aa, Mycobacterium
LCAVRPDIGGVLIRGEKGTAKS

SEQ ID NO: 687727 - protein, 19 aa, Mycobacterium
LCDELKIAPEPELTGTAAV

SEQ ID NO: 687728 - protein, 19 aa, Mycobacterium
LCDGTLGAAPWLGAEAIDR

SEQ ID NO: 687729 - protein, 20 aa, Mycobacterium
LCDIFARYDVTFSLGDGLRP

SEQ ID NO: 687730 - protein, 17 aa, Mycobacterium
LCDIPIVVLTTSAAEED

SEQ ID NO: 687731 - protein, 23 aa, Mycobacterium
LCDNARAGMRIHVLAPSGNFVPK

SEQ ID NO: 687732 - protein, 21 aa, Mycobacterium
LCDPWVNPAYFGSWFPFPDNS

SEQ ID NO: 687733 - protein, 26 aa, Mycobacterium
LCDQRRIPLLFLQNISGFMVGRDYEA

SEQ ID NO: 687734 - protein, 19 aa, Mycobacterium
LCDRIAFVVDGSIVALDTP

SEQ ID NO: 687735 - protein, 20 aa, Mycobacterium
LCDTAMWIDHGTIRMQGEIE

SEQ ID NO: 687736 - protein, 20 aa, Mycobacterium
LCDVWDPAKVLRLMESDGLS

SEQ ID NO: 687737 - protein, 19 aa, Mycobacterium
LCEALTIAGAQVIRVPVYR

SEQ ID NO: 687738 - protein, 21 aa, Mycobacterium
LCEAMCGLKITVSDGVATSAR

SEQ ID NO: 687739 - protein, 24 aa, Mycobacterium
LCEHARTGMRIHVLAPSGNFVPKT

SEQ ID NO: 687740 - protein, 18 aa, Mycobacterium
LCEIGIQFDDDFIEWSVS

SEQ ID NO: 687741 - protein, 23 aa, Mycobacterium
LCEIKDVQIRDGLHILGETPSDE

SEQ ID NO: 687742 - protein, 23 aa, Mycobacterium
LCEIKDVQIRDGLHILGQKPTGE

SEQ ID NO: 687743 - protein, 23 aa, Mycobacterium
LCEIKDVQIRDGLHILGQKPTGK

SEQ ID NO: 687744 - protein, 23 aa, Mycobacterium
LCEIKDVQIRDGLHILGQQPAGE

SEQ ID NO: 687745 - protein, 23 aa, Mycobacterium
LCEIKDVQIRDGLHILGSAPEGG

SEQ ID NO: 687746 - protein, 26 aa, Mycobacterium
LCEILARYDVTFSLGDGLRPGSIADA

SEQ ID NO: 687747 - protein, 20 aa, Mycobacterium
LCELKDIIERSAAAGDPCGT

SEQ ID NO: 687748 - protein, 27 aa, Mycobacterium
LCENCNYVKESAGWRVTTTVDENRTHT

SEQ ID NO: 687749 - protein, 24 aa, Mycobacterium
LCERCNYVKETAGWNVAPVPGADR

SEQ ID NO: 687750 - protein, 17 aa, Mycobacterium
LCESLGYDNVWFGDSQN

SEQ ID NO: 687751 - protein, 21 aa, Mycobacterium
LCFAGANLIPLRGGLIDLNAF

SEQ ID NO: 687752 - protein, 19 aa, Mycobacterium
LCFARDPRSGPAVLNNPDL

SEQ ID NO: 687753 - protein, 17 aa, Mycobacterium
LCFCASMGTGPAVGPGY

SEQ ID NO: 687754 - protein, 19 aa, Mycobacterium
LCFCASMGTGPHLGPGYDL

SEQ ID NO: 687755 - protein, 17 aa, Mycobacterium
LCFVFGRLPTAPVGTLK

SEQ ID NO: 687756 - protein, 19 aa, Mycobacterium
LCGELRLADFDHLELSNLN

SEQ ID NO: 687757 - protein, 19 aa, Mycobacterium
LCGLSALPEDYVGVVVVTS

SEQ ID NO: 687758 - protein, 20 aa, Mycobacterium
LCGQRPISMLYLIPTLHNPL

SEQ ID NO: 687759 - protein, 18 aa, Mycobacterium
LCGSELREVLQVRRCLEV

SEQ ID NO: 687760 - protein, 18 aa, Mycobacterium
LCGSPGRQPGRTKVGNTP

SEQ ID NO: 687761 - protein, 26 aa, Mycobacterium
LCGSQLYFEAWASFSTASLRNRFKTA

SEQ ID NO: 687762 - protein, 21 aa, Mycobacterium
LCGTLRLADFDTLEVSNLNRV

SEQ ID NO: 687763 - protein, 19 aa, Mycobacterium
LCGTSEVIGEFLAENVLAS

SEQ ID NO: 687764 - protein, 20 aa, Mycobacterium
LCGVVGFKPAYGAIPAQGVW

SEQ ID NO: 687765 - protein, 23 aa, Mycobacterium
LCHELRHGVSPSLVLGKLANTGF

SEQ ID NO: 687766 - protein, 24 aa, Mycobacterium
LCHISHVYPTGASLYFTVVAAQRG

SEQ ID NO: 687767 - protein, 18 aa, Mycobacterium
LCIHPVMISAAGESLPSV

SEQ ID NO: 687768 - protein, 22 aa, Mycobacterium
LCKNLHLAECNWLVPVGRRDGL

SEQ ID NO: 687769 - protein, 25 aa, Mycobacterium
LCLAEAGWPVRVWTDLLPRQTTSAV

SEQ ID NO: 687770 - protein, 19 aa, Mycobacterium
LCLGLQCIVIEAARSVGLT

SEQ ID NO: 687771 - protein, 26 aa, Mycobacterium
LCLRDMGMMFGEYWDLTALAEDCAAD

SEQ ID NO: 687772 - protein, 20 aa, Mycobacterium
LCLYPNVYVMDQFSTQIRHF

SEQ ID NO: 687773 - protein, 21 aa, Mycobacterium
LCMDNGMPILVFNLLTNGNIA

SEQ ID NO: 687774 - protein, 21 aa, Mycobacterium
LCMDNGMPILVFNLLVDGNIA

SEQ ID NO: 687775 - protein, 21 aa, Mycobacterium
LCMDNRMPILVFNLLTEGNIA

SEQ ID NO: 687776 - protein, 19 aa, Mycobacterium
LCNAGKYALGLRKVLLASG

SEQ ID NO: 687777 - protein, 19 aa, Mycobacterium
LCNSAGFGTSGRFCELPPE

SEQ ID NO: 687778 - protein, 21 aa, Mycobacterium
LCPAPVRVPILFGGRSEATMR

SEQ ID NO: 687779 - protein, 27 aa, Mycobacterium
LCPHGCYPCAAGSWISVAVADDTEWQR

SEQ ID NO: 687780 - protein, 29 aa, Mycobacterium
LCPHGCYPCAGGAWLAVAVADDSQWRGLC

SEQ ID NO: 687781 - protein, 18 aa, Mycobacterium
LCPLRLRDNDGWPLYPIR

SEQ ID NO: 687782 - protein, 20 aa, Mycobacterium
LCQLVGPVAFARLTGLRAID

SEQ ID NO: 687783 - protein, 20 aa, Mycobacterium
LCRCTGYRPIRDAVCGVVPP

SEQ ID NO: 687784 - protein, 24 aa, Mycobacterium
LCRDNCHYCTFVTVPGKLRAQGAG

SEQ ID NO: 687785 - protein, 24 aa, Mycobacterium
LCRDTCHYCTFVTVPGKLRAHGAG

SEQ ID NO: 687786 - protein, 24 aa, Mycobacterium
LCRDTCHYCTFVTVPGKLRAQGAG

SEQ ID NO: 687787 - protein, 24 aa, Mycobacterium
LCRDTCHYCTFVTVPGKLRAQGMG

SEQ ID NO: 687788 - protein, 23 aa, Mycobacterium
LCREKYCDQRSLTEALTEALTES

SEQ ID NO: 687789 - protein, 20 aa, Mycobacterium
LCRHGDVIVFSAAIPGQGGT

SEQ ID NO: 687790 - protein, 18 aa, Mycobacterium
LCRLSLGYAQLWQGDLTG

SEQ ID NO: 687791 - protein, 24 aa, Mycobacterium
LCRMPGGGWVLSRMLGTRFFRHSR

SEQ ID NO: 687792 - protein, 25 aa, Mycobacterium
LCRQGVCGECRIPVARGDILHRDTY

SEQ ID NO: 687793 - protein, 25 aa, Mycobacterium
LCRQGVCGECRIPVTAGVLEHRDFV

SEQ ID NO: 687794 - protein, 18 aa, Mycobacterium
LCRSHAFSDCTIELLNFD

SEQ ID NO: 687795 - protein, 18 aa, Mycobacterium
LCRTPLAGLDRTRKVARV

SEQ ID NO: 687796 - protein, 17 aa, Mycobacterium
LCSALLTDSEWAQGEHA

SEQ ID NO: 687797 - protein, 30 aa, Mycobacterium
LCSERPAIHRFPGSMAKRIQTLAQIIVDRY

SEQ ID NO: 687798 - protein, 21 aa, Mycobacterium
LCSETLELLLRSTGYNDDVTL

SEQ ID NO: 687799 - protein, 17 aa, Mycobacterium
LCSEVRRVRASELLDYT

SEQ ID NO: 687800 - protein, 24 aa, Mycobacterium
LCSLTRPALAPTIGSLVGSALFGD

SEQ ID NO: 687801 - protein, 18 aa, Mycobacterium
LCSPTRAALLTGRNPTTV

SEQ ID NO: 687802 - protein, 19 aa, Mycobacterium
LCSPTRASLLTGRNATTVG

SEQ ID NO: 687803 - protein, 27 aa, Mycobacterium
LCSVRGWAAGFGCNLALAADFTVAATD

SEQ ID NO: 687804 - protein, 25 aa, Mycobacterium
LCSYLNKMLWILTGNFAKRGAQHLH

SEQ ID NO: 687805 - protein, 20 aa, Mycobacterium
LCTAAVIGTVHDWKSRAATA

SEQ ID NO: 687806 - protein, 20 aa, Mycobacterium
LCTAERVAVCDLAGRPPFRA

SEQ ID NO: 687807 - protein, 29 aa, Mycobacterium
LCTDAAATHAFWVCDDCDALAAQLSCALT

SEQ ID NO: 687808 - protein, 19 aa, Mycobacterium
LCTDFPREFQSVAITPFPV

SEQ ID NO: 687809 - protein, 24 aa, Mycobacterium
LCTRIRSIRCQEIFDYSTYDQPYA

SEQ ID NO: 687810 - protein, 19 aa, Mycobacterium
LCVCDMAWVVGLPQGLVSH

SEQ ID NO: 687811 - protein, 19 aa, Mycobacterium
LCVDYAKSRTLWGKNIGQF

SEQ ID NO: 687812 - protein, 18 aa, Mycobacterium
LCVFTDPQVREVCMDGGL

SEQ ID NO: 687813 - protein, 28 aa, Mycobacterium
LCVGHAGRITAPRGWDLVRHAGPLFSEP

SEQ ID NO: 687814 - protein, 17 aa, Mycobacterium
LCVKFLHDWAGPEAMIK

SEQ ID NO: 687815 - protein, 20 aa, Mycobacterium
LCVSGGAAMPVEVMRGFEQA

SEQ ID NO: 687816 - protein, 18 aa, Mycobacterium
LCVTVAPLLLGGGPGRIV

SEQ ID NO: 687817 - protein, 19 aa, Mycobacterium
LDAAAARLRGVGVGAAAAF

SEQ ID NO: 687818 - protein, 22 aa, Mycobacterium
LDAAARPARRAGVMRAKGVDKV

SEQ ID NO: 687819 - protein, 19 aa, Mycobacterium
LDAAARYGAHHLVDHTAGP

SEQ ID NO: 687820 - protein, 23 aa, Mycobacterium
LDAADLFVLPSLVADDGQMEGLP

SEQ ID NO: 687821 - protein, 22 aa, Mycobacterium
LDAAELAKLFDKRAARTSPERA

SEQ ID NO: 687822 - protein, 19 aa, Mycobacterium
LDAAELVAALSSVLYESRR

SEQ ID NO: 687823 - protein, 19 aa, Mycobacterium
LDAAERGEPVILVRDHTRP

SEQ ID NO: 687824 - protein, 27 aa, Mycobacterium
LDAAETGRSFAFLTIFNKNRPGGTVVA

SEQ ID NO: 687825 - protein, 17 aa, Mycobacterium
LDAAGQVLGCYFLLEPE

SEQ ID NO: 687826 - protein, 22 aa, Mycobacterium
LDAAGVPWGRMNGVADVVAHPQ

SEQ ID NO: 687827 - protein, 20 aa, Mycobacterium
LDAAGVPWQVTPGVPAYAAA

SEQ ID NO: 687828 - protein, 18 aa, Mycobacterium
LDAAGWLRVTDRLKEMIK

SEQ ID NO: 687829 - protein, 18 aa, Mycobacterium
LDAAIAWYHDHLGMVVMH

SEQ ID NO: 687830 - protein, 19 aa, Mycobacterium
LDAAIKWYHDHLGMIVLHE

SEQ ID NO: 687831 - protein, 29 aa, Mycobacterium
LDAAISVCRACPRLVTWREEVAVAKRRAF

SEQ ID NO: 687832 - protein, 18 aa, Mycobacterium
LDAAKWVNAGWRVFCLGK

SEQ ID NO: 687833 - protein, 17 aa, Mycobacterium
LDAALAIVGGRWKFLIV

SEQ ID NO: 687834 - protein, 24 aa, Mycobacterium
LDAALDRFGPPAGDPAWVVKDDHL

SEQ ID NO: 687835 - protein, 19 aa, Mycobacterium
LDAALRCAPGHRMAGMLDT

SEQ ID NO: 687836 - protein, 21 aa, Mycobacterium
LDAALRFIVDYQYSYSGVRMV

SEQ ID NO: 687837 - protein, 20 aa, Mycobacterium
LDAALRFIVQYQQSYSGVRL

SEQ ID NO: 687838 - protein, 20 aa, Mycobacterium
LDAAMDYWAEFYKRGQRNEA

SEQ ID NO: 687839 - protein, 18 aa, Mycobacterium
LDAAMQWQSDGAEWIHLV

SEQ ID NO: 687840 - protein, 17 aa, Mycobacterium
LDAARRGVRQSVILAAG

SEQ ID NO: 687841 - protein, 19 aa, Mycobacterium
LDAAVAEALRVMIERTRAV

SEQ ID NO: 687842 - protein, 19 aa, Mycobacterium
LDAAVPVPPDIPWFPKDQE

SEQ ID NO: 687843 - protein, 17 aa, Mycobacterium
LDAAVPVPRDIPWFPKD

SEQ ID NO: 687844 - protein, 19 aa, Mycobacterium
LDACIAIIIEVGYARASAA

SEQ ID NO: 687845 - protein, 29 aa, Mycobacterium
LDACLDKYARLFAWLGLWERHTDLAVIPA

SEQ ID NO: 687846 - protein, 17 aa, Mycobacterium
LDACPAVTAGVCMNILL

SEQ ID NO: 687847 - protein, 28 aa, Mycobacterium
LDADAYAGVPCWSGGPSYWAHTTVAVAY

SEQ ID NO: 687848 - protein, 19 aa, Mycobacterium
LDADCVFYAPLWSDPEEVC

SEQ ID NO: 687849 - protein, 20 aa, Mycobacterium
LDADCVFYAPLWSDVDEICR

SEQ ID NO: 687850 - protein, 23 aa, Mycobacterium
LDADCVFYTPIIMDVDTVCRLLR

SEQ ID NO: 687851 - protein, 20 aa, Mycobacterium
LDADCVMYSPLIPNDDEVIA

SEQ ID NO: 687852 - protein, 18 aa, Mycobacterium
LDADFDLDAFDHVARWNG

SEQ ID NO: 687853 - protein, 17 aa, Mycobacterium
LDADGVATEVPWASHAD

SEQ ID NO: 687854 - protein, 18 aa, Mycobacterium
LDADLLMDAGFVVVSHHP

SEQ ID NO: 687855 - protein, 20 aa, Mycobacterium
LDADPGFGVVCWVDSVAGAE

SEQ ID NO: 687856 - protein, 17 aa, Mycobacterium
LDADPRLTAGIRVVAGE

SEQ ID NO: 687857 - protein, 19 aa, Mycobacterium
LDADVVFGIRAFDALEDRL

SEQ ID NO: 687858 - protein, 26 aa, Mycobacterium
LDAEAAAEWFARILFSLFSTPSSIRD

SEQ ID NO: 687859 - protein, 20 aa, Mycobacterium
LDAEFPKFRQLLPAEHTAVA

SEQ ID NO: 687860 - protein, 19 aa, Mycobacterium
LDAEFPKFRQLLPTEHTAI

SEQ ID NO: 687861 - protein, 20 aa, Mycobacterium
LDAEFPKFRQLLPTEHTALA

SEQ ID NO: 687862 - protein, 21 aa, Mycobacterium
LDAEFPKFRQLLPVEHTAVAT

SEQ ID NO: 687863 - protein, 24 aa, Mycobacterium
LDAELPLADAVLMLRVQAERMNGG

SEQ ID NO: 687864 - protein, 18 aa, Mycobacterium
LDAESLSPFVTWGTNPGQ

SEQ ID NO: 687865 - protein, 17 aa, Mycobacterium
LDAEVDRACALVLDALT

SEQ ID NO: 687866 - protein, 21 aa, Mycobacterium
LDAEVDRACALVLDVLTVQQQ

SEQ ID NO: 687867 - protein, 19 aa, Mycobacterium
LDAEYLRWHTLDHRPEQHR

SEQ ID NO: 687868 - protein, 19 aa, Mycobacterium
LDAFAHHRQGLGLPALTIG

SEQ ID NO: 687869 - protein, 18 aa, Mycobacterium
LDAFGIDVHGRRCLDAGA

SEQ ID NO: 687870 - protein, 18 aa, Mycobacterium
LDAFRSVIELNLIATFNL

SEQ ID NO: 687871 - protein, 18 aa, Mycobacterium
LDAFVLFSSAAGILGAQG

SEQ ID NO: 687872 - protein, 20 aa, Mycobacterium
LDAFVVFSSVAGVLGAPGQA

SEQ ID NO: 687873 - protein, 20 aa, Mycobacterium
LDAFYEHGLQPWDCAAGALI

SEQ ID NO: 687874 - protein, 17 aa, Mycobacterium
LDAGAALAHITLAAVGL

SEQ ID NO: 687875 - protein, 18 aa, Mycobacterium
LDAGAHWDPRTVTNMRTG

SEQ ID NO: 687876 - protein, 25 aa, Mycobacterium
LDAGATYRPGTRFGPQGIRRSTNLF

SEQ ID NO: 687877 - protein, 18 aa, Mycobacterium
LDAGKAIRLFYEHPEKSL

SEQ ID NO: 687878 - protein, 19 aa, Mycobacterium
LDAGKAIRLFYEHPEKSLD

SEQ ID NO: 687879 - protein, 20 aa, Mycobacterium
LDAGKAMRLFYEHPEKSLDA

SEQ ID NO: 687880 - protein, 18 aa, Mycobacterium
LDAGLDLLGCDDGDIAEL

SEQ ID NO: 687881 - protein, 26 aa, Mycobacterium
LDAGLRRLKLAAIRRTAPEVLITAKT

SEQ ID NO: 687882 - protein, 26 aa, Mycobacterium
LDAGLRRLKLAAVRRTAPEVLITAKT

SEQ ID NO: 687883 - protein, 19 aa, Mycobacterium
LDAGLVLTSIGYRGKRIGD

SEQ ID NO: 687884 - protein, 23 aa, Mycobacterium
LDAGRLRPLATLEKMFIPPSGFH

SEQ ID NO: 687885 - protein, 21 aa, Mycobacterium
LDAGVVARLGRRIADHLDPDG

SEQ ID NO: 687886 - protein, 18 aa, Mycobacterium
LDAHCEVVLAELRNELGE

SEQ ID NO: 687887 - protein, 18 aa, Mycobacterium
LDAHGTVAFEKACEQAGV

SEQ ID NO: 687888 - protein, 23 aa, Mycobacterium
LDAHLREALAFEAPYVLDRLLSD

SEQ ID NO: 687889 - protein, 18 aa, Mycobacterium
LDAIAARDRARGRDQDRG

SEQ ID NO: 687890 - protein, 20 aa, Mycobacterium
LDAIFATRTLDEWAAIFATE

SEQ ID NO: 687891 - protein, 17 aa, Mycobacterium
LDAIKVPVVVAINGACV

SEQ ID NO: 687892 - protein, 18 aa, Mycobacterium
LDAIPPQLAAAIDNVVVL

SEQ ID NO: 687893 - protein, 25 aa, Mycobacterium
LDAKAVAAFSRWYAGGIDLSDPPAG

SEQ ID NO: 687894 - protein, 25 aa, Mycobacterium
LDAKLRASMRAELKQLGAMSNTTTI

SEQ ID NO: 687895 - protein, 20 aa, Mycobacterium
LDALAHHRHHHGLPATSLAW

SEQ ID NO: 687896 - protein, 18 aa, Mycobacterium
LDALAPLLGTWAGQGSGE

SEQ ID NO: 687897 - protein, 17 aa, Mycobacterium
LDALARMSLRVRAAGGT

SEQ ID NO: 687898 - protein, 25 aa, Mycobacterium
LDALARNKMRVVPGLTSKAMSVASQ

SEQ ID NO: 687899 - protein, 20 aa, Mycobacterium
LDALDAVFPDARFVMTHRDP

SEQ ID NO: 687900 - protein, 37 aa, Mycobacterium
LDALDLKPGMTLLEVGCGWGLTLQRAMEKYDVNVIGL

SEQ ID NO: 687901 - protein, 33 aa, Mycobacterium
LDALEFEALVALLRFPARFFTTAPVSRVAARDL

SEQ ID NO: 687902 - protein, 26 aa, Mycobacterium
LDALEGYPAFAITPDWGIAAWNTTYA

SEQ ID NO: 687903 - protein, 19 aa, Mycobacterium
LDALGCLLDTYGLTVAIET

SEQ ID NO: 687904 - protein, 18 aa, Mycobacterium
LDALGHVLFEARGEVTSQ

SEQ ID NO: 687905 - protein, 18 aa, Mycobacterium
LDALGVVAKRARRPMFSS

SEQ ID NO: 687906 - protein, 30 aa, Mycobacterium
LDALGWDPPRFCGTAFQNAWLNPVMWNAFM

SEQ ID NO: 687907 - protein, 28 aa, Mycobacterium
LDALITKVWKTPAFFLTHPLGVAAFGRE

SEQ ID NO: 687908 - protein, 28 aa, Mycobacterium
LDALITKVWKTPGFFLTHPLGVAAFGRE

SEQ ID NO: 687909 - protein, 24 aa, Mycobacterium
LDALLAFADRLAKFTARAEQIATA

SEQ ID NO: 687910 - protein, 18 aa, Mycobacterium
LDALLALKPDCVVYTALG

SEQ ID NO: 687911 - protein, 20 aa, Mycobacterium
LDALLFRGSLDARLRELVIL

SEQ ID NO: 687912 - protein, 17 aa, Mycobacterium
LDALLVFGKVVECRSLS

SEQ ID NO: 687913 - protein, 17 aa, Mycobacterium
LDALMGWQPGSAAVSML

SEQ ID NO: 687914 - protein, 17 aa, Mycobacterium
LDALNPLGLWAEKHIDL

SEQ ID NO: 687915 - protein, 21 aa, Mycobacterium
LDALPAVLVLRADEWDSPLVP

SEQ ID NO: 687916 - protein, 18 aa, Mycobacterium
LDALPEFAPPYELLNEPG

SEQ ID NO: 687917 - protein, 20 aa, Mycobacterium
LDALPERQRQLVILRDIVGA

SEQ ID NO: 687918 - protein, 17 aa, Mycobacterium
LDALPEVNVRGPVRERL

SEQ ID NO: 687919 - protein, 25 aa, Mycobacterium
LDALQRFRHNLGRGLLGRRIEAPAL

SEQ ID NO: 687920 - protein, 26 aa, Mycobacterium
LDALRARFGTLKGVERAAENGDFVSI

SEQ ID NO: 687921 - protein, 30 aa, Mycobacterium
LDALRDRGALRRFVPFDVDAGILSTAAAAI

SEQ ID NO: 687922 - protein, 18 aa, Mycobacterium
LDALRTGHDTVLFAALVN

SEQ ID NO: 687923 - protein, 25 aa, Mycobacterium
LDALRTRLFPLATLVTPNLDEVRLL

SEQ ID NO: 687924 - protein, 23 aa, Mycobacterium
LDALRVRHALLVISKADLADPGP

SEQ ID NO: 687925 - protein, 17 aa, Mycobacterium
LDALSLWAPTQSVTAYD

SEQ ID NO: 687926 - protein, 20 aa, Mycobacterium
LDALSQVKDRLFLPYQVALE

SEQ ID NO: 687927 - protein, 19 aa, Mycobacterium
LDALSWLNINALDQFPDEF

SEQ ID NO: 687928 - protein, 22 aa, Mycobacterium
LDALTMFGAIGFTWEHDLHLYW

SEQ ID NO: 687929 - protein, 25 aa, Mycobacterium
LDALTMLGAIGFTWEHDVHLYWRRA

SEQ ID NO: 687930 - protein, 19 aa, Mycobacterium
LDALTSWIRHTHSVGVPVA

SEQ ID NO: 687931 - protein, 18 aa, Mycobacterium
LDALVSVCRACPRLVDWR

SEQ ID NO: 687932 - protein, 19 aa, Mycobacterium
LDALVSVCRACPRLVDWRE

SEQ ID NO: 687933 - protein, 18 aa, Mycobacterium
LDALWRMHQGSMFIATME

SEQ ID NO: 687934 - protein, 20 aa, Mycobacterium
LDAMGALVCHGALSRNPELR

SEQ ID NO: 687935 - protein, 24 aa, Mycobacterium
LDAMGKRVVHCGGPGVGQAAKICN

SEQ ID NO: 687936 - protein, 26 aa, Mycobacterium
LDAMPARLPIRALWKAIELAAMAEHA

SEQ ID NO: 687937 - protein, 17 aa, Mycobacterium
LDAMSSWWTSVHGHGHP

SEQ ID NO: 687938 - protein, 28 aa, Mycobacterium
LDAPELYRRNGIQFLPFNTVYQLAAERA

SEQ ID NO: 687939 - protein, 21 aa, Mycobacterium
LDAPICLTWELTYACNLACVH

SEQ ID NO: 687940 - protein, 23 aa, Mycobacterium
LDAPKRLGSFMDGRLWKMLLGSS

SEQ ID NO: 687941 - protein, 19 aa, Mycobacterium
LDAPKRLGSFMDSRLWRML

SEQ ID NO: 687942 - protein, 25 aa, Mycobacterium
LDAPRGALIFRRRGGGAVCAVNAGR

SEQ ID NO: 687943 - protein, 17 aa, Mycobacterium
LDAPVARYWPEFAQAGK

SEQ ID NO: 687944 - protein, 17 aa, Mycobacterium
LDAPVLLHPADEVLWRM

SEQ ID NO: 687945 - protein, 26 aa, Mycobacterium
LDAQLHVATALPVVRAALLDAYEHQG

SEQ ID NO: 687946 - protein, 23 aa, Mycobacterium
LDAQRWARERAQRALADASAHRV

SEQ ID NO: 687947 - protein, 18 aa, Mycobacterium
LDAQRWARERAQRAVAKA

SEQ ID NO: 687948 - protein, 24 aa, Mycobacterium
LDAQRWARERAQRVVAQAQPANLS

SEQ ID NO: 687949 - protein, 18 aa, Mycobacterium
LDAQRWARQRAQRAIAKA

SEQ ID NO: 687950 - protein, 20 aa, Mycobacterium
LDARATLLRRLIEIDPDDRY

SEQ ID NO: 687951 - protein, 27 aa, Mycobacterium
LDARAYRLDWPAGMTVFEIDQPEVIEF

SEQ ID NO: 687952 - protein, 26 aa, Mycobacterium
LDARAYRLPWSAGTVVYEVDQPEVIA

SEQ ID NO: 687953 - protein, 18 aa, Mycobacterium
LDARFGTAAGRKVLAGEV

SEQ ID NO: 687954 - protein, 27 aa, Mycobacterium
LDARGYRLDWPAGTVLFEIDMPDVLEF

SEQ ID NO: 687955 - protein, 19 aa, Mycobacterium
LDARIPIIVLTGLNDEHFG

SEQ ID NO: 687956 - protein, 23 aa, Mycobacterium
LDARPLFAANLALPWPDDPLAAL

SEQ ID NO: 687957 - protein, 27 aa, Mycobacterium
LDARPYRLPWPTGMRVYEIDQPEVIEF

SEQ ID NO: 687958 - protein, 18 aa, Mycobacterium
LDARQWFQSFPAVAGSSL

SEQ ID NO: 687959 - protein, 20 aa, Mycobacterium
LDARRGLAFQLVEGAAKLGR

SEQ ID NO: 687960 - protein, 17 aa, Mycobacterium
LDARRPDLVASVGSLAR

SEQ ID NO: 687961 - protein, 25 aa, Mycobacterium
LDARTYRLPWPDGTVVYELDQPDVI

SEQ ID NO: 687962 - protein, 19 aa, Mycobacterium
LDARWRRMIIDALESAEPG

SEQ ID NO: 687963 - protein, 18 aa, Mycobacterium
LDARYLKRAREVATQVTE

SEQ ID NO: 687964 - protein, 27 aa, Mycobacterium
LDASGVRLAIVASTWHSQICDALLAGA

SEQ ID NO: 687965 - protein, 18 aa, Mycobacterium
LDASLIFEAMATGCSAVS

SEQ ID NO: 687966 - protein, 21 aa, Mycobacterium
LDASLLLAVLTRFLPPDDPRV

SEQ ID NO: 687967 - protein, 18 aa, Mycobacterium
LDASLLLVVLTRFLPPDD

SEQ ID NO: 687968 - protein, 34 aa, Mycobacterium
LDASSRTAIEFAVRRLKGAFGVVVTERCVPGDGT

SEQ ID NO: 687969 - protein, 27 aa, Mycobacterium
LDASTFLGRLALIRIYNGRIRKGQQVA

SEQ ID NO: 687970 - protein, 20 aa, Mycobacterium
LDASVSIHAVERFLGDTARE

SEQ ID NO: 687971 - protein, 27 aa, Mycobacterium
LDATGLRLGIVASTWHGKICEALLQGA

SEQ ID NO: 687972 - protein, 19 aa, Mycobacterium
LDATNALGRFSDVLNQTLT

SEQ ID NO: 687973 - protein, 19 aa, Mycobacterium
LDATRWQYVTGVADETLVD

SEQ ID NO: 687974 - protein, 18 aa, Mycobacterium
LDATRWQYVTGVPDETLV

SEQ ID NO: 687975 - protein, 19 aa, Mycobacterium
LDAVAIGSGIPVDWQLMNL

SEQ ID NO: 687976 - protein, 17 aa, Mycobacterium
LDAVALAHHSGYRTMIS

SEQ ID NO: 687977 - protein, 17 aa, Mycobacterium
LDAVALAHHSGYRTMMS

SEQ ID NO: 687978 - protein, 17 aa, Mycobacterium
LDAVIFPASADVGAADM

SEQ ID NO: 687979 - protein, 30 aa, Mycobacterium
LDAVLGRLAPRARVVLCGVISSYLTGEHPG

SEQ ID NO: 687980 - protein, 19 aa, Mycobacterium
LDAVLGRVDAAWMLEQLAT

SEQ ID NO: 687981 - protein, 24 aa, Mycobacterium
LDAVLRSRPGWYAVGLDTGNRRLA

SEQ ID NO: 687982 - protein, 24 aa, Mycobacterium
LDAVPRMRGVLTLFEGVATGAADG

SEQ ID NO: 687983 - protein, 20 aa, Mycobacterium
LDAVRLGRAIGVIYLPATER

SEQ ID NO: 687984 - protein, 19 aa, Mycobacterium
LDAVTGWHISAVRNRISPV

SEQ ID NO: 687985 - protein, 19 aa, Mycobacterium
LDAWLARFAAPGMCNPDDE

SEQ ID NO: 687986 - protein, 25 aa, Mycobacterium
LDAWQGMGVKEYFGQDGYIAGQEAG

SEQ ID NO: 687987 - protein, 19 aa, Mycobacterium
LDAYFEDDVHLWDWAAGAL

SEQ ID NO: 687988 - protein, 20 aa, Mycobacterium
LDAYLDRYVETFGGAVEVNV

SEQ ID NO: 687989 - protein, 17 aa, Mycobacterium
LDAYLPTLASHWRRVLG

SEQ ID NO: 687990 - protein, 17 aa, Mycobacterium
LDAYPRIEIAVITCGAA

SEQ ID NO: 687991 - protein, 19 aa, Mycobacterium
LDCCQESDGGVALVITGAE

SEQ ID NO: 687992 - protein, 18 aa, Mycobacterium
LDCCQESDGGVALVVTSA

SEQ ID NO: 687993 - protein, 19 aa, Mycobacterium
LDCCQESDGGVALVVTSAE

SEQ ID NO: 687994 - protein, 19 aa, Mycobacterium
LDCCQESDGGVALVVTSTE

SEQ ID NO: 687995 - protein, 19 aa, Mycobacterium
LDCCQESDGGVAMVVTSVE

SEQ ID NO: 687996 - protein, 20 aa, Mycobacterium
LDCGCWRGADLEHVDDHQLR

SEQ ID NO: 687997 - protein, 18 aa, Mycobacterium
LDCGSLEVLVRGVRVDPD

SEQ ID NO: 687998 - protein, 26 aa, Mycobacterium
LDCLTAGCWPAWWLSNEDRGEIDILE

SEQ ID NO: 687999 - protein, 17 aa, Mycobacterium
LDCPLGEAIALHSSGLA

SEQ ID NO: 688000 - protein, 20 aa, Mycobacterium
LDCPVRWVHVSDMPDLAGLL

SEQ ID NO: 688001 - protein, 19 aa, Mycobacterium
LDCTYDFEVTAAKYLHALR

SEQ ID NO: 688002 - protein, 17 aa, Mycobacterium
LDDAAGWLDPVGGAHLR

SEQ ID NO: 688003 - protein, 22 aa, Mycobacterium
LDDAEWGQAIVAVIVPESDTAP

SEQ ID NO: 688004 - protein, 25 aa, Mycobacterium
LDDAMPYDEPWGWMQPTRHALGALL

SEQ ID NO: 688005 - protein, 24 aa, Mycobacterium
LDDARLFGVDWGFRLADVAVPVRW

SEQ ID NO: 688006 - protein, 21 aa, Mycobacterium
LDDATRCTLNFALATSLSTVC

SEQ ID NO: 688007 - protein, 19 aa, Mycobacterium
LDDAVAWFVGRTVSRSDVG

SEQ ID NO: 688008 - protein, 18 aa, Mycobacterium
LDDCARNGDFVCARWKRP

SEQ ID NO: 688009 - protein, 19 aa, Mycobacterium
LDDCEAGLRFLFEHAHELE

SEQ ID NO: 688010 - protein, 26 aa, Mycobacterium
LDDEIRWVLTKGKLPASEWIDVISTA

SEQ ID NO: 688011 - protein, 19 aa, Mycobacterium
LDDEVRWVLTKGKLPTSEW

SEQ ID NO: 688012 - protein, 19 aa, Mycobacterium
LDDEVRWVLTKGKLPTSMW

SEQ ID NO: 688013 - protein, 20 aa, Mycobacterium
LDDFELRGGPARQALVEAFN

SEQ ID NO: 688014 - protein, 17 aa, Mycobacterium
LDDGPLYAVKVVLSDLG

SEQ ID NO: 688015 - protein, 19 aa, Mycobacterium
LDDGREWARLSAGEQADVI

SEQ ID NO: 688016 - protein, 20 aa, Mycobacterium
LDDGRLAGYDGVNRVNPPLR

SEQ ID NO: 688017 - protein, 25 aa, Mycobacterium
LDDGTTWRIEIERAHMEEDTGKLTH

SEQ ID NO: 688018 - protein, 31 aa, Mycobacterium
LDDHPGLRIGWFEGGIAWVPWALQDAEHLVA

SEQ ID NO: 688019 - protein, 24 aa, Mycobacterium
LDDHPGRYLPALAGTPIDRAELRN

SEQ ID NO: 688020 - protein, 17 aa, Mycobacterium
LDDHRIGIVVGDCVGRG

SEQ ID NO: 688021 - protein, 22 aa, Mycobacterium
LDDHSRLLPGYRWGYAEDTVRL

SEQ ID NO: 688022 - protein, 18 aa, Mycobacterium
LDDIAAILDIRRHGAAPC

SEQ ID NO: 688023 - protein, 21 aa, Mycobacterium
LDDIISLSFFTPAVNQIELHP

SEQ ID NO: 688024 - protein, 22 aa, Mycobacterium
LDDIPRGSAVVIDNAGRLDCTV

SEQ ID NO: 688025 - protein, 26 aa, Mycobacterium
LDDKGRLTLPAKFRDSLAGGLMVTKS

SEQ ID NO: 688026 - protein, 29 aa, Mycobacterium
LDDLAERVGWQWRLVWYRAVSELLTGDYD

SEQ ID NO: 688027 - protein, 21 aa, Mycobacterium
LDDLAKRLIVLVEPIEAIVDR

SEQ ID NO: 688028 - protein, 18 aa, Mycobacterium
LDDLAKRLIVLVEPVEAI

SEQ ID NO: 688029 - protein, 19 aa, Mycobacterium
LDDLDVLDWPDQVKTMQRN

SEQ ID NO: 688030 - protein, 25 aa, Mycobacterium
LDDLPRLAARLERPAEPLVLVSRRH

SEQ ID NO: 688031 - protein, 18 aa, Mycobacterium
LDDLPVLYELAAEAGGPD

SEQ ID NO: 688032 - protein, 18 aa, Mycobacterium
LDDLPVLYELAAEEDAAD

SEQ ID NO: 688033 - protein, 24 aa, Mycobacterium
LDDLPVRRLWGIGPVAEEKLHRLG

SEQ ID NO: 688034 - protein, 22 aa, Mycobacterium
LDDLRARLARTRWPEAECVDDW

SEQ ID NO: 688035 - protein, 23 aa, Mycobacterium
LDDLRRILAPNGRLCIASLGYGE

SEQ ID NO: 688036 - protein, 23 aa, Mycobacterium
LDDLRTARAFLCALTGSPVTLGF

SEQ ID NO: 688037 - protein, 22 aa, Mycobacterium
LDDLRVLAALSQRMDRPIGLNH

SEQ ID NO: 688038 - protein, 18 aa, Mycobacterium
LDDLVSWLGPTVQRYLTA

SEQ ID NO: 688039 - protein, 17 aa, Mycobacterium
LDDMRRTRVANLKLDSI

SEQ ID NO: 688040 - protein, 25 aa, Mycobacterium
LDDNRVLYEWDYAKQLLHVQMLRDR

SEQ ID NO: 688041 - protein, 18 aa, Mycobacterium
LDDPARFAEMLADRLART

SEQ ID NO: 688042 - protein, 19 aa, Mycobacterium
LDDPGLRQLRYDEVLTRAQ

SEQ ID NO: 688043 - protein, 25 aa, Mycobacterium
LDDPLFRWRAMGSHGAFRSESLGLG

SEQ ID NO: 688044 - protein, 23 aa, Mycobacterium
LDDPLPWLLVDRRAMKVTAVHDE

SEQ ID NO: 688045 - protein, 19 aa, Mycobacterium
LDDPLPWLVADRRAVRVTA

SEQ ID NO: 688046 - protein, 24 aa, Mycobacterium
LDDPRLELVGVYAYSAEKAGADAG

SEQ ID NO: 688047 - protein, 28 aa, Mycobacterium
LDDPRYLGWRHRRVDDDDYYAFIDKFVA

SEQ ID NO: 688048 - protein, 18 aa, Mycobacterium
LDDQLLIEWQRDFFDFGH

SEQ ID NO: 688049 - protein, 24 aa, Mycobacterium
LDDQLRSWLAFGEEKVKEVVVLAR

SEQ ID NO: 688050 - protein, 33 aa, Mycobacterium
LDDQRLAFYRTLYRDHARYGAVLWVVAANMASY

SEQ ID NO: 688051 - protein, 18 aa, Mycobacterium
LDDQWGLSQILSWQSNAA

SEQ ID NO: 688052 - protein, 17 aa, Mycobacterium
LDDRAKAALRYADGLIW

SEQ ID NO: 688053 - protein, 23 aa, Mycobacterium
LDDRARWLYAKAIQHALVSGWND

SEQ ID NO: 688054 - protein, 17 aa, Mycobacterium
LDDSVATYECIRELHPE

SEQ ID NO: 688055 - protein, 22 aa, Mycobacterium
LDDTFRAPRLITVEDLLTHRSG

SEQ ID NO: 688056 - protein, 19 aa, Mycobacterium
LDDTLDFLRVWWTENPVEY

SEQ ID NO: 688057 - protein, 24 aa, Mycobacterium
LDDVRASGLLPTWEETNAFVEGLR

SEQ ID NO: 688058 - protein, 24 aa, Mycobacterium
LDDVRIPGRMIVGGKERFDARIAK

SEQ ID NO: 688059 - protein, 18 aa, Mycobacterium
LDDVRRLQAVVRGIHMDP

SEQ ID NO: 688060 - protein, 24 aa, Mycobacterium
LDDVRWELGRFGKLNVRHGKGSRR

SEQ ID NO: 688061 - protein, 17 aa, Mycobacterium
LDDVVQWSRQTDRPLWN

SEQ ID NO: 688062 - protein, 20 aa, Mycobacterium
LDDWRMTRGRLHDALLTVAD

SEQ ID NO: 688063 - protein, 17 aa, Mycobacterium
LDDYRRVLAAGVNIVGS

SEQ ID NO: 688064 - protein, 22 aa, Mycobacterium
LDEAALRVARDIATKDTRVIRA

SEQ ID NO: 688065 - protein, 22 aa, Mycobacterium
LDEAERGAVVGYMLAEQLATVM

SEQ ID NO: 688066 - protein, 19 aa, Mycobacterium
LDEAERRKALLRLADAIAA

SEQ ID NO: 688067 - protein, 19 aa, Mycobacterium
LDEALGFARGIPAAKHGAV

SEQ ID NO: 688068 - protein, 23 aa, Mycobacterium
LDEALRPSSLRSYVLPDEPLLSA

SEQ ID NO: 688069 - protein, 20 aa, Mycobacterium
LDEAQPWVDGHLGGMGPFTV

SEQ ID NO: 688070 - protein, 18 aa, Mycobacterium
LDEARRGLTNAIVAYLEN

SEQ ID NO: 688071 - protein, 22 aa, Mycobacterium
LDEATLRWVVTTAVGDVLSARF

SEQ ID NO: 688072 - protein, 19 aa, Mycobacterium
LDEAVKLIGRNVIGVQGDS

SEQ ID NO: 688073 - protein, 19 aa, Mycobacterium
LDEAVSLIGGRAYRGIALT

SEQ ID NO: 688074 - protein, 24 aa, Mycobacterium
LDEDECWWYESLLDQECPEWILHA

SEQ ID NO: 688075 - protein, 19 aa, Mycobacterium
LDEEGRLFVVGRDDEMIVS

SEQ ID NO: 688076 - protein, 17 aa, Mycobacterium
LDEFAALAARYGATLRI

SEQ ID NO: 688077 - protein, 21 aa, Mycobacterium
LDEFAEHLALERGRSVHTQRA

SEQ ID NO: 688078 - protein, 20 aa, Mycobacterium
LDEFAYRLSGSADLYEHTGR

SEQ ID NO: 688079 - protein, 20 aa, Mycobacterium
LDEFAYRLTGSADLYEHTAR

SEQ ID NO: 688080 - protein, 30 aa, Mycobacterium
LDEFLPQFLKGCIQLGAWPLLETTWEMAPV

SEQ ID NO: 688081 - protein, 29 aa, Mycobacterium
LDEFPERRVRLMMEMHVLAPLHLTQLAIP

SEQ ID NO: 688082 - protein, 20 aa, Mycobacterium
LDEFREIRRTAGLSEKLTVV

SEQ ID NO: 688083 - protein, 24 aa, Mycobacterium
LDEFTYPLKWGWVDVDDVVETLAR

SEQ ID NO: 688084 - protein, 17 aa, Mycobacterium
LDEGFALLSDDFTYWSI

SEQ ID NO: 688085 - protein, 19 aa, Mycobacterium
LDEGFARPGARRTRETFEI

SEQ ID NO: 688086 - protein, 18 aa, Mycobacterium
LDEGVDFGPLVGADALKR

SEQ ID NO: 688087 - protein, 19 aa, Mycobacterium
LDEGWLRTGDVGRIDQHGY

SEQ ID NO: 688088 - protein, 18 aa, Mycobacterium
LDEHKRMVARPMTNVFPS

SEQ ID NO: 688089 - protein, 17 aa, Mycobacterium
LDEHPGWIDEVQVPGSA

SEQ ID NO: 688090 - protein, 23 aa, Mycobacterium
LDEIKRLSERIGALRKQESEHDS

SEQ ID NO: 688091 - protein, 25 aa, Mycobacterium
LDEILTRLLEVWPVPVRRIALIGHS

SEQ ID NO: 688092 - protein, 18 aa, Mycobacterium
LDEIRWGNEQGCFGGVLL

SEQ ID NO: 688093 - protein, 28 aa, Mycobacterium
LDEISAWRFIVPPAAFLGSLLVDTKGQR

SEQ ID NO: 688094 - protein, 20 aa, Mycobacterium
LDEKVSWSAVAAVVYGLVLE

SEQ ID NO: 688095 - protein, 19 aa, Mycobacterium
LDELAALYANGTVTAREWI

SEQ ID NO: 688096 - protein, 19 aa, Mycobacterium
LDELAGLYADGAITAREWI

SEQ ID NO: 688097 - protein, 21 aa, Mycobacterium
LDELCAALAELADAVVVTNEV

SEQ ID NO: 688098 - protein, 23 aa, Mycobacterium
LDELCLTIAPVLVGGGAPRIAAG

SEQ ID NO: 688099 - protein, 19 aa, Mycobacterium
LDELCLTIAPYIVGGQARR

SEQ ID NO: 688100 - protein, 23 aa, Mycobacterium
LDELCLTVAPYLVGGLARRIATG

SEQ ID NO: 688101 - protein, 18 aa, Mycobacterium
LDELGWRGLIAQSTDLDA

SEQ ID NO: 688102 - protein, 26 aa, Mycobacterium
LDELLNRWPEWDVDYDSLKLAPTSTV

SEQ ID NO: 688103 - protein, 26 aa, Mycobacterium
LDELLNRWPEWGIDYETAQLASTSTV

SEQ ID NO: 688104 - protein, 25 aa, Mycobacterium
LDELLNRWPQWDIDYDSLQLAPTST

SEQ ID NO: 688105 - protein, 24 aa, Mycobacterium
LDELPVRKLWGIGPVAEERLNRLG

SEQ ID NO: 688106 - protein, 25 aa, Mycobacterium
LDELRARIGAVTMGRVLTLIIAPDS

SEQ ID NO: 688107 - protein, 22 aa, Mycobacterium
LDELREGSEITVIGRPRYTVPG

SEQ ID NO: 688108 - protein, 20 aa, Mycobacterium
LDELRPTLDRALTVIADPPG

SEQ ID NO: 688109 - protein, 19 aa, Mycobacterium
LDELRRAILDGGVPPGTPI

SEQ ID NO: 688110 - protein, 21 aa, Mycobacterium
LDELRRVWESLGVSRLSLIDA

SEQ ID NO: 688111 - protein, 24 aa, Mycobacterium
LDELRTRAGRCFDRVAAGETVSVV

SEQ ID NO: 688112 - protein, 20 aa, Mycobacterium
LDELTRLAVETGDDGLWSFL

SEQ ID NO: 688113 - protein, 19 aa, Mycobacterium
LDELVGFFVNTLVLRTDLG

SEQ ID NO: 688114 - protein, 19 aa, Mycobacterium
LDELVGFFVNTLVLRVDLK

SEQ ID NO: 688115 - protein, 19 aa, Mycobacterium
LDELVGFFVNTLVLRVDVT

SEQ ID NO: 688116 - protein, 24 aa, Mycobacterium
LDELWKRYQKVQVEGHRQYNPAWN

SEQ ID NO: 688117 - protein, 23 aa, Mycobacterium
LDEMSSSMGFVVGKLAKAPDGSR

SEQ ID NO: 688118 - protein, 19 aa, Mycobacterium
LDEMVNFAAAMEREGMQIP

SEQ ID NO: 688119 - protein, 17 aa, Mycobacterium
LDEPAPFIDWRNREGGA

SEQ ID NO: 688120 - protein, 23 aa, Mycobacterium
LDEPELLKTLGATPHLGVLVSGP

SEQ ID NO: 688121 - protein, 25 aa, Mycobacterium
LDEPLALSGGQSWWGGIDTERSHLL

SEQ ID NO: 688122 - protein, 24 aa, Mycobacterium
LDEPPLRLLLGRDVLKAMRDKIAA

SEQ ID NO: 688123 - protein, 17 aa, Mycobacterium
LDEPRPGRPRVVGDEQI

SEQ ID NO: 688124 - protein, 20 aa, Mycobacterium
LDEPWCRPLATHVGHFHTGA

SEQ ID NO: 688125 - protein, 21 aa, Mycobacterium
LDEPWCRTLATHLGHFAPTEA

SEQ ID NO: 688126 - protein, 23 aa, Mycobacterium
LDERDFPATSVRFFASARSQGRK

SEQ ID NO: 688127 - protein, 18 aa, Mycobacterium
LDERRAAVLASIREQGKL

SEQ ID NO: 688128 - protein, 17 aa, Mycobacterium
LDERRGPVLDRIVEMTV

SEQ ID NO: 688129 - protein, 18 aa, Mycobacterium
LDERVKIVAFSHHSNVTG

SEQ ID NO: 688130 - protein, 23 aa, Mycobacterium
LDERWTLLVVRELLLGSTHFNDL

SEQ ID NO: 688131 - protein, 21 aa, Mycobacterium
LDESAARWAVREAKEAEKQAR

SEQ ID NO: 688132 - protein, 21 aa, Mycobacterium
LDETRRLAIVEADGAEARDVW

SEQ ID NO: 688133 - protein, 24 aa, Mycobacterium
LDEVAEHYFHFGGVSPINGINRAL

SEQ ID NO: 688134 - protein, 20 aa, Mycobacterium
LDEVDGFVWHCYLPTITPGQ

SEQ ID NO: 688135 - protein, 22 aa, Mycobacterium
LDEVIRWLTGFDETTLRRRLTD

SEQ ID NO: 688136 - protein, 22 aa, Mycobacterium
LDEVLPRVHLAAVQHAGGEITN

SEQ ID NO: 688137 - protein, 17 aa, Mycobacterium
LDEVPMLLQPGILGIAW

SEQ ID NO: 688138 - protein, 23 aa, Mycobacterium
LDEVRASGVLPTWEETQRFIDGL

SEQ ID NO: 688139 - protein, 23 aa, Mycobacterium
LDEVRPSQRCRLLSDDLDIEITG

SEQ ID NO: 688140 - protein, 18 aa, Mycobacterium
LDEYAIAALRAEPVDSYG

SEQ ID NO: 688141 - protein, 20 aa, Mycobacterium
LDEYGDLLAPLDADAPIADK

SEQ ID NO: 688142 - protein, 20 aa, Mycobacterium
LDEYLAFIGFDGDRSPTLET

SEQ ID NO: 688143 - protein, 21 aa, Mycobacterium
LDFAGNADFAIAIRTALFKDG

SEQ ID NO: 688144 - protein, 21 aa, Mycobacterium
LDFAGNADFAIAIRTALMRAG

SEQ ID NO: 688145 - protein, 21 aa, Mycobacterium
LDFAGNADFAIAIRTALMRDG

SEQ ID NO: 688146 - protein, 18 aa, Mycobacterium
LDFDRPVPREVLNECLEI

SEQ ID NO: 688147 - protein, 19 aa, Mycobacterium
LDFELPVQDLLGGASVDHV

SEQ ID NO: 688148 - protein, 19 aa, Mycobacterium
LDFESYVALASRISGLPIA

SEQ ID NO: 688149 - protein, 18 aa, Mycobacterium
LDFFAPMVEQVFAREPWS

SEQ ID NO: 688150 - protein, 20 aa, Mycobacterium
LDFGALVAAFLDGHRAPEDR

SEQ ID NO: 688151 - protein, 17 aa, Mycobacterium
LDFHLRRVRVPEPGTLR

SEQ ID NO: 688152 - protein, 20 aa, Mycobacterium
LDFHQWREGLLRGIAAHHAG

SEQ ID NO: 688153 - protein, 18 aa, Mycobacterium
LDFKSHIFQSFAEIPSYS

SEQ ID NO: 688154 - protein, 20 aa, Mycobacterium
LDFLRDVRLLSARMLSMAKL

SEQ ID NO: 688155 - protein, 30 aa, Mycobacterium
LDFLRSCSIKHRLASVIFSLEMSKSEIVMR

SEQ ID NO: 688156 - protein, 25 aa, Mycobacterium
LDFLRSCSIKHRQASIIFSLEMSKS

SEQ ID NO: 688157 - protein, 22 aa, Mycobacterium
LDFMFRHIQPYFTEDINQLVNE

SEQ ID NO: 688158 - protein, 17 aa, Mycobacterium
LDFMGCCAFEVLAEQAG

SEQ ID NO: 688159 - protein, 19 aa, Mycobacterium
LDFMPVVFSLFQWGKRHLP

SEQ ID NO: 688160 - protein, 34 aa, Mycobacterium
LDFMRSCSIKHQLPSIVFSLEMSKTEIVMRLLSA

SEQ ID NO: 688161 - protein, 30 aa, Mycobacterium
LDFMRSCSIKHRMASVIFSLEMSKSEIVMR

SEQ ID NO: 688162 - protein, 20 aa, Mycobacterium
LDFNEVFFTDARVPAENLVG

SEQ ID NO: 688163 - protein, 25 aa, Mycobacterium
LDFPTGPAYYLMGFDIGAFTPIFVM

SEQ ID NO: 688164 - protein, 17 aa, Mycobacterium
LDFRGEFFTHTIMAPNF

SEQ ID NO: 688165 - protein, 25 aa, Mycobacterium
LDFRPKHKLAVLVVSAIPLAEPVRV

SEQ ID NO: 688166 - protein, 25 aa, Mycobacterium
LDFRPKHKLAVLVVSAIPLTEPVQV

SEQ ID NO: 688167 - protein, 24 aa, Mycobacterium
LDFRPKHKLAVLVVSVIPLAEPAR

SEQ ID NO: 688168 - protein, 24 aa, Mycobacterium
LDFRPKHRLTVLVVRAYPLVAPVR

SEQ ID NO: 688169 - protein, 20 aa, Mycobacterium
LDFSDLRAGGAPLVTVDKHS

SEQ ID NO: 688170 - protein, 20 aa, Mycobacterium
LDFSTEWKAYHREGAPDLYP

SEQ ID NO: 688171 - protein, 19 aa, Mycobacterium
LDFSTEWTAYHRDGAPELY

SEQ ID NO: 688172 - protein, 17 aa, Mycobacterium
LDFTFAGLPAYQQRLGR

SEQ ID NO: 688173 - protein, 23 aa, Mycobacterium
LDFVRPRHRMVLTTFRADGSLQS

SEQ ID NO: 688174 - protein, 22 aa, Mycobacterium
LDFVSDGRFRLGIGTSGPQVIE

SEQ ID NO: 688175 - protein, 17 aa, Mycobacterium
LDFYRMAVLPEMENLDG

SEQ ID NO: 688176 - protein, 21 aa, Mycobacterium
LDGADMFLGLSAGLVPEEIIA

SEQ ID NO: 688177 - protein, 18 aa, Mycobacterium
LDGAEAFHAALEFWSAMH

SEQ ID NO: 688178 - protein, 22 aa, Mycobacterium
LDGAFYLSRPAYAAMMRQGYGR

SEQ ID NO: 688179 - protein, 17 aa, Mycobacterium
LDGALPVREHPGTRVAS

SEQ ID NO: 688180 - protein, 19 aa, Mycobacterium
LDGALVCTRAVYRKMAKRG

SEQ ID NO: 688181 - protein, 18 aa, Mycobacterium
LDGARFIGINGGPHFQFS

SEQ ID NO: 688182 - protein, 17 aa, Mycobacterium
LDGARKVLKLVDALEDS

SEQ ID NO: 688183 - protein, 18 aa, Mycobacterium
LDGARLLIWTTTPWTLPS

SEQ ID NO: 688184 - protein, 17 aa, Mycobacterium
LDGARQVSAPTLLVRGL

SEQ ID NO: 688185 - protein, 18 aa, Mycobacterium
LDGAVVFDGARIEAGAVV

SEQ ID NO: 688186 - protein, 18 aa, Mycobacterium
LDGAWWPHTASIARELPE

SEQ ID NO: 688187 - protein, 19 aa, Mycobacterium
LDGAWWPRTASISQELPEL

SEQ ID NO: 688188 - protein, 23 aa, Mycobacterium
LDGCGVLDGGWLDTGDLARIDAE

SEQ ID NO: 688189 - protein, 17 aa, Mycobacterium
LDGCGVVAAPARRERGV

SEQ ID NO: 688190 - protein, 25 aa, Mycobacterium
LDGDARGGAALSVREITGTPILFAS

SEQ ID NO: 688191 - protein, 24 aa, Mycobacterium
LDGDARGGAALSVREVTGQPILFA

SEQ ID NO: 688192 - protein, 25 aa, Mycobacterium
LDGDARGGAALSVREVTGVPILFAS

SEQ ID NO: 688193 - protein, 24 aa, Mycobacterium
LDGDFPVAIPLPIVPAGPIRARVN

SEQ ID NO: 688194 - protein, 19 aa, Mycobacterium
LDGDRAWLRTGGLPGVSAV

SEQ ID NO: 688195 - protein, 19 aa, Mycobacterium
LDGEGCSRFVVTDVTKDGT

SEQ ID NO: 688196 - protein, 19 aa, Mycobacterium
LDGETSRGLAIKAILGALD

SEQ ID NO: 688197 - protein, 20 aa, Mycobacterium
LDGFCSASLMIDHPACRRAV

SEQ ID NO: 688198 - protein, 20 aa, Mycobacterium
LDGFCSASLMVDRDSGFGVA

SEQ ID NO: 688199 - protein, 18 aa, Mycobacterium
LDGFLLDEAEVIYWGRCR

SEQ ID NO: 688200 - protein, 25 aa, Mycobacterium
LDGFRGAQVPIIWLNWGTRSDRANL

SEQ ID NO: 688201 - protein, 28 aa, Mycobacterium
LDGFRLLTEMGYRPSEIVIAGDSAGGFL

SEQ ID NO: 688202 - protein, 17 aa, Mycobacterium
LDGFVLDEAEVIYWGVC

SEQ ID NO: 688203 - protein, 19 aa, Mycobacterium
LDGGADWVPRAWRDMDTTM

SEQ ID NO: 688204 - protein, 23 aa, Mycobacterium
LDGGAYAAAAIDWRDRVDVITAA

SEQ ID NO: 688205 - protein, 18 aa, Mycobacterium
LDGGCPFDPHASTLMATE

SEQ ID NO: 688206 - protein, 17 aa, Mycobacterium
LDGGFGVGKTHLLASTY

SEQ ID NO: 688207 - protein, 25 aa, Mycobacterium
LDGGFKQSVRMIADHMGFRIDPNIR

SEQ ID NO: 688208 - protein, 23 aa, Mycobacterium
LDGGRWQDEWLYARAYTIAGGSS

SEQ ID NO: 688209 - protein, 23 aa, Mycobacterium
LDGGVADWRCSNVAVGHDGGQRF

SEQ ID NO: 688210 - protein, 22 aa, Mycobacterium
LDGHTDAIVGFDLDYVTITDPH

SEQ ID NO: 688211 - protein, 23 aa, Mycobacterium
LDGILAASGWWGKRFRDNETVDP

SEQ ID NO: 688212 - protein, 18 aa, Mycobacterium
LDGIRPAQAIGLVPLAGG

SEQ ID NO: 688213 - protein, 18 aa, Mycobacterium
LDGKAVVPAEDMVKRLRA

SEQ ID NO: 688214 - protein, 18 aa, Mycobacterium
LDGLCARTLRIGDHDDVA

SEQ ID NO: 688215 - protein, 24 aa, Mycobacterium
LDGLDQPHGLFFAGPTLYVAESDQ

SEQ ID NO: 688216 - protein, 25 aa, Mycobacterium
LDGLEKLAKLGVTWVSVHLPGDSMA

SEQ ID NO: 688217 - protein, 24 aa, Mycobacterium
LDGLKPGGLLLLRIPDRDAVYGWT

SEQ ID NO: 688218 - protein, 19 aa, Mycobacterium
LDGLPEFAAPYEFLNEEGM

SEQ ID NO: 688219 - protein, 18 aa, Mycobacterium
LDGLPEFAPPYEFLNDDG

SEQ ID NO: 688220 - protein, 19 aa, Mycobacterium
LDGLPGRTAAVVGAGSMGS

SEQ ID NO: 688221 - protein, 26 aa, Mycobacterium
LDGLPNYQRLFSLRVGQTLREQFEAD

SEQ ID NO: 688222 - protein, 25 aa, Mycobacterium
LDGLQCPQGVAICDRQVYVIDSGAK

SEQ ID NO: 688223 - protein, 18 aa, Mycobacterium
LDGLRLVFERNRDNQRKL

SEQ ID NO: 688224 - protein, 24 aa, Mycobacterium
LDGLRPEVWAGRYTFGRMGLRLPA

SEQ ID NO: 688225 - protein, 21 aa, Mycobacterium
LDGLRRLGVRLDGDGLPFTVR

SEQ ID NO: 688226 - protein, 17 aa, Mycobacterium
LDGLSWQQLDTLVARHH

SEQ ID NO: 688227 - protein, 33 aa, Mycobacterium
LDGLTRWLTGMFDRDGWQPGGVVVVGAHRDIDG

SEQ ID NO: 688228 - protein, 28 aa, Mycobacterium
LDGMNGCTVFRGHARFEDPHTLRVGDDL

SEQ ID NO: 688229 - protein, 19 aa, Mycobacterium
LDGPARMRVALDVRAGFGT

SEQ ID NO: 688230 - protein, 17 aa, Mycobacterium
LDGPRGVAVIFDKNSTR

SEQ ID NO: 688231 - protein, 17 aa, Mycobacterium
LDGPRLVALAASLDMVA

SEQ ID NO: 688232 - protein, 17 aa, Mycobacterium
LDGPVALLRLEPVEVVT

SEQ ID NO: 688233 - protein, 17 aa, Mycobacterium
LDGPVGPAARAFLERAR

SEQ ID NO: 688234 - protein, 23 aa, Mycobacterium
LDGQLPGGSAYVIGEAGLTTALH

SEQ ID NO: 688235 - protein, 17 aa, Mycobacterium
LDGQWGGAFGTLPTGLD

SEQ ID NO: 688236 - protein, 26 aa, Mycobacterium
LDGRADPGEIVWTWVVYEDDPAQGKD

SEQ ID NO: 688237 - protein, 27 aa, Mycobacterium
LDGRADPGEIVWTWVVYEDDPTKGKDR

SEQ ID NO: 688238 - protein, 27 aa, Mycobacterium
LDGRADPGEIVWTWVVYEDDPTQGQDR

SEQ ID NO: 688239 - protein, 27 aa, Mycobacterium
LDGRADPGEIVWTWVVYEDDPTRGKDR

SEQ ID NO: 688240 - protein, 19 aa, Mycobacterium
LDGRARMSLDSLVTALTTL

SEQ ID NO: 688241 - protein, 36 aa, Mycobacterium
LDGRDMAEMFAWLRPTDLVWRYWVNNYVQGRKPAAF

SEQ ID NO: 688242 - protein, 21 aa, Mycobacterium
LDGRIRHVMIPGIIAEDDDRP

SEQ ID NO: 688243 - protein, 21 aa, Mycobacterium
LDGRIRHVMIPGMIAEDDDRP

SEQ ID NO: 688244 - protein, 21 aa, Mycobacterium
LDGRLPFDLRRAVLSNGSVIL

SEQ ID NO: 688245 - protein, 25 aa, Mycobacterium
LDGRLRAAVIARCIAAGVFGAMEFW

SEQ ID NO: 688246 - protein, 20 aa, Mycobacterium
LDGRLVRFIAALESPSAVRV

SEQ ID NO: 688247 - protein, 20 aa, Mycobacterium
LDGRYFRLNPGPGIEWYDID

SEQ ID NO: 688248 - protein, 19 aa, Mycobacterium
LDGSAEWVPKVWRDMDTRM

SEQ ID NO: 688249 - protein, 17 aa, Mycobacterium
LDGSLGMHDVPSGGTDV

SEQ ID NO: 688250 - protein, 18 aa, Mycobacterium
LDGSLGMREAPERGTDVV

SEQ ID NO: 688251 - protein, 17 aa, Mycobacterium
LDGSLGMREAPGRGTDV

SEQ ID NO: 688252 - protein, 20 aa, Mycobacterium
LDGTELFVDVWARYIGTLMS

SEQ ID NO: 688253 - protein, 17 aa, Mycobacterium
LDGTETFDVTGIEELNS

SEQ ID NO: 688254 - protein, 17 aa, Mycobacterium
LDGTWRSPRHRLRAHQL

SEQ ID NO: 688255 - protein, 21 aa, Mycobacterium
LDGVCYPGQLASHLGLTRSNV

SEQ ID NO: 688256 - protein, 22 aa, Mycobacterium
LDGVCYRLRADGTSSRAAPDDR

SEQ ID NO: 688257 - protein, 22 aa, Mycobacterium
LDGVDAFAAHLVVSYRIEALPR

SEQ ID NO: 688258 - protein, 21 aa, Mycobacterium
LDGVDAFAGHLVVSYRREALP

SEQ ID NO: 688259 - protein, 20 aa, Mycobacterium
LDGVDAFAGHVVVSYRREAL

SEQ ID NO: 688260 - protein, 17 aa, Mycobacterium
LDGVGLRRTRWWTDAAG

SEQ ID NO: 688261 - protein, 23 aa, Mycobacterium
LDGVPSPRAFGAMTVDNPNNGLP

SEQ ID NO: 688262 - protein, 18 aa, Mycobacterium
LDGVQLLGGHGFTKEHPV

SEQ ID NO: 688263 - protein, 18 aa, Mycobacterium
LDGVRWAERSNVWVGARP

SEQ ID NO: 688264 - protein, 17 aa, Mycobacterium
LDGVSGDWALVHHSPNI

SEQ ID NO: 688265 - protein, 26 aa, Mycobacterium
LDGWLRPVPPGVVGELYLAGSGVGVG

SEQ ID NO: 688266 - protein, 23 aa, Mycobacterium
LDGWLRPVPPGVVGELYVAGAGV

SEQ ID NO: 688267 - protein, 23 aa, Mycobacterium
LDGWSKPILLQEIFAAYYGVQLP

SEQ ID NO: 688268 - protein, 21 aa, Mycobacterium
LDGWSKPILLQEIFASYYGVR

SEQ ID NO: 688269 - protein, 25 aa, Mycobacterium
LDGWSMPILLGDIFAAYYGQRLPAA

SEQ ID NO: 688270 - protein, 17 aa, Mycobacterium
LDGYEFVTGCNDFGGGL

SEQ ID NO: 688271 - protein, 17 aa, Mycobacterium
LDGYGWHPHAWRYAFAH

SEQ ID NO: 688272 - protein, 25 aa, Mycobacterium
LDGYPRPGKTVLFLGRYDEPRKGMA

SEQ ID NO: 688273 - protein, 22 aa, Mycobacterium
LDGYRDSWRYGVSMLARALTGA

SEQ ID NO: 688274 - protein, 24 aa, Mycobacterium
LDGYRRQPVHTVEVLGLNRQRITL

SEQ ID NO: 688275 - protein, 18 aa, Mycobacterium
LDGYRRVVARTATYEYVD

SEQ ID NO: 688276 - protein, 20 aa, Mycobacterium
LDGYSAADCVALLREAALTA

SEQ ID NO: 688277 - protein, 21 aa, Mycobacterium
LDGYSGCLLVVSHDRALLDRM

SEQ ID NO: 688278 - protein, 23 aa, Mycobacterium
LDHACGLGTGGFFLADVADVPPV

SEQ ID NO: 688279 - protein, 19 aa, Mycobacterium
LDHACIRSSAAAALAATSE

SEQ ID NO: 688280 - protein, 24 aa, Mycobacterium
LDHAMWFMRGFRADEWLLYDQSSP

SEQ ID NO: 688281 - protein, 18 aa, Mycobacterium
LDHAMWFMRPFRADEWLL

SEQ ID NO: 688282 - protein, 19 aa, Mycobacterium
LDHAMWFMRSFRADEWLLY

SEQ ID NO: 688283 - protein, 20 aa, Mycobacterium
LDHARRLRDAFPHAALIEIP

SEQ ID NO: 688284 - protein, 24 aa, Mycobacterium
LDHFDEIRDLLAFRNPASLPVFIG

SEQ ID NO: 688285 - protein, 22 aa, Mycobacterium
LDHFGGLLAGLLLDPGQFLVPG

SEQ ID NO: 688286 - protein, 31 aa, Mycobacterium
LDHFRANPGAARYNIAVVNWFNEEGSRFKPS

SEQ ID NO: 688287 - protein, 26 aa, Mycobacterium
LDHHLSGGVPVRWSDHHVRACFRCPV

SEQ ID NO: 688288 - protein, 22 aa, Mycobacterium
LDHHVNLRPGRLYPGVSSPLAG

SEQ ID NO: 688289 - protein, 20 aa, Mycobacterium
LDHIEFGNGVVHAERGAHGG

SEQ ID NO: 688290 - protein, 18 aa, Mycobacterium
LDHLARRVVLTAARLATR

SEQ ID NO: 688291 - protein, 17 aa, Mycobacterium
LDHLARRVVTVAGRLAG

SEQ ID NO: 688292 - protein, 18 aa, Mycobacterium
LDHLCVAMTAAGWDPKVV

SEQ ID NO: 688293 - protein, 23 aa, Mycobacterium
LDHLERGGARRPMLIAPDSAASY

SEQ ID NO: 688294 - protein, 22 aa, Mycobacterium
LDHLERLGVDAIWLNPVTVSPM

SEQ ID NO: 688295 - protein, 25 aa, Mycobacterium
LDHLGGLLAGLLLDLGQLGVPGRLV

SEQ ID NO: 688296 - protein, 17 aa, Mycobacterium
LDHLLPVPGSRVITVSS

SEQ ID NO: 688297 - protein, 18 aa, Mycobacterium
LDHLRHLGRIPATMRYTA

SEQ ID NO: 688298 - protein, 25 aa, Mycobacterium
LDHLTEGRVAWNIVTSYLDSAARNL

SEQ ID NO: 688299 - protein, 25 aa, Mycobacterium
LDHMPEQFQLPGIVHGLRWIADGDY

SEQ ID NO: 688300 - protein, 34 aa, Mycobacterium
LDHPEEMDAAFAKAWFKLMHRDMGPVSRYLGPWV

SEQ ID NO: 688301 - protein, 30 aa, Mycobacterium
LDHPRLGWADAPVGPVLAEALGLPVSMASH

SEQ ID NO: 688302 - protein, 25 aa, Mycobacterium
LDHPRLGWADAPVGPVLAETLGLPV

SEQ ID NO: 688303 - protein, 17 aa, Mycobacterium
LDHREHLETLAARPDVW

SEQ ID NO: 688304 - protein, 22 aa, Mycobacterium
LDHRISGRLEIRYEQRGPEAWR

SEQ ID NO: 688305 - protein, 25 aa, Mycobacterium
LDHRWPPGWEVLELNPAQVAEQRRV

SEQ ID NO: 688306 - protein, 20 aa, Mycobacterium
LDHSIWFHRPFRPDIWHRYE

SEQ ID NO: 688307 - protein, 19 aa, Mycobacterium
LDHTLGLLLMREGRGLEVH

SEQ ID NO: 688308 - protein, 24 aa, Mycobacterium
LDHVAEHYLHFGGVSPINRINLAL

SEQ ID NO: 688309 - protein, 19 aa, Mycobacterium
LDHVREVVCEDSLGLAEEF

SEQ ID NO: 688310 - protein, 25 aa, Mycobacterium
LDHVVAHPRITWVGGANELNAGYAA

SEQ ID NO: 688311 - protein, 19 aa, Mycobacterium
LDHYLALGFLRGLLAILAD

SEQ ID NO: 688312 - protein, 19 aa, Mycobacterium
LDHYMWRLTSGRARRPHPK

SEQ ID NO: 688313 - protein, 21 aa, Mycobacterium
LDIAAATAVRFEPGVPHTVRL

SEQ ID NO: 688314 - protein, 19 aa, Mycobacterium
LDIAHRFGRREARNGRPAE

SEQ ID NO: 688315 - protein, 23 aa, Mycobacterium
LDIAPSALYWHFANKQQLLGAVA

SEQ ID NO: 688316 - protein, 27 aa, Mycobacterium
LDIARSRLAPFGTRFVGVHTRYDGLAD

SEQ ID NO: 688317 - protein, 24 aa, Mycobacterium
LDIARTSLLAAGWPETVPGVTVDR

SEQ ID NO: 688318 - protein, 21 aa, Mycobacterium
LDIARTSLLTAGWPETVPGVT

SEQ ID NO: 688319 - protein, 17 aa, Mycobacterium
LDICAPASASVTYPPAT

SEQ ID NO: 688320 - protein, 27 aa, Mycobacterium
LDICERDGLGFIPWAPVAQGGLGQAGD

SEQ ID NO: 688321 - protein, 22 aa, Mycobacterium
LDIDLSRTVGWFTTKYPVSLSV

SEQ ID NO: 688322 - protein, 26 aa, Mycobacterium
LDIEDICNRWAAGRFDTGVFKEGQGE

SEQ ID NO: 688323 - protein, 19 aa, Mycobacterium
LDIENYWFRRHEVVYQRLA

SEQ ID NO: 688324 - protein, 31 aa, Mycobacterium
LDIERRHCFELDSELPIRVAVLRTENADEHV

SEQ ID NO: 688325 - protein, 17 aa, Mycobacterium
LDIGAVLGTGGYSELDE

SEQ ID NO: 688326 - protein, 23 aa, Mycobacterium
LDIGCGLGDNAIYLAQQGYRVTA

SEQ ID NO: 688327 - protein, 19 aa, Mycobacterium
LDIGCGWGATMRHAVQEYD

SEQ ID NO: 688328 - protein, 20 aa, Mycobacterium
LDIGCGWGATMRRAIEKYDV

SEQ ID NO: 688329 - protein, 19 aa, Mycobacterium
LDIGCGWGSTMRHAIEEYD

SEQ ID NO: 688330 - protein, 19 aa, Mycobacterium
LDIGCGWGSTMRRAVEKYD

SEQ ID NO: 688331 - protein, 19 aa, Mycobacterium
LDIGCGWGTTMKRAVERFD

SEQ ID NO: 688332 - protein, 20 aa, Mycobacterium
LDIGEVLLRAHAAARMSPGV

SEQ ID NO: 688333 - protein, 24 aa, Mycobacterium
LDIGRTALLAAGWPETVPGVTVDR

SEQ ID NO: 688334 - protein, 23 aa, Mycobacterium
LDIGRTALLTAGWPETVPGVTVD

SEQ ID NO: 688335 - protein, 18 aa, Mycobacterium
LDIISARQQIAFYTDMLP

SEQ ID NO: 688336 - protein, 17 aa, Mycobacterium
LDIKDLRSVIQYLTSDE

SEQ ID NO: 688337 - protein, 17 aa, Mycobacterium
LDILAAVAMLLTQIREG

SEQ ID NO: 688338 - protein, 17 aa, Mycobacterium
LDILDARLSELGVTDLV

SEQ ID NO: 688339 - protein, 27 aa, Mycobacterium
LDINVFGRRAGIAAADFADVHDFVDMP

SEQ ID NO: 688340 - protein, 27 aa, Mycobacterium
LDINVFGRRAGIAAAEYAEAHDFIDLP

SEQ ID NO: 688341 - protein, 27 aa, Mycobacterium
LDINVFGRRAGIAAAEYAQNHNFVDMP

SEQ ID NO: 688342 - protein, 28 aa, Mycobacterium
LDINVFGRRAGIAAANYALGHDFVELPE

SEQ ID NO: 688343 - protein, 27 aa, Mycobacterium
LDINVFGRRAGIAAANYARGHDFVDMP

SEQ ID NO: 688344 - protein, 27 aa, Mycobacterium
LDINVFGRRAGIAAANYARGHDFVEMP

SEQ ID NO: 688345 - protein, 17 aa, Mycobacterium
LDIPEQIARAGAQGIRQ

SEQ ID NO: 688346 - protein, 21 aa, Mycobacterium
LDIPEVDTVLFLRPTESATVF

SEQ ID NO: 688347 - protein, 17 aa, Mycobacterium
LDIPFTEDIGPRSIASF

SEQ ID NO: 688348 - protein, 17 aa, Mycobacterium
LDIPMVALAGMRREQEL

SEQ ID NO: 688349 - protein, 18 aa, Mycobacterium
LDIPRAGSSSVVLPPQQV

SEQ ID NO: 688350 - protein, 17 aa, Mycobacterium
LDIPTWVIGGGTLEIQL

SEQ ID NO: 688351 - protein, 17 aa, Mycobacterium
LDIPVAAVAAMRREQPM

SEQ ID NO: 688352 - protein, 18 aa, Mycobacterium
LDIPVFGICYGFQAMAQA

SEQ ID NO: 688353 - protein, 23 aa, Mycobacterium
LDIQTTLSIYGWVTEDIAMRTAA

SEQ ID NO: 688354 - protein, 22 aa, Mycobacterium
LDIRASHVALRILHDDTAVTGV

SEQ ID NO: 688355 - protein, 20 aa, Mycobacterium
LDIRPSLLVHTALATAQFIL

SEQ ID NO: 688356 - protein, 25 aa, Mycobacterium
LDIRRELARRLGLAAPSISWHATRD

SEQ ID NO: 688357 - protein, 23 aa, Mycobacterium
LDIRVSTPRGWSVTRVGYAEPID

SEQ ID NO: 688358 - protein, 23 aa, Mycobacterium
LDITRPLATLTFDAVSAVPLAGA

SEQ ID NO: 688359 - protein, 20 aa, Mycobacterium
LDIVDHLALDTGLHLISGNN

SEQ ID NO: 688360 - protein, 24 aa, Mycobacterium
LDIVIAHALARGASVRLIGDDQQL

SEQ ID NO: 688361 - protein, 19 aa, Mycobacterium
LDIVMANAGVTWVARLGEI

SEQ ID NO: 688362 - protein, 17 aa, Mycobacterium
LDIWRYIQLEDLELPSI

SEQ ID NO: 688363 - protein, 18 aa, Mycobacterium
LDKAGLQATRAWAEGLVG

SEQ ID NO: 688364 - protein, 17 aa, Mycobacterium
LDKAMLDWGTRELHEEM

SEQ ID NO: 688365 - protein, 17 aa, Mycobacterium
LDKARRLLWPVKQKYGS

SEQ ID NO: 688366 - protein, 21 aa, Mycobacterium
LDKERELFCQVFATQDRADGV

SEQ ID NO: 688367 - protein, 21 aa, Mycobacterium
LDKFLRRVSAGAVGELYVAGA

SEQ ID NO: 688368 - protein, 20 aa, Mycobacterium
LDKFPLWTGQPYDIDNLSAD

SEQ ID NO: 688369 - protein, 18 aa, Mycobacterium
LDKHFSISVVDCSSTMDS

SEQ ID NO: 688370 - protein, 26 aa, Mycobacterium
LDKIARWSLPLTRIGGRMLAIKGDRA

SEQ ID NO: 688371 - protein, 20 aa, Mycobacterium
LDKIFYRSGQGVTLTATGYS

SEQ ID NO: 688372 - protein, 25 aa, Mycobacterium
LDKLDLKPGMTLLDIGCGWGTTMKR

SEQ ID NO: 688373 - protein, 21 aa, Mycobacterium
LDKLESIPGFTAEITKSQIRQ

SEQ ID NO: 688374 - protein, 19 aa, Mycobacterium
LDKLTKWSMPLLKREGRML

SEQ ID NO: 688375 - protein, 30 aa, Mycobacterium
LDKLTKWSMPLLRPGGRMLAIKGERASEEV

SEQ ID NO: 688376 - protein, 25 aa, Mycobacterium
LDKLTRWSVPFLRDGGRMLPIKGER

SEQ ID NO: 688377 - protein, 18 aa, Mycobacterium
LDKMFALIEDWSERLSKW

SEQ ID NO: 688378 - protein, 17 aa, Mycobacterium
LDKMGWRSSDTAELSFT

SEQ ID NO: 688379 - protein, 18 aa, Mycobacterium
LDKMGWRSSDTAELSYTD

SEQ ID NO: 688380 - protein, 22 aa, Mycobacterium
LDKPGSVVLWTNCHHPFYDHNP

SEQ ID NO: 688381 - protein, 28 aa, Mycobacterium
LDKPKLVFFFDEAHLLFSDASKAFLEQV

SEQ ID NO: 688382 - protein, 19 aa, Mycobacterium
LDKRFKRRGVQIVSDGKRS

SEQ ID NO: 688383 - protein, 22 aa, Mycobacterium
LDKRGVSCVARLLDEVAPRTCA

SEQ ID NO: 688384 - protein, 19 aa, Mycobacterium
LDKRKRGFDLCIYMLGADH

SEQ ID NO: 688385 - protein, 22 aa, Mycobacterium
LDKSDVLAGLFAVWDSLDALLD

SEQ ID NO: 688386 - protein, 25 aa, Mycobacterium
LDKSRPLWEMYLIEGLEKGRVALYT

SEQ ID NO: 688387 - protein, 23 aa, Mycobacterium
LDKSRPLWEMYLVEGLSKNRLAL

SEQ ID NO: 688388 - protein, 19 aa, Mycobacterium
LDKSTVLTGLFAVWDDLDA

SEQ ID NO: 688389 - protein, 21 aa, Mycobacterium
LDKTRFRSHPDLDVCTHGLTL

SEQ ID NO: 688390 - protein, 17 aa, Mycobacterium
LDKTRFRSHPDLDVLSH

SEQ ID NO: 688391 - protein, 18 aa, Mycobacterium
LDKTSGSRPNWWHATPMV

SEQ ID NO: 688392 - protein, 17 aa, Mycobacterium
LDLAAGPLRYAGWSSCF

SEQ ID NO: 688393 - protein, 32 aa, Mycobacterium
LDLAGGAVMDLGCYGIHVMRALGAMRVDGLGG

SEQ ID NO: 688394 - protein, 25 aa, Mycobacterium
LDLAGGAWADHLIKLLEDVRTELAR

SEQ ID NO: 688395 - protein, 19 aa, Mycobacterium
LDLALQCAPDHPWARDHPE

SEQ ID NO: 688396 - protein, 19 aa, Mycobacterium
LDLALQCAPDHPWVRAHPE

SEQ ID NO: 688397 - protein, 17 aa, Mycobacterium
LDLALRRGVDMPADLAT

SEQ ID NO: 688398 - protein, 18 aa, Mycobacterium
LDLALVFNEGPDHSAAAV

SEQ ID NO: 688399 - protein, 18 aa, Mycobacterium
LDLAMRFGTNSGGPVRVE

SEQ ID NO: 688400 - protein, 17 aa, Mycobacterium
LDLAQRFGTIEGDSVYV

SEQ ID NO: 688401 - protein, 17 aa, Mycobacterium
LDLASGDLGELLHQSAN

SEQ ID NO: 688402 - protein, 25 aa, Mycobacterium
LDLATRLGTAIAERGWTLVSGGGNV

SEQ ID NO: 688403 - protein, 17 aa, Mycobacterium
LDLCAGPGGKTALLAAL

SEQ ID NO: 688404 - protein, 25 aa, Mycobacterium
LDLCAPDLDSARRWRDYDTIVNAAA

SEQ ID NO: 688405 - protein, 27 aa, Mycobacterium
LDLCTERGIAFVPFFPLGSAFVPDNPV

SEQ ID NO: 688406 - protein, 19 aa, Mycobacterium
LDLDAGYWRAGGRVKVGPK

SEQ ID NO: 688407 - protein, 25 aa, Mycobacterium
LDLDALRAATHFVVVTATYGDGELP

SEQ ID NO: 688408 - protein, 18 aa, Mycobacterium
LDLDAVAMLSRLASGLLD

SEQ ID NO: 688409 - protein, 17 aa, Mycobacterium
LDLDLAIPKEMGGSGNG

SEQ ID NO: 688410 - protein, 25 aa, Mycobacterium
LDLDLASYVLEWHARVPDWRDYYLG

SEQ ID NO: 688411 - protein, 25 aa, Mycobacterium
LDLDLASYVLEWHARVPDWRDYYLS

SEQ ID NO: 688412 - protein, 26 aa, Mycobacterium
LDLDLNWLSSDPFYRDSLENDPLAFS

SEQ ID NO: 688413 - protein, 24 aa, Mycobacterium
LDLDLRLVRYFTVVAEQRHFGRAS

SEQ ID NO: 688414 - protein, 35 aa, Mycobacterium
LDLDWLSAHADRGSWYINRVHRLLARVLTLSVPTA

SEQ ID NO: 688415 - protein, 23 aa, Mycobacterium
LDLDYRPMFWESPAAATEVVQRA

SEQ ID NO: 688416 - protein, 24 aa, Mycobacterium
LDLESRWGGALFHDVIRLYFSPAR

SEQ ID NO: 688417 - protein, 22 aa, Mycobacterium
LDLEVIDAFLSWYVPDLDVSDH

SEQ ID NO: 688418 - protein, 19 aa, Mycobacterium
LDLFCKIFVDPGDLVTVES

SEQ ID NO: 688419 - protein, 20 aa, Mycobacterium
LDLFLLRITLALLSDRPILV

SEQ ID NO: 688420 - protein, 21 aa, Mycobacterium
LDLFLRIIGELVRRHWSSTGG

SEQ ID NO: 688421 - protein, 21 aa, Mycobacterium
LDLFLTPTFRGYLANYGAVLY

SEQ ID NO: 688422 - protein, 17 aa, Mycobacterium
LDLFTAEDTAWLTRMAT

SEQ ID NO: 688423 - protein, 18 aa, Mycobacterium
LDLGCGSGAFLEHAPQDL

SEQ ID NO: 688424 - protein, 18 aa, Mycobacterium
LDLGCWYPTGEAVAAIDS

SEQ ID NO: 688425 - protein, 18 aa, Mycobacterium
LDLGDGLRPYTRDTNVMP

SEQ ID NO: 688426 - protein, 19 aa, Mycobacterium
LDLGELRVVHACWHDDSIG

SEQ ID NO: 688427 - protein, 17 aa, Mycobacterium
LDLGPIVLFVYYEPSIL

SEQ ID NO: 688428 - protein, 21 aa, Mycobacterium
LDLGRKVTCYLSAEFLMGPQL

SEQ ID NO: 688429 - protein, 20 aa, Mycobacterium
LDLGSLRRARGTAASVRPLP

SEQ ID NO: 688430 - protein, 17 aa, Mycobacterium
LDLGVTFIDTANVYGSG

SEQ ID NO: 688431 - protein, 22 aa, Mycobacterium
LDLHAPVARYWPEFGQAGKEAI

SEQ ID NO: 688432 - protein, 25 aa, Mycobacterium
LDLIKAAVRRFGRDGTDGYDLVLRS

SEQ ID NO: 688433 - protein, 29 aa, Mycobacterium
LDLIKAAVRRFGREGTDGYDLVLRSSAPP

SEQ ID NO: 688434 - protein, 17 aa, Mycobacterium
LDLIPAAEMVKFAKNGS

SEQ ID NO: 688435 - protein, 17 aa, Mycobacterium
LDLIPPELAAAMDNVVV

SEQ ID NO: 688436 - protein, 17 aa, Mycobacterium
LDLKAARLLPAGQVDDD

SEQ ID NO: 688437 - protein, 21 aa, Mycobacterium
LDLKAARLLPAGRMDDEEDLA

SEQ ID NO: 688438 - protein, 17 aa, Mycobacterium
LDLKDLRAVITHLISDE

SEQ ID NO: 688439 - protein, 17 aa, Mycobacterium
LDLKDLRAVITHLTSDQ

SEQ ID NO: 688440 - protein, 24 aa, Mycobacterium
LDLKERREGDVLGRNQSGRAITLR

SEQ ID NO: 688441 - protein, 33 aa, Mycobacterium
LDLKLRHAMQFELKRIQREVGITFIYVTHDQEE

SEQ ID NO: 688442 - protein, 34 aa, Mycobacterium
LDLKLRHVMQFELKRIQREIGITFIYVTHDQEEA

SEQ ID NO: 688443 - protein, 32 aa, Mycobacterium
LDLKRPANWLLAARCARGFLSMSSEKPDPALT

SEQ ID NO: 688444 - protein, 21 aa, Mycobacterium
LDLKTPGGMDVLHKLLDTADA

SEQ ID NO: 688445 - protein, 22 aa, Mycobacterium
LDLLDFYACYRAYVRGKVRSLR

SEQ ID NO: 688446 - protein, 17 aa, Mycobacterium
LDLLGCDDGDIAELTVR

SEQ ID NO: 688447 - protein, 19 aa, Mycobacterium
LDLLGFDFLVDGLVVALTE

SEQ ID NO: 688448 - protein, 17 aa, Mycobacterium
LDLLMSIDFRMTSTTLL

SEQ ID NO: 688449 - protein, 17 aa, Mycobacterium
LDLLNRLGIAALPNTAG

SEQ ID NO: 688450 - protein, 25 aa, Mycobacterium
LDLLPTVRGAFCLTFMDENTLYACR

SEQ ID NO: 688451 - protein, 22 aa, Mycobacterium
LDLLQRLQRAMGLPAVEDPDAA

SEQ ID NO: 688452 - protein, 19 aa, Mycobacterium
LDLLQRVQRAIGLARVDDP

SEQ ID NO: 688453 - protein, 18 aa, Mycobacterium
LDLLRIDLMRSLGVGIND

SEQ ID NO: 688454 - protein, 17 aa, Mycobacterium
LDLLRLDLDEWDRAMAL

SEQ ID NO: 688455 - protein, 19 aa, Mycobacterium
LDLLRLGTYQLLRTRVDSY

SEQ ID NO: 688456 - protein, 20 aa, Mycobacterium
LDLLRLGTYQLLRTRVGSHA

SEQ ID NO: 688457 - protein, 17 aa, Mycobacterium
LDLLRWHGAEEVEHKAV

SEQ ID NO: 688458 - protein, 29 aa, Mycobacterium
LDLLSQGRFRFGVGVGWLREEIANHGVDP

SEQ ID NO: 688459 - protein, 21 aa, Mycobacterium
LDLLTGWRDAWELGTTARSAA

SEQ ID NO: 688460 - protein, 24 aa, Mycobacterium
LDLLTGWRDAWQLGTTARDHALAL

SEQ ID NO: 688461 - protein, 18 aa, Mycobacterium
LDLLWRNRRGELDMSIAM

SEQ ID NO: 688462 - protein, 18 aa, Mycobacterium
LDLLWRNRRGELEMSVAM

SEQ ID NO: 688463 - protein, 25 aa, Mycobacterium
LDLMPRYEVRWDRCRRVSMQNVSGW

SEQ ID NO: 688464 - protein, 20 aa, Mycobacterium
LDLNSIFAIQDPGAYPLVLA

SEQ ID NO: 688465 - protein, 17 aa, Mycobacterium
LDLPAADAIMLLAAHIS

SEQ ID NO: 688466 - protein, 21 aa, Mycobacterium
LDLPAELIGGGTTEIQLNIIA

SEQ ID NO: 688467 - protein, 22 aa, Mycobacterium
LDLPARADYDFLLARVEGELEN

SEQ ID NO: 688468 - protein, 27 aa, Mycobacterium
LDLPARTRLAAAWARANQRLLEAGAEI

SEQ ID NO: 688469 - protein, 18 aa, Mycobacterium
LDLPATIYDLLARSAAQH

SEQ ID NO: 688470 - protein, 24 aa, Mycobacterium
LDLPEAPAPFMPVGTDPLSVAIIG

SEQ ID NO: 688471 - protein, 18 aa, Mycobacterium
LDLPERFGGAGGDFGYSA

SEQ ID NO: 688472 - protein, 17 aa, Mycobacterium
LDLPFMESVIWAFKQLW

SEQ ID NO: 688473 - protein, 21 aa, Mycobacterium
LDLPVPELTLAEVLRGAAITT

SEQ ID NO: 688474 - protein, 26 aa, Mycobacterium
LDLQARFKLSYLFVSHDLSVVKHLAH

SEQ ID NO: 688475 - protein, 20 aa, Mycobacterium
LDLQDRFGLSYLFVSHDLSV

SEQ ID NO: 688476 - protein, 19 aa, Mycobacterium
LDLQEQFRLSYLFVSHDLS

SEQ ID NO: 688477 - protein, 21 aa, Mycobacterium
LDLRAQMDLVRQLAESVQYAH

SEQ ID NO: 688478 - protein, 19 aa, Mycobacterium
LDLRCAEGQELVRRLVEHA

SEQ ID NO: 688479 - protein, 24 aa, Mycobacterium
LDLREPICAWQTFEEHIRAWEDTI

SEQ ID NO: 688480 - protein, 17 aa, Mycobacterium
LDLRGWSSMADIVDTKP

SEQ ID NO: 688481 - protein, 17 aa, Mycobacterium
LDLRIAALATKLAGFGP

SEQ ID NO: 688482 - protein, 22 aa, Mycobacterium
LDLRKLRYFVAVAEELNFGRAA

SEQ ID NO: 688483 - protein, 24 aa, Mycobacterium
LDLRKPRGRELFCDLVEKSDIVVE

SEQ ID NO: 688484 - protein, 26 aa, Mycobacterium
LDLRKRLRRATGRSVPLAAMLGGMTG

SEQ ID NO: 688485 - protein, 17 aa, Mycobacterium
LDLRPASRLGVVGLVEV

SEQ ID NO: 688486 - protein, 19 aa, Mycobacterium
LDLRPIVTTGYLREAFVGR

SEQ ID NO: 688487 - protein, 25 aa, Mycobacterium
LDLRRLVDRAGRWLLNYRPQPLAVG

SEQ ID NO: 688488 - protein, 17 aa, Mycobacterium
LDLRSPRGATYLATAPG

SEQ ID NO: 688489 - protein, 21 aa, Mycobacterium
LDLRSVKALNCGAEPVRAETM

SEQ ID NO: 688490 - protein, 33 aa, Mycobacterium
LDLSAGPRRYAGWSSCFRREAGSYGKDTRGIIR

SEQ ID NO: 688491 - protein, 19 aa, Mycobacterium
LDLSGPLLTAWELAQAWPD

SEQ ID NO: 688492 - protein, 17 aa, Mycobacterium
LDLSPNLGQLVITALNA

SEQ ID NO: 688493 - protein, 17 aa, Mycobacterium
LDLSRFATSMSATGFID

SEQ ID NO: 688494 - protein, 27 aa, Mycobacterium
LDLSRLRFLSVEGFRALLFVNDELRKA

SEQ ID NO: 688495 - protein, 19 aa, Mycobacterium
LDLTEYPERVIAVIRAAIT

SEQ ID NO: 688496 - protein, 20 aa, Mycobacterium
LDLTGCMALGITGPILRSTG

SEQ ID NO: 688497 - protein, 19 aa, Mycobacterium
LDLTLRTGPFGDRYGQNPG

SEQ ID NO: 688498 - protein, 22 aa, Mycobacterium
LDLTRPVGRDVILECIQLAMQA

SEQ ID NO: 688499 - protein, 20 aa, Mycobacterium
LDLVCAYLGLVSVPLQHNAP

SEQ ID NO: 688500 - protein, 25 aa, Mycobacterium
LDLVEINEAFALVGLASIKDLGIDP

SEQ ID NO: 688501 - protein, 19 aa, Mycobacterium
LDLVGAWHLLDAAARKVFR

SEQ ID NO: 688502 - protein, 17 aa, Mycobacterium
LDLVLAILRARQLFAGA

SEQ ID NO: 688503 - protein, 17 aa, Mycobacterium
LDLVLAILRARQLFGGE

SEQ ID NO: 688504 - protein, 18 aa, Mycobacterium
LDLVLAILRARQLFGGEQ

SEQ ID NO: 688505 - protein, 20 aa, Mycobacterium
LDLVLRWYLDDVRGRFPDSP

SEQ ID NO: 688506 - protein, 23 aa, Mycobacterium
LDLWLRMLLRSAACFVPQELSVR

SEQ ID NO: 688507 - protein, 35 aa, Mycobacterium
LDLYWPGRLEGCAEPSIQREAFAWHIELAKRTGKP

SEQ ID NO: 688508 - protein, 18 aa, Mycobacterium
LDMAYKLVEYDGIGRTKL

SEQ ID NO: 688509 - protein, 21 aa, Mycobacterium
LDMFYNLGIAGRAMRRIGAIE

SEQ ID NO: 688510 - protein, 23 aa, Mycobacterium
LDMHPSMRLRVEHYLQRRDSPYL

SEQ ID NO: 688511 - protein, 31 aa, Mycobacterium
LDMKKPANWWLAARCVRGFLSMSSGKPDPAL

SEQ ID NO: 688512 - protein, 18 aa, Mycobacterium
LDMLGEGEVRRMLLWHAF

SEQ ID NO: 688513 - protein, 22 aa, Mycobacterium
LDMLMGALGPMLSSGIASGIDL

SEQ ID NO: 688514 - protein, 19 aa, Mycobacterium
LDMLTAPRLAEMLRTSLIE

SEQ ID NO: 688515 - protein, 26 aa, Mycobacterium
LDMMRRDCAIARPVKPTVFTDLKSGH

SEQ ID NO: 688516 - protein, 19 aa, Mycobacterium
LDMPPLRVDPATVLSDNPH

SEQ ID NO: 688517 - protein, 21 aa, Mycobacterium
LDMRAGVLTRQVDWTAPSGTR

SEQ ID NO: 688518 - protein, 17 aa, Mycobacterium
LDMRLAKIDAATRELQA

SEQ ID NO: 688519 - protein, 26 aa, Mycobacterium
LDMSRHWYRYHHLFGELLRAELHRCE

SEQ ID NO: 688520 - protein, 19 aa, Mycobacterium
LDMTRPLADVSFSAVESSP

SEQ ID NO: 688521 - protein, 17 aa, Mycobacterium
LDMTVWIMRRPEDDIAA

SEQ ID NO: 688522 - protein, 18 aa, Mycobacterium
LDMVDNIRAGDGRPDLDH

SEQ ID NO: 688523 - protein, 21 aa, Mycobacterium
LDMVSRLKQAVGERVDVVGGN

SEQ ID NO: 688524 - protein, 23 aa, Mycobacterium
LDMWCHLDPVWGPAREVRACQPL

SEQ ID NO: 688525 - protein, 21 aa, Mycobacterium
LDMYRRCRALLMPGVEDFGIV

SEQ ID NO: 688526 - protein, 24 aa, Mycobacterium
LDNCAREPIHIPGSIQPRGVLAVV

SEQ ID NO: 688527 - protein, 17 aa, Mycobacterium
LDNGCPFDPAASTVFGE

SEQ ID NO: 688528 - protein, 28 aa, Mycobacterium
LDNGNWTWRYDAIRKFPDFDVLWDDVDR

SEQ ID NO: 688529 - protein, 18 aa, Mycobacterium
LDNHARIWGSRAVSTAIC

SEQ ID NO: 688530 - protein, 17 aa, Mycobacterium
LDNHGPDAIALYVSGQM

SEQ ID NO: 688531 - protein, 17 aa, Mycobacterium
LDNHGWRSVGTTAAQLL

SEQ ID NO: 688532 - protein, 25 aa, Mycobacterium
LDNLGRPTSFIWYGPRWAQAATAPS

SEQ ID NO: 688533 - protein, 18 aa, Mycobacterium
LDNLPKQFDLVAAERGRM

SEQ ID NO: 688534 - protein, 18 aa, Mycobacterium
LDNLTFVGERLFVSSFTG

SEQ ID NO: 688535 - protein, 18 aa, Mycobacterium
LDNLTFVINCNLQRLDGP

SEQ ID NO: 688536 - protein, 25 aa, Mycobacterium
LDNNCPVCRSGPFTATRPYEVEQLE

SEQ ID NO: 688537 - protein, 21 aa, Mycobacterium
LDNPTYLGVRVWGKQEKYEVL

SEQ ID NO: 688538 - protein, 27 aa, Mycobacterium
LDNPWLTGLCTMRWAGRLLPAASRKLP

SEQ ID NO: 688539 - protein, 17 aa, Mycobacterium
LDNPYLVVACVVGDGEA

SEQ ID NO: 688540 - protein, 26 aa, Mycobacterium
LDNQIWQCPVVLLADVRSVGVQGDGR

SEQ ID NO: 688541 - protein, 23 aa, Mycobacterium
LDNRAAAALMSRLRGVVERPDPL

SEQ ID NO: 688542 - protein, 17 aa, Mycobacterium
LDNRVSVMLPHLPVDEP

SEQ ID NO: 688543 - protein, 25 aa, Mycobacterium
LDNSYVHNLIHGFILAAQHLVPGGT

SEQ ID NO: 688544 - protein, 24 aa, Mycobacterium
LDNTRAREVLGWQPQVALAEGIAK

SEQ ID NO: 688545 - protein, 32 aa, Mycobacterium
LDNVPITPIWLCPLRLRDRDGWPLYPMRPDHT

SEQ ID NO: 688546 - protein, 18 aa, Mycobacterium
LDPAAGWIVGVVGVHPYQ

SEQ ID NO: 688547 - protein, 17 aa, Mycobacterium
LDPAEFVLLPIDDLTVE

SEQ ID NO: 688548 - protein, 18 aa, Mycobacterium
LDPAEVRRRNLLPTSAFP

SEQ ID NO: 688549 - protein, 17 aa, Mycobacterium
LDPAGRDFYVDWDEVAT

SEQ ID NO: 688550 - protein, 19 aa, Mycobacterium
LDPAIALADLHNVTYIARI

SEQ ID NO: 688551 - protein, 17 aa, Mycobacterium
LDPAIGLDGEWMRDIAD

SEQ ID NO: 688552 - protein, 17 aa, Mycobacterium
LDPALEMAEMARATKFH

SEQ ID NO: 688553 - protein, 17 aa, Mycobacterium
LDPALPVSDQRARAEAS

SEQ ID NO: 688554 - protein, 19 aa, Mycobacterium
LDPALSIGDIVIADRVVQH

SEQ ID NO: 688555 - protein, 25 aa, Mycobacterium
LDPARGVMLSALWAAGTGQLVLIIH

SEQ ID NO: 688556 - protein, 17 aa, Mycobacterium
LDPAVAGAMQLALSAES

SEQ ID NO: 688557 - protein, 19 aa, Mycobacterium
LDPAVTMPVEISRALFDGL

SEQ ID NO: 688558 - protein, 17 aa, Mycobacterium
LDPCNKHKPALVDIAAE

SEQ ID NO: 688559 - protein, 28 aa, Mycobacterium
LDPDAKRALCGAAVIGSRFGADLLALLG

SEQ ID NO: 688560 - protein, 18 aa, Mycobacterium
LDPDASLGAGWACGVTVV

SEQ ID NO: 688561 - protein, 19 aa, Mycobacterium
LDPDASLGAGWACGVTVVL

SEQ ID NO: 688562 - protein, 19 aa, Mycobacterium
LDPDDVVVVLSYDEELGPT

SEQ ID NO: 688563 - protein, 27 aa, Mycobacterium
LDPDEAVAMAVCLRLAAGGSVAGVGES

SEQ ID NO: 688564 - protein, 25 aa, Mycobacterium
LDPDLAWQPELWRALVAAVPADPPH

SEQ ID NO: 688565 - protein, 24 aa, Mycobacterium
LDPDLRTGWSVTVVGHAEPITDID

SEQ ID NO: 688566 - protein, 23 aa, Mycobacterium
LDPEAAAIFAHMGNYQAVRTHFF

SEQ ID NO: 688567 - protein, 31 aa, Mycobacterium
LDPEAVWWGKRVLGLPIHDNWWQTETGGIMI

SEQ ID NO: 688568 - protein, 24 aa, Mycobacterium
LDPEERKAAIASLIRSAHEANSGL

SEQ ID NO: 688569 - protein, 21 aa, Mycobacterium
LDPEITRMLLGVVPAAYHAGV

SEQ ID NO: 688570 - protein, 19 aa, Mycobacterium
LDPELVKGVLALIAELASD

SEQ ID NO: 688571 - protein, 18 aa, Mycobacterium
LDPEMINEVLAVMSSLAS

SEQ ID NO: 688572 - protein, 17 aa, Mycobacterium
LDPEMINEVLAVMTGLA

SEQ ID NO: 688573 - protein, 21 aa, Mycobacterium
LDPEMTSPYAWYQYFINTADA

SEQ ID NO: 688574 - protein, 21 aa, Mycobacterium
LDPEMVKGILALIADLGADGM

SEQ ID NO: 688575 - protein, 17 aa, Mycobacterium
LDPERPIQLIVAGKSHP

SEQ ID NO: 688576 - protein, 17 aa, Mycobacterium
LDPETNYQIGFVPQGIG

SEQ ID NO: 688577 - protein, 22 aa, Mycobacterium
LDPETRSGVVLVGAKSAGRKIF

SEQ ID NO: 688578 - protein, 24 aa, Mycobacterium
LDPEWCERFCVGLPTDSQTLSSGA

SEQ ID NO: 688579 - protein, 24 aa, Mycobacterium
LDPFERFHKARGFDEWQENHAWLY

SEQ ID NO: 688580 - protein, 20 aa, Mycobacterium
LDPFQVRACTALENGHGVLV

SEQ ID NO: 688581 - protein, 17 aa, Mycobacterium
LDPGHTVGWTLVGDQPE

SEQ ID NO: 688582 - protein, 17 aa, Mycobacterium
LDPGRTVVRLNPAATAD

SEQ ID NO: 688583 - protein, 20 aa, Mycobacterium
LDPGYPAARKQLMLDDVAPQ

SEQ ID NO: 688584 - protein, 17 aa, Mycobacterium
LDPIFAVPTDAHGAKLT

SEQ ID NO: 688585 - protein, 20 aa, Mycobacterium
LDPKLGYANDPAWIVFDSLH

SEQ ID NO: 688586 - protein, 19 aa, Mycobacterium
LDPLAFPGLDPAGAPADEL

SEQ ID NO: 688587 - protein, 19 aa, Mycobacterium
LDPLGLRLVAHPSGFGENL

SEQ ID NO: 688588 - protein, 19 aa, Mycobacterium
LDPLIPRLWALQRSAMYRD

SEQ ID NO: 688589 - protein, 18 aa, Mycobacterium
LDPLPLLIRDGVPSIALR

SEQ ID NO: 688590 - protein, 17 aa, Mycobacterium
LDPLVPLPGFVIKRAIK

SEQ ID NO: 688591 - protein, 18 aa, Mycobacterium
LDPNDLYDVLAINAASAS

SEQ ID NO: 688592 - protein, 18 aa, Mycobacterium
LDPPGGRREVGALRTNHI

SEQ ID NO: 688593 - protein, 20 aa, Mycobacterium
LDPPLGIPGTLWQKSLVPVV

SEQ ID NO: 688594 - protein, 19 aa, Mycobacterium
LDPPLGISGTLWQKAMTPM

SEQ ID NO: 688595 - protein, 24 aa, Mycobacterium
LDPPRAGEVLVEMAAAGLCHSDDH

SEQ ID NO: 688596 - protein, 25 aa, Mycobacterium
LDPPRGGEVLVRMAVAGICHSDDHL

SEQ ID NO: 688597 - protein, 21 aa, Mycobacterium
LDPPWSFGPAGERYEIEVRGN

SEQ ID NO: 688598 - protein, 30 aa, Mycobacterium
LDPQLARFLVMGAMNWTAEWWDPRRGSVDA

SEQ ID NO: 688599 - protein, 17 aa, Mycobacterium
LDPQLRETFLGARAQLP

SEQ ID NO: 688600 - protein, 23 aa, Mycobacterium
LDPQLRVKGVRGLRVVDASAMPK

SEQ ID NO: 688601 - protein, 26 aa, Mycobacterium
LDPQRGPLWGAVWLRGSDDADSTSSV

SEQ ID NO: 688602 - protein, 18 aa, Mycobacterium
LDPRCEMGGPGGPGPMGG

SEQ ID NO: 688603 - protein, 17 aa, Mycobacterium
LDPRLPVSDLLAEPLQA

SEQ ID NO: 688604 - protein, 19 aa, Mycobacterium
LDPRLRAKLGVTWSPQEQR

SEQ ID NO: 688605 - protein, 23 aa, Mycobacterium
LDPRPQPRVEVHVHRIAAVAGHR

SEQ ID NO: 688606 - protein, 19 aa, Mycobacterium
LDPRRCAPVEIGVDPTESW

SEQ ID NO: 688607 - protein, 25 aa, Mycobacterium
LDPRSGAMMRAVWLASRDSGDVLLL

SEQ ID NO: 688608 - protein, 32 aa, Mycobacterium
LDPRSPQLYRDWKLLTAWAVRLLRATYGQRPD

SEQ ID NO: 688609 - protein, 17 aa, Mycobacterium
LDPRTDLTTGLRIEDQL

SEQ ID NO: 688610 - protein, 20 aa, Mycobacterium
LDPRTSPLCDHFAEQYAELR

SEQ ID NO: 688611 - protein, 25 aa, Mycobacterium
LDPRVTDAWGVPAARIECSHSPDEV

SEQ ID NO: 688612 - protein, 35 aa, Mycobacterium
LDPRVWPYVIERLLAAGAYDAWLTPIIMKKGRPAH

SEQ ID NO: 688613 - protein, 19 aa, Mycobacterium
LDPSREWQPTLGVAGLLTR

SEQ ID NO: 688614 - protein, 25 aa, Mycobacterium
LDPTDRKTVCLFGDGAGAVVVGPTT

SEQ ID NO: 688615 - protein, 25 aa, Mycobacterium
LDPTGRLTLERRVADFFEGGATQLV

SEQ ID NO: 688616 - protein, 18 aa, Mycobacterium
LDPTLGQRFMDAYGDILY

SEQ ID NO: 688617 - protein, 20 aa, Mycobacterium
LDPTMFAAFAPHALELSVEE

SEQ ID NO: 688618 - protein, 21 aa, Mycobacterium
LDPTMFAAFAPHVLDLTVEEG

SEQ ID NO: 688619 - protein, 21 aa, Mycobacterium
LDPTMFAAFAPHVLELTIEEG

SEQ ID NO: 688620 - protein, 23 aa, Mycobacterium
LDPTMLVPLLRLLAAGEPVTVEA

SEQ ID NO: 688621 - protein, 17 aa, Mycobacterium
LDPVRRVGHQVEDVLRL

SEQ ID NO: 688622 - protein, 19 aa, Mycobacterium
LDPWGHYDGLLAWLNGLVN

SEQ ID NO: 688623 - protein, 19 aa, Mycobacterium
LDPWPDVRDGLELLRSNFL

SEQ ID NO: 688624 - protein, 19 aa, Mycobacterium
LDPYLKVSVVTAGITADTI

SEQ ID NO: 688625 - protein, 19 aa, Mycobacterium
LDPYLPVEVVTGGVTADTV

SEQ ID NO: 688626 - protein, 19 aa, Mycobacterium
LDQAARIAPSVALPSKEAI

SEQ ID NO: 688627 - protein, 32 aa, Mycobacterium
LDQAWGGPVLRLRWWEVLRCIASVRSGLVPRR

SEQ ID NO: 688628 - protein, 18 aa, Mycobacterium
LDQFGRRVSVAAINSPSA

SEQ ID NO: 688629 - protein, 17 aa, Mycobacterium
LDQFSRVLARQSGALAQ

SEQ ID NO: 688630 - protein, 25 aa, Mycobacterium
LDQHPSPRSKRVLLQGWEQVDEHVD

SEQ ID NO: 688631 - protein, 23 aa, Mycobacterium
LDQLARRRIHTWGNHAALTSPAA

SEQ ID NO: 688632 - protein, 33 aa, Mycobacterium
LDQLCGPGGWVRRFVLGNIPVRFPVLPAADDRG

SEQ ID NO: 688633 - protein, 36 aa, Mycobacterium
LDQPLYRYAIYQTRTDEFYLYAGFHHLVCDGFGAMV

SEQ ID NO: 688634 - protein, 23 aa, Mycobacterium
LDQQVRFVPGWFKDTLHDAPIEQ

SEQ ID NO: 688635 - protein, 17 aa, Mycobacterium
LDQRHVQEFSEGLDEVV

SEQ ID NO: 688636 - protein, 24 aa, Mycobacterium
LDQRLGEGWLRDLDRLHALAPLAG

SEQ ID NO: 688637 - protein, 17 aa, Mycobacterium
LDQWGRFDEAFAALRGW

SEQ ID NO: 688638 - protein, 18 aa, Mycobacterium
LDQWRAELFGADGTLVDH

SEQ ID NO: 688639 - protein, 19 aa, Mycobacterium
LDRAATFYVAGHRGLVGSA

SEQ ID NO: 688640 - protein, 20 aa, Mycobacterium
LDRAGPLPAVTAVDGASLEA

SEQ ID NO: 688641 - protein, 21 aa, Mycobacterium
LDRAHTAAIVWSDEPDGDHGQ

SEQ ID NO: 688642 - protein, 21 aa, Mycobacterium
LDRALAGVGFMLSVDPYLNET

SEQ ID NO: 688643 - protein, 20 aa, Mycobacterium
LDRALELGADYAFDSRDDQL

SEQ ID NO: 688644 - protein, 23 aa, Mycobacterium
LDRARAFAFRRRVQPVFQNPYSS

SEQ ID NO: 688645 - protein, 17 aa, Mycobacterium
LDRARAGGEVVITDRGI

SEQ ID NO: 688646 - protein, 24 aa, Mycobacterium
LDRARRFYERLGWHGQVVQETVFF

SEQ ID NO: 688647 - protein, 18 aa, Mycobacterium
LDRASLRASMARDPALAE

SEQ ID NO: 688648 - protein, 26 aa, Mycobacterium
LDRASLWSASFASRVGGLRATQDEVV

SEQ ID NO: 688649 - protein, 17 aa, Mycobacterium
LDRAVAPMMIEAGGGVI

SEQ ID NO: 688650 - protein, 23 aa, Mycobacterium
LDRAVGLRRLRAAKCRTHNLPLI

SEQ ID NO: 688651 - protein, 17 aa, Mycobacterium
LDRCGRADVLVNNVGHW

SEQ ID NO: 688652 - protein, 30 aa, Mycobacterium
LDRDAWPTARSCIDEVWFLTLDTEVRRARL

SEQ ID NO: 688653 - protein, 17 aa, Mycobacterium
LDRDIPPAQAYREAVEL

SEQ ID NO: 688654 - protein, 22 aa, Mycobacterium
LDRDLPLLTLPPDVPFRRIVDW

SEQ ID NO: 688655 - protein, 19 aa, Mycobacterium
LDRDLRVAAVMAHGEWIDF

SEQ ID NO: 688656 - protein, 25 aa, Mycobacterium
LDRDRPLWECWIIEGLAGGRWATLI

SEQ ID NO: 688657 - protein, 24 aa, Mycobacterium
LDRDRPLWECYLIEGLSDDRWAVL

SEQ ID NO: 688658 - protein, 35 aa, Mycobacterium
LDRDVQSLFGVWRGSAADAYRSGWDEMQDGATKVW

SEQ ID NO: 688659 - protein, 19 aa, Mycobacterium
LDREIRAPWASPIRTDEHT

SEQ ID NO: 688660 - protein, 25 aa, Mycobacterium
LDRERPLWECWIIEGLSESRWALLT

SEQ ID NO: 688661 - protein, 19 aa, Mycobacterium
LDRFADAFGPSGFAPEAFK

SEQ ID NO: 688662 - protein, 20 aa, Mycobacterium
LDRFGPPAGDPAWVVKDDHL

SEQ ID NO: 688663 - protein, 18 aa, Mycobacterium
LDRFVNLQVGDWVGQTAA

SEQ ID NO: 688664 - protein, 25 aa, Mycobacterium
LDRGHPLWECYIIDGIEGGRIAIML

SEQ ID NO: 688665 - protein, 17 aa, Mycobacterium
LDRGLAFNAHEVLEAAW

SEQ ID NO: 688666 - protein, 17 aa, Mycobacterium
LDRGMVFVVAHVRGGGE

SEQ ID NO: 688667 - protein, 21 aa, Mycobacterium
LDRGPEMLSFVLKHSPLKLCW

SEQ ID NO: 688668 - protein, 25 aa, Mycobacterium
LDRHFCLYGPAAIGWGTRSRLVVHF

SEQ ID NO: 688669 - protein, 17 aa, Mycobacterium
LDRHFRKDIVITQFMVV

SEQ ID NO: 688670 - protein, 19 aa, Mycobacterium
LDRHGDPVVANALFHSGDH

SEQ ID NO: 688671 - protein, 17 aa, Mycobacterium
LDRHGNPVAADRLFHSG

SEQ ID NO: 688672 - protein, 33 aa, Mycobacterium
LDRHIARMYGQWCPRPWPDPTRRLLTITTGAVV

SEQ ID NO: 688673 - protein, 19 aa, Mycobacterium
LDRHLPRGLRRWSSALLAA

SEQ ID NO: 688674 - protein, 29 aa, Mycobacterium
LDRHPSLKIGWFEGGIAWVPTALQDAEHM

SEQ ID NO: 688675 - protein, 19 aa, Mycobacterium
LDRHWRNARTLASHNPVIY

SEQ ID NO: 688676 - protein, 25 aa, Mycobacterium
LDRIKSVKRAAGVTVNDVVLAMCSG

SEQ ID NO: 688677 - protein, 17 aa, Mycobacterium
LDRKNVREHIAFGRGIH

SEQ ID NO: 688678 - protein, 19 aa, Mycobacterium
LDRLCRHALDLLRTGIADP

SEQ ID NO: 688679 - protein, 33 aa, Mycobacterium
LDRLDYLQWLGIDCIWLPPFYDSPLRDGGYDIR

SEQ ID NO: 688680 - protein, 17 aa, Mycobacterium
LDRLEEIWTTFTKLAPK

SEQ ID NO: 688681 - protein, 20 aa, Mycobacterium
LDRLFPRSVFHSLRQAEQSL

SEQ ID NO: 688682 - protein, 26 aa, Mycobacterium
LDRLFPRSVFYSLRLAEHNLDELLHN

SEQ ID NO: 688683 - protein, 20 aa, Mycobacterium
LDRLFPRSVYYSLRLAEHNL

SEQ ID NO: 688684 - protein, 20 aa, Mycobacterium
LDRLFPRSVYYSLRMAEHNL

SEQ ID NO: 688685 - protein, 18 aa, Mycobacterium
LDRLGALPPRSEILDGTH

SEQ ID NO: 688686 - protein, 24 aa, Mycobacterium
LDRLLRPGGVVDMLTSEGGLLDRL

SEQ ID NO: 688687 - protein, 18 aa, Mycobacterium
LDRLPRLLGADDEPEALT

SEQ ID NO: 688688 - protein, 25 aa, Mycobacterium
LDRLPRPYMLIAMDLQGGMSEPDKQ

SEQ ID NO: 688689 - protein, 23 aa, Mycobacterium
LDRLRELALVWEEGELLYLAGET

SEQ ID NO: 688690 - protein, 19 aa, Mycobacterium
LDRLRQFGGDVEFNCEVVG

SEQ ID NO: 688691 - protein, 30 aa, Mycobacterium
LDRLSRGRLRICAGVGWMREEIEACGGDFD

SEQ ID NO: 688692 - protein, 19 aa, Mycobacterium
LDRLVTFFSSRRLRRVRLL

SEQ ID NO: 688693 - protein, 21 aa, Mycobacterium
LDRLYGYEVSPVLWKKVGRNL

SEQ ID NO: 688694 - protein, 25 aa, Mycobacterium
LDRMGLSWETLQKWNPRLIFGSVKG

SEQ ID NO: 688695 - protein, 25 aa, Mycobacterium
LDRMIVPGISAITWRELNREFHQTF

SEQ ID NO: 688696 - protein, 18 aa, Mycobacterium
LDRNGRLFVVGRDDEMIV

SEQ ID NO: 688697 - protein, 17 aa, Mycobacterium
LDRPAWVRAAAESMRAM

SEQ ID NO: 688698 - protein, 21 aa, Mycobacterium
LDRPFAWALIKLDGADTLLMH

SEQ ID NO: 688699 - protein, 18 aa, Mycobacterium
LDRPLADWLAGLPAAASV

SEQ ID NO: 688700 - protein, 24 aa, Mycobacterium
LDRPLTAAMALMFMASGHHYGWPV

SEQ ID NO: 688701 - protein, 23 aa, Mycobacterium
LDRPLWECWVIEGLEHNRWAILL

SEQ ID NO: 688702 - protein, 18 aa, Mycobacterium
LDRPPAVMLGPGDVQVLQ

SEQ ID NO: 688703 - protein, 24 aa, Mycobacterium
LDRPPWECWVIEGLKGGRWAILMK

SEQ ID NO: 688704 - protein, 18 aa, Mycobacterium
LDRPRKRNALDLTMIRSI

SEQ ID NO: 688705 - protein, 18 aa, Mycobacterium
LDRQAAKAARVFARAGLR

SEQ ID NO: 688706 - protein, 18 aa, Mycobacterium
LDRQSRRLARHWYDSGLR

SEQ ID NO: 688707 - protein, 23 aa, Mycobacterium
LDRRFTLAAGLLELADREFSAVR

SEQ ID NO: 688708 - protein, 19 aa, Mycobacterium
LDRRFTVQDTGGWEADATG

SEQ ID NO: 688709 - protein, 25 aa, Mycobacterium
LDRRGNRHFSFGIGVHRCIGSNVAR

SEQ ID NO: 688710 - protein, 23 aa, Mycobacterium
LDRRLKSGPLRDAGSDTLPGGTE

SEQ ID NO: 688711 - protein, 17 aa, Mycobacterium
LDRRLLLGMLAELPAGA

SEQ ID NO: 688712 - protein, 24 aa, Mycobacterium
LDRRRLQSAMTRWASVLRDADGLG

SEQ ID NO: 688713 - protein, 24 aa, Mycobacterium
LDRRSAASSEEWRGDTVRLFALAK

SEQ ID NO: 688714 - protein, 23 aa, Mycobacterium
LDRRSRAAGWGVMSNAAHPGLTK

SEQ ID NO: 688715 - protein, 21 aa, Mycobacterium
LDRRSRRGGWGLMSNAAHPGL

SEQ ID NO: 688716 - protein, 18 aa, Mycobacterium
LDRRTRIGLVPHDRQRVV

SEQ ID NO: 688717 - protein, 21 aa, Mycobacterium
LDRRTRIGLVPQDRERVVAVA

SEQ ID NO: 688718 - protein, 21 aa, Mycobacterium
LDRRTRIGLVPVDKNQAIGAV

SEQ ID NO: 688719 - protein, 18 aa, Mycobacterium
LDRRTRIGLVSRDRERAV

SEQ ID NO: 688720 - protein, 19 aa, Mycobacterium
LDRRTRIGLVTEDRERALA

SEQ ID NO: 688721 - protein, 22 aa, Mycobacterium
LDRSGEWCAATLAPAARQPAVS

SEQ ID NO: 688722 - protein, 17 aa, Mycobacterium
LDRSGLRVRHVESHDQS

SEQ ID NO: 688723 - protein, 25 aa, Mycobacterium
LDRSRPELWAARRPGQVFVVEQHSQ

SEQ ID NO: 688724 - protein, 24 aa, Mycobacterium
LDRSRPLWEMYFIEGLANDRIAVV

SEQ ID NO: 688725 - protein, 24 aa, Mycobacterium
LDRSRPLWEMYFVEGLANNRIAVV

SEQ ID NO: 688726 - protein, 23 aa, Mycobacterium
LDRSSPVPLYFQVAQVFEKAILD

SEQ ID NO: 688727 - protein, 23 aa, Mycobacterium
LDRTELPDRLGVLTPAAAMGDPL

SEQ ID NO: 688728 - protein, 29 aa, Mycobacterium
LDRTGLGHFDAWAAQFVRYEVLIETSPDG

SEQ ID NO: 688729 - protein, 17 aa, Mycobacterium
LDRTGPWREALRLMLAA

SEQ ID NO: 688730 - protein, 19 aa, Mycobacterium
LDRTPWRAEQPIVIVAPMF

SEQ ID NO: 688731 - protein, 17 aa, Mycobacterium
LDRTREFAIKPDGAHWV

SEQ ID NO: 688732 - protein, 23 aa, Mycobacterium
LDRVFKVDGFAGCEYKKLRDVLG

SEQ ID NO: 688733 - protein, 22 aa, Mycobacterium
LDRVFKVNGFAGSEYKKLRDVL

SEQ ID NO: 688734 - protein, 17 aa, Mycobacterium
LDRVHMIDGLRIITLDT

SEQ ID NO: 688735 - protein, 19 aa, Mycobacterium
LDRVVRGPIPAGVPVVRGR

SEQ ID NO: 688736 - protein, 25 aa, Mycobacterium
LDRVWRRLPFDASWYSSNELARHRA

SEQ ID NO: 688737 - protein, 24 aa, Mycobacterium
LDRWLRPVPDGVIGELYLAGAGVG

SEQ ID NO: 688738 - protein, 18 aa, Mycobacterium
LDRWLRPVPEGVVGELYV

SEQ ID NO: 688739 - protein, 17 aa, Mycobacterium
LDRWMRPVPPGVVGELY

SEQ ID NO: 688740 - protein, 17 aa, Mycobacterium
LDRWYQQLTRLWASLAG

SEQ ID NO: 688741 - protein, 20 aa, Mycobacterium
LDRYPGAREFFWVQEEPANQ

SEQ ID NO: 688742 - protein, 23 aa, Mycobacterium
LDSAAGWRTAWNRPEGPPEPQSE

SEQ ID NO: 688743 - protein, 23 aa, Mycobacterium
LDSADDLPRGWGVDVAPGQYRVR

SEQ ID NO: 688744 - protein, 17 aa, Mycobacterium
LDSAFACFAEQGYHATG

SEQ ID NO: 688745 - protein, 19 aa, Mycobacterium
LDSAVKGLCELVNRVNGST

SEQ ID NO: 688746 - protein, 18 aa, Mycobacterium
LDSDLAYQRACLHAIDYL

SEQ ID NO: 688747 - protein, 17 aa, Mycobacterium
LDSEDAWVAALRTSLQA

SEQ ID NO: 688748 - protein, 17 aa, Mycobacterium
LDSELIGNVSVKVVDIG

SEQ ID NO: 688749 - protein, 19 aa, Mycobacterium
LDSELRTLPNVVLGAHNGS

SEQ ID NO: 688750 - protein, 24 aa, Mycobacterium
LDSEVRPIVVPDIPISRIPIVLSL

SEQ ID NO: 688751 - protein, 27 aa, Mycobacterium
LDSFRGESRFTTWAYKFVILEVAHKIG

SEQ ID NO: 688752 - protein, 24 aa, Mycobacterium
LDSGCGHAALSLALAARGYTVVGL

SEQ ID NO: 688753 - protein, 24 aa, Mycobacterium
LDSGEYFDYLGFDIFYRVEGSGPP

SEQ ID NO: 688754 - protein, 17 aa, Mycobacterium
LDSGIGMAAEGDQIVDL

SEQ ID NO: 688755 - protein, 25 aa, Mycobacterium
LDSGLRPVPCGATGELYLGGAQLAR

SEQ ID NO: 688756 - protein, 19 aa, Mycobacterium
LDSGPWRKLSANRDNRVYV

SEQ ID NO: 688757 - protein, 23 aa, Mycobacterium
LDSHLPVMCDFWETVLFHAGRYR

SEQ ID NO: 688758 - protein, 19 aa, Mycobacterium
LDSHLSYQRACLHAIDYLT

SEQ ID NO: 688759 - protein, 25 aa, Mycobacterium
LDSIRMMSLAGRWRQQGIDIDFATL

SEQ ID NO: 688760 - protein, 21 aa, Mycobacterium
LDSLGGLWAQGKLADKVYAGF

SEQ ID NO: 688761 - protein, 17 aa, Mycobacterium
LDSLKWVLRNRAYTPWY

SEQ ID NO: 688762 - protein, 21 aa, Mycobacterium
LDSLRRLYATSEWLHRETTRI

SEQ ID NO: 688763 - protein, 20 aa, Mycobacterium
LDSLSPRGLLVCFGTASGPI

SEQ ID NO: 688764 - protein, 18 aa, Mycobacterium
LDSPERWEELYIADEDRV

SEQ ID NO: 688765 - protein, 18 aa, Mycobacterium
LDSPKGKQVYRLVKGRRL

SEQ ID NO: 688766 - protein, 23 aa, Mycobacterium
LDSRAYRLDWAPGTTVFELDQPL

SEQ ID NO: 688767 - protein, 24 aa, Mycobacterium
LDSRAYRLDWPAGTTVYEIDQPKV

SEQ ID NO: 688768 - protein, 24 aa, Mycobacterium
LDSRAYRLDWPAGTTVYEIDQPLV

SEQ ID NO: 688769 - protein, 24 aa, Mycobacterium
LDSRAYRLDWPAGTTVYEIDQPQV

SEQ ID NO: 688770 - protein, 23 aa, Mycobacterium
LDSRAYRLDWPTGTTVYEIDQPK

SEQ ID NO: 688771 - protein, 20 aa, Mycobacterium
LDSRAYRLEWAQGTRVYEVD

SEQ ID NO: 688772 - protein, 30 aa, Mycobacterium
LDSRAYRLKWPDGMAVYEIDQPKVLQYKAE

SEQ ID NO: 688773 - protein, 23 aa, Mycobacterium
LDSRAYRLPWADGTVVYELDVPK

SEQ ID NO: 688774 - protein, 24 aa, Mycobacterium
LDSRAYRLSWPDGTTIFELDRPQV

SEQ ID NO: 688775 - protein, 25 aa, Mycobacterium
LDSRAYRLWWPRGTTVYEIDRPQVL

SEQ ID NO: 688776 - protein, 30 aa, Mycobacterium
LDSRLRVLARREFAGMISVAIESGDGVQVT

SEQ ID NO: 688777 - protein, 19 aa, Mycobacterium
LDSRLRVVARRDFAGTISV

SEQ ID NO: 688778 - protein, 19 aa, Mycobacterium
LDSRLRVVTRREFAGMISV

SEQ ID NO: 688779 - protein, 19 aa, Mycobacterium
LDSRWPRPILGDTLADETV

SEQ ID NO: 688780 - protein, 17 aa, Mycobacterium
LDSSQLVPADWDRIRAA

SEQ ID NO: 688781 - protein, 22 aa, Mycobacterium
LDSSRFRYLIADRADLAVANVH

SEQ ID NO: 688782 - protein, 17 aa, Mycobacterium
LDSSRLVPADWDRIRGA

SEQ ID NO: 688783 - protein, 18 aa, Mycobacterium
LDSTALVVAGEACPVEVV

SEQ ID NO: 688784 - protein, 21 aa, Mycobacterium
LDSTLPMLLFSGLMNSGQACV

SEQ ID NO: 688785 - protein, 19 aa, Mycobacterium
LDSTMAGTVWRHTPSAHTY

SEQ ID NO: 688786 - protein, 19 aa, Mycobacterium
LDSVAFAIGMIAIQDKLGV

SEQ ID NO: 688787 - protein, 24 aa, Mycobacterium
LDSVPRMRGVLALFEGVATGAADG

SEQ ID NO: 688788 - protein, 21 aa, Mycobacterium
LDSWAGTLIVVSHDRYLLERV

SEQ ID NO: 688789 - protein, 22 aa, Mycobacterium
LDSWLRPVPPGTVGELYVAGTG

SEQ ID NO: 688790 - protein, 20 aa, Mycobacterium
LDSWRNYQWHQLARAFLMFV

SEQ ID NO: 688791 - protein, 18 aa, Mycobacterium
LDSYGRRSNPTWRQLESA

SEQ ID NO: 688792 - protein, 18 aa, Mycobacterium
LDSYGRSSNPSWRQLESA

SEQ ID NO: 688793 - protein, 34 aa, Mycobacterium
LDTAEFSRLVALLRFPARFFTSAPISRVSAQDLL

SEQ ID NO: 688794 - protein, 26 aa, Mycobacterium
LDTAGRLGGFLTLRWTYCDPPSELPK

SEQ ID NO: 688795 - protein, 18 aa, Mycobacterium
LDTALKLYHHAASSTTAA

SEQ ID NO: 688796 - protein, 26 aa, Mycobacterium
LDTAPGMRPVLCLFEGVATGAADGYA

SEQ ID NO: 688797 - protein, 24 aa, Mycobacterium
LDTARAEWWYSRAATVMGGTAEVQ

SEQ ID NO: 688798 - protein, 17 aa, Mycobacterium
LDTASSWPKNLLANPNA

SEQ ID NO: 688799 - protein, 27 aa, Mycobacterium
LDTAYLGHVIVLWSWALKQPNPDTAES

SEQ ID NO: 688800 - protein, 18 aa, Mycobacterium
LDTCRQQRLHVFEGGVWS

SEQ ID NO: 688801 - protein, 26 aa, Mycobacterium
LDTDEFRLYELIWQRTVASQMADARG

SEQ ID NO: 688802 - protein, 18 aa, Mycobacterium
LDTDLNFFLGQPGVTDIS

SEQ ID NO: 688803 - protein, 19 aa, Mycobacterium
LDTDLRIALLHYAPIPETL

SEQ ID NO: 688804 - protein, 22 aa, Mycobacterium
LDTDPRLAAGVRVVAGEPRVRY

SEQ ID NO: 688805 - protein, 19 aa, Mycobacterium
LDTDPRLSAGIRVVAGEPR

SEQ ID NO: 688806 - protein, 22 aa, Mycobacterium
LDTEALRPAQIEAINGVEQSLA

SEQ ID NO: 688807 - protein, 29 aa, Mycobacterium
LDTEPWRGEPLLSYLRKMVFWAAVTPEAA

SEQ ID NO: 688808 - protein, 17 aa, Mycobacterium
LDTERPHEVELRKKVKE

SEQ ID NO: 688809 - protein, 18 aa, Mycobacterium
LDTERPHEVELRKKVKEY

SEQ ID NO: 688810 - protein, 19 aa, Mycobacterium
LDTERPHEVELRKKVKEYL

SEQ ID NO: 688811 - protein, 27 aa, Mycobacterium
LDTESWRGEPLAAYLRKMVFWSDVQIE

SEQ ID NO: 688812 - protein, 31 aa, Mycobacterium
LDTFEWPRIAGSFNWATDWFDAIAADPASAD

SEQ ID NO: 688813 - protein, 20 aa, Mycobacterium
LDTFFRHVAHRSGCAVLAVD

SEQ ID NO: 688814 - protein, 20 aa, Mycobacterium
LDTFGPRWVNAVMQRQSIQP

SEQ ID NO: 688815 - protein, 17 aa, Mycobacterium
LDTFIGRGSAEFLTDYA

SEQ ID NO: 688816 - protein, 23 aa, Mycobacterium
LDTFVRKLLRLFESPKTRADLKA

SEQ ID NO: 688817 - protein, 18 aa, Mycobacterium
LDTGALIGERFKLLTPQP

SEQ ID NO: 688818 - protein, 19 aa, Mycobacterium
LDTGAWMRLHPRFDVETML

SEQ ID NO: 688819 - protein, 18 aa, Mycobacterium
LDTGFGDWFQDFPHPDDF

SEQ ID NO: 688820 - protein, 25 aa, Mycobacterium
LDTGRWWSDVRWFKAPPDVSNIGES

SEQ ID NO: 688821 - protein, 19 aa, Mycobacterium
LDTGSPWLLHNNPRGKYFD

SEQ ID NO: 688822 - protein, 18 aa, Mycobacterium
LDTGWTLGERGERFEIEI

SEQ ID NO: 688823 - protein, 17 aa, Mycobacterium
LDTGYVWINGSGSHFLG

SEQ ID NO: 688824 - protein, 24 aa, Mycobacterium
LDTKTWLGERGWTVTEANLVDAAV

SEQ ID NO: 688825 - protein, 27 aa, Mycobacterium
LDTLIKEKWLTANAVIGFFPANAVGSG

SEQ ID NO: 688826 - protein, 31 aa, Mycobacterium
LDTLIKEKWLTANGVIGFFCANAVGDDIEVY

SEQ ID NO: 688827 - protein, 20 aa, Mycobacterium
LDTLISYGFDDRAAVSAYRA

SEQ ID NO: 688828 - protein, 26 aa, Mycobacterium
LDTLIWQCPVVLLGDVRSVGVQGDNR

SEQ ID NO: 688829 - protein, 18 aa, Mycobacterium
LDTMPGRVGGLSRPRRGG

SEQ ID NO: 688830 - protein, 20 aa, Mycobacterium
LDTPINWKLAIDTFAENYHF

SEQ ID NO: 688831 - protein, 25 aa, Mycobacterium
LDTPKALAAIDGWAEDTLSYGGHDR

SEQ ID NO: 688832 - protein, 17 aa, Mycobacterium
LDTQGFRRGNLTYRHML

SEQ ID NO: 688833 - protein, 27 aa, Mycobacterium
LDTRAYRLAWPAGTIVYEIDQPEVIEF

SEQ ID NO: 688834 - protein, 24 aa, Mycobacterium
LDTRAYRLAWPPDMTVFEIDQPQV

SEQ ID NO: 688835 - protein, 27 aa, Mycobacterium
LDTRAYRLGWPGGMTVFEIDQPAVIEF

SEQ ID NO: 688836 - protein, 25 aa, Mycobacterium
LDTRAYRLHWPKGTTVFELDQPAVI

SEQ ID NO: 688837 - protein, 27 aa, Mycobacterium
LDTRAYRLPWPGGTTVYEIDQPQVIEF

SEQ ID NO: 688838 - protein, 26 aa, Mycobacterium
LDTRAYRLTWPAGTTVYELDQPEVIT

SEQ ID NO: 688839 - protein, 25 aa, Mycobacterium
LDTRFAQQMKILFPIFTSNDAKEGA

SEQ ID NO: 688840 - protein, 19 aa, Mycobacterium
LDTRIPVIDEVSRIDAVPL

SEQ ID NO: 688841 - protein, 25 aa, Mycobacterium
LDTRLPRVAALLAEGRTDWRTVRLV

SEQ ID NO: 688842 - protein, 31 aa, Mycobacterium
LDTRLRRIGALLADGRIDWRTAQLTISRTDL

SEQ ID NO: 688843 - protein, 17 aa, Mycobacterium
LDTRRALSDAALHLMFK

SEQ ID NO: 688844 - protein, 22 aa, Mycobacterium
LDTRRPARFFGLIKAGAGQAGR

SEQ ID NO: 688845 - protein, 23 aa, Mycobacterium
LDTRRPARFFGLIKSRSGHAARD

SEQ ID NO: 688846 - protein, 22 aa, Mycobacterium
LDTSAPEWAEFVGEAGELVPHR

SEQ ID NO: 688847 - protein, 19 aa, Mycobacterium
LDTSLALWERGEALAKRCE

SEQ ID NO: 688848 - protein, 19 aa, Mycobacterium
LDTSVAISWIGKETGKEVV

SEQ ID NO: 688849 - protein, 17 aa, Mycobacterium
LDTVLGLTVGADDYITK

SEQ ID NO: 688850 - protein, 24 aa, Mycobacterium
LDTVPRMRGVLALFEGVATGAADG

SEQ ID NO: 688851 - protein, 18 aa, Mycobacterium
LDTVRAGARFAKQDFNNH

SEQ ID NO: 688852 - protein, 23 aa, Mycobacterium
LDTWFSSALWPFSTMGWPDHTPE

SEQ ID NO: 688853 - protein, 20 aa, Mycobacterium
LDTYLPAGCEPLVKVGQRAI

SEQ ID NO: 688854 - protein, 17 aa, Mycobacterium
LDVACWDLMGKITGRPL

SEQ ID NO: 688855 - protein, 23 aa, Mycobacterium
LDVADFGCGSGYAINLMAQAFPA

SEQ ID NO: 688856 - protein, 21 aa, Mycobacterium
LDVADGLKVIAARSTIMSRLA

SEQ ID NO: 688857 - protein, 17 aa, Mycobacterium
LDVAFSIVVKPGRTTAD

SEQ ID NO: 688858 - protein, 19 aa, Mycobacterium
LDVAFSIVVRPGRSAAEVR

SEQ ID NO: 688859 - protein, 20 aa, Mycobacterium
LDVAHCIYAGLTTDTGSFRW

SEQ ID NO: 688860 - protein, 18 aa, Mycobacterium
LDVAHGMAKPPGLPDIED

SEQ ID NO: 688861 - protein, 19 aa, Mycobacterium
LDVANVIAFLASDAAAAVH

SEQ ID NO: 688862 - protein, 18 aa, Mycobacterium
LDVARGIVGPDTLLGLSS

SEQ ID NO: 688863 - protein, 19 aa, Mycobacterium
LDVARMVLFGQVGRELVNL

SEQ ID NO: 688864 - protein, 18 aa, Mycobacterium
LDVAWMIFAHMVFEELAG

SEQ ID NO: 688865 - protein, 19 aa, Mycobacterium
LDVAWMIYAHLVFQELAAL

SEQ ID NO: 688866 - protein, 19 aa, Mycobacterium
LDVAWMIYGHMVFQELTGL

SEQ ID NO: 688867 - protein, 17 aa, Mycobacterium
LDVCKPVSESVTYPMPT

SEQ ID NO: 688868 - protein, 22 aa, Mycobacterium
LDVCKSLGIHLVLPSGAVVFSA

SEQ ID NO: 688869 - protein, 23 aa, Mycobacterium
LDVDAAAISLVFDGANFGTLGSS

SEQ ID NO: 688870 - protein, 21 aa, Mycobacterium
LDVDCCAVVAYGALLKPELLA

SEQ ID NO: 688871 - protein, 26 aa, Mycobacterium
LDVDGGKGWPAQWCHGAPGIGLGRIG

SEQ ID NO: 688872 - protein, 25 aa, Mycobacterium
LDVDRPLWECWIIEGLNDNRWAILL

SEQ ID NO: 688873 - protein, 19 aa, Mycobacterium
LDVDVEFSPFFNALPIRRL

SEQ ID NO: 688874 - protein, 26 aa, Mycobacterium
LDVEAAGEWFARILFSLFSTPSSTLD

SEQ ID NO: 688875 - protein, 18 aa, Mycobacterium
LDVEFSVAAGEVLAILGP

SEQ ID NO: 688876 - protein, 17 aa, Mycobacterium
LDVEGWRGDNFAFTFNI

SEQ ID NO: 688877 - protein, 19 aa, Mycobacterium
LDVEGWRGDNFAFTFNIAD

SEQ ID NO: 688878 - protein, 18 aa, Mycobacterium
LDVEGWRGDNFPFTFNIA

SEQ ID NO: 688879 - protein, 18 aa, Mycobacterium
LDVEVPMRVVFGTSSVAG

SEQ ID NO: 688880 - protein, 23 aa, Mycobacterium
LDVGCGDGLLAQRLAPVSRSVTA

SEQ ID NO: 688881 - protein, 18 aa, Mycobacterium
LDVGCGHGALSIDIAQAG

SEQ ID NO: 688882 - protein, 24 aa, Mycobacterium
LDVGCGTGDCAIYLAQQGWQVTGV

SEQ ID NO: 688883 - protein, 22 aa, Mycobacterium
LDVGCGTGYFTRRIARAVQPGG

SEQ ID NO: 688884 - protein, 19 aa, Mycobacterium
LDVGCGWGGTMRRAIEKYD

SEQ ID NO: 688885 - protein, 26 aa, Mycobacterium
LDVGCGWGSAMARAVERYDVNVIGLT

SEQ ID NO: 688886 - protein, 19 aa, Mycobacterium
LDVGCGWGSTMKRALEHYD

SEQ ID NO: 688887 - protein, 25 aa, Mycobacterium
LDVHLRGAFNVVRPAFPLMCGAGYG

SEQ ID NO: 688888 - protein, 24 aa, Mycobacterium
LDVIADFEAMPGWSSPHQSAEILE

SEQ ID NO: 688889 - protein, 20 aa, Mycobacterium
LDVISRIAAGLKDPAAGRTF

SEQ ID NO: 688890 - protein, 17 aa, Mycobacterium
LDVLAQRDFRRPFDLAK

SEQ ID NO: 688891 - protein, 18 aa, Mycobacterium
LDVLTDWHRAFERLPARV

SEQ ID NO: 688892 - protein, 17 aa, Mycobacterium
LDVLVVRKLGVPFQPEL

SEQ ID NO: 688893 - protein, 20 aa, Mycobacterium
LDVMMPRLDGLEVCRQLRST

SEQ ID NO: 688894 - protein, 21 aa, Mycobacterium
LDVMRMALPVMKGDYQAFNAY

SEQ ID NO: 688895 - protein, 18 aa, Mycobacterium
LDVMRVPGIIVARTDAEA

SEQ ID NO: 688896 - protein, 24 aa, Mycobacterium
LDVPGIRPRPAFTPARPDEFTALL

SEQ ID NO: 688897 - protein, 23 aa, Mycobacterium
LDVPGIVWFRGLLRKLADDGCAV

SEQ ID NO: 688898 - protein, 19 aa, Mycobacterium
LDVPILIGAFNKIMLRTVG

SEQ ID NO: 688899 - protein, 17 aa, Mycobacterium
LDVPKVLEFKREVLRRH

SEQ ID NO: 688900 - protein, 18 aa, Mycobacterium
LDVPLYWQHWKFESSTLS

SEQ ID NO: 688901 - protein, 22 aa, Mycobacterium
LDVPRLRQVWAQMRELPRGSDV

SEQ ID NO: 688902 - protein, 24 aa, Mycobacterium
LDVPRTGRSRVMVPPAQVGVFRSD

SEQ ID NO: 688903 - protein, 22 aa, Mycobacterium
LDVPTFRMLAGLRGEVPLVSIV

SEQ ID NO: 688904 - protein, 22 aa, Mycobacterium
LDVPYPAGHTALLHRIGQHGLL

SEQ ID NO: 688905 - protein, 19 aa, Mycobacterium
LDVPYTRIHEFRHFHPERT

SEQ ID NO: 688906 - protein, 21 aa, Mycobacterium
LDVRATHPLLWSGDALQRSAD

SEQ ID NO: 688907 - protein, 25 aa, Mycobacterium
LDVRAVAEFSRWYAGEVDLSDPPSD

SEQ ID NO: 688908 - protein, 25 aa, Mycobacterium
LDVRRCPRNILTFSHGAHHCLGAAA

SEQ ID NO: 688909 - protein, 24 aa, Mycobacterium
LDVRWRLDAPDGRQAYAQGHVPGA

SEQ ID NO: 688910 - protein, 18 aa, Mycobacterium
LDVRWRLDEPDGHSAYLR

SEQ ID NO: 688911 - protein, 17 aa, Mycobacterium
LDVSDRISVVIAVPAER

SEQ ID NO: 688912 - protein, 23 aa, Mycobacterium
LDVSRLHPLVTMERTFIAPSRFH

SEQ ID NO: 688913 - protein, 19 aa, Mycobacterium
LDVSRWERAGWRVFRLGAR

SEQ ID NO: 688914 - protein, 23 aa, Mycobacterium
LDVSVSFSGLQLVQLGTAQANST

SEQ ID NO: 688915 - protein, 25 aa, Mycobacterium
LDVTGARIGEHWRIGADGLVLEVSA

SEQ ID NO: 688916 - protein, 17 aa, Mycobacterium
LDVTLPWDVDTVEDEMP

SEQ ID NO: 688917 - protein, 26 aa, Mycobacterium
LDVTLRGAVSIARRLQDPLAELVKID

SEQ ID NO: 688918 - protein, 23 aa, Mycobacterium
LDVTPGALYWHFANKQELLGAVA

SEQ ID NO: 688919 - protein, 19 aa, Mycobacterium
LDVVIAYRPLFGICSGIVP

SEQ ID NO: 688920 - protein, 19 aa, Mycobacterium
LDVVVCPGNIPIQSPGPWR

SEQ ID NO: 688921 - protein, 23 aa, Mycobacterium
LDVWSLTELVAFSRGVQGGSIVD

SEQ ID NO: 688922 - protein, 20 aa, Mycobacterium
LDVYQRRAIWVFAKPDFPIP

SEQ ID NO: 688923 - protein, 17 aa, Mycobacterium
LDVYQWLTVLQEYLVLE

SEQ ID NO: 688924 - protein, 21 aa, Mycobacterium
LDWAAAFAGLAAHRVDLPTYA

SEQ ID NO: 688925 - protein, 18 aa, Mycobacterium
LDWASPHQIGRKAIAQNA

SEQ ID NO: 688926 - protein, 24 aa, Mycobacterium
LDWDDELLGFFGVPRSMLPQIRPS

SEQ ID NO: 688927 - protein, 26 aa, Mycobacterium
LDWDDELLSFFAIPRAMLPRIGPSSS

SEQ ID NO: 688928 - protein, 26 aa, Mycobacterium
LDWDDELLSFFGIPRRMLPEIKPSSY

SEQ ID NO: 688929 - protein, 25 aa, Mycobacterium
LDWDDELLSFFSIPRAMLPAIEPSS

SEQ ID NO: 688930 - protein, 25 aa, Mycobacterium
LDWDDELLSFFSIPRQMLPPIKASS

SEQ ID NO: 688931 - protein, 19 aa, Mycobacterium
LDWFCSFSSAAALVGSPGQ

SEQ ID NO: 688932 - protein, 20 aa, Mycobacterium
LDWFCSFSSAAALVGSPGQG

SEQ ID NO: 688933 - protein, 20 aa, Mycobacterium
LDWGEVVRLGVKVAGALEAA

SEQ ID NO: 688934 - protein, 25 aa, Mycobacterium
LDWLLGNGGLDWAVKRTADSSQRLY

SEQ ID NO: 688935 - protein, 19 aa, Mycobacterium
LDWLRGAHRTASWTTSVCS

SEQ ID NO: 688936 - protein, 25 aa, Mycobacterium
LDWSAAFTGLSARRIPLPTYAFVRR

SEQ ID NO: 688937 - protein, 25 aa, Mycobacterium
LDWSDAPFAKWFVGGKINVAYNCVD

SEQ ID NO: 688938 - protein, 32 aa, Mycobacterium
LDWSQAPFAKWFADGKLNVAYNCVDRHVEAGN

SEQ ID NO: 688939 - protein, 19 aa, Mycobacterium
LDWVRGLAVDAGRILRYGL

SEQ ID NO: 688940 - protein, 17 aa, Mycobacterium
LDYADLVADRERLLNLK

SEQ ID NO: 688941 - protein, 26 aa, Mycobacterium
LDYAGGVRAGHRLKFWTPGGSSTPLL

SEQ ID NO: 688942 - protein, 19 aa, Mycobacterium
LDYALRSGESFSSRHRFVD

SEQ ID NO: 688943 - protein, 19 aa, Mycobacterium
LDYALRSGGSFSSRHRFVD

SEQ ID NO: 688944 - protein, 18 aa, Mycobacterium
LDYARPGDTITVVGIDRL

SEQ ID NO: 688945 - protein, 25 aa, Mycobacterium
LDYARRGDVLMVWRLDRLGRSLPHL

SEQ ID NO: 688946 - protein, 20 aa, Mycobacterium
LDYASPVPAILTMKLMGLPL

SEQ ID NO: 688947 - protein, 20 aa, Mycobacterium
LDYASPVPAILTMKLMGLPY

SEQ ID NO: 688948 - protein, 23 aa, Mycobacterium
LDYDCPRAVLDEALKVTPGLESP

SEQ ID NO: 688949 - protein, 23 aa, Mycobacterium
LDYDCPRAVLDKATLITPGLESP

SEQ ID NO: 688950 - protein, 20 aa, Mycobacterium
LDYDCPRAVLDRATAVTPGL

SEQ ID NO: 688951 - protein, 20 aa, Mycobacterium
LDYDCPRAVLHQATTITPGL

SEQ ID NO: 688952 - protein, 20 aa, Mycobacterium
LDYDCPRSVLDRATAITPGL

SEQ ID NO: 688953 - protein, 18 aa, Mycobacterium
LDYDCPRSVVDKATAITP

SEQ ID NO: 688954 - protein, 20 aa, Mycobacterium
LDYDCPRTVLDKATEVTPGL

SEQ ID NO: 688955 - protein, 18 aa, Mycobacterium
LDYDPHLRQVTATADLSR

SEQ ID NO: 688956 - protein, 32 aa, Mycobacterium
LDYFLGLMLRAPFRLARDVIPHMGPGSAIINV

SEQ ID NO: 688957 - protein, 32 aa, Mycobacterium
LDYFLGLMLRAPFRLARDVLPHMGPGSAIINV

SEQ ID NO: 688958 - protein, 20 aa, Mycobacterium
LDYHEWREGLLRGLAAHHAG

SEQ ID NO: 688959 - protein, 18 aa, Mycobacterium
LDYIRFGSDFSRERYDRL

SEQ ID NO: 688960 - protein, 19 aa, Mycobacterium
LDYLARLIAEGVLHAPVEA

SEQ ID NO: 688961 - protein, 20 aa, Mycobacterium
LDYLIAFFGALYAGRIAVPL

SEQ ID NO: 688962 - protein, 17 aa, Mycobacterium
LDYLPIPHLHPGDGGPY

SEQ ID NO: 688963 - protein, 32 aa, Mycobacterium
LDYPALAALCDIFYPRVYLRRGAIVPAGTISL

SEQ ID NO: 688964 - protein, 18 aa, Mycobacterium
LDYPDLAGRLVLMGPGGL

SEQ ID NO: 688965 - protein, 19 aa, Mycobacterium
LDYPLPWADQPGRSHLVTA

SEQ ID NO: 688966 - protein, 17 aa, Mycobacterium
LDYRGKRVLIIGSGATA

SEQ ID NO: 688967 - protein, 23 aa, Mycobacterium
LDYRLIKEVWAYGDDRIAVRFAY

SEQ ID NO: 688968 - protein, 19 aa, Mycobacterium
LDYRLRRVAELTGLDPAQP

SEQ ID NO: 688969 - protein, 18 aa, Mycobacterium
LDYRSRRPLMTFKTDHFT

SEQ ID NO: 688970 - protein, 18 aa, Mycobacterium
LDYRSRRPVMTFKSDHFT

SEQ ID NO: 688971 - protein, 18 aa, Mycobacterium
LDYSISFDTPAWVPGRLL

SEQ ID NO: 688972 - protein, 34 aa, Mycobacterium
LDYSPCLECKLCVAVCPVGAIGKNGEFDFRACSV

SEQ ID NO: 688973 - protein, 19 aa, Mycobacterium
LDYVIPYVKQREAFGEPIA

SEQ ID NO: 688974 - protein, 23 aa, Mycobacterium
LDYWTDRVHRLLRACVRDRALVP

SEQ ID NO: 688975 - protein, 19 aa, Mycobacterium
LEAAAAWDGIGTELSAAAS

SEQ ID NO: 688976 - protein, 19 aa, Mycobacterium
LEAAAAWDGIGTELSSAAN

SEQ ID NO: 688977 - protein, 18 aa, Mycobacterium
LEAAAGIAGVIKVVLSLE

SEQ ID NO: 688978 - protein, 21 aa, Mycobacterium
LEAAAGIAGVIKVVMALENET

SEQ ID NO: 688979 - protein, 19 aa, Mycobacterium
LEAAAGVAGFMKAVLAVNN

SEQ ID NO: 688980 - protein, 29 aa, Mycobacterium
LEAAAVRGTEVFWAVAFHGPEQLTLIVTR

SEQ ID NO: 688981 - protein, 30 aa, Mycobacterium
LEAAELYARILAGAGVEWGLLGPREVDRVW

SEQ ID NO: 688982 - protein, 25 aa, Mycobacterium
LEAAFSVGRVDEFAAWVDALEDAGT

SEQ ID NO: 688983 - protein, 18 aa, Mycobacterium
LEAAKPFIKALCAAQQEL

SEQ ID NO: 688984 - protein, 17 aa, Mycobacterium
LEAALRCRPEHRMAGML

SEQ ID NO: 688985 - protein, 23 aa, Mycobacterium
LEAANLRGQWIYDEMLESVVGGP

SEQ ID NO: 688986 - protein, 18 aa, Mycobacterium
LEAARQFATRSTRVVSAG

SEQ ID NO: 688987 - protein, 20 aa, Mycobacterium
LEAAYRYALSHGLADMSLRP

SEQ ID NO: 688988 - protein, 17 aa, Mycobacterium
LEACPGCFKHYGLEERI

SEQ ID NO: 688989 - protein, 20 aa, Mycobacterium
LEADIVFLAMGFVGPEKPGL

SEQ ID NO: 688990 - protein, 19 aa, Mycobacterium
LEADLVLLAMGFVGPEKPG

SEQ ID NO: 688991 - protein, 19 aa, Mycobacterium
LEADLVLLAMGFVGPEREG

SEQ ID NO: 688992 - protein, 25 aa, Mycobacterium
LEADSFSGWFLTVLGAARVAFAQFT

SEQ ID NO: 688993 - protein, 17 aa, Mycobacterium
LEAEAILSPAGRPSWQA

SEQ ID NO: 688994 - protein, 25 aa, Mycobacterium
LEAELRCGTVSPVDPARMTPRDVED

SEQ ID NO: 688995 - protein, 21 aa, Mycobacterium
LEAFANFGFPESHALSFASLV

SEQ ID NO: 688996 - protein, 18 aa, Mycobacterium
LEAFKESADVLILSNHIE

SEQ ID NO: 688997 - protein, 17 aa, Mycobacterium
LEAFLRIMVFDQKLITP

SEQ ID NO: 688998 - protein, 17 aa, Mycobacterium
LEAFLTRRIRSHGLVTA

SEQ ID NO: 688999 - protein, 22 aa, Mycobacterium
LEAFQSGLSWLTILRKRENFRR

SEQ ID NO: 689000 - protein, 19 aa, Mycobacterium
LEAGFPQGAYVDIRATNEQ

SEQ ID NO: 689001 - protein, 20 aa, Mycobacterium
LEAGMVLAVTAYVWEEGVGA

SEQ ID NO: 689002 - protein, 22 aa, Mycobacterium
LEAGMVLAVTGYVWERGVGAVF

SEQ ID NO: 689003 - protein, 40 aa, Mycobacterium
LEAGNVGEAYRWFNHSMLYAFQGAFGPLIAPGFILSGIPR

SEQ ID NO: 689004 - protein, 25 aa, Mycobacterium
LEAGPAGAFRPLWAHNRTDERQALA

SEQ ID NO: 689005 - protein, 18 aa, Mycobacterium
LEAGVGLGSMPIYRFGTE

SEQ ID NO: 689006 - protein, 31 aa, Mycobacterium
LEAGYRRFLERRLRETFGFEGSPIRINVRVR

SEQ ID NO: 689007 - protein, 21 aa, Mycobacterium
LEAHPAVLLFSHRSYLDGVIV

SEQ ID NO: 689008 - protein, 22 aa, Mycobacterium
LEAIAAKIRRQHADVFGAVPAS

SEQ ID NO: 689009 - protein, 21 aa, Mycobacterium
LEAINGWATLQPENWWAPQPP

SEQ ID NO: 689010 - protein, 21 aa, Mycobacterium
LEAIPRISRAQVMDALSSQAN

SEQ ID NO: 689011 - protein, 27 aa, Mycobacterium
LEAKPVLWRLIATITRQWIDTTRELIE

SEQ ID NO: 689012 - protein, 19 aa, Mycobacterium
LEALAPLLGTWTGQGAGEY

SEQ ID NO: 689013 - protein, 22 aa, Mycobacterium
LEALDGWPVNVALLGKGNTVSA

SEQ ID NO: 689014 - protein, 22 aa, Mycobacterium
LEALDSWPVNIALLGKGNTVNP

SEQ ID NO: 689015 - protein, 23 aa, Mycobacterium
LEALEAITINAAYQYREEQSKGS

SEQ ID NO: 689016 - protein, 17 aa, Mycobacterium
LEALGASGYVTYNEARD

SEQ ID NO: 689017 - protein, 19 aa, Mycobacterium
LEALGDRVALYGFRSNSRH

SEQ ID NO: 689018 - protein, 17 aa, Mycobacterium
LEALGVLRRVVGGAIAL

SEQ ID NO: 689019 - protein, 23 aa, Mycobacterium
LEALGVPVPRYAEIRSVDELDEF

SEQ ID NO: 689020 - protein, 20 aa, Mycobacterium
LEALKIAAIVAGVAQALATV

SEQ ID NO: 689021 - protein, 17 aa, Mycobacterium
LEALLAYEEAGRARAPF

SEQ ID NO: 689022 - protein, 17 aa, Mycobacterium
LEALLAYEESTKARAPY

SEQ ID NO: 689023 - protein, 18 aa, Mycobacterium
LEALMAWITDSHGAGQPV

SEQ ID NO: 689024 - protein, 20 aa, Mycobacterium
LEALPRDEIARCAAEHPQYR

SEQ ID NO: 689025 - protein, 19 aa, Mycobacterium
LEALQWRGDNIAKLPTPTS

SEQ ID NO: 689026 - protein, 22 aa, Mycobacterium
LEALRIPAAVAARFLGKAATFA

SEQ ID NO: 689027 - protein, 21 aa, Mycobacterium
LEALRIPMQYLAELFTAGDTA

SEQ ID NO: 689028 - protein, 20 aa, Mycobacterium
LEALRVELRLAAERVGALAV

SEQ ID NO: 689029 - protein, 24 aa, Mycobacterium
LEALTMLGAIGFTWEHDLHLYWRR

SEQ ID NO: 689030 - protein, 18 aa, Mycobacterium
LEAMACGVPVVATAVGGI

SEQ ID NO: 689031 - protein, 35 aa, Mycobacterium; identical to SEQ ID NO: 202173

SEQ ID NO: 689032 - protein, 30 aa, Mycobacterium
LEANPRITALMCTADILALSAMDYLRGHGI

SEQ ID NO: 689033 - protein, 31 aa, Mycobacterium
LEAPSRDDALLAFPAMQAMPTPYVEASDISN

SEQ ID NO: 689034 - protein, 21 aa, Mycobacterium
LEAPTAWLFGPEAHGLSAEVA

SEQ ID NO: 689035 - protein, 17 aa, Mycobacterium
LEAPVGLAKSAPPPGWP

SEQ ID NO: 689036 - protein, 19 aa, Mycobacterium
LEAQFRPGSSPAYHIEHLE

SEQ ID NO: 689037 - protein, 18 aa, Mycobacterium
LEAQWKYNFRDGADAQVS

SEQ ID NO: 689038 - protein, 24 aa, Mycobacterium
LEARAKRLVACWGNNDGPELRRRL

SEQ ID NO: 689039 - protein, 25 aa, Mycobacterium
LEARANRLAHRFREAGLREGDVVAI

SEQ ID NO: 689040 - protein, 23 aa, Mycobacterium
LEARDVEFDWARLPFHYVPNEPL

SEQ ID NO: 689041 - protein, 23 aa, Mycobacterium
LEARGKTAMLAKVRRAPALIKVE

SEQ ID NO: 689042 - protein, 23 aa, Mycobacterium
LEARGKTAMLAKVRRAPELIKVE

SEQ ID NO: 689043 - protein, 21 aa, Mycobacterium
LEARGSGQWATFSELVADCGA

SEQ ID NO: 689044 - protein, 21 aa, Mycobacterium
LEARIDSLAARNAKLMDTLKE

SEQ ID NO: 689045 - protein, 17 aa, Mycobacterium
LEARIDSLASRNSKLME

SEQ ID NO: 689046 - protein, 17 aa, Mycobacterium
LEARIVLAMLLERTTWI

SEQ ID NO: 689047 - protein, 21 aa, Mycobacterium
LEARPFFNLSSGYVTRGDAHM

SEQ ID NO: 689048 - protein, 24 aa, Mycobacterium
LEARPSGETLSMFAYYVDPAGVRI

SEQ ID NO: 689049 - protein, 24 aa, Mycobacterium
LEARRARCAVIAGMNALFDSGPDL

SEQ ID NO: 689050 - protein, 27 aa, Mycobacterium
LEARTELMSSLGIPADIAAAIAEHQND

SEQ ID NO: 689051 - protein, 18 aa, Mycobacterium
LEARVCGYEITPARRPGL

SEQ ID NO: 689052 - protein, 17 aa, Mycobacterium
LEASALAQARRAFAENP

SEQ ID NO: 689053 - protein, 23 aa, Mycobacterium
LEASKRISALVADAKQYSQLDRA

SEQ ID NO: 689054 - protein, 23 aa, Mycobacterium
LEASKRISALVADAKQYSQMDRA

SEQ ID NO: 689055 - protein, 25 aa, Mycobacterium
LEASLKFYTALGFTEVKRLTVPDQM

SEQ ID NO: 689056 - protein, 19 aa, Mycobacterium
LEASMSYYLIQQIEANPKI

SEQ ID NO: 689057 - protein, 21 aa, Mycobacterium
LEATIDCLVEFGYSGTTTSRI

SEQ ID NO: 689058 - protein, 20 aa, Mycobacterium
LEATVALPALAARFPEARLS

SEQ ID NO: 689059 - protein, 26 aa, Mycobacterium
LEAVAARLPALIFVCTEAAGVDPEAL

SEQ ID NO: 689060 - protein, 22 aa, Mycobacterium
LEAVAVCRRAGIPVIADGGLQY

SEQ ID NO: 689061 - protein, 20 aa, Mycobacterium
LEAVCDLYALSVIEDDKAWY

SEQ ID NO: 689062 - protein, 22 aa, Mycobacterium
LEAVGARVALLIAQGVGDPDHD

SEQ ID NO: 689063 - protein, 17 aa, Mycobacterium
LEAVIMDRVWNRGEVVT

SEQ ID NO: 689064 - protein, 24 aa, Mycobacterium
LEAVPYLRRVHVWPDCDRAWATPW

SEQ ID NO: 689065 - protein, 17 aa, Mycobacterium
LEAVRPGARLILVGDAD

SEQ ID NO: 689066 - protein, 26 aa, Mycobacterium
LEAVSGWAAKQPTVWWNEGTDTPAPH

SEQ ID NO: 689067 - protein, 17 aa, Mycobacterium
LEAVVMDRVWSRGDETA

SEQ ID NO: 689068 - protein, 21 aa, Mycobacterium
LEAVVMDWVWYHQEPVTVRDV

SEQ ID NO: 689069 - protein, 18 aa, Mycobacterium
LEAWPDGDVAGLRAAASR

SEQ ID NO: 689070 - protein, 18 aa, Mycobacterium
LEAWRRELADCIAEAQLE

SEQ ID NO: 689071 - protein, 17 aa, Mycobacterium
LEAWTKNHWDWFDPFYA

SEQ ID NO: 689072 - protein, 23 aa, Mycobacterium
LEAYCAIPSMGAVLHTLNIRLAP

SEQ ID NO: 689073 - protein, 23 aa, Mycobacterium
LEAYCPVKWQPVVPGVEVPLDDG

SEQ ID NO: 689074 - protein, 19 aa, Mycobacterium
LEAYGREGEPCRRCGRAMR

SEQ ID NO: 689075 - protein, 22 aa, Mycobacterium
LEAYNALPLRRAVHAVFECCCC

SEQ ID NO: 689076 - protein, 17 aa, Mycobacterium
LEAYRVSATVSFDPNVR

SEQ ID NO: 689077 - protein, 26 aa, Mycobacterium
LECAAGPRLPLAMARNLGADAALDAA

SEQ ID NO: 689078 - protein, 19 aa, Mycobacterium
LECDLRAPQDWAVVENIYH

SEQ ID NO: 689079 - protein, 24 aa, Mycobacterium
LECEPYRRLAFTFHTFTKDLTTVG

SEQ ID NO: 689080 - protein, 22 aa, Mycobacterium
LECGDVTFARCGDVAAAVRRDP

SEQ ID NO: 689081 - protein, 23 aa, Mycobacterium
LECIPRATTDLVYIRMHGPDPEA

SEQ ID NO: 689082 - protein, 18 aa, Mycobacterium
LECPQGHPVGRILKEAAH

SEQ ID NO: 689083 - protein, 26 aa, Mycobacterium
LEDAEFGLACAIGIAPCMHAGQGCAN

SEQ ID NO: 689084 - protein, 24 aa, Mycobacterium
LEDAGFCAKGKGMSWINEHDLTHR

SEQ ID NO: 689085 - protein, 25 aa, Mycobacterium
LEDAGFCDKGRGMSWIAGHDLTHRG

SEQ ID NO: 689086 - protein, 19 aa, Mycobacterium
LEDAHFGRAFSSGMAATDC

SEQ ID NO: 689087 - protein, 25 aa, Mycobacterium
LEDAMRFYFEFHFDTGDGYLAHLHD

SEQ ID NO: 689088 - protein, 22 aa, Mycobacterium
LEDCGYYVRWLFDNTDRSNGMD

SEQ ID NO: 689089 - protein, 22 aa, Mycobacterium
LEDCLGLACDRGVRIVANAGGL

SEQ ID NO: 689090 - protein, 17 aa, Mycobacterium
LEDCYAALTWLAGLPSV

SEQ ID NO: 689091 - protein, 17 aa, Mycobacterium
LEDCYSALTWLAGLPSV

SEQ ID NO: 689092 - protein, 17 aa, Mycobacterium
LEDDARVDFGWLRAQRR

SEQ ID NO: 689093 - protein, 17 aa, Mycobacterium
LEDFDVFHPDRMSSRIL

SEQ ID NO: 689094 - protein, 23 aa, Mycobacterium
LEDGRPAVYVIPSDVSVVREAAI

SEQ ID NO: 689095 - protein, 24 aa, Mycobacterium
LEDGRVFAGTAFGKVGQTLGEAVF

SEQ ID NO: 689096 - protein, 24 aa, Mycobacterium
LEDGTTWRVEIERAHMEEDTGKLT

SEQ ID NO: 689097 - protein, 24 aa, Mycobacterium
LEDGTTWRVHIERAHMEEDTGKLT

SEQ ID NO: 689098 - protein, 18 aa, Mycobacterium
LEDHNIPMAWEYAPTFVE

SEQ ID NO: 689099 - protein, 19 aa, Mycobacterium
LEDILARRMRIAIEYPHRG

SEQ ID NO: 689100 - protein, 20 aa, Mycobacterium
LEDKWGRWMGRWTAEEHLHA

SEQ ID NO: 689101 - protein, 19 aa, Mycobacterium
LEDLDVLDWPDKVKTMQRN

SEQ ID NO: 689102 - protein, 19 aa, Mycobacterium
LEDLDVLDWPEKVKTMQRN

SEQ ID NO: 689103 - protein, 23 aa, Mycobacterium
LEDLFVRPAFRRRGIARKLLATL

SEQ ID NO: 689104 - protein, 17 aa, Mycobacterium
LEDLGWYVADNLPPELI

SEQ ID NO: 689105 - protein, 23 aa, Mycobacterium
LEDLLAESWVRIVLHPDRVARYR

SEQ ID NO: 689106 - protein, 26 aa, Mycobacterium
LEDLLSFPAVKLLVRKAGARSSEMAE

SEQ ID NO: 689107 - protein, 19 aa, Mycobacterium
LEDLRGAVRVRVIDDIIMM

SEQ ID NO: 689108 - protein, 28 aa, Mycobacterium
LEDLVFAWRACRAVKSNAIVVARDGATV

SEQ ID NO: 689109 - protein, 24 aa, Mycobacterium
LEDPEFGAGFSRLYNQWIADYCAP

SEQ ID NO: 689110 - protein, 26 aa, Mycobacterium
LEDPERAIAALIARYPDAETVQLHPA

SEQ ID NO: 689111 - protein, 22 aa, Mycobacterium
LEDRFPAMRAYSAEQHQRTVED

SEQ ID NO: 689112 - protein, 21 aa, Mycobacterium
LEDRIKDLINRGGEKINAEEI

SEQ ID NO: 689113 - protein, 24 aa, Mycobacterium
LEDSNMLIFAWGATVPMIAHAAGI

SEQ ID NO: 689114 - protein, 18 aa, Mycobacterium
LEDVIAYCDQFPLDELPE

SEQ ID NO: 689115 - protein, 25 aa, Mycobacterium
LEDVVPCTGCGRNLVVYYHVSRRQG

SEQ ID NO: 689116 - protein, 17 aa, Mycobacterium
LEEAGIEAGTWRVLVDA

SEQ ID NO: 689117 - protein, 25 aa, Mycobacterium
LEEAGISWRLLPPIPAHGPVDPAAL

SEQ ID NO: 689118 - protein, 18 aa, Mycobacterium
LEEAHDLLVRALESVEKG

SEQ ID NO: 689119 - protein, 23 aa, Mycobacterium
LEEALQVIRLCLSTRGPITFSGK

SEQ ID NO: 689120 - protein, 18 aa, Mycobacterium
LEEAMALVGRASSYGEAH

SEQ ID NO: 689121 - protein, 21 aa, Mycobacterium
LEEASRLVAHAANPARARRRA

SEQ ID NO: 689122 - protein, 25 aa, Mycobacterium
LEEAWRASQVEMITWLGELYGLDKY

SEQ ID NO: 689123 - protein, 17 aa, Mycobacterium
LEEAYWFAEGVLPLLKK

SEQ ID NO: 689124 - protein, 17 aa, Mycobacterium
LEECPACLRHYGVEEKI

SEQ ID NO: 689125 - protein, 18 aa, Mycobacterium
LEECPGCLQHYGIEEQIK

SEQ ID NO: 689126 - protein, 20 aa, Mycobacterium
LEEDLRYGPDVTTLATVPAG

SEQ ID NO: 689127 - protein, 23 aa, Mycobacterium
LEEFDDYLALQCGRSAHTRRAYL

SEQ ID NO: 689128 - protein, 23 aa, Mycobacterium
LEEFDEYLALQCGRSAHTRRAYL

SEQ ID NO: 689129 - protein, 18 aa, Mycobacterium
LEEFNWDRLNPLLNVENQ

SEQ ID NO: 689130 - protein, 18 aa, Mycobacterium
LEEGGLVAGYRPELDLAR

SEQ ID NO: 689131 - protein, 22 aa, Mycobacterium
LEEGLGRPVRRIPMSPKALLAV

SEQ ID NO: 689132 - protein, 18 aa, Mycobacterium
LEEGTCICGASLAEGTEG

SEQ ID NO: 689133 - protein, 18 aa, Mycobacterium
LEEGVLAYDLFKNKKDDC

SEQ ID NO: 689134 - protein, 19 aa, Mycobacterium
LEEICAVSPRYVVTAQVST

SEQ ID NO: 689135 - protein, 24 aa, Mycobacterium
LEEILKRFPEWDVDLASAELSPTS

SEQ ID NO: 689136 - protein, 24 aa, Mycobacterium
LEEILKRFPEWDVDLGNAKLSPTS

SEQ ID NO: 689137 - protein, 24 aa, Mycobacterium
LEEILKRFPEWDVDLSQAKLSPTS

SEQ ID NO: 689138 - protein, 24 aa, Mycobacterium
LEEILKRFPEWEVDLSKATLSPTS

SEQ ID NO: 689139 - protein, 24 aa, Mycobacterium
LEEILKRFPEWEVDWDNARPSETA

SEQ ID NO: 689140 - protein, 19 aa, Mycobacterium
LEEILKRWPDWTFDEDNAH

SEQ ID NO: 689141 - protein, 24 aa, Mycobacterium
LEEILKRWPDWTIDLGNAVRSPTA

SEQ ID NO: 689142 - protein, 23 aa, Mycobacterium
LEEILKRWPDWTVDMGNAVRAPT

SEQ ID NO: 689143 - protein, 27 aa, Mycobacterium
LEEIPGAMGRLGVWSGQGPQLDLHQPT

SEQ ID NO: 689144 - protein, 20 aa, Mycobacterium
LEEIRRLWVVEKHEFEDNLP

SEQ ID NO: 689145 - protein, 25 aa, Mycobacterium
LEEKLCCAAVFVTRARRAIASATYV

SEQ ID NO: 689146 - protein, 17 aa, Mycobacterium
LEEKMGWHAQPTAQVIL

SEQ ID NO: 689147 - protein, 19 aa, Mycobacterium
LEEKPEWLIAERESYQNVL

SEQ ID NO: 689148 - protein, 18 aa, Mycobacterium
LEELEWCLERGAKTVLVR

SEQ ID NO: 689149 - protein, 22 aa, Mycobacterium
LEELKALWFSEAAKYNGLPLGD

SEQ ID NO: 689150 - protein, 23 aa, Mycobacterium
LEELKALWFSEAAKYNGLPLSDL

SEQ ID NO: 689151 - protein, 17 aa, Mycobacterium
LEELLKERLEIIKTRRR

SEQ ID NO: 689152 - protein, 18 aa, Mycobacterium
LEELPGWSWGRGEDSWER

SEQ ID NO: 689153 - protein, 23 aa, Mycobacterium
LEELPLVCDRVITVQGGRVTAEF

SEQ ID NO: 689154 - protein, 24 aa, Mycobacterium
LEELSCQLPAVGHRLLARLQAEGT

SEQ ID NO: 689155 - protein, 24 aa, Mycobacterium
LEELSCQLPAVGHRLLARLQVEAT

SEQ ID NO: 689156 - protein, 24 aa, Mycobacterium
LEELSCQLPAVGHRLLARLQVETS

SEQ ID NO: 689157 - protein, 23 aa, Mycobacterium
LEEMPDAAIPLVFRLLGETGSHA

SEQ ID NO: 689158 - protein, 18 aa, Mycobacterium
LEEQLEILTGLWTTPTGD

SEQ ID NO: 689159 - protein, 21 aa, Mycobacterium
LEEQWGRFLGRWTAEEHLHAV

SEQ ID NO: 689160 - protein, 24 aa, Mycobacterium
LEERAACIPERMLGSTGAAAEDLA

SEQ ID NO: 689161 - protein, 18 aa, Mycobacterium
LEERAAWLYSKAAQHVSE

SEQ ID NO: 689162 - protein, 18 aa, Mycobacterium
LEERAELDALKGDGGSSW

SEQ ID NO: 689163 - protein, 18 aa, Mycobacterium
LEERAELDALKGEGGSSW

SEQ ID NO: 689164 - protein, 27 aa, Mycobacterium
LEERIAAIWRRFFGYDRIGVNDRFLEL

SEQ ID NO: 689165 - protein, 17 aa, Mycobacterium
LEERRDAMFAGEHINTS

SEQ ID NO: 689166 - protein, 22 aa, Mycobacterium
LEERYVREWLAGMTVAHVVDYE

SEQ ID NO: 689167 - protein, 25 aa, Mycobacterium
LEESFAERGVRLFKNARAQSVTRTE

SEQ ID NO: 689168 - protein, 17 aa, Mycobacterium
LEETEIPAGGIDDALVI

SEQ ID NO: 689169 - protein, 25 aa, Mycobacterium
LEETGRPWVEVHFANISAPPWSERG

SEQ ID NO: 689170 - protein, 18 aa, Mycobacterium
LEEVEAWYFSLDDEAMAA

SEQ ID NO: 689171 - protein, 17 aa, Mycobacterium
LEEVIAAAAGLRPRPEI

SEQ ID NO: 689172 - protein, 17 aa, Mycobacterium
LEFAERVGGEIVNADAM

SEQ ID NO: 689173 - protein, 23 aa, Mycobacterium
LEFAQMYRRFGARVTVVERGPRL

SEQ ID NO: 689174 - protein, 17 aa, Mycobacterium
LEFARAAERLGFSEISV

SEQ ID NO: 689175 - protein, 21 aa, Mycobacterium
LEFAVRLGVDLVALSFVRSPA

SEQ ID NO: 689176 - protein, 26 aa, Mycobacterium
LEFDALRRAGGCWVLTNHPFLSGRAS

SEQ ID NO: 689177 - protein, 28 aa, Mycobacterium
LEFEQTFMFYLPRICEHCLNPSCVASCP

SEQ ID NO: 689178 - protein, 19 aa, Mycobacterium
LEFEYRRLRLPAPDWQVLL

SEQ ID NO: 689179 - protein, 24 aa, Mycobacterium
LEFIQFHPTMLFDGSSGGRRPLIT

SEQ ID NO: 689180 - protein, 23 aa, Mycobacterium
LEFIYCPWHQWGFELATGTTAVK

SEQ ID NO: 689181 - protein, 24 aa, Mycobacterium
LEFIYCPWHQWGFELATGTTAVKP

SEQ ID NO: 689182 - protein, 18 aa, Mycobacterium
LEFIYRVSTEAKTFGQSW

SEQ ID NO: 689183 - protein, 20 aa, Mycobacterium
LEFLAGRGWIIVRVSALHLR

SEQ ID NO: 689184 - protein, 21 aa, Mycobacterium
LEFLGEAAVTVPELGTFVAER

SEQ ID NO: 689185 - protein, 20 aa, Mycobacterium
LEFLGFKAARIADVGVAGIW

SEQ ID NO: 689186 - protein, 18 aa, Mycobacterium
LEFLPARRVDTIRTGDEW

SEQ ID NO: 689187 - protein, 19 aa, Mycobacterium
LEFLYGAFADYVRDRRREP

SEQ ID NO: 689188 - protein, 21 aa, Mycobacterium
LEFNARVLALAADDSMPLLER

SEQ ID NO: 689189 - protein, 25 aa, Mycobacterium
LEFNLLMLVAPVLRKLAYADAAAGT

SEQ ID NO: 689190 - protein, 18 aa, Mycobacterium
LEFQVGLERVLTRMPDFT

SEQ ID NO: 689191 - protein, 24 aa, Mycobacterium
LEFRRRVQAELDFELPVQDLLGGA

SEQ ID NO: 689192 - protein, 23 aa, Mycobacterium
LEFRVLRDRLFDTLAAVEPEVDE

SEQ ID NO: 689193 - protein, 23 aa, Mycobacterium
LEFRVLRDRLFDTLAAVEPEVDQ

SEQ ID NO: 689194 - protein, 22 aa, Mycobacterium
LEFRVLRDRLFDTLASADPEVE

SEQ ID NO: 689195 - protein, 20 aa, Mycobacterium
LEFRVLRDRLFETLAAVEPE

SEQ ID NO: 689196 - protein, 30 aa, Mycobacterium
LEFTEGVGFDKGFLSAYFVTDFDAQEAVLD

SEQ ID NO: 689197 - protein, 29 aa, Mycobacterium
LEFTEGVGFDKGFLSAYFVTDFDSQEAVL

SEQ ID NO: 689198 - protein, 30 aa, Mycobacterium
LEFTEGVGFDKGYLSAYFVTDFDAQQAVLE

SEQ ID NO: 689199 - protein, 21 aa, Mycobacterium
LEFTSRAAVVEYMRTSLTTDI

SEQ ID NO: 689200 - protein, 17 aa, Mycobacterium
LEFVPASDVDPMLFDRS

SEQ ID NO: 689201 - protein, 23 aa, Mycobacterium
LEGAAALLHRLEVDLQVRAEMLV

SEQ ID NO: 689202 - protein, 22 aa, Mycobacterium
LEGAAPRGDFCINILAAYDAFD

SEQ ID NO: 689203 - protein, 18 aa, Mycobacterium
LEGAARFSAGTGRHGAKT

SEQ ID NO: 689204 - protein, 18 aa, Mycobacterium
LEGASATELLQWTDETFG

SEQ ID NO: 689205 - protein, 19 aa, Mycobacterium
LEGASATEVLRWTDETFGG

SEQ ID NO: 689206 - protein, 19 aa, Mycobacterium
LEGAWGEAGTRSYGSDRSS

SEQ ID NO: 689207 - protein, 19 aa, Mycobacterium
LEGEQAFYAALEFWSALHG

SEQ ID NO: 689208 - protein, 19 aa, Mycobacterium
LEGETAKLLRMEEELGKRV

SEQ ID NO: 689209 - protein, 24 aa, Mycobacterium
LEGFMRDVPCPECDGTRLKPEILA

SEQ ID NO: 689210 - protein, 18 aa, Mycobacterium
LEGFRPGVMERMGLGPED

SEQ ID NO: 689211 - protein, 18 aa, Mycobacterium
LEGGDSWPSRPGRVDKVV

SEQ ID NO: 689212 - protein, 17 aa, Mycobacterium
LEGGEILLTTGIETRTW

SEQ ID NO: 689213 - protein, 19 aa, Mycobacterium
LEGGEWVINGSKQFITNSG

SEQ ID NO: 689214 - protein, 17 aa, Mycobacterium
LEGGGRLVVELTPDEAA

SEQ ID NO: 689215 - protein, 17 aa, Mycobacterium
LEGGGRLVVELTPEEAA

SEQ ID NO: 689216 - protein, 24 aa, Mycobacterium
LEGGPRPTHFAGVLTVVCKLLQIV

SEQ ID NO: 689217 - protein, 17 aa, Mycobacterium
LEGHFTLVFSHADDPGT

SEQ ID NO: 689218 - protein, 20 aa, Mycobacterium
LEGKTLPGIEVLGEPQPGGG

SEQ ID NO: 689219 - protein, 20 aa, Mycobacterium
LEGKTLPGIEVLGRPQPGQT

SEQ ID NO: 689220 - protein, 18 aa, Mycobacterium
LEGLAARLTTDRLTDADL

SEQ ID NO: 689221 - protein, 17 aa, Mycobacterium
LEGLEAIPSVLPAAPAG

SEQ ID NO: 689222 - protein, 17 aa, Mycobacterium
LEGLFARLAAGSTPDSN

SEQ ID NO: 689223 - protein, 20 aa, Mycobacterium
LEGLGFLYSYLQRVFVFTRT

SEQ ID NO: 689224 - protein, 17 aa, Mycobacterium
LEGLGKRTVLPGHGPEL

SEQ ID NO: 689225 - protein, 20 aa, Mycobacterium
LEGLGKWAVPGPVVESVAVA

SEQ ID NO: 689226 - protein, 17 aa, Mycobacterium
LEGLPVVILYTIGAKSG

SEQ ID NO: 689227 - protein, 17 aa, Mycobacterium
LEGLRILDLGIIVAGGE

SEQ ID NO: 689228 - protein, 17 aa, Mycobacterium
LEGLRVLDLGVIVVGAD

SEQ ID NO: 689229 - protein, 18 aa, Mycobacterium
LEGLSHSMAPKAAAQAVA

SEQ ID NO: 689230 - protein, 17 aa, Mycobacterium
LEGLSRWAKATKDGGGL

SEQ ID NO: 689231 - protein, 22 aa, Mycobacterium
LEGNVWRLDFAWPEDRVAAEYD

SEQ ID NO: 689232 - protein, 28 aa, Mycobacterium
LEGPRFCGHPDLRYALVPSTSPVSRDFR

SEQ ID NO: 689233 - protein, 17 aa, Mycobacterium
LEGPRGVAVIFEKNSTR

SEQ ID NO: 689234 - protein, 19 aa, Mycobacterium
LEGPRGVAVIFEKNSTRTR

SEQ ID NO: 689235 - protein, 20 aa, Mycobacterium
LEGPSTIAAIVLESIPGTAG

SEQ ID NO: 689236 - protein, 26 aa, Mycobacterium
LEGPSYTRPASWRGLDVPDVLLSGDH

SEQ ID NO: 689237 - protein, 26 aa, Mycobacterium
LEGPSYTRPPSWRGLDVPEILLSGDH

SEQ ID NO: 689238 - protein, 18 aa, Mycobacterium
LEGQVVALARTHLDRALA

SEQ ID NO: 689239 - protein, 24 aa, Mycobacterium
LEGRETFGGISIHSAEWDPGLDLT

SEQ ID NO: 689240 - protein, 17 aa, Mycobacterium
LEGRIALEEILKRFPEW

SEQ ID NO: 689241 - protein, 18 aa, Mycobacterium
LEGRIALEEILKRFPEWD

SEQ ID NO: 689242 - protein, 18 aa, Mycobacterium
LEGRIALEEILKRWPDWT

SEQ ID NO: 689243 - protein, 21 aa, Mycobacterium
LEGRITVAYRFTRPGQDVTLF

SEQ ID NO: 689244 - protein, 20 aa, Mycobacterium
LEGRLLAGLLAPYGDEPMPT

SEQ ID NO: 689245 - protein, 21 aa, Mycobacterium
LEGRLLAGLLAPYGDEPTPTQ

SEQ ID NO: 689246 - protein, 21 aa, Mycobacterium
LEGRVVLVTGGVRGVGAGISQ

SEQ ID NO: 689247 - protein, 17 aa, Mycobacterium
LEGSYRLAPKGSGTEVT

SEQ ID NO: 689248 - protein, 20 aa, Mycobacterium
LEGTLEFGDLVLHPDSYTAS

SEQ ID NO: 689249 - protein, 17 aa, Mycobacterium
LEGTYRLAPKGSGTEVT

SEQ ID NO: 689250 - protein, 27 aa, Mycobacterium
LEGVPLAELFRRSGLDAPAPDDDDTLF

SEQ ID NO: 689251 - protein, 22 aa, Mycobacterium
LEGVRLGKGLGFYDRSLANRNP

SEQ ID NO: 689252 - protein, 25 aa, Mycobacterium
LEGVRWAERSDIWVGPGALTPDGRP

SEQ ID NO: 689253 - protein, 27 aa, Mycobacterium
LEGVVRSRGRLWLAHLPDMAVGLDSAG

SEQ ID NO: 689254 - protein, 17 aa, Mycobacterium
LEGWRGIPVHRVPSVSV

SEQ ID NO: 689255 - protein, 17 aa, Mycobacterium
LEGYLLTGRHGLFNCYE

SEQ ID NO: 689256 - protein, 17 aa, Mycobacterium
LEGYLLTGRHGLFSCYE

SEQ ID NO: 689257 - protein, 21 aa, Mycobacterium
LEGYRDSWRYSASLLTNVVTG

SEQ ID NO: 689258 - protein, 33 aa, Mycobacterium
LEHAAALAWPGTEQQWLGGWFARAGLGATSRAN

SEQ ID NO: 689259 - protein, 19 aa, Mycobacterium
LEHAARVPVSLLKEVLVTG

SEQ ID NO: 689260 - protein, 20 aa, Mycobacterium
LEHACALQAVVGPTVNSYKR

SEQ ID NO: 689261 - protein, 25 aa, Mycobacterium
LEHARSAAYHAVWALADGSDDPALA

SEQ ID NO: 689262 - protein, 17 aa, Mycobacterium
LEHEAMPTLTPVPGLAA

SEQ ID NO: 689263 - protein, 17 aa, Mycobacterium
LEHFELDGYFEVIAGAS

SEQ ID NO: 689264 - protein, 18 aa, Mycobacterium
LEHFRKVIEINLVGVFIG

SEQ ID NO: 689265 - protein, 17 aa, Mycobacterium
LEHGPQMLSFVLKHTPL

SEQ ID NO: 689266 - protein, 18 aa, Mycobacterium
LEHIAEGYHIFSAKLDDC

SEQ ID NO: 689267 - protein, 17 aa, Mycobacterium
LEHICLRRINWLPKSEN

SEQ ID NO: 689268 - protein, 22 aa, Mycobacterium
LEHIKPGLPRTLIHVSGSEVLL

SEQ ID NO: 689269 - protein, 18 aa, Mycobacterium
LEHKRIRRAVASYVGDNK

SEQ ID NO: 689270 - protein, 19 aa, Mycobacterium
LEHKVIFFSGQDHLDDAGQ

SEQ ID NO: 689271 - protein, 24 aa, Mycobacterium
LEHLPAHLLGGVLVGHSVGAYVAS

SEQ ID NO: 689272 - protein, 17 aa, Mycobacterium
LEHNRVWMKTHAALPDD

SEQ ID NO: 689273 - protein, 20 aa, Mycobacterium
LEHRAALVVNSRESAMELLG

SEQ ID NO: 689274 - protein, 20 aa, Mycobacterium
LEHRAALVVNTREAAVELLS

SEQ ID NO: 689275 - protein, 18 aa, Mycobacterium
LEHRAAWVEAEADGTITS

SEQ ID NO: 689276 - protein, 17 aa, Mycobacterium
LEHRAAWVEAEADGTVT

SEQ ID NO: 689277 - protein, 18 aa, Mycobacterium
LEHRAAWVEAESDGTVTS

SEQ ID NO: 689278 - protein, 17 aa, Mycobacterium
LEHRPVYTAGRRTEPHE

SEQ ID NO: 689279 - protein, 26 aa, Mycobacterium
LEHTPLKMCWVPGYSDYYPEAPGGRS

SEQ ID NO: 689280 - protein, 17 aa, Mycobacterium
LEHVGAIRPEQLRRAHD

SEQ ID NO: 689281 - protein, 22 aa, Mycobacterium
LEHVNRIGLDAAPDWPRGHDND

SEQ ID NO: 689282 - protein, 23 aa, Mycobacterium
LEHVNRIGLDAAPDWPSGHDNDV

SEQ ID NO: 689283 - protein, 29 aa, Mycobacterium
LEHYEKLEGVALTFPGKVNRLATMVRGNL

SEQ ID NO: 689284 - protein, 31 aa, Mycobacterium; identical to SEQ ID NO: 81835

SEQ ID NO: 689285 - protein, 17 aa, Mycobacterium
LEHYTAILGEWILDTPQ

SEQ ID NO: 689286 - protein, 20 aa, Mycobacterium
LEHYTAMLGQWVLQNRGLDY

SEQ ID NO: 689287 - protein, 18 aa, Mycobacterium
LEIAGWDRKKRWYRAQEL

SEQ ID NO: 689288 - protein, 19 aa, Mycobacterium
LEIALACHHRIAADAKGSQ

SEQ ID NO: 689289 - protein, 21 aa, Mycobacterium
LEIAPRCALITPSAPHECAAL

SEQ ID NO: 689290 - protein, 23 aa, Mycobacterium
LEIDGMLVCWAIPRSPSTDPKDK

SEQ ID NO: 689291 - protein, 26 aa, Mycobacterium
LEIDRHWPALCRVVERPDWLADPRYG

SEQ ID NO: 689292 - protein, 20 aa, Mycobacterium
LEIESAIGRNVRLLRQQQGL

SEQ ID NO: 689293 - protein, 18 aa, Mycobacterium
LEIFAAGKEPLKFTAYDG

SEQ ID NO: 689294 - protein, 27 aa, Mycobacterium
LEIFAAGRRPLKFTAYDGSSCGPEDAT

SEQ ID NO: 689295 - protein, 26 aa, Mycobacterium
LEIGDIRFGEVFAHGAPLTHFTQIFV

SEQ ID NO: 689296 - protein, 19 aa, Mycobacterium
LEIGGDWYDVLALDDHRIG

SEQ ID NO: 689297 - protein, 18 aa, Mycobacterium
LEIGGDWYDVLPIGEHRI

SEQ ID NO: 689298 - protein, 29 aa, Mycobacterium
LEIGHARQRCVLVALLIDVNRPIPVGQLV

SEQ ID NO: 689299 - protein, 18 aa, Mycobacterium
LEIGRRFATLSLPLAEMR

SEQ ID NO: 689300 - protein, 23 aa, Mycobacterium
LEIGTGWGELCIRAAARGARVRS

SEQ ID NO: 689301 - protein, 23 aa, Mycobacterium
LEIGTGWGELCIRAASRGAQVRS

SEQ ID NO: 689302 - protein, 26 aa, Mycobacterium
LEIHGPVPRLRQTGVITRAREFLMRL

SEQ ID NO: 689303 - protein, 17 aa, Mycobacterium
LEIHGVDIVFLRDGKVV

SEQ ID NO: 689304 - protein, 18 aa, Mycobacterium
LEIHSGSLADVRRAGEAI

SEQ ID NO: 689305 - protein, 18 aa, Mycobacterium
LEIKKFCPNCGKHQAHKE

SEQ ID NO: 689306 - protein, 17 aa, Mycobacterium
LEIKKFCPNCGTHQPHK

SEQ ID NO: 689307 - protein, 22 aa, Mycobacterium
LEIKRLTNGLLPFYNGSNPLVL

SEQ ID NO: 689308 - protein, 22 aa, Mycobacterium
LEILEAIAATGVREIEATAFVS

SEQ ID NO: 689309 - protein, 19 aa, Mycobacterium
LEILGELDPGHGLRAEELS

SEQ ID NO: 689310 - protein, 20 aa, Mycobacterium
LEILPALTYLHSIGLVYNDL

SEQ ID NO: 689311 - protein, 25 aa, Mycobacterium
LEILREFDTLLVMSVEPGFGGQKFI

SEQ ID NO: 689312 - protein, 22 aa, Mycobacterium
LEILRGFRGLNLVGADVVEVAP

SEQ ID NO: 689313 - protein, 18 aa, Mycobacterium
LEINRRFGTPIPPETGEV

SEQ ID NO: 689314 - protein, 19 aa, Mycobacterium
LEIPEMLDEIRALRNQQAP

SEQ ID NO: 689315 - protein, 23 aa, Mycobacterium
LEIPEVLILAWGHTIPMIADAVG

SEQ ID NO: 689316 - protein, 24 aa, Mycobacterium
LEIPGVSESLVWTARQRLATFVTP

SEQ ID NO: 689317 - protein, 19 aa, Mycobacterium
LEIPIKRILLGAAPGEAVQ

SEQ ID NO: 689318 - protein, 17 aa, Mycobacterium
LEIPPLLVELVQPMSPD

SEQ ID NO: 689319 - protein, 20 aa, Mycobacterium
LEIRAALGPLIGRLAAQRHT

SEQ ID NO: 689320 - protein, 24 aa, Mycobacterium
LEIRKRRRGILGFDDLLTRLADAL

SEQ ID NO: 689321 - protein, 23 aa, Mycobacterium
LEIRKRRRGVLGYDDLLTRLADA

SEQ ID NO: 689322 - protein, 17 aa, Mycobacterium
LEISLEHPCVFTIRVTP

SEQ ID NO: 689323 - protein, 24 aa, Mycobacterium
LEISPNLWAGYGLVRGGAGTALVG

SEQ ID NO: 689324 - protein, 21 aa, Mycobacterium
LEITARLAAPLLPLVTEVIWR

SEQ ID NO: 689325 - protein, 18 aa, Mycobacterium
LEITEKLLQPWGIVHGGV

SEQ ID NO: 689326 - protein, 17 aa, Mycobacterium
LEITIMVTEWLKRVPEF

SEQ ID NO: 689327 - protein, 26 aa, Mycobacterium
LEITSIPTVMAFRDGVLVYRQAGAMP

SEQ ID NO: 689328 - protein, 19 aa, Mycobacterium
LEITTCLRRGEIEMVTRYE

SEQ ID NO: 689329 - protein, 23 aa, Mycobacterium
LEITTCLRRGEIEMVTRYEPPDA

SEQ ID NO: 689330 - protein, 24 aa, Mycobacterium
LEITTCLRRGELEIVTRYEPAAAD

SEQ ID NO: 689331 - protein, 24 aa, Mycobacterium
LEITTCLRRGELEIVTRYEPRDAD

SEQ ID NO: 689332 - protein, 36 aa, Mycobacterium
LEIVKKLPPRMVVSRARLQLTLAWTNVLLQRLAPAA

SEQ ID NO: 689333 - protein, 22 aa, Mycobacterium
LEIWRGKAYPLGATYDGSGTNF

SEQ ID NO: 689334 - protein, 21 aa, Mycobacterium
LEIYARLSPEGDRRMLGRPEF

SEQ ID NO: 689335 - protein, 20 aa, Mycobacterium
LEKAHVRHSGALAMGMDGVN

SEQ ID NO: 689336 - protein, 18 aa, Mycobacterium
LEKAIRWLTYTVESELLL

SEQ ID NO: 689337 - protein, 24 aa, Mycobacterium
LEKAKAMGAIAMFGERYPDEVRVV

SEQ ID NO: 689338 - protein, 24 aa, Mycobacterium
LEKAKAMGAMAMFGEAYPDEVRVV

SEQ ID NO: 689339 - protein, 24 aa, Mycobacterium
LEKAKAMGAMAMFGERYPDQVRVV

SEQ ID NO: 689340 - protein, 25 aa, Mycobacterium
LEKCFPLSVRGNLSLDFNNETVVQW

SEQ ID NO: 689341 - protein, 26 aa, Mycobacterium
LEKCIGCELCAWACPADAIFVEGADN

SEQ ID NO: 689342 - protein, 27 aa, Mycobacterium
LEKCIGCELCAWACPADAIFVEGADNS

SEQ ID NO: 689343 - protein, 20 aa, Mycobacterium
LEKGPRLGVLGVVLEVDGRP

SEQ ID NO: 689344 - protein, 19 aa, Mycobacterium
LEKGPRLGVLGVVVEIDGR

SEQ ID NO: 689345 - protein, 19 aa, Mycobacterium
LEKGPRLGVLGVVVEIEGR

SEQ ID NO: 689346 - protein, 19 aa, Mycobacterium
LEKGPRLGVLGVVVEVDGR

SEQ ID NO: 689347 - protein, 20 aa, Mycobacterium
LEKHGPPVYVRHEIVHNRHV

SEQ ID NO: 689348 - protein, 18 aa, Mycobacterium
LEKLRPGDFYKPANQLVY

SEQ ID NO: 689349 - protein, 26 aa, Mycobacterium
LEKLWEGLRQLYPVGIDHRDLIDSDA

SEQ ID NO: 689350 - protein, 24 aa, Mycobacterium
LEKMLLERAYFLGVTAPQLTALVG

SEQ ID NO: 689351 - protein, 18 aa, Mycobacterium
LEKPKIAYTLAWMRDVGA

SEQ ID NO: 689352 - protein, 24 aa, Mycobacterium
LEKRFSPKMRLAVTAALEHYTATF

SEQ ID NO: 689353 - protein, 17 aa, Mycobacterium
LEKRRAHVPWVTSGTTA

SEQ ID NO: 689354 - protein, 21 aa, Mycobacterium
LEKSDRLGLQIVRTLVSAELD

SEQ ID NO: 689355 - protein, 27 aa, Mycobacterium
LEKSRLMAEGWRRQGLDLDITALTYPG

SEQ ID NO: 689356 - protein, 24 aa, Mycobacterium
LEKTRGALDFNRPGLPMVASLPSV

SEQ ID NO: 689357 - protein, 18 aa, Mycobacterium
LEKVSSWVGARLTYSPGS

SEQ ID NO: 689358 - protein, 19 aa, Mycobacterium
LEKVTARRHLVAGLMKIHL

SEQ ID NO: 689359 - protein, 19 aa, Mycobacterium
LEKVTARRHLVAGLMTIHL

SEQ ID NO: 689360 - protein, 34 aa, Mycobacterium
LEKWDEIWAAGGTPRTVFPLTFAELVRITGGQVC

SEQ ID NO: 689361 - protein, 19 aa, Mycobacterium
LEKYTCVFADSVLMMADCF

SEQ ID NO: 689362 - protein, 23 aa, Mycobacterium
LELADGKLICLVRATSDEDARRR

SEQ ID NO: 689363 - protein, 17 aa, Mycobacterium
LELADLGYRGDRNNVAS

SEQ ID NO: 689364 - protein, 19 aa, Mycobacterium
LELAEFGIRVNSIHPYSVD

SEQ ID NO: 689365 - protein, 24 aa, Mycobacterium
LELAEYGIRCNVVAPGSTDTPMLR

SEQ ID NO: 689366 - protein, 20 aa, Mycobacterium
LELAGCYAWSPDKVGRDAGE

SEQ ID NO: 689367 - protein, 17 aa, Mycobacterium
LELAGFFGGESATVPPV

SEQ ID NO: 689368 - protein, 18 aa, Mycobacterium
LELAGNDVVVVWSDANLD

SEQ ID NO: 689369 - protein, 19 aa, Mycobacterium
LELAGPVLRISPHVDTTAD

SEQ ID NO: 689370 - protein, 17 aa, Mycobacterium
LELALACDILIASEKAR

SEQ ID NO: 689371 - protein, 21 aa, Mycobacterium
LELAMPILPQQALLYRLCGDR

SEQ ID NO: 689372 - protein, 34 aa, Mycobacterium
LELAPVCRPDCPGLCPDCGIALATAEPGHHHDKI

SEQ ID NO: 689373 - protein, 26 aa, Mycobacterium
LELAREFDAAGLPPGVLNVVTGDGEP

SEQ ID NO: 689374 - protein, 23 aa, Mycobacterium
LELARRPELRGALREDPEGIAVF

SEQ ID NO: 689375 - protein, 20 aa, Mycobacterium
LELAWTTGLVRWEDDPQPGW

SEQ ID NO: 689376 - protein, 17 aa, Mycobacterium
LELDPGLETRIGEIVTR

SEQ ID NO: 689377 - protein, 21 aa, Mycobacterium
LELFHRSTLTFQDLVGELTGH

SEQ ID NO: 689378 - protein, 17 aa, Mycobacterium
LELFKNATATMKAAAER

SEQ ID NO: 689379 - protein, 19 aa, Mycobacterium
LELFLCASPEFIRELPEPI

SEQ ID NO: 689380 - protein, 18 aa, Mycobacterium
LELGAGGGSLVEWMVEQG

SEQ ID NO: 689381 - protein, 17 aa, Mycobacterium
LELGALVEPMSVAYHAA

SEQ ID NO: 689382 - protein, 31 aa, Mycobacterium
LELGCGTGDCSIYLAQHGWRVTAVDFVAKPL

SEQ ID NO: 689383 - protein, 22 aa, Mycobacterium
LELGESLGIPRAKLVEVLSKGS

SEQ ID NO: 689384 - protein, 28 aa, Mycobacterium
LELGFRSSIQKEWEWRISRGESLKNLEA

SEQ ID NO: 689385 - protein, 28 aa, Mycobacterium
LELGFRSSIQKEWEWRVSRGESLKNLQA

SEQ ID NO: 689386 - protein, 29 aa, Mycobacterium
LELGFRSSIQKEWEWRVSRGESLKNLQAF

SEQ ID NO: 689387 - protein, 19 aa, Mycobacterium
LELGTLIAGPFAGRLLGDM

SEQ ID NO: 689388 - protein, 17 aa, Mycobacterium
LELHPMFNPAAYVSAEF

SEQ ID NO: 689389 - protein, 25 aa, Mycobacterium
LELIDEIQTRIGLKPTPLTWPVGIA

SEQ ID NO: 689390 - protein, 25 aa, Mycobacterium
LELIDRIGVGKVMWSSDYPHNESTY

SEQ ID NO: 689391 - protein, 17 aa, Mycobacterium
LELIFAPAPFFDEGIGV

SEQ ID NO: 689392 - protein, 17 aa, Mycobacterium
LELIGLMGVPPRDWDQE

SEQ ID NO: 689393 - protein, 27 aa, Mycobacterium
LELISRLPGWDSPAADAARGRIGTAKA

SEQ ID NO: 689394 - protein, 19 aa, Mycobacterium
LELKAGRILFNGWPTGVEV

SEQ ID NO: 689395 - protein, 19 aa, Mycobacterium
LELKKFCPNCGKHQAHRET

SEQ ID NO: 689396 - protein, 22 aa, Mycobacterium
LELKVALATVQLRAGEDAAVYA

SEQ ID NO: 689397 - protein, 23 aa, Mycobacterium
LELLAHCGYRLSPIEQVMAGHIS

SEQ ID NO: 689398 - protein, 21 aa, Mycobacterium
LELLAPEFSRSGVEIESVVVS

SEQ ID NO: 689399 - protein, 17 aa, Mycobacterium
LELLARLAVLATGTQIS

SEQ ID NO: 689400 - protein, 27 aa, Mycobacterium
LELLARLQAELGLAYLFISHDLAVIRQ

SEQ ID NO: 689401 - protein, 20 aa, Mycobacterium
LELLAYAAACTTRLRLGVAV

SEQ ID NO: 689402 - protein, 20 aa, Mycobacterium
LELLCERFGVSMQPVTRGTA

SEQ ID NO: 689403 - protein, 20 aa, Mycobacterium
LELLDADSLAALKQDAEEGR

SEQ ID NO: 689404 - protein, 22 aa, Mycobacterium
LELLEAAKLPAAPMHSTQEVLE

SEQ ID NO: 689405 - protein, 19 aa, Mycobacterium
LELLHACALVHDDVIDDSS

SEQ ID NO: 689406 - protein, 17 aa, Mycobacterium
LELLKGVPVAGGTATAH

SEQ ID NO: 689407 - protein, 26 aa, Mycobacterium
LELLNRLWKLVSLRCNFFTPTKKPIG

SEQ ID NO: 689408 - protein, 25 aa, Mycobacterium
LELLPTVRGAFCLTFMDENTLYAAR

SEQ ID NO: 689409 - protein, 19 aa, Mycobacterium
LELLRGEGLITRVQGAGTF

SEQ ID NO: 689410 - protein, 18 aa, Mycobacterium
LELLRRVQNRIGRQVWLI

SEQ ID NO: 689411 - protein, 28 aa, Mycobacterium
LELLSRLQSELALTYLLIGHDLAVIRQL

SEQ ID NO: 689412 - protein, 20 aa, Mycobacterium
LELLSYAAAVTTRLRLGVAV

SEQ ID NO: 689413 - protein, 19 aa, Mycobacterium
LELLYAGAMFHDIGLTDGY

SEQ ID NO: 689414 - protein, 18 aa, Mycobacterium
LELNAGKQLSRVRIWDGS

SEQ ID NO: 689415 - protein, 19 aa, Mycobacterium
LELNVAFQMLYARYPDITA

SEQ ID NO: 689416 - protein, 17 aa, Mycobacterium
LELPAGISSTLQLWRPD

SEQ ID NO: 689417 - protein, 24 aa, Mycobacterium
LELPDPPDSWGWGKTAHLLVGSLA

SEQ ID NO: 689418 - protein, 17 aa, Mycobacterium
LELPEFVVSGGKAVPIP

SEQ ID NO: 689419 - protein, 17 aa, Mycobacterium
LELPELGLDPELAAGAV

SEQ ID NO: 689420 - protein, 20 aa, Mycobacterium
LELPERVRARNPVPHLRVVM

SEQ ID NO: 689421 - protein, 18 aa, Mycobacterium
LELPHIWGGLADLSGADT

SEQ ID NO: 689422 - protein, 20 aa, Mycobacterium
LELPPQWSPAQRETFLDSQA

SEQ ID NO: 689423 - protein, 21 aa, Mycobacterium
LELPSGVTVHAGRDGVDAVEF

SEQ ID NO: 689424 - protein, 19 aa, Mycobacterium
LELPTTIARLNVPYGDAGG

SEQ ID NO: 689425 - protein, 19 aa, Mycobacterium
LELRAHFRALSAWLTSALE

SEQ ID NO: 689426 - protein, 17 aa, Mycobacterium
LELRHVLSYVPVNEGVV

SEQ ID NO: 689427 - protein, 21 aa, Mycobacterium
LELRKAVFCGHDFGAHLVWDM

SEQ ID NO: 689428 - protein, 18 aa, Mycobacterium
LELRKRRVEFDGDDVEWL

SEQ ID NO: 689429 - protein, 25 aa, Mycobacterium
LELRNGRLRLDHRNIVVVDEAGLIG

SEQ ID NO: 689430 - protein, 33 aa, Mycobacterium
LELRNRLEASLGITLPVALVWAYPTITDLATAL

SEQ ID NO: 689431 - protein, 20 aa, Mycobacterium
LELRTPRWVSAEDRLLVTVL

SEQ ID NO: 689432 - protein, 20 aa, Mycobacterium
LELRTPRWVSGEDRLLVTVL

SEQ ID NO: 689433 - protein, 25 aa, Mycobacterium
LELRVLRLDTEYAWAEDPPSRIRHH

SEQ ID NO: 689434 - protein, 17 aa, Mycobacterium
LELRVSVPNGVYGDLQR

SEQ ID NO: 689435 - protein, 17 aa, Mycobacterium
LELSDRSLICLPSTYTT

SEQ ID NO: 689436 - protein, 18 aa, Mycobacterium
LELSHAWDAATLRVVSKA

SEQ ID NO: 689437 - protein, 18 aa, Mycobacterium
LELSMMTERVLKRLPDLR

SEQ ID NO: 689438 - protein, 19 aa, Mycobacterium
LELSRPMWMSYLIDGLEDG

SEQ ID NO: 689439 - protein, 24 aa, Mycobacterium
LELSRTQAFSGLSLRDVARGAGIS

SEQ ID NO: 689440 - protein, 17 aa, Mycobacterium
LELSTGVAVAFPRSPFV

SEQ ID NO: 689441 - protein, 18 aa, Mycobacterium
LELSYVFRRDSWGRGWAY

SEQ ID NO: 689442 - protein, 23 aa, Mycobacterium
LELTGRPLFGNGADGYTNAQGVG

SEQ ID NO: 689443 - protein, 17 aa, Mycobacterium
LELTIDLVRCVNEGETV

SEQ ID NO: 689444 - protein, 18 aa, Mycobacterium
LELVGSATLNRDPEGAPY

SEQ ID NO: 689445 - protein, 20 aa, Mycobacterium
LELVLARSAGILGIELGADA

SEQ ID NO: 689446 - protein, 20 aa, Mycobacterium
LELVLARSAGILGIELGAEA

SEQ ID NO: 689447 - protein, 18 aa, Mycobacterium
LELVPWLRKGQWGAPLLF

SEQ ID NO: 689448 - protein, 19 aa, Mycobacterium
LELVSLTQILAWDLPLTRK

SEQ ID NO: 689449 - protein, 20 aa, Mycobacterium
LELWFREGAADGFNLNIDRL

SEQ ID NO: 689450 - protein, 18 aa, Mycobacterium
LELWLAEFPQPRPPRETW

SEQ ID NO: 689451 - protein, 25 aa, Mycobacterium
LELYFRRAGAWLALLHCLAATDMHH

SEQ ID NO: 689452 - protein, 17 aa, Mycobacterium
LELYLAVPCTNRVLHTV

SEQ ID NO: 689453 - protein, 21 aa, Mycobacterium
LEMAAVLAGMFPGRGGERARD

SEQ ID NO: 689454 - protein, 17 aa, Mycobacterium
LEMAEMARATKFHEPFE

SEQ ID NO: 689455 - protein, 21 aa, Mycobacterium
LEMALGCDFMIASERAVFADT

SEQ ID NO: 689456 - protein, 18 aa, Mycobacterium
LEMDRWELDPEQLATHPG

SEQ ID NO: 689457 - protein, 17 aa, Mycobacterium
LEMGASWIHGTTDNPLV

SEQ ID NO: 689458 - protein, 19 aa, Mycobacterium
LEMLSGLQSEFADQIRDAA

SEQ ID NO: 689459 - protein, 17 aa, Mycobacterium
LEMNTRLQVEHPVTELT

SEQ ID NO: 689460 - protein, 22 aa, Mycobacterium
LEMPQLPGRGWIEYEPYGTVLI

SEQ ID NO: 689461 - protein, 17 aa, Mycobacterium
LEMQKLAALGPAAPTAS

SEQ ID NO: 689462 - protein, 18 aa, Mycobacterium
LEMRATSVGPDLSRVFVR

SEQ ID NO: 689463 - protein, 21 aa, Mycobacterium
LEMSDRVAGGAGMHVDLDHDI

SEQ ID NO: 689464 - protein, 22 aa, Mycobacterium
LEMTGQFGSWRRSISIRHAEIL

SEQ ID NO: 689465 - protein, 18 aa, Mycobacterium
LEMTKWFDTNYHYIVPEL

SEQ ID NO: 689466 - protein, 19 aa, Mycobacterium
LEMVHMAGVTTCLDMGVGI

SEQ ID NO: 689467 - protein, 20 aa, Mycobacterium
LEMWAQDAAAMYGYAAESAA

SEQ ID NO: 689468 - protein, 18 aa, Mycobacterium
LENACRVIQRYEPKGRRY

SEQ ID NO: 689469 - protein, 19 aa, Mycobacterium
LENELHRRCVAAGVQVLCG

SEQ ID NO: 689470 - protein, 25 aa, Mycobacterium
LENFRPGTLEKWGLGPSEIKQKNPQ

SEQ ID NO: 689471 - protein, 29 aa, Mycobacterium
LENMRYKWRKWLYFDCNWKVALEAFNETY

SEQ ID NO: 689472 - protein, 29 aa, Mycobacterium
LENMRYKWRKWLYFDCNWKVAMEAFNETY

SEQ ID NO: 689473 - protein, 18 aa, Mycobacterium
LENPMLGFGLALLAGLVG

SEQ ID NO: 689474 - protein, 18 aa, Mycobacterium
LENQNAWIGHNGNIPGYQ

SEQ ID NO: 689475 - protein, 27 aa, Mycobacterium
LENRFAEQLKIFGPVFMSNDAREGAIA

SEQ ID NO: 689476 - protein, 18 aa, Mycobacterium
LENRFVGRVGLFRNQPGD

SEQ ID NO: 689477 - protein, 21 aa, Mycobacterium
LENRLADHLMRSWQAGATSLR

SEQ ID NO: 689478 - protein, 28 aa, Mycobacterium
LENTFRWNWRLGDVAIWDNRATQHYGIA

SEQ ID NO: 689479 - protein, 27 aa, Mycobacterium
LENTIRWSWELGDIAVWDNRATQHYAV

SEQ ID NO: 689480 - protein, 30 aa, Mycobacterium
LENYHSLTLPRTWLEAMVKAYIGDSLAADF

SEQ ID NO: 689481 - protein, 19 aa, Mycobacterium
LEPAEDFADVAFRSFHFIY

SEQ ID NO: 689482 - protein, 17 aa, Mycobacterium
LEPALDGAIAHYFLHAE

SEQ ID NO: 689483 - protein, 17 aa, Mycobacterium
LEPARLIMERAGSLVHT

SEQ ID NO: 689484 - protein, 20 aa, Mycobacterium
LEPAWSFGPEGQRYEMEVRG

SEQ ID NO: 689485 - protein, 24 aa, Mycobacterium
LEPDEIDAGFVLTCQSYPTTDSLT

SEQ ID NO: 689486 - protein, 17 aa, Mycobacterium
LEPDFVAQAGFSLQQTL

SEQ ID NO: 689487 - protein, 18 aa, Mycobacterium
LEPDVACEITLQPVRRYG

SEQ ID NO: 689488 - protein, 22 aa, Mycobacterium
LEPEAQVAFSQRLGEVDRSADG

SEQ ID NO: 689489 - protein, 17 aa, Mycobacterium
LEPELAKTRAVVDVQTK

SEQ ID NO: 689490 - protein, 23 aa, Mycobacterium
LEPELLEFLLATSITERTCGGLA

SEQ ID NO: 689491 - protein, 23 aa, Mycobacterium
LEPETFAGLISLRLPSEEELAEA

SEQ ID NO: 689492 - protein, 24 aa, Mycobacterium
LEPETFAGLISLRLPTAAELADAG

SEQ ID NO: 689493 - protein, 20 aa, Mycobacterium
LEPFALGAFNDCSIRRPNAP

SEQ ID NO: 689494 - protein, 26 aa, Mycobacterium
LEPGAPRKLALVPGYLDIHYSSGVGT

SEQ ID NO: 689495 - protein, 21 aa, Mycobacterium
LEPGHGLKIGYFAQEHDTLDN

SEQ ID NO: 689496 - protein, 26 aa, Mycobacterium
LEPGKVARPNAPFADAVTQWESLERF

SEQ ID NO: 689497 - protein, 34 aa, Mycobacterium
LEPGMAFSIEPGVYFPGQWGARIEDIVVITENGC

SEQ ID NO: 689498 - protein, 19 aa, Mycobacterium
LEPGMTLLDIGCGWGATMR

SEQ ID NO: 689499 - protein, 18 aa, Mycobacterium
LEPGMVLAVTGYVWEEGV

SEQ ID NO: 689500 - protein, 18 aa, Mycobacterium
LEPGTRVLLVDDVISTGG

SEQ ID NO: 689501 - protein, 23 aa, Mycobacterium
LEPHLRAGTLILVDDVNLDFGGR

SEQ ID NO: 689502 - protein, 18 aa, Mycobacterium
LEPIPAYRLLGMVDGHRA

SEQ ID NO: 689503 - protein, 23 aa, Mycobacterium
LEPKGVVLQWTWVPPRPADELET

SEQ ID NO: 689504 - protein, 23 aa, Mycobacterium
LEPLCRWGYDHMKVHTEARTEQM

SEQ ID NO: 689505 - protein, 18 aa, Mycobacterium
LEPLRARLADGMPAYGSC

SEQ ID NO: 689506 - protein, 17 aa, Mycobacterium
LEPNGFAGLSLRETLDV

SEQ ID NO: 689507 - protein, 17 aa, Mycobacterium
LEPNLLGIHVHPITCSL

SEQ ID NO: 689508 - protein, 24 aa, Mycobacterium
LEPNLRVLVNLGYGDPAYGYDTGP

SEQ ID NO: 689509 - protein, 17 aa, Mycobacterium
LEPPAGPALGLNLGNWC

SEQ ID NO: 689510 - protein, 23 aa, Mycobacterium
LEPRPEPDSGPGPRPSITKNSDE

SEQ ID NO: 689511 - protein, 22 aa, Mycobacterium
LEPRPPATLAVMRSAVISTGAQ

SEQ ID NO: 689512 - protein, 18 aa, Mycobacterium
LEPRRFASGSAQNMLSPT

SEQ ID NO: 689513 - protein, 18 aa, Mycobacterium
LEPRVCAVFEDAHLGILA

SEQ ID NO: 689514 - protein, 17 aa, Mycobacterium
LEPRWFAWVDDMRDWTI

SEQ ID NO: 689515 - protein, 17 aa, Mycobacterium
LEPRYAMERVLVDLWRV

SEQ ID NO: 689516 - protein, 25 aa, Mycobacterium
LEPTARRILAHFGLDHHFEVIAGAS

SEQ ID NO: 689517 - protein, 26 aa, Mycobacterium
LEPTARRILAHFGLDRHFEVIAGASP

SEQ ID NO: 689518 - protein, 25 aa, Mycobacterium
LEPTARRILAHFGLEQHFEVIAGAS

SEQ ID NO: 689519 - protein, 25 aa, Mycobacterium
LEPTARRVLAHFGLDAHFEVIAGAT

SEQ ID NO: 689520 - protein, 24 aa, Mycobacterium
LEPTDAILAGGTWLFSEPNSHIRR

SEQ ID NO: 689521 - protein, 21 aa, Mycobacterium
LEPTFRRSVIYIVEHNDGGTL

SEQ ID NO: 689522 - protein, 17 aa, Mycobacterium
LEPTLIYAKDCLALAAE

SEQ ID NO: 689523 - protein, 19 aa, Mycobacterium
LEPTLIYAKDCLALAAETQ

SEQ ID NO: 689524 - protein, 17 aa, Mycobacterium
LEPVARITTHRTVSVLY

SEQ ID NO: 689525 - protein, 23 aa, Mycobacterium
LEPVRAHRAWLRSTLAGLLKQAG

SEQ ID NO: 689526 - protein, 20 aa, Mycobacterium
LEPVRTAWCGVPGQRSGVTW

SEQ ID NO: 689527 - protein, 25 aa, Mycobacterium
LEPVTDKWAAFGWDVRAVDGHDVGQ

SEQ ID NO: 689528 - protein, 19 aa, Mycobacterium
LEPWWGRGTARLIVDDDGW

SEQ ID NO: 689529 - protein, 23 aa, Mycobacterium
LEPYWEALRKVYAPFDVAAAGPT

SEQ ID NO: 689530 - protein, 17 aa, Mycobacterium
LEQAGLRGLLRVVGAEH

SEQ ID NO: 689531 - protein, 32 aa, Mycobacterium
LEQARDWLRRFELRPGFEVVLPPPAPLDPIDE

SEQ ID NO: 689532 - protein, 25 aa, Mycobacterium
LEQARKRFAAAWNHQDGGHPINDSE

SEQ ID NO: 689533 - protein, 20 aa, Mycobacterium
LEQARLAGYGYIELPVFEDT

SEQ ID NO: 689534 - protein, 31 aa, Mycobacterium
LEQAVSAPMCTRVLADFGARVIKVENPKGGD

SEQ ID NO: 689535 - protein, 18 aa, Mycobacterium
LEQEGAWVDDLRATLQAR

SEQ ID NO: 689536 - protein, 17 aa, Mycobacterium
LEQFDLAAAADRRLSTY

SEQ ID NO: 689537 - protein, 23 aa, Mycobacterium
LEQFSLSVCGRVIDELEPGPPKP

SEQ ID NO: 689538 - protein, 20 aa, Mycobacterium
LEQGLTCAILGVPVADLVGL

SEQ ID NO: 689539 - protein, 21 aa, Mycobacterium
LEQHFGHLVDYGFTAAMEDEL

SEQ ID NO: 689540 - protein, 19 aa, Mycobacterium
LEQHFGRLVDYGFTAAMED

SEQ ID NO: 689541 - protein, 20 aa, Mycobacterium
LEQHFSRLVDYDFTAAMEDE

SEQ ID NO: 689542 - protein, 18 aa, Mycobacterium
LEQHPAVLLFSHRSYLDG

SEQ ID NO: 689543 - protein, 18 aa, Mycobacterium
LEQHRIPLGGTVLLVSGR

SEQ ID NO: 689544 - protein, 18 aa, Mycobacterium
LEQISFRIAATDDQFLSI

SEQ ID NO: 689545 - protein, 21 aa, Mycobacterium
LEQLKSLGLRTFLLPLNPGKD

SEQ ID NO: 689546 - protein, 23 aa, Mycobacterium
LEQLRLRTSMKWRAHPADVLPLW

SEQ ID NO: 689547 - protein, 23 aa, Mycobacterium
LEQLRPLPERVLMVGDRSHDVHG

SEQ ID NO: 689548 - protein, 21 aa, Mycobacterium
LEQLSALAIMLTLFSAAGEST

SEQ ID NO: 689549 - protein, 17 aa, Mycobacterium
LEQLTADLPRLWEAETT

SEQ ID NO: 689550 - protein, 22 aa, Mycobacterium
LEQMRLFAKYVIPAFPDVLASR

SEQ ID NO: 689551 - protein, 20 aa, Mycobacterium
LEQQVCFALAITNRAVLAVY

SEQ ID NO: 689552 - protein, 20 aa, Mycobacterium
LEQRASALGVDLRWGDELTG

SEQ ID NO: 689553 - protein, 22 aa, Mycobacterium
LEQRGVGEWASFSELVAECTDG

SEQ ID NO: 689554 - protein, 17 aa, Mycobacterium
LEQRRAQVLARTGRELT

SEQ ID NO: 689555 - protein, 25 aa, Mycobacterium
LEQRYCVADVLPLTPLQQGLLFHAD

SEQ ID NO: 689556 - protein, 25 aa, Mycobacterium
LEQSPAEWNRVLGVNLTGTWLTIRA

SEQ ID NO: 689557 - protein, 24 aa, Mycobacterium
LEQSRRAALAWGHAEVDNARFATE

SEQ ID NO: 689558 - protein, 27 aa, Mycobacterium
LEQTFMFYLPRICEHCLNPSCVASCPS

SEQ ID NO: 689559 - protein, 19 aa, Mycobacterium
LEQTRISGVLINLRPDRPA

SEQ ID NO: 689560 - protein, 19 aa, Mycobacterium
LEQVAAWYWSMTHPEEGGT

SEQ ID NO: 689561 - protein, 23 aa, Mycobacterium
LEQVDGTLICLVRAKSDEEARRR

SEQ ID NO: 689562 - protein, 21 aa, Mycobacterium
LERAARWGATPLKAPAVDAIL

SEQ ID NO: 689563 - protein, 17 aa, Mycobacterium
LERAATDQRPDWTAAAI

SEQ ID NO: 689564 - protein, 18 aa, Mycobacterium
LERACAAGNASLYVNGID

SEQ ID NO: 689565 - protein, 17 aa, Mycobacterium
LERALALGADYAFDSRD

SEQ ID NO: 689566 - protein, 23 aa, Mycobacterium
LERALEGLVEFLPSKTWFDKTDA

SEQ ID NO: 689567 - protein, 21 aa, Mycobacterium
LERALELTASYAREREQFDRP

SEQ ID NO: 689568 - protein, 17 aa, Mycobacterium
LERALIAGHDFVLLGER

SEQ ID NO: 689569 - protein, 17 aa, Mycobacterium
LERARGTLAEIFAAGEP

SEQ ID NO: 689570 - protein, 21 aa, Mycobacterium
LERDEWEFALLSGALARGIPV

SEQ ID NO: 689571 - protein, 20 aa, Mycobacterium
LERDLYKAAGVTDGDVYRRA

SEQ ID NO: 689572 - protein, 28 aa, Mycobacterium
LERDTCWPWLEAEWRLVSEHVRTIVALG

SEQ ID NO: 689573 - protein, 18 aa, Mycobacterium
LEREICVAYDATKYDITG

SEQ ID NO: 689574 - protein, 26 aa, Mycobacterium
LERFDLSSLRFVMWCATPVTRSVAED

SEQ ID NO: 689575 - protein, 24 aa, Mycobacterium
LERGDLGAAMGWLTEARQLLEVID

SEQ ID NO: 689576 - protein, 19 aa, Mycobacterium
LERGGRSLLSFGADADAQR

SEQ ID NO: 689577 - protein, 19 aa, Mycobacterium
LERGHLWFHLHGRTLCGGY

SEQ ID NO: 689578 - protein, 17 aa, Mycobacterium
LERGLQLTAEYAREREQ

SEQ ID NO: 689579 - protein, 23 aa, Mycobacterium
LERGLRLSGFDVFTAVDGAEALR

SEQ ID NO: 689580 - protein, 19 aa, Mycobacterium
LERGMAFSVEPGVYFPGQW

SEQ ID NO: 689581 - protein, 17 aa, Mycobacterium
LERGYWQGWDMHPGHLV

SEQ ID NO: 689582 - protein, 19 aa, Mycobacterium
LERHARAGVLAPVSACASG

SEQ ID NO: 689583 - protein, 21 aa, Mycobacterium
LERHGWHPVRTPLNQLLADNG

SEQ ID NO: 689584 - protein, 22 aa, Mycobacterium
LERHPIPEWIVVGAGTGGTSAT

SEQ ID NO: 689585 - protein, 26 aa, Mycobacterium
LERHYPRTAAELASWHQSWATACQKA

SEQ ID NO: 689586 - protein, 22 aa, Mycobacterium
LERICAVHERSERVAVIGEVGS

SEQ ID NO: 689587 - protein, 24 aa, Mycobacterium
LERIGFAAQHIWDGSARRVLAHAT

SEQ ID NO: 689588 - protein, 24 aa, Mycobacterium
LERIGFAAQHIWNGSAERVLAHAT

SEQ ID NO: 689589 - protein, 19 aa, Mycobacterium
LERIHLLQPHYARTLDMWA

SEQ ID NO: 689590 - protein, 26 aa, Mycobacterium
LERIKRRELPGLAVATDWLRAHKPLD

SEQ ID NO: 689591 - protein, 17 aa, Mycobacterium
LERIPVPVLAIGDDGSI

SEQ ID NO: 689592 - protein, 27 aa, Mycobacterium
LERIRFTSPHPAEFTDDVILAMAETPA

SEQ ID NO: 689593 - protein, 22 aa, Mycobacterium
LERKADDALWKRYSAARETFNR

SEQ ID NO: 689594 - protein, 28 aa, Mycobacterium
LERKLVEVPVGFKWFVDGLVGGSIGFGG

SEQ ID NO: 689595 - protein, 18 aa, Mycobacterium
LERLACGEPANAPEDDAA

SEQ ID NO: 689596 - protein, 19 aa, Mycobacterium
LERLAQAPIPLRVAAHEGW

SEQ ID NO: 689597 - protein, 17 aa, Mycobacterium
LERLDIVVASVHSKLAM

SEQ ID NO: 689598 - protein, 23 aa, Mycobacterium
LERLGKVWAAMAITEPAFGSDSA

SEQ ID NO: 689599 - protein, 23 aa, Mycobacterium
LERLGLDYVDLYLIHWPGGDTSK

SEQ ID NO: 689600 - protein, 24 aa, Mycobacterium
LERLGLDYVDLYLIHWPVSQQGKH

SEQ ID NO: 689601 - protein, 21 aa, Mycobacterium
LERLKGLFLASFEAIEHRHAQ

SEQ ID NO: 689602 - protein, 26 aa, Mycobacterium
LERLLDRWAGFDGVEFVTMADAAEQF

SEQ ID NO: 689603 - protein, 17 aa, Mycobacterium
LERLMGWVLTYPFNMTT

SEQ ID NO: 689604 - protein, 20 aa, Mycobacterium
LERLPLGLPGRRHIRSIDAI

SEQ ID NO: 689605 - protein, 26 aa, Mycobacterium
LERLRPGDFYRPAHQNIYDAILDLYG

SEQ ID NO: 689606 - protein, 20 aa, Mycobacterium
LERLTGRLATLGAVTTNVVY

SEQ ID NO: 689607 - protein, 27 aa, Mycobacterium
LERLYPRTAAELASWKHRWARACQQAF

SEQ ID NO: 689608 - protein, 36 aa, Mycobacterium; identical to SEQ ID NO: 81857

SEQ ID NO: 689609 - protein, 34 aa, Mycobacterium
LERLYPRTAAELFSWGRSWLETCQNAFADLDVDP

SEQ ID NO: 689610 - protein, 20 aa, Mycobacterium
LERMGEVFGAVGTETQVIVL

SEQ ID NO: 689611 - protein, 19 aa, Mycobacterium
LERMREAVAADDPLRALWL

SEQ ID NO: 689612 - protein, 24 aa, Mycobacterium
LERNGVHPLPAWNRHDPESVRFWE

SEQ ID NO: 689613 - protein, 26 aa, Mycobacterium
LERNKERLRRILITEVGCPVTVSGSQ

SEQ ID NO: 689614 - protein, 27 aa, Mycobacterium
LERNKERLRRVLITEVGCPVSVTGSQI

SEQ ID NO: 689615 - protein, 21 aa, Mycobacterium
LERNKMRVVPGLTSKAMSVAS

SEQ ID NO: 689616 - protein, 18 aa, Mycobacterium
LERPAIGYGIRYEFGIFD

SEQ ID NO: 689617 - protein, 18 aa, Mycobacterium
LERPASKMQFAYIEDNEE

SEQ ID NO: 689618 - protein, 20 aa, Mycobacterium
LERPDLRAGDWCEQPDEIDK

SEQ ID NO: 689619 - protein, 17 aa, Mycobacterium
LERPLAYTTVMTVLDNL

SEQ ID NO: 689620 - protein, 20 aa, Mycobacterium
LERQVCFALAVTNRAVLAIY

SEQ ID NO: 689621 - protein, 25 aa, Mycobacterium
LERQWLHARSLAFAHPADGRRIEIV

SEQ ID NO: 689622 - protein, 25 aa, Mycobacterium
LERQWLHARSLAFAHPADGRRVEFT

SEQ ID NO: 689623 - protein, 22 aa, Mycobacterium
LERRERIGGTWDLFRYPGVRSD

SEQ ID NO: 689624 - protein, 20 aa, Mycobacterium
LERRFRVLRYDTRGHGASPV

SEQ ID NO: 689625 - protein, 17 aa, Mycobacterium
LERRIAFRRELRNILRD

SEQ ID NO: 689626 - protein, 26 aa, Mycobacterium
LERRLGDRLFNDFLALHFSQTRPQTE

SEQ ID NO: 689627 - protein, 17 aa, Mycobacterium
LERRLGLVAEAYTTGRA

SEQ ID NO: 689628 - protein, 27 aa, Mycobacterium
LERRLGRRLFKDFLALHFSTTRPPSQE

SEQ ID NO: 689629 - protein, 26 aa, Mycobacterium
LERRRAEVPWVTWGTTIMIARSVAKF

SEQ ID NO: 689630 - protein, 17 aa, Mycobacterium
LERRTGRRLAHLAEGSE

SEQ ID NO: 689631 - protein, 26 aa, Mycobacterium
LERSGPSRARYLMLRLLERAGEQRVA

SEQ ID NO: 689632 - protein, 19 aa, Mycobacterium
LERTIGACRGFVYAASTMG

SEQ ID NO: 689633 - protein, 17 aa, Mycobacterium
LERTLAFHLAGHALHSI

SEQ ID NO: 689634 - protein, 18 aa, Mycobacterium
LERTLGMSGGNIFHGGLS

SEQ ID NO: 689635 - protein, 18 aa, Mycobacterium
LERTQIRALGLLKGACAQ

SEQ ID NO: 689636 - protein, 26 aa, Mycobacterium
LERTSNWMEFVWKPGYADYYPELPGG

SEQ ID NO: 689637 - protein, 19 aa, Mycobacterium
LERTVPFRFSMSGETLDVG

SEQ ID NO: 689638 - protein, 19 aa, Mycobacterium
LERTYKWVPRVGIEHLRAV

SEQ ID NO: 689639 - protein, 25 aa, Mycobacterium
LERVGIELGRGGYLTVDRVSRTSVS

SEQ ID NO: 689640 - protein, 20 aa, Mycobacterium
LERVLARSAGILGIQLGAEA

SEQ ID NO: 689641 - protein, 19 aa, Mycobacterium
LERVLGWDTRQRDSIAITL

SEQ ID NO: 689642 - protein, 18 aa, Mycobacterium
LERVLRALPQAGVRVGTL

SEQ ID NO: 689643 - protein, 24 aa, Mycobacterium
LERVWEPKAAGALRLHHAAEGCQL

SEQ ID NO: 689644 - protein, 18 aa, Mycobacterium
LERVWRCAEPLTEDATAD

SEQ ID NO: 689645 - protein, 23 aa, Mycobacterium
LERWGEAMAVEIAPFGLGVTILV

SEQ ID NO: 689646 - protein, 23 aa, Mycobacterium
LERWGESMACEIAPFGLGVTVVV

SEQ ID NO: 689647 - protein, 21 aa, Mycobacterium
LERYFPHASHQVLLLSTDTEI

SEQ ID NO: 689648 - protein, 17 aa, Mycobacterium
LERYLRHVGKAATTRLD

SEQ ID NO: 689649 - protein, 24 aa, Mycobacterium
LERYRAATMMARIREAKGMKVAQP

SEQ ID NO: 689650 - protein, 21 aa, Mycobacterium
LESAAESFASVTAGLAEQAWQ

SEQ ID NO: 689651 - protein, 23 aa, Mycobacterium
LESAATRLVGCWGNNDGPALRAR

SEQ ID NO: 689652 - protein, 17 aa, Mycobacterium
LESAAVSEVRWNAVVLA

SEQ ID NO: 689653 - protein, 19 aa, Mycobacterium
LESAIRLALLDALSAAAEE

SEQ ID NO: 689654 - protein, 18 aa, Mycobacterium
LESALGMTAGNIFHGGLQ

SEQ ID NO: 689655 - protein, 32 aa, Mycobacterium
LESARTHLLYGVWLRRRRRIVDARVHLSAALT

SEQ ID NO: 689656 - protein, 17 aa, Mycobacterium
LESATVTEVRWDAVVLG

SEQ ID NO: 689657 - protein, 21 aa, Mycobacterium
LESAYRLAVINTFGGGANELQ

SEQ ID NO: 689658 - protein, 18 aa, Mycobacterium
LESEALAAVCPIFRDAER

SEQ ID NO: 689659 - protein, 20 aa, Mycobacterium
LESGALNFGNTISGIHNTSG

SEQ ID NO: 689660 - protein, 19 aa, Mycobacterium
LESGARERLVFGRNEPGLQ

SEQ ID NO: 689661 - protein, 18 aa, Mycobacterium
LESGCYARIRPDRLQPEV

SEQ ID NO: 689662 - protein, 19 aa, Mycobacterium
LESGCYAWIRPGREPEITR

SEQ ID NO: 689663 - protein, 19 aa, Mycobacterium
LESGWRPDDSVILAAAGTS

SEQ ID NO: 689664 - protein, 21 aa, Mycobacterium
LESIPGLADEVFAMMKPTAPI

SEQ ID NO: 689665 - protein, 18 aa, Mycobacterium
LESKFRVTFPRSNVLSAL

SEQ ID NO: 689666 - protein, 17 aa, Mycobacterium
LESKIGLIDWLIQDPGN

SEQ ID NO: 689667 - protein, 17 aa, Mycobacterium
LESLDMLERALSLQPTG

SEQ ID NO: 689668 - protein, 24 aa, Mycobacterium
LESLESLGPIFAELRGAGRELLEL

SEQ ID NO: 689669 - protein, 24 aa, Mycobacterium
LESLPANAIGKVFLEVAGPEDEIE

SEQ ID NO: 689670 - protein, 20 aa, Mycobacterium
LESLPLSGWMTIETTPLSPH

SEQ ID NO: 689671 - protein, 21 aa, Mycobacterium
LESLPQWSSIHRKVEILERDD

SEQ ID NO: 689672 - protein, 23 aa, Mycobacterium
LESLPRNEIIAGMAEVVKAGFIA

SEQ ID NO: 689673 - protein, 23 aa, Mycobacterium
LESLPRNEIVAGMAEIVKAGFIA

SEQ ID NO: 689674 - protein, 24 aa, Mycobacterium
LESLRAETKFAYSTVSEAVRLLRD

SEQ ID NO: 689675 - protein, 24 aa, Mycobacterium
LESLRARFGTLTEVERPVATGDFI

SEQ ID NO: 689676 - protein, 25 aa, Mycobacterium
LESLRARFGTLTGVDRPVATGDFVS

SEQ ID NO: 689677 - protein, 25 aa, Mycobacterium
LESLRRLRGLGHLTVLPGHGPELDD

SEQ ID NO: 689678 - protein, 18 aa, Mycobacterium
LESLSQIVLHLGNGASVS

SEQ ID NO: 689679 - protein, 18 aa, Mycobacterium
LESLTRSLAVEWAPKVRV

SEQ ID NO: 689680 - protein, 22 aa, Mycobacterium
LESPDLRLSGFIGPGHVSTVVG

SEQ ID NO: 689681 - protein, 24 aa, Mycobacterium
LESPDLRLSGFLGPGHVSTVVGLR

SEQ ID NO: 689682 - protein, 25 aa, Mycobacterium
LESQRAGLGIGFTAVLPRLTPATGL

SEQ ID NO: 689683 - protein, 21 aa, Mycobacterium
LESRGPISLVEFNARRPFHPQ

SEQ ID NO: 689684 - protein, 20 aa, Mycobacterium
LESRIGRWMGSWVGGGYALP

SEQ ID NO: 689685 - protein, 31 aa, Mycobacterium
LESRKLVGIKVGREWRLPRWQFAPDNTTGTL

SEQ ID NO: 689686 - protein, 20 aa, Mycobacterium
LESRLDNVVYRAGLARTRRM

SEQ ID NO: 689687 - protein, 21 aa, Mycobacterium
LESRPEDRRAFVEEAAGVLKH

SEQ ID NO: 689688 - protein, 18 aa, Mycobacterium
LESRPLVRNGRRIELDSA

SEQ ID NO: 689689 - protein, 17 aa, Mycobacterium
LESRVSLTVAHTDHRGH

SEQ ID NO: 689690 - protein, 19 aa, Mycobacterium
LESTMRFILSAKSAYVDGQ

SEQ ID NO: 689691 - protein, 26 aa, Mycobacterium
LESVSSSPDFLGWIDPTAAAASPHTG

SEQ ID NO: 689692 - protein, 18 aa, Mycobacterium
LESYGAGCVYVVDSGGAM

SEQ ID NO: 689693 - protein, 19 aa, Mycobacterium
LESYLPKLAVTHGKAMGTG

SEQ ID NO: 689694 - protein, 22 aa, Mycobacterium
LESYRRYGLEVAPHLERVGATV

SEQ ID NO: 689695 - protein, 25 aa, Mycobacterium
LETAELPVDCLLVFGQEGPGVTDAS

SEQ ID NO: 689696 - protein, 26 aa, Mycobacterium
LETAPKLGAGLDWKTSLQELTAEKGW

SEQ ID NO: 689697 - protein, 17 aa, Mycobacterium
LETARSFFPNVVTTHTW

SEQ ID NO: 689698 - protein, 17 aa, Mycobacterium
LETAVIWQVYLASPPAD

SEQ ID NO: 689699 - protein, 34 aa, Mycobacterium
LETDAPLVITMIWLHAAMPRVFRGRSVFSPYLVP

SEQ ID NO: 689700 - protein, 17 aa, Mycobacterium
LETEGHRILKLNIGNPA

SEQ ID NO: 689701 - protein, 17 aa, Mycobacterium
LETELTEQLSYIWEWGG

SEQ ID NO: 689702 - protein, 25 aa, Mycobacterium
LETEQLFGWVAFEFGTYRFGLQEHL

SEQ ID NO: 689703 - protein, 25 aa, Mycobacterium
LETGRARVAGYLPDFEAQAVTWEAG

SEQ ID NO: 689704 - protein, 17 aa, Mycobacterium
LETGRCRVAGYLPDFEA

SEQ ID NO: 689705 - protein, 17 aa, Mycobacterium
LETGRRARRGRGALAAL

SEQ ID NO: 689706 - protein, 18 aa, Mycobacterium
LETGWAMEELAGYQQHVD

SEQ ID NO: 689707 - protein, 23 aa, Mycobacterium
LETHLGWIAKTGWNIEGEPEWAA

SEQ ID NO: 689708 - protein, 23 aa, Mycobacterium
LETHLGWVAKAGWNIDVAAGVPD

SEQ ID NO: 689709 - protein, 25 aa, Mycobacterium
LETHLGWVAKAGWNIRLASDGADGS

SEQ ID NO: 689710 - protein, 23 aa, Mycobacterium
LETHLGWVAKSGWNIDVANGVPE

SEQ ID NO: 689711 - protein, 24 aa, Mycobacterium
LETHPERWELIYGSAAVLPAESRD

SEQ ID NO: 689712 - protein, 21 aa, Mycobacterium
LETIVSLTYFTPAVNQIELHP

SEQ ID NO: 689713 - protein, 19 aa, Mycobacterium
LETLAAHWGVTQERPHDAF

SEQ ID NO: 689714 - protein, 19 aa, Mycobacterium
LETLAAHWSVTQERPHDAF

SEQ ID NO: 689715 - protein, 17 aa, Mycobacterium
LETLGPALLKFAPGLAA

SEQ ID NO: 689716 - protein, 21 aa, Mycobacterium
LETLIDFSYLIAVQDIKTDSV

SEQ ID NO: 689717 - protein, 21 aa, Mycobacterium
LETLIDFSYLIAVRDIKIDLV

SEQ ID NO: 689718 - protein, 22 aa, Mycobacterium
LETLVDFVYLIAVRDISQDMDR

SEQ ID NO: 689719 - protein, 21 aa, Mycobacterium
LETMASAGILVRVKMPKRRTG

SEQ ID NO: 689720 - protein, 26 aa, Mycobacterium
LETPLPWPPPFWKSAADQGLTSVHLA

SEQ ID NO: 689721 - protein, 17 aa, Mycobacterium
LETRLVPERGYHLELIT

SEQ ID NO: 689722 - protein, 33 aa, Mycobacterium
LETRVALHAIRERWPRFTVDTEGLRRVTMSNVA

SEQ ID NO: 689723 - protein, 31 aa, Mycobacterium
LETTATRAGDSWILNGFKWFASNCAGEAFVV

SEQ ID NO: 689724 - protein, 21 aa, Mycobacterium
LETTPEHWDTIIGVNVRGVIN

SEQ ID NO: 689725 - protein, 22 aa, Mycobacterium
LETVCLPRDAFFGRVETVPTGR

SEQ ID NO: 689726 - protein, 18 aa, Mycobacterium
LETVHGFDLVIDGSGADA

SEQ ID NO: 689727 - protein, 19 aa, Mycobacterium
LETVHGFDLVIDGSGADAL

SEQ ID NO: 689728 - protein, 19 aa, Mycobacterium
LETVMGRPEVRPMSEDCLG

SEQ ID NO: 689729 - protein, 18 aa, Mycobacterium
LETVPICVGYRIDGEHTN

SEQ ID NO: 689730 - protein, 21 aa, Mycobacterium
LETVQSIGLANHRLIAQLDAE

SEQ ID NO: 689731 - protein, 19 aa, Mycobacterium
LETYGALFDRLKDGKISQR

SEQ ID NO: 689732 - protein, 23 aa, Mycobacterium
LETYRRGRKFVHIDIEPTQIGRV

SEQ ID NO: 689733 - protein, 23 aa, Mycobacterium
LEVAAGIAGLIKTILCLKHQAIP

SEQ ID NO: 689734 - protein, 35 aa, Mycobacterium
LEVAAGIAGLIKTILCLKNRAIPATLHYTSPNPEL

SEQ ID NO: 689735 - protein, 18 aa, Mycobacterium
LEVACHRVAVGRVRDTKA

SEQ ID NO: 689736 - protein, 17 aa, Mycobacterium
LEVADLLFSPGPRCSVR

SEQ ID NO: 689737 - protein, 22 aa, Mycobacterium
LEVADMGPVLAVHVGGGAVGVA

SEQ ID NO: 689738 - protein, 19 aa, Mycobacterium
LEVAEQLFATPQEGRSLGV

SEQ ID NO: 689739 - protein, 18 aa, Mycobacterium
LEVAHYVDHVIAFLDTIG

SEQ ID NO: 689740 - protein, 19 aa, Mycobacterium
LEVAIRCMIEEPFAGFTGD

SEQ ID NO: 689741 - protein, 18 aa, Mycobacterium
LEVAIRCMIEEPFSGFHG

SEQ ID NO: 689742 - protein, 18 aa, Mycobacterium
LEVAIRCMVEEPFSGFKG

SEQ ID NO: 689743 - protein, 23 aa, Mycobacterium
LEVALDQCWDLLRQRRALRETGQ

SEQ ID NO: 689744 - protein, 26 aa, Mycobacterium
LEVASQLRAGTVWINNWHQIDPALPF

SEQ ID NO: 689745 - protein, 17 aa, Mycobacterium
LEVDEILFATGRKPLTD

SEQ ID NO: 689746 - protein, 20 aa, Mycobacterium
LEVDEVLFATGRAPRTDDIG

SEQ ID NO: 689747 - protein, 17 aa, Mycobacterium
LEVDGGLTFPNLDIPVP

SEQ ID NO: 689748 - protein, 18 aa, Mycobacterium
LEVEIPRDRGYGHGKLIE

SEQ ID NO: 689749 - protein, 23 aa, Mycobacterium
LEVEPFEAMIVFVRTKQATEEVA

SEQ ID NO: 689750 - protein, 17 aa, Mycobacterium
LEVFTKTRLTTEQFAAY

SEQ ID NO: 689751 - protein, 17 aa, Mycobacterium
LEVGCRLIDTAAAYGNE

SEQ ID NO: 689752 - protein, 18 aa, Mycobacterium
LEVGLARPFAESTYDSVV

SEQ ID NO: 689753 - protein, 17 aa, Mycobacterium
LEVGLLIYNAGANTCRE

SEQ ID NO: 689754 - protein, 17 aa, Mycobacterium
LEVGLLIYNAGANTCRQ

SEQ ID NO: 689755 - protein, 19 aa, Mycobacterium
LEVGLPQPIVDIFATHHLA

SEQ ID NO: 689756 - protein, 19 aa, Mycobacterium
LEVHGQYVAAAWSLDVSPL

SEQ ID NO: 689757 - protein, 20 aa, Mycobacterium
LEVIRLCKAAGFSLDEIAVL

SEQ ID NO: 689758 - protein, 24 aa, Mycobacterium
LEVKAICVSPTFVAAVASLAPAAT

SEQ ID NO: 689759 - protein, 21 aa, Mycobacterium
LEVLEALGFTREDDMFGRRKW

SEQ ID NO: 689760 - protein, 17 aa, Mycobacterium
LEVLGPLTDPRAHGGDP

SEQ ID NO: 689761 - protein, 19 aa, Mycobacterium
LEVLKDFDTLLVMSVEPGF

SEQ ID NO: 689762 - protein, 17 aa, Mycobacterium
LEVLRLGGLETGTVPSP

SEQ ID NO: 689763 - protein, 19 aa, Mycobacterium
LEVLRLLATRLSRRDIGQR

SEQ ID NO: 689764 - protein, 20 aa, Mycobacterium
LEVLRPLVRDALARGDLRAD

SEQ ID NO: 689765 - protein, 17 aa, Mycobacterium
LEVLRVGAPEFTASAAD

SEQ ID NO: 689766 - protein, 18 aa, Mycobacterium
LEVMALLVMQAEWLAKRG

SEQ ID NO: 689767 - protein, 18 aa, Mycobacterium
LEVNLAVEIFLRRVQSPK

SEQ ID NO: 689768 - protein, 21 aa, Mycobacterium
LEVPGDLPSAVYAVKLTTDEG

SEQ ID NO: 689769 - protein, 17 aa, Mycobacterium
LEVPGNIYTRLGNPTTD

SEQ ID NO: 689770 - protein, 17 aa, Mycobacterium
LEVPICGVLAGRVDVSL

SEQ ID NO: 689771 - protein, 17 aa, Mycobacterium
LEVPIWADAPDDVCFTW

SEQ ID NO: 689772 - protein, 18 aa, Mycobacterium
LEVPRDARRADALSALAG

SEQ ID NO: 689773 - protein, 24 aa, Mycobacterium
LEVPVDTFAGFIFLNPDPNAQPLR

SEQ ID NO: 689774 - protein, 19 aa, Mycobacterium
LEVQEMLLLDAHTTLTTQV

SEQ ID NO: 689775 - protein, 17 aa, Mycobacterium
LEVRFDGHAALLSDLNS

SEQ ID NO: 689776 - protein, 20 aa, Mycobacterium
LEVRGPAAYRGFDVDLRDVG

SEQ ID NO: 689777 - protein, 19 aa, Mycobacterium
LEVRIADAIGNVMTNLQLE

SEQ ID NO: 689778 - protein, 40 aa, Mycobacterium
LEVRIYRTGGELHLDWWYDIRRLGPTDVESFSRQYSAAVL

SEQ ID NO: 689779 - protein, 17 aa, Mycobacterium
LEVRLQAWALILEAVAG

SEQ ID NO: 689780 - protein, 17 aa, Mycobacterium
LEVSDRISVVMSVPAER

SEQ ID NO: 689781 - protein, 21 aa, Mycobacterium
LEVSFGTGWLLTRYANNFDTY

SEQ ID NO: 689782 - protein, 22 aa, Mycobacterium
LEVSRQLATLSIFASSGGKTAE

SEQ ID NO: 689783 - protein, 22 aa, Mycobacterium
LEVSVLTEWLRAVPEAPAAARV

SEQ ID NO: 689784 - protein, 21 aa, Mycobacterium
LEVTARLAAPLLPSATEIVWR

SEQ ID NO: 689785 - protein, 21 aa, Mycobacterium
LEVTARLAAPLLPSVTEVVWR

SEQ ID NO: 689786 - protein, 30 aa, Mycobacterium
LEVTEGVGFDKGFLSAYFVTDFDSQEAVLE

SEQ ID NO: 689787 - protein, 23 aa, Mycobacterium
LEVTMPREMLLRVSDLAHLLRLP

SEQ ID NO: 689788 - protein, 21 aa, Mycobacterium
LEVTTRLAAPLLPLITEVIWR

SEQ ID NO: 689789 - protein, 18 aa, Mycobacterium
LEVVADVRPELVSFTFGV

SEQ ID NO: 689790 - protein, 17 aa, Mycobacterium
LEVVEAFLAASRGGDIA

SEQ ID NO: 689791 - protein, 25 aa, Mycobacterium
LEVVPLYKERYVLLVSGDQLAPGTR

SEQ ID NO: 689792 - protein, 19 aa, Mycobacterium
LEVYAGPALAIGDDVEALY

SEQ ID NO: 689793 - protein, 19 aa, Mycobacterium
LEVYPHAASVALFRLGRTL

SEQ ID NO: 689794 - protein, 23 aa, Mycobacterium
LEVYRARFTPSAFAAEPRTFLTV

SEQ ID NO: 689795 - protein, 23 aa, Mycobacterium
LEWREIDGAATLYTFTIARRPTG

SEQ ID NO: 689796 - protein, 21 aa, Mycobacterium
LEWVILRLGGVISVDPEAMPF

SEQ ID NO: 689797 - protein, 25 aa, Mycobacterium
LEWYGSPPGALAFRVKGGGLTCALN

SEQ ID NO: 689798 - protein, 17 aa, Mycobacterium
LEYALAHDERFGIWGGL

SEQ ID NO: 689799 - protein, 25 aa, Mycobacterium
LEYDPGLAAAHWGIAYSVGPNYNKA

SEQ ID NO: 689800 - protein, 17 aa, Mycobacterium
LEYFAASGYEGDPFLLQ

SEQ ID NO: 689801 - protein, 25 aa, Mycobacterium
LEYHGRADLAWGFVDSYVRASGDDG

SEQ ID NO: 689802 - protein, 26 aa, Mycobacterium
LEYITRSGFDYTWFVLNAKIIEKEFA

SEQ ID NO: 689803 - protein, 24 aa, Mycobacterium
LEYLEMFYNLGIAGRAMRRIGAIE

SEQ ID NO: 689804 - protein, 23 aa, Mycobacterium
LEYLLLRPLDMELFDTGSESKWR

SEQ ID NO: 689805 - protein, 18 aa, Mycobacterium
LEYLRLEVGDAVKPETLQ

SEQ ID NO: 689806 - protein, 18 aa, Mycobacterium
LEYLSRVVFTRQGPEGAQ

SEQ ID NO: 689807 - protein, 18 aa, Mycobacterium
LEYPVWMWHWARPGDPAV

SEQ ID NO: 689808 - protein, 21 aa, Mycobacterium
LEYRDWLEGELEKFDGPVDLV

SEQ ID NO: 689809 - protein, 18 aa, Mycobacterium
LEYRSGAGTVSWTTCHDA

SEQ ID NO: 689810 - protein, 23 aa, Mycobacterium
LEYWSDRVHRLLSACVRDRDLVN

SEQ ID NO: 689811 - protein, 20 aa, Mycobacterium
LFAAAGRYILDRAIFDALKR

SEQ ID NO: 689812 - protein, 17 aa, Mycobacterium
LFAAIVVLMQWGDKHLP

SEQ ID NO: 689813 - protein, 18 aa, Mycobacterium
LFAALDWLSERLAGQRYL

SEQ ID NO: 689814 - protein, 18 aa, Mycobacterium
LFAALDWVSDRLGRQRYL

SEQ ID NO: 689815 - protein, 18 aa, Mycobacterium
LFAAPGWTASAGAIEMLP

SEQ ID NO: 689816 - protein, 19 aa, Mycobacterium
LFAAWRNDPSFVLNQPPFD

SEQ ID NO: 689817 - protein, 18 aa, Mycobacterium
LFADACAVIPGGVNSPVR

SEQ ID NO: 689818 - protein, 17 aa, Mycobacterium
LFAEIGPFFADRNGGYT

SEQ ID NO: 689819 - protein, 18 aa, Mycobacterium
LFAEPAPQLLLLDEPTNN

SEQ ID NO: 689820 - protein, 18 aa, Mycobacterium
LFAERCITGLAANVEHLR

SEQ ID NO: 689821 - protein, 17 aa, Mycobacterium
LFAERGFEAVTTEDIAA

SEQ ID NO: 689822 - protein, 18 aa, Mycobacterium
LFAESLWLELREHGVDVL

SEQ ID NO: 689823 - protein, 18 aa, Mycobacterium
LFAEYGRQYQALAGQVAA

SEQ ID NO: 689824 - protein, 23 aa, Mycobacterium
LFAGEVLGIAGLMGSGRTEVLRA

SEQ ID NO: 689825 - protein, 17 aa, Mycobacterium
LFAGILAQVPFVDPLTT

SEQ ID NO: 689826 - protein, 18 aa, Mycobacterium
LFAGYGQAYQSISLQANA

SEQ ID NO: 689827 - protein, 24 aa, Mycobacterium
LFAHRCPPESVAHAYEPAPQDFSE

SEQ ID NO: 689828 - protein, 19 aa, Mycobacterium
LFAKTLKWASTTPLDDGMV

SEQ ID NO: 689829 - protein, 21 aa, Mycobacterium
LFALCALLRHEPDVWTDVGWV

SEQ ID NO: 689830 - protein, 17 aa, Mycobacterium
LFALHGFTSVTTTSLSE

SEQ ID NO: 689831 - protein, 25 aa, Mycobacterium
LFALMCGDLSAPVTFAVERTGWAPT

SEQ ID NO: 689832 - protein, 25 aa, Mycobacterium
LFALRPDWLTPSAFESLVLLSEKIL

SEQ ID NO: 689833 - protein, 17 aa, Mycobacterium
LFALSARGLLDMAMAVV

SEQ ID NO: 689834 - protein, 19 aa, Mycobacterium
LFAQLPFYDVVDTDDSVVV

SEQ ID NO: 689835 - protein, 18 aa, Mycobacterium
LFAQRCIAGLTANAEHLR

SEQ ID NO: 689836 - protein, 18 aa, Mycobacterium
LFAQRCITGLTANVEHLR

SEQ ID NO: 689837 - protein, 25 aa, Mycobacterium
LFARKGFADPVARMASAITELLAKG

SEQ ID NO: 689838 - protein, 20 aa, Mycobacterium
LFARRLPEGRRYGVVCGTGR

SEQ ID NO: 689839 - protein, 19 aa, Mycobacterium
LFARTCAEVALKRDMFAGI

SEQ ID NO: 689840 - protein, 17 aa, Mycobacterium
LFASARAAVPVTPLNYR

SEQ ID NO: 689841 - protein, 19 aa, Mycobacterium
LFASCRGQEAAQVGAVACL

SEQ ID NO: 689842 - protein, 24 aa, Mycobacterium
LFASDIPPLSWFLGNSPPPFLNLL

SEQ ID NO: 689843 - protein, 19 aa, Mycobacterium
LFASWRSDPSFILNLSPFD

SEQ ID NO: 689844 - protein, 19 aa, Mycobacterium
LFAVLAYGEVAAFYRLTDE

SEQ ID NO: 689845 - protein, 28 aa, Mycobacterium
LFCAVLAFSRWRFVAFATDQKASTTLAL

SEQ ID NO: 689846 - protein, 18 aa, Mycobacterium
LFCDPEAHGAVTADAICK

SEQ ID NO: 689847 - protein, 20 aa, Mycobacterium
LFCVHPAGGVSWPYQVLGNH

SEQ ID NO: 689848 - protein, 25 aa, Mycobacterium
LFDALLPRYIATRVYAALLEAAASE

SEQ ID NO: 689849 - protein, 31 aa, Mycobacterium
LFDARLKRPVPFLPARIGLITGRASAAEHDV

SEQ ID NO: 689850 - protein, 25 aa, Mycobacterium
LFDCCSLHAGQACILHSRLLLPDSL

SEQ ID NO: 689851 - protein, 17 aa, Mycobacterium
LFDEEIASVHILRPTPN

SEQ ID NO: 689852 - protein, 27 aa, Mycobacterium
LFDELLIELDIHFRIEDDLYYPALSAA

SEQ ID NO: 689853 - protein, 24 aa, Mycobacterium
LFDGTDTVMLVWLGQRRIPGIESG

SEQ ID NO: 689854 - protein, 20 aa, Mycobacterium
LFDNELIPIAGLTHDEIIRP

SEQ ID NO: 689855 - protein, 25 aa, Mycobacterium
LFDPAFASPRFECHFNVEVGKTITH

SEQ ID NO: 689856 - protein, 21 aa, Mycobacterium
LFDPRERPLCDARYWVDNLRN

SEQ ID NO: 689857 - protein, 18 aa, Mycobacterium
LFDSFSVRMREAMLALLA

SEQ ID NO: 689858 - protein, 21 aa, Mycobacterium
LFDSLRIGIELTPEQVWTQFH

SEQ ID NO: 689859 - protein, 18 aa, Mycobacterium
LFDTALIVNQAFLAPARI

SEQ ID NO: 689860 - protein, 17 aa, Mycobacterium
LFDTLLVFQNFPSLGLA

SEQ ID NO: 689861 - protein, 18 aa, Mycobacterium
LFDVPGLARHARGLKTTA

SEQ ID NO: 689862 - protein, 18 aa, Mycobacterium
LFDVVDRYGLPVLAPPIP

SEQ ID NO: 689863 - protein, 18 aa, Mycobacterium
LFDYRDYRSAFERRCTEL

SEQ ID NO: 689864 - protein, 20 aa, Mycobacterium
LFEEVWSWGTKVLKLDVQAN

SEQ ID NO: 689865 - protein, 18 aa, Mycobacterium
LFEFADDLLFGLSEESID

SEQ ID NO: 689866 - protein, 23 aa, Mycobacterium
LFEGGWAWVIPFDNYLGSTSRLC

SEQ ID NO: 689867 - protein, 20 aa, Mycobacterium
LFEHIDMIEAFRLGDPAPVF

SEQ ID NO: 689868 - protein, 18 aa, Mycobacterium
LFEPPPGAGRGFARELHK

SEQ ID NO: 689869 - protein, 17 aa, Mycobacterium
LFERGGFDVRAPEDDDP

SEQ ID NO: 689870 - protein, 28 aa, Mycobacterium
LFERHALAYREAYAQARAFHERFVQALA

SEQ ID NO: 689871 - protein, 27 aa, Mycobacterium
LFERVAGHERFRFYLNVEIGEHLSHDD

SEQ ID NO: 689872 - protein, 20 aa, Mycobacterium
LFEVDYLDHFVFVLTEGVDG

SEQ ID NO: 689873 - protein, 22 aa, Mycobacterium
LFEVPRRTTFVAISREVARLLS

SEQ ID NO: 689874 - protein, 17 aa, Mycobacterium
LFFDAPMSYLHVPVNAL

SEQ ID NO: 689875 - protein, 23 aa, Mycobacterium
LFFDNRIAWVASIHEDVDGERHV

SEQ ID NO: 689876 - protein, 20 aa, Mycobacterium
LFFEGGPDFEYFKAPAKTAS

SEQ ID NO: 689877 - protein, 18 aa, Mycobacterium
LFFFRRWAGDEHRDLSTV

SEQ ID NO: 689878 - protein, 24 aa, Mycobacterium
LFFHRLGPVQARRLLLTGDIIRAA

SEQ ID NO: 689879 - protein, 25 aa, Mycobacterium
LFFNTLLCVAFEWGVGLQHLELGKI

SEQ ID NO: 689880 - protein, 24 aa, Mycobacterium
LFFVCGRPEPAWEVLAKTRDAVGS

SEQ ID NO: 689881 - protein, 24 aa, Mycobacterium
LFGAGKMFLPQVVKSARVMKKAVA

SEQ ID NO: 689882 - protein, 18 aa, Mycobacterium
LFGALPAINPGVVETGPH

SEQ ID NO: 689883 - protein, 18 aa, Mycobacterium
LFGALVCQVPLLDMRRYH

SEQ ID NO: 689884 - protein, 17 aa, Mycobacterium
LFGALVCSVPLLDMKRF

SEQ ID NO: 689885 - protein, 19 aa, Mycobacterium
LFGAYGREYQAIVNLLKAF

SEQ ID NO: 689886 - protein, 17 aa, Mycobacterium
LFGCRDVSVDDSFFGLG

SEQ ID NO: 689887 - protein, 30 aa, Mycobacterium
LFGDRIEREAAWKIARRGMVRSFQTPVGFP

SEQ ID NO: 689888 - protein, 17 aa, Mycobacterium
LFGEGLHPNADRITHHL

SEQ ID NO: 689889 - protein, 18 aa, Mycobacterium
LFGELQRRGADTFEVTEE

SEQ ID NO: 689890 - protein, 27 aa, Mycobacterium
LFGEPSLTEPWGWQMHGHHCVLNCQIV

SEQ ID NO: 689891 - protein, 19 aa, Mycobacterium
LFGGELVMTTGLTVGLSHA

SEQ ID NO: 689892 - protein, 17 aa, Mycobacterium
LFGGTPPAYPGWPDYSA

SEQ ID NO: 689893 - protein, 17 aa, Mycobacterium
LFGGWTGVDLARLDPDE

SEQ ID NO: 689894 - protein, 32 aa, Mycobacterium
LFGHPSFRYYGWGPRMWWWAQTMGIRKFQEMV

SEQ ID NO: 689895 - protein, 26 aa, Mycobacterium
LFGHSMGAVVAFEFARIAEQRGIAVR

SEQ ID NO: 689896 - protein, 26 aa, Mycobacterium
LFGHSMGAVVAFEFARIAESHDVAVR

SEQ ID NO: 689897 - protein, 20 aa, Mycobacterium
LFGIRLPSPVFMAPIGVIGV

SEQ ID NO: 689898 - protein, 19 aa, Mycobacterium
LFGLGCAAGAAGVGRLHDY

SEQ ID NO: 689899 - protein, 18 aa, Mycobacterium
LFGLGCVAGAAGVARAND

SEQ ID NO: 689900 - protein, 19 aa, Mycobacterium
LFGLLRAGAIPVMCLPGHR

SEQ ID NO: 689901 - protein, 18 aa, Mycobacterium
LFGLSWPLRHRVVPNAAT

SEQ ID NO: 689902 - protein, 19 aa, Mycobacterium
LFGMFSRSHVFPIGQFADG

SEQ ID NO: 689903 - protein, 19 aa, Mycobacterium
LFGMFSRSHVFPIGQFADR

SEQ ID NO: 689904 - protein, 19 aa, Mycobacterium
LFGMFSRSHVFPIRQFADG

SEQ ID NO: 689905 - protein, 22 aa, Mycobacterium
LFGNDWVCLVAREGPDDDWQRW

SEQ ID NO: 689906 - protein, 28 aa, Mycobacterium
LFGNGGNGGVGWAGLDGGNGGSGGLLMG

SEQ ID NO: 689907 - protein, 23 aa, Mycobacterium
LFGPGEARRAGRIIGAWADAYLG

SEQ ID NO: 689908 - protein, 31 aa, Mycobacterium
LFGPGGIGTFSWPGAYGTWWQADPGADLVLI

SEQ ID NO: 689909 - protein, 30 aa, Mycobacterium; identical to SEQ ID NO: 202254

SEQ ID NO: 689910 - protein, 31 aa, Mycobacterium
LFGPGGLGTFSWPGAYGTWWQADPSADVILI

SEQ ID NO: 689911 - protein, 18 aa, Mycobacterium
LFGQCARALLASFKIWRT

SEQ ID NO: 689912 - protein, 17 aa, Mycobacterium
LFGQYRALIGWGQGRTP

SEQ ID NO: 689913 - protein, 30 aa, Mycobacterium
LFGRDGFILSNLIPALSFSWITDEQPNLLV

SEQ ID NO: 689914 - protein, 24 aa, Mycobacterium
LFGRPATAVLIDFADLAVTPVAFD

SEQ ID NO: 689915 - protein, 19 aa, Mycobacterium
LFGSHMWDGSAVPIDENLA

SEQ ID NO: 689916 - protein, 19 aa, Mycobacterium
LFGSHMWDGSAVPIGENLS

SEQ ID NO: 689917 - protein, 17 aa, Mycobacterium
LFGTASEFIGFLDSGAL

SEQ ID NO: 689918 - protein, 21 aa, Mycobacterium
LFGTWHYWWQAHLLDCLIDAQ

SEQ ID NO: 689919 - protein, 21 aa, Mycobacterium
LFGTWHYWWQAHLLDCLLDAQ

SEQ ID NO: 689920 - protein, 24 aa, Mycobacterium
LFGVPGAKIDSVFDALRDSELEVV

SEQ ID NO: 689921 - protein, 25 aa, Mycobacterium
LFHARAKLRRKGCDLLVVNAVGDGR

SEQ ID NO: 689922 - protein, 25 aa, Mycobacterium
LFHATRLTAVVSWSDLLPNMYDGPL

SEQ ID NO: 689923 - protein, 26 aa, Mycobacterium
LFHCWTEARLGTLLDRALPRTELIQL

SEQ ID NO: 689924 - protein, 17 aa, Mycobacterium
LFHGNAIMALWAPALAN

SEQ ID NO: 689925 - protein, 17 aa, Mycobacterium
LFHIISGNLGYQVEHHL

SEQ ID NO: 689926 - protein, 18 aa, Mycobacterium
LFHIRAESLDVCFELADR

SEQ ID NO: 689927 - protein, 19 aa, Mycobacterium
LFHREFLRFGEMLEPVFAA

SEQ ID NO: 689928 - protein, 17 aa, Mycobacterium
LFHRERTGEPCIVDSSL

SEQ ID NO: 689929 - protein, 17 aa, Mycobacterium
LFIAGALGYGRFCAESG

SEQ ID NO: 689930 - protein, 24 aa, Mycobacterium
LFIDVLIRLTARYALQSRTDTATE

SEQ ID NO: 689931 - protein, 24 aa, Mycobacterium
LFIEVSMRLTRRFALSSRTDSATE

SEQ ID NO: 689932 - protein, 26 aa, Mycobacterium
LFIIGRIKDLLIVYGRNHSPDDIEAT

SEQ ID NO: 689933 - protein, 19 aa, Mycobacterium
LFIQGRGALKRELVTCLRT

SEQ ID NO: 689934 - protein, 20 aa, Mycobacterium
LFITGRIKDLLIVDGSNHYP

SEQ ID NO: 689935 - protein, 26 aa, Mycobacterium
LFIVGRIKDLLIIRGRNYYPEDIEAT

SEQ ID NO: 689936 - protein, 23 aa, Mycobacterium
LFKALPGDLSILYPSPAEDKDTL

SEQ ID NO: 689937 - protein, 24 aa, Mycobacterium
LFKEREVAELLGIPPTVTQAALFP

SEQ ID NO: 689938 - protein, 21 aa, Mycobacterium
LFKKYRTALDYAQADRTELEE

SEQ ID NO: 689939 - protein, 17 aa, Mycobacterium
LFKPSEVTPLTWSEVTR

SEQ ID NO: 689940 - protein, 17 aa, Mycobacterium
LFKRWPALAGKKDRRHA

SEQ ID NO: 689941 - protein, 31 aa, Mycobacterium
LFKVDSLWEHARRGGTVGAQGRWQGLHDLQQ

SEQ ID NO: 689942 - protein, 17 aa, Mycobacterium
LFLALLDREFELRGEQI

SEQ ID NO: 689943 - protein, 18 aa, Mycobacterium
LFLDELWPDFTREHLENA

SEQ ID NO: 689944 - protein, 17 aa, Mycobacterium
LFLFHLLEYMDVEYELD

SEQ ID NO: 689945 - protein, 25 aa, Mycobacterium
LFLGRFPLELIHPFPTPTEADETRT

SEQ ID NO: 689946 - protein, 20 aa, Mycobacterium
LFLIHWPLPTLYDGDFVSTW

SEQ ID NO: 689947 - protein, 34 aa, Mycobacterium
LFLIHWPLPTLYGGDFVSTWKVFEEFARDGRARS

SEQ ID NO: 689948 - protein, 27 aa, Mycobacterium
LFLKDGRLHYVYNWLGERIQTISAPEP

SEQ ID NO: 689949 - protein, 17 aa, Mycobacterium
LFLLDEPFRGWTLGAAW

SEQ ID NO: 689950 - protein, 23 aa, Mycobacterium
LFLNEPRPLLAPAEADDFARAQL

SEQ ID NO: 689951 - protein, 24 aa, Mycobacterium
LFLPLRYGQVALREKMPRRFYCHA

SEQ ID NO: 689952 - protein, 25 aa, Mycobacterium
LFLRADHLAHFVSCLVYLPRDRYTT

SEQ ID NO: 689953 - protein, 25 aa, Mycobacterium
LFLRAEFLAERFLRVLSAPAVRRGC

SEQ ID NO: 689954 - protein, 17 aa, Mycobacterium
LFLRAGTVLRAEDGSPL

SEQ ID NO: 689955 - protein, 20 aa, Mycobacterium
LFLRDLVLALQWVRDNIAVF

SEQ ID NO: 689956 - protein, 17 aa, Mycobacterium
LFLRLSVFAGSFDLDAA

SEQ ID NO: 689957 - protein, 18 aa, Mycobacterium
LFLRRIDDQWFRYHQLFR

SEQ ID NO: 689958 - protein, 26 aa, Mycobacterium
LFLRVDRLQFFVSCLVYLPRDRYTTA

SEQ ID NO: 689959 - protein, 26 aa, Mycobacterium
LFLRVDRLQFFVSCLVYVPRDRYTTA

SEQ ID NO: 689960 - protein, 17 aa, Mycobacterium
LFLSLADRIPFALTAWT

SEQ ID NO: 689961 - protein, 18 aa, Mycobacterium
LFLTPTFRGYLANYGAVL

SEQ ID NO: 689962 - protein, 24 aa, Mycobacterium
LFLVPPERIHGLVFAGLRAATTPV

SEQ ID NO: 689963 - protein, 34 aa, Mycobacterium
LFMRRDEVEAAWAWAEPILRHWQDADRVPRTYPA

SEQ ID NO: 689964 - protein, 18 aa, Mycobacterium
LFMTMLHRHCEHVLDTDA

SEQ ID NO: 689965 - protein, 17 aa, Mycobacterium
LFNAHLDNPVVVRKRAE

SEQ ID NO: 689966 - protein, 19 aa, Mycobacterium
LFNALHAKIDFGSLAKTLT

SEQ ID NO: 689967 - protein, 25 aa, Mycobacterium
LFNDMTVHFVLRTRGRLSGGETVLV

SEQ ID NO: 689968 - protein, 23 aa, Mycobacterium
LFNEDFAGLVVSGDDAWDTINEY

SEQ ID NO: 689969 - protein, 23 aa, Mycobacterium
LFNMCLHRGMQVCRAEMGNASNF

SEQ ID NO: 689970 - protein, 17 aa, Mycobacterium
LFNVKVGGARRCAAQSW

SEQ ID NO: 689971 - protein, 19 aa, Mycobacterium
LFPAMPPICRVCQMPAVFP

SEQ ID NO: 689972 - protein, 19 aa, Mycobacterium
LFPDEFAKRAKAFGESVGL

SEQ ID NO: 689973 - protein, 18 aa, Mycobacterium
LFPEVKDMFLTPTVSGLE

SEQ ID NO: 689974 - protein, 19 aa, Mycobacterium
LFPHAKLGIGPPITDGFYY

SEQ ID NO: 689975 - protein, 29 aa, Mycobacterium
LFPHAVRWRGDIYLEDGLHRAVRAALRNR

SEQ ID NO: 689976 - protein, 19 aa, Mycobacterium
LFPLIARSYALQFAQNELV

SEQ ID NO: 689977 - protein, 25 aa, Mycobacterium
LFPMAEDRWGMFLGDVSGKGAGAAA

SEQ ID NO: 689978 - protein, 19 aa, Mycobacterium
LFPQSPLMTLETYRSIGSN

SEQ ID NO: 689979 - protein, 25 aa, Mycobacterium
LFPRVDLSRTVGWFTTKYPVALTPG

SEQ ID NO: 689980 - protein, 17 aa, Mycobacterium
LFPSRRGRPSVPAEVMA

SEQ ID NO: 689981 - protein, 17 aa, Mycobacterium
LFPTADGYLGLFVTHDG

SEQ ID NO: 689982 - protein, 17 aa, Mycobacterium
LFPTLINPVREIQCDAG

SEQ ID NO: 689983 - protein, 25 aa, Mycobacterium
LFPTWLRISSQLARYSTSMKRSARI

SEQ ID NO: 689984 - protein, 24 aa, Mycobacterium
LFPVSVRDGLRWARDTGTLTAAFP

SEQ ID NO: 689985 - protein, 32 aa, Mycobacterium
LFQEFAGLPVRRVWRPTTFYTMLLQQLTDHRT

SEQ ID NO: 689986 - protein, 18 aa, Mycobacterium
LFQGDLRFLIGPNGAGKT

SEQ ID NO: 689987 - protein, 23 aa, Mycobacterium
LFQHPGTEFIYMLEGVMDYSHSR

SEQ ID NO: 689988 - protein, 17 aa, Mycobacterium
LFQMKFYAVALYRTRGV

SEQ ID NO: 689989 - protein, 17 aa, Mycobacterium
LFQPGVLSIAWGTSIRQ

SEQ ID NO: 689990 - protein, 18 aa, Mycobacterium
LFQSHMWDGSAVPIDENL

SEQ ID NO: 689991 - protein, 19 aa, Mycobacterium
LFQSHMWDGSAVPIDENLV

SEQ ID NO: 689992 - protein, 17 aa, Mycobacterium
LFQWLTALYPVWQGIDA

SEQ ID NO: 689993 - protein, 29 aa, Mycobacterium
LFRAQKANLGWGYGVHVCLGMHLARLEMR

SEQ ID NO: 689994 - protein, 26 aa, Mycobacterium
LFREALDLVESFGFTLMGLIPGFADP

SEQ ID NO: 689995 - protein, 18 aa, Mycobacterium
LFREAPLMGIWEGSGNVS

SEQ ID NO: 689996 - protein, 23 aa, Mycobacterium
LFRESYRAFLDRHVAPYHDEWEK

SEQ ID NO: 689997 - protein, 18 aa, Mycobacterium
LFRFPKLKVGIVEAGSKW

SEQ ID NO: 689998 - protein, 18 aa, Mycobacterium
LFRLLLPARFGGLQASFP

SEQ ID NO: 689999 - protein, 22 aa, Mycobacterium
LFRPKDCARTVAFYRDSLGLAI

SEQ ID NO: 690000 - protein, 18 aa, Mycobacterium
LFRRLSFDLISIPTDIVA

SEQ ID NO: 690001 - protein, 19 aa, Mycobacterium
LFRRWRIRLCGVELVEHSL

SEQ ID NO: 690002 - protein, 20 aa, Mycobacterium
LFRSRPATWAAKAIGDRLRV

SEQ ID NO: 690003 - protein, 17 aa, Mycobacterium
LFRSWKLHDELGLNIVM

SEQ ID NO: 690004 - protein, 20 aa, Mycobacterium
LFRTECPDNVVVLDRCGSHQ

SEQ ID NO: 690005 - protein, 18 aa, Mycobacterium
LFRYPGVRSDSDMFTLGY

SEQ ID NO: 690006 - protein, 18 aa, Mycobacterium
LFSAHAKQYQAFSVQAAT

SEQ ID NO: 690007 - protein, 17 aa, Mycobacterium
LFSALELLHACALVHDD

SEQ ID NO: 690008 - protein, 29 aa, Mycobacterium
LFSDSGLDNAFRRRWFGWINPAQTMVAYA

SEQ ID NO: 690009 - protein, 17 aa, Mycobacterium
LFSEPAPHLLLLDEPTN

SEQ ID NO: 690010 - protein, 24 aa, Mycobacterium
LFSGKLMQFPGLKLAFAEAQAGWI

SEQ ID NO: 690011 - protein, 17 aa, Mycobacterium
LFSGPRPAELHPFVELD

SEQ ID NO: 690012 - protein, 26 aa, Mycobacterium
LFSGTCPAWVYFWLGAARIGAVSAAV

SEQ ID NO: 690013 - protein, 19 aa, Mycobacterium
LFSHVPWLSSQLLGAVEAF

SEQ ID NO: 690014 - protein, 19 aa, Mycobacterium
LFSHVPWLSSQLLNAVEAF

SEQ ID NO: 690015 - protein, 19 aa, Mycobacterium
LFSPGYPGFLRGLAAGGPG

SEQ ID NO: 690016 - protein, 31 aa, Mycobacterium
LFSPMSFLRRPACWMQLLATSGRCFSAAPNF

SEQ ID NO: 690017 - protein, 22 aa, Mycobacterium
LFSSRALMDFLRKLLGEAPSRG

SEQ ID NO: 690018 - protein, 17 aa, Mycobacterium
LFTAALARTELIRAVSG

SEQ ID NO: 690019 - protein, 18 aa, Mycobacterium
LFTAFVPFAARWPVEVHI

SEQ ID NO: 690020 - protein, 17 aa, Mycobacterium
LFTAGLVKAVFATETLA

SEQ ID NO: 690021 - protein, 18 aa, Mycobacterium
LFTALDWLEDRLADQRYL

SEQ ID NO: 690022 - protein, 26 aa, Mycobacterium
LFTATCPEWIYFWLGAARIGAVSAAV

SEQ ID NO: 690023 - protein, 26 aa, Mycobacterium
LFTATCPEWVYFWLGAARIGAVSAAI

SEQ ID NO: 690024 - protein, 21 aa, Mycobacterium
LFTDFAPRLLVSHPAEVKVAH

SEQ ID NO: 690025 - protein, 23 aa, Mycobacterium
LFTGDCLFPGGPGRTTRPEDFDS

SEQ ID NO: 690026 - protein, 27 aa, Mycobacterium
LFTGDCLFPGGVGKTWQPGDFTQLVED

SEQ ID NO: 690027 - protein, 18 aa, Mycobacterium
LFTGELIDFRGEYFEVDS

SEQ ID NO: 690028 - protein, 23 aa, Mycobacterium
LFTHLRPLLFTIAYEMLGSATEA

SEQ ID NO: 690029 - protein, 20 aa, Mycobacterium
LFTNWPRPVLATVAGDELQA

SEQ ID NO: 690030 - protein, 28 aa, Mycobacterium
LFTPRFLTRLGVQAVVWDMRLRHRIGAT

SEQ ID NO: 690031 - protein, 24 aa, Mycobacterium
LFTQMAGLAAMWRSVGVAPNATIG

SEQ ID NO: 690032 - protein, 19 aa, Mycobacterium
LFTRDGWMRMGDICEIDPD

SEQ ID NO: 690033 - protein, 17 aa, Mycobacterium
LFTRPGHEYTRQLLDAI

SEQ ID NO: 690034 - protein, 18 aa, Mycobacterium
LFTSTPRTGVWRLHHDGS

SEQ ID NO: 690035 - protein, 27 aa, Mycobacterium
LFTVLPLGELWIAASRLRQVDQVRHSL

SEQ ID NO: 690036 - protein, 20 aa, Mycobacterium
LFTVQAMLPLLNRGASIVLT

SEQ ID NO: 690037 - protein, 26 aa, Mycobacterium
LFTYRPEYRGALQLVPGAQTIALAPL

SEQ ID NO: 690038 - protein, 17 aa, Mycobacterium
LFVAFVGAALDYQSGEL

SEQ ID NO: 690039 - protein, 23 aa, Mycobacterium
LFVAIPGLLAWQIDLHATWSTRL

SEQ ID NO: 690040 - protein, 17 aa, Mycobacterium
LFVDRGFETTSMDDIAE

SEQ ID NO: 690041 - protein, 18 aa, Mycobacterium
LFVDVWARYIGTLMSLTP

SEQ ID NO: 690042 - protein, 17 aa, Mycobacterium
LFVETIRLQGKRGPVPV

SEQ ID NO: 690043 - protein, 17 aa, Mycobacterium
LFVFTSIGRLGHDRDGN

SEQ ID NO: 690044 - protein, 20 aa, Mycobacterium
LFVGECRDGGRLLELDLNGG

SEQ ID NO: 690045 - protein, 20 aa, Mycobacterium
LFVGECREAGRLLELDLNGG

SEQ ID NO: 690046 - protein, 17 aa, Mycobacterium
LFVGIGVAAAAYYTYRS

SEQ ID NO: 690047 - protein, 18 aa, Mycobacterium
LFVHGAWHAAWCWDDHFL

SEQ ID NO: 690048 - protein, 18 aa, Mycobacterium
LFVLDGWLRPAATGVVGE

SEQ ID NO: 690049 - protein, 22 aa, Mycobacterium
LFVPGSTFAPFMASVLAGAVAA

SEQ ID NO: 690050 - protein, 20 aa, Mycobacterium
LFVQCTRPWIMPYGSGNLEY

SEQ ID NO: 690051 - protein, 33 aa, Mycobacterium
LFVQRFRLWGSSDLRRWLPLDIHRPTKSTLVTL

SEQ ID NO: 690052 - protein, 20 aa, Mycobacterium
LFVRGMCGAATPAADGHPSG

SEQ ID NO: 690053 - protein, 24 aa, Mycobacterium
LFVRGMCGAGTPIRDGHPAGVFGW

SEQ ID NO: 690054 - protein, 20 aa, Mycobacterium
LFVRGMCGAGTPVVDGHPAG

SEQ ID NO: 690055 - protein, 24 aa, Mycobacterium
LFVRPEFRRRGLARALLAELAAEC

SEQ ID NO: 690056 - protein, 22 aa, Mycobacterium
LFVRYLRPVRQGSAFAVPKVLR

SEQ ID NO: 690057 - protein, 30 aa, Mycobacterium
LFVSEPIVLPGMVVPIELDDAGRAAVDAAQ

SEQ ID NO: 690058 - protein, 23 aa, Mycobacterium
LFVVYGRIAERLAQQGFTVVRPE

SEQ ID NO: 690059 - protein, 18 aa, Mycobacterium
LFWHGLKGAPAERDAGPS

SEQ ID NO: 690060 - protein, 18 aa, Mycobacterium
LFWIGRYVERADDTARIL

SEQ ID NO: 690061 - protein, 19 aa, Mycobacterium
LFWLEEFHIDGLRVDAVAS

SEQ ID NO: 690062 - protein, 18 aa, Mycobacterium
LFWQEYRADPAEFWFRVD

SEQ ID NO: 690063 - protein, 21 aa, Mycobacterium
LFWQRKYRVLQRLGESRADVR

SEQ ID NO: 690064 - protein, 17 aa, Mycobacterium
LFYGLGGAGGMGGSATA

SEQ ID NO: 690065 - protein, 19 aa, Mycobacterium
LFYPIPGLTLGGLVVDEDT

SEQ ID NO: 690066 - protein, 17 aa, Mycobacterium
LFYPNFMLLIWEPGWYL

SEQ ID NO: 690067 - protein, 25 aa, Mycobacterium
LFYRYSDRNPVHFMLVAEFDDVLDE

SEQ ID NO: 690068 - protein, 26 aa, Mycobacterium
LGAAACARLALEPGLSPADAAGTWSP

SEQ ID NO: 690069 - protein, 23 aa, Mycobacterium
LGAAALRPAPVGAYPAGASAYGA

SEQ ID NO: 690070 - protein, 30 aa, Mycobacterium
LGAACWDAREWLRRPTLRHGASADLVCFTE

SEQ ID NO: 690071 - protein, 29 aa, Mycobacterium
LGAAELRKAWLELHESWLVAKAGEIGVTD

SEQ ID NO: 690072 - protein, 18 aa, Mycobacterium
LGAAEVLAAEGFTVVLLP

SEQ ID NO: 690073 - protein, 17 aa, Mycobacterium
LGAAFHAAGRCTAEADA

SEQ ID NO: 690074 - protein, 20 aa, Mycobacterium
LGAAFMRPNPVLGHQLVQGI

SEQ ID NO: 690075 - protein, 24 aa, Mycobacterium
LGAAFPLKQAWHVNVLGTSRVLRA

SEQ ID NO: 690076 - protein, 17 aa, Mycobacterium
LGAAFVSKWSGDPGAVS

SEQ ID NO: 690077 - protein, 25 aa, Mycobacterium
LGAAHATELPYVWGNLAAGPKDPTF

SEQ ID NO: 690078 - protein, 20 aa, Mycobacterium
LGAAHPVPWESFAADYDTIR

SEQ ID NO: 690079 - protein, 17 aa, Mycobacterium
LGAALAGYGRRVLLVDL

SEQ ID NO: 690080 - protein, 26 aa, Mycobacterium
LGAALAIKFAEAGADVVLAARTQSRL

SEQ ID NO: 690081 - protein, 20 aa, Mycobacterium
LGAALARMEMRVIFDVLLDR

SEQ ID NO: 690082 - protein, 17 aa, Mycobacterium
LGAALNAVNIRWSLAEI

SEQ ID NO: 690083 - protein, 17 aa, Mycobacterium
LGAAMARLAEAESTMIR

SEQ ID NO: 690084 - protein, 26 aa, Mycobacterium
LGAANFKAGPLLAFSGGHLCYQIEHH

SEQ ID NO: 690085 - protein, 22 aa, Mycobacterium
LGAANFKAGRVLAFSSGNLCYQ

SEQ ID NO: 690086 - protein, 25 aa, Mycobacterium
LGAAPARLVGFSMGALIAQELTLTR

SEQ ID NO: 690087 - protein, 26 aa, Mycobacterium
LGAASWRARSWLGRPGLEHGAPADLL

SEQ ID NO: 690088 - protein, 24 aa, Mycobacterium
LGAAWSVLMPARVFAFTAHAATSF

SEQ ID NO: 690089 - protein, 17 aa, Mycobacterium
LGAAYLAGFDWGLRRGY

SEQ ID NO: 690090 - protein, 20 aa, Mycobacterium
LGACSLAVPVIRQTDDAVVA

SEQ ID NO: 690091 - protein, 18 aa, Mycobacterium
LGACSLAVPVTRASDHTV

SEQ ID NO: 690092 - protein, 20 aa, Mycobacterium
LGADFFAFSGHKVYGPTGIG

SEQ ID NO: 690093 - protein, 19 aa, Mycobacterium
LGADFFVFSGHKIYGPTGI

SEQ ID NO: 690094 - protein, 22 aa, Mycobacterium
LGADGKLGAFVEVKNSTIGTGT

SEQ ID NO: 690095 - protein, 19 aa, Mycobacterium
LGADGVVGVRLEWRHQGEG

SEQ ID NO: 690096 - protein, 19 aa, Mycobacterium
LGADLLAVVARLNRLATQR

SEQ ID NO: 690097 - protein, 20 aa, Mycobacterium
LGADLLAVVARLNRLATQRI

SEQ ID NO: 690098 - protein, 20 aa, Mycobacterium
LGADLVFGWDHFHRPEMAEL

SEQ ID NO: 690099 - protein, 25 aa, Mycobacterium
LGADRPGWATGFGRVIDEPDARIVA

SEQ ID NO: 690100 - protein, 29 aa, Mycobacterium
LGADVPPNSGMRWWAQWTPFTYPFNMTQQ

SEQ ID NO: 690101 - protein, 18 aa, Mycobacterium
LGADVWRQTRVTGLVVEE

SEQ ID NO: 690102 - protein, 17 aa, Mycobacterium
LGADWIWLADDDGRPQN

SEQ ID NO: 690103 - protein, 25 aa, Mycobacterium
LGADWPRLVAPVFDAKKAVVFDDRW

SEQ ID NO: 690104 - protein, 25 aa, Mycobacterium
LGADWPRLVAPVFDAKKSVVFDDRW

SEQ ID NO: 690105 - protein, 26 aa, Mycobacterium
LGADWPRLVAPVFEPKKAVLFDDRWA

SEQ ID NO: 690106 - protein, 17 aa, Mycobacterium
LGADWVWLADDDGHPQG

SEQ ID NO: 690107 - protein, 17 aa, Mycobacterium
LGADWVWLADDDGRPGG

SEQ ID NO: 690108 - protein, 18 aa, Mycobacterium
LGADWVWLADDDGRPQDS

SEQ ID NO: 690109 - protein, 23 aa, Mycobacterium
LGAECTIEHGCVVAEAKALHGAD

SEQ ID NO: 690110 - protein, 19 aa, Mycobacterium
LGAEGVWCGSVWLTTEEAE

SEQ ID NO: 690111 - protein, 26 aa, Mycobacterium
LGAEHLRKVVGWSRDRGVVVASDECY

SEQ ID NO: 690112 - protein, 19 aa, Mycobacterium
LGAEIGYPLLVKASAGGGG

SEQ ID NO: 690113 - protein, 26 aa, Mycobacterium
LGAEIKRFGTWESIGDLGWLDDDGYL

SEQ ID NO: 690114 - protein, 20 aa, Mycobacterium
LGAELGAPVIQGSTRTKERE

SEQ ID NO: 690115 - protein, 20 aa, Mycobacterium
LGAELGRGAVIVVNLSGRGD

SEQ ID NO: 690116 - protein, 19 aa, Mycobacterium
LGAELTVPIGDRLGLSAQD

SEQ ID NO: 690117 - protein, 24 aa, Mycobacterium
LGAEMPMRVIGILVGIPESLQRSV

SEQ ID NO: 690118 - protein, 18 aa, Mycobacterium
LGAEPGCAVTIGDMTFDW

SEQ ID NO: 690119 - protein, 17 aa, Mycobacterium
LGAESRSEMLSMLRAAL

SEQ ID NO: 690120 - protein, 21 aa, Mycobacterium
LGAEVRWASCNIFSTQDHAAA

SEQ ID NO: 690121 - protein, 20 aa, Mycobacterium
LGAFAARLWLPMLRAERDPG

SEQ ID NO: 690122 - protein, 17 aa, Mycobacterium
LGAFCSSEPDAGSDVGA

SEQ ID NO: 690123 - protein, 18 aa, Mycobacterium
LGAFEAWLVLRSLGSAGL

SEQ ID NO: 690124 - protein, 21 aa, Mycobacterium
LGAFGCTISYHNRREIEGSGY

SEQ ID NO: 690125 - protein, 18 aa, Mycobacterium
LGAFLAPVEIAILLEEVL

SEQ ID NO: 690126 - protein, 19 aa, Mycobacterium
LGAGAGDLSEDFWRISADS

SEQ ID NO: 690127 - protein, 19 aa, Mycobacterium
LGAGAKAAHLVDWADDIDP

SEQ ID NO: 690128 - protein, 18 aa, Mycobacterium
LGAGAPWFESWVEHTDPK

SEQ ID NO: 690129 - protein, 18 aa, Mycobacterium
LGAGDAFGGSLCHGLLHG

SEQ ID NO: 690130 - protein, 36 aa, Mycobacterium
LGAGEAIDLLKGVLMPAIMSAVKPPVPPVPAAPLAT

SEQ ID NO: 690131 - protein, 17 aa, Mycobacterium
LGAGFLSAWSGDPGAVT

SEQ ID NO: 690132 - protein, 18 aa, Mycobacterium
LGAGIKWAAMLPETSPGD

SEQ ID NO: 690133 - protein, 18 aa, Mycobacterium
LGAGIRWGATLPGTGAGD

SEQ ID NO: 690134 - protein, 18 aa, Mycobacterium
LGAGLAAMFPGLAAVDVS

SEQ ID NO: 690135 - protein, 20 aa, Mycobacterium
LGAGLDWKTSLQELTAARGL

SEQ ID NO: 690136 - protein, 20 aa, Mycobacterium
LGAGLDWKTSLQELTAARSM

SEQ ID NO: 690137 - protein, 27 aa, Mycobacterium
LGAGMHPWGKWGRDFTEYGVAAARTAL

SEQ ID NO: 690138 - protein, 23 aa, Mycobacterium
LGAGSWPAEFARFDVGQQDPRAR

SEQ ID NO: 690139 - protein, 24 aa, Mycobacterium
LGAGWACGVTVVLPPPGTVGAVDC

SEQ ID NO: 690140 - protein, 21 aa, Mycobacterium
LGAGYRPVSVHLPHQALTPAS

SEQ ID NO: 690141 - protein, 19 aa, Mycobacterium
LGAHDLLNEYIRHIGSAIF

SEQ ID NO: 690142 - protein, 26 aa, Mycobacterium
LGAHFARIQIAIAFDELFKRITNLRL

SEQ ID NO: 690143 - protein, 30 aa, Mycobacterium; identical to SEQ ID NO: 99866

SEQ ID NO: 690144 - protein, 17 aa, Mycobacterium
LGAIGTRIVIPEQLGAD

SEQ ID NO: 690145 - protein, 31 aa, Mycobacterium
LGAKLGRLVMRSACAQFGLWRSHGVGKGTVL

SEQ ID NO: 690146 - protein, 25 aa, Mycobacterium
LGAKPAQVALAWLISYPGVVAIPGA

SEQ ID NO: 690147 - protein, 17 aa, Mycobacterium
LGALAAGDARRLAPLLG

SEQ ID NO: 690148 - protein, 17 aa, Mycobacterium
LGALAAGIERLVCGCGS

SEQ ID NO: 690149 - protein, 19 aa, Mycobacterium
LGALAARLWLPLLNAERTG

SEQ ID NO: 690150 - protein, 17 aa, Mycobacterium
LGALDRRQESAFEAAAA

SEQ ID NO: 690151 - protein, 27 aa, Mycobacterium
LGALGFGRGTLYSAINPIAGMGNAGTL

SEQ ID NO: 690152 - protein, 18 aa, Mycobacterium
LGALGLRTASYLAQLGAG

SEQ ID NO: 690153 - protein, 17 aa, Mycobacterium
LGALPGRVAVGGDSAGG

SEQ ID NO: 690154 - protein, 19 aa, Mycobacterium
LGALRAALVGELVDLAADP

SEQ ID NO: 690155 - protein, 24 aa, Mycobacterium
LGALRKAWNLAKHEVAPWWATNSK

SEQ ID NO: 690156 - protein, 17 aa, Mycobacterium
LGALRLRNVSALVEAFA

SEQ ID NO: 690157 - protein, 17 aa, Mycobacterium
LGALSLTAREVFQAPFR

SEQ ID NO: 690158 - protein, 26 aa, Mycobacterium
LGALTPRIVSLDVQYFGVMWPNNSAV

SEQ ID NO: 690159 - protein, 23 aa, Mycobacterium
LGALTRYFAAYNLVCGPVVDEEN

SEQ ID NO: 690160 - protein, 19 aa, Mycobacterium
LGAMAKVPAFTTWQPPPQP

SEQ ID NO: 690161 - protein, 26 aa, Mycobacterium
LGAMLRRLEPDWSITLIERLDAVAAE

SEQ ID NO: 690162 - protein, 17 aa, Mycobacterium
LGAMRLRSLGVELNGTP

SEQ ID NO: 690163 - protein, 20 aa, Mycobacterium
LGAMTAMFIGFRAREIILNV

SEQ ID NO: 690164 - protein, 20 aa, Mycobacterium
LGAMTPMFVGFRAREIILSL

SEQ ID NO: 690165 - protein, 18 aa, Mycobacterium
LGANATVFAAAWGTTVGR

SEQ ID NO: 690166 - protein, 19 aa, Mycobacterium
LGANLARLELRVLFEELLG

SEQ ID NO: 690167 - protein, 19 aa, Mycobacterium
LGANLARLELRVLFEELLS

SEQ ID NO: 690168 - protein, 20 aa, Mycobacterium
LGANLARLELRVLFEELLSR

SEQ ID NO: 690169 - protein, 20 aa, Mycobacterium
LGANLARREITVLFSELHRH

SEQ ID NO: 690170 - protein, 24 aa, Mycobacterium
LGANLPKPLRWIADKTNPGLLHPI

SEQ ID NO: 690171 - protein, 24 aa, Mycobacterium
LGAPADIAAAVGFLCSEEAGFITG

SEQ ID NO: 690172 - protein, 22 aa, Mycobacterium
LGAPCRAVHVGDELAVGALTIR

SEQ ID NO: 690173 - protein, 20 aa, Mycobacterium
LGAPCWIDLTTSDIDRAQDF

SEQ ID NO: 690174 - protein, 21 aa, Mycobacterium
LGAPCWIDLTTSDVARAQDFY

SEQ ID NO: 690175 - protein, 19 aa, Mycobacterium
LGAPESIGAMASMMRPENQ

SEQ ID NO: 690176 - protein, 17 aa, Mycobacterium
LGAPLAQGIPAFGDSIG

SEQ ID NO: 690177 - protein, 28 aa, Mycobacterium
LGAPLARLEARLALSSITARFPGARLMD

SEQ ID NO: 690178 - protein, 20 aa, Mycobacterium
LGAPLARLEGRIALEEVLKR

SEQ ID NO: 690179 - protein, 26 aa, Mycobacterium
LGAPLRDWWQVCEWASRLDDDRVRDT

SEQ ID NO: 690180 - protein, 26 aa, Mycobacterium
LGAPQLDGIQSWLGLQGIDLTTPSGL

SEQ ID NO: 690181 - protein, 17 aa, Mycobacterium
LGAPRFEVASALEQAAL

SEQ ID NO: 690182 - protein, 18 aa, Mycobacterium
LGAPRIAERFTELTREVP

SEQ ID NO: 690183 - protein, 24 aa, Mycobacterium
LGAPSLDIGLSWRQFQQVEEGLVG

SEQ ID NO: 690184 - protein, 20 aa, Mycobacterium
LGAPVPRFSAVSSVEDAVAF

SEQ ID NO: 690185 - protein, 18 aa, Mycobacterium
LGAPVYFCDSRSPWQRGT

SEQ ID NO: 690186 - protein, 27 aa, Mycobacterium
LGAQAARPVMFSTFLMWVLADLFTTLP

SEQ ID NO: 690187 - protein, 23 aa, Mycobacterium
LGAQCNIEHGCVVAEADTLRGAE

SEQ ID NO: 690188 - protein, 19 aa, Mycobacterium
LGAQGVWMGSAFLTSAEYD

SEQ ID NO: 690189 - protein, 21 aa, Mycobacterium
LGAQLARLELRVMLEELYANV

SEQ ID NO: 690190 - protein, 20 aa, Mycobacterium
LGAQLARLELRVMLEELYPC

SEQ ID NO: 690191 - protein, 25 aa, Mycobacterium
LGAQMPMKVISMLLGIPEDDQEYIR

SEQ ID NO: 690192 - protein, 21 aa, Mycobacterium
LGARAGELGALLASDDSRPEV

SEQ ID NO: 690193 - protein, 21 aa, Mycobacterium
LGARFSPAWLTRLVNKGLAGS

SEQ ID NO: 690194 - protein, 26 aa, Mycobacterium
LGARLHARLGALIGEGVLEVRGLGLW

SEQ ID NO: 690195 - protein, 19 aa, Mycobacterium
LGARLPASFDSWDSLVHLA

SEQ ID NO: 690196 - protein, 29 aa, Mycobacterium
LGARPDPFCAMESCWLKHMESAHRDVVDR

SEQ ID NO: 690197 - protein, 17 aa, Mycobacterium
LGARPFARENYVNKFTA

SEQ ID NO: 690198 - protein, 32 aa, Mycobacterium
LGARQRLSIAGALLCSPRALLFDEPLNGLDVP

SEQ ID NO: 690199 - protein, 17 aa, Mycobacterium
LGARSGETGKVYFPPKE

SEQ ID NO: 690200 - protein, 20 aa, Mycobacterium
LGARVMRAAVAAARNMARSG

SEQ ID NO: 690201 - protein, 20 aa, Mycobacterium
LGASAVLISPAWKRAEVDHA

SEQ ID NO: 690202 - protein, 23 aa, Mycobacterium
LGASEAKRAAALRRITVTGDPAS

SEQ ID NO: 690203 - protein, 19 aa, Mycobacterium
LGASGVWMGSAFLTSAEYD

SEQ ID NO: 690204 - protein, 20 aa, Mycobacterium
LGASGVWTGSIWLTAAEYDL

SEQ ID NO: 690205 - protein, 23 aa, Mycobacterium
LGASWRPGCPVEPGQLRRVYVGY

SEQ ID NO: 690206 - protein, 23 aa, Mycobacterium
LGATALRPAPVGAYPAGASAYGA

SEQ ID NO: 690207 - protein, 18 aa, Mycobacterium
LGATFAECEMRIVLGAMF

SEQ ID NO: 690208 - protein, 19 aa, Mycobacterium
LGATFALVEMRVILREILR

SEQ ID NO: 690209 - protein, 18 aa, Mycobacterium
LGATNGWQSLPGIGPKTA

SEQ ID NO: 690210 - protein, 25 aa, Mycobacterium
LGATSDLTAAVWVFPDGDAFDVVMR

SEQ ID NO: 690211 - protein, 19 aa, Mycobacterium
LGAVFAAAGHELYLVGGSV

SEQ ID NO: 690212 - protein, 27 aa, Mycobacterium
LGAVGLCALRCAFLQGAATVFAADRVD

SEQ ID NO: 690213 - protein, 18 aa, Mycobacterium
LGAVHLDKGCYRGQETVA

SEQ ID NO: 690214 - protein, 24 aa, Mycobacterium
LGAVLDRLAAYRARTVDIDGCEYR

SEQ ID NO: 690215 - protein, 22 aa, Mycobacterium
LGAVLERLAAYEARSVDIDGCT

SEQ ID NO: 690216 - protein, 17 aa, Mycobacterium
LGAVNAPTMAVLGRPLI

SEQ ID NO: 690217 - protein, 21 aa, Mycobacterium
LGAVPECPRGPHLGYTNVSFR

SEQ ID NO: 690218 - protein, 18 aa, Mycobacterium
LGAVSSDFVASVRGSIEE

SEQ ID NO: 690219 - protein, 17 aa, Mycobacterium
LGAVTGVMWKRFSETGA

SEQ ID NO: 690220 - protein, 19 aa, Mycobacterium
LGAVVYFPLGTDLTDDDEL

SEQ ID NO: 690221 - protein, 18 aa, Mycobacterium
LGAVYVPLFTAFGADAIA

SEQ ID NO: 690222 - protein, 23 aa, Mycobacterium
LGAWRARVAPFNVNYRYVKSELQ

SEQ ID NO: 690223 - protein, 20 aa, Mycobacterium
LGAYAARLWLPMLRAERKLI

SEQ ID NO: 690224 - protein, 18 aa, Mycobacterium
LGCDLDLVDLAGLAHDIG

SEQ ID NO: 690225 - protein, 17 aa, Mycobacterium
LGCDLDLVELAGLAHDI

SEQ ID NO: 690226 - protein, 23 aa, Mycobacterium
LGCEVKAMYPLGPIFHGSGLNVT

SEQ ID NO: 690227 - protein, 17 aa, Mycobacterium
LGCGEGADALWLAERGW

SEQ ID NO: 690228 - protein, 23 aa, Mycobacterium
LGCKEALFTLGDRPEARWDEARQ

SEQ ID NO: 690229 - protein, 24 aa, Mycobacterium
LGCKEALFTLGDRPEDRWEEARQW

SEQ ID NO: 690230 - protein, 24 aa, Mycobacterium
LGCKEALFTLGDRPEDRWPEAREW

SEQ ID NO: 690231 - protein, 23 aa, Mycobacterium
LGCKEALFTLGDRPEERWPEAGR

SEQ ID NO: 690232 - protein, 23 aa, Mycobacterium
LGCKEALFTLGDRPEERWPEAKQ

SEQ ID NO: 690233 - protein, 22 aa, Mycobacterium
LGCKRPSFHNSYLATYNRRNVS

SEQ ID NO: 690234 - protein, 20 aa, Mycobacterium
LGCRVVRAYLGIWEQPDTAS

SEQ ID NO: 690235 - protein, 20 aa, Mycobacterium
LGCSLVALSDIVYIAPQAYL

SEQ ID NO: 690236 - protein, 19 aa, Mycobacterium
LGCTGDFRGLIDVVSAYSA

SEQ ID NO: 690237 - protein, 18 aa, Mycobacterium
LGDAARYAGDLAFPRLEA

SEQ ID NO: 690238 - protein, 19 aa, Mycobacterium
LGDALGFDVDTPWKKLPAA

SEQ ID NO: 690239 - protein, 19 aa, Mycobacterium
LGDALGFDVDTPWRKLPAK

SEQ ID NO: 690240 - protein, 27 aa, Mycobacterium
LGDAPGKGWRLIQAVVAFPDVESANNF

SEQ ID NO: 690241 - protein, 26 aa, Mycobacterium
LGDCVECPFHGWRWGPDGTNRYIPYQ

SEQ ID NO: 690242 - protein, 27 aa, Mycobacterium
LGDDADKAFVMGLLLIRLYEHRRAAHA

SEQ ID NO: 690243 - protein, 24 aa, Mycobacterium
LGDDENRFSPAFLDDVEAALDQVI

SEQ ID NO: 690244 - protein, 17 aa, Mycobacterium
LGDDIGLIAISDRQREL

SEQ ID NO: 690245 - protein, 26 aa, Mycobacterium
LGDDWPRALTAAGFSHGEPTAWAAEG

SEQ ID NO: 690246 - protein, 24 aa, Mycobacterium
LGDELRTLISVPLFHATGCNSQLL

SEQ ID NO: 690247 - protein, 27 aa, Mycobacterium
LGDEPRYRPSAALQRFVHARDITCRFP

SEQ ID NO: 690248 - protein, 23 aa, Mycobacterium
LGDEVRQPISIIPTGSIALDVAL

SEQ ID NO: 690249 - protein, 24 aa, Mycobacterium
LGDFRCPQRGIGVIGSGHFENYDA

SEQ ID NO: 690250 - protein, 20 aa, Mycobacterium
LGDFRFYLDFYTKQSAGGLE

SEQ ID NO: 690251 - protein, 32 aa, Mycobacterium
LGDGPARAWEHGRFGAPYLRDSLLSAGALCET

SEQ ID NO: 690252 - protein, 23 aa, Mycobacterium
LGDGRQWLSWIGIDDLVDIYHRA

SEQ ID NO: 690253 - protein, 23 aa, Mycobacterium
LGDGRQWLSWIGIDDLVDVYHRA

SEQ ID NO: 690254 - protein, 23 aa, Mycobacterium
LGDGSRFGVSITFAQQPSPDGLA

SEQ ID NO: 690255 - protein, 18 aa, Mycobacterium
LGDGVVRISIGLEGTEDL

SEQ ID NO: 690256 - protein, 22 aa, Mycobacterium
LGDIRECLRIGLQAANGSNAQS

SEQ ID NO: 690257 - protein, 21 aa, Mycobacterium
LGDIRRYGATYMNYVGKPLAY

SEQ ID NO: 690258 - protein, 18 aa, Mycobacterium
LGDKVLKLSAARSAGAHP

SEQ ID NO: 690259 - protein, 18 aa, Mycobacterium
LGDLAIRGLVSSPLLRCR

SEQ ID NO: 690260 - protein, 24 aa, Mycobacterium
LGDLARLGHRVPLVGQAAGVQQKR

SEQ ID NO: 690261 - protein, 18 aa, Mycobacterium
LGDLEVYAGPALAIGDDV

SEQ ID NO: 690262 - protein, 26 aa, Mycobacterium
LGDLFAGKVTEHFGRPVWTISQGPQV

SEQ ID NO: 690263 - protein, 18 aa, Mycobacterium
LGDLPLSLDLTYLAPDIG

SEQ ID NO: 690264 - protein, 23 aa, Mycobacterium
LGDLRQLPGLAVQRLMADGFGFG

SEQ ID NO: 690265 - protein, 21 aa, Mycobacterium
LGDLRSLLTFLADRGAGLDGL

SEQ ID NO: 690266 - protein, 20 aa, Mycobacterium
LGDLYSERALASGMTTEKAD

SEQ ID NO: 690267 - protein, 29 aa, Mycobacterium
LGDNFLPPEVVDWPLNVVVVRSGDRTILV

SEQ ID NO: 690268 - protein, 21 aa, Mycobacterium
LGDPALPHLFFVDGGALAVEN

SEQ ID NO: 690269 - protein, 26 aa, Mycobacterium
LGDPARWFPPPGYPDSLALCIVDAIF

SEQ ID NO: 690270 - protein, 25 aa, Mycobacterium
LGDPHYAYKLDWLAALRDSAEGWLR

SEQ ID NO: 690271 - protein, 26 aa, Mycobacterium
LGDPLLWSIPLHWAGVHAGILANSPD

SEQ ID NO: 690272 - protein, 20 aa, Mycobacterium
LGDPPYYAFRIVLGDLGTSG

SEQ ID NO: 690273 - protein, 25 aa, Mycobacterium
LGDPRLHAAASRCVAIAAERAPAEL

SEQ ID NO: 690274 - protein, 17 aa, Mycobacterium
LGDPRLVERGTALVERS

SEQ ID NO: 690275 - protein, 20 aa, Mycobacterium
LGDPSGFVKLVADGKHGELL

SEQ ID NO: 690276 - protein, 24 aa, Mycobacterium
LGDPVCKPAALAKLVHTREPDVID

SEQ ID NO: 690277 - protein, 17 aa, Mycobacterium
LGDPWVYSSMPMEHLGM

SEQ ID NO: 690278 - protein, 18 aa, Mycobacterium
LGDQARRSVVKALRKLGV

SEQ ID NO: 690279 - protein, 18 aa, Mycobacterium
LGDQILLPGLMDMEVNLL

SEQ ID NO: 690280 - protein, 19 aa, Mycobacterium
LGDQPDVRWRRGSEIAPEL

SEQ ID NO: 690281 - protein, 17 aa, Mycobacterium
LGDRAAELIDELNAELT

SEQ ID NO: 690282 - protein, 24 aa, Mycobacterium
LGDRIATGALWRDFGLPPFERLRV

SEQ ID NO: 690283 - protein, 25 aa, Mycobacterium
LGDRLRLALDSSLCGAVTGAPAALA

SEQ ID NO: 690284 - protein, 20 aa, Mycobacterium
LGDRVAIYAFRSHGRHAVHL

SEQ ID NO: 690285 - protein, 25 aa, Mycobacterium
LGDRVGALGRAWAHDEVRVGDRVCI

SEQ ID NO: 690286 - protein, 27 aa, Mycobacterium
LGDRYLRAAVRAEWPRLVQAIGCGHSG

SEQ ID NO: 690287 - protein, 18 aa, Mycobacterium
LGDSAAWYRPAPDSADTP

SEQ ID NO: 690288 - protein, 18 aa, Mycobacterium
LGDSITFVIHIPLSIDLL

SEQ ID NO: 690289 - protein, 22 aa, Mycobacterium
LGDSWYRIPAFYFACPATVLGP

SEQ ID NO: 690290 - protein, 18 aa, Mycobacterium
LGDTFRWKGENVATTQVE

SEQ ID NO: 690291 - protein, 18 aa, Mycobacterium
LGDVANWISYGASPRASL

SEQ ID NO: 690292 - protein, 20 aa, Mycobacterium
LGDVCGKGLDAAVLTGKIRN

SEQ ID NO: 690293 - protein, 19 aa, Mycobacterium
LGDVCGKGLDAAVMTGKIR

SEQ ID NO: 690294 - protein, 21 aa, Mycobacterium
LGDVCLIWAEQMLRESGVEAR

SEQ ID NO: 690295 - protein, 20 aa, Mycobacterium
LGDVTVPGWVRVSSMLTRRV

SEQ ID NO: 690296 - protein, 17 aa, Mycobacterium
LGDVVLPASIRATSDPE

SEQ ID NO: 690297 - protein, 19 aa, Mycobacterium
LGDYPAAIAEGEWVLDARR

SEQ ID NO: 690298 - protein, 26 aa, Mycobacterium
LGEAAFTRWKALGATFIAARPSTQLH

SEQ ID NO: 690299 - protein, 24 aa, Mycobacterium
LGEAARQGFSIALIPDGDDPRREI

SEQ ID NO: 690300 - protein, 26 aa, Mycobacterium
LGEAEGAFLFCSFVMALADHQQGNHL

SEQ ID NO: 690301 - protein, 19 aa, Mycobacterium
LGEALGFDVDTPWRKLPAK

SEQ ID NO: 690302 - protein, 18 aa, Mycobacterium
LGEALGQSPGRLIVLTVD

SEQ ID NO: 690303 - protein, 25 aa, Mycobacterium
LGEALRYVERIGIDRIAEYEHALLE

SEQ ID NO: 690304 - protein, 22 aa, Mycobacterium
LGEAMSGFAHLTGEADGPPTLP

SEQ ID NO: 690305 - protein, 17 aa, Mycobacterium
LGEAVVDLMGRIYRDFE

SEQ ID NO: 690306 - protein, 20 aa, Mycobacterium
LGEEGRLGLSDGRAVASGFA

SEQ ID NO: 690307 - protein, 19 aa, Mycobacterium
LGEFVAWLRLPLQARHGQV

SEQ ID NO: 690308 - protein, 18 aa, Mycobacterium
LGEFVSWLRLPPAGRAGA

SEQ ID NO: 690309 - protein, 18 aa, Mycobacterium
LGEGAPWFESWVQNADHD

SEQ ID NO: 690310 - protein, 32 aa, Mycobacterium
LGEGPARAWERGRFGAPYLRDSLLAAGALCET

SEQ ID NO: 690311 - protein, 17 aa, Mycobacterium
LGEHLRASLAELPDRDL

SEQ ID NO: 690312 - protein, 24 aa, Mycobacterium
LGEIPRWGTPFAEQLALWEQAVNQ

SEQ ID NO: 690313 - protein, 21 aa, Mycobacterium
LGEIRRVLVPGGRLVVLEHVR

SEQ ID NO: 690314 - protein, 21 aa, Mycobacterium
LGEKFDAVLLVSNLINYPDAQ

SEQ ID NO: 690315 - protein, 18 aa, Mycobacterium
LGELDAWYTERGLPTLLC

SEQ ID NO: 690316 - protein, 20 aa, Mycobacterium
LGELDWRRQLDLGFDLIDAQ

SEQ ID NO: 690317 - protein, 19 aa, Mycobacterium
LGELFAEPVMQTFGEPVWI

SEQ ID NO: 690318 - protein, 22 aa, Mycobacterium
LGELLWSFAPSDRMTRPRPASL

SEQ ID NO: 690319 - protein, 26 aa, Mycobacterium
LGELRGNMFVLRLDAIGFWQRLHHTF

SEQ ID NO: 690320 - protein, 19 aa, Mycobacterium
LGEMCGLAASAMERATQAL

SEQ ID NO: 690321 - protein, 23 aa, Mycobacterium
LGEMCGLAGAAMERATRALLQAD

SEQ ID NO: 690322 - protein, 21 aa, Mycobacterium
LGEMCGLAGVAMERATQALLQ

SEQ ID NO: 690323 - protein, 32 aa, Mycobacterium
LGEPERTRWGLPVDRLRFAMSNYQRLTFQQMT

SEQ ID NO: 690324 - protein, 17 aa, Mycobacterium
LGEPFAVALNGGDAPLV

SEQ ID NO: 690325 - protein, 17 aa, Mycobacterium
LGEPFNWVQHVSIELTA

SEQ ID NO: 690326 - protein, 22 aa, Mycobacterium
LGEPMKAIPAFREPGPRLEVMD

SEQ ID NO: 690327 - protein, 17 aa, Mycobacterium
LGEPVARVVRADEALPF

SEQ ID NO: 690328 - protein, 24 aa, Mycobacterium
LGEQEFASRIGVPADDFATYLQGS

SEQ ID NO: 690329 - protein, 22 aa, Mycobacterium
LGEQFMQWFLKEQVEEVATMTT

SEQ ID NO: 690330 - protein, 21 aa, Mycobacterium
LGEQFMQWFLQEQIEEVALMA

SEQ ID NO: 690331 - protein, 17 aa, Mycobacterium
LGEQLAIVTGLWTTRPG

SEQ ID NO: 690332 - protein, 17 aa, Mycobacterium
LGERAEEFLALKVEGIL

SEQ ID NO: 690333 - protein, 19 aa, Mycobacterium
LGERALIGAGWSDFGGAQL

SEQ ID NO: 690334 - protein, 20 aa, Mycobacterium
LGERGFRVGAVHGDLGQSAR

SEQ ID NO: 690335 - protein, 34 aa, Mycobacterium
LGERRGYLATRWKNVLLDWVVVELMTRFPKAARR

SEQ ID NO: 690336 - protein, 30 aa, Mycobacterium
LGERVSALGRAWAGDAVRPGDRVCVLGFNS

SEQ ID NO: 690337 - protein, 26 aa, Mycobacterium
LGESVAEGTVTRWLKKVGDSVQVDEA

SEQ ID NO: 690338 - protein, 17 aa, Mycobacterium
LGESVARALGRKFVRVA

SEQ ID NO: 690339 - protein, 28 aa, Mycobacterium
LGESVARALGRKFVRVALGGVRDEAEIR

SEQ ID NO: 690340 - protein, 27 aa, Mycobacterium
LGESVARALGRRFVRVALGGVRDEAEI

SEQ ID NO: 690341 - protein, 17 aa, Mycobacterium
LGESWRDGGELLALAAK

SEQ ID NO: 690342 - protein, 24 aa, Mycobacterium
LGETELWQLAFRVVCEHPAALDTD

SEQ ID NO: 690343 - protein, 17 aa, Mycobacterium
LGETGYLASDWKLESEG

SEQ ID NO: 690344 - protein, 23 aa, Mycobacterium
LGETLAGLITRAEVVALGRRAEM

SEQ ID NO: 690345 - protein, 22 aa, Mycobacterium
LGEVETMFAMTIHKSQGSQADE

SEQ ID NO: 690346 - protein, 17 aa, Mycobacterium
LGEVFTAAGAEWRQAGC

SEQ ID NO: 690347 - protein, 33 aa, Mycobacterium
LGEVFTVAGAEWRQAGCSMCLGMNPDQLAPGER

SEQ ID NO: 690348 - protein, 18 aa, Mycobacterium
LGEVLLWRQSNKLVAGEK

SEQ ID NO: 690349 - protein, 19 aa, Mycobacterium
LGEVNPRLSGASPMTNLTT

SEQ ID NO: 690350 - protein, 32 aa, Mycobacterium
LGEVPARAWEHGRFGAPYLRDSLLAAGALCET

SEQ ID NO: 690351 - protein, 19 aa, Mycobacterium
LGEWGIRWIPELGDEDLDP

SEQ ID NO: 690352 - protein, 20 aa, Mycobacterium
LGEYASWLDAERVVVNVYQR

SEQ ID NO: 690353 - protein, 21 aa, Mycobacterium
LGEYGYRAVLVADRADDPVTI

SEQ ID NO: 690354 - protein, 24 aa, Mycobacterium
LGEYPGDFWVYARNKIMVAARIAG

SEQ ID NO: 690355 - protein, 18 aa, Mycobacterium
LGEYRPGLIAAEENHVRH

SEQ ID NO: 690356 - protein, 32 aa, Mycobacterium
LGEYSLDLFALLPLGELWVAAARNRQVDQLQH

SEQ ID NO: 690357 - protein, 23 aa, Mycobacterium
LGFAAVSAYRCAGMGGSYAGVLR

SEQ ID NO: 690358 - protein, 18 aa, Mycobacterium
LGFALPSMLLPMWDSELG

SEQ ID NO: 690359 - protein, 23 aa, Mycobacterium
LGFARLAIQHAYPIVPFASVGAE

SEQ ID NO: 690360 - protein, 24 aa, Mycobacterium
LGFCLGTRLQMTWLDEDSPSALKP

SEQ ID NO: 690361 - protein, 20 aa, Mycobacterium
LGFDGKWVLHPAQIEAGNEI

SEQ ID NO: 690362 - protein, 17 aa, Mycobacterium
LGFDIPRNVFGPGLSIA

SEQ ID NO: 690363 - protein, 22 aa, Mycobacterium
LGFDSGPVLTLWEQSSGEFSAA

SEQ ID NO: 690364 - protein, 25 aa, Mycobacterium
LGFEAADVAARWPVPGPHDDKYTQG

SEQ ID NO: 690365 - protein, 19 aa, Mycobacterium
LGFEAVLTPTGTRWEDAWI

SEQ ID NO: 690366 - protein, 20 aa, Mycobacterium
LGFGCVAAPIGGPGEAVAAV

SEQ ID NO: 690367 - protein, 20 aa, Mycobacterium
LGFGCVAAPIGSPGEAVAAV

SEQ ID NO: 690368 - protein, 26 aa, Mycobacterium
LGFGLARRLAAAGADVVMAIRNRAKG

SEQ ID NO: 690369 - protein, 18 aa, Mycobacterium
LGFGRSALRDRIGVTPAC

SEQ ID NO: 690370 - protein, 17 aa, Mycobacterium
LGFGSLFLPETVAKECL

SEQ ID NO: 690371 - protein, 17 aa, Mycobacterium
LGFGTAFISERWNVKEA

SEQ ID NO: 690372 - protein, 17 aa, Mycobacterium
LGFGTGFISERWNVKEA

SEQ ID NO: 690373 - protein, 24 aa, Mycobacterium
LGFHCGVVSGGFRGIIEPLAEELM

SEQ ID NO: 690374 - protein, 17 aa, Mycobacterium
LGFLEAQGGGTILLANG

SEQ ID NO: 690375 - protein, 17 aa, Mycobacterium
LGFNLFGHAIARAVIHG

SEQ ID NO: 690376 - protein, 30 aa, Mycobacterium
LGFPFTDHGLRLGVEAALRSLARIAPTQRH

SEQ ID NO: 690377 - protein, 17 aa, Mycobacterium
LGFQLGSLWYISLDYIN

SEQ ID NO: 690378 - protein, 22 aa, Mycobacterium
LGFQLGSLWYISLDYINHQTSL

SEQ ID NO: 690379 - protein, 21 aa, Mycobacterium
LGFQLLRPVKGEDRYFVVTHW

SEQ ID NO: 690380 - protein, 21 aa, Mycobacterium
LGFRRSRSVVIVHIFTQTGRT

SEQ ID NO: 690381 - protein, 25 aa, Mycobacterium
LGFSMRKSVDGFSFDGVTARQLELG

SEQ ID NO: 690382 - protein, 19 aa, Mycobacterium
LGFSPELVTAVSPSGVVVT

SEQ ID NO: 690383 - protein, 26 aa, Mycobacterium
LGFSQGATISGLWIRENAGEADAPSP

SEQ ID NO: 690384 - protein, 25 aa, Mycobacterium
LGFSVPERFGGPGVNDFRYNAIVID

SEQ ID NO: 690385 - protein, 20 aa, Mycobacterium
LGFTAVRCRVTLAGDADDAT

SEQ ID NO: 690386 - protein, 17 aa, Mycobacterium
LGFVEAQGGGSVLLARG

SEQ ID NO: 690387 - protein, 17 aa, Mycobacterium
LGFVEAQGGGTILLARG

SEQ ID NO: 690388 - protein, 18 aa, Mycobacterium
LGFVNGFVRRVGGRVEAV

SEQ ID NO: 690389 - protein, 23 aa, Mycobacterium
LGFVTPMPLGVEVRGTRAQGRTA

SEQ ID NO: 690390 - protein, 18 aa, Mycobacterium
LGGAAARHPAYAVMLTAL

SEQ ID NO: 690391 - protein, 20 aa, Mycobacterium
LGGACAKVTTVLAGSSVDPH

SEQ ID NO: 690392 - protein, 21 aa, Mycobacterium
LGGAEALVFAYDGLRERGLRS

SEQ ID NO: 690393 - protein, 23 aa, Mycobacterium
LGGAGGNAGLWGNGGAGGAGGDG

SEQ ID NO: 690394 - protein, 17 aa, Mycobacterium
LGGAGRWRDSGMADTTP

SEQ ID NO: 690395 - protein, 20 aa, Mycobacterium
LGGASVDYWGAIAERHNLQL

SEQ ID NO: 690396 - protein, 17 aa, Mycobacterium
LGGATLWEVEFRGEVTA

SEQ ID NO: 690397 - protein, 18 aa, Mycobacterium
LGGAVFFDEMHTLHEKGY

SEQ ID NO: 690398 - protein, 25 aa, Mycobacterium
LGGCEAYPGVFAPFGGYSDACVVSG

SEQ ID NO: 690399 - protein, 18 aa, Mycobacterium
LGGCLVVRTGQPRIHALG

SEQ ID NO: 690400 - protein, 23 aa, Mycobacterium
LGGDELRTGLMIMTKRLDTGSPW

SEQ ID NO: 690401 - protein, 17 aa, Mycobacterium
LGGDFGGVWYWNRYPGI

SEQ ID NO: 690402 - protein, 25 aa, Mycobacterium
LGGDFGGVWYWNRYPGIQCDNESYC

SEQ ID NO: 690403 - protein, 19 aa, Mycobacterium
LGGDFTFASVVWQIADAHS

SEQ ID NO: 690404 - protein, 22 aa, Mycobacterium
LGGDGGNADWMGNGGAGGSGGA

SEQ ID NO: 690405 - protein, 26 aa, Mycobacterium
LGGDKDFWLQVGIDPIRIMTSSGTFF

SEQ ID NO: 690406 - protein, 18 aa, Mycobacterium
LGGDLGLTLSQQVFGQGY

SEQ ID NO: 690407 - protein, 25 aa, Mycobacterium
LGGDVARLLYTLGWHEVPAPSGDAG

SEQ ID NO: 690408 - protein, 20 aa, Mycobacterium
LGGDVVRLTGTVRFGAPGGD

SEQ ID NO: 690409 - protein, 18 aa, Mycobacterium
LGGEILQRLKRGWRPDQI

SEQ ID NO: 690410 - protein, 25 aa, Mycobacterium
LGGELRQALLMARNRLGPTAITARQ

SEQ ID NO: 690411 - protein, 19 aa, Mycobacterium
LGGELRRFQHYHGKALGAF

SEQ ID NO: 690412 - protein, 32 aa, Mycobacterium
LGGEPARLARLERRIADFLGFSTVLTSVGQVY

SEQ ID NO: 690413 - protein, 22 aa, Mycobacterium
LGGESISAMGLIAAVNTNLNAG

SEQ ID NO: 690414 - protein, 22 aa, Mycobacterium
LGGFAWKVALGLPGSLGAPRPR

SEQ ID NO: 690415 - protein, 35 aa, Mycobacterium
LGGFGTRFLAQPTWRHGVMKLIFMEVPLRAVPGLR

SEQ ID NO: 690416 - protein, 17 aa, Mycobacterium
LGGFVRRIETITADIDD

SEQ ID NO: 690417 - protein, 24 aa, Mycobacterium
LGGGAAAAHLVDWADDIDPAWLEG

SEQ ID NO: 690418 - protein, 25 aa, Mycobacterium
LGGGALRPAPVGAFPASASACGAEQ

SEQ ID NO: 690419 - protein, 23 aa, Mycobacterium
LGGGAYFIHFAWDSSDPDQLSET

SEQ ID NO: 690420 - protein, 19 aa, Mycobacterium
LGGGIWKVNYRTVAERILA

SEQ ID NO: 690421 - protein, 25 aa, Mycobacterium
LGGGLKLAIWAAIPLLTPYVREICG

SEQ ID NO: 690422 - protein, 24 aa, Mycobacterium
LGGGLPIGACLAVGATGDLLTPGL

SEQ ID NO: 690423 - protein, 18 aa, Mycobacterium
LGGGPGMGMPGLGGGIPG

SEQ ID NO: 690424 - protein, 18 aa, Mycobacterium
LGGGVLYSGPVSGLADIE

SEQ ID NO: 690425 - protein, 26 aa, Mycobacterium
LGGHGVYGVELFVRGDEVYFCDVSAR

SEQ ID NO: 690426 - protein, 19 aa, Mycobacterium
LGGIPGQLVVSGWSAGAGI

SEQ ID NO: 690427 - protein, 17 aa, Mycobacterium
LGGIPLAGFFAAGEIGP

SEQ ID NO: 690428 - protein, 18 aa, Mycobacterium
LGGIRAVGYSPELVAAVH

SEQ ID NO: 690429 - protein, 28 aa, Mycobacterium
LGGITHLVPRDSIGWVEAEGDYARLHSA

SEQ ID NO: 690430 - protein, 24 aa, Mycobacterium
LGGKLPAALAERLRITKTEAHRWI

SEQ ID NO: 690431 - protein, 27 aa, Mycobacterium
LGGKPIDGPGWFYPPTVVTDITKDMAL

SEQ ID NO: 690432 - protein, 23 aa, Mycobacterium
LGGLAGLAGRIVDALAELLGTAA

SEQ ID NO: 690433 - protein, 19 aa, Mycobacterium
LGGLCPSTPVSDWLFTDTA

SEQ ID NO: 690434 - protein, 23 aa, Mycobacterium
LGGLDLRTADGFDPLVGLSPFSL

SEQ ID NO: 690435 - protein, 20 aa, Mycobacterium
LGGLECLSGIPGSAGATPVQ

SEQ ID NO: 690436 - protein, 18 aa, Mycobacterium
LGGLIDRFNLRGERLGLV

SEQ ID NO: 690437 - protein, 18 aa, Mycobacterium
LGGLLGRARVKNKIGRRE

SEQ ID NO: 690438 - protein, 23 aa, Mycobacterium
LGGLPRLNSAVVRLMGSDLLTIR

SEQ ID NO: 690439 - protein, 17 aa, Mycobacterium
LGGLRPAFRKDGTITAG

SEQ ID NO: 690440 - protein, 17 aa, Mycobacterium
LGGLRPLLVTDPGLIEA

SEQ ID NO: 690441 - protein, 17 aa, Mycobacterium
LGGMDYLSPERVELRYT

SEQ ID NO: 690442 - protein, 25 aa, Mycobacterium
LGGMPMPRALMWALHEHLLGANPAV

SEQ ID NO: 690443 - protein, 24 aa, Mycobacterium
LGGMPMPRALVWALHEHLLGANPA

SEQ ID NO: 690444 - protein, 18 aa, Mycobacterium
LGGMRFPSSSFSFFHYVD

SEQ ID NO: 690445 - protein, 17 aa, Mycobacterium
LGGNGGLLFGNAGDGGS

SEQ ID NO: 690446 - protein, 19 aa, Mycobacterium
LGGNRPRWLGADIGQRQFY

SEQ ID NO: 690447 - protein, 24 aa, Mycobacterium
LGGPARAVVHVCRHRDGPRPWLVW

SEQ ID NO: 690448 - protein, 18 aa, Mycobacterium
LGGPQRRTLFLLSSTDAY

SEQ ID NO: 690449 - protein, 20 aa, Mycobacterium
LGGQGIFGVELFIKGDQVYF

SEQ ID NO: 690450 - protein, 19 aa, Mycobacterium
LGGQGIFGVELFVKGDDVW

SEQ ID NO: 690451 - protein, 17 aa, Mycobacterium
LGGQWGSAFGTLPTGLD

SEQ ID NO: 690452 - protein, 24 aa, Mycobacterium
LGGRAEFAGPISTVRCFQDNALLK

SEQ ID NO: 690453 - protein, 18 aa, Mycobacterium
LGGRGALNLFSRKANSFT

SEQ ID NO: 690454 - protein, 18 aa, Mycobacterium
LGGRHPRDLIARGEQNML

SEQ ID NO: 690455 - protein, 21 aa, Mycobacterium
LGGRHRFGYTLGVDGGYLTGG

SEQ ID NO: 690456 - protein, 24 aa, Mycobacterium
LGGRLPAALANRLRITRGEAGRRV

SEQ ID NO: 690457 - protein, 17 aa, Mycobacterium
LGGRPVRVPAVAASAAS

SEQ ID NO: 690458 - protein, 23 aa, Mycobacterium
LGGRSMLAHSLHAMTKLAPQHLV

SEQ ID NO: 690459 - protein, 26 aa, Mycobacterium
LGGRWADKFGGLVFDATGITTPEGLK

SEQ ID NO: 690460 - protein, 26 aa, Mycobacterium
LGGRWADQFGGLVFDATGITTPEGLR

SEQ ID NO: 690461 - protein, 24 aa, Mycobacterium
LGGSVKCLHRYPGLAPVLESQTFA

SEQ ID NO: 690462 - protein, 30 aa, Mycobacterium
LGGSVNCIRHLAAICAEADLDLDVVGMFEK

SEQ ID NO: 690463 - protein, 24 aa, Mycobacterium
LGGSWQGAASLAMAGAAAPYAGWL

SEQ ID NO: 690464 - protein, 23 aa, Mycobacterium
LGGTALRPAPVGAYPAGASAYGA

SEQ ID NO: 690465 - protein, 21 aa, Mycobacterium
LGGTVLAKFGEAVPVGKLSVP

SEQ ID NO: 690466 - protein, 25 aa, Mycobacterium
LGGVAMPKSLLWALHEHILGANPAV

SEQ ID NO: 690467 - protein, 17 aa, Mycobacterium
LGGVFVIEVPDLDTALA

SEQ ID NO: 690468 - protein, 18 aa, Mycobacterium
LGGVLGIISGAERVEQAT

SEQ ID NO: 690469 - protein, 18 aa, Mycobacterium
LGGVLYLFVRGMCGPDTP

SEQ ID NO: 690470 - protein, 20 aa, Mycobacterium
LGGVQLSRRGFIGAGIASGL

SEQ ID NO: 690471 - protein, 18 aa, Mycobacterium
LGGWLASWARITDTGACV

SEQ ID NO: 690472 - protein, 17 aa, Mycobacterium
LGGYGIGLVTFFEFLMR

SEQ ID NO: 690473 - protein, 25 aa, Mycobacterium
LGGYPDVVGPFFGRAAAAVKALTEQ

SEQ ID NO: 690474 - protein, 21 aa, Mycobacterium
LGHALSGHAVYRTMLMHLMRI

SEQ ID NO: 690475 - protein, 24 aa, Mycobacterium
LGHARKRLGATVAPKEIEFVDSLP

SEQ ID NO: 690476 - protein, 18 aa, Mycobacterium
LGHDQLRAAHALTAAIPR

SEQ ID NO: 690477 - protein, 18 aa, Mycobacterium
LGHDQLRAAHALTAAVPL

SEQ ID NO: 690478 - protein, 20 aa, Mycobacterium
LGHDQLRAAHALTESVAALR

SEQ ID NO: 690479 - protein, 24 aa, Mycobacterium
LGHFYRGVGLSIYEGYGLTETSAA

SEQ ID NO: 690480 - protein, 18 aa, Mycobacterium
LGHGLSVGAERGRELAEI

SEQ ID NO: 690481 - protein, 17 aa, Mycobacterium
LGHKAVLDVARGQVRAL

SEQ ID NO: 690482 - protein, 19 aa, Mycobacterium
LGHLCIDFHRGIHEAADNR

SEQ ID NO: 690483 - protein, 18 aa, Mycobacterium
LGHLGVQFAAKMGFVTVA

SEQ ID NO: 690484 - protein, 19 aa, Mycobacterium
LGHLLKPGRLREVLAEHAD

SEQ ID NO: 690485 - protein, 22 aa, Mycobacterium
LGHNRWHPDIPPAVTVKKGDSF

SEQ ID NO: 690486 - protein, 18 aa, Mycobacterium
LGHPGLIAPLTFTSAPAM

SEQ ID NO: 690487 - protein, 20 aa, Mycobacterium
LGHPRKGLFLVQSDAVDSVL

SEQ ID NO: 690488 - protein, 23 aa, Mycobacterium
LGHQAGLCALKPKPALSDVADPD

SEQ ID NO: 690489 - protein, 22 aa, Mycobacterium
LGHQAGLCALKPKPTLADVADP

SEQ ID NO: 690490 - protein, 17 aa, Mycobacterium
LGHQLGLPAGIASDGSE

SEQ ID NO: 690491 - protein, 25 aa, Mycobacterium
LGHREIADMITALICHGTLTRFPKL

SEQ ID NO: 690492 - protein, 17 aa, Mycobacterium
LGHRINHQPTRMSGGEQ

SEQ ID NO: 690493 - protein, 25 aa, Mycobacterium
LGHRKGILQFRWQRVSRQLTDVDGP

SEQ ID NO: 690494 - protein, 25 aa, Mycobacterium
LGHRKGYLQFRWQRLSRALTEADGP

SEQ ID NO: 690495 - protein, 20 aa, Mycobacterium
LGHRRAVAWASQRDADVSVQ

SEQ ID NO: 690496 - protein, 20 aa, Mycobacterium
LGHSCIELYTGVRPKGLWSL

SEQ ID NO: 690497 - protein, 24 aa, Mycobacterium
LGHVARFGLLLARTDPDVPKHKGL

SEQ ID NO: 690498 - protein, 17 aa, Mycobacterium
LGHVLLCTQRVARRLVA

SEQ ID NO: 690499 - protein, 24 aa, Mycobacterium
LGIADRLGVEIPRDRGYGHGKIVE

SEQ ID NO: 690500 - protein, 20 aa, Mycobacterium
LGIAQWCFDTTLAYTKQRKQ

SEQ ID NO: 690501 - protein, 20 aa, Mycobacterium
LGIARASLYGTYGSKRGLYL

SEQ ID NO: 690502 - protein, 21 aa, Mycobacterium
LGIAYLRHVLRLEPIASTPLE

SEQ ID NO: 690503 - protein, 29 aa, Mycobacterium
LGICDVVLCALPARYLTPMSDLKPKSLSD

SEQ ID NO: 690504 - protein, 17 aa, Mycobacterium
LGIDGSHSYHHVVATKD

SEQ ID NO: 690505 - protein, 19 aa, Mycobacterium
LGIDSVRFTGGEPLIFKDL

SEQ ID NO: 690506 - protein, 18 aa, Mycobacterium
LGIDWPLVDGAPPTLSDR

SEQ ID NO: 690507 - protein, 23 aa, Mycobacterium
LGIEDRPALSPGSAVLVVTRGPN

SEQ ID NO: 690508 - protein, 17 aa, Mycobacterium
LGIGFGNVVQTRAFLTE

SEQ ID NO: 690509 - protein, 21 aa, Mycobacterium
LGIGMLSVFGLPPVELVNLAA

SEQ ID NO: 690510 - protein, 18 aa, Mycobacterium
LGIGRPSTYSSIIKTIQD

SEQ ID NO: 690511 - protein, 20 aa, Mycobacterium
LGIGRPSTYSSIIKTIQDRG

SEQ ID NO: 690512 - protein, 22 aa, Mycobacterium
LGIGRRTIERWVSAYEAEGEVG

SEQ ID NO: 690513 - protein, 20 aa, Mycobacterium
LGIHPVFKTVDTCAAEFDAK

SEQ ID NO: 690514 - protein, 17 aa, Mycobacterium
LGIHVHPITCSLGVPTR

SEQ ID NO: 690515 - protein, 37 aa, Mycobacterium; identical to SEQ ID NO: 99924

SEQ ID NO: 690516 - protein, 20 aa, Mycobacterium
LGIKPVFLRENWYCPECQEV

SEQ ID NO: 690517 - protein, 18 aa, Mycobacterium
LGILEHFDIASFPVDSAD

SEQ ID NO: 690518 - protein, 18 aa, Mycobacterium
LGILEQFDMASLPVDSAD

SEQ ID NO: 690519 - protein, 26 aa, Mycobacterium
LGILHRLAATVARVGVFRPITRGDGA

SEQ ID NO: 690520 - protein, 17 aa, Mycobacterium
LGILIERAAKLQLAAMA

SEQ ID NO: 690521 - protein, 17 aa, Mycobacterium
LGILIERGYPIVFGVPT

SEQ ID NO: 690522 - protein, 17 aa, Mycobacterium
LGIPCVVAVAGLDDVPA

SEQ ID NO: 690523 - protein, 22 aa, Mycobacterium
LGIPELRAAIAADYERQHGITV

SEQ ID NO: 690524 - protein, 22 aa, Mycobacterium
LGIPELRAAIAADYHRQHGISV

SEQ ID NO: 690525 - protein, 26 aa, Mycobacterium
LGIPGPEGLQFVGRVGTGFTEKELSK

SEQ ID NO: 690526 - protein, 18 aa, Mycobacterium
LGIPTVLYGLGRTRVDDS

SEQ ID NO: 690527 - protein, 25 aa, Mycobacterium
LGIPVGRAVQSWDVLAQFGNMLSVS

SEQ ID NO: 690528 - protein, 17 aa, Mycobacterium
LGIPYTLSLRVAEIEHW

SEQ ID NO: 690529 - protein, 17 aa, Mycobacterium
LGIQFGIRMLRTDANKS

SEQ ID NO: 690530 - protein, 18 aa, Mycobacterium
LGIRARSALTSALLRSSR

SEQ ID NO: 690531 - protein, 31 aa, Mycobacterium
LGIRLKLNPLREVIRGKRLVVVDDSIVRGNT

SEQ ID NO: 690532 - protein, 22 aa, Mycobacterium
LGIRLLDHGHFRSGGDEYADDN

SEQ ID NO: 690533 - protein, 22 aa, Mycobacterium
LGISHTRLWAPAYLPRKTHRSR

SEQ ID NO: 690534 - protein, 24 aa, Mycobacterium
LGISRIGRRTGIPGLELTMEAVRA

SEQ ID NO: 690535 - protein, 19 aa, Mycobacterium
LGITRPTIYRHFGSTDELL

SEQ ID NO: 690536 - protein, 21 aa, Mycobacterium
LGITTDWKSRWYADKQYSDYV

SEQ ID NO: 690537 - protein, 24 aa, Mycobacterium
LGITTEWKSRWYADKQYKDYVKED

SEQ ID NO: 690538 - protein, 19 aa, Mycobacterium
LGIVPLLLLDMWEHAFYLQ

SEQ ID NO: 690539 - protein, 24 aa, Mycobacterium
LGKAAELRYGRIPELEKQLEQALP

SEQ ID NO: 690540 - protein, 22 aa, Mycobacterium
LGKDGGTMPITLWIVDTSAQAP

SEQ ID NO: 690541 - protein, 28 aa, Mycobacterium
LGKEDWYRWQWRVHVGLWAAASASKLDG

SEQ ID NO: 690542 - protein, 26 aa, Mycobacterium
LGKGIKDFRFIACLSESADGEVPGRV

SEQ ID NO: 690543 - protein, 17 aa, Mycobacterium
LGKGLAKAVKWGPAEVA

SEQ ID NO: 690544 - protein, 19 aa, Mycobacterium
LGKHLGVGVTSIYWYFRKK

SEQ ID NO: 690545 - protein, 18 aa, Mycobacterium
LGKILLCRVRRGRIEENF

SEQ ID NO: 690546 - protein, 22 aa, Mycobacterium
LGKKLRAGIELEDGPVRVDGFA

SEQ ID NO: 690547 - protein, 18 aa, Mycobacterium
LGKLDLKPGMTLLDVGCG

SEQ ID NO: 690548 - protein, 19 aa, Mycobacterium
LGKLMFRGMDMMRHRSAFD

SEQ ID NO: 690549 - protein, 18 aa, Mycobacterium
LGKNLLVAIMPWEGHNYE

SEQ ID NO: 690550 - protein, 32 aa, Mycobacterium
LGKQAALPCTPRGIVHLLRRFDVPIAGAHVVV

SEQ ID NO: 690551 - protein, 24 aa, Mycobacterium
LGKQRPGSFRALGRDEIGQLYKAV

SEQ ID NO: 690552 - protein, 22 aa, Mycobacterium
LGKRLPAYMVPAAVVVLEALPL

SEQ ID NO: 690553 - protein, 26 aa, Mycobacterium
LGKSMRIFKSELREMQSENKGENKAE

SEQ ID NO: 690554 - protein, 23 aa, Mycobacterium
LGKTFYLLDTFAGLDPRFVSAGE

SEQ ID NO: 690555 - protein, 24 aa, Mycobacterium
LGKTLTWGELRGRVAALADALSRR

SEQ ID NO: 690556 - protein, 28 aa, Mycobacterium
LGKTPPGHLWRWELTPISGTRTLVTHTY

SEQ ID NO: 690557 - protein, 18 aa, Mycobacterium
LGKTSGWVHRASVRAKSV

SEQ ID NO: 690558 - protein, 20 aa, Mycobacterium
LGKVAGDWSFGQRVAIDHTQ

SEQ ID NO: 690559 - protein, 17 aa, Mycobacterium
LGLAAARAGDVSAQAKV

SEQ ID NO: 690560 - protein, 27 aa, Mycobacterium
LGLAEVHCDVWAGFVFVNFDTTPRQSL

SEQ ID NO: 690561 - protein, 25 aa, Mycobacterium
LGLAHEVRMRWCGPEVEVEGIISLK

SEQ ID NO: 690562 - protein, 17 aa, Mycobacterium
LGLAIDGGWWVLGVHSP

SEQ ID NO: 690563 - protein, 29 aa, Mycobacterium
LGLAQAPRVDSYGGFVFASLAPDGISLTE

SEQ ID NO: 690564 - protein, 18 aa, Mycobacterium
LGLARAYVSGDLDLYGVH

SEQ ID NO: 690565 - protein, 18 aa, Mycobacterium
LGLARAYVSGDLEPHGVH

SEQ ID NO: 690566 - protein, 18 aa, Mycobacterium
LGLARAYVSGDLQAYGVH

SEQ ID NO: 690567 - protein, 18 aa, Mycobacterium
LGLARAYVSGDLQPHGVH

SEQ ID NO: 690568 - protein, 18 aa, Mycobacterium
LGLARAYVSGDLQTRGVH

SEQ ID NO: 690569 - protein, 17 aa, Mycobacterium
LGLAVLGARAAGKVILD

SEQ ID NO: 690570 - protein, 17 aa, Mycobacterium
LGLDAADIASLLERGVL

SEQ ID NO: 690571 - protein, 21 aa, Mycobacterium
LGLDETTAFLVIAATLLDLKA

SEQ ID NO: 690572 - protein, 17 aa, Mycobacterium
LGLDEVQRATKDLGFTA

SEQ ID NO: 690573 - protein, 17 aa, Mycobacterium
LGLDFLYKAFSTTDIAA

SEQ ID NO: 690574 - protein, 21 aa, Mycobacterium
LGLDGTEVFDITGIEAINDGK

SEQ ID NO: 690575 - protein, 22 aa, Mycobacterium
LGLDGTEVFDITGIEALNDGKT

SEQ ID NO: 690576 - protein, 24 aa, Mycobacterium
LGLDPRLAPAPALERQADQRSDEW

SEQ ID NO: 690577 - protein, 17 aa, Mycobacterium
LGLDQIDLFQLHRIDPK

SEQ ID NO: 690578 - protein, 17 aa, Mycobacterium
LGLDRLRSAVYRRETYV

SEQ ID NO: 690579 - protein, 18 aa, Mycobacterium
LGLDRYGVRFRIESNDGD

SEQ ID NO: 690580 - protein, 19 aa, Mycobacterium
LGLDSVRFVLLMKQLGVTR

SEQ ID NO: 690581 - protein, 18 aa, Mycobacterium
LGLEAAYCAETVAITYEE

SEQ ID NO: 690582 - protein, 18 aa, Mycobacterium
LGLEFLRHIERCAVLVHV

SEQ ID NO: 690583 - protein, 17 aa, Mycobacterium
LGLEFLSFSGPDVQEGL

SEQ ID NO: 690584 - protein, 22 aa, Mycobacterium
LGLEGIPTFQLQSGCSGAVAAF

SEQ ID NO: 690585 - protein, 17 aa, Mycobacterium
LGLELYGPALRGLQFVW

SEQ ID NO: 690586 - protein, 24 aa, Mycobacterium
LGLEPPRFCAACGRRMVVQVRPDG

SEQ ID NO: 690587 - protein, 27 aa, Mycobacterium
LGLERQWLHARSLAFAHPADGRRVEIT

SEQ ID NO: 690588 - protein, 17 aa, Mycobacterium
LGLERVGIELGPGNYLT

SEQ ID NO: 690589 - protein, 18 aa, Mycobacterium
LGLETAVASGRLGTHRGH

SEQ ID NO: 690590 - protein, 24 aa, Mycobacterium
LGLEVLSPPFVMAGNAIRDDMGEL

SEQ ID NO: 690591 - protein, 18 aa, Mycobacterium
LGLFEINEAASLVQEAAH

SEQ ID NO: 690592 - protein, 18 aa, Mycobacterium
LGLFEINEAASLVQESAH

SEQ ID NO: 690593 - protein, 17 aa, Mycobacterium
LGLFGLDAAEAHAICRR

SEQ ID NO: 690594 - protein, 19 aa, Mycobacterium
LGLFLSLPGVGQWRTLRRV

SEQ ID NO: 690595 - protein, 25 aa, Mycobacterium
LGLFLSLPGVNEWRTLQRVPIGGEA

SEQ ID NO: 690596 - protein, 25 aa, Mycobacterium
LGLFLSLPGVNQWRTLERVPIGGEA

SEQ ID NO: 690597 - protein, 26 aa, Mycobacterium
LGLFLSLPGVNQWRTLRRVPIGGEPL

SEQ ID NO: 690598 - protein, 19 aa, Mycobacterium
LGLFLSLPGVSQWRTLRRV

SEQ ID NO: 690599 - protein, 19 aa, Mycobacterium
LGLFPFRRNLSLFAVDLGL

SEQ ID NO: 690600 - protein, 17 aa, Mycobacterium
LGLGEPHAISAMHGRGV

SEQ ID NO: 690601 - protein, 30 aa, Mycobacterium
LGLGLDARGVFWLPPYHDFGLISVILSGLA

SEQ ID NO: 690602 - protein, 17 aa, Mycobacterium
LGLGYGIHSCLGAALAR

SEQ ID NO: 690603 - protein, 23 aa, Mycobacterium
LGLHIRSVEGFREVVTTPRALTV

SEQ ID NO: 690604 - protein, 20 aa, Mycobacterium
LGLHTCWVAEAWGSDAPSAL

SEQ ID NO: 690605 - protein, 18 aa, Mycobacterium
LGLHVPDPFWLPTPKMLS

SEQ ID NO: 690606 - protein, 18 aa, Mycobacterium
LGLIPSLLTVRQSIADAI

SEQ ID NO: 690607 - protein, 22 aa, Mycobacterium
LGLIRLRHAVGVYSAGRILNPV

SEQ ID NO: 690608 - protein, 20 aa, Mycobacterium
LGLITRYAFDQALKTGVLER

SEQ ID NO: 690609 - protein, 17 aa, Mycobacterium
LGLIVGKSVGSAVDRHR

SEQ ID NO: 690610 - protein, 22 aa, Mycobacterium
LGLKPRKAFGPIRVGATGTTVS

SEQ ID NO: 690611 - protein, 17 aa, Mycobacterium
LGLLGFSVPEQFGGPGV

SEQ ID NO: 690612 - protein, 17 aa, Mycobacterium
LGLLGIPEKGIAVAVDW

SEQ ID NO: 690613 - protein, 22 aa, Mycobacterium
LGLLPPDAPMPFNNPASQVLAS

SEQ ID NO: 690614 - protein, 23 aa, Mycobacterium
LGLLQRVQRAIGLVRVDDPDAAV

SEQ ID NO: 690615 - protein, 17 aa, Mycobacterium
LGLLQVWQALTESVSRR

SEQ ID NO: 690616 - protein, 18 aa, Mycobacterium
LGLLRFLLGLDLIDRVVF

SEQ ID NO: 690617 - protein, 17 aa, Mycobacterium
LGLLRLTGATGHGGSGA

SEQ ID NO: 690618 - protein, 19 aa, Mycobacterium
LGLLRVCGGADLAAMAGFC

SEQ ID NO: 690619 - protein, 17 aa, Mycobacterium
LGLPADFLIAPDGTVAA

SEQ ID NO: 690620 - protein, 22 aa, Mycobacterium
LGLPAECGVGFVTGAQAANTTG

SEQ ID NO: 690621 - protein, 21 aa, Mycobacterium
LGLPAELVSTLAANGVTTPFP

SEQ ID NO: 690622 - protein, 18 aa, Mycobacterium
LGLPAGAMISLCAALDAE

SEQ ID NO: 690623 - protein, 23 aa, Mycobacterium
LGLPALATIRSWASVGVDPAITG

SEQ ID NO: 690624 - protein, 23 aa, Mycobacterium
LGLPALATVRSWASVGVDPAVTG

SEQ ID NO: 690625 - protein, 21 aa, Mycobacterium
LGLPAPDWQVLLAVPAELAGQ

SEQ ID NO: 690626 - protein, 22 aa, Mycobacterium
LGLPDLLLLLATDMAAVDHHEG

SEQ ID NO: 690627 - protein, 23 aa, Mycobacterium
LGLPHEVAAVIAFCASPDNTYMT

SEQ ID NO: 690628 - protein, 26 aa, Mycobacterium
LGLPPSALRVIALRALDTTGRHSALL

SEQ ID NO: 690629 - protein, 26 aa, Mycobacterium
LGLPRDSYPRMLGWGRSGSPLLDIGI

SEQ ID NO: 690630 - protein, 23 aa, Mycobacterium
LGLPSRERILLSALVNVGVKTPY

SEQ ID NO: 690631 - protein, 23 aa, Mycobacterium
LGLPTAPFWFAGTVEELTAIGQH

SEQ ID NO: 690632 - protein, 24 aa, Mycobacterium
LGLPTVPFWFAGSVEELTAVAEHA

SEQ ID NO: 690633 - protein, 21 aa, Mycobacterium
LGLPVFGICYGFQVMAQALGG

SEQ ID NO: 690634 - protein, 19 aa, Mycobacterium
LGLPYQRPVHTLRDHLDVL

SEQ ID NO: 690635 - protein, 24 aa, Mycobacterium
LGLQAADVAAHWPVPGPRDDKYTQ

SEQ ID NO: 690636 - protein, 17 aa, Mycobacterium
LGLQGIVVPERWGGAGA

SEQ ID NO: 690637 - protein, 25 aa, Mycobacterium
LGLQIRLDWDRGFELIAPTAAAPTD

SEQ ID NO: 690638 - protein, 24 aa, Mycobacterium
LGLRAGGPYLPVTVRTEAPAERLD

SEQ ID NO: 690639 - protein, 25 aa, Mycobacterium
LGLRDVLAALGWVRDNIAAFGGDPG

SEQ ID NO: 690640 - protein, 19 aa, Mycobacterium
LGLRIVMRLAVEGPNAQLH

SEQ ID NO: 690641 - protein, 25 aa, Mycobacterium
LGLRPHLAVAAGRVGAVSGLPPEHN

SEQ ID NO: 690642 - protein, 17 aa, Mycobacterium
LGLRVEFDTEVFDADGI

SEQ ID NO: 690643 - protein, 17 aa, Mycobacterium
LGLRVLRNIERVIREEM

SEQ ID NO: 690644 - protein, 18 aa, Mycobacterium
LGLRWPAEIAPFGVHLVI

SEQ ID NO: 690645 - protein, 21 aa, Mycobacterium
LGLRWPGSVAPFAVHVVIANK

SEQ ID NO: 690646 - protein, 21 aa, Mycobacterium
LGLRWPPAIAPFDVHLVIANK

SEQ ID NO: 690647 - protein, 17 aa, Mycobacterium
LGLSAFGEEGDEFDPQL

SEQ ID NO: 690648 - protein, 17 aa, Mycobacterium
LGLSEGELAEFVPHVSE

SEQ ID NO: 690649 - protein, 17 aa, Mycobacterium
LGLSYLLPRAIGSSRAF

SEQ ID NO: 690650 - protein, 25 aa, Mycobacterium
LGLTDFPPSMGIRLNIPQPDLRKVV

SEQ ID NO: 690651 - protein, 18 aa, Mycobacterium
LGLTGWPRAAEESIVARD

SEQ ID NO: 690652 - protein, 19 aa, Mycobacterium
LGLTPARYVELVRVDFARA

SEQ ID NO: 690653 - protein, 24 aa, Mycobacterium
LGLTPEIWHRLAAEVDLVVHPAAL

SEQ ID NO: 690654 - protein, 17 aa, Mycobacterium
LGLTYERLRAHNDRIVC

SEQ ID NO: 690655 - protein, 24 aa, Mycobacterium
LGLVDPRAAALLEELGWTTEAHVP

SEQ ID NO: 690656 - protein, 20 aa, Mycobacterium
LGLVGHGFGGSAAVFAAVGL

SEQ ID NO: 690657 - protein, 19 aa, Mycobacterium
LGLVPRPATDFLDALVSLD

SEQ ID NO: 690658 - protein, 20 aa, Mycobacterium
LGLYPVLTRLVAKKKLKDVW

SEQ ID NO: 690659 - protein, 19 aa, Mycobacterium
LGMAAAADVCLRTVEREYR

SEQ ID NO: 690660 - protein, 17 aa, Mycobacterium
LGMAEAELGAFLRTVPR

SEQ ID NO: 690661 - protein, 24 aa, Mycobacterium
LGMALCRYVLAFPPLVDMSRDGVV

SEQ ID NO: 690662 - protein, 21 aa, Mycobacterium
LGMEPYDRFWVRDEVTGEEYQ

SEQ ID NO: 690663 - protein, 21 aa, Mycobacterium
LGMEPYERFWVRDEITGQEFN

SEQ ID NO: 690664 - protein, 20 aa, Mycobacterium
LGMGAVDLWTEELFGPVLAV

SEQ ID NO: 690665 - protein, 17 aa, Mycobacterium
LGMGLVKGHGAADWSKR

SEQ ID NO: 690666 - protein, 25 aa, Mycobacterium
LGMIDPDAWAFVWVVDPPLFEPADD

SEQ ID NO: 690667 - protein, 19 aa, Mycobacterium
LGMIPAFVMLRRVMLTAWI

SEQ ID NO: 690668 - protein, 22 aa, Mycobacterium
LGMNDVKSWIAFGASPRASLGI

SEQ ID NO: 690669 - protein, 22 aa, Mycobacterium
LGMNDVKTWIAFGASPRASLGI

SEQ ID NO: 690670 - protein, 26 aa, Mycobacterium
LGMPDEIASAIAFLLSDEASFVTATD

SEQ ID NO: 690671 - protein, 23 aa, Mycobacterium
LGMPFYVMQAIEGWSPMDGGWAP

SEQ ID NO: 690672 - protein, 19 aa, Mycobacterium
LGMPVNWGIGTPDLPIPQL

SEQ ID NO: 690673 - protein, 19 aa, Mycobacterium
LGMRALDVLGEVTVTKNPS

SEQ ID NO: 690674 - protein, 23 aa, Mycobacterium
LGMSQRLGIAVALLGDPKVLLFD

SEQ ID NO: 690675 - protein, 29 aa, Mycobacterium
LGMVRCVRAALPLLRKAQWARIVNFSAHS

SEQ ID NO: 690676 - protein, 28 aa, Mycobacterium
LGMVRCVRTALPLLRKAQWARIVNFSAH

SEQ ID NO: 690677 - protein, 22 aa, Mycobacterium
LGNAAIRSFVQKVCHEQLTHWL

SEQ ID NO: 690678 - protein, 19 aa, Mycobacterium
LGNACPFDPYASMLAAPEG

SEQ ID NO: 690679 - protein, 19 aa, Mycobacterium
LGNAIDIFPVQVLGRPPSW

SEQ ID NO: 690680 - protein, 19 aa, Mycobacterium
LGNARRALVESLCYARQRR

SEQ ID NO: 690681 - protein, 20 aa, Mycobacterium
LGNARRALVESLCYARRRHA

SEQ ID NO: 690682 - protein, 24 aa, Mycobacterium
LGNARWLPFVIAHGLIDELVPFAS

SEQ ID NO: 690683 - protein, 20 aa, Mycobacterium
LGNAVKFFAGRLVKAAEREA

SEQ ID NO: 690684 - protein, 19 aa, Mycobacterium
LGNAWRISGETAVRQTDYG

SEQ ID NO: 690685 - protein, 17 aa, Mycobacterium
LGNAYTLAAPVIATQAR

SEQ ID NO: 690686 - protein, 25 aa, Mycobacterium
LGNCGPPIETGEGWLVLTHGVGPMR

SEQ ID NO: 690687 - protein, 28 aa, Mycobacterium
LGNEDWYQWQWRVHVGLWAAASASKLEG

SEQ ID NO: 690688 - protein, 18 aa, Mycobacterium
LGNGAWIELRSGWLADAD

SEQ ID NO: 690689 - protein, 18 aa, Mycobacterium
LGNGGDGGPGIFGGTGGT

SEQ ID NO: 690690 - protein, 19 aa, Mycobacterium
LGNLPRLNSAVVRAIGSEL

SEQ ID NO: 690691 - protein, 17 aa, Mycobacterium
LGNLVRLHRPMPHPSEM

SEQ ID NO: 690692 - protein, 25 aa, Mycobacterium
LGNMGAPMARRLVDWPGGLTVFDLR

SEQ ID NO: 690693 - protein, 17 aa, Mycobacterium
LGNMLSAFVAITPLDPS

SEQ ID NO: 690694 - protein, 23 aa, Mycobacterium
LGNPEEFASLALELVTNSYMNAE

SEQ ID NO: 690695 - protein, 19 aa, Mycobacterium
LGNPVLWSNSLHWAGVHAG

SEQ ID NO: 690696 - protein, 19 aa, Mycobacterium
LGNPVLWSVPLHWAGVHAG

SEQ ID NO: 690697 - protein, 25 aa, Mycobacterium
LGNQMPMRVIGMLLGIPEEDQRRVT

SEQ ID NO: 690698 - protein, 20 aa, Mycobacterium
LGNRIPVLLGAGGDSASISL

SEQ ID NO: 690699 - protein, 26 aa, Mycobacterium
LGNTVDWRFAATVGERLARPGPPSTE

SEQ ID NO: 690700 - protein, 20 aa, Mycobacterium
LGNWFRAAGYDTHYDGKWHI

SEQ ID NO: 690701 - protein, 25 aa, Mycobacterium
LGPADLPSGFAVRYQAATRPLQVGG

SEQ ID NO: 690702 - protein, 24 aa, Mycobacterium
LGPAERYRRWLAVLRGQATVVIGT

SEQ ID NO: 690703 - protein, 22 aa, Mycobacterium
LGPAGRFASIYDRVRAWAAKPG

SEQ ID NO: 690704 - protein, 26 aa, Mycobacterium
LGPAGRFASIYDRVRAWACKPGADGV

SEQ ID NO: 690705 - protein, 24 aa, Mycobacterium
LGPAHLPPGFTVRYQAASRPLQVG

SEQ ID NO: 690706 - protein, 19 aa, Mycobacterium
LGPALAAGCTVVLKPAPDA

SEQ ID NO: 690707 - protein, 19 aa, Mycobacterium
LGPALLKFAPGLAAAYLPG

SEQ ID NO: 690708 - protein, 25 aa, Mycobacterium
LGPARAFVGECRRRCASSPPTYASV

SEQ ID NO: 690709 - protein, 17 aa, Mycobacterium
LGPASVLPWSWITDCSA

SEQ ID NO: 690710 - protein, 19 aa, Mycobacterium
LGPDASFITGIDLLVDGGV

SEQ ID NO: 690711 - protein, 32 aa, Mycobacterium
LGPDDRLCIVPPFYHCFGMVMGTLGAVSHGTT

SEQ ID NO: 690712 - protein, 18 aa, Mycobacterium
LGPDFLVEVLEIRAALGP

SEQ ID NO: 690713 - protein, 28 aa, Mycobacterium
LGPDHIAPRPGRIWLRVTGYGEQSGRPA

SEQ ID NO: 690714 - protein, 18 aa, Mycobacterium
LGPEFLVELFEIRAALGP

SEQ ID NO: 690715 - protein, 17 aa, Mycobacterium
LGPEGRGQVLARFAQWL

SEQ ID NO: 690716 - protein, 20 aa, Mycobacterium
LGPEHRVPWETFNADYDTIR

SEQ ID NO: 690717 - protein, 19 aa, Mycobacterium
LGPELALTVLQGIHDDAEK

SEQ ID NO: 690718 - protein, 22 aa, Mycobacterium
LGPEPDDLVLSRWHGVGPMGGT

SEQ ID NO: 690719 - protein, 19 aa, Mycobacterium
LGPESLIWKFYGDNRTQFF

SEQ ID NO: 690720 - protein, 17 aa, Mycobacterium
LGPESWAQDAIAVMNAA

SEQ ID NO: 690721 - protein, 19 aa, Mycobacterium
LGPFAIRTSYRARLYVPTD

SEQ ID NO: 690722 - protein, 19 aa, Mycobacterium
LGPFTIKVAYRARLRVPAV

SEQ ID NO: 690723 - protein, 22 aa, Mycobacterium
LGPGGLAAHFVWANRGKESITL

SEQ ID NO: 690724 - protein, 23 aa, Mycobacterium
LGPGPRIALMLSLVPSAEPMSGA

SEQ ID NO: 690725 - protein, 17 aa, Mycobacterium
LGPGRLESLAALDDSKK

SEQ ID NO: 690726 - protein, 27 aa, Mycobacterium
LGPGSRARFGDVLPFLVKVLAADEPLS

SEQ ID NO: 690727 - protein, 17 aa, Mycobacterium
LGPHAFRAVRLDRNRHL

SEQ ID NO: 690728 - protein, 17 aa, Mycobacterium
LGPHEFLSFIEGRAAMF

SEQ ID NO: 690729 - protein, 28 aa, Mycobacterium
LGPHGRKKHLLRFLDWILDNEDRLVGIM

SEQ ID NO: 690730 - protein, 17 aa, Mycobacterium
LGPHPVLAASILESAGT

SEQ ID NO: 690731 - protein, 22 aa, Mycobacterium
LGPIGVDGVGLIGHGGDGGNAG

SEQ ID NO: 690732 - protein, 19 aa, Mycobacterium
LGPIRARLSGPESIRKVLS

SEQ ID NO: 690733 - protein, 20 aa, Mycobacterium
LGPKAVRSAASWAEGIAGTT

SEQ ID NO: 690734 - protein, 17 aa, Mycobacterium
LGPKGRNAILEKLTGPP

SEQ ID NO: 690735 - protein, 17 aa, Mycobacterium
LGPKGSLYVTRPMIGPY

SEQ ID NO: 690736 - protein, 26 aa, Mycobacterium
LGPKMLALAAIRARGAHPYLVTPDHT

SEQ ID NO: 690737 - protein, 19 aa, Mycobacterium
LGPKVLKLAAQRSAGAHPY

SEQ ID NO: 690738 - protein, 17 aa, Mycobacterium
LGPLILRKVIASILAVD

SEQ ID NO: 690739 - protein, 18 aa, Mycobacterium
LGPLPPLRMDPQTGPILS

SEQ ID NO: 690740 - protein, 17 aa, Mycobacterium
LGPLPPLRMEPDAEPIL

SEQ ID NO: 690741 - protein, 25 aa, Mycobacterium
LGPLRLQFWVCGVFEVHDGKITLWR

SEQ ID NO: 690742 - protein, 22 aa, Mycobacterium
LGPLRLQFWVCGVFEVSDEGTI

SEQ ID NO: 690743 - protein, 21 aa, Mycobacterium
LGPLRRCRALGTAVGTFLSTL

SEQ ID NO: 690744 - protein, 17 aa, Mycobacterium
LGPLSVFFFDLLHVDGR

SEQ ID NO: 690745 - protein, 18 aa, Mycobacterium
LGPLTIRTVYRARLRVPA

SEQ ID NO: 690746 - protein, 20 aa, Mycobacterium
LGPLTLKNRFIKAATFEGVM

SEQ ID NO: 690747 - protein, 24 aa, Mycobacterium
LGPMLEAANAWQGLAGELGSAASA

SEQ ID NO: 690748 - protein, 28 aa, Mycobacterium
LGPMVDDLLRLVLRHSFETEAINVAERA

SEQ ID NO: 690749 - protein, 17 aa, Mycobacterium
LGPNGIGVLYGRRELLA

SEQ ID NO: 690750 - protein, 25 aa, Mycobacterium
LGPNKPWVFETWLADPNQWSMVVVG

SEQ ID NO: 690751 - protein, 19 aa, Mycobacterium
LGPPPDEPNAFVVEGAPTS

SEQ ID NO: 690752 - protein, 28 aa, Mycobacterium
LGPQAARPVLFSTFLMWVLADLFTTLPE

SEQ ID NO: 690753 - protein, 17 aa, Mycobacterium
LGPQFLSQFLGRVINTH

SEQ ID NO: 690754 - protein, 19 aa, Mycobacterium
LGPQISTLILPADASWSEG

SEQ ID NO: 690755 - protein, 20 aa, Mycobacterium
LGPQLLRLAGRRTQGTCTWM

SEQ ID NO: 690756 - protein, 20 aa, Mycobacterium
LGPQTCALVSEHFYPQMPFT

SEQ ID NO: 690757 - protein, 20 aa, Mycobacterium
LGPQVLKLAARRSAGAHPYL

SEQ ID NO: 690758 - protein, 17 aa, Mycobacterium
LGPRAQEFLALKVEGIR

SEQ ID NO: 690759 - protein, 20 aa, Mycobacterium
LGPRDVVVVPELAYPTYDVG

SEQ ID NO: 690760 - protein, 18 aa, Mycobacterium
LGPRFIDACKRRYGPTFT

SEQ ID NO: 690761 - protein, 19 aa, Mycobacterium
LGPRRLRHQRRPPRVAPTA

SEQ ID NO: 690762 - protein, 17 aa, Mycobacterium
LGPRYAVANPLNIQLSG

SEQ ID NO: 690763 - protein, 23 aa, Mycobacterium
LGPSGKRPAYIVERVKKTWELGD

SEQ ID NO: 690764 - protein, 17 aa, Mycobacterium
LGPSYRLFYERPVHLVR

SEQ ID NO: 690765 - protein, 17 aa, Mycobacterium
LGPTGIGVLYGRRALLN

SEQ ID NO: 690766 - protein, 17 aa, Mycobacterium
LGPTGIGVLYGRRDVLA

SEQ ID NO: 690767 - protein, 18 aa, Mycobacterium
LGPTGIGVLYGRRGLLDA

SEQ ID NO: 690768 - protein, 25 aa, Mycobacterium
LGPTHAIELLAVFGTYRTVAGPFLA

SEQ ID NO: 690769 - protein, 18 aa, Mycobacterium
LGPVAATLIRCESTRQVT

SEQ ID NO: 690770 - protein, 25 aa, Mycobacterium
LGPVHVCSAFLPGMIETHGGGRVVN

SEQ ID NO: 690771 - protein, 19 aa, Mycobacterium
LGPVSAERIAEVLGVDPEG

SEQ ID NO: 690772 - protein, 18 aa, Mycobacterium
LGPVYGVQWRAWPTPSGE

SEQ ID NO: 690773 - protein, 20 aa, Mycobacterium
LGPWSPVSLGDYCAGSNHVL

SEQ ID NO: 690774 - protein, 17 aa, Mycobacterium
LGQAGKTVFVFPGQGAQ

SEQ ID NO: 690775 - protein, 18 aa, Mycobacterium
LGQAGKTVFVFPGQGAQY

SEQ ID NO: 690776 - protein, 18 aa, Mycobacterium
LGQAVIDLRVGNGHLDGT

SEQ ID NO: 690777 - protein, 25 aa, Mycobacterium
LGQDSRPPVTVPLGANAAALAGDGK

SEQ ID NO: 690778 - protein, 19 aa, Mycobacterium
LGQFCLVSTFSEWTVVPAQ

SEQ ID NO: 690779 - protein, 35 aa, Mycobacterium
LGQGFLAGLGRLALSPVFREPRQVLELDRDGDKIE

SEQ ID NO: 690780 - protein, 17 aa, Mycobacterium
LGQGIHLVKGFYRRPLK

SEQ ID NO: 690781 - protein, 18 aa, Mycobacterium
LGQGLLLVAVGPGRSIQD

SEQ ID NO: 690782 - protein, 25 aa, Mycobacterium
LGQHGVNIMEFCKAYNAATENQRGQ

SEQ ID NO: 690783 - protein, 24 aa, Mycobacterium
LGQHGVNIMEFCKAYNAATESQRG

SEQ ID NO: 690784 - protein, 24 aa, Mycobacterium
LGQKYPWALGRPAREVWAEIWDDI

SEQ ID NO: 690785 - protein, 18 aa, Mycobacterium
LGQLDVRLGSVRALAEKE

SEQ ID NO: 690786 - protein, 33 aa, Mycobacterium
LGQLDYLQWLGIDCIWLPPFYDSPLRDGGYDIR

SEQ ID NO: 690787 - protein, 18 aa, Mycobacterium
LGQLKRPDEVLVLDEASA

SEQ ID NO: 690788 - protein, 17 aa, Mycobacterium
LGQLLPQPVRPIPILIG

SEQ ID NO: 690789 - protein, 30 aa, Mycobacterium
LGQLPPATAMRRWMDSFGDWIATKNGMLDT

SEQ ID NO: 690790 - protein, 18 aa, Mycobacterium
LGQLQGWLTGAAGLDSPS

SEQ ID NO: 690791 - protein, 27 aa, Mycobacterium
LGQLSPELVKGMAWGLAPYTAAIGGGD

SEQ ID NO: 690792 - protein, 18 aa, Mycobacterium
LGQLWAADVDVDWTQGDQ

SEQ ID NO: 690793 - protein, 18 aa, Mycobacterium
LGQMALASVAGRAIAGTG

SEQ ID NO: 690794 - protein, 28 aa, Mycobacterium
LGQMLVKLCLKDGIPLINIVRKPEQEEL

SEQ ID NO: 690795 - protein, 18 aa, Mycobacterium
LGQQEFASRIGVQVEDLT

SEQ ID NO: 690796 - protein, 24 aa, Mycobacterium
LGQSPPWARYDIDDVRVIEIDDAT

SEQ ID NO: 690797 - protein, 27 aa, Mycobacterium
LGQTGARFWPWLAYSGAILRGTKLSTR

SEQ ID NO: 690798 - protein, 24 aa, Mycobacterium
LGQVPPEVVSAVFYNFALARVAKA

SEQ ID NO: 690799 - protein, 23 aa, Mycobacterium
LGQWHFTSGPGFGHTRNPWSRKH

SEQ ID NO: 690800 - protein, 18 aa, Mycobacterium
LGQWPFTSGPAFGHTRNP

SEQ ID NO: 690801 - protein, 22 aa, Mycobacterium
LGRARVKNKIGRREEPRDLDES

SEQ ID NO: 690802 - protein, 18 aa, Mycobacterium
LGRAVAPGPFVPTVIASA

SEQ ID NO: 690803 - protein, 26 aa, Mycobacterium
LGRDAIDRWKALIIGTGAVGLIEEMI

SEQ ID NO: 690804 - protein, 20 aa, Mycobacterium
LGRDDVCYVSMPLFHSNAVL

SEQ ID NO: 690805 - protein, 21 aa, Mycobacterium
LGRDFPPGFLFLDPPDHTRLR

SEQ ID NO: 690806 - protein, 17 aa, Mycobacterium
LGRDGRVTLSMPVNERT

SEQ ID NO: 690807 - protein, 31 aa, Mycobacterium
LGRDHLRKVVTWARERGVLVASDECYLGLSW

SEQ ID NO: 690808 - protein, 25 aa, Mycobacterium
LGRDRFILSCGHSSLTLYIQLYLGG

SEQ ID NO: 690809 - protein, 17 aa, Mycobacterium
LGRDVDFLTHIGTDDRG

SEQ ID NO: 690810 - protein, 21 aa, Mycobacterium
LGRDVQRLIEWSSDTETGDRD

SEQ ID NO: 690811 - protein, 26 aa, Mycobacterium
LGREHAPLEFGLRVTTLVRDTSEQAW

SEQ ID NO: 690812 - protein, 19 aa, Mycobacterium
LGRELGKGAVIVVNLSGRG

SEQ ID NO: 690813 - protein, 26 aa, Mycobacterium
LGRELSRLRPGVMKSSFPMPVTGADY

SEQ ID NO: 690814 - protein, 24 aa, Mycobacterium
LGREVIRLLPVPPIAMRMRTAVAI

SEQ ID NO: 690815 - protein, 22 aa, Mycobacterium
LGRFAELGVIPNMQPLWAQMDA

SEQ ID NO: 690816 - protein, 17 aa, Mycobacterium
LGRFGIETALESSERCV

SEQ ID NO: 690817 - protein, 20 aa, Mycobacterium
LGRFGSGYVYSSQFASQDEA

SEQ ID NO: 690818 - protein, 17 aa, Mycobacterium
LGRFGWAPTVQLTTYLR

SEQ ID NO: 690819 - protein, 18 aa, Mycobacterium
LGRFIQQRVDGVRLREEH

SEQ ID NO: 690820 - protein, 17 aa, Mycobacterium
LGRFSALTREWFTTAFA

SEQ ID NO: 690821 - protein, 25 aa, Mycobacterium
LGRFWRIDRGDTFLVPSPIAHIGGS

SEQ ID NO: 690822 - protein, 18 aa, Mycobacterium
LGRGAGFYDRTLALVNPA

SEQ ID NO: 690823 - protein, 17 aa, Mycobacterium
LGRGGLADIEWTVQLLQ

SEQ ID NO: 690824 - protein, 17 aa, Mycobacterium
LGRGGLADIEWTVQLMQ

SEQ ID NO: 690825 - protein, 19 aa, Mycobacterium
LGRGTVWCTLLTIDPRRGL

SEQ ID NO: 690826 - protein, 20 aa, Mycobacterium
LGRGVVSEWMRLLPSATYHA

SEQ ID NO: 690827 - protein, 23 aa, Mycobacterium
LGRHAAEIYAEFAADHGDKDFSA

SEQ ID NO: 690828 - protein, 24 aa, Mycobacterium
LGRHAAEIYAEFIASDVSHNALDF

SEQ ID NO: 690829 - protein, 21 aa, Mycobacterium
LGRHFPFDPAQAVIPEPQPID

SEQ ID NO: 690830 - protein, 17 aa, Mycobacterium
LGRHFPFDPSQATIPDP

SEQ ID NO: 690831 - protein, 21 aa, Mycobacterium
LGRHFPFDPSQAVIPDPQPID

SEQ ID NO: 690832 - protein, 17 aa, Mycobacterium
LGRHFPFDPSQITIPEP

SEQ ID NO: 690833 - protein, 18 aa, Mycobacterium
LGRHLLGVRYARTGTVPN

SEQ ID NO: 690834 - protein, 21 aa, Mycobacterium
LGRIDGRPVAVFSHDQTVYQG

SEQ ID NO: 690835 - protein, 27 aa, Mycobacterium
LGRIDRPRWVASLPWEQLEDEHHRLCV

SEQ ID NO: 690836 - protein, 17 aa, Mycobacterium
LGRIPHMVHLYRYRDML

SEQ ID NO: 690837 - protein, 19 aa, Mycobacterium
LGRISLRTQVPLLLDEYTR

SEQ ID NO: 690838 - protein, 25 aa, Mycobacterium
LGRKYPWALGRPASEVWAEIWDDIG

SEQ ID NO: 690839 - protein, 26 aa, Mycobacterium
LGRLAPKARVVLCGVISSYLTGEHPG

SEQ ID NO: 690840 - protein, 24 aa, Mycobacterium
LGRLEELSVWAAACQNRCPPTTFQ

SEQ ID NO: 690841 - protein, 21 aa, Mycobacterium
LGRLEELSVWVAACQGTCPPQ

SEQ ID NO: 690842 - protein, 22 aa, Mycobacterium
LGRLGVPVVAEFTCPSARTIVM

SEQ ID NO: 690843 - protein, 18 aa, Mycobacterium
LGRLHFALAPQGTLFLGH

SEQ ID NO: 690844 - protein, 23 aa, Mycobacterium
LGRLNGYLLPILGADGRDGLTAR

SEQ ID NO: 690845 - protein, 20 aa, Mycobacterium
LGRLRVLLGAALDGKKLSAA

SEQ ID NO: 690846 - protein, 22 aa, Mycobacterium
LGRLRYAVVAHGGFGVAQRIVQ

SEQ ID NO: 690847 - protein, 26 aa, Mycobacterium
LGRLTRPEQWSGFGALGEAAPESAPE

SEQ ID NO: 690848 - protein, 22 aa, Mycobacterium
LGRLVACDLIGMGASDKLDGSG

SEQ ID NO: 690849 - protein, 18 aa, Mycobacterium
LGRMFARDTGMSFPAYVR

SEQ ID NO: 690850 - protein, 25 aa, Mycobacterium
LGRNQLRIGMFPAVDPDDVSALTQC

SEQ ID NO: 690851 - protein, 25 aa, Mycobacterium
LGRNQLRVAMFAAIDPEDISKLTQC

SEQ ID NO: 690852 - protein, 21 aa, Mycobacterium
LGRPDRPGGATTRDQTAPQTG

SEQ ID NO: 690853 - protein, 18 aa, Mycobacterium
LGRPEEYAKLVAAIVDNP

SEQ ID NO: 690854 - protein, 27 aa, Mycobacterium
LGRPLRIAHAWSLSFDASWQPMVGLLD

SEQ ID NO: 690855 - protein, 26 aa, Mycobacterium
LGRPRADAGIGPRLELLADLVTRPTR

SEQ ID NO: 690856 - protein, 21 aa, Mycobacterium
LGRPWRDMRRPTIPGVAQAKD

SEQ ID NO: 690857 - protein, 24 aa, Mycobacterium
LGRQIREAFGLPGIANAWGLTEFP

SEQ ID NO: 690858 - protein, 27 aa, Mycobacterium
LGRQKFWPERMFSLLAGFVEAGESLEA

SEQ ID NO: 690859 - protein, 19 aa, Mycobacterium
LGRRDGWPDAELCVDLATD

SEQ ID NO: 690860 - protein, 17 aa, Mycobacterium
LGRRELLPHSDLDLLLV

SEQ ID NO: 690861 - protein, 19 aa, Mycobacterium
LGRRFLLMADRTRYPPDGV

SEQ ID NO: 690862 - protein, 22 aa, Mycobacterium
LGRRIALMFASRGGTVRIYARR

SEQ ID NO: 690863 - protein, 32 aa, Mycobacterium
LGRRKSPPTAGWRRWLYLASFKQVNVGESPKV

SEQ ID NO: 690864 - protein, 22 aa, Mycobacterium
LGRRTTMYLTYWTAGETRNRGQ

SEQ ID NO: 690865 - protein, 24 aa, Mycobacterium
LGRSGLRVSPFALGAMTFGEDFGA

SEQ ID NO: 690866 - protein, 28 aa, Mycobacterium
LGRSGLRVSPLCLGAMTFGEDLGWGSSV

SEQ ID NO: 690867 - protein, 23 aa, Mycobacterium
LGRSQLPDGWALVVSDDDVPVGW

SEQ ID NO: 690868 - protein, 17 aa, Mycobacterium
LGRSRLVVVDCDTTEQL

SEQ ID NO: 690869 - protein, 25 aa, Mycobacterium
LGRSTYKMTFGHRGINIPVIDHSTG

SEQ ID NO: 690870 - protein, 20 aa, Mycobacterium
LGRTEIRRLAKELEFRPRKS

SEQ ID NO: 690871 - protein, 18 aa, Mycobacterium
LGRTEQRDILGLLISARG

SEQ ID NO: 690872 - protein, 22 aa, Mycobacterium
LGRTKQVIGIIIGHNDLIEEGK

SEQ ID NO: 690873 - protein, 27 aa, Mycobacterium
LGRTLVEVPVGFKWFVGGLLDGTIGFG

SEQ ID NO: 690874 - protein, 25 aa, Mycobacterium
LGRTTGYSCGVTWGPGKDPGTIVNQ

SEQ ID NO: 690875 - protein, 19 aa, Mycobacterium
LGRVADAFAELERRHTHGK

SEQ ID NO: 690876 - protein, 19 aa, Mycobacterium
LGRVIPKLWRDWCPPGYDA

SEQ ID NO: 690877 - protein, 25 aa, Mycobacterium
LGRVWSQCHSLAFDFSVWEIFGALL

SEQ ID NO: 690878 - protein, 18 aa, Mycobacterium
LGRWWSEVLEWPHTIDGD

SEQ ID NO: 690879 - protein, 26 aa, Mycobacterium
LGRYIRPRVEVELAFVMGEQLSGPGV

SEQ ID NO: 690880 - protein, 17 aa, Mycobacterium
LGRYKRGDLVVIVAGAP

SEQ ID NO: 690881 - protein, 32 aa, Mycobacterium
LGSAAESFGSVTAGLAGQAWQGAASRAMVAAA

SEQ ID NO: 690882 - protein, 17 aa, Mycobacterium
LGSAAPYAAPNEALPTA

SEQ ID NO: 690883 - protein, 20 aa, Mycobacterium
LGSAASSFSSVTFGLAGQAW

SEQ ID NO: 690884 - protein, 18 aa, Mycobacterium
LGSACGSTGWVASIIGVH

SEQ ID NO: 690885 - protein, 21 aa, Mycobacterium
LGSACSVAAFTAAMHAGQGCA

SEQ ID NO: 690886 - protein, 22 aa, Mycobacterium
LGSAFPGDSWQGSAAENYAGKN

SEQ ID NO: 690887 - protein, 20 aa, Mycobacterium
LGSALARLEARVAFEEVLKR

SEQ ID NO: 690888 - protein, 20 aa, Mycobacterium
LGSALARLEARVAFEEVLTR

SEQ ID NO: 690889 - protein, 17 aa, Mycobacterium
LGSCISVGLLANATHRG

SEQ ID NO: 690890 - protein, 27 aa, Mycobacterium
LGSDKDFWERVGIDPIRIMMTGETYFT

SEQ ID NO: 690891 - protein, 17 aa, Mycobacterium
LGSDVPFALHGGTALGT

SEQ ID NO: 690892 - protein, 25 aa, Mycobacterium
LGSDWPRLVAPTFDARKAVVFDDRW

SEQ ID NO: 690893 - protein, 25 aa, Mycobacterium
LGSDWPRLVAPTFDGKKAVVFDDRW

SEQ ID NO: 690894 - protein, 25 aa, Mycobacterium
LGSDWPRLVAPVFDGKKAVVFDDRW

SEQ ID NO: 690895 - protein, 25 aa, Mycobacterium
LGSDWPRLVAPVFDSRKAVVLDDRW

SEQ ID NO: 690896 - protein, 37 aa, Mycobacterium
LGSEGQLNITLLFGFSPRFPFPDSYQEFCRAVSLAKS

SEQ ID NO: 690897 - protein, 23 aa, Mycobacterium
LGSEPRLPHGIVSETIELPPLEP

SEQ ID NO: 690898 - protein, 18 aa, Mycobacterium
LGSEPYELLRYGPDDAGL

SEQ ID NO: 690899 - protein, 18 aa, Mycobacterium
LGSETVVLDFPKRIVREP

SEQ ID NO: 690900 - protein, 24 aa, Mycobacterium
LGSFTTRGWISLRGKTVVIINPDA

SEQ ID NO: 690901 - protein, 19 aa, Mycobacterium
LGSGCVMPGFVEAHGHPLM

SEQ ID NO: 690902 - protein, 19 aa, Mycobacterium
LGSGFKMSVRMVADYMGFR

SEQ ID NO: 690903 - protein, 17 aa, Mycobacterium
LGSGFVADNPVLKHPAV

SEQ ID NO: 690904 - protein, 18 aa, Mycobacterium
LGSGGVMLPNHAPLAVAE

SEQ ID NO: 690905 - protein, 20 aa, Mycobacterium
LGSGTMPWRRTVASGVNIAL

SEQ ID NO: 690906 - protein, 17 aa, Mycobacterium
LGSHASFDLTVRTKGDV

SEQ ID NO: 690907 - protein, 18 aa, Mycobacterium
LGSHRPGGEWALEPGTAG

SEQ ID NO: 690908 - protein, 18 aa, Mycobacterium
LGSIEFAVSVLNVPLIVV

SEQ ID NO: 690909 - protein, 25 aa, Mycobacterium
LGSILARLHFWGVVSDMDVPGGVTG

SEQ ID NO: 690910 - protein, 24 aa, Mycobacterium
LGSIPEFNRDALVSTLQDLYGPAR

SEQ ID NO: 690911 - protein, 18 aa, Mycobacterium
LGSIRGYKAESLGLFTQR

SEQ ID NO: 690912 - protein, 17 aa, Mycobacterium
LGSIRLPGSHFRNDIGL

SEQ ID NO: 690913 - protein, 22 aa, Mycobacterium
LGSKAAGAPIGIDVEGHGRQEE

SEQ ID NO: 690914 - protein, 17 aa, Mycobacterium
LGSKINLAELFYTGDRN

SEQ ID NO: 690915 - protein, 29 aa, Mycobacterium
LGSKMNRFFLRGALVARLLSEASWKQYPQ

SEQ ID NO: 690916 - protein, 23 aa, Mycobacterium
LGSKMQRFFARNALVARLVSEAA

SEQ ID NO: 690917 - protein, 19 aa, Mycobacterium
LGSLERLGVPFGLHSDCPM

SEQ ID NO: 690918 - protein, 20 aa, Mycobacterium
LGSLKTTFKFLPPALDFLGP

SEQ ID NO: 690919 - protein, 17 aa, Mycobacterium
LGSLLRRLGQKTDLSAG

SEQ ID NO: 690920 - protein, 18 aa, Mycobacterium
LGSLPWSSVLHCQRGRLS

SEQ ID NO: 690921 - protein, 22 aa, Mycobacterium
LGSLVAGSRYRGDFEERLKKVL

SEQ ID NO: 690922 - protein, 22 aa, Mycobacterium
LGSPELSAFFVDRYRHHAHDTA

SEQ ID NO: 690923 - protein, 34 aa, Mycobacterium
LGSPGGSVIIQFVVKTVVGLLDWGLDPQQAVSMV

SEQ ID NO: 690924 - protein, 23 aa, Mycobacterium
LGSPPVWSNSLHWAGVHAGILAS

SEQ ID NO: 690925 - protein, 21 aa, Mycobacterium
LGSPQLSYPSIHIAGTNGKTS

SEQ ID NO: 690926 - protein, 31 aa, Mycobacterium
LGSQMAAFHDDFVRILASGSNLYATAEATNA

SEQ ID NO: 690927 - protein, 19 aa, Mycobacterium
LGSRARSLTRTRSVSETIS

SEQ ID NO: 690928 - protein, 19 aa, Mycobacterium
LGSRFGVAVVGTHKAYDAD

SEQ ID NO: 690929 - protein, 18 aa, Mycobacterium
LGSRLAADHMPTWNPLQL

SEQ ID NO: 690930 - protein, 20 aa, Mycobacterium
LGSRWPESPPGWNPADHERS

SEQ ID NO: 690931 - protein, 28 aa, Mycobacterium
LGSRYFRLLPRRLVERIVPKPGTGPSEA

SEQ ID NO: 690932 - protein, 19 aa, Mycobacterium
LGSSGVWELFWPDFPADGL

SEQ ID NO: 690933 - protein, 19 aa, Mycobacterium
LGSSGVWELFWPGFPADGL

SEQ ID NO: 690934 - protein, 19 aa, Mycobacterium
LGSSGVWELFWPGFPLEGL

SEQ ID NO: 690935 - protein, 19 aa, Mycobacterium
LGSSGVWELFWPGFPPDGL

SEQ ID NO: 690936 - protein, 18 aa, Mycobacterium
LGSSGVWELFWPGMTLGA

SEQ ID NO: 690937 - protein, 20 aa, Mycobacterium
LGSSLCAANAAAAARTTGLL

SEQ ID NO: 690938 - protein, 19 aa, Mycobacterium
LGSSLPKTEYEMRARIARA

SEQ ID NO: 690939 - protein, 19 aa, Mycobacterium
LGSTLTEPGTRVAVASENR

SEQ ID NO: 690940 - protein, 17 aa, Mycobacterium
LGSTPAWGGSARLAKTV

SEQ ID NO: 690941 - protein, 19 aa, Mycobacterium
LGSVAKRPWVVNGELAVRD

SEQ ID NO: 690942 - protein, 20 aa, Mycobacterium
LGSVFFSVDLDPRWVKKIAT

SEQ ID NO: 690943 - protein, 17 aa, Mycobacterium
LGSVSGFVRRVDGKPRA

SEQ ID NO: 690944 - protein, 18 aa, Mycobacterium
LGSVTGFVRRIDGNVHAI

SEQ ID NO: 690945 - protein, 17 aa, Mycobacterium
LGSVWTTMHLFKEREVA

SEQ ID NO: 690946 - protein, 25 aa, Mycobacterium
LGSWPARGGTLACLPGEYGPNLAVM

SEQ ID NO: 690947 - protein, 20 aa, Mycobacterium
LGSYRRLVVFGGDADLATVL

SEQ ID NO: 690948 - protein, 25 aa, Mycobacterium
LGTAAGYLKPEFKALGIDFDNRGAL

SEQ ID NO: 690949 - protein, 18 aa, Mycobacterium
LGTACLSMAKILENMEIG

SEQ ID NO: 690950 - protein, 17 aa, Mycobacterium
LGTALDWLADNTASSNH

SEQ ID NO: 690951 - protein, 21 aa, Mycobacterium
LGTALGRTICAGISRRVRLDE

SEQ ID NO: 690952 - protein, 18 aa, Mycobacterium
LGTAMAALMPNLHNAAQV

SEQ ID NO: 690953 - protein, 24 aa, Mycobacterium
LGTANFKAGRLLGFASGNLCYQIE

SEQ ID NO: 690954 - protein, 26 aa, Mycobacterium
LGTANFRAGPALAFMSGNLCYQIEHH

SEQ ID NO: 690955 - protein, 27 aa, Mycobacterium
LGTAVDWGFAATVGRRLARPGPPSSDY

SEQ ID NO: 690956 - protein, 27 aa, Mycobacterium
LGTAVDWQFAATVGRRLARPGPPSSDY

SEQ ID NO: 690957 - protein, 27 aa, Mycobacterium
LGTDEEWDRILAVNLRAHIRAADVLVP

SEQ ID NO: 690958 - protein, 24 aa, Mycobacterium
LGTDGAPGGWLIGNGGAGGSGAAG

SEQ ID NO: 690959 - protein, 23 aa, Mycobacterium
LGTDGIFFDAAWDVRVTDTSLRD

SEQ ID NO: 690960 - protein, 25 aa, Mycobacterium
LGTDHRWRLEHCGAGTREHFDRAAR

SEQ ID NO: 690961 - protein, 25 aa, Mycobacterium
LGTEALIRWQHPTLGLLMPDSFIQV

SEQ ID NO: 690962 - protein, 18 aa, Mycobacterium
LGTGAGYLKAEFEALGAD

SEQ ID NO: 690963 - protein, 17 aa, Mycobacterium
LGTGAPWFESWAEHSDP

SEQ ID NO: 690964 - protein, 23 aa, Mycobacterium
LGTGCSTSLVAIHLAVQSVLTGE

SEQ ID NO: 690965 - protein, 20 aa, Mycobacterium
LGTGLFLWQNIFGVWPSDGE

SEQ ID NO: 690966 - protein, 17 aa, Mycobacterium
LGTGVVRITLPAKLIPF

SEQ ID NO: 690967 - protein, 17 aa, Mycobacterium
LGTIEVRVCDGVSNLRE

SEQ ID NO: 690968 - protein, 23 aa, Mycobacterium
LGTKVLHLRGAFHGRSGYTLSLT

SEQ ID NO: 690969 - protein, 17 aa, Mycobacterium
LGTLGIGRYAMYVQDYG

SEQ ID NO: 690970 - protein, 17 aa, Mycobacterium
LGTLKRVDVVLRRVDAD

SEQ ID NO: 690971 - protein, 18 aa, Mycobacterium
LGTLTWRQLDERINALAA

SEQ ID NO: 690972 - protein, 17 aa, Mycobacterium
LGTLTWRQLDERSSALA

SEQ ID NO: 690973 - protein, 17 aa, Mycobacterium
LGTLVWVGSGTPPDDAV

SEQ ID NO: 690974 - protein, 18 aa, Mycobacterium
LGTNHAYAVVETGKASTM

SEQ ID NO: 690975 - protein, 17 aa, Mycobacterium
LGTNILLAALRPAAVLA

SEQ ID NO: 690976 - protein, 23 aa, Mycobacterium
LGTPELRAAIAADYRRQHGLDVE

SEQ ID NO: 690977 - protein, 23 aa, Mycobacterium
LGTPITGASGWSHRVDVVEAEYL

SEQ ID NO: 690978 - protein, 25 aa, Mycobacterium
LGTPLWARPSERVAFTAVLLGRSDI

SEQ ID NO: 690979 - protein, 18 aa, Mycobacterium
LGTPRAGLRTYLAVRGGI

SEQ ID NO: 690980 - protein, 22 aa, Mycobacterium
LGTRGIWHRGWFANTVHAASPA

SEQ ID NO: 690981 - protein, 31 aa, Mycobacterium
LGTRLSDPKDVVWYEAITSYLSGDFDNDGTV

SEQ ID NO: 690982 - protein, 25 aa, Mycobacterium
LGTSCPDHFLRTKVKPLVLDLPADA

SEQ ID NO: 690983 - protein, 18 aa, Mycobacterium
LGTSILLVTHDFGVVAHV

SEQ ID NO: 690984 - protein, 23 aa, Mycobacterium
LGTSRAYIGPGIAYAFARSPFVH

SEQ ID NO: 690985 - protein, 18 aa, Mycobacterium
LGTSVLCNSYRHPAVLAK

SEQ ID NO: 690986 - protein, 17 aa, Mycobacterium
LGTTPARVRSWRDSADP

SEQ ID NO: 690987 - protein, 18 aa, Mycobacterium
LGTTRWLVAILENHQRPD

SEQ ID NO: 690988 - protein, 23 aa, Mycobacterium
LGTTVPAAPGFQLVISYNPGYQS

SEQ ID NO: 690989 - protein, 25 aa, Mycobacterium
LGTVADRPAILVATYFGDLGAALPA

SEQ ID NO: 690990 - protein, 20 aa, Mycobacterium
LGTVCAPTAVLIRPDGYVAW

SEQ ID NO: 690991 - protein, 24 aa, Mycobacterium
LGTVEYRTAWQLQRELADARVAGG

SEQ ID NO: 690992 - protein, 23 aa, Mycobacterium
LGTVQMCRAFLPVLRQRPEANIT

SEQ ID NO: 690993 - protein, 24 aa, Mycobacterium
LGTYASIVALHLAKIARTAHDEHV

SEQ ID NO: 690994 - protein, 17 aa, Mycobacterium
LGTYRFFADCVGHIDDD

SEQ ID NO: 690995 - protein, 17 aa, Mycobacterium
LGTYRFFLDCVGHIDDI

SEQ ID NO: 690996 - protein, 25 aa, Mycobacterium
LGVAEPRLLVDVSRLDLTEVALTDD

SEQ ID NO: 690997 - protein, 22 aa, Mycobacterium
LGVALHRVRFQLGDSALPVAPA

SEQ ID NO: 690998 - protein, 23 aa, Mycobacterium
LGVDAIWINPWYPSPMADAGYDV

SEQ ID NO: 690999 - protein, 20 aa, Mycobacterium
LGVDAVCVPFHVRPTDLEAF

SEQ ID NO: 691000 - protein, 31 aa, Mycobacterium
LGVDHLRKVVGWARDRGCLVASDECYLGLGW

SEQ ID NO: 691001 - protein, 26 aa, Mycobacterium
LGVDHLRKVVGWARERGSVVASDECY

SEQ ID NO: 691002 - protein, 19 aa, Mycobacterium
LGVDIPINLTLGGTQFGGL

SEQ ID NO: 691003 - protein, 25 aa, Mycobacterium
LGVDRVHLLGHDWGAIQGWTAVTDD

SEQ ID NO: 691004 - protein, 19 aa, Mycobacterium
LGVDYLDLYLIHWPVPENN

SEQ ID NO: 691005 - protein, 27 aa, Mycobacterium
LGVEALARFPCEPFRPDLVFAEAASLG

SEQ ID NO: 691006 - protein, 21 aa, Mycobacterium
LGVEEELLRLGAKPGCAVTIG

SEQ ID NO: 691007 - protein, 28 aa, Mycobacterium
LGVEGRKRLRFDGIAQPWLRDLAKRFAR

SEQ ID NO: 691008 - protein, 17 aa, Mycobacterium
LGVELSCDPPIDRVDAA

SEQ ID NO: 691009 - protein, 27 aa, Mycobacterium
LGVERVHLLGHDWGSIQAWAAVTDDSV

SEQ ID NO: 691010 - protein, 24 aa, Mycobacterium
LGVEWRMIQLLILEGDRLTRCELF

SEQ ID NO: 691011 - protein, 28 aa, Mycobacterium
LGVFTRTHGWRWLRVRLAEEPKDPWELD

SEQ ID NO: 691012 - protein, 21 aa, Mycobacterium
LGVGITSHLYGGVLRNPDPWD

SEQ ID NO: 691013 - protein, 26 aa, Mycobacterium
LGVGKGDRVILMLGNQVELWESMLAV

SEQ ID NO: 691014 - protein, 24 aa, Mycobacterium
LGVGYTAIMTPVFDVRRSPAGELL

SEQ ID NO: 691015 - protein, 18 aa, Mycobacterium
LGVHEVPRLQLRDAAHRC

SEQ ID NO: 691016 - protein, 26 aa, Mycobacterium
LGVKDFRFNQIVSEEMFLTGSVGIGL

SEQ ID NO: 691017 - protein, 22 aa, Mycobacterium
LGVLKAGAAFSVVAASTSEAAL

SEQ ID NO: 691018 - protein, 23 aa, Mycobacterium
LGVLKSGAAYMPIDPALPEERIE

SEQ ID NO: 691019 - protein, 25 aa, Mycobacterium
LGVLPRGGFDIVHLSNILDWLTPDE

SEQ ID NO: 691020 - protein, 17 aa, Mycobacterium
LGVLVVITGVAGSGKSS

SEQ ID NO: 691021 - protein, 19 aa, Mycobacterium
LGVNWKVRCVTGAPEAAVA

SEQ ID NO: 691022 - protein, 17 aa, Mycobacterium
LGVPIFLHPTIPPQPVI

SEQ ID NO: 691023 - protein, 17 aa, Mycobacterium
LGVPLVAGNVVSAEGTR

SEQ ID NO: 691024 - protein, 17 aa, Mycobacterium
LGVPLVRDDEFMRLLDH

SEQ ID NO: 691025 - protein, 33 aa, Mycobacterium
LGVPPHGWINLHFSLLPAWRGAAPVQAAIAAGD

SEQ ID NO: 691026 - protein, 23 aa, Mycobacterium
LGVPSDRWVFPWSSATCNDVYFP

SEQ ID NO: 691027 - protein, 31 aa, Mycobacterium
LGVPTSTIALAWLLRRSPVIVPIPGTSSVDH

SEQ ID NO: 691028 - protein, 20 aa, Mycobacterium
LGVPVFGICYGFQAMAQALG

SEQ ID NO: 691029 - protein, 24 aa, Mycobacterium
LGVPYTAIMTPVFDVHRNPAGDLL

SEQ ID NO: 691030 - protein, 25 aa, Mycobacterium
LGVQEVWAVGGAQGVALLAHGGTDT

SEQ ID NO: 691031 - protein, 26 aa, Mycobacterium
LGVRADAPWMPWNIEFIRRINGLDSV

SEQ ID NO: 691032 - protein, 18 aa, Mycobacterium
LGVREVYLAAARQTIDEE

SEQ ID NO: 691033 - protein, 21 aa, Mycobacterium
LGVRIGVVVNDFGAINIDAML

SEQ ID NO: 691034 - protein, 20 aa, Mycobacterium
LGVRITDSFDLIAGTSAGGI

SEQ ID NO: 691035 - protein, 25 aa, Mycobacterium
LGVRLPESLVALLRRQNGGYLQVGF

SEQ ID NO: 691036 - protein, 26 aa, Mycobacterium
LGVRPAGEYRYLLIASPAGAYFSQGI

SEQ ID NO: 691037 - protein, 26 aa, Mycobacterium
LGVRQASIISINWAQLDTVFGHFRHL

SEQ ID NO: 691038 - protein, 20 aa, Mycobacterium
LGVRRDFVKKLLARKTPPKG

SEQ ID NO: 691039 - protein, 19 aa, Mycobacterium
LGVRSCLSIPLISEGSAIG

SEQ ID NO: 691040 - protein, 19 aa, Mycobacterium
LGVSDRAGAVATALREGIY

SEQ ID NO: 691041 - protein, 17 aa, Mycobacterium
LGVSHIVVSGESGGGNL

SEQ ID NO: 691042 - protein, 18 aa, Mycobacterium
LGVSHLYLSPILTAVAGS

SEQ ID NO: 691043 - protein, 18 aa, Mycobacterium
LGVSLFIPYRYTEDRIFR

SEQ ID NO: 691044 - protein, 25 aa, Mycobacterium
LGVSRPSLRESLRVLEALGVVEIRR

SEQ ID NO: 691045 - protein, 21 aa, Mycobacterium
LGVSRSAIRVVLREVPDTHWA

SEQ ID NO: 691046 - protein, 21 aa, Mycobacterium
LGVTCSLFVDQIHYWGDIIVD

SEQ ID NO: 691047 - protein, 18 aa, Mycobacterium
LGVTGRWAPIVTVRTAQY

SEQ ID NO: 691048 - protein, 23 aa, Mycobacterium
LGVTRTKLYRHFTDAADLQRAVA

SEQ ID NO: 691049 - protein, 19 aa, Mycobacterium
LGVTSAVWRLCEGLDATED

SEQ ID NO: 691050 - protein, 18 aa, Mycobacterium
LGVTTGRAASPRRLRKGE

SEQ ID NO: 691051 - protein, 19 aa, Mycobacterium
LGVVGTAFVRQALAQLSSL

SEQ ID NO: 691052 - protein, 18 aa, Mycobacterium
LGVVGVITPWNFPMTIAS

SEQ ID NO: 691053 - protein, 19 aa, Mycobacterium
LGVVMARHIVKIEPFASLP

SEQ ID NO: 691054 - protein, 21 aa, Mycobacterium
LGVVMARYILQIEPFASMPAE

SEQ ID NO: 691055 - protein, 18 aa, Mycobacterium
LGVVVCFAGQVFPAAGIR

SEQ ID NO: 691056 - protein, 19 aa, Mycobacterium
LGVVVGEAGRGYFNEAVVA

SEQ ID NO: 691057 - protein, 26 aa, Mycobacterium
LGWADPETGLAFGFVHNRLLTPMVVS

SEQ ID NO: 691058 - protein, 17 aa, Mycobacterium
LGWAEQWSADAEAAALR

SEQ ID NO: 691059 - protein, 17 aa, Mycobacterium
LGWAVFWLVHAPTGAMA

SEQ ID NO: 691060 - protein, 24 aa, Mycobacterium
LGWDDARGLAQWVVMTVLTGTEIP

SEQ ID NO: 691061 - protein, 20 aa, Mycobacterium
LGWDRKRIGDRVDELLDLVG

SEQ ID NO: 691062 - protein, 23 aa, Mycobacterium
LGWKLAASINGWAPDGLLDSYEA

SEQ ID NO: 691063 - protein, 26 aa, Mycobacterium
LGWQREMLARIGVPYRVIDVAAGDLG

SEQ ID NO: 691064 - protein, 28 aa, Mycobacterium
LGWVNLHFSVLPAWRGAAPVQAALAAGD

SEQ ID NO: 691065 - protein, 18 aa, Mycobacterium
LGWVRELGDIIGRDGDPA

SEQ ID NO: 691066 - protein, 24 aa, Mycobacterium
LGYAAGWRLVRAMPEAMAQGVFGA

SEQ ID NO: 691067 - protein, 25 aa, Mycobacterium
LGYACGVVSGGFRRIIEPLAEELML

SEQ ID NO: 691068 - protein, 17 aa, Mycobacterium
LGYAQNFLNMCFGEVPE

SEQ ID NO: 691069 - protein, 19 aa, Mycobacterium
LGYDGKWVLHPDQIAAGNE

SEQ ID NO: 691070 - protein, 19 aa, Mycobacterium
LGYELVRAVLRDERFEVPR

SEQ ID NO: 691071 - protein, 25 aa, Mycobacterium
LGYFEGWAAVGCEPSRMGIGPVGAV

SEQ ID NO: 691072 - protein, 18 aa, Mycobacterium
LGYGAIWAGGSPPAELDW

SEQ ID NO: 691073 - protein, 17 aa, Mycobacterium
LGYGPLVRAAVGFTNLW

SEQ ID NO: 691074 - protein, 18 aa, Mycobacterium
LGYGTVWVGASPAADLAF

SEQ ID NO: 691075 - protein, 17 aa, Mycobacterium
LGYGVESVRSWARQADI

SEQ ID NO: 691076 - protein, 19 aa, Mycobacterium
LGYIGMVLGSYRWLNPSGR

SEQ ID NO: 691077 - protein, 25 aa, Mycobacterium
LGYKCSIRTPWWRTPSLWIPDLFML

SEQ ID NO: 691078 - protein, 17 aa, Mycobacterium
LGYLATIKPEFDRRNVK

SEQ ID NO: 691079 - protein, 27 aa, Mycobacterium
LGYLMFRAGAVMRPRVLAVLRPLGLGM

SEQ ID NO: 691080 - protein, 24 aa, Mycobacterium
LGYLREEWPLGEWDFVDPEAARVY

SEQ ID NO: 691081 - protein, 25 aa, Mycobacterium
LGYPELVAPLTFLAIAGRRVQLEIF

SEQ ID NO: 691082 - protein, 18 aa, Mycobacterium
LGYPHVLAGQRLCIYLDP

SEQ ID NO: 691083 - protein, 29 aa, Mycobacterium
LGYPRGNLAFRWFLADGVPQRPEVKLVKA

SEQ ID NO: 691084 - protein, 17 aa, Mycobacterium
LGYPRLGLIQTNLAFVI

SEQ ID NO: 691085 - protein, 17 aa, Mycobacterium
LGYRAALKDSVREPDGA

SEQ ID NO: 691086 - protein, 19 aa, Mycobacterium
LGYRHPMGPLRSTDLVGLD

SEQ ID NO: 691087 - protein, 24 aa, Mycobacterium
LGYRMENGHVVVCGRVKDVIIMAG

SEQ ID NO: 691088 - protein, 26 aa, Mycobacterium
LGYRPEEFEHFGVPIKKRGRVCDEKL

SEQ ID NO: 691089 - protein, 24 aa, Mycobacterium
LGYRPEEFEHFGVPIKSRGRLCDE

SEQ ID NO: 691090 - protein, 25 aa, Mycobacterium
LGYSARGAAALGFPGTAGKEAAGEP

SEQ ID NO: 691091 - protein, 25 aa, Mycobacterium
LGYSCGVVSGGFRQVIDPLAHELAL

SEQ ID NO: 691092 - protein, 17 aa, Mycobacterium
LGYSDLKEGDFIESYEL

SEQ ID NO: 691093 - protein, 24 aa, Mycobacterium
LGYWEPRAAISLNETILRRLGTNW

SEQ ID NO: 691094 - protein, 24 aa, Mycobacterium
LGYWEPRAAITLNESILRSHASNW

SEQ ID NO: 691095 - protein, 25 aa, Mycobacterium
LGYWRRSGLTASRFVACPFAGAGAP

SEQ ID NO: 691096 - protein, 20 aa, Mycobacterium
LGYYKRPEVTAGVFDADGFY

SEQ ID NO: 691097 - protein, 22 aa, Mycobacterium
LHAAGLAHALARKGSDTAVLAL

SEQ ID NO: 691098 - protein, 25 aa, Mycobacterium
LHAAHATELPFVWGNLGSGRKDPTF

SEQ ID NO: 691099 - protein, 23 aa, Mycobacterium
LHAAKGLEWDAVYLVGLADGTLP

SEQ ID NO: 691100 - protein, 26 aa, Mycobacterium
LHAALARYPRELPFLAPFNDGLPAMI

SEQ ID NO: 691101 - protein, 19 aa, Mycobacterium
LHAALEIIGRWHVRTGRPV

SEQ ID NO: 691102 - protein, 17 aa, Mycobacterium
LHAANGFVYADDDVAAA

SEQ ID NO: 691103 - protein, 20 aa, Mycobacterium
LHAARLALCAATRQVIANGL

SEQ ID NO: 691104 - protein, 27 aa, Mycobacterium
LHAARRAEIPLSPHFPSTRAGSGSPGQ

SEQ ID NO: 691105 - protein, 18 aa, Mycobacterium
LHAATSLQHCLQLVADHA

SEQ ID NO: 691106 - protein, 18 aa, Mycobacterium
LHADAWGATLTRTEPQSI

SEQ ID NO: 691107 - protein, 24 aa, Mycobacterium
LHADELPGMLVLRILAGQLAEAEA

SEQ ID NO: 691108 - protein, 18 aa, Mycobacterium
LHAEEWLGPASTLMIEAV

SEQ ID NO: 691109 - protein, 24 aa, Mycobacterium
LHAELTRYQLVIWTAGNVSARVPD

SEQ ID NO: 691110 - protein, 22 aa, Mycobacterium
LHAEVHRVCLPHTAPAPMSNSL

SEQ ID NO: 691111 - protein, 18 aa, Mycobacterium
LHAGETVVPIGAPVPAAG

SEQ ID NO: 691112 - protein, 20 aa, Mycobacterium
LHAGGLEHRSEFVVGSLAGP

SEQ ID NO: 691113 - protein, 20 aa, Mycobacterium
LHAHHTLEFDSTVNYPLDRR

SEQ ID NO: 691114 - protein, 20 aa, Mycobacterium
LHAHVLLQRDVHYIVRDDAV

SEQ ID NO: 691115 - protein, 25 aa, Mycobacterium
LHAHVLLQRDVHYIVRDGAVHLINS

SEQ ID NO: 691116 - protein, 19 aa, Mycobacterium
LHAIALHRPGIRFVSFSSV

SEQ ID NO: 691117 - protein, 24 aa, Mycobacterium
LHAIPPHRVTAICGFADLDALVAA

SEQ ID NO: 691118 - protein, 20 aa, Mycobacterium
LHALALGADWVWLADDDGHP

SEQ ID NO: 691119 - protein, 23 aa, Mycobacterium
LHALARGADWVWLADDDGRPQDS

SEQ ID NO: 691120 - protein, 18 aa, Mycobacterium
LHALAWMVPGEISLFGLD

SEQ ID NO: 691121 - protein, 24 aa, Mycobacterium
LHALSARYSDGWQAHAAHTYVGAA

SEQ ID NO: 691122 - protein, 20 aa, Mycobacterium
LHALSLGADWIWLADDDGRP

SEQ ID NO: 691123 - protein, 18 aa, Mycobacterium
LHALTLGADWVWLADDDG

SEQ ID NO: 691124 - protein, 18 aa, Mycobacterium
LHALVKIGSRRSLRVRSL

SEQ ID NO: 691125 - protein, 25 aa, Mycobacterium
LHAMAKLAPQHLVVVLGHCHERISP

SEQ ID NO: 691126 - protein, 28 aa, Mycobacterium
LHAPRLWPEYHPGYFGAFVRDPDGNNVE

SEQ ID NO: 691127 - protein, 21 aa, Mycobacterium
LHARIRLLRRYSLSAENRQPA

SEQ ID NO: 691128 - protein, 20 aa, Mycobacterium
LHAWMTLPAAERIAEIRDTG

SEQ ID NO: 691129 - protein, 21 aa, Mycobacterium
LHCDPRLRVGRVATKPGPITS

SEQ ID NO: 691130 - protein, 20 aa, Mycobacterium
LHCGPAGAGHFVKMVHNGIE

SEQ ID NO: 691131 - protein, 17 aa, Mycobacterium
LHCPARMSIAAELLGVD

SEQ ID NO: 691132 - protein, 19 aa, Mycobacterium
LHDATVFYTVMGRTLDDEP

SEQ ID NO: 691133 - protein, 29 aa, Mycobacterium
LHDDGVFGFKCFLLHSGVDEFPHLDADEM

SEQ ID NO: 691134 - protein, 25 aa, Mycobacterium
LHDDRLAAILSRYAVVEGDSARSAR

SEQ ID NO: 691135 - protein, 19 aa, Mycobacterium
LHDEEVFAPIAPVTVVDSV

SEQ ID NO: 691136 - protein, 18 aa, Mycobacterium
LHDLKAVVLAVGHVPAGL

SEQ ID NO: 691137 - protein, 22 aa, Mycobacterium
LHDLKIDLLLSRGGKPTDNPHV

SEQ ID NO: 691138 - protein, 20 aa, Mycobacterium
LHDLPYYRALAQWRAAALLQ

SEQ ID NO: 691139 - protein, 22 aa, Mycobacterium
LHDLRHSAAMRMARDPQMTLSD

SEQ ID NO: 691140 - protein, 19 aa, Mycobacterium
LHDLVDPMASLTLLSELMN

SEQ ID NO: 691141 - protein, 24 aa, Mycobacterium
LHDNIRAAWLWSGRRAIIAGRAAA

SEQ ID NO: 691142 - protein, 25 aa, Mycobacterium
LHDPIRVAEEWAMIDNLSGGRIGVA

SEQ ID NO: 691143 - protein, 23 aa, Mycobacterium
LHDRFRLLTGGARTAVRRQQTLR

SEQ ID NO: 691144 - protein, 23 aa, Mycobacterium
LHDRFRLLTGGARTVVRRQQTLR

SEQ ID NO: 691145 - protein, 19 aa, Mycobacterium
LHDRLPKIYLELLDAARGL

SEQ ID NO: 691146 - protein, 19 aa, Mycobacterium
LHDRRLPLASGVSGAIDQL

SEQ ID NO: 691147 - protein, 23 aa, Mycobacterium
LHDSTRWKLRHIGRYTLSGTKPP

SEQ ID NO: 691148 - protein, 19 aa, Mycobacterium
LHEAELQLAEFIGLDEVKN

SEQ ID NO: 691149 - protein, 18 aa, Mycobacterium
LHEAELQLAEFIGLEEVK

SEQ ID NO: 691150 - protein, 18 aa, Mycobacterium
LHEAEVIWHVLRPLTGED

SEQ ID NO: 691151 - protein, 26 aa, Mycobacterium
LHEASGRKHLWLDVVALAQNLRPQSS

SEQ ID NO: 691152 - protein, 30 aa, Mycobacterium
LHEATADLDLDWWLTFSSVASLLGAPGQGS

SEQ ID NO: 691153 - protein, 18 aa, Mycobacterium
LHEEAGLQAEHWQVLIDL

SEQ ID NO: 691154 - protein, 25 aa, Mycobacterium
LHEHPAHCWEPKRLRLHLFSIAARI

SEQ ID NO: 691155 - protein, 18 aa, Mycobacterium
LHEHWGDDPCAYLGVAVS

SEQ ID NO: 691156 - protein, 17 aa, Mycobacterium
LHEKVVLGVQSAAGFAE

SEQ ID NO: 691157 - protein, 20 aa, Mycobacterium
LHELAPGLVLWECDKTIYRA

SEQ ID NO: 691158 - protein, 24 aa, Mycobacterium
LHELFPPGQLDWMVLFSSCGYLAG

SEQ ID NO: 691159 - protein, 26 aa, Mycobacterium
LHEPEAWWWQKWVDPLGQHTEFSGVD

SEQ ID NO: 691160 - protein, 22 aa, Mycobacterium
LHEPRLWPEYHENYYGAFVRDP

SEQ ID NO: 691161 - protein, 27 aa, Mycobacterium
LHEPRLWPEYHPGYFGAFVRDPDGNNV

SEQ ID NO: 691162 - protein, 24 aa, Mycobacterium
LHERLLRRDIPAVVLNAKNDAEEA

SEQ ID NO: 691163 - protein, 18 aa, Mycobacterium
LHEVKPLSLVVGLIEELR

SEQ ID NO: 691164 - protein, 17 aa, Mycobacterium
LHEYRWDGSQLVRRRLD

SEQ ID NO: 691165 - protein, 17 aa, Mycobacterium
LHFCLGSALARLEARVA

SEQ ID NO: 691166 - protein, 17 aa, Mycobacterium
LHFEWTDDPRWLIYLQD

SEQ ID NO: 691167 - protein, 17 aa, Mycobacterium
LHFGRAAQRLLIAQPPL

SEQ ID NO: 691168 - protein, 17 aa, Mycobacterium
LHFKRAADRLMITPPPL

SEQ ID NO: 691169 - protein, 18 aa, Mycobacterium
LHFMPGWLEMLVEVGRGR

SEQ ID NO: 691170 - protein, 22 aa, Mycobacterium
LHFPQDLTVGLAVTRLGRSSVT

SEQ ID NO: 691171 - protein, 19 aa, Mycobacterium
LHFPQQLVVGLAVTRLGRS

SEQ ID NO: 691172 - protein, 20 aa, Mycobacterium
LHFSAPALLAERRLQPTMCV

SEQ ID NO: 691173 - protein, 34 aa, Mycobacterium
LHGEAYRGHIFWDELFIFPVLNLRLPAVTRSLLL

SEQ ID NO: 691174 - protein, 33 aa, Mycobacterium
LHGEAYRGHIFWDELFIFPVLNLRVPTVTRSLL

SEQ ID NO: 691175 - protein, 24 aa, Mycobacterium
LHGEAYRGHVFWDSLFVSPVLSVR

SEQ ID NO: 691176 - protein, 24 aa, Mycobacterium
LHGESGLYYDDWTMRRPETVDLVG

SEQ ID NO: 691177 - protein, 17 aa, Mycobacterium
LHGGDPVRARSVIGRAV

SEQ ID NO: 691178 - protein, 29 aa, Mycobacterium
LHGGGCAPGLLGRWSHGWTARADVRSRTS

SEQ ID NO: 691179 - protein, 17 aa, Mycobacterium
LHGGYGYMREYRVSQAF

SEQ ID NO: 691180 - protein, 22 aa, Mycobacterium
LHGHPARWIEIAAEWGTRDYWS

SEQ ID NO: 691181 - protein, 17 aa, Mycobacterium
LHGKRISGRYALIQTNG

SEQ ID NO: 691182 - protein, 17 aa, Mycobacterium
LHGLGFGVGDVRAILLT

SEQ ID NO: 691183 - protein, 19 aa, Mycobacterium
LHGLPELRAIFGELLGIPV

SEQ ID NO: 691184 - protein, 18 aa, Mycobacterium
LHGLRLVFERNRDAQGGR

SEQ ID NO: 691185 - protein, 18 aa, Mycobacterium
LHGLRLVFERNRDAQRGR

SEQ ID NO: 691186 - protein, 18 aa, Mycobacterium
LHGMGFLHEACVQLWGEG

SEQ ID NO: 691187 - protein, 27 aa, Mycobacterium
LHGNHPVRLFIGSGMPTGLWGRVVDAF

SEQ ID NO: 691188 - protein, 27 aa, Mycobacterium
LHGNHPVRLFIGSGMPTGLWGRVVEAF

SEQ ID NO: 691189 - protein, 26 aa, Mycobacterium
LHGPQRWRIKANWKIGAENFAGDMYH

SEQ ID NO: 691190 - protein, 36 aa, Mycobacterium
LHGPRSFALPEFDPFWKRVVETGVLVIMHASDSGYS

SEQ ID NO: 691191 - protein, 18 aa, Mycobacterium
LHGPVALVHFDAHLDTWD

SEQ ID NO: 691192 - protein, 18 aa, Mycobacterium
LHGQFPAFARAFDAAVDE

SEQ ID NO: 691193 - protein, 24 aa, Mycobacterium
LHGQKLRGGYALTRIREGSEEAWL

SEQ ID NO: 691194 - protein, 17 aa, Mycobacterium
LHGRDVWQEPCDDVDDV

SEQ ID NO: 691195 - protein, 17 aa, Mycobacterium
LHGRDVWQESCRDVDDL

SEQ ID NO: 691196 - protein, 20 aa, Mycobacterium
LHGRVRVTVPPGWTVATTEL

SEQ ID NO: 691197 - protein, 29 aa, Mycobacterium
LHGSLFEFRCARCAEPYSGALPHMPEPAL

SEQ ID NO: 691198 - protein, 30 aa, Mycobacterium
LHGSLFEFRCARCGIPYSEALPVMTEPAIE

SEQ ID NO: 691199 - protein, 21 aa, Mycobacterium
LHGSRISGRYALIQTNGDQWL

SEQ ID NO: 691200 - protein, 31 aa, Mycobacterium
LHGVFPASMGRPEYPTPVGVYSVLAKERDVT

SEQ ID NO: 691201 - protein, 18 aa, Mycobacterium
LHGVQLWVALPGSDRDTA

SEQ ID NO: 691202 - protein, 17 aa, Mycobacterium
LHGWQWNLTNGRCLTTK

SEQ ID NO: 691203 - protein, 25 aa, Mycobacterium
LHGWQWRLDDGRCLTARGHQLRSRR

SEQ ID NO: 691204 - protein, 25 aa, Mycobacterium
LHGWQWRLDDGRCLTARGHQLRSSR

SEQ ID NO: 691205 - protein, 25 aa, Mycobacterium
LHGWQWRLDDGRCLTTRGHQLRSSK

SEQ ID NO: 691206 - protein, 29 aa, Mycobacterium
LHHAAEGCQLDWWLGFSSVASLLGSPGQA

SEQ ID NO: 691207 - protein, 19 aa, Mycobacterium
LHHALALAGRHLRKHPNAQ

SEQ ID NO: 691208 - protein, 17 aa, Mycobacterium
LHHAVAFVKFSTSLGQV

SEQ ID NO: 691209 - protein, 17 aa, Mycobacterium
LHHCAMCPDHDAESHAT

SEQ ID NO: 691210 - protein, 17 aa, Mycobacterium
LHHCIADGIATTQMLAK

SEQ ID NO: 691211 - protein, 18 aa, Mycobacterium
LHHEVMAGLARRFPSGVG

SEQ ID NO: 691212 - protein, 24 aa, Mycobacterium
LHHHIKRSLILDGLLGSARELTRE

SEQ ID NO: 691213 - protein, 24 aa, Mycobacterium
LHHHVKRSLILDGLLGSARELTRE

SEQ ID NO: 691214 - protein, 24 aa, Mycobacterium
LHHHVKRSLVLDGLLGSSRELTRE

SEQ ID NO: 691215 - protein, 31 aa, Mycobacterium
LHHIAPRLKVLGLCHSVYWTMVGLCELIDVP

SEQ ID NO: 691216 - protein, 26 aa, Mycobacterium
LHHLACAVLDSSLRPVPPGTVGELYV

SEQ ID NO: 691217 - protein, 18 aa, Mycobacterium
LHHLRHDIDLERLVDALL

SEQ ID NO: 691218 - protein, 18 aa, Mycobacterium
LHHQSKWTVGGMVKGAGM

SEQ ID NO: 691219 - protein, 22 aa, Mycobacterium
LHHRLVRAGVPAVVLNAKNDAE

SEQ ID NO: 691220 - protein, 20 aa, Mycobacterium
LHHVPGLAFLPNRRPAEPNQ

SEQ ID NO: 691221 - protein, 20 aa, Mycobacterium
LHHVPGLAFLPNRRPPEPNQ

SEQ ID NO: 691222 - protein, 17 aa, Mycobacterium
LHIAGALGVEYPAYRAA

SEQ ID NO: 691223 - protein, 28 aa, Mycobacterium
LHIALKAFWPAPLPFSLLHVDTGHNLPE

SEQ ID NO: 691224 - protein, 22 aa, Mycobacterium
LHIFPRACHGFDSLLPEWTTSQ

SEQ ID NO: 691225 - protein, 23 aa, Mycobacterium
LHIHRILLQRSWIAIMRGDFAAA

SEQ ID NO: 691226 - protein, 17 aa, Mycobacterium
LHIPRTTWYDDVRFEEV

SEQ ID NO: 691227 - protein, 23 aa, Mycobacterium
LHKEAFRQWVLLRHTEWIKALEP

SEQ ID NO: 691228 - protein, 22 aa, Mycobacterium
LHKGLPPRAGIVTDRGTQLQRA

SEQ ID NO: 691229 - protein, 18 aa, Mycobacterium
LHKHVPWGAHLSVSPGDV

SEQ ID NO: 691230 - protein, 24 aa, Mycobacterium
LHKHYPSQAAHDWFDEQAFLGLAR

SEQ ID NO: 691231 - protein, 24 aa, Mycobacterium
LHKLEAQRVFGRCWQFLAHETEIP

SEQ ID NO: 691232 - protein, 27 aa, Mycobacterium
LHKLLMKRRRLRAERLVFLGVAGKQRG

SEQ ID NO: 691233 - protein, 25 aa, Mycobacterium
LHKQRTGLPHLTWKYASSVDGRSAA

SEQ ID NO: 691234 - protein, 25 aa, Mycobacterium
LHKQRTGLPHVTWKFATSVDGRSAA

SEQ ID NO: 691235 - protein, 26 aa, Mycobacterium
LHKQRTGLPHVTWKYATSIDGRSAAA

SEQ ID NO: 691236 - protein, 25 aa, Mycobacterium
LHKQRTGLPHVTWKYATSVDGRSAA

SEQ ID NO: 691237 - protein, 17 aa, Mycobacterium
LHKRTRLAFLELAAELA

SEQ ID NO: 691238 - protein, 18 aa, Mycobacterium
LHKTIVFVTHDFDEAVKV

SEQ ID NO: 691239 - protein, 18 aa, Mycobacterium
LHKTVVVAAFEGWNDAGD

SEQ ID NO: 691240 - protein, 20 aa, Mycobacterium
LHKVAADWRGPIPQQVHFLD

SEQ ID NO: 691241 - protein, 25 aa, Mycobacterium
LHKVPLRIVHVMQWPPGSATWSEIP

SEQ ID NO: 691242 - protein, 19 aa, Mycobacterium
LHLAARAYTATGLSHNLAP

SEQ ID NO: 691243 - protein, 17 aa, Mycobacterium
LHLAVKAFRPGRLPFPV

SEQ ID NO: 691244 - protein, 24 aa, Mycobacterium
LHLAYDLLEGWDLLVLVDALPCRV

SEQ ID NO: 691245 - protein, 20 aa, Mycobacterium
LHLDHCGWNTRLVEGTWRPT

SEQ ID NO: 691246 - protein, 25 aa, Mycobacterium
LHLELAVGAGLRSGLEDALRTAVRS

SEQ ID NO: 691247 - protein, 23 aa, Mycobacterium
LHLEPAAAFALPVVRKPAPGLAT

SEQ ID NO: 691248 - protein, 18 aa, Mycobacterium
LHLERCGFESVVVVEHTV

SEQ ID NO: 691249 - protein, 17 aa, Mycobacterium
LHLEYPTGVVLDSVTVG

SEQ ID NO: 691250 - protein, 17 aa, Mycobacterium
LHLGCGLDGRYFRLNPG

SEQ ID NO: 691251 - protein, 26 aa, Mycobacterium
LHLGLPRWASHPGMLFRVDDLDCAAR

SEQ ID NO: 691252 - protein, 18 aa, Mycobacterium
LHLHAAVIAQILAKKFRP

SEQ ID NO: 691253 - protein, 19 aa, Mycobacterium
LHLHRGIGYLVGDPRVTNI

SEQ ID NO: 691254 - protein, 37 aa, Mycobacterium
LHLILRHFKMPGFLVPEFRRKAVIIAVGGVYDIRIHL

SEQ ID NO: 691255 - protein, 18 aa, Mycobacterium
LHLITHLSRAGWLRWSDK

SEQ ID NO: 691256 - protein, 17 aa, Mycobacterium
LHLLPLADLLGVVPVLA

SEQ ID NO: 691257 - protein, 18 aa, Mycobacterium
LHLMFKRGGLENVTREDI

SEQ ID NO: 691258 - protein, 33 aa, Mycobacterium
LHLPRLSAAINHERVRLGIGLSPSVSARLRDTR

SEQ ID NO: 691259 - protein, 18 aa, Mycobacterium
LHLPSTFAAWKALADGPS

SEQ ID NO: 691260 - protein, 17 aa, Mycobacterium
LHLPTLWQRSDPWIETG

SEQ ID NO: 691261 - protein, 24 aa, Mycobacterium
LHLRPGGCGRDYRILSVAMLEVTF

SEQ ID NO: 691262 - protein, 17 aa, Mycobacterium
LHLSALPGDPGFDSAAG

SEQ ID NO: 691263 - protein, 19 aa, Mycobacterium
LHLTLKHIHWNVVGPNFIG

SEQ ID NO: 691264 - protein, 24 aa, Mycobacterium
LHLTLKHIHWNVVGPNFIGVHEMI

SEQ ID NO: 691265 - protein, 24 aa, Mycobacterium
LHLTLKHVHWNVVGPNFIGVHEML

SEQ ID NO: 691266 - protein, 17 aa, Mycobacterium
LHLTMPISLRTNTDDMG

SEQ ID NO: 691267 - protein, 21 aa, Mycobacterium
LHLTRWKVGRLLDEARSAGLV

SEQ ID NO: 691268 - protein, 23 aa, Mycobacterium
LHLVDFPVTLGIRPNIPQEDLRE

SEQ ID NO: 691269 - protein, 18 aa, Mycobacterium
LHLVPPPGMSPEMVKGLP

SEQ ID NO: 691270 - protein, 25 aa, Mycobacterium
LHLWPKARCALMGVGAPPLLRSDIP

SEQ ID NO: 691271 - protein, 21 aa, Mycobacterium
LHLYWRRAISLAASIGPANRW

SEQ ID NO: 691272 - protein, 19 aa, Mycobacterium
LHMMARLRTGQPLGAVQLV

SEQ ID NO: 691273 - protein, 23 aa, Mycobacterium
LHMSRPALYKRLRGIEDALGVDL

SEQ ID NO: 691274 - protein, 24 aa, Mycobacterium
LHMSRPALYSRLAAIQRRLGVDLD

SEQ ID NO: 691275 - protein, 20 aa, Mycobacterium
LHMVPSMLSTLLLLPQIDEW

SEQ ID NO: 691276 - protein, 23 aa, Mycobacterium
LHNFPGIEFSALVASPNGAKRAI

SEQ ID NO: 691277 - protein, 20 aa, Mycobacterium
LHNGTVWQWNRPVYDVQGGS

SEQ ID NO: 691278 - protein, 19 aa, Mycobacterium
LHNGTVYRWNRPIYDVVNG

SEQ ID NO: 691279 - protein, 25 aa, Mycobacterium
LHNGTVYRWNRPVYDVSEVAGEGRP

SEQ ID NO: 691280 - protein, 18 aa, Mycobacterium
LHNKGAKLVLTDIGTAEL

SEQ ID NO: 691281 - protein, 21 aa, Mycobacterium
LHNRFRNLLGRRLRGARLGTG

SEQ ID NO: 691282 - protein, 20 aa, Mycobacterium
LHNSQPWQWVAGGGRVDLFL

SEQ ID NO: 691283 - protein, 20 aa, Mycobacterium
LHNSQPWRWIAVGPTLQLWA

SEQ ID NO: 691284 - protein, 25 aa, Mycobacterium
LHNSQPWRWVAEADTLQLWADRARS

SEQ ID NO: 691285 - protein, 19 aa, Mycobacterium
LHNSQPWRWVVGGPTVDLF

SEQ ID NO: 691286 - protein, 20 aa, Mycobacterium
LHNTQPWRWIVDLGASAGDL

SEQ ID NO: 691287 - protein, 24 aa, Mycobacterium
LHNTWRFGIDRVLAGVALSEDAHA

SEQ ID NO: 691288 - protein, 25 aa, Mycobacterium
LHNTWRFGIDRVLAGVAMSDDSHAW

SEQ ID NO: 691289 - protein, 27 aa, Mycobacterium
LHNTYGMAAANVWEGLQLGIRRFDAAL

SEQ ID NO: 691290 - protein, 25 aa, Mycobacterium
LHPADEVLWRMTHPDSDFRSISDGE

SEQ ID NO: 691291 - protein, 22 aa, Mycobacterium
LHPADEVLWRMTHPDSDFRSVA

SEQ ID NO: 691292 - protein, 18 aa, Mycobacterium
LHPARPRSLRFRPRVRTP

SEQ ID NO: 691293 - protein, 24 aa, Mycobacterium
LHPDGRWDGLHVFHLHGGGFVEQP

SEQ ID NO: 691294 - protein, 19 aa, Mycobacterium
LHPDNEPGVLILAVHHLAA

SEQ ID NO: 691295 - protein, 18 aa, Mycobacterium
LHPEFRTVPMVWYIPPLS

SEQ ID NO: 691296 - protein, 23 aa, Mycobacterium
LHPEPRLLVPRQETFWATRKVEF

SEQ ID NO: 691297 - protein, 17 aa, Mycobacterium
LHPERLDRAVLMNCTAS

SEQ ID NO: 691298 - protein, 19 aa, Mycobacterium
LHPEYRTVPMVWYIPPLSP

SEQ ID NO: 691299 - protein, 17 aa, Mycobacterium
LHPGLRCVSDLRSTDVA

SEQ ID NO: 691300 - protein, 18 aa, Mycobacterium
LHPGRIDMGLGRSGQRRQ

SEQ ID NO: 691301 - protein, 19 aa, Mycobacterium
LHPHTRMLNRVKVHPQMII

SEQ ID NO: 691302 - protein, 19 aa, Mycobacterium
LHPKIAVDENVLFVDDGDL

SEQ ID NO: 691303 - protein, 31 aa, Mycobacterium
LHPLALPLLRPRQVIMLGRPTLHRPVSALLA

SEQ ID NO: 691304 - protein, 17 aa, Mycobacterium
LHPLATMERTFIAPSRF

SEQ ID NO: 691305 - protein, 18 aa, Mycobacterium
LHPLCGVIDLDTLDELMA

SEQ ID NO: 691306 - protein, 25 aa, Mycobacterium
LHPLPPGLGRFPLRRVADYPNTAPA

SEQ ID NO: 691307 - protein, 26 aa, Mycobacterium
LHPLPPGLGRFPLRRVEDYPDTAPAE

SEQ ID NO: 691308 - protein, 25 aa, Mycobacterium
LHPQQRVAMRVAWKALENSGINPGS

SEQ ID NO: 691309 - protein, 21 aa, Mycobacterium
LHPRALAAYRRAEGRLPSDAP

SEQ ID NO: 691310 - protein, 21 aa, Mycobacterium
LHPRALAAYRRAEGRVKRDAP

SEQ ID NO: 691311 - protein, 23 aa, Mycobacterium
LHPRFTQPELRAFHAEYGIATEA

SEQ ID NO: 691312 - protein, 24 aa, Mycobacterium
LHPSAIAALGIREWDAVSLTGSRT

SEQ ID NO: 691313 - protein, 22 aa, Mycobacterium
LHPTNLGRLVLGKQAALPCTPR

SEQ ID NO: 691314 - protein, 17 aa, Mycobacterium
LHPVSAVLAALVEAPNG

SEQ ID NO: 691315 - protein, 25 aa, Mycobacterium
LHPVSRLTTALALAQWIEEHRPDCE

SEQ ID NO: 691316 - protein, 23 aa, Mycobacterium
LHPYEVPRDFLLEPQRFTRDNGL

SEQ ID NO: 691317 - protein, 22 aa, Mycobacterium
LHPYRVRHLLDRYGSLIDEVLA

SEQ ID NO: 691318 - protein, 26 aa, Mycobacterium
LHPYRVRHLLDRYGSLIGEVLALADG

SEQ ID NO: 691319 - protein, 29 aa, Mycobacterium
LHPYRVRHLLDRYGSLIGEVLKLAEDNPD

SEQ ID NO: 691320 - protein, 17 aa, Mycobacterium
LHQAGLRRVFVGIETGS

SEQ ID NO: 691321 - protein, 18 aa, Mycobacterium
LHQALRTYAGLDFLTDLR

SEQ ID NO: 691322 - protein, 18 aa, Mycobacterium
LHQARSLIRHNIRIEPEH

SEQ ID NO: 691323 - protein, 24 aa, Mycobacterium
LHQCRLTIWHACWMMDNGAKGRHE

SEQ ID NO: 691324 - protein, 19 aa, Mycobacterium
LHQLRRAAPEVDFRAVNDR

SEQ ID NO: 691325 - protein, 25 aa, Mycobacterium
LHQRYGWQWNIVPLLKIPGVTNVHR

SEQ ID NO: 691326 - protein, 25 aa, Mycobacterium
LHQSRINAMPAFRGRGFYWHSDFET

SEQ ID NO: 691327 - protein, 24 aa, Mycobacterium
LHRAARMWPDRSAVTVIPDTTRWR

SEQ ID NO: 691328 - protein, 17 aa, Mycobacterium
LHRAISSFARMDAVVIT

SEQ ID NO: 691329 - protein, 25 aa, Mycobacterium
LHRALADLMPWLADRVDALKSLDDV

SEQ ID NO: 691330 - protein, 18 aa, Mycobacterium
LHRARTDLFAAARRELLP

SEQ ID NO: 691331 - protein, 29 aa, Mycobacterium
LHRATRPGARWYIWCFAQGAVHGVPTPFQ

SEQ ID NO: 691332 - protein, 19 aa, Mycobacterium
LHRDLRLLAADLVFDLPMV

SEQ ID NO: 691333 - protein, 19 aa, Mycobacterium
LHRDPRVVICVDDPHPPYS

SEQ ID NO: 691334 - protein, 27 aa, Mycobacterium
LHREFDLAQRFSHPRIVTVFERGQDWL

SEQ ID NO: 691335 - protein, 20 aa, Mycobacterium
LHREGWRVVAAMRTPDLGLP

SEQ ID NO: 691336 - protein, 22 aa, Mycobacterium
LHRELRGAAIGHFASTEITSPP

SEQ ID NO: 691337 - protein, 19 aa, Mycobacterium
LHRFGESIGQLAAAIRGGD

SEQ ID NO: 691338 - protein, 24 aa, Mycobacterium
LHRGDLCVRREEMWSPVTDGIATA

SEQ ID NO: 691339 - protein, 25 aa, Mycobacterium
LHRGDPVAGLTWLPFVDQRYTAVTG

SEQ ID NO: 691340 - protein, 32 aa, Mycobacterium
LHRGEDGWESADWTLRRGRIVLTDGDSPAGLR

SEQ ID NO: 691341 - protein, 25 aa, Mycobacterium
LHRGQRAYLGYGLWSKRRRAPGLTP

SEQ ID NO: 691342 - protein, 26 aa, Mycobacterium
LHRGRRRLREHLIGFAYQSGYLARPA

SEQ ID NO: 691343 - protein, 17 aa, Mycobacterium
LHRGRRTARPSGDDREL

SEQ ID NO: 691344 - protein, 17 aa, Mycobacterium
LHRHPRLDFKRHMRRAW

SEQ ID NO: 691345 - protein, 23 aa, Mycobacterium
LHRHVKRSLVLDGLLGSAHELIR

SEQ ID NO: 691346 - protein, 25 aa, Mycobacterium
LHRIFRGAACVVHLAWGFQPTRNTR

SEQ ID NO: 691347 - protein, 29 aa, Mycobacterium
LHRILLQRSWIAIFWSRFAEAVELIAEAR

SEQ ID NO: 691348 - protein, 20 aa, Mycobacterium
LHRIPLLPVGMFKQTGAHVL

SEQ ID NO: 691349 - protein, 17 aa, Mycobacterium
LHRKYGCSLQIGGSDQW

SEQ ID NO: 691350 - protein, 19 aa, Mycobacterium
LHRLCDVAGALDCPLLLKE

SEQ ID NO: 691351 - protein, 19 aa, Mycobacterium
LHRLDEHLVEFEAKATAAG

SEQ ID NO: 691352 - protein, 17 aa, Mycobacterium
LHRLGIDTIGGFAALAD

SEQ ID NO: 691353 - protein, 33 aa, Mycobacterium
LHRLLRRYRLELARPDYRACWDYGGMPVPKDGM

SEQ ID NO: 691354 - protein, 26 aa, Mycobacterium
LHRPGIRFVSFSSVNGFFGGSTVGGY

SEQ ID NO: 691355 - protein, 17 aa, Mycobacterium
LHRPKLGFPVPIRHWLR

SEQ ID NO: 691356 - protein, 24 aa, Mycobacterium
LHRRCADVRYLGSWPTGETGGAAP

SEQ ID NO: 691357 - protein, 23 aa, Mycobacterium
LHRRCADVRYLGSWPTGQAVGMQ

SEQ ID NO: 691358 - protein, 24 aa, Mycobacterium
LHRRCVDVRYLGSWPTESAAGAPP

SEQ ID NO: 691359 - protein, 20 aa, Mycobacterium
LHRRFGDLVRFVFALVPSRF

SEQ ID NO: 691360 - protein, 19 aa, Mycobacterium
LHRRFGDLVRLVFAVVPRR

SEQ ID NO: 691361 - protein, 21 aa, Mycobacterium
LHRRFGNLVRLIFAFVPPRYR

SEQ ID NO: 691362 - protein, 20 aa, Mycobacterium
LHRRLGRWVQLGGHCDDDDA

SEQ ID NO: 691363 - protein, 19 aa, Mycobacterium
LHRRRIAGASVLLGVDGVT

SEQ ID NO: 691364 - protein, 24 aa, Mycobacterium
LHRRSARALRNWVHREQHHLDQLR

SEQ ID NO: 691365 - protein, 18 aa, Mycobacterium
LHRRSCAARETLDGRLRA

SEQ ID NO: 691366 - protein, 21 aa, Mycobacterium
LHRRTEGWAAGLYLAALSLAG

SEQ ID NO: 691367 - protein, 22 aa, Mycobacterium
LHRRYGWQWNIVPLLKVPGVTN

SEQ ID NO: 691368 - protein, 23 aa, Mycobacterium
LHRSDCPLFAPGTYTDRPAVITP

SEQ ID NO: 691369 - protein, 18 aa, Mycobacterium
LHRSEAVGLVGIVRTAAI

SEQ ID NO: 691370 - protein, 26 aa, Mycobacterium
LHRSFGRLVNVVFRFVPERFRRHPRA

SEQ ID NO: 691371 - protein, 19 aa, Mycobacterium
LHRSLGTALGRTICAGISR

SEQ ID NO: 691372 - protein, 18 aa, Mycobacterium
LHRVLKAAMELTGARYAA

SEQ ID NO: 691373 - protein, 24 aa, Mycobacterium
LHRVRSRVGAVLPGEWTPRFAEAL

SEQ ID NO: 691374 - protein, 19 aa, Mycobacterium
LHRVTPRLTRAEIAEHQRV

SEQ ID NO: 691375 - protein, 23 aa, Mycobacterium
LHRYRVVAVTSDIAALVECAGGF

SEQ ID NO: 691376 - protein, 18 aa, Mycobacterium
LHSAGYAVPHWPAEWGGG

SEQ ID NO: 691377 - protein, 18 aa, Mycobacterium
LHSAGYAVPHWPAQWGGG

SEQ ID NO: 691378 - protein, 25 aa, Mycobacterium
LHSAREVFSTIGFDRASLRQIAEEA

SEQ ID NO: 691379 - protein, 21 aa, Mycobacterium
LHSARLALCRATRQVIANGLA

SEQ ID NO: 691380 - protein, 23 aa, Mycobacterium
LHSARRPGLRLGQQRHRSRGPVH

SEQ ID NO: 691381 - protein, 17 aa, Mycobacterium
LHSCPQMAWSQVRTTVA

SEQ ID NO: 691382 - protein, 20 aa, Mycobacterium
LHSGLPYPPGVAIHETGGAR

SEQ ID NO: 691383 - protein, 25 aa, Mycobacterium
LHSHYWLSGQVGWLAADRWAVPLVH

SEQ ID NO: 691384 - protein, 20 aa, Mycobacterium
LHSKFGKLPYERLFEPAISY

SEQ ID NO: 691385 - protein, 24 aa, Mycobacterium
LHSLDLAEVLAFAHGRPTAATVRH

SEQ ID NO: 691386 - protein, 21 aa, Mycobacterium
LHSMIGWPAGTLADFQNARAT

SEQ ID NO: 691387 - protein, 30 aa, Mycobacterium
LHSNPGAARKAGRRFALLAPIVATHRKLVA

SEQ ID NO: 691388 - protein, 24 aa, Mycobacterium
LHSRFARELPELAIGWQAEPAPAP

SEQ ID NO: 691389 - protein, 18 aa, Mycobacterium
LHSSFAPLFRPGGVGRTP

SEQ ID NO: 691390 - protein, 19 aa, Mycobacterium
LHSTFAPLFGKSGVGRTPV

SEQ ID NO: 691391 - protein, 31 aa, Mycobacterium
LHSVARSHVEVALKHPIKLIANALGSPPKDV

SEQ ID NO: 691392 - protein, 25 aa, Mycobacterium
LHTAKGLEFPAVFVTGWEDGMFPHM

SEQ ID NO: 691393 - protein, 26 aa, Mycobacterium
LHTAKGLEFPLVFVTGWEDGMFPHMR

SEQ ID NO: 691394 - protein, 21 aa, Mycobacterium
LHTALRLPRDAALTVDGQDVV

SEQ ID NO: 691395 - protein, 18 aa, Mycobacterium
LHTARLALCQATRQVIAN

SEQ ID NO: 691396 - protein, 19 aa, Mycobacterium
LHTARLALCQATRQVIANG

SEQ ID NO: 691397 - protein, 17 aa, Mycobacterium
LHTDHPMCLEIRPYTTG

SEQ ID NO: 691398 - protein, 26 aa, Mycobacterium
LHTDLKRLEAGGVTGQFWSVYVPPQQ

SEQ ID NO: 691399 - protein, 20 aa, Mycobacterium
LHTEECRKLGLAFAADPSQQ

SEQ ID NO: 691400 - protein, 19 aa, Mycobacterium
LHTEFRKLVSRGFTPRQVE

SEQ ID NO: 691401 - protein, 23 aa, Mycobacterium
LHTILRLPTGIFYAQGVKANVLF

SEQ ID NO: 691402 - protein, 18 aa, Mycobacterium
LHTKGVDVLGLILGKTDT

SEQ ID NO: 691403 - protein, 18 aa, Mycobacterium
LHTKVGLMDELDKVKRVV

SEQ ID NO: 691404 - protein, 26 aa, Mycobacterium
LHTLEFPDVPGVRIDAGFTSGSTVST

SEQ ID NO: 691405 - protein, 17 aa, Mycobacterium
LHTLPPAAQAAILEELD

SEQ ID NO: 691406 - protein, 29 aa, Mycobacterium
LHTMPFAALHFFPARALELGGFQEPVTTV

SEQ ID NO: 691407 - protein, 18 aa, Mycobacterium
LHTPLPVLAFTSLPEVRS

SEQ ID NO: 691408 - protein, 22 aa, Mycobacterium
LHTRAHLPYLVYLRNPTTGGVF

SEQ ID NO: 691409 - protein, 22 aa, Mycobacterium
LHTRALVALCAVQLGVAERALR

SEQ ID NO: 691410 - protein, 17 aa, Mycobacterium
LHTRFPNGFTATVRGVF

SEQ ID NO: 691411 - protein, 24 aa, Mycobacterium
LHTSTRFRNLWSHHEVAHAPVSPV

SEQ ID NO: 691412 - protein, 26 aa, Mycobacterium
LHTTYPPLRRPRHRRVLTVANQKGGV

SEQ ID NO: 691413 - protein, 24 aa, Mycobacterium
LHTVGMLFSPGYPGFLRGVTASGP

SEQ ID NO: 691414 - protein, 18 aa, Mycobacterium
LHTVHRLLVSRAFTPRKL

SEQ ID NO: 691415 - protein, 18 aa, Mycobacterium
LHTVHRLLVSRAFTPRKM

SEQ ID NO: 691416 - protein, 29 aa, Mycobacterium
LHVAAKAFWPSPLPFPVMHIDTGHNFDEV

SEQ ID NO: 691417 - protein, 19 aa, Mycobacterium
LHVDGAFGLWAAAAPSTRH

SEQ ID NO: 691418 - protein, 20 aa, Mycobacterium
LHVDVLWKTVDDFTIQVQRG

SEQ ID NO: 691419 - protein, 19 aa, Mycobacterium
LHVELPAGAGHVWQSDVGL

SEQ ID NO: 691420 - protein, 18 aa, Mycobacterium
LHVGQRVIAMVMFVGEHG

SEQ ID NO: 691421 - protein, 17 aa, Mycobacterium
LHVGRALTDSEITKRAR

SEQ ID NO: 691422 - protein, 18 aa, Mycobacterium
LHVHPGCPHAFESMAPNA

SEQ ID NO: 691423 - protein, 22 aa, Mycobacterium
LHVHVVPRWGGDANFITIIGGS

SEQ ID NO: 691424 - protein, 18 aa, Mycobacterium
LHVLAGAAIKAGLDVIVA

SEQ ID NO: 691425 - protein, 20 aa, Mycobacterium
LHVLEVYLAAVIGIDDSTNT

SEQ ID NO: 691426 - protein, 24 aa, Mycobacterium
LHVLQNCRIRWGTVVEVEGEHVKL

SEQ ID NO: 691427 - protein, 17 aa, Mycobacterium
LHVLVAALQQWGDRHLP

SEQ ID NO: 691428 - protein, 19 aa, Mycobacterium
LHVMELKPAFAEATAGRGD

SEQ ID NO: 691429 - protein, 27 aa, Mycobacterium
LHVPGRAPVVPALGMALLGARAAGKII

SEQ ID NO: 691430 - protein, 18 aa, Mycobacterium
LHVRGSVVLHRLNEKHQS

SEQ ID NO: 691431 - protein, 29 aa, Mycobacterium
LHVRHYIPFASTFAAFLTRAHDFIRMAAV

SEQ ID NO: 691432 - protein, 26 aa, Mycobacterium
LHVRSGAIARGGLRFSDRPEDYRTEV

SEQ ID NO: 691433 - protein, 18 aa, Mycobacterium
LHVRSWRSAYRGLIAEDY

SEQ ID NO: 691434 - protein, 21 aa, Mycobacterium
LHWAAGKGFKAVFLPTTPHPS

SEQ ID NO: 691435 - protein, 22 aa, Mycobacterium
LHWLSTHVPIYALNILLATATD

SEQ ID NO: 691436 - protein, 17 aa, Mycobacterium
LHYCLGANLARLEGRVA

SEQ ID NO: 691437 - protein, 20 aa, Mycobacterium
LHYEMPLILNVPTFTICCAT

SEQ ID NO: 691438 - protein, 23 aa, Mycobacterium
LHYGPPFCSVLGIGHEPADPDHI

SEQ ID NO: 691439 - protein, 17 aa, Mycobacterium
LHYPATYVAGIYNRLFD

SEQ ID NO: 691440 - protein, 26 aa, Mycobacterium
LHYRLKDFRKGIAFGNPYRLINQCAP

SEQ ID NO: 691441 - protein, 17 aa, Mycobacterium
LHYRTKGAVGMPLTIRI

SEQ ID NO: 691442 - protein, 19 aa, Mycobacterium
LHYSLKRLRLILAEMGCHA

SEQ ID NO: 691443 - protein, 19 aa, Mycobacterium
LHYSLRRTWDYFVRHLHGT

SEQ ID NO: 691444 - protein, 33 aa, Mycobacterium
LIAACAKRFPGGWMVFDTIPWLMSVYSRRRGWR

SEQ ID NO: 691445 - protein, 23 aa, Mycobacterium
LIAAEWPHPALLQVDTPRCAPSD

SEQ ID NO: 691446 - protein, 19 aa, Mycobacterium
LIAAGSKLAELVFPAPPAP

SEQ ID NO: 691447 - protein, 18 aa, Mycobacterium
LIAAKWNLSREQLDTFAA

SEQ ID NO: 691448 - protein, 19 aa, Mycobacterium
LIAALRAIFAAWNCGDRLN

SEQ ID NO: 691449 - protein, 17 aa, Mycobacterium
LIAANRSQLMALIATNV

SEQ ID NO: 691450 - protein, 18 aa, Mycobacterium
LIAARRGVGVIFQSAPLL

SEQ ID NO: 691451 - protein, 22 aa, Mycobacterium
LIAATCRGAAGAASVSVCGEFA

SEQ ID NO: 691452 - protein, 19 aa, Mycobacterium
LIADFAMQLPVAIIAEILG

SEQ ID NO: 691453 - protein, 18 aa, Mycobacterium
LIADRLLPGGVFHAATDH

SEQ ID NO: 691454 - protein, 22 aa, Mycobacterium
LIADRVVAWLADRYARRRDGDP

SEQ ID NO: 691455 - protein, 17 aa, Mycobacterium
LIADSGLTVSQLVSTAW

SEQ ID NO: 691456 - protein, 24 aa, Mycobacterium
LIAEALAMLGLRRLHVKRVVLTHF

SEQ ID NO: 691457 - protein, 18 aa, Mycobacterium
LIAECDVILLPKVHAEDL

SEQ ID NO: 691458 - protein, 21 aa, Mycobacterium
LIAEFTPWISEIQVPGSASNL

SEQ ID NO: 691459 - protein, 17 aa, Mycobacterium
LIAEGKFNAPVLEITQA

SEQ ID NO: 691460 - protein, 25 aa, Mycobacterium
LIAEGRVRPIIGARLPIQRAGEAHQ

SEQ ID NO: 691461 - protein, 21 aa, Mycobacterium
LIAEHGLRFPVGHSADARTVA

SEQ ID NO: 691462 - protein, 26 aa, Mycobacterium
LIAEISTRFEAVIVEGQKAGTIRPQL

SEQ ID NO: 691463 - protein, 24 aa, Mycobacterium
LIAEKRPDLGPIFMNALPVLMTEA

SEQ ID NO: 691464 - protein, 23 aa, Mycobacterium
LIAELKQEFTIVIVTHNMQQAAR

SEQ ID NO: 691465 - protein, 18 aa, Mycobacterium
LIAEVFFSAAASRELFSA

SEQ ID NO: 691466 - protein, 23 aa, Mycobacterium
LIAEVLYHIGVDIGDHLRCRAVK

SEQ ID NO: 691467 - protein, 17 aa, Mycobacterium
LIAFDVLGSGVGEHVLV

SEQ ID NO: 691468 - protein, 17 aa, Mycobacterium
LIAFDYIEESMALGAIS

SEQ ID NO: 691469 - protein, 19 aa, Mycobacterium
LIAFGLAWSEYLGSEQGSI

SEQ ID NO: 691470 - protein, 25 aa, Mycobacterium
LIAFGRARLAFLERHLDLARATTAD

SEQ ID NO: 691471 - protein, 18 aa, Mycobacterium
LIAFGRYPAFDDLSPQFG

SEQ ID NO: 691472 - protein, 22 aa, Mycobacterium
LIAGCGTFQAAVFAFMNRAARV

SEQ ID NO: 691473 - protein, 23 aa, Mycobacterium
LIAGELRPTSGMVHASGEIGYLP

SEQ ID NO: 691474 - protein, 18 aa, Mycobacterium
LIAGERGGSIVFTSSTAG

SEQ ID NO: 691475 - protein, 18 aa, Mycobacterium
LIAGIPVTEDQWWERSPI

SEQ ID NO: 691476 - protein, 19 aa, Mycobacterium
LIAGPGVYICDECIDLCNE

SEQ ID NO: 691477 - protein, 17 aa, Mycobacterium
LIAGSWSPRYAHNLGGD

SEQ ID NO: 691478 - protein, 17 aa, Mycobacterium
LIAGTRSKAGWLAGTAA

SEQ ID NO: 691479 - protein, 17 aa, Mycobacterium
LIAGVPVVPVPADVGVA

SEQ ID NO: 691480 - protein, 17 aa, Mycobacterium
LIAGWRVLLSQLPFHDP

SEQ ID NO: 691481 - protein, 31 aa, Mycobacterium
LIAGYKCPRSIEFVNALPLSGAGKVLKRELR

SEQ ID NO: 691482 - protein, 24 aa, Mycobacterium
LIAHCRERLAGYKCPKRVEFVDSL

SEQ ID NO: 691483 - protein, 17 aa, Mycobacterium
LIAHLSRYQTLQPGDVI

SEQ ID NO: 691484 - protein, 22 aa, Mycobacterium
LIAIRPGYWRPANFAAATATLD

SEQ ID NO: 691485 - protein, 29 aa, Mycobacterium
LIAKGAGNMSSWSALFPHASSTGSPNTAI

SEQ ID NO: 691486 - protein, 17 aa, Mycobacterium
LIAKLSYTNLGFALAPK

SEQ ID NO: 691487 - protein, 37 aa, Mycobacterium
LIALPSGRYSWRMSLPAMVCYWSELAREIVLPPAGTP

SEQ ID NO: 691488 - protein, 18 aa, Mycobacterium
LIALTMNLSRRWANDGIR

SEQ ID NO: 691489 - protein, 26 aa, Mycobacterium
LIAMPALRLDAAFAHLNLGDCHGNAA

SEQ ID NO: 691490 - protein, 24 aa, Mycobacterium
LIAPCSRAMYGFLGLDPDHRSCTS

SEQ ID NO: 691491 - protein, 17 aa, Mycobacterium
LIAPLRIGLREAGVPVL

SEQ ID NO: 691492 - protein, 20 aa, Mycobacterium
LIAPLTFLAVAGRRVQLDLF

SEQ ID NO: 691493 - protein, 26 aa, Mycobacterium
LIAPMPGVVLRLGAAVGDAVTAGTPI

SEQ ID NO: 691494 - protein, 22 aa, Mycobacterium
LIAPNLWAGVGLVRGGAGTALV

SEQ ID NO: 691495 - protein, 24 aa, Mycobacterium
LIAQLCAMASVAVHDFGFEPGDVR

SEQ ID NO: 691496 - protein, 24 aa, Mycobacterium
LIARCPCLLAVCSAGAGYDVIDVD

SEQ ID NO: 691497 - protein, 19 aa, Mycobacterium
LIARIGWTCRDVWWAAIQD

SEQ ID NO: 691498 - protein, 18 aa, Mycobacterium
LIARLAARPLDKSRPLWE

SEQ ID NO: 691499 - protein, 18 aa, Mycobacterium
LIARLDAAVARHAPKWMR

SEQ ID NO: 691500 - protein, 24 aa, Mycobacterium
LIARNLFRDMTHPLIARPLPAETG

SEQ ID NO: 691501 - protein, 18 aa, Mycobacterium
LIARRHMHTYGTTREQLS

SEQ ID NO: 691502 - protein, 19 aa, Mycobacterium
LIARRLRLDPAEVRRRNLL

SEQ ID NO: 691503 - protein, 22 aa, Mycobacterium
LIARRVREARVFSEVIPHSASV

SEQ ID NO: 691504 - protein, 20 aa, Mycobacterium
LIARRVREARVFSEVIPHTA

SEQ ID NO: 691505 - protein, 21 aa, Mycobacterium
LIARRVREARVFSEVIPHTAS

SEQ ID NO: 691506 - protein, 21 aa, Mycobacterium
LIARRVREARVFSEVIPHTAT

SEQ ID NO: 691507 - protein, 20 aa, Mycobacterium
LIARRVREARVFSEVIPHTT

SEQ ID NO: 691508 - protein, 27 aa, Mycobacterium
LIASQLIGLAMTRYVWQIEPIASMSDS

SEQ ID NO: 691509 - protein, 26 aa, Mycobacterium
LIATFNLNRLQAWHMSRNEPDDEERG

SEQ ID NO: 691510 - protein, 18 aa, Mycobacterium
LIATGGMGQVWEAVDSRL

SEQ ID NO: 691511 - protein, 20 aa, Mycobacterium
LIATMAADGIVFALSNPDPE

SEQ ID NO: 691512 - protein, 18 aa, Mycobacterium
LIATMAPNGIVFALSNPD

SEQ ID NO: 691513 - protein, 18 aa, Mycobacterium
LIATVAAPPIAPRALDAD

SEQ ID NO: 691514 - protein, 18 aa, Mycobacterium
LIATVAAPPLVSRAVDAD

SEQ ID NO: 691515 - protein, 20 aa, Mycobacterium
LIAVRRGRGGGFTVQAPEYD

SEQ ID NO: 691516 - protein, 24 aa, Mycobacterium
LICALPRIRGAELVIVGGPAQADF

SEQ ID NO: 691517 - protein, 18 aa, Mycobacterium
LICDEIKGETIVRRIQRR

SEQ ID NO: 691518 - protein, 26 aa, Mycobacterium
LICGDVIRPGVPWMLTRTHARLAGAM

SEQ ID NO: 691519 - protein, 17 aa, Mycobacterium
LIDACRLSRARVVVTPY

SEQ ID NO: 691520 - protein, 19 aa, Mycobacterium
LIDAFFHRGLMLMSFDEHL

SEQ ID NO: 691521 - protein, 21 aa, Mycobacterium
LIDAFFHRGLMLMSFDEHLMH

SEQ ID NO: 691522 - protein, 22 aa, Mycobacterium
LIDAGIEVAAWIVLTHSTRLGE

SEQ ID NO: 691523 - protein, 18 aa, Mycobacterium
LIDAPAFVANGFLNGEVT

SEQ ID NO: 691524 - protein, 19 aa, Mycobacterium
LIDAVKFTPALTGPHAQLT

SEQ ID NO: 691525 - protein, 19 aa, Mycobacterium
LIDEHRPHVVVTYDPFGGY

SEQ ID NO: 691526 - protein, 18 aa, Mycobacterium
LIDEIFGLLVRDFNSYAV

SEQ ID NO: 691527 - protein, 19 aa, Mycobacterium
LIDEYRPRTLVLSAGAAPR

SEQ ID NO: 691528 - protein, 23 aa, Mycobacterium
LIDFAAQLLTGFSPPGATQAVYT

SEQ ID NO: 691529 - protein, 19 aa, Mycobacterium
LIDGVPWSRMAVIVRSVPR

SEQ ID NO: 691530 - protein, 23 aa, Mycobacterium
LIDKGVPVDLVFQSIAGTEGANS

SEQ ID NO: 691531 - protein, 22 aa, Mycobacterium
LIDLQFAREWIQPHRIHDPEKL

SEQ ID NO: 691532 - protein, 29 aa, Mycobacterium
LIDMAVGPLWRIAVLRLTEQQCRIVLTAH

SEQ ID NO: 691533 - protein, 22 aa, Mycobacterium
LIDMKGGELVFGPNPLTPEFSI

SEQ ID NO: 691534 - protein, 23 aa, Mycobacterium
LIDPALLRPGRLEKLVFVEPPDA

SEQ ID NO: 691535 - protein, 23 aa, Mycobacterium
LIDPALLRPGRLERLVFVEPPDA

SEQ ID NO: 691536 - protein, 24 aa, Mycobacterium
LIDPALLRPGRLERLVFVEPPDAA

SEQ ID NO: 691537 - protein, 26 aa, Mycobacterium
LIDPALLRPGRLERRVFVEPPDAAAR

SEQ ID NO: 691538 - protein, 29 aa, Mycobacterium
LIDPDAWAFTWVVDWPMFESAAEATASGD

SEQ ID NO: 691539 - protein, 25 aa, Mycobacterium
LIDQPRFVQPYLWALDSLHRVGARA

SEQ ID NO: 691540 - protein, 18 aa, Mycobacterium
LIDRASRWLLNYRPQPLA

SEQ ID NO: 691541 - protein, 25 aa, Mycobacterium
LIDRATRWLLNYRPLPLAVGAEINR

SEQ ID NO: 691542 - protein, 26 aa, Mycobacterium
LIDRCWAPKVYGAWNLHRVLQEGTGG

SEQ ID NO: 691543 - protein, 23 aa, Mycobacterium
LIDREMLRPTYVFAAVDHTGADV

SEQ ID NO: 691544 - protein, 22 aa, Mycobacterium
LIDRGAPVDLVFQSIAGTEGAN

SEQ ID NO: 691545 - protein, 23 aa, Mycobacterium
LIDRLKDIINRGGENVSSVEVEA

SEQ ID NO: 691546 - protein, 25 aa, Mycobacterium
LIDRPLRPSFVNGLRNEIQVVVTIL

SEQ ID NO: 691547 - protein, 26 aa, Mycobacterium
LIDRPLRPSFVSGLRNEIQVVVTILS

SEQ ID NO: 691548 - protein, 26 aa, Mycobacterium
LIDRPLRPSFVSGLRNEIQVVVTVLS

SEQ ID NO: 691549 - protein, 26 aa, Mycobacterium
LIDRPLRPSFVSGLRNEIQVVVTVMS

SEQ ID NO: 691550 - protein, 26 aa, Mycobacterium
LIDRSKPNNARWCSMAICGNRMKARR

SEQ ID NO: 691551 - protein, 26 aa, Mycobacterium
LIDRSKPNTARWCSMAICGNRMKARR

SEQ ID NO: 691552 - protein, 17 aa, Mycobacterium
LIDRVVFWMLPMDDPLP

SEQ ID NO: 691553 - protein, 17 aa, Mycobacterium
LIDSSGLSRVTVRAAVG

SEQ ID NO: 691554 - protein, 17 aa, Mycobacterium
LIDVEIMDFADLKHPAE

SEQ ID NO: 691555 - protein, 21 aa, Mycobacterium
LIDVYSCFPSAVQVAARELGL

SEQ ID NO: 691556 - protein, 22 aa, Mycobacterium
LIDWADERAHLPVDPEWGPGWH

SEQ ID NO: 691557 - protein, 25 aa, Mycobacterium
LIEAQAGHILRCLRHARTADSNYVE

SEQ ID NO: 691558 - protein, 17 aa, Mycobacterium
LIEAREKAFWAAKAAGA

SEQ ID NO: 691559 - protein, 18 aa, Mycobacterium
LIEDGLTYDTLRGVSIEG

SEQ ID NO: 691560 - protein, 20 aa, Mycobacterium
LIEDRFRYTAGQFVTVKTTI

SEQ ID NO: 691561 - protein, 28 aa, Mycobacterium
LIEEKGFCAVAAEADWPDAYRVNRYVRG

SEQ ID NO: 691562 - protein, 28 aa, Mycobacterium
LIEESIYGWKEFELELMRDGHDNVVVVC

SEQ ID NO: 691563 - protein, 25 aa, Mycobacterium
LIEESIYGWKEFELELMRDGNDNVV

SEQ ID NO: 691564 - protein, 27 aa, Mycobacterium
LIEESIYGWKEFELELMRDGRDNVVVV

SEQ ID NO: 691565 - protein, 27 aa, Mycobacterium
LIEESIYGWKEFELELMRDSHDNVVVV

SEQ ID NO: 691566 - protein, 20 aa, Mycobacterium
LIEEWLEFVGEKLPTGVKDE

SEQ ID NO: 691567 - protein, 17 aa, Mycobacterium
LIEEYPTRLVVTRTMSK

SEQ ID NO: 691568 - protein, 20 aa, Mycobacterium
LIEFLLRMIQSMVIAPPEPP

SEQ ID NO: 691569 - protein, 21 aa, Mycobacterium
LIEGPSGWGEFGAFLEYQPPE

SEQ ID NO: 691570 - protein, 20 aa, Mycobacterium
LIEHCAGFLGSLGLYTLGQK

SEQ ID NO: 691571 - protein, 23 aa, Mycobacterium
LIEIRPGAGAFVLRKPTTAVGTG

SEQ ID NO: 691572 - protein, 25 aa, Mycobacterium
LIEKERPRFVVPLVEAASREALDKL

SEQ ID NO: 691573 - protein, 19 aa, Mycobacterium
LIEKHKINMLFFAGDAIGR

SEQ ID NO: 691574 - protein, 17 aa, Mycobacterium
LIEKIQGGFLDFDAAIA

SEQ ID NO: 691575 - protein, 18 aa, Mycobacterium
LIEKIQGGFLDFDAAIAT

SEQ ID NO: 691576 - protein, 25 aa, Mycobacterium
LIELLAWQFASPVRWIETQDLLFTE

SEQ ID NO: 691577 - protein, 19 aa, Mycobacterium
LIELLRPGTFTSVKTFQRE

SEQ ID NO: 691578 - protein, 23 aa, Mycobacterium
LIELPDNRWHLVITAHHIVIDGW

SEQ ID NO: 691579 - protein, 20 aa, Mycobacterium
LIELQERISLEQNREQVGRA

SEQ ID NO: 691580 - protein, 25 aa, Mycobacterium
LIEMPRERWRLVLTAHHIVIDGWSL

SEQ ID NO: 691581 - protein, 18 aa, Mycobacterium
LIEPGVRTGLPLLVDNPK

SEQ ID NO: 691582 - protein, 24 aa, Mycobacterium
LIEQGGVEFACFDLLAELTVALLT

SEQ ID NO: 691583 - protein, 27 aa, Mycobacterium
LIEQKGFCAVAAEADWPDAYRVNRYVH

SEQ ID NO: 691584 - protein, 18 aa, Mycobacterium
LIERAGVVTLVVQREEPP

SEQ ID NO: 691585 - protein, 24 aa, Mycobacterium
LIERAKLFLHRSGGPRLTDEEALA

SEQ ID NO: 691586 - protein, 19 aa, Mycobacterium
LIERLKLGAELNEPDVATF

SEQ ID NO: 691587 - protein, 20 aa, Mycobacterium
LIERLQRPTLVMAPNKTLAA

SEQ ID NO: 691588 - protein, 18 aa, Mycobacterium
LIERLQRPTLVMEPNKTL

SEQ ID NO: 691589 - protein, 20 aa, Mycobacterium
LIESVPGWLELAVVNAASSV

SEQ ID NO: 691590 - protein, 23 aa, Mycobacterium
LIETARLWISLGHHDRHGIWHLD

SEQ ID NO: 691591 - protein, 18 aa, Mycobacterium
LIETCWHAALAAAGGATC

SEQ ID NO: 691592 - protein, 24 aa, Mycobacterium
LIEVHSAWGSSPWFFEDALARGLR

SEQ ID NO: 691593 - protein, 18 aa, Mycobacterium
LIEVIGGQGIRLSSYLPT

SEQ ID NO: 691594 - protein, 19 aa, Mycobacterium
LIEWQRDFFDFGHVVKGYA

SEQ ID NO: 691595 - protein, 17 aa, Mycobacterium
LIFAPAPFFDEGIGVAT

SEQ ID NO: 691596 - protein, 18 aa, Mycobacterium
LIFAPAPFYDEGLRVQPP

SEQ ID NO: 691597 - protein, 23 aa, Mycobacterium
LIFGTVNSLIEWYRPSRTLSADE

SEQ ID NO: 691598 - protein, 21 aa, Mycobacterium
LIFMEVPLRAVPGLRIRADAE

SEQ ID NO: 691599 - protein, 26 aa, Mycobacterium
LIFRAPGLRVGEPVYLTGNFITAVKS

SEQ ID NO: 691600 - protein, 17 aa, Mycobacterium
LIFSYQASRKFPRAARR

SEQ ID NO: 691601 - protein, 19 aa, Mycobacterium
LIGASRATAMFLLGDTIDA

SEQ ID NO: 691602 - protein, 23 aa, Mycobacterium
LIGASRKRFLGSLLTDLKGVERP

SEQ ID NO: 691603 - protein, 18 aa, Mycobacterium
LIGAWCFVDHYGPVSAHM

SEQ ID NO: 691604 - protein, 23 aa, Mycobacterium
LIGAWSAAFARYERTVGQVLLTA

SEQ ID NO: 691605 - protein, 32 aa, Mycobacterium
LIGEVLAELGFRPRRLAGRVVWMAPPDAPLPA

SEQ ID NO: 691606 - protein, 25 aa, Mycobacterium
LIGEYGITWILPRLAGWGAAADLLL

SEQ ID NO: 691607 - protein, 22 aa, Mycobacterium
LIGGFRPLFRALDPDQINALSG

SEQ ID NO: 691608 - protein, 17 aa, Mycobacterium
LIGGHNMLPGTITSADR

SEQ ID NO: 691609 - protein, 26 aa, Mycobacterium
LIGGKCPACGTYVFPPRENNCPNPGC

SEQ ID NO: 691610 - protein, 26 aa, Mycobacterium
LIGGKCTGCGTLVFPPRTTNCPNPGC

SEQ ID NO: 691611 - protein, 18 aa, Mycobacterium
LIGHRGFELIADCLGMTI

SEQ ID NO: 691612 - protein, 22 aa, Mycobacterium
LIGHSLGGFVIQRYLEERSAAA

SEQ ID NO: 691613 - protein, 18 aa, Mycobacterium
LIGKRPRKSAAEVAGPDA

SEQ ID NO: 691614 - protein, 39 aa, Mycobacterium
LIGLGVDLFGAFIIDSAGSFGIDSAGSFGIDSAGIGIAL

SEQ ID NO: 691615 - protein, 24 aa, Mycobacterium
LIGLKTHCKTCLVVRREGSTIRRY

SEQ ID NO: 691616 - protein, 17 aa, Mycobacterium
LIGLMGVPPRDWDQEKA

SEQ ID NO: 691617 - protein, 17 aa, Mycobacterium
LIGLVGALYADAVRALL

SEQ ID NO: 691618 - protein, 18 aa, Mycobacterium
LIGMLNLLIGGGFDTTTA

SEQ ID NO: 691619 - protein, 17 aa, Mycobacterium
LIGPHWQHGPLVAADLV

SEQ ID NO: 691620 - protein, 18 aa, Mycobacterium
LIGPLRIGLRQAGVPVLL

SEQ ID NO: 691621 - protein, 18 aa, Mycobacterium
LIGPPFIIARFMKYLELE

SEQ ID NO: 691622 - protein, 18 aa, Mycobacterium
LIGPRGYVAERMAAFAEA

SEQ ID NO: 691623 - protein, 26 aa, Mycobacterium
LIGQFGIGFYASFMVADRVELLTRKA

SEQ ID NO: 691624 - protein, 21 aa, Mycobacterium
LIGQFGIGFYSSFMVADKVEL

SEQ ID NO: 691625 - protein, 22 aa, Mycobacterium
LIGRAGALLVDIAIDVSPTGYR

SEQ ID NO: 691626 - protein, 23 aa, Mycobacterium
LIGRAGALLVDIGIDTVPRGYRI

SEQ ID NO: 691627 - protein, 18 aa, Mycobacterium
LIGRDGVEIDELWRGGPY

SEQ ID NO: 691628 - protein, 24 aa, Mycobacterium
LIGRGGVSLTEHWRDGVRTFQGLC

SEQ ID NO: 691629 - protein, 18 aa, Mycobacterium
LIGRKSARLDNSYVHNLI

SEQ ID NO: 691630 - protein, 21 aa, Mycobacterium
LIGRKSARLDNSYVHNLIHGF

SEQ ID NO: 691631 - protein, 20 aa, Mycobacterium
LIGRLLARPDVTAVHVLVRR

SEQ ID NO: 691632 - protein, 28 aa, Mycobacterium
LIGRNVLPGRWSFQVVEDYDDGYYRCFK

SEQ ID NO: 691633 - protein, 21 aa, Mycobacterium
LIGRTGVTFIDLVPSLLDPML

SEQ ID NO: 691634 - protein, 19 aa, Mycobacterium
LIGSAGWQLLAECVATPRA

SEQ ID NO: 691635 - protein, 23 aa, Mycobacterium
LIGSERTVLCWAMGLTQQHHAVA

SEQ ID NO: 691636 - protein, 25 aa, Mycobacterium
LIGTFNVSRLAAWHMSKNDPVDAEG

SEQ ID NO: 691637 - protein, 24 aa, Mycobacterium
LIGTGLGWRRLDVVDETGSTNADL

SEQ ID NO: 691638 - protein, 32 aa, Mycobacterium
LIGWLRNRMAHYKCPRSLYFEAQLPRTDAGKL

SEQ ID NO: 691639 - protein, 21 aa, Mycobacterium
LIHGFSMLWLNGVLPSDPGEC

SEQ ID NO: 691640 - protein, 20 aa, Mycobacterium
LIHKRAHGAAVVLDHDRPVG

SEQ ID NO: 691641 - protein, 22 aa, Mycobacterium
LIHKRAHGVAVVVFEGRPIGLV

SEQ ID NO: 691642 - protein, 22 aa, Mycobacterium
LIHKRAHGVAVVVSEGRPIGLV

SEQ ID NO: 691643 - protein, 19 aa, Mycobacterium
LIHLPREAGYGLIPRTKNG

SEQ ID NO: 691644 - protein, 19 aa, Mycobacterium
LIHRECLTPFNIELLPCGQ

SEQ ID NO: 691645 - protein, 25 aa, Mycobacterium
LIHYHFGGLPGLHCAVARETCELVI

SEQ ID NO: 691646 - protein, 17 aa, Mycobacterium
LIIAIAMTEPGAGSDLA

SEQ ID NO: 691647 - protein, 18 aa, Mycobacterium
LIIGRRGPLQAPFTTLEL

SEQ ID NO: 691648 - protein, 18 aa, Mycobacterium
LIIHAAVAYASVEFSDIT

SEQ ID NO: 691649 - protein, 26 aa, Mycobacterium
LIKAILCLEHKAIPATLHYTSPNPEL

SEQ ID NO: 691650 - protein, 18 aa, Mycobacterium
LIKDCLKNDLPPDFPELS

SEQ ID NO: 691651 - protein, 24 aa, Mycobacterium
LIKFEKGRSWPRRSTLEKLEKVLD

SEQ ID NO: 691652 - protein, 18 aa, Mycobacterium
LIKGGRPADTPVLVVQHG

SEQ ID NO: 691653 - protein, 24 aa, Mycobacterium
LIKLLLAGRHGRIPPTLFADNPTK

SEQ ID NO: 691654 - protein, 19 aa, Mycobacterium
LIKNIEVAARTGGGDPAGN

SEQ ID NO: 691655 - protein, 19 aa, Mycobacterium
LIKNIEVAARTGGGDPGGN

SEQ ID NO: 691656 - protein, 20 aa, Mycobacterium
LIKNIEVAARVGGGDPAGNP

SEQ ID NO: 691657 - protein, 21 aa, Mycobacterium
LIKNIEVAARVGGGDPAGNPT

SEQ ID NO: 691658 - protein, 26 aa, Mycobacterium
LIKRIGCGFTSYRIRALLRRQNQPAR

SEQ ID NO: 691659 - protein, 22 aa, Mycobacterium
LIKVCADLGLDTCRVHGRSGVW

SEQ ID NO: 691660 - protein, 25 aa, Mycobacterium
LILAGTRKPVWFFAYPGKPSELAPE

SEQ ID NO: 691661 - protein, 17 aa, Mycobacterium
LILDCLRSGGHVRCRSG

SEQ ID NO: 691662 - protein, 30 aa, Mycobacterium
LILDPGLGFAKTAHHNWLLLQAIPDLQELG

SEQ ID NO: 691663 - protein, 25 aa, Mycobacterium
LILEGDRLTRCELFDESDLDTAIAR

SEQ ID NO: 691664 - protein, 24 aa, Mycobacterium
LILGAYRFSDFRSEKTAPKGPGLT

SEQ ID NO: 691665 - protein, 18 aa, Mycobacterium
LILHTGDLFDAFRPGYAE

SEQ ID NO: 691666 - protein, 24 aa, Mycobacterium
LILHTRVLAGLAVAQMFPQAPIIV

SEQ ID NO: 691667 - protein, 24 aa, Mycobacterium
LILLRSMGIPGRYVSGYLHPERDA

SEQ ID NO: 691668 - protein, 23 aa, Mycobacterium
LILLRTVGAIAFDEEQLDMAASF

SEQ ID NO: 691669 - protein, 28 aa, Mycobacterium
LILNAPSFPGWDSFGAMVNHFRFIRDHQ

SEQ ID NO: 691670 - protein, 19 aa, Mycobacterium
LILNSRLVTLTGIGGIGKS

SEQ ID NO: 691671 - protein, 27 aa, Mycobacterium
LILQYDLWKAKGLRAVPPTAIQKYMPN

SEQ ID NO: 691672 - protein, 24 aa, Mycobacterium
LILRGRRFGAHQALQWGLLTEVTN

SEQ ID NO: 691673 - protein, 22 aa, Mycobacterium
LILRLADDRVVLGLNYHQIVAD

SEQ ID NO: 691674 - protein, 22 aa, Mycobacterium
LILRQRYPVPGAPYGLAYSATL

SEQ ID NO: 691675 - protein, 17 aa, Mycobacterium
LILRVVVGLSAEETAAA

SEQ ID NO: 691676 - protein, 17 aa, Mycobacterium
LILRVVVGLSAEETADA

SEQ ID NO: 691677 - protein, 17 aa, Mycobacterium
LILRVVVGMSAEETAEA

SEQ ID NO: 691678 - protein, 19 aa, Mycobacterium
LILTCGTFGNVIRLLPPLV

SEQ ID NO: 691679 - protein, 19 aa, Mycobacterium
LILTHGWPDSFWRYAKVLA

SEQ ID NO: 691680 - protein, 23 aa, Mycobacterium
LILYRTMLPGVLQFSLHTPTNVS

SEQ ID NO: 691681 - protein, 22 aa, Mycobacterium
LIMDSLRYWVIEMHVDGFRFDL

SEQ ID NO: 691682 - protein, 24 aa, Mycobacterium
LIMDSLRYWVLEMHVDGFRFDLAA

SEQ ID NO: 691683 - protein, 25 aa, Mycobacterium
LIMLRGMGIPARYVSGYLHPTRGAA

SEQ ID NO: 691684 - protein, 20 aa, Mycobacterium
LIMTHGWPGSVAEFVDVIDE

SEQ ID NO: 691685 - protein, 25 aa, Mycobacterium
LINAEAKAFGLLVGLPGAYVSNTIA

SEQ ID NO: 691686 - protein, 28 aa, Mycobacterium
LINAPLLAATGRPLIGNGANGAPGTGAN

SEQ ID NO: 691687 - protein, 17 aa, Mycobacterium
LINDPFAEPLVRAVGVE

SEQ ID NO: 691688 - protein, 27 aa, Mycobacterium
LINEVLKGAWAYRGWVMSDWGATPSWE

SEQ ID NO: 691689 - protein, 27 aa, Mycobacterium
LINEVLKGAWGYRGWVMSDWGGTPGWE

SEQ ID NO: 691690 - protein, 31 aa, Mycobacterium
LINGPTQALLGRPLIGNGASGAPGTGQAGGD

SEQ ID NO: 691691 - protein, 18 aa, Mycobacterium
LINIHHSFLPAFIGAAPY

SEQ ID NO: 691692 - protein, 18 aa, Mycobacterium
LINIHHSFLPAFTGAMPY

SEQ ID NO: 691693 - protein, 18 aa, Mycobacterium
LINIHHSFLPAFTGASPY

SEQ ID NO: 691694 - protein, 18 aa, Mycobacterium
LINLEVLGCFAMTETGHG

SEQ ID NO: 691695 - protein, 25 aa, Mycobacterium
LINMPRGLLEFGPNSLPPIVQLNGA

SEQ ID NO: 691696 - protein, 25 aa, Mycobacterium
LINRWYYNPDYFKIMSSCANSQMGV

SEQ ID NO: 691697 - protein, 19 aa, Mycobacterium
LINRYPVFRSLAVKDRDGS

SEQ ID NO: 691698 - protein, 17 aa, Mycobacterium
LINRYQPSVLWNDIGYP

SEQ ID NO: 691699 - protein, 18 aa, Mycobacterium
LINWAFDVVNWAIDWAVS

SEQ ID NO: 691700 - protein, 17 aa, Mycobacterium
LIPAGSIAGRVVVVDRD

SEQ ID NO: 691701 - protein, 22 aa, Mycobacterium
LIPDQRAGCSLADSISPDELRA

SEQ ID NO: 691702 - protein, 22 aa, Mycobacterium
LIPDQRAGCSLADSITADQLRD

SEQ ID NO: 691703 - protein, 22 aa, Mycobacterium
LIPDQRAGCSLADSITAEELQA

SEQ ID NO: 691704 - protein, 25 aa, Mycobacterium
LIPESMKPFLPRTVREVPLDTSALP

SEQ ID NO: 691705 - protein, 18 aa, Mycobacterium
LIPFALAGTCQRIEQVRC

SEQ ID NO: 691706 - protein, 22 aa, Mycobacterium
LIPGVLAALVRRGVDFATAEDA

SEQ ID NO: 691707 - protein, 18 aa, Mycobacterium
LIPHAFWQSYLQHRDQLL

SEQ ID NO: 691708 - protein, 25 aa, Mycobacterium
LIPHLQEFLANWFVSVDHVRTDQRQ

SEQ ID NO: 691709 - protein, 32 aa, Mycobacterium
LIPLATEEMIRWVTPVKHFMRTAAADTVVRGT

SEQ ID NO: 691710 - protein, 18 aa, Mycobacterium
LIPLATEEMIRWVTPVKQ

SEQ ID NO: 691711 - protein, 32 aa, Mycobacterium
LIPNFAAGAVKAFIAAGLWSPKGKSWHITEFT

SEQ ID NO: 691712 - protein, 17 aa, Mycobacterium
LIPPEVLAELAASATLV

SEQ ID NO: 691713 - protein, 18 aa, Mycobacterium
LIPPHSFASVLIATSDSV

SEQ ID NO: 691714 - protein, 18 aa, Mycobacterium
LIPQSRFVALPSNNHLLT

SEQ ID NO: 691715 - protein, 23 aa, Mycobacterium
LIPRARAKISMRVAPGGDAAAHL

SEQ ID NO: 691716 - protein, 23 aa, Mycobacterium
LIPRARAKISMRVAPGGDAKAHL

SEQ ID NO: 691717 - protein, 23 aa, Mycobacterium
LIPRARAKVSMRVAPGGDAAAHL

SEQ ID NO: 691718 - protein, 23 aa, Mycobacterium
LIPRPQRMYLRFGEPIDTTQPDG

SEQ ID NO: 691719 - protein, 25 aa, Mycobacterium
LIPRSHQATREWLATNPARIGQAAL

SEQ ID NO: 691720 - protein, 20 aa, Mycobacterium
LIPSAAPPWLAPLVDQPGAV

SEQ ID NO: 691721 - protein, 19 aa, Mycobacterium
LIPSGSIADHIVVRDGDEV

SEQ ID NO: 691722 - protein, 17 aa, Mycobacterium
LIPVALVVVNVFVENVL

SEQ ID NO: 691723 - protein, 24 aa, Mycobacterium
LIQARGLVDVAIPRGGAGLIDAVV

SEQ ID NO: 691724 - protein, 24 aa, Mycobacterium
LIQARGLVDVAIPRGGAGLIEAVV

SEQ ID NO: 691725 - protein, 26 aa, Mycobacterium
LIQARGLVDVVIPRGGAGLIDAVVRD

SEQ ID NO: 691726 - protein, 27 aa, Mycobacterium
LIQARGLVDVVIPRGGAGLIDAVVRDA

SEQ ID NO: 691727 - protein, 31 aa, Mycobacterium
LIQARGLVDVVIPRGGANLINAVVRDAQVPT

SEQ ID NO: 691728 - protein, 27 aa, Mycobacterium
LIQARGLVDVVIPRGGASLINAVVRDA

SEQ ID NO: 691729 - protein, 24 aa, Mycobacterium
LIQERPRFTTALQKLGTFGSTAHQ

SEQ ID NO: 691730 - protein, 24 aa, Mycobacterium
LIQFKRPQFDATRRRLDAAYTIED

SEQ ID NO: 691731 - protein, 21 aa, Mycobacterium
LIQNRCLLYHLIGGGNGDWDV

SEQ ID NO: 691732 - protein, 20 aa, Mycobacterium
LIQNVCFLYHLIGGGTGDWD

SEQ ID NO: 691733 - protein, 18 aa, Mycobacterium
LIQNVCFLYHVLGGGTGD

SEQ ID NO: 691734 - protein, 17 aa, Mycobacterium
LIQRGTLRVGDSIVAGD

SEQ ID NO: 691735 - protein, 18 aa, Mycobacterium
LIQSWPIYRQLTGADPLG

SEQ ID NO: 691736 - protein, 24 aa, Mycobacterium
LIRAAERPILLVGHGVHTSRTQQQ

SEQ ID NO: 691737 - protein, 18 aa, Mycobacterium
LIRAAEYVLYFEAGTKTV

SEQ ID NO: 691738 - protein, 21 aa, Mycobacterium
LIRAFWPGALSLVVHQAPSLQ

SEQ ID NO: 691739 - protein, 18 aa, Mycobacterium
LIRDASEIEGVWGNFTNT

SEQ ID NO: 691740 - protein, 22 aa, Mycobacterium
LIREAKSPILLVGHGVHTSRTG

SEQ ID NO: 691741 - protein, 18 aa, Mycobacterium
LIREAWEPVLKNWQEMSA

SEQ ID NO: 691742 - protein, 25 aa, Mycobacterium
LIREYPQLAAFEFAIRAEDGIALDA

SEQ ID NO: 691743 - protein, 18 aa, Mycobacterium
LIRFAEAAIQVMGKAGDH

SEQ ID NO: 691744 - protein, 23 aa, Mycobacterium
LIRFPELAAYPFVVLDRDHTLRR

SEQ ID NO: 691745 - protein, 18 aa, Mycobacterium
LIRGHGRLAGPRRVSVSD

SEQ ID NO: 691746 - protein, 22 aa, Mycobacterium
LIRHLGVLEVPRLQLREAAHRC

SEQ ID NO: 691747 - protein, 25 aa, Mycobacterium
LIRHRVTVQWPWKLTIGDNSWIGVG

SEQ ID NO: 691748 - protein, 19 aa, Mycobacterium
LIRLQCYEGLTANEALYDW

SEQ ID NO: 691749 - protein, 20 aa, Mycobacterium
LIRLTSPVGCLGRTATKDVE

SEQ ID NO: 691750 - protein, 19 aa, Mycobacterium
LIRMARPVASPALDVYGLM

SEQ ID NO: 691751 - protein, 19 aa, Mycobacterium
LIRNGCKVVAEGANMPCSP

SEQ ID NO: 691752 - protein, 31 aa, Mycobacterium
LIRPGQRVLLWVSAHPLWGFWGAGRITGRPA

SEQ ID NO: 691753 - protein, 27 aa, Mycobacterium
LIRPSEVLFVPRVVEMVFQRFQAELDR

SEQ ID NO: 691754 - protein, 22 aa, Mycobacterium
LIRRASTCFEKAVVSRVYGSTE

SEQ ID NO: 691755 - protein, 18 aa, Mycobacterium
LIRRIWNLHEGPVRHEGR

SEQ ID NO: 691756 - protein, 23 aa, Mycobacterium
LIRSKGVGVFFCTQLPTDVPNDV

SEQ ID NO: 691757 - protein, 24 aa, Mycobacterium
LIRSKGVGVFFCTQLPTDVPNNVL

SEQ ID NO: 691758 - protein, 18 aa, Mycobacterium
LIRSRLRMGDRVIVETPT

SEQ ID NO: 691759 - protein, 19 aa, Mycobacterium
LIRTAPCEHRLVLTAHHIV

SEQ ID NO: 691760 - protein, 24 aa, Mycobacterium
LIRTAPDRHRFVLTIHHIVVDGWS

SEQ ID NO: 691761 - protein, 18 aa, Mycobacterium
LIRVKRDDLANAFGKIND

SEQ ID NO: 691762 - protein, 18 aa, Mycobacterium
LISAFPRDRGWPVDELLS

SEQ ID NO: 691763 - protein, 33 aa, Mycobacterium
LISCGAALDHLRVALAAAGWRARISRFPDPADP

SEQ ID NO: 691764 - protein, 19 aa, Mycobacterium
LISCGAALDHLRVAMAAAQ

SEQ ID NO: 691765 - protein, 24 aa, Mycobacterium
LISCGAVLDHFRVAMAAAGWSITV

SEQ ID NO: 691766 - protein, 18 aa, Mycobacterium
LISDEIYHGLSYGDQKTS

SEQ ID NO: 691767 - protein, 35 aa, Mycobacterium
LISDGRFTLAVGVGYLKREFAALGVEFDERAAVFE

SEQ ID NO: 691768 - protein, 23 aa, Mycobacterium
LISELKQEFTIVIVTHNMQQAAR

SEQ ID NO: 691769 - protein, 21 aa, Mycobacterium
LISELRYPATDSIEQLPTGGT

SEQ ID NO: 691770 - protein, 19 aa, Mycobacterium
LISGPWLGASVTMMAAATT

SEQ ID NO: 691771 - protein, 26 aa, Mycobacterium
LISGTCMSTGFSLWAHRMAVEYLLTA

SEQ ID NO: 691772 - protein, 22 aa, Mycobacterium
LISLKAGGFGLNLTEADYCFLL

SEQ ID NO: 691773 - protein, 25 aa, Mycobacterium
LISRGGWCTITVRYDRASVRNDALF

SEQ ID NO: 691774 - protein, 25 aa, Mycobacterium
LISRGGWCTITVRYDRASVRNEPLF

SEQ ID NO: 691775 - protein, 20 aa, Mycobacterium
LISRLTGRRVQLVAQRPEGA

SEQ ID NO: 691776 - protein, 22 aa, Mycobacterium
LISSAFTPRNVRRIEEQIHANA

SEQ ID NO: 691777 - protein, 18 aa, Mycobacterium
LISYDAKVADYWPEFAQS

SEQ ID NO: 691778 - protein, 23 aa, Mycobacterium
LITAHSATVDWLTTVLAEDALGG

SEQ ID NO: 691779 - protein, 17 aa, Mycobacterium
LITAHTATVEWLTTVLA

SEQ ID NO: 691780 - protein, 25 aa, Mycobacterium
LITARASGAGYRWANPSRLVDGELE

SEQ ID NO: 691781 - protein, 17 aa, Mycobacterium
LITDGRLTVPISATYPL

SEQ ID NO: 691782 - protein, 17 aa, Mycobacterium
LITDIGLTTFPLTSGSK

SEQ ID NO: 691783 - protein, 24 aa, Mycobacterium
LITEALSWRHGVFLASTLSSETTA

SEQ ID NO: 691784 - protein, 22 aa, Mycobacterium
LITELRLLTAHRADLVADRTRT

SEQ ID NO: 691785 - protein, 23 aa, Mycobacterium
LITESRLGILATIKSSGLPQLSP

SEQ ID NO: 691786 - protein, 18 aa, Mycobacterium
LITIKRYWSEWKDPRLII

SEQ ID NO: 691787 - protein, 23 aa, Mycobacterium
LITPELRALIEAAWAKLAAPGAC

SEQ ID NO: 691788 - protein, 26 aa, Mycobacterium
LITPEVVRRLCWDWQPVADVASTVEE

SEQ ID NO: 691789 - protein, 17 aa, Mycobacterium
LITPRDGGGYGITAQWD

SEQ ID NO: 691790 - protein, 17 aa, Mycobacterium
LITRAEIAALRRRAHAL

SEQ ID NO: 691791 - protein, 18 aa, Mycobacterium
LITRTGVTRFMPVYPTEK

SEQ ID NO: 691792 - protein, 18 aa, Mycobacterium
LITTPGLINVDFADVKSV

SEQ ID NO: 691793 - protein, 27 aa, Mycobacterium
LITTVLPEIVRRSGVDPADIDDIIFAE

SEQ ID NO: 691794 - protein, 25 aa, Mycobacterium
LIVAPRWLRTCVQPIAVRDVLYYLV

SEQ ID NO: 691795 - protein, 26 aa, Mycobacterium
LIVCPRICGICGGSHLYKSAYALDTA

SEQ ID NO: 691796 - protein, 18 aa, Mycobacterium
LIVDEAWGAHLPFHENLP

SEQ ID NO: 691797 - protein, 24 aa, Mycobacterium
LIVDEPFLAPARIDLGALRAHAVA

SEQ ID NO: 691798 - protein, 17 aa, Mycobacterium
LIVDPFAQLFVDAAGQD

SEQ ID NO: 691799 - protein, 18 aa, Mycobacterium
LIVDPYFRDAIEAAIDSW

SEQ ID NO: 691800 - protein, 25 aa, Mycobacterium
LIVELRRLAAVLGIDLSRDHARELV

SEQ ID NO: 691801 - protein, 19 aa, Mycobacterium
LIVGARSRADFVFAAQLEK

SEQ ID NO: 691802 - protein, 19 aa, Mycobacterium
LIVKGEFGAAAAMLEPAAA

SEQ ID NO: 691803 - protein, 19 aa, Mycobacterium
LIVNPFFHIFGYKAGCIAS

SEQ ID NO: 691804 - protein, 18 aa, Mycobacterium
LIVNPFFHTFGYKAGCIA

SEQ ID NO: 691805 - protein, 19 aa, Mycobacterium
LIVPGCDHASLLVRTNDRY

SEQ ID NO: 691806 - protein, 17 aa, Mycobacterium
LIVPGCDHASMLVKTND

SEQ ID NO: 691807 - protein, 36 aa, Mycobacterium
LIVPVPLPRRLTGDLVRLPLRVRRAVRQTRAVFDGV

SEQ ID NO: 691808 - protein, 19 aa, Mycobacterium
LIVRNRLPHAAAIAGFLAA

SEQ ID NO: 691809 - protein, 19 aa, Mycobacterium
LIVSRTMSKAFAFAGGRLG

SEQ ID NO: 691810 - protein, 18 aa, Mycobacterium
LIVVVDVPGYLPGVDQEW

SEQ ID NO: 691811 - protein, 18 aa, Mycobacterium
LIVYWWPTPDKASVAGAI

SEQ ID NO: 691812 - protein, 19 aa, Mycobacterium
LIYCAITGFGRGAGADLPG

SEQ ID NO: 691813 - protein, 25 aa, Mycobacterium
LIYDCRRRPNGIIARNERIDWDEIV

SEQ ID NO: 691814 - protein, 20 aa, Mycobacterium
LIYGAAAFGFWADKAPRYLA

SEQ ID NO: 691815 - protein, 17 aa, Mycobacterium
LIYGPARTGRPWKTVED

SEQ ID NO: 691816 - protein, 18 aa, Mycobacterium
LIYPRFTTLDLIGPQQVL

SEQ ID NO: 691817 - protein, 18 aa, Mycobacterium
LIYRQWLDAGLDVHYVQN

SEQ ID NO: 691818 - protein, 30 aa, Mycobacterium
LIYRVWPDLRVKPHLDKSVATIKADAALRT

SEQ ID NO: 691819 - protein, 26 aa, Mycobacterium
LIYYHFRSKFDIFLAVYEDGMRRVRE

SEQ ID NO: 691820 - protein, 17 aa, Mycobacterium
LKAAAIVCGVAQALTAA

SEQ ID NO: 691821 - protein, 34 aa, Mycobacterium
LKAAARQCGIDWPQPAVLCTVRLARRVLSRDEAP

SEQ ID NO: 691822 - protein, 25 aa, Mycobacterium
LKAAGRPDDEFAFVVHGTMADPRWL

SEQ ID NO: 691823 - protein, 25 aa, Mycobacterium
LKAAGRPEDEFAFVVHGTMADPRWL

SEQ ID NO: 691824 - protein, 18 aa, Mycobacterium
LKAALAMHLGSDVAPEHI

SEQ ID NO: 691825 - protein, 17 aa, Mycobacterium
LKAALGESLRHAGRLAE

SEQ ID NO: 691826 - protein, 17 aa, Mycobacterium
LKAANAMREEAAQSPGW

SEQ ID NO: 691827 - protein, 17 aa, Mycobacterium
LKAARLLPAGQVDDDED

SEQ ID NO: 691828 - protein, 22 aa, Mycobacterium
LKAARPQAGYLVEWDLPADLDM

SEQ ID NO: 691829 - protein, 17 aa, Mycobacterium
LKAAVAIAGPEAATDLD

SEQ ID NO: 691830 - protein, 17 aa, Mycobacterium
LKACMRASNEWALEEIC

SEQ ID NO: 691831 - protein, 22 aa, Mycobacterium
LKADGSTACGCWIYSGVYADEV

SEQ ID NO: 691832 - protein, 23 aa, Mycobacterium
LKADGTTACGCWIYSGVYAGDVN

SEQ ID NO: 691833 - protein, 21 aa, Mycobacterium
LKADIRPGYTGQLTAKVERIE

SEQ ID NO: 691834 - protein, 19 aa, Mycobacterium
LKAEFFKTLGHPARIRILE

SEQ ID NO: 691835 - protein, 18 aa, Mycobacterium
LKAEKVLQAIGFAPNVDG

SEQ ID NO: 691836 - protein, 25 aa, Mycobacterium
LKAEPALDILAGWLASRIDGEVTRV

SEQ ID NO: 691837 - protein, 24 aa, Mycobacterium
LKAEVLSIKTTVDYCVQDYINGNN

SEQ ID NO: 691838 - protein, 19 aa, Mycobacterium
LKAGELVVMPTDTVYGLGC

SEQ ID NO: 691839 - protein, 17 aa, Mycobacterium
LKAGERALLVYPPGLEM

SEQ ID NO: 691840 - protein, 18 aa, Mycobacterium
LKAGGARDVELLAIGQLI

SEQ ID NO: 691841 - protein, 23 aa, Mycobacterium
LKAGRLRFRLAPGSGAAMANGQA

SEQ ID NO: 691842 - protein, 23 aa, Mycobacterium
LKAGTSVAILPGRHPVLVAKQVA

SEQ ID NO: 691843 - protein, 18 aa, Mycobacterium
LKAHGARDVELLAIAQLV

SEQ ID NO: 691844 - protein, 23 aa, Mycobacterium
LKAIPECSGQVGIAGFCMGGQFA

SEQ ID NO: 691845 - protein, 20 aa, Mycobacterium
LKAKFVFVGAGGGALGLLQK

SEQ ID NO: 691846 - protein, 23 aa, Mycobacterium
LKALGRGVLRADLAVLDGDTRVG

SEQ ID NO: 691847 - protein, 19 aa, Mycobacterium
LKALQDWTARLFEAGYVGA

SEQ ID NO: 691848 - protein, 18 aa, Mycobacterium
LKALRALLKGALSIPDKY

SEQ ID NO: 691849 - protein, 25 aa, Mycobacterium
LKANEEFMWRLADRVLDPFLAGRGG

SEQ ID NO: 691850 - protein, 25 aa, Mycobacterium
LKAPAGVEIKWIYRGGRADLVPEDR

SEQ ID NO: 691851 - protein, 22 aa, Mycobacterium
LKAPFEGAGGIREWMWVEVASW

SEQ ID NO: 691852 - protein, 17 aa, Mycobacterium
LKAPLERDGGFRHRIQA

SEQ ID NO: 691853 - protein, 20 aa, Mycobacterium
LKAPLLDYLASDGIVHSLDM

SEQ ID NO: 691854 - protein, 29 aa, Mycobacterium
LKAPLSCLNEARFGIIFGSMGAARECLRT

SEQ ID NO: 691855 - protein, 22 aa, Mycobacterium
LKAQIRAGGLDAMLVSDLNNVR

SEQ ID NO: 691856 - protein, 25 aa, Mycobacterium
LKARAEALSRAFLDQGITFSLSGQE

SEQ ID NO: 691857 - protein, 20 aa, Mycobacterium
LKARAVPVNVNFNYTPREVD

SEQ ID NO: 691858 - protein, 20 aa, Mycobacterium
LKAREDALAAAHGEIARLSN

SEQ ID NO: 691859 - protein, 21 aa, Mycobacterium
LKAREFGQEVIRQFEQDIDIW

SEQ ID NO: 691860 - protein, 23 aa, Mycobacterium
LKARKVKGAEEMVAAISRRLEMD

SEQ ID NO: 691861 - protein, 22 aa, Mycobacterium
LKARPLVRYTVRTGADGRVRGL

SEQ ID NO: 691862 - protein, 23 aa, Mycobacterium
LKATARAAAPLQLVIDVAPPGPS

SEQ ID NO: 691863 - protein, 22 aa, Mycobacterium
LKATDMQAALGLSQLAKLDGFV

SEQ ID NO: 691864 - protein, 19 aa, Mycobacterium
LKATLKHLACLEYSTVAIQ

SEQ ID NO: 691865 - protein, 20 aa, Mycobacterium
LKATLKHLACLEYSTVEIQN

SEQ ID NO: 691866 - protein, 20 aa, Mycobacterium
LKATRAAIAAARRAFDDGPW

SEQ ID NO: 691867 - protein, 21 aa, Mycobacterium
LKATWSGTVVAVFQPAEEVGG

SEQ ID NO: 691868 - protein, 20 aa, Mycobacterium
LKAVCRSILCSGELGHHRGL

SEQ ID NO: 691869 - protein, 21 aa, Mycobacterium
LKAVFTASFALWVPLPQVLEQ

SEQ ID NO: 691870 - protein, 18 aa, Mycobacterium
LKAVLLLVAEYGIPKAWR

SEQ ID NO: 691871 - protein, 22 aa, Mycobacterium
LKAVRGDAGLPFVGHTLDYIRF

SEQ ID NO: 691872 - protein, 19 aa, Mycobacterium
LKAYRWADDSVVSFRAEAN

SEQ ID NO: 691873 - protein, 21 aa, Mycobacterium
LKCAIADGCADVPALKACTAA

SEQ ID NO: 691874 - protein, 22 aa, Mycobacterium
LKCAIADGCADVPALKACTAAG

SEQ ID NO: 691875 - protein, 19 aa, Mycobacterium
LKCAIADGCADVPALKSCT

SEQ ID NO: 691876 - protein, 23 aa, Mycobacterium
LKCAIADGCADVPSLKSCTSAGT

SEQ ID NO: 691877 - protein, 18 aa, Mycobacterium
LKCPFTLGHSRAVAELAA

SEQ ID NO: 691878 - protein, 18 aa, Mycobacterium
LKCPFTLGHSRTVARLAG

SEQ ID NO: 691879 - protein, 17 aa, Mycobacterium
LKCYCRTHHLIKSFCGW

SEQ ID NO: 691880 - protein, 21 aa, Mycobacterium
LKDARRAGASVVRVGTHSTEA

SEQ ID NO: 691881 - protein, 19 aa, Mycobacterium
LKDAVGFAVKALQAGTAGA

SEQ ID NO: 691882 - protein, 17 aa, Mycobacterium
LKDDGVIVLHDCNPTHP

SEQ ID NO: 691883 - protein, 22 aa, Mycobacterium
LKDDLPVAWKHRSERYTEKLAT

SEQ ID NO: 691884 - protein, 18 aa, Mycobacterium
LKDDVDWNNIPKNPFDAI

SEQ ID NO: 691885 - protein, 21 aa, Mycobacterium
LKDFLDWLFTRYDEIVAATTD

SEQ ID NO: 691886 - protein, 22 aa, Mycobacterium
LKDGDAIAGAFGYWRETGQFVL

SEQ ID NO: 691887 - protein, 18 aa, Mycobacterium
LKDGRYEVRAEIPGVDPA

SEQ ID NO: 691888 - protein, 21 aa, Mycobacterium
LKDGWLRTGDMGSFDAHGFLT

SEQ ID NO: 691889 - protein, 19 aa, Mycobacterium
LKDHSFSALSLREVTREAG

SEQ ID NO: 691890 - protein, 23 aa, Mycobacterium
LKDLRLPDFREYAVDVPAPGATV

SEQ ID NO: 691891 - protein, 18 aa, Mycobacterium
LKDLVIVRGVNHYPQDIE

SEQ ID NO: 691892 - protein, 29 aa, Mycobacterium
LKDQGLLPFWCVNHGPTLSMYYRDPDGNQ

SEQ ID NO: 691893 - protein, 27 aa, Mycobacterium
LKDRGKHGGVVACALANRANRIAHALV

SEQ ID NO: 691894 - protein, 26 aa, Mycobacterium
LKDRGKPGGVVACALAHRANRIAHAL

SEQ ID NO: 691895 - protein, 25 aa, Mycobacterium
LKDRLRPDLRIHVAAAEADFWEAPD

SEQ ID NO: 691896 - protein, 22 aa, Mycobacterium
LKDRVGRSYVIQYLTPKSDTKP

SEQ ID NO: 691897 - protein, 18 aa, Mycobacterium
LKDSGFYWATRSGVTVSM

SEQ ID NO: 691898 - protein, 24 aa, Mycobacterium
LKDSVCTQCPFLGACDTSPIARNF

SEQ ID NO: 691899 - protein, 32 aa, Mycobacterium
LKDTLVMSYEWPKDRQSVSWTLVSSSLLRSLE

SEQ ID NO: 691900 - protein, 20 aa, Mycobacterium
LKDVSGYVITLANAENLPSH

SEQ ID NO: 691901 - protein, 18 aa, Mycobacterium
LKDWKEVYEDFSHDTLKV

SEQ ID NO: 691902 - protein, 17 aa, Mycobacterium
LKEAARRVIPAAVIDRP

SEQ ID NO: 691903 - protein, 33 aa, Mycobacterium
LKEAGFAFLDRYGLQFSVSRGYLSAGINEVLEH

SEQ ID NO: 691904 - protein, 17 aa, Mycobacterium
LKEAGVVPNARVTVEAN

SEQ ID NO: 691905 - protein, 25 aa, Mycobacterium
LKEAIRRFGPIFAQYYGQSEAPMVI

SEQ ID NO: 691906 - protein, 18 aa, Mycobacterium
LKEALAQGIPARPVVIGP

SEQ ID NO: 691907 - protein, 19 aa, Mycobacterium
LKEEVFGPVAPIAGFDTEE

SEQ ID NO: 691908 - protein, 19 aa, Mycobacterium
LKEEVFGPVAPITGFDTEE

SEQ ID NO: 691909 - protein, 20 aa, Mycobacterium
LKEFMVRNTYIYPPKESMRI

SEQ ID NO: 691910 - protein, 24 aa, Mycobacterium
LKEGERLWLSWAMANRDPGLFDHP

SEQ ID NO: 691911 - protein, 18 aa, Mycobacterium
LKEGQAVIFPADRSDVLL

SEQ ID NO: 691912 - protein, 18 aa, Mycobacterium
LKEHDRLHDAVKHALAAG

SEQ ID NO: 691913 - protein, 27 aa, Mycobacterium
LKEHGPRFALAGSYALWAYGAPEPSHD

SEQ ID NO: 691914 - protein, 23 aa, Mycobacterium
LKEKGIDTGVKFDQLQRVQPTKQ

SEQ ID NO: 691915 - protein, 26 aa, Mycobacterium
LKEKMPRRFYCRARWHESPLDSETQV

SEQ ID NO: 691916 - protein, 17 aa, Mycobacterium
LKELCAVFDGFYTLLVS

SEQ ID NO: 691917 - protein, 22 aa, Mycobacterium
LKELEDAAGIAITGAGTRLPMR

SEQ ID NO: 691918 - protein, 18 aa, Mycobacterium
LKELIPRQQFEVPVQAAI

SEQ ID NO: 691919 - protein, 18 aa, Mycobacterium
LKELIPRQQFEVPVQAAV

SEQ ID NO: 691920 - protein, 18 aa, Mycobacterium
LKELKLRGETVAVLIADY

SEQ ID NO: 691921 - protein, 23 aa, Mycobacterium
LKELLTRRAGLLSGGQRQQLAIA

SEQ ID NO: 691922 - protein, 24 aa, Mycobacterium
LKELTGSAPLGWYTGRDSPYTREL

SEQ ID NO: 691923 - protein, 19 aa, Mycobacterium
LKELVLKPVEGSGGYGIVF

SEQ ID NO: 691924 - protein, 21 aa, Mycobacterium
LKENIKRQWWRSVITSRDDVV

SEQ ID NO: 691925 - protein, 21 aa, Mycobacterium
LKENIKRQWWRSVVTGRDDVV

SEQ ID NO: 691926 - protein, 18 aa, Mycobacterium
LKEPLYRIYEMRLRQGLT

SEQ ID NO: 691927 - protein, 19 aa, Mycobacterium
LKERGMLTDAEFEQPKRRI

SEQ ID NO: 691928 - protein, 25 aa, Mycobacterium
LKERLRPDLRIHVASAEANFWESPD

SEQ ID NO: 691929 - protein, 29 aa, Mycobacterium
LKESMSFAFEPNCGFGRRLANLGGTVLVG

SEQ ID NO: 691930 - protein, 26 aa, Mycobacterium
LKETIAVGAKTLWLQLGLRHDEVVRD

SEQ ID NO: 691931 - protein, 20 aa, Mycobacterium
LKEVVARARRDGFVDVPRAA

SEQ ID NO: 691932 - protein, 26 aa, Mycobacterium
LKEYASRGTWIWPPEPSLRLIADTIE

SEQ ID NO: 691933 - protein, 18 aa, Mycobacterium
LKEYPGLYHEVFNEPERN

SEQ ID NO: 691934 - protein, 21 aa, Mycobacterium
LKFAFSEGGIGWIPFYLDRSD

SEQ ID NO: 691935 - protein, 26 aa, Mycobacterium
LKFDSILGRLPYDVSLEGEDTIVVGD

SEQ ID NO: 691936 - protein, 20 aa, Mycobacterium
LKFGAAGYLAAEWQTESEGG

SEQ ID NO: 691937 - protein, 21 aa, Mycobacterium
LKFGAAGYLEAEWKPESEGGF

SEQ ID NO: 691938 - protein, 17 aa, Mycobacterium
LKFGATHAFPDAASAAA

SEQ ID NO: 691939 - protein, 20 aa, Mycobacterium
LKFGATHAFPTMAEALLPVM

SEQ ID NO: 691940 - protein, 20 aa, Mycobacterium
LKFLTDQGVDLIVTSGGLGP

SEQ ID NO: 691941 - protein, 17 aa, Mycobacterium
LKFPSFGKSAKAWKADD

SEQ ID NO: 691942 - protein, 19 aa, Mycobacterium
LKFRDGAHFAALDGGAVTL

SEQ ID NO: 691943 - protein, 18 aa, Mycobacterium
LKFRDPRIPTLEEFAEAV

SEQ ID NO: 691944 - protein, 21 aa, Mycobacterium
LKFSDWGRFGYQLVLQPSMSL

SEQ ID NO: 691945 - protein, 18 aa, Mycobacterium
LKFYASVRLDVRRIETLK

SEQ ID NO: 691946 - protein, 17 aa, Mycobacterium
LKFYSSVRLDVRRIETL

SEQ ID NO: 691947 - protein, 18 aa, Mycobacterium
LKFYSSVRLDVRRIETLK

SEQ ID NO: 691948 - protein, 21 aa, Mycobacterium
LKGASFPWRTIRGEECSAYWP

SEQ ID NO: 691949 - protein, 20 aa, Mycobacterium
LKGAVLFVTDLARAIPLPTQ

SEQ ID NO: 691950 - protein, 20 aa, Mycobacterium
LKGERPTFSGKYYRTENALA

SEQ ID NO: 691951 - protein, 17 aa, Mycobacterium
LKGESAPVFTADGDVLF

SEQ ID NO: 691952 - protein, 17 aa, Mycobacterium
LKGGAARDVELLALAQL

SEQ ID NO: 691953 - protein, 17 aa, Mycobacterium
LKGGRPADTPVLVVQHG

SEQ ID NO: 691954 - protein, 23 aa, Mycobacterium
LKGKPPNVYGFALSKARAKDEFD

SEQ ID NO: 691955 - protein, 19 aa, Mycobacterium
LKGKRVLEVSCGHGGGASY

SEQ ID NO: 691956 - protein, 21 aa, Mycobacterium
LKGLAELLERVSVPVHVNTHE

SEQ ID NO: 691957 - protein, 17 aa, Mycobacterium
LKGLFHFTSRPAALNGI

SEQ ID NO: 691958 - protein, 18 aa, Mycobacterium
LKGLPATFIAVGTADCLR

SEQ ID NO: 691959 - protein, 19 aa, Mycobacterium
LKGLPEVVGNVWPQAIVQT

SEQ ID NO: 691960 - protein, 21 aa, Mycobacterium
LKGLTIRGSIVGTRQDMAEAL

SEQ ID NO: 691961 - protein, 21 aa, Mycobacterium
LKGLTIRGSIVGTRQDMVEAI

SEQ ID NO: 691962 - protein, 21 aa, Mycobacterium
LKGLYEFFTPLLRNLGHSARV

SEQ ID NO: 691963 - protein, 17 aa, Mycobacterium
LKGMAPAAAQAVESAVE

SEQ ID NO: 691964 - protein, 17 aa, Mycobacterium
LKGPLVPVDDLAQKILD

SEQ ID NO: 691965 - protein, 22 aa, Mycobacterium
LKGPSCFTAPLIPVRPDLPDVL

SEQ ID NO: 691966 - protein, 20 aa, Mycobacterium
LKGPVEFEWKVPKHGSNTIE

SEQ ID NO: 691967 - protein, 17 aa, Mycobacterium
LKGQKVFISGIDQAQAV

SEQ ID NO: 691968 - protein, 20 aa, Mycobacterium
LKGQVPRGFVVLKSGASADK

SEQ ID NO: 691969 - protein, 19 aa, Mycobacterium
LKGSCAASYGHRSAIPRNA

SEQ ID NO: 691970 - protein, 21 aa, Mycobacterium
LKHDLTPIVCIGEHLDVREAG

SEQ ID NO: 691971 - protein, 22 aa, Mycobacterium
LKHELTPIVCIGEHLDVREAGG

SEQ ID NO: 691972 - protein, 22 aa, Mycobacterium
LKHELTPIVCIGEHLDVREAGN

SEQ ID NO: 691973 - protein, 21 aa, Mycobacterium
LKHELTPIVCIGEHLEVREAG

SEQ ID NO: 691974 - protein, 21 aa, Mycobacterium
LKHGLTPIVCIGEQLEVREAG

SEQ ID NO: 691975 - protein, 19 aa, Mycobacterium
LKHIHWNVVGPNFIGVHEM

SEQ ID NO: 691976 - protein, 18 aa, Mycobacterium
LKHLALIAHHCYGSVDLA

SEQ ID NO: 691977 - protein, 22 aa, Mycobacterium
LKHLRAGASVIVIGSNAAFMSS

SEQ ID NO: 691978 - protein, 21 aa, Mycobacterium
LKHRAGDTFCEIVPRDLKDLD

SEQ ID NO: 691979 - protein, 21 aa, Mycobacterium
LKHRAGDTFCEIVPRHLKDLD

SEQ ID NO: 691980 - protein, 26 aa, Mycobacterium
LKHRLARSLFLYALCNGFIGENTTIV

SEQ ID NO: 691981 - protein, 27 aa, Mycobacterium
LKHRLARSLFLYALCNGWIDEGTTVIE

SEQ ID NO: 691982 - protein, 28 aa, Mycobacterium
LKHRLARSLFLYALCNGWIDEGTTVVEA

SEQ ID NO: 691983 - protein, 28 aa, Mycobacterium
LKHRLARSLFLYALCNGWIGEGTTVVEA

SEQ ID NO: 691984 - protein, 27 aa, Mycobacterium
LKHRLARSLFLYALCNGWIGENTTVVE

SEQ ID NO: 691985 - protein, 28 aa, Mycobacterium
LKHRLARSLFLYALCNGWINEGTTVVEA

SEQ ID NO: 691986 - protein, 29 aa, Mycobacterium
LKHRLARSLFLYGLCNGWICEGTTIIEAS

SEQ ID NO: 691987 - protein, 25 aa, Mycobacterium
LKHTPLKMCWVPRYSDYYPESPGGR

SEQ ID NO: 691988 - protein, 18 aa, Mycobacterium
LKHWHFGPTYTLDEYIAL

SEQ ID NO: 691989 - protein, 18 aa, Mycobacterium
LKIANGLSPDRLREQLDV

SEQ ID NO: 691990 - protein, 17 aa, Mycobacterium
LKIDGVALSLVYRDGRL

SEQ ID NO: 691991 - protein, 18 aa, Mycobacterium
LKIIAAALNMEHCKQVVA

SEQ ID NO: 691992 - protein, 21 aa, Mycobacterium
LKILDNYCRHMGGDLSGGTIK

SEQ ID NO: 691993 - protein, 17 aa, Mycobacterium
LKILLNVAFDGEKLSNE

SEQ ID NO: 691994 - protein, 27 aa, Mycobacterium
LKIPFFTDGVPPFFLTPGLDVERTEFD

SEQ ID NO: 691995 - protein, 26 aa, Mycobacterium
LKIQIMPQVWAMRYTLERVVRGKDTI

SEQ ID NO: 691996 - protein, 20 aa, Mycobacterium
LKIQVVPQVWAMRYTLERLI

SEQ ID NO: 691997 - protein, 17 aa, Mycobacterium
LKIQWAASAARNGISLD

SEQ ID NO: 691998 - protein, 21 aa, Mycobacterium
LKIRKRPKAEIAERVDNLLEV

SEQ ID NO: 691999 - protein, 30 aa, Mycobacterium
LKIRSPATFAVRWLIPRFASFHRLHPDIDV

SEQ ID NO: 692000 - protein, 17 aa, Mycobacterium
LKISEAVDYLRAVAPTH

SEQ ID NO: 692001 - protein, 24 aa, Mycobacterium
LKISSWHCDVWKPVIAAVNGVCAG

SEQ ID NO: 692002 - protein, 21 aa, Mycobacterium
LKITHPSAIAWAAQMGTVTLH

SEQ ID NO: 692003 - protein, 19 aa, Mycobacterium
LKITKPALYYHFSSRDELV

SEQ ID NO: 692004 - protein, 17 aa, Mycobacterium
LKIVARAGVGLDNVDVD

SEQ ID NO: 692005 - protein, 19 aa, Mycobacterium
LKIVARAGVGLDNVDVKAA

SEQ ID NO: 692006 - protein, 27 aa, Mycobacterium
LKIVGPVGPSWRKGPYNVRGRGPRDTY

SEQ ID NO: 692007 - protein, 17 aa, Mycobacterium
LKKAGNRLMEFVGGRAI

SEQ ID NO: 692008 - protein, 27 aa, Mycobacterium
LKKAQTRLADLVARSGILVFASHSNEF

SEQ ID NO: 692009 - protein, 24 aa, Mycobacterium
LKKFCDAFEPYGFDPKAIHPSYGM

SEQ ID NO: 692010 - protein, 21 aa, Mycobacterium
LKKKPGIHAVHLTDGDPNNLT

SEQ ID NO: 692011 - protein, 33 aa, Mycobacterium
LKKLPADLPKAGVWSQWHSLVFDVSVWEIWGPL

SEQ ID NO: 692012 - protein, 32 aa, Mycobacterium
LKKLPFPMLSDIKRELCLATGVLNEDGVADRV

SEQ ID NO: 692013 - protein, 22 aa, Mycobacterium
LKKLTTGIATWIRDRTVLFDGE

SEQ ID NO: 692014 - protein, 17 aa, Mycobacterium
LKKMKRSNGLVGRARQR

SEQ ID NO: 692015 - protein, 18 aa, Mycobacterium
LKKMSADAARELGMAQLD

SEQ ID NO: 692016 - protein, 22 aa, Mycobacterium
LKKPPPRGGFPMVSFLDGGVPP

SEQ ID NO: 692017 - protein, 20 aa, Mycobacterium
LKKSFGDLVVLDGIDTTVSH

SEQ ID NO: 692018 - protein, 29 aa, Mycobacterium
LKKSGAWCVAADFSVGMLAAGAARHVPKV

SEQ ID NO: 692019 - protein, 18 aa, Mycobacterium
LKKTLTLEVAQHLGDNLV

SEQ ID NO: 692020 - protein, 21 aa, Mycobacterium
LKKVDAVVVPGGFSYGDYLRA

SEQ ID NO: 692021 - protein, 17 aa, Mycobacterium
LKKWGYTGEQAYLILGT

SEQ ID NO: 692022 - protein, 18 aa, Mycobacterium
LKKWPELGIPIVMSDLKF

SEQ ID NO: 692023 - protein, 18 aa, Mycobacterium
LKLADGVATVERIITLHG

SEQ ID NO: 692024 - protein, 18 aa, Mycobacterium
LKLAEHMIEGAALSAALL

SEQ ID NO: 692025 - protein, 18 aa, Mycobacterium
LKLAEHMVDGAAIWAALA

SEQ ID NO: 692026 - protein, 18 aa, Mycobacterium
LKLAEHMVEGAAIMAALL

SEQ ID NO: 692027 - protein, 18 aa, Mycobacterium
LKLAEHMVEGAAISAALL

SEQ ID NO: 692028 - protein, 23 aa, Mycobacterium
LKLAEVCQRLGISTGSFYHYFEN

SEQ ID NO: 692029 - protein, 22 aa, Mycobacterium
LKLAGAISESFPRLRVRGDEQR

SEQ ID NO: 692030 - protein, 17 aa, Mycobacterium
LKLAGDFADVVFTVAQT

SEQ ID NO: 692031 - protein, 17 aa, Mycobacterium
LKLAGRGWRDACRADPA

SEQ ID NO: 692032 - protein, 17 aa, Mycobacterium
LKLAIPIDEVPFKHDRL

SEQ ID NO: 692033 - protein, 17 aa, Mycobacterium
LKLARKVTGRESVISFT

SEQ ID NO: 692034 - protein, 19 aa, Mycobacterium
LKLARNITGRESIISFTNA

SEQ ID NO: 692035 - protein, 23 aa, Mycobacterium
LKLDKGGFAKWIGMTDDVDEALL

SEQ ID NO: 692036 - protein, 23 aa, Mycobacterium
LKLDKGGFAKWIGMTDDVDESLL

SEQ ID NO: 692037 - protein, 24 aa, Mycobacterium
LKLDLGALVRTLSPNGDFFGHDKI

SEQ ID NO: 692038 - protein, 24 aa, Mycobacterium
LKLDRKIAERRVFPAVDVNPSGTR

SEQ ID NO: 692039 - protein, 25 aa, Mycobacterium
LKLDRKISERRVFPAVDVNPSGTRK

SEQ ID NO: 692040 - protein, 21 aa, Mycobacterium
LKLECPQGHPVGRILKDAPHQ

SEQ ID NO: 692041 - protein, 28 aa, Mycobacterium
LKLEETFMFYLPRICEHCLNPSCVASCP

SEQ ID NO: 692042 - protein, 21 aa, Mycobacterium
LKLEPGRRALVRTGVAVAIPF

SEQ ID NO: 692043 - protein, 20 aa, Mycobacterium
LKLEVGERVEVVGGNVATRS

SEQ ID NO: 692044 - protein, 19 aa, Mycobacterium
LKLEYGRRSVRVEYRGAAG

SEQ ID NO: 692045 - protein, 18 aa, Mycobacterium
LKLFAGGNAKFWDPADID

SEQ ID NO: 692046 - protein, 18 aa, Mycobacterium
LKLFAGGNAKFWDPAGID

SEQ ID NO: 692047 - protein, 17 aa, Mycobacterium
LKLFAGGNAKFWNPADI

SEQ ID NO: 692048 - protein, 17 aa, Mycobacterium
LKLFLDPSRVVRSTDRS

SEQ ID NO: 692049 - protein, 26 aa, Mycobacterium
LKLFQVCKHRGIPIITVINKWDRPGR

SEQ ID NO: 692050 - protein, 23 aa, Mycobacterium
LKLGGSPLRLSASLLIRAARPVA

SEQ ID NO: 692051 - protein, 17 aa, Mycobacterium
LKLGRELGKGAVIVVNL

SEQ ID NO: 692052 - protein, 36 aa, Mycobacterium
LKLGRKKDEWSVYLSPSHWAVLELGGGASKDDDDTS

SEQ ID NO: 692053 - protein, 22 aa, Mycobacterium
LKLGSRNPLLLARQVGSVANLT

SEQ ID NO: 692054 - protein, 22 aa, Mycobacterium
LKLGSRQPLLLARQVGSVANVT

SEQ ID NO: 692055 - protein, 18 aa, Mycobacterium
LKLGTGCEEVIGLEPAAG

SEQ ID NO: 692056 - protein, 18 aa, Mycobacterium
LKLIADKMFDEFKEPLYA

SEQ ID NO: 692057 - protein, 31 aa, Mycobacterium
LKLISARFGVPVPNLSAWRNGVVGDMTSTFN

SEQ ID NO: 692058 - protein, 17 aa, Mycobacterium
LKLISPYDVIGDVRQPN

SEQ ID NO: 692059 - protein, 18 aa, Mycobacterium
LKLISPYDVLGEPRQPNL

SEQ ID NO: 692060 - protein, 21 aa, Mycobacterium
LKLLCPVDNLATFRLIENGVE

SEQ ID NO: 692061 - protein, 19 aa, Mycobacterium
LKLLGSVTLQRVWDLSAAA

SEQ ID NO: 692062 - protein, 18 aa, Mycobacterium
LKLLGTLPANLGVEIPAN

SEQ ID NO: 692063 - protein, 20 aa, Mycobacterium
LKLLLEFADELPALPAELEE

SEQ ID NO: 692064 - protein, 17 aa, Mycobacterium
LKLLLEFADELPDLPPE

SEQ ID NO: 692065 - protein, 17 aa, Mycobacterium
LKLPAKVRDRYDVSSLR

SEQ ID NO: 692066 - protein, 17 aa, Mycobacterium
LKLPGGMQPLWGPEERR

SEQ ID NO: 692067 - protein, 21 aa, Mycobacterium
LKLPIPVQRRVAAGVLSAGHA

SEQ ID NO: 692068 - protein, 18 aa, Mycobacterium
LKLPLRQPHNIAWSTWLL

SEQ ID NO: 692069 - protein, 21 aa, Mycobacterium
LKLPSVLLPLWDSELGTGLVS

SEQ ID NO: 692070 - protein, 21 aa, Mycobacterium
LKLRGETVAVLIADYRMPQMS

SEQ ID NO: 692071 - protein, 20 aa, Mycobacterium
LKLRVMSWGAAPAPDALLRQ

SEQ ID NO: 692072 - protein, 20 aa, Mycobacterium
LKLSAWHCNVEKPVITAVNG

SEQ ID NO: 692073 - protein, 22 aa, Mycobacterium
LKLSHPDLLYSPTQSWVYDENF

SEQ ID NO: 692074 - protein, 25 aa, Mycobacterium
LKLSMYVLNSAFYKPALLSRDMQAL

SEQ ID NO: 692075 - protein, 19 aa, Mycobacterium
LKLTDLRAAETTGVSDFLW

SEQ ID NO: 692076 - protein, 20 aa, Mycobacterium
LKLTPMTLVARMVLLALRSH

SEQ ID NO: 692077 - protein, 20 aa, Mycobacterium
LKLVDPLVISSPRRRSLVTA

SEQ ID NO: 692078 - protein, 17 aa, Mycobacterium
LKLVVVDYLQLMTSGKK

SEQ ID NO: 692079 - protein, 17 aa, Mycobacterium
LKLWKALLETGAVEMAV

SEQ ID NO: 692080 - protein, 21 aa, Mycobacterium
LKLYGIEYGHPVIVIGGKPHE

SEQ ID NO: 692081 - protein, 17 aa, Mycobacterium
LKMAAAMRREGMGMTVG

SEQ ID NO: 692082 - protein, 20 aa, Mycobacterium
LKMDGSWRVAEHSVRVDHRA

SEQ ID NO: 692083 - protein, 21 aa, Mycobacterium
LKMEGSWRVGERPVRVDHRAR

SEQ ID NO: 692084 - protein, 20 aa, Mycobacterium
LKMGRGTVWESAYAALYLLA

SEQ ID NO: 692085 - protein, 19 aa, Mycobacterium
LKMHYVRAGAGEPVVLLHG

SEQ ID NO: 692086 - protein, 19 aa, Mycobacterium
LKNAKRARVYDGWNSTWLT

SEQ ID NO: 692087 - protein, 18 aa, Mycobacterium
LKNAKVLVIGAGGLGSPT

SEQ ID NO: 692088 - protein, 21 aa, Mycobacterium
LKNEVWVSHGVISGASNTSFA

SEQ ID NO: 692089 - protein, 20 aa, Mycobacterium
LKNFERYSSAYGIDLSMVRS

SEQ ID NO: 692090 - protein, 19 aa, Mycobacterium
LKNKIALMCDVDIDGIIST

SEQ ID NO: 692091 - protein, 18 aa, Mycobacterium
LKNLMAVARKDVVLSSGW

SEQ ID NO: 692092 - protein, 17 aa, Mycobacterium
LKNLRFVGEPGQIALLR

SEQ ID NO: 692093 - protein, 26 aa, Mycobacterium
LKNPGERPKQMFLRGKGGAWSAIAVT

SEQ ID NO: 692094 - protein, 29 aa, Mycobacterium
LKNQVRCRVEGRFGVSVNQPAAVVKVATA

SEQ ID NO: 692095 - protein, 22 aa, Mycobacterium
LKNRGFENFTIFDRESDVGGTW

SEQ ID NO: 692096 - protein, 18 aa, Mycobacterium
LKNRLGVIAWRKQHPEVA

SEQ ID NO: 692097 - protein, 17 aa, Mycobacterium
LKNRLLLADLLRRHPEI

SEQ ID NO: 692098 - protein, 22 aa, Mycobacterium
LKNRPDCIHLGAAGHVLGTGQT

SEQ ID NO: 692099 - protein, 18 aa, Mycobacterium
LKNSMTRRFYSRSEVTGK

SEQ ID NO: 692100 - protein, 20 aa, Mycobacterium
LKNTGLRNLPCHAFSANTAW

SEQ ID NO: 692101 - protein, 23 aa, Mycobacterium
LKNVWVEAIWRFSTGSFRHANLF

SEQ ID NO: 692102 - protein, 23 aa, Mycobacterium
LKPADIQTAFIYDHFTPFVFTQL

SEQ ID NO: 692103 - protein, 20 aa, Mycobacterium
LKPAELAAVVSSVLYESRGG

SEQ ID NO: 692104 - protein, 24 aa, Mycobacterium
LKPALGRFGVWTGEPATPDQAVEI

SEQ ID NO: 692105 - protein, 24 aa, Mycobacterium
LKPAPDAPLEFGVLMEAIEEAGLP

SEQ ID NO: 692106 - protein, 17 aa, Mycobacterium
LKPAPDTPWAAAVLGEL

SEQ ID NO: 692107 - protein, 23 aa, Mycobacterium
LKPAPDTPWAAAVLGQIITEHTD

SEQ ID NO: 692108 - protein, 22 aa, Mycobacterium
LKPAPDTPWCAAVLGRIIAEHT

SEQ ID NO: 692109 - protein, 19 aa, Mycobacterium
LKPDCVIYAASGPERDALA

SEQ ID NO: 692110 - protein, 20 aa, Mycobacterium
LKPDCVIYAASGPERDALAI

SEQ ID NO: 692111 - protein, 18 aa, Mycobacterium
LKPDRLALRELITQRDRD

SEQ ID NO: 692112 - protein, 26 aa, Mycobacterium
LKPENKRALADWSWGRQSIDLLAQLP

SEQ ID NO: 692113 - protein, 19 aa, Mycobacterium
LKPEPWMIQASCATADPDA

SEQ ID NO: 692114 - protein, 17 aa, Mycobacterium
LKPEQWSTPSLCAGWTV

SEQ ID NO: 692115 - protein, 21 aa, Mycobacterium
LKPGGALAITVPRWLPERICW

SEQ ID NO: 692116 - protein, 20 aa, Mycobacterium
LKPGGLGVLNVRVDKTVLDK

SEQ ID NO: 692117 - protein, 20 aa, Mycobacterium
LKPGMTLLDVGCGWGGALER

SEQ ID NO: 692118 - protein, 20 aa, Mycobacterium
LKPGWPSMFRGYLNAEERYR

SEQ ID NO: 692119 - protein, 22 aa, Mycobacterium
LKPHRSAVRPGFDFAGFNRLAD

SEQ ID NO: 692120 - protein, 20 aa, Mycobacterium
LKPKVELRDGDVIDSMFMSK

SEQ ID NO: 692121 - protein, 18 aa, Mycobacterium
LKPLDYVDHRWGAEEFAP

SEQ ID NO: 692122 - protein, 18 aa, Mycobacterium
LKPLLEFIVAGGLATTVK

SEQ ID NO: 692123 - protein, 17 aa, Mycobacterium
LKPLLSVSGLDSQIAVP

SEQ ID NO: 692124 - protein, 18 aa, Mycobacterium
LKPLMSPGGLVLFDDITY

SEQ ID NO: 692125 - protein, 18 aa, Mycobacterium
LKPLPLAPYTPRWLARKM

SEQ ID NO: 692126 - protein, 17 aa, Mycobacterium
LKPLRQVLREMGDLLNE

SEQ ID NO: 692127 - protein, 20 aa, Mycobacterium
LKPNGLLVLRIPDRDSVYGW

SEQ ID NO: 692128 - protein, 25 aa, Mycobacterium
LKPNGRYILCGGVGGAPAEDFGRVL

SEQ ID NO: 692129 - protein, 20 aa, Mycobacterium
LKPPAPLVLVPRRQRRKLNG

SEQ ID NO: 692130 - protein, 19 aa, Mycobacterium
LKPPELAAVVSCVLYETRG

SEQ ID NO: 692131 - protein, 20 aa, Mycobacterium
LKPQIGHVYGYRLEPADTGT

SEQ ID NO: 692132 - protein, 17 aa, Mycobacterium
LKPREWYDENDITLRLG

SEQ ID NO: 692133 - protein, 17 aa, Mycobacterium
LKPRKAFGPIRVAATGT

SEQ ID NO: 692134 - protein, 20 aa, Mycobacterium
LKPRKAFGPLRVAVTGATVS

SEQ ID NO: 692135 - protein, 21 aa, Mycobacterium
LKPRRVAVLAVHTSPLAQPGT

SEQ ID NO: 692136 - protein, 20 aa, Mycobacterium
LKPSLVIEFGSRYGGSALFF

SEQ ID NO: 692137 - protein, 19 aa, Mycobacterium
LKPSRGLAPYGPQTGEMLL

SEQ ID NO: 692138 - protein, 19 aa, Mycobacterium
LKPTDICKAAVRRSGTDVT

SEQ ID NO: 692139 - protein, 17 aa, Mycobacterium
LKPVEAALILSESGVPT

SEQ ID NO: 692140 - protein, 17 aa, Mycobacterium
LKPVFVEVAEGQKSTHG

SEQ ID NO: 692141 - protein, 25 aa, Mycobacterium
LKPVRCEIWEGFIFVNFDDDAMPLE

SEQ ID NO: 692142 - protein, 26 aa, Mycobacterium
LKPVRCEVWEGFIFVNFDDDAVSLEE

SEQ ID NO: 692143 - protein, 17 aa, Mycobacterium
LKPWDVIVERLKAAAKA

SEQ ID NO: 692144 - protein, 22 aa, Mycobacterium
LKQAIQLGALVPYRYHPIIVEL

SEQ ID NO: 692145 - protein, 24 aa, Mycobacterium
LKQFPHLRLIVAHMGMPEYSEFLD

SEQ ID NO: 692146 - protein, 17 aa, Mycobacterium
LKQGSTYVVRNLPVAAA

SEQ ID NO: 692147 - protein, 20 aa, Mycobacterium
LKQPIPAWRDTSFATEARQM

SEQ ID NO: 692148 - protein, 25 aa, Mycobacterium
LKQTPAEWERVLGVNLTGTWLTIRA

SEQ ID NO: 692149 - protein, 19 aa, Mycobacterium
LKQYCSLIHGQVVIDAVLA

SEQ ID NO: 692150 - protein, 17 aa, Mycobacterium
LKQYSGRLATEAVSVMQ

SEQ ID NO: 692151 - protein, 17 aa, Mycobacterium
LKRAERLGATRVEVSEE

SEQ ID NO: 692152 - protein, 27 aa, Mycobacterium
LKRAHLPLHRLPDKWAIQLNDTHPSIA

SEQ ID NO: 692153 - protein, 25 aa, Mycobacterium
LKRAIRRRWLQGILHTRAQELVATD

SEQ ID NO: 692154 - protein, 24 aa, Mycobacterium
LKRARDSGIELVRIATHCTEADVS

SEQ ID NO: 692155 - protein, 19 aa, Mycobacterium
LKRDRVWIIDPLDGTREFS

SEQ ID NO: 692156 - protein, 21 aa, Mycobacterium
LKRFNLVICDESHNLRNSSTI

SEQ ID NO: 692157 - protein, 19 aa, Mycobacterium
LKRFPEWEPDLANATLSPT

SEQ ID NO: 692158 - protein, 21 aa, Mycobacterium
LKRFPKWDIDFDKARRSRTST

SEQ ID NO: 692159 - protein, 18 aa, Mycobacterium
LKRGEVVELAHLRADAQP

SEQ ID NO: 692160 - protein, 20 aa, Mycobacterium
LKRGPFLNRRAMIAEAKETL

SEQ ID NO: 692161 - protein, 21 aa, Mycobacterium
LKRHCPQRVDVYFDNVGGPIL

SEQ ID NO: 692162 - protein, 27 aa, Mycobacterium
LKRHLGFAGTVERIWAGISPEDAPGEE

SEQ ID NO: 692163 - protein, 22 aa, Mycobacterium
LKRIAEAFRRNSQAFVDLEHHN

SEQ ID NO: 692164 - protein, 22 aa, Mycobacterium
LKRISAETAVVWSSRYPAKGGR

SEQ ID NO: 692165 - protein, 18 aa, Mycobacterium
LKRIWKPQHRALLQETST

SEQ ID NO: 692166 - protein, 20 aa, Mycobacterium
LKRKAERKITDSALKDLKKR

SEQ ID NO: 692167 - protein, 20 aa, Mycobacterium
LKRLGGYNWFGAVEPLSDAG

SEQ ID NO: 692168 - protein, 22 aa, Mycobacterium
LKRLGLCPPDVTAHPVVADGAP

SEQ ID NO: 692169 - protein, 17 aa, Mycobacterium
LKRLQPRLYSISSSPKE

SEQ ID NO: 692170 - protein, 20 aa, Mycobacterium
LKRLRAWEAQGGPVVEDALV

SEQ ID NO: 692171 - protein, 20 aa, Mycobacterium
LKRLYGGAMLTSGSRANITD

SEQ ID NO: 692172 - protein, 20 aa, Mycobacterium
LKRQGIVGIAGIDTRAVVRH

SEQ ID NO: 692173 - protein, 21 aa, Mycobacterium
LKRRPRRVLIVGSGFVGSEIA

SEQ ID NO: 692174 - protein, 21 aa, Mycobacterium
LKRTGRLSLRHALDMLEQTGR

SEQ ID NO: 692175 - protein, 21 aa, Mycobacterium
LKRTMSLMRFISFIRKEIYPG

SEQ ID NO: 692176 - protein, 20 aa, Mycobacterium
LKRVFVLTFEVDFFAKHGFR

SEQ ID NO: 692177 - protein, 18 aa, Mycobacterium
LKRVHSISAETAVADVDA

SEQ ID NO: 692178 - protein, 18 aa, Mycobacterium
LKRVPEFRVDAAAASRPP

SEQ ID NO: 692179 - protein, 17 aa, Mycobacterium
LKRWPDWTFDEDNAHRA

SEQ ID NO: 692180 - protein, 25 aa, Mycobacterium
LKRYLDVDGAWRDHLLVAITAEEVN

SEQ ID NO: 692181 - protein, 17 aa, Mycobacterium
LKRYYARHLFRLLETAP

SEQ ID NO: 692182 - protein, 23 aa, Mycobacterium
LKSADYFDVEKFPVATFVSTGVT

SEQ ID NO: 692183 - protein, 18 aa, Mycobacterium
LKSAIAAVRSRRRAKRAQ

SEQ ID NO: 692184 - protein, 17 aa, Mycobacterium
LKSAIAAVRSWRRARHL

SEQ ID NO: 692185 - protein, 29 aa, Mycobacterium
LKSATTVRCEYCIDLGSQIARQWGITDEE

SEQ ID NO: 692186 - protein, 18 aa, Mycobacterium
LKSFIKRWVGGAILAQKR

SEQ ID NO: 692187 - protein, 18 aa, Mycobacterium
LKSGAAYLPIDPGLPDAR

SEQ ID NO: 692188 - protein, 20 aa, Mycobacterium
LKSGAAYVPIDPGLPAARIA

SEQ ID NO: 692189 - protein, 19 aa, Mycobacterium
LKSGDFVRIAGVEVGKVKN

SEQ ID NO: 692190 - protein, 20 aa, Mycobacterium
LKSGHGLIELTERLIDGAML

SEQ ID NO: 692191 - protein, 22 aa, Mycobacterium
LKSGKLRDLRSGDVIEPTEQDV

SEQ ID NO: 692192 - protein, 22 aa, Mycobacterium
LKSGKLRDLRSGDVIEPTGQDV

SEQ ID NO: 692193 - protein, 18 aa, Mycobacterium
LKSIALRAIQVHGALGLT

SEQ ID NO: 692194 - protein, 19 aa, Mycobacterium
LKSIGAHHVVLYKSIWEPG

SEQ ID NO: 692195 - protein, 20 aa, Mycobacterium
LKSLGAQVHPCARISKASER

SEQ ID NO: 692196 - protein, 19 aa, Mycobacterium
LKSLHEFFTPLLRNLGACA

SEQ ID NO: 692197 - protein, 20 aa, Mycobacterium
LKSLPECTGTVGVVGFCSGG

SEQ ID NO: 692198 - protein, 20 aa, Mycobacterium
LKSPAIVRYGCRSFDRQWIV

SEQ ID NO: 692199 - protein, 28 aa, Mycobacterium
LKSPHLEAFKAKGYEVLLLTDPVDEVWV

SEQ ID NO: 692200 - protein, 20 aa, Mycobacterium
LKSPLGRDALTELLRRADVL

SEQ ID NO: 692201 - protein, 20 aa, Mycobacterium
LKSQFFANVSHELRTPLMLI

SEQ ID NO: 692202 - protein, 20 aa, Mycobacterium
LKSSDTLYCCLPLYHNNALT

SEQ ID NO: 692203 - protein, 18 aa, Mycobacterium
LKSSEPIDLINPVDESVV

SEQ ID NO: 692204 - protein, 28 aa, Mycobacterium
LKSSPEFKEFWSGLMQKWIAATAALITA

SEQ ID NO: 692205 - protein, 21 aa, Mycobacterium
LKSTGLRNLPCHAFSANAAWQ

SEQ ID NO: 692206 - protein, 20 aa, Mycobacterium
LKSVAAFRLALPRAMLRFAG

SEQ ID NO: 692207 - protein, 18 aa, Mycobacterium
LKSVADGWVAKGSTVVCT

SEQ ID NO: 692208 - protein, 23 aa, Mycobacterium
LKSVRRYDFQQAYVDDLINVVDL

SEQ ID NO: 692209 - protein, 19 aa, Mycobacterium
LKSYRGDMINGFAPDAAVR

SEQ ID NO: 692210 - protein, 17 aa, Mycobacterium
LKTAHRLWGNEGLPGQT

SEQ ID NO: 692211 - protein, 26 aa, Mycobacterium
LKTEAAFEYAARLGYDGVELMVWAEA

SEQ ID NO: 692212 - protein, 36 aa, Mycobacterium
LKTEAMAGLPPLSSGLVGFFAYDMVRRLERLPELAV

SEQ ID NO: 692213 - protein, 19 aa, Mycobacterium
LKTERELLATALADVQGMA

SEQ ID NO: 692214 - protein, 21 aa, Mycobacterium
LKTGACGRGPLIMQVNLRVGE

SEQ ID NO: 692215 - protein, 19 aa, Mycobacterium
LKTGACGRGPMVVQVNLRV

SEQ ID NO: 692216 - protein, 24 aa, Mycobacterium
LKTGDLYKRLKWRQDGRTATENAR

SEQ ID NO: 692217 - protein, 18 aa, Mycobacterium
LKTGIELPSVTLARLREH

SEQ ID NO: 692218 - protein, 19 aa, Mycobacterium
LKTHCKTALVVRREGPLIR

SEQ ID NO: 692219 - protein, 19 aa, Mycobacterium
LKTHCKTALVVRREGPVIR

SEQ ID NO: 692220 - protein, 18 aa, Mycobacterium
LKTHCKTALVVRREGSAI

SEQ ID NO: 692221 - protein, 19 aa, Mycobacterium
LKTHGVEWVRMVATSAARD

SEQ ID NO: 692222 - protein, 17 aa, Mycobacterium
LKTISPLAADVVSDDST

SEQ ID NO: 692223 - protein, 19 aa, Mycobacterium
LKTKFVFVGAGGNALSLLQ

SEQ ID NO: 692224 - protein, 17 aa, Mycobacterium
LKTLLAGETAEWEGARI

SEQ ID NO: 692225 - protein, 19 aa, Mycobacterium
LKTLPFPMLSDLKRELAEA

SEQ ID NO: 692226 - protein, 19 aa, Mycobacterium
LKTLPFPMVSDLKRELTAA

SEQ ID NO: 692227 - protein, 20 aa, Mycobacterium
LKTLTGMRSVIFVARTLGRF

SEQ ID NO: 692228 - protein, 21 aa, Mycobacterium
LKTMQRLVGVFKQLAPGADIQ

SEQ ID NO: 692229 - protein, 19 aa, Mycobacterium
LKTPAGRRAARRMARQADV

SEQ ID NO: 692230 - protein, 24 aa, Mycobacterium
LKTRPEWAALIDRQMRLLTDVAPG

SEQ ID NO: 692231 - protein, 17 aa, Mycobacterium
LKTSLLSAADIKAIPFV

SEQ ID NO: 692232 - protein, 18 aa, Mycobacterium
LKTSRVVLTLAGDKNAGL

SEQ ID NO: 692233 - protein, 17 aa, Mycobacterium
LKTSVFALYNPPAPPGI

SEQ ID NO: 692234 - protein, 21 aa, Mycobacterium
LKTTLLAAFDLKSNRSVIKLL

SEQ ID NO: 692235 - protein, 23 aa, Mycobacterium
LKTVERYARLGVDMINVGPLPGN

SEQ ID NO: 692236 - protein, 27 aa, Mycobacterium
LKVAGGFTLDGLGGWFITGVEGDPSAV

SEQ ID NO: 692237 - protein, 17 aa, Mycobacterium
LKVAIVEAGSKWMTPLL

SEQ ID NO: 692238 - protein, 18 aa, Mycobacterium
LKVAVQLLYEASRPDPTA

SEQ ID NO: 692239 - protein, 20 aa, Mycobacterium
LKVEARYAVAAEGALHLEDI

SEQ ID NO: 692240 - protein, 17 aa, Mycobacterium
LKVFADVVVSFHGAGDF

SEQ ID NO: 692241 - protein, 21 aa, Mycobacterium
LKVFDVRCAPAAYRFVSQARH

SEQ ID NO: 692242 - protein, 26 aa, Mycobacterium
LKVGEGRRSPEWTAELLGATSRSSEF

SEQ ID NO: 692243 - protein, 17 aa, Mycobacterium
LKVGIGLDVGPAYVGIV

SEQ ID NO: 692244 - protein, 25 aa, Mycobacterium
LKVGKAKYSLLCREDGGVIDDLVAY

SEQ ID NO: 692245 - protein, 19 aa, Mycobacterium
LKVGTRLMLSGEVKYFRDT

SEQ ID NO: 692246 - protein, 17 aa, Mycobacterium
LKVGTTRRFSATDRKTL

SEQ ID NO: 692247 - protein, 18 aa, Mycobacterium
LKVGTTRRFSATTRQTLV

SEQ ID NO: 692248 - protein, 18 aa, Mycobacterium
LKVGTTRRFSKTNRRTLI

SEQ ID NO: 692249 - protein, 18 aa, Mycobacterium
LKVGVTMAARAWTQAITE

SEQ ID NO: 692250 - protein, 17 aa, Mycobacterium
LKVIAAVHPGLWQPGVL

SEQ ID NO: 692251 - protein, 18 aa, Mycobacterium
LKVIESILQAAARDGQID

SEQ ID NO: 692252 - protein, 19 aa, Mycobacterium
LKVKPELLQPMGIVHGGVY

SEQ ID NO: 692253 - protein, 23 aa, Mycobacterium
LKVLDRHGDPVVASRLFHSGEHQ

SEQ ID NO: 692254 - protein, 24 aa, Mycobacterium
LKVLDRHGNPVLADRLFHSGDHQT

SEQ ID NO: 692255 - protein, 20 aa, Mycobacterium
LKVLPQRELRRGAAKLQIES

SEQ ID NO: 692256 - protein, 26 aa, Mycobacterium
LKVNGAGLVCGGVHTANATVYMIDTV

SEQ ID NO: 692257 - protein, 29 aa, Mycobacterium
LKVNMTLLRFISFILKEIYPGGKLPQVDL

SEQ ID NO: 692258 - protein, 19 aa, Mycobacterium
LKVPAALAVDSVRYSIADA

SEQ ID NO: 692259 - protein, 20 aa, Mycobacterium
LKVRRVEFFDLPKTISGKIR

SEQ ID NO: 692260 - protein, 23 aa, Mycobacterium
LKVRTRSLVSFDALAAAERLFGN

SEQ ID NO: 692261 - protein, 18 aa, Mycobacterium
LKVSYSATVIGQADPAPV

SEQ ID NO: 692262 - protein, 17 aa, Mycobacterium
LKVVAAWNDETHTGLAG

SEQ ID NO: 692263 - protein, 19 aa, Mycobacterium
LKVVPGPRDDWFTDPDALI

SEQ ID NO: 692264 - protein, 18 aa, Mycobacterium
LKVVPGPRDDWFVDPDVL

SEQ ID NO: 692265 - protein, 25 aa, Mycobacterium
LKWDEARAALLDHRVDAVVARLPFS

SEQ ID NO: 692266 - protein, 20 aa, Mycobacterium
LKWQRTQPEFAYSDRERDGL

SEQ ID NO: 692267 - protein, 17 aa, Mycobacterium
LKWTTLAGIGMVESHHG

SEQ ID NO: 692268 - protein, 17 aa, Mycobacterium
LKYALACSKARPTDTVA

SEQ ID NO: 692269 - protein, 21 aa, Mycobacterium
LKYGATRMNFRISGVGGAASL

SEQ ID NO: 692270 - protein, 19 aa, Mycobacterium
LKYPGGVVLAGDRRSTQGN

SEQ ID NO: 692271 - protein, 17 aa, Mycobacterium
LKYRLAYTADLEATFTP

SEQ ID NO: 692272 - protein, 19 aa, Mycobacterium
LKYSMSAPIQGKRLQKAVA

SEQ ID NO: 692273 - protein, 22 aa, Mycobacterium
LKYTLWRLQERVVGRGPNSPQV

SEQ ID NO: 692274 - protein, 17 aa, Mycobacterium
LKYVLSRNEQAMVHSAV

SEQ ID NO: 692275 - protein, 17 aa, Mycobacterium
LKYYERIGACKANAAGI

SEQ ID NO: 692276 - protein, 17 aa, Mycobacterium
LLAAAGVPIDWDAPVSR

SEQ ID NO: 692277 - protein, 17 aa, Mycobacterium
LLAAALQDWQMRLTRRI

SEQ ID NO: 692278 - protein, 21 aa, Mycobacterium
LLAAALWRGVELVITSMGGEE

SEQ ID NO: 692279 - protein, 22 aa, Mycobacterium
LLAAAVLCRAAGATALPYPLVE

SEQ ID NO: 692280 - protein, 32 aa, Mycobacterium
LLAACVAISRFACDGCHSVAFGSAWTDDLLPG

SEQ ID NO: 692281 - protein, 20 aa, Mycobacterium
LLAADHRVFYGIPYAAPPQG

SEQ ID NO: 692282 - protein, 18 aa, Mycobacterium
LLAAEGLLALAWPKEHGG

SEQ ID NO: 692283 - protein, 17 aa, Mycobacterium
LLAAELWERGRLVRSLG

SEQ ID NO: 692284 - protein, 18 aa, Mycobacterium
LLAAERGPEIGWAKYVIS

SEQ ID NO: 692285 - protein, 17 aa, Mycobacterium
LLAAFVAGEQLAFEELF

SEQ ID NO: 692286 - protein, 17 aa, Mycobacterium
LLAAGAPVAAHWIADRQ

SEQ ID NO: 692287 - protein, 18 aa, Mycobacterium
LLAAGAPVAAHWVADRQI

SEQ ID NO: 692288 - protein, 24 aa, Mycobacterium
LLAAGCPIDGFGVGTNLVVAADAP

SEQ ID NO: 692289 - protein, 19 aa, Mycobacterium
LLAAHGFDRRLLPVLEDGR

SEQ ID NO: 692290 - protein, 21 aa, Mycobacterium
LLAAIRFVAPYSGYPAAADAL

SEQ ID NO: 692291 - protein, 17 aa, Mycobacterium
LLAALAWTDIADLTLAP

SEQ ID NO: 692292 - protein, 17 aa, Mycobacterium
LLAALGPKMIELSGTHA

SEQ ID NO: 692293 - protein, 28 aa, Mycobacterium
LLAALPERERTVLVLRFFESMTQTQIAE

SEQ ID NO: 692294 - protein, 17 aa, Mycobacterium
LLAALSVAIDLGLGQPA

SEQ ID NO: 692295 - protein, 25 aa, Mycobacterium
LLAARPDPFCAMESSWLQHMESAHR

SEQ ID NO: 692296 - protein, 18 aa, Mycobacterium
LLAASSRRSAWWAGAVTL

SEQ ID NO: 692297 - protein, 18 aa, Mycobacterium
LLAASSRRSAWWAGTVTL

SEQ ID NO: 692298 - protein, 25 aa, Mycobacterium
LLAASTKRAAWWAGTVTLAVAKIIE

SEQ ID NO: 692299 - protein, 20 aa, Mycobacterium
LLAAVVKAAGAPVICETADE

SEQ ID NO: 692300 - protein, 19 aa, Mycobacterium
LLAAVWGAVLITAMDDLAR

SEQ ID NO: 692301 - protein, 18 aa, Mycobacterium
LLAAWARAGNKPKFIQAR

SEQ ID NO: 692302 - protein, 24 aa, Mycobacterium
LLACLGVRGKLGLLGVPASPEAVF

SEQ ID NO: 692303 - protein, 23 aa, Mycobacterium
LLACRAAVVLSGYPSAIYDEALV

SEQ ID NO: 692304 - protein, 25 aa, Mycobacterium
LLADACTLVEELMKASRQYGTIDWC

SEQ ID NO: 692305 - protein, 26 aa, Mycobacterium
LLADGKCLRSTFLYVGWRCGADGTDA

SEQ ID NO: 692306 - protein, 17 aa, Mycobacterium
LLADLGLTDQDVARRVT

SEQ ID NO: 692307 - protein, 24 aa, Mycobacterium
LLADRLDLGIAFAGPHPAGIDHCA

SEQ ID NO: 692308 - protein, 17 aa, Mycobacterium
LLADTYYDWETRGYLEY

SEQ ID NO: 692309 - protein, 18 aa, Mycobacterium
LLADVCRVARDAGADFVK

SEQ ID NO: 692310 - protein, 17 aa, Mycobacterium
LLADVLIVRGQLDEAVA

SEQ ID NO: 692311 - protein, 24 aa, Mycobacterium
LLAEAAVYRGLCHRALGDEAAARK

SEQ ID NO: 692312 - protein, 18 aa, Mycobacterium
LLAEAGLIAPHWPAPWGC

SEQ ID NO: 692313 - protein, 18 aa, Mycobacterium
LLAEAGLPEGVLSVVPGG

SEQ ID NO: 692314 - protein, 18 aa, Mycobacterium
LLAEAGVPAGVFNVLQGD

SEQ ID NO: 692315 - protein, 23 aa, Mycobacterium
LLAEAKVPWVLMHWRSVSAQRPH

SEQ ID NO: 692316 - protein, 17 aa, Mycobacterium
LLAEALVDLGAIAHNVR

SEQ ID NO: 692317 - protein, 18 aa, Mycobacterium
LLAEARIGVLATIKANGL

SEQ ID NO: 692318 - protein, 23 aa, Mycobacterium
LLAEARPVARFEVSDERTAAALC

SEQ ID NO: 692319 - protein, 25 aa, Mycobacterium
LLAEFGIPITVERQVLYWLDPVGGT

SEQ ID NO: 692320 - protein, 17 aa, Mycobacterium
LLAEFVGYWERLLTEGG

SEQ ID NO: 692321 - protein, 18 aa, Mycobacterium
LLAEKLMPVLGVVRARGV

SEQ ID NO: 692322 - protein, 19 aa, Mycobacterium
LLAELGISIAGARLLRVRG

SEQ ID NO: 692323 - protein, 19 aa, Mycobacterium
LLAELGRLDPAWAQELAKI

SEQ ID NO: 692324 - protein, 17 aa, Mycobacterium
LLAELLGRVELRELLDP

SEQ ID NO: 692325 - protein, 22 aa, Mycobacterium
LLAELREKLELAKEPGGEKAVA

SEQ ID NO: 692326 - protein, 20 aa, Mycobacterium
LLAEMKDIWDPGRVMNPGVI

SEQ ID NO: 692327 - protein, 23 aa, Mycobacterium
LLAEPGLRIPNMFDAAIEGSFRG

SEQ ID NO: 692328 - protein, 19 aa, Mycobacterium
LLAEPGWNNPPLLHKLSEF

SEQ ID NO: 692329 - protein, 24 aa, Mycobacterium
LLAEPRGYCAGVDRAVETVERALE

SEQ ID NO: 692330 - protein, 24 aa, Mycobacterium
LLAERAHAIEVYFTSVHSLVGAPE

SEQ ID NO: 692331 - protein, 18 aa, Mycobacterium
LLAERGVEGFGCFGDGSV

SEQ ID NO: 692332 - protein, 22 aa, Mycobacterium
LLAERLLTIEWREREPAGCDGV

SEQ ID NO: 692333 - protein, 18 aa, Mycobacterium
LLAERPMHGYEMIQEIGE

SEQ ID NO: 692334 - protein, 17 aa, Mycobacterium
LLAERVVGDPDGRNVLL

SEQ ID NO: 692335 - protein, 17 aa, Mycobacterium
LLAESTLPYVDGDRFVD

SEQ ID NO: 692336 - protein, 21 aa, Mycobacterium
LLAEWRITRGRLHDELLKVAS

SEQ ID NO: 692337 - protein, 22 aa, Mycobacterium
LLAFGAAELFAADRVRCRQTLE

SEQ ID NO: 692338 - protein, 21 aa, Mycobacterium
LLAFLDRPEIAGGKALAGLLR

SEQ ID NO: 692339 - protein, 19 aa, Mycobacterium
LLAFTAFPKQIWRQIWSNN

SEQ ID NO: 692340 - protein, 18 aa, Mycobacterium
LLAGAAPGADGWIRAIGY

SEQ ID NO: 692341 - protein, 24 aa, Mycobacterium
LLAGESLAGLPPLSGGMVGFLAYD

SEQ ID NO: 692342 - protein, 25 aa, Mycobacterium
LLAGFATDWLGAGSVRRFGVRFREQ

SEQ ID NO: 692343 - protein, 18 aa, Mycobacterium
LLAGGWVLRALHGTPASL

SEQ ID NO: 692344 - protein, 18 aa, Mycobacterium
LLAGLGLSDAEIAGLESD

SEQ ID NO: 692345 - protein, 25 aa, Mycobacterium
LLAGLKMPIVHGMWLSAAAQHAVTA

SEQ ID NO: 692346 - protein, 17 aa, Mycobacterium
LLAGLVGAGGGDGGSGG

SEQ ID NO: 692347 - protein, 18 aa, Mycobacterium
LLAGQRGGAIVFTSSTAG

SEQ ID NO: 692348 - protein, 19 aa, Mycobacterium
LLAGRRGPLEAAFTTVELR

SEQ ID NO: 692349 - protein, 17 aa, Mycobacterium
LLAGRRVAVLTGAGMST

SEQ ID NO: 692350 - protein, 21 aa, Mycobacterium
LLAGSLRRSGARLQHTAESYA

SEQ ID NO: 692351 - protein, 23 aa, Mycobacterium
LLAGYYRAVHKLSLEYVASVSAD

SEQ ID NO: 692352 - protein, 19 aa, Mycobacterium
LLAHDWGSIQGWAAVTDDT

SEQ ID NO: 692353 - protein, 18 aa, Mycobacterium
LLAHNEFEDAFLEIGRDR

SEQ ID NO: 692354 - protein, 18 aa, Mycobacterium
LLAIARRVVADHIRHLQA

SEQ ID NO: 692355 - protein, 18 aa, Mycobacterium
LLAIGADRRPAWASTLVA

SEQ ID NO: 692356 - protein, 27 aa, Mycobacterium
LLAKAGLRTVCLDPKLYAGGMASTVEL

SEQ ID NO: 692357 - protein, 18 aa, Mycobacterium
LLAKFRADVTLADRTYRY

SEQ ID NO: 692358 - protein, 23 aa, Mycobacterium
LLAKRPTPELVERVRELAPDVGV

SEQ ID NO: 692359 - protein, 30 aa, Mycobacterium; identical to SEQ ID NO: 202501

SEQ ID NO: 692360 - protein, 26 aa, Mycobacterium
LLALAHDVRMRWCGPEVEVEGIISLK

SEQ ID NO: 692361 - protein, 26 aa, Mycobacterium
LLALAHEVRMRWCGPEVEVEGIISLK

SEQ ID NO: 692362 - protein, 17 aa, Mycobacterium
LLALAWPKEHGGGGGSI

SEQ ID NO: 692363 - protein, 17 aa, Mycobacterium
LLALAWPKEHGGGGGSV

SEQ ID NO: 692364 - protein, 18 aa, Mycobacterium
LLALAWPKEHGGGGGSVW

SEQ ID NO: 692365 - protein, 19 aa, Mycobacterium
LLALLPLIGVWRGEGEGRD

SEQ ID NO: 692366 - protein, 19 aa, Mycobacterium
LLALLPLVGVWRGEGEGRG

SEQ ID NO: 692367 - protein, 20 aa, Mycobacterium
LLALLPLVGVWRGEGEGRGH

SEQ ID NO: 692368 - protein, 20 aa, Mycobacterium
LLALLPLVGVWRGEGEGRGP

SEQ ID NO: 692369 - protein, 19 aa, Mycobacterium
LLALLPLVGVWRGHGEGRG

SEQ ID NO: 692370 - protein, 23 aa, Mycobacterium
LLALPAHHVAGFQVLVRSVVAGT

SEQ ID NO: 692371 - protein, 17 aa, Mycobacterium
LLALRGRCESGAAIIAE

SEQ ID NO: 692372 - protein, 23 aa, Mycobacterium
LLALRRIGERPGLTVGIEPLLDL

SEQ ID NO: 692373 - protein, 18 aa, Mycobacterium
LLALTALEEPVSFSPHEL

SEQ ID NO: 692374 - protein, 18 aa, Mycobacterium
LLALWPALAAGLVEPAVT

SEQ ID NO: 692375 - protein, 17 aa, Mycobacterium
LLANGRLSAMGDPRILR

SEQ ID NO: 692376 - protein, 25 aa, Mycobacterium
LLAPADLWGAVVLVDITPRMEFHGA

SEQ ID NO: 692377 - protein, 22 aa, Mycobacterium
LLAPASRPAAIRYRSSVEAIED

SEQ ID NO: 692378 - protein, 25 aa, Mycobacterium
LLAPESRSAAIAYRASMDAFVAADD

SEQ ID NO: 692379 - protein, 26 aa, Mycobacterium
LLAPEVDVRFGIGWGAITILDSDAGI

SEQ ID NO: 692380 - protein, 17 aa, Mycobacterium
LLAPGGEVVKRFRPRTT

SEQ ID NO: 692381 - protein, 18 aa, Mycobacterium
LLAPKTMRTLVEGICAQE

SEQ ID NO: 692382 - protein, 36 aa, Mycobacterium
LLAPLELLAYCAACTNRLRLGVAVLVTSLHDPLQLA

SEQ ID NO: 692383 - protein, 36 aa, Mycobacterium
LLAPLELLAYCAACTQRLRLGVAVLVTSLHDPLQLA

SEQ ID NO: 692384 - protein, 24 aa, Mycobacterium
LLAPLRIDYTLNYRRGVPPVINEA

SEQ ID NO: 692385 - protein, 19 aa, Mycobacterium
LLAPMIGHYFTFMTPAAFV

SEQ ID NO: 692386 - protein, 21 aa, Mycobacterium
LLAPNEFFVLLSTADHEKAAD

SEQ ID NO: 692387 - protein, 25 aa, Mycobacterium
LLAPPDLWAAVVLVDITPRMEFDGA

SEQ ID NO: 692388 - protein, 19 aa, Mycobacterium
LLAPSWRYRSAADKREFVE

SEQ ID NO: 692389 - protein, 17 aa, Mycobacterium
LLAQDFDGRIKVAMDEF

SEQ ID NO: 692390 - protein, 17 aa, Mycobacterium
LLAQGSWTLRSLAAILW

SEQ ID NO: 692391 - protein, 21 aa, Mycobacterium
LLAQLQWRPELLAPEVMLSAQ

SEQ ID NO: 692392 - protein, 20 aa, Mycobacterium
LLARAPRSAGHWLSVAEAAV

SEQ ID NO: 692393 - protein, 24 aa, Mycobacterium
LLARAPRSAGHWLSVAEAAVRGPL

SEQ ID NO: 692394 - protein, 24 aa, Mycobacterium
LLARAVEEFIRFAGSIHGIPRTVA

SEQ ID NO: 692395 - protein, 33 aa, Mycobacterium
LLARCGLPLATYFSGPKLRWLLDNDRDLRARAE

SEQ ID NO: 692396 - protein, 24 aa, Mycobacterium
LLARDRAEIVPAFQLLTYPMLDDR

SEQ ID NO: 692397 - protein, 29 aa, Mycobacterium
LLAREGITSMHFVPSLLGLFLSLPGVSQW

SEQ ID NO: 692398 - protein, 25 aa, Mycobacterium
LLARELPVYIVSIGRTFRTDELDAT

SEQ ID NO: 692399 - protein, 25 aa, Mycobacterium
LLARHPRLVLIIAHMGMPEYSEFLD

SEQ ID NO: 692400 - protein, 20 aa, Mycobacterium
LLARIGDAFLAVPDGFTTHP

SEQ ID NO: 692401 - protein, 21 aa, Mycobacterium
LLARIPARLIGMGVRPEHPDL

SEQ ID NO: 692402 - protein, 19 aa, Mycobacterium
LLARLCSTIDHISHGRFGW

SEQ ID NO: 692403 - protein, 24 aa, Mycobacterium
LLARLWECGVIMLGCGTDSVRFRP

SEQ ID NO: 692404 - protein, 23 aa, Mycobacterium
LLARRLVDVTIWLGRERDTAALP

SEQ ID NO: 692405 - protein, 18 aa, Mycobacterium
LLARRPTLVVIDGVNEAM

SEQ ID NO: 692406 - protein, 18 aa, Mycobacterium
LLARRPYREPGQRSRDEY

SEQ ID NO: 692407 - protein, 27 aa, Mycobacterium
LLARVLEPYSYKGCRYLLDARYHADDD

SEQ ID NO: 692408 - protein, 22 aa, Mycobacterium
LLASDIPPLSWVLGNSPPPLLN

SEQ ID NO: 692409 - protein, 17 aa, Mycobacterium
LLASEEWAAARSLTPLA

SEQ ID NO: 692410 - protein, 19 aa, Mycobacterium
LLASFPYPHVLAMSVRLAE

SEQ ID NO: 692411 - protein, 27 aa, Mycobacterium
LLASGRGRGKMCIGISAYLVGHSNTKD

SEQ ID NO: 692412 - protein, 19 aa, Mycobacterium
LLASRPRRGQGLPLEGIRV

SEQ ID NO: 692413 - protein, 23 aa, Mycobacterium
LLATARSWAWLSGRNYVTPDDVK

SEQ ID NO: 692414 - protein, 24 aa, Mycobacterium
LLATARSWSWLSGRNYVTPDDVKA

SEQ ID NO: 692415 - protein, 28 aa, Mycobacterium
LLATELFPRMPIPQTWYDAGIAHRSDDL

SEQ ID NO: 692416 - protein, 22 aa, Mycobacterium
LLATGPISWLLQLGADLSTGYT

SEQ ID NO: 692417 - protein, 18 aa, Mycobacterium
LLATIGWDLQAYSGGRFI

SEQ ID NO: 692418 - protein, 18 aa, Mycobacterium
LLATIVRILDAFRDQLAP

SEQ ID NO: 692419 - protein, 17 aa, Mycobacterium
LLATSIPERICGGLASA

SEQ ID NO: 692420 - protein, 18 aa, Mycobacterium
LLAVELHSAASMYRSVVM

SEQ ID NO: 692421 - protein, 17 aa, Mycobacterium
LLAVGDLLIGWRLLVQA

SEQ ID NO: 692422 - protein, 18 aa, Mycobacterium
LLAVLTKRGRDLVRRVTA

SEQ ID NO: 692423 - protein, 17 aa, Mycobacterium
LLAWLRDRLAHYKCPRS

SEQ ID NO: 692424 - protein, 29 aa, Mycobacterium
LLAYCAACTERLRLGVGVLVTSLHEPLQL

SEQ ID NO: 692425 - protein, 21 aa, Mycobacterium
LLCAGITLYSPLRHWNAGRNT

SEQ ID NO: 692426 - protein, 19 aa, Mycobacterium
LLCAIGEDPDRGGLRDTPA

SEQ ID NO: 692427 - protein, 17 aa, Mycobacterium
LLCAPLLTLEQALAEEQ

SEQ ID NO: 692428 - protein, 29 aa, Mycobacterium
LLCEEEVDRACAPWGLLGEDKQATLVAGI

SEQ ID NO: 692429 - protein, 20 aa, Mycobacterium
LLCELERTGQRYGLQTICEA

SEQ ID NO: 692430 - protein, 18 aa, Mycobacterium
LLCGPGRPTVAVDAQVPL

SEQ ID NO: 692431 - protein, 34 aa, Mycobacterium
LLCGRMILWHVLFRFSAMYARKVPYRYEMDLVGR

SEQ ID NO: 692432 - protein, 22 aa, Mycobacterium
LLCIDRTGAVAGVYRKTHLFGA

SEQ ID NO: 692433 - protein, 17 aa, Mycobacterium
LLCRIMLQGLATRPPTD

SEQ ID NO: 692434 - protein, 17 aa, Mycobacterium
LLCTPWARIGSRLHGET

SEQ ID NO: 692435 - protein, 20 aa, Mycobacterium
LLDAAAAWEGLASDLGTAAS

SEQ ID NO: 692436 - protein, 17 aa, Mycobacterium
LLDACFQSVAAHPAVRQ

SEQ ID NO: 692437 - protein, 20 aa, Mycobacterium
LLDACPTCHARPRRRQTFRG

SEQ ID NO: 692438 - protein, 18 aa, Mycobacterium
LLDACRRAGLPVLVAPPS

SEQ ID NO: 692439 - protein, 24 aa, Mycobacterium
LLDAGLLRGDCLTVTGATVAENLA

SEQ ID NO: 692440 - protein, 23 aa, Mycobacterium
LLDAGLLRGDCLTVTGQTVAENL

SEQ ID NO: 692441 - protein, 20 aa, Mycobacterium
LLDAGWRPEDIALLTTGSRH

SEQ ID NO: 692442 - protein, 25 aa, Mycobacterium
LLDAISLAFLPSHRRNFNASGDTTA

SEQ ID NO: 692443 - protein, 17 aa, Mycobacterium
LLDALGKPVLWSMPLHW

SEQ ID NO: 692444 - protein, 19 aa, Mycobacterium
LLDALPRRGIGKVDRMALM

SEQ ID NO: 692445 - protein, 23 aa, Mycobacterium
LLDAPAVLGWAGFRDVAQRYSLG

SEQ ID NO: 692446 - protein, 23 aa, Mycobacterium
LLDAPAVLGWSAFRDVAQRYSLG

SEQ ID NO: 692447 - protein, 19 aa, Mycobacterium
LLDAVAVDVFARFTEALTE

SEQ ID NO: 692448 - protein, 19 aa, Mycobacterium
LLDAVPIDFAAEGQRGARE

SEQ ID NO: 692449 - protein, 19 aa, Mycobacterium
LLDAYRAAATVSFDPNVRP

SEQ ID NO: 692450 - protein, 19 aa, Mycobacterium
LLDAYWRAANYLSVGQIYL

SEQ ID NO: 692451 - protein, 19 aa, Mycobacterium
LLDCARAEKELGWQPTWSS

SEQ ID NO: 692452 - protein, 20 aa, Mycobacterium
LLDCCQESDGGVAIVVTTPE

SEQ ID NO: 692453 - protein, 20 aa, Mycobacterium
LLDCCQETDGAVAIVVTSAE

SEQ ID NO: 692454 - protein, 24 aa, Mycobacterium
LLDDACTLVEELMKASRQYGTIDW

SEQ ID NO: 692455 - protein, 17 aa, Mycobacterium
LLDDAGVTVTRFVRFEV

SEQ ID NO: 692456 - protein, 17 aa, Mycobacterium
LLDDAVRRAGPRPPTGL

SEQ ID NO: 692457 - protein, 24 aa, Mycobacterium
LLDDQVRFLPGWFKDTLQDAPIDR

SEQ ID NO: 692458 - protein, 17 aa, Mycobacterium
LLDDVGFAEAEETWQRE

SEQ ID NO: 692459 - protein, 18 aa, Mycobacterium
LLDEAGVTVTRFARFEVG

SEQ ID NO: 692460 - protein, 18 aa, Mycobacterium
LLDEAGVTVTRFVRFEVG

SEQ ID NO: 692461 - protein, 22 aa, Mycobacterium
LLDEELTWVLPLNEVLSQHDRL

SEQ ID NO: 692462 - protein, 18 aa, Mycobacterium
LLDEFAKRFDGFSIGSND

SEQ ID NO: 692463 - protein, 18 aa, Mycobacterium
LLDEGICVFLPNVRGSGG

SEQ ID NO: 692464 - protein, 24 aa, Mycobacterium
LLDEGQRLLIFLPLAHVLARSLTL

SEQ ID NO: 692465 - protein, 17 aa, Mycobacterium
LLDELFDSFSVRMREAM

SEQ ID NO: 692466 - protein, 25 aa, Mycobacterium
LLDEPSMGLAPLLITKIFNIIEEIN

SEQ ID NO: 692467 - protein, 25 aa, Mycobacterium
LLDEQVRFLPGWFKDTLCDAPIDRI

SEQ ID NO: 692468 - protein, 29 aa, Mycobacterium
LLDFCAARMPYFCVPRFVEVVGELPKNVI

SEQ ID NO: 692469 - protein, 24 aa, Mycobacterium
LLDFFKNPVKGFFRALDVTLPWDV

SEQ ID NO: 692470 - protein, 21 aa, Mycobacterium
LLDFMPRYEVDWANCNRVHMQ

SEQ ID NO: 692471 - protein, 18 aa, Mycobacterium
LLDGEIRSAFSMTEPAVA

SEQ ID NO: 692472 - protein, 22 aa, Mycobacterium
LLDGFAGLPVRTVARPTKFYAM

SEQ ID NO: 692473 - protein, 18 aa, Mycobacterium
LLDGGFMQSVRLCVDRLG

SEQ ID NO: 692474 - protein, 19 aa, Mycobacterium
LLDGGFMQSVRLCVDRLGF

SEQ ID NO: 692475 - protein, 27 aa, Mycobacterium
LLDGGGRGAVPIGVLVVRGGQGLAVEL

SEQ ID NO: 692476 - protein, 24 aa, Mycobacterium
LLDGKRATSHWGALSALKMCGVTA

SEQ ID NO: 692477 - protein, 18 aa, Mycobacterium
LLDGLGIDRAHFVGNSWG

SEQ ID NO: 692478 - protein, 24 aa, Mycobacterium
LLDGLRGSGQFVEAFRTRLKSYID

SEQ ID NO: 692479 - protein, 18 aa, Mycobacterium
LLDGSRYGSLGITEPDAG

SEQ ID NO: 692480 - protein, 19 aa, Mycobacterium
LLDGVDWAARSNVWVGACT

SEQ ID NO: 692481 - protein, 18 aa, Mycobacterium
LLDGVRWLREQADVSRPD

SEQ ID NO: 692482 - protein, 19 aa, Mycobacterium
LLDGYMVRLGATRESLAHW

SEQ ID NO: 692483 - protein, 26 aa, Mycobacterium
LLDGYPRPGKTVLFLGRYDEPRKGVG

SEQ ID NO: 692484 - protein, 27 aa, Mycobacterium
LLDHLPEQYQRPGIVHGLRWIADGEYA

SEQ ID NO: 692485 - protein, 23 aa, Mycobacterium
LLDICNLGARIGSRIGRHGLHKL

SEQ ID NO: 692486 - protein, 25 aa, Mycobacterium
LLDIGCGWGACMARAAEKYDVNVIG

SEQ ID NO: 692487 - protein, 22 aa, Mycobacterium
LLDIGCGWGALMKRAIEKYDVD

SEQ ID NO: 692488 - protein, 25 aa, Mycobacterium
LLDIGCGWGATIARALERYDVNVVG

SEQ ID NO: 692489 - protein, 21 aa, Mycobacterium
LLDIGCGWGATMRRAIEKHDV

SEQ ID NO: 692490 - protein, 21 aa, Mycobacterium
LLDIGCGWGATMRRAIERYDV

SEQ ID NO: 692491 - protein, 26 aa, Mycobacterium
LLDIGCGWGGALKRAVERYDVNVIGI

SEQ ID NO: 692492 - protein, 24 aa, Mycobacterium
LLDIGCGWGGALQRAVEKYDVNVI

SEQ ID NO: 692493 - protein, 26 aa, Mycobacterium
LLDIGCGWGGTLLRALEKYDVNVIGL

SEQ ID NO: 692494 - protein, 25 aa, Mycobacterium
LLDIGCGWGSTIMRAVEKYDVNVIG

SEQ ID NO: 692495 - protein, 24 aa, Mycobacterium
LLDIGCGWGSVLQRAVEKYDVNVV

SEQ ID NO: 692496 - protein, 21 aa, Mycobacterium
LLDIGCGWGTTMRRAVERFDV

SEQ ID NO: 692497 - protein, 18 aa, Mycobacterium
LLDIISRGFPAPPEHQLP

SEQ ID NO: 692498 - protein, 27 aa, Mycobacterium
LLDIWRRPDLAPGRRAPVLIQVPGGAW

SEQ ID NO: 692499 - protein, 22 aa, Mycobacterium
LLDLAARHKLVVTCEDNGVNGG

SEQ ID NO: 692500 - protein, 20 aa, Mycobacterium
LLDLAGAICTRAWCDDDGAL

SEQ ID NO: 692501 - protein, 23 aa, Mycobacterium
LLDLFLRIIVELFRRHWTSTGQE

SEQ ID NO: 692502 - protein, 21 aa, Mycobacterium
LLDLLRLGAYQLLRTRVDAHA

SEQ ID NO: 692503 - protein, 21 aa, Mycobacterium
LLDLLRLGTYQLLRTRVEPHA

SEQ ID NO: 692504 - protein, 23 aa, Mycobacterium
LLDLPEPPTAVFAASDETALGVI

SEQ ID NO: 692505 - protein, 19 aa, Mycobacterium
LLDLREYYSLRASNRNAPL

SEQ ID NO: 692506 - protein, 19 aa, Mycobacterium
LLDLRVAFLDAEGEKPGPV

SEQ ID NO: 692507 - protein, 19 aa, Mycobacterium
LLDMPESDWQTMLDVNLTG

SEQ ID NO: 692508 - protein, 18 aa, Mycobacterium
LLDNRIISCFSMTEPQGG

SEQ ID NO: 692509 - protein, 24 aa, Mycobacterium
LLDPAVGLDGEWMREIADAMLSSP

SEQ ID NO: 692510 - protein, 18 aa, Mycobacterium
LLDPAVGLDGRWMREIAD

SEQ ID NO: 692511 - protein, 20 aa, Mycobacterium
LLDPGFPMLLQRNAYTVEAV

SEQ ID NO: 692512 - protein, 20 aa, Mycobacterium
LLDPSIPLTEAFKQYAEALA

SEQ ID NO: 692513 - protein, 20 aa, Mycobacterium
LLDPSIPLTEVFKEYAEALA

SEQ ID NO: 692514 - protein, 25 aa, Mycobacterium
LLDPSLPLQDVFKGYAEMLAREIEL

SEQ ID NO: 692515 - protein, 24 aa, Mycobacterium
LLDPVGACRQCLVEVEGQRKPLAA

SEQ ID NO: 692516 - protein, 24 aa, Mycobacterium
LLDPVGACRQCLVEVEGQRKPMAS

SEQ ID NO: 692517 - protein, 25 aa, Mycobacterium
LLDQEGRDDLALRIAVQPGGCAGLR

SEQ ID NO: 692518 - protein, 19 aa, Mycobacterium
LLDQGWRPEDVALLTTGSR

SEQ ID NO: 692519 - protein, 17 aa, Mycobacterium
LLDQGYRVIRFDNRDCG

SEQ ID NO: 692520 - protein, 26 aa, Mycobacterium
LLDQLLKLWVEQGALPARMSALGDVA

SEQ ID NO: 692521 - protein, 17 aa, Mycobacterium
LLDRARRLLWPVKKKYG

SEQ ID NO: 692522 - protein, 24 aa, Mycobacterium
LLDRARTAGIPIIHIQHDSGPGSP

SEQ ID NO: 692523 - protein, 17 aa, Mycobacterium
LLDRASSKYALVIYAAK

SEQ ID NO: 692524 - protein, 28 aa, Mycobacterium
LLDRERCILCARCTRFSEQIAGDPFIDM

SEQ ID NO: 692525 - protein, 24 aa, Mycobacterium
LLDRFAKAKVLFLIDEPFDGWTLR

SEQ ID NO: 692526 - protein, 17 aa, Mycobacterium
LLDRHRPLWELHVVEGL

SEQ ID NO: 692527 - protein, 18 aa, Mycobacterium
LLDRLAGRPSEFPLAQTT

SEQ ID NO: 692528 - protein, 19 aa, Mycobacterium
LLDRLAPHYQQMLWQLPAG

SEQ ID NO: 692529 - protein, 24 aa, Mycobacterium
LLDRLGSASGLWHEVVSIFDGDGL

SEQ ID NO: 692530 - protein, 24 aa, Mycobacterium
LLDRLKMPRSLREFGVDEEAFLAA

SEQ ID NO: 692531 - protein, 26 aa, Mycobacterium
LLDRLLAGKLPEGWDADLPHWDLDAK

SEQ ID NO: 692532 - protein, 23 aa, Mycobacterium
LLDRLTRMRAHWPVGTLPLTAIA

SEQ ID NO: 692533 - protein, 21 aa, Mycobacterium
LLDRSRYIKALAVAAKQPDVV

SEQ ID NO: 692534 - protein, 23 aa, Mycobacterium
LLDRSRYVKALAVAAKHQDVADL

SEQ ID NO: 692535 - protein, 19 aa, Mycobacterium
LLDRVTFRAADAMSLPVAE

SEQ ID NO: 692536 - protein, 22 aa, Mycobacterium
LLDRWSAVMMNNYGTPPLALAS

SEQ ID NO: 692537 - protein, 24 aa, Mycobacterium
LLDVERFDLDPGRPILHGLVGDID

SEQ ID NO: 692538 - protein, 17 aa, Mycobacterium
LLDVFALADRVMVIESG

SEQ ID NO: 692539 - protein, 26 aa, Mycobacterium
LLDVGCGWGATMLRALERYDVNVVGL

SEQ ID NO: 692540 - protein, 26 aa, Mycobacterium
LLDVGCGWGATMMRAVEKYDVNVVGL

SEQ ID NO: 692541 - protein, 21 aa, Mycobacterium
LLDVGCGWGATMRRAIEKYGV

SEQ ID NO: 692542 - protein, 22 aa, Mycobacterium
LLDVGCGWGATMRRAVERHDVN

SEQ ID NO: 692543 - protein, 23 aa, Mycobacterium
LLDVGCGWGGALERAVTKYDVNV

SEQ ID NO: 692544 - protein, 26 aa, Mycobacterium
LLDVGCGWGGAVVRALEKYDVNVIGI

SEQ ID NO: 692545 - protein, 21 aa, Mycobacterium
LLDVGCGWGSMLKRAVERYDV

SEQ ID NO: 692546 - protein, 25 aa, Mycobacterium
LLDVGCGWGTTIVRALERYDVNVVG

SEQ ID NO: 692547 - protein, 24 aa, Mycobacterium
LLDVKPRFGHRATLEHYAFNSEDQ

SEQ ID NO: 692548 - protein, 23 aa, Mycobacterium
LLDVLKTEIWPLLDDRSPITKTE

SEQ ID NO: 692549 - protein, 20 aa, Mycobacterium
LLDVMRLGARIVKRSTETHQ

SEQ ID NO: 692550 - protein, 24 aa, Mycobacterium
LLDVSRIQWRFERLFRHVDVAEPW

SEQ ID NO: 692551 - protein, 17 aa, Mycobacterium
LLDWQREAADPGEFLES

SEQ ID NO: 692552 - protein, 19 aa, Mycobacterium
LLDYFPDDFLLVIDESHVT

SEQ ID NO: 692553 - protein, 25 aa, Mycobacterium
LLDYSAKSDRALLFVTNDENKGDWY

SEQ ID NO: 692554 - protein, 25 aa, Mycobacterium
LLEAAILQWYWLKDKFPGDDQWNSL

SEQ ID NO: 692555 - protein, 28 aa, Mycobacterium
LLEALPERERTVLILRFFESMTQTQIAE

SEQ ID NO: 692556 - protein, 29 aa, Mycobacterium
LLEALPERERTVLVLRFFDSMTQTQIAER

SEQ ID NO: 692557 - protein, 18 aa, Mycobacterium
LLEAWRPALAAADRAKVV

SEQ ID NO: 692558 - protein, 20 aa, Mycobacterium
LLECTMAGLATCTLTHMTEM

SEQ ID NO: 692559 - protein, 18 aa, Mycobacterium
LLEDLHHPNVISVLAHGE

SEQ ID NO: 692560 - protein, 23 aa, Mycobacterium
LLEELPVYLASVGAQGSWLDEEV

SEQ ID NO: 692561 - protein, 18 aa, Mycobacterium
LLEFSIPGFAEFVHAQEG

SEQ ID NO: 692562 - protein, 17 aa, Mycobacterium
LLEGFDEILALAGAGAP

SEQ ID NO: 692563 - protein, 22 aa, Mycobacterium
LLEGLPLSRLTPFKQQLIDPLA

SEQ ID NO: 692564 - protein, 24 aa, Mycobacterium
LLEGQRATSHWSTLPLLKPFGVTP

SEQ ID NO: 692565 - protein, 19 aa, Mycobacterium
LLEHAGVADLGDWGAAFTA

SEQ ID NO: 692566 - protein, 27 aa, Mycobacterium
LLEHWGIRPDFVLGHSVGELSAAHVAG

SEQ ID NO: 692567 - protein, 21 aa, Mycobacterium
LLEIEPALKALEGVVMELDDC

SEQ ID NO: 692568 - protein, 18 aa, Mycobacterium
LLELAAAVADGFPGARNR

SEQ ID NO: 692569 - protein, 21 aa, Mycobacterium
LLELLPQITLINGYGSSETGN

SEQ ID NO: 692570 - protein, 24 aa, Mycobacterium
LLELLPRRGAVVVPVPPQEGTDLL

SEQ ID NO: 692571 - protein, 22 aa, Mycobacterium
LLELPGQVLGALDAGGADQDGL

SEQ ID NO: 692572 - protein, 23 aa, Mycobacterium
LLELPQLPGRGWVEYEPYGTVLI

SEQ ID NO: 692573 - protein, 24 aa, Mycobacterium
LLEMRLALETAAVRRLCRTPDVVD

SEQ ID NO: 692574 - protein, 29 aa, Mycobacterium
LLENFRPGTLEKWGLGPERLDEVNPDLVI

SEQ ID NO: 692575 - protein, 18 aa, Mycobacterium
LLEPGGRFVSFSFNPDFR

SEQ ID NO: 692576 - protein, 18 aa, Mycobacterium
LLEPRNIPYRVFINDWDP

SEQ ID NO: 692577 - protein, 24 aa, Mycobacterium
LLEQARAAFDWSRRAQRADGSWPI

SEQ ID NO: 692578 - protein, 17 aa, Mycobacterium
LLEQFDLVAAADRRLST

SEQ ID NO: 692579 - protein, 19 aa, Mycobacterium
LLEQGCAVVGADVVTPPHD

SEQ ID NO: 692580 - protein, 18 aa, Mycobacterium
LLERACADVGAPPAVGRL

SEQ ID NO: 692581 - protein, 18 aa, Mycobacterium
LLERAGFVLEGRLARHAV

SEQ ID NO: 692582 - protein, 17 aa, Mycobacterium
LLERAGVGPEIVDDVIW

SEQ ID NO: 692583 - protein, 18 aa, Mycobacterium
LLERAGVGPEIVDDVIWG

SEQ ID NO: 692584 - protein, 20 aa, Mycobacterium
LLERAHFAASAYADYDQASV

SEQ ID NO: 692585 - protein, 24 aa, Mycobacterium
LLERAPRSAGHWLAVAEAAVRGPI

SEQ ID NO: 692586 - protein, 19 aa, Mycobacterium
LLERASGGYLRATRHRVTL

SEQ ID NO: 692587 - protein, 20 aa, Mycobacterium
LLERCGRFFTPGKFSDDLRT

SEQ ID NO: 692588 - protein, 19 aa, Mycobacterium
LLERDVHYIVRDGAVHLIN

SEQ ID NO: 692589 - protein, 23 aa, Mycobacterium
LLERDVRAIMPMHCSGLATHARF

SEQ ID NO: 692590 - protein, 18 aa, Mycobacterium
LLEREQVLLWKRERRQLA

SEQ ID NO: 692591 - protein, 18 aa, Mycobacterium
LLERGGFDGQHFAAMVHP

SEQ ID NO: 692592 - protein, 19 aa, Mycobacterium
LLERGRAGVSVDVPNNFDP

SEQ ID NO: 692593 - protein, 23 aa, Mycobacterium
LLERKELIVAPGVYDGISAHLAK

SEQ ID NO: 692594 - protein, 24 aa, Mycobacterium
LLERLRAWGVEHVFGYPGDGINGL

SEQ ID NO: 692595 - protein, 22 aa, Mycobacterium
LLERQLTGWTRRAHVVWPDGLP

SEQ ID NO: 692596 - protein, 23 aa, Mycobacterium
LLERRERIGGTWDLFRYPGIRSD

SEQ ID NO: 692597 - protein, 20 aa, Mycobacterium
LLERRGIVSTWFWPGHSIET

SEQ ID NO: 692598 - protein, 18 aa, Mycobacterium
LLERSGLVALRDVIDQQF

SEQ ID NO: 692599 - protein, 18 aa, Mycobacterium
LLERVQRSPATTALTATL

SEQ ID NO: 692600 - protein, 18 aa, Mycobacterium
LLERVSALLTPFDADEWH

SEQ ID NO: 692601 - protein, 24 aa, Mycobacterium
LLESADLLLAHLVLRPFLDAYHIV

SEQ ID NO: 692602 - protein, 27 aa, Mycobacterium
LLESLRASALFTGLRGRAPVDLDAAAR

SEQ ID NO: 692603 - protein, 17 aa, Mycobacterium
LLESMVLSNRMVDIRPV

SEQ ID NO: 692604 - protein, 22 aa, Mycobacterium
LLESPCYPGATAAARAAGLRPI

SEQ ID NO: 692605 - protein, 22 aa, Mycobacterium
LLETPIRSVVAFQLYADNQTMG

SEQ ID NO: 692606 - protein, 24 aa, Mycobacterium
LLETVLRWPFLDFNKILDRPLEEV

SEQ ID NO: 692607 - protein, 24 aa, Mycobacterium
LLEVEEVFLPLARLLHLQVAARQR

SEQ ID NO: 692608 - protein, 21 aa, Mycobacterium
LLEVLDRNGVRRGADAPLRGA

SEQ ID NO: 692609 - protein, 17 aa, Mycobacterium
LLEVRGEVFFRLEDFEA

SEQ ID NO: 692610 - protein, 19 aa, Mycobacterium
LLEVSWEALEHAGIPPDSL

SEQ ID NO: 692611 - protein, 18 aa, Mycobacterium
LLEVTWEALEHAGIPTES

SEQ ID NO: 692612 - protein, 18 aa, Mycobacterium
LLEVVGLRRTDAARYPTE

SEQ ID NO: 692613 - protein, 18 aa, Mycobacterium
LLEWDCDHMVPLARPTET

SEQ ID NO: 692614 - protein, 27 aa, Mycobacterium
LLEYGRSAAGWARRLVFVNGHGGNVAA

SEQ ID NO: 692615 - protein, 17 aa, Mycobacterium
LLEYLRTAPDFYFDEMS

SEQ ID NO: 692616 - protein, 17 aa, Mycobacterium
LLEYPVWMWHWASPADA

SEQ ID NO: 692617 - protein, 29 aa, Mycobacterium
LLFAAMRRPRVGVMIARGDLAVEVGYERL

SEQ ID NO: 692618 - protein, 18 aa, Mycobacterium
LLFARSVVSIGLASEEDA

SEQ ID NO: 692619 - protein, 20 aa, Mycobacterium
LLFASARAAIPFTPLNYRLS

SEQ ID NO: 692620 - protein, 18 aa, Mycobacterium
LLFDRLGPVVLVMTSANA

SEQ ID NO: 692621 - protein, 25 aa, Mycobacterium
LLFGTVDSWLLWNLTGGIDGGVHAT

SEQ ID NO: 692622 - protein, 18 aa, Mycobacterium
LLFGVGVGARAELEVATS

SEQ ID NO: 692623 - protein, 19 aa, Mycobacterium
LLFHIRAESLDVCFELADR

SEQ ID NO: 692624 - protein, 29 aa, Mycobacterium
LLFIGCTPIVWAGPIANWIAACDTMIALD

SEQ ID NO: 692625 - protein, 37 aa, Mycobacterium; identical to SEQ ID NO: 82085

SEQ ID NO: 692626 - protein, 24 aa, Mycobacterium
LLFNDLTVYFALRVRGRLQRGETV

SEQ ID NO: 692627 - protein, 19 aa, Mycobacterium
LLFNDLTVYFALTVRGRLQ

SEQ ID NO: 692628 - protein, 25 aa, Mycobacterium
LLFNPAGLLSFFLSNPVYALSLVTP

SEQ ID NO: 692629 - protein, 17 aa, Mycobacterium
LLFPALVAADGARVVNL

SEQ ID NO: 692630 - protein, 22 aa, Mycobacterium
LLFPTLCKPTATLWAGDPPQVP

SEQ ID NO: 692631 - protein, 20 aa, Mycobacterium
LLFPTLCKPTATLWTGDPPQ

SEQ ID NO: 692632 - protein, 20 aa, Mycobacterium
LLFPWRTVLENVVLGLEVRG

SEQ ID NO: 692633 - protein, 25 aa, Mycobacterium
LLFQIPRLPEWLFGFNETEAFKKFG

SEQ ID NO: 692634 - protein, 24 aa, Mycobacterium
LLFSEGRALANLEFDSAPGDPIDP

SEQ ID NO: 692635 - protein, 18 aa, Mycobacterium
LLFSSARANTAFTPLNYR

SEQ ID NO: 692636 - protein, 20 aa, Mycobacterium
LLFTEGKALVTLEFDSAPDD

SEQ ID NO: 692637 - protein, 31 aa, Mycobacterium
LLFVHGGWHGAWCWEHFLDFFADAGYRAVAV

SEQ ID NO: 692638 - protein, 19 aa, Mycobacterium
LLGAATWSVGQVHGGTAGA

SEQ ID NO: 692639 - protein, 19 aa, Mycobacterium
LLGAAVARIREAGVITAVR

SEQ ID NO: 692640 - protein, 18 aa, Mycobacterium
LLGADIITAFAQRLGDQE

SEQ ID NO: 692641 - protein, 20 aa, Mycobacterium
LLGAGLRPWRLAKVLPATAL

SEQ ID NO: 692642 - protein, 17 aa, Mycobacterium
LLGAHGGLHQKWFNLYD

SEQ ID NO: 692643 - protein, 18 aa, Mycobacterium
LLGAMLAAHGDLRQRPSA

SEQ ID NO: 692644 - protein, 23 aa, Mycobacterium
LLGARAGTTAELWHVPPELDSLK

SEQ ID NO: 692645 - protein, 25 aa, Mycobacterium
LLGARRWIRMPAVRFGPDTCTHRGR

SEQ ID NO: 692646 - protein, 19 aa, Mycobacterium
LLGASRKRFLGTLLAGPDG

SEQ ID NO: 692647 - protein, 20 aa, Mycobacterium
LLGASRKRFLGTLLAGPDGS

SEQ ID NO: 692648 - protein, 18 aa, Mycobacterium
LLGCTPLGPVGWAQGLGS

SEQ ID NO: 692649 - protein, 19 aa, Mycobacterium
LLGDAFAERGFDIDTFEVV

SEQ ID NO: 692650 - protein, 26 aa, Mycobacterium
LLGDANMYVCSAFEAAGGRLVRTSHE

SEQ ID NO: 692651 - protein, 25 aa, Mycobacterium
LLGDILRRGIAEGSFRADLDVDTDA

SEQ ID NO: 692652 - protein, 24 aa, Mycobacterium
LLGDLPKGWAPVIGLWESDSDEEF

SEQ ID NO: 692653 - protein, 19 aa, Mycobacterium
LLGDLPVGEGLRLDDVSAH

SEQ ID NO: 692654 - protein, 22 aa, Mycobacterium
LLGDLPVRRVIALGESQSAMFL

SEQ ID NO: 692655 - protein, 17 aa, Mycobacterium
LLGDVADPLVWITGQLC

SEQ ID NO: 692656 - protein, 26 aa, Mycobacterium
LLGEVGLRVATAWEFDLYGGTVLLAA

SEQ ID NO: 692657 - protein, 18 aa, Mycobacterium
LLGEVKRRGATTFEVTEE

SEQ ID NO: 692658 - protein, 18 aa, Mycobacterium
LLGGAFACAGYEIEDVVI

SEQ ID NO: 692659 - protein, 17 aa, Mycobacterium
LLGGAVYLAPEHKVVLS

SEQ ID NO: 692660 - protein, 22 aa, Mycobacterium
LLGGCPRLTVLATSREPIGVSG

SEQ ID NO: 692661 - protein, 23 aa, Mycobacterium
LLGGEIRSAFSMTEPAVASSDAR

SEQ ID NO: 692662 - protein, 18 aa, Mycobacterium
LLGGELRQGALAGIMADA

SEQ ID NO: 692663 - protein, 19 aa, Mycobacterium
LLGGLGAGVVVNGRDRHAV

SEQ ID NO: 692664 - protein, 19 aa, Mycobacterium
LLGGLPFGEELVMWWNFVG

SEQ ID NO: 692665 - protein, 17 aa, Mycobacterium
LLGGMPLAGGPGGAAAG

SEQ ID NO: 692666 - protein, 26 aa, Mycobacterium
LLGGRPIREPVFHYGPFVMNTRAELI

SEQ ID NO: 692667 - protein, 26 aa, Mycobacterium
LLGGRPIREPVFHYGPFVMNTRAEVI

SEQ ID NO: 692668 - protein, 17 aa, Mycobacterium
LLGGYGFTREYPVERMM

SEQ ID NO: 692669 - protein, 24 aa, Mycobacterium
LLGHARKRLGAAVAPKEIQFVDAL

SEQ ID NO: 692670 - protein, 20 aa, Mycobacterium
LLGHPEPVYAHVPLVLNADG

SEQ ID NO: 692671 - protein, 19 aa, Mycobacterium
LLGHRVVRVVPIPPIALGL

SEQ ID NO: 692672 - protein, 18 aa, Mycobacterium
LLGHYGKAVIWDREQTTV

SEQ ID NO: 692673 - protein, 24 aa, Mycobacterium
LLGIKPKAALLLITRVTFDQTGTP

SEQ ID NO: 692674 - protein, 25 aa, Mycobacterium
LLGIKPRSALLLITRIAYDQHDTPC

SEQ ID NO: 692675 - protein, 18 aa, Mycobacterium
LLGIPAQGVRVIMRDTGG

SEQ ID NO: 692676 - protein, 25 aa, Mycobacterium
LLGIPYAREELDLEVAPQRVRSERV

SEQ ID NO: 692677 - protein, 28 aa, Mycobacterium
LLGKKCFALRIASVMARDEGWLAEHMLI

SEQ ID NO: 692678 - protein, 17 aa, Mycobacterium
LLGKKCYSLRIASAMAR

SEQ ID NO: 692679 - protein, 28 aa, Mycobacterium
LLGKKCYSLRIASAMARDEGWLAEHMLI

SEQ ID NO: 692680 - protein, 19 aa, Mycobacterium
LLGKRAGVIATSLRPRPVD

SEQ ID NO: 692681 - protein, 23 aa, Mycobacterium
LLGKRHRFGYTLGVDGGYLTGGT

SEQ ID NO: 692682 - protein, 18 aa, Mycobacterium
LLGLAAWNLSPDVAVSQI

SEQ ID NO: 692683 - protein, 27 aa, Mycobacterium
LLGLMKRLPWLSAVPAYFVGVGVLPEH

SEQ ID NO: 692684 - protein, 22 aa, Mycobacterium
LLGLPVDNWPVLGGMGNASWVQ

SEQ ID NO: 692685 - protein, 19 aa, Mycobacterium
LLGMFSRSDVFPIRQFADG

SEQ ID NO: 692686 - protein, 29 aa, Mycobacterium
LLGMLRRRLGLDTAWIASFRSGMQVFEVI

SEQ ID NO: 692687 - protein, 24 aa, Mycobacterium
LLGMRTGQGYAEFVVNHFGQDGAI

SEQ ID NO: 692688 - protein, 22 aa, Mycobacterium
LLGNGFRLGLVAAHDDGADLRV

SEQ ID NO: 692689 - protein, 18 aa, Mycobacterium
LLGPFPRDRGWPIDELLS

SEQ ID NO: 692690 - protein, 33 aa, Mycobacterium
LLGPLLTCDGVHLVKGFYRRPLKVSGAEDANGG

SEQ ID NO: 692691 - protein, 23 aa, Mycobacterium
LLGPRRPGVSLAPGARDVLVDVA

SEQ ID NO: 692692 - protein, 21 aa, Mycobacterium
LLGPRWATPHQAYWDAMFAAL

SEQ ID NO: 692693 - protein, 18 aa, Mycobacterium
LLGQARLLLARAAAADPA

SEQ ID NO: 692694 - protein, 18 aa, Mycobacterium
LLGQCLDLVGPHPGRVDH

SEQ ID NO: 692695 - protein, 24 aa, Mycobacterium
LLGQSYFALGMVQFSTSIALQAIP

SEQ ID NO: 692696 - protein, 18 aa, Mycobacterium
LLGQVGLAEKAHVKPATL

SEQ ID NO: 692697 - protein, 31 aa, Mycobacterium
LLGREVKKLPTLRGRTIITMFYENSTRTRVS

SEQ ID NO: 692698 - protein, 18 aa, Mycobacterium
LLGRFLQDDVRVGAGEPE

SEQ ID NO: 692699 - protein, 18 aa, Mycobacterium
LLGRLAALDVFMGRRAVA

SEQ ID NO: 692700 - protein, 19 aa, Mycobacterium
LLGRLGYRAYGWRLGLNIG

SEQ ID NO: 692701 - protein, 24 aa, Mycobacterium
LLGRRCGACRLEIDRGEMSRISAA

SEQ ID NO: 692702 - protein, 34 aa, Mycobacterium
LLGRTEIRRLAKELDFRPRKSLGQNFVHDANTVR

SEQ ID NO: 692703 - protein, 17 aa, Mycobacterium
LLGRVPMRNDWPSELKI

SEQ ID NO: 692704 - protein, 17 aa, Mycobacterium
LLGSAAWILTDRPAIQQ

SEQ ID NO: 692705 - protein, 18 aa, Mycobacterium
LLGSAAWILTDRPAVQEQ

SEQ ID NO: 692706 - protein, 18 aa, Mycobacterium
LLGSELGLIPSLLTVRQS

SEQ ID NO: 692707 - protein, 22 aa, Mycobacterium
LLGSITLQRVWELSAAAAGPRS

SEQ ID NO: 692708 - protein, 19 aa, Mycobacterium
LLGSIYFPGIMSMLQGDMP

SEQ ID NO: 692709 - protein, 23 aa, Mycobacterium
LLGSLRMGNRFVHTGKPTPAGYA

SEQ ID NO: 692710 - protein, 21 aa, Mycobacterium
LLGSLTLQRVWELGAAAAGPE

SEQ ID NO: 692711 - protein, 18 aa, Mycobacterium
LLGSNLVGVGGAYYDTAA

SEQ ID NO: 692712 - protein, 17 aa, Mycobacterium
LLGSWGVVASMQPAFDA

SEQ ID NO: 692713 - protein, 18 aa, Mycobacterium
LLGTGAPWFESWLEHTDH

SEQ ID NO: 692714 - protein, 22 aa, Mycobacterium
LLGTLLRCPGCRTDFDVVQAGV

SEQ ID NO: 692715 - protein, 17 aa, Mycobacterium
LLGTLYRNGSGRWTLGS

SEQ ID NO: 692716 - protein, 25 aa, Mycobacterium
LLGVDEVWAVGGAQAVALLAYGGTD

SEQ ID NO: 692717 - protein, 26 aa, Mycobacterium
LLGVDEVWAVGGAQAVALLAYGGTDT

SEQ ID NO: 692718 - protein, 26 aa, Mycobacterium
LLGVDEVWAVGGAQAVALLAYGGTDV

SEQ ID NO: 692719 - protein, 18 aa, Mycobacterium
LLGVGGRVDSVLVQELLD

SEQ ID NO: 692720 - protein, 27 aa, Mycobacterium
LLGVLKAGGAFMPLDPAQPVSRIAAMI

SEQ ID NO: 692721 - protein, 18 aa, Mycobacterium
LLGVLLFDVNPRATKRNE

SEQ ID NO: 692722 - protein, 17 aa, Mycobacterium
LLGVPWVELNPHPLYLP

SEQ ID NO: 692723 - protein, 21 aa, Mycobacterium
LLGVRKWVRIAGVHFAPDTCS

SEQ ID NO: 692724 - protein, 18 aa, Mycobacterium
LLGWPRDVLPFELATETL

SEQ ID NO: 692725 - protein, 17 aa, Mycobacterium
LLGWTTVNGLQFYVRQF

SEQ ID NO: 692726 - protein, 18 aa, Mycobacterium
LLGYSIAHLKYFASLARS

SEQ ID NO: 692727 - protein, 28 aa, Mycobacterium
LLHAGFSPPLVWRVMERFGVTNFTAAPT

SEQ ID NO: 692728 - protein, 25 aa, Mycobacterium
LLHALPRLVATGIPVLLGASRKRFL

SEQ ID NO: 692729 - protein, 17 aa, Mycobacterium
LLHARLVSAIALISSPH

SEQ ID NO: 692730 - protein, 18 aa, Mycobacterium
LLHAYVHTELHVFAATFH

SEQ ID NO: 692731 - protein, 19 aa, Mycobacterium
LLHDLHRATGLVVHLAVLD

SEQ ID NO: 692732 - protein, 25 aa, Mycobacterium
LLHDLWARRRMAVLHVTHDVDEAIL

SEQ ID NO: 692733 - protein, 26 aa, Mycobacterium
LLHDVLREAWGFKGFVVSDWGGTHST

SEQ ID NO: 692734 - protein, 25 aa, Mycobacterium
LLHEIPWDLVASIGVTLRLRHTDLN

SEQ ID NO: 692735 - protein, 25 aa, Mycobacterium
LLHELERTGGRYGLQTMCEGGGQAN

SEQ ID NO: 692736 - protein, 22 aa, Mycobacterium
LLHGAYRYRWHHAVAAYAEGRP

SEQ ID NO: 692737 - protein, 18 aa, Mycobacterium
LLHGEIRSAFSMTEPAVA

SEQ ID NO: 692738 - protein, 27 aa, Mycobacterium
LLHGFPESWYSWRHQIPALAAAGYRVV

SEQ ID NO: 692739 - protein, 23 aa, Mycobacterium
LLHGIGGTLIRLFGNARVTVLPH

SEQ ID NO: 692740 - protein, 25 aa, Mycobacterium
LLHGSGNGCAQCVAGIKDRLQQMRW

SEQ ID NO: 692741 - protein, 19 aa, Mycobacterium
LLHGSGPGVTGWRNYRGNL

SEQ ID NO: 692742 - protein, 17 aa, Mycobacterium
LLHGWPQTGQCWRKVAR

SEQ ID NO: 692743 - protein, 22 aa, Mycobacterium
LLHKGCYGRLVADPKLIEPTVE

SEQ ID NO: 692744 - protein, 17 aa, Mycobacterium
LLHKVVLARALQLTAET

SEQ ID NO: 692745 - protein, 24 aa, Mycobacterium
LLHLMRLAGNLGWMPIGGWALRAI

SEQ ID NO: 692746 - protein, 25 aa, Mycobacterium
LLHPLSAPMTLRWLTDRFDRRPLTE

SEQ ID NO: 692747 - protein, 26 aa, Mycobacterium
LLHPMSAPMALRWLTDRFAARPLTAN

SEQ ID NO: 692748 - protein, 27 aa, Mycobacterium
LLHPMSAPMSMEWLSARFRGEPLPTGP

SEQ ID NO: 692749 - protein, 27 aa, Mycobacterium
LLHPMSAPMTLRWLRDRFAGRPISAHI

SEQ ID NO: 692750 - protein, 22 aa, Mycobacterium
LLHQYPHLLALSASSPFWDGED

SEQ ID NO: 692751 - protein, 17 aa, Mycobacterium
LLHRDMGPISRYLGPWI

SEQ ID NO: 692752 - protein, 17 aa, Mycobacterium
LLHRDMGPISRYLGPWV

SEQ ID NO: 692753 - protein, 26 aa, Mycobacterium
LLHRGGRACLAGWLGGLAPIPDFNPL

SEQ ID NO: 692754 - protein, 24 aa, Mycobacterium
LLHRHTGPIFPLIEDLFGVSIAEL

SEQ ID NO: 692755 - protein, 22 aa, Mycobacterium
LLHRSANEMDRLLAAHRAAHAK

SEQ ID NO: 692756 - protein, 24 aa, Mycobacterium
LLHRSDCPLFSPGSYARRPKVLTP

SEQ ID NO: 692757 - protein, 17 aa, Mycobacterium
LLHSRLVSAIALISSPH

SEQ ID NO: 692758 - protein, 18 aa, Mycobacterium
LLIADAMVQLSAEHRAVI

SEQ ID NO: 692759 - protein, 24 aa, Mycobacterium
LLIAFGLAWARFVGTGAPIGIDVE

SEQ ID NO: 692760 - protein, 21 aa, Mycobacterium
LLIAFGMAWTEFLGSKAAGAP

SEQ ID NO: 692761 - protein, 19 aa, Mycobacterium
LLIAPRLDDRYPTYGVLAS

SEQ ID NO: 692762 - protein, 18 aa, Mycobacterium
LLIARPGFVIGRMSAGMS

SEQ ID NO: 692763 - protein, 17 aa, Mycobacterium
LLIASPAGAYFKGGIKP

SEQ ID NO: 692764 - protein, 17 aa, Mycobacterium
LLIEGRNAISRVPADRW

SEQ ID NO: 692765 - protein, 26 aa, Mycobacterium
LLIELPGDRWRFLITAHHIVIGGWSI

SEQ ID NO: 692766 - protein, 19 aa, Mycobacterium
LLIELRAAISQVLTEQGKT

SEQ ID NO: 692767 - protein, 20 aa, Mycobacterium
LLIERIDAEYARYFTPTGRP

SEQ ID NO: 692768 - protein, 17 aa, Mycobacterium
LLIGAAAAWMFDYYPLR

SEQ ID NO: 692769 - protein, 19 aa, Mycobacterium
LLILGGRPIREPVVHYGPF

SEQ ID NO: 692770 - protein, 17 aa, Mycobacterium
LLILRVAALFHENLKVL

SEQ ID NO: 692771 - protein, 29 aa, Mycobacterium
LLILTRLRESPCSVTELSAAVGMEQPAVS

SEQ ID NO: 692772 - protein, 26 aa, Mycobacterium
LLIQRCGGCGRLRHPPRPMCPHCRSL

SEQ ID NO: 692773 - protein, 19 aa, Mycobacterium
LLIRKAGAQSADMAAELVK

SEQ ID NO: 692774 - protein, 20 aa, Mycobacterium
LLITHDRWFLDEVATTTWEV

SEQ ID NO: 692775 - protein, 18 aa, Mycobacterium
LLITRWISTFAPDPAPLP

SEQ ID NO: 692776 - protein, 20 aa, Mycobacterium
LLIVRPGFVIGRMTAGMTPA

SEQ ID NO: 692777 - protein, 17 aa, Mycobacterium
LLKDRPLADISVDDLAK

SEQ ID NO: 692778 - protein, 32 aa, Mycobacterium
LLKDRRATSHWLTLPALKAFGAIPVADERIVR

SEQ ID NO: 692779 - protein, 24 aa, Mycobacterium
LLKDRVADVPAFLDAVEVVGRGGT

SEQ ID NO: 692780 - protein, 28 aa, Mycobacterium
LLKEAGFGRLRIPTELGGAGLSVRQLFS

SEQ ID NO: 692781 - protein, 17 aa, Mycobacterium
LLKEGFSDFLIVDEAQG

SEQ ID NO: 692782 - protein, 17 aa, Mycobacterium
LLKERLDLIKAKRRGTG

SEQ ID NO: 692783 - protein, 27 aa, Mycobacterium
LLKESTRWTWWQQRRLQTMIDYATSES

SEQ ID NO: 692784 - protein, 26 aa, Mycobacterium
LLKEVAEAYLAFNVWVLKEDALFLQD

SEQ ID NO: 692785 - protein, 17 aa, Mycobacterium
LLKEVWGPAYAKETHYL

SEQ ID NO: 692786 - protein, 32 aa, Mycobacterium
LLKFESARLWPLLDELRRVGVRLVQAQDHHDV

SEQ ID NO: 692787 - protein, 20 aa, Mycobacterium
LLKGGREWLSPTTWTYNELL

SEQ ID NO: 692788 - protein, 19 aa, Mycobacterium
LLKGGRPAKTPVLVVQQGT

SEQ ID NO: 692789 - protein, 17 aa, Mycobacterium
LLKGLTAHYLLKSVYPV

SEQ ID NO: 692790 - protein, 20 aa, Mycobacterium
LLKGQLGFLDRLMAHPDPAR

SEQ ID NO: 692791 - protein, 19 aa, Mycobacterium
LLKIGWPAEDLAGYVDGEA

SEQ ID NO: 692792 - protein, 18 aa, Mycobacterium
LLKKAPALRRIVKRQQAP

SEQ ID NO: 692793 - protein, 19 aa, Mycobacterium
LLKLGARPGCAVTIGDMTF

SEQ ID NO: 692794 - protein, 21 aa, Mycobacterium
LLKLLHPVMPFVTEVLWKTLT

SEQ ID NO: 692795 - protein, 22 aa, Mycobacterium
LLKLPIPVQRRVAAGVLSAGHA

SEQ ID NO: 692796 - protein, 20 aa, Mycobacterium
LLKLRLATYGKPEFTTDATH

SEQ ID NO: 692797 - protein, 19 aa, Mycobacterium
LLKPELLAVPRLGWVNLHF

SEQ ID NO: 692798 - protein, 20 aa, Mycobacterium
LLKPFTARYFEVILGVWERR

SEQ ID NO: 692799 - protein, 18 aa, Mycobacterium
LLKPRPPTLLALVCPSVV

SEQ ID NO: 692800 - protein, 17 aa, Mycobacterium
LLKRLEAKFADQPNAVL

SEQ ID NO: 692801 - protein, 24 aa, Mycobacterium
LLKSKLRTGGLLLNHCITRHDNKS

SEQ ID NO: 692802 - protein, 19 aa, Mycobacterium
LLKSLGAAEVIGRLPADPD

SEQ ID NO: 692803 - protein, 21 aa, Mycobacterium
LLKTFWDWRDLQLPDGTVIWL

SEQ ID NO: 692804 - protein, 18 aa, Mycobacterium
LLKTYARIRGRWHAALPV

SEQ ID NO: 692805 - protein, 24 aa, Mycobacterium
LLKVAACGVCGSDIPRMLRNGGYV

SEQ ID NO: 692806 - protein, 26 aa, Mycobacterium
LLKVFRGAACVVHLAWGFQPTRNRRY

SEQ ID NO: 692807 - protein, 17 aa, Mycobacterium
LLKVRRATIPGVLDVSD

SEQ ID NO: 692808 - protein, 17 aa, Mycobacterium
LLLAALRPVDTATAPIP

SEQ ID NO: 692809 - protein, 19 aa, Mycobacterium
LLLACHLAGCGYSMCESVD

SEQ ID NO: 692810 - protein, 17 aa, Mycobacterium
LLLADGMPIAWRGKLLT

SEQ ID NO: 692811 - protein, 19 aa, Mycobacterium
LLLADGMPIAWRGQLLTGK

SEQ ID NO: 692812 - protein, 30 aa, Mycobacterium; identical to SEQ ID NO: 100155

SEQ ID NO: 692813 - protein, 18 aa, Mycobacterium
LLLAGLEPDLKWERFVNA

SEQ ID NO: 692814 - protein, 24 aa, Mycobacterium
LLLAGRIGAAGARTRYTGIGGNVP

SEQ ID NO: 692815 - protein, 17 aa, Mycobacterium
LLLAISARSIAQVDETI

SEQ ID NO: 692816 - protein, 17 aa, Mycobacterium
LLLAMGVSDITVLDSRG

SEQ ID NO: 692817 - protein, 19 aa, Mycobacterium
LLLARAGIEVTVFEKHADF

SEQ ID NO: 692818 - protein, 18 aa, Mycobacterium
LLLARAGINVVVLEKHGD

SEQ ID NO: 692819 - protein, 17 aa, Mycobacterium
LLLARAGVDVTVMEKHA

SEQ ID NO: 692820 - protein, 18 aa, Mycobacterium
LLLARAGVEVVVLEKHGD

SEQ ID NO: 692821 - protein, 17 aa, Mycobacterium
LLLARLAGRGMRRILTE

SEQ ID NO: 692822 - protein, 18 aa, Mycobacterium
LLLDAGCKVDVWETTYLH

SEQ ID NO: 692823 - protein, 17 aa, Mycobacterium
LLLDARVVWGEVGLHTA

SEQ ID NO: 692824 - protein, 17 aa, Mycobacterium
LLLDDWVGAALVSGYAT

SEQ ID NO: 692825 - protein, 26 aa, Mycobacterium
LLLDGRKLLWWAMSRFTTLGNLPYRY

SEQ ID NO: 692826 - protein, 25 aa, Mycobacterium
LLLDLQERFGLAYLFVSHDLSVVRH

SEQ ID NO: 692827 - protein, 24 aa, Mycobacterium
LLLDLWRRHGFGVLLITHDVDEAV

SEQ ID NO: 692828 - protein, 17 aa, Mycobacterium
LLLEFADELPDLPPELE

SEQ ID NO: 692829 - protein, 18 aa, Mycobacterium
LLLEFGVVSRRYRHAVGE

SEQ ID NO: 692830 - protein, 20 aa, Mycobacterium
LLLERLLPVPGSRVVTVSSM

SEQ ID NO: 692831 - protein, 18 aa, Mycobacterium
LLLETSWDAIEHAGLDPA

SEQ ID NO: 692832 - protein, 18 aa, Mycobacterium
LLLETSWDAVEHAGLAPG

SEQ ID NO: 692833 - protein, 18 aa, Mycobacterium
LLLETTWEALDDAGIAGQ

SEQ ID NO: 692834 - protein, 27 aa, Mycobacterium
LLLFSALELLHAWALIHDDVIDASSTR

SEQ ID NO: 692835 - protein, 17 aa, Mycobacterium
LLLFVAGRDQVRVEFTG

SEQ ID NO: 692836 - protein, 17 aa, Mycobacterium
LLLGAWLAQGITAAAQL

SEQ ID NO: 692837 - protein, 24 aa, Mycobacterium
LLLGAYRFTEFRSAKTAPTDAGIR

SEQ ID NO: 692838 - protein, 18 aa, Mycobacterium
LLLGAYVADVWQPFVESG

SEQ ID NO: 692839 - protein, 18 aa, Mycobacterium
LLLGCGDAVIGINPATDS

SEQ ID NO: 692840 - protein, 19 aa, Mycobacterium
LLLGCGDAVIGINPATDSP

SEQ ID NO: 692841 - protein, 19 aa, Mycobacterium
LLLGEFEDLLGPRTKLVAA

SEQ ID NO: 692842 - protein, 21 aa, Mycobacterium
LLLGERAAPCWVILYRTGQTL

SEQ ID NO: 692843 - protein, 20 aa, Mycobacterium
LLLGGSGPRMMRLVAQYADW

SEQ ID NO: 692844 - protein, 18 aa, Mycobacterium
LLLGGSIFPAMQNFLLAA

SEQ ID NO: 692845 - protein, 17 aa, Mycobacterium
LLLGTALRQLSDDHRAV

SEQ ID NO: 692846 - protein, 18 aa, Mycobacterium
LLLGVGVGVRAELAVSSS

SEQ ID NO: 692847 - protein, 19 aa, Mycobacterium
LLLHEKWSAAGGVVSTVVG

SEQ ID NO: 692848 - protein, 23 aa, Mycobacterium
LLLHSYAGPVIWLEKFRMQLRNT

SEQ ID NO: 692849 - protein, 20 aa, Mycobacterium
LLLHYGIDWDTSWVAEPRHR

SEQ ID NO: 692850 - protein, 19 aa, Mycobacterium
LLLHYLPEIDMRTGDILAM

SEQ ID NO: 692851 - protein, 18 aa, Mycobacterium
LLLLHGYPSSSFDFREVI

SEQ ID NO: 692852 - protein, 18 aa, Mycobacterium
LLLLKGKYLVHPELPAGV

SEQ ID NO: 692853 - protein, 22 aa, Mycobacterium
LLLLYFPFRARRFFYDVDNRRF

SEQ ID NO: 692854 - protein, 19 aa, Mycobacterium
LLLMREGRLLAHTTPDRLR

SEQ ID NO: 692855 - protein, 19 aa, Mycobacterium
LLLMRRMVFVGYSLSDEDF

SEQ ID NO: 692856 - protein, 17 aa, Mycobacterium
LLLMTLIATNFFGQNTP

SEQ ID NO: 692857 - protein, 19 aa, Mycobacterium
LLLNRISLAPGEAIFLPAG

SEQ ID NO: 692858 - protein, 18 aa, Mycobacterium
LLLNRISLSPGEAIFLPA

SEQ ID NO: 692859 - protein, 18 aa, Mycobacterium
LLLNRLSLAPGEALYLPA

SEQ ID NO: 692860 - protein, 18 aa, Mycobacterium
LLLNTALESGETVLLEGS

SEQ ID NO: 692861 - protein, 18 aa, Mycobacterium
LLLPAGLETTYRSSGNLL

SEQ ID NO: 692862 - protein, 17 aa, Mycobacterium
LLLPAGVETTYRSLGNL

SEQ ID NO: 692863 - protein, 18 aa, Mycobacterium
LLLPEVILANRLSPALTF

SEQ ID NO: 692864 - protein, 18 aa, Mycobacterium
LLLPGGEVVDTWREGYPY

SEQ ID NO: 692865 - protein, 21 aa, Mycobacterium
LLLPVGETWLLVDAGADGVTV

SEQ ID NO: 692866 - protein, 26 aa, Mycobacterium
LLLRDEFRPATTLNVLAAAWLQFETH

SEQ ID NO: 692867 - protein, 17 aa, Mycobacterium
LLLRLAVPSRTAEISGL

SEQ ID NO: 692868 - protein, 25 aa, Mycobacterium
LLLRLKAWRLDVAKEQKVPAYVVFT

SEQ ID NO: 692869 - protein, 18 aa, Mycobacterium
LLLRRERTGTGGAVSVAQ

SEQ ID NO: 692870 - protein, 25 aa, Mycobacterium
LLLRRVQRGAVGLGPRGERREQLVG

SEQ ID NO: 692871 - protein, 17 aa, Mycobacterium
LLLSCLMTGGFARDPRG

SEQ ID NO: 692872 - protein, 19 aa, Mycobacterium
LLLSEFEALLGPKTKLVAA

SEQ ID NO: 692873 - protein, 18 aa, Mycobacterium
LLLSHFVIGEAISGLGEA

SEQ ID NO: 692874 - protein, 19 aa, Mycobacterium
LLLTGSGRMGMWARSSLTT

SEQ ID NO: 692875 - protein, 19 aa, Mycobacterium
LLLTHIPPWTSREDVIAEA

SEQ ID NO: 692876 - protein, 18 aa, Mycobacterium
LLLVRLPYHLSVLTQAAA

SEQ ID NO: 692877 - protein, 34 aa, Mycobacterium
LLLWPRTLPFFPFAHAERWLRLLPNAKLVEVPDS

SEQ ID NO: 692878 - protein, 19 aa, Mycobacterium
LLLWRKGFCEKLINQGLRV

SEQ ID NO: 692879 - protein, 18 aa, Mycobacterium
LLLWRTAFCQKLIDQGLR

SEQ ID NO: 692880 - protein, 23 aa, Mycobacterium
LLMAAKLRNLFVASGKLQVGRLW

SEQ ID NO: 692881 - protein, 17 aa, Mycobacterium
LLMAHCREAKAFLHCSS

SEQ ID NO: 692882 - protein, 18 aa, Mycobacterium
LLMDHHWQDGVSCAVDVA

SEQ ID NO: 692883 - protein, 19 aa, Mycobacterium
LLMDSLRYWVTEMHVDGFR

SEQ ID NO: 692884 - protein, 22 aa, Mycobacterium
LLMDSRAGYKYGDVTVLDHMAY

SEQ ID NO: 692885 - protein, 18 aa, Mycobacterium
LLMERHFPHTGWLRLDRD

SEQ ID NO: 692886 - protein, 24 aa, Mycobacterium
LLMETRPSALVAIAALSRLGAVAV

SEQ ID NO: 692887 - protein, 18 aa, Mycobacterium
LLMGCGDAVIGVNPATDS

SEQ ID NO: 692888 - protein, 29 aa, Mycobacterium
LLMGIPVDGGLHFAGRVGTGFTERDLAHL

SEQ ID NO: 692889 - protein, 17 aa, Mycobacterium
LLMGISFGYADDTAAVN

SEQ ID NO: 692890 - protein, 19 aa, Mycobacterium
LLMGVKPQGGVFYRFAVPG

SEQ ID NO: 692891 - protein, 21 aa, Mycobacterium
LLMGYRVPKTAFAFQKFSDAV

SEQ ID NO: 692892 - protein, 17 aa, Mycobacterium
LLMKAPEVIQLYADGPN

SEQ ID NO: 692893 - protein, 25 aa, Mycobacterium
LLMLARRLPTASAFLHQPGIAAGDM

SEQ ID NO: 692894 - protein, 22 aa, Mycobacterium
LLMNSRSGYKYGDVTVLDHMAY

SEQ ID NO: 692895 - protein, 17 aa, Mycobacterium
LLMPLFHGNLMKSYESI

SEQ ID NO: 692896 - protein, 19 aa, Mycobacterium
LLMPWLTVAENIAFAKRFG

SEQ ID NO: 692897 - protein, 19 aa, Mycobacterium
LLMRAPRVIQDYGDGPSGP

SEQ ID NO: 692898 - protein, 18 aa, Mycobacterium
LLMREGRLVAHTTPSQLR

SEQ ID NO: 692899 - protein, 20 aa, Mycobacterium
LLMSEFEYWGVPGPDLTVTS

SEQ ID NO: 692900 - protein, 23 aa, Mycobacterium
LLMWLTGQHDVVFGTAVSGRPTD

SEQ ID NO: 692901 - protein, 25 aa, Mycobacterium
LLNAARAPFSLSFSTHHVQLDTAAY

SEQ ID NO: 692902 - protein, 26 aa, Mycobacterium
LLNAVHFELLWLLNKRDYYGHITDED

SEQ ID NO: 692903 - protein, 20 aa, Mycobacterium
LLNCYLWLAPDGVTLIDTGW

SEQ ID NO: 692904 - protein, 27 aa, Mycobacterium
LLNDVLKAAWGYRGWVMSDWGGTPGWE

SEQ ID NO: 692905 - protein, 23 aa, Mycobacterium
LLNEHLDHCLTRAAAEGGDQAHA

SEQ ID NO: 692906 - protein, 31 aa, Mycobacterium
LLNEISMLMAYEVLRDIPLHDVEIETPLEHM

SEQ ID NO: 692907 - protein, 17 aa, Mycobacterium
LLNEPQFDEPSVVNGGN

SEQ ID NO: 692908 - protein, 18 aa, Mycobacterium
LLNGLGIDRAHFVGNSWG

SEQ ID NO: 692909 - protein, 24 aa, Mycobacterium
LLNGPRYWLMNAIEKAPQGPPVIK

SEQ ID NO: 692910 - protein, 24 aa, Mycobacterium
LLNGPRYWLMNAIEKEAQGPQVTK

SEQ ID NO: 692911 - protein, 24 aa, Mycobacterium
LLNGPRYWLMNAIEKQRQGPQITK

SEQ ID NO: 692912 - protein, 24 aa, Mycobacterium
LLNGPRYWLMNSIEKEPQGLPETK

SEQ ID NO: 692913 - protein, 27 aa, Mycobacterium
LLNGQKIWSSRAVFGERAFGLFRSDPA

SEQ ID NO: 692914 - protein, 26 aa, Mycobacterium
LLNLAPRWYIGSVLRHVDFVASDVPG

SEQ ID NO: 692915 - protein, 19 aa, Mycobacterium
LLNRIEVRGGAGSGKTFLA

SEQ ID NO: 692916 - protein, 22 aa, Mycobacterium
LLNRPGRTLGCYTVHQSRELVI

SEQ ID NO: 692917 - protein, 25 aa, Mycobacterium
LLNSGILRLRCEVVQSVSGWPVSAV

SEQ ID NO: 692918 - protein, 25 aa, Mycobacterium
LLNSRICAAVNDWLLDRWLEPDSTD

SEQ ID NO: 692919 - protein, 19 aa, Mycobacterium
LLNTGRLPHQWHTLTKTGK

SEQ ID NO: 692920 - protein, 19 aa, Mycobacterium
LLNVPFARRGKRMDECIDI

SEQ ID NO: 692921 - protein, 17 aa, Mycobacterium
LLNWARIAYNADTAVTM

SEQ ID NO: 692922 - protein, 32 aa, Mycobacterium
LLNWQRCGIDGARLRPAVNAFDLPVIVDEVVP

SEQ ID NO: 692923 - protein, 24 aa, Mycobacterium
LLNWRRLAPKPSFSAPVSGAGRFG

SEQ ID NO: 692924 - protein, 21 aa, Mycobacterium
LLPAALIYRAGMHVHAGELDA

SEQ ID NO: 692925 - protein, 21 aa, Mycobacterium
LLPAARPGTLFIDSSTVDVAD

SEQ ID NO: 692926 - protein, 18 aa, Mycobacterium
LLPAGALLAELAGRGHEV

SEQ ID NO: 692927 - protein, 18 aa, Mycobacterium
LLPAGGLPVDERWATRIH

SEQ ID NO: 692928 - protein, 18 aa, Mycobacterium
LLPAHFGTALARAEPLGD

SEQ ID NO: 692929 - protein, 19 aa, Mycobacterium
LLPALLRKSHATILNVTSG

SEQ ID NO: 692930 - protein, 18 aa, Mycobacterium
LLPASFALVGFARRDWED

SEQ ID NO: 692931 - protein, 37 aa, Mycobacterium
LLPDALSQLVQWPGFAGEIACSAWPAGAGALLSISFP

SEQ ID NO: 692932 - protein, 18 aa, Mycobacterium
LLPDIPHIAVFDTGFFHD

SEQ ID NO: 692933 - protein, 19 aa, Mycobacterium
LLPDSGYWLPKDQLPDNAI

SEQ ID NO: 692934 - protein, 20 aa, Mycobacterium
LLPDTARITGSVLLDGRDVT

SEQ ID NO: 692935 - protein, 25 aa, Mycobacterium
LLPDVYSNDALICFNSHAFMDDPDF

SEQ ID NO: 692936 - protein, 17 aa, Mycobacterium
LLPEALETWPLELFAES

SEQ ID NO: 692937 - protein, 24 aa, Mycobacterium
LLPEALETWPLRIFGEALPRHLEL

SEQ ID NO: 692938 - protein, 22 aa, Mycobacterium
LLPEISVPYGVNVLWDGRASID

SEQ ID NO: 692939 - protein, 23 aa, Mycobacterium
LLPELACDAPLLAAVLNGAAGQL

SEQ ID NO: 692940 - protein, 19 aa, Mycobacterium
LLPERLAHMANRWKAIAFS

SEQ ID NO: 692941 - protein, 31 aa, Mycobacterium
LLPERSARWILPLLWRRWSPGYRGADEDLRH

SEQ ID NO: 692942 - protein, 18 aa, Mycobacterium
LLPFALAGTCQRIEQVRC

SEQ ID NO: 692943 - protein, 25 aa, Mycobacterium
LLPFKPEMRDLLAGRSDRDHIGEFN

SEQ ID NO: 692944 - protein, 32 aa, Mycobacterium
LLPFTSRLSGAEWRSWRHAAKRLVIGTNVMRG

SEQ ID NO: 692945 - protein, 18 aa, Mycobacterium
LLPGDGAEALAYSHKRGW

SEQ ID NO: 692946 - protein, 17 aa, Mycobacterium
LLPGDLAVWDGHVAMVV

SEQ ID NO: 692947 - protein, 17 aa, Mycobacterium
LLPGGLFTADVMGETLD

SEQ ID NO: 692948 - protein, 19 aa, Mycobacterium
LLPGLFGFGPFAPTTGSPA

SEQ ID NO: 692949 - protein, 20 aa, Mycobacterium
LLPGRDGLVHISKLGKGKRI

SEQ ID NO: 692950 - protein, 20 aa, Mycobacterium
LLPGRDGLVHISKLGRGKRI

SEQ ID NO: 692951 - protein, 23 aa, Mycobacterium
LLPGVPLDRVIAFGAEDDPSKFN

SEQ ID NO: 692952 - protein, 18 aa, Mycobacterium
LLPHFDMWDPAHEKIKWD

SEQ ID NO: 692953 - protein, 17 aa, Mycobacterium
LLPHGYPASSYVYRNLM

SEQ ID NO: 692954 - protein, 17 aa, Mycobacterium
LLPIIGWLPDGIAPVDA

SEQ ID NO: 692955 - protein, 18 aa, Mycobacterium
LLPITKFFPATDVAILAR

SEQ ID NO: 692956 - protein, 18 aa, Mycobacterium
LLPITKFFPATDVVTLSR

SEQ ID NO: 692957 - protein, 23 aa, Mycobacterium
LLPKSREGYKYGDATLVDHLAYD

SEQ ID NO: 692958 - protein, 24 aa, Mycobacterium
LLPLADIGTAFVITMPTYDATLFV

SEQ ID NO: 692959 - protein, 25 aa, Mycobacterium
LLPLALKGPVLWVAALIGEEIFDAL

SEQ ID NO: 692960 - protein, 17 aa, Mycobacterium
LLPLFSGPAARPMNGVT

SEQ ID NO: 692961 - protein, 17 aa, Mycobacterium
LLPLGSEVARRCALFLM

SEQ ID NO: 692962 - protein, 23 aa, Mycobacterium
LLPLLHRDPRVWADPERFDPDQF

SEQ ID NO: 692963 - protein, 21 aa, Mycobacterium
LLPLTERRLGIAVSASASAPA

SEQ ID NO: 692964 - protein, 22 aa, Mycobacterium
LLPLYFELDGSFPNHEANPLDP

SEQ ID NO: 692965 - protein, 22 aa, Mycobacterium
LLPLYFELDGSFPNHEANPLEP

SEQ ID NO: 692966 - protein, 30 aa, Mycobacterium
LLPMADDGLRRWGVDPEVRDRFLGVIEGRA

SEQ ID NO: 692967 - protein, 24 aa, Mycobacterium
LLPMAHDGLRRWGVDAEVRDRFLG

SEQ ID NO: 692968 - protein, 18 aa, Mycobacterium
LLPMRWKTSDGWRDTDAR

SEQ ID NO: 692969 - protein, 19 aa, Mycobacterium
LLPNRGVIVIPTRDGEQGR

SEQ ID NO: 692970 - protein, 19 aa, Mycobacterium
LLPPCRHRSTALRIAGTAA

SEQ ID NO: 692971 - protein, 26 aa, Mycobacterium
LLPPGCAIVSDVGRFIAGSWPYITKA

SEQ ID NO: 692972 - protein, 19 aa, Mycobacterium
LLPPRIALQILMTGDPITA

SEQ ID NO: 692973 - protein, 18 aa, Mycobacterium
LLPQPWVGAAARSAAAAC

SEQ ID NO: 692974 - protein, 18 aa, Mycobacterium
LLPQRIVDELGAPVRLAR

SEQ ID NO: 692975 - protein, 33 aa, Mycobacterium
LLPQTRPLLRRIISISQAHVWSPYLSLTQDDAT

SEQ ID NO: 692976 - protein, 23 aa, Mycobacterium
LLPRLEAGMIPKVEACLRAVTGG

SEQ ID NO: 692977 - protein, 22 aa, Mycobacterium
LLPRTGEAVVTILAILKTGAAY

SEQ ID NO: 692978 - protein, 25 aa, Mycobacterium
LLPRVIPRLWRDWGPQGYDTGAELA

SEQ ID NO: 692979 - protein, 21 aa, Mycobacterium
LLPSFDPRQTLAMMAQEHATV

SEQ ID NO: 692980 - protein, 17 aa, Mycobacterium
LLPSGRSNYGLTSVNTT

SEQ ID NO: 692981 - protein, 33 aa, Mycobacterium
LLPSKRIPPTRGWRKVLYRGTFKLINPGQSRDE

SEQ ID NO: 692982 - protein, 21 aa, Mycobacterium
LLPSLFRGAALSDLPAREAVA

SEQ ID NO: 692983 - protein, 20 aa, Mycobacterium
LLPSLFRGAALSDLPTSEAL

SEQ ID NO: 692984 - protein, 18 aa, Mycobacterium
LLPTAVEEMVRWTSPSPS

SEQ ID NO: 692985 - protein, 26 aa, Mycobacterium
LLPTEFRDHLVLGYEILKWEADTPRP

SEQ ID NO: 692986 - protein, 20 aa, Mycobacterium
LLPVGELLGDAAAAVGQLAE

SEQ ID NO: 692987 - protein, 19 aa, Mycobacterium
LLPVGRLRAGRTFRPAPRR

SEQ ID NO: 692988 - protein, 27 aa, Mycobacterium
LLPVLVVGAPLRFRHRVYNTAVVIHRG

SEQ ID NO: 692989 - protein, 26 aa, Mycobacterium
LLPVLVVGAPLRYRHRIYNTAVVVHR

SEQ ID NO: 692990 - protein, 18 aa, Mycobacterium
LLPVLVVGAPVRHRHRIY

SEQ ID NO: 692991 - protein, 26 aa, Mycobacterium
LLPVVKGLGLRRAWAATIDYTPDHLP

SEQ ID NO: 692992 - protein, 19 aa, Mycobacterium
LLPWTAMRKPHYVRITPTE

SEQ ID NO: 692993 - protein, 17 aa, Mycobacterium
LLQAARCPTQARDTAIE

SEQ ID NO: 692994 - protein, 17 aa, Mycobacterium
LLQAICYDEVLLETVGV

SEQ ID NO: 692995 - protein, 18 aa, Mycobacterium
LLQALHRRLRGYAIAPLV

SEQ ID NO: 692996 - protein, 31 aa, Mycobacterium
LLQALRGGAIYDHWLAIGGVKSVLGAPTSPE

SEQ ID NO: 692997 - protein, 17 aa, Mycobacterium
LLQDRGFGEVGSVTATD

SEQ ID NO: 692998 - protein, 19 aa, Mycobacterium
LLQDRSFSGLSLREVTREA

SEQ ID NO: 692999 - protein, 18 aa, Mycobacterium
LLQDRSFSSLSLREVTRE

SEQ ID NO: 693000 - protein, 19 aa, Mycobacterium
LLQDRSFSSLSLREVTREV

SEQ ID NO: 693001 - protein, 24 aa, Mycobacterium
LLQERGSLRTGYCGHTLRDHLAQP

SEQ ID NO: 693002 - protein, 26 aa, Mycobacterium
LLQEWLRYGWYFLISRRDPAGLREWI

SEQ ID NO: 693003 - protein, 26 aa, Mycobacterium
LLQFRRDLWPLIAREVECVYYERHLA

SEQ ID NO: 693004 - protein, 23 aa, Mycobacterium
LLQGAFSRFSFIDRLPFRDGAGA

SEQ ID NO: 693005 - protein, 19 aa, Mycobacterium
LLQGARRVAAESGIDNPTV

SEQ ID NO: 693006 - protein, 18 aa, Mycobacterium
LLQGCPQLHILATSRELL

SEQ ID NO: 693007 - protein, 18 aa, Mycobacterium
LLQGLAFATSRRRMMDWL

SEQ ID NO: 693008 - protein, 19 aa, Mycobacterium
LLQGPFLIYRELLKQSIQA

SEQ ID NO: 693009 - protein, 18 aa, Mycobacterium
LLQHRRVMYVPYVAPRDF

SEQ ID NO: 693010 - protein, 17 aa, Mycobacterium
LLQIAAIIVEYFASGPA

SEQ ID NO: 693011 - protein, 23 aa, Mycobacterium
LLQLKSWRLNIAKEQNVPAYVVF

SEQ ID NO: 693012 - protein, 21 aa, Mycobacterium
LLQLKSWRLNTAKEQNVPAYV

SEQ ID NO: 693013 - protein, 21 aa, Mycobacterium
LLQLPVSWLGAGVYQSLNIPA

SEQ ID NO: 693014 - protein, 18 aa, Mycobacterium
LLQPEQWGGLQCDPGLFY

SEQ ID NO: 693015 - protein, 24 aa, Mycobacterium
LLQPGVLSLAWGSVVRQLAAGLGI

SEQ ID NO: 693016 - protein, 24 aa, Mycobacterium
LLQPGVLSLAWGSVVRQLAAGLGV

SEQ ID NO: 693017 - protein, 26 aa, Mycobacterium
LLQPLALAPRGIWLGPKELRTFYRIR

SEQ ID NO: 693018 - protein, 28 aa, Mycobacterium
LLQPLRSVLLAIMFEWGIALQGWESQQK

SEQ ID NO: 693019 - protein, 18 aa, Mycobacterium
LLQPMGLVHGGVYCSMIE

SEQ ID NO: 693020 - protein, 34 aa, Mycobacterium
LLQQLCDEWARRGWLAVRYNLPYRRRRPKGPPSG

SEQ ID NO: 693021 - protein, 25 aa, Mycobacterium
LLQRCFTGLELRRDRIVVGPMWPEP

SEQ ID NO: 693022 - protein, 18 aa, Mycobacterium
LLQRCFTGLETRDDRLIL

SEQ ID NO: 693023 - protein, 24 aa, Mycobacterium
LLQRHTGPIFPLIEDLFGVSVVEV

SEQ ID NO: 693024 - protein, 18 aa, Mycobacterium
LLQRLTVAEFFRLMRQFG

SEQ ID NO: 693025 - protein, 23 aa, Mycobacterium
LLQRPEEVAARRGLPIEDVAPAG

SEQ ID NO: 693026 - protein, 18 aa, Mycobacterium
LLQSFDLSYGEDEGGEDD

SEQ ID NO: 693027 - protein, 18 aa, Mycobacterium
LLQTAERLGIFAPVERLI

SEQ ID NO: 693028 - protein, 17 aa, Mycobacterium
LLQTIPLRRLGAPREIA

SEQ ID NO: 693029 - protein, 24 aa, Mycobacterium
LLQTLLVLEMFYRVEIDVPGDDPL

SEQ ID NO: 693030 - protein, 25 aa, Mycobacterium
LLQWQNWSLRIGFNHREGMTLHTVR

SEQ ID NO: 693031 - protein, 25 aa, Mycobacterium
LLRAAARLLAMRGYARVRLEDLGSA

SEQ ID NO: 693032 - protein, 20 aa, Mycobacterium
LLRAALCEKDRMVLPASALT

SEQ ID NO: 693033 - protein, 17 aa, Mycobacterium
LLRADMDALPVLEHTGL

SEQ ID NO: 693034 - protein, 23 aa, Mycobacterium
LLRAEGVLARDGRIALGEVRYEF

SEQ ID NO: 693035 - protein, 18 aa, Mycobacterium
LLRAEVLPGAGGSAPRTQ

SEQ ID NO: 693036 - protein, 18 aa, Mycobacterium
LLRAINPVLGFLLRTPLA

SEQ ID NO: 693037 - protein, 23 aa, Mycobacterium
LLRALAAPLRIAIVLQLQQSQRC

SEQ ID NO: 693038 - protein, 17 aa, Mycobacterium
LLRAQFNSVGMRLFSLH

SEQ ID NO: 693039 - protein, 21 aa, Mycobacterium
LLRARLGDGPVHMDTLGEDVR

SEQ ID NO: 693040 - protein, 19 aa, Mycobacterium
LLRCRVAGAPLGLDRPWWV

SEQ ID NO: 693041 - protein, 24 aa, Mycobacterium
LLRDELRPGDVVLVKASNSAGLGA

SEQ ID NO: 693042 - protein, 19 aa, Mycobacterium
LLRDFPFEKSEVVRPAAGY

SEQ ID NO: 693043 - protein, 17 aa, Mycobacterium
LLRDGFFTTLRLTEDDR

SEQ ID NO: 693044 - protein, 20 aa, Mycobacterium
LLRDIRRGMESAGMYCEGVK

SEQ ID NO: 693045 - protein, 18 aa, Mycobacterium
LLRDRGYTIVEPEVGELV

SEQ ID NO: 693046 - protein, 30 aa, Mycobacterium
LLREAHDLCGLPVATFRSDMILAHPRYRGQ

SEQ ID NO: 693047 - protein, 30 aa, Mycobacterium
LLREAHDLCGLPVAVFRCDMILADTTYAGQ

SEQ ID NO: 693048 - protein, 30 aa, Mycobacterium
LLREAHDLCGLPVAVFRSDMILAHSRYAGQ

SEQ ID NO: 693049 - protein, 30 aa, Mycobacterium
LLREAHDLCGLPVAVFRSDMILAHSRYTGQ

SEQ ID NO: 693050 - protein, 31 aa, Mycobacterium
LLREAHDLCGLPVAVFRSDMILAHSRYTGQL

SEQ ID NO: 693051 - protein, 28 aa, Mycobacterium
LLREAHDLCGLPVSVFRSDMILADTSYA

SEQ ID NO: 693052 - protein, 29 aa, Mycobacterium
LLREAHDLCGLPVSVFRSDMILSDTSYAG

SEQ ID NO: 693053 - protein, 31 aa, Mycobacterium
LLREAHDLCGLPVTVFRCDMILADTTYAGQL

SEQ ID NO: 693054 - protein, 24 aa, Mycobacterium
LLREAVLTEGWRLHPDTDPVAAAT

SEQ ID NO: 693055 - protein, 26 aa, Mycobacterium
LLREELLAVPALGWVNLHFSVLPAWR

SEQ ID NO: 693056 - protein, 28 aa, Mycobacterium
LLREGLASLLARSGYRVVGQVGDAASLL

SEQ ID NO: 693057 - protein, 24 aa, Mycobacterium
LLREGLSSLLDRSGFDVVGQAADA

SEQ ID NO: 693058 - protein, 22 aa, Mycobacterium
LLREHPELIPTAVEEFLRYTSP

SEQ ID NO: 693059 - protein, 26 aa, Mycobacterium
LLREIFPRTVIAMAFGSTMILSQAKT

SEQ ID NO: 693060 - protein, 19 aa, Mycobacterium
LLREKRPAIAGPLLRPFFE

SEQ ID NO: 693061 - protein, 19 aa, Mycobacterium
LLRELELLEPLRARLADGM

SEQ ID NO: 693062 - protein, 19 aa, Mycobacterium
LLRELRSQLMAGFADLVLR

SEQ ID NO: 693063 - protein, 18 aa, Mycobacterium
LLREPDLGELERLLDAGG

SEQ ID NO: 693064 - protein, 17 aa, Mycobacterium
LLREQRFGGIINVASAA

SEQ ID NO: 693065 - protein, 23 aa, Mycobacterium
LLRFLPEMAEHLLGETPLLPTPH

SEQ ID NO: 693066 - protein, 28 aa, Mycobacterium
LLRFYRLAQELVWQWMFGRITADSRDAA

SEQ ID NO: 693067 - protein, 19 aa, Mycobacterium
LLRGCGAQRVIDTRTEAFD

SEQ ID NO: 693068 - protein, 26 aa, Mycobacterium
LLRGDELGQLGFNYTLNIPTLPVDLD

SEQ ID NO: 693069 - protein, 29 aa, Mycobacterium
LLRGDPRLPEWRLMAARAVARRDELARQK

SEQ ID NO: 693070 - protein, 22 aa, Mycobacterium
LLRGRLAATTGLARRYHHRMPV

SEQ ID NO: 693071 - protein, 22 aa, Mycobacterium
LLRHEPDVWTDVGWVPTDAGYG

SEQ ID NO: 693072 - protein, 19 aa, Mycobacterium
LLRHGDFGLGTFNRLDGEM

SEQ ID NO: 693073 - protein, 18 aa, Mycobacterium
LLRHHFRRLIGVTPSDYR

SEQ ID NO: 693074 - protein, 20 aa, Mycobacterium
LLRHHFRRLIGVTPSDYRKR

SEQ ID NO: 693075 - protein, 27 aa, Mycobacterium
LLRINRLIFAAGVPHHYQSVLLSPTRS

SEQ ID NO: 693076 - protein, 21 aa, Mycobacterium
LLRISAFGRRGPWRQRSATPL

SEQ ID NO: 693077 - protein, 17 aa, Mycobacterium
LLRKRLVEFETSGGDGR

SEQ ID NO: 693078 - protein, 17 aa, Mycobacterium
LLRKRLVEFETTGSEGR

SEQ ID NO: 693079 - protein, 23 aa, Mycobacterium
LLRLALDAGPSVLYRLHLDLASL

SEQ ID NO: 693080 - protein, 22 aa, Mycobacterium
LLRLDEVVPVWIPSAADDATQD

SEQ ID NO: 693081 - protein, 26 aa, Mycobacterium
LLRLKSIPISLALPWGLNISDLAGHI

SEQ ID NO: 693082 - protein, 27 aa, Mycobacterium
LLRLKVFPLAISLPWGIAPAALPQLPL

SEQ ID NO: 693083 - protein, 20 aa, Mycobacterium
LLRLLHPVIPFLTEALWQAL

SEQ ID NO: 693084 - protein, 21 aa, Mycobacterium
LLRLLPASLLASADMAHATHP

SEQ ID NO: 693085 - protein, 17 aa, Mycobacterium
LLRLRRVATDAAETNGA

SEQ ID NO: 693086 - protein, 19 aa, Mycobacterium
LLRLVEPDLSITLIERLDA

SEQ ID NO: 693087 - protein, 33 aa, Mycobacterium
LLRLWRPPCGPGQWCTLGLFAARDEPSLRKLLV

SEQ ID NO: 693088 - protein, 23 aa, Mycobacterium
LLRMFADGVGLSYEHALLVERIE

SEQ ID NO: 693089 - protein, 31 aa, Mycobacterium
LLRMKMFRRVCGGLEPMWLWLNHDGTPRPKH

SEQ ID NO: 693090 - protein, 21 aa, Mycobacterium
LLRMPGFGLDGPWRDNPAFAY

SEQ ID NO: 693091 - protein, 21 aa, Mycobacterium
LLRNHYEGWLSQVALAVMAAE

SEQ ID NO: 693092 - protein, 22 aa, Mycobacterium
LLRNVWAYVVICCGRTHRSSRP

SEQ ID NO: 693093 - protein, 23 aa, Mycobacterium
LLRPLALAPKGIWLGPNELRAFY

SEQ ID NO: 693094 - protein, 18 aa, Mycobacterium
LLRPMFDYRHRQLADDLA

SEQ ID NO: 693095 - protein, 22 aa, Mycobacterium
LLRPSRSWGPDRIAVRCGGEQI

SEQ ID NO: 693096 - protein, 22 aa, Mycobacterium
LLRPTLELLARIAARHPTARTH

SEQ ID NO: 693097 - protein, 18 aa, Mycobacterium
LLRQAGRAAHRIGGGTAG

SEQ ID NO: 693098 - protein, 17 aa, Mycobacterium
LLRQAMMSALGERQGPA

SEQ ID NO: 693099 - protein, 25 aa, Mycobacterium
LLRQCARALAAIHRAEWNGLGLVRE

SEQ ID NO: 693100 - protein, 29 aa, Mycobacterium
LLRQLRLGEYDVLIGINLLREGLDLPEVS

SEQ ID NO: 693101 - protein, 18 aa, Mycobacterium
LLRQWLRTVAEHLDTPAA

SEQ ID NO: 693102 - protein, 25 aa, Mycobacterium
LLRRAATAWPGRVAVADAVGRHTYS

SEQ ID NO: 693103 - protein, 17 aa, Mycobacterium
LLRRAGVIEASRENAAD

SEQ ID NO: 693104 - protein, 17 aa, Mycobacterium
LLRRASERLAKVDLPAP

SEQ ID NO: 693105 - protein, 26 aa, Mycobacterium
LLRRAVARLPLRLVYPDGTAIGAGDA

SEQ ID NO: 693106 - protein, 18 aa, Mycobacterium
LLRRDGMSDGDVNRVFST

SEQ ID NO: 693107 - protein, 23 aa, Mycobacterium
LLRRDGPQLLPAIFSYSQQNCIR

SEQ ID NO: 693108 - protein, 17 aa, Mycobacterium
LLRRIGLAASKYWVCKR

SEQ ID NO: 693109 - protein, 17 aa, Mycobacterium
LLRRLHAGFTDRTGLEL

SEQ ID NO: 693110 - protein, 18 aa, Mycobacterium
LLRRMAAGAGLIPGVHPR

SEQ ID NO: 693111 - protein, 19 aa, Mycobacterium
LLRRNRKVLVGPVTWSVEL

SEQ ID NO: 693112 - protein, 21 aa, Mycobacterium
LLRRPRVAAVAPMARDDTAPG

SEQ ID NO: 693113 - protein, 23 aa, Mycobacterium
LLRRRGDKYFPAPGVEPHAAVDI

SEQ ID NO: 693114 - protein, 23 aa, Mycobacterium
LLRRRGDKYFPAPGVQPHAAVDI

SEQ ID NO: 693115 - protein, 19 aa, Mycobacterium
LLRRSAAAMLARHPNLRAA

SEQ ID NO: 693116 - protein, 18 aa, Mycobacterium
LLRRWWAEGEVAAVVGHQ

SEQ ID NO: 693117 - protein, 25 aa, Mycobacterium
LLRSGLPFGTCLQAVYLHPQGGDEF

SEQ ID NO: 693118 - protein, 21 aa, Mycobacterium
LLRSITLRLTIAPVQRTWPAL

SEQ ID NO: 693119 - protein, 28 aa, Mycobacterium
LLRSLSKAPFRWSRPVMDRFDAACIAAY

SEQ ID NO: 693120 - protein, 24 aa, Mycobacterium
LLRSRPAQMAAFLGVLLSGATVVT

SEQ ID NO: 693121 - protein, 17 aa, Mycobacterium
LLRSVCRVVTARRTVCH

SEQ ID NO: 693122 - protein, 20 aa, Mycobacterium
LLRSYELWERLAIDAQSDIY

SEQ ID NO: 693123 - protein, 22 aa, Mycobacterium
LLRVFFKSWFRVEVSGIENLPD

SEQ ID NO: 693124 - protein, 24 aa, Mycobacterium
LLRVSHAFHSPAMDPILAEFEAIA

SEQ ID NO: 693125 - protein, 18 aa, Mycobacterium
LLRWAGELAPGSWIGVQM

SEQ ID NO: 693126 - protein, 17 aa, Mycobacterium
LLRWAQQAFTDFSVVPP

SEQ ID NO: 693127 - protein, 22 aa, Mycobacterium
LLRWDEERLLFDPGEGTQRQML

SEQ ID NO: 693128 - protein, 20 aa, Mycobacterium
LLRWSVWRMATGARNITTTG

SEQ ID NO: 693129 - protein, 21 aa, Mycobacterium
LLRWSVWRMAVGNRNITTTGQ

SEQ ID NO: 693130 - protein, 21 aa, Mycobacterium
LLRWVIAAPQYRHWHHAREPQ

SEQ ID NO: 693131 - protein, 27 aa, Mycobacterium
LLSAAVPEWAGSAWLRRVPGVAAPVST

SEQ ID NO: 693132 - protein, 17 aa, Mycobacterium
LLSAIPGLAEAPGPDLA

SEQ ID NO: 693133 - protein, 18 aa, Mycobacterium
LLSCEGLHAGAREALSIA

SEQ ID NO: 693134 - protein, 17 aa, Mycobacterium
LLSCGAVLDHLRVAMSV

SEQ ID NO: 693135 - protein, 17 aa, Mycobacterium
LLSCPCGPATAEFAEEY

SEQ ID NO: 693136 - protein, 18 aa, Mycobacterium
LLSCYGDPVLHVGPTGAG

SEQ ID NO: 693137 - protein, 23 aa, Mycobacterium
LLSDGFRPTLFIVEYNGKFPPPV

SEQ ID NO: 693138 - protein, 17 aa, Mycobacterium
LLSDLVAQVVRLDTVLP

SEQ ID NO: 693139 - protein, 23 aa, Mycobacterium
LLSDTRASPWLTRHPEMPEWHLH

SEQ ID NO: 693140 - protein, 25 aa, Mycobacterium
LLSDYRNGNDWRRIGLMDCGERWAV

SEQ ID NO: 693141 - protein, 18 aa, Mycobacterium
LLSEAAFKAHPDYAQVAI

SEQ ID NO: 693142 - protein, 17 aa, Mycobacterium
LLSECVTSPRAVLFVTP

SEQ ID NO: 693143 - protein, 19 aa, Mycobacterium
LLSEGACACATSPEYLWRN

SEQ ID NO: 693144 - protein, 21 aa, Mycobacterium
LLSELFGGHALLAPTTTLAHM

SEQ ID NO: 693145 - protein, 25 aa, Mycobacterium
LLSEPILKPGSWIGGDRDGNPNVTA

SEQ ID NO: 693146 - protein, 23 aa, Mycobacterium
LLSEPILRPGSWIGGDRDGNPNV

SEQ ID NO: 693147 - protein, 19 aa, Mycobacterium
LLSERIIFLGQQVDDDIAN

SEQ ID NO: 693148 - protein, 18 aa, Mycobacterium
LLSERIIFLGSEVSDEIA

SEQ ID NO: 693149 - protein, 26 aa, Mycobacterium
LLSEYDRFALLHGDYRLDNLLFDPDR

SEQ ID NO: 693150 - protein, 17 aa, Mycobacterium
LLSFPKPVVMACTGHAI

SEQ ID NO: 693151 - protein, 18 aa, Mycobacterium
LLSFPVDYASITRLLFSR

SEQ ID NO: 693152 - protein, 19 aa, Mycobacterium
LLSGEGLYRAFKGVDVAID

SEQ ID NO: 693153 - protein, 23 aa, Mycobacterium
LLSGFERRGRWNVPKKLTTFAFW

SEQ ID NO: 693154 - protein, 17 aa, Mycobacterium
LLSGGRFTLGLGTQIRT

SEQ ID NO: 693155 - protein, 18 aa, Mycobacterium
LLSGIDPAGVFRRVADRA

SEQ ID NO: 693156 - protein, 18 aa, Mycobacterium
LLSGKRCFIGLKLNQIRA

SEQ ID NO: 693157 - protein, 18 aa, Mycobacterium
LLSGPWRAILNAATMLGQ

SEQ ID NO: 693158 - protein, 28 aa, Mycobacterium
LLSGSGWLKRFWNNWGPDANIWNTIFSS

SEQ ID NO: 693159 - protein, 24 aa, Mycobacterium
LLSHLRDEYALSIILITHEMEVVR

SEQ ID NO: 693160 - protein, 24 aa, Mycobacterium
LLSKHIRLIAAFDHRHVFLDPNPD

SEQ ID NO: 693161 - protein, 25 aa, Mycobacterium
LLSKHIRLLAAFDHRHIFLDPDPDA

SEQ ID NO: 693162 - protein, 23 aa, Mycobacterium
LLSKHIRLVAAFDHRDIFLDPNP

SEQ ID NO: 693163 - protein, 23 aa, Mycobacterium
LLSKHIRLVAAFDHRHIFLDPDP

SEQ ID NO: 693164 - protein, 18 aa, Mycobacterium
LLSMGPWGTLALANPKLL

SEQ ID NO: 693165 - protein, 24 aa, Mycobacterium
LLSMRTGQGYAEFAVSSFGTDAAV

SEQ ID NO: 693166 - protein, 25 aa, Mycobacterium
LLSMRTGQGYAEFAVSTFGTDAAIG

SEQ ID NO: 693167 - protein, 23 aa, Mycobacterium
LLSNRILPAAGMHHMSRVVLGIP

SEQ ID NO: 693168 - protein, 18 aa, Mycobacterium
LLSPFPRDRGWPVDDLLS

SEQ ID NO: 693169 - protein, 29 aa, Mycobacterium
LLSPGLDTRAWRLPWLNDTVIFEVDRPRT

SEQ ID NO: 693170 - protein, 19 aa, Mycobacterium
LLSQLGIPITVQRQVMYWL

SEQ ID NO: 693171 - protein, 18 aa, Mycobacterium
LLSQNVLRKARAHEAAVQ

SEQ ID NO: 693172 - protein, 22 aa, Mycobacterium
LLSRHIRLIAAFDHRHVFLDPD

SEQ ID NO: 693173 - protein, 21 aa, Mycobacterium
LLSRIGDAFLALPEGFTAHPR

SEQ ID NO: 693174 - protein, 24 aa, Mycobacterium
LLSRLREWGVQQVFGYPGDGINGL

SEQ ID NO: 693175 - protein, 25 aa, Mycobacterium
LLSRPELKAAVGQIVNADGGQSRNR

SEQ ID NO: 693176 - protein, 22 aa, Mycobacterium
LLSRRGQVLAALAERIESRFGV

SEQ ID NO: 693177 - protein, 21 aa, Mycobacterium
LLSRRRIFVPILRVTAIEPGA

SEQ ID NO: 693178 - protein, 18 aa, Mycobacterium
LLSRSGLPAADSGPEAGT

SEQ ID NO: 693179 - protein, 17 aa, Mycobacterium
LLSSAALGRLVTSIAGE

SEQ ID NO: 693180 - protein, 29 aa, Mycobacterium
LLSSDELLALFGRLGYRFAPERIPETVDY

SEQ ID NO: 693181 - protein, 19 aa, Mycobacterium
LLSVFARLSGGKAVVEVGT

SEQ ID NO: 693182 - protein, 23 aa, Mycobacterium
LLSVGSYRPARVVTNDELCENID

SEQ ID NO: 693183 - protein, 27 aa, Mycobacterium
LLSVGYAACHWCHVMAHESFADDEVAA

SEQ ID NO: 693184 - protein, 18 aa, Mycobacterium
LLSVLARLTGGRAVVEVG

SEQ ID NO: 693185 - protein, 19 aa, Mycobacterium
LLSVRDLRLPPKIEKVSFD

SEQ ID NO: 693186 - protein, 18 aa, Mycobacterium
LLSVSALACASLLGTPSA

SEQ ID NO: 693187 - protein, 22 aa, Mycobacterium
LLSVSFGTDWSWVGPARDAGIP

SEQ ID NO: 693188 - protein, 19 aa, Mycobacterium
LLSWRPGLTYRQLATELTE

SEQ ID NO: 693189 - protein, 17 aa, Mycobacterium
LLTAAGVPVELHHAESL

SEQ ID NO: 693190 - protein, 20 aa, Mycobacterium
LLTADMVRPGAAVLDVGVSR

SEQ ID NO: 693191 - protein, 24 aa, Mycobacterium
LLTAEHRTALIVTHDLLDALAVAD

SEQ ID NO: 693192 - protein, 25 aa, Mycobacterium
LLTAKGEAFLPVLVTGLQWAQGWFS

SEQ ID NO: 693193 - protein, 17 aa, Mycobacterium
LLTAMDFKSNPMLHRVS

SEQ ID NO: 693194 - protein, 18 aa, Mycobacterium
LLTAVPFAPGYGVEIGLL

SEQ ID NO: 693195 - protein, 17 aa, Mycobacterium
LLTAWRAALAASGRAKA

SEQ ID NO: 693196 - protein, 21 aa, Mycobacterium
LLTCGKLYYELAARKSKQDRD

SEQ ID NO: 693197 - protein, 19 aa, Mycobacterium
LLTDGRFLLTTSIGLPQKA

SEQ ID NO: 693198 - protein, 25 aa, Mycobacterium
LLTDLALSCAMWLGMGRMLRTLDIG

SEQ ID NO: 693199 - protein, 27 aa, Mycobacterium
LLTDVLRGQWGFRGTVVSDYWSVPFLA

SEQ ID NO: 693200 - protein, 17 aa, Mycobacterium
LLTDYFLPADKYPAINI

SEQ ID NO: 693201 - protein, 18 aa, Mycobacterium
LLTELGWTLRCVPMPPKG

SEQ ID NO: 693202 - protein, 19 aa, Mycobacterium
LLTEPDLLRLWWAEGDVAA

SEQ ID NO: 693203 - protein, 20 aa, Mycobacterium
LLTEPDLLRRWWAEGEVAAV

SEQ ID NO: 693204 - protein, 18 aa, Mycobacterium
LLTGGRGDLTWGQAAERF

SEQ ID NO: 693205 - protein, 22 aa, Mycobacterium
LLTGHALLRLRDGVITHTEGDT

SEQ ID NO: 693206 - protein, 17 aa, Mycobacterium
LLTGMLCEMGDRGSDSA

SEQ ID NO: 693207 - protein, 18 aa, Mycobacterium
LLTGRPLIGDGADGISPG

SEQ ID NO: 693208 - protein, 26 aa, Mycobacterium
LLTGSGPAWWQTLWNVWGPNANVWNT

SEQ ID NO: 693209 - protein, 18 aa, Mycobacterium
LLTHWARDRHRGPKFSLE

SEQ ID NO: 693210 - protein, 17 aa, Mycobacterium
LLTLAALAEFSSSRRPL

SEQ ID NO: 693211 - protein, 23 aa, Mycobacterium
LLTLHPRVGRWLQLGGHCEPTDE

SEQ ID NO: 693212 - protein, 18 aa, Mycobacterium
LLTLLLFDIGSFAGLAPL

SEQ ID NO: 693213 - protein, 28 aa, Mycobacterium
LLTLRGALVRDPRAWSGYLTEAIETFAD

SEQ ID NO: 693214 - protein, 24 aa, Mycobacterium
LLTNEVAWEKGVFGTDSALNGVIN

SEQ ID NO: 693215 - protein, 25 aa, Mycobacterium
LLTNLPMVLADVAFHAAQLASTIGQ

SEQ ID NO: 693216 - protein, 25 aa, Mycobacterium
LLTNQGWRGSAGFMAGFRRAGARHQ

SEQ ID NO: 693217 - protein, 17 aa, Mycobacterium
LLTNVSKLFAERCITGL

SEQ ID NO: 693218 - protein, 26 aa, Mycobacterium
LLTPLALAPKGIWFAPKDLRLFYQIR

SEQ ID NO: 693219 - protein, 17 aa, Mycobacterium
LLTPLLFDMGSFAGLAR

SEQ ID NO: 693220 - protein, 17 aa, Mycobacterium
LLTPRTQPWLADHRIAG

SEQ ID NO: 693221 - protein, 19 aa, Mycobacterium
LLTQLWAGKKIDWPGSRHR

SEQ ID NO: 693222 - protein, 18 aa, Mycobacterium
LLTRAELVAALDDLEELS

SEQ ID NO: 693223 - protein, 18 aa, Mycobacterium
LLTRAGCHLCARAAEELT

SEQ ID NO: 693224 - protein, 18 aa, Mycobacterium
LLTRELFYTAVTRAARKV

SEQ ID NO: 693225 - protein, 18 aa, Mycobacterium
LLTREVRRAISRTFNRAG

SEQ ID NO: 693226 - protein, 18 aa, Mycobacterium
LLTRLEPLLAKRPAAVVI

SEQ ID NO: 693227 - protein, 17 aa, Mycobacterium
LLTRPDLVAALDELEEL

SEQ ID NO: 693228 - protein, 18 aa, Mycobacterium
LLTRPEFGAMFLDDLLNG

SEQ ID NO: 693229 - protein, 24 aa, Mycobacterium
LLTRREAFRRLALLGVGATAAGAL

SEQ ID NO: 693230 - protein, 21 aa, Mycobacterium
LLTRRRIFVPILRVTAIEPGA

SEQ ID NO: 693231 - protein, 17 aa, Mycobacterium
LLTSGKIYYELAARKAK

SEQ ID NO: 693232 - protein, 18 aa, Mycobacterium
LLTSHVWRQDHNGASHQD

SEQ ID NO: 693233 - protein, 18 aa, Mycobacterium
LLTSLGIRRRRLKTSLLS

SEQ ID NO: 693234 - protein, 19 aa, Mycobacterium
LLTSPTWGLVRYAKITTIK

SEQ ID NO: 693235 - protein, 19 aa, Mycobacterium
LLTSVPFAPGYGVEIGLLL

SEQ ID NO: 693236 - protein, 17 aa, Mycobacterium
LLTTKPFLYVFNADEAV

SEQ ID NO: 693237 - protein, 24 aa, Mycobacterium
LLTTLFKGSAIPVSTVRPITGTPG

SEQ ID NO: 693238 - protein, 17 aa, Mycobacterium
LLTTWTAGFPEPRTFTM

SEQ ID NO: 693239 - protein, 18 aa, Mycobacterium
LLTVHHWGDLSAGIAELR

SEQ ID NO: 693240 - protein, 19 aa, Mycobacterium
LLTVRARAVLTGATVAFTD

SEQ ID NO: 693241 - protein, 24 aa, Mycobacterium
LLTVTRLLAPVLVPVVYRAAIAAR

SEQ ID NO: 693242 - protein, 18 aa, Mycobacterium
LLVADAWHHRILIWDEVP

SEQ ID NO: 693243 - protein, 18 aa, Mycobacterium
LLVADLAYVRGMVHRQLR

SEQ ID NO: 693244 - protein, 17 aa, Mycobacterium
LLVADLAYVRGMVYRQL

SEQ ID NO: 693245 - protein, 27 aa, Mycobacterium
LLVADTRGGALLAFGLADSLILRQRYP

SEQ ID NO: 693246 - protein, 19 aa, Mycobacterium
LLVADWNRPYTREEAAYPL

SEQ ID NO: 693247 - protein, 26 aa, Mycobacterium
LLVAECLRAGAWDGLEPAELAGVLSA

SEQ ID NO: 693248 - protein, 18 aa, Mycobacterium
LLVAEGFPIEVPRRSLRD

SEQ ID NO: 693249 - protein, 17 aa, Mycobacterium
LLVALSGRPAGSVDITP

SEQ ID NO: 693250 - protein, 18 aa, Mycobacterium
LLVASDFDGTLAPIVNNP

SEQ ID NO: 693251 - protein, 21 aa, Mycobacterium
LLVCRIGDLPLAYRDHCPVCA

SEQ ID NO: 693252 - protein, 17 aa, Mycobacterium
LLVDDWHMITAAGGLMP

SEQ ID NO: 693253 - protein, 18 aa, Mycobacterium
LLVDIAARGRSLGVLLIG

SEQ ID NO: 693254 - protein, 17 aa, Mycobacterium
LLVEFLAYTGLRAAEAA

SEQ ID NO: 693255 - protein, 20 aa, Mycobacterium
LLVEIFGVIGARVQIPDHFG

SEQ ID NO: 693256 - protein, 17 aa, Mycobacterium
LLVELERLYNHAADLGA

SEQ ID NO: 693257 - protein, 20 aa, Mycobacterium
LLVESGMAPLFPLVVIVYAD

SEQ ID NO: 693258 - protein, 17 aa, Mycobacterium
LLVFLPLAHVLARALTL

SEQ ID NO: 693259 - protein, 18 aa, Mycobacterium
LLVFSTYRLAVLDRLCGS

SEQ ID NO: 693260 - protein, 19 aa, Mycobacterium
LLVGDRAGGELAWDLAASK

SEQ ID NO: 693261 - protein, 18 aa, Mycobacterium
LLVGEFVPGRRQRSSDET

SEQ ID NO: 693262 - protein, 20 aa, Mycobacterium
LLVGISTRLLAGATDVVGAD

SEQ ID NO: 693263 - protein, 21 aa, Mycobacterium
LLVGLPFPARPAGVPEAAIGY

SEQ ID NO: 693264 - protein, 26 aa, Mycobacterium
LLVGPNLLAGWGFRTDRRAHDEIAAI

SEQ ID NO: 693265 - protein, 20 aa, Mycobacterium
LLVHCCASDPPWELLREANI

SEQ ID NO: 693266 - protein, 19 aa, Mycobacterium
LLVHCGRLSVEKRVDRSID

SEQ ID NO: 693267 - protein, 24 aa, Mycobacterium
LLVHLRGAGTLLLSGDVAHFCDNF

SEQ ID NO: 693268 - protein, 18 aa, Mycobacterium
LLVHPYIRAAREAANNIV

SEQ ID NO: 693269 - protein, 18 aa, Mycobacterium
LLVIHGGPGLPHGYLRSL

SEQ ID NO: 693270 - protein, 23 aa, Mycobacterium
LLVKGGVVFNGYWKNEDETKAVI

SEQ ID NO: 693271 - protein, 17 aa, Mycobacterium
LLVLLASELAAAVYVEP

SEQ ID NO: 693272 - protein, 18 aa, Mycobacterium
LLVLLRKRLVEFETSGGD

SEQ ID NO: 693273 - protein, 17 aa, Mycobacterium
LLVPEAHLDAALRFVNE

SEQ ID NO: 693274 - protein, 17 aa, Mycobacterium
LLVPFARAANWPADLNI

SEQ ID NO: 693275 - protein, 26 aa, Mycobacterium
LLVPPGDAPWRLGMSAAGTFENLRLE

SEQ ID NO: 693276 - protein, 25 aa, Mycobacterium
LLVPPGDGPWRLGMSSSGTFENLRM

SEQ ID NO: 693277 - protein, 25 aa, Mycobacterium
LLVPPGDGPWRLGMSTAGTFENLRL

SEQ ID NO: 693278 - protein, 18 aa, Mycobacterium
LLVRALELAQQIAEVPGP

SEQ ID NO: 693279 - protein, 19 aa, Mycobacterium
LLVRARKAFRAQYPRDSQS

SEQ ID NO: 693280 - protein, 18 aa, Mycobacterium
LLVRCLQRHPALAAKLRK

SEQ ID NO: 693281 - protein, 17 aa, Mycobacterium
LLVRCLQRHPVLASRLR

SEQ ID NO: 693282 - protein, 25 aa, Mycobacterium
LLVRDGAPCLVEPHLQRLTTSARLM

SEQ ID NO: 693283 - protein, 19 aa, Mycobacterium
LLVRKAGARSADMAEVLAQ

SEQ ID NO: 693284 - protein, 20 aa, Mycobacterium
LLVRLAEAGVAWVQIDEPVL

SEQ ID NO: 693285 - protein, 19 aa, Mycobacterium
LLVRQGQRATLAFDNTTMM

SEQ ID NO: 693286 - protein, 26 aa, Mycobacterium
LLVSAGLPAPRFGTATTFEQAKQIAA

SEQ ID NO: 693287 - protein, 20 aa, Mycobacterium
LLVSGGVVFSGYWNNETATS

SEQ ID NO: 693288 - protein, 24 aa, Mycobacterium
LLVSGRASFELAQKATMAGIPILA

SEQ ID NO: 693289 - protein, 24 aa, Mycobacterium
LLVSGRASFELTQKAVLAGIPVLA

SEQ ID NO: 693290 - protein, 23 aa, Mycobacterium
LLVSHAMALIAIELEKPARVADA

SEQ ID NO: 693291 - protein, 21 aa, Mycobacterium
LLVSSAGPAWARLADPELSWL

SEQ ID NO: 693292 - protein, 20 aa, Mycobacterium
LLVTRTGLPMGITPRELDAL

SEQ ID NO: 693293 - protein, 19 aa, Mycobacterium
LLVVGGGYTGLWSALHAAR

SEQ ID NO: 693294 - protein, 18 aa, Mycobacterium
LLVVHGGPGLPHYYLSAL

SEQ ID NO: 693295 - protein, 18 aa, Mycobacterium
LLVVHGGPGLPHYYLTSL

SEQ ID NO: 693296 - protein, 17 aa, Mycobacterium
LLVVRRAPGVWHLVSTV

SEQ ID NO: 693297 - protein, 22 aa, Mycobacterium
LLWDEIHSALELYNEHRSTITR

SEQ ID NO: 693298 - protein, 18 aa, Mycobacterium
LLWDTAINGYTPRQVAAL

SEQ ID NO: 693299 - protein, 19 aa, Mycobacterium
LLWGDARVGNVLYKDFAPV

SEQ ID NO: 693300 - protein, 20 aa, Mycobacterium
LLWGDARVGNVLYRDFRPVA

SEQ ID NO: 693301 - protein, 19 aa, Mycobacterium
LLWHARFPAPEEFSARVDS

SEQ ID NO: 693302 - protein, 27 aa, Mycobacterium
LLWHLTEVHLFWAAVLFRNVTAEDGVA

SEQ ID NO: 693303 - protein, 17 aa, Mycobacterium
LLWRPDLQQPKRSQNGQ

SEQ ID NO: 693304 - protein, 18 aa, Mycobacterium
LLWSRPIKDYPDLKIGLS

SEQ ID NO: 693305 - protein, 18 aa, Mycobacterium
LLYCGEWIHSHVLHICLL

SEQ ID NO: 693306 - protein, 18 aa, Mycobacterium
LLYCGEWIHSHVLHVYLL

SEQ ID NO: 693307 - protein, 18 aa, Mycobacterium
LLYCGEWINSHALHIYLL

SEQ ID NO: 693308 - protein, 19 aa, Mycobacterium
LLYEAGLPRDLFAVVPGPG

SEQ ID NO: 693309 - protein, 25 aa, Mycobacterium
LLYEAIPAPARRTGGHPAKRTFQAL

SEQ ID NO: 693310 - protein, 22 aa, Mycobacterium
LLYEIAEPAYLGPDVVTHFDTI

SEQ ID NO: 693311 - protein, 20 aa, Mycobacterium
LLYESIRLFSERGYRETGME

SEQ ID NO: 693312 - protein, 18 aa, Mycobacterium
LLYFPVMGANEIWRIDPD

SEQ ID NO: 693313 - protein, 29 aa, Mycobacterium
LLYKLLRSDWLEPRWMVGIDPQSEGLARA

SEQ ID NO: 693314 - protein, 17 aa, Mycobacterium
LLYQRIGQFAAVRRGLW

SEQ ID NO: 693315 - protein, 17 aa, Mycobacterium
LLYRHWHSAGRQESSTE

SEQ ID NO: 693316 - protein, 18 aa, Mycobacterium
LLYTLGWHEVAVPPVAGE

SEQ ID NO: 693317 - protein, 24 aa, Mycobacterium
LLYTVVLHRFLRWRQPGYDPARHL

SEQ ID NO: 693318 - protein, 18 aa, Mycobacterium
LLYWAQVLLIARGLTLDD

SEQ ID NO: 693319 - protein, 18 aa, Mycobacterium
LLYWTQVLMLARGLSLDD

SEQ ID NO: 693320 - protein, 31 aa, Mycobacterium
LLYYSCPQHFTAYCGFDVLAHGSEPFVSRLD

SEQ ID NO: 693321 - protein, 29 aa, Mycobacterium
LMAAGVRLLGLRPRPAVTVRAVCRSAGMT

SEQ ID NO: 693322 - protein, 24 aa, Mycobacterium
LMAALRLNVPTVFVSGGPMEGGRA

SEQ ID NO: 693323 - protein, 21 aa, Mycobacterium
LMAAMGRARTRVMITAVDSDT

SEQ ID NO: 693324 - protein, 17 aa, Mycobacterium
LMAARKGRMVEMANHTT

SEQ ID NO: 693325 - protein, 22 aa, Mycobacterium
LMAARSALLLGAERAIVIDRIP

SEQ ID NO: 693326 - protein, 20 aa, Mycobacterium
LMAARSALLLGAERAIVVDR

SEQ ID NO: 693327 - protein, 28 aa, Mycobacterium
LMAEGRSNAGIARRLWVTEGTVEKHVRS

SEQ ID NO: 693328 - protein, 18 aa, Mycobacterium
LMAELLPAHMIPRHVALV

SEQ ID NO: 693329 - protein, 30 aa, Mycobacterium
LMAGAGPAPMLAAAAGWEALAAALDAQAVE

SEQ ID NO: 693330 - protein, 17 aa, Mycobacterium
LMAGYGRTAPKEVEDAV

SEQ ID NO: 693331 - protein, 17 aa, Mycobacterium
LMAHVKLGLKEEMLNTE

SEQ ID NO: 693332 - protein, 29 aa, Mycobacterium
LMAITPKSSWPWVRTLLHSVFDQPDAGSV

SEQ ID NO: 693333 - protein, 25 aa, Mycobacterium
LMAKRLTAAGIRCDLHLWDGQIHDF

SEQ ID NO: 693334 - protein, 17 aa, Mycobacterium
LMALLDFFGYFSGLTAS

SEQ ID NO: 693335 - protein, 17 aa, Mycobacterium
LMALRVRDTLCALAVGA

SEQ ID NO: 693336 - protein, 17 aa, Mycobacterium
LMAPFTVEASRHLEQAW

SEQ ID NO: 693337 - protein, 17 aa, Mycobacterium
LMAQRVIDKITRFAPNF

SEQ ID NO: 693338 - protein, 18 aa, Mycobacterium
LMARLPFELTAGQREVLE

SEQ ID NO: 693339 - protein, 22 aa, Mycobacterium
LMARLRSPLLAVVKNGKLHGVI

SEQ ID NO: 693340 - protein, 22 aa, Mycobacterium
LMARRGYDGFGIDALAAAVHCS

SEQ ID NO: 693341 - protein, 25 aa, Mycobacterium
LMASRRTVVCWAMGLTQHAHAVATI

SEQ ID NO: 693342 - protein, 26 aa, Mycobacterium
LMAVEDWPLLRWRMREYTHGRWGREI

SEQ ID NO: 693343 - protein, 24 aa, Mycobacterium
LMAVGDLLSGWLLARQAAVAIEKL

SEQ ID NO: 693344 - protein, 21 aa, Mycobacterium
LMAVPDRFSLMHGDYRLDNLL

SEQ ID NO: 693345 - protein, 26 aa, Mycobacterium
LMAVTPKASWPWVKTLLHSVFDQPDA

SEQ ID NO: 693346 - protein, 24 aa, Mycobacterium
LMCAKSLVREELWSAKLRDQDLKE

SEQ ID NO: 693347 - protein, 19 aa, Mycobacterium
LMCDVRFAAAGAKFTTAFS

SEQ ID NO: 693348 - protein, 17 aa, Mycobacterium
LMCGADLVLPDRYLQAA

SEQ ID NO: 693349 - protein, 27 aa, Mycobacterium
LMCVAMRAKFTGPVLDYVKKGRSESGL

SEQ ID NO: 693350 - protein, 17 aa, Mycobacterium
LMCVYRNPMFGHIHTDA

SEQ ID NO: 693351 - protein, 17 aa, Mycobacterium
LMDAFRSADEVLLNGVQ

SEQ ID NO: 693352 - protein, 17 aa, Mycobacterium
LMDCDMRGTYTFHRRVL

SEQ ID NO: 693353 - protein, 23 aa, Mycobacterium
LMDCGERWGVFTAGMGVDGDVVA

SEQ ID NO: 693354 - protein, 20 aa, Mycobacterium
LMDCPAHAITEIGERQPDVV

SEQ ID NO: 693355 - protein, 19 aa, Mycobacterium
LMDGRLVARVDLKADRAGD

SEQ ID NO: 693356 - protein, 19 aa, Mycobacterium
LMDGRLVARVDLKADRPAD

SEQ ID NO: 693357 - protein, 19 aa, Mycobacterium
LMDGWAIAIFFSELLAVYQ

SEQ ID NO: 693358 - protein, 17 aa, Mycobacterium
LMDKLRTSGPWESEQTH

SEQ ID NO: 693359 - protein, 18 aa, Mycobacterium
LMDLLGSPQLSYPSIHIG

SEQ ID NO: 693360 - protein, 20 aa, Mycobacterium
LMDNPHVNRIVVIDPDTGIE

SEQ ID NO: 693361 - protein, 34 aa, Mycobacterium
LMDPMAFVRRPYRWIKQLGIEAAYGRTLAAAPNF

SEQ ID NO: 693362 - protein, 18 aa, Mycobacterium
LMDRALATAGEWGARRVW

SEQ ID NO: 693363 - protein, 19 aa, Mycobacterium
LMDRCLSVMLQAWADEPFE

SEQ ID NO: 693364 - protein, 20 aa, Mycobacterium
LMDRLGCSLTPQYDEGVNLL

SEQ ID NO: 693365 - protein, 26 aa, Mycobacterium
LMDTHPFEWLPMLSRVLGSAQLVPGA

SEQ ID NO: 693366 - protein, 18 aa, Mycobacterium
LMEAVALSDRFVDIRPVT

SEQ ID NO: 693367 - protein, 19 aa, Mycobacterium
LMEPWDGPAAVCFTDGTVI

SEQ ID NO: 693368 - protein, 17 aa, Mycobacterium
LMEQLRVAVPAVQLMSV

SEQ ID NO: 693369 - protein, 34 aa, Mycobacterium
LMESEPRFDPAVWARLGAELGVLGLAVPEADGGA

SEQ ID NO: 693370 - protein, 23 aa, Mycobacterium
LMESWHPLGVVGVISAFNFPVAV

SEQ ID NO: 693371 - protein, 18 aa, Mycobacterium
LMEWCAMVGCPIVGIQDS

SEQ ID NO: 693372 - protein, 21 aa, Mycobacterium
LMFGHGLAVAAMRAQDGDSQL

SEQ ID NO: 693373 - protein, 17 aa, Mycobacterium
LMFQEMVNRIGADVPGM

SEQ ID NO: 693374 - protein, 21 aa, Mycobacterium
LMFRVYLTKREDFAAMNEVYG

SEQ ID NO: 693375 - protein, 26 aa, Mycobacterium
LMFVYRVSAEQAFRVLQWRSQETNVK

SEQ ID NO: 693376 - protein, 25 aa, Mycobacterium
LMGAKKWVRMPGVHFGPETCTYRGE

SEQ ID NO: 693377 - protein, 17 aa, Mycobacterium
LMGCGDAVVGINPATDS

SEQ ID NO: 693378 - protein, 27 aa, Mycobacterium
LMGIPGPSGLHFAGRVGTGFTERDLAN

SEQ ID NO: 693379 - protein, 28 aa, Mycobacterium
LMGIPGPSGLHFAGRVGTGFTQRNLDSL

SEQ ID NO: 693380 - protein, 22 aa, Mycobacterium
LMGLCSEVRRVRAAELLDYTNY

SEQ ID NO: 693381 - protein, 21 aa, Mycobacterium
LMGLCSEVRRVRASELLDYTN

SEQ ID NO: 693382 - protein, 20 aa, Mycobacterium
LMGNCGVGFAPCRQQDHDVL

SEQ ID NO: 693383 - protein, 18 aa, Mycobacterium
LMGPYLMHPIHWAVVDRW

SEQ ID NO: 693384 - protein, 18 aa, Mycobacterium
LMGSIAERHGRLDVLVNN

SEQ ID NO: 693385 - protein, 17 aa, Mycobacterium
LMGYVLAEIGFRVRRLA

SEQ ID NO: 693386 - protein, 24 aa, Mycobacterium
LMHAAAPVLRRMAEDLSDQSVSVV

SEQ ID NO: 693387 - protein, 21 aa, Mycobacterium
LMHAAGLWTAFSGLLSGQTVV

SEQ ID NO: 693388 - protein, 21 aa, Mycobacterium
LMHAAGMWTAFAALLHGLTVV

SEQ ID NO: 693389 - protein, 20 aa, Mycobacterium
LMHAAGMWTAFSAIMAGTPV

SEQ ID NO: 693390 - protein, 19 aa, Mycobacterium
LMHAAGMWTAFSALCAGLP

SEQ ID NO: 693391 - protein, 27 aa, Mycobacterium
LMHGVEPNMRWRTFCAELLAIADKLNV

SEQ ID NO: 693392 - protein, 28 aa, Mycobacterium
LMHGVEPNMRWRTFCAELLAIVDKLNVD

SEQ ID NO: 693393 - protein, 27 aa, Mycobacterium
LMHGVEPNMRWRTFCAELVAIADKLNV

SEQ ID NO: 693394 - protein, 20 aa, Mycobacterium
LMHQRRLFPLIARSYALQFA

SEQ ID NO: 693395 - protein, 17 aa, Mycobacterium
LMHRITLMGDVPVNVHG

SEQ ID NO: 693396 - protein, 19 aa, Mycobacterium
LMHRSRLQVLMTVLARENP

SEQ ID NO: 693397 - protein, 17 aa, Mycobacterium
LMHVKFGQYHVRDVKFV

SEQ ID NO: 693398 - protein, 19 aa, Mycobacterium
LMILPPLIHGAAQWSVMTA

SEQ ID NO: 693399 - protein, 25 aa, Mycobacterium
LMILRRPRAGLSYEALLATVEQRLA

SEQ ID NO: 693400 - protein, 30 aa, Mycobacterium
LMIREYRPDAAPGILIPFFASHTAKVQNQV

SEQ ID NO: 693401 - protein, 21 aa, Mycobacterium
LMIVFPGAVGLFAEIDSPIKL

SEQ ID NO: 693402 - protein, 17 aa, Mycobacterium
LMKALWSPGWTEFSGEF

SEQ ID NO: 693403 - protein, 28 aa, Mycobacterium
LMKASRQYGTIDWCVGVFKTPSRNLTVV

SEQ ID NO: 693404 - protein, 28 aa, Mycobacterium
LMKASRQYGTIDWCVGVFKTPSRTLTVV

SEQ ID NO: 693405 - protein, 18 aa, Mycobacterium
LMKGLAARKSDISNGVAH

SEQ ID NO: 693406 - protein, 18 aa, Mycobacterium
LMKIALAACSGMSSDQPL

SEQ ID NO: 693407 - protein, 21 aa, Mycobacterium
LMKVLSGVYPHGSYDGEIFFD

SEQ ID NO: 693408 - protein, 17 aa, Mycobacterium
LMLAERFGLGPADTCYL

SEQ ID NO: 693409 - protein, 18 aa, Mycobacterium
LMLAWCCDLIVAADDTVF

SEQ ID NO: 693410 - protein, 19 aa, Mycobacterium
LMLEVSWEALERTGIDPTT

SEQ ID NO: 693411 - protein, 18 aa, Mycobacterium
LMLLHGLCMALDEVVLAE

SEQ ID NO: 693412 - protein, 18 aa, Mycobacterium
LMLNRPEYVESWLAINEL

SEQ ID NO: 693413 - protein, 17 aa, Mycobacterium
LMLPFLEQFVVKARYAD

SEQ ID NO: 693414 - protein, 22 aa, Mycobacterium
LMLPQRRGLVAFTSSSGSVHYA

SEQ ID NO: 693415 - protein, 23 aa, Mycobacterium
LMLQEFGEVVAPGGAGVVIASMA

SEQ ID NO: 693416 - protein, 24 aa, Mycobacterium
LMLTRPRERKALISSAENLSFLVL

SEQ ID NO: 693417 - protein, 20 aa, Mycobacterium
LMLTRRHLYAVTGYRPRNRQ

SEQ ID NO: 693418 - protein, 24 aa, Mycobacterium
LMLTYRLGSLEALLGPSHSEVLAA

SEQ ID NO: 693419 - protein, 17 aa, Mycobacterium
LMMGICQSVLTGFPAVL

SEQ ID NO: 693420 - protein, 18 aa, Mycobacterium
LMMHCVHRNPGVPAYFDS

SEQ ID NO: 693421 - protein, 19 aa, Mycobacterium
LMMRHMMFVGYSLQDEDFH

SEQ ID NO: 693422 - protein, 20 aa, Mycobacterium
LMNADGWGAGFFDDEGVARR

SEQ ID NO: 693423 - protein, 22 aa, Mycobacterium
LMNADGWGAGFFDSRDDDPAPR

SEQ ID NO: 693424 - protein, 17 aa, Mycobacterium
LMNVPFAKRGKRMDECI

SEQ ID NO: 693425 - protein, 21 aa, Mycobacterium
LMPAEGRWLLVDTAGDGVQLE

SEQ ID NO: 693426 - protein, 20 aa, Mycobacterium
LMPDRLALAAIYPRNRECLL

SEQ ID NO: 693427 - protein, 23 aa, Mycobacterium
LMPDTRVGHTFGHEFIGTVHEVG

SEQ ID NO: 693428 - protein, 18 aa, Mycobacterium
LMPEKLYAAVSFDAVNRV

SEQ ID NO: 693429 - protein, 25 aa, Mycobacterium
LMPEPFRIAREMVRVLGPGGRIAIL

SEQ ID NO: 693430 - protein, 17 aa, Mycobacterium
LMPFRLAVLHAAWLIDT

SEQ ID NO: 693431 - protein, 20 aa, Mycobacterium
LMPGQVLRLGVAAGTGTATA

SEQ ID NO: 693432 - protein, 25 aa, Mycobacterium
LMPIGPRRRLWSLLGDSLRPRRLDD

SEQ ID NO: 693433 - protein, 25 aa, Mycobacterium
LMPLATDEMIRWVTPVKEFMRTASS

SEQ ID NO: 693434 - protein, 30 aa, Mycobacterium
LMPLATEEIIRWSAPVKEFMRTATRDTEVR

SEQ ID NO: 693435 - protein, 25 aa, Mycobacterium
LMPLATEEMIRWVTPVKEFMRTAAE

SEQ ID NO: 693436 - protein, 20 aa, Mycobacterium
LMPLGLRLIEEGFALYDPMP

SEQ ID NO: 693437 - protein, 19 aa, Mycobacterium
LMPLGLRLIEEGFSLYDPM

SEQ ID NO: 693438 - protein, 25 aa, Mycobacterium
LMPLGRSKVSAGIDLAFDRFPSLGK

SEQ ID NO: 693439 - protein, 18 aa, Mycobacterium
LMPPPISAGSGWRKRKQP

SEQ ID NO: 693440 - protein, 18 aa, Mycobacterium
LMPPPISAGSGWRKRKQQ

SEQ ID NO: 693441 - protein, 18 aa, Mycobacterium
LMPTSSVNLGDWAASRLV

SEQ ID NO: 693442 - protein, 18 aa, Mycobacterium
LMPTSSVNLGNWAASRLV

SEQ ID NO: 693443 - protein, 19 aa, Mycobacterium
LMPVNAFGGTHGWGYDGVL

SEQ ID NO: 693444 - protein, 23 aa, Mycobacterium
LMQMAWALVLSRLTDRDDVVFGV

SEQ ID NO: 693445 - protein, 23 aa, Mycobacterium
LMQMAWALVLSRLTDTDDVVFGV

SEQ ID NO: 693446 - protein, 20 aa, Mycobacterium
LMQMAWALVLSRLTDTHDVT

SEQ ID NO: 693447 - protein, 17 aa, Mycobacterium
LMQPWRFIRITDDTLRS

SEQ ID NO: 693448 - protein, 21 aa, Mycobacterium
LMQQRGAQLWQWLQDGAQVYV

SEQ ID NO: 693449 - protein, 18 aa, Mycobacterium
LMQRFYTTSWRFAPFLWQ

SEQ ID NO: 693450 - protein, 18 aa, Mycobacterium
LMQSCTPGAMMAISASEP

SEQ ID NO: 693451 - protein, 25 aa, Mycobacterium
LMQVWANELAQYWIRVNTIHPTGVA

SEQ ID NO: 693452 - protein, 19 aa, Mycobacterium
LMRAAGIQGARRGKRVRTT

SEQ ID NO: 693453 - protein, 18 aa, Mycobacterium
LMRAAGIQGVRRGKRVRT

SEQ ID NO: 693454 - protein, 29 aa, Mycobacterium
LMRALGVPVHNIWGLRPALQPGTRDPLPL

SEQ ID NO: 693455 - protein, 27 aa, Mycobacterium
LMRALGVPVHNMWGLRPATVAGTSEIA

SEQ ID NO: 693456 - protein, 17 aa, Mycobacterium
LMRALVGEGVFRRTRDG

SEQ ID NO: 693457 - protein, 17 aa, Mycobacterium
LMRDLRTAVPASTHTFW

SEQ ID NO: 693458 - protein, 18 aa, Mycobacterium
LMRDPSLLVTRPTRGDPA

SEQ ID NO: 693459 - protein, 17 aa, Mycobacterium
LMRDVGFDYYWTDEHCP

SEQ ID NO: 693460 - protein, 18 aa, Mycobacterium
LMREACGYDSNSRARTVD

SEQ ID NO: 693461 - protein, 18 aa, Mycobacterium
LMRELWRGDRVDFDGEYY

SEQ ID NO: 693462 - protein, 18 aa, Mycobacterium
LMRFFRFIVTEIYPGGRI

SEQ ID NO: 693463 - protein, 17 aa, Mycobacterium
LMRGGVLQLHRWGLLDA

SEQ ID NO: 693464 - protein, 18 aa, Mycobacterium
LMRHAKSAYPPGVDDHQR

SEQ ID NO: 693465 - protein, 22 aa, Mycobacterium
LMRHPNLRASFVSRDIPRPVQV

SEQ ID NO: 693466 - protein, 17 aa, Mycobacterium
LMRHPRKALSRDDILRQ

SEQ ID NO: 693467 - protein, 17 aa, Mycobacterium
LMRHRITMLCIPPSLLA

SEQ ID NO: 693468 - protein, 19 aa, Mycobacterium
LMRIGALLRRSDMSLLDQW

SEQ ID NO: 693469 - protein, 19 aa, Mycobacterium
LMRIGALLRRTDMSLLDQW

SEQ ID NO: 693470 - protein, 23 aa, Mycobacterium
LMRLADEYRAWLGANPEATLADV

SEQ ID NO: 693471 - protein, 18 aa, Mycobacterium
LMRLALPVIKADYHAFDT

SEQ ID NO: 693472 - protein, 18 aa, Mycobacterium
LMRLWVEAEVLRLAGERL

SEQ ID NO: 693473 - protein, 23 aa, Mycobacterium
LMRNLWAYVVIFCGHFPDGTQKF

SEQ ID NO: 693474 - protein, 24 aa, Mycobacterium
LMRNPRLKARMSVLQQPGAVSPEF

SEQ ID NO: 693475 - protein, 24 aa, Mycobacterium
LMRNRVDLIVGHGRFVDPHSIVVE

SEQ ID NO: 693476 - protein, 21 aa, Mycobacterium
LMRRALEYASGLGVLIAQHAE

SEQ ID NO: 693477 - protein, 19 aa, Mycobacterium
LMRRDEQFRSALASRDLIG

SEQ ID NO: 693478 - protein, 17 aa, Mycobacterium
LMRRGELVMVFPGGARE

SEQ ID NO: 693479 - protein, 18 aa, Mycobacterium
LMRSGAKDQLRFSAPPRL

SEQ ID NO: 693480 - protein, 18 aa, Mycobacterium
LMRSGAKDQLRFTAPPRL

SEQ ID NO: 693481 - protein, 26 aa, Mycobacterium
LMRTFAVELGEHFIRVNSVHPTNVNT

SEQ ID NO: 693482 - protein, 25 aa, Mycobacterium
LMRTFAVELGQHFIRVNSVHPTNVN

SEQ ID NO: 693483 - protein, 24 aa, Mycobacterium
LMRTRGVLDFGAQMALSARLAADH

SEQ ID NO: 693484 - protein, 18 aa, Mycobacterium
LMRVEHDGVYLAVGSIGG

SEQ ID NO: 693485 - protein, 24 aa, Mycobacterium
LMRVEKDGRYVIVASHGGAPEHPA

SEQ ID NO: 693486 - protein, 18 aa, Mycobacterium
LMRVWELCQVCTDADTWS

SEQ ID NO: 693487 - protein, 20 aa, Mycobacterium
LMRYYPVVFGTIRLAAEDVD

SEQ ID NO: 693488 - protein, 24 aa, Mycobacterium
LMSDWPEFPSQYGGVDADHPNRFP

SEQ ID NO: 693489 - protein, 23 aa, Mycobacterium
LMSGEAVASWAVCEPGRGWSPLD

SEQ ID NO: 693490 - protein, 18 aa, Mycobacterium
LMSGERTAGVALSADVTV

SEQ ID NO: 693491 - protein, 23 aa, Mycobacterium
LMSGFERRGRWNVPKKLTTFALF

SEQ ID NO: 693492 - protein, 25 aa, Mycobacterium
LMSGKWHLGATIDRSPWARGFERSF

SEQ ID NO: 693493 - protein, 24 aa, Mycobacterium
LMSGKWHLGATIDRSPYARGFERS

SEQ ID NO: 693494 - protein, 28 aa, Mycobacterium
LMSMFGLHRRLRGCAVGHFAATEVTSPP

SEQ ID NO: 693495 - protein, 26 aa, Mycobacterium
LMSPAAFVRRPLRWIQALSDGSRQGN

SEQ ID NO: 693496 - protein, 18 aa, Mycobacterium
LMSPEPWIERFERCWQLL

SEQ ID NO: 693497 - protein, 25 aa, Mycobacterium
LMSPVSFVRRPGRWIKELAAEGHLG

SEQ ID NO: 693498 - protein, 21 aa, Mycobacterium
LMSQSRACARTRGKSDPIDAL

SEQ ID NO: 693499 - protein, 17 aa, Mycobacterium
LMSWLSTARLDLFGHLI

SEQ ID NO: 693500 - protein, 20 aa, Mycobacterium
LMTDEIFGPILPVLTVQNLD

SEQ ID NO: 693501 - protein, 24 aa, Mycobacterium
LMTDGRWDFKFLGMQIMIEGLALG

SEQ ID NO: 693502 - protein, 24 aa, Mycobacterium
LMTDMRDPLTIAFHKARGRADLLR

SEQ ID NO: 693503 - protein, 19 aa, Mycobacterium
LMTFTRAVGAYSLDDGLRV

SEQ ID NO: 693504 - protein, 24 aa, Mycobacterium
LMTIPGMLSGTVPLVLTVPPDAEV

SEQ ID NO: 693505 - protein, 25 aa, Mycobacterium
LMTLKENGFRLLAMTPHESACPLAE

SEQ ID NO: 693506 - protein, 17 aa, Mycobacterium
LMTPGLHGSTFGGNPVC

SEQ ID NO: 693507 - protein, 23 aa, Mycobacterium
LMTPQCRGRLELRSTDPAAPVYI

SEQ ID NO: 693508 - protein, 21 aa, Mycobacterium
LMTRKEPYGAVGRIIPYNHPI

SEQ ID NO: 693509 - protein, 18 aa, Mycobacterium
LMTVYWDRYILPRRVQAT

SEQ ID NO: 693510 - protein, 20 aa, Mycobacterium
LMVFFDLWVSAGMTPRVDPL

SEQ ID NO: 693511 - protein, 18 aa, Mycobacterium
LMVSIGMALGTTEELILQ

SEQ ID NO: 693512 - protein, 28 aa, Mycobacterium
LMWGEYRPGELVRGRWGLLEPPAPWLPE

SEQ ID NO: 693513 - protein, 25 aa, Mycobacterium
LMYTDGACQLAFWRDDGYLVCEARD

SEQ ID NO: 693514 - protein, 21 aa, Mycobacterium
LMYTGGACRLAFWKDDGYLVC

SEQ ID NO: 693515 - protein, 17 aa, Mycobacterium
LNAADLFYRGERNVIVD

SEQ ID NO: 693516 - protein, 22 aa, Mycobacterium
LNAAEAFETFLATKYVGQKRFS

SEQ ID NO: 693517 - protein, 19 aa, Mycobacterium
LNAAGSVFLTRPSLAHFVR

SEQ ID NO: 693518 - protein, 19 aa, Mycobacterium
LNAAGSVFLTRPTLAHHTR

SEQ ID NO: 693519 - protein, 18 aa, Mycobacterium
LNAAPWPISYRHKYIPRA

SEQ ID NO: 693520 - protein, 25 aa, Mycobacterium
LNADEFLTVMLRWLNAFVPKPGQTI

SEQ ID NO: 693521 - protein, 17 aa, Mycobacterium
LNADNLIEWQRDFFDFG

SEQ ID NO: 693522 - protein, 18 aa, Mycobacterium
LNAGCVIGNLARELGAIP

SEQ ID NO: 693523 - protein, 26 aa, Mycobacterium
LNAGGLFGVLTNVVWTNRGPCAIDGF

SEQ ID NO: 693524 - protein, 26 aa, Mycobacterium
LNAGGLFGVLTNVVWTNRGPCAIEGF

SEQ ID NO: 693525 - protein, 24 aa, Mycobacterium
LNAGKGKRALAVELRKKGVDDEVI

SEQ ID NO: 693526 - protein, 18 aa, Mycobacterium
LNAGLGFGGGCLPKDIRA

SEQ ID NO: 693527 - protein, 17 aa, Mycobacterium
LNAGRPVAIASAAEPGE

SEQ ID NO: 693528 - protein, 18 aa, Mycobacterium
LNAGWNFTEPGVDGYPYR

SEQ ID NO: 693529 - protein, 25 aa, Mycobacterium
LNALERNKMRVVPGITSKAMSVAAG

SEQ ID NO: 693530 - protein, 23 aa, Mycobacterium
LNALKEKLFPLATLVTPNLDEVG

SEQ ID NO: 693531 - protein, 17 aa, Mycobacterium
LNALPPFLTGGSMIETV

SEQ ID NO: 693532 - protein, 24 aa, Mycobacterium
LNALRPQLLAARHTPEGYKTVQAT

SEQ ID NO: 693533 - protein, 19 aa, Mycobacterium
LNALVGIARPGHFGGDVSH

SEQ ID NO: 693534 - protein, 21 aa, Mycobacterium
LNAPDARFFVSVARREEKGSD

SEQ ID NO: 693535 - protein, 22 aa, Mycobacterium
LNAPEGFGAKVVEVLVNETGLA

SEQ ID NO: 693536 - protein, 26 aa, Mycobacterium
LNAPTLRPGKPAGCAASDYKGVTVKG

SEQ ID NO: 693537 - protein, 22 aa, Mycobacterium
LNAPWVGFIIKWMAKGNTWIYR

SEQ ID NO: 693538 - protein, 24 aa, Mycobacterium
LNAQAAAFQAEFEGLLSGGAAAYV

SEQ ID NO: 693539 - protein, 25 aa, Mycobacterium
LNAQGGSGCAARAAAALSAGALNGA

SEQ ID NO: 693540 - protein, 30 aa, Mycobacterium
LNARAKNGDTYRVLFGVATTQGVNPAPLAQ

SEQ ID NO: 693541 - protein, 17 aa, Mycobacterium
LNASGRSPAAWTPEYFC

SEQ ID NO: 693542 - protein, 17 aa, Mycobacterium
LNASGRSPAAWTPEYFG

SEQ ID NO: 693543 - protein, 17 aa, Mycobacterium
LNASGRSPAGWTPEYFG

SEQ ID NO: 693544 - protein, 22 aa, Mycobacterium
LNASQALAFVRQRHGLENGDLD

SEQ ID NO: 693545 - protein, 25 aa, Mycobacterium
LNAVAGKPPEEWGMDPVRYEDMIPG

SEQ ID NO: 693546 - protein, 27 aa, Mycobacterium
LNAVGWTRFIAGMARDVILERSAARQV

SEQ ID NO: 693547 - protein, 30 aa, Mycobacterium
LNAVLGRLAPRARVVLCGVISSYLTGDHPG

SEQ ID NO: 693548 - protein, 19 aa, Mycobacterium
LNAVVSWPAEEWGRDPAGF

SEQ ID NO: 693549 - protein, 24 aa, Mycobacterium
LNAYLKRSRFDRIIIADVGDIVEG

SEQ ID NO: 693550 - protein, 23 aa, Mycobacterium
LNCDFGVGIVRKGSAESQLSYTA

SEQ ID NO: 693551 - protein, 25 aa, Mycobacterium
LNCEEPVWLQWFLILAKKMRFMGLA

SEQ ID NO: 693552 - protein, 24 aa, Mycobacterium
LNDARLAYLFEVDYVDHFVWVMTD

SEQ ID NO: 693553 - protein, 18 aa, Mycobacterium
LNDASTWAQARAAAETLI

SEQ ID NO: 693554 - protein, 17 aa, Mycobacterium
LNDAVTRLWSFLAPAYD

SEQ ID NO: 693555 - protein, 23 aa, Mycobacterium
LNDCPAELWSKLDAQAIAKEHGA

SEQ ID NO: 693556 - protein, 20 aa, Mycobacterium
LNDFAAFCRYRAGATTIRDL

SEQ ID NO: 693557 - protein, 20 aa, Mycobacterium
LNDFGALLGEAWTQKKRMSP

SEQ ID NO: 693558 - protein, 19 aa, Mycobacterium
LNDFPLFWDTGLLEHNIHL

SEQ ID NO: 693559 - protein, 17 aa, Mycobacterium
LNDGRIGDNVFLLEDNT

SEQ ID NO: 693560 - protein, 22 aa, Mycobacterium
LNDGRYAVYIKFHHSLQDGVSA

SEQ ID NO: 693561 - protein, 18 aa, Mycobacterium
LNDHLRLGHEVMARVWDE

SEQ ID NO: 693562 - protein, 17 aa, Mycobacterium
LNDIALYLNFDMLGSPN

SEQ ID NO: 693563 - protein, 24 aa, Mycobacterium
LNDLLGVGFARRRVSPKTRYVLVH

SEQ ID NO: 693564 - protein, 23 aa, Mycobacterium
LNDLWRSADHLGFEGIWDYDHFF

SEQ ID NO: 693565 - protein, 18 aa, Mycobacterium
LNDNRWAILLKIHPCMAD

SEQ ID NO: 693566 - protein, 19 aa, Mycobacterium
LNDPEYQSAIGIFTTPEEL

SEQ ID NO: 693567 - protein, 18 aa, Mycobacterium
LNDRELRSPLILVPVSLS

SEQ ID NO: 693568 - protein, 39 aa, Mycobacterium
LNDTQGRWQLHWRLGWSFACLTHRCLLAHTCPHCQRPPR

SEQ ID NO: 693569 - protein, 17 aa, Mycobacterium
LNEADYARMWVQAATTM

SEQ ID NO: 693570 - protein, 24 aa, Mycobacterium
LNEAFASVVLKFQKDLGIPDEKLN

SEQ ID NO: 693571 - protein, 22 aa, Mycobacterium
LNEAIFLPLLRVFFKSWFRVEV

SEQ ID NO: 693572 - protein, 17 aa, Mycobacterium
LNEASAFDQIDNAPEEK

SEQ ID NO: 693573 - protein, 17 aa, Mycobacterium
LNEAVTRMWTFLAPAYD

SEQ ID NO: 693574 - protein, 19 aa, Mycobacterium
LNEFRWDGTRLRRRRLDAG

SEQ ID NO: 693575 - protein, 19 aa, Mycobacterium
LNEHGWRATAQNSIDEMHR

SEQ ID NO: 693576 - protein, 19 aa, Mycobacterium
LNEIATGYIGEWPEFKERF

SEQ ID NO: 693577 - protein, 19 aa, Mycobacterium
LNEIHRATGHDQLFDTVFV

SEQ ID NO: 693578 - protein, 25 aa, Mycobacterium
LNEKMKEAGVWVFANGLTEPSDATV

SEQ ID NO: 693579 - protein, 22 aa, Mycobacterium
LNELRRDYELMFRRVVAEGIAD

SEQ ID NO: 693580 - protein, 26 aa, Mycobacterium
LNELRTWFGFGVAGNFAGHLEQAGES

SEQ ID NO: 693581 - protein, 22 aa, Mycobacterium
LNELWDIQACEIVADLYRALHV

SEQ ID NO: 693582 - protein, 17 aa, Mycobacterium
LNERPLEGFKMIDPTCG

SEQ ID NO: 693583 - protein, 24 aa, Mycobacterium
LNETALRPAHWLQKRKRAQSSKDA

SEQ ID NO: 693584 - protein, 20 aa, Mycobacterium
LNEVGISHVVFKPGTVEQIR

SEQ ID NO: 693585 - protein, 27 aa, Mycobacterium
LNEVGWRQAGLAARYIAHRGGIAAVVS

SEQ ID NO: 693586 - protein, 19 aa, Mycobacterium
LNEVGWRQAGLAARYLAQR

SEQ ID NO: 693587 - protein, 18 aa, Mycobacterium
LNEYWSAVREPDWSQFVV

SEQ ID NO: 693588 - protein, 19 aa, Mycobacterium
LNFAVGPFASLLDRARDAI

SEQ ID NO: 693589 - protein, 17 aa, Mycobacterium
LNFDMLGSINAGYFTDD

SEQ ID NO: 693590 - protein, 17 aa, Mycobacterium
LNFFKDPVKGFFRALDY

SEQ ID NO: 693591 - protein, 22 aa, Mycobacterium
LNFKPPRPLEATSIPAGGVDDA

SEQ ID NO: 693592 - protein, 24 aa, Mycobacterium
LNFLNPRPGTPFGDLEVLPASEAL

SEQ ID NO: 693593 - protein, 25 aa, Mycobacterium
LNFLNPRPGTPFGDLEVLPATEALK

SEQ ID NO: 693594 - protein, 24 aa, Mycobacterium
LNFRDVLNVLGLYPGDPGLIGGDF

SEQ ID NO: 693595 - protein, 18 aa, Mycobacterium
LNFSPVIVHETWRADWAE

SEQ ID NO: 693596 - protein, 18 aa, Mycobacterium
LNGDGLQGFGGWNSGSGN

SEQ ID NO: 693597 - protein, 18 aa, Mycobacterium
LNGDGLRGFEALNSGTDN

SEQ ID NO: 693598 - protein, 23 aa, Mycobacterium
LNGESPLHWCKAINQIGWTSPEP

SEQ ID NO: 693599 - protein, 29 aa, Mycobacterium
LNGGKRLRPAFAYWGWRAVATGEPDSEVL

SEQ ID NO: 693600 - protein, 29 aa, Mycobacterium
LNGGQTCMAWTRMLVPLSRYSEALDLVAA

SEQ ID NO: 693601 - protein, 21 aa, Mycobacterium
LNGHQGCVIWFTGLSGSGKST

SEQ ID NO: 693602 - protein, 17 aa, Mycobacterium
LNGIFAVNVNGTFYAVQ

SEQ ID NO: 693603 - protein, 23 aa, Mycobacterium
LNGNCRRPGCIQARRRSHPEQME

SEQ ID NO: 693604 - protein, 17 aa, Mycobacterium
LNGPVPHAEDVVARSVR

SEQ ID NO: 693605 - protein, 17 aa, Mycobacterium
LNGQCLRLDAGQRFAPK

SEQ ID NO: 693606 - protein, 18 aa, Mycobacterium
LNGQFREKDGRQLVIRDL

SEQ ID NO: 693607 - protein, 18 aa, Mycobacterium
LNGQKIWSSRAPFAEMGF

SEQ ID NO: 693608 - protein, 18 aa, Mycobacterium
LNGQKIWSSRAPFAERGF

SEQ ID NO: 693609 - protein, 21 aa, Mycobacterium
LNGQLFRFVLFQTQAEEFYLF

SEQ ID NO: 693610 - protein, 25 aa, Mycobacterium
LNGRADVAPATRSRVKALLAQHHYV

SEQ ID NO: 693611 - protein, 17 aa, Mycobacterium
LNGSPAYPRSEEEIRAE

SEQ ID NO: 693612 - protein, 21 aa, Mycobacterium
LNGTQALSFVRQRHDLPRGDL

SEQ ID NO: 693613 - protein, 17 aa, Mycobacterium
LNGTYNLTRLVAAAVAA

SEQ ID NO: 693614 - protein, 24 aa, Mycobacterium
LNGWFDPRPDLVLSGINHGANVGR

SEQ ID NO: 693615 - protein, 27 aa, Mycobacterium
LNHGWREYGARVGIWRTIESLDRHGVR

SEQ ID NO: 693616 - protein, 28 aa, Mycobacterium
LNHLMPVKLKWGISLGALIMHLRESKLI

SEQ ID NO: 693617 - protein, 23 aa, Mycobacterium
LNHLRKYTTIWYVARLRGDLDIA

SEQ ID NO: 693618 - protein, 23 aa, Mycobacterium
LNHRPEVRGGVLAQECAAPLEAF

SEQ ID NO: 693619 - protein, 27 aa, Mycobacterium
LNHVADRPKLAWFLLQAVRYTPHQLFA

SEQ ID NO: 693620 - protein, 24 aa, Mycobacterium
LNIARPQHSWALRYRLAGNRSLSV

SEQ ID NO: 693621 - protein, 19 aa, Mycobacterium
LNICVSYRLIGAVDAARLH

SEQ ID NO: 693622 - protein, 17 aa, Mycobacterium
LNIEGREQLALTKTIEI

SEQ ID NO: 693623 - protein, 17 aa, Mycobacterium
LNIGERAPECFLNGPDA

SEQ ID NO: 693624 - protein, 22 aa, Mycobacterium
LNIGNPAPFGFEAPDVIMRDII

SEQ ID NO: 693625 - protein, 22 aa, Mycobacterium
LNIGNPAPFGFEAPDVIMRDMI

SEQ ID NO: 693626 - protein, 19 aa, Mycobacterium
LNIKGPELLNKFVGETERH

SEQ ID NO: 693627 - protein, 26 aa, Mycobacterium
LNILSDINAFMGIRLVHNAYPVTAAD

SEQ ID NO: 693628 - protein, 25 aa, Mycobacterium
LNILSDINAIMGYFYVHGNYPDLMS

SEQ ID NO: 693629 - protein, 17 aa, Mycobacterium
LNIPAPPAVSIPDMPDT

SEQ ID NO: 693630 - protein, 19 aa, Mycobacterium
LNIPLRGTIGTLIDGEPII

SEQ ID NO: 693631 - protein, 22 aa, Mycobacterium
LNIPTGIPLRYDLDADLRPVVP

SEQ ID NO: 693632 - protein, 24 aa, Mycobacterium
LNKLGVSASSLWIRHEKHVPPKPF

SEQ ID NO: 693633 - protein, 22 aa, Mycobacterium
LNKLKTATVHWVDVYTGPITWQ

SEQ ID NO: 693634 - protein, 17 aa, Mycobacterium
LNKPTRLLPLFSGPATR

SEQ ID NO: 693635 - protein, 24 aa, Mycobacterium
LNKTARWPFLFRLTTIKKPETRAR

SEQ ID NO: 693636 - protein, 17 aa, Mycobacterium
LNKVIAALIAFRDDPIE

SEQ ID NO: 693637 - protein, 26 aa, Mycobacterium
LNKVRFPAPVPVGSRVRAQTALVSVD

SEQ ID NO: 693638 - protein, 17 aa, Mycobacterium
LNLADLGSMRFYRETAL

SEQ ID NO: 693639 - protein, 23 aa, Mycobacterium
LNLANLPGYRTGGTIHIVVNNQI

SEQ ID NO: 693640 - protein, 23 aa, Mycobacterium
LNLARDIGCVFSIDTDAHAPGQL

SEQ ID NO: 693641 - protein, 19 aa, Mycobacterium
LNLARQFFPLLSIPTNIFN

SEQ ID NO: 693642 - protein, 24 aa, Mycobacterium
LNLAWSGTPLVVWNRTLERCLPVE

SEQ ID NO: 693643 - protein, 17 aa, Mycobacterium
LNLCRIFTDGDQTLYAD

SEQ ID NO: 693644 - protein, 21 aa, Mycobacterium
LNLEVRYRARLHVPVHGAVHT

SEQ ID NO: 693645 - protein, 18 aa, Mycobacterium
LNLGEYFDRIGYGGAAAP

SEQ ID NO: 693646 - protein, 25 aa, Mycobacterium
LNLGKLLTKRARIIGTTLRARPVTG

SEQ ID NO: 693647 - protein, 26 aa, Mycobacterium
LNLLADLNAFAGIQFVHGDYPDLDPN

SEQ ID NO: 693648 - protein, 24 aa, Mycobacterium
LNLLADLNAVIGIVDGTHYYVGLP

SEQ ID NO: 693649 - protein, 18 aa, Mycobacterium
LNLLFGEVAAQLAAAGIA

SEQ ID NO: 693650 - protein, 17 aa, Mycobacterium
LNLLRPVSSGVCVAVAD

SEQ ID NO: 693651 - protein, 19 aa, Mycobacterium
LNLLTTKPFLYVFNADEAV

SEQ ID NO: 693652 - protein, 19 aa, Mycobacterium
LNLLTTKPFLYVFNADESV

SEQ ID NO: 693653 - protein, 17 aa, Mycobacterium
LNLLVAPMARNGAEALG

SEQ ID NO: 693654 - protein, 17 aa, Mycobacterium
LNLLVAPMVRTGAEPIG

SEQ ID NO: 693655 - protein, 20 aa, Mycobacterium
LNLNPYWLGAHPSYTLSKYG

SEQ ID NO: 693656 - protein, 18 aa, Mycobacterium
LNLPDWPPAMPSLVLHPQ

SEQ ID NO: 693657 - protein, 22 aa, Mycobacterium
LNLSIRDGWWDEWFDGENGWEI

SEQ ID NO: 693658 - protein, 17 aa, Mycobacterium
LNLSSAWYLSRAAAKPM

SEQ ID NO: 693659 - protein, 18 aa, Mycobacterium
LNLSSAWYLSRAAAKPMI

SEQ ID NO: 693660 - protein, 18 aa, Mycobacterium
LNLTDAHNGLRVFNRTVA

SEQ ID NO: 693661 - protein, 18 aa, Mycobacterium
LNLVEVFFSIITRQEIRR

SEQ ID NO: 693662 - protein, 25 aa, Mycobacterium
LNLVPRVCDMFFLRYRKELDQRAGD

SEQ ID NO: 693663 - protein, 25 aa, Mycobacterium
LNLVPRWYIGSILRHVDFVASDVPG

SEQ ID NO: 693664 - protein, 17 aa, Mycobacterium
LNLWEFAKPTIAQVHGY

SEQ ID NO: 693665 - protein, 24 aa, Mycobacterium
LNLYRANMPAGFVTDGSSLPQTSV

SEQ ID NO: 693666 - protein, 25 aa, Mycobacterium
LNLYRANMPAPFFVPVKQLPQTRVP

SEQ ID NO: 693667 - protein, 31 aa, Mycobacterium
LNMFPLRKSYVRRLMREAGFTTVRTYGDFQE

SEQ ID NO: 693668 - protein, 25 aa, Mycobacterium
LNMPAEGLLGRPLIGDGADGAPGTG

SEQ ID NO: 693669 - protein, 27 aa, Mycobacterium
LNMPAKPARRWSRLRCLASAPTFPADR

SEQ ID NO: 693670 - protein, 27 aa, Mycobacterium
LNNRGRLSIDVLQRWGTDLLTALVALE

SEQ ID NO: 693671 - protein, 23 aa, Mycobacterium
LNNRLAPGLTRYFATKAGMTDLI

SEQ ID NO: 693672 - protein, 19 aa, Mycobacterium
LNNRPRPTLDLDTPAQRMA

SEQ ID NO: 693673 - protein, 17 aa, Mycobacterium
LNNRRQFVAPMRKAIAT

SEQ ID NO: 693674 - protein, 21 aa, Mycobacterium
LNPADLYDVLAINAASASTQL

SEQ ID NO: 693675 - protein, 19 aa, Mycobacterium
LNPATGAMFTALWVPNTGQ

SEQ ID NO: 693676 - protein, 18 aa, Mycobacterium
LNPDVFYWAHATFFKSTL

SEQ ID NO: 693677 - protein, 32 aa, Mycobacterium
LNPEAVWWGKRVLGLPIHDNWWQTETGGIMIA

SEQ ID NO: 693678 - protein, 18 aa, Mycobacterium
LNPELFYWAHASFVDQVI

SEQ ID NO: 693679 - protein, 17 aa, Mycobacterium
LNPESRFLREIPQELID

SEQ ID NO: 693680 - protein, 17 aa, Mycobacterium
LNPESRFLREIPQELIE

SEQ ID NO: 693681 - protein, 18 aa, Mycobacterium
LNPFALLASQGVPLALGS

SEQ ID NO: 693682 - protein, 24 aa, Mycobacterium
LNPFAVAIARFRLTVAALKASGLS

SEQ ID NO: 693683 - protein, 17 aa, Mycobacterium
LNPGLNFYLGQPSVTLL

SEQ ID NO: 693684 - protein, 19 aa, Mycobacterium
LNPHAELIAAISHREVIDR

SEQ ID NO: 693685 - protein, 21 aa, Mycobacterium
LNPINIRWSPPEIAYALRDSQ

SEQ ID NO: 693686 - protein, 17 aa, Mycobacterium
LNPKGRLRHPLEASHTV

SEQ ID NO: 693687 - protein, 19 aa, Mycobacterium
LNPLGLWAEKHIDLICAAD

SEQ ID NO: 693688 - protein, 18 aa, Mycobacterium
LNPLRFVYMNTDTVMHVH

SEQ ID NO: 693689 - protein, 19 aa, Mycobacterium
LNPNDWWIVQTLGSINSAQ

SEQ ID NO: 693690 - protein, 23 aa, Mycobacterium
LNPNHYLAVAIDYLYTHRPDWPQ

SEQ ID NO: 693691 - protein, 23 aa, Mycobacterium
LNPNHYLAVAIDYLYTHRPSWPA

SEQ ID NO: 693692 - protein, 23 aa, Mycobacterium
LNPNHYLAVAIDYLYTHRPSWPD

SEQ ID NO: 693693 - protein, 22 aa, Mycobacterium
LNPNHYLAVAIEYLYTQRPSWP

SEQ ID NO: 693694 - protein, 33 aa, Mycobacterium
LNPNLFVAAAFPPRRVCNELKTLMPNSFHIGMG

SEQ ID NO: 693695 - protein, 23 aa, Mycobacterium
LNPRGIAPFRCVDPLRWVTAGHG

SEQ ID NO: 693696 - protein, 17 aa, Mycobacterium
LNPRGVIVVVEAEHLCM

SEQ ID NO: 693697 - protein, 24 aa, Mycobacterium
LNPRKRVGQIIGEPMELHGLSSGA

SEQ ID NO: 693698 - protein, 19 aa, Mycobacterium
LNPRLGRREIESILQQADP

SEQ ID NO: 693699 - protein, 18 aa, Mycobacterium
LNPRLLVDTHQGYQSRCE

SEQ ID NO: 693700 - protein, 22 aa, Mycobacterium
LNPRLREFALREGLADAHARFA

SEQ ID NO: 693701 - protein, 22 aa, Mycobacterium
LNPRLREFALREGLADARLRMA

SEQ ID NO: 693702 - protein, 22 aa, Mycobacterium
LNPRLREFALREGLADSQHRFA

SEQ ID NO: 693703 - protein, 17 aa, Mycobacterium
LNPRVPEDLAFAESRIR

SEQ ID NO: 693704 - protein, 17 aa, Mycobacterium
LNPSTGVELLIPDFNGE

SEQ ID NO: 693705 - protein, 17 aa, Mycobacterium
LNPSTGVELLIPDFNGK

SEQ ID NO: 693706 - protein, 17 aa, Mycobacterium
LNPTTLHYVRRPDDNTE

SEQ ID NO: 693707 - protein, 21 aa, Mycobacterium
LNPVMWNAFMGWTGVDQYDEG

SEQ ID NO: 693708 - protein, 20 aa, Mycobacterium
LNPVNIRWTPAEIAYSLEDS

SEQ ID NO: 693709 - protein, 17 aa, Mycobacterium
LNPVRRGDALARDIAHA

SEQ ID NO: 693710 - protein, 18 aa, Mycobacterium
LNPVRRGEALQRDIARAD

SEQ ID NO: 693711 - protein, 25 aa, Mycobacterium
LNQARWRAIACATQLLAGKHHRSQE

SEQ ID NO: 693712 - protein, 24 aa, Mycobacterium
LNQGEVCTCPSRSLIQADIYDEFL

SEQ ID NO: 693713 - protein, 23 aa, Mycobacterium
LNQGEVCTCPSRSLIQSDIYDEF

SEQ ID NO: 693714 - protein, 24 aa, Mycobacterium
LNQGEVCTCPSRSLVQADIYDEFL

SEQ ID NO: 693715 - protein, 20 aa, Mycobacterium
LNQHAKWLATSLELPWRRPI

SEQ ID NO: 693716 - protein, 18 aa, Mycobacterium
LNQHAKWLKVTNHIPWRR

SEQ ID NO: 693717 - protein, 25 aa, Mycobacterium
LNQLWMCGLPGYGPGDLIDLSFSEE

SEQ ID NO: 693718 - protein, 27 aa, Mycobacterium
LNQLWMCGLPGYYPGDLIDFEFSGDTI

SEQ ID NO: 693719 - protein, 27 aa, Mycobacterium
LNQRHGFDCPGCAWPEEHGGRKLAEFC

SEQ ID NO: 693720 - protein, 26 aa, Mycobacterium
LNQSSGRIKLAWFLLNAARYMPAQLY

SEQ ID NO: 693721 - protein, 21 aa, Mycobacterium
LNQWMLEHWGFSHANRVYSTP

SEQ ID NO: 693722 - protein, 22 aa, Mycobacterium
LNRAEVHAAILGRVRRHAQATA

SEQ ID NO: 693723 - protein, 28 aa, Mycobacterium
LNRAMADYRIRLWEALRELERIHGDQGD

SEQ ID NO: 693724 - protein, 25 aa, Mycobacterium
LNRFEHLALDWGERAKPLVGDLRAD

SEQ ID NO: 693725 - protein, 19 aa, Mycobacterium
LNRFHTTALCSPTRQALLT

SEQ ID NO: 693726 - protein, 25 aa, Mycobacterium
LNRGLKYGVKHGFSAAGAATRQFKR

SEQ ID NO: 693727 - protein, 23 aa, Mycobacterium
LNRLGIKGGDGVAILARNHRWFI

SEQ ID NO: 693728 - protein, 17 aa, Mycobacterium
LNRLGINTIGQFAALQT

SEQ ID NO: 693729 - protein, 18 aa, Mycobacterium
LNRLPKVAALFLAGGISA

SEQ ID NO: 693730 - protein, 24 aa, Mycobacterium
LNRLRTLYLTHRFGQRIASRGEGA

SEQ ID NO: 693731 - protein, 23 aa, Mycobacterium
LNRLSDLLFILSRVANNGKDTLW

SEQ ID NO: 693732 - protein, 22 aa, Mycobacterium
LNRLTLEPGEGIYLPAGNLHAY

SEQ ID NO: 693733 - protein, 23 aa, Mycobacterium
LNRPEALNALSPHMIGELRAAYA

SEQ ID NO: 693734 - protein, 23 aa, Mycobacterium
LNRPEALNALSPHMVSELRAAYD

SEQ ID NO: 693735 - protein, 17 aa, Mycobacterium
LNRPFGVAVDADGAVYT

SEQ ID NO: 693736 - protein, 25 aa, Mycobacterium
LNRPGYLRFDFSWQGALSEAQRQEV

SEQ ID NO: 693737 - protein, 25 aa, Mycobacterium
LNRPGYLRFDFSWQGPLTEDQRTHI

SEQ ID NO: 693738 - protein, 25 aa, Mycobacterium
LNRPRWPRLKGRGTFAGVEVHSAQW

SEQ ID NO: 693739 - protein, 17 aa, Mycobacterium
LNRRAMQLFGPIYRRSI

SEQ ID NO: 693740 - protein, 19 aa, Mycobacterium
LNRRFSPQMYLGVVEVTEQ

SEQ ID NO: 693741 - protein, 19 aa, Mycobacterium
LNRRPRLSGLRELRQRLYG

SEQ ID NO: 693742 - protein, 25 aa, Mycobacterium
LNRRQKFLLSLNVPIIMRVLCQAII

SEQ ID NO: 693743 - protein, 30 aa, Mycobacterium
LNRRSAATPSRLVLLAPWLDVSMSDPRSAE

SEQ ID NO: 693744 - protein, 17 aa, Mycobacterium
LNRSLDIAILEAAFVTL

SEQ ID NO: 693745 - protein, 25 aa, Mycobacterium
LNRSRLEMVLKVLDVDGAVRRVKGG

SEQ ID NO: 693746 - protein, 26 aa, Mycobacterium
LNRSVISALWWVHWRVTKNPEEAQRR

SEQ ID NO: 693747 - protein, 25 aa, Mycobacterium
LNRVPRAALERVLPKPGTGPNEQTR

SEQ ID NO: 693748 - protein, 29 aa, Mycobacterium
LNRVRRKHGLPSLGLNLCRIFTDGDQTLY

SEQ ID NO: 693749 - protein, 26 aa, Mycobacterium
LNRWRKSGYQAFDMLKVESLRFEDED

SEQ ID NO: 693750 - protein, 18 aa, Mycobacterium
LNRYDCSNGVRIRADIHV

SEQ ID NO: 693751 - protein, 19 aa, Mycobacterium
LNSAALSYEKLITALSSEE

SEQ ID NO: 693752 - protein, 41 aa, Mycobacterium
LNSAGAYLDWLFRYLVSALRTLPRVMVIGAPEDRIPALSFT

SEQ ID NO: 693753 - protein, 17 aa, Mycobacterium
LNSAVVRAIGSELLSIR

SEQ ID NO: 693754 - protein, 20 aa, Mycobacterium
LNSCQPQLIAAAHWEAIDNF

SEQ ID NO: 693755 - protein, 30 aa, Mycobacterium
LNSFLRCCTDVWRVGRFLVIDAGLSGPDRE

SEQ ID NO: 693756 - protein, 19 aa, Mycobacterium
LNSGLRAGYEVKMALGAPE

SEQ ID NO: 693757 - protein, 28 aa, Mycobacterium
LNSLIPLKLRWGISLGALIMHLRQSALI

SEQ ID NO: 693758 - protein, 29 aa, Mycobacterium
LNSLLRCCSDITRVARLMVIDIGLWPEDR

SEQ ID NO: 693759 - protein, 17 aa, Mycobacterium
LNSLPQFGFLDDRNRQQ

SEQ ID NO: 693760 - protein, 22 aa, Mycobacterium
LNSLVKFRWNGSGVEVLGNTPG

SEQ ID NO: 693761 - protein, 22 aa, Mycobacterium
LNSPFRPDRRWGGDNTDAIYFM

SEQ ID NO: 693762 - protein, 23 aa, Mycobacterium
LNSPFTDFFIKWMSRINTFMYRR

SEQ ID NO: 693763 - protein, 29 aa, Mycobacterium
LNSPFTDVLIKWMSRLNTWMYRRNGGEGL

SEQ ID NO: 693764 - protein, 22 aa, Mycobacterium
LNSPWVAFIIKWMAKGNAWIYR

SEQ ID NO: 693765 - protein, 23 aa, Mycobacterium
LNSRLDGGPVRFHYRVQIGGPTD

SEQ ID NO: 693766 - protein, 23 aa, Mycobacterium
LNSRPRKTLDWKTPAEALDELLS

SEQ ID NO: 693767 - protein, 19 aa, Mycobacterium
LNSRPRPTLDLDTPAQRMA

SEQ ID NO: 693768 - protein, 22 aa, Mycobacterium
LNSSYAYLLWCTDFPSTSAVAR

SEQ ID NO: 693769 - protein, 19 aa, Mycobacterium
LNSVAGRLLGSVPSEVSRR

SEQ ID NO: 693770 - protein, 21 aa, Mycobacterium
LNSWKRLGFCERDIARPGSDR

SEQ ID NO: 693771 - protein, 27 aa, Mycobacterium
LNSWVRRYPDVPVQIVAAGTGAKAAER

SEQ ID NO: 693772 - protein, 19 aa, Mycobacterium
LNTAGSVFLTRPNLAHHTR

SEQ ID NO: 693773 - protein, 23 aa, Mycobacterium
LNTAVWSGGSFIYVPKGVHVDIP

SEQ ID NO: 693774 - protein, 19 aa, Mycobacterium
LNTAVWSGGSFIYVPPGVH

SEQ ID NO: 693775 - protein, 22 aa, Mycobacterium
LNTAVWSGGSFIYVPPGVHVDI

SEQ ID NO: 693776 - protein, 21 aa, Mycobacterium
LNTAWLHKPMFTLRGGTNEVL

SEQ ID NO: 693777 - protein, 23 aa, Mycobacterium
LNTCSAAGILGAERMSNYGAAKT

SEQ ID NO: 693778 - protein, 28 aa, Mycobacterium
LNTELAFPCVWIAPWTRADGLVPLRHSL

SEQ ID NO: 693779 - protein, 18 aa, Mycobacterium
LNTGLVLTSIGYRGKQIR

SEQ ID NO: 693780 - protein, 25 aa, Mycobacterium
LNTHSWSAAPNFAFELSVRRTSDAD

SEQ ID NO: 693781 - protein, 20 aa, Mycobacterium
LNTHVKFHWNGNAVELIGNT

SEQ ID NO: 693782 - protein, 25 aa, Mycobacterium
LNTLAHLRSQLALRQEWEAQHVTVS

SEQ ID NO: 693783 - protein, 27 aa, Mycobacterium
LNTLSFRRLRVLGTTFSVRTADEMAAV

SEQ ID NO: 693784 - protein, 19 aa, Mycobacterium
LNTPMPEIHAFYEAFSPRF

SEQ ID NO: 693785 - protein, 19 aa, Mycobacterium
LNTRFGVERVVRNAFERAE

SEQ ID NO: 693786 - protein, 20 aa, Mycobacterium
LNTRLLRYFVKRYTLKRGAL

SEQ ID NO: 693787 - protein, 33 aa, Mycobacterium
LNTSRRAARSDIRWQPQVWKSFAEELGILAAPL

SEQ ID NO: 693788 - protein, 18 aa, Mycobacterium
LNVAAPIDAAAGANVLAY

SEQ ID NO: 693789 - protein, 20 aa, Mycobacterium
LNVAEGVMVSAVWASATSQL

SEQ ID NO: 693790 - protein, 26 aa, Mycobacterium
LNVAISRAQYAAVIVRSELLTRYLPG

SEQ ID NO: 693791 - protein, 18 aa, Mycobacterium
LNVARMRLLGATVVSVEA

SEQ ID NO: 693792 - protein, 17 aa, Mycobacterium
LNVARMRLLGSTVVSVE

SEQ ID NO: 693793 - protein, 25 aa, Mycobacterium
LNVAVSRAKYAAVIVRSAALTEYLP

SEQ ID NO: 693794 - protein, 24 aa, Mycobacterium
LNVAVSRAKYLAVVVRSEHLTDYL

SEQ ID NO: 693795 - protein, 20 aa, Mycobacterium
LNVAVSRAQYAAVIVRSPSL

SEQ ID NO: 693796 - protein, 18 aa, Mycobacterium
LNVEVPIPAVFNAPTVAE

SEQ ID NO: 693797 - protein, 17 aa, Mycobacterium
LNVGCIPSKALLRNAEI

SEQ ID NO: 693798 - protein, 18 aa, Mycobacterium
LNVGCIPSKALLRNAELA

SEQ ID NO: 693799 - protein, 18 aa, Mycobacterium
LNVGCIPSKALLRNAELV

SEQ ID NO: 693800 - protein, 23 aa, Mycobacterium
LNVGCIPTKMFVYAAEVAATIRE

SEQ ID NO: 693801 - protein, 23 aa, Mycobacterium
LNVGCIPTKMFVYAAGVAEQIRE

SEQ ID NO: 693802 - protein, 18 aa, Mycobacterium
LNVGCIPTKMFVYPADLA

SEQ ID NO: 693803 - protein, 18 aa, Mycobacterium
LNVKRPGPELTVERVGVP

SEQ ID NO: 693804 - protein, 17 aa, Mycobacterium
LNVLANIVGKPYSQIFT

SEQ ID NO: 693805 - protein, 17 aa, Mycobacterium
LNVLPIYGGSSYAVQLA

SEQ ID NO: 693806 - protein, 17 aa, Mycobacterium
LNVLSVGSFQVFPGNGA

SEQ ID NO: 693807 - protein, 24 aa, Mycobacterium
LNVPAETLATWFGDLPRQGRPDPA

SEQ ID NO: 693808 - protein, 28 aa, Mycobacterium
LNVPRRDLRMLAARLGSDVPFALHGGTA

SEQ ID NO: 693809 - protein, 17 aa, Mycobacterium
LNVPYFFMASDGVEAHD

SEQ ID NO: 693810 - protein, 20 aa, Mycobacterium
LNVRIRLALRRCGGGGEPRG

SEQ ID NO: 693811 - protein, 23 aa, Mycobacterium
LNVRPVFLTLKYAGRAMVRNGGG

SEQ ID NO: 693812 - protein, 23 aa, Mycobacterium
LNVRWRKGQTLEPDWKIDQDGWV

SEQ ID NO: 693813 - protein, 24 aa, Mycobacterium
LNVSGGVLFRYALDADRLAQFLLV

SEQ ID NO: 693814 - protein, 19 aa, Mycobacterium
LNVVSALLFGGMWNAPIPD

SEQ ID NO: 693815 - protein, 25 aa, Mycobacterium
LNWFPLDHVGGLVMFHIRDVWLRCR

SEQ ID NO: 693816 - protein, 28 aa, Mycobacterium
LNWPYEHLNEAPAYWQALASKCYDAVGQ

SEQ ID NO: 693817 - protein, 25 aa, Mycobacterium
LNWSSLPLKLFAGGNAKFWDPADID

SEQ ID NO: 693818 - protein, 17 aa, Mycobacterium
LNWVTWVDGETTYSPLP

SEQ ID NO: 693819 - protein, 19 aa, Mycobacterium
LNWYRNFDRNWALTERLAG

SEQ ID NO: 693820 - protein, 18 aa, Mycobacterium
LNYDLPWNPMRIEQRIGR

SEQ ID NO: 693821 - protein, 17 aa, Mycobacterium
LNYGGLVSGFANLGNTM

SEQ ID NO: 693822 - protein, 34 aa, Mycobacterium
LNYLGAVQLILKFIPGMRDRGFGHIVNVSSVGVQ

SEQ ID NO: 693823 - protein, 33 aa, Mycobacterium
LNYLGAVQLILKFIPGMRERGFGHIINVSSVGV

SEQ ID NO: 693824 - protein, 31 aa, Mycobacterium
LNYLGAVQLILKFIPGMRERGYGHIVNVSSV

SEQ ID NO: 693825 - protein, 30 aa, Mycobacterium
LNYLGAVQLILKFIPGMRERKFGQIINVSS

SEQ ID NO: 693826 - protein, 17 aa, Mycobacterium
LNYLLTSHVWRQDHNGA

SEQ ID NO: 693827 - protein, 18 aa, Mycobacterium
LNYPEAWGDEDRRVADAI

SEQ ID NO: 693828 - protein, 19 aa, Mycobacterium
LNYRSVMVLGTARVVEDPD

SEQ ID NO: 693829 - protein, 21 aa, Mycobacterium
LNYYAPLRLIRGLAPGMIERG

SEQ ID NO: 693830 - protein, 19 aa, Mycobacterium
LNYYAPLRLIRGLAPKMLE

SEQ ID NO: 693831 - protein, 21 aa, Mycobacterium
LNYYGPLRLIRGLAPGMLERG

SEQ ID NO: 693832 - protein, 17 aa, Mycobacterium
LPAAAGFAAQQPLTGDA

SEQ ID NO: 693833 - protein, 20 aa, Mycobacterium
LPAAAPRISKLVAALASSNE

SEQ ID NO: 693834 - protein, 23 aa, Mycobacterium
LPAADAALSWAARYGDRDDDGFI

SEQ ID NO: 693835 - protein, 26 aa, Mycobacterium
LPAAERRPETALSLVAPAWERVVAEQ

SEQ ID NO: 693836 - protein, 19 aa, Mycobacterium
LPAAGSYADYCVRQREYTS

SEQ ID NO: 693837 - protein, 17 aa, Mycobacterium
LPAAGVWSQCHSPAFDV

SEQ ID NO: 693838 - protein, 17 aa, Mycobacterium
LPAAIVAAGDYAGAPDG

SEQ ID NO: 693839 - protein, 21 aa, Mycobacterium
LPAALGADWLVSAWDQCAAFH

SEQ ID NO: 693840 - protein, 18 aa, Mycobacterium
LPAAQARLLASIEAHGEA

SEQ ID NO: 693841 - protein, 23 aa, Mycobacterium
LPAAQFVHLFVPRGAITVEAVGE

SEQ ID NO: 693842 - protein, 20 aa, Mycobacterium
LPAARAAHVAGVPAARFYID

SEQ ID NO: 693843 - protein, 17 aa, Mycobacterium
LPAARHVSAGSLLDEQC

SEQ ID NO: 693844 - protein, 17 aa, Mycobacterium
LPAARRARTYVAELLTR

SEQ ID NO: 693845 - protein, 17 aa, Mycobacterium
LPAAVAHLVSERNRYAP

SEQ ID NO: 693846 - protein, 17 aa, Mycobacterium
LPAAVALARRHDPKVIV

SEQ ID NO: 693847 - protein, 18 aa, Mycobacterium
LPAAYQAAFQDFMAGNVS

SEQ ID NO: 693848 - protein, 28 aa, Mycobacterium
LPACGNCRWCASGYTYLCDVGADIYSKA

SEQ ID NO: 693849 - protein, 20 aa, Mycobacterium
LPACPGVASGTAYTDVDEAL

SEQ ID NO: 693850 - protein, 19 aa, Mycobacterium
LPACPGVATGIAYTDVDAA

SEQ ID NO: 693851 - protein, 19 aa, Mycobacterium
LPACPGVVSGRAYSDVDEA

SEQ ID NO: 693852 - protein, 17 aa, Mycobacterium
LPADAFDFVFIDCPPSL

SEQ ID NO: 693853 - protein, 22 aa, Mycobacterium
LPADALTDIFLRRPPRTRSGNP

SEQ ID NO: 693854 - protein, 20 aa, Mycobacterium
LPADAPRIPLNFAIVARRAS

SEQ ID NO: 693855 - protein, 19 aa, Mycobacterium
LPADDRLRAALKRQSIPPE

SEQ ID NO: 693856 - protein, 18 aa, Mycobacterium
LPADDRLRAVLSGNTTHP

SEQ ID NO: 693857 - protein, 17 aa, Mycobacterium
LPADEARDLALAQLDRV

SEQ ID NO: 693858 - protein, 25 aa, Mycobacterium
LPADEFSSVVSFTMLHHVPTVSLQN

SEQ ID NO: 693859 - protein, 20 aa, Mycobacterium
LPADFPRDIPVIKGIYRQDG

SEQ ID NO: 693860 - protein, 18 aa, Mycobacterium
LPADHPLTGMPNVVLTPH

SEQ ID NO: 693861 - protein, 34 aa, Mycobacterium
LPADLRESSRYVARIRPIRVGRILDLPMRRTSMS

SEQ ID NO: 693862 - protein, 26 aa, Mycobacterium
LPADLRPGDLLAVACTGAYHHSMASN

SEQ ID NO: 693863 - protein, 23 aa, Mycobacterium
LPADLRTRLDAALAKPAAQQPSW

SEQ ID NO: 693864 - protein, 20 aa, Mycobacterium
LPADLYRRLSTDLGANGCKV

SEQ ID NO: 693865 - protein, 18 aa, Mycobacterium
LPADMLAMVTAARATASL

SEQ ID NO: 693866 - protein, 17 aa, Mycobacterium
LPADTGIVGPMIDHGFP

SEQ ID NO: 693867 - protein, 18 aa, Mycobacterium
LPADVLIFDLEDAVGPDA

SEQ ID NO: 693868 - protein, 21 aa, Mycobacterium
LPADVRLAAKARDGRLPFVFE

SEQ ID NO: 693869 - protein, 24 aa, Mycobacterium
LPAEEFSSVVSFTMLHHVPTTELQ

SEQ ID NO: 693870 - protein, 25 aa, Mycobacterium
LPAEIDVASAGFWAAEAGHRVAHTI

SEQ ID NO: 693871 - protein, 19 aa, Mycobacterium
LPAELAAAVRKRRPDLDPG

SEQ ID NO: 693872 - protein, 23 aa, Mycobacterium
LPAELDVASAAFWAADAGHRVAH

SEQ ID NO: 693873 - protein, 28 aa, Mycobacterium
LPAELIGPALEDWAKWGQARHDYFLRAD

SEQ ID NO: 693874 - protein, 20 aa, Mycobacterium
LPAEPIRVVFRGDESGTTDN

SEQ ID NO: 693875 - protein, 27 aa, Mycobacterium
LPAEPLPRISIFLSVFDVHVQRVPVAG

SEQ ID NO: 693876 - protein, 24 aa, Mycobacterium
LPAEQRAAVIAVDMQGYSVADAAE

SEQ ID NO: 693877 - protein, 17 aa, Mycobacterium
LPAEVLDAAAVTIQKLW

SEQ ID NO: 693878 - protein, 22 aa, Mycobacterium
LPAFAPALLRARFHLWESGSTA

SEQ ID NO: 693879 - protein, 21 aa, Mycobacterium
LPAFAPAMVRARFHLWESGET

SEQ ID NO: 693880 - protein, 18 aa, Mycobacterium
LPAFEPLEPLSVVLAGGG

SEQ ID NO: 693881 - protein, 20 aa, Mycobacterium
LPAGAAMTVGIRYSGNPRPN

SEQ ID NO: 693882 - protein, 20 aa, Mycobacterium
LPAGAGHVWQSDVGLEAHPW

SEQ ID NO: 693883 - protein, 17 aa, Mycobacterium
LPAGAVLRWRRVDLALF

SEQ ID NO: 693884 - protein, 24 aa, Mycobacterium
LPAGEQRLVVELARGSGARSVSDL

SEQ ID NO: 693885 - protein, 17 aa, Mycobacterium
LPAGGRFSAHTFWDDIE

SEQ ID NO: 693886 - protein, 18 aa, Mycobacterium
LPAGGRLGLYGFGGSAHI

SEQ ID NO: 693887 - protein, 26 aa, Mycobacterium
LPAGIDRPGIERMLQLLLDGFTMLRS

SEQ ID NO: 693888 - protein, 24 aa, Mycobacterium
LPAGIPAELVAAGFEDPDEIGRGG

SEQ ID NO: 693889 - protein, 19 aa, Mycobacterium
LPAGLASIFVDVPLSTLGL

SEQ ID NO: 693890 - protein, 18 aa, Mycobacterium
LPAGRALTHGIALLSRGR

SEQ ID NO: 693891 - protein, 25 aa, Mycobacterium
LPAGRFPLLASAFMTVGVAKAAGVP

SEQ ID NO: 693892 - protein, 18 aa, Mycobacterium
LPAGRLHDSLGIREVSYL

SEQ ID NO: 693893 - protein, 23 aa, Mycobacterium
LPAGSEVRLCLGAINRDGTDEHS

SEQ ID NO: 693894 - protein, 21 aa, Mycobacterium
LPAGSLVDVAEFCRELADTAA

SEQ ID NO: 693895 - protein, 24 aa, Mycobacterium
LPAGSRLLLLWGAANRDPSHFDAP

SEQ ID NO: 693896 - protein, 23 aa, Mycobacterium
LPAGSRLLLLWGAANRDPTHFDH

SEQ ID NO: 693897 - protein, 18 aa, Mycobacterium
LPAGTLLVIVHSGGGRAK

SEQ ID NO: 693898 - protein, 22 aa, Mycobacterium
LPAGTRLQSWIQLTNATDNEIS

SEQ ID NO: 693899 - protein, 18 aa, Mycobacterium
LPAGTWRDEREANLLDGG

SEQ ID NO: 693900 - protein, 24 aa, Mycobacterium
LPAHAGVFLRLIAQRAPDLHRART

SEQ ID NO: 693901 - protein, 18 aa, Mycobacterium
LPAHATVVTGGKRWGETG

SEQ ID NO: 693902 - protein, 20 aa, Mycobacterium
LPAHAYHRYHLPVAGVVKES

SEQ ID NO: 693903 - protein, 17 aa, Mycobacterium
LPAHPAFDWYTERISEQ

SEQ ID NO: 693904 - protein, 19 aa, Mycobacterium
LPAHVAANFEGLVVRVEDS

SEQ ID NO: 693905 - protein, 19 aa, Mycobacterium
LPAIARRQAKKIAVFVADI

SEQ ID NO: 693906 - protein, 28 aa, Mycobacterium
LPAIDAVLLAAALWRGVELVIASMGGAE

SEQ ID NO: 693907 - protein, 17 aa, Mycobacterium
LPAIGAFHTVRPLSDAE

SEQ ID NO: 693908 - protein, 17 aa, Mycobacterium
LPAILGFVPEKSLVLVS

SEQ ID NO: 693909 - protein, 18 aa, Mycobacterium
LPAIQHFLELLRADPRLP

SEQ ID NO: 693910 - protein, 17 aa, Mycobacterium
LPAIRAAIDSVLPSGKF

SEQ ID NO: 693911 - protein, 17 aa, Mycobacterium
LPAIVIVTNRLVYGGAE

SEQ ID NO: 693912 - protein, 18 aa, Mycobacterium
LPAKGPWQQKIIKEIPQT

SEQ ID NO: 693913 - protein, 24 aa, Mycobacterium
LPAKKWLGQRGFDPLYGARPLRRL

SEQ ID NO: 693914 - protein, 19 aa, Mycobacterium
LPALDEVWCNAFRGAVDDL

SEQ ID NO: 693915 - protein, 20 aa, Mycobacterium
LPALDVNGLFEFYTETLGFK

SEQ ID NO: 693916 - protein, 17 aa, Mycobacterium
LPALFAAIITSAGGVPQ

SEQ ID NO: 693917 - protein, 20 aa, Mycobacterium
LPALFSAAAVRELAETTIGI

SEQ ID NO: 693918 - protein, 20 aa, Mycobacterium
LPALGRAGAFDVLLAAYSLG

SEQ ID NO: 693919 - protein, 20 aa, Mycobacterium
LPALHTIAAKAISLRPVLAR

SEQ ID NO: 693920 - protein, 19 aa, Mycobacterium
LPALIFGLYCAAFMESLDP

SEQ ID NO: 693921 - protein, 19 aa, Mycobacterium
LPALIRRYDEAVASRAVSV

SEQ ID NO: 693922 - protein, 17 aa, Mycobacterium
LPALIRRYEEARAGGVP

SEQ ID NO: 693923 - protein, 17 aa, Mycobacterium
LPALLARSVADALVGRF

SEQ ID NO: 693924 - protein, 19 aa, Mycobacterium
LPALLDMFEYFNAVTAARR

SEQ ID NO: 693925 - protein, 20 aa, Mycobacterium
LPALLDMFGYFNAVTTARRE

SEQ ID NO: 693926 - protein, 19 aa, Mycobacterium
LPALNSFVLPGGSPLSALL

SEQ ID NO: 693927 - protein, 19 aa, Mycobacterium
LPALPALPVPPALPAPTTP

SEQ ID NO: 693928 - protein, 20 aa, Mycobacterium
LPALPHLSVPAISIPGINTG

SEQ ID NO: 693929 - protein, 30 aa, Mycobacterium
LPALVEWYRRRDLPAWLALPERLLPIRAAG

SEQ ID NO: 693930 - protein, 28 aa, Mycobacterium
LPAMAEGSFKMAFAITEPDAGSNSHNII

SEQ ID NO: 693931 - protein, 26 aa, Mycobacterium
LPAMFADVRRALAIAEVIRAATVTDT

SEQ ID NO: 693932 - protein, 26 aa, Mycobacterium
LPAMLSRLVIMGGMFDADGNDVGADW

SEQ ID NO: 693933 - protein, 20 aa, Mycobacterium
LPANPFVALADRPTWTMNIN

SEQ ID NO: 693934 - protein, 18 aa, Mycobacterium
LPANRPSPLAGRTSVTYY

SEQ ID NO: 693935 - protein, 19 aa, Mycobacterium
LPAPASYRSYLTWLAAQDR

SEQ ID NO: 693936 - protein, 25 aa, Mycobacterium
LPAPEALTGVLYRLADVNVPGAEKV

SEQ ID NO: 693937 - protein, 19 aa, Mycobacterium
LPAPEFKKAGGEYRGPATA

SEQ ID NO: 693938 - protein, 22 aa, Mycobacterium
LPAPEILSFLYLEARLADEGRY

SEQ ID NO: 693939 - protein, 20 aa, Mycobacterium
LPAPFDGGFYLRPTVLADAT

SEQ ID NO: 693940 - protein, 20 aa, Mycobacterium
LPAPLRLRDEVTWVDYSYVN

SEQ ID NO: 693941 - protein, 19 aa, Mycobacterium
LPAPLRWLERRTRDDLLHP

SEQ ID NO: 693942 - protein, 18 aa, Mycobacterium
LPAPLRWLERRTRDNQLH

SEQ ID NO: 693943 - protein, 25 aa, Mycobacterium
LPAPLTFICIFGYQAQSAFFDHADI

SEQ ID NO: 693944 - protein, 18 aa, Mycobacterium
LPAPRDEFHIALAEQSKN

SEQ ID NO: 693945 - protein, 18 aa, Mycobacterium
LPAPRPAPDDVWEELLAA

SEQ ID NO: 693946 - protein, 25 aa, Mycobacterium
LPAPRVSPFPAVFQDLSLVVAADVS

SEQ ID NO: 693947 - protein, 24 aa, Mycobacterium
LPAPRVSPFPAVFQDVALIVGDDV

SEQ ID NO: 693948 - protein, 23 aa, Mycobacterium
LPAPRVSPFPAVFQDVSLVVPAD

SEQ ID NO: 693949 - protein, 23 aa, Mycobacterium
LPAPRVSPFPAVFQDVSLVVSAD

SEQ ID NO: 693950 - protein, 18 aa, Mycobacterium
LPAPSGWRNLASGYQQRR

SEQ ID NO: 693951 - protein, 25 aa, Mycobacterium
LPAPVAYRRFVTWLSGQDNDAARSA

SEQ ID NO: 693952 - protein, 17 aa, Mycobacterium
LPAPVGAGAYNVYTGDQ

SEQ ID NO: 693953 - protein, 26 aa, Mycobacterium
LPAPWRAEALVLLAFSAYVRGDGPLT

SEQ ID NO: 693954 - protein, 19 aa, Mycobacterium
LPAQCGLPSLHTGVWDPFF

SEQ ID NO: 693955 - protein, 17 aa, Mycobacterium
LPARGAVTVEEIAVAAG

SEQ ID NO: 693956 - protein, 20 aa, Mycobacterium
LPARGTVGLRFGVSPPPWLD

SEQ ID NO: 693957 - protein, 25 aa, Mycobacterium
LPARLRELAVLRIAHLTKCEYEWLH

SEQ ID NO: 693958 - protein, 18 aa, Mycobacterium
LPASGFRWVQQGLGRAVP

SEQ ID NO: 693959 - protein, 19 aa, Mycobacterium
LPASGGVVLTGRLSPGTQG

SEQ ID NO: 693960 - protein, 19 aa, Mycobacterium
LPASGGVVLTGRLSSGTQG

SEQ ID NO: 693961 - protein, 17 aa, Mycobacterium
LPASPCLASRLYTDTAV

SEQ ID NO: 693962 - protein, 29 aa, Mycobacterium
LPATAFKPSYGIAEATLFVATIAPAAQAS

SEQ ID NO: 693963 - protein, 22 aa, Mycobacterium
LPATEFAGFLWVALDPGAELDV

SEQ ID NO: 693964 - protein, 20 aa, Mycobacterium
LPATEFAGFLWVSLDPGTAL

SEQ ID NO: 693965 - protein, 18 aa, Mycobacterium
LPATFVYAGIDVERSGLF

SEQ ID NO: 693966 - protein, 17 aa, Mycobacterium
LPATFVYAGIEVERSGL

SEQ ID NO: 693967 - protein, 17 aa, Mycobacterium
LPATGFQVSCFPVKVHE

SEQ ID NO: 693968 - protein, 26 aa, Mycobacterium
LPATGSFSGTGTWLPLLRSGPDGQAE

SEQ ID NO: 693969 - protein, 18 aa, Mycobacterium
LPATLVFDHPTPSAIAQY

SEQ ID NO: 693970 - protein, 20 aa, Mycobacterium
LPATRIPLHGSIEVDEPYVL

SEQ ID NO: 693971 - protein, 19 aa, Mycobacterium
LPATWPLQVVGSTSGSGVS

SEQ ID NO: 693972 - protein, 18 aa, Mycobacterium
LPAVDAWNNTGGALSIIA

SEQ ID NO: 693973 - protein, 17 aa, Mycobacterium
LPAVELFVVTGRTRDEV

SEQ ID NO: 693974 - protein, 19 aa, Mycobacterium
LPAVIERRGYVLIVSSLAA

SEQ ID NO: 693975 - protein, 19 aa, Mycobacterium
LPAVLPSLPGVGLGGITGA

SEQ ID NO: 693976 - protein, 25 aa, Mycobacterium
LPAVSREVLRAGPAVDDVRAAAERL

SEQ ID NO: 693977 - protein, 17 aa, Mycobacterium
LPAVVRAVLEPLGLTAE

SEQ ID NO: 693978 - protein, 24 aa, Mycobacterium
LPAWDVSCGLYVALAVTAALRHRD

SEQ ID NO: 693979 - protein, 22 aa, Mycobacterium
LPAYALPLFIRIVDTLEHTTTF

SEQ ID NO: 693980 - protein, 18 aa, Mycobacterium
LPAYGACAGMILLASEIL

SEQ ID NO: 693981 - protein, 17 aa, Mycobacterium
LPAYKLAVERGSVDGLL

SEQ ID NO: 693982 - protein, 17 aa, Mycobacterium
LPAYMVPAAVVVLDALP

SEQ ID NO: 693983 - protein, 19 aa, Mycobacterium
LPCDGELELNAGREVATVV

SEQ ID NO: 693984 - protein, 19 aa, Mycobacterium
LPCFHDMGMVGFLTIPMYF

SEQ ID NO: 693985 - protein, 21 aa, Mycobacterium
LPCHTGVRLLGGSSHALGRVT

SEQ ID NO: 693986 - protein, 21 aa, Mycobacterium
LPCNGEAVGEIQARGPWVTGS

SEQ ID NO: 693987 - protein, 17 aa, Mycobacterium
LPCPCSFAQAPTHGDCL

SEQ ID NO: 693988 - protein, 17 aa, Mycobacterium
LPCPDHRPIGIDLREDW

SEQ ID NO: 693989 - protein, 25 aa, Mycobacterium
LPCSMKPRSDLVLQIAATSDSAKTE

SEQ ID NO: 693990 - protein, 25 aa, Mycobacterium
LPCSMKPRSDLVLQIAGTSDIAKTQ

SEQ ID NO: 693991 - protein, 25 aa, Mycobacterium
LPCTGGNLVRYAAGFEALRDRSDSF

SEQ ID NO: 693992 - protein, 17 aa, Mycobacterium
LPDAAAEPVEFAQRLSI

SEQ ID NO: 693993 - protein, 23 aa, Mycobacterium
LPDAELRPFVATMDFTRRTPNTI

SEQ ID NO: 693994 - protein, 19 aa, Mycobacterium
LPDALRALVPVSMRSVDAL

SEQ ID NO: 693995 - protein, 19 aa, Mycobacterium
LPDALRALVPVSMRSVDAW

SEQ ID NO: 693996 - protein, 21 aa, Mycobacterium
LPDAPTWRAQHLVAAQPLVEP

SEQ ID NO: 693997 - protein, 27 aa, Mycobacterium
LPDATAETFKDGWLHTGDMAREDEDGY

SEQ ID NO: 693998 - protein, 17 aa, Mycobacterium
LPDAVLNRLNDILRGHL

SEQ ID NO: 693999 - protein, 26 aa, Mycobacterium
LPDDHRRAIAALGFGVLSKSYFRFER

SEQ ID NO: 694000 - protein, 24 aa, Mycobacterium
LPDDLKFKLVEPLRLLFKDEVRAV

SEQ ID NO: 694001 - protein, 25 aa, Mycobacterium
LPDDLKFKLVEPLRLLFKDEVRAVG

SEQ ID NO: 694002 - protein, 17 aa, Mycobacterium
LPDDRLDDLLALAHEVR

SEQ ID NO: 694003 - protein, 17 aa, Mycobacterium
LPDDRLEELLALAHEVR

SEQ ID NO: 694004 - protein, 17 aa, Mycobacterium
LPDDSWRNEGIQQMPGN

SEQ ID NO: 694005 - protein, 24 aa, Mycobacterium
LPDDWEPLGAIAIGYPEQTPQPLG

SEQ ID NO: 694006 - protein, 18 aa, Mycobacterium
LPDEARQLLLLAAAEPIG

SEQ ID NO: 694007 - protein, 31 aa, Mycobacterium
LPDELPAAALWWRLAAELTPAAALDTPDAGL

SEQ ID NO: 694008 - protein, 19 aa, Mycobacterium
LPDEMTRIKTELFVPQANT

SEQ ID NO: 694009 - protein, 20 aa, Mycobacterium
LPDEPSILCAEDLAPADTAG

SEQ ID NO: 694010 - protein, 17 aa, Mycobacterium
LPDEPWQSAVEATEAAD

SEQ ID NO: 694011 - protein, 20 aa, Mycobacterium
LPDERPRFRAAGGPAGGGRI

SEQ ID NO: 694012 - protein, 23 aa, Mycobacterium
LPDEVKQRYSVPVGGRGWIGPGA

SEQ ID NO: 694013 - protein, 17 aa, Mycobacterium
LPDEVPVPFDIPVLHRD

SEQ ID NO: 694014 - protein, 19 aa, Mycobacterium
LPDFAALRRPHARKLDLPT

SEQ ID NO: 694015 - protein, 27 aa, Mycobacterium
LPDFAGYAPKLWRYWAQHLDPDRALRD

SEQ ID NO: 694016 - protein, 20 aa, Mycobacterium
LPDFPQLWADMLGGQTDDLQ

SEQ ID NO: 694017 - protein, 17 aa, Mycobacterium
LPDFVSTGIPVLVGASR

SEQ ID NO: 694018 - protein, 18 aa, Mycobacterium
LPDGAALAALLADSARRC

SEQ ID NO: 694019 - protein, 17 aa, Mycobacterium
LPDGAGYTSSLVRFPGA

SEQ ID NO: 694020 - protein, 20 aa, Mycobacterium
LPDGALMRRAAYGLAAEIIG

SEQ ID NO: 694021 - protein, 20 aa, Mycobacterium
LPDGALMRRAAYGLATEIIR

SEQ ID NO: 694022 - protein, 18 aa, Mycobacterium
LPDGEWVLLMLAAAQRDP

SEQ ID NO: 694023 - protein, 30 aa, Mycobacterium
LPDGISRLRFRLRWRDFRLTVDVNHSDVTY

SEQ ID NO: 694024 - protein, 21 aa, Mycobacterium
LPDGLPGLLLIADDDLEGWAR

SEQ ID NO: 694025 - protein, 17 aa, Mycobacterium
LPDGLRGTLYRNGPGKL

SEQ ID NO: 694026 - protein, 17 aa, Mycobacterium
LPDGMALAELLADSDPP

SEQ ID NO: 694027 - protein, 25 aa, Mycobacterium
LPDGRELACLEWGDPTGYPTFYFHG

SEQ ID NO: 694028 - protein, 17 aa, Mycobacterium
LPDGRFGIIDFGAVSEH

SEQ ID NO: 694029 - protein, 27 aa, Mycobacterium
LPDGRPHLVAMWYAVVDGEIWFETKAK

SEQ ID NO: 694030 - protein, 22 aa, Mycobacterium
LPDGRRVVGEWVHGPHLPTGPA

SEQ ID NO: 694031 - protein, 26 aa, Mycobacterium
LPDGTLPNVTAWVPMGAGNYTFPLGM

SEQ ID NO: 694032 - protein, 18 aa, Mycobacterium
LPDGTPFPTLYYLTHPEL

SEQ ID NO: 694033 - protein, 17 aa, Mycobacterium
LPDGWDADMPRWEPGSK

SEQ ID NO: 694034 - protein, 27 aa, Mycobacterium
LPDHLEMYRRMWVLRLLDMALEEMRAD

SEQ ID NO: 694035 - protein, 20 aa, Mycobacterium
LPDHSLVAICPITVRDREHP

SEQ ID NO: 694036 - protein, 25 aa, Mycobacterium
LPDIEVCGPPSYTVSTFFHGVNHLP

SEQ ID NO: 694037 - protein, 22 aa, Mycobacterium
LPDIYCPFPAAFAHSRHPAATE

SEQ ID NO: 694038 - protein, 23 aa, Mycobacterium
LPDKACWALQNLVARRYLSKDGQ

SEQ ID NO: 694039 - protein, 24 aa, Mycobacterium
LPDKARPSAREVLEIQAYEEFCLP

SEQ ID NO: 694040 - protein, 24 aa, Mycobacterium
LPDKEFDALFTRDKPVIFAYHGYP

SEQ ID NO: 694041 - protein, 24 aa, Mycobacterium
LPDKPVCCGLTWISTGQLSTAKKV

SEQ ID NO: 694042 - protein, 23 aa, Mycobacterium
LPDLDGIRVLRTFDESMALREHA

SEQ ID NO: 694043 - protein, 19 aa, Mycobacterium
LPDLFPVNFMIKPSLMAIG

SEQ ID NO: 694044 - protein, 18 aa, Mycobacterium
LPDLGLGCRCLFGQSSFG

SEQ ID NO: 694045 - protein, 25 aa, Mycobacterium
LPDLPGITEAWPWTNRQATEASSVP

SEQ ID NO: 694046 - protein, 17 aa, Mycobacterium
LPDLSRRLLDEPLALSG

SEQ ID NO: 694047 - protein, 22 aa, Mycobacterium
LPDMVAAGWGRIVNISSSSTHS

SEQ ID NO: 694048 - protein, 23 aa, Mycobacterium
LPDNELRRIAALCAAFDVDGMRA

SEQ ID NO: 694049 - protein, 18 aa, Mycobacterium
LPDPLLCWNEERGAHDFG

SEQ ID NO: 694050 - protein, 20 aa, Mycobacterium
LPDPPPPVFFGGSSESAGAV

SEQ ID NO: 694051 - protein, 19 aa, Mycobacterium
LPDPPRLPLIPVAEQADPH

SEQ ID NO: 694052 - protein, 23 aa, Mycobacterium
LPDPRLDKLAELFGSERIVAAPV

SEQ ID NO: 694053 - protein, 23 aa, Mycobacterium
LPDPRTGLALKMIADYRNLVAHG

SEQ ID NO: 694054 - protein, 26 aa, Mycobacterium
LPDQPIRTVVPYADFGTALTLTIGCH

SEQ ID NO: 694055 - protein, 27 aa, Mycobacterium
LPDQPIRTVVPYADFGTALTLTIGVMM

SEQ ID NO: 694056 - protein, 17 aa, Mycobacterium
LPDRACRGRSRCGIGND

SEQ ID NO: 694057 - protein, 19 aa, Mycobacterium
LPDRCVIDGEIVLPADNHL

SEQ ID NO: 694058 - protein, 23 aa, Mycobacterium
LPDREFDALFTRDKPVIFAYHGY

SEQ ID NO: 694059 - protein, 22 aa, Mycobacterium
LPDRELRRIAALCAAFDVDGMR

SEQ ID NO: 694060 - protein, 21 aa, Mycobacterium
LPDRFVEEFAGALAQHRCWQR

SEQ ID NO: 694061 - protein, 21 aa, Mycobacterium
LPDRLPLQVGDTWSEAGPDGQ

SEQ ID NO: 694062 - protein, 19 aa, Mycobacterium
LPDRLRAAGFHDVEVEVQA

SEQ ID NO: 694063 - protein, 24 aa, Mycobacterium
LPDRLRAAGFTDIEHHLDGGNQRW

SEQ ID NO: 694064 - protein, 23 aa, Mycobacterium
LPDRLRREFAHDFGRQPQMMKLF

SEQ ID NO: 694065 - protein, 19 aa, Mycobacterium
LPDRPAAIAYRDLRQTCAE

SEQ ID NO: 694066 - protein, 21 aa, Mycobacterium
LPDRRVALYVLPRTLDDVPGL

SEQ ID NO: 694067 - protein, 18 aa, Mycobacterium
LPDRTWPDKVITRAPQWG

SEQ ID NO: 694068 - protein, 19 aa, Mycobacterium
LPDRTWPEKAITTAPMWAA

SEQ ID NO: 694069 - protein, 18 aa, Mycobacterium
LPDRTWPERVIDRAPLWC

SEQ ID NO: 694070 - protein, 17 aa, Mycobacterium
LPDRVARFTAKRDHDLA

SEQ ID NO: 694071 - protein, 17 aa, Mycobacterium
LPDRVLMVGDRMHDVEG

SEQ ID NO: 694072 - protein, 17 aa, Mycobacterium
LPDRVRNSYDISSLKRV

SEQ ID NO: 694073 - protein, 23 aa, Mycobacterium
LPDRYARGWHCLGPVKNFTDGEP

SEQ ID NO: 694074 - protein, 19 aa, Mycobacterium
LPDSAPEHMAHRMAAGLEP

SEQ ID NO: 694075 - protein, 22 aa, Mycobacterium
LPDSRRAVVAPLLLASAYHARL

SEQ ID NO: 694076 - protein, 28 aa, Mycobacterium
LPDTAKVLSRFVDAIVWRTFGQDRLQAM

SEQ ID NO: 694077 - protein, 23 aa, Mycobacterium
LPDTELRRIAALCAAFDVDGMRA

SEQ ID NO: 694078 - protein, 24 aa, Mycobacterium
LPDTIPAVAFSAGFSTSLRALIAE

SEQ ID NO: 694079 - protein, 23 aa, Mycobacterium
LPDTKGPLLINARADKVATSPAF

SEQ ID NO: 694080 - protein, 24 aa, Mycobacterium
LPDTRRYLGRHLSVLELISADTAA

SEQ ID NO: 694081 - protein, 17 aa, Mycobacterium
LPDVALLDYRMPGMDGA

SEQ ID NO: 694082 - protein, 24 aa, Mycobacterium
LPDVARPFLANNWHRYVGDHDDPV

SEQ ID NO: 694083 - protein, 23 aa, Mycobacterium
LPDVRYFGATFFTYVGKALAYLM

SEQ ID NO: 694084 - protein, 22 aa, Mycobacterium
LPDVRYFGATFFTYVGKALGYL

SEQ ID NO: 694085 - protein, 21 aa, Mycobacterium
LPDVYYRSGDWAPFDMATVFG

SEQ ID NO: 694086 - protein, 17 aa, Mycobacterium
LPDWQYLDSNLRGIDGV

SEQ ID NO: 694087 - protein, 21 aa, Mycobacterium
LPEAARTLIEYGLAESTPAVV

SEQ ID NO: 694088 - protein, 28 aa, Mycobacterium
LPEADWQSASPLPGWNVKAVVSHIIGTE

SEQ ID NO: 694089 - protein, 18 aa, Mycobacterium
LPEAGAWVRETLGPLSTD

SEQ ID NO: 694090 - protein, 19 aa, Mycobacterium
LPEAIPSGYLPILRALDAD

SEQ ID NO: 694091 - protein, 19 aa, Mycobacterium
LPEALRRAAVAAAITCTRP

SEQ ID NO: 694092 - protein, 17 aa, Mycobacterium
LPEAQLDRFAIRLELKY

SEQ ID NO: 694093 - protein, 25 aa, Mycobacterium
LPEARRAAAEAGYAGAMFPWQSGSD

SEQ ID NO: 694094 - protein, 19 aa, Mycobacterium
LPEAVSLTRRMGMTGKLAL

SEQ ID NO: 694095 - protein, 20 aa, Mycobacterium
LPEAVSPVWKAMASGGSTGR

SEQ ID NO: 694096 - protein, 20 aa, Mycobacterium
LPEAVSPVWKAMGSGGSTGR

SEQ ID NO: 694097 - protein, 22 aa, Mycobacterium
LPEAVVVRTAWVYTGGAGKDFV

SEQ ID NO: 694098 - protein, 18 aa, Mycobacterium
LPEDADFSLFGKVAPMLP

SEQ ID NO: 694099 - protein, 26 aa, Mycobacterium
LPEDASPAFLGFNLFQHAIARAVIHA

SEQ ID NO: 694100 - protein, 20 aa, Mycobacterium
LPEDERVALLVGELSTRRPL

SEQ ID NO: 694101 - protein, 17 aa, Mycobacterium
LPEDLRAKFGLVSEDQA

SEQ ID NO: 694102 - protein, 20 aa, Mycobacterium
LPEDLVFRVNYLGGDMPTFT

SEQ ID NO: 694103 - protein, 25 aa, Mycobacterium
LPEDPWPAIRRWAATSCVSTIIERT

SEQ ID NO: 694104 - protein, 17 aa, Mycobacterium
LPEDRVVVELSPYDLTR

SEQ ID NO: 694105 - protein, 17 aa, Mycobacterium
LPEEARASLGKQVPHPS

SEQ ID NO: 694106 - protein, 18 aa, Mycobacterium
LPEELAREAHDWTLSPQR

SEQ ID NO: 694107 - protein, 18 aa, Mycobacterium
LPEELIRFMKTRTGQRKV

SEQ ID NO: 694108 - protein, 23 aa, Mycobacterium
LPEELPSGLPPVALIADDDLPGW

SEQ ID NO: 694109 - protein, 18 aa, Mycobacterium
LPEEVPVPFDIPVLHRDA

SEQ ID NO: 694110 - protein, 18 aa, Mycobacterium
LPEFDPFWHRCVEHDVLV

SEQ ID NO: 694111 - protein, 19 aa, Mycobacterium
LPEFPAFERSTADVVDLIT

SEQ ID NO: 694112 - protein, 24 aa, Mycobacterium
LPEFPWDTIADAKAAAAAHPDGIV

SEQ ID NO: 694113 - protein, 19 aa, Mycobacterium
LPEFPWDTLADAKAQASAH

SEQ ID NO: 694114 - protein, 25 aa, Mycobacterium
LPEGAPILFIERLRSVGGVPLSLDT

SEQ ID NO: 694115 - protein, 23 aa, Mycobacterium
LPEGFDRWEVEQFLYREARYADE

SEQ ID NO: 694116 - protein, 21 aa, Mycobacterium
LPEGFRTVVYYADIEGFTYAE

SEQ ID NO: 694117 - protein, 20 aa, Mycobacterium
LPEGPTLFLCDGETEGIVIE

SEQ ID NO: 694118 - protein, 21 aa, Mycobacterium
LPEGRAGRIVAWRDQSTVDPV

SEQ ID NO: 694119 - protein, 22 aa, Mycobacterium
LPEGRRAIRYLGDFVKEVTDGC

SEQ ID NO: 694120 - protein, 22 aa, Mycobacterium
LPEGRRYGVTAGTGRFVEALDA

SEQ ID NO: 694121 - protein, 22 aa, Mycobacterium
LPEGRTVLYLYPLTGRPGLDIP

SEQ ID NO: 694122 - protein, 21 aa, Mycobacterium
LPEGSRLAVEQALDSSPMKSV

SEQ ID NO: 694123 - protein, 36 aa, Mycobacterium
LPEHAVPAAVRRSFDRFVWDTPVLKINYALDAPVPW

SEQ ID NO: 694124 - protein, 22 aa, Mycobacterium
LPEHKPRHLLGISEPDDLFAAV

SEQ ID NO: 694125 - protein, 18 aa, Mycobacterium
LPEHLIVVGSGVTGAEFV

SEQ ID NO: 694126 - protein, 23 aa, Mycobacterium
LPEHLVIVGGGFVAAEFAHVFSA

SEQ ID NO: 694127 - protein, 21 aa, Mycobacterium
LPEHQRMAVYYADVVGMRYQE

SEQ ID NO: 694128 - protein, 22 aa, Mycobacterium
LPEKVADLRVYLDDLVVQLRAA

SEQ ID NO: 694129 - protein, 20 aa, Mycobacterium
LPEKVREAALREVGKLERAS

SEQ ID NO: 694130 - protein, 17 aa, Mycobacterium
LPELAGLLRTPLFTLER

SEQ ID NO: 694131 - protein, 17 aa, Mycobacterium
LPELGLRRENIAFVSGI

SEQ ID NO: 694132 - protein, 20 aa, Mycobacterium
LPELHLGSTPAWGGSARLAK

SEQ ID NO: 694133 - protein, 19 aa, Mycobacterium
LPELIGLTSSCDVVLDPAD

SEQ ID NO: 694134 - protein, 21 aa, Mycobacterium
LPELIQWLPVAALDQPIGNIG

SEQ ID NO: 694135 - protein, 25 aa, Mycobacterium
LPELIRRAVVVKAEVVAADEKESEL

SEQ ID NO: 694136 - protein, 18 aa, Mycobacterium
LPELLPSLRRGGVAAVSP

SEQ ID NO: 694137 - protein, 19 aa, Mycobacterium
LPELPLLRCRVAGAPLGLD

SEQ ID NO: 694138 - protein, 22 aa, Mycobacterium
LPELPQLRWKVTGAPLGLDRPW

SEQ ID NO: 694139 - protein, 22 aa, Mycobacterium
LPELPQLRWRVTGAPFGLDRPW

SEQ ID NO: 694140 - protein, 23 aa, Mycobacterium
LPELPQLRWRVTGAPLGLDRPWF

SEQ ID NO: 694141 - protein, 21 aa, Mycobacterium
LPELQEFIASFWYHYDEAHYD

SEQ ID NO: 694142 - protein, 17 aa, Mycobacterium
LPELRALANQVGVKGTS

SEQ ID NO: 694143 - protein, 19 aa, Mycobacterium
LPELRRRIAEDLGGRGLTR

SEQ ID NO: 694144 - protein, 22 aa, Mycobacterium
LPELVATGFPVLLGASRKRFLG

SEQ ID NO: 694145 - protein, 21 aa, Mycobacterium
LPENATPAYLGFNLFGHAIAR

SEQ ID NO: 694146 - protein, 27 aa, Mycobacterium
LPEPALRLVAVARLRLLCRASGITDVS

SEQ ID NO: 694147 - protein, 20 aa, Mycobacterium
LPEPERMSGGGLRPGPGAPR

SEQ ID NO: 694148 - protein, 24 aa, Mycobacterium
LPEPKEFGHFLAVALEHGVTLDYA

SEQ ID NO: 694149 - protein, 25 aa, Mycobacterium
LPEPLKCLTENLWALHTNRHDYLHA

SEQ ID NO: 694150 - protein, 25 aa, Mycobacterium
LPEPLKCLVENLWALHTNRYDYVAN

SEQ ID NO: 694151 - protein, 18 aa, Mycobacterium
LPEPLTAYMGKLRRHAYR

SEQ ID NO: 694152 - protein, 20 aa, Mycobacterium
LPEPPSVWRLAAGDAGTLED

SEQ ID NO: 694153 - protein, 26 aa, Mycobacterium
LPEPRVVGPVRIPHGGVNLADLLVGS

SEQ ID NO: 694154 - protein, 22 aa, Mycobacterium
LPEPTFVPVLGRIAAGGPILAE

SEQ ID NO: 694155 - protein, 23 aa, Mycobacterium
LPEPTFVPVLGRIAAGGPILAEE

SEQ ID NO: 694156 - protein, 17 aa, Mycobacterium
LPEPVELLTMLQPHSSM

SEQ ID NO: 694157 - protein, 23 aa, Mycobacterium
LPEPWRVEALVLLGFSAYARGDG

SEQ ID NO: 694158 - protein, 17 aa, Mycobacterium
LPEPYGLRLAEPDADAE

SEQ ID NO: 694159 - protein, 19 aa, Mycobacterium
LPEQLRKTLTWDRGKELSG

SEQ ID NO: 694160 - protein, 24 aa, Mycobacterium
LPEQPRLLIKWVEACYGATSVEML

SEQ ID NO: 694161 - protein, 27 aa, Mycobacterium
LPERGAPGAVCRWCGHGEPLLRCTRCG

SEQ ID NO: 694162 - protein, 19 aa, Mycobacterium
LPERLPAAEALSWGLVSAV

SEQ ID NO: 694163 - protein, 21 aa, Mycobacterium
LPERNTGAGVAARIGAALESM

SEQ ID NO: 694164 - protein, 19 aa, Mycobacterium
LPERVIGVLHRQRRPLRGP

SEQ ID NO: 694165 - protein, 17 aa, Mycobacterium
LPESARRAYDVRPIVTA

SEQ ID NO: 694166 - protein, 18 aa, Mycobacterium
LPESFVIKPTHGSGAAII

SEQ ID NO: 694167 - protein, 25 aa, Mycobacterium
LPESGRWSPECIGGQWISGEPGQVG

SEQ ID NO: 694168 - protein, 24 aa, Mycobacterium
LPESIRIRWVRALVDLRVARLLAY

SEQ ID NO: 694169 - protein, 18 aa, Mycobacterium
LPESLYLAAAGGRKPRRI

SEQ ID NO: 694170 - protein, 22 aa, Mycobacterium
LPESPAEMVVGWVGDILSEHGN

SEQ ID NO: 694171 - protein, 22 aa, Mycobacterium
LPETARRAVDCFAAEVPYYGML

SEQ ID NO: 694172 - protein, 22 aa, Mycobacterium
LPETLWIEPLWKTLLSNKAILA

SEQ ID NO: 694173 - protein, 21 aa, Mycobacterium
LPEVDGFVWHAYVPAIDPGQR

SEQ ID NO: 694174 - protein, 21 aa, Mycobacterium
LPEVLAAGARRVVVVRAITAA

SEQ ID NO: 694175 - protein, 17 aa, Mycobacterium
LPEVLAFRDEIVERHNL

SEQ ID NO: 694176 - protein, 22 aa, Mycobacterium
LPEVRLTAPILLLDGASMWFRS

SEQ ID NO: 694177 - protein, 25 aa, Mycobacterium
LPEVVDATLALPVRDLIADGEAIAL

SEQ ID NO: 694178 - protein, 23 aa, Mycobacterium
LPEWERDRVRAVIDPAVIVDEHN

SEQ ID NO: 694179 - protein, 18 aa, Mycobacterium
LPEWERDRVREVIDPAVV

SEQ ID NO: 694180 - protein, 18 aa, Mycobacterium
LPEWERDRVREVIDPVVV

SEQ ID NO: 694181 - protein, 22 aa, Mycobacterium
LPEWPQMLLRALMFRLAVHALH

SEQ ID NO: 694182 - protein, 26 aa, Mycobacterium
LPFACKGGVCGTCRAKVTGGAVDMRR

SEQ ID NO: 694183 - protein, 27 aa, Mycobacterium
LPFAGHPTVGLAWWLRERGTPVNTLQV

SEQ ID NO: 694184 - protein, 28 aa, Mycobacterium
LPFAGLRVVDMTTFWAGPSCTHLLAMLG

SEQ ID NO: 694185 - protein, 26 aa, Mycobacterium
LPFDEHLRPGGVIDLVEDVNRNTYRA

SEQ ID NO: 694186 - protein, 19 aa, Mycobacterium
LPFDNPFTAAGMQYYTQMP

SEQ ID NO: 694187 - protein, 21 aa, Mycobacterium
LPFDRHIHAGKEIGLDRLGKE

SEQ ID NO: 694188 - protein, 18 aa, Mycobacterium
LPFDRPSYWDLFEPALRA

SEQ ID NO: 694189 - protein, 20 aa, Mycobacterium
LPFDRVVDAVSPVRTLSRNP

SEQ ID NO: 694190 - protein, 19 aa, Mycobacterium
LPFDTSRPVALTAPVTVQR

SEQ ID NO: 694191 - protein, 21 aa, Mycobacterium
LPFEDYRMMPRATFCQPQVAS

SEQ ID NO: 694192 - protein, 23 aa, Mycobacterium
LPFEEVLDLLGPLQEVGERISRD

SEQ ID NO: 694193 - protein, 19 aa, Mycobacterium
LPFEIRTTAPSDFVTSAGR

SEQ ID NO: 694194 - protein, 24 aa, Mycobacterium
LPFGEELVMWWNFVGRSHDDIAAY

SEQ ID NO: 694195 - protein, 17 aa, Mycobacterium
LPFGGAVVSLTPAVDHV

SEQ ID NO: 694196 - protein, 31 aa, Mycobacterium
LPFGGCGQSGIGRELGIEGIRAFTQARAFVR

SEQ ID NO: 694197 - protein, 18 aa, Mycobacterium
LPFGLPVPVDDGAADHLQ

SEQ ID NO: 694198 - protein, 25 aa, Mycobacterium
LPFIARAVIDALKLHPNVNASYNEE

SEQ ID NO: 694199 - protein, 17 aa, Mycobacterium
LPFKIDDHTAWRLLEGL

SEQ ID NO: 694200 - protein, 18 aa, Mycobacterium
LPFLIKLEQRGEMLVPGK

SEQ ID NO: 694201 - protein, 17 aa, Mycobacterium
LPFMESVIWAFKQLWDK

SEQ ID NO: 694202 - protein, 19 aa, Mycobacterium
LPFPPNWPVFAPKDKIGDW

SEQ ID NO: 694203 - protein, 20 aa, Mycobacterium
LPFPPNWPVFAPKDKIGDWL

SEQ ID NO: 694204 - protein, 17 aa, Mycobacterium
LPFSHPQVLAAATAELI

SEQ ID NO: 694205 - protein, 30 aa, Mycobacterium
LPFSPVCRPDCAGLCPQCGVVLDTDPDHHH

SEQ ID NO: 694206 - protein, 26 aa, Mycobacterium
LPFTDVFLAEEWRHVVLARRIGTAAA

SEQ ID NO: 694207 - protein, 22 aa, Mycobacterium
LPFVELNAAFYPKREGKLPPTS

SEQ ID NO: 694208 - protein, 17 aa, Mycobacterium
LPFVRRVAEADLVLTEM

SEQ ID NO: 694209 - protein, 27 aa, Mycobacterium
LPFYDPWFAKARTSGAIEAREMDEGML

SEQ ID NO: 694210 - protein, 25 aa, Mycobacterium
LPFYHDMGFVLGVIAPILGGYRGDL

SEQ ID NO: 694211 - protein, 23 aa, Mycobacterium
LPFYHDMGLVLGVCAAILGGYPS

SEQ ID NO: 694212 - protein, 23 aa, Mycobacterium
LPFYHDMGLVLGVCAPILCGRHA

SEQ ID NO: 694213 - protein, 25 aa, Mycobacterium
LPFYHDMGLVLGVCAPILGGHPAKL

SEQ ID NO: 694214 - protein, 23 aa, Mycobacterium
LPFYHDMGLVLGVCAPILGGYQA

SEQ ID NO: 694215 - protein, 22 aa, Mycobacterium
LPFYHDMGLVLGVCAPILGGYR

SEQ ID NO: 694216 - protein, 23 aa, Mycobacterium
LPFYHDMGLVLGVCAPILSGHRA

SEQ ID NO: 694217 - protein, 29 aa, Mycobacterium
LPFYHDMGLVLGVCAPVLGGIRTVLMSPV

SEQ ID NO: 694218 - protein, 17 aa, Mycobacterium
LPFYIRGYEAEAVGIED

SEQ ID NO: 694219 - protein, 20 aa, Mycobacterium
LPGAAGFLAGFRRLGARHQQ

SEQ ID NO: 694220 - protein, 17 aa, Mycobacterium
LPGAAIRRGLYYRYRLL

SEQ ID NO: 694221 - protein, 21 aa, Mycobacterium
LPGAAIWHMAWSDKDDAIDWQ

SEQ ID NO: 694222 - protein, 28 aa, Mycobacterium
LPGADVRVCAVAAVAGVPAGPAHAARAA

SEQ ID NO: 694223 - protein, 21 aa, Mycobacterium
LPGAECARLNLPPMCHHNPTH

SEQ ID NO: 694224 - protein, 17 aa, Mycobacterium
LPGAGSLLAPPWTVEKF

SEQ ID NO: 694225 - protein, 19 aa, Mycobacterium
LPGAIPMSAVVAAHIDLAQ

SEQ ID NO: 694226 - protein, 17 aa, Mycobacterium
LPGALLMIGDPTSDPLL

SEQ ID NO: 694227 - protein, 22 aa, Mycobacterium
LPGAQWRLVLTAHHIVIDGWSM

SEQ ID NO: 694228 - protein, 17 aa, Mycobacterium
LPGARFTPFLTVPGAEN

SEQ ID NO: 694229 - protein, 19 aa, Mycobacterium
LPGATSLGAPLRCLNEARF

SEQ ID NO: 694230 - protein, 19 aa, Mycobacterium
LPGCIGALMHSGQGCALAT

SEQ ID NO: 694231 - protein, 17 aa, Mycobacterium
LPGDCAIERADIPADPE

SEQ ID NO: 694232 - protein, 22 aa, Mycobacterium
LPGDLAEPGHCRSIVEQTVKEF

SEQ ID NO: 694233 - protein, 19 aa, Mycobacterium
LPGDPEFGDPLSTAGDGGP

SEQ ID NO: 694234 - protein, 19 aa, Mycobacterium
LPGDPLALIAPAGSGPGGG

SEQ ID NO: 694235 - protein, 17 aa, Mycobacterium
LPGDPLALIAPAGTEGG

SEQ ID NO: 694236 - protein, 17 aa, Mycobacterium
LPGDPLALIAPAQSGGG

SEQ ID NO: 694237 - protein, 17 aa, Mycobacterium
LPGDPLALIAPVSGEAP

SEQ ID NO: 694238 - protein, 18 aa, Mycobacterium
LPGDRFVLGVQWHPEQSL

SEQ ID NO: 694239 - protein, 22 aa, Mycobacterium
LPGDTFVGPRFGLYGRTQPTWR

SEQ ID NO: 694240 - protein, 24 aa, Mycobacterium
LPGEARPDTLLGWVQSDIAANAVR

SEQ ID NO: 694241 - protein, 17 aa, Mycobacterium
LPGEDPFYLPPAGYHHA

SEQ ID NO: 694242 - protein, 17 aa, Mycobacterium
LPGEHRVDKDAAWKDLP

SEQ ID NO: 694243 - protein, 19 aa, Mycobacterium
LPGELAKAIGNGFALAEQE

SEQ ID NO: 694244 - protein, 22 aa, Mycobacterium
LPGEPLAATLLSWQQQGTEAVA

SEQ ID NO: 694245 - protein, 19 aa, Mycobacterium
LPGEPRVDTGIPWRETRRS

SEQ ID NO: 694246 - protein, 17 aa, Mycobacterium
LPGESLFVLEVAPASYA

SEQ ID NO: 694247 - protein, 18 aa, Mycobacterium
LPGEVADKFATMFDAELR

SEQ ID NO: 694248 - protein, 24 aa, Mycobacterium
LPGEYSCLTLVWAVLDRASAGWRG

SEQ ID NO: 694249 - protein, 21 aa, Mycobacterium
LPGFGCVAAAIGRPGEAVAAV

SEQ ID NO: 694250 - protein, 18 aa, Mycobacterium
LPGFPHWNAGMLSTVHKR

SEQ ID NO: 694251 - protein, 19 aa, Mycobacterium
LPGFPHWNAGMLSTVHKRP

SEQ ID NO: 694252 - protein, 17 aa, Mycobacterium
LPGFVLHVEICEDMFVP

SEQ ID NO: 694253 - protein, 19 aa, Mycobacterium
LPGGALALVNDAGMRRYIG

SEQ ID NO: 694254 - protein, 20 aa, Mycobacterium
LPGGDALYWVGDTAPVLDEI

SEQ ID NO: 694255 - protein, 32 aa, Mycobacterium
LPGGEGGFHLCAAWLVEAYLLIGARSQAELLF

SEQ ID NO: 694256 - protein, 24 aa, Mycobacterium
LPGGEPIPGVSFVFVSNSSPWTYA

SEQ ID NO: 694257 - protein, 18 aa, Mycobacterium
LPGGEVTPEKLIVIGEIA

SEQ ID NO: 694258 - protein, 19 aa, Mycobacterium
LPGGGFVRRVPSEGLELDV

SEQ ID NO: 694259 - protein, 25 aa, Mycobacterium
LPGGKRIYLATGYDKWGMTNGIAAS

SEQ ID NO: 694260 - protein, 18 aa, Mycobacterium
LPGGLPVSGIDVAGAGGT

SEQ ID NO: 694261 - protein, 19 aa, Mycobacterium
LPGGLRWVARHDPSAYVPE

SEQ ID NO: 694262 - protein, 17 aa, Mycobacterium
LPGGSALGSTINVPAID

SEQ ID NO: 694263 - protein, 17 aa, Mycobacterium
LPGGSLVTVEPGGAVEL

SEQ ID NO: 694264 - protein, 19 aa, Mycobacterium
LPGHGFYWFQLREPDPEPG

SEQ ID NO: 694265 - protein, 17 aa, Mycobacterium
LPGHGHSAWREDGDYSP

SEQ ID NO: 694266 - protein, 20 aa, Mycobacterium
LPGHGRGRRAHPFTIADLAA

SEQ ID NO: 694267 - protein, 17 aa, Mycobacterium
LPGHLVGFVEALRAAGI

SEQ ID NO: 694268 - protein, 18 aa, Mycobacterium
LPGHPMAVFTPGHTSGHC

SEQ ID NO: 694269 - protein, 17 aa, Mycobacterium
LPGIAGNLTGLFNTGSN

SEQ ID NO: 694270 - protein, 18 aa, Mycobacterium
LPGIDGHISVVVDRVAAR

SEQ ID NO: 694271 - protein, 20 aa, Mycobacterium
LPGIEARPLVTLNGDADFAE

SEQ ID NO: 694272 - protein, 18 aa, Mycobacterium
LPGIEVRPLVTLNGDTDF

SEQ ID NO: 694273 - protein, 18 aa, Mycobacterium
LPGIGVWTAAETAQRAFG

SEQ ID NO: 694274 - protein, 20 aa, Mycobacterium
LPGIGYQGTQTWPAGRPAPG

SEQ ID NO: 694275 - protein, 25 aa, Mycobacterium
LPGIIAHGLCTMAFTSWAALTELAD

SEQ ID NO: 694276 - protein, 21 aa, Mycobacterium
LPGKALDWGKNLVHGLIQGML

SEQ ID NO: 694277 - protein, 30 aa, Mycobacterium
LPGKPTLAARWRPVLEPVLAELAAGELVVD

SEQ ID NO: 694278 - protein, 19 aa, Mycobacterium
LPGKWGEYLLASRATTIYG

SEQ ID NO: 694279 - protein, 18 aa, Mycobacterium
LPGLDGWERAEGALRRSV

SEQ ID NO: 694280 - protein, 19 aa, Mycobacterium
LPGLERKAHECESTRPEGP

SEQ ID NO: 694281 - protein, 21 aa, Mycobacterium
LPGLKRFRIASKIVKGQPLGG

SEQ ID NO: 694282 - protein, 17 aa, Mycobacterium
LPGLLAEMDEFIEAEIK

SEQ ID NO: 694283 - protein, 17 aa, Mycobacterium
LPGLLAEMDEFIESDIK

SEQ ID NO: 694284 - protein, 17 aa, Mycobacterium
LPGLLTILHDGGYHDTE

SEQ ID NO: 694285 - protein, 17 aa, Mycobacterium
LPGLLTILHDGGYRDTE

SEQ ID NO: 694286 - protein, 32 aa, Mycobacterium
LPGLNRHFMYPIPYWLGLDIDTLIPRLQRLID

SEQ ID NO: 694287 - protein, 19 aa, Mycobacterium
LPGLPKIAVHWPLIDFECG

SEQ ID NO: 694288 - protein, 18 aa, Mycobacterium
LPGLPLGVTTGFWALPDA

SEQ ID NO: 694289 - protein, 17 aa, Mycobacterium
LPGLPVYVYDNSGQGYP

SEQ ID NO: 694290 - protein, 21 aa, Mycobacterium
LPGLQPFMPPYVPGGGSKPHY

SEQ ID NO: 694291 - protein, 18 aa, Mycobacterium
LPGLRALQKYAVRVGGGV

SEQ ID NO: 694292 - protein, 20 aa, Mycobacterium
LPGLRQALGLAEDGTDERAS

SEQ ID NO: 694293 - protein, 17 aa, Mycobacterium
LPGLVAAVSERLGPIAI

SEQ ID NO: 694294 - protein, 24 aa, Mycobacterium
LPGMGSLLLPPWVLTRYDPEGVEM

SEQ ID NO: 694295 - protein, 20 aa, Mycobacterium
LPGMLARGAGGILISGSAAG

SEQ ID NO: 694296 - protein, 18 aa, Mycobacterium
LPGMLHLAILRSPYAHAT

SEQ ID NO: 694297 - protein, 22 aa, Mycobacterium
LPGMPGNSGLAFAGDTNVVTWT

SEQ ID NO: 694298 - protein, 23 aa, Mycobacterium
LPGNPDPVGFVRRLGDEVIPRLA

SEQ ID NO: 694299 - protein, 19 aa, Mycobacterium
LPGNVPVLYPDGSEASMFE

SEQ ID NO: 694300 - protein, 26 aa, Mycobacterium
LPGPAADWLAPHGWQPFVGALTLQLP

SEQ ID NO: 694301 - protein, 19 aa, Mycobacterium
LPGPAVPGVAPWAGDFLLD

SEQ ID NO: 694302 - protein, 18 aa, Mycobacterium
LPGPCAVVYEAGPTGFGL

SEQ ID NO: 694303 - protein, 17 aa, Mycobacterium
LPGPDGWQQVGAAVRRP

SEQ ID NO: 694304 - protein, 20 aa, Mycobacterium
LPGPELGRLMAVSAGETGGT

SEQ ID NO: 694305 - protein, 26 aa, Mycobacterium
LPGPGARPSAILAYPLVAACPTITQG

SEQ ID NO: 694306 - protein, 17 aa, Mycobacterium
LPGPHVFGPPRDHDQAI

SEQ ID NO: 694307 - protein, 23 aa, Mycobacterium
LPGPHVLGHAMAVARDIAANTAP

SEQ ID NO: 694308 - protein, 27 aa, Mycobacterium
LPGPIQRLSEGFALMITTGFLPQRFRD

SEQ ID NO: 694309 - protein, 20 aa, Mycobacterium
LPGPLLRISPHLDTTAEDLE

SEQ ID NO: 694310 - protein, 18 aa, Mycobacterium
LPGPLRWLERRTRDEQLH

SEQ ID NO: 694311 - protein, 20 aa, Mycobacterium
LPGPNGAVVPTDWKAARCTA

SEQ ID NO: 694312 - protein, 19 aa, Mycobacterium
LPGPNGSVVPSTWRAQRAT

SEQ ID NO: 694313 - protein, 20 aa, Mycobacterium
LPGPPGRWVQADGRHPFVGA

SEQ ID NO: 694314 - protein, 19 aa, Mycobacterium
LPGPVPIDSVIAVYVDNAD

SEQ ID NO: 694315 - protein, 18 aa, Mycobacterium
LPGQVVYVGAKYAVVGLS

SEQ ID NO: 694316 - protein, 18 aa, Mycobacterium
LPGQVVYVGAKYAVVGLT

SEQ ID NO: 694317 - protein, 19 aa, Mycobacterium
LPGQWPFIRGGDALRDVKS

SEQ ID NO: 694318 - protein, 17 aa, Mycobacterium
LPGQWPFVRGGDPRRDV

SEQ ID NO: 694319 - protein, 20 aa, Mycobacterium
LPGRDTYKALKKGSGKQEVA

SEQ ID NO: 694320 - protein, 24 aa, Mycobacterium
LPGREPITGVSFAFVSNSSPWTFA

SEQ ID NO: 694321 - protein, 26 aa, Mycobacterium
LPGRERAKILWRIGDLIDEHAEEFAQ

SEQ ID NO: 694322 - protein, 20 aa, Mycobacterium
LPGRERAKVMWRIADLIDEH

SEQ ID NO: 694323 - protein, 18 aa, Mycobacterium
LPGRFVYEDDDIVAFLTI

SEQ ID NO: 694324 - protein, 19 aa, Mycobacterium
LPGRFVYEDDDVVAFLTIA

SEQ ID NO: 694325 - protein, 18 aa, Mycobacterium
LPGRGAATVDEIAAASGL

SEQ ID NO: 694326 - protein, 17 aa, Mycobacterium
LPGRGWVQYEPYGTVLI

SEQ ID NO: 694327 - protein, 23 aa, Mycobacterium
LPGRLRAAGFTDVRTDVSGGRQR

SEQ ID NO: 694328 - protein, 18 aa, Mycobacterium
LPGRRALQTLVDYTISRH

SEQ ID NO: 694329 - protein, 18 aa, Mycobacterium
LPGRRHIRSIDAIRRARL

SEQ ID NO: 694330 - protein, 17 aa, Mycobacterium
LPGRRRPSSRAVRSARV

SEQ ID NO: 694331 - protein, 18 aa, Mycobacterium
LPGRVRRAAYRADTLDRW

SEQ ID NO: 694332 - protein, 19 aa, Mycobacterium
LPGSFYRPTLIADVAETSE

SEQ ID NO: 694333 - protein, 18 aa, Mycobacterium
LPGSGLRDHNMQWDFWTL

SEQ ID NO: 694334 - protein, 19 aa, Mycobacterium
LPGSLAHFVNRWKAISFST

SEQ ID NO: 694335 - protein, 24 aa, Mycobacterium
LPGSPEYGDAVAIWNGAVTERPAA

SEQ ID NO: 694336 - protein, 18 aa, Mycobacterium
LPGSWPFVRGGDALRDVK

SEQ ID NO: 694337 - protein, 23 aa, Mycobacterium
LPGSYAAADFVGWYNGHPDHADT

SEQ ID NO: 694338 - protein, 24 aa, Mycobacterium
LPGTARIGAPEGWLGAASTALRAA

SEQ ID NO: 694339 - protein, 19 aa, Mycobacterium
LPGTLNFWDWMTAADENTP

SEQ ID NO: 694340 - protein, 18 aa, Mycobacterium
LPGTTRGPRVRTFEEQIM

SEQ ID NO: 694341 - protein, 18 aa, Mycobacterium
LPGVEGFRRAHRQARNAH

SEQ ID NO: 694342 - protein, 18 aa, Mycobacterium
LPGVGLYLDGGFGVGKTH

SEQ ID NO: 694343 - protein, 17 aa, Mycobacterium
LPGVGVWTAAETVQRAF

SEQ ID NO: 694344 - protein, 25 aa, Mycobacterium
LPGVLSGRVRICLGYTEPEGGSDVA

SEQ ID NO: 694345 - protein, 17 aa, Mycobacterium
LPGVLSRRIDPRNCTVL

SEQ ID NO: 694346 - protein, 17 aa, Mycobacterium
LPGVLSRRIDPRNGTVL

SEQ ID NO: 694347 - protein, 20 aa, Mycobacterium
LPGVPLDRILAFGAEDDPTK

SEQ ID NO: 694348 - protein, 25 aa, Mycobacterium
LPGVSGANPCRRAQRRVRPLPAGLF

SEQ ID NO: 694349 - protein, 19 aa, Mycobacterium
LPGVSQWRTLRRVPIGGEA

SEQ ID NO: 694350 - protein, 22 aa, Mycobacterium
LPGYEEFAPWLLVEKTGNVHVI

SEQ ID NO: 694351 - protein, 19 aa, Mycobacterium
LPGYMVPAALVALPELPMT

SEQ ID NO: 694352 - protein, 19 aa, Mycobacterium
LPGYMVPAAVVGLDALPLT

SEQ ID NO: 694353 - protein, 25 aa, Mycobacterium
LPGYPFARQRHWVEYNASSAWVANG

SEQ ID NO: 694354 - protein, 17 aa, Mycobacterium
LPHADIVPMVKPQFEVG

SEQ ID NO: 694355 - protein, 17 aa, Mycobacterium
LPHAGFRTEHGGTGDVG

SEQ ID NO: 694356 - protein, 18 aa, Mycobacterium
LPHDMAFTENYAILNDFP

SEQ ID NO: 694357 - protein, 17 aa, Mycobacterium
LPHDVSLEGDDTIVVGN

SEQ ID NO: 694358 - protein, 24 aa, Mycobacterium
LPHIASAVAIARQWLDCPDRGVGL

SEQ ID NO: 694359 - protein, 21 aa, Mycobacterium
LPHKLAGAGHRFRQPDLEQAL

SEQ ID NO: 694360 - protein, 17 aa, Mycobacterium
LPHLFFVEGGALAVENA

SEQ ID NO: 694361 - protein, 17 aa, Mycobacterium
LPHLKEGASIIATASAA

SEQ ID NO: 694362 - protein, 24 aa, Mycobacterium
LPHLPGLAEIEPWTNRRATDSSTV

SEQ ID NO: 694363 - protein, 20 aa, Mycobacterium
LPHLQRLAVYTGEALDELDE

SEQ ID NO: 694364 - protein, 19 aa, Mycobacterium
LPHLRFAALAWGPKDGRLM

SEQ ID NO: 694365 - protein, 18 aa, Mycobacterium
LPHLRTARPTDYLFTHHG

SEQ ID NO: 694366 - protein, 17 aa, Mycobacterium
LPHLVPVVFAVGEDSPD

SEQ ID NO: 694367 - protein, 22 aa, Mycobacterium
LPHMRRQRQGLLVWVSSSSAAG

SEQ ID NO: 694368 - protein, 25 aa, Mycobacterium
LPHQCYRLGEQLGYTTAVTWSAIPG

SEQ ID NO: 694369 - protein, 20 aa, Mycobacterium
LPHQLLRSWYILYFQLPWLP

SEQ ID NO: 694370 - protein, 17 aa, Mycobacterium
LPHRVPSGFHGNWVPST

SEQ ID NO: 694371 - protein, 18 aa, Mycobacterium
LPHSPYLAAVAGRKPSRV

SEQ ID NO: 694372 - protein, 18 aa, Mycobacterium
LPHTAMWTAAKVILPGRY

SEQ ID NO: 694373 - protein, 19 aa, Mycobacterium
LPHVAGFRRSHWQARDARS

SEQ ID NO: 694374 - protein, 19 aa, Mycobacterium
LPHVPVRRHARSWHQYSEP

SEQ ID NO: 694375 - protein, 31 aa, Mycobacterium
LPHYFGFGTGYGLDPDWRHGMWQGDLVVQGK

SEQ ID NO: 694376 - protein, 17 aa, Mycobacterium
LPHYGVVAITGYDEACE

SEQ ID NO: 694377 - protein, 27 aa, Mycobacterium
LPIAPWLPDRLWGGLTRLSRPFFVWLT

SEQ ID NO: 694378 - protein, 24 aa, Mycobacterium
LPIARDLAGHLIRVMTIAPGLFDT

SEQ ID NO: 694379 - protein, 19 aa, Mycobacterium
LPIAREWWTRLGRTPPWPN

SEQ ID NO: 694380 - protein, 19 aa, Mycobacterium
LPIDGGLRIDDLRDHPEIT

SEQ ID NO: 694381 - protein, 19 aa, Mycobacterium
LPIDPNVLFDGMSAFVQYS

SEQ ID NO: 694382 - protein, 20 aa, Mycobacterium
LPIGEYPAEVAVRILGSEFL

SEQ ID NO: 694383 - protein, 23 aa, Mycobacterium
LPILERAKFLAIFASNLDEFYMV

SEQ ID NO: 694384 - protein, 18 aa, Mycobacterium
LPILLREIFAIYFGQALA

SEQ ID NO: 694385 - protein, 17 aa, Mycobacterium
LPIPLSALEKAVELNGV

SEQ ID NO: 694386 - protein, 17 aa, Mycobacterium
LPIPSVVTPQMFTHQLL

SEQ ID NO: 694387 - protein, 17 aa, Mycobacterium
LPIPWVEAEDISNAVLF

SEQ ID NO: 694388 - protein, 19 aa, Mycobacterium
LPIREAWHDGMEPFCGVAV

SEQ ID NO: 694389 - protein, 21 aa, Mycobacterium
LPIRIARHIAGTLAHPAAPAP

SEQ ID NO: 694390 - protein, 17 aa, Mycobacterium
LPIRPVEARGARVRAED

SEQ ID NO: 694391 - protein, 17 aa, Mycobacterium
LPIRSIVAIGTPLDYGQ

SEQ ID NO: 694392 - protein, 17 aa, Mycobacterium
LPIRTLSDMVWIPESER

SEQ ID NO: 694393 - protein, 17 aa, Mycobacterium
LPISHALSRAGDIEPVE

SEQ ID NO: 694394 - protein, 25 aa, Mycobacterium
LPITLGGTMAKYDWTINGEPYSKTH

SEQ ID NO: 694395 - protein, 21 aa, Mycobacterium
LPITLGHELAHHYLLAGNIPE

SEQ ID NO: 694396 - protein, 20 aa, Mycobacterium
LPITPGWNYLVRLYRPRAEI

SEQ ID NO: 694397 - protein, 20 aa, Mycobacterium
LPIVGAKADMLRQAAGIAGN

SEQ ID NO: 694398 - protein, 17 aa, Mycobacterium
LPIVLGLNLTEHAEMTP

SEQ ID NO: 694399 - protein, 25 aa, Mycobacterium
LPIYRPPLDMSRLFGEPRLGGDGAV

SEQ ID NO: 694400 - protein, 17 aa, Mycobacterium
LPKAIPVHFDDYAVFAS

SEQ ID NO: 694401 - protein, 24 aa, Mycobacterium
LPKAPRGALAMAIHALTLAINQRL

SEQ ID NO: 694402 - protein, 33 aa, Mycobacterium
LPKASVMTHYRWLRALAGFGGLGLRLRSNDTLY

SEQ ID NO: 694403 - protein, 19 aa, Mycobacterium
LPKAVGIPHTVLLTGSNGY

SEQ ID NO: 694404 - protein, 20 aa, Mycobacterium
LPKDAATVWAELNGESPLHW

SEQ ID NO: 694405 - protein, 19 aa, Mycobacterium
LPKFSDIRYDYSLAGGATM

SEQ ID NO: 694406 - protein, 19 aa, Mycobacterium
LPKGNAIERIGNWGCFCIV

SEQ ID NO: 694407 - protein, 20 aa, Mycobacterium
LPKHARRCVFWEVDPATLGN

SEQ ID NO: 694408 - protein, 19 aa, Mycobacterium
LPKHARRCVFWEVDPATVG

SEQ ID NO: 694409 - protein, 23 aa, Mycobacterium
LPKHARRCVYWEVDPATLGNQDH

SEQ ID NO: 694410 - protein, 23 aa, Mycobacterium
LPKHARRCVYWEVDPPVGGGGDQ

SEQ ID NO: 694411 - protein, 20 aa, Mycobacterium
LPKICLDIGRGVRGTIGHTQ

SEQ ID NO: 694412 - protein, 20 aa, Mycobacterium
LPKICLEAGRGVRGTIGHTQ

SEQ ID NO: 694413 - protein, 18 aa, Mycobacterium
LPKIYLELLDAARGLERL

SEQ ID NO: 694414 - protein, 29 aa, Mycobacterium
LPKKQIDGALRFSWSHLTGEVPWDVVAQR

SEQ ID NO: 694415 - protein, 18 aa, Mycobacterium
LPKLAGRAVDVRWDAPQT

SEQ ID NO: 694416 - protein, 17 aa, Mycobacterium
LPKLANQFLTAWSPEDG

SEQ ID NO: 694417 - protein, 24 aa, Mycobacterium
LPKLESGMVPKIEACLRAVNGGVP

SEQ ID NO: 694418 - protein, 17 aa, Mycobacterium
LPKLKGFKNRFRTEYQV

SEQ ID NO: 694419 - protein, 27 aa, Mycobacterium
LPKLPQCIPNVWLGTVGVNPNPYTGSP

SEQ ID NO: 694420 - protein, 22 aa, Mycobacterium
LPKLPSPASQLWRSRRQIRLDL

SEQ ID NO: 694421 - protein, 17 aa, Mycobacterium
LPKMGLEETHEFARPHI

SEQ ID NO: 694422 - protein, 17 aa, Mycobacterium
LPKMGLEETHEYAKPHI

SEQ ID NO: 694423 - protein, 24 aa, Mycobacterium
LPKNSRLGYRETINYATKISTDGI

SEQ ID NO: 694424 - protein, 24 aa, Mycobacterium
LPKNSRLGYRETINYATRISTDGI

SEQ ID NO: 694425 - protein, 21 aa, Mycobacterium
LPKPPFAQWIPEPLWALQRKL

SEQ ID NO: 694426 - protein, 20 aa, Mycobacterium
LPKQYRGVIQYVQVNGRTKI

SEQ ID NO: 694427 - protein, 19 aa, Mycobacterium
LPKRIDFACYSAIYYTLRR

SEQ ID NO: 694428 - protein, 18 aa, Mycobacterium
LPKRRPVDLRLKDWKEVY

SEQ ID NO: 694429 - protein, 19 aa, Mycobacterium
LPKRRPVPLRLKDWHEVYE

SEQ ID NO: 694430 - protein, 19 aa, Mycobacterium
LPKRRPVPLRLLDWKEVYE

SEQ ID NO: 694431 - protein, 19 aa, Mycobacterium
LPKRRPVPLRLRDWKEVYE

SEQ ID NO: 694432 - protein, 20 aa, Mycobacterium
LPKRRPVPLRLRDWREVYED

SEQ ID NO: 694433 - protein, 24 aa, Mycobacterium
LPKVDARGVTFVRPELVGEVRYSE

SEQ ID NO: 694434 - protein, 20 aa, Mycobacterium
LPKVLEFKAQVLAQQGAEPK

SEQ ID NO: 694435 - protein, 18 aa, Mycobacterium
LPKYKLPEEVVFWDEPLP

SEQ ID NO: 694436 - protein, 20 aa, Mycobacterium
LPLADLLGVVPVLATDVLRR

SEQ ID NO: 694437 - protein, 23 aa, Mycobacterium
LPLAGLRVGDWLVDPQWWAARRE

SEQ ID NO: 694438 - protein, 20 aa, Mycobacterium
LPLAHSLSWQGRGRDADDVL

SEQ ID NO: 694439 - protein, 26 aa, Mycobacterium
LPLAIDHLRYFAGAIRAQEGGLSQID

SEQ ID NO: 694440 - protein, 17 aa, Mycobacterium
LPLATVGGVAIKASAHG

SEQ ID NO: 694441 - protein, 18 aa, Mycobacterium
LPLDAGWASLQLLTDEVL

SEQ ID NO: 694442 - protein, 22 aa, Mycobacterium
LPLDCTYDFEVAAAKYLHALRD

SEQ ID NO: 694443 - protein, 18 aa, Mycobacterium
LPLDEVKFSYELGACTKD

SEQ ID NO: 694444 - protein, 24 aa, Mycobacterium
LPLDEWPTRLRRLISEQVSLILRR

SEQ ID NO: 694445 - protein, 24 aa, Mycobacterium
LPLDRSRPLWEMWVIENVAGTDAH

SEQ ID NO: 694446 - protein, 19 aa, Mycobacterium
LPLDVARDIVGPDVLLGLS

SEQ ID NO: 694447 - protein, 20 aa, Mycobacterium
LPLDVARGIIGRRPVIGRST

SEQ ID NO: 694448 - protein, 17 aa, Mycobacterium
LPLEAPVGLAKSAPPPG

SEQ ID NO: 694449 - protein, 23 aa, Mycobacterium
LPLEQRAAVVAVDMQGYSVADTA

SEQ ID NO: 694450 - protein, 21 aa, Mycobacterium
LPLFHDMGMMGFLIVPMCRAM

SEQ ID NO: 694451 - protein, 19 aa, Mycobacterium
LPLFHDMGMMGLLIIPMYE

SEQ ID NO: 694452 - protein, 18 aa, Mycobacterium
LPLFPYMDIHVTPLARHP

SEQ ID NO: 694453 - protein, 19 aa, Mycobacterium
LPLFRYLGGPNAHILPVPM

SEQ ID NO: 694454 - protein, 19 aa, Mycobacterium
LPLGAGRLTREWLAEDPPG

SEQ ID NO: 694455 - protein, 21 aa, Mycobacterium
LPLGAPLPIAPVVPAGAPLVA

SEQ ID NO: 694456 - protein, 20 aa, Mycobacterium
LPLGCAVGGSLLLGRSNAIL

SEQ ID NO: 694457 - protein, 17 aa, Mycobacterium
LPLGDHGVQCGTAIVTE

SEQ ID NO: 694458 - protein, 26 aa, Mycobacterium
LPLGGGRHARAWFACYDLLHRLGGSY

SEQ ID NO: 694459 - protein, 17 aa, Mycobacterium
LPLGLGLVVLDIPFDGI

SEQ ID NO: 694460 - protein, 19 aa, Mycobacterium
LPLGRLVSGRLARINAAIT

SEQ ID NO: 694461 - protein, 19 aa, Mycobacterium
LPLGVEIVAPRCDLTDIPR

SEQ ID NO: 694462 - protein, 26 aa, Mycobacterium
LPLGVPQPRMVRIFREFAPDVVHLAS

SEQ ID NO: 694463 - protein, 19 aa, Mycobacterium
LPLGVQFVGGLGSDGDLLA

SEQ ID NO: 694464 - protein, 17 aa, Mycobacterium
LPLGVRELARMAVAFAN

SEQ ID NO: 694465 - protein, 19 aa, Mycobacterium
LPLHPGFAASWQLLRTAPV

SEQ ID NO: 694466 - protein, 31 aa, Mycobacterium
LPLHPGFAASWQRLRTATALVPLDHADERRR

SEQ ID NO: 694467 - protein, 24 aa, Mycobacterium
LPLLAGHVRVEWAGDIYCVVLNLC

SEQ ID NO: 694468 - protein, 18 aa, Mycobacterium
LPLLAPMSEVAGRLSAQV

SEQ ID NO: 694469 - protein, 24 aa, Mycobacterium
LPLLDPLRMIPVLGNPLADLLQPF

SEQ ID NO: 694470 - protein, 24 aa, Mycobacterium
LPLLEPLRALPLGNTVADLIQPDL

SEQ ID NO: 694471 - protein, 25 aa, Mycobacterium
LPLLEPLRALPVIGDPLADLVEPNL

SEQ ID NO: 694472 - protein, 20 aa, Mycobacterium
LPLLLLDEGHCLRDQALDVC

SEQ ID NO: 694473 - protein, 25 aa, Mycobacterium
LPLLPEWLLPWLLRLYWRRWSPGYD

SEQ ID NO: 694474 - protein, 17 aa, Mycobacterium
LPLLPRLGHLPVPQRDA

SEQ ID NO: 694475 - protein, 25 aa, Mycobacterium
LPLLQFLIYPAVDFTVRRPSRDLFA

SEQ ID NO: 694476 - protein, 18 aa, Mycobacterium
LPLLRELGIGFVAYSPLG

SEQ ID NO: 694477 - protein, 21 aa, Mycobacterium
LPLLVTRPGGLLVEISDGTTE

SEQ ID NO: 694478 - protein, 17 aa, Mycobacterium
LPLLVVHGGPGLPHSYL

SEQ ID NO: 694479 - protein, 17 aa, Mycobacterium
LPLLVVHGGPGLPHYYL

SEQ ID NO: 694480 - protein, 18 aa, Mycobacterium
LPLMFEPYDRKALRKRAI

SEQ ID NO: 694481 - protein, 25 aa, Mycobacterium
LPLMIPRRIAMELVLTGAPISAARA

SEQ ID NO: 694482 - protein, 17 aa, Mycobacterium
LPLMPAGGHIVFVTSHQ

SEQ ID NO: 694483 - protein, 25 aa, Mycobacterium
LPLMPEPGMRIAVIGGYAHLGVPAG

SEQ ID NO: 694484 - protein, 17 aa, Mycobacterium
LPLMPLANMAGRAVGGP

SEQ ID NO: 694485 - protein, 24 aa, Mycobacterium
LPLPAEAASALFQVVSQRYLKTSI

SEQ ID NO: 694486 - protein, 18 aa, Mycobacterium
LPLPAPVTVVGGGLTGIE

SEQ ID NO: 694487 - protein, 19 aa, Mycobacterium
LPLPDERVALMFDIGTPDV

SEQ ID NO: 694488 - protein, 19 aa, Mycobacterium
LPLPGDWNIAAGCVAGIDV

SEQ ID NO: 694489 - protein, 26 aa, Mycobacterium
LPLPGHAPSGLGFRPDGTLYIVSTEK

SEQ ID NO: 694490 - protein, 27 aa, Mycobacterium
LPLPGHSPCGLGFRPDGTLLIASAHDR

SEQ ID NO: 694491 - protein, 26 aa, Mycobacterium
LPLPGHSPSGLGFRPDGSLLIASTED

SEQ ID NO: 694492 - protein, 26 aa, Mycobacterium
LPLPGHTPSGLGFRPDGSLLIASAED

SEQ ID NO: 694493 - protein, 25 aa, Mycobacterium
LPLPHWAGVVPLTLTAGTPVPAADL

SEQ ID NO: 694494 - protein, 19 aa, Mycobacterium
LPLPPGTLPTLWNAEDRYR

SEQ ID NO: 694495 - protein, 20 aa, Mycobacterium
LPLPRCTRYPIHDAAAAVRL

SEQ ID NO: 694496 - protein, 20 aa, Mycobacterium
LPLPTPVGMEVMPPEPPLPA

SEQ ID NO: 694497 - protein, 23 aa, Mycobacterium
LPLPYSLALRLRDAGVAPDVVSE

SEQ ID NO: 694498 - protein, 17 aa, Mycobacterium
LPLQCQYAELTFLATPL

SEQ ID NO: 694499 - protein, 18 aa, Mycobacterium
LPLQLIEDQVMTRLDPET

SEQ ID NO: 694500 - protein, 20 aa, Mycobacterium
LPLQPSQYWARQCYVGASFL

SEQ ID NO: 694501 - protein, 19 aa, Mycobacterium
LPLRAPDAVPGVLIVLRSV

SEQ ID NO: 694502 - protein, 27 aa, Mycobacterium
LPLRERTVLELRFFKGMTQSQIAAQIG

SEQ ID NO: 694503 - protein, 20 aa, Mycobacterium
LPLRIARHVADVVVRPASPA

SEQ ID NO: 694504 - protein, 17 aa, Mycobacterium
LPLRPFKTMAVNVDGRL

SEQ ID NO: 694505 - protein, 17 aa, Mycobacterium
LPLRPFKTMAVNVEGQL

SEQ ID NO: 694506 - protein, 17 aa, Mycobacterium
LPLRRLRDRFTANDSPS

SEQ ID NO: 694507 - protein, 17 aa, Mycobacterium
LPLSARLAAKAPRLVNR

SEQ ID NO: 694508 - protein, 17 aa, Mycobacterium
LPLSGWMTIETTPLRPH

SEQ ID NO: 694509 - protein, 18 aa, Mycobacterium
LPLSHDMGLIAYLISPMF

SEQ ID NO: 694510 - protein, 43 aa, Mycobacterium
LPLSHSQLAAWFQYRIEGAREEFNMPLALRFEGPLDSVALAAA

SEQ ID NO: 694511 - protein, 33 aa, Mycobacterium
LPLSPVCRPDCSGLCPQCGVALDAEPGHHHDQI

SEQ ID NO: 694512 - protein, 17 aa, Mycobacterium
LPLTFTLVVANSGDPSW

SEQ ID NO: 694513 - protein, 18 aa, Mycobacterium
LPLTYRFEPGAADDGVTV

SEQ ID NO: 694514 - protein, 19 aa, Mycobacterium
LPLTYRFEPGAADDGVTVH

SEQ ID NO: 694515 - protein, 17 aa, Mycobacterium
LPLVCTLNGAPVLAATA

SEQ ID NO: 694516 - protein, 19 aa, Mycobacterium
LPLVCVVGVDHQWGLEVGV

SEQ ID NO: 694517 - protein, 26 aa, Mycobacterium
LPLVPLLPRWLVRRTVGVAAGNVSSN

SEQ ID NO: 694518 - protein, 19 aa, Mycobacterium
LPLVQRLISRTGLSISEFW

SEQ ID NO: 694519 - protein, 20 aa, Mycobacterium
LPLVVGCTSLATAPVIDEAR

SEQ ID NO: 694520 - protein, 19 aa, Mycobacterium
LPLYCTGVGKVLLAHAPED

SEQ ID NO: 694521 - protein, 32 aa, Mycobacterium
LPLYHDMGLMLGLCAPVLGGWHTVLISPFAFL

SEQ ID NO: 694522 - protein, 19 aa, Mycobacterium
LPLYHDMGLTFLLTGFMSG

SEQ ID NO: 694523 - protein, 27 aa, Mycobacterium
LPMAADRGVGWKVLRDAGRVVSVDGIF

SEQ ID NO: 694524 - protein, 23 aa, Mycobacterium
LPMADEGLRRWEVAAEVRDRYLG

SEQ ID NO: 694525 - protein, 20 aa, Mycobacterium
LPMAEAYGLGVLLYAPLAGG

SEQ ID NO: 694526 - protein, 17 aa, Mycobacterium
LPMAHLDSLVAHSDIAD

SEQ ID NO: 694527 - protein, 18 aa, Mycobacterium
LPMALTLIRPDLDQWTPG

SEQ ID NO: 694528 - protein, 20 aa, Mycobacterium
LPMDALGGLGGLSGLAGQGG

SEQ ID NO: 694529 - protein, 17 aa, Mycobacterium
LPMDKVLAGVRTIVQDM

SEQ ID NO: 694530 - protein, 25 aa, Mycobacterium
LPMEELIAAFLPVLFPGMEIVQHHA

SEQ ID NO: 694531 - protein, 26 aa, Mycobacterium
LPMFHCNGWCFTWAVGAAGGTHICLR

SEQ ID NO: 694532 - protein, 17 aa, Mycobacterium
LPMFLSGRLYDDGVIDP

SEQ ID NO: 694533 - protein, 17 aa, Mycobacterium
LPMGAPHEVWWGREEYI

SEQ ID NO: 694534 - protein, 17 aa, Mycobacterium
LPMLQLYMRGVHFHNGK

SEQ ID NO: 694535 - protein, 19 aa, Mycobacterium
LPMMKLRIANPEYLVDIND

SEQ ID NO: 694536 - protein, 19 aa, Mycobacterium
LPMNGFRGGFGHIGLGGSM

SEQ ID NO: 694537 - protein, 17 aa, Mycobacterium
LPMPHGWAEYTVERQLE

SEQ ID NO: 694538 - protein, 19 aa, Mycobacterium
LPMPQGRGFFFEKVFPAFW

SEQ ID NO: 694539 - protein, 17 aa, Mycobacterium
LPMQGVAAVAAVTAVTR

SEQ ID NO: 694540 - protein, 19 aa, Mycobacterium
LPMRDLIRMATHAHHYLAI

SEQ ID NO: 694541 - protein, 17 aa, Mycobacterium
LPMRSEWVLDDCARNGD

SEQ ID NO: 694542 - protein, 20 aa, Mycobacterium
LPMRSLVAVCGGGDIQRNEH

SEQ ID NO: 694543 - protein, 18 aa, Mycobacterium
LPMTGAPALVASQIEGGT

SEQ ID NO: 694544 - protein, 17 aa, Mycobacterium
LPMTPARIWRALQQGRA

SEQ ID NO: 694545 - protein, 20 aa, Mycobacterium
LPMVELPDYILIGADGPIRL

SEQ ID NO: 694546 - protein, 19 aa, Mycobacterium
LPMVFLCQNNLYAEMTPTS

SEQ ID NO: 694547 - protein, 35 aa, Mycobacterium
LPMVLLVHGGPWARDCWYYQPEVQLLANRGYAVLQ

SEQ ID NO: 694548 - protein, 18 aa, Mycobacterium
LPNADCWCEAPLTELITE

SEQ ID NO: 694549 - protein, 22 aa, Mycobacterium
LPNAHWLYEFGDPRRLASTEAL

SEQ ID NO: 694550 - protein, 19 aa, Mycobacterium
LPNAIGLRAPLACLSEARY

SEQ ID NO: 694551 - protein, 17 aa, Mycobacterium
LPNAKFGERVLAEVRRR

SEQ ID NO: 694552 - protein, 21 aa, Mycobacterium
LPNARLDVWYEDGVTAGAPGA

SEQ ID NO: 694553 - protein, 20 aa, Mycobacterium
LPNERAMNFLGEPRVVIGPL

SEQ ID NO: 694554 - protein, 21 aa, Mycobacterium
LPNERWRFIITAHHIVIDGWS

SEQ ID NO: 694555 - protein, 17 aa, Mycobacterium
LPNEVFVAVNISPSAVL

SEQ ID NO: 694556 - protein, 26 aa, Mycobacterium
LPNEVPRGVCGHLSYTEIIGAAVIAD

SEQ ID NO: 694557 - protein, 18 aa, Mycobacterium
LPNGHGLNADKLTYGDLI

SEQ ID NO: 694558 - protein, 26 aa, Mycobacterium
LPNGRPHLVAMWYAILDGEIWFETKA

SEQ ID NO: 694559 - protein, 17 aa, Mycobacterium
LPNIPGLEDLDLSGIPK

SEQ ID NO: 694560 - protein, 21 aa, Mycobacterium
LPNLATWGWGPDDLREALAKL

SEQ ID NO: 694561 - protein, 26 aa, Mycobacterium
LPNLPVACAVWEPEPSWSTSTEAWLM

SEQ ID NO: 694562 - protein, 18 aa, Mycobacterium
LPNLRALNVVVHGLLGDG

SEQ ID NO: 694563 - protein, 19 aa, Mycobacterium
LPNLRALNVVVHGLLGEGV

SEQ ID NO: 694564 - protein, 20 aa, Mycobacterium
LPNMRTVVHCLPPRDWTEPG

SEQ ID NO: 694565 - protein, 24 aa, Mycobacterium
LPNPDRGDLFFDFEGDPLWTDDGV

SEQ ID NO: 694566 - protein, 20 aa, Mycobacterium
LPNPLARWVADAANRRTAAS

SEQ ID NO: 694567 - protein, 26 aa, Mycobacterium
LPNRLRKVANHWRLRRSGNATIVELT

SEQ ID NO: 694568 - protein, 21 aa, Mycobacterium
LPNSCRFAVALFGLLRAGAIP

SEQ ID NO: 694569 - protein, 18 aa, Mycobacterium
LPNTGARFLAGDLAPTMI

SEQ ID NO: 694570 - protein, 25 aa, Mycobacterium
LPNVNEFFGALGITAAGLGPLGLAL

SEQ ID NO: 694571 - protein, 21 aa, Mycobacterium
LPNYRNSWLRQGFDESDLVRG

SEQ ID NO: 694572 - protein, 18 aa, Mycobacterium
LPPADLWSYSPADQQSIL

SEQ ID NO: 694573 - protein, 21 aa, Mycobacterium
LPPADVVVCSLTLHHHAGENA

SEQ ID NO: 694574 - protein, 19 aa, Mycobacterium
LPPAGKWPREIVCVDPKAI

SEQ ID NO: 694575 - protein, 19 aa, Mycobacterium
LPPAGSYGDYCIRQHEFLS

SEQ ID NO: 694576 - protein, 20 aa, Mycobacterium
LPPAIAGAWHTRGYYGSVSH

SEQ ID NO: 694577 - protein, 17 aa, Mycobacterium
LPPAIVVTGECDPIRDW

SEQ ID NO: 694578 - protein, 25 aa, Mycobacterium
LPPALRVALTPGWMALRPLAGRVVK

SEQ ID NO: 694579 - protein, 24 aa, Mycobacterium
LPPAPAEALFRWLGTKDGQNKVMN

SEQ ID NO: 694580 - protein, 18 aa, Mycobacterium
LPPARIMTVDDLHRAAAA

SEQ ID NO: 694581 - protein, 18 aa, Mycobacterium
LPPASMFVNLELEDDAYA

SEQ ID NO: 694582 - protein, 22 aa, Mycobacterium
LPPATYFAGGKIQWILENVPGV

SEQ ID NO: 694583 - protein, 22 aa, Mycobacterium
LPPATYFSGAKLQWILENVDGV

SEQ ID NO: 694584 - protein, 22 aa, Mycobacterium
LPPATYFSGGKLQWILDNVDGV

SEQ ID NO: 694585 - protein, 22 aa, Mycobacterium
LPPATYFSGGKLQWILENVEGV

SEQ ID NO: 694586 - protein, 22 aa, Mycobacterium
LPPATYFSGGKLQWLLENVDGL

SEQ ID NO: 694587 - protein, 17 aa, Mycobacterium
LPPAVAEYAARRPALVQ

SEQ ID NO: 694588 - protein, 18 aa, Mycobacterium
LPPAVIVTAGLDPLHNEG

SEQ ID NO: 694589 - protein, 20 aa, Mycobacterium
LPPAWIGVGTLDLFYEECLQ

SEQ ID NO: 694590 - protein, 21 aa, Mycobacterium
LPPAWIGVGTLDLFYSESLEY

SEQ ID NO: 694591 - protein, 21 aa, Mycobacterium
LPPCQPKNVMFMYCTNSQDEI

SEQ ID NO: 694592 - protein, 21 aa, Mycobacterium
LPPCRPPPRREIVEGVAGGGD

SEQ ID NO: 694593 - protein, 17 aa, Mycobacterium
LPPDFVDSGAVQRGDTI

SEQ ID NO: 694594 - protein, 20 aa, Mycobacterium
LPPDLPIGYHRLHLQIGSQD

SEQ ID NO: 694595 - protein, 24 aa, Mycobacterium
LPPDVPFRRIVDWAEAHRAAEREA

SEQ ID NO: 694596 - protein, 17 aa, Mycobacterium
LPPEGASAIVFRDTAHA

SEQ ID NO: 694597 - protein, 21 aa, Mycobacterium
LPPEGASAIVFRDTTHAAELA

SEQ ID NO: 694598 - protein, 17 aa, Mycobacterium
LPPEGASAIVFRDVDHA

SEQ ID NO: 694599 - protein, 23 aa, Mycobacterium
LPPEGLDSVALVVAGEACPAELV

SEQ ID NO: 694600 - protein, 22 aa, Mycobacterium
LPPEHRDAFRVPLTEVDEPGSY

SEQ ID NO: 694601 - protein, 24 aa, Mycobacterium
LPPEINSALMFAGPGAGPLLAAAG

SEQ ID NO: 694602 - protein, 19 aa, Mycobacterium
LPPEINSARIFSGAGSGPL

SEQ ID NO: 694603 - protein, 18 aa, Mycobacterium
LPPELDFASLFHGVDERV

SEQ ID NO: 694604 - protein, 27 aa, Mycobacterium
LPPEQRLAFVLHDAFAVPFDQIAPLVG

SEQ ID NO: 694605 - protein, 31 aa, Mycobacterium
LPPERARLGFGTVDARGWTEGRLREAMDAAA

SEQ ID NO: 694606 - protein, 21 aa, Mycobacterium
LPPERFTRFETWLTKSMGDRR

SEQ ID NO: 694607 - protein, 20 aa, Mycobacterium
LPPERLPSRLARLTPNTITS

SEQ ID NO: 694608 - protein, 17 aa, Mycobacterium
LPPEVHSTLLSTGPGPS

SEQ ID NO: 694609 - protein, 22 aa, Mycobacterium
LPPEVLAILCAHLDALEPVEVR

SEQ ID NO: 694610 - protein, 17 aa, Mycobacterium
LPPGEFAAFPVGDFFEP

SEQ ID NO: 694611 - protein, 18 aa, Mycobacterium
LPPGEFDSYVGWSIARIG

SEQ ID NO: 694612 - protein, 18 aa, Mycobacterium
LPPGELVLASAPLLEGKL

SEQ ID NO: 694613 - protein, 17 aa, Mycobacterium
LPPGGLLLLYTDGLIER

SEQ ID NO: 694614 - protein, 17 aa, Mycobacterium
LPPGKVGEICFKSKIAR

SEQ ID NO: 694615 - protein, 17 aa, Mycobacterium
LPPGPAFYPDGELTDEP

SEQ ID NO: 694616 - protein, 17 aa, Mycobacterium
LPPGPPGAMKVGGDDGY

SEQ ID NO: 694617 - protein, 19 aa, Mycobacterium
LPPGSEVSDMFSGRHLATV

SEQ ID NO: 694618 - protein, 17 aa, Mycobacterium
LPPGVLNLVIGGVDIGD

SEQ ID NO: 694619 - protein, 19 aa, Mycobacterium
LPPHAGHVYLCEFAHRWVD

SEQ ID NO: 694620 - protein, 24 aa, Mycobacterium
LPPHELEFFFFVLAFAGSDTTKNA

SEQ ID NO: 694621 - protein, 18 aa, Mycobacterium
LPPHHDMGLISMILGTVS

SEQ ID NO: 694622 - protein, 19 aa, Mycobacterium
LPPHLEWTAPFGALSAANW

SEQ ID NO: 694623 - protein, 25 aa, Mycobacterium
LPPHYHTGIVIGHTVSGAWRYQENN

SEQ ID NO: 694624 - protein, 18 aa, Mycobacterium
LPPIDLPRRMFAGGEIEL

SEQ ID NO: 694625 - protein, 17 aa, Mycobacterium
LPPIFSALISTRPQAAM

SEQ ID NO: 694626 - protein, 25 aa, Mycobacterium
LPPIPEFYGGAVIFDGADAASVLHA

SEQ ID NO: 694627 - protein, 18 aa, Mycobacterium
LPPLAGIVHAAGEMGTTP

SEQ ID NO: 694628 - protein, 27 aa, Mycobacterium
LPPLMHGAAQWAVFTAMNTGQSVVFSP

SEQ ID NO: 694629 - protein, 26 aa, Mycobacterium
LPPLPGDLRARLDAALAKPAAQQPSW

SEQ ID NO: 694630 - protein, 19 aa, Mycobacterium
LPPLQGLHTHSFRWDHAIA

SEQ ID NO: 694631 - protein, 19 aa, Mycobacterium
LPPLRTGQRQIISLHPDIE

SEQ ID NO: 694632 - protein, 25 aa, Mycobacterium
LPPLSSGLVGFFAYDLVRRLERLPE

SEQ ID NO: 694633 - protein, 25 aa, Mycobacterium
LPPLYAEHWEPFWAACAEAGLVVNH

SEQ ID NO: 694634 - protein, 25 aa, Mycobacterium
LPPMPACAVAACTRPADSARGYCNT

SEQ ID NO: 694635 - protein, 23 aa, Mycobacterium
LPPMPIGGPPPVPPEPPPAPPEP

SEQ ID NO: 694636 - protein, 17 aa, Mycobacterium
LPPNIIEHWYAGGPALA

SEQ ID NO: 694637 - protein, 17 aa, Mycobacterium
LPPPAALTGEWFGALAV

SEQ ID NO: 694638 - protein, 19 aa, Mycobacterium
LPPPASQVWRSRRRIREDL

SEQ ID NO: 694639 - protein, 20 aa, Mycobacterium
LPPPCTTGFLPAQQRRPPSF

SEQ ID NO: 694640 - protein, 22 aa, Mycobacterium
LPPPGPRQLAAILQRPKGSSRD

SEQ ID NO: 694641 - protein, 18 aa, Mycobacterium
LPPPGPRQLLALIKGPPP

SEQ ID NO: 694642 - protein, 23 aa, Mycobacterium
LPPPLHGLHGIEFAGGYRASKDY

SEQ ID NO: 694643 - protein, 18 aa, Mycobacterium
LPPPRQGIYTALRAQAKV

SEQ ID NO: 694644 - protein, 19 aa, Mycobacterium
LPPQLIPSGITSIRVSAEV

SEQ ID NO: 694645 - protein, 20 aa, Mycobacterium
LPPRDIVHIWTVDRHLVETV

SEQ ID NO: 694646 - protein, 18 aa, Mycobacterium
LPPRDVVHIWTVDRHLVE

SEQ ID NO: 694647 - protein, 18 aa, Mycobacterium
LPPRHRSLYDKRLQRERQ

SEQ ID NO: 694648 - protein, 27 aa, Mycobacterium
LPPRLRKVANCWTLRPSGPAGAATVVS

SEQ ID NO: 694649 - protein, 23 aa, Mycobacterium
LPPRLRRDLGPFSPWGRVARYRR

SEQ ID NO: 694650 - protein, 22 aa, Mycobacterium
LPPRQRAALMTAFGLEDGPPPD

SEQ ID NO: 694651 - protein, 24 aa, Mycobacterium
LPPRTRLPALRQVWTAERLAGATA

SEQ ID NO: 694652 - protein, 26 aa, Mycobacterium
LPPSAFAFLVGRGVRASLRYRVPPMP

SEQ ID NO: 694653 - protein, 17 aa, Mycobacterium
LPPSALWGRENYFRGLL

SEQ ID NO: 694654 - protein, 21 aa, Mycobacterium
LPPTAGTLIRLFHAETTELEV

SEQ ID NO: 694655 - protein, 19 aa, Mycobacterium
LPPVDAFWSVTMYDAEGFQ

SEQ ID NO: 694656 - protein, 18 aa, Mycobacterium
LPPVPVVLPKPVRQLQQT

SEQ ID NO: 694657 - protein, 21 aa, Mycobacterium
LPPVRELAARLGVNTNTAAAA

SEQ ID NO: 694658 - protein, 17 aa, Mycobacterium
LPPVRYGAASLIVVNKL

SEQ ID NO: 694659 - protein, 17 aa, Mycobacterium
LPPYPGWPDQIDDGDPD

SEQ ID NO: 694660 - protein, 30 aa, Mycobacterium
LPQAELAQQTWFRLSALAERVSATVRIAGE

SEQ ID NO: 694661 - protein, 23 aa, Mycobacterium
LPQALRRSLTWDQGHEMLRHARI

SEQ ID NO: 694662 - protein, 21 aa, Mycobacterium
LPQANSALEFDRTAAHGHRLD

SEQ ID NO: 694663 - protein, 19 aa, Mycobacterium
LPQARRVLTDALADHLLNE

SEQ ID NO: 694664 - protein, 18 aa, Mycobacterium
LPQELAHLCDLMGDVDVV

SEQ ID NO: 694665 - protein, 17 aa, Mycobacterium
LPQEVVYLYNGPGGTSF

SEQ ID NO: 694666 - protein, 25 aa, Mycobacterium
LPQGRSSERWIDWNLHGHQVVTHLA

SEQ ID NO: 694667 - protein, 17 aa, Mycobacterium
LPQHGAMPYRSISKGWR

SEQ ID NO: 694668 - protein, 18 aa, Mycobacterium
LPQHHDMGLISAYMFILL

SEQ ID NO: 694669 - protein, 21 aa, Mycobacterium
LPQHLMAAFSDLLAGNISGAV

SEQ ID NO: 694670 - protein, 18 aa, Mycobacterium
LPQILELFVEGYADRPAV

SEQ ID NO: 694671 - protein, 19 aa, Mycobacterium
LPQIPVRLHARSWHRYPEP

SEQ ID NO: 694672 - protein, 19 aa, Mycobacterium
LPQKERLLIEQRLRRSMKG

SEQ ID NO: 694673 - protein, 19 aa, Mycobacterium
LPQKGLDSITVFVGGEACP

SEQ ID NO: 694674 - protein, 24 aa, Mycobacterium
LPQKLREAVKLTVYVGRKERVDGT

SEQ ID NO: 694675 - protein, 21 aa, Mycobacterium
LPQKVGVGMARRMSLTGDYLS

SEQ ID NO: 694676 - protein, 23 aa, Mycobacterium
LPQKVGVGMARRMSMTGDYLSAD

SEQ ID NO: 694677 - protein, 18 aa, Mycobacterium
LPQLAKRFYAQAVEERNH

SEQ ID NO: 694678 - protein, 29 aa, Mycobacterium
LPQLLRSCGRPYPWVQIRVVDPTGRDVAP

SEQ ID NO: 694679 - protein, 18 aa, Mycobacterium
LPQLRVLIQIADDSGNDL

SEQ ID NO: 694680 - protein, 18 aa, Mycobacterium
LPQLRVLIQIADDSGNEL

SEQ ID NO: 694681 - protein, 20 aa, Mycobacterium
LPQPGGWNRFQVRVDDLAAV

SEQ ID NO: 694682 - protein, 18 aa, Mycobacterium
LPQPPAHRQRQRSVHPQP

SEQ ID NO: 694683 - protein, 25 aa, Mycobacterium
LPQPQAPNPESWLLVGISETADRLT

SEQ ID NO: 694684 - protein, 20 aa, Mycobacterium
LPQQCLRSDRLSALHQWGLP

SEQ ID NO: 694685 - protein, 20 aa, Mycobacterium
LPQQCLRSDRLSALQQWGLP

SEQ ID NO: 694686 - protein, 18 aa, Mycobacterium
LPQQCLRSDRMSALNQWG

SEQ ID NO: 694687 - protein, 18 aa, Mycobacterium
LPQRAVIVDLCTGSGALA

SEQ ID NO: 694688 - protein, 20 aa, Mycobacterium
LPQRFEVLDHDIAVVGVPFD

SEQ ID NO: 694689 - protein, 27 aa, Mycobacterium
LPQRGRSLIGAWCFIDHYGPVAARMDV

SEQ ID NO: 694690 - protein, 18 aa, Mycobacterium
LPQRLSLFGHTRLPATEV

SEQ ID NO: 694691 - protein, 19 aa, Mycobacterium
LPQRPDPHALLGTTFHEWV

SEQ ID NO: 694692 - protein, 20 aa, Mycobacterium
LPQRRPRRILFVSGGSGITP

SEQ ID NO: 694693 - protein, 20 aa, Mycobacterium
LPQRTVVRFAPGGGDAITVS

SEQ ID NO: 694694 - protein, 17 aa, Mycobacterium
LPQRVARRVSQLHAGAR

SEQ ID NO: 694695 - protein, 24 aa, Mycobacterium
LPQRWIDFLHRWDPARWPRANPRA

SEQ ID NO: 694696 - protein, 20 aa, Mycobacterium
LPQSRRPAGDDVRTAAPEGL

SEQ ID NO: 694697 - protein, 18 aa, Mycobacterium
LPQTILMYPMTVASQIAQ

SEQ ID NO: 694698 - protein, 19 aa, Mycobacterium
LPQTVTLAFTSYAGLDVGR

SEQ ID NO: 694699 - protein, 18 aa, Mycobacterium
LPQTYALLGRTPRRAVRL

SEQ ID NO: 694700 - protein, 25 aa, Mycobacterium
LPQVDAKILWLFKRAVPATYTRALG

SEQ ID NO: 694701 - protein, 17 aa, Mycobacterium
LPQVFGWARSVDPCQPL

SEQ ID NO: 694702 - protein, 24 aa, Mycobacterium
LPQWRMPELDPKAALARTSTIRLQ

SEQ ID NO: 694703 - protein, 18 aa, Mycobacterium
LPQYGVVAVTGYEEATAV

SEQ ID NO: 694704 - protein, 17 aa, Mycobacterium
LPQYLAESRGLGCSICF

SEQ ID NO: 694705 - protein, 22 aa, Mycobacterium
LPRAELFASSVDRLYDIVTASR

SEQ ID NO: 694706 - protein, 19 aa, Mycobacterium
LPRALARVAEFGGVVVDGT

SEQ ID NO: 694707 - protein, 29 aa, Mycobacterium
LPRARLRLRQVDHLKCVRTTEFIYTNSFH

SEQ ID NO: 694708 - protein, 19 aa, Mycobacterium
LPRARVGFAGVARNEETHQ

SEQ ID NO: 694709 - protein, 25 aa, Mycobacterium
LPRCGSCPACGTDGLTPCGPGSVAN

SEQ ID NO: 694710 - protein, 25 aa, Mycobacterium
LPRDFPRPALGSFRGGRVRIALTEA

SEQ ID NO: 694711 - protein, 21 aa, Mycobacterium
LPRDRRPRVLAVDSVPDSVGA

SEQ ID NO: 694712 - protein, 22 aa, Mycobacterium
LPREALNLIRMISEPGLNGIEV

SEQ ID NO: 694713 - protein, 17 aa, Mycobacterium
LPREALNLVKMISEPGL

SEQ ID NO: 694714 - protein, 25 aa, Mycobacterium
LPREFAAKIGIVLREEVARLTKSGF

SEQ ID NO: 694715 - protein, 20 aa, Mycobacterium
LPREGDADFSFLPRFGPGKG

SEQ ID NO: 694716 - protein, 17 aa, Mycobacterium
LPRELVGEGSLFLLKVV

SEQ ID NO: 694717 - protein, 17 aa, Mycobacterium
LPRFASAALALSVVPGS

SEQ ID NO: 694718 - protein, 20 aa, Mycobacterium
LPRFDGMRPVLGAWIVGDES

SEQ ID NO: 694719 - protein, 25 aa, Mycobacterium
LPRFIQKRLDGIALLITTGFLPQRF

SEQ ID NO: 694720 - protein, 20 aa, Mycobacterium
LPRFSRPDCSAPTFCTPELP

SEQ ID NO: 694721 - protein, 23 aa, Mycobacterium
LPRGCIAAGDRAFFCDYVLEYLA

SEQ ID NO: 694722 - protein, 21 aa, Mycobacterium
LPRGEARGVTYVEPVLVGEVR

SEQ ID NO: 694723 - protein, 17 aa, Mycobacterium
LPRGGLPETERWFARVH

SEQ ID NO: 694724 - protein, 17 aa, Mycobacterium
LPRGLAEHIMAQVEQPA

SEQ ID NO: 694725 - protein, 18 aa, Mycobacterium
LPRGQGWQLRQQIIDTAM

SEQ ID NO: 694726 - protein, 23 aa, Mycobacterium
LPRGRTRPLWWTLRRPHRPLTYH

SEQ ID NO: 694727 - protein, 23 aa, Mycobacterium
LPRIAGSCGMVIFGVTGDLARKK

SEQ ID NO: 694728 - protein, 25 aa, Mycobacterium
LPRIARMGFDVVYLPPIHPIGKVHR

SEQ ID NO: 694729 - protein, 26 aa, Mycobacterium
LPRIGRQFYDIWALLGHDLVTELLAD

SEQ ID NO: 694730 - protein, 18 aa, Mycobacterium
LPRIGWPRYIRLSENLPT

SEQ ID NO: 694731 - protein, 17 aa, Mycobacterium
LPRIHWAVASLRTEQRW

SEQ ID NO: 694732 - protein, 21 aa, Mycobacterium
LPRIRCRGGIAARCTAADTVF

SEQ ID NO: 694733 - protein, 23 aa, Mycobacterium
LPRKECPAPEPIPGAVSLKLPLR

SEQ ID NO: 694734 - protein, 19 aa, Mycobacterium
LPRKFKTAISGLQDVVHEI

SEQ ID NO: 694735 - protein, 30 aa, Mycobacterium
LPRKLSADLLRLPMRVRRAVRETRAVFEAV

SEQ ID NO: 694736 - protein, 20 aa, Mycobacterium
LPRLHAFNIVMRGALGGGAT

SEQ ID NO: 694737 - protein, 27 aa, Mycobacterium
LPRLKPKCFYDLVVEVALIRPGPIQGG

SEQ ID NO: 694738 - protein, 26 aa, Mycobacterium
LPRLKPRMFYDLVVEVALIRPGPIQG

SEQ ID NO: 694739 - protein, 22 aa, Mycobacterium
LPRLSSFSIAGWLRGKSRTQAV

SEQ ID NO: 694740 - protein, 26 aa, Mycobacterium
LPRMASGEMRATMALTEPGGGSDLQA

SEQ ID NO: 694741 - protein, 17 aa, Mycobacterium
LPRMPKGAVLAFDELNQ

SEQ ID NO: 694742 - protein, 17 aa, Mycobacterium
LPRPCAIAGRRMSATLA

SEQ ID NO: 694743 - protein, 19 aa, Mycobacterium
LPRPITVDLFRGLAELEDT

SEQ ID NO: 694744 - protein, 20 aa, Mycobacterium
LPRPLRPLRNAGIRLAAGVP

SEQ ID NO: 694745 - protein, 21 aa, Mycobacterium
LPRPWAPDDERIMLQDCLDEV

SEQ ID NO: 694746 - protein, 19 aa, Mycobacterium
LPRQGDIAVRVCAHGETST

SEQ ID NO: 694747 - protein, 24 aa, Mycobacterium
LPRQIPYTVACDLLLTGRHITAAQ

SEQ ID NO: 694748 - protein, 20 aa, Mycobacterium
LPRQPGRVIAIASADTPLKG

SEQ ID NO: 694749 - protein, 24 aa, Mycobacterium
LPRRGDTSQIMWFEADPTYVLHFP

SEQ ID NO: 694750 - protein, 20 aa, Mycobacterium
LPRRLGASMHQRLDLLSEGA

SEQ ID NO: 694751 - protein, 22 aa, Mycobacterium
LPRRTPGRRSPLWQQRQRAAQL

SEQ ID NO: 694752 - protein, 23 aa, Mycobacterium
LPRSEARGVTYVRPELVGEVRYS

SEQ ID NO: 694753 - protein, 19 aa, Mycobacterium
LPRSRRIGADRVVQMAPTV

SEQ ID NO: 694754 - protein, 27 aa, Mycobacterium
LPRTAKLPADFRVVIIGAGIAGITAAL

SEQ ID NO: 694755 - protein, 30 aa, Mycobacterium
LPRTAKLPPDFKVVIIGAGIAGMAAALELA

SEQ ID NO: 694756 - protein, 21 aa, Mycobacterium
LPRTGEAIAAILAVLKTGAAY

SEQ ID NO: 694757 - protein, 26 aa, Mycobacterium
LPRTIEIEAGFFWCMPGDADVAPLNP

SEQ ID NO: 694758 - protein, 18 aa, Mycobacterium
LPRTMTFKVLKRQLSADG

SEQ ID NO: 694759 - protein, 23 aa, Mycobacterium
LPRTRPFRVSYGITTRGVVDDVI

SEQ ID NO: 694760 - protein, 20 aa, Mycobacterium
LPRTYELLGRTPRRPRPWRA

SEQ ID NO: 694761 - protein, 25 aa, Mycobacterium
LPRVARMNFDIVYLPPIHPIGKVHR

SEQ ID NO: 694762 - protein, 24 aa, Mycobacterium
LPRVATGEVHVCFGVTEPGAGLDT

SEQ ID NO: 694763 - protein, 23 aa, Mycobacterium
LPRVVSAPVELTASPALGALPLA

SEQ ID NO: 694764 - protein, 26 aa, Mycobacterium
LPRVYSGHVRLCLGYTEPEGGSDVAT

SEQ ID NO: 694765 - protein, 17 aa, Mycobacterium
LPRWSMIDKALGLDSPD

SEQ ID NO: 694766 - protein, 18 aa, Mycobacterium
LPRWSMIDKALGLDTPDP

SEQ ID NO: 694767 - protein, 17 aa, Mycobacterium
LPRWTMIDKALGLGSPD

SEQ ID NO: 694768 - protein, 18 aa, Mycobacterium
LPSALASRLRITRAEASR

SEQ ID NO: 694769 - protein, 24 aa, Mycobacterium
LPSARRLLLFKADGSVSVHADDRA

SEQ ID NO: 694770 - protein, 19 aa, Mycobacterium
LPSAVTVWTTGFGVPGLAA

SEQ ID NO: 694771 - protein, 18 aa, Mycobacterium
LPSAVWAPYGLAGVLERE

SEQ ID NO: 694772 - protein, 17 aa, Mycobacterium
LPSCVPYDPASPDDLSE

SEQ ID NO: 694773 - protein, 17 aa, Mycobacterium
LPSCVPYDPATPDDLSE

SEQ ID NO: 694774 - protein, 20 aa, Mycobacterium
LPSDDPRIWPNLVAGQLDWD

SEQ ID NO: 694775 - protein, 29 aa, Mycobacterium
LPSDIVIELEVPRRQLALAGVSPIDRLRP

SEQ ID NO: 694776 - protein, 26 aa, Mycobacterium
LPSDLAPGWYRLHLRDGQQATLVAAP

SEQ ID NO: 694777 - protein, 34 aa, Mycobacterium
LPSDRLLNLLHYVKWYLDGTLTFRRSCAHGVCGS

SEQ ID NO: 694778 - protein, 18 aa, Mycobacterium
LPSEAEWEVAARGGLTGA

SEQ ID NO: 694779 - protein, 22 aa, Mycobacterium
LPSEFFFEIAQWANGDSQAVAA

SEQ ID NO: 694780 - protein, 30 aa, Mycobacterium
LPSEITFRRWCAALSTRWCNMRVQLEGSHG

SEQ ID NO: 694781 - protein, 19 aa, Mycobacterium
LPSERELIDSSGLSRVTVR

SEQ ID NO: 694782 - protein, 17 aa, Mycobacterium
LPSERRLAELVGSSRPT

SEQ ID NO: 694783 - protein, 17 aa, Mycobacterium
LPSERRLAEVLGVSRPV

SEQ ID NO: 694784 - protein, 19 aa, Mycobacterium
LPSFAGRTIIITGANAGLG

SEQ ID NO: 694785 - protein, 18 aa, Mycobacterium
LPSFAGRTVIVTGANSGL

SEQ ID NO: 694786 - protein, 19 aa, Mycobacterium
LPSFAGRTVIVTGANSGLG

SEQ ID NO: 694787 - protein, 20 aa, Mycobacterium
LPSFEELFAHRALPAVALSG

SEQ ID NO: 694788 - protein, 29 aa, Mycobacterium
LPSFKIDFEDYWAFLAFAVAKGGPRLFEG

SEQ ID NO: 694789 - protein, 18 aa, Mycobacterium
LPSFPALLKKQLKGAPMP

SEQ ID NO: 694790 - protein, 19 aa, Mycobacterium
LPSFRGRTVVITGANSGLG

SEQ ID NO: 694791 - protein, 18 aa, Mycobacterium
LPSFTGRTVIVTGANSGL

SEQ ID NO: 694792 - protein, 19 aa, Mycobacterium
LPSGAKFGSLVHAVLETSD

SEQ ID NO: 694793 - protein, 17 aa, Mycobacterium
LPSGGRVRYRKIRDGSE

SEQ ID NO: 694794 - protein, 17 aa, Mycobacterium
LPSGKFTSGPHVDAFED

SEQ ID NO: 694795 - protein, 17 aa, Mycobacterium
LPSGSWFPDQPLTRDFD

SEQ ID NO: 694796 - protein, 22 aa, Mycobacterium
LPSGTATLWAWLGTNATPAMDA

SEQ ID NO: 694797 - protein, 25 aa, Mycobacterium
LPSGTLWALDLIEVPSRLRPAMTAM

SEQ ID NO: 694798 - protein, 20 aa, Mycobacterium
LPSHGCEMEGWFWRLTDSAS

SEQ ID NO: 694799 - protein, 22 aa, Mycobacterium
LPSKRRYEVFRALDNERLADIL

SEQ ID NO: 694800 - protein, 18 aa, Mycobacterium
LPSLCGRDPKLLGVGGIA

SEQ ID NO: 694801 - protein, 26 aa, Mycobacterium
LPSLLRRLVIMGGSYDHRGNTTAVAE

SEQ ID NO: 694802 - protein, 24 aa, Mycobacterium
LPSLRMRTTLGIAHWQLEGRIDGR

SEQ ID NO: 694803 - protein, 17 aa, Mycobacterium
LPSLRRGGVAAVSPIGV

SEQ ID NO: 694804 - protein, 18 aa, Mycobacterium
LPSMLLGLASPISSALNA

SEQ ID NO: 694805 - protein, 17 aa, Mycobacterium
LPSMLLPLWDSDLGTGF

SEQ ID NO: 694806 - protein, 25 aa, Mycobacterium
LPSMMRYQVPMWPERALTRHNGAEL

SEQ ID NO: 694807 - protein, 19 aa, Mycobacterium
LPSNESITNLWNGQVAQSG

SEQ ID NO: 694808 - protein, 21 aa, Mycobacterium
LPSNRLAQVSVRVRELCEKYD

SEQ ID NO: 694809 - protein, 18 aa, Mycobacterium
LPSNRYAEIAVRVREVCD

SEQ ID NO: 694810 - protein, 17 aa, Mycobacterium
LPSPIRGACVLLVDGLG

SEQ ID NO: 694811 - protein, 19 aa, Mycobacterium
LPSPLPYLLGELPAGSSAH

SEQ ID NO: 694812 - protein, 17 aa, Mycobacterium
LPSRGVGVIELRGESVT

SEQ ID NO: 694813 - protein, 22 aa, Mycobacterium
LPSRLRRVANRWTLATAGEAGL

SEQ ID NO: 694814 - protein, 17 aa, Mycobacterium
LPSRPHLEWQLRRRVLA

SEQ ID NO: 694815 - protein, 17 aa, Mycobacterium
LPSRPHLEWQLRSRVRA

SEQ ID NO: 694816 - protein, 19 aa, Mycobacterium
LPSRPSHWRKNLLACTGIE

SEQ ID NO: 694817 - protein, 20 aa, Mycobacterium
LPSRTRWTLSNLHGLGAALY

SEQ ID NO: 694818 - protein, 18 aa, Mycobacterium
LPSSDPFTTVAVLRTMAE

SEQ ID NO: 694819 - protein, 17 aa, Mycobacterium
LPSSDPRRADFHVETQL

SEQ ID NO: 694820 - protein, 19 aa, Mycobacterium
LPSSGGVVLTGRLSPSLQG

SEQ ID NO: 694821 - protein, 23 aa, Mycobacterium
LPSTPRRPLAEIVEWMSDREQCG

SEQ ID NO: 694822 - protein, 20 aa, Mycobacterium
LPSVIGARLISAGTIPRLVE

SEQ ID NO: 694823 - protein, 20 aa, Mycobacterium
LPSVLERRGYVLIVSSLAAY

SEQ ID NO: 694824 - protein, 18 aa, Mycobacterium
LPSVRRDLEDLVRIDSVW

SEQ ID NO: 694825 - protein, 23 aa, Mycobacterium
LPSVRSASVGLWIGVGSRDEGVT

SEQ ID NO: 694826 - protein, 17 aa, Mycobacterium
LPSYIYRSVDPVVAEML

SEQ ID NO: 694827 - protein, 19 aa, Mycobacterium
LPSYLHWYGLAMRGPVLRG

SEQ ID NO: 694828 - protein, 27 aa, Mycobacterium
LPSYPHPRLMPDFWQFPTVSMGLGPMN

SEQ ID NO: 694829 - protein, 27 aa, Mycobacterium
LPTAAPRWVVDPDFNLDFHVRRVRVSE

SEQ ID NO: 694830 - protein, 26 aa, Mycobacterium
LPTAAPRWVVDPDFNLDYHVRRVRVP

SEQ ID NO: 694831 - protein, 28 aa, Mycobacterium
LPTACCFENRWNPDWLAVADKVRSGFLG

SEQ ID NO: 694832 - protein, 20 aa, Mycobacterium
LPTAGCARHSSGLSVQTFLR

SEQ ID NO: 694833 - protein, 21 aa, Mycobacterium
LPTAGLPFHFQAWEQFEGFVD

SEQ ID NO: 694834 - protein, 26 aa, Mycobacterium
LPTALRPALFPLWLAIRPIAGRVIQV

SEQ ID NO: 694835 - protein, 19 aa, Mycobacterium
LPTAPALLGNTVVWKPSVT

SEQ ID NO: 694836 - protein, 21 aa, Mycobacterium
LPTAWLAEGLLMYLPAEAQDR

SEQ ID NO: 694837 - protein, 20 aa, Mycobacterium
LPTDAALAWASSPCTDLSLA

SEQ ID NO: 694838 - protein, 17 aa, Mycobacterium
LPTDAFKATVDRFNGFA

SEQ ID NO: 694839 - protein, 18 aa, Mycobacterium
LPTDFPAPSVASFSGARF

SEQ ID NO: 694840 - protein, 19 aa, Mycobacterium
LPTEAEWEFAAGAGSTAVY

SEQ ID NO: 694841 - protein, 19 aa, Mycobacterium
LPTEERFGALDALVRQDQR

SEQ ID NO: 694842 - protein, 31 aa, Mycobacterium
LPTEGGVRLSGRWSWATGVMHANWIMVGALC

SEQ ID NO: 694843 - protein, 17 aa, Mycobacterium
LPTFLRVVGDLRELLEV

SEQ ID NO: 694844 - protein, 17 aa, Mycobacterium
LPTGAAFGSLVHAVLET

SEQ ID NO: 694845 - protein, 22 aa, Mycobacterium
LPTGDFSGWIDPPGLAGTPAAP

SEQ ID NO: 694846 - protein, 25 aa, Mycobacterium
LPTGGTSFARWAAILSEHARSPAVV

SEQ ID NO: 694847 - protein, 17 aa, Mycobacterium
LPTGSGVRSILESECRS

SEQ ID NO: 694848 - protein, 22 aa, Mycobacterium
LPTHIMQIVTWLAQSPQLLAVA

SEQ ID NO: 694849 - protein, 17 aa, Mycobacterium
LPTHVLNVLHLLLPAGE

SEQ ID NO: 694850 - protein, 17 aa, Mycobacterium
LPTKVVQAFQVFLQNNA

SEQ ID NO: 694851 - protein, 17 aa, Mycobacterium
LPTLAICRGLQVLNVAL

SEQ ID NO: 694852 - protein, 17 aa, Mycobacterium
LPTLGELDLHLFAEGRH

SEQ ID NO: 694853 - protein, 17 aa, Mycobacterium
LPTLGEVDLHLFAEGRH

SEQ ID NO: 694854 - protein, 20 aa, Mycobacterium
LPTLLAAPYFRDAVEAGIDS

SEQ ID NO: 694855 - protein, 17 aa, Mycobacterium
LPTLLDWLSDTPDPDAG

SEQ ID NO: 694856 - protein, 20 aa, Mycobacterium
LPTMEKAGLIQRGQQVSVRE

SEQ ID NO: 694857 - protein, 47 aa, Mycobacterium
LPTNFPGPRPAFGTPSYFAQLAFAVLHVLALPITVPVQAIIGKTEGV

SEQ ID NO: 694858 - protein, 18 aa, Mycobacterium
LPTPALRDAGVEHPPACT

SEQ ID NO: 694859 - protein, 25 aa, Mycobacterium
LPTPSYRRNLEWTVEHLHTLLAVRC

SEQ ID NO: 694860 - protein, 24 aa, Mycobacterium
LPTQLCAFAAGVLRAEAAHEPGHY

SEQ ID NO: 694861 - protein, 24 aa, Mycobacterium
LPTQLCAFAAGVLRAEAAHEPGYY

SEQ ID NO: 694862 - protein, 24 aa, Mycobacterium
LPTQLCAFAAGVLRAEASHEPGHY

SEQ ID NO: 694863 - protein, 24 aa, Mycobacterium
LPTQLCAFTAGVLRAEATHEPGYY

SEQ ID NO: 694864 - protein, 24 aa, Mycobacterium
LPTQLCAFTAGVLRAEAVHEPGYY

SEQ ID NO: 694865 - protein, 19 aa, Mycobacterium
LPTQLFVDVRNLITAPQIA

SEQ ID NO: 694866 - protein, 36 aa, Mycobacterium
LPTQLPMMVSFLDFRKIPLVGMWAEMNFGTYGDSLS

SEQ ID NO: 694867 - protein, 17 aa, Mycobacterium
LPTRALLISAHDEPAIV

SEQ ID NO: 694868 - protein, 23 aa, Mycobacterium
LPTRATQAVQVFLQKNVVTAVLG

SEQ ID NO: 694869 - protein, 19 aa, Mycobacterium
LPTRLRLPDLLRITDEGAD

SEQ ID NO: 694870 - protein, 17 aa, Mycobacterium
LPTRPAVPVLSGVLLSG

SEQ ID NO: 694871 - protein, 24 aa, Mycobacterium
LPTRPRATLVLRKDADHAINRLRL

SEQ ID NO: 694872 - protein, 18 aa, Mycobacterium
LPTRPRATLVLRKDADHS

SEQ ID NO: 694873 - protein, 24 aa, Mycobacterium
LPTRPRATLVLRKDADHSIKRLRL

SEQ ID NO: 694874 - protein, 24 aa, Mycobacterium
LPTRPRATLVLRKDSDHSINRLRL

SEQ ID NO: 694875 - protein, 25 aa, Mycobacterium
LPTRYARGWHCLGVAESFRDGEPHA

SEQ ID NO: 694876 - protein, 19 aa, Mycobacterium
LPTSGGVVLTGRLSLRAQG

SEQ ID NO: 694877 - protein, 25 aa, Mycobacterium
LPTSPAESFTAMWADVRRPELRQLE

SEQ ID NO: 694878 - protein, 22 aa, Mycobacterium
LPTTAACPEFAYTPDTTAAAVQ

SEQ ID NO: 694879 - protein, 27 aa, Mycobacterium
LPTTVKAGLELLGFPVGDPRPPLLPLD

SEQ ID NO: 694880 - protein, 17 aa, Mycobacterium
LPTTVKAGLELQGRPVG

SEQ ID NO: 694881 - protein, 21 aa, Mycobacterium
LPTTYRLLGRTPRRLRRLRAA

SEQ ID NO: 694882 - protein, 21 aa, Mycobacterium
LPTTYRLLGRTPRRVRALRAS

SEQ ID NO: 694883 - protein, 17 aa, Mycobacterium
LPTVRIRRIYACYDAGR

SEQ ID NO: 694884 - protein, 24 aa, Mycobacterium
LPTYAVIACSPFAAITKIGSFDFS

SEQ ID NO: 694885 - protein, 23 aa, Mycobacterium
LPTYAVICCPAFGAAGKIGKFNW

SEQ ID NO: 694886 - protein, 24 aa, Mycobacterium
LPTYAVICCPAFGAAGKIGTFNHA

SEQ ID NO: 694887 - protein, 24 aa, Mycobacterium
LPTYAVICCPAFGAAGKVGKFNWA

SEQ ID NO: 694888 - protein, 24 aa, Mycobacterium
LPTYAVICCPAFGAAGKVGTFNWA

SEQ ID NO: 694889 - protein, 25 aa, Mycobacterium
LPTYAVICCPAFGAAGLVGKFNWAM

SEQ ID NO: 694890 - protein, 20 aa, Mycobacterium
LPTYFKNIFEGHVATQYMNG

SEQ ID NO: 694891 - protein, 25 aa, Mycobacterium
LPTYGFARDRFWLGDGRGPGGSGAA

SEQ ID NO: 694892 - protein, 25 aa, Mycobacterium
LPTYPFEHRQFWFSDNRAIDRDTQT

SEQ ID NO: 694893 - protein, 25 aa, Mycobacterium
LPTYPFQRRHFWPKTSGIAGVDGQG

SEQ ID NO: 694894 - protein, 32 aa, Mycobacterium
LPTYPFQRRRFWPKSAGMAIDGRVGASAGSGI

SEQ ID NO: 694895 - protein, 18 aa, Mycobacterium
LPTYPGMVAHQYTDGQGY

SEQ ID NO: 694896 - protein, 17 aa, Mycobacterium
LPVAAYLKPAAKLALPT

SEQ ID NO: 694897 - protein, 23 aa, Mycobacterium
LPVADLNIAAWLLDHVDSPAGDG

SEQ ID NO: 694898 - protein, 19 aa, Mycobacterium
LPVADVRFLPAGAIPRTTS

SEQ ID NO: 694899 - protein, 18 aa, Mycobacterium
LPVAHWPALGGMGNASWT

SEQ ID NO: 694900 - protein, 18 aa, Mycobacterium
LPVANWPVLGGMGNASWV

SEQ ID NO: 694901 - protein, 19 aa, Mycobacterium
LPVAYAAVGPSFWGEGQYP

SEQ ID NO: 694902 - protein, 21 aa, Mycobacterium
LPVAYAVVGPSFWGDGQYPPS

SEQ ID NO: 694903 - protein, 23 aa, Mycobacterium
LPVAYAVVGPSFWGDGQYPPSDA

SEQ ID NO: 694904 - protein, 20 aa, Mycobacterium
LPVDEEWLAVRGYRQAEGNK

SEQ ID NO: 694905 - protein, 19 aa, Mycobacterium
LPVDGRWVIVVTGGAGAIS

SEQ ID NO: 694906 - protein, 19 aa, Mycobacterium
LPVDPRLGRMILQAGVEGC

SEQ ID NO: 694907 - protein, 18 aa, Mycobacterium
LPVDPRLGRMILQAQTEG

SEQ ID NO: 694908 - protein, 19 aa, Mycobacterium
LPVDVARAITGPATLIGQS

SEQ ID NO: 694909 - protein, 27 aa, Mycobacterium
LPVEGILFAVEWNRFWHDSWGRRPAQM

SEQ ID NO: 694910 - protein, 24 aa, Mycobacterium
LPVEQRAAVVAVDMQGYSVADTAA

SEQ ID NO: 694911 - protein, 21 aa, Mycobacterium
LPVEYYPTGRLNFVDTAANPT

SEQ ID NO: 694912 - protein, 23 aa, Mycobacterium
LPVFPGDTYLAGAKVLRQYGIGP

SEQ ID NO: 694913 - protein, 19 aa, Mycobacterium
LPVFSDLVSLQYVRPELGG

SEQ ID NO: 694914 - protein, 25 aa, Mycobacterium
LPVFVRELLEPLGLTAEAPAGTRAR

SEQ ID NO: 694915 - protein, 17 aa, Mycobacterium
LPVGALLAELARRGHDV

SEQ ID NO: 694916 - protein, 25 aa, Mycobacterium
LPVGGWNCRPGADFGYLACDAAGTD

SEQ ID NO: 694917 - protein, 17 aa, Mycobacterium
LPVGLTVTMDGRQGAET

SEQ ID NO: 694918 - protein, 22 aa, Mycobacterium
LPVGRLRAGHRFRPARRRPVDE

SEQ ID NO: 694919 - protein, 17 aa, Mycobacterium
LPVGSRFAAGNGVVCAA

SEQ ID NO: 694920 - protein, 19 aa, Mycobacterium
LPVGVRLIFQAAEELMPGG

SEQ ID NO: 694921 - protein, 18 aa, Mycobacterium
LPVHEIVTTFPLEDIAAA

SEQ ID NO: 694922 - protein, 17 aa, Mycobacterium
LPVHLYGAFADIHALTE

SEQ ID NO: 694923 - protein, 21 aa, Mycobacterium
LPVIACSPLRGARLDTVGRVL

SEQ ID NO: 694924 - protein, 19 aa, Mycobacterium
LPVICSRWYGVIPPIKEVR

SEQ ID NO: 694925 - protein, 25 aa, Mycobacterium
LPVIGSKELIAWLPTLLGLGPRDVV

SEQ ID NO: 694926 - protein, 25 aa, Mycobacterium
LPVIGTKELIAWLPTLLGLGADDLI

SEQ ID NO: 694927 - protein, 25 aa, Mycobacterium
LPVIGTKELIAWLPTLLGLGSDDVV

SEQ ID NO: 694928 - protein, 26 aa, Mycobacterium
LPVKLNFPPPLAHLGSDPSTFDYQWQ

SEQ ID NO: 694929 - protein, 17 aa, Mycobacterium
LPVLGICRGAQVLNVAF

SEQ ID NO: 694930 - protein, 17 aa, Mycobacterium
LPVLGICRGAQVLNVAL

SEQ ID NO: 694931 - protein, 18 aa, Mycobacterium
LPVLGMAGSAFFDEAARR

SEQ ID NO: 694932 - protein, 17 aa, Mycobacterium
LPVLLLPADTFATRVSS

SEQ ID NO: 694933 - protein, 22 aa, Mycobacterium
LPVLVKASAGGGGRGMRVVREL

SEQ ID NO: 694934 - protein, 17 aa, Mycobacterium
LPVMFFIYGGGYLLGSS

SEQ ID NO: 694935 - protein, 18 aa, Mycobacterium
LPVMVFIHGGGYILGSSA

SEQ ID NO: 694936 - protein, 17 aa, Mycobacterium
LPVNEFTATVERFNGFA

SEQ ID NO: 694937 - protein, 17 aa, Mycobacterium
LPVNRPSLLGDRTSVTY

SEQ ID NO: 694938 - protein, 21 aa, Mycobacterium
LPVPADHALDQGVRAVGGGQP

SEQ ID NO: 694939 - protein, 17 aa, Mycobacterium
LPVPQLRGDGAARIVEV

SEQ ID NO: 694940 - protein, 17 aa, Mycobacterium
LPVPSLVIALLLGVPPE

SEQ ID NO: 694941 - protein, 22 aa, Mycobacterium
LPVPSMVIALLLGVPPEDLELF

SEQ ID NO: 694942 - protein, 20 aa, Mycobacterium
LPVPVFDKLVAVSGHRPIER

SEQ ID NO: 694943 - protein, 18 aa, Mycobacterium
LPVQCLPGPSAVTTALAV

SEQ ID NO: 694944 - protein, 18 aa, Mycobacterium
LPVQLVVRSVGYRGVPTP

SEQ ID NO: 694945 - protein, 23 aa, Mycobacterium
LPVQMRMSWYILFQQIPWLSERN

SEQ ID NO: 694946 - protein, 26 aa, Mycobacterium
LPVRMSAKHWRRWRLTGDRSSYRSTK

SEQ ID NO: 694947 - protein, 18 aa, Mycobacterium
LPVRPDRLLAGGDAVQIG

SEQ ID NO: 694948 - protein, 21 aa, Mycobacterium
LPVRRAGAVVPVRRRPIPAFE

SEQ ID NO: 694949 - protein, 22 aa, Mycobacterium
LPVRSRLRRRWDVEGPLATVLD

SEQ ID NO: 694950 - protein, 20 aa, Mycobacterium
LPVRVETWEGLVFVSLDVTA

SEQ ID NO: 694951 - protein, 19 aa, Mycobacterium
LPVRVVDTAMPWQANGRPR

SEQ ID NO: 694952 - protein, 17 aa, Mycobacterium
LPVSATVWREGHDAVAA

SEQ ID NO: 694953 - protein, 26 aa, Mycobacterium
LPVSECWELLAGAPIGRLVTNFEGES

SEQ ID NO: 694954 - protein, 23 aa, Mycobacterium
LPVSRPRITLVSNVTGRVVGADY

SEQ ID NO: 694955 - protein, 23 aa, Mycobacterium
LPVSRRRVLVFSGDISGRTGMGI

SEQ ID NO: 694956 - protein, 24 aa, Mycobacterium
LPVSVDTFAGFIFLNPDPHAAPLR

SEQ ID NO: 694957 - protein, 20 aa, Mycobacterium
LPVSVVRPTTKYEMKAHNAG

SEQ ID NO: 694958 - protein, 20 aa, Mycobacterium
LPVSYWKLTEREIAQHYRSI

SEQ ID NO: 694959 - protein, 18 aa, Mycobacterium
LPVTFSLVVGNVGEPSWP

SEQ ID NO: 694960 - protein, 17 aa, Mycobacterium
LPVTGYADLVRAVKKRV

SEQ ID NO: 694961 - protein, 18 aa, Mycobacterium
LPVTGYADLVRAVKKRVP

SEQ ID NO: 694962 - protein, 19 aa, Mycobacterium
LPVTRVFTGGSVGGHAAIY

SEQ ID NO: 694963 - protein, 17 aa, Mycobacterium
LPVVCIGGGAGMAPILS

SEQ ID NO: 694964 - protein, 24 aa, Mycobacterium
LPVVCSVRGWAVGFGCNLALAADF

SEQ ID NO: 694965 - protein, 17 aa, Mycobacterium
LPVVDRVIVLGAAGEIV

SEQ ID NO: 694966 - protein, 21 aa, Mycobacterium
LPVVIKDVMQVAGLACSGGSP

SEQ ID NO: 694967 - protein, 20 aa, Mycobacterium
LPVVLFFHGGGFVMGDLDTH

SEQ ID NO: 694968 - protein, 21 aa, Mycobacterium
LPVVLGGNMMQYNWTINGQPF

SEQ ID NO: 694969 - protein, 18 aa, Mycobacterium
LPVVPGFDGVARLADGRR

SEQ ID NO: 694970 - protein, 17 aa, Mycobacterium
LPVVRKFAEAAGIDVKT

SEQ ID NO: 694971 - protein, 17 aa, Mycobacterium
LPVYDAIVVDSPPTGRI

SEQ ID NO: 694972 - protein, 17 aa, Mycobacterium
LPWADLAALPESYAVAW

SEQ ID NO: 694973 - protein, 19 aa, Mycobacterium
LPWAKKLYRTRLWLRSEAN

SEQ ID NO: 694974 - protein, 19 aa, Mycobacterium
LPWARDLAVAIERLGNFLA

SEQ ID NO: 694975 - protein, 17 aa, Mycobacterium
LPWDDPGTIDRRHHPWD

SEQ ID NO: 694976 - protein, 17 aa, Mycobacterium
LPWHALRTPIADIGSTT

SEQ ID NO: 694977 - protein, 22 aa, Mycobacterium
LPWHPGRCAEVLVGDTTVGYAG

SEQ ID NO: 694978 - protein, 23 aa, Mycobacterium
LPWLSMLPAYFVGVGVRPEHAPA

SEQ ID NO: 694979 - protein, 27 aa, Mycobacterium
LPWLSRKRIQEEWGISDEVMRDLVNAG

SEQ ID NO: 694980 - protein, 26 aa, Mycobacterium
LPWLSRKRIQQEWGVSDEVMRDLVNA

SEQ ID NO: 694981 - protein, 24 aa, Mycobacterium
LPWLTRLGAVYTYDAPWHRGRDVD

SEQ ID NO: 694982 - protein, 23 aa, Mycobacterium
LPWLTRLGSVYTYDAPWHRGRDV

SEQ ID NO: 694983 - protein, 24 aa, Mycobacterium
LPWLTRLGTVYSYDAPWHRGRDVD

SEQ ID NO: 694984 - protein, 24 aa, Mycobacterium
LPWMAELSGEFGLTRPPADQLDEL

SEQ ID NO: 694985 - protein, 22 aa, Mycobacterium
LPWMAEYVEEFGLIPPPADRLT

SEQ ID NO: 694986 - protein, 21 aa, Mycobacterium
LPWPDPDAWLAALAASPLLGQ

SEQ ID NO: 694987 - protein, 19 aa, Mycobacterium
LPWWLRPFARFRADDHFTG

SEQ ID NO: 694988 - protein, 20 aa, Mycobacterium
LPYAAQLCRRAIVMDGGVIV

SEQ ID NO: 694989 - protein, 19 aa, Mycobacterium
LPYAILRLGGVISPDGSAN

SEQ ID NO: 694990 - protein, 19 aa, Mycobacterium
LPYAWPRKPVVAENVVCTS

SEQ ID NO: 694991 - protein, 29 aa, Mycobacterium
LPYDRALELGCGTGFFLLNLIQAGVARRG

SEQ ID NO: 694992 - protein, 28 aa, Mycobacterium
LPYDRALELGCGTGFFLLNLIQSGVARR

SEQ ID NO: 694993 - protein, 17 aa, Mycobacterium
LPYDVQERFLATLDAEL

SEQ ID NO: 694994 - protein, 24 aa, Mycobacterium
LPYEPDLLTILAIALHEVDTIEVA

SEQ ID NO: 694995 - protein, 21 aa, Mycobacterium
LPYEPRTAYRSELPVMERYAA

SEQ ID NO: 694996 - protein, 32 aa, Mycobacterium
LPYERSTCFWQRIAYLYSRFDALIEAVKRQGQ

SEQ ID NO: 694997 - protein, 31 aa, Mycobacterium
LPYERSTCFWQRIAYLYSRFDELIVQATDAG

SEQ ID NO: 694998 - protein, 31 aa, Mycobacterium
LPYERSTCFWQRIAYLYSRFDSLVDEVKRQG

SEQ ID NO: 694999 - protein, 17 aa, Mycobacterium
LPYFPLPLGDLSVPYAG

SEQ ID NO: 695000 - protein, 18 aa, Mycobacterium
LPYFPVTPFFPLAGPAGM

SEQ ID NO: 695001 - protein, 18 aa, Mycobacterium
LPYGFDFRSPVGRFEEAL

SEQ ID NO: 695002 - protein, 19 aa, Mycobacterium
LPYGLPFSELLALHAVAPT

SEQ ID NO: 695003 - protein, 19 aa, Mycobacterium
LPYGSVITASGRISGVTEP

SEQ ID NO: 695004 - protein, 18 aa, Mycobacterium
LPYHRPPLSKGYLAGKNG

SEQ ID NO: 695005 - protein, 18 aa, Mycobacterium
LPYILRLFDIQGLSTRSA

SEQ ID NO: 695006 - protein, 18 aa, Mycobacterium
LPYILSDGHLRELALTGK

SEQ ID NO: 695007 - protein, 25 aa, Mycobacterium
LPYLRVRLHMSRHDIVITGYDDEQR

SEQ ID NO: 695008 - protein, 17 aa, Mycobacterium
LPYNRMNGILAPGLFGL

SEQ ID NO: 695009 - protein, 27 aa, Mycobacterium
LPYNSGRFGKQWAMVHRSIFRLAFPGG

SEQ ID NO: 695010 - protein, 32 aa, Mycobacterium
LPYNSGRFGKQWFTVHRTIFRLALPGGTPRPK

SEQ ID NO: 695011 - protein, 18 aa, Mycobacterium
LPYNVAVPALLHLLAEFP

SEQ ID NO: 695012 - protein, 19 aa, Mycobacterium
LPYNVAVPALLHLLAEFPS

SEQ ID NO: 695013 - protein, 21 aa, Mycobacterium
LPYPASALMGNAFMRGIESPM

SEQ ID NO: 695014 - protein, 25 aa, Mycobacterium
LPYPDGLRLDVQFLPKDEAPPTTEQ

SEQ ID NO: 695015 - protein, 17 aa, Mycobacterium
LPYPKWLPPPAPPEGIN

SEQ ID NO: 695016 - protein, 23 aa, Mycobacterium
LPYPRPIPYRDGVPIEYDGGDYR

SEQ ID NO: 695017 - protein, 17 aa, Mycobacterium
LPYRELFGPNVAGTAEL

SEQ ID NO: 695018 - protein, 19 aa, Mycobacterium
LPYSLKVLAENLLRNEDGS

SEQ ID NO: 695019 - protein, 19 aa, Mycobacterium
LPYSLKVLLENLLRNEDGR

SEQ ID NO: 695020 - protein, 19 aa, Mycobacterium
LPYSPPEHAFKMVPSSLGI

SEQ ID NO: 695021 - protein, 17 aa, Mycobacterium
LPYSRNASVAKLIATDA

SEQ ID NO: 695022 - protein, 18 aa, Mycobacterium
LPYTRFPIEEVVGAFEAV

SEQ ID NO: 695023 - protein, 19 aa, Mycobacterium
LPYTYRVSLVGTDQAGRLM

SEQ ID NO: 695024 - protein, 21 aa, Mycobacterium
LPYYGRWLLSVARVLVEKHHI

SEQ ID NO: 695025 - protein, 27 aa, Mycobacterium
LQAAAQRLPFLPIRAGLGSDVRAFWGD

SEQ ID NO: 695026 - protein, 18 aa, Mycobacterium
LQAAEQFARYTGVRPDPG

SEQ ID NO: 695027 - protein, 24 aa, Mycobacterium
LQAAGRLGEFSDWAKSLNQRTILR

SEQ ID NO: 695028 - protein, 17 aa, Mycobacterium
LQAALSRLATLLGSAAS

SEQ ID NO: 695029 - protein, 19 aa, Mycobacterium
LQAAMALDLSRFATSMSAT

SEQ ID NO: 695030 - protein, 22 aa, Mycobacterium
LQAAQRRAPVAIGPYGPEVLSY

SEQ ID NO: 695031 - protein, 19 aa, Mycobacterium
LQAATAWAGLADELGAAAQ

SEQ ID NO: 695032 - protein, 19 aa, Mycobacterium
LQAATAWDALANELRTAAA

SEQ ID NO: 695033 - protein, 18 aa, Mycobacterium
LQAATQWDALSHVYYDDQ

SEQ ID NO: 695034 - protein, 18 aa, Mycobacterium
LQAATQWDALSHVYYEDR

SEQ ID NO: 695035 - protein, 17 aa, Mycobacterium
LQAATQWDAMSHVYYED

SEQ ID NO: 695036 - protein, 21 aa, Mycobacterium
LQAAVMYWAYIAYIFGVAEEL

SEQ ID NO: 695037 - protein, 20 aa, Mycobacterium
LQAAWALLLTWLTGQDDVVF

SEQ ID NO: 695038 - protein, 20 aa, Mycobacterium
LQAAYRMSINDLEWMTPQTR

SEQ ID NO: 695039 - protein, 18 aa, Mycobacterium
LQACFGTRDWDAMSEILA

SEQ ID NO: 695040 - protein, 24 aa, Mycobacterium
LQADGRGATMIFTRTKRTAQKVSD

SEQ ID NO: 695041 - protein, 18 aa, Mycobacterium
LQADLGAIVVEANTIDEE

SEQ ID NO: 695042 - protein, 24 aa, Mycobacterium
LQADNCKLISWPIATLSPNGVRTA

SEQ ID NO: 695043 - protein, 17 aa, Mycobacterium
LQAFTLRVGRPVGPMLA

SEQ ID NO: 695044 - protein, 21 aa, Mycobacterium
LQAGFRRLAGYIFGRNHGGEI

SEQ ID NO: 695045 - protein, 23 aa, Mycobacterium
LQAGLDVFGRLDIVVANAGIAPM

SEQ ID NO: 695046 - protein, 17 aa, Mycobacterium
LQAGLGRDSKGIDHLGR

SEQ ID NO: 695047 - protein, 22 aa, Mycobacterium
LQAGRPPMRYRAAAVHADAESA

SEQ ID NO: 695048 - protein, 18 aa, Mycobacterium
LQAGRVAVPLSVPLGGVS

SEQ ID NO: 695049 - protein, 19 aa, Mycobacterium
LQAGYRWRSGNFPGEDADP

SEQ ID NO: 695050 - protein, 18 aa, Mycobacterium
LQAIAGLLGVPVDDRKKL

SEQ ID NO: 695051 - protein, 18 aa, Mycobacterium
LQAIEQQLLAAINAPTQT

SEQ ID NO: 695052 - protein, 20 aa, Mycobacterium
LQAKEVVSAFEAARAAMIHP

SEQ ID NO: 695053 - protein, 18 aa, Mycobacterium
LQALALAIFIPRATSVES

SEQ ID NO: 695054 - protein, 18 aa, Mycobacterium
LQALFGLSYLFVSHDLSV

SEQ ID NO: 695055 - protein, 28 aa, Mycobacterium
LQALLYCAVLHRFLRWRIRDYDPDRHLG

SEQ ID NO: 695056 - protein, 26 aa, Mycobacterium
LQALPEDFRMAVYYADVEGFPYKEIA

SEQ ID NO: 695057 - protein, 23 aa, Mycobacterium
LQALPREEWPSAIRRLVSGQISL

SEQ ID NO: 695058 - protein, 26 aa, Mycobacterium
LQALQLRWFEHWLKDDARAAIAGKPL

SEQ ID NO: 695059 - protein, 18 aa, Mycobacterium
LQALTFISGDQWLAHRGS

SEQ ID NO: 695060 - protein, 18 aa, Mycobacterium
LQALTFISGDQWLTHRGS

SEQ ID NO: 695061 - protein, 17 aa, Mycobacterium
LQALVFVARRLPDAPLA

SEQ ID NO: 695062 - protein, 25 aa, Mycobacterium
LQANGFDVGRRLGIGSRETYIPALK

SEQ ID NO: 695063 - protein, 18 aa, Mycobacterium
LQANWTWARSALDEGQVA

SEQ ID NO: 695064 - protein, 19 aa, Mycobacterium
LQAPHWPKPYGRAASPAEQ

SEQ ID NO: 695065 - protein, 25 aa, Mycobacterium
LQAPNCKLITWPIARCSARGIRTAE

SEQ ID NO: 695066 - protein, 18 aa, Mycobacterium
LQAPYDLVVEVAQAGKLP

SEQ ID NO: 695067 - protein, 23 aa, Mycobacterium
LQAPYDLVVEVARAGKLPVTLFT

SEQ ID NO: 695068 - protein, 19 aa, Mycobacterium
LQAPYELVAEVARAGKLPV

SEQ ID NO: 695069 - protein, 23 aa, Mycobacterium
LQAPYELVVEVARAGKLPVTMFT

SEQ ID NO: 695070 - protein, 17 aa, Mycobacterium
LQAQIAEGVGRKQLGAN

SEQ ID NO: 695071 - protein, 17 aa, Mycobacterium
LQAQLLADFGAWLDVTG

SEQ ID NO: 695072 - protein, 21 aa, Mycobacterium
LQARGSGAWATFSELVADCEA

SEQ ID NO: 695073 - protein, 20 aa, Mycobacterium
LQASAAWNGLAEELGAAADS

SEQ ID NO: 695074 - protein, 18 aa, Mycobacterium
LQASALVRGVRCIGAHSD

SEQ ID NO: 695075 - protein, 17 aa, Mycobacterium
LQATLLMFINEQCNASR

SEQ ID NO: 695076 - protein, 17 aa, Mycobacterium
LQAVIALLKGADLDVAL

SEQ ID NO: 695077 - protein, 25 aa, Mycobacterium
LQAVLRPHRPGFGNVERPAAGAVAL

SEQ ID NO: 695078 - protein, 17 aa, Mycobacterium
LQAWSGGIVGLGRGAPD

SEQ ID NO: 695079 - protein, 25 aa, Mycobacterium
LQAYPGYPRRSALVAIGADAMFGGP

SEQ ID NO: 695080 - protein, 18 aa, Mycobacterium
LQAYSMTMYAGWRAVIAG

SEQ ID NO: 695081 - protein, 18 aa, Mycobacterium
LQAYSMTMYAGWRAVVAA

SEQ ID NO: 695082 - protein, 20 aa, Mycobacterium
LQCAEVVGVLQTVFDFTAQW

SEQ ID NO: 695083 - protein, 25 aa, Mycobacterium
LQCDAMPVLRWVRRMRSNSELPAQL

SEQ ID NO: 695084 - protein, 25 aa, Mycobacterium
LQCDEIRPEHLLVGVLQSAGRDLGA

SEQ ID NO: 695085 - protein, 22 aa, Mycobacterium
LQCGLPRVAFEVTKRMLDDGLL

SEQ ID NO: 695086 - protein, 25 aa, Mycobacterium
LQCGYCTPGQIMSGVACIREGHANS

SEQ ID NO: 695087 - protein, 17 aa, Mycobacterium
LQDALGLEQAPLRIECI

SEQ ID NO: 695088 - protein, 18 aa, Mycobacterium
LQDALHCVGYAVVEDVLD

SEQ ID NO: 695089 - protein, 24 aa, Mycobacterium
LQDDRWTYRFNLFDMARALDNQVF

SEQ ID NO: 695090 - protein, 20 aa, Mycobacterium
LQDGGLMACHAYTWKQVVGT

SEQ ID NO: 695091 - protein, 24 aa, Mycobacterium
LQDHTAFDCVWEYPDGALPLRNNG

SEQ ID NO: 695092 - protein, 18 aa, Mycobacterium
LQDPYPLYERMHATGTVH

SEQ ID NO: 695093 - protein, 25 aa, Mycobacterium
LQDRLGVEMEDYLILGACNPALAHR

SEQ ID NO: 695094 - protein, 18 aa, Mycobacterium
LQDSDFRAGCPVVAVAVE

SEQ ID NO: 695095 - protein, 17 aa, Mycobacterium
LQDTARVLSRFVDAIVW

SEQ ID NO: 695096 - protein, 17 aa, Mycobacterium
LQEAWTEFCERLRRAGE

SEQ ID NO: 695097 - protein, 17 aa, Mycobacterium
LQEELHKTIVFVTHDFG

SEQ ID NO: 695098 - protein, 24 aa, Mycobacterium
LQEELPDLRICFLHGGGCAPGLLG

SEQ ID NO: 695099 - protein, 23 aa, Mycobacterium
LQEFIGEFWYHYDEAHYAELAAR

SEQ ID NO: 695100 - protein, 18 aa, Mycobacterium
LQEGMAFSVEPGIYFPGQ

SEQ ID NO: 695101 - protein, 32 aa, Mycobacterium
LQEGRIGLNVWREWWNGLPIFDEHVDQIVSWL

SEQ ID NO: 695102 - protein, 23 aa, Mycobacterium
LQEHLRRFVALDYHRSWHTGLVL

SEQ ID NO: 695103 - protein, 23 aa, Mycobacterium
LQEIKRLLDEAVLAERKQLARAL

SEQ ID NO: 695104 - protein, 23 aa, Mycobacterium
LQEIWGYLCCHYAIRSLMSQAAH

SEQ ID NO: 695105 - protein, 26 aa, Mycobacterium
LQEKMPRRFYCRATWHEAPLDSETQV

SEQ ID NO: 695106 - protein, 23 aa, Mycobacterium
LQELEKAAGVAITAGGTKLSIPD

SEQ ID NO: 695107 - protein, 20 aa, Mycobacterium
LQELEKGAGVAVTGGGSLLP

SEQ ID NO: 695108 - protein, 17 aa, Mycobacterium
LQEQWPGTSDDFGREQF

SEQ ID NO: 695109 - protein, 17 aa, Mycobacterium
LQERGRVRMPDIADPVL

SEQ ID NO: 695110 - protein, 21 aa, Mycobacterium
LQESYLRWAQVDLDTVTDTKA

SEQ ID NO: 695111 - protein, 24 aa, Mycobacterium
LQEVRASGVLPTWAATRKFVDALR

SEQ ID NO: 695112 - protein, 21 aa, Mycobacterium
LQEWFRRVPEFQICAAQATRL

SEQ ID NO: 695113 - protein, 22 aa, Mycobacterium
LQEWLQALFPFNPFSPQGWSMH

SEQ ID NO: 695114 - protein, 25 aa, Mycobacterium
LQFAAMRAGVVMVPLNWRLVTAEMR

SEQ ID NO: 695115 - protein, 19 aa, Mycobacterium
LQFALKRAKAGELLLGGAA

SEQ ID NO: 695116 - protein, 19 aa, Mycobacterium
LQFALKRAKAGELMLGGAA

SEQ ID NO: 695117 - protein, 17 aa, Mycobacterium
LQFDAGVDRVDGRKIFV

SEQ ID NO: 695118 - protein, 17 aa, Mycobacterium
LQFDPVIVRLLAQHQPF

SEQ ID NO: 695119 - protein, 19 aa, Mycobacterium
LQFDVFNWLGIKSQWLNSV

SEQ ID NO: 695120 - protein, 25 aa, Mycobacterium
LQFELDRYLGWPGQAPSYAIGQRIW

SEQ ID NO: 695121 - protein, 17 aa, Mycobacterium
LQFGRPIGSFQAVKHRL

SEQ ID NO: 695122 - protein, 19 aa, Mycobacterium
LQFGTNHLGHFALTGHLLP

SEQ ID NO: 695123 - protein, 19 aa, Mycobacterium
LQFGTNHLGHFALTGLLLD

SEQ ID NO: 695124 - protein, 18 aa, Mycobacterium
LQFLPRALAAAGGRPVLL

SEQ ID NO: 695125 - protein, 23 aa, Mycobacterium
LQFRTIHGYKRAFRIAGSGPAIL

SEQ ID NO: 695126 - protein, 27 aa, Mycobacterium
LQGDRHWPALCAAVQRPDWPTDERFAT

SEQ ID NO: 695127 - protein, 26 aa, Mycobacterium
LQGDVKRFRAFDNWEGDAATACEASL

SEQ ID NO: 695128 - protein, 17 aa, Mycobacterium
LQGELRKTVIFVTHDID

SEQ ID NO: 695129 - protein, 20 aa, Mycobacterium
LQGESWSGGASTAMAGAAAP

SEQ ID NO: 695130 - protein, 18 aa, Mycobacterium
LQGGSPVALNWAIDSVRK

SEQ ID NO: 695131 - protein, 18 aa, Mycobacterium
LQGHPTPVLPWVDVASGS

SEQ ID NO: 695132 - protein, 22 aa, Mycobacterium
LQGHRCGACRIEIGRSELARIS

SEQ ID NO: 695133 - protein, 25 aa, Mycobacterium
LQGIRAFRDPMGWQSSRLEFLRAWL

SEQ ID NO: 695134 - protein, 17 aa, Mycobacterium
LQGIRVLRTYDESMALR

SEQ ID NO: 695135 - protein, 26 aa, Mycobacterium
LQGLGGVYPEIFLPLHGEHQAHNAAV

SEQ ID NO: 695136 - protein, 27 aa, Mycobacterium
LQGLGGVYPEIFLPLHGEHQAHNAVLA

SEQ ID NO: 695137 - protein, 20 aa, Mycobacterium
LQGLGGVYTDIFLPLHGEHQ

SEQ ID NO: 695138 - protein, 23 aa, Mycobacterium
LQGLRSFLKATLMVFVQDHTFAS

SEQ ID NO: 695139 - protein, 17 aa, Mycobacterium
LQGMDNFQGMTRQNILA

SEQ ID NO: 695140 - protein, 18 aa, Mycobacterium
LQGMDYLSPERVELRYIM

SEQ ID NO: 695141 - protein, 28 aa, Mycobacterium
LQGNLDPVVLLAGWPVVERAVRAVVEDG

SEQ ID NO: 695142 - protein, 18 aa, Mycobacterium
LQGPSAVFNIPWVLQLRG

SEQ ID NO: 695143 - protein, 24 aa, Mycobacterium
LQGRGRGGIRLNVEMTVSANDPGS

SEQ ID NO: 695144 - protein, 17 aa, Mycobacterium
LQGSGWAVLGYDTLGNR

SEQ ID NO: 695145 - protein, 25 aa, Mycobacterium
LQGSPMPSLGMDFGRGLAAGAAAAG

SEQ ID NO: 695146 - protein, 20 aa, Mycobacterium
LQGVAFSQGYLDAGGVRTRY

SEQ ID NO: 695147 - protein, 24 aa, Mycobacterium
LQGWERRPVDVADMVYAAATAYPW

SEQ ID NO: 695148 - protein, 18 aa, Mycobacterium
LQGWTLDRLPAVDRAVLR

SEQ ID NO: 695149 - protein, 18 aa, Mycobacterium
LQGWTLERLPAVDRAILR

SEQ ID NO: 695150 - protein, 28 aa, Mycobacterium
LQHASYMAGNYLTGWAVGVFRSPSGTET

SEQ ID NO: 695151 - protein, 18 aa, Mycobacterium
LQHCGFDPSFAVGGDLGQ

SEQ ID NO: 695152 - protein, 17 aa, Mycobacterium
LQHCPRVSVLATSRQPL

SEQ ID NO: 695153 - protein, 19 aa, Mycobacterium
LQHCYPDRQLPSEGMTRGA

SEQ ID NO: 695154 - protein, 19 aa, Mycobacterium
LQHDRVWIIDPLDGTREFS

SEQ ID NO: 695155 - protein, 17 aa, Mycobacterium
LQHEMYTVKGIKLAINY

SEQ ID NO: 695156 - protein, 24 aa, Mycobacterium
LQHFDRRAGLVAVRRDDLNRPVQR

SEQ ID NO: 695157 - protein, 24 aa, Mycobacterium
LQHHVKRTLVLDGLLGSSRELTRR

SEQ ID NO: 695158 - protein, 20 aa, Mycobacterium
LQHPELWSSSVIVPTEPEPP

SEQ ID NO: 695159 - protein, 19 aa, Mycobacterium
LQHPGVRVWVARDGSDLVG

SEQ ID NO: 695160 - protein, 28 aa, Mycobacterium
LQHRGFEIIGAAGAPVWHQLTTRDYGAA

SEQ ID NO: 695161 - protein, 21 aa, Mycobacterium
LQIAALKARYLSREDVPEDVV

SEQ ID NO: 695162 - protein, 17 aa, Mycobacterium
LQIAFYFTVKTYDSLVE

SEQ ID NO: 695163 - protein, 17 aa, Mycobacterium
LQIARYVTRDVEYYGQT

SEQ ID NO: 695164 - protein, 19 aa, Mycobacterium
LQIEGLRVAKAERAQGLGT

SEQ ID NO: 695165 - protein, 20 aa, Mycobacterium
LQIEGLRVAKAERAQGLGTA

SEQ ID NO: 695166 - protein, 27 aa, Mycobacterium
LQIEPEVGLACRVNWRGDVVVSLEPFA

SEQ ID NO: 695167 - protein, 26 aa, Mycobacterium
LQIEPEVGLACRVVWDGDTVVTLQPF

SEQ ID NO: 695168 - protein, 18 aa, Mycobacterium
LQIHPSVLRAIAGVGYES

SEQ ID NO: 695169 - protein, 24 aa, Mycobacterium
LQILEWPMALVLGAGQALAESQHN

SEQ ID NO: 695170 - protein, 25 aa, Mycobacterium
LQILRRPRSGLSYETLLATVEQRLP

SEQ ID NO: 695171 - protein, 40 aa, Mycobacterium
LQIQASRCMDCGIPFCHKGCPLGNLIPEWNDMVYRGNWRE

SEQ ID NO: 695172 - protein, 19 aa, Mycobacterium
LQIRMGFKEIEVGFPSASQ

SEQ ID NO: 695173 - protein, 19 aa, Mycobacterium
LQIRQSLDLTFAHGVAVAA

SEQ ID NO: 695174 - protein, 20 aa, Mycobacterium
LQIRSGTPFADLTLPSDPYW

SEQ ID NO: 695175 - protein, 23 aa, Mycobacterium
LQISPRVSFRRMAEVVGTTEQTV

SEQ ID NO: 695176 - protein, 19 aa, Mycobacterium
LQITHQWIREHGRVLVFTQ

SEQ ID NO: 695177 - protein, 21 aa, Mycobacterium
LQIVRDIWRGSPVDFSGKHYT

SEQ ID NO: 695178 - protein, 26 aa, Mycobacterium
LQKAGLRTVCLDSKLYAGGMASTVEL

SEQ ID NO: 695179 - protein, 28 aa, Mycobacterium
LQKCGTELLSVLAIDRIEAGGQWHCADG

SEQ ID NO: 695180 - protein, 18 aa, Mycobacterium
LQKGSRTLIFLPLAHVLA

SEQ ID NO: 695181 - protein, 24 aa, Mycobacterium
LQKHKRGAIDILIAVLTPIAGSEL

SEQ ID NO: 695182 - protein, 24 aa, Mycobacterium
LQKHRRTAIDVGMALLTPLMGQEF

SEQ ID NO: 695183 - protein, 25 aa, Mycobacterium
LQKISELYDRVGFAAAGKFNEFDNL

SEQ ID NO: 695184 - protein, 25 aa, Mycobacterium
LQKMSTILSRRVWENAGSPEVDPDR

SEQ ID NO: 695185 - protein, 19 aa, Mycobacterium
LQKPARWIQQLALNTHSWS

SEQ ID NO: 695186 - protein, 20 aa, Mycobacterium
LQKRLIRLTGAHDWRRRLGL

SEQ ID NO: 695187 - protein, 23 aa, Mycobacterium
LQKRLKDELEWVRSGAKARQAKN

SEQ ID NO: 695188 - protein, 19 aa, Mycobacterium
LQKRWSEIEAKAAEVTEKK

SEQ ID NO: 695189 - protein, 20 aa, Mycobacterium
LQKTCFDVGEALALQYFHSA

SEQ ID NO: 695190 - protein, 23 aa, Mycobacterium
LQKTDCPRRITIGPWDHMKSLKA

SEQ ID NO: 695191 - protein, 24 aa, Mycobacterium
LQKTLKGNIFGGGSSHIETPRLAA

SEQ ID NO: 695192 - protein, 23 aa, Mycobacterium
LQKTLKGNIFGGGTTHTETPRLV

SEQ ID NO: 695193 - protein, 19 aa, Mycobacterium
LQLALSVCYELHYRGFAGV

SEQ ID NO: 695194 - protein, 23 aa, Mycobacterium
LQLANYFLRHRGMLTSNVGEAYG

SEQ ID NO: 695195 - protein, 24 aa, Mycobacterium
LQLAPLEPFALCIGVHAVEHTDSA

SEQ ID NO: 695196 - protein, 17 aa, Mycobacterium
LQLCAEGSMTVAMPSTP

SEQ ID NO: 695197 - protein, 17 aa, Mycobacterium
LQLDGSDRACSWLPIYH

SEQ ID NO: 695198 - protein, 30 aa, Mycobacterium
LQLEGYKGVKVRSYPGLRMSYLSLDTTDPV

SEQ ID NO: 695199 - protein, 17 aa, Mycobacterium
LQLEYNWIKEFDPRFNV

SEQ ID NO: 695200 - protein, 17 aa, Mycobacterium
LQLGLSLIWTEAKRRGV

SEQ ID NO: 695201 - protein, 17 aa, Mycobacterium
LQLGRLKDSVGLRPEQV

SEQ ID NO: 695202 - protein, 17 aa, Mycobacterium
LQLHGGYGYLREYGLEK

SEQ ID NO: 695203 - protein, 20 aa, Mycobacterium
LQLHGGYGYMREYSVARAFV

SEQ ID NO: 695204 - protein, 17 aa, Mycobacterium
LQLHYARTLDLWAAALA

SEQ ID NO: 695205 - protein, 22 aa, Mycobacterium
LQLPAMQVLVAPDCYADSMSAL

SEQ ID NO: 695206 - protein, 22 aa, Mycobacterium
LQLPDMLLMLATDVAAVDHHEG

SEQ ID NO: 695207 - protein, 18 aa, Mycobacterium
LQLPEMLLLLATDLAAVD

SEQ ID NO: 695208 - protein, 18 aa, Mycobacterium
LQLPGSWTDFLDAGKGDA

SEQ ID NO: 695209 - protein, 21 aa, Mycobacterium
LQLPKPIGLHATYLVRDGLVL

SEQ ID NO: 695210 - protein, 18 aa, Mycobacterium
LQLPLWGGIGEEDRLRAR

SEQ ID NO: 695211 - protein, 31 aa, Mycobacterium
LQLPNRASFAVALFGLMRAGAIPVMCLPGHR

SEQ ID NO: 695212 - protein, 17 aa, Mycobacterium
LQLPPAIAGAWHTRGYY

SEQ ID NO: 695213 - protein, 17 aa, Mycobacterium
LQLPRYVNARSRVARVA

SEQ ID NO: 695214 - protein, 21 aa, Mycobacterium
LQLRFCNVIDEFTREALATRP

SEQ ID NO: 695215 - protein, 21 aa, Mycobacterium
LQLRLAPELTNLIEEYLPDDV

SEQ ID NO: 695216 - protein, 22 aa, Mycobacterium
LQLRLHPAASRVAMLAEQTPAA

SEQ ID NO: 695217 - protein, 19 aa, Mycobacterium
LQLRPSSYSLPAIDVDHTR

SEQ ID NO: 695218 - protein, 17 aa, Mycobacterium
LQLTITDTGSWKPPRPP

SEQ ID NO: 695219 - protein, 24 aa, Mycobacterium
LQLTRTLCCSLSVGAAERGLHTAV

SEQ ID NO: 695220 - protein, 17 aa, Mycobacterium
LQLTYLVVMTSSHSVQM

SEQ ID NO: 695221 - protein, 20 aa, Mycobacterium
LQLVAPRVGLAGMVTAVLGT

SEQ ID NO: 695222 - protein, 26 aa, Mycobacterium
LQLVRWGAEMRFSYTKGLYDYYVAPD

SEQ ID NO: 695223 - protein, 20 aa, Mycobacterium
LQLYLGVVGYPFLPVGDHVV

SEQ ID NO: 695224 - protein, 23 aa, Mycobacterium
LQLYLGVVGYPFLPVGDHVVKTS

SEQ ID NO: 695225 - protein, 18 aa, Mycobacterium
LQMAKEYWNAEYAKPQLM

SEQ ID NO: 695226 - protein, 19 aa, Mycobacterium
LQMAKSYWNARYAKPQLML

SEQ ID NO: 695227 - protein, 24 aa, Mycobacterium
LQMFERATAGFGWSRPSRSALADA

SEQ ID NO: 695228 - protein, 18 aa, Mycobacterium
LQMGVGPWFVIRGMTQRV

SEQ ID NO: 695229 - protein, 25 aa, Mycobacterium
LQMLNDCPLRWLAERHGGTNPRALR

SEQ ID NO: 695230 - protein, 18 aa, Mycobacterium
LQNFPMASFRPTDIDLDG

SEQ ID NO: 695231 - protein, 19 aa, Mycobacterium
LQNRLPCLYLVDSGGAFLP

SEQ ID NO: 695232 - protein, 24 aa, Mycobacterium
LQNVHCLSGPFAVDGAEPGDLLIV

SEQ ID NO: 695233 - protein, 24 aa, Mycobacterium
LQNVPIEPIWLCPLRLRDSADGGA

SEQ ID NO: 695234 - protein, 20 aa, Mycobacterium
LQNYLDRRGGAIVDEPATAE

SEQ ID NO: 695235 - protein, 17 aa, Mycobacterium
LQPALFVEVSPELARIR

SEQ ID NO: 695236 - protein, 17 aa, Mycobacterium
LQPALWVRQGAPQRRPC

SEQ ID NO: 695237 - protein, 25 aa, Mycobacterium
LQPARLTVDLLRPVALQPLQMHSSV

SEQ ID NO: 695238 - protein, 18 aa, Mycobacterium
LQPARLTVDLPRPTALKP

SEQ ID NO: 695239 - protein, 25 aa, Mycobacterium
LQPARLTVEILRRVASAPVRVSASV

SEQ ID NO: 695240 - protein, 25 aa, Mycobacterium
LQPDKFWAGFCERVGLAELATDERF

SEQ ID NO: 695241 - protein, 27 aa, Mycobacterium
LQPDKFWAGFCRRMGLAELVADERFVP

SEQ ID NO: 695242 - protein, 25 aa, Mycobacterium
LQPEATCVPMRWTRRIQSTVTGAGV

SEQ ID NO: 695243 - protein, 20 aa, Mycobacterium
LQPEVAFSMVQLGLTFDDMK

SEQ ID NO: 695244 - protein, 18 aa, Mycobacterium
LQPEVTRYFVPRFAATPI

SEQ ID NO: 695245 - protein, 21 aa, Mycobacterium
LQPFLRPFIDFGYATGLPGPF

SEQ ID NO: 695246 - protein, 18 aa, Mycobacterium
LQPFMIHYTASKHAVTGM

SEQ ID NO: 695247 - protein, 25 aa, Mycobacterium
LQPFPLPALACLLRSITLRLTIAPV

SEQ ID NO: 695248 - protein, 25 aa, Mycobacterium
LQPFPLPALTCLLRSITLRLTIAPV

SEQ ID NO: 695249 - protein, 25 aa, Mycobacterium
LQPGDGRVVSNFVWQALSNAPLTIY

SEQ ID NO: 695250 - protein, 32 aa, Mycobacterium
LQPGMKLLDIGCGWGATLRRALSRYDVDVVGL

SEQ ID NO: 695251 - protein, 17 aa, Mycobacterium
LQPGPAFYPDGELTDEP

SEQ ID NO: 695252 - protein, 20 aa, Mycobacterium
LQPGQAVCHFGITTGETCGT

SEQ ID NO: 695253 - protein, 24 aa, Mycobacterium
LQPGRYWPEFCRHIDREDLIHDER

SEQ ID NO: 695254 - protein, 17 aa, Mycobacterium
LQPGSSIMPGKVNPVIP

SEQ ID NO: 695255 - protein, 24 aa, Mycobacterium
LQPHKRTGVDIAIALITPLVGQEF

SEQ ID NO: 695256 - protein, 24 aa, Mycobacterium
LQPHKRTGVDIAIALLTPLMGQEF

SEQ ID NO: 695257 - protein, 25 aa, Mycobacterium
LQPIEWRYTNDPAWVMREKGDRLPH

SEQ ID NO: 695258 - protein, 25 aa, Mycobacterium
LQPIEWRYTNDPSWVMRDKGERLHY

SEQ ID NO: 695259 - protein, 25 aa, Mycobacterium
LQPIEWRYTNDPSWVMREKGDRLPY

SEQ ID NO: 695260 - protein, 21 aa, Mycobacterium
LQPKPEAVAWAVAFDPDSGDA

SEQ ID NO: 695261 - protein, 19 aa, Mycobacterium
LQPKSVRWQYTHGVPADRL

SEQ ID NO: 695262 - protein, 25 aa, Mycobacterium
LQPLIPLTPEWLAKRMTGTLLATPA

SEQ ID NO: 695263 - protein, 17 aa, Mycobacterium
LQPLPSLQLRIGAPSVI

SEQ ID NO: 695264 - protein, 18 aa, Mycobacterium
LQPLPSLRLQIGAPSVLR

SEQ ID NO: 695265 - protein, 18 aa, Mycobacterium
LQPQAGWESNEPDELAQV

SEQ ID NO: 695266 - protein, 17 aa, Mycobacterium
LQPQARYILPSFIEHSS

SEQ ID NO: 695267 - protein, 20 aa, Mycobacterium
LQPQMRCELADLTPRQPTIP

SEQ ID NO: 695268 - protein, 21 aa, Mycobacterium
LQPRGVGVIEVRGQSVTRGYT

SEQ ID NO: 695269 - protein, 19 aa, Mycobacterium
LQPRPAFVVHTQALLDRPP

SEQ ID NO: 695270 - protein, 19 aa, Mycobacterium
LQPRSPVLFDHLDSNAAAR

SEQ ID NO: 695271 - protein, 19 aa, Mycobacterium
LQPWDCAAGALIAAEAGAR

SEQ ID NO: 695272 - protein, 17 aa, Mycobacterium
LQPWIVRRVIYRGLRDP

SEQ ID NO: 695273 - protein, 17 aa, Mycobacterium
LQPWKDLLRDVAATEAM

SEQ ID NO: 695274 - protein, 25 aa, Mycobacterium
LQPYGGAWLNSWLDRDLGISGRLTL

SEQ ID NO: 695275 - protein, 25 aa, Mycobacterium
LQPYGGAWLNSWLDRDLGVSGRLSV

SEQ ID NO: 695276 - protein, 19 aa, Mycobacterium
LQQALRIHRHLKGIDAPVP

SEQ ID NO: 695277 - protein, 20 aa, Mycobacterium
LQQAVPPPDWQGDASDAYGL

SEQ ID NO: 695278 - protein, 18 aa, Mycobacterium
LQQDWVWPELFSPQEDLE

SEQ ID NO: 695279 - protein, 17 aa, Mycobacterium
LQQELADLLPGCGGLQV

SEQ ID NO: 695280 - protein, 17 aa, Mycobacterium
LQQGFLYSHPLEVTDLG

SEQ ID NO: 695281 - protein, 22 aa, Mycobacterium
LQQGGLMACLAYTWKQVVDTPL

SEQ ID NO: 695282 - protein, 21 aa, Mycobacterium
LQQIVHEFSDAAGLSVDDGAT

SEQ ID NO: 695283 - protein, 29 aa, Mycobacterium
LQQLAPSLFRLRIPGGRAHLLNCYLWLAP

SEQ ID NO: 695284 - protein, 18 aa, Mycobacterium
LQQLPAAMVPAVFAVTES

SEQ ID NO: 695285 - protein, 18 aa, Mycobacterium
LQQPPARRRSLAERVQDA

SEQ ID NO: 695286 - protein, 17 aa, Mycobacterium
LQQQWRAVKRENKARLS

SEQ ID NO: 695287 - protein, 22 aa, Mycobacterium
LQQRCERIPNVVVLPMNGAAAV

SEQ ID NO: 695288 - protein, 23 aa, Mycobacterium
LQQRKRLLTDYLRDAVAEVTRVD

SEQ ID NO: 695289 - protein, 27 aa, Mycobacterium
LQQTQAAFSTVERDVLSAVNAPSLALT

SEQ ID NO: 695290 - protein, 18 aa, Mycobacterium
LQQVLARTRERGFDIDWT

SEQ ID NO: 695291 - protein, 19 aa, Mycobacterium
LQRAEAFARAFGFATSLRT

SEQ ID NO: 695292 - protein, 17 aa, Mycobacterium
LQRAGFVLEARLCRHAV

SEQ ID NO: 695293 - protein, 17 aa, Mycobacterium
LQRAGLRTLCMEANTYT

SEQ ID NO: 695294 - protein, 17 aa, Mycobacterium
LQRAGRRLPDTPVLPPP

SEQ ID NO: 695295 - protein, 25 aa, Mycobacterium
LQRAHGRGALFDSLFVFENAPVEHA

SEQ ID NO: 695296 - protein, 19 aa, Mycobacterium
LQRAIGYERAAEMTLTGDR

SEQ ID NO: 695297 - protein, 20 aa, Mycobacterium
LQRATRWGATPVKAPALEEI

SEQ ID NO: 695298 - protein, 25 aa, Mycobacterium
LQRDFGVAVAGRFGIDYRFSEAAKP

SEQ ID NO: 695299 - protein, 17 aa, Mycobacterium
LQRDVHYIVRDDAVHLI

SEQ ID NO: 695300 - protein, 26 aa, Mycobacterium
LQREGITAMHFVPSLLGLFLSLPGVN

SEQ ID NO: 695301 - protein, 20 aa, Mycobacterium
LQREVQNFLRLASPPAASSR

SEQ ID NO: 695302 - protein, 20 aa, Mycobacterium
LQRFVPFDVDESVLSAAASA

SEQ ID NO: 695303 - protein, 24 aa, Mycobacterium
LQRFYRPIFRGVYLPKSAEPTLRD

SEQ ID NO: 695304 - protein, 20 aa, Mycobacterium
LQRHADGWDTLGRNIDETFR

SEQ ID NO: 695305 - protein, 22 aa, Mycobacterium
LQRHAGPIFPLIEDLFGVSVAQ

SEQ ID NO: 695306 - protein, 36 aa, Mycobacterium
LQRHDIKAVVLLHEMLRHCKPLGAWGNGSAALEAAG

SEQ ID NO: 695307 - protein, 22 aa, Mycobacterium
LQRHTGPIFPLIEDLFGVSVVE

SEQ ID NO: 695308 - protein, 17 aa, Mycobacterium
LQRIFKSIVEEDAPPSS

SEQ ID NO: 695309 - protein, 20 aa, Mycobacterium
LQRIGDAFLSVPEDFSVHPR

SEQ ID NO: 695310 - protein, 27 aa, Mycobacterium
LQRIKDLVIPPAWKKVWISPHPNGHIQ

SEQ ID NO: 695311 - protein, 25 aa, Mycobacterium
LQRIKDLVIPPAWKNVWISPHANGH

SEQ ID NO: 695312 - protein, 25 aa, Mycobacterium
LQRIKDLVIPPAWQKVWIAPYPNGH

SEQ ID NO: 695313 - protein, 33 aa, Mycobacterium
LQRIKSLAIPPAWNEVWISPHINGHIQAVGRDT

SEQ ID NO: 695314 - protein, 25 aa, Mycobacterium
LQRIKTRMGWQIPWYTMVPESSFDR

SEQ ID NO: 695315 - protein, 30 aa, Mycobacterium
LQRKASRAAVLWKVGMAIPINTNPLDSAAH

SEQ ID NO: 695316 - protein, 17 aa, Mycobacterium
LQRKLLAPFFVWVTVGL

SEQ ID NO: 695317 - protein, 21 aa, Mycobacterium
LQRLEGHFTLVFASADDPGTI

SEQ ID NO: 695318 - protein, 23 aa, Mycobacterium
LQRLGKVWAAMAITEPGFGSDSA

SEQ ID NO: 695319 - protein, 22 aa, Mycobacterium
LQRLGRPVFGPTFEVDVGSDLR

SEQ ID NO: 695320 - protein, 17 aa, Mycobacterium
LQRLRLLEISYGVVVTV

SEQ ID NO: 695321 - protein, 18 aa, Mycobacterium
LQRLWTPHRMSYIAEAPM

SEQ ID NO: 695322 - protein, 22 aa, Mycobacterium
LQRMPGAFSPLVAKSLTDIGFD

SEQ ID NO: 695323 - protein, 24 aa, Mycobacterium
LQRPCATLTAALRADAGLADRWRE

SEQ ID NO: 695324 - protein, 25 aa, Mycobacterium
LQRQWLHARSLAFAHPADGRRVEIV

SEQ ID NO: 695325 - protein, 19 aa, Mycobacterium
LQRRDAWQIVDMVNKITDP

SEQ ID NO: 695326 - protein, 19 aa, Mycobacterium
LQRREAWQIIDHVNSLTDP

SEQ ID NO: 695327 - protein, 18 aa, Mycobacterium
LQRRERADLFAILDAGTI

SEQ ID NO: 695328 - protein, 20 aa, Mycobacterium
LQRRFRDAFTATAHFQVNEA

SEQ ID NO: 695329 - protein, 17 aa, Mycobacterium
LQRRGVGAGSRVALMSS

SEQ ID NO: 695330 - protein, 17 aa, Mycobacterium
LQRRLAPHGTTIAAAAH

SEQ ID NO: 695331 - protein, 17 aa, Mycobacterium
LQRRLWAVSEELTGVTF

SEQ ID NO: 695332 - protein, 18 aa, Mycobacterium
LQRRVRVDMYRRLGYYPT

SEQ ID NO: 695333 - protein, 30 aa, Mycobacterium
LQRSGKWPHIWRIVGEYANFSIFDVETNDE

SEQ ID NO: 695334 - protein, 18 aa, Mycobacterium
LQRSYVRALWRATKPGAR

SEQ ID NO: 695335 - protein, 22 aa, Mycobacterium
LQRTGMGGGIGFYVDTDSKDST

SEQ ID NO: 695336 - protein, 17 aa, Mycobacterium
LQRTVEVVRALQTGEEL

SEQ ID NO: 695337 - protein, 21 aa, Mycobacterium
LQRVAPQIGLAGMVMTVLGEG

SEQ ID NO: 695338 - protein, 25 aa, Mycobacterium
LQRVGVPIADLLAGMYGAFGVLAAL

SEQ ID NO: 695339 - protein, 19 aa, Mycobacterium
LQRWHDVERTMVLNYYGPL

SEQ ID NO: 695340 - protein, 27 aa, Mycobacterium
LQRYLTDNRKIIAWVNSAVIWNSDDQR

SEQ ID NO: 695341 - protein, 23 aa, Mycobacterium
LQSAADLPRGWGVDVAPGHYRVR

SEQ ID NO: 695342 - protein, 18 aa, Mycobacterium
LQSAESFSSRHRFIDTAG

SEQ ID NO: 695343 - protein, 17 aa, Mycobacterium
LQSARIVADILSPDELV

SEQ ID NO: 695344 - protein, 24 aa, Mycobacterium
LQSDNCKLISWPIATLSPNGVRTA

SEQ ID NO: 695345 - protein, 20 aa, Mycobacterium
LQSGSSWAGVVSELESDFTC

SEQ ID NO: 695346 - protein, 21 aa, Mycobacterium
LQSHYLGAIYADWSPDRRLDM

SEQ ID NO: 695347 - protein, 19 aa, Mycobacterium
LQSLGATWAANPAPFLGQI

SEQ ID NO: 695348 - protein, 25 aa, Mycobacterium
LQSLGAVVHPCARITKVSERVDFVR

SEQ ID NO: 695349 - protein, 23 aa, Mycobacterium
LQSLPQDLLNVVNAPTQALLGRA

SEQ ID NO: 695350 - protein, 25 aa, Mycobacterium
LQSLRARFGTLKGVERGVQEGDFVS

SEQ ID NO: 695351 - protein, 25 aa, Mycobacterium
LQSLRARFGTLTGVDRPVADGDFVS

SEQ ID NO: 695352 - protein, 19 aa, Mycobacterium
LQSLRVRFGTLNPVERPVA

SEQ ID NO: 695353 - protein, 17 aa, Mycobacterium
LQSLVDRSGILVFASHS

SEQ ID NO: 695354 - protein, 18 aa, Mycobacterium
LQSPRVWSTTLLREPIDL

SEQ ID NO: 695355 - protein, 23 aa, Mycobacterium
LQSRAARLVACWGNNDGPDLRSR

SEQ ID NO: 695356 - protein, 19 aa, Mycobacterium
LQSRPEERRAFIEEAAGVL

SEQ ID NO: 695357 - protein, 19 aa, Mycobacterium
LQSRQRWVISVAALSVIGS

SEQ ID NO: 695358 - protein, 20 aa, Mycobacterium
LQSRYLGPIYADWSPDRRLD

SEQ ID NO: 695359 - protein, 19 aa, Mycobacterium
LQSTGWLTADGRERRVGYA

SEQ ID NO: 695360 - protein, 25 aa, Mycobacterium
LQSVDGIGAMWARHVREGLSQLAES

SEQ ID NO: 695361 - protein, 26 aa, Mycobacterium
LQSVDGIGAMWARHVREGLSQLAEST

SEQ ID NO: 695362 - protein, 24 aa, Mycobacterium
LQSVDGIGSMWARHIREGLSQLAE

SEQ ID NO: 695363 - protein, 26 aa, Mycobacterium
LQSVEGIGAMWARHVREGLSQLAEST

SEQ ID NO: 695364 - protein, 23 aa, Mycobacterium
LQSYEIPRDFIIETTPWTLENGL

SEQ ID NO: 695365 - protein, 22 aa, Mycobacterium
LQSYEIPRDFLVETTPFTLENG

SEQ ID NO: 695366 - protein, 23 aa, Mycobacterium
LQSYEVPADFLVEAEPFSEDNGL

SEQ ID NO: 695367 - protein, 22 aa, Mycobacterium
LQSYEVPRDFIIETTPFTLENG

SEQ ID NO: 695368 - protein, 23 aa, Mycobacterium
LQSYEVPRDFLIETTPFTLENGL

SEQ ID NO: 695369 - protein, 24 aa, Mycobacterium
LQTAFCVGITRAALTAATEAHTGP

SEQ ID NO: 695370 - protein, 18 aa, Mycobacterium
LQTAWRSPDELRLRGTDA

SEQ ID NO: 695371 - protein, 17 aa, Mycobacterium
LQTEYNHSFKFVLLESL

SEQ ID NO: 695372 - protein, 20 aa, Mycobacterium
LQTGVTWKDLGLIIVDEEQR

SEQ ID NO: 695373 - protein, 17 aa, Mycobacterium
LQTIARMIRLRGAETVI

SEQ ID NO: 695374 - protein, 20 aa, Mycobacterium
LQTIEQDLLGAVNAPTQVLF

SEQ ID NO: 695375 - protein, 17 aa, Mycobacterium
LQTIVSRELSPFEPAVV

SEQ ID NO: 695376 - protein, 18 aa, Mycobacterium
LQTLLPGLFPSSVDTTTT

SEQ ID NO: 695377 - protein, 19 aa, Mycobacterium
LQTNAGRWARRDELDEAIS

SEQ ID NO: 695378 - protein, 19 aa, Mycobacterium
LQTPEAWARIILEGPPAAT

SEQ ID NO: 695379 - protein, 18 aa, Mycobacterium
LQTPEFVEEFILDQTMEP

SEQ ID NO: 695380 - protein, 18 aa, Mycobacterium
LQTPGGLRTPARLWDEIL

SEQ ID NO: 695381 - protein, 38 aa, Mycobacterium
LQTRAFDPLPLCSKICSDGRCPFLHAVRDVRAASGNFL

SEQ ID NO: 695382 - protein, 23 aa, Mycobacterium
LQTSLRSLPLVMVIGSPETSIPV

SEQ ID NO: 695383 - protein, 27 aa, Mycobacterium
LQTTRARRWLRRKLRGGQPRRSPRVAR

SEQ ID NO: 695384 - protein, 18 aa, Mycobacterium
LQTTRRFDALKIFLTLRA

SEQ ID NO: 695385 - protein, 21 aa, Mycobacterium
LQTTRRFDALKVLVTLRAVGQ

SEQ ID NO: 695386 - protein, 22 aa, Mycobacterium
LQTVAALLRLQARRTNNPEGRE

SEQ ID NO: 695387 - protein, 23 aa, Mycobacterium
LQTVAALLRLQARRTPNDEAREA

SEQ ID NO: 695388 - protein, 23 aa, Mycobacterium
LQTVAALLRLQARRTSNEEAREA

SEQ ID NO: 695389 - protein, 24 aa, Mycobacterium
LQTVAALLRLQARRTTNAEGREAL

SEQ ID NO: 695390 - protein, 23 aa, Mycobacterium
LQTVFDFTVQWALDRHTFGRPLA

SEQ ID NO: 695391 - protein, 23 aa, Mycobacterium
LQTVFDLTVQWALDRHTFGRPLA

SEQ ID NO: 695392 - protein, 17 aa, Mycobacterium
LQTVGWTAAAPQTGAGT

SEQ ID NO: 695393 - protein, 28 aa, Mycobacterium
LQVAGAFTLDGLGGWFIDGIDGDPSNVI

SEQ ID NO: 695394 - protein, 20 aa, Mycobacterium
LQVAGIGLLRSWRARNSSPG

SEQ ID NO: 695395 - protein, 17 aa, Mycobacterium
LQVASLDHAMWFMRAFR

SEQ ID NO: 695396 - protein, 17 aa, Mycobacterium
LQVCGAIGLTAEHDLHR

SEQ ID NO: 695397 - protein, 17 aa, Mycobacterium
LQVFDSWAGTLSLTDYR

SEQ ID NO: 695398 - protein, 17 aa, Mycobacterium
LQVFRGGGHFYLEDHID

SEQ ID NO: 695399 - protein, 18 aa, Mycobacterium
LQVGPGVFVPRPETEAVL

SEQ ID NO: 695400 - protein, 20 aa, Mycobacterium
LQVHCYRMLGSLQDAEDTLQ

SEQ ID NO: 695401 - protein, 27 aa, Mycobacterium
LQVIFAYPGVHAIWLHRINHWLWLRGA

SEQ ID NO: 695402 - protein, 17 aa, Mycobacterium
LQVLALVAMDPPVGPSA

SEQ ID NO: 695403 - protein, 17 aa, Mycobacterium
LQVLALVAMEPPVGAGA

SEQ ID NO: 695404 - protein, 19 aa, Mycobacterium
LQVLGDRWFGHGIGRASFA

SEQ ID NO: 695405 - protein, 27 aa, Mycobacterium
LQVLHDLYQRWPFFRSVLSNMAQVMAK

SEQ ID NO: 695406 - protein, 17 aa, Mycobacterium
LQVLIDLGLGYLTLSRR

SEQ ID NO: 695407 - protein, 20 aa, Mycobacterium
LQVLLAIAVKTISNYSNHLF

SEQ ID NO: 695408 - protein, 24 aa, Mycobacterium
LQVMPGEFVCLMGPSGSGKSTLLN

SEQ ID NO: 695409 - protein, 29 aa, Mycobacterium
LQVNFRGSTGFGKAFLKAAIGEFAGKMHD

SEQ ID NO: 695410 - protein, 21 aa, Mycobacterium
LQVNVRQALTLADQATAAGDA

SEQ ID NO: 695411 - protein, 22 aa, Mycobacterium
LQVNVRQALTLADQATAAGDVA

SEQ ID NO: 695412 - protein, 21 aa, Mycobacterium
LQVNVRQALTLADQATTAGDT

SEQ ID NO: 695413 - protein, 22 aa, Mycobacterium
LQVNVRQALTLADQAVAAGDTN

SEQ ID NO: 695414 - protein, 19 aa, Mycobacterium
LQVPAERWVYPHAGTDAHD

SEQ ID NO: 695415 - protein, 23 aa, Mycobacterium
LQVPDARIALCSNGGAGALFTTV

SEQ ID NO: 695416 - protein, 24 aa, Mycobacterium
LQVRAGETLGLLGPNGAGKTTAVR

SEQ ID NO: 695417 - protein, 18 aa, Mycobacterium
LQVRRISHVDARTSYAEL

SEQ ID NO: 695418 - protein, 24 aa, Mycobacterium
LQVRRPGDACAFDIDAAAAAVTRR

SEQ ID NO: 695419 - protein, 17 aa, Mycobacterium
LQVRRPVDLDGRAALIG

SEQ ID NO: 695420 - protein, 24 aa, Mycobacterium
LQVSCGRVARSLWAVIVDPDTGTE

SEQ ID NO: 695421 - protein, 18 aa, Mycobacterium
LQVSRWTREMFCLMEGRH

SEQ ID NO: 695422 - protein, 19 aa, Mycobacterium
LQVTIWVKRLRAVDFTLGY

SEQ ID NO: 695423 - protein, 29 aa, Mycobacterium
LQVWAEPFVPLRVPKIFNLRTDPFERADI

SEQ ID NO: 695424 - protein, 17 aa, Mycobacterium
LQVWPDQMHVFQALPRM

SEQ ID NO: 695425 - protein, 25 aa, Mycobacterium
LQVWSRGTIALAFAAVLIGAGEFEQ

SEQ ID NO: 695426 - protein, 17 aa, Mycobacterium
LQWDLRYGAEVVATLAS

SEQ ID NO: 695427 - protein, 22 aa, Mycobacterium
LQWERRYNRVAAYGQSKLANLL

SEQ ID NO: 695428 - protein, 25 aa, Mycobacterium
LQWKPVGGFPITVGWLHAIRRGHAR

SEQ ID NO: 695429 - protein, 17 aa, Mycobacterium
LQWLATMRDDGVRRIAV

SEQ ID NO: 695430 - protein, 26 aa, Mycobacterium
LQWQNWSLRVGFNYREGMTLHAVTYN

SEQ ID NO: 695431 - protein, 23 aa, Mycobacterium
LQWQQPRGRWVLKTPAHLEHLDV

SEQ ID NO: 695432 - protein, 23 aa, Mycobacterium
LQWREIDGAGALYTYTVARRPTG

SEQ ID NO: 695433 - protein, 25 aa, Mycobacterium
LQYADGGCQLAFWRHDEHLVCEARD

SEQ ID NO: 695434 - protein, 20 aa, Mycobacterium
LQYAKTWRTLAKLSLPNKYL

SEQ ID NO: 695435 - protein, 19 aa, Mycobacterium
LQYCKDRKAFGQPIGSFQH

SEQ ID NO: 695436 - protein, 18 aa, Mycobacterium
LQYFERFFLPSLAKEARP

SEQ ID NO: 695437 - protein, 31 aa, Mycobacterium
LQYHRPRKRWALKGFHGFRLKELFDTYPDAR

SEQ ID NO: 695438 - protein, 18 aa, Mycobacterium
LQYKAIIAAERMIPRNLM

SEQ ID NO: 695439 - protein, 24 aa, Mycobacterium
LQYLDCKFAGYLAERRREPRGDVL

SEQ ID NO: 695440 - protein, 19 aa, Mycobacterium
LQYLLLRSGPLTMPPSTLG

SEQ ID NO: 695441 - protein, 20 aa, Mycobacterium
LQYPGGETKLDIVRATEGAD

SEQ ID NO: 695442 - protein, 21 aa, Mycobacterium
LRAAAAAWRNAGAQFAVAEIH

SEQ ID NO: 695443 - protein, 18 aa, Mycobacterium
LRAAAAGGRYIAGGTTLV

SEQ ID NO: 695444 - protein, 17 aa, Mycobacterium
LRAAAALVTGTTAVVEI

SEQ ID NO: 695445 - protein, 17 aa, Mycobacterium
LRAAADIANDGVIESVR

SEQ ID NO: 695446 - protein, 17 aa, Mycobacterium
LRAAAEFLGRRPNATQD

SEQ ID NO: 695447 - protein, 26 aa, Mycobacterium
LRAAAGRCDIAWPGSKVLCTVRLARR

SEQ ID NO: 695448 - protein, 17 aa, Mycobacterium
LRAAAIIGAGSASFEML

SEQ ID NO: 695449 - protein, 21 aa, Mycobacterium
LRAAAPHALAMLRGFNLIDQL

SEQ ID NO: 695450 - protein, 24 aa, Mycobacterium
LRAAASRWRAFGAAAKGVKGTLDA

SEQ ID NO: 695451 - protein, 19 aa, Mycobacterium
LRAADLFGAQVKWAEVDIE

SEQ ID NO: 695452 - protein, 24 aa, Mycobacterium
LRAAEGFPMNFGFIANGSASSTAP

SEQ ID NO: 695453 - protein, 26 aa, Mycobacterium
LRAAEHPRPEYVLLHISDTHLVGDDG

SEQ ID NO: 695454 - protein, 17 aa, Mycobacterium
LRAAELLGVAPAHAAVF

SEQ ID NO: 695455 - protein, 18 aa, Mycobacterium
LRAAEYGRNVCVLTIDPA

SEQ ID NO: 695456 - protein, 20 aa, Mycobacterium
LRAAGLRPGDRVAVRYPAGN

SEQ ID NO: 695457 - protein, 25 aa, Mycobacterium
LRAAGRPDDEFGFVVHGTMADPRWL

SEQ ID NO: 695458 - protein, 22 aa, Mycobacterium
LRAAGVRLLRIGMVSPLCADTV

SEQ ID NO: 695459 - protein, 18 aa, Mycobacterium
LRAAHAVHGPVALVHFDA

SEQ ID NO: 695460 - protein, 17 aa, Mycobacterium
LRAAHGITVPGRHQLFL

SEQ ID NO: 695461 - protein, 20 aa, Mycobacterium
LRAAHHLSLCPQCAAEVDDH

SEQ ID NO: 695462 - protein, 20 aa, Mycobacterium
LRAAHHLSLCPQCAAEVDDQ

SEQ ID NO: 695463 - protein, 21 aa, Mycobacterium
LRAAHHLSMCPQCAAEVDDQS

SEQ ID NO: 695464 - protein, 19 aa, Mycobacterium
LRAAICGPGSALDLPITLH

SEQ ID NO: 695465 - protein, 25 aa, Mycobacterium
LRAAIDGTVGYPCVVKPVMSSSGKG

SEQ ID NO: 695466 - protein, 27 aa, Mycobacterium
LRAAIEAFSAVKPSLAWSETYPSTLAY

SEQ ID NO: 695467 - protein, 19 aa, Mycobacterium
LRAAKCQTRNLPLIGAPAN

SEQ ID NO: 695468 - protein, 19 aa, Mycobacterium
LRAAKCRTHNLPLIGAPAN

SEQ ID NO: 695469 - protein, 19 aa, Mycobacterium
LRAALDALRVRLARAAESA

SEQ ID NO: 695470 - protein, 17 aa, Mycobacterium
LRAALDVAAGGRRRDGV

SEQ ID NO: 695471 - protein, 19 aa, Mycobacterium
LRAALEAMLAKLAAPGACN

SEQ ID NO: 695472 - protein, 17 aa, Mycobacterium
LRAALPRGGTDVDAVLP

SEQ ID NO: 695473 - protein, 18 aa, Mycobacterium
LRAALRPGMTVALGDGVG

SEQ ID NO: 695474 - protein, 19 aa, Mycobacterium
LRAALVAADTKARVEDIYL

SEQ ID NO: 695475 - protein, 17 aa, Mycobacterium
LRAAMGLTPARTRHEAV

SEQ ID NO: 695476 - protein, 19 aa, Mycobacterium
LRAAQFGGPDSARWRIGDD

SEQ ID NO: 695477 - protein, 17 aa, Mycobacterium
LRAAQPFNAEPDHKSNI

SEQ ID NO: 695478 - protein, 20 aa, Mycobacterium
LRAAREVARRGPGLVPDGVE

SEQ ID NO: 695479 - protein, 23 aa, Mycobacterium
LRAARRPVVLAGHGAARGDATAA

SEQ ID NO: 695480 - protein, 18 aa, Mycobacterium
LRAASFVSLGQLDTAPGL

SEQ ID NO: 695481 - protein, 19 aa, Mycobacterium
LRAATSRRHCLAMLAEFAA

SEQ ID NO: 695482 - protein, 17 aa, Mycobacterium
LRAAVGAEVERMLGPAD

SEQ ID NO: 695483 - protein, 19 aa, Mycobacterium
LRAAYPEWTGEQIFNKARL

SEQ ID NO: 695484 - protein, 23 aa, Mycobacterium
LRACRERLLRLGFEVLTHRTVPP

SEQ ID NO: 695485 - protein, 24 aa, Mycobacterium
LRACTAAGFTPCFRVETHDYVTAV

SEQ ID NO: 695486 - protein, 24 aa, Mycobacterium
LRACVNAGLVRRIEPAGSSARYET

SEQ ID NO: 695487 - protein, 18 aa, Mycobacterium
LRADADFMIWTHAERVEA

SEQ ID NO: 695488 - protein, 33 aa, Mycobacterium
LRADALAAVLRRECPRLQAGATVVAAHWRHEVA

SEQ ID NO: 695489 - protein, 22 aa, Mycobacterium
LRADALAGLEVFGIEIDAARNQ

SEQ ID NO: 695490 - protein, 18 aa, Mycobacterium
LRADALEFMDTVRRAEKD

SEQ ID NO: 695491 - protein, 24 aa, Mycobacterium
LRADARLAMRLILQQHGALPAEPV

SEQ ID NO: 695492 - protein, 24 aa, Mycobacterium
LRADARLAVRSILQERGALPVEST

SEQ ID NO: 695493 - protein, 18 aa, Mycobacterium
LRADAVLAVSRRADELGW

SEQ ID NO: 695494 - protein, 24 aa, Mycobacterium
LRADGRPRSLVWVAGRGTADNAGA

SEQ ID NO: 695495 - protein, 25 aa, Mycobacterium
LRADGSCFEGLYAAGEVAGFGGGGV

SEQ ID NO: 695496 - protein, 19 aa, Mycobacterium
LRADIPIMLGAEGPKNVAL

SEQ ID NO: 695497 - protein, 25 aa, Mycobacterium
LRADLPRILELLARFTDDAVAADRI

SEQ ID NO: 695498 - protein, 19 aa, Mycobacterium
LRADLTLVCDGRWSLCRQE

SEQ ID NO: 695499 - protein, 19 aa, Mycobacterium
LRADLWDQFAELARAGTTL

SEQ ID NO: 695500 - protein, 18 aa, Mycobacterium
LRADPGLLGAFIEETLRF

SEQ ID NO: 695501 - protein, 22 aa, Mycobacterium
LRADPLWLIAHLSRAGWLRWSD

SEQ ID NO: 695502 - protein, 26 aa, Mycobacterium
LRADPRLPEWRAMAARALAQRDELAR

SEQ ID NO: 695503 - protein, 18 aa, Mycobacterium
LRADRLQYFVSCLVYLPR

SEQ ID NO: 695504 - protein, 17 aa, Mycobacterium
LRAEARHGRMLPFVIEL

SEQ ID NO: 695505 - protein, 17 aa, Mycobacterium
LRAEARKGRMIPCAIEL

SEQ ID NO: 695506 - protein, 17 aa, Mycobacterium
LRAEARQGRMLPYVIEL

SEQ ID NO: 695507 - protein, 20 aa, Mycobacterium
LRAEFARRNLGLVLLGTDPL

SEQ ID NO: 695508 - protein, 17 aa, Mycobacterium
LRAEFSDQVWLVELSEL

SEQ ID NO: 695509 - protein, 28 aa, Mycobacterium
LRAEHPVFRRRRFFSGKPVGRRGQGGLP

SEQ ID NO: 695510 - protein, 19 aa, Mycobacterium
LRAELTVACDGRWSIARQA

SEQ ID NO: 695511 - protein, 20 aa, Mycobacterium
LRAELTVACDGRWSIVRQEA

SEQ ID NO: 695512 - protein, 21 aa, Mycobacterium
LRAELTVACDGRWSMARQEAG

SEQ ID NO: 695513 - protein, 19 aa, Mycobacterium
LRAELTVACDGRWSVARRA

SEQ ID NO: 695514 - protein, 17 aa, Mycobacterium
LRAEPPASDALRLEPTV

SEQ ID NO: 695515 - protein, 35 aa, Mycobacterium
LRAERPRLVVLGMSRRYHADFSFASYDPAWIDALF

SEQ ID NO: 695516 - protein, 29 aa, Mycobacterium
LRAESLSGLPPALIVVAGFDPLRDEGEQY

SEQ ID NO: 695517 - protein, 17 aa, Mycobacterium
LRAETLAGILRDADHAG

SEQ ID NO: 695518 - protein, 19 aa, Mycobacterium
LRAEVGLPVYFGNRNWEPY

SEQ ID NO: 695519 - protein, 24 aa, Mycobacterium
LRAEVKPTPLGVVGVIGPWNFPVN

SEQ ID NO: 695520 - protein, 18 aa, Mycobacterium
LRAEVLRILAGVDAEIKR

SEQ ID NO: 695521 - protein, 19 aa, Mycobacterium
LRAFAARLLGIPAQGVRVI

SEQ ID NO: 695522 - protein, 20 aa, Mycobacterium
LRAFAARLLGIPAQHVRVIM

SEQ ID NO: 695523 - protein, 18 aa, Mycobacterium
LRAFTFPFDDVRVLIVGQ

SEQ ID NO: 695524 - protein, 18 aa, Mycobacterium
LRAFTFPFDQVRILIVGQ

SEQ ID NO: 695525 - protein, 18 aa, Mycobacterium
LRAGAIARFAPVMGEVVA

SEQ ID NO: 695526 - protein, 18 aa, Mycobacterium
LRAGAIARFAPVMGEVVS

SEQ ID NO: 695527 - protein, 21 aa, Mycobacterium
LRAGATRLGLSGTRSVLDGLS

SEQ ID NO: 695528 - protein, 20 aa, Mycobacterium
LRAGDAARWHALALAATSAD

SEQ ID NO: 695529 - protein, 18 aa, Mycobacterium
LRAGDYVNMGLACHAELP

SEQ ID NO: 695530 - protein, 18 aa, Mycobacterium
LRAGEFIRPETVADDLGI

SEQ ID NO: 695531 - protein, 17 aa, Mycobacterium
LRAGERVLVHAAAGGVG

SEQ ID NO: 695532 - protein, 21 aa, Mycobacterium
LRAGETLRALGLQSSGVRIKG

SEQ ID NO: 695533 - protein, 17 aa, Mycobacterium
LRAGEVPTLGNWFRAAG

SEQ ID NO: 695534 - protein, 20 aa, Mycobacterium
LRAGFDANLVVLDRDLRVAA

SEQ ID NO: 695535 - protein, 30 aa, Mycobacterium
LRAGGFDVGRPAAWIAEGLLPYLPPAAQDL

SEQ ID NO: 695536 - protein, 19 aa, Mycobacterium
LRAGGFKHHAKVEMQWVAS

SEQ ID NO: 695537 - protein, 21 aa, Mycobacterium
LRAGHDVWWTVLLDGGVRISI

SEQ ID NO: 695538 - protein, 17 aa, Mycobacterium
LRAGHRVLVIGAGPIGL

SEQ ID NO: 695539 - protein, 24 aa, Mycobacterium
LRAGIACQLKGLGVTAIDIDPRCT

SEQ ID NO: 695540 - protein, 25 aa, Mycobacterium
LRAGIPSLILWTAGDQPMWGSRVKQ

SEQ ID NO: 695541 - protein, 23 aa, Mycobacterium
LRAGIPTLILWFTSDQPIFGAAV

SEQ ID NO: 695542 - protein, 24 aa, Mycobacterium
LRAGIPTLILWTAGDQPFWGSHIK

SEQ ID NO: 695543 - protein, 20 aa, Mycobacterium
LRAGKLMGLSGILDDLIQES

SEQ ID NO: 695544 - protein, 18 aa, Mycobacterium
LRAGLGMVDQAHALIPEA

SEQ ID NO: 695545 - protein, 17 aa, Mycobacterium
LRAGLGMVDQAHELIPE

SEQ ID NO: 695546 - protein, 20 aa, Mycobacterium
LRAGLGVAMGNAHPDALAAA

SEQ ID NO: 695547 - protein, 18 aa, Mycobacterium
LRAGLSVLDIGCGPGTIT

SEQ ID NO: 695548 - protein, 18 aa, Mycobacterium
LRAGRLVAVSMSLGHGRT

SEQ ID NO: 695549 - protein, 18 aa, Mycobacterium
LRAGRRSLVMQVDIFGDS

SEQ ID NO: 695550 - protein, 18 aa, Mycobacterium
LRAGTLTRRAHWQSPAGK

SEQ ID NO: 695551 - protein, 17 aa, Mycobacterium
LRAGTLTRTAHWRSPAG

SEQ ID NO: 695552 - protein, 21 aa, Mycobacterium
LRAGVDLDDAAAIAAATDEVD

SEQ ID NO: 695553 - protein, 24 aa, Mycobacterium
LRAGVPPFYVMDVWQAAAERQRTH

SEQ ID NO: 695554 - protein, 19 aa, Mycobacterium
LRAGVPTLILWSTADQPYW

SEQ ID NO: 695555 - protein, 20 aa, Mycobacterium
LRAGYEVKMALGAPESIGAM

SEQ ID NO: 695556 - protein, 28 aa, Mycobacterium
LRAGYPLSQITAALCDRWQPGARLLPVS

SEQ ID NO: 695557 - protein, 19 aa, Mycobacterium
LRAGYWRQVRAQLVVSPAM

SEQ ID NO: 695558 - protein, 24 aa, Mycobacterium
LRAHAAAVPPMFADLVNAPARRQV

SEQ ID NO: 695559 - protein, 22 aa, Mycobacterium
LRAHGVPVWVQQWHKAMHMFQL

SEQ ID NO: 695560 - protein, 21 aa, Mycobacterium
LRAHQLRIGTTCGCPRMRPHL

SEQ ID NO: 695561 - protein, 24 aa, Mycobacterium
LRAHRLRNNLSWVNDYYDDMAWLA

SEQ ID NO: 695562 - protein, 19 aa, Mycobacterium
LRAIADFFGVPASYLIDRD

SEQ ID NO: 695563 - protein, 20 aa, Mycobacterium
LRAIFAAWNCGDRLNFRGQF

SEQ ID NO: 695564 - protein, 20 aa, Mycobacterium
LRAIFVNAVVFPRLKVIESI

SEQ ID NO: 695565 - protein, 20 aa, Mycobacterium
LRAIGAIRRFGGRSSARTWL

SEQ ID NO: 695566 - protein, 26 aa, Mycobacterium
LRAILDEWKTITGLDRKVDDALWKRY

SEQ ID NO: 695567 - protein, 26 aa, Mycobacterium
LRAILELRLPVIGAIDGHVRAGGLGL

SEQ ID NO: 695568 - protein, 19 aa, Mycobacterium
LRAIPGIRSVRELRMPAGR

SEQ ID NO: 695569 - protein, 17 aa, Mycobacterium
LRAIPPLLGGIRLGLAR

SEQ ID NO: 695570 - protein, 19 aa, Mycobacterium
LRAIPVIGDPLADLIEPNM

SEQ ID NO: 695571 - protein, 23 aa, Mycobacterium
LRAKEFTTAGIVARVGGNAPFDA

SEQ ID NO: 695572 - protein, 20 aa, Mycobacterium
LRAKLLDDRVRAFVTEHPNA

SEQ ID NO: 695573 - protein, 17 aa, Mycobacterium
LRAKRFASIQFHAESIL

SEQ ID NO: 695574 - protein, 24 aa, Mycobacterium
LRAKTIRDGREIVLGMARCRIPVV

SEQ ID NO: 695575 - protein, 19 aa, Mycobacterium
LRAKVFPKLVNVLKLRSGL

SEQ ID NO: 695576 - protein, 17 aa, Mycobacterium
LRALAAPVRIAIVLQLR

SEQ ID NO: 695577 - protein, 17 aa, Mycobacterium
LRALAGLLDHIAPGRAA

SEQ ID NO: 695578 - protein, 22 aa, Mycobacterium
LRALALLDTRWVVIGEPFLAAA

SEQ ID NO: 695579 - protein, 19 aa, Mycobacterium
LRALALTPRRDGTVPADSP

SEQ ID NO: 695580 - protein, 18 aa, Mycobacterium
LRALARIAPTQSHRYALV

SEQ ID NO: 695581 - protein, 18 aa, Mycobacterium
LRALATMARRRHTARVFV

SEQ ID NO: 695582 - protein, 18 aa, Mycobacterium
LRALAVSDLDPFIDLLND

SEQ ID NO: 695583 - protein, 17 aa, Mycobacterium
LRALAWGDTTVRIAADA

SEQ ID NO: 695584 - protein, 19 aa, Mycobacterium
LRALFRSGMYFGAEAGAYA

SEQ ID NO: 695585 - protein, 19 aa, Mycobacterium
LRALFSPGVRTFFGRPCVV

SEQ ID NO: 695586 - protein, 19 aa, Mycobacterium
LRALGAAEVIGRLPADPDA

SEQ ID NO: 695587 - protein, 19 aa, Mycobacterium
LRALGGRPPYTVVVGCEAG

SEQ ID NO: 695588 - protein, 26 aa, Mycobacterium
LRALGHAIRAWAVRQPASWALLYGSP

SEQ ID NO: 695589 - protein, 21 aa, Mycobacterium
LRALGPIGWIAARAGARAIRA

SEQ ID NO: 695590 - protein, 22 aa, Mycobacterium
LRALGPVVGRRVLITGASGGVG

SEQ ID NO: 695591 - protein, 17 aa, Mycobacterium
LRALHAVAIVNENDTVA

SEQ ID NO: 695592 - protein, 17 aa, Mycobacterium
LRALHAVGIVNENDTVA

SEQ ID NO: 695593 - protein, 21 aa, Mycobacterium
LRALLGLPITVRGADFGSLYL

SEQ ID NO: 695594 - protein, 20 aa, Mycobacterium
LRALLLQSLHPLAMAGVAEH

SEQ ID NO: 695595 - protein, 20 aa, Mycobacterium
LRALLRPGGVFAAHEYSVRD

SEQ ID NO: 695596 - protein, 17 aa, Mycobacterium
LRALLTVADVVIEGSRP

SEQ ID NO: 695597 - protein, 20 aa, Mycobacterium
LRALNYPKIVLGVSGGLDST

SEQ ID NO: 695598 - protein, 25 aa, Mycobacterium
LRALPEFVATGIPVLLGASRKRFLG

SEQ ID NO: 695599 - protein, 18 aa, Mycobacterium
LRALPERQRQASLLPLLH

SEQ ID NO: 695600 - protein, 23 aa, Mycobacterium
LRALPTDGWLRIVATCVEIGQGW

SEQ ID NO: 695601 - protein, 18 aa, Mycobacterium
LRALPVLVVVEVLFGVQQ

SEQ ID NO: 695602 - protein, 18 aa, Mycobacterium
LRALRLATALGCAAGTSE

SEQ ID NO: 695603 - protein, 18 aa, Mycobacterium
LRALRLHRQITLAQLSET

SEQ ID NO: 695604 - protein, 26 aa, Mycobacterium
LRALRRRVGFVFQHFNLVGRLSCLEN

SEQ ID NO: 695605 - protein, 23 aa, Mycobacterium
LRALRRRVHRLAWITPEPTRYWR

SEQ ID NO: 695606 - protein, 25 aa, Mycobacterium
LRALTDATYSWSMLINTQFAGPGSS

SEQ ID NO: 695607 - protein, 22 aa, Mycobacterium
LRALVADGWLRIIATCMEIGHD

SEQ ID NO: 695608 - protein, 17 aa, Mycobacterium
LRALVDVDIAVNGEQLR

SEQ ID NO: 695609 - protein, 18 aa, Mycobacterium
LRALVGEHVPEHFLGAFT

SEQ ID NO: 695610 - protein, 23 aa, Mycobacterium
LRALVPCLGAGGLGGLRGVEALL

SEQ ID NO: 695611 - protein, 18 aa, Mycobacterium
LRALVPQRLILAHRDRAL

SEQ ID NO: 695612 - protein, 26 aa, Mycobacterium
LRALYRDHLLVLAALDLAATVEDEPV

SEQ ID NO: 695613 - protein, 17 aa, Mycobacterium
LRAMIEVTRDVFLSPVV

SEQ ID NO: 695614 - protein, 19 aa, Mycobacterium
LRAMLGTRLPRYMVPQRIV

SEQ ID NO: 695615 - protein, 20 aa, Mycobacterium
LRAMLRPGDHVIIPTDAYGG

SEQ ID NO: 695616 - protein, 19 aa, Mycobacterium
LRAMLRPGDHVVIPDDAYG

SEQ ID NO: 695617 - protein, 20 aa, Mycobacterium
LRANDLVKQFAAPVNGRGGG

SEQ ID NO: 695618 - protein, 20 aa, Mycobacterium
LRANEPLQIMFGIGGEHDLS

SEQ ID NO: 695619 - protein, 28 aa, Mycobacterium
LRANHPVFRRRRFFSGKPLGRRGQDGLP

SEQ ID NO: 695620 - protein, 19 aa, Mycobacterium
LRAPEVCDRELGLSLPDAT

SEQ ID NO: 695621 - protein, 35 aa, Mycobacterium
LRAPLERVWRAISDAEEFGRWFGVRFDGPFVAGTS

SEQ ID NO: 695622 - protein, 17 aa, Mycobacterium
LRAPQDWAVVENIYHQA

SEQ ID NO: 695623 - protein, 18 aa, Mycobacterium
LRAPRWLPTPARHRARAA

SEQ ID NO: 695624 - protein, 18 aa, Mycobacterium
LRAPTVVRMRESGDIDDG

SEQ ID NO: 695625 - protein, 17 aa, Mycobacterium
LRAPVLTVVAPGLGTLN

SEQ ID NO: 695626 - protein, 18 aa, Mycobacterium
LRAPVYFCDSRSPWQRGS

SEQ ID NO: 695627 - protein, 19 aa, Mycobacterium
LRAPYTIEFGFERTVGPKI

SEQ ID NO: 695628 - protein, 21 aa, Mycobacterium
LRAQETLICYDRNTLRDNQSR

SEQ ID NO: 695629 - protein, 18 aa, Mycobacterium
LRAQGAIVLGMTNVPEMS

SEQ ID NO: 695630 - protein, 19 aa, Mycobacterium
LRAQIAPLQQVWTREAAAA

SEQ ID NO: 695631 - protein, 18 aa, Mycobacterium
LRAQIVFARSRSGAADAP

SEQ ID NO: 695632 - protein, 20 aa, Mycobacterium
LRAQPGLPVCQLRRSTGQRC

SEQ ID NO: 695633 - protein, 26 aa, Mycobacterium
LRAQRAHVLWAHRRARRRLAALRLLR

SEQ ID NO: 695634 - protein, 21 aa, Mycobacterium
LRARAARRAAAQPGLAANVGT

SEQ ID NO: 695635 - protein, 17 aa, Mycobacterium
LRARAGIDQLTVSEHDI

SEQ ID NO: 695636 - protein, 19 aa, Mycobacterium
LRARALAPLADFPEASRDR

SEQ ID NO: 695637 - protein, 26 aa, Mycobacterium
LRARFGDAGVFELTYQIGLENMRARV

SEQ ID NO: 695638 - protein, 23 aa, Mycobacterium
LRARKARGAKPFAMLVRDLKIAR

SEQ ID NO: 695639 - protein, 18 aa, Mycobacterium
LRARKGMVLDAADHDTWS

SEQ ID NO: 695640 - protein, 25 aa, Mycobacterium
LRARLADRLPAYLVPAAVVAIEALP

SEQ ID NO: 695641 - protein, 19 aa, Mycobacterium
LRARLARTRWPEAECVDDW

SEQ ID NO: 695642 - protein, 21 aa, Mycobacterium
LRARLDAMGVVPAKGLFGVPD

SEQ ID NO: 695643 - protein, 17 aa, Mycobacterium
LRARLDGLTTRDAARLG

SEQ ID NO: 695644 - protein, 19 aa, Mycobacterium
LRARLIERINNLRVGHSLD

SEQ ID NO: 695645 - protein, 26 aa, Mycobacterium
LRARLRPRGAAQISVVVTRIGSGAAS

SEQ ID NO: 695646 - protein, 20 aa, Mycobacterium
LRARLVLLAVADDGMSTVEY

SEQ ID NO: 695647 - protein, 24 aa, Mycobacterium
LRARNPKLIYARLSAFGGNGPHGN

SEQ ID NO: 695648 - protein, 18 aa, Mycobacterium
LRARRDRLAAGLSDIGFE

SEQ ID NO: 695649 - protein, 20 aa, Mycobacterium
LRARRFPQARFVSSDIERDG

SEQ ID NO: 695650 - protein, 22 aa, Mycobacterium
LRARRPAHGLTLLREALGGDSE

SEQ ID NO: 695651 - protein, 18 aa, Mycobacterium
LRARRRAALLSQIQQTAH

SEQ ID NO: 695652 - protein, 19 aa, Mycobacterium
LRARSWWSGPDVVLLVDDW

SEQ ID NO: 695653 - protein, 21 aa, Mycobacterium
LRARVLKRWSVAPGTPPVTVV

SEQ ID NO: 695654 - protein, 19 aa, Mycobacterium
LRARVLTFLGRRQLFDPAL

SEQ ID NO: 695655 - protein, 18 aa, Mycobacterium
LRARVWIAQVGRIPLLLL

SEQ ID NO: 695656 - protein, 18 aa, Mycobacterium
LRASAGSIFCVPVVVAPD

SEQ ID NO: 695657 - protein, 17 aa, Mycobacterium
LRASAGSIFSIPVISHH

SEQ ID NO: 695658 - protein, 19 aa, Mycobacterium
LRASDLARAITFVAETPRG

SEQ ID NO: 695659 - protein, 19 aa, Mycobacterium
LRASGLRKLTMRAVAVRLG

SEQ ID NO: 695660 - protein, 30 aa, Mycobacterium
LRASKPLVRLRVPFTLSRNEIDDVERGSQD

SEQ ID NO: 695661 - protein, 29 aa, Mycobacterium
LRASNRIAIERGKAFGGFERSKYKSGEFF

SEQ ID NO: 695662 - protein, 18 aa, Mycobacterium
LRASQLAVTDWDRRRLFD

SEQ ID NO: 695663 - protein, 23 aa, Mycobacterium
LRASSYPDLTVRMVAARAGVSPA

SEQ ID NO: 695664 - protein, 24 aa, Mycobacterium
LRASVLSRRGRPLGWVSGRAAQLG

SEQ ID NO: 695665 - protein, 17 aa, Mycobacterium
LRASWTATTLELGPHVE

SEQ ID NO: 695666 - protein, 17 aa, Mycobacterium
LRASYPLGHGHGPVSPL

SEQ ID NO: 695667 - protein, 19 aa, Mycobacterium
LRATADWFVMLKAERRRLR

SEQ ID NO: 695668 - protein, 18 aa, Mycobacterium
LRATAHFAVGGVTQTISA

SEQ ID NO: 695669 - protein, 32 aa, Mycobacterium
LRATAPVCWNEVTHFWALLKYEDIRFVSANPA

SEQ ID NO: 695670 - protein, 24 aa, Mycobacterium
LRATGRGVLRPDLTVLSDGQSIGV

SEQ ID NO: 695671 - protein, 17 aa, Mycobacterium
LRATGYRALDNELAGRP

SEQ ID NO: 695672 - protein, 17 aa, Mycobacterium
LRATGYRALGNELAGRP

SEQ ID NO: 695673 - protein, 18 aa, Mycobacterium
LRATHPLAPTLPLIRRLL

SEQ ID NO: 695674 - protein, 17 aa, Mycobacterium
LRATLPLVDAGAASPRE

SEQ ID NO: 695675 - protein, 23 aa, Mycobacterium
LRATMRKLMMDFFARLAASEEQR

SEQ ID NO: 695676 - protein, 18 aa, Mycobacterium
LRATRISPLYPQRPRESQ

SEQ ID NO: 695677 - protein, 18 aa, Mycobacterium
LRATRSKVGMVFQQFNLF

SEQ ID NO: 695678 - protein, 27 aa, Mycobacterium
LRATRTIRRPPRCDGIATIIAELDEDS

SEQ ID NO: 695679 - protein, 20 aa, Mycobacterium
LRATSFANLTMRAVAARAGV

SEQ ID NO: 695680 - protein, 24 aa, Mycobacterium
LRATTDFRSAAVLIHAGGEVDAAN

SEQ ID NO: 695681 - protein, 23 aa, Mycobacterium
LRAVAPRAAVPIHQGIIAPDARG

SEQ ID NO: 695682 - protein, 17 aa, Mycobacterium
LRAVGAYDFGGKLADAM

SEQ ID NO: 695683 - protein, 21 aa, Mycobacterium
LRAVGRGVLRADLSVLTDDTP

SEQ ID NO: 695684 - protein, 22 aa, Mycobacterium
LRAVIEAGVAQGVFRGVDVDLT

SEQ ID NO: 695685 - protein, 18 aa, Mycobacterium
LRAVPGLRIRADAELSRM

SEQ ID NO: 695686 - protein, 21 aa, Mycobacterium
LRAVREVARRGPGLVPDGVDI

SEQ ID NO: 695687 - protein, 17 aa, Mycobacterium
LRAVSAIGVRFPLESTA

SEQ ID NO: 695688 - protein, 30 aa, Mycobacterium
LRAWLRRFSTDWPRWGWRRAAKMARRAGWA

SEQ ID NO: 695689 - protein, 27 aa, Mycobacterium
LRAWRSSAQEYLVWRAAANHFELVRDA

SEQ ID NO: 695690 - protein, 18 aa, Mycobacterium
LRAYRVHLLGGRPDAREH

SEQ ID NO: 695691 - protein, 19 aa, Mycobacterium
LRAYRVVRYDGAREEAEVA

SEQ ID NO: 695692 - protein, 20 aa, Mycobacterium
LRCFVVLAEELHFGRAAQRL

SEQ ID NO: 695693 - protein, 20 aa, Mycobacterium
LRCGESLSAVLLECTMAGLA

SEQ ID NO: 695694 - protein, 18 aa, Mycobacterium
LRCGEVLSSVLLECTMAG

SEQ ID NO: 695695 - protein, 20 aa, Mycobacterium
LRCNYCMPAEGLDWLPGQQL

SEQ ID NO: 695696 - protein, 18 aa, Mycobacterium
LRCPTCFTDSSPDLRNVV

SEQ ID NO: 695697 - protein, 17 aa, Mycobacterium
LRCQVRIDPLRRAYTDA

SEQ ID NO: 695698 - protein, 28 aa, Mycobacterium
LRCYLDDRPIFLGRNGRISVFNSERALA

SEQ ID NO: 695699 - protein, 28 aa, Mycobacterium
LRCYLDDRPIFLGRNGRISVFSSERALA

SEQ ID NO: 695700 - protein, 17 aa, Mycobacterium
LRDAAAMLLDAARRLES

SEQ ID NO: 695701 - protein, 23 aa, Mycobacterium
LRDAARAAVRLMNHGRSAENGEG

SEQ ID NO: 695702 - protein, 23 aa, Mycobacterium
LRDAARLAFRYLLDTLLERPMSR

SEQ ID NO: 695703 - protein, 19 aa, Mycobacterium
LRDAFPHAALIEIPDCSAF

SEQ ID NO: 695704 - protein, 17 aa, Mycobacterium
LRDAGAIAGEPGVLNAG

SEQ ID NO: 695705 - protein, 20 aa, Mycobacterium
LRDAGCVLQQGFLYSHPLEV

SEQ ID NO: 695706 - protein, 17 aa, Mycobacterium
LRDAGHDVVVWDLSDAD

SEQ ID NO: 695707 - protein, 20 aa, Mycobacterium
LRDAGMEGVVFVGVPRTMND

SEQ ID NO: 695708 - protein, 26 aa, Mycobacterium
LRDALGRRGGGFVLIGRRHLRSNNSW

SEQ ID NO: 695709 - protein, 17 aa, Mycobacterium
LRDAMALLDAEDSYGEA

SEQ ID NO: 695710 - protein, 18 aa, Mycobacterium
LRDAMNYGGLSVYSGEWW

SEQ ID NO: 695711 - protein, 19 aa, Mycobacterium
LRDAPLSVMTTWQHRHREL

SEQ ID NO: 695712 - protein, 22 aa, Mycobacterium
LRDARERYAPVPVIEVVLPAVR

SEQ ID NO: 695713 - protein, 19 aa, Mycobacterium
LRDASGITQVVFRAEDVLA

SEQ ID NO: 695714 - protein, 19 aa, Mycobacterium
LRDAVAAVIRRHDVLRTVY

SEQ ID NO: 695715 - protein, 19 aa, Mycobacterium
LRDAVAWATVQRPGFTLRG

SEQ ID NO: 695716 - protein, 17 aa, Mycobacterium
LRDAVGIPEGWMVAGHI

SEQ ID NO: 695717 - protein, 17 aa, Mycobacterium
LRDAVGVPAEWFLAGHV

SEQ ID NO: 695718 - protein, 17 aa, Mycobacterium
LRDCARLSSAKGDILEV

SEQ ID NO: 695719 - protein, 19 aa, Mycobacterium
LRDCDPMTGALIKASKATA

SEQ ID NO: 695720 - protein, 24 aa, Mycobacterium
LRDDFLRNFWMQMIRNPVGSLREL

SEQ ID NO: 695721 - protein, 27 aa, Mycobacterium
LRDDLEGWQRLNVCAFLASGIAAAHPG

SEQ ID NO: 695722 - protein, 24 aa, Mycobacterium
LRDDPRFASAAARREHHDEFDEVL

SEQ ID NO: 695723 - protein, 25 aa, Mycobacterium
LRDDWPEALRRSGFDPRRPTSWSAE

SEQ ID NO: 695724 - protein, 19 aa, Mycobacterium
LRDDYFWQGDEHMIGVVDA

SEQ ID NO: 695725 - protein, 28 aa, Mycobacterium
LRDEAPVYFNGRFGFWALSRFADVEAAL

SEQ ID NO: 695726 - protein, 20 aa, Mycobacterium
LRDEELLVFLGVIANAGSET

SEQ ID NO: 695727 - protein, 19 aa, Mycobacterium
LRDELCTAGGTAVDILCDV

SEQ ID NO: 695728 - protein, 18 aa, Mycobacterium
LRDELRGLGPLPATGRGL

SEQ ID NO: 695729 - protein, 19 aa, Mycobacterium
LRDEMRRYLDLGYDAVKMK

SEQ ID NO: 695730 - protein, 25 aa, Mycobacterium
LRDEPRWPKYAPAAVEHGVLSSLSF

SEQ ID NO: 695731 - protein, 28 aa, Mycobacterium
LRDEPRWPRYAPAAVERGVLSSLSFKLY

SEQ ID NO: 695732 - protein, 17 aa, Mycobacterium
LRDEVTWVDYSYVNHVV

SEQ ID NO: 695733 - protein, 24 aa, Mycobacterium
LRDFCRRHEVLLIFDEIATGFGRT

SEQ ID NO: 695734 - protein, 17 aa, Mycobacterium
LRDFELDAAIAHFGPED

SEQ ID NO: 695735 - protein, 18 aa, Mycobacterium
LRDFELLAPLRARLSDGL

SEQ ID NO: 695736 - protein, 18 aa, Mycobacterium
LRDGALLTEVIASTLGVR

SEQ ID NO: 695737 - protein, 20 aa, Mycobacterium
LRDGDSWLINGSKMFTTGAH

SEQ ID NO: 695738 - protein, 17 aa, Mycobacterium
LRDGDVIDSMFMSKKAL

SEQ ID NO: 695739 - protein, 17 aa, Mycobacterium
LRDGELETAIASHDLGF

SEQ ID NO: 695740 - protein, 19 aa, Mycobacterium
LRDGFEWQQVYTRSEPGTL

SEQ ID NO: 695741 - protein, 20 aa, Mycobacterium
LRDGFIAGLEEEQWDAVIQV

SEQ ID NO: 695742 - protein, 19 aa, Mycobacterium
LRDGMTLALEPWFARTTDR

SEQ ID NO: 695743 - protein, 18 aa, Mycobacterium
LRDGRPVTGGAFCRHDPD

SEQ ID NO: 695744 - protein, 17 aa, Mycobacterium
LRDGTGWDSEYQRDVWR

SEQ ID NO: 695745 - protein, 19 aa, Mycobacterium
LRDGVIPRRLVTSCEHFHR

SEQ ID NO: 695746 - protein, 17 aa, Mycobacterium
LRDGVPVKAERWAALAT

SEQ ID NO: 695747 - protein, 21 aa, Mycobacterium
LRDGWCRTGDMGRLDERGLLY

SEQ ID NO: 695748 - protein, 20 aa, Mycobacterium
LRDHFRCIAPDYLGFGLSEH

SEQ ID NO: 695749 - protein, 28 aa, Mycobacterium
LRDHHVRFCAAAPIVTFDGYRLGAVVVM

SEQ ID NO: 695750 - protein, 17 aa, Mycobacterium
LRDIAEMGGGFTTSTGE

SEQ ID NO: 695751 - protein, 19 aa, Mycobacterium
LRDIDGMPAVFARTEHETV

SEQ ID NO: 695752 - protein, 18 aa, Mycobacterium
LRDIEWRIGPGERTGIVG

SEQ ID NO: 695753 - protein, 23 aa, Mycobacterium
LRDIKAGVAAGRFTIDDPELALA

SEQ ID NO: 695754 - protein, 19 aa, Mycobacterium
LRDIKARALDNCAAAGLTV

SEQ ID NO: 695755 - protein, 26 aa, Mycobacterium
LRDILELPLPVIIAVNGHVRAGGFGL

SEQ ID NO: 695756 - protein, 29 aa, Mycobacterium
LRDILGLLRDAYCRHIGVEYTHILEPEQQ

SEQ ID NO: 695757 - protein, 19 aa, Mycobacterium
LRDIREVVANASLDDTSKA

SEQ ID NO: 695758 - protein, 20 aa, Mycobacterium
LRDIRLRRGRLYELTRTGRG

SEQ ID NO: 695759 - protein, 24 aa, Mycobacterium
LRDIRRRVGLVFQDPDDQLFMPTV

SEQ ID NO: 695760 - protein, 25 aa, Mycobacterium
LRDIWLLRMRAALAGARGAGGDYQR

SEQ ID NO: 695761 - protein, 19 aa, Mycobacterium
LRDKFGIGAQLLLPSTVNR

SEQ ID NO: 695762 - protein, 25 aa, Mycobacterium
LRDKICADAVAFARHIGYTCAGTVE

SEQ ID NO: 695763 - protein, 22 aa, Mycobacterium
LRDKLRLGTTVLGSRFDEDTDI

SEQ ID NO: 695764 - protein, 17 aa, Mycobacterium
LRDKLSAPRVIWVMVPA

SEQ ID NO: 695765 - protein, 23 aa, Mycobacterium
LRDKRIPFEMCPSSNVQTGAVAS

SEQ ID NO: 695766 - protein, 22 aa, Mycobacterium
LRDKRIPLEMCPSSNVQTGAVK

SEQ ID NO: 695767 - protein, 25 aa, Mycobacterium
LRDLASRIFTEFTYRSGSTTISTGV

SEQ ID NO: 695768 - protein, 25 aa, Mycobacterium
LRDLEVARLLSNWATTESDPLSAAD

SEQ ID NO: 695769 - protein, 24 aa, Mycobacterium
LRDLGCDYAICYFPEAAYDRSGIE

SEQ ID NO: 695770 - protein, 24 aa, Mycobacterium
LRDLGRCRGEPVLAPVVFTSALDL

SEQ ID NO: 695771 - protein, 17 aa, Mycobacterium
LRDLSWVPDTDVEVTPV

SEQ ID NO: 695772 - protein, 17 aa, Mycobacterium
LRDLTTIALKISPLRAH

SEQ ID NO: 695773 - protein, 25 aa, Mycobacterium
LRDLVLPLRRLTVITGANGTGKSSL

SEQ ID NO: 695774 - protein, 24 aa, Mycobacterium
LRDLYRDRLLVLAALDVASTVENE

SEQ ID NO: 695775 - protein, 18 aa, Mycobacterium
LRDMGLFGLMIPEEYGGL

SEQ ID NO: 695776 - protein, 19 aa, Mycobacterium
LRDNGFRGALTIIGDEPHE

SEQ ID NO: 695777 - protein, 19 aa, Mycobacterium
LRDNPAWITGIEHRIETPS

SEQ ID NO: 695778 - protein, 19 aa, Mycobacterium
LRDPHELPGATWLPDSGNT

SEQ ID NO: 695779 - protein, 21 aa, Mycobacterium
LRDPLRLGAYQLLRTRVEPHA

SEQ ID NO: 695780 - protein, 24 aa, Mycobacterium
LRDPRFRMPPGMFLAAQGITSGPL

SEQ ID NO: 695781 - protein, 23 aa, Mycobacterium
LRDRCPADLFAALIASQNPPVLR

SEQ ID NO: 695782 - protein, 21 aa, Mycobacterium
LRDRDGLDLVTEFAVRAEPQE

SEQ ID NO: 695783 - protein, 23 aa, Mycobacterium
LRDREINILFAVDLFNEGLDIPE

SEQ ID NO: 695784 - protein, 20 aa, Mycobacterium
LRDRFRCIAPDYLGFGLSER

SEQ ID NO: 695785 - protein, 19 aa, Mycobacterium
LRDRIPKVAAVFAQGDIDF

SEQ ID NO: 695786 - protein, 17 aa, Mycobacterium
LRDRIRFGTEIVSARFE

SEQ ID NO: 695787 - protein, 19 aa, Mycobacterium
LRDRISLAHQRFDRLIRTA

SEQ ID NO: 695788 - protein, 19 aa, Mycobacterium
LRDRLALRGTQLFGKTLGV

SEQ ID NO: 695789 - protein, 19 aa, Mycobacterium
LRDRLDLVGKIGLTSDELG

SEQ ID NO: 695790 - protein, 23 aa, Mycobacterium
LRDRLGSIPGVMVEHKRFGVATH

SEQ ID NO: 695791 - protein, 18 aa, Mycobacterium
LRDRLRRWTGQSVPAARL

SEQ ID NO: 695792 - protein, 40 aa, Mycobacterium
LRDRPRLAAAAQRIAAPLMKEWPDVLATPRPTPAYWLHEG

SEQ ID NO: 695793 - protein, 25 aa, Mycobacterium
LRDRVPMVMLLEGAGFRPSGEHYGR

SEQ ID NO: 695794 - protein, 19 aa, Mycobacterium
LRDRVRWRGWSAGPGPALA

SEQ ID NO: 695795 - protein, 25 aa, Mycobacterium
LRDSEGWPLYPIRPGQTYVNIGFWS

SEQ ID NO: 695796 - protein, 25 aa, Mycobacterium
LRDTFPAALIMYGAAEMEMLQRAEQ

SEQ ID NO: 695797 - protein, 21 aa, Mycobacterium
LRDTFPAALVAPVAAYLVSED

SEQ ID NO: 695798 - protein, 19 aa, Mycobacterium
LRDTIIVAAFEGWNDAGDA

SEQ ID NO: 695799 - protein, 20 aa, Mycobacterium
LRDTWLSARRDLLDRRNRAR

SEQ ID NO: 695800 - protein, 22 aa, Mycobacterium
LRDVGWRGSLQSDKPEIVEAVA

SEQ ID NO: 695801 - protein, 18 aa, Mycobacterium
LRDVLSVLRDAYCRHAGV

SEQ ID NO: 695802 - protein, 24 aa, Mycobacterium
LRDVPANLRRGSVVDFDQFTVTRH

SEQ ID NO: 695803 - protein, 21 aa, Mycobacterium
LRDVPYVHDFDCRDGQLRFSV

SEQ ID NO: 695804 - protein, 29 aa, Mycobacterium
LRDWFEFLDRGGLVWSRVRLEEVGRFVAW

SEQ ID NO: 695805 - protein, 22 aa, Mycobacterium
LRDWKAEFPDAVVVSYVNTTAA

SEQ ID NO: 695806 - protein, 25 aa, Mycobacterium
LRDWLPDDHLALFVSELVDEVLDLA

SEQ ID NO: 695807 - protein, 21 aa, Mycobacterium
LRDWQVLRFTWLDLTEYPERV

SEQ ID NO: 695808 - protein, 32 aa, Mycobacterium
LRDWRQWWDWAPGACWHHPFGPRREFCRPDHP

SEQ ID NO: 695809 - protein, 29 aa, Mycobacterium
LRDWRQWWRWVPGASWRHPFGPDSDVADR

SEQ ID NO: 695810 - protein, 24 aa, Mycobacterium
LRDYLLAVKACFAAFRSGTLDHHG

SEQ ID NO: 695811 - protein, 26 aa, Mycobacterium
LRDYSEAMVLPALELYTHGLLTDSTM

SEQ ID NO: 695812 - protein, 24 aa, Mycobacterium
LRDYVLAVKACFSAFRTGTLDHHG

SEQ ID NO: 695813 - protein, 34 aa, Mycobacterium
LREAAGGWRMYTRSRYAPYVEKLLLDGARSKLTR

SEQ ID NO: 695814 - protein, 18 aa, Mycobacterium
LREAAVAALARRFGVTGL

SEQ ID NO: 695815 - protein, 24 aa, Mycobacterium
LREAEAYDGPSLVIAYSHCIAHGF

SEQ ID NO: 695816 - protein, 24 aa, Mycobacterium
LREAELPGAVLARVASSHLRVGSF

SEQ ID NO: 695817 - protein, 19 aa, Mycobacterium
LREAELWAATAAVRTGFEY

SEQ ID NO: 695818 - protein, 17 aa, Mycobacterium
LREAFAYSHFEIAEILE

SEQ ID NO: 695819 - protein, 19 aa, Mycobacterium
LREAFKKPIPPRVVDSGPV

SEQ ID NO: 695820 - protein, 20 aa, Mycobacterium
LREAGGGWRMYTRAKYAPYV

SEQ ID NO: 695821 - protein, 19 aa, Mycobacterium
LREAHAAGHDVARLHSGDP

SEQ ID NO: 695822 - protein, 29 aa, Mycobacterium
LREAHDLCALPVGVFRCDMILADTTYAGQ

SEQ ID NO: 695823 - protein, 18 aa, Mycobacterium
LREAHDLCGLPVTVFRCD

SEQ ID NO: 695824 - protein, 29 aa, Mycobacterium
LREAHDLCGLPVTVFRCDMILADTSYAGQ

SEQ ID NO: 695825 - protein, 18 aa, Mycobacterium
LREAHDLCGVPVAVFRSD

SEQ ID NO: 695826 - protein, 17 aa, Mycobacterium
LREAIPMPVEDKPDEPS

SEQ ID NO: 695827 - protein, 21 aa, Mycobacterium
LREAIQIIRDLLCGEHVDGKG

SEQ ID NO: 695828 - protein, 27 aa, Mycobacterium
LREALKAVPARRLWVNPDCGLKTRKVD

SEQ ID NO: 695829 - protein, 22 aa, Mycobacterium
LREAPTLPAIERYTGVLYDALD

SEQ ID NO: 695830 - protein, 21 aa, Mycobacterium
LREATQIAVKALRAGSADGSG

SEQ ID NO: 695831 - protein, 21 aa, Mycobacterium
LREATRIAVKALRAGSESSNG

SEQ ID NO: 695832 - protein, 24 aa, Mycobacterium
LREATVATTAWGLRGLRTAERKAQ

SEQ ID NO: 695833 - protein, 24 aa, Mycobacterium
LREAVAPMRILTGIEVDILEDGSL

SEQ ID NO: 695834 - protein, 17 aa, Mycobacterium
LREAVFMDSDRWDELAG

SEQ ID NO: 695835 - protein, 33 aa, Mycobacterium
LREAVSRYWAIDEIRPAFIHVHLAEVLSRIPGV

SEQ ID NO: 695836 - protein, 19 aa, Mycobacterium
LREAYELSSQYNLHLANTR

SEQ ID NO: 695837 - protein, 26 aa, Mycobacterium
LRECPTEVPVGVGFLKRSGLVRRGDP

SEQ ID NO: 695838 - protein, 23 aa, Mycobacterium
LREDAGGPAVAWVQQIEYQRMGL

SEQ ID NO: 695839 - protein, 17 aa, Mycobacterium
LREDWPQALRDSGFDAT

SEQ ID NO: 695840 - protein, 19 aa, Mycobacterium
LREDWPTALAAAGFDRTQP

SEQ ID NO: 695841 - protein, 17 aa, Mycobacterium
LREEIDRGLTYGLEAAP

SEQ ID NO: 695842 - protein, 21 aa, Mycobacterium
LREELWRVVGGKVDSTVSAEG

SEQ ID NO: 695843 - protein, 18 aa, Mycobacterium
LREERFGLFAAFEIANTR

SEQ ID NO: 695844 - protein, 17 aa, Mycobacterium
LREEVGIELPEATVLGL

SEQ ID NO: 695845 - protein, 17 aa, Mycobacterium
LREFADRGTVGEVADAM

SEQ ID NO: 695846 - protein, 18 aa, Mycobacterium
LREFKTGAARMALEAQVP

SEQ ID NO: 695847 - protein, 24 aa, Mycobacterium
LREFLDSLGGLWAEGKLADKIYAA

SEQ ID NO: 695848 - protein, 24 aa, Mycobacterium
LREFPGRLTPQLSRALHRHATRFL

SEQ ID NO: 695849 - protein, 24 aa, Mycobacterium
LREFSLTATTGWPGPEPLDGAAYT

SEQ ID NO: 695850 - protein, 17 aa, Mycobacterium
LREGDIEAVGPRILSAA

SEQ ID NO: 695851 - protein, 20 aa, Mycobacterium
LREGEIPGALVIERNVLEWR

SEQ ID NO: 695852 - protein, 26 aa, Mycobacterium
LREGLACAVLRRPDHRETYDAMFDLW

SEQ ID NO: 695853 - protein, 21 aa, Mycobacterium
LREGRAMHVPIRFNRSIDPDK

SEQ ID NO: 695854 - protein, 18 aa, Mycobacterium
LREHCRATLTPYEVPARI

SEQ ID NO: 695855 - protein, 17 aa, Mycobacterium
LREHGVDVLELVLGVTR

SEQ ID NO: 695856 - protein, 21 aa, Mycobacterium
LREHGVRVLVIRPGQVRTRMS

SEQ ID NO: 695857 - protein, 27 aa, Mycobacterium
LREHLGGLCERVALLPGADTQAFVDID

SEQ ID NO: 695858 - protein, 22 aa, Mycobacterium
LREHVPDAGGMIIASDRTAARA

SEQ ID NO: 695859 - protein, 29 aa, Mycobacterium
LREICEFPFSRLYEKLGLPAAAQDNDNEL

SEQ ID NO: 695860 - protein, 23 aa, Mycobacterium
LREIGGPVPAGFGVTPADVERGG

SEQ ID NO: 695861 - protein, 21 aa, Mycobacterium
LREIGRLFGRIAHLLDAVADY

SEQ ID NO: 695862 - protein, 20 aa, Mycobacterium
LREINWKVLVEQFLEGYHIR

SEQ ID NO: 695863 - protein, 21 aa, Mycobacterium
LREIPRPGAQFTPVAVYVGGR

SEQ ID NO: 695864 - protein, 21 aa, Mycobacterium
LREITSLNAIIGRLSSKELGE

SEQ ID NO: 695865 - protein, 17 aa, Mycobacterium
LREIVRLVIGLERRLGD

SEQ ID NO: 695866 - protein, 20 aa, Mycobacterium
LREKAVRLQHGWMNSYTGDQ

SEQ ID NO: 695867 - protein, 20 aa, Mycobacterium
LREKIGAVTMGRVLTLIIVP

SEQ ID NO: 695868 - protein, 26 aa, Mycobacterium
LREKMPRRFYCHARWHSSELNSETQV

SEQ ID NO: 695869 - protein, 20 aa, Mycobacterium
LREKVGAVTMGRVLTLIIAP

SEQ ID NO: 695870 - protein, 24 aa, Mycobacterium
LREKYPLYHIEKWDTWALSRFSDI

SEQ ID NO: 695871 - protein, 21 aa, Mycobacterium
LRELAARPGITLFEVDTIEGT

SEQ ID NO: 695872 - protein, 19 aa, Mycobacterium
LRELAIMRIGWLTACDYEW

SEQ ID NO: 695873 - protein, 18 aa, Mycobacterium
LRELCAGLDMARQSVSKH

SEQ ID NO: 695874 - protein, 19 aa, Mycobacterium
LRELCRRHDVLLVFDEIAT

SEQ ID NO: 695875 - protein, 18 aa, Mycobacterium
LRELERGGLRAAVDAAVQ

SEQ ID NO: 695876 - protein, 19 aa, Mycobacterium
LRELERGGLRAAVDAAVQA

SEQ ID NO: 695877 - protein, 19 aa, Mycobacterium
LRELFSIAMRYFALTMLHI

SEQ ID NO: 695878 - protein, 20 aa, Mycobacterium
LRELGWDVIRVIKEDRDSDV

SEQ ID NO: 695879 - protein, 18 aa, Mycobacterium
LRELGWEIEDVTAYRTVR

SEQ ID NO: 695880 - protein, 18 aa, Mycobacterium
LRELGYRTVLAVVVTPNA

SEQ ID NO: 695881 - protein, 23 aa, Mycobacterium
LRELHHVMLWAAFRYSTKPQAVP

SEQ ID NO: 695882 - protein, 26 aa, Mycobacterium
LRELIKACAGRDFLDRRDEAIIRLMA

SEQ ID NO: 695883 - protein, 18 aa, Mycobacterium
LRELLAGPVTDDADVAEA

SEQ ID NO: 695884 - protein, 20 aa, Mycobacterium
LRELLEVLHLVFGGLHHHGA

SEQ ID NO: 695885 - protein, 17 aa, Mycobacterium
LRELLGRVVEQGTGHEL

SEQ ID NO: 695886 - protein, 17 aa, Mycobacterium
LRELLVERLPELPQLRW

SEQ ID NO: 695887 - protein, 19 aa, Mycobacterium
LRELPGLRLIGLDRDPSAL

SEQ ID NO: 695888 - protein, 18 aa, Mycobacterium
LRELRGGVHFNALTISGI

SEQ ID NO: 695889 - protein, 23 aa, Mycobacterium
LRELRLEVDIVYFTVPVPFFGGK

SEQ ID NO: 695890 - protein, 18 aa, Mycobacterium
LRELRLHNGTVWRWNRPV

SEQ ID NO: 695891 - protein, 22 aa, Mycobacterium
LRELRSAGAVFGLLDVDEEFFI

SEQ ID NO: 695892 - protein, 17 aa, Mycobacterium
LRELRSDMMTGFTDLVL

SEQ ID NO: 695893 - protein, 24 aa, Mycobacterium
LRELRSSGAVFGLLDIDDEFFIIL

SEQ ID NO: 695894 - protein, 25 aa, Mycobacterium
LRELRSSGAVFGLLDIDDEFFVILR

SEQ ID NO: 695895 - protein, 19 aa, Mycobacterium
LRELSRFGLDPGVAAPSYG

SEQ ID NO: 695896 - protein, 23 aa, Mycobacterium
LRELTGAGMLDCKNALAESDGDF

SEQ ID NO: 695897 - protein, 18 aa, Mycobacterium
LRELTGIALRLSPLRAHA

SEQ ID NO: 695898 - protein, 22 aa, Mycobacterium
LRELVGRYWAIDEIKPARLHGN

SEQ ID NO: 695899 - protein, 17 aa, Mycobacterium
LRELWRAHLRNTGRHGS

SEQ ID NO: 695900 - protein, 19 aa, Mycobacterium
LREMAGRWADAIFTVQRDI

SEQ ID NO: 695901 - protein, 18 aa, Mycobacterium
LREMVRRTMAILATPAAR

SEQ ID NO: 695902 - protein, 19 aa, Mycobacterium
LREQCGLTDAIAFDVSNAC

SEQ ID NO: 695903 - protein, 19 aa, Mycobacterium
LREQGVTAPAGFRAAGIAA

SEQ ID NO: 695904 - protein, 23 aa, Mycobacterium
LREQIPGLPLLLLTAKDSVEDRI

SEQ ID NO: 695905 - protein, 18 aa, Mycobacterium
LRERAELAAHWLSHGQWT

SEQ ID NO: 695906 - protein, 19 aa, Mycobacterium
LRERCAALAAETRGYQTDD

SEQ ID NO: 695907 - protein, 22 aa, Mycobacterium
LRERCARENGWLGGSFPGDDAA

SEQ ID NO: 695908 - protein, 20 aa, Mycobacterium
LRERCGLTGTHLGCEHGACG

SEQ ID NO: 695909 - protein, 18 aa, Mycobacterium
LRERGIVELARYKPLLDS

SEQ ID NO: 695910 - protein, 20 aa, Mycobacterium
LRERGLRSVSPLSVQMYMPN

SEQ ID NO: 695911 - protein, 21 aa, Mycobacterium
LRERIARYKVPRSFDFTDTLP

SEQ ID NO: 695912 - protein, 20 aa, Mycobacterium
LRERICADAVAFAQSIGYTC

SEQ ID NO: 695913 - protein, 17 aa, Mycobacterium
LRERIGFEPADVDDVIA

SEQ ID NO: 695914 - protein, 18 aa, Mycobacterium
LRERIPDLHFSVSATTRA

SEQ ID NO: 695915 - protein, 23 aa, Mycobacterium
LRERIPISIAALGPRNVELTAEI

SEQ ID NO: 695916 - protein, 22 aa, Mycobacterium
LRERLLAIVVEWAESIAEAPTT

SEQ ID NO: 695917 - protein, 22 aa, Mycobacterium
LRERLNWDVTWRTAQFVVAAVC

SEQ ID NO: 695918 - protein, 19 aa, Mycobacterium
LRERLPFELTAGQREVLDV

SEQ ID NO: 695919 - protein, 26 aa, Mycobacterium
LRERLPRVAALFARGAVSTRVVETLT

SEQ ID NO: 695920 - protein, 22 aa, Mycobacterium
LRERLSLLIRWTCVPDGGTDDI

SEQ ID NO: 695921 - protein, 20 aa, Mycobacterium
LRERVRRGAAEVNRDDIVTS

SEQ ID NO: 695922 - protein, 19 aa, Mycobacterium
LRESAIELLSSWQAPDAEQ

SEQ ID NO: 695923 - protein, 20 aa, Mycobacterium
LRESLDWLATHLKGEPPQRR

SEQ ID NO: 695924 - protein, 23 aa, Mycobacterium
LRETGFWRFAPDPNDPDENQAIE

SEQ ID NO: 695925 - protein, 17 aa, Mycobacterium
LRETRIHGVTTNRDLLV

SEQ ID NO: 695926 - protein, 23 aa, Mycobacterium
LRETRLEMDIVYFAVRLPFASGV

SEQ ID NO: 695927 - protein, 25 aa, Mycobacterium
LRETWSAADSLRWVQIASTGVDPVL

SEQ ID NO: 695928 - protein, 18 aa, Mycobacterium
LREVFGFDYAEIADAVGK

SEQ ID NO: 695929 - protein, 26 aa, Mycobacterium
LREVFWRKAHAAAMERAITLLLRQTP

SEQ ID NO: 695930 - protein, 17 aa, Mycobacterium
LREVGLEVLGTARRVVV

SEQ ID NO: 695931 - protein, 17 aa, Mycobacterium
LREVGLEVMGSARRVVV

SEQ ID NO: 695932 - protein, 20 aa, Mycobacterium
LREVGRLFGRIAHVLDAVED

SEQ ID NO: 695933 - protein, 20 aa, Mycobacterium
LREVKELFDTQVLHRLPVST

SEQ ID NO: 695934 - protein, 25 aa, Mycobacterium
LREVLQVRRCLEVEGARLAASNRTD

SEQ ID NO: 695935 - protein, 19 aa, Mycobacterium
LREVTKLVHEVNGLVIVDH

SEQ ID NO: 695936 - protein, 20 aa, Mycobacterium
LREWLLGQARYFGVERNAAL

SEQ ID NO: 695937 - protein, 26 aa, Mycobacterium
LREYIDWQPFFNAWEMKGRFPDILNN

SEQ ID NO: 695938 - protein, 30 aa, Mycobacterium
LREYIDWQPFFNAWEMKGRFPDILNNPGTG

SEQ ID NO: 695939 - protein, 20 aa, Mycobacterium
LRFAEAGFDVFAFDYRGFGA

SEQ ID NO: 695940 - protein, 25 aa, Mycobacterium
LRFAFASAPVPFVWNQANPAFSSMA

SEQ ID NO: 695941 - protein, 21 aa, Mycobacterium
LRFAHVDGCHSYECVAKDINL

SEQ ID NO: 695942 - protein, 21 aa, Mycobacterium
LRFASSTGYGRRAVAYERLSA

SEQ ID NO: 695943 - protein, 20 aa, Mycobacterium
LRFASWRDIHQTAVRVAGRL

SEQ ID NO: 695944 - protein, 17 aa, Mycobacterium
LRFDLRRGGHVGFGLGL

SEQ ID NO: 695945 - protein, 38 aa, Mycobacterium
LRFDRIPQPWLREPAKRWIRLRLSRGLNLEAGGGRPLL

SEQ ID NO: 695946 - protein, 17 aa, Mycobacterium
LRFESRKILGIPDLSVS

SEQ ID NO: 695947 - protein, 19 aa, Mycobacterium
LRFEVFGLVNGDPVVVLEH

SEQ ID NO: 695948 - protein, 17 aa, Mycobacterium
LRFFHFLGKEIFPGGQM

SEQ ID NO: 695949 - protein, 18 aa, Mycobacterium
LRFFTRSSIVRMFEDAGY

SEQ ID NO: 695950 - protein, 21 aa, Mycobacterium
LRFGPQPIKAPYLVQRAGFVG

SEQ ID NO: 695951 - protein, 20 aa, Mycobacterium
LRFGPQPIRAPYLVQQASFV

SEQ ID NO: 695952 - protein, 27 aa, Mycobacterium
LRFGRFIRQGWMGSDYLVARRVLPDGS

SEQ ID NO: 695953 - protein, 19 aa, Mycobacterium
LRFGSARVAVTAGYPALSP

SEQ ID NO: 695954 - protein, 23 aa, Mycobacterium
LRFGTIHPRTMVAALDFSGAGAR

SEQ ID NO: 695955 - protein, 19 aa, Mycobacterium
LRFIPDTEVRFVWHEPGPV

SEQ ID NO: 695956 - protein, 19 aa, Mycobacterium
LRFKNLRTGEMYPDEIADI

SEQ ID NO: 695957 - protein, 21 aa, Mycobacterium
LRFLADQVLRRYPVRVSRDLR

SEQ ID NO: 695958 - protein, 19 aa, Mycobacterium
LRFLGKTVTWGDLRHRVAA

SEQ ID NO: 695959 - protein, 20 aa, Mycobacterium
LRFLKEDPWERLAALRESVP

SEQ ID NO: 695960 - protein, 21 aa, Mycobacterium
LRFLKEDPWERLAALRQAIPN

SEQ ID NO: 695961 - protein, 21 aa, Mycobacterium
LRFLKEDPWERLADLREAVPN

SEQ ID NO: 695962 - protein, 25 aa, Mycobacterium
LRFLKEDPWERLATLRAAMPNICLQ

SEQ ID NO: 695963 - protein, 24 aa, Mycobacterium
LRFLKEDPWERLAVLREAAPNICL

SEQ ID NO: 695964 - protein, 21 aa, Mycobacterium
LRFLMRNPRRALSRSEILDRV

SEQ ID NO: 695965 - protein, 23 aa, Mycobacterium
LRFPKRQGMRIDFILGSPALARR

SEQ ID NO: 695966 - protein, 20 aa, Mycobacterium
LRFRGNDGVMHYVSVGCSRY

SEQ ID NO: 695967 - protein, 20 aa, Mycobacterium
LRFRIYRPAVVVGDSRTGEI

SEQ ID NO: 695968 - protein, 25 aa, Mycobacterium
LRFRPRVRTPFTRRSLSRDGSPTGD

SEQ ID NO: 695969 - protein, 22 aa, Mycobacterium
LRFSEDFGALADRDVVFVCVPT

SEQ ID NO: 695970 - protein, 19 aa, Mycobacterium
LRFSSSYQEAAEFADVFFV

SEQ ID NO: 695971 - protein, 19 aa, Mycobacterium
LRFVRPIKAGDELYCDVWI

SEQ ID NO: 695972 - protein, 18 aa, Mycobacterium
LRFYTEILGFQTKHDVPM

SEQ ID NO: 695973 - protein, 17 aa, Mycobacterium
LRFYWEKIEGLRFRRKL

SEQ ID NO: 695974 - protein, 19 aa, Mycobacterium
LRGADAVIFAAGAGPGSGA

SEQ ID NO: 695975 - protein, 28 aa, Mycobacterium
LRGAEAHNCRLCKSLREGHALDAGGSED

SEQ ID NO: 695976 - protein, 19 aa, Mycobacterium
LRGAGLRLLVPEAHLDAAL

SEQ ID NO: 695977 - protein, 18 aa, Mycobacterium
LRGAGWQVSGTARAELFA

SEQ ID NO: 695978 - protein, 20 aa, Mycobacterium
LRGAIEVARRVPARLQRETA

SEQ ID NO: 695979 - protein, 21 aa, Mycobacterium
LRGALQLAVMASVLGANPVRD

SEQ ID NO: 695980 - protein, 17 aa, Mycobacterium
LRGALTMLAEALTGNGR

SEQ ID NO: 695981 - protein, 26 aa, Mycobacterium
LRGALVRDPHAWSGYLTEAIDAFAGR
